United States Patent 7,888,497 (BIOINFORMATICALLY DETECTABLE GROUP OF NOVEL REGULATORY OLIGONUCLEOTIDES AND USES THEREOF) - sequence listing, part 105

SEQ ID NO: 4442280 - DNA, 18 bp, Homo sapiens
ctagcatttatttctctg

SEQ ID NO: 4442281 - DNA, 13 bp, Homo sapiens
ctagccataataa

SEQ ID NO: 4442282 - DNA, 21 bp, Homo sapiens
ctagccatacgctcagctcat

SEQ ID NO: 4442283 - DNA, 15 bp, Homo sapiens
ctagcccctggggtg

SEQ ID NO: 4442284 - DNA, 13 bp, Homo sapiens
ctagcccttccct

SEQ ID NO: 4442285 - DNA, 20 bp, Homo sapiens
ctagcgatctctcctggcct

SEQ ID NO: 4442286 - DNA, 16 bp, Homo sapiens
ctagcgctgccgcacc

SEQ ID NO: 4442287 - DNA, 22 bp, Homo sapiens
ctagcggagcccagcctgggag

SEQ ID NO: 4442288 - DNA, 14 bp, Homo sapiens
ctagcggctgctcc

SEQ ID NO: 4442289 - DNA, 19 bp, Homo sapiens
ctagctagaagtgggccag

SEQ ID NO: 4442290 - DNA, 23 bp, Homo sapiens
ctagctagaagtgggccaggaca

SEQ ID NO: 4442291 - DNA, 22 bp, Homo sapiens
ctagctctcccagtgaactcct

SEQ ID NO: 4442292 - DNA, 16 bp, Homo sapiens
ctagctgcacagggca

SEQ ID NO: 4442293 - DNA, 13 bp, Homo sapiens
ctagctggctctg

SEQ ID NO: 4442294 - DNA, 15 bp, Homo sapiens
ctagcttctgctttt

SEQ ID NO: 4442295 - DNA, 21 bp, Homo sapiens
ctagcttctgcttttctgccc

SEQ ID NO: 4442296 - DNA, 22 bp, Homo sapiens
ctagcttctgcttttctgccct

SEQ ID NO: 4442297 - DNA, 19 bp, Homo sapiens
ctagctttagaccctgggt

SEQ ID NO: 4442298 - DNA, 19 bp, Homo sapiens
ctaggaagcacgggggagt

SEQ ID NO: 4442299 - DNA, 16 bp, Homo sapiens
ctaggaatcccagagg

SEQ ID NO: 4442300 - DNA, 17 bp, Homo sapiens
ctaggaatcccagaggt

SEQ ID NO: 4442301 - DNA, 20 bp, Homo sapiens
ctaggacacagttcctggga

SEQ ID NO: 4442302 - DNA, 23 bp, Homo sapiens
ctaggacccgtctccagctgctg

SEQ ID NO: 4442303 - DNA, 15 bp, Homo sapiens
ctaggagaggggggc

SEQ ID NO: 4442304 - DNA, 18 bp, Homo sapiens
ctaggagctccttctggc

SEQ ID NO: 4442305 - DNA, 15 bp, Homo sapiens
ctaggagctgggagg

SEQ ID NO: 4442306 - DNA, 22 bp, Homo sapiens
ctaggatagctaactgtaaatc

SEQ ID NO: 4442307 - DNA, 23 bp, Homo sapiens
ctaggatattgaatgtgaaacat

SEQ ID NO: 4442308 - DNA, 16 bp, Homo sapiens
ctaggcaggacctgtg

SEQ ID NO: 4442309 - DNA, 14 bp, Homo sapiens
ctaggcaggcaaga

SEQ ID NO: 4442310 - DNA, 15 bp, Homo sapiens
ctaggccactcctcc

SEQ ID NO: 4442311 - DNA, 16 bp, Homo sapiens
ctaggcctcaactcct

SEQ ID NO: 4442312 - DNA, 23 bp, Homo sapiens
ctaggcctgaaatgacatttcac

SEQ ID NO: 4442313 - DNA, 24 bp, Homo sapiens
ctaggcgattttgtctaccatttg

SEQ ID NO: 4442314 - DNA, 16 bp, Homo sapiens
ctaggctgttctgtag

SEQ ID NO: 4442315 - DNA, 16 bp, Homo sapiens
ctagggacccctcgcc

SEQ ID NO: 4442316 - DNA, 21 bp, Homo sapiens
ctagggacccctcgccccagc

SEQ ID NO: 4442317 - DNA, 14 bp, Homo sapiens
ctagggagagaccc

SEQ ID NO: 4442318 - DNA, 15 bp, Homo sapiens
ctagggagagaccct

SEQ ID NO: 4442319 - DNA, 23 bp, Homo sapiens
ctagggatccctcatctgtccct

SEQ ID NO: 4442320 - DNA, 15 bp, Homo sapiens
ctagggattcaggct

SEQ ID NO: 4442321 - DNA, 21 bp, Homo sapiens
ctagggcaagtcttaaatgtg

SEQ ID NO: 4442322 - DNA, 16 bp, Homo sapiens
ctagggccaagcccag

SEQ ID NO: 4442323 - DNA, 14 bp, Homo sapiens
ctaggggatgaggg

SEQ ID NO: 4442324 - DNA, 15 bp, Homo sapiens
ctagggtggggagag

SEQ ID NO: 4442325 - DNA, 19 bp, Homo sapiens
ctaggtagaaaaagggtca

SEQ ID NO: 4442326 - DNA, 23 bp, Homo sapiens
ctaggtctcggactaagcctacc

SEQ ID NO: 4442327 - DNA, 20 bp, Homo sapiens
ctaggtgggaagatggtttg

SEQ ID NO: 4442328 - DNA, 15 bp, Homo sapiens
ctaggtgtccccaac

SEQ ID NO: 4442329 - DNA, 22 bp, Homo sapiens
ctaggtgtccccaacgtcccct

SEQ ID NO: 4442330 - DNA, 14 bp, Homo sapiens
ctagtcacaaagac

SEQ ID NO: 4442331 - DNA, 12 bp, Homo sapiens
ctagtcactgga

SEQ ID NO: 4442332 - DNA, 13 bp, Homo sapiens
ctagtcagagaga

SEQ ID NO: 4442333 - DNA, 23 bp, Homo sapiens
ctagtctgtgtgggactgtacac

SEQ ID NO: 4442334 - DNA, 14 bp, Homo sapiens
ctagtctttccagt

SEQ ID NO: 4442335 - DNA, 19 bp, Homo sapiens
ctagtgaaagaggcagctt

SEQ ID NO: 4442336 - DNA, 17 bp, Homo sapiens
ctagtgaaggcttctct

SEQ ID NO: 4442337 - DNA, 18 bp, Homo sapiens
ctagtgcaaaaactgtaa

SEQ ID NO: 4442338 - DNA, 21 bp, Homo sapiens
ctagtgcaaaaactgtaaaag

SEQ ID NO: 4442339 - DNA, 20 bp, Homo sapiens
ctagtgggccctctctctgg

SEQ ID NO: 4442340 - DNA, 22 bp, Homo sapiens
ctagtggggtctccctctcctg

SEQ ID NO: 4442341 - DNA, 19 bp, Homo sapiens
ctagtgtaccaagtgcttc

SEQ ID NO: 4442342 - DNA, 19 bp, Homo sapiens
ctagtgtttaagtcatttt

SEQ ID NO: 4442343 - DNA, 20 bp, Homo sapiens
ctagtgtttaagtcattttt

SEQ ID NO: 4442344 - DNA, 22 bp, Homo sapiens
ctagttccagaaaacctctcct

SEQ ID NO: 4442345 - DNA, 12 bp, Homo sapiens
ctagttctagat

SEQ ID NO: 4442346 - DNA, 13 bp, Homo sapiens
ctagttctgccag

SEQ ID NO: 4442347 - DNA, 15 bp, Homo sapiens
ctataaaagctttct

SEQ ID NO: 4442348 - DNA, 16 bp, Homo sapiens
ctataaaagctttctg

SEQ ID NO: 4442349 - DNA, 19 bp, Homo sapiens
ctataaacttaagggcaag

SEQ ID NO: 4442350 - DNA, 16 bp, Homo sapiens
ctataaagggtcaggc

SEQ ID NO: 4442351 - DNA, 19 bp, Homo sapiens
ctataaagggtcaggcccg

SEQ ID NO: 4442352 - DNA, 14 bp, Homo sapiens
ctataaatgaatgt

SEQ ID NO: 4442353 - DNA, 14 bp, Homo sapiens
ctataaatgttgct

SEQ ID NO: 4442354 - DNA, 17 bp, Homo sapiens
ctataaatttaagaaaa

SEQ ID NO: 4442355 - DNA, 20 bp, Homo sapiens
ctataaatttaagaaaacaa

SEQ ID NO: 4442356 - DNA, 17 bp, Homo sapiens
ctataacaaaagcaata

SEQ ID NO: 4442357 - DNA, 13 bp, Homo sapiens
ctataacaaatgc

SEQ ID NO: 4442358 - DNA, 22 bp, Homo sapiens
ctataacaaatgctttattatt

SEQ ID NO: 4442359 - DNA, 18 bp, Homo sapiens
ctataacattatataaca

SEQ ID NO: 4442360 - DNA, 18 bp, Homo sapiens
ctataagaataaggcttt

SEQ ID NO: 4442361 - DNA, 21 bp, Homo sapiens
ctataagatacaataaaacaa

SEQ ID NO: 4442362 - DNA, 15 bp, Homo sapiens
ctataagatgaaaca

SEQ ID NO: 4442363 - DNA, 21 bp, Homo sapiens
ctataagcaaattgctttttt

SEQ ID NO: 4442364 - DNA, 22 bp, Homo sapiens
ctataagcaagaaggcaaaaat

SEQ ID NO: 4442365 - DNA, 14 bp, Homo sapiens
ctataatcaaatga

SEQ ID NO: 4442366 - DNA, 17 bp, Homo sapiens
ctataatcaaatgattt

SEQ ID NO: 4442367 - DNA, 17 bp, Homo sapiens
ctataatcccagcattt

SEQ ID NO: 4442368 - DNA, 21 bp, Homo sapiens
ctataatgtcagcttatccta

SEQ ID NO: 4442369 - DNA, 22 bp, Homo sapiens
ctataatgtgaaatgtaactgt

SEQ ID NO: 4442370 - DNA, 17 bp, Homo sapiens
ctatacaggctgggaag

SEQ ID NO: 4442371 - DNA, 12 bp, Homo sapiens
ctatacatgttg

SEQ ID NO: 4442372 - DNA, 14 bp, Homo sapiens
ctatacctgccttt

SEQ ID NO: 4442373 - DNA, 14 bp, Homo sapiens
ctatacttgaacaa

SEQ ID NO: 4442374 - DNA, 17 bp, Homo sapiens
ctatacttgaacaaaag

SEQ ID NO: 4442375 - DNA, 21 bp, Homo sapiens
ctatacttgaacaaaagggtc

SEQ ID NO: 4442376 - DNA, 22 bp, Homo sapiens
ctatacttgaacaaaagggtca

SEQ ID NO: 4442377 - DNA, 17 bp, Homo sapiens
ctatagcaaagtagtac

SEQ ID NO: 4442378 - DNA, 16 bp, Homo sapiens
ctatagcactgagctc

SEQ ID NO: 4442379 - DNA, 19 bp, Homo sapiens
ctatagccaaaaatagcta

SEQ ID NO: 4442380 - DNA, 14 bp, Homo sapiens
ctataggtccagaa

SEQ ID NO: 4442381 - DNA, 15 bp, Homo sapiens
ctataggtccagaag

SEQ ID NO: 4442382 - DNA, 21 bp, Homo sapiens
ctataggtgctacaaaaacac

SEQ ID NO: 4442383 - DNA, 18 bp, Homo sapiens
ctatagttactgtcctgt

SEQ ID NO: 4442384 - DNA, 14 bp, Homo sapiens
ctatataatttatt

SEQ ID NO: 4442385 - DNA, 18 bp, Homo sapiens
ctatatagaatttcctgt

SEQ ID NO: 4442386 - DNA, 22 bp, Homo sapiens
ctatatataaaacggtgctgtg

SEQ ID NO: 4442387 - DNA, 16 bp, Homo sapiens
ctatatgagaagaata

SEQ ID NO: 4442388 - DNA, 17 bp, Homo sapiens
ctatatgagaagaatag

SEQ ID NO: 4442389 - DNA, 19 bp, Homo sapiens
ctatatgtagtgcattttt

SEQ ID NO: 4442390 - DNA, 20 bp, Homo sapiens
ctatatgtgaaacatttttt

SEQ ID NO: 4442391 - DNA, 21 bp, Homo sapiens
ctatatgtgaaacattttttc

SEQ ID NO: 4442392 - DNA, 22 bp, Homo sapiens
ctatatgtgaaacattttttct

SEQ ID NO: 4442393 - DNA, 13 bp, Homo sapiens
ctatattaaatga

SEQ ID NO: 4442394 - DNA, 19 bp, Homo sapiens
ctatattaaatgagggttt

SEQ ID NO: 4442395 - DNA, 22 bp, Homo sapiens
ctatattcctttttctatgaaa

SEQ ID NO: 4442396 - DNA, 23 bp, Homo sapiens
ctatatttgattatgtatggata

SEQ ID NO: 4442397 - DNA, 20 bp, Homo sapiens
ctatattttttgttaaatga

SEQ ID NO: 4442398 - DNA, 22 bp, Homo sapiens
ctatattttttgttaaatgatt

SEQ ID NO: 4442399 - DNA, 13 bp, Homo sapiens
ctatcaatattta

SEQ ID NO: 4442400 - DNA, 16 bp, Homo sapiens
ctatcacctatttcca

SEQ ID NO: 4442401 - DNA, 16 bp, Homo sapiens
ctatcaggtaataaaa

SEQ ID NO: 4442402 - DNA, 14 bp, Homo sapiens
ctatccaaacatgt

SEQ ID NO: 4442403 - DNA, 18 bp, Homo sapiens
ctatccaaacatgtattt

SEQ ID NO: 4442404 - DNA, 19 bp, Homo sapiens
ctatccaaacatgtattta

SEQ ID NO: 4442405 - DNA, 20 bp, Homo sapiens
ctatccaaacatgtatttat

SEQ ID NO: 4442406 - DNA, 20 bp, Homo sapiens
ctatccacagaacctttgtc

SEQ ID NO: 4442407 - DNA, 12 bp, Homo sapiens
ctatccacccag

SEQ ID NO: 4442408 - DNA, 14 bp, Homo sapiens
ctatccacccagcc

SEQ ID NO: 4442409 - DNA, 16 bp, Homo sapiens
ctatccacccagccca

SEQ ID NO: 4442410 - DNA, 14 bp, Homo sapiens
ctatccgctgccag

SEQ ID NO: 4442411 - DNA, 17 bp, Homo sapiens
ctatccgtgttgcaggt

SEQ ID NO: 4442412 - DNA, 17 bp, Homo sapiens
ctatcctgcgggtttta

SEQ ID NO: 4442413 - DNA, 13 bp, Homo sapiens
ctatcctgtttaa

SEQ ID NO: 4442414 - DNA, 16 bp, Homo sapiens
ctatcctgtttaataa

SEQ ID NO: 4442415 - DNA, 22 bp, Homo sapiens
ctatccttataggcctgtccct

SEQ ID NO: 4442416 - DNA, 13 bp, Homo sapiens
ctatccttccagg

SEQ ID NO: 4442417 - DNA, 16 bp, Homo sapiens
ctatccttccagtggc

SEQ ID NO: 4442418 - DNA, 12 bp, Homo sapiens
ctatccttggct

SEQ ID NO: 4442419 - DNA, 16 bp, Homo sapiens
ctatctaaccctccca

SEQ ID NO: 4442420 - DNA, 12 bp, Homo sapiens
ctatctacaaaa

SEQ ID NO: 4442421 - DNA, 14 bp, Homo sapiens
ctatctacaaaaat

SEQ ID NO: 4442422 - DNA, 19 bp, Homo sapiens
ctatctagcatttatttct

SEQ ID NO: 4442423 - DNA, 18 bp, Homo sapiens
ctatctatacctgccttt

SEQ ID NO: 4442424 - DNA, 14 bp, Homo sapiens
ctatctatttgagg

SEQ ID NO: 4442425 - DNA, 12 bp, Homo sapiens
ctatctcagcca

SEQ ID NO: 4442426 - DNA, 15 bp, Homo sapiens
ctatctcagccatag

SEQ ID NO: 4442427 - DNA, 21 bp, Homo sapiens
ctatctcatgccagtgcctta

SEQ ID NO: 4442428 - DNA, 16 bp, Homo sapiens
ctatctggtattaaat

SEQ ID NO: 4442429 - DNA, 20 bp, Homo sapiens
ctatctggtattaaatgcca

SEQ ID NO: 4442430 - DNA, 22 bp, Homo sapiens
ctatctgtcatctctctggggc

SEQ ID NO: 4442431 - DNA, 15 bp, Homo sapiens
ctatcttaatactaa

SEQ ID NO: 4442432 - DNA, 16 bp, Homo sapiens
ctatcttcatgtaaat

SEQ ID NO: 4442433 - DNA, 17 bp, Homo sapiens
ctatcttcatgtaaatt

SEQ ID NO: 4442434 - DNA, 20 bp, Homo sapiens
ctatcttcatgtaaattgac

SEQ ID NO: 4442435 - DNA, 19 bp, Homo sapiens
ctatcttttgtttcctttt

SEQ ID NO: 4442436 - DNA, 16 bp, Homo sapiens
ctatgaaaagctagaa

SEQ ID NO: 4442437 - DNA, 16 bp, Homo sapiens
ctatgaactgaaggca

SEQ ID NO: 4442438 - DNA, 16 bp, Homo sapiens
ctatgactctctgcta

SEQ ID NO: 4442439 - DNA, 19 bp, Homo sapiens
ctatgaggaaactgagtca

SEQ ID NO: 4442440 - DNA, 17 bp, Homo sapiens
ctatgaggagcctctga

SEQ ID NO: 4442441 - DNA, 15 bp, Homo sapiens
ctatgagggtgtttc

SEQ ID NO: 4442442 - DNA, 23 bp, Homo sapiens
ctatgagggtgtttcctctaaac

SEQ ID NO: 4442443 - DNA, 21 bp, Homo sapiens
cctttcttcctatttatcata

SEQ ID NO: 4442444 - DNA, 13 bp, Homo sapiens
cctttctttgcct

SEQ ID NO: 4442445 - DNA, 15 bp, Homo sapiens
cctttctttgcctct

SEQ ID NO: 4442446 - DNA, 17 bp, Homo sapiens
cctttctttgcctctgc

SEQ ID NO: 4442447 - DNA, 18 bp, Homo sapiens
cctttctttgcctctgca

SEQ ID NO: 4442448 - DNA, 15 bp, Homo sapiens
cctttctttttcttc

SEQ ID NO: 4442449 - DNA, 23 bp, Homo sapiens
cctttctttttcttcttccctcc

SEQ ID NO: 4442450 - DNA, 20 bp, Homo sapiens
cctttgaatattttttgaag

SEQ ID NO: 4442451 - DNA, 15 bp, Homo sapiens
cctttgacctcggtg

SEQ ID NO: 4442452 - DNA, 19 bp, Homo sapiens
cctttgagtgcagtcctga

SEQ ID NO: 4442453 - DNA, 23 bp, Homo sapiens
cctaattttgccaaaatcctgaa

SEQ ID NO: 4442454 - DNA, 17 bp, Homo sapiens
cctacaagagcagcctg

SEQ ID NO: 4442455 - DNA, 21 bp, Homo sapiens
cctacaagagcagcctgtggc

SEQ ID NO: 4442456 - DNA, 18 bp, Homo sapiens
cctacactcacctgcact

SEQ ID NO: 4442457 - DNA, 16 bp, Homo sapiens
cctacagactccatct

SEQ ID NO: 4442458 - DNA, 17 bp, Homo sapiens
cctacagactccatctc

SEQ ID NO: 4442459 - DNA, 21 bp, Homo sapiens
cctacagactccatctcttct

SEQ ID NO: 4442460 - DNA, 22 bp, Homo sapiens
cctacagcactactgggtgtca

SEQ ID NO: 4442461 - DNA, 18 bp, Homo sapiens
cctacagtatataagctt

SEQ ID NO: 4442462 - DNA, 16 bp, Homo sapiens
cctacagtgtacagtc

SEQ ID NO: 4442463 - DNA, 20 bp, Homo sapiens
cctacagtgtacagtcttgt

SEQ ID NO: 4442464 - DNA, 19 bp, Homo sapiens
cctacagttttaactgtgg

SEQ ID NO: 4442465 - DNA, 15 bp, Homo sapiens
cctacatatttgtat

SEQ ID NO: 4442466 - DNA, 22 bp, Homo sapiens
cctacatcctaaggttcttgct

SEQ ID NO: 4442467 - DNA, 18 bp, Homo sapiens
cctaccatcagctctgcc

SEQ ID NO: 4442468 - DNA, 19 bp, Homo sapiens
cctaccatcagctctgcct

SEQ ID NO: 4442469 - DNA, 13 bp, Homo sapiens
cctacccacacct

SEQ ID NO: 4442470 - DNA, 18 bp, Homo sapiens
cctacccacacctctgcc

SEQ ID NO: 4442471 - DNA, 19 bp, Homo sapiens
cctacccacacctctgcca

SEQ ID NO: 4442472 - DNA, 20 bp, Homo sapiens
cctacccagttgcctccagg

SEQ ID NO: 4442473 - DNA, 14 bp, Homo sapiens
cctaccccaccacg

SEQ ID NO: 4442474 - DNA, 16 bp, Homo sapiens
cctaccctaaccaagt

SEQ ID NO: 4442475 - DNA, 13 bp, Homo sapiens
cctaccctcccac

SEQ ID NO: 4442476 - DNA, 18 bp, Homo sapiens
cctacctcaacctgtaaa

SEQ ID NO: 4442477 - DNA, 21 bp, Homo sapiens
cctacgagggaggaacacctg

SEQ ID NO: 4442478 - DNA, 16 bp, Homo sapiens
cctactccaaaatgtt

SEQ ID NO: 4442479 - DNA, 14 bp, Homo sapiens
cctactcccctggg

SEQ ID NO: 4442480 - DNA, 13 bp, Homo sapiens
cctactctcaggt

SEQ ID NO: 4442481 - DNA, 14 bp, Homo sapiens
cctacttccaggat

SEQ ID NO: 4442482 - DNA, 13 bp, Homo sapiens
cctactttcttca

SEQ ID NO: 4442483 - DNA, 22 bp, Homo sapiens
cctagaaattgaacaaaaatgt

SEQ ID NO: 4442484 - DNA, 22 bp, Homo sapiens
cctagaagggctagaacctgga

SEQ ID NO: 4442485 - DNA, 19 bp, Homo sapiens
cctagaatgtttcatttgc

SEQ ID NO: 4442486 - DNA, 14 bp, Homo sapiens
cctagactgttact

SEQ ID NO: 4442487 - DNA, 15 bp, Homo sapiens
cctagactgttactt

SEQ ID NO: 4442488 - DNA, 17 bp, Homo sapiens
cctagagaacgcagccc

SEQ ID NO: 4442489 - DNA, 19 bp, Homo sapiens
cctagagaacgcagcccta

SEQ ID NO: 4442490 - DNA, 24 bp, Homo sapiens
cctagagaagacaggctggaagat

SEQ ID NO: 4442491 - DNA, 23 bp, Homo sapiens
cctagagaagctaaaacctgagc

SEQ ID NO: 4442492 - DNA, 13 bp, Homo sapiens
cctagagcctgcc

SEQ ID NO: 4442493 - DNA, 17 bp, Homo sapiens
cctagagcctgcctgga

SEQ ID NO: 4442494 - DNA, 13 bp, Homo sapiens
cctagatccagaa

SEQ ID NO: 4442495 - DNA, 16 bp, Homo sapiens
cctagcaatacaggga

SEQ ID NO: 4442496 - DNA, 19 bp, Homo sapiens
cctagcactgccccacatg

SEQ ID NO: 4442497 - DNA, 13 bp, Homo sapiens
cctagcaggctgt

SEQ ID NO: 4442498 - DNA, 12 bp, Homo sapiens
cctagcccttcc

SEQ ID NO: 4442499 - DNA, 16 bp, Homo sapiens
cctagcctggctctgc

SEQ ID NO: 4442500 - DNA, 17 bp, Homo sapiens
cctagcgatctctcctg

SEQ ID NO: 4442501 - DNA, 15 bp, Homo sapiens
cctagcggagcccag

SEQ ID NO: 4442502 - DNA, 17 bp, Homo sapiens
cctagcggagcccagcc

SEQ ID NO: 4442503 - DNA, 18 bp, Homo sapiens
cctagcggagcccagcct

SEQ ID NO: 4442504 - DNA, 22 bp, Homo sapiens
cctagctacactgagcagggag

SEQ ID NO: 4442505 - DNA, 22 bp, Homo sapiens
cctagctcctgccacatggagc

SEQ ID NO: 4442506 - DNA, 21 bp, Homo sapiens
cctagctgcacagggcagctg

SEQ ID NO: 4442507 - DNA, 16 bp, Homo sapiens
cctagctgtgtgaata

SEQ ID NO: 4442508 - DNA, 17 bp, Homo sapiens
cctagctgtgttattcc

SEQ ID NO: 4442509 - DNA, 23 bp, Homo sapiens
cctagctttagaccctgggtggg

SEQ ID NO: 4442510 - DNA, 19 bp, Homo sapiens
cctaggacccgtctccagc

SEQ ID NO: 4442511 - DNA, 20 bp, Homo sapiens
cctaggacccgtctccagct

SEQ ID NO: 4442512 - DNA, 16 bp, Homo sapiens
cctaggccacgtccag

SEQ ID NO: 4442513 - DNA, 14 bp, Homo sapiens
cctaggccactcct

SEQ ID NO: 4442514 - DNA, 20 bp, Homo sapiens
cctagggtcttgggggtcag

SEQ ID NO: 4442515 - DNA, 13 bp, Homo sapiens
cctagtactgccc

SEQ ID NO: 4442516 - DNA, 20 bp, Homo sapiens
cctagtagctgggatgacag

SEQ ID NO: 4442517 - DNA, 19 bp, Homo sapiens
cctagtagctgggattaca

SEQ ID NO: 4442518 - DNA, 14 bp, Homo sapiens
cctagtcccttccc

SEQ ID NO: 4442519 - DNA, 21 bp, Homo sapiens
cctagtcccttcccctccctg

SEQ ID NO: 4442520 - DNA, 21 bp, Homo sapiens
cctagtccgctgaagatggag

SEQ ID NO: 4442521 - DNA, 22 bp, Homo sapiens
cctagtgaaggcttctctctgt

SEQ ID NO: 4442522 - DNA, 18 bp, Homo sapiens
ccttctacactctcctgg

SEQ ID NO: 4442523 - DNA, 20 bp, Homo sapiens
ccttctacactctcctgggc

SEQ ID NO: 4442524 - DNA, 20 bp, Homo sapiens
ccttctaccccaaggccagt

SEQ ID NO: 4442525 - DNA, 13 bp, Homo sapiens
ccttctacctgcc

SEQ ID NO: 4442526 - DNA, 14 bp, Homo sapiens
ccttctacctgcca

SEQ ID NO: 4442527 - DNA, 15 bp, Homo sapiens
ccttctacctgccac

SEQ ID NO: 4442528 - DNA, 16 bp, Homo sapiens
ccttctacctgccact

SEQ ID NO: 4442529 - DNA, 23 bp, Homo sapiens
ccttctagaacacctgccttcta

SEQ ID NO: 4442530 - DNA, 18 bp, Homo sapiens
ccttctatacccacccag

SEQ ID NO: 4442531 - DNA, 14 bp, Homo sapiens
ccttctatgtatta

SEQ ID NO: 4442532 - DNA, 20 bp, Homo sapiens
ccttctcaccagctgcaaag

SEQ ID NO: 4442533 - DNA, 21 bp, Homo sapiens
ccttctcaccagctgcaaagt

SEQ ID NO: 4442534 - DNA, 22 bp, Homo sapiens
ccttctcaccagctgcaaagtg

SEQ ID NO: 4442535 - DNA, 16 bp, Homo sapiens
ccttctccatccacat

SEQ ID NO: 4442536 - DNA, 19 bp, Homo sapiens
ccttctcgtgtttgcttaa

SEQ ID NO: 4442537 - DNA, 17 bp, Homo sapiens
cctggcgtgctcagacc

SEQ ID NO: 4442538 - DNA, 19 bp, Homo sapiens
cctggcgtgctcagaccca

SEQ ID NO: 4442539 - DNA, 12 bp, Homo sapiens
cctggctccact

SEQ ID NO: 4442540 - DNA, 12 bp, Homo sapiens
cctggctccagt

SEQ ID NO: 4442541 - DNA, 14 bp, Homo sapiens
cctggctcccacct

SEQ ID NO: 4442542 - DNA, 15 bp, Homo sapiens
cctggctcccacctg

SEQ ID NO: 4442543 - DNA, 21 bp, Homo sapiens
cctggctcccatgaccatact

SEQ ID NO: 4442544 - DNA, 12 bp, Homo sapiens
cctggctccctc

SEQ ID NO: 4442545 - DNA, 15 bp, Homo sapiens
cctggctcctgaggg

SEQ ID NO: 4442546 - DNA, 15 bp, Homo sapiens
cctggctctgccccc

SEQ ID NO: 4442547 - DNA, 19 bp, Homo sapiens
cctggctctgccccctccc

SEQ ID NO: 4442548 - DNA, 12 bp, Homo sapiens
cctggctctgtg

SEQ ID NO: 4442549 - DNA, 21 bp, Homo sapiens
cctggctgaggttcctctgcc

SEQ ID NO: 4442550 - DNA, 15 bp, Homo sapiens
cctggctgctgcccc

SEQ ID NO: 4442551 - DNA, 16 bp, Homo sapiens
cctggctgctgccccc

SEQ ID NO: 4442552 - DNA, 13 bp, Homo sapiens
cctggctggctcc

SEQ ID NO: 4442553 - DNA, 19 bp, Homo sapiens
cctggctggctcctagggg

SEQ ID NO: 4442554 - DNA, 15 bp, Homo sapiens
cctggcttcatacag

SEQ ID NO: 4442555 - DNA, 16 bp, Homo sapiens
cctggcttcatacaga

SEQ ID NO: 4442556 - DNA, 12 bp, Homo sapiens
cctggctttgcc

SEQ ID NO: 4442557 - DNA, 15 bp, Homo sapiens
cctggctttgcctct

SEQ ID NO: 4442558 - DNA, 22 bp, Homo sapiens
cctgggaaggcctcttggagac

SEQ ID NO: 4442559 - DNA, 23 bp, Homo sapiens
cctgggaaggcgagtctggggac

SEQ ID NO: 4442560 - DNA, 12 bp, Homo sapiens
cctgggaagggg

SEQ ID NO: 4442561 - DNA, 18 bp, Homo sapiens
cctgggacacagacccag

SEQ ID NO: 4442562 - DNA, 23 bp, Homo sapiens
cctgggacacagacccaggaccc

SEQ ID NO: 4442563 - DNA, 13 bp, Homo sapiens
cctgggactcgga

SEQ ID NO: 4442564 - DNA, 24 bp, Homo sapiens
cctgggagagtggacctgtgctgt

SEQ ID NO: 4442565 - DNA, 21 bp, Homo sapiens
cctgggagccagtcctccact

SEQ ID NO: 4442566 - DNA, 15 bp, Homo sapiens
cctgggaggacaggc

SEQ ID NO: 4442567 - DNA, 16 bp, Homo sapiens
cctgggaggacaggca

SEQ ID NO: 4442568 - DNA, 22 bp, Homo sapiens
cctgggagtgttcccgtgcctg

SEQ ID NO: 4442569 - DNA, 13 bp, Homo sapiens
cctgggcactccg

SEQ ID NO: 4442570 - DNA, 19 bp, Homo sapiens
cctgggcactccgcgccga

SEQ ID NO: 4442571 - DNA, 19 bp, Homo sapiens
cctgggcagccaggctgcc

SEQ ID NO: 4442572 - DNA, 23 bp, Homo sapiens
cctgggcagccaggctgccaagg

SEQ ID NO: 4442573 - DNA, 15 bp, Homo sapiens
cctgggcagtgagtg

SEQ ID NO: 4442574 - DNA, 17 bp, Homo sapiens
cctgggcagtgagtgcc

SEQ ID NO: 4442575 - DNA, 22 bp, Homo sapiens
cctgggccacgccggccacacc

SEQ ID NO: 4442576 - DNA, 22 bp, Homo sapiens
cctgggccagcggggctgctca

SEQ ID NO: 4442577 - DNA, 12 bp, Homo sapiens
cctgggcccctc

SEQ ID NO: 4442578 - DNA, 18 bp, Homo sapiens
cctgggcccctccacgcc

SEQ ID NO: 4442579 - DNA, 18 bp, Homo sapiens
cctgggcccctccctacc

SEQ ID NO: 4442580 - DNA, 19 bp, Homo sapiens
cctgggcccctccctacct

SEQ ID NO: 4442581 - DNA, 11 bp, Homo sapiens
cctgggccctc

SEQ ID NO: 4442582 - DNA, 14 bp, Homo sapiens
cctgggccctctct

SEQ ID NO: 4442583 - DNA, 14 bp, Homo sapiens
cctgggccctgggc

SEQ ID NO: 4442584 - DNA, 17 bp, Homo sapiens
cctgggccctgggctgg

SEQ ID NO: 4442585 - DNA, 13 bp, Homo sapiens
cctgggcctgccc

SEQ ID NO: 4442586 - DNA, 16 bp, Homo sapiens
cctgggcctgcccctg

SEQ ID NO: 4442587 - DNA, 22 bp, Homo sapiens
cctgggcctttgcaagatgctt

SEQ ID NO: 4442588 - DNA, 23 bp, Homo sapiens
cctgggcctttgcaagatgcttg

SEQ ID NO: 4442589 - DNA, 16 bp, Homo sapiens
cctgggcgaccaccgg

SEQ ID NO: 4442590 - DNA, 16 bp, Homo sapiens
cctgggctcactgtgc

SEQ ID NO: 4442591 - DNA, 17 bp, Homo sapiens
cctgggctcactgtgct

SEQ ID NO: 4442592 - DNA, 14 bp, Homo sapiens
cctgggctgccacc

SEQ ID NO: 4442593 - DNA, 17 bp, Homo sapiens
cctgggctgccaccagc

SEQ ID NO: 4442594 - DNA, 13 bp, Homo sapiens
cctgggctggcac

SEQ ID NO: 4442595 - DNA, 17 bp, Homo sapiens
cctgggctgggtgctgg

SEQ ID NO: 4442596 - DNA, 18 bp, Homo sapiens
cctgggctgtctgtcacc

SEQ ID NO: 4442597 - DNA, 19 bp, Homo sapiens
cctgggctgtctgtcacca

SEQ ID NO: 4442598 - DNA, 13 bp, Homo sapiens
cctgggcttggcc

SEQ ID NO: 4442599 - DNA, 15 bp, Homo sapiens
cctgggcttggcctg

SEQ ID NO: 4442600 - DNA, 16 bp, Homo sapiens
cctgggcttggcctgc

SEQ ID NO: 4442601 - DNA, 20 bp, Homo sapiens
cctgggcttggcctgctgtg

SEQ ID NO: 4442602 - DNA, 20 bp, Homo sapiens
cctggggagctcctgggacc

SEQ ID NO: 4442603 - DNA, 13 bp, Homo sapiens
cctggggaggccc

SEQ ID NO: 4442604 - DNA, 15 bp, Homo sapiens
cctggggaggcccta

SEQ ID NO: 4442605 - DNA, 13 bp, Homo sapiens
cctggggcccagc

SEQ ID NO: 4442606 - DNA, 23 bp, Homo sapiens
cctggggctgagtctccagggcc

SEQ ID NO: 4442607 - DNA, 17 bp, Homo sapiens
cctgggggaagccctgg

SEQ ID NO: 4442608 - DNA, 19 bp, Homo sapiens
cctgggggcagggagagga

SEQ ID NO: 4442609 - DNA, 19 bp, Homo sapiens
cctgggggccttgggtgag

SEQ ID NO: 4442610 - DNA, 22 bp, Homo sapiens
cctgggggccttgggtgagtgg

SEQ ID NO: 4442611 - DNA, 12 bp, Homo sapiens
cctggggggcag

SEQ ID NO: 4442612 - DNA, 15 bp, Homo sapiens
cctgggggtggcagg

SEQ ID NO: 4442613 - DNA, 17 bp, Homo sapiens
cctggggtgcatctcct

SEQ ID NO: 4442614 - DNA, 17 bp, Homo sapiens
cctggggttctctacag

SEQ ID NO: 4442615 - DNA, 23 bp, Homo sapiens
cctgggtaagaagggtgggagtg

SEQ ID NO: 4442616 - DNA, 18 bp, Homo sapiens
cctgggtactgaaagcct

SEQ ID NO: 4442617 - DNA, 14 bp, Homo sapiens
cctgggtcagtctg

SEQ ID NO: 4442618 - DNA, 22 bp, Homo sapiens
cctgggtcagtctggtgggagg

SEQ ID NO: 4442619 - DNA, 17 bp, Homo sapiens
cctgggtcatgggcctg

SEQ ID NO: 4442620 - DNA, 18 bp, Homo sapiens
cctgggtcatgggcctgt

SEQ ID NO: 4442621 - DNA, 16 bp, Homo sapiens
cctgggtgacagagtg

SEQ ID NO: 4442622 - DNA, 18 bp, Homo sapiens
cctgggtgacagagtgag

SEQ ID NO: 4442623 - DNA, 19 bp, Homo sapiens
cctgggtgacagagtgaga

SEQ ID NO: 4442624 - DNA, 21 bp, Homo sapiens
cctgggtggggctgctcctcc

SEQ ID NO: 4442625 - DNA, 17 bp, Homo sapiens
cctgggtgtcaagtgcc

SEQ ID NO: 4442626 - DNA, 16 bp, Homo sapiens
cctgggttaagtatta

SEQ ID NO: 4442627 - DNA, 12 bp, Homo sapiens
cctgggttttgt

SEQ ID NO: 4442628 - DNA, 18 bp, Homo sapiens
cctggtaagcagaggctt

SEQ ID NO: 4442629 - DNA, 21 bp, Homo sapiens
cctggtagaggggccggctgt

SEQ ID NO: 4442630 - DNA, 20 bp, Homo sapiens
cctggtatatccaaaagctt

SEQ ID NO: 4442631 - DNA, 21 bp, Homo sapiens
cctggtcaccgagactcagcc

SEQ ID NO: 4442632 - DNA, 22 bp, Homo sapiens
cctggtccagggaagctggccg

SEQ ID NO: 4442633 - DNA, 22 bp, Homo sapiens
cctggtcccctcccccatcccc

SEQ ID NO: 4442634 - DNA, 15 bp, Homo sapiens
cctggtccctcaccc

SEQ ID NO: 4442635 - DNA, 15 bp, Homo sapiens
cctggtccttccact

SEQ ID NO: 4442636 - DNA, 13 bp, Homo sapiens
cctggtctctggt

SEQ ID NO: 4442637 - DNA, 14 bp, Homo sapiens
cctggtctctggtc

SEQ ID NO: 4442638 - DNA, 12 bp, Homo sapiens
cctggtgcccct

SEQ ID NO: 4442639 - DNA, 14 bp, Homo sapiens
cctggtgcccctgc

SEQ ID NO: 4442640 - DNA, 22 bp, Homo sapiens
cctggtgctaacaacaaagttc

SEQ ID NO: 4442641 - DNA, 13 bp, Homo sapiens
cctggtgctgccg

SEQ ID NO: 4442642 - DNA, 18 bp, Homo sapiens
cctggtgctgccgagggc

SEQ ID NO: 4442643 - DNA, 17 bp, Homo sapiens
cctggtgctttccttca

SEQ ID NO: 4442644 - DNA, 15 bp, Homo sapiens
cctggtggcaccaga

SEQ ID NO: 4442645 - DNA, 18 bp, Homo sapiens
cctggtggcaccagatgc

SEQ ID NO: 4442646 - DNA, 19 bp, Homo sapiens
cctggtgggtccaggggcc

SEQ ID NO: 4442647 - DNA, 21 bp, Homo sapiens
cctggtggtggctcgggaggc

SEQ ID NO: 4442648 - DNA, 23 bp, Homo sapiens
cctggtgtttctagcactggcct

SEQ ID NO: 4442649 - DNA, 22 bp, Homo sapiens
cctggttcatatttatactttg

SEQ ID NO: 4442650 - DNA, 14 bp, Homo sapiens
cctggttctcatct

SEQ ID NO: 4442651 - DNA, 16 bp, Homo sapiens
cctggttctcatcttt

SEQ ID NO: 4442652 - DNA, 13 bp, Homo sapiens
cctggttttattt

SEQ ID NO: 4442653 - DNA, 14 bp, Homo sapiens
cctggtttttgcct

SEQ ID NO: 4442654 - DNA, 19 bp, Homo sapiens
cctggtttttggattaaat

SEQ ID NO: 4442655 - DNA, 22 bp, Homo sapiens
cctggtttttggattaaattag

SEQ ID NO: 4442656 - DNA, 14 bp, Homo sapiens
cctgtaaaacttta

SEQ ID NO: 4442657 - DNA, 18 bp, Homo sapiens
cctgtaaaactttatttt

SEQ ID NO: 4442658 - DNA, 14 bp, Homo sapiens
cctgtaaaagagag

SEQ ID NO: 4442659 - DNA, 18 bp, Homo sapiens
cctgtaaaagagaggggc

SEQ ID NO: 4442660 - DNA, 13 bp, Homo sapiens
cctgtaaatatat

SEQ ID NO: 4442661 - DNA, 12 bp, Homo sapiens
cctgtaaattat

SEQ ID NO: 4442662 - DNA, 15 bp, Homo sapiens
cctgtaaattatttt

SEQ ID NO: 4442663 - DNA, 17 bp, Homo sapiens
cctgtaaattattttaa

SEQ ID NO: 4442664 - DNA, 23 bp, Homo sapiens
cctgtaaattattttaaattata

SEQ ID NO: 4442665 - DNA, 21 bp, Homo sapiens
cctgtaagaagcggcatagca

SEQ ID NO: 4442666 - DNA, 15 bp, Homo sapiens
cctgtaatcacagct

SEQ ID NO: 4442667 - DNA, 17 bp, Homo sapiens
cctgtaatcccagaact

SEQ ID NO: 4442668 - DNA, 15 bp, Homo sapiens
cctgtaatcccagca

SEQ ID NO: 4442669 - DNA, 23 bp, Homo sapiens
cctgtaatcccagctactcagga

SEQ ID NO: 4442670 - DNA, 19 bp, Homo sapiens
cctgtacacagtgccccct

SEQ ID NO: 4442671 - DNA, 15 bp, Homo sapiens
cctgtactaaggagc

SEQ ID NO: 4442672 - DNA, 18 bp, Homo sapiens
cctgtagcaatggccaga

SEQ ID NO: 4442673 - DNA, 23 bp, Homo sapiens
cctgtagcaatggccagagcctc

SEQ ID NO: 4442674 - DNA, 13 bp, Homo sapiens
cctgtagctctgc

SEQ ID NO: 4442675 - DNA, 20 bp, Homo sapiens
cctgtagctctgcctccctc

SEQ ID NO: 4442676 - DNA, 17 bp, Homo sapiens
cctgtagctttcctggt

SEQ ID NO: 4442677 - DNA, 19 bp, Homo sapiens
cctgtagctttcctggtcc

SEQ ID NO: 4442678 - DNA, 23 bp, Homo sapiens
cctgtagggtttggacagaccca

SEQ ID NO: 4442679 - DNA, 15 bp, Homo sapiens
cctgtataagacact

SEQ ID NO: 4442680 - DNA, 21 bp, Homo sapiens
cctgtatactcttgaattcct

SEQ ID NO: 4442681 - DNA, 16 bp, Homo sapiens
cctgtattcttgtttg

SEQ ID NO: 4442682 - DNA, 18 bp, Homo sapiens
cctgtatttaagcaaata

SEQ ID NO: 4442683 - DNA, 14 bp, Homo sapiens
cctgtcaccaagct

SEQ ID NO: 4442684 - DNA, 22 bp, Homo sapiens
cctgtcattcccaccaccctga

SEQ ID NO: 4442685 - DNA, 16 bp, Homo sapiens
cctgtccaatctttga

SEQ ID NO: 4442686 - DNA, 13 bp, Homo sapiens
cctgtccaccctg

SEQ ID NO: 4442687 - DNA, 16 bp, Homo sapiens
cctgtccaccctgcca

SEQ ID NO: 4442688 - DNA, 18 bp, Homo sapiens
cctgtcccaattctgccc

SEQ ID NO: 4442689 - DNA, 13 bp, Homo sapiens
cctgtcccattct

SEQ ID NO: 4442690 - DNA, 14 bp, Homo sapiens
cctgtccctgggag

SEQ ID NO: 4442691 - DNA, 14 bp, Homo sapiens
cctgtcccttttcc

SEQ ID NO: 4442692 - DNA, 15 bp, Homo sapiens
cctgtcccttttccc

SEQ ID NO: 4442693 - DNA, 14 bp, Homo sapiens
cctgtccggcccag

SEQ ID NO: 4442694 - DNA, 20 bp, Homo sapiens
cctgtccggcccagtgccac

SEQ ID NO: 4442695 - DNA, 13 bp, Homo sapiens
cctgtcctcctcg

SEQ ID NO: 4442696 - DNA, 14 bp, Homo sapiens
cctgtcctcctggt

SEQ ID NO: 4442697 - DNA, 16 bp, Homo sapiens
cctgtcctcctggtgg

SEQ ID NO: 4442698 - DNA, 17 bp, Homo sapiens
cctgtcctcctggtggg

SEQ ID NO: 4442699 - DNA, 22 bp, Homo sapiens
cctgtcctcctggtgggtccag

SEQ ID NO: 4442700 - DNA, 12 bp, Homo sapiens
cctgtcctgccc

SEQ ID NO: 4442701 - DNA, 19 bp, Homo sapiens
cctgtctaggtctcctcag

SEQ ID NO: 4442702 - DNA, 20 bp, Homo sapiens
cctgtctaggtctcctcagg

SEQ ID NO: 4442703 - DNA, 17 bp, Homo sapiens
cctgtctcatccccagg

SEQ ID NO: 4442704 - DNA, 18 bp, Homo sapiens
cctgtctcatccccaggg

SEQ ID NO: 4442705 - DNA, 20 bp, Homo sapiens
cctgtctcatccccaggggt

SEQ ID NO: 4442706 - DNA, 21 bp, Homo sapiens
cctgtctccctcctctgcccg

SEQ ID NO: 4442707 - DNA, 17 bp, Homo sapiens
cctgtctctactaaaaa

SEQ ID NO: 4442708 - DNA, 18 bp, Homo sapiens
cctgtctggctcggaccc

SEQ ID NO: 4442709 - DNA, 23 bp, Homo sapiens
cctgtctggctcggacccacccc

SEQ ID NO: 4442710 - DNA, 16 bp, Homo sapiens
cctgtctgttcccagc

SEQ ID NO: 4442711 - DNA, 19 bp, Homo sapiens
cctgtctgttcccagcccc

SEQ ID NO: 4442712 - DNA, 15 bp, Homo sapiens
cctgtctgtttatat

SEQ ID NO: 4442713 - DNA, 14 bp, Homo sapiens
cctgtcttcccagg

SEQ ID NO: 4442714 - DNA, 22 bp, Homo sapiens
cctgtgaaagactcaatgagct

SEQ ID NO: 4442715 - DNA, 22 bp, Homo sapiens
cctgtgacatggtgcctgagag

SEQ ID NO: 4442716 - DNA, 19 bp, Homo sapiens
cctgtgaccacaacatgag

SEQ ID NO: 4442717 - DNA, 20 bp, Homo sapiens
cctgtgagcatggggccagg

SEQ ID NO: 4442718 - DNA, 17 bp, Homo sapiens
cctgtgcctgattattt

SEQ ID NO: 4442719 - DNA, 12 bp, Homo sapiens
cctgtgcctggc

SEQ ID NO: 4442720 - DNA, 13 bp, Homo sapiens
cctgtgcctggcc

SEQ ID NO: 4442721 - DNA, 14 bp, Homo sapiens
cctgtgcctggccc

SEQ ID NO: 4442722 - DNA, 18 bp, Homo sapiens
cctgtgctcaccctctct

SEQ ID NO: 4442723 - DNA, 23 bp, Homo sapiens
cctgtggaacataaaaaggacat

SEQ ID NO: 4442724 - DNA, 19 bp, Homo sapiens
cctgtggaaggcagagaaa

SEQ ID NO: 4442725 - DNA, 22 bp, Homo sapiens
cctgtggaataaagatggtcca

SEQ ID NO: 4442726 - DNA, 17 bp, Homo sapiens
cctgtggaatgggctca

SEQ ID NO: 4442727 - DNA, 23 bp, Homo sapiens
cctgtggacaggatgaggacaga

SEQ ID NO: 4442728 - DNA, 17 bp, Homo sapiens
cctgtggattagaatag

SEQ ID NO: 4442729 - DNA, 19 bp, Homo sapiens
cctgtggcactcagggagc

SEQ ID NO: 4442730 - DNA, 23 bp, Homo sapiens
cctgtggcatctttgccttgggc

SEQ ID NO: 4442731 - DNA, 17 bp, Homo sapiens
cctgtggccagcagccc

SEQ ID NO: 4442732 - DNA, 13 bp, Homo sapiens
cctgtggcccctc

SEQ ID NO: 4442733 - DNA, 17 bp, Homo sapiens
cctgtggcccctcccct

SEQ ID NO: 4442734 - DNA, 19 bp, Homo sapiens
cctgtggcctgctcatcac

SEQ ID NO: 4442735 - DNA, 16 bp, Homo sapiens
cctgtggcggtgcctg

SEQ ID NO: 4442736 - DNA, 22 bp, Homo sapiens
cctgtggctgtgtgtctgcttg

SEQ ID NO: 4442737 - DNA, 21 bp, Homo sapiens
cctgtgggagccgcagagcct

SEQ ID NO: 4442738 - DNA, 15 bp, Homo sapiens
cctgtggggcctggg

SEQ ID NO: 4442739 - DNA, 22 bp, Homo sapiens
cctgtggggggtaatccctgct

SEQ ID NO: 4442740 - DNA, 14 bp, Homo sapiens
cctgtgggggtggc

SEQ ID NO: 4442741 - DNA, 22 bp, Homo sapiens
cctgtgggggtggccatccctg

SEQ ID NO: 4442742 - DNA, 15 bp, Homo sapiens
cctgtggtgaagtgt

SEQ ID NO: 4442743 - DNA, 17 bp, Homo sapiens
cctgtggtgaagtgtgg

SEQ ID NO: 4442744 - DNA, 19 bp, Homo sapiens
cctgtggtgaagtgtggct

SEQ ID NO: 4442745 - DNA, 21 bp, Homo sapiens
cctgtggtgaagtgtggctgg

SEQ ID NO: 4442746 - DNA, 14 bp, Homo sapiens
cctgtgtactgtgt

SEQ ID NO: 4442747 - DNA, 17 bp, Homo sapiens
cctgtgtattaaacctt

SEQ ID NO: 4442748 - DNA, 15 bp, Homo sapiens
cctgtgtgaccctgg

SEQ ID NO: 4442749 - DNA, 20 bp, Homo sapiens
cctgtgtgaccctgggcagt

SEQ ID NO: 4442750 - DNA, 15 bp, Homo sapiens
cctgtgttctgggct

SEQ ID NO: 4442751 - DNA, 22 bp, Homo sapiens
cctgtgttctgggctggggcca

SEQ ID NO: 4442752 - DNA, 21 bp, Homo sapiens
cctgttaatttataatgtatt

SEQ ID NO: 4442753 - DNA, 22 bp, Homo sapiens
cctgttaatttataatgtattt

SEQ ID NO: 4442754 - DNA, 23 bp, Homo sapiens
cctgttaatttataatgtatttg

SEQ ID NO: 4442755 - DNA, 15 bp, Homo sapiens
cctgttacttgcttc

SEQ ID NO: 4442756 - DNA, 14 bp, Homo sapiens
cctgttcacaccag

SEQ ID NO: 4442757 - DNA, 14 bp, Homo sapiens
cctgttccctaccc

SEQ ID NO: 4442758 - DNA, 12 bp, Homo sapiens
cctgttctccct

SEQ ID NO: 4442759 - DNA, 16 bp, Homo sapiens
cctgttggccttggaa

SEQ ID NO: 4442760 - DNA, 14 bp, Homo sapiens
cctgtttctggcac

SEQ ID NO: 4442761 - DNA, 14 bp, Homo sapiens
cctgtttgaaatat

SEQ ID NO: 4442762 - DNA, 23 bp, Homo sapiens
cctgtttgaaggggagagaggga

SEQ ID NO: 4442763 - DNA, 16 bp, Homo sapiens
cctgttttatatatta

SEQ ID NO: 4442764 - DNA, 16 bp, Homo sapiens
ccttaaaaccaaagag

SEQ ID NO: 4442765 - DNA, 20 bp, Homo sapiens
ccttaaacaaaaattaaaat

SEQ ID NO: 4442766 - DNA, 15 bp, Homo sapiens
ccttaacccacctct

SEQ ID NO: 4442767 - DNA, 17 bp, Homo sapiens
ccttaacccacctctcc

SEQ ID NO: 4442768 - DNA, 18 bp, Homo sapiens
ccttaacccacctctcct

SEQ ID NO: 4442769 - DNA, 13 bp, Homo sapiens
ccttaactgacat

SEQ ID NO: 4442770 - DNA, 16 bp, Homo sapiens
ccttaagatattgaag

SEQ ID NO: 4442771 - DNA, 18 bp, Homo sapiens
ccttaagcacaattaatt

SEQ ID NO: 4442772 - DNA, 19 bp, Homo sapiens
ccttaatatttcttcaaat

SEQ ID NO: 4442773 - DNA, 16 bp, Homo sapiens
ccttaattacttaaaa

SEQ ID NO: 4442774 - DNA, 18 bp, Homo sapiens
ccttaatttcctttttga

SEQ ID NO: 4442775 - DNA, 19 bp, Homo sapiens
ccttacaacgccgagtgca

SEQ ID NO: 4442776 - DNA, 22 bp, Homo sapiens
ccttacaagttagaaaacataa

SEQ ID NO: 4442777 - DNA, 21 bp, Homo sapiens
ccttaccaacagcttttccca

SEQ ID NO: 4442778 - DNA, 16 bp, Homo sapiens
ccttaccccttagcct

SEQ ID NO: 4442779 - DNA, 17 bp, Homo sapiens
ccttacctcctgcccag

SEQ ID NO: 4442780 - DNA, 14 bp, Homo sapiens
ccttacctttttat

SEQ ID NO: 4442781 - DNA, 21 bp, Homo sapiens
ccttactcacctctctctaag

SEQ ID NO: 4442782 - DNA, 22 bp, Homo sapiens
ccttactcttcttgaaatttta

SEQ ID NO: 4442783 - DNA, 18 bp, Homo sapiens
ccttactgtttacagttt

SEQ ID NO: 4442784 - DNA, 20 bp, Homo sapiens
ccttagactcttttccttcc

SEQ ID NO: 4442785 - DNA, 18 bp, Homo sapiens
ccttagagccaggcacac

SEQ ID NO: 4442786 - DNA, 19 bp, Homo sapiens
ccttagcagccctggatgg

SEQ ID NO: 4442787 - DNA, 12 bp, Homo sapiens
ccttagcctctc

SEQ ID NO: 4442788 - DNA, 14 bp, Homo sapiens
ccttagcctctccc

SEQ ID NO: 4442789 - DNA, 15 bp, Homo sapiens
ccttagcctctccca

SEQ ID NO: 4442790 - DNA, 17 bp, Homo sapiens
ccttagcgttctggact

SEQ ID NO: 4442791 - DNA, 19 bp, Homo sapiens
ccttagcttcaggaacctc

SEQ ID NO: 4442792 - DNA, 15 bp, Homo sapiens
ccttaggatggggct

SEQ ID NO: 4442793 - DNA, 22 bp, Homo sapiens
ccttaggccacatgggagcagt

SEQ ID NO: 4442794 - DNA, 13 bp, Homo sapiens
ccttaggctttgt

SEQ ID NO: 4442795 - DNA, 14 bp, Homo sapiens
ccttagtctttcct

SEQ ID NO: 4442796 - DNA, 13 bp, Homo sapiens
ccttatccaaaat

SEQ ID NO: 4442797 - DNA, 13 bp, Homo sapiens
ccttatccctctc

SEQ ID NO: 4442798 - DNA, 18 bp, Homo sapiens
ccttatgtgttacattat

SEQ ID NO: 4442799 - DNA, 16 bp, Homo sapiens
ccttattagagtgtct

SEQ ID NO: 4442800 - DNA, 13 bp, Homo sapiens
ccttatttctcat

SEQ ID NO: 4442801 - DNA, 19 bp, Homo sapiens
ccttatttgccttctactc

SEQ ID NO: 4442802 - DNA, 23 bp, Homo sapiens
ccttatttgtctgtaaaaaatgg

SEQ ID NO: 4442803 - DNA, 20 bp, Homo sapiens
ccttattttgagtaaatatt

SEQ ID NO: 4442804 - DNA, 22 bp, Homo sapiens
ccttcaaagtctcaatgaaata

SEQ ID NO: 4442805 - DNA, 22 bp, Homo sapiens
ccttcaacaattctaaaatgat

SEQ ID NO: 4442806 - DNA, 15 bp, Homo sapiens
ccttcaacccagtgg

SEQ ID NO: 4442807 - DNA, 22 bp, Homo sapiens
ccttcaagaatcagaagaaagg

SEQ ID NO: 4442808 - DNA, 13 bp, Homo sapiens
ccttcaagtgcca

SEQ ID NO: 4442809 - DNA, 13 bp, Homo sapiens
ccttcacaaatgt

SEQ ID NO: 4442810 - DNA, 18 bp, Homo sapiens
ccttcagaacagaggcat

SEQ ID NO: 4442811 - DNA, 20 bp, Homo sapiens
ccttcagatcagccacacct

SEQ ID NO: 4442812 - DNA, 13 bp, Homo sapiens
ccttcagccctca

SEQ ID NO: 4442813 - DNA, 14 bp, Homo sapiens
ccttcagcttgctt

SEQ ID NO: 4442814 - DNA, 14 bp, Homo sapiens
ccttcaggactctg

SEQ ID NO: 4442815 - DNA, 16 bp, Homo sapiens
ccttcagggagacagg

SEQ ID NO: 4442816 - DNA, 21 bp, Homo sapiens
ccttcagggagacaggcaggg

SEQ ID NO: 4442817 - DNA, 16 bp, Homo sapiens
ccttcagggctgagtt

SEQ ID NO: 4442818 - DNA, 22 bp, Homo sapiens
ccttcagtgagcccctccccag

SEQ ID NO: 4442819 - DNA, 14 bp, Homo sapiens
ccttcagtgcccac

SEQ ID NO: 4442820 - DNA, 18 bp, Homo sapiens
ccttcagttatgattttt

SEQ ID NO: 4442821 - DNA, 17 bp, Homo sapiens
ccttcatcatgagttct

SEQ ID NO: 4442822 - DNA, 21 bp, Homo sapiens
ccttcatcatgagttctgctg

SEQ ID NO: 4442823 - DNA, 17 bp, Homo sapiens
ccttcatctgggacaaa

SEQ ID NO: 4442824 - DNA, 17 bp, Homo sapiens
ccttcatgacagcctcc

SEQ ID NO: 4442825 - DNA, 15 bp, Homo sapiens
ccttccaatgctgtg

SEQ ID NO: 4442826 - DNA, 15 bp, Homo sapiens
ccttccacagctggc

SEQ ID NO: 4442827 - DNA, 20 bp, Homo sapiens
ccttccactgtgcacctgcg

SEQ ID NO: 4442828 - DNA, 16 bp, Homo sapiens
ccttccagagcccaag

SEQ ID NO: 4442829 - DNA, 10 bp, Homo sapiens
ccttccagat

SEQ ID NO: 4442830 - DNA, 12 bp, Homo sapiens
ccttccagatcc

SEQ ID NO: 4442831 - DNA, 19 bp, Homo sapiens
ccttccagatcctctctgg

SEQ ID NO: 4442832 - DNA, 22 bp, Homo sapiens
ccttccagtggctcgctccctg

SEQ ID NO: 4442833 - DNA, 20 bp, Homo sapiens
ccttccatgtcggcctctaa

SEQ ID NO: 4442834 - DNA, 15 bp, Homo sapiens
ccttccatgtgcctt

SEQ ID NO: 4442835 - DNA, 22 bp, Homo sapiens
ccttcccaacgtactcctcaga

SEQ ID NO: 4442836 - DNA, 21 bp, Homo sapiens
ccttcccaaggttactcagca

SEQ ID NO: 4442837 - DNA, 20 bp, Homo sapiens
ccttcccacatgcctgcgcc

SEQ ID NO: 4442838 - DNA, 17 bp, Homo sapiens
ccttcccactcaccccg

SEQ ID NO: 4442839 - DNA, 12 bp, Homo sapiens
ccttcccagggc

SEQ ID NO: 4442840 - DNA, 15 bp, Homo sapiens
ccttcccagggcacc

SEQ ID NO: 4442841 - DNA, 20 bp, Homo sapiens
ccttcccagggcacccaggc

SEQ ID NO: 4442842 - DNA, 14 bp, Homo sapiens
ccttccccagaccc

SEQ ID NO: 4442843 - DNA, 15 bp, Homo sapiens
ccttcccccatccct

SEQ ID NO: 4442844 - DNA, 18 bp, Homo sapiens
ccttcccccatccctacc

SEQ ID NO: 4442845 - DNA, 17 bp, Homo sapiens
ccttcccctccctggct

SEQ ID NO: 4442846 - DNA, 18 bp, Homo sapiens
ccttcccctccctggctc

SEQ ID NO: 4442847 - DNA, 21 bp, Homo sapiens
ccttcccctgaggacctttct

SEQ ID NO: 4442848 - DNA, 12 bp, Homo sapiens
ccttcccctgct

SEQ ID NO: 4442849 - DNA, 14 bp, Homo sapiens
ccttcccctgctga

SEQ ID NO: 4442850 - DNA, 21 bp, Homo sapiens
ccttccccttctgtgtcacag

SEQ ID NO: 4442851 - DNA, 23 bp, Homo sapiens
ccttcccggcccccggccaagga

SEQ ID NO: 4442852 - DNA, 12 bp, Homo sapiens
ccttccctagct

SEQ ID NO: 4442853 - DNA, 11 bp, Homo sapiens
ccttccctctc

SEQ ID NO: 4442854 - DNA, 19 bp, Homo sapiens
ccttccctctctccctgcc

SEQ ID NO: 4442855 - DNA, 21 bp, Homo sapiens
ccttccctctctccctgcctc

SEQ ID NO: 4442856 - DNA, 13 bp, Homo sapiens
ccttccctctctg

SEQ ID NO: 4442857 - DNA, 15 bp, Homo sapiens
ccttccctctctgat

SEQ ID NO: 4442858 - DNA, 14 bp, Homo sapiens
ccttccctggcccc

SEQ ID NO: 4442859 - DNA, 15 bp, Homo sapiens
ccttccctgttctcc

SEQ ID NO: 4442860 - DNA, 17 bp, Homo sapiens
ccttccgacaggagcac

SEQ ID NO: 4442861 - DNA, 19 bp, Homo sapiens
ccttcctcagctgcctcct

SEQ ID NO: 4442862 - DNA, 20 bp, Homo sapiens
ccttcctcagctgcctcctg

SEQ ID NO: 4442863 - DNA, 18 bp, Homo sapiens
ccttcctgctgctgctac

SEQ ID NO: 4442864 - DNA, 17 bp, Homo sapiens
ccttcctgggaggacag

SEQ ID NO: 4442865 - DNA, 22 bp, Homo sapiens
ccttcctgtttttcacattttc

SEQ ID NO: 4442866 - DNA, 15 bp, Homo sapiens
ccttccttcaggact

SEQ ID NO: 4442867 - DNA, 17 bp, Homo sapiens
ccttccttcaggactct

SEQ ID NO: 4442868 - DNA, 19 bp, Homo sapiens
ccttccttcaggactctgc

SEQ ID NO: 4442869 - DNA, 19 bp, Homo sapiens
ccttcctttaggtctggtt

SEQ ID NO: 4442870 - DNA, 18 bp, Homo sapiens
ccttccttttccctgctt

SEQ ID NO: 4442871 - DNA, 21 bp, Homo sapiens
ccttccttttccctgcttcca

SEQ ID NO: 4442872 - DNA, 22 bp, Homo sapiens
ccttcctttttattcagctaga

SEQ ID NO: 4442873 - DNA, 14 bp, Homo sapiens
ccttctacactctc

SEQ ID NO: 4442874 - DNA, 16 bp, Homo sapiens
ccttctacactctcct

SEQ ID NO: 4442875 - DNA, 17 bp, Homo sapiens
ccttctacactctcctg

SEQ ID NO: 4442876 - DNA, 21 bp, Homo sapiens
ccggcgtcagcctccagcctc

SEQ ID NO: 4442877 - DNA, 23 bp, Homo sapiens
ccggcgtcagcctccagcctctg

SEQ ID NO: 4442878 - DNA, 18 bp, Homo sapiens
ccggctaatttttgtaat

SEQ ID NO: 4442879 - DNA, 16 bp, Homo sapiens
ccggctttgtggcact

SEQ ID NO: 4442880 - DNA, 17 bp, Homo sapiens
ccggctttgtggcactg

SEQ ID NO: 4442881 - DNA, 19 bp, Homo sapiens
ccgggacacctaggctagg

SEQ ID NO: 4442882 - DNA, 20 bp, Homo sapiens
ccgggacacctaggctaggg

SEQ ID NO: 4442883 - DNA, 17 bp, Homo sapiens
ccgggacctggtgctgc

SEQ ID NO: 4442884 - DNA, 17 bp, Homo sapiens
ccgggactgctgctctc

SEQ ID NO: 4442885 - DNA, 19 bp, Homo sapiens
ccgggactgctgctctccc

SEQ ID NO: 4442886 - DNA, 19 bp, Homo sapiens
ccgggagcctccccctcag

SEQ ID NO: 4442887 - DNA, 15 bp, Homo sapiens
ccgggagctgggccc

SEQ ID NO: 4442888 - DNA, 22 bp, Homo sapiens
ccgggaggcagaggttgcagtg

SEQ ID NO: 4442889 - DNA, 19 bp, Homo sapiens
ccgggcgcggccagccccg

SEQ ID NO: 4442890 - DNA, 14 bp, Homo sapiens
ccgggcgcggtggc

SEQ ID NO: 4442891 - DNA, 15 bp, Homo sapiens
ccggggaccctgtga

SEQ ID NO: 4442892 - DNA, 12 bp, Homo sapiens
ccggggccccct

SEQ ID NO: 4442893 - DNA, 18 bp, Homo sapiens
ccggggccccctggtcac

SEQ ID NO: 4442894 - DNA, 14 bp, Homo sapiens
ccggggcctggaca

SEQ ID NO: 4442895 - DNA, 15 bp, Homo sapiens
ccggggcctggacag

SEQ ID NO: 4442896 - DNA, 15 bp, Homo sapiens
ccggggcctgggcag

SEQ ID NO: 4442897 - DNA, 19 bp, Homo sapiens
ccggggcctgggcaggagg

SEQ ID NO: 4442898 - DNA, 20 bp, Homo sapiens
ccggggcctgggcaggaggg

SEQ ID NO: 4442899 - DNA, 12 bp, Homo sapiens
ccgggggacaga

SEQ ID NO: 4442900 - DNA, 21 bp, Homo sapiens
ccgggggcagtctgagagagg

SEQ ID NO: 4442901 - DNA, 22 bp, Homo sapiens
ccgggtccggcctctccctgcc

SEQ ID NO: 4442902 - DNA, 14 bp, Homo sapiens
ccgggtctgcctct

SEQ ID NO: 4442903 - DNA, 13 bp, Homo sapiens
ccgggtgtggcct

SEQ ID NO: 4442904 - DNA, 17 bp, Homo sapiens
ccgggtgtggcctcagc

SEQ ID NO: 4442905 - DNA, 22 bp, Homo sapiens
ccggtaaaatgaggccggacag

SEQ ID NO: 4442906 - DNA, 15 bp, Homo sapiens
ccggtcagtgccttt

SEQ ID NO: 4442907 - DNA, 13 bp, Homo sapiens
ccggtccacaggt

SEQ ID NO: 4442908 - DNA, 21 bp, Homo sapiens
ccggtcccccagagcatctgc

SEQ ID NO: 4442909 - DNA, 16 bp, Homo sapiens
ccggtcgggcagccag

SEQ ID NO: 4442910 - DNA, 18 bp, Homo sapiens
ccggtcgggcagccagca

SEQ ID NO: 4442911 - DNA, 20 bp, Homo sapiens
ccggtcgggcagccagcaga

SEQ ID NO: 4442912 - DNA, 21 bp, Homo sapiens
ccggtcgggcagccagcagag

SEQ ID NO: 4442913 - DNA, 15 bp, Homo sapiens
ccggtgccagctgcc

SEQ ID NO: 4442914 - DNA, 18 bp, Homo sapiens
ccggtgggaccctgtccg

SEQ ID NO: 4442915 - DNA, 19 bp, Homo sapiens
ccggttaaattccatatgc

SEQ ID NO: 4442916 - DNA, 17 bp, Homo sapiens
ccggttcagacccctgc

SEQ ID NO: 4442917 - DNA, 19 bp, Homo sapiens
ccggttcagacccctgcct

SEQ ID NO: 4442918 - DNA, 16 bp, Homo sapiens
ccggttttcctcagct

SEQ ID NO: 4442919 - DNA, 18 bp, Homo sapiens
ccggttttcctcagctct

SEQ ID NO: 4442920 - DNA, 14 bp, Homo sapiens
ccgtaatcccagct

SEQ ID NO: 4442921 - DNA, 13 bp, Homo sapiens
ccgtaatttaact

SEQ ID NO: 4442922 - DNA, 18 bp, Homo sapiens
ccgtagctcccctggctg

SEQ ID NO: 4442923 - DNA, 14 bp, Homo sapiens
ccgtatcacagtgt

SEQ ID NO: 4442924 - DNA, 14 bp, Homo sapiens
ccgtattgaatttg

SEQ ID NO: 4442925 - DNA, 12 bp, Homo sapiens
ccgtcatttcat

SEQ ID NO: 4442926 - DNA, 20 bp, Homo sapiens
ccgtccatccgactgcccct

SEQ ID NO: 4442927 - DNA, 18 bp, Homo sapiens
ccgtcggactgcccccag

SEQ ID NO: 4442928 - DNA, 19 bp, Homo sapiens
ccgtcggactgcccccaga

SEQ ID NO: 4442929 - DNA, 11 bp, Homo sapiens
ccgtctacatt

SEQ ID NO: 4442930 - DNA, 18 bp, Homo sapiens
ccgtctaggattgggcct

SEQ ID NO: 4442931 - DNA, 14 bp, Homo sapiens
ccgtctctactaaa

SEQ ID NO: 4442932 - DNA, 18 bp, Homo sapiens
ccgtctggacctggggag

SEQ ID NO: 4442933 - DNA, 20 bp, Homo sapiens
ccgtctggggttcagcccct

SEQ ID NO: 4442934 - DNA, 21 bp, Homo sapiens
ccgtgaactctggtgctcctg

SEQ ID NO: 4442935 - DNA, 12 bp, Homo sapiens
ccgtgagcatgc

SEQ ID NO: 4442936 - DNA, 18 bp, Homo sapiens
ccgtgatggagaggacag

SEQ ID NO: 4442937 - DNA, 19 bp, Homo sapiens
ccgtgatggagaggacaga

SEQ ID NO: 4442938 - DNA, 23 bp, Homo sapiens
ccgtgatggagaggacagagcag

SEQ ID NO: 4442939 - DNA, 19 bp, Homo sapiens
ccgtgcatggctcctgtct

SEQ ID NO: 4442940 - DNA, 17 bp, Homo sapiens
ccgtgcccgcaggaact

SEQ ID NO: 4442941 - DNA, 20 bp, Homo sapiens
ccgagctcctggggagctcc

SEQ ID NO: 4442942 - DNA, 14 bp, Homo sapiens
ccgagctggaaaac

SEQ ID NO: 4442943 - DNA, 15 bp, Homo sapiens
ccgaggacccagacc

SEQ ID NO: 4442944 - DNA, 11 bp, Homo sapiens
ccgaggccagt

SEQ ID NO: 4442945 - DNA, 18 bp, Homo sapiens
ccgaggctacagctccac

SEQ ID NO: 4442946 - DNA, 17 bp, Homo sapiens
ccgagggctggccggga

SEQ ID NO: 4442947 - DNA, 19 bp, Homo sapiens
ccgagggtcctggctcctg

SEQ ID NO: 4442948 - DNA, 23 bp, Homo sapiens
ccgagggtcctggctcctgaggg

SEQ ID NO: 4442949 - DNA, 20 bp, Homo sapiens
ccgaggtgggcagatcactt

SEQ ID NO: 4442950 - DNA, 17 bp, Homo sapiens
ccgagtgaactggtctt

SEQ ID NO: 4442951 - DNA, 20 bp, Homo sapiens
ccgagtgaactggtcttcct

SEQ ID NO: 4442952 - DNA, 15 bp, Homo sapiens
ccgatattctccctg

SEQ ID NO: 4442953 - DNA, 11 bp, Homo sapiens
ccgatgccacc

SEQ ID NO: 4442954 - DNA, 14 bp, Homo sapiens
ccgatttctgtaaa

SEQ ID NO: 4442955 - DNA, 17 bp, Homo sapiens
ccgcaccccagagtgtg

SEQ ID NO: 4442956 - DNA, 18 bp, Homo sapiens
ccgcacgactgcgggagc

SEQ ID NO: 4442957 - DNA, 21 bp, Homo sapiens
ccgcacgactgcgggagccag

SEQ ID NO: 4442958 - DNA, 23 bp, Homo sapiens
ccgcagacggtctgtgtgctgtt

SEQ ID NO: 4442959 - DNA, 18 bp, Homo sapiens
ccgcagcccgcctgccgt

SEQ ID NO: 4442960 - DNA, 20 bp, Homo sapiens
ccgcatcttctccatctggc

SEQ ID NO: 4442961 - DNA, 22 bp, Homo sapiens
ccgcatcttctccatctggcag

SEQ ID NO: 4442962 - DNA, 18 bp, Homo sapiens
ccgcatgtgtgcctggcc

SEQ ID NO: 4442963 - DNA, 23 bp, Homo sapiens
ccgcattccctgagtcaccagga

SEQ ID NO: 4442964 - DNA, 14 bp, Homo sapiens
ccgccacgtcccag

SEQ ID NO: 4442965 - DNA, 21 bp, Homo sapiens
ccgccacgtcccagcatccct

SEQ ID NO: 4442966 - DNA, 16 bp, Homo sapiens
ccgccactcgccttct

SEQ ID NO: 4442967 - DNA, 11 bp, Homo sapiens
ccgccagcctc

SEQ ID NO: 4442968 - DNA, 12 bp, Homo sapiens
ccgccagcctcc

SEQ ID NO: 4442969 - DNA, 12 bp, Homo sapiens
ccgccagctggg

SEQ ID NO: 4442970 - DNA, 16 bp, Homo sapiens
ccgccagggctgggga

SEQ ID NO: 4442971 - DNA, 16 bp, Homo sapiens
ccgccattgccaccag

SEQ ID NO: 4442972 - DNA, 12 bp, Homo sapiens
ccgcccaaggcc

SEQ ID NO: 4442973 - DNA, 13 bp, Homo sapiens
ccgcccaaggcct

SEQ ID NO: 4442974 - DNA, 14 bp, Homo sapiens
ccgcccactcctgg

SEQ ID NO: 4442975 - DNA, 13 bp, Homo sapiens
ccgcccagcctct

SEQ ID NO: 4442976 - DNA, 13 bp, Homo sapiens
ccgcccccagtcc

SEQ ID NO: 4442977 - DNA, 15 bp, Homo sapiens
ccgcccctcccacgc

SEQ ID NO: 4442978 - DNA, 14 bp, Homo sapiens
ccgccctcaggggc

SEQ ID NO: 4442979 - DNA, 24 bp, Homo sapiens
ccgccctgggctgtctgtcaccag

SEQ ID NO: 4442980 - DNA, 18 bp, Homo sapiens
ccgccgcctcccacggca

SEQ ID NO: 4442981 - DNA, 13 bp, Homo sapiens
ccgccgctgccct

SEQ ID NO: 4442982 - DNA, 23 bp, Homo sapiens
ccgcctcaatgtggttgcaaggc

SEQ ID NO: 4442983 - DNA, 13 bp, Homo sapiens
ccgcctccacact

SEQ ID NO: 4442984 - DNA, 12 bp, Homo sapiens
ccgcctccagga

SEQ ID NO: 4442985 - DNA, 21 bp, Homo sapiens
ccgcctccctctcagaggcct

SEQ ID NO: 4442986 - DNA, 19 bp, Homo sapiens
ccgcctcgacctccccacc

SEQ ID NO: 4442987 - DNA, 13 bp, Homo sapiens
ccgcctgaaggca

SEQ ID NO: 4442988 - DNA, 18 bp, Homo sapiens
ccgcctgaaggcacagct

SEQ ID NO: 4442989 - DNA, 14 bp, Homo sapiens
ccgcctgccagtcc

SEQ ID NO: 4442990 - DNA, 12 bp, Homo sapiens
ccgcctgcccag

SEQ ID NO: 4442991 - DNA, 19 bp, Homo sapiens
ccgcctgcccagactgatg

SEQ ID NO: 4442992 - DNA, 22 bp, Homo sapiens
ccgcctgcccgtctctctccca

SEQ ID NO: 4442993 - DNA, 18 bp, Homo sapiens
ccgcctgccgtgcatggc

SEQ ID NO: 4442994 - DNA, 20 bp, Homo sapiens
ccgcctgggtcatgggcctg

SEQ ID NO: 4442995 - DNA, 16 bp, Homo sapiens
ccgcctgtcacaataa

SEQ ID NO: 4442996 - DNA, 19 bp, Homo sapiens
ccgccttctcccacatgag

SEQ ID NO: 4442997 - DNA, 22 bp, Homo sapiens
ccgcctttagttctccactggg

SEQ ID NO: 4442998 - DNA, 16 bp, Homo sapiens
ccgcgccgatgccacc

SEQ ID NO: 4442999 - DNA, 17 bp, Homo sapiens
ccgcgccgatgccaccg

SEQ ID NO: 4443000 - DNA, 18 bp, Homo sapiens
ccgcgctcgcccagcagg

SEQ ID NO: 4443001 - DNA, 20 bp, Homo sapiens
ccgcgctcgcccagcaggag

SEQ ID NO: 4443002 - DNA, 20 bp, Homo sapiens
ccgcgggagacagcttctct

SEQ ID NO: 4443003 - DNA, 22 bp, Homo sapiens
ccctgggcttggcctgctgtga

SEQ ID NO: 4443004 - DNA, 15 bp, Homo sapiens
ccctggggcaggggt

SEQ ID NO: 4443005 - DNA, 16 bp, Homo sapiens
ccctggggcaggggtg

SEQ ID NO: 4443006 - DNA, 13 bp, Homo sapiens
ccctggggcccag

SEQ ID NO: 4443007 - DNA, 23 bp, Homo sapiens
ccctggggctgagtctccagggc

SEQ ID NO: 4443008 - DNA, 18 bp, Homo sapiens
ccctgggtaagaagggtg

SEQ ID NO: 4443009 - DNA, 14 bp, Homo sapiens
ccctggtcaccgag

SEQ ID NO: 4443010 - DNA, 19 bp, Homo sapiens
ccctggtcaccgagactca

SEQ ID NO: 4443011 - DNA, 16 bp, Homo sapiens
ccctggtccagggaag

SEQ ID NO: 4443012 - DNA, 18 bp, Homo sapiens
ccctggtccagggaagct

SEQ ID NO: 4443013 - DNA, 13 bp, Homo sapiens
ccctggtctcagc

SEQ ID NO: 4443014 - DNA, 17 bp, Homo sapiens
ccctggtctcagcagcg

SEQ ID NO: 4443015 - DNA, 21 bp, Homo sapiens
ccctggtgtttctagcactgg

SEQ ID NO: 4443016 - DNA, 20 bp, Homo sapiens
ccctgtcaagcttctctgtt

SEQ ID NO: 4443017 - DNA, 19 bp, Homo sapiens
ccctgtcaccaagctcaca

SEQ ID NO: 4443018 - DNA, 13 bp, Homo sapiens
ccctgtcacctct

SEQ ID NO: 4443019 - DNA, 19 bp, Homo sapiens
ccctgtcatttgaacctgg

SEQ ID NO: 4443020 - DNA, 20 bp, Homo sapiens
ccctgtcatttgaacctgga

SEQ ID NO: 4443021 - DNA, 14 bp, Homo sapiens
ccctgtccaaaagc

SEQ ID NO: 4443022 - DNA, 23 bp, Homo sapiens
ccctgtccaaaagcgccctcact

SEQ ID NO: 4443023 - DNA, 13 bp, Homo sapiens
ccctgtcccattc

SEQ ID NO: 4443024 - DNA, 14 bp, Homo sapiens
ccctgtcctcctcg

SEQ ID NO: 4443025 - DNA, 15 bp, Homo sapiens
ccctgtcctcctcgg

SEQ ID NO: 4443026 - DNA, 14 bp, Homo sapiens
ccctgtcctgcaca

SEQ ID NO: 4443027 - DNA, 13 bp, Homo sapiens
ccctgtctccagg

SEQ ID NO: 4443028 - DNA, 13 bp, Homo sapiens
ccctgtctggaag

SEQ ID NO: 4443029 - DNA, 14 bp, Homo sapiens
ccctgtctggaaga

SEQ ID NO: 4443030 - DNA, 23 bp, Homo sapiens
ccctgtctgtagagggccctggt

SEQ ID NO: 4443031 - DNA, 18 bp, Homo sapiens
ccctgtctgttcccagcc

SEQ ID NO: 4443032 - DNA, 20 bp, Homo sapiens
ccctgtgacatggtgcctga

SEQ ID NO: 4443033 - DNA, 22 bp, Homo sapiens
ccctgtgcagccgctgagcgag

SEQ ID NO: 4443034 - DNA, 24 bp, Homo sapiens
ccctgtgccttggtgtgctgtatc

SEQ ID NO: 4443035 - DNA, 23 bp, Homo sapiens
ccctgtggaatgggctcaaggtt

SEQ ID NO: 4443036 - DNA, 19 bp, Homo sapiens
ccctgtggatgctgctgcc

SEQ ID NO: 4443037 - DNA, 22 bp, Homo sapiens
ccctgtgggagccgcagagcct

SEQ ID NO: 4443038 - DNA, 12 bp, Homo sapiens
ccctgtgggggt

SEQ ID NO: 4443039 - DNA, 19 bp, Homo sapiens
ccctgtgtatacagccctg

SEQ ID NO: 4443040 - DNA, 15 bp, Homo sapiens
ccctgtgttctgggc

SEQ ID NO: 4443041 - DNA, 17 bp, Homo sapiens
ccctgtgttctgggctg

SEQ ID NO: 4443042 - DNA, 20 bp, Homo sapiens
ccctgtgttctgggctgggg

SEQ ID NO: 4443043 - DNA, 21 bp, Homo sapiens
ccctgttctccctttctctct

SEQ ID NO: 4443044 - DNA, 21 bp, Homo sapiens
cccttaaaaatgaatgtcttg

SEQ ID NO: 4443045 - DNA, 22 bp, Homo sapiens
cccttaagcagcaacagcctac

SEQ ID NO: 4443046 - DNA, 18 bp, Homo sapiens
cccttaattacttaaaaa

SEQ ID NO: 4443047 - DNA, 20 bp, Homo sapiens
cccttaattacttaaaaaaa

SEQ ID NO: 4443048 - DNA, 21 bp, Homo sapiens
cccttacagccctaagtggct

SEQ ID NO: 4443049 - DNA, 14 bp, Homo sapiens
cccttacagtagga

SEQ ID NO: 4443050 - DNA, 17 bp, Homo sapiens
cccttagcctccctgaa

SEQ ID NO: 4443051 - DNA, 16 bp, Homo sapiens
cccttagcctctccca

SEQ ID NO: 4443052 - DNA, 19 bp, Homo sapiens
cccttatgcggttaatttt

SEQ ID NO: 4443053 - DNA, 18 bp, Homo sapiens
cccttattcctaatggct

SEQ ID NO: 4443054 - DNA, 17 bp, Homo sapiens
cccttcagtgcccacca

SEQ ID NO: 4443055 - DNA, 16 bp, Homo sapiens
cccttccaatgctgtg

SEQ ID NO: 4443056 - DNA, 16 bp, Homo sapiens
cccttccacagctggc

SEQ ID NO: 4443057 - DNA, 15 bp, Homo sapiens
cccttccatgtgcct

SEQ ID NO: 4443058 - DNA, 16 bp, Homo sapiens
cccttccatgtgcctt

SEQ ID NO: 4443059 - DNA, 17 bp, Homo sapiens
cccttccatgtgccttt

SEQ ID NO: 4443060 - DNA, 13 bp, Homo sapiens
atttcaaaatata

SEQ ID NO: 4443061 - DNA, 16 bp, Homo sapiens
atttcaaaatgctttt

SEQ ID NO: 4443062 - DNA, 13 bp, Homo sapiens
atttcaaactttt

SEQ ID NO: 4443063 - DNA, 17 bp, Homo sapiens
atttcaaacttttgaaa

SEQ ID NO: 4443064 - DNA, 14 bp, Homo sapiens
atttcaaatctgta

SEQ ID NO: 4443065 - DNA, 11 bp, Homo sapiens
atttcaaatgt

SEQ ID NO: 4443066 - DNA, 23 bp, Homo sapiens
atttcaaatgttagatattgcta

SEQ ID NO: 4443067 - DNA, 11 bp, Homo sapiens
atttcaagtgc

SEQ ID NO: 4443068 - DNA, 12 bp, Homo sapiens
atttcaagtgcc

SEQ ID NO: 4443069 - DNA, 13 bp, Homo sapiens
atttcaagtgcct

SEQ ID NO: 4443070 - DNA, 22 bp, Homo sapiens
atttcaagttccaagttgctaa

SEQ ID NO: 4443071 - DNA, 23 bp, Homo sapiens
atttcaagttccaagttgctaat

SEQ ID NO: 4443072 - DNA, 16 bp, Homo sapiens
atttcaataaatcttt

SEQ ID NO: 4443073 - DNA, 20 bp, Homo sapiens
atttcaatgtgtataaattg

SEQ ID NO: 4443074 - DNA, 10 bp, Homo sapiens
atttcacagt

SEQ ID NO: 4443075 - DNA, 17 bp, Homo sapiens
atttcacattattctgg

SEQ ID NO: 4443076 - DNA, 16 bp, Homo sapiens
atttcacatttttgta

SEQ ID NO: 4443077 - DNA, 20 bp, Homo sapiens
atttcacccctccctttctc

SEQ ID NO: 4443078 - DNA, 18 bp, Homo sapiens
atttcacctgtaaacctg

SEQ ID NO: 4443079 - DNA, 19 bp, Homo sapiens
atttcacctgtaaacctga

SEQ ID NO: 4443080 - DNA, 16 bp, Homo sapiens
atttcacgattcattt

SEQ ID NO: 4443081 - DNA, 13 bp, Homo sapiens
atttcactgtctt

SEQ ID NO: 4443082 - DNA, 12 bp, Homo sapiens
atttcactgtga

SEQ ID NO: 4443083 - DNA, 19 bp, Homo sapiens
atttcagaagttagtttgt

SEQ ID NO: 4443084 - DNA, 21 bp, Homo sapiens
atttcagaagttagtttgtat

SEQ ID NO: 4443085 - DNA, 13 bp, Homo sapiens
atttcagatgtaa

SEQ ID NO: 4443086 - DNA, 16 bp, Homo sapiens
atttcagatgtaatgt

SEQ ID NO: 4443087 - DNA, 20 bp, Homo sapiens
atttcagatgtaatgttttc

SEQ ID NO: 4443088 - DNA, 15 bp, Homo sapiens
atttcagattttgat

SEQ ID NO: 4443089 - DNA, 18 bp, Homo sapiens
atttcagattttgataac

SEQ ID NO: 4443090 - DNA, 12 bp, Homo sapiens
atttcagccaaa

SEQ ID NO: 4443091 - DNA, 20 bp, Homo sapiens
atttcaggaaaatgtattga

SEQ ID NO: 4443092 - DNA, 19 bp, Homo sapiens
atttcaggcattggatatt

SEQ ID NO: 4443093 - DNA, 14 bp, Homo sapiens
atttcagtaagtct

SEQ ID NO: 4443094 - DNA, 17 bp, Homo sapiens
atttcagtattttccag

SEQ ID NO: 4443095 - DNA, 18 bp, Homo sapiens
atttcagtattttccagc

SEQ ID NO: 4443096 - DNA, 19 bp, Homo sapiens
atttcagtgtaaagtgtgt

SEQ ID NO: 4443097 - DNA, 24 bp, Homo sapiens
atttcagttctaaaaagatgtaat

SEQ ID NO: 4443098 - DNA, 20 bp, Homo sapiens
atttcataattcagaactaa

SEQ ID NO: 4443099 - DNA, 16 bp, Homo sapiens
atttcataattctgaa

SEQ ID NO: 4443100 - DNA, 16 bp, Homo sapiens
atttcatagttcagaa

SEQ ID NO: 4443101 - DNA, 17 bp, Homo sapiens
atttcatagttcagaat

SEQ ID NO: 4443102 - DNA, 19 bp, Homo sapiens
atttcatagttcagaattt

SEQ ID NO: 4443103 - DNA, 19 bp, Homo sapiens
atttcatatctaactttgt

SEQ ID NO: 4443104 - DNA, 13 bp, Homo sapiens
atttcatctattt

SEQ ID NO: 4443105 - DNA, 22 bp, Homo sapiens
atttcatctcatttaagggaaa

SEQ ID NO: 4443106 - DNA, 11 bp, Homo sapiens
atttcatctgc

SEQ ID NO: 4443107 - DNA, 20 bp, Homo sapiens
atttcatctgctctccttcc

SEQ ID NO: 4443108 - DNA, 19 bp, Homo sapiens
atttcatgtagtaagattt

SEQ ID NO: 4443109 - DNA, 21 bp, Homo sapiens
atttcatgtccataaaagaga

SEQ ID NO: 4443110 - DNA, 11 bp, Homo sapiens
atttcattcca

SEQ ID NO: 4443111 - DNA, 16 bp, Homo sapiens
atttcattccattgcc

SEQ ID NO: 4443112 - DNA, 18 bp, Homo sapiens
atttcattccattgccta

SEQ ID NO: 4443113 - DNA, 16 bp, Homo sapiens
atttcatttaaatatc

SEQ ID NO: 4443114 - DNA, 16 bp, Homo sapiens
atttcatttcacattt

SEQ ID NO: 4443115 - DNA, 14 bp, Homo sapiens
atttcatttccagc

SEQ ID NO: 4443116 - DNA, 17 bp, Homo sapiens
atttccaaaataatcta

SEQ ID NO: 4443117 - DNA, 22 bp, Homo sapiens
atttccaaaataatctatatta

SEQ ID NO: 4443118 - DNA, 19 bp, Homo sapiens
atttccaactcgaatctgt

SEQ ID NO: 4443119 - DNA, 13 bp, Homo sapiens
atttccactgtgc

SEQ ID NO: 4443120 - DNA, 19 bp, Homo sapiens
atttccagtttttctttac

SEQ ID NO: 4443121 - DNA, 21 bp, Homo sapiens
atttcccactgcactccagcc

SEQ ID NO: 4443122 - DNA, 15 bp, Homo sapiens
atttcccatctgcac

SEQ ID NO: 4443123 - DNA, 11 bp, Homo sapiens
atttccccagc

SEQ ID NO: 4443124 - DNA, 14 bp, Homo sapiens
atttccccagccac

SEQ ID NO: 4443125 - DNA, 15 bp, Homo sapiens
atttccccagccaca

SEQ ID NO: 4443126 - DNA, 19 bp, Homo sapiens
atttccccgatgtcccctg

SEQ ID NO: 4443127 - DNA, 14 bp, Homo sapiens
atttccctctctca

SEQ ID NO: 4443128 - DNA, 13 bp, Homo sapiens
atttccggctgct

SEQ ID NO: 4443129 - DNA, 19 bp, Homo sapiens
atttcctctattgatgtac

SEQ ID NO: 4443130 - DNA, 15 bp, Homo sapiens
atttcctggatgttt

SEQ ID NO: 4443131 - DNA, 16 bp, Homo sapiens
atttcctggccctcca

SEQ ID NO: 4443132 - DNA, 12 bp, Homo sapiens
atttcctgtaat

SEQ ID NO: 4443133 - DNA, 13 bp, Homo sapiens
atttcctttatgt

SEQ ID NO: 4443134 - DNA, 15 bp, Homo sapiens
atttcctttatgtga

SEQ ID NO: 4443135 - DNA, 23 bp, Homo sapiens
atttccttttgtccacttgtaag

SEQ ID NO: 4443136 - DNA, 17 bp, Homo sapiens
atttcctttttgacact

SEQ ID NO: 4443137 - DNA, 13 bp, Homo sapiens
cccggccccctgg

SEQ ID NO: 4443138 - DNA, 17 bp, Homo sapiens
cccggctaatttttgta

SEQ ID NO: 4443139 - DNA, 17 bp, Homo sapiens
cccggctcccaccgagg

SEQ ID NO: 4443140 - DNA, 16 bp, Homo sapiens
cccggctctgtgggtg

SEQ ID NO: 4443141 - DNA, 22 bp, Homo sapiens
cccggctctgtgggtgatgggg

SEQ ID NO: 4443142 - DNA, 20 bp, Homo sapiens
cccggctcttatagaagctt

SEQ ID NO: 4443143 - DNA, 18 bp, Homo sapiens
cccggctttggtgcgggg

SEQ ID NO: 4443144 - DNA, 20 bp, Homo sapiens
cccgggagctgggccctgcc

SEQ ID NO: 4443145 - DNA, 19 bp, Homo sapiens
cccgggcgcggccagcccc

SEQ ID NO: 4443146 - DNA, 16 bp, Homo sapiens
cccgggctgggcccct

SEQ ID NO: 4443147 - DNA, 18 bp, Homo sapiens
cccggggaccctgtgaca

SEQ ID NO: 4443148 - DNA, 21 bp, Homo sapiens
cccggggaccctgtgacatgg

SEQ ID NO: 4443149 - DNA, 14 bp, Homo sapiens
cccggggccagcac

SEQ ID NO: 4443150 - DNA, 13 bp, Homo sapiens
cccggggccccct

SEQ ID NO: 4443151 - DNA, 15 bp, Homo sapiens
cccggggcctggaca

SEQ ID NO: 4443152 - DNA, 17 bp, Homo sapiens
cccggtccacaggtcca

SEQ ID NO: 4443153 - DNA, 17 bp, Homo sapiens
cccggtcccccagagca

SEQ ID NO: 4443154 - DNA, 22 bp, Homo sapiens
cccggtcccttgagacctcagc

SEQ ID NO: 4443155 - DNA, 18 bp, Homo sapiens
cccggttcagacccctgc

SEQ ID NO: 4443156 - DNA, 14 bp, Homo sapiens
cccgtatcacagtg

SEQ ID NO: 4443157 - DNA, 13 bp, Homo sapiens
cccgtcagcatca

SEQ ID NO: 4443158 - DNA, 17 bp, Homo sapiens
cccgtcagcatcactga

SEQ ID NO: 4443159 - DNA, 13 bp, Homo sapiens
cccgtccccacac

SEQ ID NO: 4443160 - DNA, 13 bp, Homo sapiens
cccgtctccagct

SEQ ID NO: 4443161 - DNA, 15 bp, Homo sapiens
cccgtctctctccca

SEQ ID NO: 4443162 - DNA, 16 bp, Homo sapiens
cccgtctctctcccat

SEQ ID NO: 4443163 - DNA, 19 bp, Homo sapiens
cccgtctctctcccatgga

SEQ ID NO: 4443164 - DNA, 21 bp, Homo sapiens
cccgtctggggttcagcccct

SEQ ID NO: 4443165 - DNA, 16 bp, Homo sapiens
cccgtggggtgctgcc

SEQ ID NO: 4443166 - DNA, 15 bp, Homo sapiens
cccgtggggttcctc

SEQ ID NO: 4443167 - DNA, 14 bp, Homo sapiens
cccgtggtgcctgc

SEQ ID NO: 4443168 - DNA, 15 bp, Homo sapiens
cccgtggtgcctgca

SEQ ID NO: 4443169 - DNA, 20 bp, Homo sapiens
ccctaaaatggcgaacatgt

SEQ ID NO: 4443170 - DNA, 17 bp, Homo sapiens
ccctaaactttggcctt

SEQ ID NO: 4443171 - DNA, 19 bp, Homo sapiens
ccctaaagaagataaacac

SEQ ID NO: 4443172 - DNA, 15 bp, Homo sapiens
ccctaaccaagttcc

SEQ ID NO: 4443173 - DNA, 19 bp, Homo sapiens
ccctacagtatataagctt

SEQ ID NO: 4443174 - DNA, 14 bp, Homo sapiens
ccctaccctggact

SEQ ID NO: 4443175 - DNA, 18 bp, Homo sapiens
ccctacctcaacctgtaa

SEQ ID NO: 4443176 - DNA, 17 bp, Homo sapiens
ccctagaaacttccaaa

SEQ ID NO: 4443177 - DNA, 18 bp, Homo sapiens
ccctagagcctgcctgga

SEQ ID NO: 4443178 - DNA, 17 bp, Homo sapiens
ccctagctttagaccct

SEQ ID NO: 4443179 - DNA, 16 bp, Homo sapiens
ccctaggctttctcct

SEQ ID NO: 4443180 - DNA, 17 bp, Homo sapiens
ccctagtaagtgccttc

SEQ ID NO: 4443181 - DNA, 18 bp, Homo sapiens
ccctagtaagtgccttcc

SEQ ID NO: 4443182 - DNA, 20 bp, Homo sapiens
ccctagtaagtgccttccat

SEQ ID NO: 4443183 - DNA, 23 bp, Homo sapiens
ccctagtaagtgccttccatgtc

SEQ ID NO: 4443184 - DNA, 17 bp, Homo sapiens
ccctagtcccttcccct

SEQ ID NO: 4443185 - DNA, 21 bp, Homo sapiens
ccctagttttctttcctcctt

SEQ ID NO: 4443186 - DNA, 23 bp, Homo sapiens
ccctagttttctttcctcctttc

SEQ ID NO: 4443187 - DNA, 23 bp, Homo sapiens
ccctatcaagcactaaaaagttg

SEQ ID NO: 4443188 - DNA, 14 bp, Homo sapiens
ccctatcctctgag

SEQ ID NO: 4443189 - DNA, 23 bp, Homo sapiens
ccctatctaaccctcccatggca

SEQ ID NO: 4443190 - DNA, 14 bp, Homo sapiens
ccctatctgtattc

SEQ ID NO: 4443191 - DNA, 11 bp, Homo sapiens
ccctatttcta

SEQ ID NO: 4443192 - DNA, 12 bp, Homo sapiens
ccctattttaag

SEQ ID NO: 4443193 - DNA, 14 bp, Homo sapiens
ccctattttgccat

SEQ ID NO: 4443194 - DNA, 18 bp, Homo sapiens
ccctcaatccaccttcag

SEQ ID NO: 4443195 - DNA, 22 bp, Homo sapiens
ccctcacaacagtcacctcaca

SEQ ID NO: 4443196 - DNA, 13 bp, Homo sapiens
ccctcacccatcc

SEQ ID NO: 4443197 - DNA, 13 bp, Homo sapiens
ccctcacccctgg

SEQ ID NO: 4443198 - DNA, 21 bp, Homo sapiens
ccctcacctacttacccaggt

SEQ ID NO: 4443199 - DNA, 21 bp, Homo sapiens
ccctcactattcttggaccat

SEQ ID NO: 4443200 - DNA, 21 bp, Homo sapiens
ccctcagacccaggagtccag

SEQ ID NO: 4443201 - DNA, 22 bp, Homo sapiens
ccctcagacccaggagtccaga

SEQ ID NO: 4443202 - DNA, 12 bp, Homo sapiens
ccctcagactca

SEQ ID NO: 4443203 - DNA, 17 bp, Homo sapiens
ccctcagactcagaggt

SEQ ID NO: 4443204 - DNA, 18 bp, Homo sapiens
ccctcagactcagaggtc

SEQ ID NO: 4443205 - DNA, 23 bp, Homo sapiens
ccctcagactcagaggtccaggc

SEQ ID NO: 4443206 - DNA, 18 bp, Homo sapiens
ccctcagatgatctctcc

SEQ ID NO: 4443207 - DNA, 12 bp, Homo sapiens
ccctcagcagct

SEQ ID NO: 4443208 - DNA, 17 bp, Homo sapiens
ccctgagctgaggcagc

SEQ ID NO: 4443209 - DNA, 19 bp, Homo sapiens
ccctgagctgaggcagcag

SEQ ID NO: 4443210 - DNA, 15 bp, Homo sapiens
ccctgagctgcagct

SEQ ID NO: 4443211 - DNA, 21 bp, Homo sapiens
ccctgaggccctgggctgggt

SEQ ID NO: 4443212 - DNA, 12 bp, Homo sapiens
ccctgaggccta

SEQ ID NO: 4443213 - DNA, 16 bp, Homo sapiens
ccctgaggcctagact

SEQ ID NO: 4443214 - DNA, 15 bp, Homo sapiens
ccctgagtgcgggct

SEQ ID NO: 4443215 - DNA, 16 bp, Homo sapiens
ccctgagttgggcagc

SEQ ID NO: 4443216 - DNA, 20 bp, Homo sapiens
ccctgatcccaccccctcct

SEQ ID NO: 4443217 - DNA, 23 bp, Homo sapiens
ccctgatggcctttggacccagg

SEQ ID NO: 4443218 - DNA, 18 bp, Homo sapiens
ccctgattgtgccagtgc

SEQ ID NO: 4443219 - DNA, 19 bp, Homo sapiens
ccctgcaaaactccaggca

SEQ ID NO: 4443220 - DNA, 21 bp, Homo sapiens
ccctgcaacttccgctgaggg

SEQ ID NO: 4443221 - DNA, 23 bp, Homo sapiens
ccctgcaacttccgctgaggggt

SEQ ID NO: 4443222 - DNA, 18 bp, Homo sapiens
ccctgcaagaccacggag

SEQ ID NO: 4443223 - DNA, 12 bp, Homo sapiens
ccctgcacacac

SEQ ID NO: 4443224 - DNA, 13 bp, Homo sapiens
ccctgcacagcag

SEQ ID NO: 4443225 - DNA, 15 bp, Homo sapiens
ccctgcacagcaggc

SEQ ID NO: 4443226 - DNA, 22 bp, Homo sapiens
ccctgcacagcaggctgccagt

SEQ ID NO: 4443227 - DNA, 14 bp, Homo sapiens
ccctgcacaggcac

SEQ ID NO: 4443228 - DNA, 22 bp, Homo sapiens
ccctgcacaggcacacagggcc

SEQ ID NO: 4443229 - DNA, 15 bp, Homo sapiens
ccctgcacgtcatgg

SEQ ID NO: 4443230 - DNA, 12 bp, Homo sapiens
ccctgcagacct

SEQ ID NO: 4443231 - DNA, 18 bp, Homo sapiens
ccctgcagacctcaagcc

SEQ ID NO: 4443232 - DNA, 17 bp, Homo sapiens
ccctgcagcccaccaga

SEQ ID NO: 4443233 - DNA, 18 bp, Homo sapiens
ccctgccaagactcctca

SEQ ID NO: 4443234 - DNA, 10 bp, Homo sapiens
ccctgccaca

SEQ ID NO: 4443235 - DNA, 13 bp, Homo sapiens
ccctgccacagcc

SEQ ID NO: 4443236 - DNA, 18 bp, Homo sapiens
ccctgccacagccagagg

SEQ ID NO: 4443237 - DNA, 14 bp, Homo sapiens
ccctgccagtgaag

SEQ ID NO: 4443238 - DNA, 16 bp, Homo sapiens
ccctgcccaaaccctt

SEQ ID NO: 4443239 - DNA, 22 bp, Homo sapiens
ccctgcccaaacccttaactga

SEQ ID NO: 4443240 - DNA, 20 bp, Homo sapiens
ccctgcccacagaaagccag

SEQ ID NO: 4443241 - DNA, 15 bp, Homo sapiens
ccctgcccacttctg

SEQ ID NO: 4443242 - DNA, 16 bp, Homo sapiens
ccctgcccagcctgct

SEQ ID NO: 4443243 - DNA, 12 bp, Homo sapiens
ccctgcccccac

SEQ ID NO: 4443244 - DNA, 16 bp, Homo sapiens
ccctgcccccacccct

SEQ ID NO: 4443245 - DNA, 18 bp, Homo sapiens
ccctgcccccaggactgg

SEQ ID NO: 4443246 - DNA, 22 bp, Homo sapiens
ccctgcccccaggactgggcca

SEQ ID NO: 4443247 - DNA, 23 bp, Homo sapiens
ccctgccccttctacactctcct

SEQ ID NO: 4443248 - DNA, 15 bp, Homo sapiens
ccctgccctcccaag

SEQ ID NO: 4443249 - DNA, 12 bp, Homo sapiens
ccctgccctgca

SEQ ID NO: 4443250 - DNA, 13 bp, Homo sapiens
ccctgccgcctca

SEQ ID NO: 4443251 - DNA, 14 bp, Homo sapiens
ccctgccgcctcaa

SEQ ID NO: 4443252 - DNA, 9 bp, Homo sapiens
ccctgcctc

SEQ ID NO: 4443253 - DNA, 21 bp, Homo sapiens
ccctgcctcactcctccgtga

SEQ ID NO: 4443254 - DNA, 17 bp, Homo sapiens
ccctgcctcagccaggc

SEQ ID NO: 4443255 - DNA, 14 bp, Homo sapiens
ccctgcctccaccc

SEQ ID NO: 4443256 - DNA, 19 bp, Homo sapiens
ccctgcctccaccctctga

SEQ ID NO: 4443257 - DNA, 20 bp, Homo sapiens
ccctgcctccaccctctgag

SEQ ID NO: 4443258 - DNA, 12 bp, Homo sapiens
ccctgcctctca

SEQ ID NO: 4443259 - DNA, 20 bp, Homo sapiens
ccctgcctcttgtgtccctg

SEQ ID NO: 4443260 - DNA, 18 bp, Homo sapiens
ccctgcctgcagccaggg

SEQ ID NO: 4443261 - DNA, 21 bp, Homo sapiens
ccctgcctgcagccagggctg

SEQ ID NO: 4443262 - DNA, 23 bp, Homo sapiens
cccaggaggtggaggttgcagtg

SEQ ID NO: 4443263 - DNA, 12 bp, Homo sapiens
cccaggagtcca

SEQ ID NO: 4443264 - DNA, 13 bp, Homo sapiens
cccaggagtccag

SEQ ID NO: 4443265 - DNA, 17 bp, Homo sapiens
cccaggagtccagaccc

SEQ ID NO: 4443266 - DNA, 14 bp, Homo sapiens
cccaggagtccagg

SEQ ID NO: 4443267 - DNA, 20 bp, Homo sapiens
cccaggagtccaggccccca

SEQ ID NO: 4443268 - DNA, 17 bp, Homo sapiens
cccaggagttcaagacc

SEQ ID NO: 4443269 - DNA, 18 bp, Homo sapiens
cccaggagtttgaggctg

SEQ ID NO: 4443270 - DNA, 20 bp, Homo sapiens
cccaggagttttaagtccag

SEQ ID NO: 4443271 - DNA, 16 bp, Homo sapiens
cccaggccacagagaa

SEQ ID NO: 4443272 - DNA, 16 bp, Homo sapiens
cccaggccacagccag

SEQ ID NO: 4443273 - DNA, 14 bp, Homo sapiens
cccaggccagctgc

SEQ ID NO: 4443274 - DNA, 12 bp, Homo sapiens
cccaggccaggt

SEQ ID NO: 4443275 - DNA, 20 bp, Homo sapiens
cccaggccaggtgcccagga

SEQ ID NO: 4443276 - DNA, 17 bp, Homo sapiens
cccaggccccagacagg

SEQ ID NO: 4443277 - DNA, 22 bp, Homo sapiens
cccaggccccgaggacccagac

SEQ ID NO: 4443278 - DNA, 23 bp, Homo sapiens
cccaggccccgaggacccagacc

SEQ ID NO: 4443279 - DNA, 23 bp, Homo sapiens
cccaggcccctggaggctgcctc

SEQ ID NO: 4443280 - DNA, 13 bp, Homo sapiens
cccaggcccgagc

SEQ ID NO: 4443281 - DNA, 21 bp, Homo sapiens
cccaggcctctcggtgctcca

SEQ ID NO: 4443282 - DNA, 15 bp, Homo sapiens
cccaggcctgcctgc

SEQ ID NO: 4443283 - DNA, 13 bp, Homo sapiens
cccaggcctgtcc

SEQ ID NO: 4443284 - DNA, 16 bp, Homo sapiens
cccaggcctgtccacc

SEQ ID NO: 4443285 - DNA, 21 bp, Homo sapiens
cccaggcctgtccaccctgcc

SEQ ID NO: 4443286 - DNA, 16 bp, Homo sapiens
cccaggccttgtccta

SEQ ID NO: 4443287 - DNA, 13 bp, Homo sapiens
cccaggcgctgca

SEQ ID NO: 4443288 - DNA, 19 bp, Homo sapiens
cccaggcgctgcatacagg

SEQ ID NO: 4443289 - DNA, 17 bp, Homo sapiens
cccaggctcgtggactg

SEQ ID NO: 4443290 - DNA, 22 bp, Homo sapiens
cccaggctcgtggactgagtgg

SEQ ID NO: 4443291 - DNA, 14 bp, Homo sapiens
cccaggctggactg

SEQ ID NO: 4443292 - DNA, 16 bp, Homo sapiens
cccaggctggagaccc

SEQ ID NO: 4443293 - DNA, 18 bp, Homo sapiens
cccaggctggagtgcagt

SEQ ID NO: 4443294 - DNA, 20 bp, Homo sapiens
cccaggctggagtgcagtgg

SEQ ID NO: 4443295 - DNA, 14 bp, Homo sapiens
cccaggctgggaac

SEQ ID NO: 4443296 - DNA, 19 bp, Homo sapiens
cccagggacaccagccagg

SEQ ID NO: 4443297 - DNA, 20 bp, Homo sapiens
cccagggacaccagccaggc

SEQ ID NO: 4443298 - DNA, 13 bp, Homo sapiens
cccagggagtcca

SEQ ID NO: 4443299 - DNA, 16 bp, Homo sapiens
cccagggagtccaggg

SEQ ID NO: 4443300 - DNA, 18 bp, Homo sapiens
cccagggcactgccagcc

SEQ ID NO: 4443301 - DNA, 20 bp, Homo sapiens
cccagggcactgccagccca

SEQ ID NO: 4443302 - DNA, 15 bp, Homo sapiens
cccagggcctgactt

SEQ ID NO: 4443303 - DNA, 22 bp, Homo sapiens
cccagggcctgacttgagccac

SEQ ID NO: 4443304 - DNA, 23 bp, Homo sapiens
cccagggcctgacttgagccact

SEQ ID NO: 4443305 - DNA, 24 bp, Homo sapiens
cccagggcctgacttgagccactc

SEQ ID NO: 4443306 - DNA, 14 bp, Homo sapiens
cccagggctggaga

SEQ ID NO: 4443307 - DNA, 13 bp, Homo sapiens
cccaggggagagg

SEQ ID NO: 4443308 - DNA, 15 bp, Homo sapiens
cccaggggagagggt

SEQ ID NO: 4443309 - DNA, 23 bp, Homo sapiens
cccaggggagagggtctggagaa

SEQ ID NO: 4443310 - DNA, 24 bp, Homo sapiens
cccaggggagagggtctggagaag

SEQ ID NO: 4443311 - DNA, 14 bp, Homo sapiens
cccaggggcagcca

SEQ ID NO: 4443312 - DNA, 17 bp, Homo sapiens
cccaggggcagccacac

SEQ ID NO: 4443313 - DNA, 18 bp, Homo sapiens
cccaggggtctccctggc

SEQ ID NO: 4443314 - DNA, 19 bp, Homo sapiens
cccaggggtctccctggct

SEQ ID NO: 4443315 - DNA, 20 bp, Homo sapiens
cccaggggtctccctggctc

SEQ ID NO: 4443316 - DNA, 21 bp, Homo sapiens
cccaggggtctccctggctcc

SEQ ID NO: 4443317 - DNA, 22 bp, Homo sapiens
cccaggggtctccctggctccc

SEQ ID NO: 4443318 - DNA, 23 bp, Homo sapiens
cccaggggtctccctggctccct

SEQ ID NO: 4443319 - DNA, 17 bp, Homo sapiens
cccagggtagcccgcct

SEQ ID NO: 4443320 - DNA, 21 bp, Homo sapiens
cccagggtcataagtggggag

SEQ ID NO: 4443321 - DNA, 18 bp, Homo sapiens
cccagggtccctgcccac

SEQ ID NO: 4443322 - DNA, 19 bp, Homo sapiens
cccagggtggccacacctc

SEQ ID NO: 4443323 - DNA, 22 bp, Homo sapiens
cccaggtacacctccccctgcg

SEQ ID NO: 4443324 - DNA, 17 bp, Homo sapiens
cccaggttcccccagca

SEQ ID NO: 4443325 - DNA, 19 bp, Homo sapiens
cccaggttggagtgcagtg

SEQ ID NO: 4443326 - DNA, 15 bp, Homo sapiens
cccagtcagcctctc

SEQ ID NO: 4443327 - DNA, 20 bp, Homo sapiens
cccagtcagcctctctccca

SEQ ID NO: 4443328 - DNA, 23 bp, Homo sapiens
cccagtccaaatgtcctccagaa

SEQ ID NO: 4443329 - DNA, 19 bp, Homo sapiens
cccagtccatgctccaggg

SEQ ID NO: 4443330 - DNA, 14 bp, Homo sapiens
cccagtccccaccc

SEQ ID NO: 4443331 - DNA, 13 bp, Homo sapiens
cccagtccctggg

SEQ ID NO: 4443332 - DNA, 23 bp, Homo sapiens
cccagtccctgggggaagccctg

SEQ ID NO: 4443333 - DNA, 15 bp, Homo sapiens
cccagtcctgcccgc

SEQ ID NO: 4443334 - DNA, 21 bp, Homo sapiens
cccagtctaggagctccttct

SEQ ID NO: 4443335 - DNA, 13 bp, Homo sapiens
cccagtctcagac

SEQ ID NO: 4443336 - DNA, 14 bp, Homo sapiens
cccagtctcagaca

SEQ ID NO: 4443337 - DNA, 23 bp, Homo sapiens
cccagtgaactcctgccaggcac

SEQ ID NO: 4443338 - DNA, 13 bp, Homo sapiens
cccagtgagactg

SEQ ID NO: 4443339 - DNA, 17 bp, Homo sapiens
cccagtgagactgcccc

SEQ ID NO: 4443340 - DNA, 17 bp, Homo sapiens
cccagtgagccctgctc

SEQ ID NO: 4443341 - DNA, 19 bp, Homo sapiens
cccagtgagccctgctctt

SEQ ID NO: 4443342 - DNA, 21 bp, Homo sapiens
cccagtgcagggctggtcttg

SEQ ID NO: 4443343 - DNA, 12 bp, Homo sapiens
cccagtgccact

SEQ ID NO: 4443344 - DNA, 17 bp, Homo sapiens
cccagtgccactgcccc

SEQ ID NO: 4443345 - DNA, 15 bp, Homo sapiens
cccagtgcctgccac

SEQ ID NO: 4443346 - DNA, 17 bp, Homo sapiens
cccagtgcctgccactc

SEQ ID NO: 4443347 - DNA, 19 bp, Homo sapiens
cccagtgcctgccactctc

SEQ ID NO: 4443348 - DNA, 18 bp, Homo sapiens
cccagtgctcaccagccc

SEQ ID NO: 4443349 - DNA, 22 bp, Homo sapiens
cccagtggccactcagcttcct

SEQ ID NO: 4443350 - DNA, 14 bp, Homo sapiens
ccccggcagacgcc

SEQ ID NO: 4443351 - DNA, 12 bp, Homo sapiens
ccccggccccct

SEQ ID NO: 4443352 - DNA, 16 bp, Homo sapiens
ccccgggctctctgct

SEQ ID NO: 4443353 - DNA, 18 bp, Homo sapiens
ccccgggctctctgctgt

SEQ ID NO: 4443354 - DNA, 15 bp, Homo sapiens
ccccggtcccttgag

SEQ ID NO: 4443355 - DNA, 24 bp, Homo sapiens
ccccggtcccttgagacctcagcc

SEQ ID NO: 4443356 - DNA, 20 bp, Homo sapiens
ccccgtctggggttcagccc

SEQ ID NO: 4443357 - DNA, 22 bp, Homo sapiens
ccccgtggccatccctgtgagg

SEQ ID NO: 4443358 - DNA, 16 bp, Homo sapiens
ccccgtggtgcctgca

SEQ ID NO: 4443359 - DNA, 17 bp, Homo sapiens
ccccgtggtgcctgcac

SEQ ID NO: 4443360 - DNA, 13 bp, Homo sapiens
ccccgttttgggg

SEQ ID NO: 4443361 - DNA, 20 bp, Homo sapiens
cccctagcaatacagggagg

SEQ ID NO: 4443362 - DNA, 21 bp, Homo sapiens
cccctagcaatacagggaggc

SEQ ID NO: 4443363 - DNA, 18 bp, Homo sapiens
cccctagtaagtgccttc

SEQ ID NO: 4443364 - DNA, 20 bp, Homo sapiens
cccctagtaagtgccttcca

SEQ ID NO: 4443365 - DNA, 20 bp, Homo sapiens
cccctcaatccccaaaggtc

SEQ ID NO: 4443366 - DNA, 15 bp, Homo sapiens
cccctcaggactgca

SEQ ID NO: 4443367 - DNA, 19 bp, Homo sapiens
cccctccacgcctcctggc

SEQ ID NO: 4443368 - DNA, 15 bp, Homo sapiens
cccctccactgctgg

SEQ ID NO: 4443369 - DNA, 11 bp, Homo sapiens
cccctccagct

SEQ ID NO: 4443370 - DNA, 12 bp, Homo sapiens
cccctcccaccc

SEQ ID NO: 4443371 - DNA, 17 bp, Homo sapiens
cccctcccacccccagc

SEQ ID NO: 4443372 - DNA, 21 bp, Homo sapiens
cccctcccagacaggccctcc

SEQ ID NO: 4443373 - DNA, 14 bp, Homo sapiens
cccctccccagcca

SEQ ID NO: 4443374 - DNA, 15 bp, Homo sapiens
cccctccccagccag

SEQ ID NO: 4443375 - DNA, 16 bp, Homo sapiens
cccctccccagccagc

SEQ ID NO: 4443376 - DNA, 15 bp, Homo sapiens
cccctccccagggga

SEQ ID NO: 4443377 - DNA, 11 bp, Homo sapiens
cccctccccca

SEQ ID NO: 4443378 - DNA, 18 bp, Homo sapiens
cccctcccccaaccccca

SEQ ID NO: 4443379 - DNA, 18 bp, Homo sapiens
cccctcccccatgggctg

SEQ ID NO: 4443380 - DNA, 13 bp, Homo sapiens
cccctcccctgca

SEQ ID NO: 4443381 - DNA, 15 bp, Homo sapiens
cccctccctttctcc

SEQ ID NO: 4443382 - DNA, 18 bp, Homo sapiens
cccctccgccgtgccggc

SEQ ID NO: 4443383 - DNA, 13 bp, Homo sapiens
cccctccgcctcc

SEQ ID NO: 4443384 - DNA, 15 bp, Homo sapiens
cccctcctccactct

SEQ ID NO: 4443385 - DNA, 13 bp, Homo sapiens
cccctcctccagt

SEQ ID NO: 4443386 - DNA, 14 bp, Homo sapiens
cccctcctccagta

SEQ ID NO: 4443387 - DNA, 18 bp, Homo sapiens
cccctcctccctcagacc

SEQ ID NO: 4443388 - DNA, 16 bp, Homo sapiens
cccctcctccctcagg

SEQ ID NO: 4443389 - DNA, 18 bp, Homo sapiens
cccctcctccctcaggcc

SEQ ID NO: 4443390 - DNA, 11 bp, Homo sapiens
cccctcctcta

SEQ ID NO: 4443391 - DNA, 14 bp, Homo sapiens
cccctcctctgcca

SEQ ID NO: 4443392 - DNA, 14 bp, Homo sapiens
cccaagaggtctga

SEQ ID NO: 4443393 - DNA, 17 bp, Homo sapiens
cccaagaggtctgagcc

SEQ ID NO: 4443394 - DNA, 22 bp, Homo sapiens
cccaagaggtctgagccctggt

SEQ ID NO: 4443395 - DNA, 15 bp, Homo sapiens
cccaagcctgctggc

SEQ ID NO: 4443396 - DNA, 21 bp, Homo sapiens
cccaagcgttcctggccttct

SEQ ID NO: 4443397 - DNA, 14 bp, Homo sapiens
cccaaggaggaaaa

SEQ ID NO: 4443398 - DNA, 22 bp, Homo sapiens
cccaaggaggaaaaacagacaa

SEQ ID NO: 4443399 - DNA, 11 bp, Homo sapiens
cccaaggccag

SEQ ID NO: 4443400 - DNA, 15 bp, Homo sapiens
cccaaggcggcccct

SEQ ID NO: 4443401 - DNA, 14 bp, Homo sapiens
cccaaggtcctctc

SEQ ID NO: 4443402 - DNA, 18 bp, Homo sapiens
cccaaggttactcagcag

SEQ ID NO: 4443403 - DNA, 17 bp, Homo sapiens
cccaaggttgcacagca

SEQ ID NO: 4443404 - DNA, 18 bp, Homo sapiens
cccaaggttgcacagcaa

SEQ ID NO: 4443405 - DNA, 21 bp, Homo sapiens
cccaagtcaaagatgccccat

SEQ ID NO: 4443406 - DNA, 14 bp, Homo sapiens
cccaagtcccaccc

SEQ ID NO: 4443407 - DNA, 19 bp, Homo sapiens
cccaagtgggggcagaggg

SEQ ID NO: 4443408 - DNA, 15 bp, Homo sapiens
cccaagtggtgccta

SEQ ID NO: 4443409 - DNA, 16 bp, Homo sapiens
cccaagttttttaatt

SEQ ID NO: 4443410 - DNA, 11 bp, Homo sapiens
cccaataaacc

SEQ ID NO: 4443411 - DNA, 13 bp, Homo sapiens
cccaataaaccag

SEQ ID NO: 4443412 - DNA, 14 bp, Homo sapiens
cccaataaaccagt

SEQ ID NO: 4443413 - DNA, 15 bp, Homo sapiens
cccaataaaccagtg

SEQ ID NO: 4443414 - DNA, 18 bp, Homo sapiens
cccaataaaccagtgtga

SEQ ID NO: 4443415 - DNA, 12 bp, Homo sapiens
cccaataaaggc

SEQ ID NO: 4443416 - DNA, 13 bp, Homo sapiens
cccaataaaggca

SEQ ID NO: 4443417 - DNA, 14 bp, Homo sapiens
cccaataaaggcag

SEQ ID NO: 4443418 - DNA, 15 bp, Homo sapiens
cccaataaaggcagc

SEQ ID NO: 4443419 - DNA, 16 bp, Homo sapiens
cccaatacaaagatga

SEQ ID NO: 4443420 - DNA, 16 bp, Homo sapiens
cccaatcggactgcca

SEQ ID NO: 4443421 - DNA, 20 bp, Homo sapiens
cccaatcttgcccactggcc

SEQ ID NO: 4443422 - DNA, 14 bp, Homo sapiens
cccaattctgcccg

SEQ ID NO: 4443423 - DNA, 16 bp, Homo sapiens
cccaattctgcccgct

SEQ ID NO: 4443424 - DNA, 20 bp, Homo sapiens
cccacaagaaatgaaagcag

SEQ ID NO: 4443425 - DNA, 22 bp, Homo sapiens
cccacacctcagttcccttggc

SEQ ID NO: 4443426 - DNA, 16 bp, Homo sapiens
cccacacctccctact

SEQ ID NO: 4443427 - DNA, 19 bp, Homo sapiens
cccacactggggtgccgcc

SEQ ID NO: 4443428 - DNA, 22 bp, Homo sapiens
cccacactggggtgccgcctgc

SEQ ID NO: 4443429 - DNA, 17 bp, Homo sapiens
cccacagaaagccagga

SEQ ID NO: 4443430 - DNA, 14 bp, Homo sapiens
cccacagagtgctg

SEQ ID NO: 4443431 - DNA, 18 bp, Homo sapiens
cccacagagtgctggact

SEQ ID NO: 4443432 - DNA, 12 bp, Homo sapiens
cccacagctccc

SEQ ID NO: 4443433 - DNA, 17 bp, Homo sapiens
cccacagctcccacccc

SEQ ID NO: 4443434 - DNA, 15 bp, Homo sapiens
cccacagcttcctga

SEQ ID NO: 4443435 - DNA, 23 bp, Homo sapiens
cccacagtatattttatttcaat

SEQ ID NO: 4443436 - DNA, 16 bp, Homo sapiens
cccacagttttaataa

SEQ ID NO: 4443437 - DNA, 20 bp, Homo sapiens
cccacagttttaataagaac

SEQ ID NO: 4443438 - DNA, 20 bp, Homo sapiens
cccacatgaggccatctcag

SEQ ID NO: 4443439 - DNA, 23 bp, Homo sapiens
cccacatgcatgtctgcctatgc

SEQ ID NO: 4443440 - DNA, 20 bp, Homo sapiens
cccaccacaactaacaatgc

SEQ ID NO: 4443441 - DNA, 21 bp, Homo sapiens
cccaccagaacgcaccccact

SEQ ID NO: 4443442 - DNA, 13 bp, Homo sapiens
cccaccagccttg

SEQ ID NO: 4443443 - DNA, 17 bp, Homo sapiens
cccaccagccttgctct

SEQ ID NO: 4443444 - DNA, 19 bp, Homo sapiens
cccaccagccttgctctct

SEQ ID NO: 4443445 - DNA, 16 bp, Homo sapiens
cccaccaggccagctc

SEQ ID NO: 4443446 - DNA, 13 bp, Homo sapiens
cccaccagggtcc

SEQ ID NO: 4443447 - DNA, 17 bp, Homo sapiens
cccaccatggaccagcc

SEQ ID NO: 4443448 - DNA, 17 bp, Homo sapiens
cccaccattctacctga

SEQ ID NO: 4443449 - DNA, 22 bp, Homo sapiens
cccacccaactccacagggctg

SEQ ID NO: 4443450 - DNA, 14 bp, Homo sapiens
cccacccacccgcc

SEQ ID NO: 4443451 - DNA, 23 bp, Homo sapiens
cccacccagtccatgctccaggg

SEQ ID NO: 4443452 - DNA, 14 bp, Homo sapiens
cccaccccaactct

SEQ ID NO: 4443453 - DNA, 12 bp, Homo sapiens
cccaccccacac

SEQ ID NO: 4443454 - DNA, 14 bp, Homo sapiens
cccaccccacactt

SEQ ID NO: 4443455 - DNA, 17 bp, Homo sapiens
cccaccccaccccaccc

SEQ ID NO: 4443456 - DNA, 22 bp, Homo sapiens
cccaccccatccagccagaccc

SEQ ID NO: 4443457 - DNA, 13 bp, Homo sapiens
cccacccccagcc

SEQ ID NO: 4443458 - DNA, 18 bp, Homo sapiens
cccacccccagccccgac

SEQ ID NO: 4443459 - DNA, 13 bp, Homo sapiens
cccacccccagtg

SEQ ID NO: 4443460 - DNA, 23 bp, Homo sapiens
cccacccccctctctttctctgg

SEQ ID NO: 4443461 - DNA, 13 bp, Homo sapiens
cccaccccctgcc

SEQ ID NO: 4443462 - DNA, 19 bp, Homo sapiens
cccaccccctgccctgcac

SEQ ID NO: 4443463 - DNA, 23 bp, Homo sapiens
cccacccccttcagtgcccacca

SEQ ID NO: 4443464 - DNA, 22 bp, Homo sapiens
cccacccccttctctgctccac

SEQ ID NO: 4443465 - DNA, 15 bp, Homo sapiens
cccaccccgctctgc

SEQ ID NO: 4443466 - DNA, 11 bp, Homo sapiens
cccacccctct

SEQ ID NO: 4443467 - DNA, 12 bp, Homo sapiens
cccacccctgca

SEQ ID NO: 4443468 - DNA, 13 bp, Homo sapiens
cccacccgccgcc

SEQ ID NO: 4443469 - DNA, 23 bp, Homo sapiens
cccacccgccgcctcccacggca

SEQ ID NO: 4443470 - DNA, 16 bp, Homo sapiens
cccacccggccacagc

SEQ ID NO: 4443471 - DNA, 20 bp, Homo sapiens
cccacccggccacagctgct

SEQ ID NO: 4443472 - DNA, 15 bp, Homo sapiens
cccacccggcccggc

SEQ ID NO: 4443473 - DNA, 16 bp, Homo sapiens
cccacccggcccggct

SEQ ID NO: 4443474 - DNA, 16 bp, Homo sapiens
cccaccctccatgctc

SEQ ID NO: 4443475 - DNA, 14 bp, Homo sapiens
cccaccctccctgg

SEQ ID NO: 4443476 - DNA, 15 bp, Homo sapiens
cccaccctcctgtct

SEQ ID NO: 4443477 - DNA, 19 bp, Homo sapiens
cccaccctcctgtcttccc

SEQ ID NO: 4443478 - DNA, 17 bp, Homo sapiens
cccaccggaactgggct

SEQ ID NO: 4443479 - DNA, 18 bp, Homo sapiens
cccaccggaactgggctg

SEQ ID NO: 4443480 - DNA, 16 bp, Homo sapiens
cccacctatgtgccaa

SEQ ID NO: 4443481 - DNA, 16 bp, Homo sapiens
cccacctctcctgccc

SEQ ID NO: 4443482 - DNA, 21 bp, Homo sapiens
cccacctctcctgccctgtga

SEQ ID NO: 4443483 - DNA, 15 bp, Homo sapiens
cccacctctctcccc

SEQ ID NO: 4443484 - DNA, 18 bp, Homo sapiens
cccacctcttgtgcaagg

SEQ ID NO: 4443485 - DNA, 18 bp, Homo sapiens
cccacctgacacaccagg

SEQ ID NO: 4443486 - DNA, 23 bp, Homo sapiens
cccacctgcccatcacagggttg

SEQ ID NO: 4443487 - DNA, 13 bp, Homo sapiens
cccacctgctgag

SEQ ID NO: 4443488 - DNA, 20 bp, Homo sapiens
cccacctggcttcatacaga

SEQ ID NO: 4443489 - DNA, 18 bp, Homo sapiens
cccagctaggaagagcag

SEQ ID NO: 4443490 - DNA, 22 bp, Homo sapiens
cccagctaggaagagcaggact

SEQ ID NO: 4443491 - DNA, 23 bp, Homo sapiens
cccagctaggaagagcaggactc

SEQ ID NO: 4443492 - DNA, 12 bp, Homo sapiens
cccagctcagca

SEQ ID NO: 4443493 - DNA, 13 bp, Homo sapiens
cccagctcccaca

SEQ ID NO: 4443494 - DNA, 14 bp, Homo sapiens
cccagctcccacac

SEQ ID NO: 4443495 - DNA, 12 bp, Homo sapiens
cccagctcccct

SEQ ID NO: 4443496 - DNA, 13 bp, Homo sapiens
cccagctcccctc

SEQ ID NO: 4443497 - DNA, 17 bp, Homo sapiens
cccagctcccctctttt

SEQ ID NO: 4443498 - DNA, 20 bp, Homo sapiens
cccagctcccctcttttgta

SEQ ID NO: 4443499 - DNA, 23 bp, Homo sapiens
cccagctcctttctcctgtgaat

SEQ ID NO: 4443500 - DNA, 12 bp, Homo sapiens
cccagctctccc

SEQ ID NO: 4443501 - DNA, 21 bp, Homo sapiens
cccagctctccctctggccct

SEQ ID NO: 4443502 - DNA, 12 bp, Homo sapiens
cccagctctgaa

SEQ ID NO: 4443503 - DNA, 18 bp, Homo sapiens
cccagctgctcccctgga

SEQ ID NO: 4443504 - DNA, 16 bp, Homo sapiens
cccagctggtgggaag

SEQ ID NO: 4443505 - DNA, 21 bp, Homo sapiens
cccagctgtgctgtggagaga

SEQ ID NO: 4443506 - DNA, 22 bp, Homo sapiens
cccaggaaaggacggctgagca

SEQ ID NO: 4443507 - DNA, 12 bp, Homo sapiens
cccaggaaggga

SEQ ID NO: 4443508 - DNA, 17 bp, Homo sapiens
cccaggaagtggctcag

SEQ ID NO: 4443509 - DNA, 22 bp, Homo sapiens
cccaggaagtggctcagacccc

SEQ ID NO: 4443510 - DNA, 21 bp, Homo sapiens
cccaggagacagaccacttgc

SEQ ID NO: 4443511 - DNA, 14 bp, Homo sapiens
cccaggagagccag

SEQ ID NO: 4443512 - DNA, 15 bp, Homo sapiens
cccaggagagccagc

SEQ ID NO: 4443513 - DNA, 18 bp, Homo sapiens
cccaggagatgggtccag

SEQ ID NO: 4443514 - DNA, 20 bp, Homo sapiens
cccaggagatgggtccaggg

SEQ ID NO: 4443515 - DNA, 14 bp, Homo sapiens
cccaggagcctcac

SEQ ID NO: 4443516 - DNA, 17 bp, Homo sapiens
cccaggaggcagctcag

SEQ ID NO: 4443517 - DNA, 14 bp, Homo sapiens
ccatcatgtctgta

SEQ ID NO: 4443518 - DNA, 18 bp, Homo sapiens
ccatccagacctggctcc

SEQ ID NO: 4443519 - DNA, 22 bp, Homo sapiens
ccatccagaggaataaaaaggt

SEQ ID NO: 4443520 - DNA, 16 bp, Homo sapiens
ccatccagatgtgtgc

SEQ ID NO: 4443521 - DNA, 12 bp, Homo sapiens
ccatccagccag

SEQ ID NO: 4443522 - DNA, 13 bp, Homo sapiens
ccatccattctcc

SEQ ID NO: 4443523 - DNA, 14 bp, Homo sapiens
ccatccattctcct

SEQ ID NO: 4443524 - DNA, 17 bp, Homo sapiens
ccatccattctcctcag

SEQ ID NO: 4443525 - DNA, 18 bp, Homo sapiens
ccatcccctccctgcctg

SEQ ID NO: 4443526 - DNA, 21 bp, Homo sapiens
ccatcccctccctgcctgctc

SEQ ID NO: 4443527 - DNA, 22 bp, Homo sapiens
ccatcccctccctgcctgctcc

SEQ ID NO: 4443528 - DNA, 20 bp, Homo sapiens
ccatcccgaagccatcactt

SEQ ID NO: 4443529 - DNA, 15 bp, Homo sapiens
ccatccctaccactg

SEQ ID NO: 4443530 - DNA, 20 bp, Homo sapiens
ccatccctgggcccctccac

SEQ ID NO: 4443531 - DNA, 14 bp, Homo sapiens
ccatccctgggggc

SEQ ID NO: 4443532 - DNA, 20 bp, Homo sapiens
ccatccgactgcccctgctg

SEQ ID NO: 4443533 - DNA, 21 bp, Homo sapiens
ccatccgactgcccctgctgt

SEQ ID NO: 4443534 - DNA, 23 bp, Homo sapiens
ccatccgactgcccctgctgtgc

SEQ ID NO: 4443535 - DNA, 16 bp, Homo sapiens
ccatcctcatccctga

SEQ ID NO: 4443536 - DNA, 20 bp, Homo sapiens
ccatcctccctccacctcaa

SEQ ID NO: 4443537 - DNA, 17 bp, Homo sapiens
ccatcctgccatcctca

SEQ ID NO: 4443538 - DNA, 12 bp, Homo sapiens
ccatcctggcta

SEQ ID NO: 4443539 - DNA, 13 bp, Homo sapiens
ccatcggactcat

SEQ ID NO: 4443540 - DNA, 15 bp, Homo sapiens
ccatcggccaagaat

SEQ ID NO: 4443541 - DNA, 14 bp, Homo sapiens
ccatcgtcctggga

SEQ ID NO: 4443542 - DNA, 16 bp, Homo sapiens
ccatcgtcctgggact

SEQ ID NO: 4443543 - DNA, 17 bp, Homo sapiens
ccatcgtcctgggactc

SEQ ID NO: 4443544 - DNA, 19 bp, Homo sapiens
ccatctaatgcttgtttat

SEQ ID NO: 4443545 - DNA, 14 bp, Homo sapiens
ccatctcaggagat

SEQ ID NO: 4443546 - DNA, 13 bp, Homo sapiens
ccatctccctgcc

SEQ ID NO: 4443547 - DNA, 17 bp, Homo sapiens
ccatctccctgcctggc

SEQ ID NO: 4443548 - DNA, 17 bp, Homo sapiens
ccatctccgcctccaca

SEQ ID NO: 4443549 - DNA, 13 bp, Homo sapiens
ccatctctgaact

SEQ ID NO: 4443550 - DNA, 14 bp, Homo sapiens
ccatctcttccttg

SEQ ID NO: 4443551 - DNA, 15 bp, Homo sapiens
ccatctcttccttga

SEQ ID NO: 4443552 - DNA, 14 bp, Homo sapiens
ccatctcttctgca

SEQ ID NO: 4443553 - DNA, 17 bp, Homo sapiens
ccatctgaaagtggtac

SEQ ID NO: 4443554 - DNA, 22 bp, Homo sapiens
ccatctgacaaaatggggcaga

SEQ ID NO: 4443555 - DNA, 21 bp, Homo sapiens
ccatctgcgggggcagtgctc

SEQ ID NO: 4443556 - DNA, 22 bp, Homo sapiens
ccatctgcgggggcagtgctca

SEQ ID NO: 4443557 - DNA, 12 bp, Homo sapiens
ccatctgtccag

SEQ ID NO: 4443558 - DNA, 13 bp, Homo sapiens
ccatcttgctttt

SEQ ID NO: 4443559 - DNA, 22 bp, Homo sapiens
ccatcttggtagttctgtgcct

SEQ ID NO: 4443560 - DNA, 19 bp, Homo sapiens
ccatgaaattgacccccaa

SEQ ID NO: 4443561 - DNA, 15 bp, Homo sapiens
ccatgaaccaagacc

SEQ ID NO: 4443562 - DNA, 11 bp, Homo sapiens
ccatgaagcct

SEQ ID NO: 4443563 - DNA, 14 bp, Homo sapiens
ccatgaagcctttt

SEQ ID NO: 4443564 - DNA, 22 bp, Homo sapiens
ccatgaaggctggaaggcagca

SEQ ID NO: 4443565 - DNA, 16 bp, Homo sapiens
ccatgacaagaacaaa

SEQ ID NO: 4443566 - DNA, 20 bp, Homo sapiens
ccatgacagaggctgcaccc

SEQ ID NO: 4443567 - DNA, 20 bp, Homo sapiens
ccatgacaggcctgaagata

SEQ ID NO: 4443568 - DNA, 14 bp, Homo sapiens
ccatgacatcaaga

SEQ ID NO: 4443569 - DNA, 12 bp, Homo sapiens
ccatgagctcct

SEQ ID NO: 4443570 - DNA, 21 bp, Homo sapiens
ccatgagctccttaaggctct

SEQ ID NO: 4443571 - DNA, 17 bp, Homo sapiens
ccatgaggaaggaacag

SEQ ID NO: 4443572 - DNA, 18 bp, Homo sapiens
ccatgagggagatgccat

SEQ ID NO: 4443573 - DNA, 20 bp, Homo sapiens
ccatgagggagatgccatga

SEQ ID NO: 4443574 - DNA, 23 bp, Homo sapiens
ccatgagggagatgccatgagcc

SEQ ID NO: 4443575 - DNA, 17 bp, Homo sapiens
ccatgatttcccactgc

SEQ ID NO: 4443576 - DNA, 11 bp, Homo sapiens
ccatgcagaaa

SEQ ID NO: 4443577 - DNA, 14 bp, Homo sapiens
ccatgcagaaagca

SEQ ID NO: 4443578 - DNA, 15 bp, Homo sapiens
ccatgcagaaagcat

SEQ ID NO: 4443579 - DNA, 18 bp, Homo sapiens
ccatgcatgacagcctct

SEQ ID NO: 4443580 - DNA, 20 bp, Homo sapiens
ccatgccaaagctagggtgg

SEQ ID NO: 4443581 - DNA, 13 bp, Homo sapiens
ccatgccagagag

SEQ ID NO: 4443582 - DNA, 22 bp, Homo sapiens
ccatgccagattctgcctctct

SEQ ID NO: 4443583 - DNA, 14 bp, Homo sapiens
ccatgccaggaacc

SEQ ID NO: 4443584 - DNA, 15 bp, Homo sapiens
ccatgccaggaacct

SEQ ID NO: 4443585 - DNA, 15 bp, Homo sapiens
ccatgcccacctgcc

SEQ ID NO: 4443586 - DNA, 17 bp, Homo sapiens
ccatgcccacctgccca

SEQ ID NO: 4443587 - DNA, 18 bp, Homo sapiens
ccatgcccacctgcccat

SEQ ID NO: 4443588 - DNA, 18 bp, Homo sapiens
ccatgccggtacacagcc

SEQ ID NO: 4443589 - DNA, 19 bp, Homo sapiens
ccatgccggtacacagcca

SEQ ID NO: 4443590 - DNA, 22 bp, Homo sapiens
ccatgcctgtagctttcctggt

SEQ ID NO: 4443591 - DNA, 20 bp, Homo sapiens
ccatgcgtgtttctgactct

SEQ ID NO: 4443592 - DNA, 22 bp, Homo sapiens
ccatgctatctgttcctatctg

SEQ ID NO: 4443593 - DNA, 21 bp, Homo sapiens
ccatgctcaacccccctccca

SEQ ID NO: 4443594 - DNA, 23 bp, Homo sapiens
ccatgctcaacccccctcccaga

SEQ ID NO: 4443595 - DNA, 15 bp, Homo sapiens
ccatgctctctcacc

SEQ ID NO: 4443596 - DNA, 12 bp, Homo sapiens
ccatgctgggcc

SEQ ID NO: 4443597 - DNA, 17 bp, Homo sapiens
ccatgctgggccactgg

SEQ ID NO: 4443598 - DNA, 14 bp, Homo sapiens
ccatgctgggtctg

SEQ ID NO: 4443599 - DNA, 16 bp, Homo sapiens
ccatgctgggtctgag

SEQ ID NO: 4443600 - DNA, 14 bp, Homo sapiens
ccatgcttgcctga

SEQ ID NO: 4443601 - DNA, 19 bp, Homo sapiens
ccatgcttgcctgaagctt

SEQ ID NO: 4443602 - DNA, 20 bp, Homo sapiens
ccatggagacgtggtgggac

SEQ ID NO: 4443603 - DNA, 12 bp, Homo sapiens
ccatggagcccc

SEQ ID NO: 4443604 - DNA, 20 bp, Homo sapiens
ccatggagccccagccccct

SEQ ID NO: 4443605 - DNA, 23 bp, Homo sapiens
ccatggcaccttcagactttgct

SEQ ID NO: 4443606 - DNA, 23 bp, Homo sapiens
ccatggcactctatgttctaaga

SEQ ID NO: 4443607 - DNA, 12 bp, Homo sapiens
ccatggccccca

SEQ ID NO: 4443608 - DNA, 15 bp, Homo sapiens
ccatggcccccaata

SEQ ID NO: 4443609 - DNA, 16 bp, Homo sapiens
ccatggcccccaataa

SEQ ID NO: 4443610 - DNA, 17 bp, Homo sapiens
ccatggcccccaataaa

SEQ ID NO: 4443611 - DNA, 18 bp, Homo sapiens
ccatggcccccaataaag

SEQ ID NO: 4443612 - DNA, 20 bp, Homo sapiens
ccatggcccccaataaaggc

SEQ ID NO: 4443613 - DNA, 23 bp, Homo sapiens
ccatggcccccaataaaggcagc

SEQ ID NO: 4443614 - DNA, 11 bp, Homo sapiens
ccatggccctg

SEQ ID NO: 4443615 - DNA, 11 bp, Homo sapiens
ccatggcctca

SEQ ID NO: 4443616 - DNA, 19 bp, Homo sapiens
ccatggcctcagccctgct

SEQ ID NO: 4443617 - DNA, 16 bp, Homo sapiens
ccatgggcagagccca

SEQ ID NO: 4443618 - DNA, 17 bp, Homo sapiens
ccatggggtccatcccc

SEQ ID NO: 4443619 - DNA, 20 bp, Homo sapiens
ccatggtactgtagcagggg

SEQ ID NO: 4443620 - DNA, 22 bp, Homo sapiens
ccatggtactgtagcaggggaa

SEQ ID NO: 4443621 - DNA, 19 bp, Homo sapiens
ccatgtaaccactgcactt

SEQ ID NO: 4443622 - DNA, 17 bp, Homo sapiens
ccagcccctcctccctc

SEQ ID NO: 4443623 - DNA, 21 bp, Homo sapiens
ccagcccctcctccctcagac

SEQ ID NO: 4443624 - DNA, 14 bp, Homo sapiens
ccagcccctgcaga

SEQ ID NO: 4443625 - DNA, 14 bp, Homo sapiens
ccagccctcatccc

SEQ ID NO: 4443626 - DNA, 14 bp, Homo sapiens
ccagccctccctgt

SEQ ID NO: 4443627 - DNA, 15 bp, Homo sapiens
ccagccctccctgtc

SEQ ID NO: 4443628 - DNA, 16 bp, Homo sapiens
ccagccctccctgtcc

SEQ ID NO: 4443629 - DNA, 17 bp, Homo sapiens
ccagccctccctgtcct

SEQ ID NO: 4443630 - DNA, 13 bp, Homo sapiens
ccagccctgcagc

SEQ ID NO: 4443631 - DNA, 16 bp, Homo sapiens
ccagccctgctggccg

SEQ ID NO: 4443632 - DNA, 24 bp, Homo sapiens
ccagccctgctggccgcctcaccc

SEQ ID NO: 4443633 - DNA, 20 bp, Homo sapiens
ccagccctggcccaggtgcc

SEQ ID NO: 4443634 - DNA, 13 bp, Homo sapiens
ccagccctggtct

SEQ ID NO: 4443635 - DNA, 17 bp, Homo sapiens
ccagcccttcatgggtg

SEQ ID NO: 4443636 - DNA, 13 bp, Homo sapiens
ccagcccttccct

SEQ ID NO: 4443637 - DNA, 19 bp, Homo sapiens
ccagcccttccctggcccc

SEQ ID NO: 4443638 - DNA, 23 bp, Homo sapiens
ccagcccttccctggccccgccg

SEQ ID NO: 4443639 - DNA, 14 bp, Homo sapiens
ccagccggcatggc

SEQ ID NO: 4443640 - DNA, 16 bp, Homo sapiens
ccagcctacctctcca

SEQ ID NO: 4443641 - DNA, 16 bp, Homo sapiens
ccagcctagcctggct

SEQ ID NO: 4443642 - DNA, 15 bp, Homo sapiens
ccagcctcagaaggc

SEQ ID NO: 4443643 - DNA, 18 bp, Homo sapiens
ccagcctcccctcccctg

SEQ ID NO: 4443644 - DNA, 21 bp, Homo sapiens
ccagcctccgagagggagaga

SEQ ID NO: 4443645 - DNA, 17 bp, Homo sapiens
ccagcctctccccgctc

SEQ ID NO: 4443646 - DNA, 23 bp, Homo sapiens
ccagcctctccccgctctggatc

SEQ ID NO: 4443647 - DNA, 20 bp, Homo sapiens
ccagcctctgccgctgccat

SEQ ID NO: 4443648 - DNA, 19 bp, Homo sapiens
ccagcctgagcgacagtga

SEQ ID NO: 4443649 - DNA, 15 bp, Homo sapiens
ccagcctgagtgaca

SEQ ID NO: 4443650 - DNA, 15 bp, Homo sapiens
ccagcctgctctccc

SEQ ID NO: 4443651 - DNA, 13 bp, Homo sapiens
ccagcctggatgc

SEQ ID NO: 4443652 - DNA, 15 bp, Homo sapiens
ccagcctggatgcca

SEQ ID NO: 4443653 - DNA, 21 bp, Homo sapiens
ccagcctggctctgccccctc

SEQ ID NO: 4443654 - DNA, 17 bp, Homo sapiens
ccagcctgggagcccag

SEQ ID NO: 4443655 - DNA, 16 bp, Homo sapiens
ccagcctgggcaacaa

SEQ ID NO: 4443656 - DNA, 12 bp, Homo sapiens
ccagcctgggcc

SEQ ID NO: 4443657 - DNA, 21 bp, Homo sapiens
ccagcctggggctgaggctga

SEQ ID NO: 4443658 - DNA, 22 bp, Homo sapiens
ccagcctgggtcacagagtgag

SEQ ID NO: 4443659 - DNA, 21 bp, Homo sapiens
ccagccttatgtgttacatta

SEQ ID NO: 4443660 - DNA, 19 bp, Homo sapiens
ccagccttgagccctggct

SEQ ID NO: 4443661 - DNA, 21 bp, Homo sapiens
ccagccttgagccctggctgt

SEQ ID NO: 4443662 - DNA, 17 bp, Homo sapiens
ccagccttgcccagctt

SEQ ID NO: 4443663 - DNA, 21 bp, Homo sapiens
ccagccttgctctcttcaata

SEQ ID NO: 4443664 - DNA, 21 bp, Homo sapiens
ccagcgatggtgctgcccagg

SEQ ID NO: 4443665 - DNA, 22 bp, Homo sapiens
ccagcgcctagtggggtctccc

SEQ ID NO: 4443666 - DNA, 14 bp, Homo sapiens
ccagcgcctccctc

SEQ ID NO: 4443667 - DNA, 20 bp, Homo sapiens
ccagcggccccccgcacagc

SEQ ID NO: 4443668 - DNA, 14 bp, Homo sapiens
ccagcggctccaac

SEQ ID NO: 4443669 - DNA, 19 bp, Homo sapiens
ccagcgggctggcgggcct

SEQ ID NO: 4443670 - DNA, 20 bp, Homo sapiens
ccagcggtccaatgccacct

SEQ ID NO: 4443671 - DNA, 15 bp, Homo sapiens
ccagcgtcagaagtc

SEQ ID NO: 4443672 - DNA, 13 bp, Homo sapiens
ccagcgtcctcct

SEQ ID NO: 4443673 - DNA, 17 bp, Homo sapiens
ccagcgtcctcctctgt

SEQ ID NO: 4443674 - DNA, 16 bp, Homo sapiens
ccagcgtttattgtag

SEQ ID NO: 4443675 - DNA, 18 bp, Homo sapiens
ccagctaacccgtgcaga

SEQ ID NO: 4443676 - DNA, 15 bp, Homo sapiens
ccagctaatttttgt

SEQ ID NO: 4443677 - DNA, 14 bp, Homo sapiens
ccagctactcagga

SEQ ID NO: 4443678 - DNA, 16 bp, Homo sapiens
ccagctactcaggagg

SEQ ID NO: 4443679 - DNA, 19 bp, Homo sapiens
ccagctactcaggaggctg

SEQ ID NO: 4443680 - DNA, 20 bp, Homo sapiens
ccagctactggggaggctga

SEQ ID NO: 4443681 - DNA, 23 bp, Homo sapiens
ccagctactggggaggctgaggc

SEQ ID NO: 4443682 - DNA, 16 bp, Homo sapiens
ccagctacttgggagg

SEQ ID NO: 4443683 - DNA, 12 bp, Homo sapiens
ccagctcacccc

SEQ ID NO: 4443684 - DNA, 21 bp, Homo sapiens
ccagctcaggaattccctgga

SEQ ID NO: 4443685 - DNA, 19 bp, Homo sapiens
ccagctccatgttctccca

SEQ ID NO: 4443686 - DNA, 12 bp, Homo sapiens
ccagctcccaca

SEQ ID NO: 4443687 - DNA, 16 bp, Homo sapiens
ccagctcccacaccgc

SEQ ID NO: 4443688 - DNA, 16 bp, Homo sapiens
ccagctccccccaaga

SEQ ID NO: 4443689 - DNA, 19 bp, Homo sapiens
ccagctcctttctcctgtg

SEQ ID NO: 4443690 - DNA, 20 bp, Homo sapiens
ccagctcctttctcctgtga

SEQ ID NO: 4443691 - DNA, 14 bp, Homo sapiens
ccagctctccctct

SEQ ID NO: 4443692 - DNA, 16 bp, Homo sapiens
ccagctctccctctgg

SEQ ID NO: 4443693 - DNA, 17 bp, Homo sapiens
ccagctctccctctggc

SEQ ID NO: 4443694 - DNA, 18 bp, Homo sapiens
ccagctctccctctggcc

SEQ ID NO: 4443695 - DNA, 22 bp, Homo sapiens
ccagctctccctctggccctgc

SEQ ID NO: 4443696 - DNA, 13 bp, Homo sapiens
ccagctctgcccc

SEQ ID NO: 4443697 - DNA, 14 bp, Homo sapiens
ccagctctgccccc

SEQ ID NO: 4443698 - DNA, 16 bp, Homo sapiens
ccagctctgcccccgc

SEQ ID NO: 4443699 - DNA, 16 bp, Homo sapiens
ccagctctggcacagt

SEQ ID NO: 4443700 - DNA, 13 bp, Homo sapiens
ccagctgcaaagt

SEQ ID NO: 4443701 - DNA, 18 bp, Homo sapiens
ccagctgcggccaggcct

SEQ ID NO: 4443702 - DNA, 22 bp, Homo sapiens
ccagctgctccgaggacccagg

SEQ ID NO: 4443703 - DNA, 18 bp, Homo sapiens
ccagctgggagcactggt

SEQ ID NO: 4443704 - DNA, 16 bp, Homo sapiens
ccagctgtctcccacg

SEQ ID NO: 4443705 - DNA, 15 bp, Homo sapiens
ccagctgtgcacttt

SEQ ID NO: 4443706 - DNA, 16 bp, Homo sapiens
ccagctgtgctgtgga

SEQ ID NO: 4443707 - DNA, 21 bp, Homo sapiens
ccagctgtgggcggctcctgg

SEQ ID NO: 4443708 - DNA, 23 bp, Homo sapiens
ccagctgtgggcggctcctggtg

SEQ ID NO: 4443709 - DNA, 19 bp, Homo sapiens
ccagcttcatgtggcttcc

SEQ ID NO: 4443710 - DNA, 21 bp, Homo sapiens
ccagcttcggagggcccctgc

SEQ ID NO: 4443711 - DNA, 23 bp, Homo sapiens
ccagcttgctcttcagtgggaga

SEQ ID NO: 4443712 - DNA, 20 bp, Homo sapiens
ccaggaaactccacatctgc

SEQ ID NO: 4443713 - DNA, 22 bp, Homo sapiens
ccaggaaactccacatctgcct

SEQ ID NO: 4443714 - DNA, 16 bp, Homo sapiens
ccaggaaagagcagtc

SEQ ID NO: 4443715 - DNA, 22 bp, Homo sapiens
ccaggaaaggacggctgagcat

SEQ ID NO: 4443716 - DNA, 18 bp, Homo sapiens
ccaggaacagcaaatgca

SEQ ID NO: 4443717 - DNA, 16 bp, Homo sapiens
ccaggaagccgtcctg

SEQ ID NO: 4443718 - DNA, 23 bp, Homo sapiens
ccaggaaggccaaaatcaagagt

SEQ ID NO: 4443719 - DNA, 23 bp, Homo sapiens
ccaggaagggaaagcgggcagcc

SEQ ID NO: 4443720 - DNA, 14 bp, Homo sapiens
ccaggaatattaag

SEQ ID NO: 4443721 - DNA, 15 bp, Homo sapiens
ccaggaatggtgctt

SEQ ID NO: 4443722 - DNA, 20 bp, Homo sapiens
ccaggaatgttaaagtcagt

SEQ ID NO: 4443723 - DNA, 18 bp, Homo sapiens
ccaggacactaccctgag

SEQ ID NO: 4443724 - DNA, 15 bp, Homo sapiens
ccaggacaggcccgg

SEQ ID NO: 4443725 - DNA, 23 bp, Homo sapiens
ccaggaccagtcaacctgggcaa

SEQ ID NO: 4443726 - DNA, 15 bp, Homo sapiens
ccaggacgccactca

SEQ ID NO: 4443727 - DNA, 16 bp, Homo sapiens
ccaggacgccactcat

SEQ ID NO: 4443728 - DNA, 20 bp, Homo sapiens
ccaggacgccactcatttca

SEQ ID NO: 4443729 - DNA, 20 bp, Homo sapiens
ccaggacgtctggggtgtgg

SEQ ID NO: 4443730 - DNA, 20 bp, Homo sapiens
ccaggagaaggccaattcct

SEQ ID NO: 4443731 - DNA, 17 bp, Homo sapiens
ccaggagacagaccact

SEQ ID NO: 4443732 - DNA, 13 bp, Homo sapiens
ccaggagagccag

SEQ ID NO: 4443733 - DNA, 16 bp, Homo sapiens
ccaggagagccagccc

SEQ ID NO: 4443734 - DNA, 17 bp, Homo sapiens
ccaggagatgggtccag

SEQ ID NO: 4443735 - DNA, 18 bp, Homo sapiens
ccaggagatgggtccagg

SEQ ID NO: 4443736 - DNA, 21 bp, Homo sapiens
ccaggagatgggtccaggggt

SEQ ID NO: 4443737 - DNA, 20 bp, Homo sapiens
ccaggagcagccctggcccc

SEQ ID NO: 4443738 - DNA, 15 bp, Homo sapiens
ccaggaggcagctca

SEQ ID NO: 4443739 - DNA, 21 bp, Homo sapiens
ccaggagtccagaccccccag

SEQ ID NO: 4443740 - DNA, 23 bp, Homo sapiens
ccaggagtccagaccccccagcc

SEQ ID NO: 4443741 - DNA, 13 bp, Homo sapiens
ccaggagtccagg

SEQ ID NO: 4443742 - DNA, 21 bp, Homo sapiens
ccaggagtccaggcccccagc

SEQ ID NO: 4443743 - DNA, 15 bp, Homo sapiens
ccaggagttctgaag

SEQ ID NO: 4443744 - DNA, 19 bp, Homo sapiens
ccaggagtttgaggctgca

SEQ ID NO: 4443745 - DNA, 13 bp, Homo sapiens
ccaggataaagct

SEQ ID NO: 4443746 - DNA, 17 bp, Homo sapiens
ccaggatactggcacag

SEQ ID NO: 4443747 - DNA, 16 bp, Homo sapiens
ccaggatctgctccaa

SEQ ID NO: 4443748 - DNA, 16 bp, Homo sapiens
ccaggatctttgactg

SEQ ID NO: 4443749 - DNA, 17 bp, Homo sapiens
ccaggatctttgactga

SEQ ID NO: 4443750 - DNA, 22 bp, Homo sapiens
ccaggatggatgcatcacactc

SEQ ID NO: 4443751 - DNA, 22 bp, Homo sapiens
ccaggatggtctcgatctcctg

SEQ ID NO: 4443752 - DNA, 16 bp, Homo sapiens
ccaggcacacacagcc

SEQ ID NO: 4443753 - DNA, 17 bp, Homo sapiens
ccaggcacacacagccc

SEQ ID NO: 4443754 - DNA, 12 bp, Homo sapiens
ccaggcagaggg

SEQ ID NO: 4443755 - DNA, 17 bp, Homo sapiens
ccaggcagaggggcgtt

SEQ ID NO: 4443756 - DNA, 13 bp, Homo sapiens
ccaggcagatctg

SEQ ID NO: 4443757 - DNA, 20 bp, Homo sapiens
ccaggcatttagccctcaca

SEQ ID NO: 4443758 - DNA, 13 bp, Homo sapiens
ccaggccaacagc

SEQ ID NO: 4443759 - DNA, 13 bp, Homo sapiens
ccaggccacagag

SEQ ID NO: 4443760 - DNA, 14 bp, Homo sapiens
ccaggccacagaga

SEQ ID NO: 4443761 - DNA, 18 bp, Homo sapiens
ccaggccagcaggcgggc

SEQ ID NO: 4443762 - DNA, 23 bp, Homo sapiens
ccaggccagcctccgagagggag

SEQ ID NO: 4443763 - DNA, 13 bp, Homo sapiens
ccaggccagctgc

SEQ ID NO: 4443764 - DNA, 14 bp, Homo sapiens
ccaggccagctgcg

SEQ ID NO: 4443765 - DNA, 17 bp, Homo sapiens
ccaggcccaaggctccc

SEQ ID NO: 4443766 - DNA, 18 bp, Homo sapiens
ccaggcccaaggctcccg

SEQ ID NO: 4443767 - DNA, 19 bp, Homo sapiens
ccaggcccaaggctcccgg

SEQ ID NO: 4443768 - DNA, 13 bp, Homo sapiens
ccaggccccagcc

SEQ ID NO: 4443769 - DNA, 17 bp, Homo sapiens
ccaggccccaggggaga

SEQ ID NO: 4443770 - DNA, 17 bp, Homo sapiens
ccaggcccccaacccct

SEQ ID NO: 4443771 - DNA, 21 bp, Homo sapiens
ccaggcccccaacccctcctt

SEQ ID NO: 4443772 - DNA, 13 bp, Homo sapiens
ccaggcccccagc

SEQ ID NO: 4443773 - DNA, 20 bp, Homo sapiens
ccaggccccgaggacccaga

SEQ ID NO: 4443774 - DNA, 13 bp, Homo sapiens
ccaggccctccag

SEQ ID NO: 4443775 - DNA, 16 bp, Homo sapiens
ccaggccctccagtgg

SEQ ID NO: 4443776 - DNA, 19 bp, Homo sapiens
ccaggcctctctctgctcc

SEQ ID NO: 4443777 - DNA, 19 bp, Homo sapiens
ccaggcctcttggcagtca

SEQ ID NO: 4443778 - DNA, 15 bp, Homo sapiens
ccaggcctgcctgca

SEQ ID NO: 4443779 - DNA, 15 bp, Homo sapiens
ccaggcctgtccacc

SEQ ID NO: 4443780 - DNA, 18 bp, Homo sapiens
ccaggcctgtccaccctg

SEQ ID NO: 4443781 - DNA, 12 bp, Homo sapiens
ccaggcgctgca

SEQ ID NO: 4443782 - DNA, 21 bp, Homo sapiens
ccaggctccctttctcttctt

SEQ ID NO: 4443783 - DNA, 20 bp, Homo sapiens
ccaggctcgtggactgagtg

SEQ ID NO: 4443784 - DNA, 22 bp, Homo sapiens
ccaggctctcgctgccctgtgg

SEQ ID NO: 4443785 - DNA, 13 bp, Homo sapiens
ccaggctgagagc

SEQ ID NO: 4443786 - DNA, 20 bp, Homo sapiens
ccaggctgccaaggccagag

SEQ ID NO: 4443787 - DNA, 23 bp, Homo sapiens
ccaggctgcctcccttgtggcag

SEQ ID NO: 4443788 - DNA, 20 bp, Homo sapiens
ccaggctgcctcctgccctt

SEQ ID NO: 4443789 - DNA, 18 bp, Homo sapiens
ccaggctggactgcagtg

SEQ ID NO: 4443790 - DNA, 12 bp, Homo sapiens
ccaggctggaga

SEQ ID NO: 4443791 - DNA, 15 bp, Homo sapiens
ccaggctggagaccc

SEQ ID NO: 4443792 - DNA, 16 bp, Homo sapiens
ccaggctggccagtgc

SEQ ID NO: 4443793 - DNA, 13 bp, Homo sapiens
ccaggctgggcat

SEQ ID NO: 4443794 - DNA, 15 bp, Homo sapiens
ccaggctggtctcaa

SEQ ID NO: 4443795 - DNA, 13 bp, Homo sapiens
ccaggctgtctag

SEQ ID NO: 4443796 - DNA, 14 bp, Homo sapiens
ccaggctgttctca

SEQ ID NO: 4443797 - DNA, 15 bp, Homo sapiens
ccaggctgttctcag

SEQ ID NO: 4443798 - DNA, 18 bp, Homo sapiens
ccaggcttactgagctgt

SEQ ID NO: 4443799 - DNA, 20 bp, Homo sapiens
ccagggaaacagcctctctc

SEQ ID NO: 4443800 - DNA, 18 bp, Homo sapiens
ccagggaagcctgggtgt

SEQ ID NO: 4443801 - DNA, 12 bp, Homo sapiens
ccagggaattct

SEQ ID NO: 4443802 - DNA, 23 bp, Homo sapiens
ccagggaattcttacagccaagt

SEQ ID NO: 4443803 - DNA, 14 bp, Homo sapiens
ccagggacaccagc

SEQ ID NO: 4443804 - DNA, 22 bp, Homo sapiens
ccagggacaccagccaggctct

SEQ ID NO: 4443805 - DNA, 22 bp, Homo sapiens
ccagggaccactgggtgagaga

SEQ ID NO: 4443806 - DNA, 22 bp, Homo sapiens
ccagggactcagcgtcccctgc

SEQ ID NO: 4443807 - DNA, 14 bp, Homo sapiens
ccagggaggggtcc

SEQ ID NO: 4443808 - DNA, 23 bp, Homo sapiens
ccagggagtccagggtttctctg

SEQ ID NO: 4443809 - DNA, 22 bp, Homo sapiens
ccagggatcacagaccacagga

SEQ ID NO: 4443810 - DNA, 21 bp, Homo sapiens
ccagggatgattcaagccatt

SEQ ID NO: 4443811 - DNA, 20 bp, Homo sapiens
ccagggatgctgggctgggc

SEQ ID NO: 4443812 - DNA, 22 bp, Homo sapiens
ccagggatgggggatgggccag

SEQ ID NO: 4443813 - DNA, 13 bp, Homo sapiens
ccagggcacccag

SEQ ID NO: 4443814 - DNA, 17 bp, Homo sapiens
ccagggcacccaggcag

SEQ ID NO: 4443815 - DNA, 14 bp, Homo sapiens
ccagggcactgcca

SEQ ID NO: 4443816 - DNA, 16 bp, Homo sapiens
ccagggcatctgggag

SEQ ID NO: 4443817 - DNA, 14 bp, Homo sapiens
ccagggccacgctc

SEQ ID NO: 4443818 - DNA, 21 bp, Homo sapiens
ccagggccacgtgccaggccc

SEQ ID NO: 4443819 - DNA, 16 bp, Homo sapiens
ccagggcccccaccga

SEQ ID NO: 4443820 - DNA, 19 bp, Homo sapiens
ccagggcctctccttggaa

SEQ ID NO: 4443821 - DNA, 22 bp, Homo sapiens
ccagggcctctccttggaaggt

SEQ ID NO: 4443822 - DNA, 18 bp, Homo sapiens
ccagggcctgaaacccgc

SEQ ID NO: 4443823 - DNA, 13 bp, Homo sapiens
ccagggcctgact

SEQ ID NO: 4443824 - DNA, 13 bp, Homo sapiens
ccagggctggact

SEQ ID NO: 4443825 - DNA, 12 bp, Homo sapiens
ccagggctgggg

SEQ ID NO: 4443826 - DNA, 15 bp, Homo sapiens
ccaggggaaggccct

SEQ ID NO: 4443827 - DNA, 18 bp, Homo sapiens
ccaggggagagggtctgg

SEQ ID NO: 4443828 - DNA, 21 bp, Homo sapiens
ccaggggagagggtctggaga

SEQ ID NO: 4443829 - DNA, 18 bp, Homo sapiens
ccaggggccaacctcagg

SEQ ID NO: 4443830 - DNA, 19 bp, Homo sapiens
ccaggggccaattttggat

SEQ ID NO: 4443831 - DNA, 12 bp, Homo sapiens
ccaggggcccct

SEQ ID NO: 4443832 - DNA, 14 bp, Homo sapiens
ccaggggcccctcc

SEQ ID NO: 4443833 - DNA, 17 bp, Homo sapiens
ccaggggcccctccagc

SEQ ID NO: 4443834 - DNA, 20 bp, Homo sapiens
ccaggggcccctccagcttg

SEQ ID NO: 4443835 - DNA, 22 bp, Homo sapiens
ccaggggcccctccagcttgtg

SEQ ID NO: 4443836 - DNA, 18 bp, Homo sapiens
ccaggggtcccagccacc

SEQ ID NO: 4443837 - DNA, 14 bp, Homo sapiens
ccaggggtctccct

SEQ ID NO: 4443838 - DNA, 17 bp, Homo sapiens
ccaggggtctccctggc

SEQ ID NO: 4443839 - DNA, 16 bp, Homo sapiens
ccaggggtctgtctgc

SEQ ID NO: 4443840 - DNA, 16 bp, Homo sapiens
ccaggggtgcacaata

SEQ ID NO: 4443841 - DNA, 16 bp, Homo sapiens
ccaggggtgctcctgt

SEQ ID NO: 4443842 - DNA, 19 bp, Homo sapiens
ccagggtagcccgcctgcc

SEQ ID NO: 4443843 - DNA, 14 bp, Homo sapiens
ccagggtcaggcgg

SEQ ID NO: 4443844 - DNA, 19 bp, Homo sapiens
ccagggtcataagtgggga

SEQ ID NO: 4443845 - DNA, 14 bp, Homo sapiens
ccagggtcttccct

SEQ ID NO: 4443846 - DNA, 14 bp, Homo sapiens
ccagggtggccaca

SEQ ID NO: 4443847 - DNA, 18 bp, Homo sapiens
ccagggtggccacacagg

SEQ ID NO: 4443848 - DNA, 22 bp, Homo sapiens
ccagggtggccacacaggcagg

SEQ ID NO: 4443849 - DNA, 16 bp, Homo sapiens
ccagggttgaccccag

SEQ ID NO: 4443850 - DNA, 18 bp, Homo sapiens
ccagggttgaccccagag

SEQ ID NO: 4443851 - DNA, 14 bp, Homo sapiens
ccagggtttctctg

SEQ ID NO: 4443852 - DNA, 17 bp, Homo sapiens
ccaggtacacctccccc

SEQ ID NO: 4443853 - DNA, 23 bp, Homo sapiens
ccaggtacacctccccctgcgcc

SEQ ID NO: 4443854 - DNA, 23 bp, Homo sapiens
ccaggtaccagctgcgcttgctt

SEQ ID NO: 4443855 - DNA, 22 bp, Homo sapiens
ccaggtcccagcccctcctccc

SEQ ID NO: 4443856 - DNA, 14 bp, Homo sapiens
ccaggtctgcctgg

SEQ ID NO: 4443857 - DNA, 15 bp, Homo sapiens
ccaggtctgcctggt

SEQ ID NO: 4443858 - DNA, 16 bp, Homo sapiens
ccaggtctgcctggtt

SEQ ID NO: 4443859 - DNA, 18 bp, Homo sapiens
ccaggtctgcctggttcc

SEQ ID NO: 4443860 - DNA, 23 bp, Homo sapiens
ccaggtgacacgcttctgagcag

SEQ ID NO: 4443861 - DNA, 14 bp, Homo sapiens
ccaggtgcccagga

SEQ ID NO: 4443862 - DNA, 18 bp, Homo sapiens
ccaggtgccgacactgag

SEQ ID NO: 4443863 - DNA, 13 bp, Homo sapiens
tttttaaaagcct

SEQ ID NO: 4443864 - DNA, 22 bp, Homo sapiens
tttttaaaagccttccagtttt

SEQ ID NO: 4443865 - DNA, 17 bp, Homo sapiens
tttttaaaatttatttg

SEQ ID NO: 4443866 - DNA, 16 bp, Homo sapiens
tttttaaacaagtatt

SEQ ID NO: 4443867 - DNA, 11 bp, Homo sapiens
tttttaaactt

SEQ ID NO: 4443868 - DNA, 13 bp, Homo sapiens
tttttaaagacta

SEQ ID NO: 4443869 - DNA, 12 bp, Homo sapiens
tttttaaagctt

SEQ ID NO: 4443870 - DNA, 19 bp, Homo sapiens
tttttaaagtaaacttgtg

SEQ ID NO: 4443871 - DNA, 22 bp, Homo sapiens
tttttaaagtaaacttgtgtat

SEQ ID NO: 4443872 - DNA, 16 bp, Homo sapiens
tttttaaatcaaggaa

SEQ ID NO: 4443873 - DNA, 15 bp, Homo sapiens
tttttaaatgtatac

SEQ ID NO: 4443874 - DNA, 12 bp, Homo sapiens
tttttaaattac

SEQ ID NO: 4443875 - DNA, 20 bp, Homo sapiens
tttttaaattttcttcagtt

SEQ ID NO: 4443876 - DNA, 16 bp, Homo sapiens
tttttaaattttgtaa

SEQ ID NO: 4443877 - DNA, 19 bp, Homo sapiens
tttttaaattttgtaatga

SEQ ID NO: 4443878 - DNA, 18 bp, Homo sapiens
tttttaacaatctaacaa

SEQ ID NO: 4443879 - DNA, 17 bp, Homo sapiens
tttttaactttaccatg

SEQ ID NO: 4443880 - DNA, 21 bp, Homo sapiens
tttttaactttaccatgctca

SEQ ID NO: 4443881 - DNA, 20 bp, Homo sapiens
tttttaagatagtgtaactt

SEQ ID NO: 4443882 - DNA, 20 bp, Homo sapiens
tttttaagctgcaaatctga

SEQ ID NO: 4443883 - DNA, 18 bp, Homo sapiens
tttttaagttaatagatt

SEQ ID NO: 4443884 - DNA, 16 bp, Homo sapiens
tttttaagttgtcaaa

SEQ ID NO: 4443885 - DNA, 12 bp, Homo sapiens
tttttaatagaa

SEQ ID NO: 4443886 - DNA, 20 bp, Homo sapiens
tttttaatagtctagaatgt

SEQ ID NO: 4443887 - DNA, 17 bp, Homo sapiens
tttttaatcatgaatat

SEQ ID NO: 4443888 - DNA, 18 bp, Homo sapiens
tttttaatgtatagtaaa

SEQ ID NO: 4443889 - DNA, 17 bp, Homo sapiens
tttttaattaaaaactt

SEQ ID NO: 4443890 - DNA, 12 bp, Homo sapiens
tttttaatttct

SEQ ID NO: 4443891 - DNA, 20 bp, Homo sapiens
tttttacaagttatagtact

SEQ ID NO: 4443892 - DNA, 13 bp, Homo sapiens
tttttacatttca

SEQ ID NO: 4443893 - DNA, 13 bp, Homo sapiens
tttttactgtatg

SEQ ID NO: 4443894 - DNA, 15 bp, Homo sapiens
tttttactgtatgtt

SEQ ID NO: 4443895 - DNA, 13 bp, Homo sapiens
tttttacttgaat

SEQ ID NO: 4443896 - DNA, 15 bp, Homo sapiens
tttttacttgaatca

SEQ ID NO: 4443897 - DNA, 20 bp, Homo sapiens
tttttataaaaataaataga

SEQ ID NO: 4443898 - DNA, 18 bp, Homo sapiens
tttttataaactaccaaa

SEQ ID NO: 4443899 - DNA, 16 bp, Homo sapiens
tttttatactgcactt

SEQ ID NO: 4443900 - DNA, 17 bp, Homo sapiens
tttttatcccatttagt

SEQ ID NO: 4443901 - DNA, 16 bp, Homo sapiens
tttttatgctatttct

SEQ ID NO: 4443902 - DNA, 13 bp, Homo sapiens
tttttatgctctt

SEQ ID NO: 4443903 - DNA, 18 bp, Homo sapiens
tttttattaatctactgt

SEQ ID NO: 4443904 - DNA, 17 bp, Homo sapiens
tttttattccctgccca

SEQ ID NO: 4443905 - DNA, 16 bp, Homo sapiens
tttttcaactttgaat

SEQ ID NO: 4443906 - DNA, 14 bp, Homo sapiens
tttttcaagagatc

SEQ ID NO: 4443907 - DNA, 16 bp, Homo sapiens
tttttcaatatattga

SEQ ID NO: 4443908 - DNA, 20 bp, Homo sapiens
tttttcagttgttcttttta

SEQ ID NO: 4443909 - DNA, 12 bp, Homo sapiens
tttttcatactg

SEQ ID NO: 4443910 - DNA, 20 bp, Homo sapiens
tttttcatactgtacacatt

SEQ ID NO: 4443911 - DNA, 17 bp, Homo sapiens
tttttcattcatgaata

SEQ ID NO: 4443912 - DNA, 12 bp, Homo sapiens
tttttcatttgt

SEQ ID NO: 4443913 - DNA, 21 bp, Homo sapiens
tttttccaactactaatagaa

SEQ ID NO: 4443914 - DNA, 13 bp, Homo sapiens
tttttccatcttt

SEQ ID NO: 4443915 - DNA, 11 bp, Homo sapiens
tttttccgtgt

SEQ ID NO: 4443916 - DNA, 17 bp, Homo sapiens
tttttcctgtgtattaa

SEQ ID NO: 4443917 - DNA, 19 bp, Homo sapiens
tttttccttcaaagtttaa

SEQ ID NO: 4443918 - DNA, 15 bp, Homo sapiens
tttttccttgcctgt

SEQ ID NO: 4443919 - DNA, 18 bp, Homo sapiens
tttttcctttaactgaca

SEQ ID NO: 4443920 - DNA, 12 bp, Homo sapiens
tttttctaaaac

SEQ ID NO: 4443921 - DNA, 15 bp, Homo sapiens
tttttctatattatt

SEQ ID NO: 4443922 - DNA, 17 bp, Homo sapiens
tttttctgataaaagat

SEQ ID NO: 4443923 - DNA, 22 bp, Homo sapiens
tttttctggctgtgatcttaaa

SEQ ID NO: 4443924 - DNA, 16 bp, Homo sapiens
tttttctgtaatgtaa

SEQ ID NO: 4443925 - DNA, 20 bp, Homo sapiens
tttttctgtaatgtaaataa

SEQ ID NO: 4443926 - DNA, 14 bp, Homo sapiens
tttttctgtaccag

SEQ ID NO: 4443927 - DNA, 16 bp, Homo sapiens
tttttctgtaccagtt

SEQ ID NO: 4443928 - DNA, 11 bp, Homo sapiens
tttttcttccc

SEQ ID NO: 4443929 - DNA, 21 bp, Homo sapiens
tttttcttttcggaaatctta

SEQ ID NO: 4443930 - DNA, 12 bp, Homo sapiens
tttttgaacctc

SEQ ID NO: 4443931 - DNA, 12 bp, Homo sapiens
tttttgacactg

SEQ ID NO: 4443932 - DNA, 19 bp, Homo sapiens
tttttgacactgaaagttt

SEQ ID NO: 4443933 - DNA, 16 bp, Homo sapiens
tttttgaccagtttct

SEQ ID NO: 4443934 - DNA, 12 bp, Homo sapiens
tttttgactttt

SEQ ID NO: 4443935 - DNA, 15 bp, Homo sapiens
tttttgcttctactt

SEQ ID NO: 4443936 - DNA, 14 bp, Homo sapiens
tttttggagtgtta

SEQ ID NO: 4443937 - DNA, 15 bp, Homo sapiens
tttttggatttctgt

SEQ ID NO: 4443938 - DNA, 20 bp, Homo sapiens
tttttgggcagcaatttaaa

SEQ ID NO: 4443939 - DNA, 21 bp, Homo sapiens
tttttgggcagcaatttaaat

SEQ ID NO: 4443940 - DNA, 23 bp, Homo sapiens
ttgcctaggcgattttgtctacc

SEQ ID NO: 4443941 - DNA, 20 bp, Homo sapiens
ttgtgagagtggctttctac

SEQ ID NO: 4443942 - DNA, 15 bp, Homo sapiens
ttgtgatcctgagtc

SEQ ID NO: 4443943 - DNA, 20 bp, Homo sapiens
ttgtgatgaacatattcatg

SEQ ID NO: 4443944 - DNA, 23 bp, Homo sapiens
ttgtgattcaatctgtaaactgt

SEQ ID NO: 4443945 - DNA, 14 bp, Homo sapiens
ttgtgatttcttta

SEQ ID NO: 4443946 - DNA, 14 bp, Homo sapiens
ttttcatttgtaaa

SEQ ID NO: 4443947 - DNA, 18 bp, Homo sapiens
ttttcatttgtaaaaatg

SEQ ID NO: 4443948 - DNA, 14 bp, Homo sapiens
ttttcattttaact

SEQ ID NO: 4443949 - DNA, 15 bp, Homo sapiens
ttttcattttaactg

SEQ ID NO: 4443950 - DNA, 13 bp, Homo sapiens
ttttccaaaacaa

SEQ ID NO: 4443951 - DNA, 12 bp, Homo sapiens
ttttccaaagag

SEQ ID NO: 4443952 - DNA, 14 bp, Homo sapiens
ttttccaactacta

SEQ ID NO: 4443953 - DNA, 12 bp, Homo sapiens
ttttccaatatt

SEQ ID NO: 4443954 - DNA, 14 bp, Homo sapiens
ttttccaatgtttt

SEQ ID NO: 4443955 - DNA, 19 bp, Homo sapiens
ttttccacataaattttaa

SEQ ID NO: 4443956 - DNA, 18 bp, Homo sapiens
ttttccactgtgctatta

SEQ ID NO: 4443957 - DNA, 17 bp, Homo sapiens
ttttccagccttatgtg

SEQ ID NO: 4443958 - DNA, 19 bp, Homo sapiens
ttttccagccttatgtgtt

SEQ ID NO: 4443959 - DNA, 16 bp, Homo sapiens
ttttccatcataattc

SEQ ID NO: 4443960 - DNA, 20 bp, Homo sapiens
ttttccatgcgtgtttctga

SEQ ID NO: 4443961 - DNA, 20 bp, Homo sapiens
ttttccatttggcactatgg

SEQ ID NO: 4443962 - DNA, 21 bp, Homo sapiens
ttttcccaatagcactttcat

SEQ ID NO: 4443963 - DNA, 21 bp, Homo sapiens
ttttcccacgtctaactggaa

SEQ ID NO: 4443964 - DNA, 16 bp, Homo sapiens
ttttccccctttgtgc

SEQ ID NO: 4443965 - DNA, 19 bp, Homo sapiens
ttttccccggtcccttgag

SEQ ID NO: 4443966 - DNA, 14 bp, Homo sapiens
ttttccctccccag

SEQ ID NO: 4443967 - DNA, 15 bp, Homo sapiens
ttttcctaagacatt

SEQ ID NO: 4443968 - DNA, 20 bp, Homo sapiens
ttttcctaataaagttctgt

SEQ ID NO: 4443969 - DNA, 21 bp, Homo sapiens
ttttcctaatgtgatcatatg

SEQ ID NO: 4443970 - DNA, 21 bp, Homo sapiens
ttttcctacaggcctatttaa

SEQ ID NO: 4443971 - DNA, 19 bp, Homo sapiens
ttttcctatgctattgaca

SEQ ID NO: 4443972 - DNA, 18 bp, Homo sapiens
ttttcctattttcgatga

SEQ ID NO: 4443973 - DNA, 13 bp, Homo sapiens
ttttcctctggcc

SEQ ID NO: 4443974 - DNA, 17 bp, Homo sapiens
ttttcctcttagaagaa

SEQ ID NO: 4443975 - DNA, 12 bp, Homo sapiens
ttttcctcttct

SEQ ID NO: 4443976 - DNA, 16 bp, Homo sapiens
ttttcctggcagctgc

SEQ ID NO: 4443977 - DNA, 20 bp, Homo sapiens
ttttcctggcagctgctgtg

SEQ ID NO: 4443978 - DNA, 13 bp, Homo sapiens
ttttcctgtcctg

SEQ ID NO: 4443979 - DNA, 14 bp, Homo sapiens
ttttcctgtcctgc

SEQ ID NO: 4443980 - DNA, 11 bp, Homo sapiens
ttttcctgtgg

SEQ ID NO: 4443981 - DNA, 20 bp, Homo sapiens
ttttccttcctttttattca

SEQ ID NO: 4443982 - DNA, 21 bp, Homo sapiens
ttttccttgctatttcaataa

SEQ ID NO: 4443983 - DNA, 20 bp, Homo sapiens
ttttcctttttcttcgctgg

SEQ ID NO: 4443984 - DNA, 21 bp, Homo sapiens
ttttcgtttagaatcagaata

SEQ ID NO: 4443985 - DNA, 21 bp, Homo sapiens
ttttctaaaacattcccctcc

SEQ ID NO: 4443986 - DNA, 22 bp, Homo sapiens
ttttctaaaacattcccctccc

SEQ ID NO: 4443987 - DNA, 15 bp, Homo sapiens
ttttctaaatttatc

SEQ ID NO: 4443988 - DNA, 23 bp, Homo sapiens
ttttctaacagaaagcatgattt

SEQ ID NO: 4443989 - DNA, 13 bp, Homo sapiens
ttttctaagagaa

SEQ ID NO: 4443990 - DNA, 15 bp, Homo sapiens
ttttctaagagaagt

SEQ ID NO: 4443991 - DNA, 16 bp, Homo sapiens
ttttctacattattgc

SEQ ID NO: 4443992 - DNA, 18 bp, Homo sapiens
ttttctagatacaataaa

SEQ ID NO: 4443993 - DNA, 21 bp, Homo sapiens
ttttctatgaaataatgtgaa

SEQ ID NO: 4443994 - DNA, 19 bp, Homo sapiens
ttttctctataaagggtca

SEQ ID NO: 4443995 - DNA, 18 bp, Homo sapiens
ttttctctcctgtcctcc

SEQ ID NO: 4443996 - DNA, 21 bp, Homo sapiens
ttttctctttaattttaactg

SEQ ID NO: 4443997 - DNA, 14 bp, Homo sapiens
ttttctgactttta

SEQ ID NO: 4443998 - DNA, 13 bp, Homo sapiens
ttttctgccctgg

SEQ ID NO: 4443999 - DNA, 20 bp, Homo sapiens
ttttctggccagtgtttaaa

SEQ ID NO: 4444000 - DNA, 21 bp, Homo sapiens
ttttctggctgtgatcttaaa

SEQ ID NO: 4444001 - DNA, 22 bp, Homo sapiens
ttttctgttacctcaacaagaa

SEQ ID NO: 4444002 - DNA, 23 bp, Homo sapiens
ttttctgttgaagtttacaatca

SEQ ID NO: 4444003 - DNA, 17 bp, Homo sapiens
ttttcttcactcaaatt

SEQ ID NO: 4444004 - DNA, 11 bp, Homo sapiens
ttttcttcagc

SEQ ID NO: 4444005 - DNA, 17 bp, Homo sapiens
ttttcttcagcatttac

SEQ ID NO: 4444006 - DNA, 16 bp, Homo sapiens
ttttcttgatgtcact

SEQ ID NO: 4444007 - DNA, 14 bp, Homo sapiens
ttttcttgatttga

SEQ ID NO: 4444008 - DNA, 16 bp, Homo sapiens
ttttcttgcatggttt

SEQ ID NO: 4444009 - DNA, 18 bp, Homo sapiens
ttttcttgcctctgtccc

SEQ ID NO: 4444010 - DNA, 19 bp, Homo sapiens
ttttcttgcctctgtcccc

SEQ ID NO: 4444011 - DNA, 21 bp, Homo sapiens
ttttcttgcctctgtcccctt

SEQ ID NO: 4444012 - DNA, 11 bp, Homo sapiens
ttttcttgtat

SEQ ID NO: 4444013 - DNA, 18 bp, Homo sapiens
ttttctttaactgccgta

SEQ ID NO: 4444014 - DNA, 15 bp, Homo sapiens
ttttctttgcaaagt

SEQ ID NO: 4444015 - DNA, 21 bp, Homo sapiens
ttttcttttttaaattaatat

SEQ ID NO: 4444016 - DNA, 22 bp, Homo sapiens
ttttctttttttttaagttctt

SEQ ID NO: 4444017 - DNA, 23 bp, Homo sapiens
ttttgaaaaaagctcatttcatg

SEQ ID NO: 4444018 - DNA, 21 bp, Homo sapiens
ttttgaaaaattgtctttcct

SEQ ID NO: 4444019 - DNA, 12 bp, Homo sapiens
ttttgaaaataa

SEQ ID NO: 4444020 - DNA, 17 bp, Homo sapiens
ttttgaaattaacctct

SEQ ID NO: 4444021 - DNA, 20 bp, Homo sapiens
ttttgaaattatgtgacatt

SEQ ID NO: 4444022 - DNA, 16 bp, Homo sapiens
ttttgaaatttactgt

SEQ ID NO: 4444023 - DNA, 21 bp, Homo sapiens
ttttgaagattctatgttaat

SEQ ID NO: 4444024 - DNA, 14 bp, Homo sapiens
ttttgaaggcaaaa

SEQ ID NO: 4444025 - DNA, 21 bp, Homo sapiens
ttttgaaggtttcagatgagg

SEQ ID NO: 4444026 - DNA, 18 bp, Homo sapiens
ttttgaatggtgttgtat

SEQ ID NO: 4444027 - DNA, 15 bp, Homo sapiens
ttttgaattgttaca

SEQ ID NO: 4444028 - DNA, 13 bp, Homo sapiens
ttttgacactgaa

SEQ ID NO: 4444029 - DNA, 14 bp, Homo sapiens
ttttgacactgaaa

SEQ ID NO: 4444030 - DNA, 15 bp, Homo sapiens
ttttgacataaagtt

SEQ ID NO: 4444031 - DNA, 16 bp, Homo sapiens
ttttgaccagtttctt

SEQ ID NO: 4444032 - DNA, 21 bp, Homo sapiens
ttttgagatggggtctcgctc

SEQ ID NO: 4444033 - DNA, 14 bp, Homo sapiens
ttttgataactgtt

SEQ ID NO: 4444034 - DNA, 18 bp, Homo sapiens
ttttgataataatattgt

SEQ ID NO: 4444035 - DNA, 15 bp, Homo sapiens
ttttgatagttgtgt

SEQ ID NO: 4444036 - DNA, 18 bp, Homo sapiens
ttttgatataattgtact

SEQ ID NO: 4444037 - DNA, 17 bp, Homo sapiens
ttttgatgcagataaaa

SEQ ID NO: 4444038 - DNA, 19 bp, Homo sapiens
ttttgcaaagatttaatct

SEQ ID NO: 4444039 - DNA, 21 bp, Homo sapiens
ttttgcaaccaggaacagcaa

SEQ ID NO: 4444040 - DNA, 21 bp, Homo sapiens
ttttgcaacctcgctggactc

SEQ ID NO: 4444041 - DNA, 18 bp, Homo sapiens
ttttgcaatcccttaata

SEQ ID NO: 4444042 - DNA, 17 bp, Homo sapiens
ttttgcacagccaaatt

SEQ ID NO: 4444043 - DNA, 22 bp, Homo sapiens
ttttgcactgaagagagcattt

SEQ ID NO: 4444044 - DNA, 12 bp, Homo sapiens
ttttgcatgaaa

SEQ ID NO: 4444045 - DNA, 13 bp, Homo sapiens
ttttgcatgaaat

SEQ ID NO: 4444046 - DNA, 17 bp, Homo sapiens
ttttgccctatatacct

SEQ ID NO: 4444047 - DNA, 13 bp, Homo sapiens
ttttgccctttga

SEQ ID NO: 4444048 - DNA, 13 bp, Homo sapiens
ttttgcctgtaag

SEQ ID NO: 4444049 - DNA, 14 bp, Homo sapiens
ttttgcctgtaaga

SEQ ID NO: 4444050 - DNA, 20 bp, Homo sapiens
ttttgctgaattcctttaca

SEQ ID NO: 4444051 - DNA, 15 bp, Homo sapiens
ttttgctgagagcat

SEQ ID NO: 4444052 - DNA, 13 bp, Homo sapiens
ttttgctgtagaa

SEQ ID NO: 4444053 - DNA, 21 bp, Homo sapiens
ttttgctttcgaactgctagt

SEQ ID NO: 4444054 - DNA, 15 bp, Homo sapiens
ttttggaaaaacctt

SEQ ID NO: 4444055 - DNA, 14 bp, Homo sapiens
ttttggaaagtcag

SEQ ID NO: 4444056 - DNA, 18 bp, Homo sapiens
ttttggaacgcagttgat

SEQ ID NO: 4444057 - DNA, 22 bp, Homo sapiens
ttttggaagaagttttttactt

SEQ ID NO: 4444058 - DNA, 19 bp, Homo sapiens
ttttggaggtgcttgatct

SEQ ID NO: 4444059 - DNA, 21 bp, Homo sapiens
ttttggaggtgcttgatctat

SEQ ID NO: 4444060 - DNA, 17 bp, Homo sapiens
ttttggagtgttatgta

SEQ ID NO: 4444061 - DNA, 18 bp, Homo sapiens
ttttggatggtgttacat

SEQ ID NO: 4444062 - DNA, 19 bp, Homo sapiens
ttttggtaaagactggctt

SEQ ID NO: 4444063 - DNA, 14 bp, Homo sapiens
ttttggtacaaaaa

SEQ ID NO: 4444064 - DNA, 23 bp, Homo sapiens
tttgaaaaagcgaaaaaatcagg

SEQ ID NO: 4444065 - DNA, 19 bp, Homo sapiens
tttgaaaacatgtttattt

SEQ ID NO: 4444066 - DNA, 23 bp, Homo sapiens
tttgaaaagcaatattgtatatt

SEQ ID NO: 4444067 - DNA, 18 bp, Homo sapiens
tttgaaaagcagacattt

SEQ ID NO: 4444068 - DNA, 19 bp, Homo sapiens
tttgaaaatatgtactgta

SEQ ID NO: 4444069 - DNA, 13 bp, Homo sapiens
tttgaaaattaca

SEQ ID NO: 4444070 - DNA, 23 bp, Homo sapiens
tttgaaaattacatgttttttca

SEQ ID NO: 4444071 - DNA, 16 bp, Homo sapiens
tttgaaaattgtatac

SEQ ID NO: 4444072 - DNA, 15 bp, Homo sapiens
tttgaaacctgctct

SEQ ID NO: 4444073 - DNA, 13 bp, Homo sapiens
tttgaaataaaaa

SEQ ID NO: 4444074 - DNA, 19 bp, Homo sapiens
tttgaaatagattttttca

SEQ ID NO: 4444075 - DNA, 19 bp, Homo sapiens
tttgaaatagtctgtgtga

SEQ ID NO: 4444076 - DNA, 21 bp, Homo sapiens
tttgaaatgaggtctgtttaa

SEQ ID NO: 4444077 - DNA, 17 bp, Homo sapiens
tttgaaattatgtgaca

SEQ ID NO: 4444078 - DNA, 13 bp, Homo sapiens
tttgaaattctga

SEQ ID NO: 4444079 - DNA, 16 bp, Homo sapiens
tttgaaattctgaatt

SEQ ID NO: 4444080 - DNA, 20 bp, Homo sapiens
tttgaacacgaaagaaatgt

SEQ ID NO: 4444081 - DNA, 18 bp, Homo sapiens
tttgaacctccaaatgga

SEQ ID NO: 4444082 - DNA, 18 bp, Homo sapiens
tttgaagaacatgtgaga

SEQ ID NO: 4444083 - DNA, 16 bp, Homo sapiens
tttgaagattctatgt

SEQ ID NO: 4444084 - DNA, 20 bp, Homo sapiens
tttgaagcatagctacaatt

SEQ ID NO: 4444085 - DNA, 21 bp, Homo sapiens
tttgaagcatagctacaattt

SEQ ID NO: 4444086 - DNA, 13 bp, Homo sapiens
tttgaaggaaacc

SEQ ID NO: 4444087 - DNA, 19 bp, Homo sapiens
tttgaaggtttcagatgag

SEQ ID NO: 4444088 - DNA, 22 bp, Homo sapiens
tttgaagtcataccaatgaaaa

SEQ ID NO: 4444089 - DNA, 20 bp, Homo sapiens
tttgaagtgctgtttattaa

SEQ ID NO: 4444090 - DNA, 23 bp, Homo sapiens
tttgaagttagctttaacttaaa

SEQ ID NO: 4444091 - DNA, 12 bp, Homo sapiens
tttgaataagca

SEQ ID NO: 4444092 - DNA, 22 bp, Homo sapiens
tttgaataagcagaacatactg

SEQ ID NO: 4444093 - DNA, 16 bp, Homo sapiens
tttgaatattactcct

SEQ ID NO: 4444094 - DNA, 15 bp, Homo sapiens
tttgaatattttttg

SEQ ID NO: 4444095 - DNA, 21 bp, Homo sapiens
tttgaatattttttgaaggtt

SEQ ID NO: 4444096 - DNA, 11 bp, Homo sapiens
tttgaatgtta

SEQ ID NO: 4444097 - DNA, 16 bp, Homo sapiens
tttgaatgttagatgc

SEQ ID NO: 4444098 - DNA, 20 bp, Homo sapiens
tttgaattcctcctctattt

SEQ ID NO: 4444099 - DNA, 15 bp, Homo sapiens
tttgacactgctcta

SEQ ID NO: 4444100 - DNA, 23 bp, Homo sapiens
tttgacatgacgtggtaaaatgt

SEQ ID NO: 4444101 - DNA, 14 bp, Homo sapiens
tttgacctatttta

SEQ ID NO: 4444102 - DNA, 19 bp, Homo sapiens
tttgactagatgatggatg

SEQ ID NO: 4444103 - DNA, 21 bp, Homo sapiens
tttgactagggattcaggctg

SEQ ID NO: 4444104 - DNA, 13 bp, Homo sapiens
tttgactgaaaaa

SEQ ID NO: 4444105 - DNA, 15 bp, Homo sapiens
tttgactgaaaaaaa

SEQ ID NO: 4444106 - DNA, 15 bp, Homo sapiens
tttgactgtaatgta

SEQ ID NO: 4444107 - DNA, 13 bp, Homo sapiens
tttgacttttctg

SEQ ID NO: 4444108 - DNA, 21 bp, Homo sapiens
tttgagagaaatatgaagaac

SEQ ID NO: 4444109 - DNA, 18 bp, Homo sapiens
tttgagagaagccacgct

SEQ ID NO: 4444110 - DNA, 22 bp, Homo sapiens
tttgagagacgccactccctgg

SEQ ID NO: 4444111 - DNA, 22 bp, Homo sapiens
tttgagagagagtcttactctg

SEQ ID NO: 4444112 - DNA, 23 bp, Homo sapiens
tttgagattaagaatgccaggaa

SEQ ID NO: 4444113 - DNA, 22 bp, Homo sapiens
tttgagattttttttccgtgtg

SEQ ID NO: 4444114 - DNA, 14 bp, Homo sapiens
tttgagcattagaa

SEQ ID NO: 4444115 - DNA, 19 bp, Homo sapiens
tttgagctagttacataaa

SEQ ID NO: 4444116 - DNA, 18 bp, Homo sapiens
tttgaggtatcactgcag

SEQ ID NO: 4444117 - DNA, 19 bp, Homo sapiens
tttgaggtctacattcttg

SEQ ID NO: 4444118 - DNA, 17 bp, Homo sapiens
tttgagtatggctatct

SEQ ID NO: 4444119 - DNA, 19 bp, Homo sapiens
tttgagtcaaagacttaaa

SEQ ID NO: 4444120 - DNA, 13 bp, Homo sapiens
tttgagtcattga

SEQ ID NO: 4444121 - DNA, 15 bp, Homo sapiens
tttgataactgttta

SEQ ID NO: 4444122 - DNA, 20 bp, Homo sapiens
tttgataactgtttatatgt

SEQ ID NO: 4444123 - DNA, 15 bp, Homo sapiens
tttgataatgataaa

SEQ ID NO: 4444124 - DNA, 21 bp, Homo sapiens
tttgatactaagcattgaatg

SEQ ID NO: 4444125 - DNA, 16 bp, Homo sapiens
tttgatagaggtaact

SEQ ID NO: 4444126 - DNA, 13 bp, Homo sapiens
tttgatataattg

SEQ ID NO: 4444127 - DNA, 22 bp, Homo sapiens
tttgatataccaaattaaaaaa

SEQ ID NO: 4444128 - DNA, 14 bp, Homo sapiens
tttgatatatgaaa

SEQ ID NO: 4444129 - DNA, 13 bp, Homo sapiens
tttgatatgtagt

SEQ ID NO: 4444130 - DNA, 13 bp, Homo sapiens
tttgatctttgtt

SEQ ID NO: 4444131 - DNA, 16 bp, Homo sapiens
tttgatctttgtttaa

SEQ ID NO: 4444132 - DNA, 21 bp, Homo sapiens
tttgatctttgtttaaatgcc

SEQ ID NO: 4444133 - DNA, 22 bp, Homo sapiens
tttgatctttgtttaaatgcca

SEQ ID NO: 4444134 - DNA, 21 bp, Homo sapiens
tttgatgaggtattttttcct

SEQ ID NO: 4444135 - DNA, 22 bp, Homo sapiens
tttgatgcagataaaatatttt

SEQ ID NO: 4444136 - DNA, 21 bp, Homo sapiens
tttgatgcagcatttgataat

SEQ ID NO: 4444137 - DNA, 17 bp, Homo sapiens
tttgatgcatgtctttt

SEQ ID NO: 4444138 - DNA, 20 bp, Homo sapiens
tttgatgcccaatatattct

SEQ ID NO: 4444139 - DNA, 13 bp, Homo sapiens
tttgatgtacatt

SEQ ID NO: 4444140 - DNA, 18 bp, Homo sapiens
tttgatgtacattacaga

SEQ ID NO: 4444141 - DNA, 14 bp, Homo sapiens
tttgatgtatatat

SEQ ID NO: 4444142 - DNA, 18 bp, Homo sapiens
tttgatgtcatgtgttcc

SEQ ID NO: 4444143 - DNA, 12 bp, Homo sapiens
tttgattaataa

SEQ ID NO: 4444144 - DNA, 22 bp, Homo sapiens
tttgattcaaaatatttaaaaa

SEQ ID NO: 4444145 - DNA, 16 bp, Homo sapiens
tttgattcaaggctca

SEQ ID NO: 4444146 - DNA, 13 bp, Homo sapiens
tttgattccattt

SEQ ID NO: 4444147 - DNA, 12 bp, Homo sapiens
tttgattctcct

SEQ ID NO: 4444148 - DNA, 13 bp, Homo sapiens
tttgattctcctt

SEQ ID NO: 4444149 - DNA, 21 bp, Homo sapiens
tttgattctccttcagccctc

SEQ ID NO: 4444150 - DNA, 14 bp, Homo sapiens
tttgatttaatgtt

SEQ ID NO: 4444151 - DNA, 21 bp, Homo sapiens
tttgcaacagcagtgttctgg

SEQ ID NO: 4444152 - DNA, 14 bp, Homo sapiens
tttgcaaccaggaa

SEQ ID NO: 4444153 - DNA, 24 bp, Homo sapiens
tttgcaaggtgcatttttactatt

SEQ ID NO: 4444154 - DNA, 17 bp, Homo sapiens
tttgcaataatgcagta

SEQ ID NO: 4444155 - DNA, 12 bp, Homo sapiens
tttgcaatagca

SEQ ID NO: 4444156 - DNA, 18 bp, Homo sapiens
tttgcacaagttccctgg

SEQ ID NO: 4444157 - DNA, 23 bp, Homo sapiens
tttgcacaagttccctggagaaa

SEQ ID NO: 4444158 - DNA, 16 bp, Homo sapiens
tttgcacaatatttct

SEQ ID NO: 4444159 - DNA, 15 bp, Homo sapiens
tttgcaccaaagaca

SEQ ID NO: 4444160 - DNA, 14 bp, Homo sapiens
tttgcactctgtaa

SEQ ID NO: 4444161 - DNA, 20 bp, Homo sapiens
tttgcactctgtaattgcac

SEQ ID NO: 4444162 - DNA, 12 bp, Homo sapiens
tttgcagagcct

SEQ ID NO: 4444163 - DNA, 20 bp, Homo sapiens
tttgcaggatctgtctgtgc

SEQ ID NO: 4444164 - DNA, 20 bp, Homo sapiens
tttgcagttggactctcagg

SEQ ID NO: 4444165 - DNA, 17 bp, Homo sapiens
tttgcataacaattcct

SEQ ID NO: 4444166 - DNA, 18 bp, Homo sapiens
tttgcataacaattcctc

SEQ ID NO: 4444167 - DNA, 22 bp, Homo sapiens
tttgcataacaattcctctact

SEQ ID NO: 4444168 - DNA, 18 bp, Homo sapiens
tttgcatattctctattt

SEQ ID NO: 4444169 - DNA, 15 bp, Homo sapiens
tttgcatccagcagc

SEQ ID NO: 4444170 - DNA, 17 bp, Homo sapiens
tttgcatgcgcccgagg

SEQ ID NO: 4444171 - DNA, 18 bp, Homo sapiens
tttgcattaaattcacaa

SEQ ID NO: 4444172 - DNA, 16 bp, Homo sapiens
tttgcatttaaaacag

SEQ ID NO: 4444173 - DNA, 23 bp, Homo sapiens
tttgcatttaaaacagacactgg

SEQ ID NO: 4444174 - DNA, 19 bp, Homo sapiens
tttgcatttttgttttgaa

SEQ ID NO: 4444175 - DNA, 21 bp, Homo sapiens
tttgccaaaataccagagcct

SEQ ID NO: 4444176 - DNA, 16 bp, Homo sapiens
tttgccaagctaatct

SEQ ID NO: 4444177 - DNA, 16 bp, Homo sapiens
tttgccagcagagcca

SEQ ID NO: 4444178 - DNA, 19 bp, Homo sapiens
tttgccagcagagccaggg

SEQ ID NO: 4444179 - DNA, 18 bp, Homo sapiens
tttgccagttttccctgg

SEQ ID NO: 4444180 - DNA, 19 bp, Homo sapiens
tttgccagttttccctgga

SEQ ID NO: 4444181 - DNA, 18 bp, Homo sapiens
tttgcccagaaagaagat

SEQ ID NO: 4444182 - DNA, 21 bp, Homo sapiens
tttgtgaactggaagaaagca

SEQ ID NO: 4444183 - DNA, 18 bp, Homo sapiens
tttgtgaaggtgatttat

SEQ ID NO: 4444184 - DNA, 18 bp, Homo sapiens
tttgtgaccagaaagctt

SEQ ID NO: 4444185 - DNA, 15 bp, Homo sapiens
tttgtgattcaatct

SEQ ID NO: 4444186 - DNA, 16 bp, Homo sapiens
tttgtgcctttggcct

SEQ ID NO: 4444187 - DNA, 20 bp, Homo sapiens
tttgtgctatagtatttgat

SEQ ID NO: 4444188 - DNA, 17 bp, Homo sapiens
tttgtgctgtgggcagc

SEQ ID NO: 4444189 - DNA, 18 bp, Homo sapiens
tttgtggattaaaccttt

SEQ ID NO: 4444190 - DNA, 12 bp, Homo sapiens
tttgtggcctca

SEQ ID NO: 4444191 - DNA, 15 bp, Homo sapiens
tttgtggcctcagaa

SEQ ID NO: 4444192 - DNA, 12 bp, Homo sapiens
tttgtgggactg

SEQ ID NO: 4444193 - DNA, 19 bp, Homo sapiens
tttgtggtaatctacacca

SEQ ID NO: 4444194 - DNA, 15 bp, Homo sapiens
tttgtggtttggaat

SEQ ID NO: 4444195 - DNA, 16 bp, Homo sapiens
tttgtggttttatgga

SEQ ID NO: 4444196 - DNA, 16 bp, Homo sapiens
tttgtgtaataaagtg

SEQ ID NO: 4444197 - DNA, 22 bp, Homo sapiens
tttgtgtaataaagtgttttca

SEQ ID NO: 4444198 - DNA, 12 bp, Homo sapiens
tttgtgtctctt

SEQ ID NO: 4444199 - DNA, 18 bp, Homo sapiens
tttgtgtggtatgtcact

SEQ ID NO: 4444200 - DNA, 22 bp, Homo sapiens
tttgtgtgttggctttgcagct

SEQ ID NO: 4444201 - DNA, 15 bp, Homo sapiens
tttgtgtgtttcaag

SEQ ID NO: 4444202 - DNA, 18 bp, Homo sapiens
tttgttaaaaccaaactg

SEQ ID NO: 4444203 - DNA, 14 bp, Homo sapiens
tttgttaacttttg

SEQ ID NO: 4444204 - DNA, 23 bp, Homo sapiens
tttgttaatataccccaaattgt

SEQ ID NO: 4444205 - DNA, 21 bp, Homo sapiens
tttgttaatgcattgttgtaa

SEQ ID NO: 4444206 - DNA, 21 bp, Homo sapiens
tttgttaatttagaaaacttt

SEQ ID NO: 4444207 - DNA, 15 bp, Homo sapiens
tttgttacttcctta

SEQ ID NO: 4444208 - DNA, 22 bp, Homo sapiens
tttgttactttacttttgctgt

SEQ ID NO: 4444209 - DNA, 20 bp, Homo sapiens
tttgttagcaaagattaaat

SEQ ID NO: 4444210 - DNA, 13 bp, Homo sapiens
tttgttcccctcc

SEQ ID NO: 4444211 - DNA, 21 bp, Homo sapiens
tttaaaaaagcttaaaacttt

SEQ ID NO: 4444212 - DNA, 17 bp, Homo sapiens
tttaaaaaattatggaa

SEQ ID NO: 4444213 - DNA, 19 bp, Homo sapiens
tttaaaaaattatggaata

SEQ ID NO: 4444214 - DNA, 20 bp, Homo sapiens
tttaaaaaattatggaatat

SEQ ID NO: 4444215 - DNA, 22 bp, Homo sapiens
tttaaaaaattatggaatatca

SEQ ID NO: 4444216 - DNA, 14 bp, Homo sapiens
tttaaaaacatttt

SEQ ID NO: 4444217 - DNA, 17 bp, Homo sapiens
tttaaaaacatttttta

SEQ ID NO: 4444218 - DNA, 14 bp, Homo sapiens
tttaaaaactgttt

SEQ ID NO: 4444219 - DNA, 11 bp, Homo sapiens
tttaaaaataa

SEQ ID NO: 4444220 - DNA, 20 bp, Homo sapiens
tttaaaaataagtcaacagt

SEQ ID NO: 4444221 - DNA, 21 bp, Homo sapiens
tttaaaaataagtcaacagta

SEQ ID NO: 4444222 - DNA, 23 bp, Homo sapiens
tttaaaaataagtcaacagtaaa

SEQ ID NO: 4444223 - DNA, 16 bp, Homo sapiens
tttaaaaatcaacttt

SEQ ID NO: 4444224 - DNA, 22 bp, Homo sapiens
tttaaaaatggtatcaaaatta

SEQ ID NO: 4444225 - DNA, 22 bp, Homo sapiens
tttaaaactgttggaatggatt

SEQ ID NO: 4444226 - DNA, 19 bp, Homo sapiens
tttaaaagcacgacagtgg

SEQ ID NO: 4444227 - DNA, 14 bp, Homo sapiens
tttaaaagcctgct

SEQ ID NO: 4444228 - DNA, 14 bp, Homo sapiens
tttaaaataaaata

SEQ ID NO: 4444229 - DNA, 15 bp, Homo sapiens
tttaaaataaaatga

SEQ ID NO: 4444230 - DNA, 16 bp, Homo sapiens
tttaaaataaaatgaa

SEQ ID NO: 4444231 - DNA, 18 bp, Homo sapiens
tttaaaataaaatgaaaa

SEQ ID NO: 4444232 - DNA, 17 bp, Homo sapiens
tttaaaatacttattaa

SEQ ID NO: 4444233 - DNA, 14 bp, Homo sapiens
tttaaaatcactaa

SEQ ID NO: 4444234 - DNA, 18 bp, Homo sapiens
tttaaaatcactaacatt

SEQ ID NO: 4444235 - DNA, 20 bp, Homo sapiens
tttaaaatcactaacattat

SEQ ID NO: 4444236 - DNA, 12 bp, Homo sapiens
tttaaaatctat

SEQ ID NO: 4444237 - DNA, 20 bp, Homo sapiens
tttaaaatctcctaaatgct

SEQ ID NO: 4444238 - DNA, 20 bp, Homo sapiens
tttaaaatgaatcttatgca

SEQ ID NO: 4444239 - DNA, 15 bp, Homo sapiens
tttaaaattgaatag

SEQ ID NO: 4444240 - DNA, 18 bp, Homo sapiens
tttaaaatttatttgcaa

SEQ ID NO: 4444241 - DNA, 15 bp, Homo sapiens
tttaaacattatttt

SEQ ID NO: 4444242 - DNA, 23 bp, Homo sapiens
tttaaaccgctaaaagaaacttt

SEQ ID NO: 4444243 - DNA, 11 bp, Homo sapiens
tttaaaccttt

SEQ ID NO: 4444244 - DNA, 19 bp, Homo sapiens
tttaaactgtgtacataac

SEQ ID NO: 4444245 - DNA, 21 bp, Homo sapiens
tttaaactgtgtacataactg

SEQ ID NO: 4444246 - DNA, 22 bp, Homo sapiens
tttaaactgtgtacataactga

SEQ ID NO: 4444247 - DNA, 13 bp, Homo sapiens
tttaaacttgaaa

SEQ ID NO: 4444248 - DNA, 15 bp, Homo sapiens
tttaaacttgaaata

SEQ ID NO: 4444249 - DNA, 17 bp, Homo sapiens
tttaaacttgaaatata

SEQ ID NO: 4444250 - DNA, 16 bp, Homo sapiens
tttaaactttcaatat

SEQ ID NO: 4444251 - DNA, 14 bp, Homo sapiens
tttaaactttttaa

SEQ ID NO: 4444252 - DNA, 12 bp, Homo sapiens
tttaaagaaagt

SEQ ID NO: 4444253 - DNA, 12 bp, Homo sapiens
tttaaagaattg

SEQ ID NO: 4444254 - DNA, 15 bp, Homo sapiens
tttaaagacctgaca

SEQ ID NO: 4444255 - DNA, 15 bp, Homo sapiens
tttaaagatttgttt

SEQ ID NO: 4444256 - DNA, 18 bp, Homo sapiens
tttaaagccattctgatt

SEQ ID NO: 4444257 - DNA, 20 bp, Homo sapiens
tttaaagtaaacttgtgtat

SEQ ID NO: 4444258 - DNA, 23 bp, Homo sapiens
tttaaagttcttattttagtata

SEQ ID NO: 4444259 - DNA, 15 bp, Homo sapiens
tttaaataaaagcac

SEQ ID NO: 4444260 - DNA, 12 bp, Homo sapiens
tttaaataaaat

SEQ ID NO: 4444261 - DNA, 13 bp, Homo sapiens
tttaaataaatta

SEQ ID NO: 4444262 - DNA, 21 bp, Homo sapiens
tttaaataaattaagatccta

SEQ ID NO: 4444263 - DNA, 17 bp, Homo sapiens
tttaaatattttctatt

SEQ ID NO: 4444264 - DNA, 15 bp, Homo sapiens
tttaaatcaaggaaa

SEQ ID NO: 4444265 - DNA, 12 bp, Homo sapiens
tttaaatgccaa

SEQ ID NO: 4444266 - DNA, 18 bp, Homo sapiens
tttaaatgccaaaatgta

SEQ ID NO: 4444267 - DNA, 17 bp, Homo sapiens
tttaaatggaataatta

SEQ ID NO: 4444268 - DNA, 20 bp, Homo sapiens
tttaaatggaataattagct

SEQ ID NO: 4444269 - DNA, 18 bp, Homo sapiens
tttaaatgtaaagatatt

SEQ ID NO: 4444270 - DNA, 13 bp, Homo sapiens
tttaaatgtatac

SEQ ID NO: 4444271 - DNA, 14 bp, Homo sapiens
tttaaatgtgtaca

SEQ ID NO: 4444272 - DNA, 23 bp, Homo sapiens
tttaaatgtgtacaatgtacaca

SEQ ID NO: 4444273 - DNA, 17 bp, Homo sapiens
tttaaatgtgtatttct

SEQ ID NO: 4444274 - DNA, 16 bp, Homo sapiens
tttaaattaatatctt

SEQ ID NO: 4444275 - DNA, 13 bp, Homo sapiens
tttaaattacaat

SEQ ID NO: 4444276 - DNA, 22 bp, Homo sapiens
tttaaattagaaaatattctct

SEQ ID NO: 4444277 - DNA, 21 bp, Homo sapiens
tttaaattataaggactgcat

SEQ ID NO: 4444278 - DNA, 14 bp, Homo sapiens
tttaaattatatga

SEQ ID NO: 4444279 - DNA, 18 bp, Homo sapiens
tttaaattccactgaaaa

SEQ ID NO: 4444280 - DNA, 11 bp, Homo sapiens
tttaaattgtg

SEQ ID NO: 4444281 - DNA, 14 bp, Homo sapiens
tttaaattttatgt

SEQ ID NO: 4444282 - DNA, 19 bp, Homo sapiens
tttaaattttgtatgccaa

SEQ ID NO: 4444283 - DNA, 18 bp, Homo sapiens
tttaaatttttttcctta

SEQ ID NO: 4444284 - DNA, 20 bp, Homo sapiens
tttaacaaatgactgtatct

SEQ ID NO: 4444285 - DNA, 21 bp, Homo sapiens
tttaacaatccattcacaagc

SEQ ID NO: 4444286 - DNA, 12 bp, Homo sapiens
tttaacagaaat

SEQ ID NO: 4444287 - DNA, 14 bp, Homo sapiens
tttaacagaaattg

SEQ ID NO: 4444288 - DNA, 16 bp, Homo sapiens
tttaacagaaattgta

SEQ ID NO: 4444289 - DNA, 16 bp, Homo sapiens
tttaacctttgataga

SEQ ID NO: 4444290 - DNA, 14 bp, Homo sapiens
tttaacgctgccta

SEQ ID NO: 4444291 - DNA, 16 bp, Homo sapiens
tttaactaataaaata

SEQ ID NO: 4444292 - DNA, 14 bp, Homo sapiens
tttaactatgtaat

SEQ ID NO: 4444293 - DNA, 18 bp, Homo sapiens
tttaactctagaatttgg

SEQ ID NO: 4444294 - DNA, 14 bp, Homo sapiens
tttaactgacaagc

SEQ ID NO: 4444295 - DNA, 21 bp, Homo sapiens
tttaactgattaaaaatacct

SEQ ID NO: 4444296 - DNA, 17 bp, Homo sapiens
tttaactgtggatattg

SEQ ID NO: 4444297 - DNA, 13 bp, Homo sapiens
tttaacttaaata

SEQ ID NO: 4444298 - DNA, 19 bp, Homo sapiens
tttaactttaccaaatgaa

SEQ ID NO: 4444299 - DNA, 21 bp, Homo sapiens
tttaactttaccaaatgaaat

SEQ ID NO: 4444300 - DNA, 24 bp, Homo sapiens
tttaactttttgtttttatttctt

SEQ ID NO: 4444301 - DNA, 17 bp, Homo sapiens
tttaagaactaaaatgt

SEQ ID NO: 4444302 - DNA, 16 bp, Homo sapiens
tttaagaagaaagatt

SEQ ID NO: 4444303 - DNA, 17 bp, Homo sapiens
tttaagaagaaagattt

SEQ ID NO: 4444304 - DNA, 16 bp, Homo sapiens
tttaagaatattttta

SEQ ID NO: 4444305 - DNA, 18 bp, Homo sapiens
tttaagaatatttttaga

SEQ ID NO: 4444306 - DNA, 11 bp, Homo sapiens
tttaagaattt

SEQ ID NO: 4444307 - DNA, 17 bp, Homo sapiens
tttaagatgtacattta

SEQ ID NO: 4444308 - DNA, 22 bp, Homo sapiens
tttaagatgtacatttaataat

SEQ ID NO: 4444309 - DNA, 17 bp, Homo sapiens
tttaagcaagttaagtg

SEQ ID NO: 4444310 - DNA, 19 bp, Homo sapiens
tttaaggataaatcataaa

SEQ ID NO: 4444311 - DNA, 20 bp, Homo sapiens
tttaaggatggggttatgaa

SEQ ID NO: 4444312 - DNA, 16 bp, Homo sapiens
tttaaggggagaaaat

SEQ ID NO: 4444313 - DNA, 20 bp, Homo sapiens
tttaagtaacgtgctcactg

SEQ ID NO: 4444314 - DNA, 21 bp, Homo sapiens
tttaagtaacgtgctcactgt

SEQ ID NO: 4444315 - DNA, 12 bp, Homo sapiens
tttaagtcattt

SEQ ID NO: 4444316 - DNA, 14 bp, Homo sapiens
tttaagtcattttt

SEQ ID NO: 4444317 - DNA, 23 bp, Homo sapiens
tttaagtcattttttacttgaat

SEQ ID NO: 4444318 - DNA, 15 bp, Homo sapiens
tttaagtgaaaatgg

SEQ ID NO: 4444319 - DNA, 13 bp, Homo sapiens
tttaagtgaagga

SEQ ID NO: 4444320 - DNA, 23 bp, Homo sapiens
tttaagtgacataattgtccagt

SEQ ID NO: 4444321 - DNA, 17 bp, Homo sapiens
tttaagtgttggaaaaa

SEQ ID NO: 4444322 - DNA, 14 bp, Homo sapiens
tttaagttctattc

SEQ ID NO: 4444323 - DNA, 19 bp, Homo sapiens
tttaagttcttatgaggag

SEQ ID NO: 4444324 - DNA, 13 bp, Homo sapiens
tttaagtttgaag

SEQ ID NO: 4444325 - DNA, 14 bp, Homo sapiens
tttaagtttgaaga

SEQ ID NO: 4444326 - DNA, 20 bp, Homo sapiens
tttaagtttgttgctgtcaa

SEQ ID NO: 4444327 - DNA, 14 bp, Homo sapiens
tttaataaaaagga

SEQ ID NO: 4444328 - DNA, 21 bp, Homo sapiens
tttaataaactactctttgat

SEQ ID NO: 4444329 - DNA, 16 bp, Homo sapiens
tttaataaagtagtta

SEQ ID NO: 4444330 - DNA, 17 bp, Homo sapiens
tttagtgctttgtgata

SEQ ID NO: 4444331 - DNA, 22 bp, Homo sapiens
tttagtgtgaatattcctttat

SEQ ID NO: 4444332 - DNA, 22 bp, Homo sapiens
tttagtgtgtaaaattaatgta

SEQ ID NO: 4444333 - DNA, 16 bp, Homo sapiens
tttagttactttagat

SEQ ID NO: 4444334 - DNA, 18 bp, Homo sapiens
tttagtttgttcttcaga

SEQ ID NO: 4444335 - DNA, 12 bp, Homo sapiens
tttagttttaca

SEQ ID NO: 4444336 - DNA, 18 bp, Homo sapiens
tttagttttacattttaa

SEQ ID NO: 4444337 - DNA, 13 bp, Homo sapiens
tttagtttttcat

SEQ ID NO: 4444338 - DNA, 15 bp, Homo sapiens
tttagtttttcatta

SEQ ID NO: 4444339 - DNA, 16 bp, Homo sapiens
tttataaaaatataaa

SEQ ID NO: 4444340 - DNA, 22 bp, Homo sapiens
tttataaaagtgttcattgttt

SEQ ID NO: 4444341 - DNA, 16 bp, Homo sapiens
tttataaaatggctgt

SEQ ID NO: 4444342 - DNA, 19 bp, Homo sapiens
tttataaagatcatttata

SEQ ID NO: 4444343 - DNA, 14 bp, Homo sapiens
ttcctttatgtgaa

SEQ ID NO: 4444344 - DNA, 18 bp, Homo sapiens
ttcctttccctttagcac

SEQ ID NO: 4444345 - DNA, 17 bp, Homo sapiens
ttcctttcttttccccc

SEQ ID NO: 4444346 - DNA, 13 bp, Homo sapiens
ttcctttgtgctt

SEQ ID NO: 4444347 - DNA, 21 bp, Homo sapiens
ttcctttttattccttttaaa

SEQ ID NO: 4444348 - DNA, 14 bp, Homo sapiens
ttcctttttcagat

SEQ ID NO: 4444349 - DNA, 15 bp, Homo sapiens
ttcctttttgacact

SEQ ID NO: 4444350 - DNA, 16 bp, Homo sapiens
ttcctttttgacactg

SEQ ID NO: 4444351 - DNA, 17 bp, Homo sapiens
ttcctttttgacactga

SEQ ID NO: 4444352 - DNA, 18 bp, Homo sapiens
ttccttttttaaaataaa

SEQ ID NO: 4444353 - DNA, 19 bp, Homo sapiens
ttccttttttcaatatgca

SEQ ID NO: 4444354 - DNA, 23 bp, Homo sapiens
ttccttttttcaatatgcaagca

SEQ ID NO: 4444355 - DNA, 17 bp, Homo sapiens
ttccttttttgagattt

SEQ ID NO: 4444356 - DNA, 19 bp, Homo sapiens
ttcgaatatatctgtaaag

SEQ ID NO: 4444357 - DNA, 17 bp, Homo sapiens
ttcgaatctctgcccct

SEQ ID NO: 4444358 - DNA, 22 bp, Homo sapiens
ttcgaatcttaatttattattt

SEQ ID NO: 4444359 - DNA, 23 bp, Homo sapiens
ttcgaatcttaatttattatttt

SEQ ID NO: 4444360 - DNA, 13 bp, Homo sapiens
ttcgagactccat

SEQ ID NO: 4444361 - DNA, 20 bp, Homo sapiens
ttcgataaacaacaaggtgg

SEQ ID NO: 4444362 - DNA, 22 bp, Homo sapiens
ttctcccagtatgttttaacaa

SEQ ID NO: 4444363 - DNA, 23 bp, Homo sapiens
ttctcccagtatgttttaacaaa

SEQ ID NO: 4444364 - DNA, 13 bp, Homo sapiens
ttctccccagaat

SEQ ID NO: 4444365 - DNA, 19 bp, Homo sapiens
ttctccctgaccttagcgt

SEQ ID NO: 4444366 - DNA, 22 bp, Homo sapiens
ttctcccttaggaatatacata

SEQ ID NO: 4444367 - DNA, 18 bp, Homo sapiens
ttctccctttctctctcc

SEQ ID NO: 4444368 - DNA, 19 bp, Homo sapiens
ttctccctttctctctcct

SEQ ID NO: 4444369 - DNA, 24 bp, Homo sapiens
ttctccctttctctctcctctctg

SEQ ID NO: 4444370 - DNA, 14 bp, Homo sapiens
ttctccgccagcct

SEQ ID NO: 4444371 - DNA, 20 bp, Homo sapiens
ttctccgccagcctcctctg

SEQ ID NO: 4444372 - DNA, 13 bp, Homo sapiens
ttctcctgaatat

SEQ ID NO: 4444373 - DNA, 20 bp, Homo sapiens
ttctcctgcaaatttagttt

SEQ ID NO: 4444374 - DNA, 19 bp, Homo sapiens
ttctcctgccctttcccag

SEQ ID NO: 4444375 - DNA, 13 bp, Homo sapiens
ttctcctgcctca

SEQ ID NO: 4444376 - DNA, 13 bp, Homo sapiens
ttctcctggtaga

SEQ ID NO: 4444377 - DNA, 14 bp, Homo sapiens
ttctccttttccta

SEQ ID NO: 4444378 - DNA, 21 bp, Homo sapiens
ttctcgccccttccctctctc

SEQ ID NO: 4444379 - DNA, 21 bp, Homo sapiens
ttctcggggtgggacagacga

SEQ ID NO: 4444380 - DNA, 16 bp, Homo sapiens
ttctctaactcctgcc

SEQ ID NO: 4444381 - DNA, 17 bp, Homo sapiens
ttctctaactcctgcca

SEQ ID NO: 4444382 - DNA, 18 bp, Homo sapiens
ttctctaactcctgccat

SEQ ID NO: 4444383 - DNA, 23 bp, Homo sapiens
ttctctacaggcctcttcctgtt

SEQ ID NO: 4444384 - DNA, 16 bp, Homo sapiens
ttctctataaaaaata

SEQ ID NO: 4444385 - DNA, 15 bp, Homo sapiens
ttctctattaaaatg

SEQ ID NO: 4444386 - DNA, 14 bp, Homo sapiens
ttctctcaaggaga

SEQ ID NO: 4444387 - DNA, 21 bp, Homo sapiens
ttctctcatagaacattgatc

SEQ ID NO: 4444388 - DNA, 23 bp, Homo sapiens
ttctctcatagaacattgatctg

SEQ ID NO: 4444389 - DNA, 12 bp, Homo sapiens
ttctctcatcta

SEQ ID NO: 4444390 - DNA, 12 bp, Homo sapiens
ttctctccagct

SEQ ID NO: 4444391 - DNA, 14 bp, Homo sapiens
ttctctccccagcc

SEQ ID NO: 4444392 - DNA, 23 bp, Homo sapiens
ttctctccccagccccctcccac

SEQ ID NO: 4444393 - DNA, 14 bp, Homo sapiens
ttctctcctcccca

SEQ ID NO: 4444394 - DNA, 14 bp, Homo sapiens
ttctctctcctctc

SEQ ID NO: 4444395 - DNA, 20 bp, Homo sapiens
ttctctcttttaaagtattt

SEQ ID NO: 4444396 - DNA, 16 bp, Homo sapiens
ttctctgagctgtgca

SEQ ID NO: 4444397 - DNA, 16 bp, Homo sapiens
ttctctgcaattttac

SEQ ID NO: 4444398 - DNA, 21 bp, Homo sapiens
ttctctgcaattttactgtga

SEQ ID NO: 4444399 - DNA, 10 bp, Homo sapiens
ttctctgcag

SEQ ID NO: 4444400 - DNA, 21 bp, Homo sapiens
ttctctgcagtaaaacacatt

SEQ ID NO: 4444401 - DNA, 12 bp, Homo sapiens
ttctctgcccag

SEQ ID NO: 4444402 - DNA, 12 bp, Homo sapiens
ttctctgccttt

SEQ ID NO: 4444403 - DNA, 16 bp, Homo sapiens
ttctctggctggaata

SEQ ID NO: 4444404 - DNA, 14 bp, Homo sapiens
ttctctgtactttt

SEQ ID NO: 4444405 - DNA, 13 bp, Homo sapiens
ttctctgtgaaag

SEQ ID NO: 4444406 - DNA, 19 bp, Homo sapiens
ttctcttaagattaatttt

SEQ ID NO: 4444407 - DNA, 18 bp, Homo sapiens
ttctcttagcaactcaga

SEQ ID NO: 4444408 - DNA, 18 bp, Homo sapiens
ttctcttccttttatata

SEQ ID NO: 4444409 - DNA, 20 bp, Homo sapiens
ttctcttccttttatcagta

SEQ ID NO: 4444410 - DNA, 14 bp, Homo sapiens
ttctcttgctttct

SEQ ID NO: 4444411 - DNA, 17 bp, Homo sapiens
ttctcttgggaactgaa

SEQ ID NO: 4444412 - DNA, 22 bp, Homo sapiens
ttctcttgggaactgaactcac

SEQ ID NO: 4444413 - DNA, 12 bp, Homo sapiens
ttctctttgtgc

SEQ ID NO: 4444414 - DNA, 15 bp, Homo sapiens
ttctctttgtgcagt

SEQ ID NO: 4444415 - DNA, 22 bp, Homo sapiens
ttctcttttctagtttgctcat

SEQ ID NO: 4444416 - DNA, 16 bp, Homo sapiens
ttctcttttctttctg

SEQ ID NO: 4444417 - DNA, 18 bp, Homo sapiens
ttctgaactcaaactgag

SEQ ID NO: 4444418 - DNA, 14 bp, Homo sapiens
ttctgaactgttac

SEQ ID NO: 4444419 - DNA, 22 bp, Homo sapiens
ttctgaactgttacaacttgta

SEQ ID NO: 4444420 - DNA, 19 bp, Homo sapiens
ttctgaagctgacagcact

SEQ ID NO: 4444421 - DNA, 16 bp, Homo sapiens
ttctgaaggaagagaa

SEQ ID NO: 4444422 - DNA, 18 bp, Homo sapiens
ttctgaagtttcctatga

SEQ ID NO: 4444423 - DNA, 13 bp, Homo sapiens
ttctgaagtttta

SEQ ID NO: 4444424 - DNA, 23 bp, Homo sapiens
ttctgaatcaccaattaaaaacc

SEQ ID NO: 4444425 - DNA, 15 bp, Homo sapiens
ttctgaatttgcaaa

SEQ ID NO: 4444426 - DNA, 19 bp, Homo sapiens
ttctgaatttgcaaagtac

SEQ ID NO: 4444427 - DNA, 20 bp, Homo sapiens
ttctgaatttgcaaagtact

SEQ ID NO: 4444428 - DNA, 15 bp, Homo sapiens
ttctgagaaagacta

SEQ ID NO: 4444429 - DNA, 19 bp, Homo sapiens
ttctgagattcaatattga

SEQ ID NO: 4444430 - DNA, 20 bp, Homo sapiens
ttctgagcaccgaatattga

SEQ ID NO: 4444431 - DNA, 23 bp, Homo sapiens
ttctgagcaggggcccctgggga

SEQ ID NO: 4444432 - DNA, 23 bp, Homo sapiens
ttctgagctatttcatctatttt

SEQ ID NO: 4444433 - DNA, 15 bp, Homo sapiens
ttctgagtgccttct

SEQ ID NO: 4444434 - DNA, 22 bp, Homo sapiens
ttctgagtgccttctgtgggga

SEQ ID NO: 4444435 - DNA, 16 bp, Homo sapiens
ttctgagttttgtgtt

SEQ ID NO: 4444436 - DNA, 19 bp, Homo sapiens
ttctgagttttgtgtttgt

SEQ ID NO: 4444437 - DNA, 23 bp, Homo sapiens
ttctgagttttgtgtttgttgta

SEQ ID NO: 4444438 - DNA, 20 bp, Homo sapiens
ttctgatatgtgaatttgtt

SEQ ID NO: 4444439 - DNA, 22 bp, Homo sapiens
ttctgatcttggaaaaacagcg

SEQ ID NO: 4444440 - DNA, 18 bp, Homo sapiens
ttctgatgaaatgttaac

SEQ ID NO: 4444441 - DNA, 13 bp, Homo sapiens
ttctgatgtttat

SEQ ID NO: 4444442 - DNA, 22 bp, Homo sapiens
ttctgattatgtaagcatttgt

SEQ ID NO: 4444443 - DNA, 20 bp, Homo sapiens
ttctgatttctgaagtgctt

SEQ ID NO: 4444444 - DNA, 15 bp, Homo sapiens
ttctgcaaatagaaa

SEQ ID NO: 4444445 - DNA, 21 bp, Homo sapiens
ttctgcagacgtctgccttgg

SEQ ID NO: 4444446 - DNA, 18 bp, Homo sapiens
ttctgcagcaactcccac

SEQ ID NO: 4444447 - DNA, 22 bp, Homo sapiens
ttctgcagtaaatcttttacaa

SEQ ID NO: 4444448 - DNA, 23 bp, Homo sapiens
ttctgcatatgttgaatactttt

SEQ ID NO: 4444449 - DNA, 13 bp, Homo sapiens
ttctgcattacta

SEQ ID NO: 4444450 - DNA, 21 bp, Homo sapiens
ttctgcattcatttttatagc

SEQ ID NO: 4444451 - DNA, 18 bp, Homo sapiens
ttctgccaccagcccctc

SEQ ID NO: 4444452 - DNA, 16 bp, Homo sapiens
ttctgccagggagctt

SEQ ID NO: 4444453 - DNA, 16 bp, Homo sapiens
ttctgccctggctgct

SEQ ID NO: 4444454 - DNA, 12 bp, Homo sapiens
ttctgcctcctg

SEQ ID NO: 4444455 - DNA, 14 bp, Homo sapiens
ttctgcctccttta

SEQ ID NO: 4444456 - DNA, 14 bp, Homo sapiens
ttctgcctctctgg

SEQ ID NO: 4444457 - DNA, 15 bp, Homo sapiens
ttctgcctgttataa

SEQ ID NO: 4444458 - DNA, 14 bp, Homo sapiens
ttctgccttctcat

SEQ ID NO: 4444459 - DNA, 16 bp, Homo sapiens
ttctgccttctcatga

SEQ ID NO: 4444460 - DNA, 16 bp, Homo sapiens
ttctgcggggctgaga

SEQ ID NO: 4444461 - DNA, 17 bp, Homo sapiens
ttctgctacttcactgt

SEQ ID NO: 4444462 - DNA, 19 bp, Homo sapiens
ttctgctcatcattctctg

SEQ ID NO: 4444463 - DNA, 13 bp, Homo sapiens
ttctgctccaccc

SEQ ID NO: 4444464 - DNA, 17 bp, Homo sapiens
ttctgctccacccttgg

SEQ ID NO: 4444465 - DNA, 14 bp, Homo sapiens
ttctgctctggaat

SEQ ID NO: 4444466 - DNA, 23 bp, Homo sapiens
ttctgctctggaataaagttgca

SEQ ID NO: 4444467 - DNA, 21 bp, Homo sapiens
ttctgctctggttgtttctgt

SEQ ID NO: 4444468 - DNA, 15 bp, Homo sapiens
ttctgctcttttcct

SEQ ID NO: 4444469 - DNA, 14 bp, Homo sapiens
ttctgctgctggcc

SEQ ID NO: 4444470 - DNA, 14 bp, Homo sapiens
ttctgctggccaag

SEQ ID NO: 4444471 - DNA, 19 bp, Homo sapiens
ttctgctttctttgattct

SEQ ID NO: 4444472 - DNA, 18 bp, Homo sapiens
ttctgcttttaagttttt

SEQ ID NO: 4444473 - DNA, 17 bp, Homo sapiens
ttctgcttttctgccct

SEQ ID NO: 4444474 - DNA, 15 bp, Homo sapiens
ttctggactctgccc

SEQ ID NO: 4444475 - DNA, 16 bp, Homo sapiens
ttctggactctgcccc

SEQ ID NO: 4444476 - DNA, 20 bp, Homo sapiens
ttctggactctgccccaatc

SEQ ID NO: 4444477 - DNA, 21 bp, Homo sapiens
ttctggactggcgttcacctc

SEQ ID NO: 4444478 - DNA, 10 bp, Homo sapiens
ttctggagtt

SEQ ID NO: 4444479 - DNA, 19 bp, Homo sapiens
ttctggattagaatgccgg

SEQ ID NO: 4444480 - DNA, 14 bp, Homo sapiens
ttcttgtatctgga

SEQ ID NO: 4444481 - DNA, 22 bp, Homo sapiens
ttcttgtatctggattcaaatt

SEQ ID NO: 4444482 - DNA, 14 bp, Homo sapiens
ttcttgtctttatt

SEQ ID NO: 4444483 - DNA, 13 bp, Homo sapiens
ttcttgtgtagat

SEQ ID NO: 4444484 - DNA, 18 bp, Homo sapiens
ttcttgtgtagatttgaa

SEQ ID NO: 4444485 - DNA, 14 bp, Homo sapiens
ttcttgtttgaatt

SEQ ID NO: 4444486 - DNA, 16 bp, Homo sapiens
ttctttaaaagaatga

SEQ ID NO: 4444487 - DNA, 19 bp, Homo sapiens
ttctttaactgccgtaatt

SEQ ID NO: 4444488 - DNA, 23 bp, Homo sapiens
ttctttagagaatccgtattgaa

SEQ ID NO: 4444489 - DNA, 13 bp, Homo sapiens
ttctttatagtga

SEQ ID NO: 4444490 - DNA, 20 bp, Homo sapiens
ttctttatagtgaagtgtta

SEQ ID NO: 4444491 - DNA, 20 bp, Homo sapiens
ttgaataggaaataaaatta

SEQ ID NO: 4444492 - DNA, 18 bp, Homo sapiens
ttgaatagtggaacattt

SEQ ID NO: 4444493 - DNA, 17 bp, Homo sapiens
ttgaatataaaaaatca

SEQ ID NO: 4444494 - DNA, 13 bp, Homo sapiens
ttgaatattactc

SEQ ID NO: 4444495 - DNA, 16 bp, Homo sapiens
ttgaatattttttgaa

SEQ ID NO: 4444496 - DNA, 23 bp, Homo sapiens
ttgaatcaataatatattttctg

SEQ ID NO: 4444497 - DNA, 22 bp, Homo sapiens
ttgaatcagatggtgtcattta

SEQ ID NO: 4444498 - DNA, 12 bp, Homo sapiens
ttgaatgaaatt

SEQ ID NO: 4444499 - DNA, 15 bp, Homo sapiens
ttgaatgcaaaccat

SEQ ID NO: 4444500 - DNA, 16 bp, Homo sapiens
ttgaatgcaaaccata

SEQ ID NO: 4444501 - DNA, 10 bp, Homo sapiens
ttgaatgttt

SEQ ID NO: 4444502 - DNA, 23 bp, Homo sapiens
ttgaattaaattaggaataaata

SEQ ID NO: 4444503 - DNA, 20 bp, Homo sapiens
ttgaattatcttggttgaaa

SEQ ID NO: 4444504 - DNA, 22 bp, Homo sapiens
ttgaattatcttggttgaaaat

SEQ ID NO: 4444505 - DNA, 13 bp, Homo sapiens
ttgaattcctctc

SEQ ID NO: 4444506 - DNA, 15 bp, Homo sapiens
ttgaattcctctcaa

SEQ ID NO: 4444507 - DNA, 17 bp, Homo sapiens
ttgaatttcactgtctt

SEQ ID NO: 4444508 - DNA, 13 bp, Homo sapiens
ttgaatttttcct

SEQ ID NO: 4444509 - DNA, 18 bp, Homo sapiens
ttgacaaaggcaagcact

SEQ ID NO: 4444510 - DNA, 13 bp, Homo sapiens
ttgacaataaaat

SEQ ID NO: 4444511 - DNA, 15 bp, Homo sapiens
ttgacaataaaatat

SEQ ID NO: 4444512 - DNA, 18 bp, Homo sapiens
ttgacaccacttagattt

SEQ ID NO: 4444513 - DNA, 22 bp, Homo sapiens
ttgacaccacttagatttaaag

SEQ ID NO: 4444514 - DNA, 11 bp, Homo sapiens
ttgacactgaa

SEQ ID NO: 4444515 - DNA, 22 bp, Homo sapiens
ttgacactgaaagttttgtaaa

SEQ ID NO: 4444516 - DNA, 19 bp, Homo sapiens
ttgacacttttcatatcat

SEQ ID NO: 4444517 - DNA, 14 bp, Homo sapiens
ttgacagaagctat

SEQ ID NO: 4444518 - DNA, 14 bp, Homo sapiens
ttgacagactattt

SEQ ID NO: 4444519 - DNA, 16 bp, Homo sapiens
ttgacatatttaatgt

SEQ ID NO: 4444520 - DNA, 17 bp, Homo sapiens
ttgacatatttaatgtt

SEQ ID NO: 4444521 - DNA, 22 bp, Homo sapiens
ttgacatgacgtggtaaaatgt

SEQ ID NO: 4444522 - DNA, 18 bp, Homo sapiens
ttgacattgcgtttgacc

SEQ ID NO: 4444523 - DNA, 18 bp, Homo sapiens
ttgaccactccagagaag

SEQ ID NO: 4444524 - DNA, 14 bp, Homo sapiens
ttgaccagtttctt

SEQ ID NO: 4444525 - DNA, 15 bp, Homo sapiens
ttgaccagtttcttt

SEQ ID NO: 4444526 - DNA, 15 bp, Homo sapiens
ttgaccattggctgc

SEQ ID NO: 4444527 - DNA, 14 bp, Homo sapiens
ttgacccacaagaa

SEQ ID NO: 4444528 - DNA, 18 bp, Homo sapiens
ttgacccaggtggctagc

SEQ ID NO: 4444529 - DNA, 17 bp, Homo sapiens
ttgacctttatttatta

SEQ ID NO: 4444530 - DNA, 22 bp, Homo sapiens
ttgacgtcactttttggccatg

SEQ ID NO: 4444531 - DNA, 14 bp, Homo sapiens
ttgactaattttac

SEQ ID NO: 4444532 - DNA, 15 bp, Homo sapiens
ttgactaattttaca

SEQ ID NO: 4444533 - DNA, 16 bp, Homo sapiens
ttgactcctttccaat

SEQ ID NO: 4444534 - DNA, 12 bp, Homo sapiens
ttgactctgggg

SEQ ID NO: 4444535 - DNA, 18 bp, Homo sapiens
ttgactctggggtgcagc

SEQ ID NO: 4444536 - DNA, 17 bp, Homo sapiens
ttgactttttgcattta

SEQ ID NO: 4444537 - DNA, 17 bp, Homo sapiens
ttgactttttttgtatg

SEQ ID NO: 4444538 - DNA, 11 bp, Homo sapiens
ttgagaaaaat

SEQ ID NO: 4444539 - DNA, 19 bp, Homo sapiens
ttgagaaaaatatatacta

SEQ ID NO: 4444540 - DNA, 21 bp, Homo sapiens
ttgagaaatatggacacttaa

SEQ ID NO: 4444541 - DNA, 19 bp, Homo sapiens
ttgagaaccagtctcctca

SEQ ID NO: 4444542 - DNA, 23 bp, Homo sapiens
ttgagaaccagtctcctcactct

SEQ ID NO: 4444543 - DNA, 17 bp, Homo sapiens
ttgagaataagaatttg

SEQ ID NO: 4444544 - DNA, 20 bp, Homo sapiens
ttgagaatcactgctccagg

SEQ ID NO: 4444545 - DNA, 21 bp, Homo sapiens
ttgagaatcactgctccaggc

SEQ ID NO: 4444546 - DNA, 23 bp, Homo sapiens
ttgagaatcccaaatttgattga

SEQ ID NO: 4444547 - DNA, 14 bp, Homo sapiens
ttgagacctcagcc

SEQ ID NO: 4444548 - DNA, 16 bp, Homo sapiens
ttgagactttttggtg

SEQ ID NO: 4444549 - DNA, 23 bp, Homo sapiens
ttgagagaaatatgaagaactga

SEQ ID NO: 4444550 - DNA, 13 bp, Homo sapiens
ttgagagaagcca

SEQ ID NO: 4444551 - DNA, 18 bp, Homo sapiens
ttgagagaagccacgctg

SEQ ID NO: 4444552 - DNA, 16 bp, Homo sapiens
ttgagaggctgaggtg

SEQ ID NO: 4444553 - DNA, 16 bp, Homo sapiens
ttgagattatatttcc

SEQ ID NO: 4444554 - DNA, 23 bp, Homo sapiens
ttgagattcaaacccaggctgtc

SEQ ID NO: 4444555 - DNA, 19 bp, Homo sapiens
ttgagattgccccaggtct

SEQ ID NO: 4444556 - DNA, 15 bp, Homo sapiens
ttgagcaatttcccc

SEQ ID NO: 4444557 - DNA, 14 bp, Homo sapiens
ttgagcagaattca

SEQ ID NO: 4444558 - DNA, 18 bp, Homo sapiens
ttgagcaggattagataa

SEQ ID NO: 4444559 - DNA, 17 bp, Homo sapiens
ttgagcccattcttctg

SEQ ID NO: 4444560 - DNA, 19 bp, Homo sapiens
ttgagcccattcttctggg

SEQ ID NO: 4444561 - DNA, 15 bp, Homo sapiens
ttgagccctggctgt

SEQ ID NO: 4444562 - DNA, 20 bp, Homo sapiens
ttgagccgggcccctgggct

SEQ ID NO: 4444563 - DNA, 23 bp, Homo sapiens
ttgagctcagacccccactctca

SEQ ID NO: 4444564 - DNA, 12 bp, Homo sapiens
ttgagctcaggt

SEQ ID NO: 4444565 - DNA, 11 bp, Homo sapiens
ttgagctgcct

SEQ ID NO: 4444566 - DNA, 12 bp, Homo sapiens
ttgagctgcctt

SEQ ID NO: 4444567 - DNA, 13 bp, Homo sapiens
ttgagctgccttc

SEQ ID NO: 4444568 - DNA, 15 bp, Homo sapiens
ttgagcttaatcttt

SEQ ID NO: 4444569 - DNA, 23 bp, Homo sapiens
ttgaggaaagcaagaatcagaga

SEQ ID NO: 4444570 - DNA, 20 bp, Homo sapiens
ttgaggaagtggctgtccct

SEQ ID NO: 4444571 - DNA, 15 bp, Homo sapiens
ttgaggagtttccta

SEQ ID NO: 4444572 - DNA, 16 bp, Homo sapiens
ttgagtaaaaagacat

SEQ ID NO: 4444573 - DNA, 22 bp, Homo sapiens
ttgagtcattgacttcatttta

SEQ ID NO: 4444574 - DNA, 23 bp, Homo sapiens
ttgagtcttaactgtatttcagt

SEQ ID NO: 4444575 - DNA, 21 bp, Homo sapiens
ttgagtgagaagagcttgcac

SEQ ID NO: 4444576 - DNA, 20 bp, Homo sapiens
ttgagttaagtctatctggt

SEQ ID NO: 4444577 - DNA, 20 bp, Homo sapiens
ttgagtttgtaggtaaaatg

SEQ ID NO: 4444578 - DNA, 14 bp, Homo sapiens
ttgagtttttcctc

SEQ ID NO: 4444579 - DNA, 21 bp, Homo sapiens
ttgagtttttcctcccagtga

SEQ ID NO: 4444580 - DNA, 17 bp, Homo sapiens
ttgataaagatttttta

SEQ ID NO: 4444581 - DNA, 18 bp, Homo sapiens
ttgataaccttgaaaaaa

SEQ ID NO: 4444582 - DNA, 21 bp, Homo sapiens
ttgataagctattgtctgtaa

SEQ ID NO: 4444583 - DNA, 22 bp, Homo sapiens
ttgataagctattgtctgtaat

SEQ ID NO: 4444584 - DNA, 13 bp, Homo sapiens
ttgataatgataa

SEQ ID NO: 4444585 - DNA, 15 bp, Homo sapiens
ttgatactaagcatt

SEQ ID NO: 4444586 - DNA, 18 bp, Homo sapiens
ttgatagctgtcccatct

SEQ ID NO: 4444587 - DNA, 22 bp, Homo sapiens
ttgataggaaggaaactggaat

SEQ ID NO: 4444588 - DNA, 19 bp, Homo sapiens
ttgatataccaaattaaaa

SEQ ID NO: 4444589 - DNA, 13 bp, Homo sapiens
ttgatatatatta

SEQ ID NO: 4444590 - DNA, 14 bp, Homo sapiens
ttgatatatattat

SEQ ID NO: 4444591 - DNA, 23 bp, Homo sapiens
ttgatatatattataaatatata

SEQ ID NO: 4444592 - DNA, 22 bp, Homo sapiens
ttgatattctaagaaatatctg

SEQ ID NO: 4444593 - DNA, 15 bp, Homo sapiens
ttgatattgtttgct

SEQ ID NO: 4444594 - DNA, 18 bp, Homo sapiens
ttgatattgtttgctgtt

SEQ ID NO: 4444595 - DNA, 22 bp, Homo sapiens
ttgatcaacatcttttcttgcc

SEQ ID NO: 4444596 - DNA, 22 bp, Homo sapiens
ttgatcagatgctgaattgaga

SEQ ID NO: 4444597 - DNA, 15 bp, Homo sapiens
ttgatcatgtacttt

SEQ ID NO: 4444598 - DNA, 17 bp, Homo sapiens
ttgatcatgtacttttt

SEQ ID NO: 4444599 - DNA, 16 bp, Homo sapiens
ttgatctatctacaaa

SEQ ID NO: 4444600 - DNA, 14 bp, Homo sapiens
ttgatctctcttgt

SEQ ID NO: 4444601 - DNA, 13 bp, Homo sapiens
ttgatctttcact

SEQ ID NO: 4444602 - DNA, 16 bp, Homo sapiens
ttgatctttgagccca

SEQ ID NO: 4444603 - DNA, 16 bp, Homo sapiens
ttgatgaggtttattc

SEQ ID NO: 4444604 - DNA, 21 bp, Homo sapiens
ttgatgcagataaaatatttt

SEQ ID NO: 4444605 - DNA, 15 bp, Homo sapiens
ttgatgcagcatttg

SEQ ID NO: 4444606 - DNA, 18 bp, Homo sapiens
ttgatgcaggcacttatt

SEQ ID NO: 4444607 - DNA, 17 bp, Homo sapiens
ttgatgcccaatatatt

SEQ ID NO: 4444608 - DNA, 23 bp, Homo sapiens
ttgatgtacataactcctgtccc

SEQ ID NO: 4444609 - DNA, 20 bp, Homo sapiens
ttgatgttccacctgccaca

SEQ ID NO: 4444610 - DNA, 20 bp, Homo sapiens
ttgatgtttgtggcctcaga

SEQ ID NO: 4444611 - DNA, 22 bp, Homo sapiens
ttgatgtttgtggcctcagaat

SEQ ID NO: 4444612 - DNA, 16 bp, Homo sapiens
ttgatgtttttaaagg

SEQ ID NO: 4444613 - DNA, 14 bp, Homo sapiens
ttgattaaaaatgt

SEQ ID NO: 4444614 - DNA, 21 bp, Homo sapiens
ttgattatccatattgagtca

SEQ ID NO: 4444615 - DNA, 22 bp, Homo sapiens
ttgattcaaaatatttaaaaat

SEQ ID NO: 4444616 - DNA, 17 bp, Homo sapiens
ttgattcagcaaaaatc

SEQ ID NO: 4444617 - DNA, 17 bp, Homo sapiens
ttgattccattttaagt

SEQ ID NO: 4444618 - DNA, 12 bp, Homo sapiens
ttgattctcctt

SEQ ID NO: 4444619 - DNA, 19 bp, Homo sapiens
ttgatttcacatttctact

SEQ ID NO: 4444620 - DNA, 23 bp, Homo sapiens
ttgatttccgtgaactctggtgc

SEQ ID NO: 4444621 - DNA, 13 bp, Homo sapiens
ttgatttgaagaa

SEQ ID NO: 4444622 - DNA, 18 bp, Homo sapiens
ttgatttgaagaacatgt

SEQ ID NO: 4444623 - DNA, 13 bp, Homo sapiens
ttgatttgcattg

SEQ ID NO: 4444624 - DNA, 19 bp, Homo sapiens
ttgatttgcattgaacaca

SEQ ID NO: 4444625 - DNA, 22 bp, Homo sapiens
ttgattttaattactttctgaa

SEQ ID NO: 4444626 - DNA, 22 bp, Homo sapiens
ttgcaaaaaaaaaaaaaaagtg

SEQ ID NO: 4444627 - DNA, 19 bp, Homo sapiens
ttgcaaagagacatttcaa

SEQ ID NO: 4444628 - DNA, 20 bp, Homo sapiens
ttgcaaagtattgtaaatta

SEQ ID NO: 4444629 - DNA, 21 bp, Homo sapiens
ttgcaaagtattgtaaattat

SEQ ID NO: 4444630 - DNA, 18 bp, Homo sapiens
ttgcaaatatactttact

SEQ ID NO: 4444631 - DNA, 18 bp, Homo sapiens
ttgcaacctcaccttcct

SEQ ID NO: 4444632 - DNA, 17 bp, Homo sapiens
ttgcaagaatgaaatga

SEQ ID NO: 4444633 - DNA, 21 bp, Homo sapiens
ttgcaagaatgaaatgaatga

SEQ ID NO: 4444634 - DNA, 14 bp, Homo sapiens
ttgcaagatgtgaa

SEQ ID NO: 4444635 - DNA, 20 bp, Homo sapiens
ttgcaagatgtgaattattg

SEQ ID NO: 4444636 - DNA, 23 bp, Homo sapiens
ttgcaagatgtgaattattgaca

SEQ ID NO: 4444637 - DNA, 13 bp, Homo sapiens
ttgcaagggaaaa

SEQ ID NO: 4444638 - DNA, 15 bp, Homo sapiens
ttgcaataatgcagt

SEQ ID NO: 4444639 - DNA, 16 bp, Homo sapiens
ttgcaataatgcagta

SEQ ID NO: 4444640 - DNA, 21 bp, Homo sapiens
ttgcaatagcagttataacag

SEQ ID NO: 4444641 - DNA, 22 bp, Homo sapiens
ttgcaatagcagttataacaga

SEQ ID NO: 4444642 - DNA, 22 bp, Homo sapiens
ttgcaatccaggctgttctcag

SEQ ID NO: 4444643 - DNA, 17 bp, Homo sapiens
ttgcaatctaatctgaa

SEQ ID NO: 4444644 - DNA, 13 bp, Homo sapiens
ttgcaatgaagga

SEQ ID NO: 4444645 - DNA, 18 bp, Homo sapiens
ttgcacaagttccctgga

SEQ ID NO: 4444646 - DNA, 20 bp, Homo sapiens
ttgcacaatatttcttttgt

SEQ ID NO: 4444647 - DNA, 16 bp, Homo sapiens
ttgcacacagatgtga

SEQ ID NO: 4444648 - DNA, 21 bp, Homo sapiens
ttgcacactttggcccagggt

SEQ ID NO: 4444649 - DNA, 19 bp, Homo sapiens
ttgcacagccaaatttaaa

SEQ ID NO: 4444650 - DNA, 19 bp, Homo sapiens
ttgcacatggattcagttt

SEQ ID NO: 4444651 - DNA, 16 bp, Homo sapiens
ttgcaccagaaatgtt

SEQ ID NO: 4444652 - DNA, 18 bp, Homo sapiens
ttgcaccagaaatgttta

SEQ ID NO: 4444653 - DNA, 19 bp, Homo sapiens
ttgcacccagccctggtct

SEQ ID NO: 4444654 - DNA, 22 bp, Homo sapiens
ttgcacctacgggggcatctga

SEQ ID NO: 4444655 - DNA, 18 bp, Homo sapiens
ttgcacctatctcagcca

SEQ ID NO: 4444656 - DNA, 13 bp, Homo sapiens
ttgcactgaacag

SEQ ID NO: 4444657 - DNA, 21 bp, Homo sapiens
ttgcactgtggtcgtcaactt

SEQ ID NO: 4444658 - DNA, 14 bp, Homo sapiens
ttgcactttgtagt

SEQ ID NO: 4444659 - DNA, 20 bp, Homo sapiens
ttgcactttttaagtttgaa

SEQ ID NO: 4444660 - DNA, 18 bp, Homo sapiens
ttgcagaaaagcacctgc

SEQ ID NO: 4444661 - DNA, 19 bp, Homo sapiens
ttgcagaaaagcacctgcc

SEQ ID NO: 4444662 - DNA, 16 bp, Homo sapiens
ttgcagaaaattctgt

SEQ ID NO: 4444663 - DNA, 19 bp, Homo sapiens
ttgcagaaaattctgtgcc

SEQ ID NO: 4444664 - DNA, 16 bp, Homo sapiens
ttgcagcagataactt

SEQ ID NO: 4444665 - DNA, 23 bp, Homo sapiens
ttgcagctaaggaggggaaaaaa

SEQ ID NO: 4444666 - DNA, 17 bp, Homo sapiens
ttgcagctcccattcta

SEQ ID NO: 4444667 - DNA, 23 bp, Homo sapiens
ttgcagctcccattctatgtgtc

SEQ ID NO: 4444668 - DNA, 22 bp, Homo sapiens
ttgcagcttttggttaatatgt

SEQ ID NO: 4444669 - DNA, 19 bp, Homo sapiens
ttgcaggatctgtctgtgc

SEQ ID NO: 4444670 - DNA, 23 bp, Homo sapiens
ttgcagggtcctcttctgggcct

SEQ ID NO: 4444671 - DNA, 14 bp, Homo sapiens
ttgcagtatgaact

SEQ ID NO: 4444672 - DNA, 14 bp, Homo sapiens
ttgcagtcatagaa

SEQ ID NO: 4444673 - DNA, 16 bp, Homo sapiens
ttgcagtgagctgaga

SEQ ID NO: 4444674 - DNA, 18 bp, Homo sapiens
ttgcagtttatcattcaa

SEQ ID NO: 4444675 - DNA, 20 bp, Homo sapiens
ttgcagtttatcattcaagt

SEQ ID NO: 4444676 - DNA, 15 bp, Homo sapiens
ttgcagtttttcatt

SEQ ID NO: 4444677 - DNA, 13 bp, Homo sapiens
ttgcataagagct

SEQ ID NO: 4444678 - DNA, 19 bp, Homo sapiens
ttgcatcatagacgagaca

SEQ ID NO: 4444679 - DNA, 13 bp, Homo sapiens
ttgcatcatttaa

SEQ ID NO: 4444680 - DNA, 15 bp, Homo sapiens
ttgcatctgcacata

SEQ ID NO: 4444681 - DNA, 19 bp, Homo sapiens
ttgcatgtagtaacactaa

SEQ ID NO: 4444682 - DNA, 22 bp, Homo sapiens
ttgcattaaattcacaaacttt

SEQ ID NO: 4444683 - DNA, 15 bp, Homo sapiens
ttgcattgtctgtct

SEQ ID NO: 4444684 - DNA, 15 bp, Homo sapiens
ttgcatttatatgta

SEQ ID NO: 4444685 - DNA, 22 bp, Homo sapiens
ttgcatttgtggtaatctacac

SEQ ID NO: 4444686 - DNA, 13 bp, Homo sapiens
ttgcatttttgtt

SEQ ID NO: 4444687 - DNA, 17 bp, Homo sapiens
ttgcatttttgttttga

SEQ ID NO: 4444688 - DNA, 13 bp, Homo sapiens
ttgccaaaatcct

SEQ ID NO: 4444689 - DNA, 16 bp, Homo sapiens
ttgccaaagtacagaa

SEQ ID NO: 4444690 - DNA, 21 bp, Homo sapiens
ttgccaaagtacagaatttga

SEQ ID NO: 4444691 - DNA, 22 bp, Homo sapiens
ttgccaacataagttaatagaa

SEQ ID NO: 4444692 - DNA, 18 bp, Homo sapiens
ttgccaaggctctcccct

SEQ ID NO: 4444693 - DNA, 19 bp, Homo sapiens
ttgccaaggctctcccctc

SEQ ID NO: 4444694 - DNA, 23 bp, Homo sapiens
ttgccaagggcccaaagaaagag

SEQ ID NO: 4444695 - DNA, 17 bp, Homo sapiens
ttgccacagtagaactg

SEQ ID NO: 4444696 - DNA, 12 bp, Homo sapiens
ttgccaccccac

SEQ ID NO: 4444697 - DNA, 21 bp, Homo sapiens
ttgccaccccaccctccctgg

SEQ ID NO: 4444698 - DNA, 16 bp, Homo sapiens
ttgccagaggccctgg

SEQ ID NO: 4444699 - DNA, 17 bp, Homo sapiens
ttgccagaggccctgga

SEQ ID NO: 4444700 - DNA, 16 bp, Homo sapiens
ttgccagcagagccag

SEQ ID NO: 4444701 - DNA, 17 bp, Homo sapiens
ttgccagcagagccagg

SEQ ID NO: 4444702 - DNA, 14 bp, Homo sapiens
ttgccagtgtcttt

SEQ ID NO: 4444703 - DNA, 18 bp, Homo sapiens
ttgccagtgtctttcttt

SEQ ID NO: 4444704 - DNA, 21 bp, Homo sapiens
ttgccagtgtctttctttggt

SEQ ID NO: 4444705 - DNA, 22 bp, Homo sapiens
ttgccatcactggtccaggtct

SEQ ID NO: 4444706 - DNA, 18 bp, Homo sapiens
ttgccatttgtagctttg

SEQ ID NO: 4444707 - DNA, 12 bp, Homo sapiens
ttgcccagagat

SEQ ID NO: 4444708 - DNA, 18 bp, Homo sapiens
ttgcccagagatgcctcc

SEQ ID NO: 4444709 - DNA, 16 bp, Homo sapiens
ttgcccagtgagccct

SEQ ID NO: 4444710 - DNA, 17 bp, Homo sapiens
ttgcccagtgagccctg

SEQ ID NO: 4444711 - DNA, 22 bp, Homo sapiens
ttgccccatccagacctggctc

SEQ ID NO: 4444712 - DNA, 13 bp, Homo sapiens
ttgccccccatca

SEQ ID NO: 4444713 - DNA, 14 bp, Homo sapiens
ttgccccctctcac

SEQ ID NO: 4444714 - DNA, 14 bp, Homo sapiens
ttgcccctctgcct

SEQ ID NO: 4444715 - DNA, 20 bp, Homo sapiens
ttgcccctggctttgcctct

SEQ ID NO: 4444716 - DNA, 13 bp, Homo sapiens
ttgcccgctccca

SEQ ID NO: 4444717 - DNA, 14 bp, Homo sapiens
ttgcccgctcccac

SEQ ID NO: 4444718 - DNA, 23 bp, Homo sapiens
ttgcccgctcccacagcttcctg

SEQ ID NO: 4444719 - DNA, 19 bp, Homo sapiens
ttgccctgagcactcctgg

SEQ ID NO: 4444720 - DNA, 22 bp, Homo sapiens
ttgccgtctaggattgggcctc

SEQ ID NO: 4444721 - DNA, 15 bp, Homo sapiens
ttgccgtgagcatgc

SEQ ID NO: 4444722 - DNA, 16 bp, Homo sapiens
ttgccgtgagcatgca

SEQ ID NO: 4444723 - DNA, 18 bp, Homo sapiens
ttcaatatattgaacttt

SEQ ID NO: 4444724 - DNA, 19 bp, Homo sapiens
ttcaatatgcaagcagctt

SEQ ID NO: 4444725 - DNA, 20 bp, Homo sapiens
ttcaatatgcaagcagcttt

SEQ ID NO: 4444726 - DNA, 19 bp, Homo sapiens
ttcaatattgaatttttcc

SEQ ID NO: 4444727 - DNA, 20 bp, Homo sapiens
ttcaatctggattcatattt

SEQ ID NO: 4444728 - DNA, 16 bp, Homo sapiens
ttcaatctgtaaactg

SEQ ID NO: 4444729 - DNA, 17 bp, Homo sapiens
ttcaatctgtaaactgt

SEQ ID NO: 4444730 - DNA, 18 bp, Homo sapiens
ttcaatctgtaaactgtg

SEQ ID NO: 4444731 - DNA, 20 bp, Homo sapiens
ttcaatctgtaaactgtgta

SEQ ID NO: 4444732 - DNA, 15 bp, Homo sapiens
ttcaatgtaattaaa

SEQ ID NO: 4444733 - DNA, 16 bp, Homo sapiens
ttcaatgtaattaaac

SEQ ID NO: 4444734 - DNA, 17 bp, Homo sapiens
ttcaatgtgattcttct

SEQ ID NO: 4444735 - DNA, 15 bp, Homo sapiens
ttcaattgcatctcc

SEQ ID NO: 4444736 - DNA, 19 bp, Homo sapiens
ttcacaaaaaaatgttcat

SEQ ID NO: 4444737 - DNA, 14 bp, Homo sapiens
ttcacaaaatgcac

SEQ ID NO: 4444738 - DNA, 15 bp, Homo sapiens
ttcacaaactgtgaa

SEQ ID NO: 4444739 - DNA, 16 bp, Homo sapiens
ttcacaaacttttata

SEQ ID NO: 4444740 - DNA, 17 bp, Homo sapiens
ttcacaaacttttatac

SEQ ID NO: 4444741 - DNA, 22 bp, Homo sapiens
ttcacaagacccaaaaggcaga

SEQ ID NO: 4444742 - DNA, 23 bp, Homo sapiens
ttcacaagacccaaaaggcagaa

SEQ ID NO: 4444743 - DNA, 15 bp, Homo sapiens
ttcacaagcctcctg

SEQ ID NO: 4444744 - DNA, 15 bp, Homo sapiens
ttcacaataaaagct

SEQ ID NO: 4444745 - DNA, 13 bp, Homo sapiens
ttcacaatgttaa

SEQ ID NO: 4444746 - DNA, 14 bp, Homo sapiens
ttcacacagataga

SEQ ID NO: 4444747 - DNA, 13 bp, Homo sapiens
ttcacagaaaata

SEQ ID NO: 4444748 - DNA, 22 bp, Homo sapiens
ttcacagacctcagcagggcat

SEQ ID NO: 4444749 - DNA, 17 bp, Homo sapiens
ttcacaggtggacaaat

SEQ ID NO: 4444750 - DNA, 18 bp, Homo sapiens
ttcacaggttttatgtgt

SEQ ID NO: 4444751 - DNA, 18 bp, Homo sapiens
ttcacatctaacctcatc

SEQ ID NO: 4444752 - DNA, 16 bp, Homo sapiens
ttcacatgtttaactt

SEQ ID NO: 4444753 - DNA, 11 bp, Homo sapiens
ttcacattttt

SEQ ID NO: 4444754 - DNA, 14 bp, Homo sapiens
ttcaccaaatcttg

SEQ ID NO: 4444755 - DNA, 16 bp, Homo sapiens
ttcaccaagtgcaata

SEQ ID NO: 4444756 - DNA, 19 bp, Homo sapiens
ttccacttataggaattga

SEQ ID NO: 4444757 - DNA, 20 bp, Homo sapiens
ttccagaacagccctcggcc

SEQ ID NO: 4444758 - DNA, 21 bp, Homo sapiens
ttccagactcaggttccagaa

SEQ ID NO: 4444759 - DNA, 23 bp, Homo sapiens
ttccagactcaggttccagaaca

SEQ ID NO: 4444760 - DNA, 13 bp, Homo sapiens
ttccagacttcaa

SEQ ID NO: 4444761 - DNA, 20 bp, Homo sapiens
ttccagacttcaaaaataaa

SEQ ID NO: 4444762 - DNA, 14 bp, Homo sapiens
ttccagcaattctc

SEQ ID NO: 4444763 - DNA, 21 bp, Homo sapiens
ttccagccggcatggctggga

SEQ ID NO: 4444764 - DNA, 21 bp, Homo sapiens
ttccagccttatgtgttacat

SEQ ID NO: 4444765 - DNA, 22 bp, Homo sapiens
ttccagccttatgtgttacatt

SEQ ID NO: 4444766 - DNA, 18 bp, Homo sapiens
ttccagctggatgagaat

SEQ ID NO: 4444767 - DNA, 21 bp, Homo sapiens
ttccaggaaactccacatctg

SEQ ID NO: 4444768 - DNA, 14 bp, Homo sapiens
ttccaggggaacct

SEQ ID NO: 4444769 - DNA, 15 bp, Homo sapiens
ttccaggggaacctg

SEQ ID NO: 4444770 - DNA, 18 bp, Homo sapiens
ttccaggggaacctgcca

SEQ ID NO: 4444771 - DNA, 14 bp, Homo sapiens
ttccaggtctgcct

SEQ ID NO: 4444772 - DNA, 15 bp, Homo sapiens
ttccaggtctgcctg

SEQ ID NO: 4444773 - DNA, 12 bp, Homo sapiens
ttccagtcacat

SEQ ID NO: 4444774 - DNA, 11 bp, Homo sapiens
ttccagtctgg

SEQ ID NO: 4444775 - DNA, 19 bp, Homo sapiens
ttccataggaaggctgtga

SEQ ID NO: 4444776 - DNA, 14 bp, Homo sapiens
ttccatatgctcca

SEQ ID NO: 4444777 - DNA, 17 bp, Homo sapiens
ttccatatgctccagga

SEQ ID NO: 4444778 - DNA, 22 bp, Homo sapiens
ttccatcatcactgtaaagaca

SEQ ID NO: 4444779 - DNA, 12 bp, Homo sapiens
ttccatcatgtc

SEQ ID NO: 4444780 - DNA, 13 bp, Homo sapiens
ttccatcatgtct

SEQ ID NO: 4444781 - DNA, 15 bp, Homo sapiens
ttccatcatgtctgt

SEQ ID NO: 4444782 - DNA, 21 bp, Homo sapiens
ttccatccctaccccctaaga

SEQ ID NO: 4444783 - DNA, 14 bp, Homo sapiens
ttccatctagtcac

SEQ ID NO: 4444784 - DNA, 13 bp, Homo sapiens
ttccatctagttt

SEQ ID NO: 4444785 - DNA, 16 bp, Homo sapiens
ttccatgacatcaaga

SEQ ID NO: 4444786 - DNA, 22 bp, Homo sapiens
ttccatgcaactggagttcctt

SEQ ID NO: 4444787 - DNA, 23 bp, Homo sapiens
ttccatgcaactggagttcctta

SEQ ID NO: 4444788 - DNA, 23 bp, Homo sapiens
ttccatgcctgtagctttcctgg

SEQ ID NO: 4444789 - DNA, 12 bp, Homo sapiens
ttccatgggaat

SEQ ID NO: 4444790 - DNA, 16 bp, Homo sapiens
ttccatggtgtatatg

SEQ ID NO: 4444791 - DNA, 21 bp, Homo sapiens
ttccatggtgtgatcgtctga

SEQ ID NO: 4444792 - DNA, 15 bp, Homo sapiens
ttccatgtgcctttc

SEQ ID NO: 4444793 - DNA, 15 bp, Homo sapiens
ttccattatgaaaat

SEQ ID NO: 4444794 - DNA, 19 bp, Homo sapiens
ttccattatgaaaatctta

SEQ ID NO: 4444795 - DNA, 13 bp, Homo sapiens
ttccatttgcaag

SEQ ID NO: 4444796 - DNA, 19 bp, Homo sapiens
ttccatttggcactatggt

SEQ ID NO: 4444797 - DNA, 17 bp, Homo sapiens
ttcccaaaacaatctat

SEQ ID NO: 4444798 - DNA, 17 bp, Homo sapiens
ttcccaagcaaagactg

SEQ ID NO: 4444799 - DNA, 17 bp, Homo sapiens
ttcccaatgatcttgca

SEQ ID NO: 4444800 - DNA, 11 bp, Homo sapiens
ttcccactgca

SEQ ID NO: 4444801 - DNA, 15 bp, Homo sapiens
ttcccagagacagga

SEQ ID NO: 4444802 - DNA, 19 bp, Homo sapiens
ttcccagagacaggaaaat

SEQ ID NO: 4444803 - DNA, 12 bp, Homo sapiens
ttcccagcccct

SEQ ID NO: 4444804 - DNA, 19 bp, Homo sapiens
ttcccagcccctcctccct

SEQ ID NO: 4444805 - DNA, 20 bp, Homo sapiens
ttcccagcccctcctccctc

SEQ ID NO: 4444806 - DNA, 21 bp, Homo sapiens
ttcccagggaccttggaaaca

SEQ ID NO: 4444807 - DNA, 18 bp, Homo sapiens
ttcccagggcacccaggc

SEQ ID NO: 4444808 - DNA, 19 bp, Homo sapiens
ttcccagggtagcccgcct

SEQ ID NO: 4444809 - DNA, 22 bp, Homo sapiens
ttcccaggtaatttaaattggt

SEQ ID NO: 4444810 - DNA, 14 bp, Homo sapiens
ttcccagttaaaga

SEQ ID NO: 4444811 - DNA, 16 bp, Homo sapiens
ttcccagttaaagatt

SEQ ID NO: 4444812 - DNA, 22 bp, Homo sapiens
ttcccatgccggtacacagcca

SEQ ID NO: 4444813 - DNA, 15 bp, Homo sapiens
ttcccatttcttccc

SEQ ID NO: 4444814 - DNA, 14 bp, Homo sapiens
ttccccaagagaaa

SEQ ID NO: 4444815 - DNA, 15 bp, Homo sapiens
ttccccaataaagcc

SEQ ID NO: 4444816 - DNA, 19 bp, Homo sapiens
ttccccaataaagcctttt

SEQ ID NO: 4444817 - DNA, 22 bp, Homo sapiens
ttccccaccccagctcatgccc

SEQ ID NO: 4444818 - DNA, 18 bp, Homo sapiens
ttccccactaataaagtg

SEQ ID NO: 4444819 - DNA, 15 bp, Homo sapiens
ttccccactcccccg

SEQ ID NO: 4444820 - DNA, 21 bp, Homo sapiens
ttccccagaccgatccttccc

SEQ ID NO: 4444821 - DNA, 18 bp, Homo sapiens
ttccccagaggctcccaa

SEQ ID NO: 4444822 - DNA, 24 bp, Homo sapiens
ttccccagaggctcccaatcagct

SEQ ID NO: 4444823 - DNA, 14 bp, Homo sapiens
ttccccagccacag

SEQ ID NO: 4444824 - DNA, 18 bp, Homo sapiens
ttccccagccacaggcca

SEQ ID NO: 4444825 - DNA, 12 bp, Homo sapiens
ttccccatcccg

SEQ ID NO: 4444826 - DNA, 23 bp, Homo sapiens
ttccccatgggaagacgaggccc

SEQ ID NO: 4444827 - DNA, 19 bp, Homo sapiens
ttcccccaaactttttgtt

SEQ ID NO: 4444828 - DNA, 15 bp, Homo sapiens
ttcccccactgatca

SEQ ID NO: 4444829 - DNA, 12 bp, Homo sapiens
ttccccctaaac

SEQ ID NO: 4444830 - DNA, 13 bp, Homo sapiens
ttcccccttccca

SEQ ID NO: 4444831 - DNA, 17 bp, Homo sapiens
ttcccccttcccatttc

SEQ ID NO: 4444832 - DNA, 16 bp, Homo sapiens
ttccccggtcccttga

SEQ ID NO: 4444833 - DNA, 19 bp, Homo sapiens
ttcccctacacctccctcc

SEQ ID NO: 4444834 - DNA, 22 bp, Homo sapiens
ttcccctagtaagtgccttcca

SEQ ID NO: 4444835 - DNA, 13 bp, Homo sapiens
ttcccctccctgg

SEQ ID NO: 4444836 - DNA, 14 bp, Homo sapiens
ttccccttccactg

SEQ ID NO: 4444837 - DNA, 15 bp, Homo sapiens
ttccccttccactga

SEQ ID NO: 4444838 - DNA, 12 bp, Homo sapiens
ttccccttccct

SEQ ID NO: 4444839 - DNA, 20 bp, Homo sapiens
ttcccggcccccggccaagg

SEQ ID NO: 4444840 - DNA, 16 bp, Homo sapiens
ttcccgggagctgggc

SEQ ID NO: 4444841 - DNA, 13 bp, Homo sapiens
ttccctaatcttc

SEQ ID NO: 4444842 - DNA, 13 bp, Homo sapiens
ttccctcagccta

SEQ ID NO: 4444843 - DNA, 17 bp, Homo sapiens
ttccctcctagctctcc

SEQ ID NO: 4444844 - DNA, 13 bp, Homo sapiens
ttccctcctttta

SEQ ID NO: 4444845 - DNA, 18 bp, Homo sapiens
ttccctctgctgcttttg

SEQ ID NO: 4444846 - DNA, 22 bp, Homo sapiens
ttccctctgggcacgcctgctg

SEQ ID NO: 4444847 - DNA, 17 bp, Homo sapiens
ttccctgaaaacccaga

SEQ ID NO: 4444848 - DNA, 20 bp, Homo sapiens
ttccctgaaaacccagagag

SEQ ID NO: 4444849 - DNA, 13 bp, Homo sapiens
ttccctgactcat

SEQ ID NO: 4444850 - DNA, 15 bp, Homo sapiens
ttccctgatggcctt

SEQ ID NO: 4444851 - DNA, 20 bp, Homo sapiens
ttccctgatggcctttggac

SEQ ID NO: 4444852 - DNA, 23 bp, Homo sapiens
ttccctgcccaaacccttaactg

SEQ ID NO: 4444853 - DNA, 14 bp, Homo sapiens
ttccctgcctctca

SEQ ID NO: 4444854 - DNA, 13 bp, Homo sapiens
ttccctgcctgtg

SEQ ID NO: 4444855 - DNA, 18 bp, Homo sapiens
ttccctgcctgtggcatt

SEQ ID NO: 4444856 - DNA, 22 bp, Homo sapiens
ttccctgcgagacgcacacagc

SEQ ID NO: 4444857 - DNA, 17 bp, Homo sapiens
ttccctgctttgcatct

SEQ ID NO: 4444858 - DNA, 23 bp, Homo sapiens
ttccctggaaaccttccacccag

SEQ ID NO: 4444859 - DNA, 20 bp, Homo sapiens
ttccctggaactcctggcct

SEQ ID NO: 4444860 - DNA, 23 bp, Homo sapiens
ttccctggcttgtaactccacca

SEQ ID NO: 4444861 - DNA, 16 bp, Homo sapiens
ttccctgttctccctt

SEQ ID NO: 4444862 - DNA, 18 bp, Homo sapiens
ttccctgttctccctttc

SEQ ID NO: 4444863 - DNA, 14 bp, Homo sapiens
ttcccttacaaggt

SEQ ID NO: 4444864 - DNA, 14 bp, Homo sapiens
ttcccttagcctct

SEQ ID NO: 4444865 - DNA, 17 bp, Homo sapiens
ttcccttagcctctccc

SEQ ID NO: 4444866 - DNA, 21 bp, Homo sapiens
ttcccttagcctctcccaccc

SEQ ID NO: 4444867 - DNA, 22 bp, Homo sapiens
ttcccttagcctctcccacccg

SEQ ID NO: 4444868 - DNA, 20 bp, Homo sapiens
ttcccttgcaggggtccccc

SEQ ID NO: 4444869 - DNA, 17 bp, Homo sapiens
ttcccttgtgtcaagac

SEQ ID NO: 4444870 - DNA, 17 bp, Homo sapiens
ttccctttgtctttcaa

SEQ ID NO: 4444871 - DNA, 12 bp, Homo sapiens
ttccgacatccc

SEQ ID NO: 4444872 - DNA, 14 bp, Homo sapiens
ttccgactgcccag

SEQ ID NO: 4444873 - DNA, 13 bp, Homo sapiens
ttccgcttggagc

SEQ ID NO: 4444874 - DNA, 19 bp, Homo sapiens
ttccgcttggagcagaggg

SEQ ID NO: 4444875 - DNA, 16 bp, Homo sapiens
ttagttctttttgcca

SEQ ID NO: 4444876 - DNA, 22 bp, Homo sapiens
ttagtttcagtagattgcagaa

SEQ ID NO: 4444877 - DNA, 23 bp, Homo sapiens
ttagttttacattttaaaatgtt

SEQ ID NO: 4444878 - DNA, 12 bp, Homo sapiens
ttagttttgatt

SEQ ID NO: 4444879 - DNA, 17 bp, Homo sapiens
ttagtttttaacaatct

SEQ ID NO: 4444880 - DNA, 17 bp, Homo sapiens
ttagtttttcattaaat

SEQ ID NO: 4444881 - DNA, 12 bp, Homo sapiens
ttataaaaagat

SEQ ID NO: 4444882 - DNA, 21 bp, Homo sapiens
ttataaaaataaatagaaaag

SEQ ID NO: 4444883 - DNA, 14 bp, Homo sapiens
ttataaaaatataa

SEQ ID NO: 4444884 - DNA, 19 bp, Homo sapiens
ttataaaaatataaattgt

SEQ ID NO: 4444885 - DNA, 13 bp, Homo sapiens
ttataaaaatatt

SEQ ID NO: 4444886 - DNA, 16 bp, Homo sapiens
ttataaaaatattaag

SEQ ID NO: 4444887 - DNA, 21 bp, Homo sapiens
ttataaagatcatttataata

SEQ ID NO: 4444888 - DNA, 20 bp, Homo sapiens
ttataaagctgttcttgaaa

SEQ ID NO: 4444889 - DNA, 18 bp, Homo sapiens
ttataaataaaatcatgt

SEQ ID NO: 4444890 - DNA, 13 bp, Homo sapiens
ttataaatgttct

SEQ ID NO: 4444891 - DNA, 11 bp, Homo sapiens
ttataaattaa

SEQ ID NO: 4444892 - DNA, 13 bp, Homo sapiens
ttataaattaaat

SEQ ID NO: 4444893 - DNA, 12 bp, Homo sapiens
ttataaatttcg

SEQ ID NO: 4444894 - DNA, 18 bp, Homo sapiens
ttataactctgtataata

SEQ ID NO: 4444895 - DNA, 18 bp, Homo sapiens
ttataactgaaggagaag

SEQ ID NO: 4444896 - DNA, 18 bp, Homo sapiens
ttataactgtaaagatgt

SEQ ID NO: 4444897 - DNA, 21 bp, Homo sapiens
ttataagccaaaggttcagaa

SEQ ID NO: 4444898 - DNA, 14 bp, Homo sapiens
ttataagcgtattt

SEQ ID NO: 4444899 - DNA, 13 bp, Homo sapiens
ttataaggactgc

SEQ ID NO: 4444900 - DNA, 15 bp, Homo sapiens
ttataaggactgcat

SEQ ID NO: 4444901 - DNA, 16 bp, Homo sapiens
ttataaggactgcatg

SEQ ID NO: 4444902 - DNA, 17 bp, Homo sapiens
ttataaggactgcatgg

SEQ ID NO: 4444903 - DNA, 17 bp, Homo sapiens
ttataataaaatttctt

SEQ ID NO: 4444904 - DNA, 18 bp, Homo sapiens
ttataataaaggactgta

SEQ ID NO: 4444905 - DNA, 21 bp, Homo sapiens
ttataataaaggactgtaatc

SEQ ID NO: 4444906 - DNA, 21 bp, Homo sapiens
ttataatataatatggaacct

SEQ ID NO: 4444907 - DNA, 23 bp, Homo sapiens
ttataatcagaatggaagagaga

SEQ ID NO: 4444908 - DNA, 13 bp, Homo sapiens
ttataatgtattt

SEQ ID NO: 4444909 - DNA, 19 bp, Homo sapiens
ttataatgtatttgaaaat

SEQ ID NO: 4444910 - DNA, 19 bp, Homo sapiens
ttataatgtgcccaaagct

SEQ ID NO: 4444911 - DNA, 16 bp, Homo sapiens
ttataattttcctaat

SEQ ID NO: 4444912 - DNA, 19 bp, Homo sapiens
ttatacaagtaatttcctg

SEQ ID NO: 4444913 - DNA, 21 bp, Homo sapiens
ttatacagttataaaattaaa

SEQ ID NO: 4444914 - DNA, 15 bp, Homo sapiens
ttatacagttttaaa

SEQ ID NO: 4444915 - DNA, 16 bp, Homo sapiens
ttatacatttggttat

SEQ ID NO: 4444916 - DNA, 22 bp, Homo sapiens
ttatacgctggcaacacagagg

SEQ ID NO: 4444917 - DNA, 16 bp, Homo sapiens
ttatactctttctgta

SEQ ID NO: 4444918 - DNA, 18 bp, Homo sapiens
ttatgatttttttttcat

SEQ ID NO: 4444919 - DNA, 16 bp, Homo sapiens
ttatgccacctgaata

SEQ ID NO: 4444920 - DNA, 13 bp, Homo sapiens
ttatgcctcgctt

SEQ ID NO: 4444921 - DNA, 21 bp, Homo sapiens
ttatgcctcgcttatttagcc

SEQ ID NO: 4444922 - DNA, 17 bp, Homo sapiens
ttatgccttttttgatc

SEQ ID NO: 4444923 - DNA, 15 bp, Homo sapiens
ttatggaatatcatc

SEQ ID NO: 4444924 - DNA, 20 bp, Homo sapiens
ttatggaatatcatctgtca

SEQ ID NO: 4444925 - DNA, 23 bp, Homo sapiens
ttatggaatatcatctgtcatta

SEQ ID NO: 4444926 - DNA, 19 bp, Homo sapiens
ttatggaattgatttgcat

SEQ ID NO: 4444927 - DNA, 16 bp, Homo sapiens
ttatggactgttttga

SEQ ID NO: 4444928 - DNA, 18 bp, Homo sapiens
ttatggactgttttgata

SEQ ID NO: 4444929 - DNA, 20 bp, Homo sapiens
ttatggatgattaaatttta

SEQ ID NO: 4444930 - DNA, 13 bp, Homo sapiens
ttatggcctcagc

SEQ ID NO: 4444931 - DNA, 19 bp, Homo sapiens
ttatggtcctaaaagcaaa

SEQ ID NO: 4444932 - DNA, 13 bp, Homo sapiens
ttatggtctaatg

SEQ ID NO: 4444933 - DNA, 17 bp, Homo sapiens
ttatggtgatgtcactc

SEQ ID NO: 4444934 - DNA, 15 bp, Homo sapiens
ttatgtacaaccctg

SEQ ID NO: 4444935 - DNA, 17 bp, Homo sapiens
ttatgtacaaccctgac

SEQ ID NO: 4444936 - DNA, 17 bp, Homo sapiens
ttatgtacagaaaacat

SEQ ID NO: 4444937 - DNA, 21 bp, Homo sapiens
ttatgtagtttttatatgttg

SEQ ID NO: 4444938 - DNA, 11 bp, Homo sapiens
ttatgtattta

SEQ ID NO: 4444939 - DNA, 17 bp, Homo sapiens
ttatgtcatagaaatat

SEQ ID NO: 4444940 - DNA, 15 bp, Homo sapiens
ttatgtctcttctga

SEQ ID NO: 4444941 - DNA, 11 bp, Homo sapiens
ttatgtctggg

SEQ ID NO: 4444942 - DNA, 17 bp, Homo sapiens
ttatgtcttgtatttaa

SEQ ID NO: 4444943 - DNA, 18 bp, Homo sapiens
ttatgtgaagaatttaga

SEQ ID NO: 4444944 - DNA, 22 bp, Homo sapiens
ttatgtgaagaatttagatctt

SEQ ID NO: 4444945 - DNA, 11 bp, Homo sapiens
ttatgtgaatt

SEQ ID NO: 4444946 - DNA, 12 bp, Homo sapiens
ttatgtggaata

SEQ ID NO: 4444947 - DNA, 16 bp, Homo sapiens
ttatgtggaataatac

SEQ ID NO: 4444948 - DNA, 18 bp, Homo sapiens
ttatgtggaataatacat

SEQ ID NO: 4444949 - DNA, 14 bp, Homo sapiens
ttatgtgtgtgtgt

SEQ ID NO: 4444950 - DNA, 20 bp, Homo sapiens
ttatgtgttgccaaaaccaa

SEQ ID NO: 4444951 - DNA, 13 bp, Homo sapiens
ttatgttaatatt

SEQ ID NO: 4444952 - DNA, 20 bp, Homo sapiens
ttatgttccttttaaagaaa

SEQ ID NO: 4444953 - DNA, 15 bp, Homo sapiens
ttatgttgaaaaaat

SEQ ID NO: 4444954 - DNA, 23 bp, Homo sapiens
ttatgttgttgttgtttttggat

SEQ ID NO: 4444955 - DNA, 22 bp, Homo sapiens
ttattaaacgatttctaaaatc

SEQ ID NO: 4444956 - DNA, 14 bp, Homo sapiens
ttattaaactgaat

SEQ ID NO: 4444957 - DNA, 12 bp, Homo sapiens
ttattaaacttc

SEQ ID NO: 4444958 - DNA, 15 bp, Homo sapiens
ttattaaatgtagct

SEQ ID NO: 4444959 - DNA, 19 bp, Homo sapiens
ttattaagctttttggaat

SEQ ID NO: 4444960 - DNA, 12 bp, Homo sapiens
ttattaatactt

SEQ ID NO: 4444961 - DNA, 22 bp, Homo sapiens
ttattaatcatacaaactctca

SEQ ID NO: 4444962 - DNA, 17 bp, Homo sapiens
ttattaatctactgtat

SEQ ID NO: 4444963 - DNA, 15 bp, Homo sapiens
ttattaatgtttctt

SEQ ID NO: 4444964 - DNA, 19 bp, Homo sapiens
ttattactagtgtttaagt

SEQ ID NO: 4444965 - DNA, 15 bp, Homo sapiens
ttattaggtcttaaa

SEQ ID NO: 4444966 - DNA, 13 bp, Homo sapiens
ttattataaaaat

SEQ ID NO: 4444967 - DNA, 13 bp, Homo sapiens
ttattataacata

SEQ ID NO: 4444968 - DNA, 14 bp, Homo sapiens
ttattataacataa

SEQ ID NO: 4444969 - DNA, 22 bp, Homo sapiens
ttattataatcttataattgtt

SEQ ID NO: 4444970 - DNA, 14 bp, Homo sapiens
ttattattaattta

SEQ ID NO: 4444971 - DNA, 19 bp, Homo sapiens
ttattcaaagagaaaacat

SEQ ID NO: 4444972 - DNA, 14 bp, Homo sapiens
ttattcaaatttga

SEQ ID NO: 4444973 - DNA, 23 bp, Homo sapiens
ttattcaagaatgccagtagaaa

SEQ ID NO: 4444974 - DNA, 16 bp, Homo sapiens
ttattcagctagaatt

SEQ ID NO: 4444975 - DNA, 19 bp, Homo sapiens
ttattcagctagaatttct

SEQ ID NO: 4444976 - DNA, 13 bp, Homo sapiens
ttattcagtgtca

SEQ ID NO: 4444977 - DNA, 12 bp, Homo sapiens
ttattcattatt

SEQ ID NO: 4444978 - DNA, 15 bp, Homo sapiens
ttattcattatttgt

SEQ ID NO: 4444979 - DNA, 14 bp, Homo sapiens
ttattccacaaaca

SEQ ID NO: 4444980 - DNA, 17 bp, Homo sapiens
ttattccacaaacacat

SEQ ID NO: 4444981 - DNA, 17 bp, Homo sapiens
ttattccagaatgctgt

SEQ ID NO: 4444982 - DNA, 22 bp, Homo sapiens
ttattccagaatgctgtacatc

SEQ ID NO: 4444983 - DNA, 14 bp, Homo sapiens
ttattccctgccca

SEQ ID NO: 4444984 - DNA, 21 bp, Homo sapiens
ttattcctagtctttccagtc

SEQ ID NO: 4444985 - DNA, 12 bp, Homo sapiens
ttattcctttcc

SEQ ID NO: 4444986 - DNA, 16 bp, Homo sapiens
ttattctacttttaaa

SEQ ID NO: 4444987 - DNA, 18 bp, Homo sapiens
ttattctacttttaaata

SEQ ID NO: 4444988 - DNA, 22 bp, Homo sapiens
ttattctgggcaccacaaaata

SEQ ID NO: 4444989 - DNA, 22 bp, Homo sapiens
ttattgaaaggggacacctgta

SEQ ID NO: 4444990 - DNA, 23 bp, Homo sapiens
ttattgaaaggggacacctgtac

SEQ ID NO: 4444991 - DNA, 15 bp, Homo sapiens
ttattgaattagaaa

SEQ ID NO: 4444992 - DNA, 16 bp, Homo sapiens
ttattgaattagaaaa

SEQ ID NO: 4444993 - DNA, 12 bp, Homo sapiens
ttattgacactg

SEQ ID NO: 4444994 - DNA, 14 bp, Homo sapiens
ttattgacactgaa

SEQ ID NO: 4444995 - DNA, 17 bp, Homo sapiens
ttattgacactgaactt

SEQ ID NO: 4444996 - DNA, 14 bp, Homo sapiens
ttattgagtttgta

SEQ ID NO: 4444997 - DNA, 19 bp, Homo sapiens
ttattgatattctaagaaa

SEQ ID NO: 4444998 - DNA, 21 bp, Homo sapiens
ttattgcccatgatataactt

SEQ ID NO: 4444999 - DNA, 23 bp, Homo sapiens
ttacaactgcctcgaaacacaga

SEQ ID NO: 4445000 - DNA, 20 bp, Homo sapiens
ttacaagggagaagacaaca

SEQ ID NO: 4445001 - DNA, 17 bp, Homo sapiens
ttacaagtaatgtaaag

SEQ ID NO: 4445002 - DNA, 15 bp, Homo sapiens
ttacaagttatagta

SEQ ID NO: 4445003 - DNA, 19 bp, Homo sapiens
ttacaagttatagtactag

SEQ ID NO: 4445004 - DNA, 15 bp, Homo sapiens
ttacaatagttctgt

SEQ ID NO: 4445005 - DNA, 17 bp, Homo sapiens
ttacaatagttctgtgg

SEQ ID NO: 4445006 - DNA, 14 bp, Homo sapiens
ttacaatgtattaa

SEQ ID NO: 4445007 - DNA, 15 bp, Homo sapiens
ttacaatttgcacaa

SEQ ID NO: 4445008 - DNA, 23 bp, Homo sapiens
ttacaatttgcacaatatttctt

SEQ ID NO: 4445009 - DNA, 18 bp, Homo sapiens
ttacaattttttatcatg

SEQ ID NO: 4445010 - DNA, 20 bp, Homo sapiens
ttacaattttttatcatgca

SEQ ID NO: 4445011 - DNA, 13 bp, Homo sapiens
ttacacagagaaa

SEQ ID NO: 4445012 - DNA, 16 bp, Homo sapiens
ttacacagcccaagag

SEQ ID NO: 4445013 - DNA, 19 bp, Homo sapiens
ttacacagtgagactgtac

SEQ ID NO: 4445014 - DNA, 14 bp, Homo sapiens
ttacacatcttaaa

SEQ ID NO: 4445015 - DNA, 14 bp, Homo sapiens
ttacacatttcact

SEQ ID NO: 4445016 - DNA, 22 bp, Homo sapiens
ttacactacacactgtgtactg

SEQ ID NO: 4445017 - DNA, 23 bp, Homo sapiens
ttacagagaatttctaaagtaaa

SEQ ID NO: 4445018 - DNA, 21 bp, Homo sapiens
ttacagagaggatacatttaa

SEQ ID NO: 4445019 - DNA, 22 bp, Homo sapiens
ttacagagaggatacatttaat

SEQ ID NO: 4445020 - DNA, 13 bp, Homo sapiens
ttacagattaaag

SEQ ID NO: 4445021 - DNA, 14 bp, Homo sapiens
ttacagattaaaga

SEQ ID NO: 4445022 - DNA, 11 bp, Homo sapiens
ttacagatttc

SEQ ID NO: 4445023 - DNA, 22 bp, Homo sapiens
ttacagatttctcactatatat

SEQ ID NO: 4445024 - DNA, 15 bp, Homo sapiens
ttacagctactttaa

SEQ ID NO: 4445025 - DNA, 19 bp, Homo sapiens
ttacagctcattaaacttt

SEQ ID NO: 4445026 - DNA, 20 bp, Homo sapiens
ttacaggaatgaagaactgt

SEQ ID NO: 4445027 - DNA, 14 bp, Homo sapiens
ttacagggtgactc

SEQ ID NO: 4445028 - DNA, 23 bp, Homo sapiens
ttacagtaaaattaagtgtgtat

SEQ ID NO: 4445029 - DNA, 14 bp, Homo sapiens
ttacagtaaatgtt

SEQ ID NO: 4445030 - DNA, 17 bp, Homo sapiens
ttacagtaggagcccag

SEQ ID NO: 4445031 - DNA, 17 bp, Homo sapiens
ttacataacggaaagtt

SEQ ID NO: 4445032 - DNA, 21 bp, Homo sapiens
ttacatactttatcaatgtgt

SEQ ID NO: 4445033 - DNA, 17 bp, Homo sapiens
ttacatcagtagcattt

SEQ ID NO: 4445034 - DNA, 18 bp, Homo sapiens
ttacatcagtagcatttt

SEQ ID NO: 4445035 - DNA, 21 bp, Homo sapiens
ttacatgagttcaaatacttt

SEQ ID NO: 4445036 - DNA, 14 bp, Homo sapiens
ttacatgatttaaa

SEQ ID NO: 4445037 - DNA, 21 bp, Homo sapiens
ttacatggtgtaaatattagt

SEQ ID NO: 4445038 - DNA, 15 bp, Homo sapiens
ttacattattaaacg

SEQ ID NO: 4445039 - DNA, 18 bp, Homo sapiens
ttacattcagaaatgtgg

SEQ ID NO: 4445040 - DNA, 23 bp, Homo sapiens
ttacattgccgtggcatcttaaa

SEQ ID NO: 4445041 - DNA, 17 bp, Homo sapiens
ttacatttaaacctttt

SEQ ID NO: 4445042 - DNA, 15 bp, Homo sapiens
ttacatttcttttaa

SEQ ID NO: 4445043 - DNA, 21 bp, Homo sapiens
ttaccaaaaataaatatatct

SEQ ID NO: 4445044 - DNA, 12 bp, Homo sapiens
ttaccaaaaatt

SEQ ID NO: 4445045 - DNA, 13 bp, Homo sapiens
ttaccaaatgaaa

SEQ ID NO: 4445046 - DNA, 23 bp, Homo sapiens
ttaccaaatgaaatgccaaagga

SEQ ID NO: 4445047 - DNA, 17 bp, Homo sapiens
ttaccacgccttgacct

SEQ ID NO: 4445048 - DNA, 14 bp, Homo sapiens
ttaccactcaggca

SEQ ID NO: 4445049 - DNA, 16 bp, Homo sapiens
tgttttcattttactg

SEQ ID NO: 4445050 - DNA, 15 bp, Homo sapiens
tgttttccactgtgc

SEQ ID NO: 4445051 - DNA, 17 bp, Homo sapiens
tgttttccactgtgcta

SEQ ID NO: 4445052 - DNA, 16 bp, Homo sapiens
tgttttccctctgctg

SEQ ID NO: 4445053 - DNA, 17 bp, Homo sapiens
tgttttccctctgctgc

SEQ ID NO: 4445054 - DNA, 15 bp, Homo sapiens
tgttttctctctgtt

SEQ ID NO: 4445055 - DNA, 13 bp, Homo sapiens
tgttttctgtaga

SEQ ID NO: 4445056 - DNA, 12 bp, Homo sapiens
tgttttcttaaa

SEQ ID NO: 4445057 - DNA, 17 bp, Homo sapiens
tgttttgaaggcaaaat

SEQ ID NO: 4445058 - DNA, 21 bp, Homo sapiens
tgttttgaatattactcctat

SEQ ID NO: 4445059 - DNA, 15 bp, Homo sapiens
tgttttgtaccagtg

SEQ ID NO: 4445060 - DNA, 20 bp, Homo sapiens
tgttttgtaccagtgaattt

SEQ ID NO: 4445061 - DNA, 19 bp, Homo sapiens
tgttttgtggtttggaata

SEQ ID NO: 4445062 - DNA, 16 bp, Homo sapiens
tgttttgtgtgtaagg

SEQ ID NO: 4445063 - DNA, 15 bp, Homo sapiens
tgttttgttaatata

SEQ ID NO: 4445064 - DNA, 16 bp, Homo sapiens
tgttttgttaatatac

SEQ ID NO: 4445065 - DNA, 15 bp, Homo sapiens
tgtttttactgtatg

SEQ ID NO: 4445066 - DNA, 16 bp, Homo sapiens
tgtttttactgtatgt

SEQ ID NO: 4445067 - DNA, 16 bp, Homo sapiens
tgtttttatcttttta

SEQ ID NO: 4445068 - DNA, 14 bp, Homo sapiens
tgtttttatttctt

SEQ ID NO: 4445069 - DNA, 11 bp, Homo sapiens
tgtttttcatt

SEQ ID NO: 4445070 - DNA, 12 bp, Homo sapiens
tgtttttctcca

SEQ ID NO: 4445071 - DNA, 12 bp, Homo sapiens
tgtttttcttca

SEQ ID NO: 4445072 - DNA, 10 bp, Homo sapiens
tgtttttggg

SEQ ID NO: 4445073 - DNA, 18 bp, Homo sapiens
tgtttttgggatgtctta

SEQ ID NO: 4445074 - DNA, 16 bp, Homo sapiens
tgtttttggtttctta

SEQ ID NO: 4445075 - DNA, 12 bp, Homo sapiens
tgttttttaaga

SEQ ID NO: 4445076 - DNA, 19 bp, Homo sapiens
tgttttttaagatggcaat

SEQ ID NO: 4445077 - DNA, 12 bp, Homo sapiens
tgttttttaagt

SEQ ID NO: 4445078 - DNA, 15 bp, Homo sapiens
tgttttttcatttgt

SEQ ID NO: 4445079 - DNA, 22 bp, Homo sapiens
tgttttttctttttttttaagt

SEQ ID NO: 4445080 - DNA, 12 bp, Homo sapiens
tgttttttgata

SEQ ID NO: 4445081 - DNA, 14 bp, Homo sapiens
tgtttttttctaaa

SEQ ID NO: 4445082 - DNA, 16 bp, Homo sapiens
tgtttttttctaaaaa

SEQ ID NO: 4445083 - DNA, 15 bp, Homo sapiens
tgtttttttgtttgt

SEQ ID NO: 4445084 - DNA, 18 bp, Homo sapiens
tgtttttttttttgagat

SEQ ID NO: 4445085 - DNA, 22 bp, Homo sapiens
ttaaaaaaaaaaaaaagcttta

SEQ ID NO: 4445086 - DNA, 17 bp, Homo sapiens
ttaaaaaaaaaaaatca

SEQ ID NO: 4445087 - DNA, 16 bp, Homo sapiens
ttaaaaaaaaaagtca

SEQ ID NO: 4445088 - DNA, 13 bp, Homo sapiens
ttaaaaaaaaaat

SEQ ID NO: 4445089 - DNA, 22 bp, Homo sapiens
ttaaaaaaaaacctgagcccca

SEQ ID NO: 4445090 - DNA, 18 bp, Homo sapiens
ttaaaaaaaaagatctgt

SEQ ID NO: 4445091 - DNA, 17 bp, Homo sapiens
ttaaaaaacaaatgttc

SEQ ID NO: 4445092 - DNA, 11 bp, Homo sapiens
ttaaaaaacag

SEQ ID NO: 4445093 - DNA, 13 bp, Homo sapiens
ttaaaaaactaaa

SEQ ID NO: 4445094 - DNA, 12 bp, Homo sapiens
ttaaaaaagctt

SEQ ID NO: 4445095 - DNA, 16 bp, Homo sapiens
ttaaaaaatattttct

SEQ ID NO: 4445096 - DNA, 19 bp, Homo sapiens
ttaaaaaattatggaatat

SEQ ID NO: 4445097 - DNA, 13 bp, Homo sapiens
ttaaaaaattctt

SEQ ID NO: 4445098 - DNA, 16 bp, Homo sapiens
ttaaaaacctgtatct

SEQ ID NO: 4445099 - DNA, 16 bp, Homo sapiens
ttaaaaactttaaaga

SEQ ID NO: 4445100 - DNA, 18 bp, Homo sapiens
ttaaaaactttaaagata

SEQ ID NO: 4445101 - DNA, 22 bp, Homo sapiens
ttaaaaaggcagtttgcaaaaa

SEQ ID NO: 4445102 - DNA, 23 bp, Homo sapiens
ttaaaaataactgagatattatt

SEQ ID NO: 4445103 - DNA, 15 bp, Homo sapiens
ttaaaaataagtcaa

SEQ ID NO: 4445104 - DNA, 18 bp, Homo sapiens
ttaataaaactgcgagga

SEQ ID NO: 4445105 - DNA, 20 bp, Homo sapiens
ttaataaaactgcgaggaca

SEQ ID NO: 4445106 - DNA, 17 bp, Homo sapiens
ttaataaagtagttatt

SEQ ID NO: 4445107 - DNA, 17 bp, Homo sapiens
ttaataactttctctgt

SEQ ID NO: 4445108 - DNA, 19 bp, Homo sapiens
ttaataatttagacttcaa

SEQ ID NO: 4445109 - DNA, 19 bp, Homo sapiens
ttaataatttttgctgaat

SEQ ID NO: 4445110 - DNA, 20 bp, Homo sapiens
ttaatacatcacatcttatt

SEQ ID NO: 4445111 - DNA, 19 bp, Homo sapiens
ttaataccacaaacactgt

SEQ ID NO: 4445112 - DNA, 17 bp, Homo sapiens
ttaatactaccttgaaa

SEQ ID NO: 4445113 - DNA, 14 bp, Homo sapiens
ttaatactctattt

SEQ ID NO: 4445114 - DNA, 14 bp, Homo sapiens
ttaatacttttcca

SEQ ID NO: 4445115 - DNA, 15 bp, Homo sapiens
ttaatacttttccac

SEQ ID NO: 4445116 - DNA, 21 bp, Homo sapiens
ttaatacttttccacagattt

SEQ ID NO: 4445117 - DNA, 19 bp, Homo sapiens
ttaatagcaacagagcact

SEQ ID NO: 4445118 - DNA, 12 bp, Homo sapiens
ttaatagcacta

SEQ ID NO: 4445119 - DNA, 19 bp, Homo sapiens
ttaatagccaaagatttca

SEQ ID NO: 4445120 - DNA, 21 bp, Homo sapiens
ttaatagccaaagatttcata

SEQ ID NO: 4445121 - DNA, 15 bp, Homo sapiens
ttaatagtaatttgt

SEQ ID NO: 4445122 - DNA, 14 bp, Homo sapiens
ttaatagtgttctc

SEQ ID NO: 4445123 - DNA, 16 bp, Homo sapiens
ttaatataagtttctt

SEQ ID NO: 4445124 - DNA, 13 bp, Homo sapiens
ttaatatattaaa

SEQ ID NO: 4445125 - DNA, 15 bp, Homo sapiens
ttaatatcactcatt

SEQ ID NO: 4445126 - DNA, 17 bp, Homo sapiens
ttaatatcactcattaa

SEQ ID NO: 4445127 - DNA, 18 bp, Homo sapiens
ttaatatcactcattaat

SEQ ID NO: 4445128 - DNA, 14 bp, Homo sapiens
ttaatatctttctg

SEQ ID NO: 4445129 - DNA, 15 bp, Homo sapiens
ttaatatgagcttca

SEQ ID NO: 4445130 - DNA, 20 bp, Homo sapiens
ttaatatgctgcaacaaaat

SEQ ID NO: 4445131 - DNA, 17 bp, Homo sapiens
ttaatatggtgtatttt

SEQ ID NO: 4445132 - DNA, 23 bp, Homo sapiens
ttaatattttgtaatattctgtt

SEQ ID NO: 4445133 - DNA, 16 bp, Homo sapiens
ttaatcaagagaaact

SEQ ID NO: 4445134 - DNA, 19 bp, Homo sapiens
ttaatcaagagaaacttca

SEQ ID NO: 4445135 - DNA, 20 bp, Homo sapiens
ttaatcacctctctgtagtt

SEQ ID NO: 4445136 - DNA, 15 bp, Homo sapiens
ttaatcatacaaact

SEQ ID NO: 4445137 - DNA, 18 bp, Homo sapiens
ttaatcatgaatatgatg

SEQ ID NO: 4445138 - DNA, 14 bp, Homo sapiens
ttaatcattatttg

SEQ ID NO: 4445139 - DNA, 16 bp, Homo sapiens
ttaatcattatttgag

SEQ ID NO: 4445140 - DNA, 19 bp, Homo sapiens
ttaatcattttcattccta

SEQ ID NO: 4445141 - DNA, 17 bp, Homo sapiens
ttaatccttctttgtaa

SEQ ID NO: 4445142 - DNA, 23 bp, Homo sapiens
ttaatctacattataataaaatt

SEQ ID NO: 4445143 - DNA, 12 bp, Homo sapiens
ttaatctctgtg

SEQ ID NO: 4445144 - DNA, 14 bp, Homo sapiens
ttaatcttagtgta

SEQ ID NO: 4445145 - DNA, 21 bp, Homo sapiens
ttaatcttagtgtatgattac

SEQ ID NO: 4445146 - DNA, 12 bp, Homo sapiens
ttaatcttggat

SEQ ID NO: 4445147 - DNA, 16 bp, Homo sapiens
ttaatcttggatagct

SEQ ID NO: 4445148 - DNA, 17 bp, Homo sapiens
ttaatctttgaaaggtt

SEQ ID NO: 4445149 - DNA, 20 bp, Homo sapiens
ttaatcttttcttatttttg

SEQ ID NO: 4445150 - DNA, 14 bp, Homo sapiens
ttaatgaaaaggaa

SEQ ID NO: 4445151 - DNA, 15 bp, Homo sapiens
ttaatgaaaataaga

SEQ ID NO: 4445152 - DNA, 21 bp, Homo sapiens
ttaatgaaagggtttgtaata

SEQ ID NO: 4445153 - DNA, 15 bp, Homo sapiens
ttaatgaaccttaga

SEQ ID NO: 4445154 - DNA, 16 bp, Homo sapiens
ttaatgacaacactta

SEQ ID NO: 4445155 - DNA, 17 bp, Homo sapiens
ttaatgacacaccttgg

SEQ ID NO: 4445156 - DNA, 23 bp, Homo sapiens
ttaatgaccatgttatattgctt

SEQ ID NO: 4445157 - DNA, 22 bp, Homo sapiens
ttaatgagaatagaaacgtaaa

SEQ ID NO: 4445158 - DNA, 15 bp, Homo sapiens
ttaatgcactttcta

SEQ ID NO: 4445159 - DNA, 20 bp, Homo sapiens
tgtgctgcgcctgcaggcag

SEQ ID NO: 4445160 - DNA, 15 bp, Homo sapiens
tgtgctggaggggtg

SEQ ID NO: 4445161 - DNA, 16 bp, Homo sapiens
tgtgctggaggggtgg

SEQ ID NO: 4445162 - DNA, 14 bp, Homo sapiens
tgtgctgtgggcag

SEQ ID NO: 4445163 - DNA, 16 bp, Homo sapiens
tgtgctgtttgaaaat

SEQ ID NO: 4445164 - DNA, 14 bp, Homo sapiens
tgtgctgttttctg

SEQ ID NO: 4445165 - DNA, 18 bp, Homo sapiens
tgtgcttcatctgtggga

SEQ ID NO: 4445166 - DNA, 16 bp, Homo sapiens
tgtgcttctaatatta

SEQ ID NO: 4445167 - DNA, 15 bp, Homo sapiens
tgtgcttctccccag

SEQ ID NO: 4445168 - DNA, 14 bp, Homo sapiens
tgtgctttccagct

SEQ ID NO: 4445169 - DNA, 20 bp, Homo sapiens
tgtgctttccagctcacccc

SEQ ID NO: 4445170 - DNA, 15 bp, Homo sapiens
tgtgctttctattgt

SEQ ID NO: 4445171 - DNA, 22 bp, Homo sapiens
tgtgctttttaagaatattttt

SEQ ID NO: 4445172 - DNA, 15 bp, Homo sapiens
tgtggaaaaaatatt

SEQ ID NO: 4445173 - DNA, 19 bp, Homo sapiens
tgtggaacataaaaaggac

SEQ ID NO: 4445174 - DNA, 20 bp, Homo sapiens
tgtggaattttgagaaaaat

SEQ ID NO: 4445175 - DNA, 17 bp, Homo sapiens
tgtggaccaattattga

SEQ ID NO: 4445176 - DNA, 18 bp, Homo sapiens
tgtggacttattcattcc

SEQ ID NO: 4445177 - DNA, 19 bp, Homo sapiens
tgtggagaccctgccacag

SEQ ID NO: 4445178 - DNA, 20 bp, Homo sapiens
tgtggagaccctgccacagc

SEQ ID NO: 4445179 - DNA, 19 bp, Homo sapiens
tgtggaggaagagccacct

SEQ ID NO: 4445180 - DNA, 20 bp, Homo sapiens
tgtggaggaagagccacctg

SEQ ID NO: 4445181 - DNA, 21 bp, Homo sapiens
tgtggaggaagagccacctgc

SEQ ID NO: 4445182 - DNA, 21 bp, Homo sapiens
tgtggagggagtgagccagca

SEQ ID NO: 4445183 - DNA, 21 bp, Homo sapiens
tgtggatgaaaaaaagggaaa

SEQ ID NO: 4445184 - DNA, 19 bp, Homo sapiens
tgtggatgaccacataaga

SEQ ID NO: 4445185 - DNA, 19 bp, Homo sapiens
tgtggatgatcaatccttt

SEQ ID NO: 4445186 - DNA, 22 bp, Homo sapiens
tgtggatgccgatttctgtaaa

SEQ ID NO: 4445187 - DNA, 15 bp, Homo sapiens
tgtggcaactaaacc

SEQ ID NO: 4445188 - DNA, 19 bp, Homo sapiens
tgtggcagagttacagttc

SEQ ID NO: 4445189 - DNA, 20 bp, Homo sapiens
tgtggcagagttacagttct

SEQ ID NO: 4445190 - DNA, 22 bp, Homo sapiens
tgtggcagggagcagtacacaa

SEQ ID NO: 4445191 - DNA, 13 bp, Homo sapiens
tgtggcagggggc

SEQ ID NO: 4445192 - DNA, 19 bp, Homo sapiens
tgtggcagtaaagagaaac

SEQ ID NO: 4445193 - DNA, 20 bp, Homo sapiens
tgtggcagtaaagagaaact

SEQ ID NO: 4445194 - DNA, 11 bp, Homo sapiens
tgtggcagtgg

SEQ ID NO: 4445195 - DNA, 21 bp, Homo sapiens
tgtggcatccagagtccctgc

SEQ ID NO: 4445196 - DNA, 14 bp, Homo sapiens
tgtggccagcagcc

SEQ ID NO: 4445197 - DNA, 21 bp, Homo sapiens
tgtggccaggggtgctcctgt

SEQ ID NO: 4445198 - DNA, 16 bp, Homo sapiens
tgtggccatatatgct

SEQ ID NO: 4445199 - DNA, 20 bp, Homo sapiens
tgtggccatatatgctgtat

SEQ ID NO: 4445200 - DNA, 22 bp, Homo sapiens
tgtggcccctcccctgcagacg

SEQ ID NO: 4445201 - DNA, 20 bp, Homo sapiens
tgtggccctctcccttaccc

SEQ ID NO: 4445202 - DNA, 14 bp, Homo sapiens
tgtggccctggcct

SEQ ID NO: 4445203 - DNA, 13 bp, Homo sapiens
tgtggccggcctc

SEQ ID NO: 4445204 - DNA, 18 bp, Homo sapiens
tgtggccggcctcctcct

SEQ ID NO: 4445205 - DNA, 20 bp, Homo sapiens
tgtggccggtgccagctgcc

SEQ ID NO: 4445206 - DNA, 22 bp, Homo sapiens
tgtggccggtgccagctgccct

SEQ ID NO: 4445207 - DNA, 11 bp, Homo sapiens
tgtggcctcag

SEQ ID NO: 4445208 - DNA, 13 bp, Homo sapiens
tgtggcctcagcc

SEQ ID NO: 4445209 - DNA, 16 bp, Homo sapiens
tgtggcctcagccctc

SEQ ID NO: 4445210 - DNA, 17 bp, Homo sapiens
tgtggcctcagccctca

SEQ ID NO: 4445211 - DNA, 12 bp, Homo sapiens
tgtggcgagcca

SEQ ID NO: 4445212 - DNA, 20 bp, Homo sapiens
tgtggctcctatctgtgttt

SEQ ID NO: 4445213 - DNA, 13 bp, Homo sapiens
tgtggctggtgtc

SEQ ID NO: 4445214 - DNA, 19 bp, Homo sapiens
tgtggctggtgtccccttc

SEQ ID NO: 4445215 - DNA, 16 bp, Homo sapiens
tgtgggactgtacaca

SEQ ID NO: 4445216 - DNA, 19 bp, Homo sapiens
tgtgggactgtacacactt

SEQ ID NO: 4445217 - DNA, 21 bp, Homo sapiens
tgtgggagccgcagagcctga

SEQ ID NO: 4445218 - DNA, 14 bp, Homo sapiens
tgtgggagtgtgta

SEQ ID NO: 4445219 - DNA, 14 bp, Homo sapiens
tgtgggcagcaccc

SEQ ID NO: 4445220 - DNA, 19 bp, Homo sapiens
tgtgggcagcaccctcccc

SEQ ID NO: 4445221 - DNA, 16 bp, Homo sapiens
tgtggggattttcact

SEQ ID NO: 4445222 - DNA, 13 bp, Homo sapiens
tgtggggcctggg

SEQ ID NO: 4445223 - DNA, 16 bp, Homo sapiens
tgtgggggtctgtgtg

SEQ ID NO: 4445224 - DNA, 16 bp, Homo sapiens
tgtgggggtggccatc

SEQ ID NO: 4445225 - DNA, 21 bp, Homo sapiens
tgtgggggtggccatccctgg

SEQ ID NO: 4445226 - DNA, 20 bp, Homo sapiens
tgtggggtgacgggactcag

SEQ ID NO: 4445227 - DNA, 13 bp, Homo sapiens
tgtgggtctctga

SEQ ID NO: 4445228 - DNA, 16 bp, Homo sapiens
tgtgggtctgtgtgtg

SEQ ID NO: 4445229 - DNA, 20 bp, Homo sapiens
tgtgggtctgtgtgtgtgta

SEQ ID NO: 4445230 - DNA, 14 bp, Homo sapiens
tgtgggtgttaatt

SEQ ID NO: 4445231 - DNA, 21 bp, Homo sapiens
tgtgggttatcatggaagaaa

SEQ ID NO: 4445232 - DNA, 17 bp, Homo sapiens
tgtggtaatctacacca

SEQ ID NO: 4445233 - DNA, 16 bp, Homo sapiens
tgtggtacatggtgtt

SEQ ID NO: 4445234 - DNA, 17 bp, Homo sapiens
tgtggtaggtgataaag

SEQ ID NO: 4445235 - DNA, 21 bp, Homo sapiens
tgtggtattcaactaatacat

SEQ ID NO: 4445236 - DNA, 20 bp, Homo sapiens
tgtggtcgtcaactttcctc

SEQ ID NO: 4445237 - DNA, 14 bp, Homo sapiens
tgtggtctattgtc

SEQ ID NO: 4445238 - DNA, 23 bp, Homo sapiens
tgtggtgaagtgtggctggtgtc

SEQ ID NO: 4445239 - DNA, 13 bp, Homo sapiens
tgtggtttggaat

SEQ ID NO: 4445240 - DNA, 11 bp, Homo sapiens
tgtgtaaaatt

SEQ ID NO: 4445241 - DNA, 16 bp, Homo sapiens
tgtgtaaaattaatgt

SEQ ID NO: 4445242 - DNA, 23 bp, Homo sapiens
tgtgtaaaattaatgtaataaag

SEQ ID NO: 4445243 - DNA, 20 bp, Homo sapiens
tgtgtaaatgcttaaatttc

SEQ ID NO: 4445244 - DNA, 14 bp, Homo sapiens
tgtgtaaatttctc

SEQ ID NO: 4445245 - DNA, 17 bp, Homo sapiens
tgtgtaaatttgtatcc

SEQ ID NO: 4445246 - DNA, 23 bp, Homo sapiens
tgtgtaaggagtataccatgaga

SEQ ID NO: 4445247 - DNA, 22 bp, Homo sapiens
tgtgtaataaagtgttttcaga

SEQ ID NO: 4445248 - DNA, 21 bp, Homo sapiens
tgtgtacaactttttaaatag

SEQ ID NO: 4445249 - DNA, 17 bp, Homo sapiens
tgtgtacaatgtacaca

SEQ ID NO: 4445250 - DNA, 15 bp, Homo sapiens
tgtgtacataactga

SEQ ID NO: 4445251 - DNA, 17 bp, Homo sapiens
tgtgtacctcactgtcc

SEQ ID NO: 4445252 - DNA, 18 bp, Homo sapiens
tgtgtacctgtggctgtg

SEQ ID NO: 4445253 - DNA, 22 bp, Homo sapiens
tgtgtactcagggcattctgtt

SEQ ID NO: 4445254 - DNA, 14 bp, Homo sapiens
tgtgtactgtgtca

SEQ ID NO: 4445255 - DNA, 13 bp, Homo sapiens
tgtgtacttcttc

SEQ ID NO: 4445256 - DNA, 21 bp, Homo sapiens
tgtgtacttcttcatccatag

SEQ ID NO: 4445257 - DNA, 10 bp, Homo sapiens
tgtgtagaaa

SEQ ID NO: 4445258 - DNA, 16 bp, Homo sapiens
tgtgtagatttgaaaa

SEQ ID NO: 4445259 - DNA, 17 bp, Homo sapiens
tgtgtagatttgaaaat

SEQ ID NO: 4445260 - DNA, 19 bp, Homo sapiens
tgtgtagatttgaaaattg

SEQ ID NO: 4445261 - DNA, 22 bp, Homo sapiens
tgtgtagttgtctctcttcaga

SEQ ID NO: 4445262 - DNA, 13 bp, Homo sapiens
tgtgtataggaat

SEQ ID NO: 4445263 - DNA, 13 bp, Homo sapiens
tgtgtatatgtat

SEQ ID NO: 4445264 - DNA, 13 bp, Homo sapiens
tgtgtatattaca

SEQ ID NO: 4445265 - DNA, 14 bp, Homo sapiens
tgtgtatattacac

SEQ ID NO: 4445266 - DNA, 19 bp, Homo sapiens
tgtgtatattacaccaatg

SEQ ID NO: 4445267 - DNA, 21 bp, Homo sapiens
tgtgtatcgtaaccagccaga

SEQ ID NO: 4445268 - DNA, 13 bp, Homo sapiens
tgtgtatgtgtgt

SEQ ID NO: 4445269 - DNA, 15 bp, Homo sapiens
tgtgtattaacatgc

SEQ ID NO: 4445270 - DNA, 14 bp, Homo sapiens
tgtgtattccaaga

SEQ ID NO: 4445271 - DNA, 18 bp, Homo sapiens
tgtgtatttaattgtaaa

SEQ ID NO: 4445272 - DNA, 21 bp, Homo sapiens
tgtgtatttaattgtaaactg

SEQ ID NO: 4445273 - DNA, 15 bp, Homo sapiens
tgtgtatttacgctt

SEQ ID NO: 4445274 - DNA, 19 bp, Homo sapiens
tgtgtatttatttaaaact

SEQ ID NO: 4445275 - DNA, 22 bp, Homo sapiens
tgtgtatttatttaaaactctg

SEQ ID NO: 4445276 - DNA, 15 bp, Homo sapiens
tgtgtattttcagtc

SEQ ID NO: 4445277 - DNA, 12 bp, Homo sapiens
tgttaggtttta

SEQ ID NO: 4445278 - DNA, 23 bp, Homo sapiens
tgttagttaccttatagttactg

SEQ ID NO: 4445279 - DNA, 14 bp, Homo sapiens
tgttataactctgc

SEQ ID NO: 4445280 - DNA, 18 bp, Homo sapiens
tgttataactctgcacta

SEQ ID NO: 4445281 - DNA, 13 bp, Homo sapiens
tgttatatataat

SEQ ID NO: 4445282 - DNA, 15 bp, Homo sapiens
tgttatatataataa

SEQ ID NO: 4445283 - DNA, 14 bp, Homo sapiens
tgttatatcaggga

SEQ ID NO: 4445284 - DNA, 13 bp, Homo sapiens
tgttatattgctt

SEQ ID NO: 4445285 - DNA, 21 bp, Homo sapiens
tgttatcagtcaatattttta

SEQ ID NO: 4445286 - DNA, 22 bp, Homo sapiens
tgttatcttatactgtacaata

SEQ ID NO: 4445287 - DNA, 15 bp, Homo sapiens
tgttatgaacatcca

SEQ ID NO: 4445288 - DNA, 17 bp, Homo sapiens
tgttatgactatgtaaa

SEQ ID NO: 4445289 - DNA, 18 bp, Homo sapiens
tgttatgactatgtaaac

SEQ ID NO: 4445290 - DNA, 18 bp, Homo sapiens
tgttattaatgtttcttc

SEQ ID NO: 4445291 - DNA, 21 bp, Homo sapiens
tgttattaatgtttcttctcc

SEQ ID NO: 4445292 - DNA, 15 bp, Homo sapiens
tgttattcaaatttg

SEQ ID NO: 4445293 - DNA, 22 bp, Homo sapiens
tgttattgatcccttctcctgc

SEQ ID NO: 4445294 - DNA, 13 bp, Homo sapiens
tgttatttattga

SEQ ID NO: 4445295 - DNA, 19 bp, Homo sapiens
tgttatttccccagccaca

SEQ ID NO: 4445296 - DNA, 16 bp, Homo sapiens
tgttatttctatgaaa

SEQ ID NO: 4445297 - DNA, 15 bp, Homo sapiens
tgttatttcttccct

SEQ ID NO: 4445298 - DNA, 16 bp, Homo sapiens
tgttatttcttccctg

SEQ ID NO: 4445299 - DNA, 18 bp, Homo sapiens
tgttatttttaagctttt

SEQ ID NO: 4445300 - DNA, 15 bp, Homo sapiens
tgttcaatattttct

SEQ ID NO: 4445301 - DNA, 13 bp, Homo sapiens
tgttcaatgaaat

SEQ ID NO: 4445302 - DNA, 22 bp, Homo sapiens
tgttcaatgccaatgagtctgt

SEQ ID NO: 4445303 - DNA, 14 bp, Homo sapiens
tgttcacaaactgt

SEQ ID NO: 4445304 - DNA, 16 bp, Homo sapiens
tgttcacaccagagaa

SEQ ID NO: 4445305 - DNA, 14 bp, Homo sapiens
tgttcagcattctt

SEQ ID NO: 4445306 - DNA, 21 bp, Homo sapiens
tgttcaggaaaaggttgaata

SEQ ID NO: 4445307 - DNA, 23 bp, Homo sapiens
tgttcaggaaaaggttgaataat

SEQ ID NO: 4445308 - DNA, 13 bp, Homo sapiens
tgttcagtaataa

SEQ ID NO: 4445309 - DNA, 15 bp, Homo sapiens
tgttcatcttgtaca

SEQ ID NO: 4445310 - DNA, 16 bp, Homo sapiens
tgttcatgatagaaag

SEQ ID NO: 4445311 - DNA, 21 bp, Homo sapiens
tgttcatgatagaaagaataa

SEQ ID NO: 4445312 - DNA, 13 bp, Homo sapiens
tgttcatttcatt

SEQ ID NO: 4445313 - DNA, 15 bp, Homo sapiens
tgttcattttaagta

SEQ ID NO: 4445314 - DNA, 19 bp, Homo sapiens
tgttcattttgaaaatatg

SEQ ID NO: 4445315 - DNA, 17 bp, Homo sapiens
tgttccaaattcagttt

SEQ ID NO: 4445316 - DNA, 14 bp, Homo sapiens
tgttccaaatttag

SEQ ID NO: 4445317 - DNA, 21 bp, Homo sapiens
tgttccaatgccacatacttg

SEQ ID NO: 4445318 - DNA, 20 bp, Homo sapiens
tgttccagccaaagcatgcc

SEQ ID NO: 4445319 - DNA, 20 bp, Homo sapiens
tgttcccagcccctcctccc

SEQ ID NO: 4445320 - DNA, 17 bp, Homo sapiens
tgttcccagcccctgca

SEQ ID NO: 4445321 - DNA, 18 bp, Homo sapiens
tgttccccagttcagtgt

SEQ ID NO: 4445322 - DNA, 23 bp, Homo sapiens
tgttcccctcctccactctcccc

SEQ ID NO: 4445323 - DNA, 14 bp, Homo sapiens
tgttccccttccac

SEQ ID NO: 4445324 - DNA, 20 bp, Homo sapiens
tgttccccttccactgaggg

SEQ ID NO: 4445325 - DNA, 19 bp, Homo sapiens
aaaaattaacttagttttt

SEQ ID NO: 4445326 - DNA, 17 bp, Homo sapiens
aaaaattacatatataa

SEQ ID NO: 4445327 - DNA, 20 bp, Homo sapiens
aaaaattatgtgttgccaaa

SEQ ID NO: 4445328 - DNA, 21 bp, Homo sapiens
aaaaattcagagtccttgcaa

SEQ ID NO: 4445329 - DNA, 23 bp, Homo sapiens
aaaaattggttttatttttttct

SEQ ID NO: 4445330 - DNA, 13 bp, Homo sapiens
aaaaatttattat

SEQ ID NO: 4445331 - DNA, 13 bp, Homo sapiens
aaaaatttcacga

SEQ ID NO: 4445332 - DNA, 10 bp, Homo sapiens
aaaacaaaaa

SEQ ID NO: 4445333 - DNA, 16 bp, Homo sapiens
aaaacaaaacaaaact

SEQ ID NO: 4445334 - DNA, 22 bp, Homo sapiens
aaaacaaaatttgactaatttt

SEQ ID NO: 4445335 - DNA, 13 bp, Homo sapiens
aaaacaaatgtta

SEQ ID NO: 4445336 - DNA, 22 bp, Homo sapiens
aaaacaagtatataatttactt

SEQ ID NO: 4445337 - DNA, 19 bp, Homo sapiens
aaaacaatattactttgtc

SEQ ID NO: 4445338 - DNA, 15 bp, Homo sapiens
aaaacacaagcaaaa

SEQ ID NO: 4445339 - DNA, 13 bp, Homo sapiens
aaaacacacaggt

SEQ ID NO: 4445340 - DNA, 18 bp, Homo sapiens
aaaacacagcaagggtga

SEQ ID NO: 4445341 - DNA, 18 bp, Homo sapiens
aaaacacttccagtctgg

SEQ ID NO: 4445342 - DNA, 22 bp, Homo sapiens
aaaacacttggcatacaaaata

SEQ ID NO: 4445343 - DNA, 18 bp, Homo sapiens
aaaacagcctcacagaag

SEQ ID NO: 4445344 - DNA, 17 bp, Homo sapiens
aaaacaggcaaagtttt

SEQ ID NO: 4445345 - DNA, 19 bp, Homo sapiens
aaaacaggcaaagttttac

SEQ ID NO: 4445346 - DNA, 12 bp, Homo sapiens
aaaacaggtaga

SEQ ID NO: 4445347 - DNA, 22 bp, Homo sapiens
aaaacaggtagaattatctaat

SEQ ID NO: 4445348 - DNA, 22 bp, Homo sapiens
aaaacagtttcatctaaatgaa

SEQ ID NO: 4445349 - DNA, 17 bp, Homo sapiens
aaaacataaaaattcag

SEQ ID NO: 4445350 - DNA, 19 bp, Homo sapiens
aaaacatcactatcaattt

SEQ ID NO: 4445351 - DNA, 21 bp, Homo sapiens
aaaacatcactatcaatttta

SEQ ID NO: 4445352 - DNA, 22 bp, Homo sapiens
aaaacatcactatcaattttaa

SEQ ID NO: 4445353 - DNA, 13 bp, Homo sapiens
aaaacatctcatc

SEQ ID NO: 4445354 - DNA, 19 bp, Homo sapiens
aaaacatgtttatttttct

SEQ ID NO: 4445355 - DNA, 19 bp, Homo sapiens
aaaacattctatctactga

SEQ ID NO: 4445356 - DNA, 22 bp, Homo sapiens
aaaacattgtccccaatgaata

SEQ ID NO: 4445357 - DNA, 13 bp, Homo sapiens
aaaacatttctaa

SEQ ID NO: 4445358 - DNA, 19 bp, Homo sapiens
aaaacatttctaagactac

SEQ ID NO: 4445359 - DNA, 15 bp, Homo sapiens
aaaacattttgaagt

SEQ ID NO: 4445360 - DNA, 17 bp, Homo sapiens
aaaaccaaacacccaga

SEQ ID NO: 4445361 - DNA, 13 bp, Homo sapiens
aaaaccacagcag

SEQ ID NO: 4445362 - DNA, 12 bp, Homo sapiens
aaaaccagagag

SEQ ID NO: 4445363 - DNA, 18 bp, Homo sapiens
aaaacctaagcaaactta

SEQ ID NO: 4445364 - DNA, 17 bp, Homo sapiens
aaaacctagaaatttat

SEQ ID NO: 4445365 - DNA, 17 bp, Homo sapiens
aaaacctgattggccac

SEQ ID NO: 4445366 - DNA, 17 bp, Homo sapiens
aaaacctttacagttag

SEQ ID NO: 4445367 - DNA, 20 bp, Homo sapiens
aaaacgcaccaatcagcact

SEQ ID NO: 4445368 - DNA, 13 bp, Homo sapiens
aaaactaaaaact

SEQ ID NO: 4445369 - DNA, 16 bp, Homo sapiens
aaaactaaaaactaga

SEQ ID NO: 4445370 - DNA, 13 bp, Homo sapiens
aaaactaatgtgt

SEQ ID NO: 4445371 - DNA, 23 bp, Homo sapiens
aaaactacaaacgtttgacaaac

SEQ ID NO: 4445372 - DNA, 21 bp, Homo sapiens
aaaactacaaatcaagtattt

SEQ ID NO: 4445373 - DNA, 22 bp, Homo sapiens
aaaactagaggtgagaaattta

SEQ ID NO: 4445374 - DNA, 17 bp, Homo sapiens
aaaactagcaactctta

SEQ ID NO: 4445375 - DNA, 13 bp, Homo sapiens
aaaactagcatta

SEQ ID NO: 4445376 - DNA, 19 bp, Homo sapiens
aaaactataacattatata

SEQ ID NO: 4445377 - DNA, 21 bp, Homo sapiens
aaaactatgtgttcaatgaaa

SEQ ID NO: 4445378 - DNA, 17 bp, Homo sapiens
aaaactcatgatcaaga

SEQ ID NO: 4445379 - DNA, 13 bp, Homo sapiens
aaaactcattttt

SEQ ID NO: 4445380 - DNA, 17 bp, Homo sapiens
aaaactctctcccagga

SEQ ID NO: 4445381 - DNA, 15 bp, Homo sapiens
aaaactctttcggta

SEQ ID NO: 4445382 - DNA, 20 bp, Homo sapiens
aaaactgaacttgaagctaa

SEQ ID NO: 4445383 - DNA, 21 bp, Homo sapiens
aaaactgaacttgaagctaac

SEQ ID NO: 4445384 - DNA, 20 bp, Homo sapiens
aaaactgcgaggacatcaaa

SEQ ID NO: 4445385 - DNA, 22 bp, Homo sapiens
aaaactgcgaggacatcaaagt

SEQ ID NO: 4445386 - DNA, 19 bp, Homo sapiens
aaaactgggataactgatt

SEQ ID NO: 4445387 - DNA, 16 bp, Homo sapiens
aaaactgtaaaagtgt

SEQ ID NO: 4445388 - DNA, 15 bp, Homo sapiens
aaaactgtataagga

SEQ ID NO: 4445389 - DNA, 17 bp, Homo sapiens
aaaactgtataaggaga

SEQ ID NO: 4445390 - DNA, 21 bp, Homo sapiens
aaaactgtgaccaagtataaa

SEQ ID NO: 4445391 - DNA, 18 bp, Homo sapiens
aaaacttcattctcgtga

SEQ ID NO: 4445392 - DNA, 19 bp, Homo sapiens
aaaacttgtgtgaaatttt

SEQ ID NO: 4445393 - DNA, 21 bp, Homo sapiens
aaaactttatgctaagtgaaa

SEQ ID NO: 4445394 - DNA, 17 bp, Homo sapiens
aaaactttattttatat

SEQ ID NO: 4445395 - DNA, 18 bp, Homo sapiens
aaaactttattttatata

SEQ ID NO: 4445396 - DNA, 23 bp, Homo sapiens
aaaactttattttatataataaa

SEQ ID NO: 4445397 - DNA, 17 bp, Homo sapiens
aaaacttttataaatta

SEQ ID NO: 4445398 - DNA, 18 bp, Homo sapiens
aaaacttttataaattaa

SEQ ID NO: 4445399 - DNA, 17 bp, Homo sapiens
aaaagaaaaaaaaaaga

SEQ ID NO: 4445400 - DNA, 21 bp, Homo sapiens
aaaagaaaaatctcattattt

SEQ ID NO: 4445401 - DNA, 12 bp, Homo sapiens
aaaagaaacttt

SEQ ID NO: 4445402 - DNA, 20 bp, Homo sapiens
aaaagaaagaagttattttc

SEQ ID NO: 4445403 - DNA, 11 bp, Homo sapiens
aaaagaaaggc

SEQ ID NO: 4445404 - DNA, 18 bp, Homo sapiens
aaaagaaaggctgttaaa

SEQ ID NO: 4445405 - DNA, 15 bp, Homo sapiens
aaaagaaatatacag

SEQ ID NO: 4445406 - DNA, 21 bp, Homo sapiens
aaaagaaatcaatagttgaat

SEQ ID NO: 4445407 - DNA, 12 bp, Homo sapiens
aaaagaagaagt

SEQ ID NO: 4445408 - DNA, 14 bp, Homo sapiens
aaaagaagaagttt

SEQ ID NO: 4445409 - DNA, 14 bp, Homo sapiens
aaaagaaggaaaga

SEQ ID NO: 4445410 - DNA, 14 bp, Homo sapiens
aaaagacagggtgg

SEQ ID NO: 4445411 - DNA, 20 bp, Homo sapiens
aaaagacagggtgggaggga

SEQ ID NO: 4445412 - DNA, 23 bp, Homo sapiens
aaaagacagggtgggagggagga

SEQ ID NO: 4445413 - DNA, 13 bp, Homo sapiens
aaaagacatgcat

SEQ ID NO: 4445414 - DNA, 13 bp, Homo sapiens
aaaagacatttaa

SEQ ID NO: 4445415 - DNA, 13 bp, Homo sapiens
aaaagaccagact

SEQ ID NO: 4445416 - DNA, 22 bp, Homo sapiens
aaaagaccaggtctacagtgat

SEQ ID NO: 4445417 - DNA, 13 bp, Homo sapiens
aaaagagaatgat

SEQ ID NO: 4445418 - DNA, 21 bp, Homo sapiens
aaaagagaccacccatatcat

SEQ ID NO: 4445419 - DNA, 22 bp, Homo sapiens
aaaagagaccacccatatcatg

SEQ ID NO: 4445420 - DNA, 19 bp, Homo sapiens
aaaagaggatgatttcaga

SEQ ID NO: 4445421 - DNA, 20 bp, Homo sapiens
aaaagaggatgatttcagaa

SEQ ID NO: 4445422 - DNA, 12 bp, Homo sapiens
aaaagagtaatt

SEQ ID NO: 4445423 - DNA, 15 bp, Homo sapiens
aaaagagtcttccaa

SEQ ID NO: 4445424 - DNA, 17 bp, Homo sapiens
aaaagagtcttccaatt

SEQ ID NO: 4445425 - DNA, 22 bp, Homo sapiens
aaaagatcattcaactaaaaat

SEQ ID NO: 4445426 - DNA, 18 bp, Homo sapiens
aaaagatccttcatttta

SEQ ID NO: 4445427 - DNA, 23 bp, Homo sapiens
aaaagatctgttttgaaggcaaa

SEQ ID NO: 4445428 - DNA, 17 bp, Homo sapiens
aaaagatgaaaatattt

SEQ ID NO: 4445429 - DNA, 23 bp, Homo sapiens
aaaagattcccttgaaatttaga

SEQ ID NO: 4445430 - DNA, 21 bp, Homo sapiens
aaaagattgaagtattttgct

SEQ ID NO: 4445431 - DNA, 21 bp, Homo sapiens
aaaagatttttaaaatgaatc

SEQ ID NO: 4445432 - DNA, 16 bp, Homo sapiens
aaaagcaaaaaagaaa

SEQ ID NO: 4445433 - DNA, 14 bp, Homo sapiens
aaaagcaaatcatt

SEQ ID NO: 4445434 - DNA, 16 bp, Homo sapiens
aaaagcaattccaacc

SEQ ID NO: 4445435 - DNA, 18 bp, Homo sapiens
aaaagcatttttattata

SEQ ID NO: 4445436 - DNA, 17 bp, Homo sapiens
aaaagcatttttcaata

SEQ ID NO: 4445437 - DNA, 22 bp, Homo sapiens
aaaagccagccaagctttaaat

SEQ ID NO: 4445438 - DNA, 11 bp, Homo sapiens
aaaagcctgct

SEQ ID NO: 4445439 - DNA, 14 bp, Homo sapiens
aaaagctagaattg

SEQ ID NO: 4445440 - DNA, 19 bp, Homo sapiens
aaaagctatcttcatgtaa

SEQ ID NO: 4445441 - DNA, 21 bp, Homo sapiens
aaaagcttagctttagaaaca

SEQ ID NO: 4445442 - DNA, 23 bp, Homo sapiens
aaaagcttagctttagaaacagt

SEQ ID NO: 4445443 - DNA, 20 bp, Homo sapiens
aaagaataaaatgtttctct

SEQ ID NO: 4445444 - DNA, 14 bp, Homo sapiens
aaagaatagaaaga

SEQ ID NO: 4445445 - DNA, 18 bp, Homo sapiens
aaagaatcattatttatt

SEQ ID NO: 4445446 - DNA, 18 bp, Homo sapiens
aaagaatgccatttctca

SEQ ID NO: 4445447 - DNA, 18 bp, Homo sapiens
aaagaatgttactgcctt

SEQ ID NO: 4445448 - DNA, 19 bp, Homo sapiens
aaagaatgttactgcctta

SEQ ID NO: 4445449 - DNA, 16 bp, Homo sapiens
aaagacagggtgggag

SEQ ID NO: 4445450 - DNA, 19 bp, Homo sapiens
aaagacattatttctcata

SEQ ID NO: 4445451 - DNA, 14 bp, Homo sapiens
aaagaccagaaatt

SEQ ID NO: 4445452 - DNA, 17 bp, Homo sapiens
aaagaccagggatgctg

SEQ ID NO: 4445453 - DNA, 19 bp, Homo sapiens
aaagacgcaaggtgtgctc

SEQ ID NO: 4445454 - DNA, 20 bp, Homo sapiens
aaagactcaaattttgtacc

SEQ ID NO: 4445455 - DNA, 16 bp, Homo sapiens
aaagactgagcagaac

SEQ ID NO: 4445456 - DNA, 17 bp, Homo sapiens
aaagactggttttctgc

SEQ ID NO: 4445457 - DNA, 20 bp, Homo sapiens
aaagactgtggaaatgccaa

SEQ ID NO: 4445458 - DNA, 22 bp, Homo sapiens
aaagacttttatgtgagatttc

SEQ ID NO: 4445459 - DNA, 18 bp, Homo sapiens
aaagagaaaacatctcat

SEQ ID NO: 4445460 - DNA, 22 bp, Homo sapiens
aaagagaaacagttggtaactt

SEQ ID NO: 4445461 - DNA, 12 bp, Homo sapiens
aaagagaaactt

SEQ ID NO: 4445462 - DNA, 14 bp, Homo sapiens
aaagagaaactttg

SEQ ID NO: 4445463 - DNA, 21 bp, Homo sapiens
aaagagaaactttgtgctaca

SEQ ID NO: 4445464 - DNA, 14 bp, Homo sapiens
aaagagacatttca

SEQ ID NO: 4445465 - DNA, 15 bp, Homo sapiens
aaagagcaagtctgg

SEQ ID NO: 4445466 - DNA, 15 bp, Homo sapiens
aaagagcatggatgc

SEQ ID NO: 4445467 - DNA, 15 bp, Homo sapiens
aaagagcccttgcct

SEQ ID NO: 4445468 - DNA, 18 bp, Homo sapiens
aaagaggacagaaaaatt

SEQ ID NO: 4445469 - DNA, 19 bp, Homo sapiens
aaagaggatgatttcagaa

SEQ ID NO: 4445470 - DNA, 18 bp, Homo sapiens
aaagaggctgcccctctc

SEQ ID NO: 4445471 - DNA, 22 bp, Homo sapiens
aaagaggctgcccctctcacca

SEQ ID NO: 4445472 - DNA, 23 bp, Homo sapiens
aaagaggctgcccctctcaccaa

SEQ ID NO: 4445473 - DNA, 20 bp, Homo sapiens
aaagagtaatttcatttaaa

SEQ ID NO: 4445474 - DNA, 20 bp, Homo sapiens
aaagagtgtgttataaaata

SEQ ID NO: 4445475 - DNA, 14 bp, Homo sapiens
aaagagttcaagaa

SEQ ID NO: 4445476 - DNA, 15 bp, Homo sapiens
aaagataaagaccag

SEQ ID NO: 4445477 - DNA, 21 bp, Homo sapiens
aaagatacagaactctttcaa

SEQ ID NO: 4445478 - DNA, 18 bp, Homo sapiens
aaagatataaggggaaag

SEQ ID NO: 4445479 - DNA, 14 bp, Homo sapiens
aaagatatggagaa

SEQ ID NO: 4445480 - DNA, 15 bp, Homo sapiens
aaagatatggagaat

SEQ ID NO: 4445481 - DNA, 16 bp, Homo sapiens
aaagatatttttatct

SEQ ID NO: 4445482 - DNA, 22 bp, Homo sapiens
aaagatcatttataatactgtt

SEQ ID NO: 4445483 - DNA, 15 bp, Homo sapiens
aaagatccttcattt

SEQ ID NO: 4445484 - DNA, 13 bp, Homo sapiens
aaagatctgtttt

SEQ ID NO: 4445485 - DNA, 16 bp, Homo sapiens
aaagatctgttttgaa

SEQ ID NO: 4445486 - DNA, 13 bp, Homo sapiens
aaagatgaaaata

SEQ ID NO: 4445487 - DNA, 16 bp, Homo sapiens
aaagatgaaaatattt

SEQ ID NO: 4445488 - DNA, 17 bp, Homo sapiens
aaagatgaaaatatttg

SEQ ID NO: 4445489 - DNA, 13 bp, Homo sapiens
aaagatgatttaa

SEQ ID NO: 4445490 - DNA, 20 bp, Homo sapiens
aaagatgcaaggaccaggac

SEQ ID NO: 4445491 - DNA, 13 bp, Homo sapiens
aaagatgcacaga

SEQ ID NO: 4445492 - DNA, 20 bp, Homo sapiens
aaagatggtaaaccagatct

SEQ ID NO: 4445493 - DNA, 20 bp, Homo sapiens
aaagatggttaaacattttc

SEQ ID NO: 4445494 - DNA, 23 bp, Homo sapiens
aaagatgtatggatttccagttt

SEQ ID NO: 4445495 - DNA, 15 bp, Homo sapiens
aaagatgtgttttgt

SEQ ID NO: 4445496 - DNA, 19 bp, Homo sapiens
aaagattaaatgtgtcatt

SEQ ID NO: 4445497 - DNA, 22 bp, Homo sapiens
aaagattattgtgacttcactg

SEQ ID NO: 4445498 - DNA, 18 bp, Homo sapiens
aaagattcccttgaaatt

SEQ ID NO: 4445499 - DNA, 23 bp, Homo sapiens
aaagattgaagtattttgctgga

SEQ ID NO: 4445500 - DNA, 19 bp, Homo sapiens
aaagattgctgaaatttta

SEQ ID NO: 4445501 - DNA, 21 bp, Homo sapiens
aaagattgctgaaattttata

SEQ ID NO: 4445502 - DNA, 22 bp, Homo sapiens
aaagattgtattgatacagaga

SEQ ID NO: 4445503 - DNA, 15 bp, Homo sapiens
aaagattgtattgct

SEQ ID NO: 4445504 - DNA, 16 bp, Homo sapiens
aaagatttatttagct

SEQ ID NO: 4445505 - DNA, 19 bp, Homo sapiens
aaagatttctagtaggcag

SEQ ID NO: 4445506 - DNA, 12 bp, Homo sapiens
aaagatttcttc

SEQ ID NO: 4445507 - DNA, 16 bp, Homo sapiens
aaagatttgtggtaac

SEQ ID NO: 4445508 - DNA, 16 bp, Homo sapiens
aaagatttttaaaatg

SEQ ID NO: 4445509 - DNA, 13 bp, Homo sapiens
aaagattttttaa

SEQ ID NO: 4445510 - DNA, 20 bp, Homo sapiens
aaagattttttaataattta

SEQ ID NO: 4445511 - DNA, 21 bp, Homo sapiens
aaagattttttaataatttag

SEQ ID NO: 4445512 - DNA, 15 bp, Homo sapiens
aaagcaaaaaagaaa

SEQ ID NO: 4445513 - DNA, 16 bp, Homo sapiens
aaagcaaaaaagaaaa

SEQ ID NO: 4445514 - DNA, 14 bp, Homo sapiens
aaagcaaatcattt

SEQ ID NO: 4445515 - DNA, 23 bp, Homo sapiens
aaagcaacaaagattgagaagcc

SEQ ID NO: 4445516 - DNA, 20 bp, Homo sapiens
aaagcaagcattcagaagaa

SEQ ID NO: 4445517 - DNA, 17 bp, Homo sapiens
aaagcaataaatgaatg

SEQ ID NO: 4445518 - DNA, 12 bp, Homo sapiens
aaagcaatattg

SEQ ID NO: 4445519 - DNA, 15 bp, Homo sapiens
aaagcaattatattg

SEQ ID NO: 4445520 - DNA, 16 bp, Homo sapiens
aaagcaattctgactg

SEQ ID NO: 4445521 - DNA, 18 bp, Homo sapiens
aaagcacaaagttctcag

SEQ ID NO: 4445522 - DNA, 18 bp, Homo sapiens
aaagcacaagtacttttg

SEQ ID NO: 4445523 - DNA, 18 bp, Homo sapiens
aaagcaccactgttctgt

SEQ ID NO: 4445524 - DNA, 17 bp, Homo sapiens
aaagcacgacagtggat

SEQ ID NO: 4445525 - DNA, 15 bp, Homo sapiens
aaagcactagagaat

SEQ ID NO: 4445526 - DNA, 16 bp, Homo sapiens
aaagcagaacagtgat

SEQ ID NO: 4445527 - DNA, 14 bp, Homo sapiens
aaagcaggaaaaaa

SEQ ID NO: 4445528 - DNA, 22 bp, Homo sapiens
aaagcaggcttgcccagtacat

SEQ ID NO: 4445529 - DNA, 16 bp, Homo sapiens
aaagcagtatttttct

SEQ ID NO: 4445530 - DNA, 13 bp, Homo sapiens
aaagcataaagct

SEQ ID NO: 4445531 - DNA, 21 bp, Homo sapiens
aaagcataaagctcaaatgaa

SEQ ID NO: 4445532 - DNA, 22 bp, Homo sapiens
aaagcatcaccactcattttga

SEQ ID NO: 4445533 - DNA, 12 bp, Homo sapiens
aaagcatccctc

SEQ ID NO: 4445534 - DNA, 15 bp, Homo sapiens
aaagcatccctcacc

SEQ ID NO: 4445535 - DNA, 17 bp, Homo sapiens
aaagcatccctcaccca

SEQ ID NO: 4445536 - DNA, 17 bp, Homo sapiens
aaagcattgtaaatgtg

SEQ ID NO: 4445537 - DNA, 19 bp, Homo sapiens
aaagcattgtaaatgtgct

SEQ ID NO: 4445538 - DNA, 13 bp, Homo sapiens
aaagcatttttca

SEQ ID NO: 4445539 - DNA, 16 bp, Homo sapiens
aaagcatttttcaata

SEQ ID NO: 4445540 - DNA, 18 bp, Homo sapiens
aaagccaccttgttacaa

SEQ ID NO: 4445541 - DNA, 21 bp, Homo sapiens
aaagccacgccctccctgcta

SEQ ID NO: 4445542 - DNA, 16 bp, Homo sapiens
aaagccaggagcagcc

SEQ ID NO: 4445543 - DNA, 18 bp, Homo sapiens
aaagccaggagcagccct

SEQ ID NO: 4445544 - DNA, 19 bp, Homo sapiens
aaagccaggagcagccctg

SEQ ID NO: 4445545 - DNA, 22 bp, Homo sapiens
aaagccatccccgctcctggtt

SEQ ID NO: 4445546 - DNA, 18 bp, Homo sapiens
aaagcccaaagtggtata

SEQ ID NO: 4445547 - DNA, 20 bp, Homo sapiens
aaagccccccagctcccaca

SEQ ID NO: 4445548 - DNA, 22 bp, Homo sapiens
aaagccccccagctcccacacc

SEQ ID NO: 4445549 - DNA, 16 bp, Homo sapiens
aaagcctgttgtttaa

SEQ ID NO: 4445550 - DNA, 21 bp, Homo sapiens
aaagcctgttgtttaagtgac

SEQ ID NO: 4445551 - DNA, 19 bp, Homo sapiens
aaagccttagggaagctgg

SEQ ID NO: 4445552 - DNA, 14 bp, Homo sapiens
aaagcggtccctgt

SEQ ID NO: 4445553 - DNA, 15 bp, Homo sapiens
aaagctaaactgaat

SEQ ID NO: 4445554 - DNA, 22 bp, Homo sapiens
aaagctacaatattctctctta

SEQ ID NO: 4445555 - DNA, 14 bp, Homo sapiens
aaagctagaaatga

SEQ ID NO: 4445556 - DNA, 20 bp, Homo sapiens
aaagctataaagcagtattt

SEQ ID NO: 4445557 - DNA, 19 bp, Homo sapiens
aaagctccatgtgcctctt

SEQ ID NO: 4445558 - DNA, 14 bp, Homo sapiens
aaagctctgaaaac

SEQ ID NO: 4445559 - DNA, 21 bp, Homo sapiens
aaagctctgttccatgcaact

SEQ ID NO: 4445560 - DNA, 16 bp, Homo sapiens
aaagctgctaaatctc

SEQ ID NO: 4445561 - DNA, 20 bp, Homo sapiens
aaatatcagttactcagccc

SEQ ID NO: 4445562 - DNA, 13 bp, Homo sapiens
aaatatcatgtta

SEQ ID NO: 4445563 - DNA, 18 bp, Homo sapiens
aaatatcatgttaaatta

SEQ ID NO: 4445564 - DNA, 21 bp, Homo sapiens
aaatatcatgttaaattagaa

SEQ ID NO: 4445565 - DNA, 18 bp, Homo sapiens
aaatatccaccactttaa

SEQ ID NO: 4445566 - DNA, 22 bp, Homo sapiens
aaatatccatttatcttttgta

SEQ ID NO: 4445567 - DNA, 10 bp, Homo sapiens
aaatatctga

SEQ ID NO: 4445568 - DNA, 19 bp, Homo sapiens
aaatatctgaacatttact

SEQ ID NO: 4445569 - DNA, 14 bp, Homo sapiens
aaatatcttggcct

SEQ ID NO: 4445570 - DNA, 19 bp, Homo sapiens
aaatatgaaccctttgttt

SEQ ID NO: 4445571 - DNA, 15 bp, Homo sapiens
aaatatgcaaagcac

SEQ ID NO: 4445572 - DNA, 16 bp, Homo sapiens
aaatatggacacttaa

SEQ ID NO: 4445573 - DNA, 20 bp, Homo sapiens
aaatatggacacttaatact

SEQ ID NO: 4445574 - DNA, 13 bp, Homo sapiens
aaatatgtattta

SEQ ID NO: 4445575 - DNA, 13 bp, Homo sapiens
aaatatgtgaagt

SEQ ID NO: 4445576 - DNA, 12 bp, Homo sapiens
aaatattaacat

SEQ ID NO: 4445577 - DNA, 12 bp, Homo sapiens
aaatattaagaa

SEQ ID NO: 4445578 - DNA, 18 bp, Homo sapiens
aaatattaagaacatttt

SEQ ID NO: 4445579 - DNA, 15 bp, Homo sapiens
aaatattaagagcta

SEQ ID NO: 4445580 - DNA, 22 bp, Homo sapiens
aaatattaagagctattttaga

SEQ ID NO: 4445581 - DNA, 15 bp, Homo sapiens
aaatattcagaaatt

SEQ ID NO: 4445582 - DNA, 19 bp, Homo sapiens
aaatattccctagaaactt

SEQ ID NO: 4445583 - DNA, 20 bp, Homo sapiens
aaatattctgaatcaccaat

SEQ ID NO: 4445584 - DNA, 21 bp, Homo sapiens
aaatattctgaatcaccaatt

SEQ ID NO: 4445585 - DNA, 14 bp, Homo sapiens
aaatattgcttcaa

SEQ ID NO: 4445586 - DNA, 19 bp, Homo sapiens
aaatattgcttcaatttca

SEQ ID NO: 4445587 - DNA, 22 bp, Homo sapiens
aaatattgtttctgcattcatt

SEQ ID NO: 4445588 - DNA, 14 bp, Homo sapiens
aaatatttaaaaat

SEQ ID NO: 4445589 - DNA, 16 bp, Homo sapiens
aaatatttaagtgaag

SEQ ID NO: 4445590 - DNA, 20 bp, Homo sapiens
aaatatttaagtgaaggaga

SEQ ID NO: 4445591 - DNA, 15 bp, Homo sapiens
aaatatttaatatca

SEQ ID NO: 4445592 - DNA, 16 bp, Homo sapiens
aaatatttaatatcaa

SEQ ID NO: 4445593 - DNA, 20 bp, Homo sapiens
aaatatttaatatcaaaaga

SEQ ID NO: 4445594 - DNA, 23 bp, Homo sapiens
aaatatttattcattatttgtca

SEQ ID NO: 4445595 - DNA, 14 bp, Homo sapiens
aaatattttaaaga

SEQ ID NO: 4445596 - DNA, 19 bp, Homo sapiens
aaatattttaaagaattgt

SEQ ID NO: 4445597 - DNA, 15 bp, Homo sapiens
aaatattttctctgt

SEQ ID NO: 4445598 - DNA, 15 bp, Homo sapiens
aaatattttgaatca

SEQ ID NO: 4445599 - DNA, 21 bp, Homo sapiens
aaatattttgttaacttttgt

SEQ ID NO: 4445600 - DNA, 22 bp, Homo sapiens
aaatatttttggtcattgtaat

SEQ ID NO: 4445601 - DNA, 16 bp, Homo sapiens
aaatcaaatatgcaaa

SEQ ID NO: 4445602 - DNA, 21 bp, Homo sapiens
aaatcaacaccttaatatgct

SEQ ID NO: 4445603 - DNA, 23 bp, Homo sapiens
aaatcaactttttattgccttct

SEQ ID NO: 4445604 - DNA, 17 bp, Homo sapiens
aaatcaaggaaaggctc

SEQ ID NO: 4445605 - DNA, 23 bp, Homo sapiens
aaatcaagtatttgggaagtgaa

SEQ ID NO: 4445606 - DNA, 15 bp, Homo sapiens
aaatcaatagttgaa

SEQ ID NO: 4445607 - DNA, 16 bp, Homo sapiens
aaatcacaatttttaa

SEQ ID NO: 4445608 - DNA, 17 bp, Homo sapiens
aaatcacgctttttgaa

SEQ ID NO: 4445609 - DNA, 15 bp, Homo sapiens
aaatcagtagaaagc

SEQ ID NO: 4445610 - DNA, 18 bp, Homo sapiens
aaatcagtagaaagctaa

SEQ ID NO: 4445611 - DNA, 19 bp, Homo sapiens
aaatcagtagaaagctaaa

SEQ ID NO: 4445612 - DNA, 23 bp, Homo sapiens
aaatcagtatattttctgtattt

SEQ ID NO: 4445613 - DNA, 19 bp, Homo sapiens
aaatcatctattttgatgc

SEQ ID NO: 4445614 - DNA, 16 bp, Homo sapiens
aaatcatctcaccttg

SEQ ID NO: 4445615 - DNA, 23 bp, Homo sapiens
aaatcatgttgatcatgtacttt

SEQ ID NO: 4445616 - DNA, 17 bp, Homo sapiens
aaatcatgttgttgtgt

SEQ ID NO: 4445617 - DNA, 19 bp, Homo sapiens
aaatcatttctgcatcagc

SEQ ID NO: 4445618 - DNA, 22 bp, Homo sapiens
aaatcatttctgcatcagctgc

SEQ ID NO: 4445619 - DNA, 23 bp, Homo sapiens
aaatcatttctgcatcagctgct

SEQ ID NO: 4445620 - DNA, 16 bp, Homo sapiens
aaatcattttaggaaa

SEQ ID NO: 4445621 - DNA, 20 bp, Homo sapiens
aaatccaaaaagctctgaaa

SEQ ID NO: 4445622 - DNA, 22 bp, Homo sapiens
aaatccaaaaagctctgaaaac

SEQ ID NO: 4445623 - DNA, 15 bp, Homo sapiens
aaatccaagatgctg

SEQ ID NO: 4445624 - DNA, 19 bp, Homo sapiens
aaatccagactttcttttt

SEQ ID NO: 4445625 - DNA, 18 bp, Homo sapiens
aaatccattccaggtagc

SEQ ID NO: 4445626 - DNA, 19 bp, Homo sapiens
aaatccattccaggtagct

SEQ ID NO: 4445627 - DNA, 12 bp, Homo sapiens
aaatcccacatc

SEQ ID NO: 4445628 - DNA, 18 bp, Homo sapiens
aaatccccccttcagaac

SEQ ID NO: 4445629 - DNA, 22 bp, Homo sapiens
aaatccggtcagccaagtgcag

SEQ ID NO: 4445630 - DNA, 14 bp, Homo sapiens
aaatcctcaggaaa

SEQ ID NO: 4445631 - DNA, 18 bp, Homo sapiens
aaatcctctgttttctct

SEQ ID NO: 4445632 - DNA, 18 bp, Homo sapiens
aaatcctgaactttctcc

SEQ ID NO: 4445633 - DNA, 18 bp, Homo sapiens
aaatcctgcccaaaatgt

SEQ ID NO: 4445634 - DNA, 22 bp, Homo sapiens
aaatcctgcccaaaatgtgaag

SEQ ID NO: 4445635 - DNA, 23 bp, Homo sapiens
aaatccttgtgacttacaatttg

SEQ ID NO: 4445636 - DNA, 22 bp, Homo sapiens
aaatcgtggcacgtattgctgt

SEQ ID NO: 4445637 - DNA, 15 bp, Homo sapiens
aaatctaacattatt

SEQ ID NO: 4445638 - DNA, 15 bp, Homo sapiens
aaatctaagctgtgt

SEQ ID NO: 4445639 - DNA, 17 bp, Homo sapiens
aaatctaccactgtatg

SEQ ID NO: 4445640 - DNA, 18 bp, Homo sapiens
aaatctagaagagtctat

SEQ ID NO: 4445641 - DNA, 15 bp, Homo sapiens
aaatctagacattct

SEQ ID NO: 4445642 - DNA, 17 bp, Homo sapiens
aaatctcattatttcaa

SEQ ID NO: 4445643 - DNA, 20 bp, Homo sapiens
aaatctcattatttcaaaat

SEQ ID NO: 4445644 - DNA, 12 bp, Homo sapiens
aaatctcattcc

SEQ ID NO: 4445645 - DNA, 12 bp, Homo sapiens
aaatctccatta

SEQ ID NO: 4445646 - DNA, 16 bp, Homo sapiens
aaatctcccattttgg

SEQ ID NO: 4445647 - DNA, 21 bp, Homo sapiens
aaatctcccattttggaattt

SEQ ID NO: 4445648 - DNA, 17 bp, Homo sapiens
aaatctcttctttgctg

SEQ ID NO: 4445649 - DNA, 22 bp, Homo sapiens
aaatctgaagaggcttctcctg

SEQ ID NO: 4445650 - DNA, 11 bp, Homo sapiens
aaatctgcctg

SEQ ID NO: 4445651 - DNA, 13 bp, Homo sapiens
aaatctgcctggg

SEQ ID NO: 4445652 - DNA, 15 bp, Homo sapiens
aaatctgcctgggtt

SEQ ID NO: 4445653 - DNA, 23 bp, Homo sapiens
aaatctggggaagaggttttatt

SEQ ID NO: 4445654 - DNA, 19 bp, Homo sapiens
aaatctgtattctgtttgc

SEQ ID NO: 4445655 - DNA, 21 bp, Homo sapiens
aaatctgtccaaaggaggctg

SEQ ID NO: 4445656 - DNA, 17 bp, Homo sapiens
aaatctgtgacctgtca

SEQ ID NO: 4445657 - DNA, 22 bp, Homo sapiens
aaatctgtgacctgtcagaata

SEQ ID NO: 4445658 - DNA, 19 bp, Homo sapiens
aaatctgtgatgatcctca

SEQ ID NO: 4445659 - DNA, 23 bp, Homo sapiens
aaatctgtgatgatcctcatatg

SEQ ID NO: 4445660 - DNA, 14 bp, Homo sapiens
aaatcttaacttga

SEQ ID NO: 4445661 - DNA, 13 bp, Homo sapiens
aaatcttgcttca

SEQ ID NO: 4445662 - DNA, 24 bp, Homo sapiens
aaatcttgtttgttactgtcattc

SEQ ID NO: 4445663 - DNA, 18 bp, Homo sapiens
aaatcttttataggattt

SEQ ID NO: 4445664 - DNA, 15 bp, Homo sapiens
aaatctttttgcttc

SEQ ID NO: 4445665 - DNA, 23 bp, Homo sapiens
aaatctttttgcttctactttca

SEQ ID NO: 4445666 - DNA, 16 bp, Homo sapiens
aaatgaaacaatgaaa

SEQ ID NO: 4445667 - DNA, 20 bp, Homo sapiens
aaatgaaacagggaaaatga

SEQ ID NO: 4445668 - DNA, 15 bp, Homo sapiens
aaatgaaagaaaatg

SEQ ID NO: 4445669 - DNA, 22 bp, Homo sapiens
aaatgaaagcagggacttgaac

SEQ ID NO: 4445670 - DNA, 13 bp, Homo sapiens
aaatgaaagctac

SEQ ID NO: 4445671 - DNA, 11 bp, Homo sapiens
aaatgaaaggg

SEQ ID NO: 4445672 - DNA, 12 bp, Homo sapiens
aaatgaaaggga

SEQ ID NO: 4445673 - DNA, 15 bp, Homo sapiens
aaatgaaagtggtaa

SEQ ID NO: 4445674 - DNA, 15 bp, Homo sapiens
aaatgaaatgccaaa

SEQ ID NO: 4445675 - DNA, 15 bp, Homo sapiens
aaatgaatattttga

SEQ ID NO: 4445676 - DNA, 22 bp, Homo sapiens
aaatgaatgattaaattatgaa

SEQ ID NO: 4445677 - DNA, 23 bp, Homo sapiens
aaatgaatgattaaattatgaag

SEQ ID NO: 4445678 - DNA, 23 bp, Homo sapiens
aaatgaatggaggaactttccaa

SEQ ID NO: 4445679 - DNA, 20 bp, Homo sapiens
aaatttagtttgttaaagcc

SEQ ID NO: 4445680 - DNA, 16 bp, Homo sapiens
aaatttataaaggtct

SEQ ID NO: 4445681 - DNA, 14 bp, Homo sapiens
aaatttatatgaaa

SEQ ID NO: 4445682 - DNA, 21 bp, Homo sapiens
aaatttattagccctgcattt

SEQ ID NO: 4445683 - DNA, 18 bp, Homo sapiens
aaatttcacagttctgta

SEQ ID NO: 4445684 - DNA, 19 bp, Homo sapiens
aaatttcacagttctgtaa

SEQ ID NO: 4445685 - DNA, 22 bp, Homo sapiens
aaatttcatttcacatttttgt

SEQ ID NO: 4445686 - DNA, 22 bp, Homo sapiens
aaatttcctgtttgaaatatca

SEQ ID NO: 4445687 - DNA, 20 bp, Homo sapiens
aaatttcttatgtgacatta

SEQ ID NO: 4445688 - DNA, 20 bp, Homo sapiens
aaatttgaataagcagaaca

SEQ ID NO: 4445689 - DNA, 16 bp, Homo sapiens
aaatttgacttttctg

SEQ ID NO: 4445690 - DNA, 15 bp, Homo sapiens
aaatttgatgatgtt

SEQ ID NO: 4445691 - DNA, 18 bp, Homo sapiens
aaatttgatggactaatt

SEQ ID NO: 4445692 - DNA, 14 bp, Homo sapiens
aaatttgattgatt

SEQ ID NO: 4445693 - DNA, 17 bp, Homo sapiens
aaatttgattgatttga

SEQ ID NO: 4445694 - DNA, 13 bp, Homo sapiens
aaatttggcctta

SEQ ID NO: 4445695 - DNA, 20 bp, Homo sapiens
aaatttggccttaagaactg

SEQ ID NO: 4445696 - DNA, 19 bp, Homo sapiens
aaatttgtgtaaatttgta

SEQ ID NO: 4445697 - DNA, 18 bp, Homo sapiens
aaatttgttcttgtattt

SEQ ID NO: 4445698 - DNA, 16 bp, Homo sapiens
aaatttgttgtttgtt

SEQ ID NO: 4445699 - DNA, 23 bp, Homo sapiens
aaattttaattcaagaaatgaca

SEQ ID NO: 4445700 - DNA, 13 bp, Homo sapiens
aaattttatatgt

SEQ ID NO: 4445701 - DNA, 13 bp, Homo sapiens
aaattttatgtca

SEQ ID NO: 4445702 - DNA, 21 bp, Homo sapiens
aaattttatgtcatagaaata

SEQ ID NO: 4445703 - DNA, 14 bp, Homo sapiens
aaattttattatta

SEQ ID NO: 4445704 - DNA, 15 bp, Homo sapiens
aaattttcaaatcct

SEQ ID NO: 4445705 - DNA, 17 bp, Homo sapiens
aaattttcttgatttga

SEQ ID NO: 4445706 - DNA, 17 bp, Homo sapiens
aaattttgcatattctc

SEQ ID NO: 4445707 - DNA, 18 bp, Homo sapiens
aaattttgcatattctct

SEQ ID NO: 4445708 - DNA, 19 bp, Homo sapiens
aaattttgcatattctcta

SEQ ID NO: 4445709 - DNA, 21 bp, Homo sapiens
aaattttgttttttaagtttt

SEQ ID NO: 4445710 - DNA, 17 bp, Homo sapiens
aaatttttgtagtagcg

SEQ ID NO: 4445711 - DNA, 16 bp, Homo sapiens
aaattttttaaaagag

SEQ ID NO: 4445712 - DNA, 17 bp, Homo sapiens
aaattttttaaaagttt

SEQ ID NO: 4445713 - DNA, 13 bp, Homo sapiens
aaattttttgact

SEQ ID NO: 4445714 - DNA, 13 bp, Homo sapiens
aacaaaaagatgt

SEQ ID NO: 4445715 - DNA, 17 bp, Homo sapiens
aacaaaaatcaaacttt

SEQ ID NO: 4445716 - DNA, 9 bp, Homo sapiens
aacaaaact

SEQ ID NO: 4445717 - DNA, 21 bp, Homo sapiens
aacaaaagcgacccattcaga

SEQ ID NO: 4445718 - DNA, 13 bp, Homo sapiens
aacaaaagggtca

SEQ ID NO: 4445719 - DNA, 17 bp, Homo sapiens
aacaaaagggtgtatag

SEQ ID NO: 4445720 - DNA, 23 bp, Homo sapiens
aacaaaagggtgtatagtgttca

SEQ ID NO: 4445721 - DNA, 14 bp, Homo sapiens
aacaaaatgtatgt

SEQ ID NO: 4445722 - DNA, 13 bp, Homo sapiens
aacaaaatttcta

SEQ ID NO: 4445723 - DNA, 24 bp, Homo sapiens
aacaaaatttgactaattttacat

SEQ ID NO: 4445724 - DNA, 12 bp, Homo sapiens
aacaaacaaaaa

SEQ ID NO: 4445725 - DNA, 20 bp, Homo sapiens
aacaaaccttgccttgaaat

SEQ ID NO: 4445726 - DNA, 18 bp, Homo sapiens
aacaaacgtaatttgtta

SEQ ID NO: 4445727 - DNA, 16 bp, Homo sapiens
aacaaactcgtttttt

SEQ ID NO: 4445728 - DNA, 11 bp, Homo sapiens
aacaaagaaac

SEQ ID NO: 4445729 - DNA, 19 bp, Homo sapiens
aacaaagacatgctttcca

SEQ ID NO: 4445730 - DNA, 19 bp, Homo sapiens
aacaaagagttcaagaaat

SEQ ID NO: 4445731 - DNA, 23 bp, Homo sapiens
aacaaagagttcaagaaataagt

SEQ ID NO: 4445732 - DNA, 17 bp, Homo sapiens
aacaaagtgctttttca

SEQ ID NO: 4445733 - DNA, 12 bp, Homo sapiens
aacaaataaata

SEQ ID NO: 4445734 - DNA, 21 bp, Homo sapiens
aacaaatgctttattatttat

SEQ ID NO: 4445735 - DNA, 18 bp, Homo sapiens
aacaaattgtttacataa

SEQ ID NO: 4445736 - DNA, 15 bp, Homo sapiens
aacaaccacaggaat

SEQ ID NO: 4445737 - DNA, 14 bp, Homo sapiens
aacaacctcaactg

SEQ ID NO: 4445738 - DNA, 18 bp, Homo sapiens
aacaacctcaactgccta

SEQ ID NO: 4445739 - DNA, 14 bp, Homo sapiens
aacaactatttact

SEQ ID NO: 4445740 - DNA, 15 bp, Homo sapiens
aacaactctttgaga

SEQ ID NO: 4445741 - DNA, 14 bp, Homo sapiens
aacaacttgtagca

SEQ ID NO: 4445742 - DNA, 16 bp, Homo sapiens
aacaacttgtagcagc

SEQ ID NO: 4445743 - DNA, 23 bp, Homo sapiens
aacaagacctcagtgccttcctg

SEQ ID NO: 4445744 - DNA, 12 bp, Homo sapiens
aacaagatttcc

SEQ ID NO: 4445745 - DNA, 22 bp, Homo sapiens
aacaagcaaggatatcagagct

SEQ ID NO: 4445746 - DNA, 15 bp, Homo sapiens
aacaagtaaatatat

SEQ ID NO: 4445747 - DNA, 20 bp, Homo sapiens
aacaagtcatttttgtattt

SEQ ID NO: 4445748 - DNA, 12 bp, Homo sapiens
aacaagttgcct

SEQ ID NO: 4445749 - DNA, 16 bp, Homo sapiens
aacaataaaatttttt

SEQ ID NO: 4445750 - DNA, 12 bp, Homo sapiens
aacaataataaa

SEQ ID NO: 4445751 - DNA, 13 bp, Homo sapiens
aacaataataaaa

SEQ ID NO: 4445752 - DNA, 19 bp, Homo sapiens
aacaataatatttcaagtg

SEQ ID NO: 4445753 - DNA, 20 bp, Homo sapiens
aacaataatatttcaagtgc

SEQ ID NO: 4445754 - DNA, 21 bp, Homo sapiens
aacaatatgtttgcaaacttg

SEQ ID NO: 4445755 - DNA, 16 bp, Homo sapiens
aacaatccattcacaa

SEQ ID NO: 4445756 - DNA, 13 bp, Homo sapiens
aacaatctattta

SEQ ID NO: 4445757 - DNA, 15 bp, Homo sapiens
aacaatctatttaaa

SEQ ID NO: 4445758 - DNA, 18 bp, Homo sapiens
aacaatctatttaaaaaa

SEQ ID NO: 4445759 - DNA, 14 bp, Homo sapiens
aacaatcttcctgt

SEQ ID NO: 4445760 - DNA, 18 bp, Homo sapiens
aacaatgaaaacaaataa

SEQ ID NO: 4445761 - DNA, 15 bp, Homo sapiens
aacaatgacatttat

SEQ ID NO: 4445762 - DNA, 18 bp, Homo sapiens
aacaatgcctattgtaat

SEQ ID NO: 4445763 - DNA, 16 bp, Homo sapiens
aacaatgccttgttgt

SEQ ID NO: 4445764 - DNA, 22 bp, Homo sapiens
aacaattctaaaatgattgtag

SEQ ID NO: 4445765 - DNA, 16 bp, Homo sapiens
aacaattggtaaaact

SEQ ID NO: 4445766 - DNA, 17 bp, Homo sapiens
aacaattggtaaaactc

SEQ ID NO: 4445767 - DNA, 23 bp, Homo sapiens
aacaattggtaaaactcactgtg

SEQ ID NO: 4445768 - DNA, 17 bp, Homo sapiens
aacaattggtgtcattt

SEQ ID NO: 4445769 - DNA, 16 bp, Homo sapiens
aacaatttatgaattg

SEQ ID NO: 4445770 - DNA, 17 bp, Homo sapiens
aacacaacaataacttt

SEQ ID NO: 4445771 - DNA, 21 bp, Homo sapiens
aacacacaggtgcaacagact

SEQ ID NO: 4445772 - DNA, 17 bp, Homo sapiens
aacacaccctgcttcat

SEQ ID NO: 4445773 - DNA, 13 bp, Homo sapiens
aacacagtatttt

SEQ ID NO: 4445774 - DNA, 19 bp, Homo sapiens
aacaccagaggggaaaaaa

SEQ ID NO: 4445775 - DNA, 23 bp, Homo sapiens
aacaccagaggggaaaaaatcat

SEQ ID NO: 4445776 - DNA, 22 bp, Homo sapiens
aacaccctttcatctcagagtc

SEQ ID NO: 4445777 - DNA, 15 bp, Homo sapiens
aacacctgccttcta

SEQ ID NO: 4445778 - DNA, 15 bp, Homo sapiens
aacacgaaagaaatg

SEQ ID NO: 4445779 - DNA, 15 bp, Homo sapiens
aacacgataaaccat

SEQ ID NO: 4445780 - DNA, 13 bp, Homo sapiens
aacactaaacatt

SEQ ID NO: 4445781 - DNA, 13 bp, Homo sapiens
aacactaaccaaa

SEQ ID NO: 4445782 - DNA, 13 bp, Homo sapiens
aacactaatatat

SEQ ID NO: 4445783 - DNA, 22 bp, Homo sapiens
aacactaatatatttaaaaata

SEQ ID NO: 4445784 - DNA, 22 bp, Homo sapiens
aacactaatcacaaactgaatg

SEQ ID NO: 4445785 - DNA, 12 bp, Homo sapiens
aacactattttc

SEQ ID NO: 4445786 - DNA, 19 bp, Homo sapiens
aacactattttcagaatct

SEQ ID NO: 4445787 - DNA, 20 bp, Homo sapiens
aacactcagcagacatttat

SEQ ID NO: 4445788 - DNA, 19 bp, Homo sapiens
aacactcatgggaatgcat

SEQ ID NO: 4445789 - DNA, 12 bp, Homo sapiens
aacactgccagc

SEQ ID NO: 4445790 - DNA, 22 bp, Homo sapiens
aacactgccagcatttcccttc

SEQ ID NO: 4445791 - DNA, 22 bp, Homo sapiens
aacactggtctgctgttccagt

SEQ ID NO: 4445792 - DNA, 16 bp, Homo sapiens
aacacttccagtctgg

SEQ ID NO: 4445793 - DNA, 22 bp, Homo sapiens
aacacttggcatacaaaatatt

SEQ ID NO: 4445794 - DNA, 23 bp, Homo sapiens
aacacttggcatacaaaatattt

SEQ ID NO: 4445795 - DNA, 17 bp, Homo sapiens
aacactttgcctcctgt

SEQ ID NO: 4445796 - DNA, 18 bp, Homo sapiens
aacagaaattgtatattg

SEQ ID NO: 4445797 - DNA, 14 bp, Homo sapiens
aaccttcaacccag

SEQ ID NO: 4445798 - DNA, 24 bp, Homo sapiens
aaccttcacgattaactgtgaaat

SEQ ID NO: 4445799 - DNA, 22 bp, Homo sapiens
aaccttccaacttcctgtggcc

SEQ ID NO: 4445800 - DNA, 15 bp, Homo sapiens
aaccttccacccagt

SEQ ID NO: 4445801 - DNA, 13 bp, Homo sapiens
aaccttccctcca

SEQ ID NO: 4445802 - DNA, 19 bp, Homo sapiens
aaccttccttcctgcttga

SEQ ID NO: 4445803 - DNA, 18 bp, Homo sapiens
aaccttgaaaactttatg

SEQ ID NO: 4445804 - DNA, 18 bp, Homo sapiens
aaccttgccttgaaattt

SEQ ID NO: 4445805 - DNA, 15 bp, Homo sapiens
aaccttgctctcctc

SEQ ID NO: 4445806 - DNA, 12 bp, Homo sapiens
aacctttaaaaa

SEQ ID NO: 4445807 - DNA, 22 bp, Homo sapiens
aacctttaaaaatgtataatga

SEQ ID NO: 4445808 - DNA, 23 bp, Homo sapiens
aacctttacagttagcagggatg

SEQ ID NO: 4445809 - DNA, 15 bp, Homo sapiens
aacctttccctcacc

SEQ ID NO: 4445810 - DNA, 22 bp, Homo sapiens
aacctttccgctgtcgccccag

SEQ ID NO: 4445811 - DNA, 23 bp, Homo sapiens
aacctttccgctgtcgccccagg

SEQ ID NO: 4445812 - DNA, 11 bp, Homo sapiens
aacctttgcta

SEQ ID NO: 4445813 - DNA, 17 bp, Homo sapiens
aacctttgctatgtaag

SEQ ID NO: 4445814 - DNA, 12 bp, Homo sapiens
aacctttgtcaa

SEQ ID NO: 4445815 - DNA, 16 bp, Homo sapiens
aacctttgtttcaact

SEQ ID NO: 4445816 - DNA, 13 bp, Homo sapiens
aaccttttcttgt

SEQ ID NO: 4445817 - DNA, 16 bp, Homo sapiens
aacgaaaatgaaagct

SEQ ID NO: 4445818 - DNA, 18 bp, Homo sapiens
aacgactgggcactgcca

SEQ ID NO: 4445819 - DNA, 13 bp, Homo sapiens
aacgagaagtgct

SEQ ID NO: 4445820 - DNA, 23 bp, Homo sapiens
aacgatacaaatttggccttaag

SEQ ID NO: 4445821 - DNA, 15 bp, Homo sapiens
aacgatccttcaaag

SEQ ID NO: 4445822 - DNA, 14 bp, Homo sapiens
aacgattatagtaa

SEQ ID NO: 4445823 - DNA, 14 bp, Homo sapiens
aacgcaccaatcag

SEQ ID NO: 4445824 - DNA, 19 bp, Homo sapiens
aacgcaccaatcagcactc

SEQ ID NO: 4445825 - DNA, 21 bp, Homo sapiens
aacgcagccctagagcctgcc

SEQ ID NO: 4445826 - DNA, 22 bp, Homo sapiens
aacgcagccctagagcctgcct

SEQ ID NO: 4445827 - DNA, 16 bp, Homo sapiens
aacgcagttgattcct

SEQ ID NO: 4445828 - DNA, 19 bp, Homo sapiens
aacgcagttgtgtggccca

SEQ ID NO: 4445829 - DNA, 13 bp, Homo sapiens
aacgcctccccct

SEQ ID NO: 4445830 - DNA, 15 bp, Homo sapiens
aacggcccaggccag

SEQ ID NO: 4445831 - DNA, 18 bp, Homo sapiens
aacggggctcttctcatt

SEQ ID NO: 4445832 - DNA, 23 bp, Homo sapiens
aacggggggctcctgcccaggcc

SEQ ID NO: 4445833 - DNA, 14 bp, Homo sapiens
aacgtaaactatga

SEQ ID NO: 4445834 - DNA, 17 bp, Homo sapiens
aacgtagcatgtggcat

SEQ ID NO: 4445835 - DNA, 13 bp, Homo sapiens
aacgtagcctggg

SEQ ID NO: 4445836 - DNA, 19 bp, Homo sapiens
aacgtccactagcttactg

SEQ ID NO: 4445837 - DNA, 18 bp, Homo sapiens
aacgtgggcttaaagcag

SEQ ID NO: 4445838 - DNA, 20 bp, Homo sapiens
aacgttctataaatgaatgt

SEQ ID NO: 4445839 - DNA, 15 bp, Homo sapiens
aacgttttaataatt

SEQ ID NO: 4445840 - DNA, 17 bp, Homo sapiens
aacgtttttcctgttct

SEQ ID NO: 4445841 - DNA, 12 bp, Homo sapiens
aactaaaatgta

SEQ ID NO: 4445842 - DNA, 13 bp, Homo sapiens
aactaaaatgtat

SEQ ID NO: 4445843 - DNA, 15 bp, Homo sapiens
aactaaaatgttcta

SEQ ID NO: 4445844 - DNA, 22 bp, Homo sapiens
aactaaaggacttgatgtacat

SEQ ID NO: 4445845 - DNA, 20 bp, Homo sapiens
aactaaagtgctgcactcaa

SEQ ID NO: 4445846 - DNA, 22 bp, Homo sapiens
aactaaatgctcatacacagtt

SEQ ID NO: 4445847 - DNA, 16 bp, Homo sapiens
aactaacaatgccttg

SEQ ID NO: 4445848 - DNA, 23 bp, Homo sapiens
aactaacagctacaaacttttaa

SEQ ID NO: 4445849 - DNA, 11 bp, Homo sapiens
aactaacatgt

SEQ ID NO: 4445850 - DNA, 20 bp, Homo sapiens
aactaactgactctgttatt

SEQ ID NO: 4445851 - DNA, 14 bp, Homo sapiens
aactaagattcttt

SEQ ID NO: 4445852 - DNA, 21 bp, Homo sapiens
aactaagcaagtatatttatt

SEQ ID NO: 4445853 - DNA, 19 bp, Homo sapiens
aactaaggactccaatgtc

SEQ ID NO: 4445854 - DNA, 19 bp, Homo sapiens
aactaatacgtgccagata

SEQ ID NO: 4445855 - DNA, 22 bp, Homo sapiens
aactaatacgtgccagatataa

SEQ ID NO: 4445856 - DNA, 13 bp, Homo sapiens
aactaatatatga

SEQ ID NO: 4445857 - DNA, 15 bp, Homo sapiens
aactaatgccttact

SEQ ID NO: 4445858 - DNA, 16 bp, Homo sapiens
aactaattcaataaaa

SEQ ID NO: 4445859 - DNA, 18 bp, Homo sapiens
aactaattgactttagaa

SEQ ID NO: 4445860 - DNA, 20 bp, Homo sapiens
aactaattgactttagaaag

SEQ ID NO: 4445861 - DNA, 15 bp, Homo sapiens
aactaatttagtaat

SEQ ID NO: 4445862 - DNA, 19 bp, Homo sapiens
aactacaaacaaaatttct

SEQ ID NO: 4445863 - DNA, 20 bp, Homo sapiens
aactacaaacgtttgacaaa

SEQ ID NO: 4445864 - DNA, 13 bp, Homo sapiens
aactacaaatcaa

SEQ ID NO: 4445865 - DNA, 14 bp, Homo sapiens
aactacagaatatt

SEQ ID NO: 4445866 - DNA, 15 bp, Homo sapiens
aactacagaatatta

SEQ ID NO: 4445867 - DNA, 20 bp, Homo sapiens
aactacagaatattaaatat

SEQ ID NO: 4445868 - DNA, 15 bp, Homo sapiens
aactacatctgcctc

SEQ ID NO: 4445869 - DNA, 17 bp, Homo sapiens
aactacatttctactat

SEQ ID NO: 4445870 - DNA, 13 bp, Homo sapiens
aactaccaaatta

SEQ ID NO: 4445871 - DNA, 22 bp, Homo sapiens
aactactcagctctcctgctgc

SEQ ID NO: 4445872 - DNA, 14 bp, Homo sapiens
aactactctttgat

SEQ ID NO: 4445873 - DNA, 15 bp, Homo sapiens
aactacttttctaaa

SEQ ID NO: 4445874 - DNA, 16 bp, Homo sapiens
aactacttttctaaaa

SEQ ID NO: 4445875 - DNA, 16 bp, Homo sapiens
aactagaaagaaggac

SEQ ID NO: 4445876 - DNA, 20 bp, Homo sapiens
aactagaggtgagaaattta

SEQ ID NO: 4445877 - DNA, 17 bp, Homo sapiens
aactagcattacattat

SEQ ID NO: 4445878 - DNA, 18 bp, Homo sapiens
aactagccaaaccaggac

SEQ ID NO: 4445879 - DNA, 21 bp, Homo sapiens
aactagccaaaccaggaccct

SEQ ID NO: 4445880 - DNA, 14 bp, Homo sapiens
aactagctgggact

SEQ ID NO: 4445881 - DNA, 14 bp, Homo sapiens
aactataacattat

SEQ ID NO: 4445882 - DNA, 15 bp, Homo sapiens
aactataacattata

SEQ ID NO: 4445883 - DNA, 22 bp, Homo sapiens
aactatacttgaacaaaagggt

SEQ ID NO: 4445884 - DNA, 20 bp, Homo sapiens
aactatacttgatagtttgg

SEQ ID NO: 4445885 - DNA, 20 bp, Homo sapiens
aactatctgaaagtaaagtt

SEQ ID NO: 4445886 - DNA, 17 bp, Homo sapiens
aactatggaatagatta

SEQ ID NO: 4445887 - DNA, 12 bp, Homo sapiens
aactatgtgttc

SEQ ID NO: 4445888 - DNA, 19 bp, Homo sapiens
aactatgtgtttttctcat

SEQ ID NO: 4445889 - DNA, 15 bp, Homo sapiens
aactattcttcattt

SEQ ID NO: 4445890 - DNA, 16 bp, Homo sapiens
aactattgcatttata

SEQ ID NO: 4445891 - DNA, 21 bp, Homo sapiens
aactattgcatttatatgtac

SEQ ID NO: 4445892 - DNA, 22 bp, Homo sapiens
aactatttatatcacacaatat

SEQ ID NO: 4445893 - DNA, 16 bp, Homo sapiens
aactattttaaataaa

SEQ ID NO: 4445894 - DNA, 18 bp, Homo sapiens
aactattttaaataaaat

SEQ ID NO: 4445895 - DNA, 13 bp, Homo sapiens
aactcaaggaaaa

SEQ ID NO: 4445896 - DNA, 21 bp, Homo sapiens
aactcaaggaaaagttctttc

SEQ ID NO: 4445897 - DNA, 18 bp, Homo sapiens
aactcaagggttttccag

SEQ ID NO: 4445898 - DNA, 22 bp, Homo sapiens
aactcactcactgtttataaat

SEQ ID NO: 4445899 - DNA, 14 bp, Homo sapiens
aactcactttcctc

SEQ ID NO: 4445900 - DNA, 23 bp, Homo sapiens
aactcagagaaaaatgctcccca

SEQ ID NO: 4445901 - DNA, 23 bp, Homo sapiens
aactcagtcattagactcctcct

SEQ ID NO: 4445902 - DNA, 15 bp, Homo sapiens
aactcatcacataaa

SEQ ID NO: 4445903 - DNA, 16 bp, Homo sapiens
aactcatcacataaag

SEQ ID NO: 4445904 - DNA, 11 bp, Homo sapiens
aactcatccct

SEQ ID NO: 4445905 - DNA, 22 bp, Homo sapiens
aactcatccttcttccactgtc

SEQ ID NO: 4445906 - DNA, 21 bp, Homo sapiens
aactcatttttgttttcatta

SEQ ID NO: 4445907 - DNA, 11 bp, Homo sapiens
aactccacagg

SEQ ID NO: 4445908 - DNA, 14 bp, Homo sapiens
aactccacatctgc

SEQ ID NO: 4445909 - DNA, 16 bp, Homo sapiens
aactccacatctgcct

SEQ ID NO: 4445910 - DNA, 10 bp, Homo sapiens
aactccaggg

SEQ ID NO: 4445911 - DNA, 15 bp, Homo sapiens
aactccatacagcct

SEQ ID NO: 4445912 - DNA, 19 bp, Homo sapiens
aactccatacagcctctac

SEQ ID NO: 4445913 - DNA, 10 bp, Homo sapiens
aactccattt

SEQ ID NO: 4445914 - DNA, 14 bp, Homo sapiens
aactcctggccttt

SEQ ID NO: 4445915 - DNA, 20 bp, Homo sapiens
aactcctgtcccttttccct

SEQ ID NO: 4445916 - DNA, 21 bp, Homo sapiens
aagaagttaattcttaaaact

SEQ ID NO: 4445917 - DNA, 15 bp, Homo sapiens
aagaagtttcatcat

SEQ ID NO: 4445918 - DNA, 18 bp, Homo sapiens
aagaagtttcatcatttt

SEQ ID NO: 4445919 - DNA, 23 bp, Homo sapiens
aagaagttttttactttggttta

SEQ ID NO: 4445920 - DNA, 12 bp, Homo sapiens
aagaataataaa

SEQ ID NO: 4445921 - DNA, 23 bp, Homo sapiens
aagaataatcacgctttcctgaa

SEQ ID NO: 4445922 - DNA, 20 bp, Homo sapiens
aagaataatttatagtaatg

SEQ ID NO: 4445923 - DNA, 16 bp, Homo sapiens
aagaatacttctcatt

SEQ ID NO: 4445924 - DNA, 12 bp, Homo sapiens
aagaatacttga

SEQ ID NO: 4445925 - DNA, 14 bp, Homo sapiens
aagaatacttgaac

SEQ ID NO: 4445926 - DNA, 15 bp, Homo sapiens
aagaatacttgaact

SEQ ID NO: 4445927 - DNA, 20 bp, Homo sapiens
aagaatagcctagatatgaa

SEQ ID NO: 4445928 - DNA, 14 bp, Homo sapiens
aagaatatgacttt

SEQ ID NO: 4445929 - DNA, 21 bp, Homo sapiens
aagaatattgcccaaataata

SEQ ID NO: 4445930 - DNA, 11 bp, Homo sapiens
aagaatattgt

SEQ ID NO: 4445931 - DNA, 13 bp, Homo sapiens
aagaatattttga

SEQ ID NO: 4445932 - DNA, 14 bp, Homo sapiens
aagaatattttgat

SEQ ID NO: 4445933 - DNA, 17 bp, Homo sapiens
aagaatattttgatgca

SEQ ID NO: 4445934 - DNA, 21 bp, Homo sapiens
aagaatatttttagactattt

SEQ ID NO: 4445935 - DNA, 13 bp, Homo sapiens
aagaatctactta

SEQ ID NO: 4445936 - DNA, 13 bp, Homo sapiens
aagaatctagaag

SEQ ID NO: 4445937 - DNA, 21 bp, Homo sapiens
aagaatctagaagatgtgtaa

SEQ ID NO: 4445938 - DNA, 16 bp, Homo sapiens
aagaatctattagatt

SEQ ID NO: 4445939 - DNA, 18 bp, Homo sapiens
aagaatctattagatttt

SEQ ID NO: 4445940 - DNA, 14 bp, Homo sapiens
aagaatcttagata

SEQ ID NO: 4445941 - DNA, 13 bp, Homo sapiens
aagaatgaaatga

SEQ ID NO: 4445942 - DNA, 16 bp, Homo sapiens
aagaatgactatataa

SEQ ID NO: 4445943 - DNA, 22 bp, Homo sapiens
aagaatgccatttctcacgccc

SEQ ID NO: 4445944 - DNA, 13 bp, Homo sapiens
aagaatgcttaat

SEQ ID NO: 4445945 - DNA, 17 bp, Homo sapiens
aagaatgcttaatcaga

SEQ ID NO: 4445946 - DNA, 22 bp, Homo sapiens
aagaatgtcaggaatttaagaa

SEQ ID NO: 4445947 - DNA, 19 bp, Homo sapiens
aagaatgttactgccttaa

SEQ ID NO: 4445948 - DNA, 22 bp, Homo sapiens
aagaattcaaatttgtaataaa

SEQ ID NO: 4445949 - DNA, 14 bp, Homo sapiens
aagaattccaaagc

SEQ ID NO: 4445950 - DNA, 19 bp, Homo sapiens
aagaattgaacccaggagg

SEQ ID NO: 4445951 - DNA, 15 bp, Homo sapiens
aagaatttagatctt

SEQ ID NO: 4445952 - DNA, 20 bp, Homo sapiens
aagaatttgaggtctacatt

SEQ ID NO: 4445953 - DNA, 16 bp, Homo sapiens
aagacaaaagtctgtc

SEQ ID NO: 4445954 - DNA, 13 bp, Homo sapiens
aagacaaattttg

SEQ ID NO: 4445955 - DNA, 17 bp, Homo sapiens
aagacaaccatatttag

SEQ ID NO: 4445956 - DNA, 14 bp, Homo sapiens
aagacaagaaaatc

SEQ ID NO: 4445957 - DNA, 22 bp, Homo sapiens
aagacaagagatctacacatgt

SEQ ID NO: 4445958 - DNA, 23 bp, Homo sapiens
aagacaataattctacatgttgt

SEQ ID NO: 4445959 - DNA, 22 bp, Homo sapiens
aagacacaaggtgatttcagac

SEQ ID NO: 4445960 - DNA, 19 bp, Homo sapiens
aagacacagaatagtttac

SEQ ID NO: 4445961 - DNA, 20 bp, Homo sapiens
aagacacagaatagtttaca

SEQ ID NO: 4445962 - DNA, 16 bp, Homo sapiens
aagacagatgccccag

SEQ ID NO: 4445963 - DNA, 21 bp, Homo sapiens
aagacagcagacaaaatgaaa

SEQ ID NO: 4445964 - DNA, 21 bp, Homo sapiens
aagacagcgataagctttcaa

SEQ ID NO: 4445965 - DNA, 14 bp, Homo sapiens
aagacagcttccca

SEQ ID NO: 4445966 - DNA, 23 bp, Homo sapiens
aagacatactccttccatcaaat

SEQ ID NO: 4445967 - DNA, 16 bp, Homo sapiens
aagacatcagtctcca

SEQ ID NO: 4445968 - DNA, 19 bp, Homo sapiens
aagacatctgcctgtaatt

SEQ ID NO: 4445969 - DNA, 12 bp, Homo sapiens
aagacatgaagc

SEQ ID NO: 4445970 - DNA, 12 bp, Homo sapiens
aagacatgtctg

SEQ ID NO: 4445971 - DNA, 16 bp, Homo sapiens
aagacatgtctgttct

SEQ ID NO: 4445972 - DNA, 19 bp, Homo sapiens
aagacatgtctgttctaca

SEQ ID NO: 4445973 - DNA, 17 bp, Homo sapiens
aagacattgtttttaaa

SEQ ID NO: 4445974 - DNA, 14 bp, Homo sapiens
aagacatttgctga

SEQ ID NO: 4445975 - DNA, 16 bp, Homo sapiens
aagacattttgttaca

SEQ ID NO: 4445976 - DNA, 18 bp, Homo sapiens
aagacattttgtttttac

SEQ ID NO: 4445977 - DNA, 22 bp, Homo sapiens
aagacattttgtttttactgta

SEQ ID NO: 4445978 - DNA, 15 bp, Homo sapiens
aagacatttttcatt

SEQ ID NO: 4445979 - DNA, 18 bp, Homo sapiens
aagacatttttcattcat

SEQ ID NO: 4445980 - DNA, 21 bp, Homo sapiens
aagacatttttcattcatgaa

SEQ ID NO: 4445981 - DNA, 17 bp, Homo sapiens
aagaccagcctgtccaa

SEQ ID NO: 4445982 - DNA, 13 bp, Homo sapiens
aagacctcatctc

SEQ ID NO: 4445983 - DNA, 21 bp, Homo sapiens
aagacgaggccctcgggccca

SEQ ID NO: 4445984 - DNA, 19 bp, Homo sapiens
aagacgcaaggtgtgctct

SEQ ID NO: 4445985 - DNA, 14 bp, Homo sapiens
aagacgccctctat

SEQ ID NO: 4445986 - DNA, 17 bp, Homo sapiens
aagacgtggctctgggt

SEQ ID NO: 4445987 - DNA, 12 bp, Homo sapiens
aagacgtttttg

SEQ ID NO: 4445988 - DNA, 22 bp, Homo sapiens
aagacgtttttgtgctgtgggc

SEQ ID NO: 4445989 - DNA, 21 bp, Homo sapiens
aagactagaaaattagactgt

SEQ ID NO: 4445990 - DNA, 14 bp, Homo sapiens
aagactatttttct

SEQ ID NO: 4445991 - DNA, 20 bp, Homo sapiens
aagactcagatgatgccagc

SEQ ID NO: 4445992 - DNA, 13 bp, Homo sapiens
aagactcaggagt

SEQ ID NO: 4445993 - DNA, 16 bp, Homo sapiens
aagactccaaagaaat

SEQ ID NO: 4445994 - DNA, 17 bp, Homo sapiens
aagactccaaagaaatg

SEQ ID NO: 4445995 - DNA, 19 bp, Homo sapiens
aagactctgtgtggctgtg

SEQ ID NO: 4445996 - DNA, 15 bp, Homo sapiens
aagactgaagatggc

SEQ ID NO: 4445997 - DNA, 15 bp, Homo sapiens
aagactgagcagaac

SEQ ID NO: 4445998 - DNA, 23 bp, Homo sapiens
aagactgctggttgacatcagac

SEQ ID NO: 4445999 - DNA, 23 bp, Homo sapiens
aagactggaagctaatttgcatt

SEQ ID NO: 4446000 - DNA, 22 bp, Homo sapiens
aagactggcttttattaatgca

SEQ ID NO: 4446001 - DNA, 23 bp, Homo sapiens
aagactggcttttattaatgcac

SEQ ID NO: 4446002 - DNA, 18 bp, Homo sapiens
aagactgggccccacatg

SEQ ID NO: 4446003 - DNA, 15 bp, Homo sapiens
aagactggttttctg

SEQ ID NO: 4446004 - DNA, 16 bp, Homo sapiens
aagactggttttctgc

SEQ ID NO: 4446005 - DNA, 14 bp, Homo sapiens
aagactttaattat

SEQ ID NO: 4446006 - DNA, 16 bp, Homo sapiens
aagacttttatgtgag

SEQ ID NO: 4446007 - DNA, 17 bp, Homo sapiens
aagagaaaattcctaga

SEQ ID NO: 4446008 - DNA, 14 bp, Homo sapiens
aagagaaactttgt

SEQ ID NO: 4446009 - DNA, 16 bp, Homo sapiens
aagagaaagaggccag

SEQ ID NO: 4446010 - DNA, 12 bp, Homo sapiens
aagagaactaaa

SEQ ID NO: 4446011 - DNA, 16 bp, Homo sapiens
aagagaagacaaaacg

SEQ ID NO: 4446012 - DNA, 20 bp, Homo sapiens
aagagaagatgcctgttaat

SEQ ID NO: 4446013 - DNA, 21 bp, Homo sapiens
aagagaagttgtaaagtatgt

SEQ ID NO: 4446014 - DNA, 19 bp, Homo sapiens
aagagacaaagatttcttc

SEQ ID NO: 4446015 - DNA, 18 bp, Homo sapiens
aagagacagagacaagta

SEQ ID NO: 4446016 - DNA, 15 bp, Homo sapiens
aagagacatttcaaa

SEQ ID NO: 4446017 - DNA, 21 bp, Homo sapiens
aagagagagagagagaaagaa

SEQ ID NO: 4446018 - DNA, 18 bp, Homo sapiens
aagagatctacacatgtt

SEQ ID NO: 4446019 - DNA, 21 bp, Homo sapiens
aagagcacactgcacagggaa

SEQ ID NO: 4446020 - DNA, 14 bp, Homo sapiens
aagagcagcctgtg

SEQ ID NO: 4446021 - DNA, 18 bp, Homo sapiens
aagagcagcctgtggcat

SEQ ID NO: 4446022 - DNA, 17 bp, Homo sapiens
aagagcaggactccagg

SEQ ID NO: 4446023 - DNA, 20 bp, Homo sapiens
aagagcagtcagagtccagt

SEQ ID NO: 4446024 - DNA, 22 bp, Homo sapiens
aagagcatggatgcatttcaaa

SEQ ID NO: 4446025 - DNA, 18 bp, Homo sapiens
aagagccacctgcaagat

SEQ ID NO: 4446026 - DNA, 15 bp, Homo sapiens
aagagccggtggtgc

SEQ ID NO: 4446027 - DNA, 14 bp, Homo sapiens
aagagctacataat

SEQ ID NO: 4446028 - DNA, 20 bp, Homo sapiens
aagagctacgtatttaatag

SEQ ID NO: 4446029 - DNA, 15 bp, Homo sapiens
aagagctagagaaat

SEQ ID NO: 4446030 - DNA, 16 bp, Homo sapiens
aagagctagcgctgcc

SEQ ID NO: 4446031 - DNA, 19 bp, Homo sapiens
aagagctagcgctgccgca

SEQ ID NO: 4446032 - DNA, 22 bp, Homo sapiens
aagagctagtctatcagcatct

SEQ ID NO: 4446033 - DNA, 18 bp, Homo sapiens
aagagctgttcacagcca

SEQ ID NO: 4446034 - DNA, 15 bp, Homo sapiens
aagctagggtggccc

SEQ ID NO: 4446035 - DNA, 18 bp, Homo sapiens
aagctcaaatgaaatgta

SEQ ID NO: 4446036 - DNA, 19 bp, Homo sapiens
aagctcaaatgaaatgtat

SEQ ID NO: 4446037 - DNA, 11 bp, Homo sapiens
aagctcacagt

SEQ ID NO: 4446038 - DNA, 23 bp, Homo sapiens
aagctcacagttcctcgccctgg

SEQ ID NO: 4446039 - DNA, 23 bp, Homo sapiens
aagctcaggaggcgaataaatgt

SEQ ID NO: 4446040 - DNA, 20 bp, Homo sapiens
aagctcatatccttttgaag

SEQ ID NO: 4446041 - DNA, 16 bp, Homo sapiens
aagctcatccctggac

SEQ ID NO: 4446042 - DNA, 18 bp, Homo sapiens
aagctcatccctggactt

SEQ ID NO: 4446043 - DNA, 19 bp, Homo sapiens
aagctcatttcatgctctg

SEQ ID NO: 4446044 - DNA, 16 bp, Homo sapiens
aagctccatgtgcctc

SEQ ID NO: 4446045 - DNA, 22 bp, Homo sapiens
aagctcgatgtggtcacagctg

SEQ ID NO: 4446046 - DNA, 23 bp, Homo sapiens
aagctcgatgtggtcacagctgt

SEQ ID NO: 4446047 - DNA, 19 bp, Homo sapiens
aagctcgcatccagacagt

SEQ ID NO: 4446048 - DNA, 14 bp, Homo sapiens
aagctctgaaaaca

SEQ ID NO: 4446049 - DNA, 20 bp, Homo sapiens
aagctctgaaaacaaggttt

SEQ ID NO: 4446050 - DNA, 20 bp, Homo sapiens
aagctgaaattttagaaata

SEQ ID NO: 4446051 - DNA, 13 bp, Homo sapiens
aagctgaatcccg

SEQ ID NO: 4446052 - DNA, 19 bp, Homo sapiens
aagctgacagcactacaaa

SEQ ID NO: 4446053 - DNA, 17 bp, Homo sapiens
aagctgacattgccaaa

SEQ ID NO: 4446054 - DNA, 22 bp, Homo sapiens
aagctgactttatagctgcaag

SEQ ID NO: 4446055 - DNA, 12 bp, Homo sapiens
aagctgcactgt

SEQ ID NO: 4446056 - DNA, 13 bp, Homo sapiens
aagctgcactgtg

SEQ ID NO: 4446057 - DNA, 12 bp, Homo sapiens
aagctgcccagc

SEQ ID NO: 4446058 - DNA, 13 bp, Homo sapiens
aagctgcccagcc

SEQ ID NO: 4446059 - DNA, 18 bp, Homo sapiens
aagctgcccagccctggc

SEQ ID NO: 4446060 - DNA, 15 bp, Homo sapiens
aagctgcctggtata

SEQ ID NO: 4446061 - DNA, 20 bp, Homo sapiens
aagctgcctggtatatccaa

SEQ ID NO: 4446062 - DNA, 15 bp, Homo sapiens
aagctgctaaatctc

SEQ ID NO: 4446063 - DNA, 19 bp, Homo sapiens
aagctgcttgtcctgggcc

SEQ ID NO: 4446064 - DNA, 23 bp, Homo sapiens
aagctggaggactagaacctgga

SEQ ID NO: 4446065 - DNA, 18 bp, Homo sapiens
aagctgggccccagccca

SEQ ID NO: 4446066 - DNA, 13 bp, Homo sapiens
aagctggtgctac

SEQ ID NO: 4446067 - DNA, 21 bp, Homo sapiens
aagctgttatttcttccctgc

SEQ ID NO: 4446068 - DNA, 17 bp, Homo sapiens
aagctgtttggaaaaga

SEQ ID NO: 4446069 - DNA, 15 bp, Homo sapiens
aagcttaaaactttg

SEQ ID NO: 4446070 - DNA, 14 bp, Homo sapiens
aagcttaaatagga

SEQ ID NO: 4446071 - DNA, 15 bp, Homo sapiens
aagcttaacatttca

SEQ ID NO: 4446072 - DNA, 22 bp, Homo sapiens
aagcttaatttttaaaaacaaa

SEQ ID NO: 4446073 - DNA, 21 bp, Homo sapiens
aagcttacatagttttcttcc

SEQ ID NO: 4446074 - DNA, 20 bp, Homo sapiens
aagcttcaaagtttatatgc

SEQ ID NO: 4446075 - DNA, 21 bp, Homo sapiens
aagcttcaaagtttatatgcc

SEQ ID NO: 4446076 - DNA, 21 bp, Homo sapiens
aagcttccatgattctattta

SEQ ID NO: 4446077 - DNA, 22 bp, Homo sapiens
aagcttccgggaaaacagctat

SEQ ID NO: 4446078 - DNA, 20 bp, Homo sapiens
aagcttgatttgatctttgt

SEQ ID NO: 4446079 - DNA, 22 bp, Homo sapiens
aagcttgatttgatctttgttt

SEQ ID NO: 4446080 - DNA, 19 bp, Homo sapiens
aagcttggtgacaaaattc

SEQ ID NO: 4446081 - DNA, 13 bp, Homo sapiens
aagctttaaatga

SEQ ID NO: 4446082 - DNA, 17 bp, Homo sapiens
aagctttaaattatgtg

SEQ ID NO: 4446083 - DNA, 13 bp, Homo sapiens
aagctttatcttt

SEQ ID NO: 4446084 - DNA, 14 bp, Homo sapiens
aagctttatctttg

SEQ ID NO: 4446085 - DNA, 16 bp, Homo sapiens
aagctttattaccagt

SEQ ID NO: 4446086 - DNA, 16 bp, Homo sapiens
aagctttatttctagc

SEQ ID NO: 4446087 - DNA, 20 bp, Homo sapiens
aagctttgactctataagca

SEQ ID NO: 4446088 - DNA, 23 bp, Homo sapiens
aagctttgcttatggtaataaaa

SEQ ID NO: 4446089 - DNA, 12 bp, Homo sapiens
aagctttggaaa

SEQ ID NO: 4446090 - DNA, 16 bp, Homo sapiens
aagctttggaaaaatc

SEQ ID NO: 4446091 - DNA, 18 bp, Homo sapiens
aagctttggttctctgat

SEQ ID NO: 4446092 - DNA, 17 bp, Homo sapiens
aagcttttaaaatgtag

SEQ ID NO: 4446093 - DNA, 14 bp, Homo sapiens
aagctttttggaat

SEQ ID NO: 4446094 - DNA, 12 bp, Homo sapiens
aaggaaaaagct

SEQ ID NO: 4446095 - DNA, 23 bp, Homo sapiens
aaggaaaaagctccatgtgcctc

SEQ ID NO: 4446096 - DNA, 18 bp, Homo sapiens
aaggaaaacaaaaaactt

SEQ ID NO: 4446097 - DNA, 13 bp, Homo sapiens
aaggaaaagttct

SEQ ID NO: 4446098 - DNA, 17 bp, Homo sapiens
aaggaaagatttgtgaa

SEQ ID NO: 4446099 - DNA, 13 bp, Homo sapiens
aaggaaagcaata

SEQ ID NO: 4446100 - DNA, 12 bp, Homo sapiens
aaggaaagctgt

SEQ ID NO: 4446101 - DNA, 21 bp, Homo sapiens
aaggaaaggctcatttaaaac

SEQ ID NO: 4446102 - DNA, 22 bp, Homo sapiens
aaggaaaggctcatttaaaaca

SEQ ID NO: 4446103 - DNA, 21 bp, Homo sapiens
aaggaaagtttgccaggagga

SEQ ID NO: 4446104 - DNA, 17 bp, Homo sapiens
aaggaacagcaatggtg

SEQ ID NO: 4446105 - DNA, 16 bp, Homo sapiens
aaggaaccaacaatct

SEQ ID NO: 4446106 - DNA, 12 bp, Homo sapiens
aaggaaccttcc

SEQ ID NO: 4446107 - DNA, 22 bp, Homo sapiens
aaggaacttgccctgagcactc

SEQ ID NO: 4446108 - DNA, 22 bp, Homo sapiens
aaggaagcattgtaaaataatt

SEQ ID NO: 4446109 - DNA, 17 bp, Homo sapiens
aaggaaggcctgagccc

SEQ ID NO: 4446110 - DNA, 20 bp, Homo sapiens
aaggaatacaatatatagct

SEQ ID NO: 4446111 - DNA, 16 bp, Homo sapiens
aaggaatgatatattc

SEQ ID NO: 4446112 - DNA, 14 bp, Homo sapiens
aaggaatttcttaa

SEQ ID NO: 4446113 - DNA, 13 bp, Homo sapiens
aaggacaacagtt

SEQ ID NO: 4446114 - DNA, 12 bp, Homo sapiens
aaggacacagtg

SEQ ID NO: 4446115 - DNA, 16 bp, Homo sapiens
aaggacaggagcctgg

SEQ ID NO: 4446116 - DNA, 15 bp, Homo sapiens
aaggacagtccctgc

SEQ ID NO: 4446117 - DNA, 18 bp, Homo sapiens
aaggacagtccctgctgg

SEQ ID NO: 4446118 - DNA, 23 bp, Homo sapiens
aaggacatggtgagtctattttt

SEQ ID NO: 4446119 - DNA, 15 bp, Homo sapiens
aaggacccaggcgct

SEQ ID NO: 4446120 - DNA, 21 bp, Homo sapiens
aaggactatgaaaagctagaa

SEQ ID NO: 4446121 - DNA, 14 bp, Homo sapiens
aaggactattatgt

SEQ ID NO: 4446122 - DNA, 17 bp, Homo sapiens
aaggactttgtacattt

SEQ ID NO: 4446123 - DNA, 15 bp, Homo sapiens
aaggagaaagaaagt

SEQ ID NO: 4446124 - DNA, 22 bp, Homo sapiens
aaggagaaagaaagtacccagc

SEQ ID NO: 4446125 - DNA, 23 bp, Homo sapiens
aaggagagactcccatgaagcct

SEQ ID NO: 4446126 - DNA, 14 bp, Homo sapiens
aaggagagcaagaa

SEQ ID NO: 4446127 - DNA, 22 bp, Homo sapiens
aaggagagcaagaaggaaagat

SEQ ID NO: 4446128 - DNA, 13 bp, Homo sapiens
aaggagagcctgc

SEQ ID NO: 4446129 - DNA, 14 bp, Homo sapiens
aaggagagcctgct

SEQ ID NO: 4446130 - DNA, 14 bp, Homo sapiens
aaggagaggcaaag

SEQ ID NO: 4446131 - DNA, 23 bp, Homo sapiens
aaggagaggcaaagaaaggagat

SEQ ID NO: 4446132 - DNA, 20 bp, Homo sapiens
aaggagaggcaacatccaaa

SEQ ID NO: 4446133 - DNA, 12 bp, Homo sapiens
aaggagcatcta

SEQ ID NO: 4446134 - DNA, 20 bp, Homo sapiens
aaggagccttttgctctctg

SEQ ID NO: 4446135 - DNA, 17 bp, Homo sapiens
aaggaggcccactgtgt

SEQ ID NO: 4446136 - DNA, 20 bp, Homo sapiens
aaggaggcctggggaggccc

SEQ ID NO: 4446137 - DNA, 22 bp, Homo sapiens
aaggaggggaaaaaaatgttgt

SEQ ID NO: 4446138 - DNA, 21 bp, Homo sapiens
aaggaggggagagacaggcag

SEQ ID NO: 4446139 - DNA, 17 bp, Homo sapiens
aaggaggggctgtaaaa

SEQ ID NO: 4446140 - DNA, 18 bp, Homo sapiens
aaggagttagaaccacag

SEQ ID NO: 4446141 - DNA, 14 bp, Homo sapiens
aaggagttggtgta

SEQ ID NO: 4446142 - DNA, 20 bp, Homo sapiens
aaggataaatcataaagtca

SEQ ID NO: 4446143 - DNA, 13 bp, Homo sapiens
aaggataaatttt

SEQ ID NO: 4446144 - DNA, 11 bp, Homo sapiens
aaggatgactt

SEQ ID NO: 4446145 - DNA, 13 bp, Homo sapiens
aaggatgactttt

SEQ ID NO: 4446146 - DNA, 16 bp, Homo sapiens
aaggatgccacttggg

SEQ ID NO: 4446147 - DNA, 23 bp, Homo sapiens
aaggatgtaaacagtgcctgctg

SEQ ID NO: 4446148 - DNA, 22 bp, Homo sapiens
aaggatgtgattgtggaatgga

SEQ ID NO: 4446149 - DNA, 16 bp, Homo sapiens
aaggattatggaaaaa

SEQ ID NO: 4446150 - DNA, 19 bp, Homo sapiens
aaggattatggaaaaataa

SEQ ID NO: 4446151 - DNA, 20 bp, Homo sapiens
aaggattatggaaaaataaa

SEQ ID NO: 4446152 - DNA, 14 bp, Homo sapiens
aataaaaatgttta

SEQ ID NO: 4446153 - DNA, 13 bp, Homo sapiens
aataaaaattcta

SEQ ID NO: 4446154 - DNA, 14 bp, Homo sapiens
aataaaacacacct

SEQ ID NO: 4446155 - DNA, 20 bp, Homo sapiens
aataaaacatcactatcaat

SEQ ID NO: 4446156 - DNA, 17 bp, Homo sapiens
aataaaactatttgtat

SEQ ID NO: 4446157 - DNA, 20 bp, Homo sapiens
aataaaactgtttgacttct

SEQ ID NO: 4446158 - DNA, 16 bp, Homo sapiens
aataaaacttggttct

SEQ ID NO: 4446159 - DNA, 16 bp, Homo sapiens
aataaaactttatgga

SEQ ID NO: 4446160 - DNA, 20 bp, Homo sapiens
aataaaatcatgtagtttgt

SEQ ID NO: 4446161 - DNA, 14 bp, Homo sapiens
aataaaattaatga

SEQ ID NO: 4446162 - DNA, 14 bp, Homo sapiens
aataaaattatttg

SEQ ID NO: 4446163 - DNA, 16 bp, Homo sapiens
aataaaattatttgca

SEQ ID NO: 4446164 - DNA, 13 bp, Homo sapiens
aataaaatttctt

SEQ ID NO: 4446165 - DNA, 12 bp, Homo sapiens
aataaaatttgt

SEQ ID NO: 4446166 - DNA, 18 bp, Homo sapiens
aataaacacatagattca

SEQ ID NO: 4446167 - DNA, 22 bp, Homo sapiens
aataaacacatagattcacctg

SEQ ID NO: 4446168 - DNA, 16 bp, Homo sapiens
aataaacagacaaaaa

SEQ ID NO: 4446169 - DNA, 12 bp, Homo sapiens
aataaacagtca

SEQ ID NO: 4446170 - DNA, 13 bp, Homo sapiens
aataaacagtcac

SEQ ID NO: 4446171 - DNA, 19 bp, Homo sapiens
aataaaccacaagcatctc

SEQ ID NO: 4446172 - DNA, 11 bp, Homo sapiens
aataaaccagt

SEQ ID NO: 4446173 - DNA, 10 bp, Homo sapiens
aataaaccat

SEQ ID NO: 4446174 - DNA, 14 bp, Homo sapiens
aataaaccctcctt

SEQ ID NO: 4446175 - DNA, 14 bp, Homo sapiens
aataaactactctt

SEQ ID NO: 4446176 - DNA, 17 bp, Homo sapiens
aataaactactctttga

SEQ ID NO: 4446177 - DNA, 19 bp, Homo sapiens
aataaactactctttgatt

SEQ ID NO: 4446178 - DNA, 19 bp, Homo sapiens
aataaactatttatatcac

SEQ ID NO: 4446179 - DNA, 17 bp, Homo sapiens
aataaactgtgtttact

SEQ ID NO: 4446180 - DNA, 20 bp, Homo sapiens
aataaagaagtatggtaatc

SEQ ID NO: 4446181 - DNA, 13 bp, Homo sapiens
aataaagaatact

SEQ ID NO: 4446182 - DNA, 17 bp, Homo sapiens
aataaagacaaccatat

SEQ ID NO: 4446183 - DNA, 13 bp, Homo sapiens
aataaagataacc

SEQ ID NO: 4446184 - DNA, 17 bp, Homo sapiens
aataaagatggtccaaa

SEQ ID NO: 4446185 - DNA, 18 bp, Homo sapiens
aataaagatggttttgat

SEQ ID NO: 4446186 - DNA, 18 bp, Homo sapiens
aataaagcctttgtatct

SEQ ID NO: 4446187 - DNA, 20 bp, Homo sapiens
aataaagcctttgtatcttt

SEQ ID NO: 4446188 - DNA, 17 bp, Homo sapiens
aataaagcttacatagt

SEQ ID NO: 4446189 - DNA, 16 bp, Homo sapiens
aataaaggaaaacaaa

SEQ ID NO: 4446190 - DNA, 11 bp, Homo sapiens
aataaaggact

SEQ ID NO: 4446191 - DNA, 22 bp, Homo sapiens
aataaaggactgtaatcttatt

SEQ ID NO: 4446192 - DNA, 14 bp, Homo sapiens
aataaaggcagctg

SEQ ID NO: 4446193 - DNA, 15 bp, Homo sapiens
aataaaggcagctgc

SEQ ID NO: 4446194 - DNA, 20 bp, Homo sapiens
aataaaggcagctgcctctg

SEQ ID NO: 4446195 - DNA, 19 bp, Homo sapiens
aataaaggcagttttctaa

SEQ ID NO: 4446196 - DNA, 9 bp, Homo sapiens
aataaagta

SEQ ID NO: 4446197 - DNA, 12 bp, Homo sapiens
aataaagtagtt

SEQ ID NO: 4446198 - DNA, 15 bp, Homo sapiens
aataaagtagttatt

SEQ ID NO: 4446199 - DNA, 20 bp, Homo sapiens
aataaagtcattattaggaa

SEQ ID NO: 4446200 - DNA, 17 bp, Homo sapiens
aataaagtgaactttgt

SEQ ID NO: 4446201 - DNA, 18 bp, Homo sapiens
aataaagtgccttctggg

SEQ ID NO: 4446202 - DNA, 15 bp, Homo sapiens
aataaagtgttttca

SEQ ID NO: 4446203 - DNA, 16 bp, Homo sapiens
aataaatccaaaaaaa

SEQ ID NO: 4446204 - DNA, 14 bp, Homo sapiens
aataaatctttcaa

SEQ ID NO: 4446205 - DNA, 13 bp, Homo sapiens
aataaatgattat

SEQ ID NO: 4446206 - DNA, 17 bp, Homo sapiens
aataaatgttcaaactg

SEQ ID NO: 4446207 - DNA, 18 bp, Homo sapiens
aataaatgttcaaactgt

SEQ ID NO: 4446208 - DNA, 21 bp, Homo sapiens
aataaattaagatcctaaact

SEQ ID NO: 4446209 - DNA, 16 bp, Homo sapiens
aataaattatgaatat

SEQ ID NO: 4446210 - DNA, 18 bp, Homo sapiens
aataaatttatatgaaaa

SEQ ID NO: 4446211 - DNA, 15 bp, Homo sapiens
aataacaagcatgca

SEQ ID NO: 4446212 - DNA, 16 bp, Homo sapiens
aataacactgtatttt

SEQ ID NO: 4446213 - DNA, 22 bp, Homo sapiens
aataacactgtattttaatgta

SEQ ID NO: 4446214 - DNA, 13 bp, Homo sapiens
aataacatttaaa

SEQ ID NO: 4446215 - DNA, 16 bp, Homo sapiens
aataaccgtaaaggtt

SEQ ID NO: 4446216 - DNA, 13 bp, Homo sapiens
aataactctggga

SEQ ID NO: 4446217 - DNA, 12 bp, Homo sapiens
aataactgaaaa

SEQ ID NO: 4446218 - DNA, 20 bp, Homo sapiens
aataactgagatattatttt

SEQ ID NO: 4446219 - DNA, 21 bp, Homo sapiens
aataactgagatattatttta

SEQ ID NO: 4446220 - DNA, 16 bp, Homo sapiens
aataactgtgtactgt

SEQ ID NO: 4446221 - DNA, 14 bp, Homo sapiens
aataactttcttac

SEQ ID NO: 4446222 - DNA, 17 bp, Homo sapiens
aataacttttatattaa

SEQ ID NO: 4446223 - DNA, 12 bp, Homo sapiens
aataactttttt

SEQ ID NO: 4446224 - DNA, 13 bp, Homo sapiens
aataagaaacttt

SEQ ID NO: 4446225 - DNA, 14 bp, Homo sapiens
aataagacaagaga

SEQ ID NO: 4446226 - DNA, 16 bp, Homo sapiens
aataagattggtgttc

SEQ ID NO: 4446227 - DNA, 21 bp, Homo sapiens
aataaggaatagctttgtatt

SEQ ID NO: 4446228 - DNA, 19 bp, Homo sapiens
aataaggtacaagaagcat

SEQ ID NO: 4446229 - DNA, 13 bp, Homo sapiens
aataagtaatatc

SEQ ID NO: 4446230 - DNA, 15 bp, Homo sapiens
aataagtcaacagta

SEQ ID NO: 4446231 - DNA, 16 bp, Homo sapiens
aataagtcaacagtaa

SEQ ID NO: 4446232 - DNA, 17 bp, Homo sapiens
aataagtggattttgta

SEQ ID NO: 4446233 - DNA, 13 bp, Homo sapiens
aataagttattgc

SEQ ID NO: 4446234 - DNA, 21 bp, Homo sapiens
aataagttcaaattcttctga

SEQ ID NO: 4446235 - DNA, 13 bp, Homo sapiens
aataataaaatca

SEQ ID NO: 4446236 - DNA, 15 bp, Homo sapiens
aataataaagtatga

SEQ ID NO: 4446237 - DNA, 17 bp, Homo sapiens
aataatacatactaatg

SEQ ID NO: 4446238 - DNA, 16 bp, Homo sapiens
aataatattgtttttc

SEQ ID NO: 4446239 - DNA, 22 bp, Homo sapiens
aataatattgtttttctttcta

SEQ ID NO: 4446240 - DNA, 18 bp, Homo sapiens
aataatatttcaagtgcc

SEQ ID NO: 4446241 - DNA, 19 bp, Homo sapiens
aataatatttcaagtgcct

SEQ ID NO: 4446242 - DNA, 13 bp, Homo sapiens
aataatgaaaata

SEQ ID NO: 4446243 - DNA, 20 bp, Homo sapiens
aataatgagctattaaaact

SEQ ID NO: 4446244 - DNA, 10 bp, Homo sapiens
aataatgcag

SEQ ID NO: 4446245 - DNA, 17 bp, Homo sapiens
aataatgcagtatggta

SEQ ID NO: 4446246 - DNA, 19 bp, Homo sapiens
aataatgcagtatggtaca

SEQ ID NO: 4446247 - DNA, 18 bp, Homo sapiens
aataatgcctttgtaacc

SEQ ID NO: 4446248 - DNA, 19 bp, Homo sapiens
aataatgtactgaattctt

SEQ ID NO: 4446249 - DNA, 11 bp, Homo sapiens
aataatgtctc

SEQ ID NO: 4446250 - DNA, 13 bp, Homo sapiens
aataatgtctctg

SEQ ID NO: 4446251 - DNA, 12 bp, Homo sapiens
aataattcatat

SEQ ID NO: 4446252 - DNA, 15 bp, Homo sapiens
aataattctacatgt

SEQ ID NO: 4446253 - DNA, 19 bp, Homo sapiens
aataattctgagttttgtg

SEQ ID NO: 4446254 - DNA, 21 bp, Homo sapiens
aataatttagacttcaagcat

SEQ ID NO: 4446255 - DNA, 13 bp, Homo sapiens
aataatttatagt

SEQ ID NO: 4446256 - DNA, 23 bp, Homo sapiens
aatacaaaaggcattttatatga

SEQ ID NO: 4446257 - DNA, 17 bp, Homo sapiens
aatacaaagttagagaa

SEQ ID NO: 4446258 - DNA, 15 bp, Homo sapiens
aatacaaattggttg

SEQ ID NO: 4446259 - DNA, 18 bp, Homo sapiens
aatacaacttaaataata

SEQ ID NO: 4446260 - DNA, 15 bp, Homo sapiens
aatacaatgtacaat

SEQ ID NO: 4446261 - DNA, 17 bp, Homo sapiens
aatacaatgtacaatta

SEQ ID NO: 4446262 - DNA, 18 bp, Homo sapiens
aatacaatgtacaattat

SEQ ID NO: 4446263 - DNA, 22 bp, Homo sapiens
aatacaatttttatttctttta

SEQ ID NO: 4446264 - DNA, 14 bp, Homo sapiens
aatacacagtattc

SEQ ID NO: 4446265 - DNA, 16 bp, Homo sapiens
aatacactagttgttt

SEQ ID NO: 4446266 - DNA, 17 bp, Homo sapiens
aatacactagttgtttc

SEQ ID NO: 4446267 - DNA, 17 bp, Homo sapiens
aatacagctcagtaaat

SEQ ID NO: 4446268 - DNA, 13 bp, Homo sapiens
aatacaggaaaca

SEQ ID NO: 4446269 - DNA, 12 bp, Homo sapiens
aatacaggaaat

SEQ ID NO: 4446270 - DNA, 23 bp, Homo sapiens
aatacagtattatagacaaaaga

SEQ ID NO: 4446271 - DNA, 16 bp, Homo sapiens
aatacagtcttccaca

SEQ ID NO: 4446272 - DNA, 18 bp, Homo sapiens
aatatatattatatacat

SEQ ID NO: 4446273 - DNA, 16 bp, Homo sapiens
aatatatcctgtgtac

SEQ ID NO: 4446274 - DNA, 14 bp, Homo sapiens
aatatatctctatt

SEQ ID NO: 4446275 - DNA, 18 bp, Homo sapiens
aatatatctgtaaagata

SEQ ID NO: 4446276 - DNA, 13 bp, Homo sapiens
aatatatcttaag

SEQ ID NO: 4446277 - DNA, 18 bp, Homo sapiens
aatatatgattctagtgt

SEQ ID NO: 4446278 - DNA, 21 bp, Homo sapiens
aatatatgccttgtataatat

SEQ ID NO: 4446279 - DNA, 14 bp, Homo sapiens
aatatatgtatata

SEQ ID NO: 4446280 - DNA, 19 bp, Homo sapiens
aatatatgtatgtaaaaat

SEQ ID NO: 4446281 - DNA, 13 bp, Homo sapiens
aatatatttatat

SEQ ID NO: 4446282 - DNA, 19 bp, Homo sapiens
aatatatttatatactttt

SEQ ID NO: 4446283 - DNA, 19 bp, Homo sapiens
aatatattttatcttggta

SEQ ID NO: 4446284 - DNA, 15 bp, Homo sapiens
aatatattttctgtt

SEQ ID NO: 4446285 - DNA, 23 bp, Homo sapiens
aatatcaaaagaaaattgatatt

SEQ ID NO: 4446286 - DNA, 24 bp, Homo sapiens
aatatcaaagagaagatgcctgtt

SEQ ID NO: 4446287 - DNA, 15 bp, Homo sapiens
aatatcaaagcattt

SEQ ID NO: 4446288 - DNA, 12 bp, Homo sapiens
aatatcacctag

SEQ ID NO: 4446289 - DNA, 15 bp, Homo sapiens
aatatcactcattaa

SEQ ID NO: 4446290 - DNA, 15 bp, Homo sapiens
aatatcagtattctg

SEQ ID NO: 4446291 - DNA, 21 bp, Homo sapiens
aatatcagtattctgacatgt

SEQ ID NO: 4446292 - DNA, 19 bp, Homo sapiens
aatatcagttactcagccc

SEQ ID NO: 4446293 - DNA, 22 bp, Homo sapiens
aatatcagttactcagccctgg

SEQ ID NO: 4446294 - DNA, 15 bp, Homo sapiens
aatatcatctgtcat

SEQ ID NO: 4446295 - DNA, 16 bp, Homo sapiens
aatatcatctgtcatt

SEQ ID NO: 4446296 - DNA, 20 bp, Homo sapiens
aatatcatctgtcattatat

SEQ ID NO: 4446297 - DNA, 20 bp, Homo sapiens
aatatccaccactttaacct

SEQ ID NO: 4446298 - DNA, 16 bp, Homo sapiens
aatatccattctgtag

SEQ ID NO: 4446299 - DNA, 17 bp, Homo sapiens
aatatccatttatcttt

SEQ ID NO: 4446300 - DNA, 20 bp, Homo sapiens
aatatccctcccctctctcc

SEQ ID NO: 4446301 - DNA, 20 bp, Homo sapiens
aatatcccttggacatttta

SEQ ID NO: 4446302 - DNA, 14 bp, Homo sapiens
aatatcctaaacat

SEQ ID NO: 4446303 - DNA, 17 bp, Homo sapiens
aatatcctaaacatcat

SEQ ID NO: 4446304 - DNA, 14 bp, Homo sapiens
aatatctaaagtta

SEQ ID NO: 4446305 - DNA, 15 bp, Homo sapiens
aatatctaaagttat

SEQ ID NO: 4446306 - DNA, 15 bp, Homo sapiens
aatatctatttgaat

SEQ ID NO: 4446307 - DNA, 15 bp, Homo sapiens
aatatctctatttaa

SEQ ID NO: 4446308 - DNA, 16 bp, Homo sapiens
aatatctctatttaat

SEQ ID NO: 4446309 - DNA, 23 bp, Homo sapiens
aatatctctatttaattttgaca

SEQ ID NO: 4446310 - DNA, 21 bp, Homo sapiens
aatatctgaacatttactaca

SEQ ID NO: 4446311 - DNA, 14 bp, Homo sapiens
aatatctgtgaaat

SEQ ID NO: 4446312 - DNA, 23 bp, Homo sapiens
aatatctgttattcaaatttgat

SEQ ID NO: 4446313 - DNA, 19 bp, Homo sapiens
aatatctttaaatatatat

SEQ ID NO: 4446314 - DNA, 23 bp, Homo sapiens
aatatctttcacatgcattttag

SEQ ID NO: 4446315 - DNA, 19 bp, Homo sapiens
aatatcttttttttaataa

SEQ ID NO: 4446316 - DNA, 20 bp, Homo sapiens
aatatgaaccctttgtttct

SEQ ID NO: 4446317 - DNA, 16 bp, Homo sapiens
aatatgacagctgtcc

SEQ ID NO: 4446318 - DNA, 13 bp, Homo sapiens
aatatgagcttca

SEQ ID NO: 4446319 - DNA, 23 bp, Homo sapiens
aatatgagcttcaatataagaag

SEQ ID NO: 4446320 - DNA, 14 bp, Homo sapiens
aatatgatgacaat

SEQ ID NO: 4446321 - DNA, 15 bp, Homo sapiens
aatatgattatacaa

SEQ ID NO: 4446322 - DNA, 24 bp, Homo sapiens
aatatgcaaagcactgacttctaa

SEQ ID NO: 4446323 - DNA, 21 bp, Homo sapiens
aatatgcaagcagctttttat

SEQ ID NO: 4446324 - DNA, 17 bp, Homo sapiens
aatatgcttataaccta

SEQ ID NO: 4446325 - DNA, 22 bp, Homo sapiens
aatatggaaatcttttacattt

SEQ ID NO: 4446326 - DNA, 14 bp, Homo sapiens
aatatggtgtattt

SEQ ID NO: 4446327 - DNA, 15 bp, Homo sapiens
aatatggtgtatttt

SEQ ID NO: 4446328 - DNA, 19 bp, Homo sapiens
aatatgtaagaacacattt

SEQ ID NO: 4446329 - DNA, 21 bp, Homo sapiens
aatatgtatttaccaaaaatt

SEQ ID NO: 4446330 - DNA, 12 bp, Homo sapiens
aatatgtctttt

SEQ ID NO: 4446331 - DNA, 13 bp, Homo sapiens
aatatgtcttttt

SEQ ID NO: 4446332 - DNA, 14 bp, Homo sapiens
aatatgtgaagttt

SEQ ID NO: 4446333 - DNA, 15 bp, Homo sapiens
aatatgtgaagtttt

SEQ ID NO: 4446334 - DNA, 21 bp, Homo sapiens
aatattaaaaaacttcatgta

SEQ ID NO: 4446335 - DNA, 23 bp, Homo sapiens
aatattaaagatttatttagcta

SEQ ID NO: 4446336 - DNA, 19 bp, Homo sapiens
aatattaaatattataatg

SEQ ID NO: 4446337 - DNA, 22 bp, Homo sapiens
aatattaagaacattttataaa

SEQ ID NO: 4446338 - DNA, 24 bp, Homo sapiens
aatattaattccaggaacacatgt

SEQ ID NO: 4446339 - DNA, 14 bp, Homo sapiens
aatattacctaatg

SEQ ID NO: 4446340 - DNA, 16 bp, Homo sapiens
aatattagttggcttt

SEQ ID NO: 4446341 - DNA, 13 bp, Homo sapiens
aatattcagaaat

SEQ ID NO: 4446342 - DNA, 16 bp, Homo sapiens
aatattcagccagctt

SEQ ID NO: 4446343 - DNA, 19 bp, Homo sapiens
aatattcagccagcttaaa

SEQ ID NO: 4446344 - DNA, 16 bp, Homo sapiens
aatattcagtggtgaa

SEQ ID NO: 4446345 - DNA, 21 bp, Homo sapiens
aatattcagtggtgaaatctt

SEQ ID NO: 4446346 - DNA, 17 bp, Homo sapiens
aatattctgaatcacca

SEQ ID NO: 4446347 - DNA, 12 bp, Homo sapiens
aatattctgttt

SEQ ID NO: 4446348 - DNA, 13 bp, Homo sapiens
aatattctgtttt

SEQ ID NO: 4446349 - DNA, 13 bp, Homo sapiens
aatattgaaaatt

SEQ ID NO: 4446350 - DNA, 14 bp, Homo sapiens
aatattgaaaattg

SEQ ID NO: 4446351 - DNA, 21 bp, Homo sapiens
aatattgaaaattgaaaagta

SEQ ID NO: 4446352 - DNA, 14 bp, Homo sapiens
aatattgaagttgt

SEQ ID NO: 4446353 - DNA, 16 bp, Homo sapiens
aatattgaagttgttt

SEQ ID NO: 4446354 - DNA, 13 bp, Homo sapiens
aatattgaatttt

SEQ ID NO: 4446355 - DNA, 18 bp, Homo sapiens
aatattgaatttttccta

SEQ ID NO: 4446356 - DNA, 18 bp, Homo sapiens
aatattgactcaaaccat

SEQ ID NO: 4446357 - DNA, 19 bp, Homo sapiens
aatattgactcaaaccata

SEQ ID NO: 4446358 - DNA, 19 bp, Homo sapiens
aatattgagaaagaaacta

SEQ ID NO: 4446359 - DNA, 14 bp, Homo sapiens
aatattgagcaata

SEQ ID NO: 4446360 - DNA, 13 bp, Homo sapiens
aatattgcttcaa

SEQ ID NO: 4446361 - DNA, 20 bp, Homo sapiens
aatattgtatatttttatct

SEQ ID NO: 4446362 - DNA, 14 bp, Homo sapiens
aatattgtcatctt

SEQ ID NO: 4446363 - DNA, 20 bp, Homo sapiens
aatattgtcatctttttcta

SEQ ID NO: 4446364 - DNA, 21 bp, Homo sapiens
aatattgtcatctttttctag

SEQ ID NO: 4446365 - DNA, 13 bp, Homo sapiens
aatattgtccatt

SEQ ID NO: 4446366 - DNA, 14 bp, Homo sapiens
aatattgtttctgc

SEQ ID NO: 4446367 - DNA, 17 bp, Homo sapiens
aatatttaaaaatgtct

SEQ ID NO: 4446368 - DNA, 23 bp, Homo sapiens
aatatttaagtttgttgctgtca

SEQ ID NO: 4446369 - DNA, 15 bp, Homo sapiens
aatatttaatatcaa

SEQ ID NO: 4446370 - DNA, 15 bp, Homo sapiens
aatatttacaatgta

SEQ ID NO: 4446371 - DNA, 16 bp, Homo sapiens
aatatttcaagtgcct

SEQ ID NO: 4446372 - DNA, 23 bp, Homo sapiens
aatatttcaagtgcctagactgt

SEQ ID NO: 4446373 - DNA, 17 bp, Homo sapiens
aatatttcttttgttgt

SEQ ID NO: 4446374 - DNA, 19 bp, Homo sapiens
aatatttcttttgttgtac

SEQ ID NO: 4446375 - DNA, 15 bp, Homo sapiens
aatattttatcctgt

SEQ ID NO: 4446376 - DNA, 16 bp, Homo sapiens
aatattttatcctgta

SEQ ID NO: 4446377 - DNA, 19 bp, Homo sapiens
aatattttatcctgtattc

SEQ ID NO: 4446378 - DNA, 13 bp, Homo sapiens
aatattttcagta

SEQ ID NO: 4446379 - DNA, 16 bp, Homo sapiens
aatattttctatttta

SEQ ID NO: 4446380 - DNA, 19 bp, Homo sapiens
aatattttctctgtacttt

SEQ ID NO: 4446381 - DNA, 14 bp, Homo sapiens
aatattttctttta

SEQ ID NO: 4446382 - DNA, 20 bp, Homo sapiens
aatattttgaatcaataata

SEQ ID NO: 4446383 - DNA, 22 bp, Homo sapiens
aatattttgtaatattctgttt

SEQ ID NO: 4446384 - DNA, 20 bp, Homo sapiens
aatatttttagactatttct

SEQ ID NO: 4446385 - DNA, 14 bp, Homo sapiens
aatatttttagata

SEQ ID NO: 4446386 - DNA, 22 bp, Homo sapiens
aatatttttatatttcctttat

SEQ ID NO: 4446387 - DNA, 12 bp, Homo sapiens
aatattttttga

SEQ ID NO: 4446388 - DNA, 13 bp, Homo sapiens
aatattttttgaa

SEQ ID NO: 4446389 - DNA, 14 bp, Homo sapiens
aatattttttgaag

SEQ ID NO: 4446390 - DNA, 15 bp, Homo sapiens
aatgaatgattaaat

SEQ ID NO: 4446391 - DNA, 19 bp, Homo sapiens
aatgaatgccgaatttggt

SEQ ID NO: 4446392 - DNA, 13 bp, Homo sapiens
aatgaattctgaa

SEQ ID NO: 4446393 - DNA, 13 bp, Homo sapiens
aatgaattgaaaa

SEQ ID NO: 4446394 - DNA, 17 bp, Homo sapiens
aatgaattgaaaaacaa

SEQ ID NO: 4446395 - DNA, 18 bp, Homo sapiens
aatgaatttatctttacc

SEQ ID NO: 4446396 - DNA, 19 bp, Homo sapiens
aatgaatttatctttacca

SEQ ID NO: 4446397 - DNA, 23 bp, Homo sapiens
aatgaatttttattgagattttc

SEQ ID NO: 4446398 - DNA, 13 bp, Homo sapiens
aatgacaacactt

SEQ ID NO: 4446399 - DNA, 15 bp, Homo sapiens
aatgacaacacttaa

SEQ ID NO: 4446400 - DNA, 16 bp, Homo sapiens
aatgacacccatgcca

SEQ ID NO: 4446401 - DNA, 13 bp, Homo sapiens
aatgacagatttc

SEQ ID NO: 4446402 - DNA, 16 bp, Homo sapiens
aatgacagatttctgt

SEQ ID NO: 4446403 - DNA, 16 bp, Homo sapiens
aatgacagtaatattg

SEQ ID NO: 4446404 - DNA, 17 bp, Homo sapiens
aatgacagtcaaaagat

SEQ ID NO: 4446405 - DNA, 16 bp, Homo sapiens
aatgacatctttttaa

SEQ ID NO: 4446406 - DNA, 14 bp, Homo sapiens
aatgacattttact

SEQ ID NO: 4446407 - DNA, 21 bp, Homo sapiens
aatgactatataatttatttc

SEQ ID NO: 4446408 - DNA, 13 bp, Homo sapiens
aatgactggctcc

SEQ ID NO: 4446409 - DNA, 19 bp, Homo sapiens
aatgactggctcctgactt

SEQ ID NO: 4446410 - DNA, 13 bp, Homo sapiens
aatgacttagaaa

SEQ ID NO: 4446411 - DNA, 16 bp, Homo sapiens
aatgacttagaaactg

SEQ ID NO: 4446412 - DNA, 16 bp, Homo sapiens
aatgacttttaaaatt

SEQ ID NO: 4446413 - DNA, 15 bp, Homo sapiens
aatgagacatccagc

SEQ ID NO: 4446414 - DNA, 19 bp, Homo sapiens
aatgagactctagggtcca

SEQ ID NO: 4446415 - DNA, 17 bp, Homo sapiens
aatgagcttgattaaat

SEQ ID NO: 4446416 - DNA, 19 bp, Homo sapiens
aatgaggagagaaaatata

SEQ ID NO: 4446417 - DNA, 22 bp, Homo sapiens
aatgaggagagaaaatatatgt

SEQ ID NO: 4446418 - DNA, 23 bp, Homo sapiens
aatgaggggaagccattttccag

SEQ ID NO: 4446419 - DNA, 19 bp, Homo sapiens
aatgaggtcagcatgtcta

SEQ ID NO: 4446420 - DNA, 16 bp, Homo sapiens
aatgaggtctgggcta

SEQ ID NO: 4446421 - DNA, 14 bp, Homo sapiens
aatgagtctgtaat

SEQ ID NO: 4446422 - DNA, 16 bp, Homo sapiens
aatgagtctgtaattt

SEQ ID NO: 4446423 - DNA, 15 bp, Homo sapiens
aatgagttacttaga

SEQ ID NO: 4446424 - DNA, 17 bp, Homo sapiens
aatgatacccaacagtt

SEQ ID NO: 4446425 - DNA, 19 bp, Homo sapiens
aatgatactgattatgaaa

SEQ ID NO: 4446426 - DNA, 21 bp, Homo sapiens
aatgatagacaattgaggtaa

SEQ ID NO: 4446427 - DNA, 14 bp, Homo sapiens
aatgatattgctga

SEQ ID NO: 4446428 - DNA, 22 bp, Homo sapiens
aatgatattgctgaagaatcta

SEQ ID NO: 4446429 - DNA, 15 bp, Homo sapiens
aatgatcaaagtttt

SEQ ID NO: 4446430 - DNA, 17 bp, Homo sapiens
aatgatcacatctaaag

SEQ ID NO: 4446431 - DNA, 21 bp, Homo sapiens
aatgatcacatctaaagcttt

SEQ ID NO: 4446432 - DNA, 23 bp, Homo sapiens
aatgatcacatctaaagctttat

SEQ ID NO: 4446433 - DNA, 22 bp, Homo sapiens
aatgatccccagctgtttatgc

SEQ ID NO: 4446434 - DNA, 23 bp, Homo sapiens
aatgatcctggaaattgcagtaa

SEQ ID NO: 4446435 - DNA, 22 bp, Homo sapiens
aatgatcctgtctctaaaaaga

SEQ ID NO: 4446436 - DNA, 18 bp, Homo sapiens
aatgatcgaaaaaataat

SEQ ID NO: 4446437 - DNA, 13 bp, Homo sapiens
aatgatcttgtgt

SEQ ID NO: 4446438 - DNA, 13 bp, Homo sapiens
aatgatgatcttc

SEQ ID NO: 4446439 - DNA, 17 bp, Homo sapiens
aatgatgccctgctcca

SEQ ID NO: 4446440 - DNA, 16 bp, Homo sapiens
aatgattatattcaca

SEQ ID NO: 4446441 - DNA, 18 bp, Homo sapiens
aatgattcaaatgtttta

SEQ ID NO: 4446442 - DNA, 22 bp, Homo sapiens
aatgattcagtgttaaatgtga

SEQ ID NO: 4446443 - DNA, 13 bp, Homo sapiens
aatgatttagtgt

SEQ ID NO: 4446444 - DNA, 20 bp, Homo sapiens
aatgatttccaaagagaaaa

SEQ ID NO: 4446445 - DNA, 15 bp, Homo sapiens
aatgcaataactctg

SEQ ID NO: 4446446 - DNA, 13 bp, Homo sapiens
aatgcaataagaa

SEQ ID NO: 4446447 - DNA, 16 bp, Homo sapiens
aatgcaataagattta

SEQ ID NO: 4446448 - DNA, 21 bp, Homo sapiens
aatgcaatgtaagcatacttt

SEQ ID NO: 4446449 - DNA, 16 bp, Homo sapiens
aatgcacagatatact

SEQ ID NO: 4446450 - DNA, 17 bp, Homo sapiens
aatgcacagatatactt

SEQ ID NO: 4446451 - DNA, 21 bp, Homo sapiens
aatgcaccaatcttgtttata

SEQ ID NO: 4446452 - DNA, 19 bp, Homo sapiens
aatgcacccatcagcactc

SEQ ID NO: 4446453 - DNA, 20 bp, Homo sapiens
aatgcacccatcagcactct

SEQ ID NO: 4446454 - DNA, 14 bp, Homo sapiens
aatgcacctcccca

SEQ ID NO: 4446455 - DNA, 16 bp, Homo sapiens
aatgcacctccccaaa

SEQ ID NO: 4446456 - DNA, 18 bp, Homo sapiens
aatgcactaagacaagaa

SEQ ID NO: 4446457 - DNA, 22 bp, Homo sapiens
aatgcactaagacaagaacatt

SEQ ID NO: 4446458 - DNA, 15 bp, Homo sapiens
aatgcacttctattt

SEQ ID NO: 4446459 - DNA, 13 bp, Homo sapiens
aatgcactttcta

SEQ ID NO: 4446460 - DNA, 18 bp, Homo sapiens
aatgcagattacactgat

SEQ ID NO: 4446461 - DNA, 13 bp, Homo sapiens
aatgcagcaggaa

SEQ ID NO: 4446462 - DNA, 15 bp, Homo sapiens
aatgcagcaggaagg

SEQ ID NO: 4446463 - DNA, 14 bp, Homo sapiens
aatgcagtatatag

SEQ ID NO: 4446464 - DNA, 16 bp, Homo sapiens
aatgcagtatggtaca

SEQ ID NO: 4446465 - DNA, 23 bp, Homo sapiens
aatgcagtatggtacatttttca

SEQ ID NO: 4446466 - DNA, 20 bp, Homo sapiens
aatgcataaatgcataattt

SEQ ID NO: 4446467 - DNA, 13 bp, Homo sapiens
aatgcataatgtt

SEQ ID NO: 4446468 - DNA, 21 bp, Homo sapiens
aatgcatccagcagtacaata

SEQ ID NO: 4446469 - DNA, 19 bp, Homo sapiens
aatgcatccattcctcagg

SEQ ID NO: 4446470 - DNA, 19 bp, Homo sapiens
aatgcattcttctctgttg

SEQ ID NO: 4446471 - DNA, 18 bp, Homo sapiens
aatgcattgttgtaaagt

SEQ ID NO: 4446472 - DNA, 21 bp, Homo sapiens
aatgcattgttgtaaagtatt

SEQ ID NO: 4446473 - DNA, 13 bp, Homo sapiens
aatgccaaaggaa

SEQ ID NO: 4446474 - DNA, 19 bp, Homo sapiens
aatgccacacattgtgctt

SEQ ID NO: 4446475 - DNA, 17 bp, Homo sapiens
aatgccaccacacgtgt

SEQ ID NO: 4446476 - DNA, 23 bp, Homo sapiens
aatgccatagtcaaagagagttt

SEQ ID NO: 4446477 - DNA, 15 bp, Homo sapiens
aatgccatcaaatga

SEQ ID NO: 4446478 - DNA, 13 bp, Homo sapiens
aatgcccagttca

SEQ ID NO: 4446479 - DNA, 22 bp, Homo sapiens
aatgccgaatttggtacacatg

SEQ ID NO: 4446480 - DNA, 23 bp, Homo sapiens
aatgccgaatttggtacacatgt

SEQ ID NO: 4446481 - DNA, 23 bp, Homo sapiens
aatgccgcgatgggtcaggtagg

SEQ ID NO: 4446482 - DNA, 19 bp, Homo sapiens
aatgccggttaaattccat

SEQ ID NO: 4446483 - DNA, 20 bp, Homo sapiens
aatgcctcttaaattatata

SEQ ID NO: 4446484 - DNA, 19 bp, Homo sapiens
aatgcctgctttttggaaa

SEQ ID NO: 4446485 - DNA, 18 bp, Homo sapiens
aatgccttgttgtattcc

SEQ ID NO: 4446486 - DNA, 20 bp, Homo sapiens
aatgcggccgcattccctga

SEQ ID NO: 4446487 - DNA, 18 bp, Homo sapiens
aatgctatttttgttttt

SEQ ID NO: 4446488 - DNA, 19 bp, Homo sapiens
aatgctatttttgttttta

SEQ ID NO: 4446489 - DNA, 20 bp, Homo sapiens
aatgctatttttgtttttag

SEQ ID NO: 4446490 - DNA, 16 bp, Homo sapiens
aatgctccccacagcg

SEQ ID NO: 4446491 - DNA, 18 bp, Homo sapiens
aatgctcctagaagtctt

SEQ ID NO: 4446492 - DNA, 13 bp, Homo sapiens
aatgctgtacatc

SEQ ID NO: 4446493 - DNA, 17 bp, Homo sapiens
aatgctgtacatctatt

SEQ ID NO: 4446494 - DNA, 21 bp, Homo sapiens
aatgctgtatttttacagcta

SEQ ID NO: 4446495 - DNA, 20 bp, Homo sapiens
aatgctgttagtaaatttct

SEQ ID NO: 4446496 - DNA, 22 bp, Homo sapiens
aatgctgttagtaaatttctgt

SEQ ID NO: 4446497 - DNA, 12 bp, Homo sapiens
aatgcttaaaaa

SEQ ID NO: 4446498 - DNA, 14 bp, Homo sapiens
aatgcttaaatttc

SEQ ID NO: 4446499 - DNA, 22 bp, Homo sapiens
aatgcttacctaatttcatttt

SEQ ID NO: 4446500 - DNA, 21 bp, Homo sapiens
aatgcttcattgaaagcttca

SEQ ID NO: 4446501 - DNA, 12 bp, Homo sapiens
aatgctttgaaa

SEQ ID NO: 4446502 - DNA, 20 bp, Homo sapiens
aatgctttgggaactgtgtt

SEQ ID NO: 4446503 - DNA, 19 bp, Homo sapiens
aatgcttttatattctaat

SEQ ID NO: 4446504 - DNA, 15 bp, Homo sapiens
aatggaaaagagaga

SEQ ID NO: 4446505 - DNA, 17 bp, Homo sapiens
aatggaaagtcatgcaa

SEQ ID NO: 4446506 - DNA, 23 bp, Homo sapiens
aatggactgttacagactgaaag

SEQ ID NO: 4446507 - DNA, 23 bp, Homo sapiens
aatggactttgcacactttggcc

SEQ ID NO: 4446508 - DNA, 19 bp, Homo sapiens
aattatgcactaaatatga

SEQ ID NO: 4446509 - DNA, 15 bp, Homo sapiens
aattatggaatatca

SEQ ID NO: 4446510 - DNA, 18 bp, Homo sapiens
aattatggcatttctatt

SEQ ID NO: 4446511 - DNA, 21 bp, Homo sapiens
aattatgggaataattgcttt

SEQ ID NO: 4446512 - DNA, 15 bp, Homo sapiens
aattatgtctcttga

SEQ ID NO: 4446513 - DNA, 11 bp, Homo sapiens
aattatgtgac

SEQ ID NO: 4446514 - DNA, 17 bp, Homo sapiens
aattatgtgacatttta

SEQ ID NO: 4446515 - DNA, 22 bp, Homo sapiens
aattatgtgacattttacatta

SEQ ID NO: 4446516 - DNA, 14 bp, Homo sapiens
aattatgttactgt

SEQ ID NO: 4446517 - DNA, 23 bp, Homo sapiens
aattatgttactgtatttttcag

SEQ ID NO: 4446518 - DNA, 16 bp, Homo sapiens
aattattactttaaat

SEQ ID NO: 4446519 - DNA, 22 bp, Homo sapiens
aattattactttaaattatatg

SEQ ID NO: 4446520 - DNA, 23 bp, Homo sapiens
aattattactttaaattatatga

SEQ ID NO: 4446521 - DNA, 17 bp, Homo sapiens
aattattatcttcttaa

SEQ ID NO: 4446522 - DNA, 23 bp, Homo sapiens
aattattatcttcttaacagttt

SEQ ID NO: 4446523 - DNA, 13 bp, Homo sapiens
aattattatttta

SEQ ID NO: 4446524 - DNA, 18 bp, Homo sapiens
aattattattttaaaata

SEQ ID NO: 4446525 - DNA, 21 bp, Homo sapiens
aattattattttaaaatatat

SEQ ID NO: 4446526 - DNA, 23 bp, Homo sapiens
aattattattttaaaatatatga

SEQ ID NO: 4446527 - DNA, 13 bp, Homo sapiens
aattattgacact

SEQ ID NO: 4446528 - DNA, 14 bp, Homo sapiens
aattattgacactg

SEQ ID NO: 4446529 - DNA, 22 bp, Homo sapiens
aattatttctgtcacagtaaaa

SEQ ID NO: 4446530 - DNA, 17 bp, Homo sapiens
aattatttcttaattat

SEQ ID NO: 4446531 - DNA, 19 bp, Homo sapiens
aattatttgcaggtcttta

SEQ ID NO: 4446532 - DNA, 17 bp, Homo sapiens
aattattttaaattata

SEQ ID NO: 4446533 - DNA, 22 bp, Homo sapiens
aattattttaaattataaggac

SEQ ID NO: 4446534 - DNA, 14 bp, Homo sapiens
aattattttaacaa

SEQ ID NO: 4446535 - DNA, 13 bp, Homo sapiens
aattcaaagcatg

SEQ ID NO: 4446536 - DNA, 19 bp, Homo sapiens
aattcaaagcatggacatt

SEQ ID NO: 4446537 - DNA, 22 bp, Homo sapiens
aattcaaagctgtgtgtttgga

SEQ ID NO: 4446538 - DNA, 12 bp, Homo sapiens
aattcaagaagt

SEQ ID NO: 4446539 - DNA, 16 bp, Homo sapiens
aattcaagaagtattt

SEQ ID NO: 4446540 - DNA, 18 bp, Homo sapiens
aattcaagcctctaaaca

SEQ ID NO: 4446541 - DNA, 20 bp, Homo sapiens
aattcaagcctctaaacaga

SEQ ID NO: 4446542 - DNA, 16 bp, Homo sapiens
aattcaaggaatttct

SEQ ID NO: 4446543 - DNA, 17 bp, Homo sapiens
aattcaaggaatttctt

SEQ ID NO: 4446544 - DNA, 23 bp, Homo sapiens
aattcaagtgcttaaaaatactt

SEQ ID NO: 4446545 - DNA, 19 bp, Homo sapiens
aattcacaaacttttatac

SEQ ID NO: 4446546 - DNA, 20 bp, Homo sapiens
aattcacagtgctcttttct

SEQ ID NO: 4446547 - DNA, 22 bp, Homo sapiens
aattcacatctaacctcatctt

SEQ ID NO: 4446548 - DNA, 21 bp, Homo sapiens
aattcacatgatgcacttcaa

SEQ ID NO: 4446549 - DNA, 16 bp, Homo sapiens
aattcacattttctca

SEQ ID NO: 4446550 - DNA, 17 bp, Homo sapiens
aattcacattttctcaa

SEQ ID NO: 4446551 - DNA, 23 bp, Homo sapiens
aattcaccagtgttcctgaagct

SEQ ID NO: 4446552 - DNA, 23 bp, Homo sapiens
aattcagaactaaatttttcata

SEQ ID NO: 4446553 - DNA, 21 bp, Homo sapiens
aattcagacatctgaggtttt

SEQ ID NO: 4446554 - DNA, 14 bp, Homo sapiens
aattcagagtcctt

SEQ ID NO: 4446555 - DNA, 12 bp, Homo sapiens
aattcagctctg

SEQ ID NO: 4446556 - DNA, 19 bp, Homo sapiens
aattcaggtttttcctttt

SEQ ID NO: 4446557 - DNA, 16 bp, Homo sapiens
aattcagtttcacttt

SEQ ID NO: 4446558 - DNA, 14 bp, Homo sapiens
aattcataaaaaca

SEQ ID NO: 4446559 - DNA, 15 bp, Homo sapiens
aattcataataaatt

SEQ ID NO: 4446560 - DNA, 19 bp, Homo sapiens
aattcatatctaaatagta

SEQ ID NO: 4446561 - DNA, 12 bp, Homo sapiens
aattcatttcta

SEQ ID NO: 4446562 - DNA, 21 bp, Homo sapiens
aattccactgaaaatttaaca

SEQ ID NO: 4446563 - DNA, 22 bp, Homo sapiens
aattccacttataggaattgac

SEQ ID NO: 4446564 - DNA, 17 bp, Homo sapiens
aattccatatgctccag

SEQ ID NO: 4446565 - DNA, 14 bp, Homo sapiens
aattcccttctttt

SEQ ID NO: 4446566 - DNA, 14 bp, Homo sapiens
aattcctacagcac

SEQ ID NO: 4446567 - DNA, 18 bp, Homo sapiens
aattcctacagcactact

SEQ ID NO: 4446568 - DNA, 14 bp, Homo sapiens
aattcctagaatta

SEQ ID NO: 4446569 - DNA, 23 bp, Homo sapiens
aattcctctcaaattcagctctg

SEQ ID NO: 4446570 - DNA, 21 bp, Homo sapiens
aattcgcccgagctgtttatg

SEQ ID NO: 4446571 - DNA, 23 bp, Homo sapiens
aattcgcccgagctgtttatgtt

SEQ ID NO: 4446572 - DNA, 12 bp, Homo sapiens
aattctaaaatg

SEQ ID NO: 4446573 - DNA, 14 bp, Homo sapiens
aattctaaaatgat

SEQ ID NO: 4446574 - DNA, 17 bp, Homo sapiens
aattctaacccaggtat

SEQ ID NO: 4446575 - DNA, 22 bp, Homo sapiens
aattctacacctcctttaagat

SEQ ID NO: 4446576 - DNA, 17 bp, Homo sapiens
aattctacctccttgtg

SEQ ID NO: 4446577 - DNA, 14 bp, Homo sapiens
aattctactggaaa

SEQ ID NO: 4446578 - DNA, 18 bp, Homo sapiens
aattctactggaaaaaaa

SEQ ID NO: 4446579 - DNA, 18 bp, Homo sapiens
aattctcattaaaagaat

SEQ ID NO: 4446580 - DNA, 16 bp, Homo sapiens
aattctccaggatttt

SEQ ID NO: 4446581 - DNA, 22 bp, Homo sapiens
aattctccaggattttaatttc

SEQ ID NO: 4446582 - DNA, 20 bp, Homo sapiens
aattctcctgcctcagcctc

SEQ ID NO: 4446583 - DNA, 11 bp, Homo sapiens
aattctgaaac

SEQ ID NO: 4446584 - DNA, 11 bp, Homo sapiens
aattctgaaat

SEQ ID NO: 4446585 - DNA, 17 bp, Homo sapiens
aattctgaaatactttt

SEQ ID NO: 4446586 - DNA, 16 bp, Homo sapiens
aattctgaatttgcaa

SEQ ID NO: 4446587 - DNA, 13 bp, Homo sapiens
aattctgactgtc

SEQ ID NO: 4446588 - DNA, 22 bp, Homo sapiens
aattctgactgtccaggagcta

SEQ ID NO: 4446589 - DNA, 17 bp, Homo sapiens
aattctgagttttgtgt

SEQ ID NO: 4446590 - DNA, 15 bp, Homo sapiens
aattctgggaaggga

SEQ ID NO: 4446591 - DNA, 14 bp, Homo sapiens
aattctgtaatttg

SEQ ID NO: 4446592 - DNA, 21 bp, Homo sapiens
aattctgtttttaatgctatt

SEQ ID NO: 4446593 - DNA, 22 bp, Homo sapiens
aattctgtttttaatgctattt

SEQ ID NO: 4446594 - DNA, 17 bp, Homo sapiens
aattcttaaaactataa

SEQ ID NO: 4446595 - DNA, 17 bp, Homo sapiens
aattcttacagccaagt

SEQ ID NO: 4446596 - DNA, 17 bp, Homo sapiens
aattcttcacatgttta

SEQ ID NO: 4446597 - DNA, 13 bp, Homo sapiens
aattcttctgaac

SEQ ID NO: 4446598 - DNA, 18 bp, Homo sapiens
aattcttctgaactcaaa

SEQ ID NO: 4446599 - DNA, 22 bp, Homo sapiens
aattcttctgcaacatttgaca

SEQ ID NO: 4446600 - DNA, 13 bp, Homo sapiens
aattcttgataaa

SEQ ID NO: 4446601 - DNA, 20 bp, Homo sapiens
aattcttggttgaggaaaca

SEQ ID NO: 4446602 - DNA, 21 bp, Homo sapiens
aattctttatcccattttatc

SEQ ID NO: 4446603 - DNA, 18 bp, Homo sapiens
aattctttgacctgttgg

SEQ ID NO: 4446604 - DNA, 21 bp, Homo sapiens
aattgaaaaaaattgaaataa

SEQ ID NO: 4446605 - DNA, 16 bp, Homo sapiens
aattgaaaagaagtag

SEQ ID NO: 4446606 - DNA, 14 bp, Homo sapiens
aattgaaaagtaca

SEQ ID NO: 4446607 - DNA, 14 bp, Homo sapiens
aattgaaataaata

SEQ ID NO: 4446608 - DNA, 16 bp, Homo sapiens
aattgaagtttcaagt

SEQ ID NO: 4446609 - DNA, 20 bp, Homo sapiens
aattgaagtttcaagtttta

SEQ ID NO: 4446610 - DNA, 21 bp, Homo sapiens
aattgaatagtttatttctgt

SEQ ID NO: 4446611 - DNA, 13 bp, Homo sapiens
aattgacccacaa

SEQ ID NO: 4446612 - DNA, 22 bp, Homo sapiens
aattgacccacaagaaatgaaa

SEQ ID NO: 4446613 - DNA, 15 bp, Homo sapiens
aattgatagcagata

SEQ ID NO: 4446614 - DNA, 14 bp, Homo sapiens
aattgatgtgatta

SEQ ID NO: 4446615 - DNA, 13 bp, Homo sapiens
aattgatttgcat

SEQ ID NO: 4446616 - DNA, 14 bp, Homo sapiens
aattgatttgcatt

SEQ ID NO: 4446617 - DNA, 20 bp, Homo sapiens
aattgcaaaaacatagaaat

SEQ ID NO: 4446618 - DNA, 12 bp, Homo sapiens
aattgcaagtct

SEQ ID NO: 4446619 - DNA, 20 bp, Homo sapiens
aattgcacaccttggaattc

SEQ ID NO: 4446620 - DNA, 20 bp, Homo sapiens
aattgcaccagaaatgttta

SEQ ID NO: 4446621 - DNA, 22 bp, Homo sapiens
aattgcacgcggagtgagtttt

SEQ ID NO: 4446622 - DNA, 17 bp, Homo sapiens
aattgcagaattcaaaa

SEQ ID NO: 4446623 - DNA, 14 bp, Homo sapiens
aattgcagtcattt

SEQ ID NO: 4446624 - DNA, 18 bp, Homo sapiens
aattgcagtttcatgtat

SEQ ID NO: 4446625 - DNA, 16 bp, Homo sapiens
aattgcctcttgcagg

SEQ ID NO: 4446626 - DNA, 23 bp, Homo sapiens
acacagttaaataaatagaaaga

SEQ ID NO: 4446627 - DNA, 22 bp, Homo sapiens
acacatactcatttttcatgat

SEQ ID NO: 4446628 - DNA, 22 bp, Homo sapiens
acacatagcaggggcaccttcc

SEQ ID NO: 4446629 - DNA, 21 bp, Homo sapiens
acacatatatataacaaataa

SEQ ID NO: 4446630 - DNA, 15 bp, Homo sapiens
acacatcagcttgcc

SEQ ID NO: 4446631 - DNA, 19 bp, Homo sapiens
acacatcctgtcagtgtca

SEQ ID NO: 4446632 - DNA, 17 bp, Homo sapiens
acacatgataccagcag

SEQ ID NO: 4446633 - DNA, 14 bp, Homo sapiens
acacatgtgttatc

SEQ ID NO: 4446634 - DNA, 15 bp, Homo sapiens
acacattctgccttg

SEQ ID NO: 4446635 - DNA, 22 bp, Homo sapiens
acacattgactcctttccaata

SEQ ID NO: 4446636 - DNA, 12 bp, Homo sapiens
acacattgcctt

SEQ ID NO: 4446637 - DNA, 14 bp, Homo sapiens
acacattgccttct

SEQ ID NO: 4446638 - DNA, 15 bp, Homo sapiens
acacattgccttctg

SEQ ID NO: 4446639 - DNA, 16 bp, Homo sapiens
acacattgctacctca

SEQ ID NO: 4446640 - DNA, 17 bp, Homo sapiens
acacattgctacctcag

SEQ ID NO: 4446641 - DNA, 20 bp, Homo sapiens
acacattggaatgccttgga

SEQ ID NO: 4446642 - DNA, 23 bp, Homo sapiens
acacatttgggatgttccttttt

SEQ ID NO: 4446643 - DNA, 11 bp, Homo sapiens
acacattttaa

SEQ ID NO: 4446644 - DNA, 13 bp, Homo sapiens
acacattttatga

SEQ ID NO: 4446645 - DNA, 16 bp, Homo sapiens
acacatttttaaaaca

SEQ ID NO: 4446646 - DNA, 15 bp, Homo sapiens
acacatttttaagat

SEQ ID NO: 4446647 - DNA, 20 bp, Homo sapiens
acacatttttggatttctgt

SEQ ID NO: 4446648 - DNA, 18 bp, Homo sapiens
acaccaacataaaaatga

SEQ ID NO: 4446649 - DNA, 15 bp, Homo sapiens
acaccaatcagcgct

SEQ ID NO: 4446650 - DNA, 19 bp, Homo sapiens
acaccacttagatttaaag

SEQ ID NO: 4446651 - DNA, 14 bp, Homo sapiens
acaccagccaggct

SEQ ID NO: 4446652 - DNA, 15 bp, Homo sapiens
acaccatcttttatt

SEQ ID NO: 4446653 - DNA, 21 bp, Homo sapiens
acaccatcttttattcttttt

SEQ ID NO: 4446654 - DNA, 13 bp, Homo sapiens
acaccatgtgcaa

SEQ ID NO: 4446655 - DNA, 15 bp, Homo sapiens
acaccattaccaaaa

SEQ ID NO: 4446656 - DNA, 20 bp, Homo sapiens
acaccattaccaaaataata

SEQ ID NO: 4446657 - DNA, 21 bp, Homo sapiens
acaccattcattccatgtcca

SEQ ID NO: 4446658 - DNA, 15 bp, Homo sapiens
acacccaggaaggga

SEQ ID NO: 4446659 - DNA, 13 bp, Homo sapiens
acacccatttaaa

SEQ ID NO: 4446660 - DNA, 17 bp, Homo sapiens
acaccccgacttttgtt

SEQ ID NO: 4446661 - DNA, 16 bp, Homo sapiens
acacccctctgctgca

SEQ ID NO: 4446662 - DNA, 14 bp, Homo sapiens
acaccctccagaga

SEQ ID NO: 4446663 - DNA, 17 bp, Homo sapiens
acaccctgccctcatgc

SEQ ID NO: 4446664 - DNA, 14 bp, Homo sapiens
acaccctggcctga

SEQ ID NO: 4446665 - DNA, 23 bp, Homo sapiens
acaccgcgtcccagctcccctct

SEQ ID NO: 4446666 - DNA, 15 bp, Homo sapiens
acacctaaccccagg

SEQ ID NO: 4446667 - DNA, 16 bp, Homo sapiens
acacctaaccccaggg

SEQ ID NO: 4446668 - DNA, 13 bp, Homo sapiens
acacctagccagc

SEQ ID NO: 4446669 - DNA, 17 bp, Homo sapiens
acacctcacacctcact

SEQ ID NO: 4446670 - DNA, 19 bp, Homo sapiens
acacctcacacctcactct

SEQ ID NO: 4446671 - DNA, 18 bp, Homo sapiens
acacctcagttcccttgg

SEQ ID NO: 4446672 - DNA, 23 bp, Homo sapiens
acacctccccctgcgccccgcac

SEQ ID NO: 4446673 - DNA, 22 bp, Homo sapiens
acacctccctactcccctgggc

SEQ ID NO: 4446674 - DNA, 12 bp, Homo sapiens
acacctctgcca

SEQ ID NO: 4446675 - DNA, 16 bp, Homo sapiens
acacctcttggggagt

SEQ ID NO: 4446676 - DNA, 19 bp, Homo sapiens
acacctgatcttacagaaa

SEQ ID NO: 4446677 - DNA, 16 bp, Homo sapiens
acacctgcacctcccc

SEQ ID NO: 4446678 - DNA, 16 bp, Homo sapiens
acacctgcctctgacc

SEQ ID NO: 4446679 - DNA, 21 bp, Homo sapiens
acacctgcctctgaccccagc

SEQ ID NO: 4446680 - DNA, 17 bp, Homo sapiens
acacctgccttctaccc

SEQ ID NO: 4446681 - DNA, 17 bp, Homo sapiens
acacctggactgagcca

SEQ ID NO: 4446682 - DNA, 23 bp, Homo sapiens
acacctggcatggtgcagggaga

SEQ ID NO: 4446683 - DNA, 20 bp, Homo sapiens
acacctgggcatttggtgag

SEQ ID NO: 4446684 - DNA, 16 bp, Homo sapiens
acaccttcctcctgca

SEQ ID NO: 4446685 - DNA, 23 bp, Homo sapiens
acaccttttattgacacagaaaa

SEQ ID NO: 4446686 - DNA, 13 bp, Homo sapiens
acacgagccacaa

SEQ ID NO: 4446687 - DNA, 18 bp, Homo sapiens
acacgagccacaagctgc

SEQ ID NO: 4446688 - DNA, 17 bp, Homo sapiens
acacgattttattgctg

SEQ ID NO: 4446689 - DNA, 19 bp, Homo sapiens
acacgccccggtcccccag

SEQ ID NO: 4446690 - DNA, 13 bp, Homo sapiens
acacggaagcaag

SEQ ID NO: 4446691 - DNA, 21 bp, Homo sapiens
acacggatctgctgggctctg

SEQ ID NO: 4446692 - DNA, 21 bp, Homo sapiens
acacgtttaatcccagcactt

SEQ ID NO: 4446693 - DNA, 20 bp, Homo sapiens
acactaaccaaacaatgcag

SEQ ID NO: 4446694 - DNA, 14 bp, Homo sapiens
acactaacctgacc

SEQ ID NO: 4446695 - DNA, 17 bp, Homo sapiens
acactaatatatttaaa

SEQ ID NO: 4446696 - DNA, 19 bp, Homo sapiens
acactaatatatttaaaaa

SEQ ID NO: 4446697 - DNA, 22 bp, Homo sapiens
acactaatatatttaaaaataa

SEQ ID NO: 4446698 - DNA, 17 bp, Homo sapiens
acactacacactgtgta

SEQ ID NO: 4446699 - DNA, 12 bp, Homo sapiens
acactagcttat

SEQ ID NO: 4446700 - DNA, 21 bp, Homo sapiens
acactagggactatcaggtaa

SEQ ID NO: 4446701 - DNA, 17 bp, Homo sapiens
acactataatataaaac

SEQ ID NO: 4446702 - DNA, 18 bp, Homo sapiens
acactatcatagttaaca

SEQ ID NO: 4446703 - DNA, 19 bp, Homo sapiens
acactattttcagaatctg

SEQ ID NO: 4446704 - DNA, 13 bp, Homo sapiens
acactcaaatcaa

SEQ ID NO: 4446705 - DNA, 18 bp, Homo sapiens
acactcaaatcaagaaac

SEQ ID NO: 4446706 - DNA, 16 bp, Homo sapiens
acactcactcctgaga

SEQ ID NO: 4446707 - DNA, 22 bp, Homo sapiens
acactcagcagacatttatctt

SEQ ID NO: 4446708 - DNA, 23 bp, Homo sapiens
acactcagccactgtcacaggca

SEQ ID NO: 4446709 - DNA, 22 bp, Homo sapiens
acactcagtggcccatggcatt

SEQ ID NO: 4446710 - DNA, 15 bp, Homo sapiens
acactccccgaagtc

SEQ ID NO: 4446711 - DNA, 14 bp, Homo sapiens
acactcctagagaa

SEQ ID NO: 4446712 - DNA, 20 bp, Homo sapiens
acactcctagagaacgcagc

SEQ ID NO: 4446713 - DNA, 17 bp, Homo sapiens
acactctaactgtatat

SEQ ID NO: 4446714 - DNA, 15 bp, Homo sapiens
acactctatatgtag

SEQ ID NO: 4446715 - DNA, 11 bp, Homo sapiens
acactctcctg

SEQ ID NO: 4446716 - DNA, 22 bp, Homo sapiens
acactctcctgggcccctccct

SEQ ID NO: 4446717 - DNA, 17 bp, Homo sapiens
acactctgctgtttgac

SEQ ID NO: 4446718 - DNA, 22 bp, Homo sapiens
acactgaaaagaaggaaagatg

SEQ ID NO: 4446719 - DNA, 14 bp, Homo sapiens
acactgaaagtttt

SEQ ID NO: 4446720 - DNA, 20 bp, Homo sapiens
acactgaaagttttgtaaaa

SEQ ID NO: 4446721 - DNA, 17 bp, Homo sapiens
acactgaccatccactc

SEQ ID NO: 4446722 - DNA, 19 bp, Homo sapiens
acactgagaatgtaagaac

SEQ ID NO: 4446723 - DNA, 20 bp, Homo sapiens
acactgagaatgtaagaact

SEQ ID NO: 4446724 - DNA, 22 bp, Homo sapiens
acactgagaatgtaagaactac

SEQ ID NO: 4446725 - DNA, 13 bp, Homo sapiens
acactgagccagt

SEQ ID NO: 4446726 - DNA, 13 bp, Homo sapiens
acactgataatca

SEQ ID NO: 4446727 - DNA, 13 bp, Homo sapiens
acactgcactttg

SEQ ID NO: 4446728 - DNA, 23 bp, Homo sapiens
acactgcactttgtttagaaaaa

SEQ ID NO: 4446729 - DNA, 21 bp, Homo sapiens
acactggaatataaaacagtc

SEQ ID NO: 4446730 - DNA, 23 bp, Homo sapiens
acactggaatataaaacagtcat

SEQ ID NO: 4446731 - DNA, 21 bp, Homo sapiens
acactggatccatcttgagcc

SEQ ID NO: 4446732 - DNA, 21 bp, Homo sapiens
acactggctcacccagtcctg

SEQ ID NO: 4446733 - DNA, 18 bp, Homo sapiens
acactgggtggtggcctg

SEQ ID NO: 4446734 - DNA, 18 bp, Homo sapiens
acactgtcctattatatt

SEQ ID NO: 4446735 - DNA, 14 bp, Homo sapiens
acactgtgctttct

SEQ ID NO: 4446736 - DNA, 22 bp, Homo sapiens
acactgtgctttctattgtaca

SEQ ID NO: 4446737 - DNA, 22 bp, Homo sapiens
acactgtgtgggggacggcttc

SEQ ID NO: 4446738 - DNA, 17 bp, Homo sapiens
acactgttagaacacta

SEQ ID NO: 4446739 - DNA, 18 bp, Homo sapiens
acactgttagaacactat

SEQ ID NO: 4446740 - DNA, 22 bp, Homo sapiens
acactgttagaacactattttc

SEQ ID NO: 4446741 - DNA, 15 bp, Homo sapiens
acacttaaaaatggt

SEQ ID NO: 4446742 - DNA, 14 bp, Homo sapiens
acacttacagagca

SEQ ID NO: 4446743 - DNA, 16 bp, Homo sapiens
acacttatattttatg

SEQ ID NO: 4446744 - DNA, 16 bp, Homo sapiens
acagtacagaaggcaa

SEQ ID NO: 4446745 - DNA, 17 bp, Homo sapiens
acagtacctgattgtat

SEQ ID NO: 4446746 - DNA, 19 bp, Homo sapiens
acagtacctgattgtattt

SEQ ID NO: 4446747 - DNA, 21 bp, Homo sapiens
acagtacctgattgtattttt

SEQ ID NO: 4446748 - DNA, 18 bp, Homo sapiens
acagtactggttactttc

SEQ ID NO: 4446749 - DNA, 14 bp, Homo sapiens
acagtaggagccca

SEQ ID NO: 4446750 - DNA, 20 bp, Homo sapiens
acagtagtttccctactgaa

SEQ ID NO: 4446751 - DNA, 14 bp, Homo sapiens
acagtatataagct

SEQ ID NO: 4446752 - DNA, 13 bp, Homo sapiens
acagtatatttta

SEQ ID NO: 4446753 - DNA, 15 bp, Homo sapiens
acagtatattttatt

SEQ ID NO: 4446754 - DNA, 21 bp, Homo sapiens
acagtatggcagctttcctca

SEQ ID NO: 4446755 - DNA, 15 bp, Homo sapiens
acagtattatagaca

SEQ ID NO: 4446756 - DNA, 18 bp, Homo sapiens
acagtattgggcaggagg

SEQ ID NO: 4446757 - DNA, 23 bp, Homo sapiens
acagtatttctggtgtatatttt

SEQ ID NO: 4446758 - DNA, 17 bp, Homo sapiens
acagtatttgtaattaa

SEQ ID NO: 4446759 - DNA, 14 bp, Homo sapiens
acagtattttccca

SEQ ID NO: 4446760 - DNA, 18 bp, Homo sapiens
acagtcaaaaccaagtca

SEQ ID NO: 4446761 - DNA, 12 bp, Homo sapiens
acagtcacctca

SEQ ID NO: 4446762 - DNA, 15 bp, Homo sapiens
acagtcataaatact

SEQ ID NO: 4446763 - DNA, 21 bp, Homo sapiens
acagtcatcgctcgtgtgttc

SEQ ID NO: 4446764 - DNA, 18 bp, Homo sapiens
acagtccacaggggccac

SEQ ID NO: 4446765 - DNA, 19 bp, Homo sapiens
acagtcccactgtgcaggt

SEQ ID NO: 4446766 - DNA, 15 bp, Homo sapiens
acagtccctgctggg

SEQ ID NO: 4446767 - DNA, 16 bp, Homo sapiens
acagtccctgctgggg

SEQ ID NO: 4446768 - DNA, 19 bp, Homo sapiens
acagtccctgctggggaag

SEQ ID NO: 4446769 - DNA, 17 bp, Homo sapiens
acagtcgctcagtctgt

SEQ ID NO: 4446770 - DNA, 16 bp, Homo sapiens
acagtctcaggaaatc

SEQ ID NO: 4446771 - DNA, 18 bp, Homo sapiens
acagtctctactgttatt

SEQ ID NO: 4446772 - DNA, 13 bp, Homo sapiens
acagtctgtcatg

SEQ ID NO: 4446773 - DNA, 23 bp, Homo sapiens
acagtcttcattttttttaattg

SEQ ID NO: 4446774 - DNA, 13 bp, Homo sapiens
acagtcttccaca

SEQ ID NO: 4446775 - DNA, 19 bp, Homo sapiens
acagtcttccatttgcaag

SEQ ID NO: 4446776 - DNA, 14 bp, Homo sapiens
acagtcttgtgaac

SEQ ID NO: 4446777 - DNA, 14 bp, Homo sapiens
acagtgagactgta

SEQ ID NO: 4446778 - DNA, 19 bp, Homo sapiens
acagtgagactgtacataa

SEQ ID NO: 4446779 - DNA, 24 bp, Homo sapiens
acagtgagactgtacataattgca

SEQ ID NO: 4446780 - DNA, 17 bp, Homo sapiens
acagtgaggcaggagaa

SEQ ID NO: 4446781 - DNA, 15 bp, Homo sapiens
acagtgatgattgaa

SEQ ID NO: 4446782 - DNA, 19 bp, Homo sapiens
acagtgattaccagggact

SEQ ID NO: 4446783 - DNA, 20 bp, Homo sapiens
acagtgattaccagggactg

SEQ ID NO: 4446784 - DNA, 16 bp, Homo sapiens
acagtgccattgtctt

SEQ ID NO: 4446785 - DNA, 14 bp, Homo sapiens
acagtgcctgctga

SEQ ID NO: 4446786 - DNA, 21 bp, Homo sapiens
acagtgctcttttctcctcac

SEQ ID NO: 4446787 - DNA, 20 bp, Homo sapiens
acagtgctgcagctccctgg

SEQ ID NO: 4446788 - DNA, 22 bp, Homo sapiens
acagtgctgtctgatctgtgct

SEQ ID NO: 4446789 - DNA, 20 bp, Homo sapiens
acagtggcaaaacaaaagta

SEQ ID NO: 4446790 - DNA, 16 bp, Homo sapiens
acagtggcgcatgcct

SEQ ID NO: 4446791 - DNA, 16 bp, Homo sapiens
acagtggctcacgcct

SEQ ID NO: 4446792 - DNA, 18 bp, Homo sapiens
acagtggctgctctggga

SEQ ID NO: 4446793 - DNA, 22 bp, Homo sapiens
acagtggctgctctgggaaggg

SEQ ID NO: 4446794 - DNA, 23 bp, Homo sapiens
acagtgggcgttgggagcctagc

SEQ ID NO: 4446795 - DNA, 17 bp, Homo sapiens
acagtggtggcaacatt

SEQ ID NO: 4446796 - DNA, 21 bp, Homo sapiens
acagtggtggcaacattcatt

SEQ ID NO: 4446797 - DNA, 20 bp, Homo sapiens
acagtggttttatactgaag

SEQ ID NO: 4446798 - DNA, 13 bp, Homo sapiens
acagtgtacagtc

SEQ ID NO: 4446799 - DNA, 22 bp, Homo sapiens
acagtgtcctaccactctaatc

SEQ ID NO: 4446800 - DNA, 22 bp, Homo sapiens
acagttatttcatcttttattc

SEQ ID NO: 4446801 - DNA, 12 bp, Homo sapiens
acagttcctcgc

SEQ ID NO: 4446802 - DNA, 14 bp, Homo sapiens
acagttcctcgccc

SEQ ID NO: 4446803 - DNA, 18 bp, Homo sapiens
acagttcctcgccctggg

SEQ ID NO: 4446804 - DNA, 19 bp, Homo sapiens
acagttcctcgccctgggt

SEQ ID NO: 4446805 - DNA, 21 bp, Homo sapiens
acagttcctgggaacatcaca

SEQ ID NO: 4446806 - DNA, 16 bp, Homo sapiens
acagttctgctctggt

SEQ ID NO: 4446807 - DNA, 12 bp, Homo sapiens
acagttctgtaa

SEQ ID NO: 4446808 - DNA, 17 bp, Homo sapiens
acagttcttggtgactg

SEQ ID NO: 4446809 - DNA, 18 bp, Homo sapiens
acagttgaaaacttgtaa

SEQ ID NO: 4446810 - DNA, 15 bp, Homo sapiens
acagttgagctcagg

SEQ ID NO: 4446811 - DNA, 15 bp, Homo sapiens
acagttgatgtttgg

SEQ ID NO: 4446812 - DNA, 23 bp, Homo sapiens
acagttgcatgtagtaacactaa

SEQ ID NO: 4446813 - DNA, 14 bp, Homo sapiens
acagttggtaactt

SEQ ID NO: 4446814 - DNA, 15 bp, Homo sapiens
acagttggtaacttt

SEQ ID NO: 4446815 - DNA, 20 bp, Homo sapiens
acagttgtataaactgtatt

SEQ ID NO: 4446816 - DNA, 12 bp, Homo sapiens
acagttgtattt

SEQ ID NO: 4446817 - DNA, 13 bp, Homo sapiens
acagtttcatcta

SEQ ID NO: 4446818 - DNA, 19 bp, Homo sapiens
acagtttcttttttcttac

SEQ ID NO: 4446819 - DNA, 15 bp, Homo sapiens
acagtttgacttttt

SEQ ID NO: 4446820 - DNA, 14 bp, Homo sapiens
acagttttaaagaa

SEQ ID NO: 4446821 - DNA, 19 bp, Homo sapiens
acagttttaaagaatcatt

SEQ ID NO: 4446822 - DNA, 13 bp, Homo sapiens
acagttttaactg

SEQ ID NO: 4446823 - DNA, 21 bp, Homo sapiens
acagttttaactgtggatatt

SEQ ID NO: 4446824 - DNA, 12 bp, Homo sapiens
acagttttcatt

SEQ ID NO: 4446825 - DNA, 15 bp, Homo sapiens
acagttttctgagaa

SEQ ID NO: 4446826 - DNA, 17 bp, Homo sapiens
acagttttctgagaaag

SEQ ID NO: 4446827 - DNA, 18 bp, Homo sapiens
acagttttctgagaaaga

SEQ ID NO: 4446828 - DNA, 21 bp, Homo sapiens
acagttttctgagaaagacta

SEQ ID NO: 4446829 - DNA, 15 bp, Homo sapiens
acagtttttattgct

SEQ ID NO: 4446830 - DNA, 20 bp, Homo sapiens
acataaaaaggacatcagca

SEQ ID NO: 4446831 - DNA, 14 bp, Homo sapiens
acataaaagtctgt

SEQ ID NO: 4446832 - DNA, 15 bp, Homo sapiens
acataaagaaattca

SEQ ID NO: 4446833 - DNA, 18 bp, Homo sapiens
acataaagaaattcaaga

SEQ ID NO: 4446834 - DNA, 23 bp, Homo sapiens
acataaagaagaaacttgtaaat

SEQ ID NO: 4446835 - DNA, 12 bp, Homo sapiens
acataaagttga

SEQ ID NO: 4446836 - DNA, 13 bp, Homo sapiens
acataaattttaa

SEQ ID NO: 4446837 - DNA, 18 bp, Homo sapiens
acataaattttaattcaa

SEQ ID NO: 4446838 - DNA, 15 bp, Homo sapiens
acataacggaaagtt

SEQ ID NO: 4446839 - DNA, 16 bp, Homo sapiens
acataacggaaagttt

SEQ ID NO: 4446840 - DNA, 19 bp, Homo sapiens
acataacggaaagttttta

SEQ ID NO: 4446841 - DNA, 16 bp, Homo sapiens
acataagaaggcaatt

SEQ ID NO: 4446842 - DNA, 17 bp, Homo sapiens
acataagaaggcaattt

SEQ ID NO: 4446843 - DNA, 23 bp, Homo sapiens
acataagagagatgagaaagctt

SEQ ID NO: 4446844 - DNA, 15 bp, Homo sapiens
acataagccattatt

SEQ ID NO: 4446845 - DNA, 16 bp, Homo sapiens
acataaggatgacttt

SEQ ID NO: 4446846 - DNA, 16 bp, Homo sapiens
acataagttaatagaa

SEQ ID NO: 4446847 - DNA, 14 bp, Homo sapiens
acataatacaatgt

SEQ ID NO: 4446848 - DNA, 23 bp, Homo sapiens
acataatcttctgccttctcatg

SEQ ID NO: 4446849 - DNA, 21 bp, Homo sapiens
acataatgggccactgaaatc

SEQ ID NO: 4446850 - DNA, 23 bp, Homo sapiens
acataattatccaggaagggaat

SEQ ID NO: 4446851 - DNA, 18 bp, Homo sapiens
acataatttagttgtttc

SEQ ID NO: 4446852 - DNA, 19 bp, Homo sapiens
acatacatgatacattttt

SEQ ID NO: 4446853 - DNA, 21 bp, Homo sapiens
acataccaagacccccgtctc

SEQ ID NO: 4446854 - DNA, 18 bp, Homo sapiens
acataccccttacaaatg

SEQ ID NO: 4446855 - DNA, 15 bp, Homo sapiens
acatacctaccagta

SEQ ID NO: 4446856 - DNA, 17 bp, Homo sapiens
acatacgggaagtttat

SEQ ID NO: 4446857 - DNA, 18 bp, Homo sapiens
acatactaatgaagtatt

SEQ ID NO: 4446858 - DNA, 12 bp, Homo sapiens
acatactcattt

SEQ ID NO: 4446859 - DNA, 16 bp, Homo sapiens
acatactcatttttca

SEQ ID NO: 4446860 - DNA, 17 bp, Homo sapiens
acatactccccaattta

SEQ ID NO: 4446861 - DNA, 18 bp, Homo sapiens
acatagaattaacacatg

SEQ ID NO: 4446862 - DNA, 14 bp, Homo sapiens
acatttatttcctc

SEQ ID NO: 4446863 - DNA, 11 bp, Homo sapiens
acatttcaaaa

SEQ ID NO: 4446864 - DNA, 16 bp, Homo sapiens
acatttcactaaaagt

SEQ ID NO: 4446865 - DNA, 16 bp, Homo sapiens
acatttcatacaacag

SEQ ID NO: 4446866 - DNA, 18 bp, Homo sapiens
acatttcatacaacagaa

SEQ ID NO: 4446867 - DNA, 18 bp, Homo sapiens
acatttcattgtacaagt

SEQ ID NO: 4446868 - DNA, 21 bp, Homo sapiens
acatttctactctagatggca

SEQ ID NO: 4446869 - DNA, 21 bp, Homo sapiens
acatttctataaaaatactac

SEQ ID NO: 4446870 - DNA, 20 bp, Homo sapiens
acatttctatagccaaaaat

SEQ ID NO: 4446871 - DNA, 18 bp, Homo sapiens
acatttctattttgcaaa

SEQ ID NO: 4446872 - DNA, 16 bp, Homo sapiens
acatttctcactgaaa

SEQ ID NO: 4446873 - DNA, 21 bp, Homo sapiens
acatttctctaactcctgcca

SEQ ID NO: 4446874 - DNA, 14 bp, Homo sapiens
acatttctctgagc

SEQ ID NO: 4446875 - DNA, 15 bp, Homo sapiens
acatttctctgagca

SEQ ID NO: 4446876 - DNA, 22 bp, Homo sapiens
acatttctcttccccttagaaa

SEQ ID NO: 4446877 - DNA, 16 bp, Homo sapiens
acatttcttaaaacac

SEQ ID NO: 4446878 - DNA, 20 bp, Homo sapiens
acatttcttaaaacacatga

SEQ ID NO: 4446879 - DNA, 21 bp, Homo sapiens
acatttcttaaattattttat

SEQ ID NO: 4446880 - DNA, 17 bp, Homo sapiens
acatttgatgcatgtct

SEQ ID NO: 4446881 - DNA, 18 bp, Homo sapiens
acatttgattaataaaat

SEQ ID NO: 4446882 - DNA, 12 bp, Homo sapiens
acatttgcaatt

SEQ ID NO: 4446883 - DNA, 13 bp, Homo sapiens
acatttgcaatta

SEQ ID NO: 4446884 - DNA, 17 bp, Homo sapiens
acatttgccttcagtct

SEQ ID NO: 4446885 - DNA, 19 bp, Homo sapiens
acatttgctgaactcagca

SEQ ID NO: 4446886 - DNA, 15 bp, Homo sapiens
acatttggagtgttc

SEQ ID NO: 4446887 - DNA, 20 bp, Homo sapiens
acatttgggagtttttatga

SEQ ID NO: 4446888 - DNA, 21 bp, Homo sapiens
acattttaaatactctactta

SEQ ID NO: 4446889 - DNA, 12 bp, Homo sapiens
acattttccttt

SEQ ID NO: 4446890 - DNA, 19 bp, Homo sapiens
acattttccttttcaaata

SEQ ID NO: 4446891 - DNA, 12 bp, Homo sapiens
acattttgaagt

SEQ ID NO: 4446892 - DNA, 13 bp, Homo sapiens
acattttgaagtg

SEQ ID NO: 4446893 - DNA, 20 bp, Homo sapiens
acattttgtaacaaagaact

SEQ ID NO: 4446894 - DNA, 17 bp, Homo sapiens
acattttgtatggagtt

SEQ ID NO: 4446895 - DNA, 15 bp, Homo sapiens
acattttgttacata

SEQ ID NO: 4446896 - DNA, 19 bp, Homo sapiens
acattttgtttttactgta

SEQ ID NO: 4446897 - DNA, 14 bp, Homo sapiens
acatttttaaaaca

SEQ ID NO: 4446898 - DNA, 15 bp, Homo sapiens
acatttttaaatgta

SEQ ID NO: 4446899 - DNA, 17 bp, Homo sapiens
acatttttaagatgcat

SEQ ID NO: 4446900 - DNA, 15 bp, Homo sapiens
acatttttcaacttt

SEQ ID NO: 4446901 - DNA, 19 bp, Homo sapiens
acatttttcaactttgaat

SEQ ID NO: 4446902 - DNA, 21 bp, Homo sapiens
acatttttcaactttgaataa

SEQ ID NO: 4446903 - DNA, 16 bp, Homo sapiens
acatttttcagcagca

SEQ ID NO: 4446904 - DNA, 16 bp, Homo sapiens
acatttttcattcatg

SEQ ID NO: 4446905 - DNA, 20 bp, Homo sapiens
acatttttcattcatgaata

SEQ ID NO: 4446906 - DNA, 18 bp, Homo sapiens
acatttttgtaatgctgt

SEQ ID NO: 4446907 - DNA, 12 bp, Homo sapiens
acattttttaaa

SEQ ID NO: 4446908 - DNA, 18 bp, Homo sapiens
acatttttttatgctctt

SEQ ID NO: 4446909 - DNA, 22 bp, Homo sapiens
acatttttttatgctcttgaaa

SEQ ID NO: 4446910 - DNA, 14 bp, Homo sapiens
accaaaaatagaaa

SEQ ID NO: 4446911 - DNA, 16 bp, Homo sapiens
accaaaatgacatctt

SEQ ID NO: 4446912 - DNA, 22 bp, Homo sapiens
accaaaatgacatctttttaaa

SEQ ID NO: 4446913 - DNA, 16 bp, Homo sapiens
accaaaattagtttta

SEQ ID NO: 4446914 - DNA, 14 bp, Homo sapiens
accaaacacccaga

SEQ ID NO: 4446915 - DNA, 20 bp, Homo sapiens
accaaaccccacttcccctc

SEQ ID NO: 4446916 - DNA, 19 bp, Homo sapiens
accaaactgggtcttcagc

SEQ ID NO: 4446917 - DNA, 13 bp, Homo sapiens
accaaagacatca

SEQ ID NO: 4446918 - DNA, 23 bp, Homo sapiens
accaaatacctcaatttttgttt

SEQ ID NO: 4446919 - DNA, 22 bp, Homo sapiens
accaaatctcagttgtttgctt

SEQ ID NO: 4446920 - DNA, 17 bp, Homo sapiens
accaaatgaaatgccaa

SEQ ID NO: 4446921 - DNA, 13 bp, Homo sapiens
accaaattgcttc

SEQ ID NO: 4446922 - DNA, 15 bp, Homo sapiens
accaaattgcttcta

SEQ ID NO: 4446923 - DNA, 20 bp, Homo sapiens
accaacagaacccacagtag

SEQ ID NO: 4446924 - DNA, 14 bp, Homo sapiens
accaacataaaaat

SEQ ID NO: 4446925 - DNA, 15 bp, Homo sapiens
accaacataaaaatg

SEQ ID NO: 4446926 - DNA, 18 bp, Homo sapiens
accaacatcccattgccc

SEQ ID NO: 4446927 - DNA, 21 bp, Homo sapiens
accaacatcccattgccctgg

SEQ ID NO: 4446928 - DNA, 22 bp, Homo sapiens
accaacatcccattgccctggt

SEQ ID NO: 4446929 - DNA, 15 bp, Homo sapiens
accaacatggagaaa

SEQ ID NO: 4446930 - DNA, 16 bp, Homo sapiens
accaacatggagaaac

SEQ ID NO: 4446931 - DNA, 23 bp, Homo sapiens
accaacatggagaaaccctgtct

SEQ ID NO: 4446932 - DNA, 20 bp, Homo sapiens
accaacccccatctccctag

SEQ ID NO: 4446933 - DNA, 23 bp, Homo sapiens
accaacgaagaaaataaaatgag

SEQ ID NO: 4446934 - DNA, 15 bp, Homo sapiens
accaactgccccagg

SEQ ID NO: 4446935 - DNA, 14 bp, Homo sapiens
accaactgggccca

SEQ ID NO: 4446936 - DNA, 15 bp, Homo sapiens
accaagaactgaagg

SEQ ID NO: 4446937 - DNA, 21 bp, Homo sapiens
accaaggatcggactctgccc

SEQ ID NO: 4446938 - DNA, 14 bp, Homo sapiens
accaagggtacaga

SEQ ID NO: 4446939 - DNA, 20 bp, Homo sapiens
accaagggtacagatcccca

SEQ ID NO: 4446940 - DNA, 13 bp, Homo sapiens
accaagtgcaata

SEQ ID NO: 4446941 - DNA, 22 bp, Homo sapiens
accaagtgcttcctacaaagac

SEQ ID NO: 4446942 - DNA, 18 bp, Homo sapiens
accaagtgtgctaaaaat

SEQ ID NO: 4446943 - DNA, 18 bp, Homo sapiens
accaatattgtacagttt

SEQ ID NO: 4446944 - DNA, 19 bp, Homo sapiens
accaatattgtacagtttt

SEQ ID NO: 4446945 - DNA, 16 bp, Homo sapiens
accaatgaaaacatgt

SEQ ID NO: 4446946 - DNA, 13 bp, Homo sapiens
accaatgcctttt

SEQ ID NO: 4446947 - DNA, 22 bp, Homo sapiens
accaatggcattattaggtctt

SEQ ID NO: 4446948 - DNA, 15 bp, Homo sapiens
accaattaaaaacct

SEQ ID NO: 4446949 - DNA, 14 bp, Homo sapiens
accaattattgata

SEQ ID NO: 4446950 - DNA, 17 bp, Homo sapiens
accaattattgatatat

SEQ ID NO: 4446951 - DNA, 23 bp, Homo sapiens
accaattattgatatatattata

SEQ ID NO: 4446952 - DNA, 18 bp, Homo sapiens
accaattctggacagaca

SEQ ID NO: 4446953 - DNA, 23 bp, Homo sapiens
accaatttggtaaaaatgctgct

SEQ ID NO: 4446954 - DNA, 13 bp, Homo sapiens
accacaaacacag

SEQ ID NO: 4446955 - DNA, 14 bp, Homo sapiens
accacaaatgcata

SEQ ID NO: 4446956 - DNA, 16 bp, Homo sapiens
accacaagacatttct

SEQ ID NO: 4446957 - DNA, 15 bp, Homo sapiens
accacaagcctgaga

SEQ ID NO: 4446958 - DNA, 17 bp, Homo sapiens
accacaagcctgagaac

SEQ ID NO: 4446959 - DNA, 14 bp, Homo sapiens
accacacacagcct

SEQ ID NO: 4446960 - DNA, 10 bp, Homo sapiens
accacagcag

SEQ ID NO: 4446961 - DNA, 21 bp, Homo sapiens
accacagcagacaccattcat

SEQ ID NO: 4446962 - DNA, 18 bp, Homo sapiens
accaccagggctccagga

SEQ ID NO: 4446963 - DNA, 15 bp, Homo sapiens
accacccatatcatg

SEQ ID NO: 4446964 - DNA, 13 bp, Homo sapiens
accacccctgcct

SEQ ID NO: 4446965 - DNA, 20 bp, Homo sapiens
accaccctagtcccttcccc

SEQ ID NO: 4446966 - DNA, 12 bp, Homo sapiens
accaccctgagc

SEQ ID NO: 4446967 - DNA, 14 bp, Homo sapiens
accaccctgagccg

SEQ ID NO: 4446968 - DNA, 15 bp, Homo sapiens
accaccgttcagtca

SEQ ID NO: 4446969 - DNA, 17 bp, Homo sapiens
accacctaggccactcc

SEQ ID NO: 4446970 - DNA, 21 bp, Homo sapiens
accacctaggccactcctcca

SEQ ID NO: 4446971 - DNA, 21 bp, Homo sapiens
accaccttcccagctctccct

SEQ ID NO: 4446972 - DNA, 15 bp, Homo sapiens
accacctttggctgg

SEQ ID NO: 4446973 - DNA, 18 bp, Homo sapiens
accacctttggctggtag

SEQ ID NO: 4446974 - DNA, 19 bp, Homo sapiens
accacgactggccagggcc

SEQ ID NO: 4446975 - DNA, 19 bp, Homo sapiens
accacgccagctaattttt

SEQ ID NO: 4446976 - DNA, 21 bp, Homo sapiens
accacgcccagctaatttttg

SEQ ID NO: 4446977 - DNA, 22 bp, Homo sapiens
accacgcctcttgaccaggctg

SEQ ID NO: 4446978 - DNA, 16 bp, Homo sapiens
accactaccagccagc

SEQ ID NO: 4446979 - DNA, 13 bp, Homo sapiens
accactccagaga

SEQ ID NO: 4446980 - DNA, 19 bp, Homo sapiens
acccccttctctgctccac

SEQ ID NO: 4446981 - DNA, 20 bp, Homo sapiens
acccccttctctgctccacc

SEQ ID NO: 4446982 - DNA, 21 bp, Homo sapiens
accccctttgactctggggtg

SEQ ID NO: 4446983 - DNA, 16 bp, Homo sapiens
accccgctctgcatgc

SEQ ID NO: 4446984 - DNA, 13 bp, Homo sapiens
accccgggcgggt

SEQ ID NO: 4446985 - DNA, 13 bp, Homo sapiens
accccgggctctc

SEQ ID NO: 4446986 - DNA, 17 bp, Homo sapiens
accccgggctctctgct

SEQ ID NO: 4446987 - DNA, 17 bp, Homo sapiens
acccctaaactccaggg

SEQ ID NO: 4446988 - DNA, 12 bp, Homo sapiens
acccctccccag

SEQ ID NO: 4446989 - DNA, 13 bp, Homo sapiens
acccctccctttc

SEQ ID NO: 4446990 - DNA, 21 bp, Homo sapiens
acccctccgtgtggagcacgt

SEQ ID NO: 4446991 - DNA, 16 bp, Homo sapiens
acccctcctccctcag

SEQ ID NO: 4446992 - DNA, 19 bp, Homo sapiens
acccctcctccctcagact

SEQ ID NO: 4446993 - DNA, 18 bp, Homo sapiens
acccctccttccccagac

SEQ ID NO: 4446994 - DNA, 18 bp, Homo sapiens
acccctcgccacctttca

SEQ ID NO: 4446995 - DNA, 17 bp, Homo sapiens
acccctcgccccagcct

SEQ ID NO: 4446996 - DNA, 16 bp, Homo sapiens
acccctctgcccctgc

SEQ ID NO: 4446997 - DNA, 17 bp, Homo sapiens
acccctctgcccctgca

SEQ ID NO: 4446998 - DNA, 18 bp, Homo sapiens
acccctctgcccctgcag

SEQ ID NO: 4446999 - DNA, 23 bp, Homo sapiens
acccctctgcccctgcagctgga

SEQ ID NO: 4447000 - DNA, 13 bp, Homo sapiens
acccctctgtagc

SEQ ID NO: 4447001 - DNA, 22 bp, Homo sapiens
acccctgagttgggcagccagg

SEQ ID NO: 4447002 - DNA, 17 bp, Homo sapiens
acccctgcccccagccc

SEQ ID NO: 4447003 - DNA, 12 bp, Homo sapiens
acccctgcctcc

SEQ ID NO: 4447004 - DNA, 16 bp, Homo sapiens
acccctgcctccaccc

SEQ ID NO: 4447005 - DNA, 19 bp, Homo sapiens
acccctgcctccaccctct

SEQ ID NO: 4447006 - DNA, 21 bp, Homo sapiens
acccctgcctccaccctctga

SEQ ID NO: 4447007 - DNA, 11 bp, Homo sapiens
acccctgcctg

SEQ ID NO: 4447008 - DNA, 18 bp, Homo sapiens
acccctgcctgttggcag

SEQ ID NO: 4447009 - DNA, 11 bp, Homo sapiens
acccctgctcc

SEQ ID NO: 4447010 - DNA, 14 bp, Homo sapiens
acccctggcctccg

SEQ ID NO: 4447011 - DNA, 20 bp, Homo sapiens
acccctggttctcatctttc

SEQ ID NO: 4447012 - DNA, 22 bp, Homo sapiens
acccctggttctcatctttctt

SEQ ID NO: 4447013 - DNA, 17 bp, Homo sapiens
accccttagcctccctg

SEQ ID NO: 4447014 - DNA, 15 bp, Homo sapiens
accccttctctcctc

SEQ ID NO: 4447015 - DNA, 17 bp, Homo sapiens
acccctttctgtcccac

SEQ ID NO: 4447016 - DNA, 23 bp, Homo sapiens
acccgagttcctctgggtttcta

SEQ ID NO: 4447017 - DNA, 15 bp, Homo sapiens
acccgccctcagggg

SEQ ID NO: 4447018 - DNA, 19 bp, Homo sapiens
acccgccgcctcccacggc

SEQ ID NO: 4447019 - DNA, 13 bp, Homo sapiens
acccgcctgacac

SEQ ID NO: 4447020 - DNA, 14 bp, Homo sapiens
acccgctgtggccg

SEQ ID NO: 4447021 - DNA, 20 bp, Homo sapiens
acccggccacagctgctgga

SEQ ID NO: 4447022 - DNA, 18 bp, Homo sapiens
acccggcccggctgagcc

SEQ ID NO: 4447023 - DNA, 13 bp, Homo sapiens
acccgggggagcc

SEQ ID NO: 4447024 - DNA, 14 bp, Homo sapiens
acccgtctccagct

SEQ ID NO: 4447025 - DNA, 17 bp, Homo sapiens
acccgtggggtgctgcc

SEQ ID NO: 4447026 - DNA, 16 bp, Homo sapiens
accctacagtatataa

SEQ ID NO: 4447027 - DNA, 19 bp, Homo sapiens
accctaccaactttactgt

SEQ ID NO: 4447028 - DNA, 14 bp, Homo sapiens
accctaccccacca

SEQ ID NO: 4447029 - DNA, 22 bp, Homo sapiens
accctagtcccttcccctccct

SEQ ID NO: 4447030 - DNA, 12 bp, Homo sapiens
accctcagcagc

SEQ ID NO: 4447031 - DNA, 16 bp, Homo sapiens
accctccagtgctgga

SEQ ID NO: 4447032 - DNA, 13 bp, Homo sapiens
accctccatgctc

SEQ ID NO: 4447033 - DNA, 16 bp, Homo sapiens
accctccatgctcctc

SEQ ID NO: 4447034 - DNA, 17 bp, Homo sapiens
accctcccatggcacct

SEQ ID NO: 4447035 - DNA, 14 bp, Homo sapiens
accctcccccgcag

SEQ ID NO: 4447036 - DNA, 14 bp, Homo sapiens
accctccctggagt

SEQ ID NO: 4447037 - DNA, 11 bp, Homo sapiens
accctcctctt

SEQ ID NO: 4447038 - DNA, 14 bp, Homo sapiens
accctcctcttgga

SEQ ID NO: 4447039 - DNA, 21 bp, Homo sapiens
accctcctgacccccatgtaa

SEQ ID NO: 4447040 - DNA, 20 bp, Homo sapiens
accctcctgttgcacccagc

SEQ ID NO: 4447041 - DNA, 23 bp, Homo sapiens
accctcctgttgcacccagccct

SEQ ID NO: 4447042 - DNA, 19 bp, Homo sapiens
accctcgggccccatcctc

SEQ ID NO: 4447043 - DNA, 22 bp, Homo sapiens
accctctcctgggggtggcagg

SEQ ID NO: 4447044 - DNA, 23 bp, Homo sapiens
accctctcctgggggtggcaggc

SEQ ID NO: 4447045 - DNA, 23 bp, Homo sapiens
accctcttgcccatcctgactga

SEQ ID NO: 4447046 - DNA, 23 bp, Homo sapiens
accctgagctgaggcagcagtgt

SEQ ID NO: 4447047 - DNA, 15 bp, Homo sapiens
accctgaggccctgg

SEQ ID NO: 4447048 - DNA, 18 bp, Homo sapiens
accctgccacagccagag

SEQ ID NO: 4447049 - DNA, 19 bp, Homo sapiens
accctgccacagccagagg

SEQ ID NO: 4447050 - DNA, 19 bp, Homo sapiens
accctgcccagagctgagt

SEQ ID NO: 4447051 - DNA, 20 bp, Homo sapiens
accctgcctcccttgacttt

SEQ ID NO: 4447052 - DNA, 16 bp, Homo sapiens
accctgctcctagcac

SEQ ID NO: 4447053 - DNA, 14 bp, Homo sapiens
accctggaaatgga

SEQ ID NO: 4447054 - DNA, 21 bp, Homo sapiens
accctggagagtgcacatgcc

SEQ ID NO: 4447055 - DNA, 22 bp, Homo sapiens
accctggcctgccagtctgcct

SEQ ID NO: 4447056 - DNA, 12 bp, Homo sapiens
accctgggaagg

SEQ ID NO: 4447057 - DNA, 22 bp, Homo sapiens
accctgggagccagtcctccac

SEQ ID NO: 4447058 - DNA, 12 bp, Homo sapiens
accctggtgctt

SEQ ID NO: 4447059 - DNA, 16 bp, Homo sapiens
accctgtccggcccag

SEQ ID NO: 4447060 - DNA, 23 bp, Homo sapiens
accctgtccggcccagtgccact

SEQ ID NO: 4447061 - DNA, 22 bp, Homo sapiens
accctgtcctgcacaccctggg

SEQ ID NO: 4447062 - DNA, 11 bp, Homo sapiens
accctgtctct

SEQ ID NO: 4447063 - DNA, 22 bp, Homo sapiens
accctgtctgtagagggccctg

SEQ ID NO: 4447064 - DNA, 23 bp, Homo sapiens
accctgtctgtagagggccctgg

SEQ ID NO: 4447065 - DNA, 20 bp, Homo sapiens
accctgtgtatacagccctg

SEQ ID NO: 4447066 - DNA, 18 bp, Homo sapiens
accctgttcctggaggtc

SEQ ID NO: 4447067 - DNA, 19 bp, Homo sapiens
acccttaccccttagcctc

SEQ ID NO: 4447068 - DNA, 13 bp, Homo sapiens
acccttaggatgg

SEQ ID NO: 4447069 - DNA, 22 bp, Homo sapiens
acccttaggatggggctcccag

SEQ ID NO: 4447070 - DNA, 23 bp, Homo sapiens
acccttaggatggggctcccagc

SEQ ID NO: 4447071 - DNA, 24 bp, Homo sapiens
acccttaggatggggctcccagct

SEQ ID NO: 4447072 - DNA, 21 bp, Homo sapiens
acccttattgctgtcctggag

SEQ ID NO: 4447073 - DNA, 18 bp, Homo sapiens
acccttccacagctggcc

SEQ ID NO: 4447074 - DNA, 17 bp, Homo sapiens
acccttcccggcccccg

SEQ ID NO: 4447075 - DNA, 19 bp, Homo sapiens
acccttcctgctgctgcta

SEQ ID NO: 4447076 - DNA, 23 bp, Homo sapiens
acccttcctgctgctgctactgc

SEQ ID NO: 4447077 - DNA, 20 bp, Homo sapiens
acccttgcatccattgttgt

SEQ ID NO: 4447078 - DNA, 15 bp, Homo sapiens
acccttgctttcctg

SEQ ID NO: 4447079 - DNA, 18 bp, Homo sapiens
acccttgctttcctgggc

SEQ ID NO: 4447080 - DNA, 12 bp, Homo sapiens
acccttggcctg

SEQ ID NO: 4447081 - DNA, 13 bp, Homo sapiens
accctttcacaag

SEQ ID NO: 4447082 - DNA, 19 bp, Homo sapiens
accctttccttccttccct

SEQ ID NO: 4447083 - DNA, 22 bp, Homo sapiens
accctttccttccttccctggc

SEQ ID NO: 4447084 - DNA, 14 bp, Homo sapiens
accctttgtttctt

SEQ ID NO: 4447085 - DNA, 19 bp, Homo sapiens
acccttttcctttgtggtt

SEQ ID NO: 4447086 - DNA, 15 bp, Homo sapiens
accgaaatctgtatt

SEQ ID NO: 4447087 - DNA, 17 bp, Homo sapiens
accgagactcagcctct

SEQ ID NO: 4447088 - DNA, 19 bp, Homo sapiens
accgagactcagcctctgc

SEQ ID NO: 4447089 - DNA, 22 bp, Homo sapiens
accgagagcttggactacacaa

SEQ ID NO: 4447090 - DNA, 17 bp, Homo sapiens
accgaggcgcgggggcc

SEQ ID NO: 4447091 - DNA, 17 bp, Homo sapiens
accgaggctacagctcc

SEQ ID NO: 4447092 - DNA, 20 bp, Homo sapiens
accgagggggctgctcccac

SEQ ID NO: 4447093 - DNA, 14 bp, Homo sapiens
accgaggttcccag

SEQ ID NO: 4447094 - DNA, 17 bp, Homo sapiens
accgagtctctgtataa

SEQ ID NO: 4447095 - DNA, 15 bp, Homo sapiens
accgcaatatgggag

SEQ ID NO: 4447096 - DNA, 11 bp, Homo sapiens
accgcccatca

SEQ ID NO: 4447097 - DNA, 16 bp, Homo sapiens
accgccttgcccagcc

SEQ ID NO: 4447098 - DNA, 13 bp, Homo sapiens
acgggatgctctt

SEQ ID NO: 4447099 - DNA, 15 bp, Homo sapiens
acgggatgctcttta

SEQ ID NO: 4447100 - DNA, 19 bp, Homo sapiens
acgggatgctctttaaata

SEQ ID NO: 4447101 - DNA, 12 bp, Homo sapiens
acggggagaaaa

SEQ ID NO: 4447102 - DNA, 21 bp, Homo sapiens
acgggggagtgagacaggctg

SEQ ID NO: 4447103 - DNA, 16 bp, Homo sapiens
acggggggccccagtc

SEQ ID NO: 4447104 - DNA, 15 bp, Homo sapiens
acggggggctcctgc

SEQ ID NO: 4447105 - DNA, 16 bp, Homo sapiens
acggggggctcctgcc

SEQ ID NO: 4447106 - DNA, 17 bp, Homo sapiens
acggggggctcctgccc

SEQ ID NO: 4447107 - DNA, 19 bp, Homo sapiens
acggggggctcctgcccag

SEQ ID NO: 4447108 - DNA, 15 bp, Homo sapiens
acgggtgccagaagc

SEQ ID NO: 4447109 - DNA, 21 bp, Homo sapiens
acgggtgcccgtaatcccagc

SEQ ID NO: 4447110 - DNA, 17 bp, Homo sapiens
acggtcccccaggaggc

SEQ ID NO: 4447111 - DNA, 18 bp, Homo sapiens
acggtgcccatcctgcca

SEQ ID NO: 4447112 - DNA, 13 bp, Homo sapiens
acggtgctaaaaa

SEQ ID NO: 4447113 - DNA, 17 bp, Homo sapiens
acggtgggccttgctgg

SEQ ID NO: 4447114 - DNA, 21 bp, Homo sapiens
acggtgggccttgctggggac

SEQ ID NO: 4447115 - DNA, 22 bp, Homo sapiens
acgtaaaacatttgtttccccc

SEQ ID NO: 4447116 - DNA, 19 bp, Homo sapiens
acgtaaagaattttcatcc

SEQ ID NO: 4447117 - DNA, 23 bp, Homo sapiens
acgtaatttgttatatcagcaga

SEQ ID NO: 4447118 - DNA, 15 bp, Homo sapiens
acgtagcatgtggca

SEQ ID NO: 4447119 - DNA, 12 bp, Homo sapiens
acgtagcctggg

SEQ ID NO: 4447120 - DNA, 16 bp, Homo sapiens
acgtataaatatcagt

SEQ ID NO: 4447121 - DNA, 18 bp, Homo sapiens
acgtataaatatcagtat

SEQ ID NO: 4447122 - DNA, 16 bp, Homo sapiens
acgtataatgctttct

SEQ ID NO: 4447123 - DNA, 15 bp, Homo sapiens
acgtatgcatttttt

SEQ ID NO: 4447124 - DNA, 21 bp, Homo sapiens
acgtatgcatttttttagttt

SEQ ID NO: 4447125 - DNA, 16 bp, Homo sapiens
acgtattggtccagct

SEQ ID NO: 4447126 - DNA, 15 bp, Homo sapiens
acgtatttttctgac

SEQ ID NO: 4447127 - DNA, 13 bp, Homo sapiens
acgtcaatgcata

SEQ ID NO: 4447128 - DNA, 15 bp, Homo sapiens
acgtcaggccctgac

SEQ ID NO: 4447129 - DNA, 22 bp, Homo sapiens
acgtcaggccctgactcctctg

SEQ ID NO: 4447130 - DNA, 15 bp, Homo sapiens
acgtcaggcctggcc

SEQ ID NO: 4447131 - DNA, 18 bp, Homo sapiens
acgtcaggcctggcctca

SEQ ID NO: 4447132 - DNA, 19 bp, Homo sapiens
acgtcaggcctggcctcat

SEQ ID NO: 4447133 - DNA, 18 bp, Homo sapiens
acgtcatcggaggctggg

SEQ ID NO: 4447134 - DNA, 22 bp, Homo sapiens
acgtcccagcatccctggagca

SEQ ID NO: 4447135 - DNA, 22 bp, Homo sapiens
acgtcccctccgccgtgccggc

SEQ ID NO: 4447136 - DNA, 15 bp, Homo sapiens
acgtctaactggaaa

SEQ ID NO: 4447137 - DNA, 23 bp, Homo sapiens
acgtctagctatgctgtatctgt

SEQ ID NO: 4447138 - DNA, 12 bp, Homo sapiens
acgtcttctaaa

SEQ ID NO: 4447139 - DNA, 21 bp, Homo sapiens
acgtgaaatgctcaagaatgt

SEQ ID NO: 4447140 - DNA, 19 bp, Homo sapiens
acgtgattttgctgtagaa

SEQ ID NO: 4447141 - DNA, 23 bp, Homo sapiens
acgtgccagatataactgtcttg

SEQ ID NO: 4447142 - DNA, 21 bp, Homo sapiens
acgtgccaggcccggggctgg

SEQ ID NO: 4447143 - DNA, 16 bp, Homo sapiens
acgtggagagctggtg

SEQ ID NO: 4447144 - DNA, 19 bp, Homo sapiens
acgtggagatagtgccagg

SEQ ID NO: 4447145 - DNA, 14 bp, Homo sapiens
acgtggggcccact

SEQ ID NO: 4447146 - DNA, 20 bp, Homo sapiens
acgtgtgcgcacgcgcagcg

SEQ ID NO: 4447147 - DNA, 14 bp, Homo sapiens
acgtgttgtatcta

SEQ ID NO: 4447148 - DNA, 17 bp, Homo sapiens
acgttaccttgacacat

SEQ ID NO: 4447149 - DNA, 20 bp, Homo sapiens
acgttaggaggacaaaagga

SEQ ID NO: 4447150 - DNA, 17 bp, Homo sapiens
acgttatatattgtatt

SEQ ID NO: 4447151 - DNA, 18 bp, Homo sapiens
acgttccttactgcagaa

SEQ ID NO: 4447152 - DNA, 19 bp, Homo sapiens
acgttctataaatgaatgt

SEQ ID NO: 4447153 - DNA, 19 bp, Homo sapiens
acgttcttacaagcttaaa

SEQ ID NO: 4447154 - DNA, 23 bp, Homo sapiens
acgttcttacaagcttaaagctt

SEQ ID NO: 4447155 - DNA, 21 bp, Homo sapiens
acgttgagaatcactgctcca

SEQ ID NO: 4447156 - DNA, 16 bp, Homo sapiens
acgttgctgagccagc

SEQ ID NO: 4447157 - DNA, 19 bp, Homo sapiens
acgttgctgagccagctgc

SEQ ID NO: 4447158 - DNA, 15 bp, Homo sapiens
acgtttaaagttctg

SEQ ID NO: 4447159 - DNA, 22 bp, Homo sapiens
acgtttaaagttctgtgtattt

SEQ ID NO: 4447160 - DNA, 17 bp, Homo sapiens
acgtttaagccaaaaca

SEQ ID NO: 4447161 - DNA, 23 bp, Homo sapiens
acgtttaagccaaaacaatgttt

SEQ ID NO: 4447162 - DNA, 20 bp, Homo sapiens
acgtttaatcccagcacttt

SEQ ID NO: 4447163 - DNA, 16 bp, Homo sapiens
acgtttacttatctta

SEQ ID NO: 4447164 - DNA, 14 bp, Homo sapiens
acgtttatttaaaa

SEQ ID NO: 4447165 - DNA, 19 bp, Homo sapiens
acgtttccccaataaagcc

SEQ ID NO: 4447166 - DNA, 18 bp, Homo sapiens
acgttttagaaaatttta

SEQ ID NO: 4447167 - DNA, 19 bp, Homo sapiens
acgttttagaaaattttat

SEQ ID NO: 4447168 - DNA, 15 bp, Homo sapiens
actaaaaaaaagatg

SEQ ID NO: 4447169 - DNA, 16 bp, Homo sapiens
actaaaaaaaagatga

SEQ ID NO: 4447170 - DNA, 17 bp, Homo sapiens
actaaaaaaaagatgaa

SEQ ID NO: 4447171 - DNA, 13 bp, Homo sapiens
actaaaaatacaa

SEQ ID NO: 4447172 - DNA, 18 bp, Homo sapiens
actaaaacattatatgta

SEQ ID NO: 4447173 - DNA, 16 bp, Homo sapiens
actaaaatgtatctaa

SEQ ID NO: 4447174 - DNA, 19 bp, Homo sapiens
actaaaattatgttactgt

SEQ ID NO: 4447175 - DNA, 16 bp, Homo sapiens
actaaaccaactctaa

SEQ ID NO: 4447176 - DNA, 19 bp, Homo sapiens
actaaacttggtgcttatt

SEQ ID NO: 4447177 - DNA, 23 bp, Homo sapiens
actaaacttggtgcttattgata

SEQ ID NO: 4447178 - DNA, 22 bp, Homo sapiens
actaaactttttttctgtacca

SEQ ID NO: 4447179 - DNA, 22 bp, Homo sapiens
actaaatatgaaccctttgttt

SEQ ID NO: 4447180 - DNA, 21 bp, Homo sapiens
actaaatgctcatacacagtt

SEQ ID NO: 4447181 - DNA, 16 bp, Homo sapiens
actaaatttttcatag

SEQ ID NO: 4447182 - DNA, 19 bp, Homo sapiens
actaacagctacaaacttt

SEQ ID NO: 4447183 - DNA, 15 bp, Homo sapiens
actaacagggagaag

SEQ ID NO: 4447184 - DNA, 17 bp, Homo sapiens
actaacatgtcctgcct

SEQ ID NO: 4447185 - DNA, 14 bp, Homo sapiens
actaaccatcccca

SEQ ID NO: 4447186 - DNA, 16 bp, Homo sapiens
actaaccatccccaac

SEQ ID NO: 4447187 - DNA, 19 bp, Homo sapiens
actaactcaagataatcct

SEQ ID NO: 4447188 - DNA, 16 bp, Homo sapiens
actaagagaagttgta

SEQ ID NO: 4447189 - DNA, 11 bp, Homo sapiens
actaagccagg

SEQ ID NO: 4447190 - DNA, 17 bp, Homo sapiens
actaagccaggcctggc

SEQ ID NO: 4447191 - DNA, 14 bp, Homo sapiens
actaagcctacctg

SEQ ID NO: 4447192 - DNA, 18 bp, Homo sapiens
actaagcctacctgctct

SEQ ID NO: 4447193 - DNA, 15 bp, Homo sapiens
actaagcttaatttt

SEQ ID NO: 4447194 - DNA, 19 bp, Homo sapiens
actaagcttaatttttaaa

SEQ ID NO: 4447195 - DNA, 22 bp, Homo sapiens
actaaggccttttatgtaattt

SEQ ID NO: 4447196 - DNA, 16 bp, Homo sapiens
actaaggcttttattt

SEQ ID NO: 4447197 - DNA, 17 bp, Homo sapiens
actaaggcttttatttc

SEQ ID NO: 4447198 - DNA, 18 bp, Homo sapiens
actaaggcttttatttct

SEQ ID NO: 4447199 - DNA, 17 bp, Homo sapiens
actaatagaataaaggc

SEQ ID NO: 4447200 - DNA, 19 bp, Homo sapiens
actaatatatttaaaaata

SEQ ID NO: 4447201 - DNA, 17 bp, Homo sapiens
actaatgtgtctcaggc

SEQ ID NO: 4447202 - DNA, 23 bp, Homo sapiens
actaattccacaccttttattga

SEQ ID NO: 4447203 - DNA, 15 bp, Homo sapiens
actaatttatacttt

SEQ ID NO: 4447204 - DNA, 14 bp, Homo sapiens
actaatttcaaaat

SEQ ID NO: 4447205 - DNA, 16 bp, Homo sapiens
actaatttcaaaatgc

SEQ ID NO: 4447206 - DNA, 19 bp, Homo sapiens
actaatttcaaaatgcttt

SEQ ID NO: 4447207 - DNA, 15 bp, Homo sapiens
actaattttacatgt

SEQ ID NO: 4447208 - DNA, 15 bp, Homo sapiens
actaattttacttct

SEQ ID NO: 4447209 - DNA, 11 bp, Homo sapiens
actacacaata

SEQ ID NO: 4447210 - DNA, 12 bp, Homo sapiens
actacacaatac

SEQ ID NO: 4447211 - DNA, 15 bp, Homo sapiens
actacacaatacagt

SEQ ID NO: 4447212 - DNA, 19 bp, Homo sapiens
actacacaatacagtatta

SEQ ID NO: 4447213 - DNA, 22 bp, Homo sapiens
actacacactgtgtactgcagt

SEQ ID NO: 4447214 - DNA, 14 bp, Homo sapiens
actacacatttgaa

SEQ ID NO: 4447215 - DNA, 17 bp, Homo sapiens
actacagaatattaaat

SEQ ID NO: 4447216 - DNA, 20 bp, Homo sapiens
actgactggaggaggcctgt

SEQ ID NO: 4447217 - DNA, 13 bp, Homo sapiens
actgacttctaag

SEQ ID NO: 4447218 - DNA, 22 bp, Homo sapiens
actgacttggatcccaaagcaa

SEQ ID NO: 4447219 - DNA, 15 bp, Homo sapiens
actgagaaatgaatg

SEQ ID NO: 4447220 - DNA, 19 bp, Homo sapiens
actgagatattattttaaa

SEQ ID NO: 4447221 - DNA, 18 bp, Homo sapiens
actgagcagccgccagct

SEQ ID NO: 4447222 - DNA, 20 bp, Homo sapiens
actgagccaaggaggcctgg

SEQ ID NO: 4447223 - DNA, 15 bp, Homo sapiens
actgagccagtcttt

SEQ ID NO: 4447224 - DNA, 13 bp, Homo sapiens
actgagccccagc

SEQ ID NO: 4447225 - DNA, 14 bp, Homo sapiens
actgagccccagcg

SEQ ID NO: 4447226 - DNA, 21 bp, Homo sapiens
actgagccccagcgggctggc

SEQ ID NO: 4447227 - DNA, 17 bp, Homo sapiens
actgagctcacatggga

SEQ ID NO: 4447228 - DNA, 23 bp, Homo sapiens
actgagctgtccagtggagggct

SEQ ID NO: 4447229 - DNA, 18 bp, Homo sapiens
actgagctgtgacccaga

SEQ ID NO: 4447230 - DNA, 13 bp, Homo sapiens
actgaggaagaac

SEQ ID NO: 4447231 - DNA, 22 bp, Homo sapiens
actgaggaagaacggggctctt

SEQ ID NO: 4447232 - DNA, 20 bp, Homo sapiens
actgaggagatgaccaggga

SEQ ID NO: 4447233 - DNA, 23 bp, Homo sapiens
actgaggagatgaccagggatgc

SEQ ID NO: 4447234 - DNA, 14 bp, Homo sapiens
actgaggcctgagc

SEQ ID NO: 4447235 - DNA, 21 bp, Homo sapiens
actgagggaccaactgggccc

SEQ ID NO: 4447236 - DNA, 23 bp, Homo sapiens
actgagggcagtcgatagagctg

SEQ ID NO: 4447237 - DNA, 17 bp, Homo sapiens
actgaggggaggggagc

SEQ ID NO: 4447238 - DNA, 22 bp, Homo sapiens
actgaggggccagggaggaagg

SEQ ID NO: 4447239 - DNA, 17 bp, Homo sapiens
actgagggggcctggat

SEQ ID NO: 4447240 - DNA, 18 bp, Homo sapiens
actgagtcactcacattg

SEQ ID NO: 4447241 - DNA, 16 bp, Homo sapiens
actgagtgggaagccc

SEQ ID NO: 4447242 - DNA, 21 bp, Homo sapiens
actgagttttgtttcactttg

SEQ ID NO: 4447243 - DNA, 16 bp, Homo sapiens
actgataaaaatgata

SEQ ID NO: 4447244 - DNA, 18 bp, Homo sapiens
actgataaaaatgatatt

SEQ ID NO: 4447245 - DNA, 21 bp, Homo sapiens
actgataacttggggaggcaa

SEQ ID NO: 4447246 - DNA, 14 bp, Homo sapiens
actgatagtccttt

SEQ ID NO: 4447247 - DNA, 19 bp, Homo sapiens
actgatcccccagatgcag

SEQ ID NO: 4447248 - DNA, 15 bp, Homo sapiens
actgatgacttacta

SEQ ID NO: 4447249 - DNA, 22 bp, Homo sapiens
actgatgagtaaactgaggccc

SEQ ID NO: 4447250 - DNA, 23 bp, Homo sapiens
actgatgatgacaggtcagcagt

SEQ ID NO: 4447251 - DNA, 15 bp, Homo sapiens
actgatgattttcct

SEQ ID NO: 4447252 - DNA, 23 bp, Homo sapiens
actgatgtgtgaagtgagaactc

SEQ ID NO: 4447253 - DNA, 14 bp, Homo sapiens
actgatgttcatga

SEQ ID NO: 4447254 - DNA, 16 bp, Homo sapiens
actgattaaaaatacc

SEQ ID NO: 4447255 - DNA, 15 bp, Homo sapiens
actgattacctgcca

SEQ ID NO: 4447256 - DNA, 15 bp, Homo sapiens
actgattagtattca

SEQ ID NO: 4447257 - DNA, 16 bp, Homo sapiens
actgatttctatggct

SEQ ID NO: 4447258 - DNA, 12 bp, Homo sapiens
actgatttgctc

SEQ ID NO: 4447259 - DNA, 23 bp, Homo sapiens
actgatttgggctgaatgtatgt

SEQ ID NO: 4447260 - DNA, 17 bp, Homo sapiens
actgcaacctctgcctc

SEQ ID NO: 4447261 - DNA, 14 bp, Homo sapiens
actgcaaccttgtt

SEQ ID NO: 4447262 - DNA, 20 bp, Homo sapiens
actgcaaccttgtttattaa

SEQ ID NO: 4447263 - DNA, 14 bp, Homo sapiens
actgcaagagatgg

SEQ ID NO: 4447264 - DNA, 21 bp, Homo sapiens
actgcaagagatggaaaaaaa

SEQ ID NO: 4447265 - DNA, 18 bp, Homo sapiens
actgcaagagccttggtg

SEQ ID NO: 4447266 - DNA, 15 bp, Homo sapiens
actgcaagagggggg

SEQ ID NO: 4447267 - DNA, 22 bp, Homo sapiens
actgcaagcatttttccatctg

SEQ ID NO: 4447268 - DNA, 16 bp, Homo sapiens
actgcacagcgtcctg

SEQ ID NO: 4447269 - DNA, 18 bp, Homo sapiens
actgcacccctgccccca

SEQ ID NO: 4447270 - DNA, 14 bp, Homo sapiens
actgcactccagcc

SEQ ID NO: 4447271 - DNA, 19 bp, Homo sapiens
actgcactccagcctgggg

SEQ ID NO: 4447272 - DNA, 16 bp, Homo sapiens
actgcactcttaaaca

SEQ ID NO: 4447273 - DNA, 18 bp, Homo sapiens
actgcactcttaaacagc

SEQ ID NO: 4447274 - DNA, 21 bp, Homo sapiens
actgcactttccaatgccaca

SEQ ID NO: 4447275 - DNA, 12 bp, Homo sapiens
actgcactttgt

SEQ ID NO: 4447276 - DNA, 13 bp, Homo sapiens
actgcactttgtt

SEQ ID NO: 4447277 - DNA, 20 bp, Homo sapiens
actgcactttgtttagaaaa

SEQ ID NO: 4447278 - DNA, 21 bp, Homo sapiens
actgcagacctgtcctcctgg

SEQ ID NO: 4447279 - DNA, 19 bp, Homo sapiens
actgcagaggggaaagact

SEQ ID NO: 4447280 - DNA, 13 bp, Homo sapiens
actgcagcctcat

SEQ ID NO: 4447281 - DNA, 13 bp, Homo sapiens
actgcatactttt

SEQ ID NO: 4447282 - DNA, 18 bp, Homo sapiens
actgcatactttttaaat

SEQ ID NO: 4447283 - DNA, 19 bp, Homo sapiens
actgcatcatctgtttgta

SEQ ID NO: 4447284 - DNA, 17 bp, Homo sapiens
actgcattcctgtgccc

SEQ ID NO: 4447285 - DNA, 16 bp, Homo sapiens
actgcattggttttcc

SEQ ID NO: 4447286 - DNA, 16 bp, Homo sapiens
actgcatttgcctgct

SEQ ID NO: 4447287 - DNA, 18 bp, Homo sapiens
actgcatttgcctgcttc

SEQ ID NO: 4447288 - DNA, 14 bp, Homo sapiens
actgccaaacctcc

SEQ ID NO: 4447289 - DNA, 17 bp, Homo sapiens
actgccaaacctcctgt

SEQ ID NO: 4447290 - DNA, 20 bp, Homo sapiens
actgccaaacctcctgtcag

SEQ ID NO: 4447291 - DNA, 23 bp, Homo sapiens
actgccaatatagaaaaataaaa

SEQ ID NO: 4447292 - DNA, 12 bp, Homo sapiens
actgccacaagc

SEQ ID NO: 4447293 - DNA, 14 bp, Homo sapiens
actgccagcccacc

SEQ ID NO: 4447294 - DNA, 17 bp, Homo sapiens
actgccagcccaccccc

SEQ ID NO: 4447295 - DNA, 16 bp, Homo sapiens
actgccaggccagcct

SEQ ID NO: 4447296 - DNA, 23 bp, Homo sapiens
actgccaggccagcctccgagag

SEQ ID NO: 4447297 - DNA, 13 bp, Homo sapiens
actgccaggctgc

SEQ ID NO: 4447298 - DNA, 15 bp, Homo sapiens
actgccaggctgcct

SEQ ID NO: 4447299 - DNA, 18 bp, Homo sapiens
actgccaggctgcctcct

SEQ ID NO: 4447300 - DNA, 21 bp, Homo sapiens
actgccaggctgcctcctgcc

SEQ ID NO: 4447301 - DNA, 18 bp, Homo sapiens
actgccattacccagtgc

SEQ ID NO: 4447302 - DNA, 13 bp, Homo sapiens
actgccccacatg

SEQ ID NO: 4447303 - DNA, 14 bp, Homo sapiens
actgccccacatgc

SEQ ID NO: 4447304 - DNA, 20 bp, Homo sapiens
actgccccacatgcatgtct

SEQ ID NO: 4447305 - DNA, 22 bp, Homo sapiens
actgccccacatgcatgtctgc

SEQ ID NO: 4447306 - DNA, 18 bp, Homo sapiens
actgccccacggagacag

SEQ ID NO: 4447307 - DNA, 18 bp, Homo sapiens
actgccccacgttgtccc

SEQ ID NO: 4447308 - DNA, 13 bp, Homo sapiens
actgcccccagaa

SEQ ID NO: 4447309 - DNA, 19 bp, Homo sapiens
actgccccccatgaggaag

SEQ ID NO: 4447310 - DNA, 22 bp, Homo sapiens
actgccccccatgaggaaggaa

SEQ ID NO: 4447311 - DNA, 18 bp, Homo sapiens
actgccccccgaggctgc

SEQ ID NO: 4447312 - DNA, 22 bp, Homo sapiens
actgcccggcacagatgctcca

SEQ ID NO: 4447313 - DNA, 17 bp, Homo sapiens
actgcccttgctgcccg

SEQ ID NO: 4447314 - DNA, 15 bp, Homo sapiens
actgccgtaatttaa

SEQ ID NO: 4447315 - DNA, 16 bp, Homo sapiens
actgccgtaatttaac

SEQ ID NO: 4447316 - DNA, 13 bp, Homo sapiens
actgcctaaaatt

SEQ ID NO: 4447317 - DNA, 19 bp, Homo sapiens
actgcctcgaaacacagaa

SEQ ID NO: 4447318 - DNA, 20 bp, Homo sapiens
actgcctgtagcaatggcca

SEQ ID NO: 4447319 - DNA, 21 bp, Homo sapiens
actgcctgtagcaatggccag

SEQ ID NO: 4447320 - DNA, 13 bp, Homo sapiens
actgcctttagaa

SEQ ID NO: 4447321 - DNA, 21 bp, Homo sapiens
actgcgaagaccctcttgccc

SEQ ID NO: 4447322 - DNA, 23 bp, Homo sapiens
actgcgcccttaactgcatccag

SEQ ID NO: 4447323 - DNA, 14 bp, Homo sapiens
actgcgggagccag

SEQ ID NO: 4447324 - DNA, 20 bp, Homo sapiens
actgcgttctgcaagcatca

SEQ ID NO: 4447325 - DNA, 13 bp, Homo sapiens
actgctaaataaa

SEQ ID NO: 4447326 - DNA, 14 bp, Homo sapiens
actgctaaataaaa

SEQ ID NO: 4447327 - DNA, 15 bp, Homo sapiens
actgctaaataaaat

SEQ ID NO: 4447328 - DNA, 14 bp, Homo sapiens
actgctacctctga

SEQ ID NO: 4447329 - DNA, 15 bp, Homo sapiens
actgctacctctgag

SEQ ID NO: 4447330 - DNA, 17 bp, Homo sapiens
actgctacctctgagaa

SEQ ID NO: 4447331 - DNA, 17 bp, Homo sapiens
actgctactatctgttt

SEQ ID NO: 4447332 - DNA, 20 bp, Homo sapiens
actgctccagcctctgccgc

SEQ ID NO: 4447333 - DNA, 21 bp, Homo sapiens
actgctccagcctctgccgct

SEQ ID NO: 4447334 - DNA, 14 bp, Homo sapiens
acttcagattgaac

SEQ ID NO: 4447335 - DNA, 21 bp, Homo sapiens
acttcagcaaccctacagtat

SEQ ID NO: 4447336 - DNA, 20 bp, Homo sapiens
acttcaggtggagagcacta

SEQ ID NO: 4447337 - DNA, 20 bp, Homo sapiens
acttcatcgacttagcctga

SEQ ID NO: 4447338 - DNA, 23 bp, Homo sapiens
acttcatgtaattttattttaaa

SEQ ID NO: 4447339 - DNA, 17 bp, Homo sapiens
acttcattttatattta

SEQ ID NO: 4447340 - DNA, 19 bp, Homo sapiens
acttcattttatatttaaa

SEQ ID NO: 4447341 - DNA, 16 bp, Homo sapiens
acttccaaagaaagtt

SEQ ID NO: 4447342 - DNA, 23 bp, Homo sapiens
acttccactgttaaaataaagct

SEQ ID NO: 4447343 - DNA, 16 bp, Homo sapiens
acttccaggggaacct

SEQ ID NO: 4447344 - DNA, 18 bp, Homo sapiens
acttccaggggaacctgc

SEQ ID NO: 4447345 - DNA, 20 bp, Homo sapiens
acttccaggggaacctgcca

SEQ ID NO: 4447346 - DNA, 16 bp, Homo sapiens
acttccaggtctgcct

SEQ ID NO: 4447347 - DNA, 15 bp, Homo sapiens
acttccatgttctgg

SEQ ID NO: 4447348 - DNA, 19 bp, Homo sapiens
acttccatgttctgggtga

SEQ ID NO: 4447349 - DNA, 14 bp, Homo sapiens
acttcccactgttc

SEQ ID NO: 4447350 - DNA, 23 bp, Homo sapiens
acttcccagctaggaagagcagg

SEQ ID NO: 4447351 - DNA, 23 bp, Homo sapiens
acttcccaggatctgctccaaca

SEQ ID NO: 4447352 - DNA, 18 bp, Homo sapiens
acttcccatctggctcag

SEQ ID NO: 4447353 - DNA, 13 bp, Homo sapiens
acttccgctgagg

SEQ ID NO: 4447354 - DNA, 22 bp, Homo sapiens
acttcctctgtgaactgtgtgt

SEQ ID NO: 4447355 - DNA, 16 bp, Homo sapiens
acttcctgtgcctttc

SEQ ID NO: 4447356 - DNA, 21 bp, Homo sapiens
acttcctgtgcctttcctatc

SEQ ID NO: 4447357 - DNA, 15 bp, Homo sapiens
acttcctgtggcctg

SEQ ID NO: 4447358 - DNA, 15 bp, Homo sapiens
acttcgaatatatct

SEQ ID NO: 4447359 - DNA, 20 bp, Homo sapiens
acttcgaatatatctgtaaa

SEQ ID NO: 4447360 - DNA, 13 bp, Homo sapiens
acttcgcacacac

SEQ ID NO: 4447361 - DNA, 18 bp, Homo sapiens
acttctacccagatggaa

SEQ ID NO: 4447362 - DNA, 19 bp, Homo sapiens
acttctacccagatggaaa

SEQ ID NO: 4447363 - DNA, 17 bp, Homo sapiens
acttctagatctcagcc

SEQ ID NO: 4447364 - DNA, 23 bp, Homo sapiens
acttctatttagccagcgtttat

SEQ ID NO: 4447365 - DNA, 17 bp, Homo sapiens
acttctatttatttatt

SEQ ID NO: 4447366 - DNA, 13 bp, Homo sapiens
acttctcaagtaa

SEQ ID NO: 4447367 - DNA, 21 bp, Homo sapiens
acttctcaagtaacatgactt

SEQ ID NO: 4447368 - DNA, 17 bp, Homo sapiens
acttctcactaatttgt

SEQ ID NO: 4447369 - DNA, 16 bp, Homo sapiens
acttctcactcaccac

SEQ ID NO: 4447370 - DNA, 20 bp, Homo sapiens
acttctcggaattcataata

SEQ ID NO: 4447371 - DNA, 19 bp, Homo sapiens
acttctctataaaaaatat

SEQ ID NO: 4447372 - DNA, 17 bp, Homo sapiens
acttctcttgctttcta

SEQ ID NO: 4447373 - DNA, 22 bp, Homo sapiens
acttctgatactttagtacaat

SEQ ID NO: 4447374 - DNA, 11 bp, Homo sapiens
acttctgctgc

SEQ ID NO: 4447375 - DNA, 16 bp, Homo sapiens
acttctgctgtacaga

SEQ ID NO: 4447376 - DNA, 22 bp, Homo sapiens
acttctgggcttcatctggcaa

SEQ ID NO: 4447377 - DNA, 16 bp, Homo sapiens
acttctgggtggggca

SEQ ID NO: 4447378 - DNA, 15 bp, Homo sapiens
acttctgtaattgtg

SEQ ID NO: 4447379 - DNA, 19 bp, Homo sapiens
acttctgtgagacccccac

SEQ ID NO: 4447380 - DNA, 20 bp, Homo sapiens
acttctgtgagacccccaca

SEQ ID NO: 4447381 - DNA, 21 bp, Homo sapiens
acttctgtttgatcactgtga

SEQ ID NO: 4447382 - DNA, 20 bp, Homo sapiens
acttcttatggaattgattt

SEQ ID NO: 4447383 - DNA, 12 bp, Homo sapiens
acttcttcatcc

SEQ ID NO: 4447384 - DNA, 18 bp, Homo sapiens
acttcttcctgtgaagtt

SEQ ID NO: 4447385 - DNA, 13 bp, Homo sapiens
acttcttctctta

SEQ ID NO: 4447386 - DNA, 16 bp, Homo sapiens
acttcttctcttagat

SEQ ID NO: 4447387 - DNA, 14 bp, Homo sapiens
acttcttctgtaat

SEQ ID NO: 4447388 - DNA, 13 bp, Homo sapiens
acttcttgaatat

SEQ ID NO: 4447389 - DNA, 18 bp, Homo sapiens
acttcttgcttctttcta

SEQ ID NO: 4447390 - DNA, 19 bp, Homo sapiens
acttcttgcttctttctag

SEQ ID NO: 4447391 - DNA, 20 bp, Homo sapiens
acttcttgcttctttctaga

SEQ ID NO: 4447392 - DNA, 17 bp, Homo sapiens
acttctttgcagagcct

SEQ ID NO: 4447393 - DNA, 15 bp, Homo sapiens
acttgaaaagaaaac

SEQ ID NO: 4447394 - DNA, 16 bp, Homo sapiens
acttgaaaccagtatt

SEQ ID NO: 4447395 - DNA, 11 bp, Homo sapiens
acttgaaatat

SEQ ID NO: 4447396 - DNA, 22 bp, Homo sapiens
acttgaaatatataatattcag

SEQ ID NO: 4447397 - DNA, 13 bp, Homo sapiens
acttgaacaaaag

SEQ ID NO: 4447398 - DNA, 17 bp, Homo sapiens
acttgaacaaaagggtc

SEQ ID NO: 4447399 - DNA, 18 bp, Homo sapiens
acttgaacaaaagggtca

SEQ ID NO: 4447400 - DNA, 15 bp, Homo sapiens
acttgaacaaagaca

SEQ ID NO: 4447401 - DNA, 16 bp, Homo sapiens
acttgaacaaagacat

SEQ ID NO: 4447402 - DNA, 17 bp, Homo sapiens
acttgaacaaagacatt

SEQ ID NO: 4447403 - DNA, 22 bp, Homo sapiens
acttgaacaaagacatttatat

SEQ ID NO: 4447404 - DNA, 21 bp, Homo sapiens
acttgaacccatatttgtaca

SEQ ID NO: 4447405 - DNA, 20 bp, Homo sapiens
acttgaacccgggaggcaga

SEQ ID NO: 4447406 - DNA, 21 bp, Homo sapiens
acttgaacccgggaggcagag

SEQ ID NO: 4447407 - DNA, 16 bp, Homo sapiens
acttgaacttgcctct

SEQ ID NO: 4447408 - DNA, 20 bp, Homo sapiens
acttgaactttccaaaacct

SEQ ID NO: 4447409 - DNA, 20 bp, Homo sapiens
acttgaagctaacgttagaa

SEQ ID NO: 4447410 - DNA, 21 bp, Homo sapiens
acttgaatcagatggtgtcat

SEQ ID NO: 4447411 - DNA, 13 bp, Homo sapiens
acttgactctaat

SEQ ID NO: 4447412 - DNA, 17 bp, Homo sapiens
acttgacttttaaggct

SEQ ID NO: 4447413 - DNA, 20 bp, Homo sapiens
acttgagaaccagtctcctc

SEQ ID NO: 4447414 - DNA, 16 bp, Homo sapiens
acttgagatgatttcc

SEQ ID NO: 4447415 - DNA, 20 bp, Homo sapiens
acttgaggaggagctggcct

SEQ ID NO: 4447416 - DNA, 20 bp, Homo sapiens
acttgatcacatgcttgaat

SEQ ID NO: 4447417 - DNA, 20 bp, Homo sapiens
acttgatcatttttaccatt

SEQ ID NO: 4447418 - DNA, 20 bp, Homo sapiens
acttgcaatccaggctgttc

SEQ ID NO: 4447419 - DNA, 21 bp, Homo sapiens
acttgcacagggattctcaca

SEQ ID NO: 4447420 - DNA, 23 bp, Homo sapiens
acttgccacatggtgtctcccaa

SEQ ID NO: 4447421 - DNA, 21 bp, Homo sapiens
acttgccctgaccatgcattt

SEQ ID NO: 4447422 - DNA, 22 bp, Homo sapiens
acttgcctaactaactggcagg

SEQ ID NO: 4447423 - DNA, 20 bp, Homo sapiens
acttgcctcttttacctgct

SEQ ID NO: 4447424 - DNA, 23 bp, Homo sapiens
acttgcctcttttacctgctgct

SEQ ID NO: 4447425 - DNA, 22 bp, Homo sapiens
acttgcgagaaattcgtgtgtt

SEQ ID NO: 4447426 - DNA, 14 bp, Homo sapiens
acttgcgagtccaa

SEQ ID NO: 4447427 - DNA, 13 bp, Homo sapiens
acttgctcccaac

SEQ ID NO: 4447428 - DNA, 16 bp, Homo sapiens
acttgctccctctcca

SEQ ID NO: 4447429 - DNA, 15 bp, Homo sapiens
acttgctctttgact

SEQ ID NO: 4447430 - DNA, 13 bp, Homo sapiens
acttgctgaagga

SEQ ID NO: 4447431 - DNA, 16 bp, Homo sapiens
acttgcttaaatttct

SEQ ID NO: 4447432 - DNA, 23 bp, Homo sapiens
acttgcttaaatttcttatgtga

SEQ ID NO: 4447433 - DNA, 14 bp, Homo sapiens
acttgcttcagtgg

SEQ ID NO: 4447434 - DNA, 20 bp, Homo sapiens
acttggaaatcagtagaaag

SEQ ID NO: 4447435 - DNA, 21 bp, Homo sapiens
acttggaaatcagtagaaagc

SEQ ID NO: 4447436 - DNA, 23 bp, Homo sapiens
acttggaatcaaggtaagctcag

SEQ ID NO: 4447437 - DNA, 17 bp, Homo sapiens
acttggcatacaaaata

SEQ ID NO: 4447438 - DNA, 19 bp, Homo sapiens
acttggcatacaaaatatt

SEQ ID NO: 4447439 - DNA, 20 bp, Homo sapiens
acttggcatacaaaatattt

SEQ ID NO: 4447440 - DNA, 22 bp, Homo sapiens
acttgggaggctgaggcaggag

SEQ ID NO: 4447441 - DNA, 16 bp, Homo sapiens
acttgggctactgaac

SEQ ID NO: 4447442 - DNA, 14 bp, Homo sapiens
acttggggaggcaa

SEQ ID NO: 4447443 - DNA, 15 bp, Homo sapiens
acttggtcagagcca

SEQ ID NO: 4447444 - DNA, 14 bp, Homo sapiens
acttggtctgcaga

SEQ ID NO: 4447445 - DNA, 22 bp, Homo sapiens
acttggtttgttatatcaggga

SEQ ID NO: 4447446 - DNA, 14 bp, Homo sapiens
acttgtatatatgg

SEQ ID NO: 4447447 - DNA, 18 bp, Homo sapiens
acttgtattttgtcactt

SEQ ID NO: 4447448 - DNA, 13 bp, Homo sapiens
acttgtcaaagaa

SEQ ID NO: 4447449 - DNA, 18 bp, Homo sapiens
acttgtcaagcctgtgca

SEQ ID NO: 4447450 - DNA, 20 bp, Homo sapiens
acttgtcatatgtagccttc

SEQ ID NO: 4447451 - DNA, 15 bp, Homo sapiens
agaaggatggcatct

SEQ ID NO: 4447452 - DNA, 18 bp, Homo sapiens
agaaggcatttgcagggt

SEQ ID NO: 4447453 - DNA, 17 bp, Homo sapiens
agaaggccccagagaga

SEQ ID NO: 4447454 - DNA, 18 bp, Homo sapiens
agaaggccccagagagac

SEQ ID NO: 4447455 - DNA, 14 bp, Homo sapiens
agaagggctagaac

SEQ ID NO: 4447456 - DNA, 18 bp, Homo sapiens
agaaggggcgtcataaat

SEQ ID NO: 4447457 - DNA, 21 bp, Homo sapiens
agaaggtattagcaaagcaaa

SEQ ID NO: 4447458 - DNA, 15 bp, Homo sapiens
agaaggttgagggca

SEQ ID NO: 4447459 - DNA, 22 bp, Homo sapiens
agaagtaaaagcaaaaaagaaa

SEQ ID NO: 4447460 - DNA, 21 bp, Homo sapiens
agaagtagctagtagcaatgt

SEQ ID NO: 4447461 - DNA, 18 bp, Homo sapiens
agaagtatttttttaatt

SEQ ID NO: 4447462 - DNA, 14 bp, Homo sapiens
agaagtccacagga

SEQ ID NO: 4447463 - DNA, 17 bp, Homo sapiens
agaagtccttatgttaa

SEQ ID NO: 4447464 - DNA, 18 bp, Homo sapiens
agaagtcggaatgtcata

SEQ ID NO: 4447465 - DNA, 21 bp, Homo sapiens
agaagtcttaattgtgtttat

SEQ ID NO: 4447466 - DNA, 23 bp, Homo sapiens
agaagtgcatctggagagaacag

SEQ ID NO: 4447467 - DNA, 16 bp, Homo sapiens
agaagtggaaatttat

SEQ ID NO: 4447468 - DNA, 18 bp, Homo sapiens
agaagtggaccaggacag

SEQ ID NO: 4447469 - DNA, 14 bp, Homo sapiens
agaagtggctgcca

SEQ ID NO: 4447470 - DNA, 22 bp, Homo sapiens
agaagtgtggggattttcactg

SEQ ID NO: 4447471 - DNA, 23 bp, Homo sapiens
agaagtgtttcagattttttaaa

SEQ ID NO: 4447472 - DNA, 16 bp, Homo sapiens
agaagttaaaaaacag

SEQ ID NO: 4447473 - DNA, 18 bp, Homo sapiens
agaagttagtttgtatat

SEQ ID NO: 4447474 - DNA, 22 bp, Homo sapiens
agaagttgtgctaaaccaagtt

SEQ ID NO: 4447475 - DNA, 23 bp, Homo sapiens
agaagttgtgctaaaccaagtta

SEQ ID NO: 4447476 - DNA, 21 bp, Homo sapiens
agaagtttcatcattttttac

SEQ ID NO: 4447477 - DNA, 17 bp, Homo sapiens
agaataaaatgtttctc

SEQ ID NO: 4447478 - DNA, 14 bp, Homo sapiens
agaataaaggcagt

SEQ ID NO: 4447479 - DNA, 23 bp, Homo sapiens
agaataaatccttgggagtcatt

SEQ ID NO: 4447480 - DNA, 13 bp, Homo sapiens
agaataaattcta

SEQ ID NO: 4447481 - DNA, 15 bp, Homo sapiens
agaataaatttggga

SEQ ID NO: 4447482 - DNA, 13 bp, Homo sapiens
agaataagaattt

SEQ ID NO: 4447483 - DNA, 17 bp, Homo sapiens
agaataatcaaatacat

SEQ ID NO: 4447484 - DNA, 17 bp, Homo sapiens
agaataatcacgctttc

SEQ ID NO: 4447485 - DNA, 20 bp, Homo sapiens
agaataatcacgctttcctg

SEQ ID NO: 4447486 - DNA, 16 bp, Homo sapiens
agaataatttatagta

SEQ ID NO: 4447487 - DNA, 17 bp, Homo sapiens
agaataatttatagtaa

SEQ ID NO: 4447488 - DNA, 23 bp, Homo sapiens
agaatacgggtccctctaaccca

SEQ ID NO: 4447489 - DNA, 14 bp, Homo sapiens
agaatacttgaact

SEQ ID NO: 4447490 - DNA, 15 bp, Homo sapiens
agaatacttgaactt

SEQ ID NO: 4447491 - DNA, 10 bp, Homo sapiens
agaatagaaa

SEQ ID NO: 4447492 - DNA, 21 bp, Homo sapiens
agaatagaaacgtaaactatg

SEQ ID NO: 4447493 - DNA, 13 bp, Homo sapiens
agaatagaaagaa

SEQ ID NO: 4447494 - DNA, 21 bp, Homo sapiens
agaatagccacatttggaata

SEQ ID NO: 4447495 - DNA, 20 bp, Homo sapiens
agaatagcctagatatgaat

SEQ ID NO: 4447496 - DNA, 17 bp, Homo sapiens
agaatataccttattta

SEQ ID NO: 4447497 - DNA, 19 bp, Homo sapiens
agaatataccttatttatt

SEQ ID NO: 4447498 - DNA, 17 bp, Homo sapiens
agaatatccatgaccta

SEQ ID NO: 4447499 - DNA, 18 bp, Homo sapiens
agaatcaccgcatttcag

SEQ ID NO: 4447500 - DNA, 17 bp, Homo sapiens
agaatcactgctccagg

SEQ ID NO: 4447501 - DNA, 17 bp, Homo sapiens
agaatcacttaagcctg

SEQ ID NO: 4447502 - DNA, 17 bp, Homo sapiens
agaatcagaagatagtc

SEQ ID NO: 4447503 - DNA, 13 bp, Homo sapiens
agaatcagagaag

SEQ ID NO: 4447504 - DNA, 17 bp, Homo sapiens
agaatcatacttaacat

SEQ ID NO: 4447505 - DNA, 19 bp, Homo sapiens
agaatcatacttaacattt

SEQ ID NO: 4447506 - DNA, 17 bp, Homo sapiens
agaatcattatttatta

SEQ ID NO: 4447507 - DNA, 15 bp, Homo sapiens
agaatccagtattat

SEQ ID NO: 4447508 - DNA, 19 bp, Homo sapiens
agaatcccaaatttgattg

SEQ ID NO: 4447509 - DNA, 20 bp, Homo sapiens
agaatcccttaacagttgta

SEQ ID NO: 4447510 - DNA, 22 bp, Homo sapiens
agaatcccttaacagttgtatt

SEQ ID NO: 4447511 - DNA, 14 bp, Homo sapiens
agaatctagaagat

SEQ ID NO: 4447512 - DNA, 16 bp, Homo sapiens
agaatctagaagatgt

SEQ ID NO: 4447513 - DNA, 13 bp, Homo sapiens
agaatctgaatgt

SEQ ID NO: 4447514 - DNA, 17 bp, Homo sapiens
agaatgaaatgaatgat

SEQ ID NO: 4447515 - DNA, 15 bp, Homo sapiens
agaatgaatttatct

SEQ ID NO: 4447516 - DNA, 20 bp, Homo sapiens
agaatgaatttatctttacc

SEQ ID NO: 4447517 - DNA, 22 bp, Homo sapiens
agaatgaatttatctttaccaa

SEQ ID NO: 4447518 - DNA, 17 bp, Homo sapiens
agaatgactgacaaaga

SEQ ID NO: 4447519 - DNA, 17 bp, Homo sapiens
agaatgcacagatatac

SEQ ID NO: 4447520 - DNA, 22 bp, Homo sapiens
agaatgccataaaattgcagtt

SEQ ID NO: 4447521 - DNA, 14 bp, Homo sapiens
agaatgccatttct

SEQ ID NO: 4447522 - DNA, 16 bp, Homo sapiens
agaatgccggttaaat

SEQ ID NO: 4447523 - DNA, 14 bp, Homo sapiens
agaatgctaatggt

SEQ ID NO: 4447524 - DNA, 11 bp, Homo sapiens
agaatgctcct

SEQ ID NO: 4447525 - DNA, 15 bp, Homo sapiens
agaatgctgtacatc

SEQ ID NO: 4447526 - DNA, 14 bp, Homo sapiens
agaatgcttaaaaa

SEQ ID NO: 4447527 - DNA, 20 bp, Homo sapiens
agaatgcttaatcagataga

SEQ ID NO: 4447528 - DNA, 16 bp, Homo sapiens
agaatggaaatttata

SEQ ID NO: 4447529 - DNA, 16 bp, Homo sapiens
agaatgtaagaactac

SEQ ID NO: 4447530 - DNA, 16 bp, Homo sapiens
agaatgtagtcagact

SEQ ID NO: 4447531 - DNA, 19 bp, Homo sapiens
agaatgtagtcagactgac

SEQ ID NO: 4447532 - DNA, 15 bp, Homo sapiens
agaatgtcagattcc

SEQ ID NO: 4447533 - DNA, 13 bp, Homo sapiens
agaatgtcagtat

SEQ ID NO: 4447534 - DNA, 16 bp, Homo sapiens
agaatgtcagtatgtg

SEQ ID NO: 4447535 - DNA, 16 bp, Homo sapiens
agaatgtcattttggt

SEQ ID NO: 4447536 - DNA, 11 bp, Homo sapiens
agaatgtgaaa

SEQ ID NO: 4447537 - DNA, 21 bp, Homo sapiens
agaatgttatccaactattaa

SEQ ID NO: 4447538 - DNA, 13 bp, Homo sapiens
agaatgttccaga

SEQ ID NO: 4447539 - DNA, 14 bp, Homo sapiens
agaatgttccagac

SEQ ID NO: 4447540 - DNA, 19 bp, Homo sapiens
agaatgttccagacattct

SEQ ID NO: 4447541 - DNA, 23 bp, Homo sapiens
agaatgtttggcactctctaacg

SEQ ID NO: 4447542 - DNA, 15 bp, Homo sapiens
agaatgttttcaaat

SEQ ID NO: 4447543 - DNA, 21 bp, Homo sapiens
agaatgttttcaaatgttctc

SEQ ID NO: 4447544 - DNA, 23 bp, Homo sapiens
agaattaacacatgatcctgcaa

SEQ ID NO: 4447545 - DNA, 14 bp, Homo sapiens
agaattaagcagaa

SEQ ID NO: 4447546 - DNA, 15 bp, Homo sapiens
agaattatctaattt

SEQ ID NO: 4447547 - DNA, 15 bp, Homo sapiens
agaattccaaagcaa

SEQ ID NO: 4447548 - DNA, 18 bp, Homo sapiens
agaattcggtgtgctgcc

SEQ ID NO: 4447549 - DNA, 16 bp, Homo sapiens
agaattgaacccagga

SEQ ID NO: 4447550 - DNA, 17 bp, Homo sapiens
agaattgaacccaggag

SEQ ID NO: 4447551 - DNA, 22 bp, Homo sapiens
agaattgaacccaggaggtgga

SEQ ID NO: 4447552 - DNA, 14 bp, Homo sapiens
agaattgagtgttt

SEQ ID NO: 4447553 - DNA, 20 bp, Homo sapiens
agaattgatatacacggatg

SEQ ID NO: 4447554 - DNA, 19 bp, Homo sapiens
agaattgcttgagcttggg

SEQ ID NO: 4447555 - DNA, 21 bp, Homo sapiens
agaattgtatatcattttgcc

SEQ ID NO: 4447556 - DNA, 22 bp, Homo sapiens
agaattgtatatcattttgcca

SEQ ID NO: 4447557 - DNA, 14 bp, Homo sapiens
agaatttagtgtat

SEQ ID NO: 4447558 - DNA, 21 bp, Homo sapiens
agaatttatcacacttctgtg

SEQ ID NO: 4447559 - DNA, 14 bp, Homo sapiens
agaatttctggtgg

SEQ ID NO: 4447560 - DNA, 14 bp, Homo sapiens
agaatttgaattat

SEQ ID NO: 4447561 - DNA, 17 bp, Homo sapiens
agaatttgagtgctctg

SEQ ID NO: 4447562 - DNA, 15 bp, Homo sapiens
agaatttgtgttgaa

SEQ ID NO: 4447563 - DNA, 15 bp, Homo sapiens
agaattttcatcccg

SEQ ID NO: 4447564 - DNA, 13 bp, Homo sapiens
agacaaaaacaag

SEQ ID NO: 4447565 - DNA, 16 bp, Homo sapiens
agacaaaaacagcctc

SEQ ID NO: 4447566 - DNA, 22 bp, Homo sapiens
agacaaaaacagcctcacagaa

SEQ ID NO: 4447567 - DNA, 17 bp, Homo sapiens
agacaaaacgagtcttt

SEQ ID NO: 4447568 - DNA, 16 bp, Homo sapiens
agacaaaatggataca

SEQ ID NO: 4447569 - DNA, 18 bp, Homo sapiens
agagctagaacctggaga

SEQ ID NO: 4447570 - DNA, 22 bp, Homo sapiens
agagctagaacctggagggcta

SEQ ID NO: 4447571 - DNA, 14 bp, Homo sapiens
agagctagagaaat

SEQ ID NO: 4447572 - DNA, 13 bp, Homo sapiens
agagctagcgctg

SEQ ID NO: 4447573 - DNA, 14 bp, Homo sapiens
agagctattttaga

SEQ ID NO: 4447574 - DNA, 13 bp, Homo sapiens
agagctcttggcc

SEQ ID NO: 4447575 - DNA, 23 bp, Homo sapiens
agagctgagttgggggtgtggct

SEQ ID NO: 4447576 - DNA, 16 bp, Homo sapiens
agagctggcgctcagc

SEQ ID NO: 4447577 - DNA, 18 bp, Homo sapiens
agagctggcgctcagcag

SEQ ID NO: 4447578 - DNA, 22 bp, Homo sapiens
agagctggcgctcagcagccct

SEQ ID NO: 4447579 - DNA, 20 bp, Homo sapiens
agagctgggaaattcatgtg

SEQ ID NO: 4447580 - DNA, 18 bp, Homo sapiens
agagctgttcacagccag

SEQ ID NO: 4447581 - DNA, 19 bp, Homo sapiens
agagctgttcacagccaga

SEQ ID NO: 4447582 - DNA, 19 bp, Homo sapiens
agagctgtttatggcctca

SEQ ID NO: 4447583 - DNA, 12 bp, Homo sapiens
agagcttccctg

SEQ ID NO: 4447584 - DNA, 16 bp, Homo sapiens
agagcttccctgactc

SEQ ID NO: 4447585 - DNA, 17 bp, Homo sapiens
agagcttccctgactca

SEQ ID NO: 4447586 - DNA, 15 bp, Homo sapiens
agagcttggactaca

SEQ ID NO: 4447587 - DNA, 17 bp, Homo sapiens
agagcttggactacaca

SEQ ID NO: 4447588 - DNA, 14 bp, Homo sapiens
agagctttgtcact

SEQ ID NO: 4447589 - DNA, 15 bp, Homo sapiens
agagctttgtcactt

SEQ ID NO: 4447590 - DNA, 17 bp, Homo sapiens
agagctttgtcacttgc

SEQ ID NO: 4447591 - DNA, 22 bp, Homo sapiens
agagctttgtcacttgccacat

SEQ ID NO: 4447592 - DNA, 13 bp, Homo sapiens
agagcttttcaga

SEQ ID NO: 4447593 - DNA, 20 bp, Homo sapiens
agagcttttcagattgtgga

SEQ ID NO: 4447594 - DNA, 17 bp, Homo sapiens
agagctttttaatagca

SEQ ID NO: 4447595 - DNA, 18 bp, Homo sapiens
agaggaaagggctggctc

SEQ ID NO: 4447596 - DNA, 19 bp, Homo sapiens
agaggaaattcaaatccct

SEQ ID NO: 4447597 - DNA, 14 bp, Homo sapiens
agaggaagcccagc

SEQ ID NO: 4447598 - DNA, 16 bp, Homo sapiens
agaggaaggggccaga

SEQ ID NO: 4447599 - DNA, 20 bp, Homo sapiens
agaggaaggggccagaggct

SEQ ID NO: 4447600 - DNA, 16 bp, Homo sapiens
agaggaagttcagatc

SEQ ID NO: 4447601 - DNA, 23 bp, Homo sapiens
agaggaatcagacttcacactgc

SEQ ID NO: 4447602 - DNA, 17 bp, Homo sapiens
agaggaatctgtttctc

SEQ ID NO: 4447603 - DNA, 18 bp, Homo sapiens
agaggaattacgtgctct

SEQ ID NO: 4447604 - DNA, 17 bp, Homo sapiens
agaggacagtctggaga

SEQ ID NO: 4447605 - DNA, 19 bp, Homo sapiens
agaggacagtctggagaag

SEQ ID NO: 4447606 - DNA, 20 bp, Homo sapiens
agaggacagtctggagaagg

SEQ ID NO: 4447607 - DNA, 20 bp, Homo sapiens
agaggactgagactggcact

SEQ ID NO: 4447608 - DNA, 19 bp, Homo sapiens
agaggagaaatgcaataac

SEQ ID NO: 4447609 - DNA, 11 bp, Homo sapiens
agaggagaaga

SEQ ID NO: 4447610 - DNA, 15 bp, Homo sapiens
agaggagaagagaca

SEQ ID NO: 4447611 - DNA, 23 bp, Homo sapiens
agaggagggcagcagaagggggt

SEQ ID NO: 4447612 - DNA, 16 bp, Homo sapiens
agaggagtctgtggct

SEQ ID NO: 4447613 - DNA, 15 bp, Homo sapiens
agaggatacatttaa

SEQ ID NO: 4447614 - DNA, 20 bp, Homo sapiens
agaggatacatttaataaaa

SEQ ID NO: 4447615 - DNA, 13 bp, Homo sapiens
agaggatgatttc

SEQ ID NO: 4447616 - DNA, 18 bp, Homo sapiens
agaggcaagctgaaattt

SEQ ID NO: 4447617 - DNA, 22 bp, Homo sapiens
agaggcaagctgaaattttaga

SEQ ID NO: 4447618 - DNA, 13 bp, Homo sapiens
agaggcaccagga

SEQ ID NO: 4447619 - DNA, 12 bp, Homo sapiens
agaggcaccagt

SEQ ID NO: 4447620 - DNA, 17 bp, Homo sapiens
agaggcaccagtccagc

SEQ ID NO: 4447621 - DNA, 12 bp, Homo sapiens
agaggcagaggt

SEQ ID NO: 4447622 - DNA, 21 bp, Homo sapiens
agaggcagcttctagacagag

SEQ ID NO: 4447623 - DNA, 14 bp, Homo sapiens
agaggcaggctggg

SEQ ID NO: 4447624 - DNA, 17 bp, Homo sapiens
agaggcaggctgggacg

SEQ ID NO: 4447625 - DNA, 16 bp, Homo sapiens
agaggcatttaaaatg

SEQ ID NO: 4447626 - DNA, 18 bp, Homo sapiens
agaggccagacatggtgt

SEQ ID NO: 4447627 - DNA, 18 bp, Homo sapiens
agaggccagccccaccca

SEQ ID NO: 4447628 - DNA, 21 bp, Homo sapiens
agaggccattctttcccaaca

SEQ ID NO: 4447629 - DNA, 14 bp, Homo sapiens
agaggccccacctg

SEQ ID NO: 4447630 - DNA, 16 bp, Homo sapiens
agaggccctgccccca

SEQ ID NO: 4447631 - DNA, 18 bp, Homo sapiens
agaggccctgcccccacc

SEQ ID NO: 4447632 - DNA, 23 bp, Homo sapiens
agaggccctggagggaaggacag

SEQ ID NO: 4447633 - DNA, 13 bp, Homo sapiens
agaggcctgcccg

SEQ ID NO: 4447634 - DNA, 12 bp, Homo sapiens
agaggcggcctc

SEQ ID NO: 4447635 - DNA, 15 bp, Homo sapiens
agaggctacagggcc

SEQ ID NO: 4447636 - DNA, 16 bp, Homo sapiens
agaggctagcttctgc

SEQ ID NO: 4447637 - DNA, 12 bp, Homo sapiens
agaggctctgga

SEQ ID NO: 4447638 - DNA, 16 bp, Homo sapiens
agaggctctggacagc

SEQ ID NO: 4447639 - DNA, 21 bp, Homo sapiens
agaggctctggacagcagaag

SEQ ID NO: 4447640 - DNA, 16 bp, Homo sapiens
agaggctgcacccctg

SEQ ID NO: 4447641 - DNA, 20 bp, Homo sapiens
agaggctgcacccctgggcc

SEQ ID NO: 4447642 - DNA, 23 bp, Homo sapiens
agaggctgcacccctgggccagc

SEQ ID NO: 4447643 - DNA, 12 bp, Homo sapiens
agaggctgcccc

SEQ ID NO: 4447644 - DNA, 20 bp, Homo sapiens
agaggctgcccctctcacca

SEQ ID NO: 4447645 - DNA, 17 bp, Homo sapiens
agaggctggaggcaggg

SEQ ID NO: 4447646 - DNA, 22 bp, Homo sapiens
agaggctggaggcagggccttg

SEQ ID NO: 4447647 - DNA, 19 bp, Homo sapiens
agaggctggcattgaggct

SEQ ID NO: 4447648 - DNA, 16 bp, Homo sapiens
agaggcttctccgcca

SEQ ID NO: 4447649 - DNA, 17 bp, Homo sapiens
agaggcttctccgccag

SEQ ID NO: 4447650 - DNA, 22 bp, Homo sapiens
agaggcttctccgccagcctcc

SEQ ID NO: 4447651 - DNA, 21 bp, Homo sapiens
agaggcttcttcagatcagtg

SEQ ID NO: 4447652 - DNA, 18 bp, Homo sapiens
agaggcttgaaggccagc

SEQ ID NO: 4447653 - DNA, 20 bp, Homo sapiens
agagggaccaaattgcttct

SEQ ID NO: 4447654 - DNA, 15 bp, Homo sapiens
agagggacgcctggg

SEQ ID NO: 4447655 - DNA, 21 bp, Homo sapiens
agagggacgcctgggggtgcc

SEQ ID NO: 4447656 - DNA, 22 bp, Homo sapiens
agagggactgttcttttgtccc

SEQ ID NO: 4447657 - DNA, 22 bp, Homo sapiens
agagggaggtcactggaaaggg

SEQ ID NO: 4447658 - DNA, 18 bp, Homo sapiens
agagggatttccctgcag

SEQ ID NO: 4447659 - DNA, 18 bp, Homo sapiens
agagggcagactgtgaac

SEQ ID NO: 4447660 - DNA, 14 bp, Homo sapiens
agagggcagaggct

SEQ ID NO: 4447661 - DNA, 22 bp, Homo sapiens
agagggcccaaagaattggaat

SEQ ID NO: 4447662 - DNA, 13 bp, Homo sapiens
agagggcccagcc

SEQ ID NO: 4447663 - DNA, 17 bp, Homo sapiens
agagggctggaggccca

SEQ ID NO: 4447664 - DNA, 20 bp, Homo sapiens
agagggctggtccttattta

SEQ ID NO: 4447665 - DNA, 12 bp, Homo sapiens
agagggcttcct

SEQ ID NO: 4447666 - DNA, 19 bp, Homo sapiens
agaggggaaaaaatcatat

SEQ ID NO: 4447667 - DNA, 22 bp, Homo sapiens
agaggggcaaatagagagtctc

SEQ ID NO: 4447668 - DNA, 21 bp, Homo sapiens
agaggggcgttctcccaaaga

SEQ ID NO: 4447669 - DNA, 21 bp, Homo sapiens
agaggggctgaatagcagaag

SEQ ID NO: 4447670 - DNA, 12 bp, Homo sapiens
agagggggtgga

SEQ ID NO: 4447671 - DNA, 15 bp, Homo sapiens
agaggggtggaggct

SEQ ID NO: 4447672 - DNA, 19 bp, Homo sapiens
agagggttcacacagccca

SEQ ID NO: 4447673 - DNA, 20 bp, Homo sapiens
agagggttcacacagcccag

SEQ ID NO: 4447674 - DNA, 21 bp, Homo sapiens
agaggtaactatcaatattta

SEQ ID NO: 4447675 - DNA, 19 bp, Homo sapiens
agaggtattggattttcac

SEQ ID NO: 4447676 - DNA, 20 bp, Homo sapiens
agaggtcaggacggctcctc

SEQ ID NO: 4447677 - DNA, 13 bp, Homo sapiens
agaggtctgagcc

SEQ ID NO: 4447678 - DNA, 15 bp, Homo sapiens
agaggtctgagccct

SEQ ID NO: 4447679 - DNA, 16 bp, Homo sapiens
agaggtctgagccctg

SEQ ID NO: 4447680 - DNA, 22 bp, Homo sapiens
agaggtgctaaattgtctgcca

SEQ ID NO: 4447681 - DNA, 15 bp, Homo sapiens
agaggtggaaaaaca

SEQ ID NO: 4447682 - DNA, 22 bp, Homo sapiens
agaggtggatcctgtaggctaa

SEQ ID NO: 4447683 - DNA, 17 bp, Homo sapiens
agaggtgggagggccct

SEQ ID NO: 4447684 - DNA, 19 bp, Homo sapiens
agaggtgggatcctccctc

SEQ ID NO: 4447685 - DNA, 19 bp, Homo sapiens
agaggtgtcgggacatggt

SEQ ID NO: 4447686 - DNA, 18 bp, Homo sapiens
agaggtgtgcacaccaaa

SEQ ID NO: 4447687 - DNA, 15 bp, Homo sapiens
agcaagcattcagaa

SEQ ID NO: 4447688 - DNA, 18 bp, Homo sapiens
agcaagcattcagaagaa

SEQ ID NO: 4447689 - DNA, 17 bp, Homo sapiens
agcaagccatcatcctc

SEQ ID NO: 4447690 - DNA, 15 bp, Homo sapiens
agcaagcgggagccc

SEQ ID NO: 4447691 - DNA, 19 bp, Homo sapiens
agcaagctgcccagccctg

SEQ ID NO: 4447692 - DNA, 17 bp, Homo sapiens
agcaagcttaatggctg

SEQ ID NO: 4447693 - DNA, 15 bp, Homo sapiens
agcaaggatatcaga

SEQ ID NO: 4447694 - DNA, 20 bp, Homo sapiens
agcaagtacagcggctcccc

SEQ ID NO: 4447695 - DNA, 18 bp, Homo sapiens
agcaataggtttgtaaaa

SEQ ID NO: 4447696 - DNA, 12 bp, Homo sapiens
agcaatatgtca

SEQ ID NO: 4447697 - DNA, 21 bp, Homo sapiens
agcaatattgtatatttttat

SEQ ID NO: 4447698 - DNA, 15 bp, Homo sapiens
agcaatctcttcatt

SEQ ID NO: 4447699 - DNA, 16 bp, Homo sapiens
agcaatctgaccctat

SEQ ID NO: 4447700 - DNA, 13 bp, Homo sapiens
agcaatctttgaa

SEQ ID NO: 4447701 - DNA, 19 bp, Homo sapiens
agcaatctttgaaataaaa

SEQ ID NO: 4447702 - DNA, 17 bp, Homo sapiens
agcaatggccagagcct

SEQ ID NO: 4447703 - DNA, 20 bp, Homo sapiens
agcaatggccagagcctctg

SEQ ID NO: 4447704 - DNA, 23 bp, Homo sapiens
agcaatggtgtcagtatccaggc

SEQ ID NO: 4447705 - DNA, 14 bp, Homo sapiens
agcaattatattgt

SEQ ID NO: 4447706 - DNA, 14 bp, Homo sapiens
agcaattccaacct

SEQ ID NO: 4447707 - DNA, 15 bp, Homo sapiens
agcaattccaacctt

SEQ ID NO: 4447708 - DNA, 16 bp, Homo sapiens
agcaattctcctgcct

SEQ ID NO: 4447709 - DNA, 18 bp, Homo sapiens
agcaattctcctgcctca

SEQ ID NO: 4447710 - DNA, 22 bp, Homo sapiens
agcaattctcctgcctcagcct

SEQ ID NO: 4447711 - DNA, 15 bp, Homo sapiens
agcaattctgactgt

SEQ ID NO: 4447712 - DNA, 16 bp, Homo sapiens
agcaatttaaatgtta

SEQ ID NO: 4447713 - DNA, 17 bp, Homo sapiens
agcaatttaaatgttat

SEQ ID NO: 4447714 - DNA, 14 bp, Homo sapiens
agcacaaaaggcag

SEQ ID NO: 4447715 - DNA, 11 bp, Homo sapiens
agcacaaaatt

SEQ ID NO: 4447716 - DNA, 20 bp, Homo sapiens
agcacaaagttctcagagct

SEQ ID NO: 4447717 - DNA, 22 bp, Homo sapiens
agcacaaagttctcagagctct

SEQ ID NO: 4447718 - DNA, 18 bp, Homo sapiens
agcacaaccttttcctca

SEQ ID NO: 4447719 - DNA, 15 bp, Homo sapiens
agcacaattaattaa

SEQ ID NO: 4447720 - DNA, 16 bp, Homo sapiens
agcacaattaattaaa

SEQ ID NO: 4447721 - DNA, 19 bp, Homo sapiens
agcacacacaataaagaac

SEQ ID NO: 4447722 - DNA, 17 bp, Homo sapiens
agcacacaggcagccag

SEQ ID NO: 4447723 - DNA, 22 bp, Homo sapiens
agcacactgcacagggaaaatt

SEQ ID NO: 4447724 - DNA, 19 bp, Homo sapiens
agcacactggaatataaaa

SEQ ID NO: 4447725 - DNA, 12 bp, Homo sapiens
agcacactggct

SEQ ID NO: 4447726 - DNA, 14 bp, Homo sapiens
agcacagaatattt

SEQ ID NO: 4447727 - DNA, 12 bp, Homo sapiens
agcacagagcct

SEQ ID NO: 4447728 - DNA, 21 bp, Homo sapiens
agcacagagcctggccccagg

SEQ ID NO: 4447729 - DNA, 17 bp, Homo sapiens
agcacagaggatttctt

SEQ ID NO: 4447730 - DNA, 15 bp, Homo sapiens
agcacagaggcctga

SEQ ID NO: 4447731 - DNA, 20 bp, Homo sapiens
agcacagcttagatttcata

SEQ ID NO: 4447732 - DNA, 12 bp, Homo sapiens
agcacaggctaa

SEQ ID NO: 4447733 - DNA, 16 bp, Homo sapiens
agcacatatggaattt

SEQ ID NO: 4447734 - DNA, 14 bp, Homo sapiens
agcacatctctctg

SEQ ID NO: 4447735 - DNA, 15 bp, Homo sapiens
agcaccaaccacagc

SEQ ID NO: 4447736 - DNA, 13 bp, Homo sapiens
agcaccaccaggg

SEQ ID NO: 4447737 - DNA, 14 bp, Homo sapiens
agcaccaggcacga

SEQ ID NO: 4447738 - DNA, 22 bp, Homo sapiens
agcaccagtgggactgtggtga

SEQ ID NO: 4447739 - DNA, 13 bp, Homo sapiens
agcaccccctgct

SEQ ID NO: 4447740 - DNA, 18 bp, Homo sapiens
agcacccgtggtgcatgg

SEQ ID NO: 4447741 - DNA, 19 bp, Homo sapiens
agcacccgtggtgcatggt

SEQ ID NO: 4447742 - DNA, 24 bp, Homo sapiens
agcaccctataaatcaacacctta

SEQ ID NO: 4447743 - DNA, 14 bp, Homo sapiens
agcaccctcccccg

SEQ ID NO: 4447744 - DNA, 17 bp, Homo sapiens
agcaccgtgatggagag

SEQ ID NO: 4447745 - DNA, 14 bp, Homo sapiens
agcacctacagtgt

SEQ ID NO: 4447746 - DNA, 14 bp, Homo sapiens
agcacctccccgct

SEQ ID NO: 4447747 - DNA, 16 bp, Homo sapiens
agcacctgccgacctc

SEQ ID NO: 4447748 - DNA, 21 bp, Homo sapiens
agcacctgccgacctcgtcct

SEQ ID NO: 4447749 - DNA, 14 bp, Homo sapiens
agcaccttcagggc

SEQ ID NO: 4447750 - DNA, 16 bp, Homo sapiens
agcaccttcagggctg

SEQ ID NO: 4447751 - DNA, 18 bp, Homo sapiens
agcaccttcagggctgag

SEQ ID NO: 4447752 - DNA, 14 bp, Homo sapiens
agcacctttctagc

SEQ ID NO: 4447753 - DNA, 17 bp, Homo sapiens
agcacgattttgcacaa

SEQ ID NO: 4447754 - DNA, 17 bp, Homo sapiens
agcacggactcttactg

SEQ ID NO: 4447755 - DNA, 13 bp, Homo sapiens
agcacgtggagat

SEQ ID NO: 4447756 - DNA, 16 bp, Homo sapiens
agcacgtttaaagttc

SEQ ID NO: 4447757 - DNA, 19 bp, Homo sapiens
agcactaaccaatgccttt

SEQ ID NO: 4447758 - DNA, 17 bp, Homo sapiens
agcactaaggccgtgtc

SEQ ID NO: 4447759 - DNA, 14 bp, Homo sapiens
agcactaaggtgga

SEQ ID NO: 4447760 - DNA, 22 bp, Homo sapiens
agcactaaggtggacagcagac

SEQ ID NO: 4447761 - DNA, 15 bp, Homo sapiens
agcactactgggtgt

SEQ ID NO: 4447762 - DNA, 14 bp, Homo sapiens
agcactagaagtgg

SEQ ID NO: 4447763 - DNA, 13 bp, Homo sapiens
agcactagagaat

SEQ ID NO: 4447764 - DNA, 15 bp, Homo sapiens
agcactagagaatgc

SEQ ID NO: 4447765 - DNA, 16 bp, Homo sapiens
agcactagagaatgca

SEQ ID NO: 4447766 - DNA, 20 bp, Homo sapiens
agcactagagaatgcacaga

SEQ ID NO: 4447767 - DNA, 15 bp, Homo sapiens
agcactaggcaccca

SEQ ID NO: 4447768 - DNA, 17 bp, Homo sapiens
agcactatgctttcctt

SEQ ID NO: 4447769 - DNA, 15 bp, Homo sapiens
agcactcctggtgca

SEQ ID NO: 4447770 - DNA, 18 bp, Homo sapiens
agcactcggggtccctgg

SEQ ID NO: 4447771 - DNA, 19 bp, Homo sapiens
agcactcggggtccctgga

SEQ ID NO: 4447772 - DNA, 20 bp, Homo sapiens
agcactcggggtccctggag

SEQ ID NO: 4447773 - DNA, 15 bp, Homo sapiens
agcactgaactgctt

SEQ ID NO: 4447774 - DNA, 12 bp, Homo sapiens
agcactgagctc

SEQ ID NO: 4447775 - DNA, 11 bp, Homo sapiens
agcactgagga

SEQ ID NO: 4447776 - DNA, 14 bp, Homo sapiens
agcactgaggaaga

SEQ ID NO: 4447777 - DNA, 20 bp, Homo sapiens
agcactgcatgtcagagcac

SEQ ID NO: 4447778 - DNA, 19 bp, Homo sapiens
agcactgccccacatgcat

SEQ ID NO: 4447779 - DNA, 21 bp, Homo sapiens
agcactggtttcaagaatatg

SEQ ID NO: 4447780 - DNA, 15 bp, Homo sapiens
agcactgtggacacc

SEQ ID NO: 4447781 - DNA, 23 bp, Homo sapiens
agcacttaaacagaagcagaggc

SEQ ID NO: 4447782 - DNA, 19 bp, Homo sapiens
agcacttagacctgccagc

SEQ ID NO: 4447783 - DNA, 14 bp, Homo sapiens
agcacttcccagga

SEQ ID NO: 4447784 - DNA, 12 bp, Homo sapiens
agcacttctaga

SEQ ID NO: 4447785 - DNA, 13 bp, Homo sapiens
agcacttgctgta

SEQ ID NO: 4447786 - DNA, 22 bp, Homo sapiens
agcactttaaaaacaggccagc

SEQ ID NO: 4447787 - DNA, 23 bp, Homo sapiens
agcactttaaaaacaggccagcc

SEQ ID NO: 4447788 - DNA, 19 bp, Homo sapiens
agcactttcattgccagtg

SEQ ID NO: 4447789 - DNA, 17 bp, Homo sapiens
agcactttgggaggccg

SEQ ID NO: 4447790 - DNA, 13 bp, Homo sapiens
agcagaaagaaga

SEQ ID NO: 4447791 - DNA, 21 bp, Homo sapiens
agcagaaagtaagcatttcca

SEQ ID NO: 4447792 - DNA, 12 bp, Homo sapiens
agcagaacactg

SEQ ID NO: 4447793 - DNA, 16 bp, Homo sapiens
agcagaagggggtggt

SEQ ID NO: 4447794 - DNA, 22 bp, Homo sapiens
agcagaagggggtggtgtctcc

SEQ ID NO: 4447795 - DNA, 15 bp, Homo sapiens
agcagaattcattca

SEQ ID NO: 4447796 - DNA, 21 bp, Homo sapiens
agcagacaataacttcttaaa

SEQ ID NO: 4447797 - DNA, 17 bp, Homo sapiens
agcagacaccattcatt

SEQ ID NO: 4447798 - DNA, 18 bp, Homo sapiens
agcagacaccattcattc

SEQ ID NO: 4447799 - DNA, 15 bp, Homo sapiens
agcagacagccctgg

SEQ ID NO: 4447800 - DNA, 20 bp, Homo sapiens
agcagacaggcctggccctg

SEQ ID NO: 4447801 - DNA, 16 bp, Homo sapiens
agcagacattgttaca

SEQ ID NO: 4447802 - DNA, 17 bp, Homo sapiens
agcagacattgttacaa

SEQ ID NO: 4447803 - DNA, 16 bp, Homo sapiens
agcagacatttatctt

SEQ ID NO: 4447804 - DNA, 13 bp, Homo sapiens
agcagaccagcac

SEQ ID NO: 4447805 - DNA, 22 bp, Homo sapiens
agcagaccattggggctcccag

SEQ ID NO: 4447806 - DNA, 21 bp, Homo sapiens
agccagcgtcctcctctgtga

SEQ ID NO: 4447807 - DNA, 12 bp, Homo sapiens
agccagctgcag

SEQ ID NO: 4447808 - DNA, 13 bp, Homo sapiens
agccagctgcaga

SEQ ID NO: 4447809 - DNA, 14 bp, Homo sapiens
agccagcttaaacc

SEQ ID NO: 4447810 - DNA, 16 bp, Homo sapiens
agccagctttccctgc

SEQ ID NO: 4447811 - DNA, 22 bp, Homo sapiens
agccagctttccctgcctctca

SEQ ID NO: 4447812 - DNA, 16 bp, Homo sapiens
agccaggagcagccct

SEQ ID NO: 4447813 - DNA, 18 bp, Homo sapiens
agccaggagcagccctgg

SEQ ID NO: 4447814 - DNA, 20 bp, Homo sapiens
agccaggagcagccctggcc

SEQ ID NO: 4447815 - DNA, 20 bp, Homo sapiens
agccaggagtgcccccggga

SEQ ID NO: 4447816 - DNA, 18 bp, Homo sapiens
agccaggcacacactgtg

SEQ ID NO: 4447817 - DNA, 20 bp, Homo sapiens
agccaggctgccaaggccag

SEQ ID NO: 4447818 - DNA, 15 bp, Homo sapiens
agccaggcttttctc

SEQ ID NO: 4447819 - DNA, 13 bp, Homo sapiens
agccagggcaggg

SEQ ID NO: 4447820 - DNA, 15 bp, Homo sapiens
agccagggcagggcg

SEQ ID NO: 4447821 - DNA, 12 bp, Homo sapiens
agccagggctgg

SEQ ID NO: 4447822 - DNA, 16 bp, Homo sapiens
agccaggtgccttgga

SEQ ID NO: 4447823 - DNA, 17 bp, Homo sapiens
agccaggtgccttggag

SEQ ID NO: 4447824 - DNA, 15 bp, Homo sapiens
agccaggtggcacct

SEQ ID NO: 4447825 - DNA, 17 bp, Homo sapiens
agccaggtttagcggca

SEQ ID NO: 4447826 - DNA, 21 bp, Homo sapiens
agccagtgacctttgacctcg

SEQ ID NO: 4447827 - DNA, 23 bp, Homo sapiens
agccagtggcgggtgatggccag

SEQ ID NO: 4447828 - DNA, 14 bp, Homo sapiens
agccatacacatgg

SEQ ID NO: 4447829 - DNA, 16 bp, Homo sapiens
agccatactgcgtcca

SEQ ID NO: 4447830 - DNA, 20 bp, Homo sapiens
agccatactgcgtccaccct

SEQ ID NO: 4447831 - DNA, 16 bp, Homo sapiens
agccatacttatctct

SEQ ID NO: 4447832 - DNA, 16 bp, Homo sapiens
agccataggtgcagtt

SEQ ID NO: 4447833 - DNA, 13 bp, Homo sapiens
agccatcaaaatg

SEQ ID NO: 4447834 - DNA, 15 bp, Homo sapiens
agccatcaaaatgct

SEQ ID NO: 4447835 - DNA, 18 bp, Homo sapiens
agccatcaaaatgctttt

SEQ ID NO: 4447836 - DNA, 14 bp, Homo sapiens
agccatcaagcact

SEQ ID NO: 4447837 - DNA, 19 bp, Homo sapiens
agccatcaagcacttccca

SEQ ID NO: 4447838 - DNA, 16 bp, Homo sapiens
agccatcacttctccc

SEQ ID NO: 4447839 - DNA, 20 bp, Homo sapiens
agccatcacttctccccgca

SEQ ID NO: 4447840 - DNA, 16 bp, Homo sapiens
agccatcctccctcca

SEQ ID NO: 4447841 - DNA, 23 bp, Homo sapiens
agccatcctccctccacctcaag

SEQ ID NO: 4447842 - DNA, 22 bp, Homo sapiens
agccatcgtcctgggactcgga

SEQ ID NO: 4447843 - DNA, 23 bp, Homo sapiens
agccatctaatgcttgtttatga

SEQ ID NO: 4447844 - DNA, 14 bp, Homo sapiens
agccatcttggcag

SEQ ID NO: 4447845 - DNA, 17 bp, Homo sapiens
agccatcttggcagggt

SEQ ID NO: 4447846 - DNA, 18 bp, Homo sapiens
agccatgaggagttgctg

SEQ ID NO: 4447847 - DNA, 21 bp, Homo sapiens
agccatgatttcccactgcac

SEQ ID NO: 4447848 - DNA, 20 bp, Homo sapiens
agccatgctacagttagtct

SEQ ID NO: 4447849 - DNA, 21 bp, Homo sapiens
agccattaaatgaatattttg

SEQ ID NO: 4447850 - DNA, 22 bp, Homo sapiens
agccattaaatgaatattttga

SEQ ID NO: 4447851 - DNA, 22 bp, Homo sapiens
agccatttcactctcaaacttc

SEQ ID NO: 4447852 - DNA, 19 bp, Homo sapiens
agccatttttcaaagcaat

SEQ ID NO: 4447853 - DNA, 14 bp, Homo sapiens
agcccaagaggact

SEQ ID NO: 4447854 - DNA, 21 bp, Homo sapiens
agcccaagaggtctgagccct

SEQ ID NO: 4447855 - DNA, 16 bp, Homo sapiens
agcccaaggtcaggga

SEQ ID NO: 4447856 - DNA, 17 bp, Homo sapiens
agcccaaggtcagggag

SEQ ID NO: 4447857 - DNA, 18 bp, Homo sapiens
agcccaaggtcagggagg

SEQ ID NO: 4447858 - DNA, 23 bp, Homo sapiens
agcccaccagacgtcaggccctg

SEQ ID NO: 4447859 - DNA, 22 bp, Homo sapiens
agcccacccccctccccaactc

SEQ ID NO: 4447860 - DNA, 19 bp, Homo sapiens
agcccaccctcctgtcttc

SEQ ID NO: 4447861 - DNA, 20 bp, Homo sapiens
agcccacgtcaggcctggcc

SEQ ID NO: 4447862 - DNA, 22 bp, Homo sapiens
agcccacgtcaggcctggcctc

SEQ ID NO: 4447863 - DNA, 16 bp, Homo sapiens
agcccactgaggggcc

SEQ ID NO: 4447864 - DNA, 20 bp, Homo sapiens
agcccagatggaaagacgtt

SEQ ID NO: 4447865 - DNA, 21 bp, Homo sapiens
agcccagcactgcttgaggaa

SEQ ID NO: 4447866 - DNA, 14 bp, Homo sapiens
agcccagcctggga

SEQ ID NO: 4447867 - DNA, 14 bp, Homo sapiens
agcccagctctgaa

SEQ ID NO: 4447868 - DNA, 16 bp, Homo sapiens
agcccagctggtggga

SEQ ID NO: 4447869 - DNA, 23 bp, Homo sapiens
agcccagcttggccctttccttc

SEQ ID NO: 4447870 - DNA, 16 bp, Homo sapiens
agcccaggagcctcac

SEQ ID NO: 4447871 - DNA, 17 bp, Homo sapiens
agcccaggagcctcact

SEQ ID NO: 4447872 - DNA, 20 bp, Homo sapiens
agcccagtccactgagcaag

SEQ ID NO: 4447873 - DNA, 16 bp, Homo sapiens
agcccagtgaagcctc

SEQ ID NO: 4447874 - DNA, 18 bp, Homo sapiens
agcccagtgaagcctctg

SEQ ID NO: 4447875 - DNA, 15 bp, Homo sapiens
agcccatcctgacca

SEQ ID NO: 4447876 - DNA, 11 bp, Homo sapiens
agcccatgccc

SEQ ID NO: 4447877 - DNA, 20 bp, Homo sapiens
agcccatgcccacctgccca

SEQ ID NO: 4447878 - DNA, 18 bp, Homo sapiens
agcccatggcactctatg

SEQ ID NO: 4447879 - DNA, 15 bp, Homo sapiens
agcccatggccccca

SEQ ID NO: 4447880 - DNA, 18 bp, Homo sapiens
agcccatggcccccaata

SEQ ID NO: 4447881 - DNA, 20 bp, Homo sapiens
agcccatggcccccaataaa

SEQ ID NO: 4447882 - DNA, 21 bp, Homo sapiens
agcccatggcccccaataaag

SEQ ID NO: 4447883 - DNA, 22 bp, Homo sapiens
agcccatggcccccaataaagg

SEQ ID NO: 4447884 - DNA, 17 bp, Homo sapiens
agcccattctctctcct

SEQ ID NO: 4447885 - DNA, 18 bp, Homo sapiens
agcccattctctctcctg

SEQ ID NO: 4447886 - DNA, 21 bp, Homo sapiens
agcccattctctctcctgtcc

SEQ ID NO: 4447887 - DNA, 15 bp, Homo sapiens
agcccattcttctgg

SEQ ID NO: 4447888 - DNA, 19 bp, Homo sapiens
agcccattggccgagctcc

SEQ ID NO: 4447889 - DNA, 21 bp, Homo sapiens
agcccattggccgagctcctg

SEQ ID NO: 4447890 - DNA, 22 bp, Homo sapiens
agcccattggccgagctcctgg

SEQ ID NO: 4447891 - DNA, 21 bp, Homo sapiens
agccccaactccaggggcacc

SEQ ID NO: 4447892 - DNA, 22 bp, Homo sapiens
agccccaactccaggggcacct

SEQ ID NO: 4447893 - DNA, 12 bp, Homo sapiens
agccccacccag

SEQ ID NO: 4447894 - DNA, 13 bp, Homo sapiens
agccccacccagg

SEQ ID NO: 4447895 - DNA, 15 bp, Homo sapiens
agccccacccaggag

SEQ ID NO: 4447896 - DNA, 12 bp, Homo sapiens
agccccacttca

SEQ ID NO: 4447897 - DNA, 17 bp, Homo sapiens
agccccacttcaccccc

SEQ ID NO: 4447898 - DNA, 11 bp, Homo sapiens
agccccagccc

SEQ ID NO: 4447899 - DNA, 14 bp, Homo sapiens
agccccagcccaga

SEQ ID NO: 4447900 - DNA, 12 bp, Homo sapiens
agccccagcccc

SEQ ID NO: 4447901 - DNA, 14 bp, Homo sapiens
agccccagccccct

SEQ ID NO: 4447902 - DNA, 12 bp, Homo sapiens
agccccaggaga

SEQ ID NO: 4447903 - DNA, 15 bp, Homo sapiens
agccccaggccagct

SEQ ID NO: 4447904 - DNA, 20 bp, Homo sapiens
agccccagggtcttccctac

SEQ ID NO: 4447905 - DNA, 16 bp, Homo sapiens
agccccattcctggga

SEQ ID NO: 4447906 - DNA, 17 bp, Homo sapiens
agcccccagcagaggca

SEQ ID NO: 4447907 - DNA, 19 bp, Homo sapiens
agcccccagcagaggcagg

SEQ ID NO: 4447908 - DNA, 23 bp, Homo sapiens
agcccccagcagaggcaggctgg

SEQ ID NO: 4447909 - DNA, 13 bp, Homo sapiens
agccccccagcac

SEQ ID NO: 4447910 - DNA, 19 bp, Homo sapiens
agcccccctgctgctgccc

SEQ ID NO: 4447911 - DNA, 13 bp, Homo sapiens
agccccctcatct

SEQ ID NO: 4447912 - DNA, 23 bp, Homo sapiens
agccccctcatctgcaggacaga

SEQ ID NO: 4447913 - DNA, 21 bp, Homo sapiens
agccccctttgggcccaggga

SEQ ID NO: 4447914 - DNA, 16 bp, Homo sapiens
agccccgactccagcc

SEQ ID NO: 4447915 - DNA, 22 bp, Homo sapiens
agccccgactccagccagcgcc

SEQ ID NO: 4447916 - DNA, 13 bp, Homo sapiens
agccccgcctgtc

SEQ ID NO: 4447917 - DNA, 15 bp, Homo sapiens
agccccggcaagcca

SEQ ID NO: 4447918 - DNA, 16 bp, Homo sapiens
agccccggcaagccac

SEQ ID NO: 4447919 - DNA, 14 bp, Homo sapiens
agccccggcccccc

SEQ ID NO: 4447920 - DNA, 19 bp, Homo sapiens
agccccggggccccctggt

SEQ ID NO: 4447921 - DNA, 24 bp, Homo sapiens
agccccggggtgagtccattctcc

SEQ ID NO: 4447922 - DNA, 18 bp, Homo sapiens
agccccgtggggttcctc

SEQ ID NO: 4447923 - DNA, 18 bp, Homo sapiens
agcccctatagcactgag

SEQ ID NO: 4447924 - DNA, 22 bp, Homo sapiens
agcctcagagatctcccttctc

SEQ ID NO: 4447925 - DNA, 17 bp, Homo sapiens
agcctcatactcctggg

SEQ ID NO: 4447926 - DNA, 18 bp, Homo sapiens
agcctcatactcctgggc

SEQ ID NO: 4447927 - DNA, 19 bp, Homo sapiens
agcctcatactcctgggct

SEQ ID NO: 4447928 - DNA, 19 bp, Homo sapiens
agcctcatccagcctcaga

SEQ ID NO: 4447929 - DNA, 21 bp, Homo sapiens
agcctcatccagcctcagaga

SEQ ID NO: 4447930 - DNA, 20 bp, Homo sapiens
agcctccaagcacagagcct

SEQ ID NO: 4447931 - DNA, 19 bp, Homo sapiens
agcctccaagcctgcctcc

SEQ ID NO: 4447932 - DNA, 22 bp, Homo sapiens
agcctccaccccacaacccaaa

SEQ ID NO: 4447933 - DNA, 16 bp, Homo sapiens
agcctccagcctctgt

SEQ ID NO: 4447934 - DNA, 18 bp, Homo sapiens
agcctccagcctctgttc

SEQ ID NO: 4447935 - DNA, 16 bp, Homo sapiens
agcctcccaaggagaa

SEQ ID NO: 4447936 - DNA, 19 bp, Homo sapiens
agcctcccaaggagaacaa

SEQ ID NO: 4447937 - DNA, 21 bp, Homo sapiens
agcctcccaaggagaacaaat

SEQ ID NO: 4447938 - DNA, 17 bp, Homo sapiens
agcctcccaccagagcc

SEQ ID NO: 4447939 - DNA, 21 bp, Homo sapiens
agcctcccaccagagccggga

SEQ ID NO: 4447940 - DNA, 21 bp, Homo sapiens
agcctccccatctgtccagct

SEQ ID NO: 4447941 - DNA, 22 bp, Homo sapiens
agcctccccatctgtccagctg

SEQ ID NO: 4447942 - DNA, 23 bp, Homo sapiens
agcctccccctcagatgatctct

SEQ ID NO: 4447943 - DNA, 13 bp, Homo sapiens
agcctcccctccc

SEQ ID NO: 4447944 - DNA, 17 bp, Homo sapiens
agcctcccctcccctgg

SEQ ID NO: 4447945 - DNA, 20 bp, Homo sapiens
agcctcccctcccctgggga

SEQ ID NO: 4447946 - DNA, 15 bp, Homo sapiens
agcctcccctgccag

SEQ ID NO: 4447947 - DNA, 22 bp, Homo sapiens
agcctcccctgccagggcaggg

SEQ ID NO: 4447948 - DNA, 12 bp, Homo sapiens
agcctccctgaa

SEQ ID NO: 4447949 - DNA, 12 bp, Homo sapiens
agcctcctctgt

SEQ ID NO: 4447950 - DNA, 15 bp, Homo sapiens
agcctcctctgtctg

SEQ ID NO: 4447951 - DNA, 16 bp, Homo sapiens
agcctcctctgtctgc

SEQ ID NO: 4447952 - DNA, 17 bp, Homo sapiens
agcctcctgccccctgc

SEQ ID NO: 4447953 - DNA, 19 bp, Homo sapiens
agcctcctgccccctgcca

SEQ ID NO: 4447954 - DNA, 20 bp, Homo sapiens
agcctcctgccccctgccag

SEQ ID NO: 4447955 - DNA, 18 bp, Homo sapiens
agcctcctgtacctcagt

SEQ ID NO: 4447956 - DNA, 15 bp, Homo sapiens
agcctcctgtgcctg

SEQ ID NO: 4447957 - DNA, 21 bp, Homo sapiens
agcctcgttggaagaggaaca

SEQ ID NO: 4447958 - DNA, 17 bp, Homo sapiens
agcctctacagccgtcc

SEQ ID NO: 4447959 - DNA, 17 bp, Homo sapiens
agcctctcccacccggc

SEQ ID NO: 4447960 - DNA, 18 bp, Homo sapiens
agcctctcccacccggcc

SEQ ID NO: 4447961 - DNA, 15 bp, Homo sapiens
agcctctccccgctc

SEQ ID NO: 4447962 - DNA, 18 bp, Homo sapiens
agcctctccgactctgca

SEQ ID NO: 4447963 - DNA, 20 bp, Homo sapiens
agcctctccgactctgcacc

SEQ ID NO: 4447964 - DNA, 14 bp, Homo sapiens
agcctctcctttgt

SEQ ID NO: 4447965 - DNA, 18 bp, Homo sapiens
agcctctctcccagtcta

SEQ ID NO: 4447966 - DNA, 22 bp, Homo sapiens
agcctctctccttggccacaga

SEQ ID NO: 4447967 - DNA, 22 bp, Homo sapiens
agcctctgcagcggaatctgtt

SEQ ID NO: 4447968 - DNA, 10 bp, Homo sapiens
agcctctgcc

SEQ ID NO: 4447969 - DNA, 17 bp, Homo sapiens
agcctctgccgctgcca

SEQ ID NO: 4447970 - DNA, 18 bp, Homo sapiens
agcctctgccgctgccat

SEQ ID NO: 4447971 - DNA, 19 bp, Homo sapiens
agcctctgccgctgccatg

SEQ ID NO: 4447972 - DNA, 14 bp, Homo sapiens
agcctctggacagc

SEQ ID NO: 4447973 - DNA, 15 bp, Homo sapiens
agcctctggcccctc

SEQ ID NO: 4447974 - DNA, 16 bp, Homo sapiens
agcctctggcccctca

SEQ ID NO: 4447975 - DNA, 17 bp, Homo sapiens
agcctctggcccctcac

SEQ ID NO: 4447976 - DNA, 11 bp, Homo sapiens
agcctctgtcc

SEQ ID NO: 4447977 - DNA, 18 bp, Homo sapiens
agcctgaactgagcccca

SEQ ID NO: 4447978 - DNA, 23 bp, Homo sapiens
agcctgaattgctttctgctctt

SEQ ID NO: 4447979 - DNA, 22 bp, Homo sapiens
agcctgaatttgggatggaagc

SEQ ID NO: 4447980 - DNA, 20 bp, Homo sapiens
agcctgaccaacatggagaa

SEQ ID NO: 4447981 - DNA, 18 bp, Homo sapiens
agcctgaccctcatcttt

SEQ ID NO: 4447982 - DNA, 23 bp, Homo sapiens
agcctgacgctcagccccaggcc

SEQ ID NO: 4447983 - DNA, 15 bp, Homo sapiens
agcctgagtgacaga

SEQ ID NO: 4447984 - DNA, 22 bp, Homo sapiens
agcctgatctttgggcatcaga

SEQ ID NO: 4447985 - DNA, 18 bp, Homo sapiens
agcctgatgagattttta

SEQ ID NO: 4447986 - DNA, 22 bp, Homo sapiens
agcctgcacccctccggccccg

SEQ ID NO: 4447987 - DNA, 24 bp, Homo sapiens
agcctgcacccctccggccccgtc

SEQ ID NO: 4447988 - DNA, 16 bp, Homo sapiens
agcctgcactttgatg

SEQ ID NO: 4447989 - DNA, 23 bp, Homo sapiens
agcctgcactttgatgtcatgtg

SEQ ID NO: 4447990 - DNA, 23 bp, Homo sapiens
agcctgcattgagcttgcatgct

SEQ ID NO: 4447991 - DNA, 13 bp, Homo sapiens
agcctgcctggag

SEQ ID NO: 4447992 - DNA, 14 bp, Homo sapiens
agcctgcctggagc

SEQ ID NO: 4447993 - DNA, 14 bp, Homo sapiens
agcctgctccccca

SEQ ID NO: 4447994 - DNA, 15 bp, Homo sapiens
agcctgctcccccac

SEQ ID NO: 4447995 - DNA, 13 bp, Homo sapiens
agcctgctctccc

SEQ ID NO: 4447996 - DNA, 15 bp, Homo sapiens
agcctgctctcccta

SEQ ID NO: 4447997 - DNA, 10 bp, Homo sapiens
agcctgctgg

SEQ ID NO: 4447998 - DNA, 17 bp, Homo sapiens
agcctgctggcacccac

SEQ ID NO: 4447999 - DNA, 18 bp, Homo sapiens
agcctgctggcacccacc

SEQ ID NO: 4448000 - DNA, 13 bp, Homo sapiens
agcctgctggctg

SEQ ID NO: 4448001 - DNA, 18 bp, Homo sapiens
agcctgctggctgcggcc

SEQ ID NO: 4448002 - DNA, 19 bp, Homo sapiens
agcctgctggctgcggccc

SEQ ID NO: 4448003 - DNA, 22 bp, Homo sapiens
agcctgctggtcacagcctcct

SEQ ID NO: 4448004 - DNA, 13 bp, Homo sapiens
agcctggatgcca

SEQ ID NO: 4448005 - DNA, 18 bp, Homo sapiens
agcctggccaacatggtg

SEQ ID NO: 4448006 - DNA, 14 bp, Homo sapiens
agcctggccaccag

SEQ ID NO: 4448007 - DNA, 21 bp, Homo sapiens
agcctggccccaggccccaga

SEQ ID NO: 4448008 - DNA, 17 bp, Homo sapiens
agcctggccccatggtc

SEQ ID NO: 4448009 - DNA, 13 bp, Homo sapiens
agcctggctctgc

SEQ ID NO: 4448010 - DNA, 19 bp, Homo sapiens
agcctggctctgccccgca

SEQ ID NO: 4448011 - DNA, 17 bp, Homo sapiens
agcctgggagcccagag

SEQ ID NO: 4448012 - DNA, 18 bp, Homo sapiens
agcctgggagcccagagg

SEQ ID NO: 4448013 - DNA, 23 bp, Homo sapiens
agcctgggcaacgagtgaaactc

SEQ ID NO: 4448014 - DNA, 18 bp, Homo sapiens
agcctgggcagccaggct

SEQ ID NO: 4448015 - DNA, 19 bp, Homo sapiens
agcctgggcagccaggctg

SEQ ID NO: 4448016 - DNA, 20 bp, Homo sapiens
agcctgggcagccaggctgc

SEQ ID NO: 4448017 - DNA, 16 bp, Homo sapiens
agcctggggtgttctc

SEQ ID NO: 4448018 - DNA, 20 bp, Homo sapiens
agcctgggtgtcaagtgcct

SEQ ID NO: 4448019 - DNA, 16 bp, Homo sapiens
agcctggtccttccct

SEQ ID NO: 4448020 - DNA, 22 bp, Homo sapiens
agcctggtccttccctgatggc

SEQ ID NO: 4448021 - DNA, 18 bp, Homo sapiens
agcctgtaatcccagcta

SEQ ID NO: 4448022 - DNA, 16 bp, Homo sapiens
agcctgtgcaaaaaaa

SEQ ID NO: 4448023 - DNA, 14 bp, Homo sapiens
agcctgtggcatct

SEQ ID NO: 4448024 - DNA, 21 bp, Homo sapiens
agcctgttccataggaaggct

SEQ ID NO: 4448025 - DNA, 14 bp, Homo sapiens
agcctgtttctatc

SEQ ID NO: 4448026 - DNA, 23 bp, Homo sapiens
agcctgtttctatcctgtttaat

SEQ ID NO: 4448027 - DNA, 14 bp, Homo sapiens
agccttaactttaa

SEQ ID NO: 4448028 - DNA, 20 bp, Homo sapiens
agccttaccttgaaatgctg

SEQ ID NO: 4448029 - DNA, 16 bp, Homo sapiens
agccttagcagccctg

SEQ ID NO: 4448030 - DNA, 14 bp, Homo sapiens
agccttagggaagc

SEQ ID NO: 4448031 - DNA, 20 bp, Homo sapiens
agccttatgaaaattatact

SEQ ID NO: 4448032 - DNA, 16 bp, Homo sapiens
agccttatgtgttaca

SEQ ID NO: 4448033 - DNA, 18 bp, Homo sapiens
agccttatgtgttacatt

SEQ ID NO: 4448034 - DNA, 19 bp, Homo sapiens
agccttatttacctagtgc

SEQ ID NO: 4448035 - DNA, 18 bp, Homo sapiens
agccttcaagaatcagaa

SEQ ID NO: 4448036 - DNA, 12 bp, Homo sapiens
agccttcaagtg

SEQ ID NO: 4448037 - DNA, 13 bp, Homo sapiens
agccttcaagtgc

SEQ ID NO: 4448038 - DNA, 17 bp, Homo sapiens
agccttcaagtgccaaa

SEQ ID NO: 4448039 - DNA, 18 bp, Homo sapiens
agccttcaagtgccaaac

SEQ ID NO: 4448040 - DNA, 17 bp, Homo sapiens
agccttccaactagctg

SEQ ID NO: 4448041 - DNA, 12 bp, Homo sapiens
agccttccagtt

SEQ ID NO: 4448042 - DNA, 17 bp, Homo sapiens
agctattttagaaagct

SEQ ID NO: 4448043 - DNA, 19 bp, Homo sapiens
agctattttagaaagctaa

SEQ ID NO: 4448044 - DNA, 17 bp, Homo sapiens
agctattttcctctggc

SEQ ID NO: 4448045 - DNA, 21 bp, Homo sapiens
agctatttttttcctaagaca

SEQ ID NO: 4448046 - DNA, 22 bp, Homo sapiens
agctatttttttcctaagacat

SEQ ID NO: 4448047 - DNA, 18 bp, Homo sapiens
agctcaaaaatactcttg

SEQ ID NO: 4448048 - DNA, 20 bp, Homo sapiens
agctcaaaaatactcttgat

SEQ ID NO: 4448049 - DNA, 19 bp, Homo sapiens
agctcaactttctgttgga

SEQ ID NO: 4448050 - DNA, 14 bp, Homo sapiens
agctcacacatcct

SEQ ID NO: 4448051 - DNA, 20 bp, Homo sapiens
agctcacagttcctcgccct

SEQ ID NO: 4448052 - DNA, 21 bp, Homo sapiens
agctcacagttcctcgccctg

SEQ ID NO: 4448053 - DNA, 14 bp, Homo sapiens
agctcaccccccac

SEQ ID NO: 4448054 - DNA, 17 bp, Homo sapiens
agctcaccccccacact

SEQ ID NO: 4448055 - DNA, 23 bp, Homo sapiens
agctcacttctgggcttcatctg

SEQ ID NO: 4448056 - DNA, 23 bp, Homo sapiens
agctcagacttgccaggctccct

SEQ ID NO: 4448057 - DNA, 21 bp, Homo sapiens
agctcaggaaccgaggcaggg

SEQ ID NO: 4448058 - DNA, 19 bp, Homo sapiens
agctcaggaattccctgga

SEQ ID NO: 4448059 - DNA, 23 bp, Homo sapiens
agctcaggaggcgaataaatgtt

SEQ ID NO: 4448060 - DNA, 20 bp, Homo sapiens
agctcagtaacataactgct

SEQ ID NO: 4448061 - DNA, 22 bp, Homo sapiens
agctcagtaacataactgcttc

SEQ ID NO: 4448062 - DNA, 14 bp, Homo sapiens
agctcatccctgga

SEQ ID NO: 4448063 - DNA, 16 bp, Homo sapiens
agctcatctgcaaaag

SEQ ID NO: 4448064 - DNA, 16 bp, Homo sapiens
agctcattaaactttt

SEQ ID NO: 4448065 - DNA, 18 bp, Homo sapiens
agctcattaaactttttt

SEQ ID NO: 4448066 - DNA, 19 bp, Homo sapiens
agctccaaatccaaggaaa

SEQ ID NO: 4448067 - DNA, 18 bp, Homo sapiens
agctccacacgccccggt

SEQ ID NO: 4448068 - DNA, 13 bp, Homo sapiens
agctccagcgatg

SEQ ID NO: 4448069 - DNA, 14 bp, Homo sapiens
agctccagggactg

SEQ ID NO: 4448070 - DNA, 22 bp, Homo sapiens
agctccatcaatgaggtatctt

SEQ ID NO: 4448071 - DNA, 19 bp, Homo sapiens
agctccatgtgcctctttg

SEQ ID NO: 4448072 - DNA, 18 bp, Homo sapiens
agctccatgttctcccaa

SEQ ID NO: 4448073 - DNA, 15 bp, Homo sapiens
agctcccaccccacc

SEQ ID NO: 4448074 - DNA, 17 bp, Homo sapiens
agctcccaccccacccc

SEQ ID NO: 4448075 - DNA, 13 bp, Homo sapiens
agctcccattcta

SEQ ID NO: 4448076 - DNA, 20 bp, Homo sapiens
agctcccccgtggtgcctgc

SEQ ID NO: 4448077 - DNA, 22 bp, Homo sapiens
agctcccctcggagaagagctg

SEQ ID NO: 4448078 - DNA, 12 bp, Homo sapiens
agctcccctctt

SEQ ID NO: 4448079 - DNA, 17 bp, Homo sapiens
agctcccctggctggct

SEQ ID NO: 4448080 - DNA, 18 bp, Homo sapiens
agctcccctggctggctc

SEQ ID NO: 4448081 - DNA, 20 bp, Homo sapiens
agctcccctggctggctcct

SEQ ID NO: 4448082 - DNA, 16 bp, Homo sapiens
agctccctggcttctg

SEQ ID NO: 4448083 - DNA, 18 bp, Homo sapiens
agctccgggatcagcaac

SEQ ID NO: 4448084 - DNA, 20 bp, Homo sapiens
agctccgggggtacagccct

SEQ ID NO: 4448085 - DNA, 14 bp, Homo sapiens
agctccgtggagca

SEQ ID NO: 4448086 - DNA, 17 bp, Homo sapiens
agctcctcaaagcctca

SEQ ID NO: 4448087 - DNA, 14 bp, Homo sapiens
agctcctccctcca

SEQ ID NO: 4448088 - DNA, 15 bp, Homo sapiens
agctcctccctccag

SEQ ID NO: 4448089 - DNA, 22 bp, Homo sapiens
agctcctccctccagctgcgac

SEQ ID NO: 4448090 - DNA, 23 bp, Homo sapiens
agctcctccctccagctgcgact

SEQ ID NO: 4448091 - DNA, 18 bp, Homo sapiens
agctcctggaccaggccc

SEQ ID NO: 4448092 - DNA, 19 bp, Homo sapiens
agctccttcctggagactg

SEQ ID NO: 4448093 - DNA, 16 bp, Homo sapiens
agctcctttcatgctc

SEQ ID NO: 4448094 - DNA, 18 bp, Homo sapiens
agctcctttctcctgtga

SEQ ID NO: 4448095 - DNA, 13 bp, Homo sapiens
agctcgatccaaa

SEQ ID NO: 4448096 - DNA, 13 bp, Homo sapiens
agctcgtgtgtcc

SEQ ID NO: 4448097 - DNA, 23 bp, Homo sapiens
agctcgtgtgtcctcatggagaa

SEQ ID NO: 4448098 - DNA, 17 bp, Homo sapiens
agctctactgcctcaac

SEQ ID NO: 4448099 - DNA, 18 bp, Homo sapiens
agctctaggctgttctgt

SEQ ID NO: 4448100 - DNA, 22 bp, Homo sapiens
agctctaggctgttctgtagct

SEQ ID NO: 4448101 - DNA, 14 bp, Homo sapiens
agctctcaggccga

SEQ ID NO: 4448102 - DNA, 17 bp, Homo sapiens
agctctcaggccgagag

SEQ ID NO: 4448103 - DNA, 19 bp, Homo sapiens
agctctccctctggccctg

SEQ ID NO: 4448104 - DNA, 23 bp, Homo sapiens
agctctccctctggccctgcctt

SEQ ID NO: 4448105 - DNA, 14 bp, Homo sapiens
agctctctctagaa

SEQ ID NO: 4448106 - DNA, 21 bp, Homo sapiens
agctctgaagaactctctgga

SEQ ID NO: 4448107 - DNA, 14 bp, Homo sapiens
agctctgagccaga

SEQ ID NO: 4448108 - DNA, 15 bp, Homo sapiens
agctctgagccagat

SEQ ID NO: 4448109 - DNA, 16 bp, Homo sapiens
agctctgagccagatt

SEQ ID NO: 4448110 - DNA, 17 bp, Homo sapiens
agctctgatctgaggct

SEQ ID NO: 4448111 - DNA, 12 bp, Homo sapiens
agctctgccccc

SEQ ID NO: 4448112 - DNA, 23 bp, Homo sapiens
agctctggctctgcctcaggagg

SEQ ID NO: 4448113 - DNA, 21 bp, Homo sapiens
agctctggggtgggcagtttt

SEQ ID NO: 4448114 - DNA, 22 bp, Homo sapiens
agctctggttatttttctcttg

SEQ ID NO: 4448115 - DNA, 18 bp, Homo sapiens
agctcttcaggcctccct

SEQ ID NO: 4448116 - DNA, 18 bp, Homo sapiens
agctcttcttaaagtatt

SEQ ID NO: 4448117 - DNA, 18 bp, Homo sapiens
agctcttgggtcagagaa

SEQ ID NO: 4448118 - DNA, 20 bp, Homo sapiens
agctcttgggtcagagaaaa

SEQ ID NO: 4448119 - DNA, 18 bp, Homo sapiens
agctcttttttgtttgtt

SEQ ID NO: 4448120 - DNA, 23 bp, Homo sapiens
agctcttttttgtttgtttcttt

SEQ ID NO: 4448121 - DNA, 12 bp, Homo sapiens
agctgaaacatg

SEQ ID NO: 4448122 - DNA, 16 bp, Homo sapiens
agctgacattgccaaa

SEQ ID NO: 4448123 - DNA, 18 bp, Homo sapiens
agctgacattgccaaaaa

SEQ ID NO: 4448124 - DNA, 22 bp, Homo sapiens
agctgactccagtataatctcc

SEQ ID NO: 4448125 - DNA, 19 bp, Homo sapiens
agctgagactacaagtgtg

SEQ ID NO: 4448126 - DNA, 14 bp, Homo sapiens
agctgagagccctg

SEQ ID NO: 4448127 - DNA, 16 bp, Homo sapiens
agctgagagccctgct

SEQ ID NO: 4448128 - DNA, 17 bp, Homo sapiens
agctgaggcagcagtgt

SEQ ID NO: 4448129 - DNA, 12 bp, Homo sapiens
agctgcaaagtg

SEQ ID NO: 4448130 - DNA, 13 bp, Homo sapiens
agctgcaaagtgt

SEQ ID NO: 4448131 - DNA, 21 bp, Homo sapiens
agctgcaaggtactctggtga

SEQ ID NO: 4448132 - DNA, 15 bp, Homo sapiens
agctgcacagggcag

SEQ ID NO: 4448133 - DNA, 21 bp, Homo sapiens
agctgcacagggcagctgggc

SEQ ID NO: 4448134 - DNA, 13 bp, Homo sapiens
agctgcactgtga

SEQ ID NO: 4448135 - DNA, 17 bp, Homo sapiens
agctgcagaagggtggg

SEQ ID NO: 4448136 - DNA, 18 bp, Homo sapiens
agctgcagctgagcctga

SEQ ID NO: 4448137 - DNA, 23 bp, Homo sapiens
agctgcatctataatgtcagctt

SEQ ID NO: 4448138 - DNA, 16 bp, Homo sapiens
agctgcccagccctgg

SEQ ID NO: 4448139 - DNA, 22 bp, Homo sapiens
agctgccctccttgtccaccca

SEQ ID NO: 4448140 - DNA, 18 bp, Homo sapiens
agctgcctctgctccctc

SEQ ID NO: 4448141 - DNA, 14 bp, Homo sapiens
agctgccttcaagg

SEQ ID NO: 4448142 - DNA, 18 bp, Homo sapiens
agctgccttcaaggactg

SEQ ID NO: 4448143 - DNA, 13 bp, Homo sapiens
agctgccttccct

SEQ ID NO: 4448144 - DNA, 18 bp, Homo sapiens
agctgccttccctagctt

SEQ ID NO: 4448145 - DNA, 19 bp, Homo sapiens
agctgccttccctagcttt

SEQ ID NO: 4448146 - DNA, 14 bp, Homo sapiens
agctgcggccaggc

SEQ ID NO: 4448147 - DNA, 16 bp, Homo sapiens
agctgcggccaggcct

SEQ ID NO: 4448148 - DNA, 13 bp, Homo sapiens
agctgctaaatct

SEQ ID NO: 4448149 - DNA, 18 bp, Homo sapiens
agctgctatccccatctc

SEQ ID NO: 4448150 - DNA, 19 bp, Homo sapiens
agctgctatccccatctcc

SEQ ID NO: 4448151 - DNA, 21 bp, Homo sapiens
agctgctatccccatctccct

SEQ ID NO: 4448152 - DNA, 16 bp, Homo sapiens
agctgctcccctggag

SEQ ID NO: 4448153 - DNA, 14 bp, Homo sapiens
agctgctctccttc

SEQ ID NO: 4448154 - DNA, 15 bp, Homo sapiens
agctgctgaaacaac

SEQ ID NO: 4448155 - DNA, 19 bp, Homo sapiens
agctgctgagatcctggac

SEQ ID NO: 4448156 - DNA, 20 bp, Homo sapiens
agctgctgagatcctggact

SEQ ID NO: 4448157 - DNA, 17 bp, Homo sapiens
agctgctggcttgcagt

SEQ ID NO: 4448158 - DNA, 14 bp, Homo sapiens
agctgcttccagtg

SEQ ID NO: 4448159 - DNA, 15 bp, Homo sapiens
agctgcttccagtgt

SEQ ID NO: 4448160 - DNA, 14 bp, Homo sapiens
aggaatttgtattt

SEQ ID NO: 4448161 - DNA, 16 bp, Homo sapiens
aggaatttgtattttg

SEQ ID NO: 4448162 - DNA, 14 bp, Homo sapiens
aggaattttaaaaa

SEQ ID NO: 4448163 - DNA, 23 bp, Homo sapiens
aggacaaatctaaaatgcaaaga

SEQ ID NO: 4448164 - DNA, 22 bp, Homo sapiens
aggacaacagttctgagctgta

SEQ ID NO: 4448165 - DNA, 23 bp, Homo sapiens
aggacaaccatgcaaattgtgaa

SEQ ID NO: 4448166 - DNA, 14 bp, Homo sapiens
aggacaagttttag

SEQ ID NO: 4448167 - DNA, 18 bp, Homo sapiens
aggacaagttttagttaa

SEQ ID NO: 4448168 - DNA, 16 bp, Homo sapiens
aggacacagttcctgg

SEQ ID NO: 4448169 - DNA, 21 bp, Homo sapiens
aggacacagttcctgggaaca

SEQ ID NO: 4448170 - DNA, 23 bp, Homo sapiens
aggacaccctccctccagggtcc

SEQ ID NO: 4448171 - DNA, 16 bp, Homo sapiens
aggacactaccctgag

SEQ ID NO: 4448172 - DNA, 17 bp, Homo sapiens
aggacactaccctgaga

SEQ ID NO: 4448173 - DNA, 17 bp, Homo sapiens
aggacagaatgtgttct

SEQ ID NO: 4448174 - DNA, 17 bp, Homo sapiens
aggacagagcaggggct

SEQ ID NO: 4448175 - DNA, 21 bp, Homo sapiens
aggacagagcaggggctccag

SEQ ID NO: 4448176 - DNA, 12 bp, Homo sapiens
aggacagagcca

SEQ ID NO: 4448177 - DNA, 15 bp, Homo sapiens
aggacagagggaagc

SEQ ID NO: 4448178 - DNA, 23 bp, Homo sapiens
aggacagagggaagccagtcagg

SEQ ID NO: 4448179 - DNA, 16 bp, Homo sapiens
aggacagagggcacat

SEQ ID NO: 4448180 - DNA, 18 bp, Homo sapiens
aggacagcaaagcagcag

SEQ ID NO: 4448181 - DNA, 20 bp, Homo sapiens
aggacagcaaagcagcagtg

SEQ ID NO: 4448182 - DNA, 22 bp, Homo sapiens
aggacagcctgtggcggtgcct

SEQ ID NO: 4448183 - DNA, 19 bp, Homo sapiens
aggacagctcctggaccag

SEQ ID NO: 4448184 - DNA, 18 bp, Homo sapiens
aggacaggaccagatttt

SEQ ID NO: 4448185 - DNA, 12 bp, Homo sapiens
aggacaggagcc

SEQ ID NO: 4448186 - DNA, 13 bp, Homo sapiens
aggacaggcaggc

SEQ ID NO: 4448187 - DNA, 15 bp, Homo sapiens
aggacaggcaggcca

SEQ ID NO: 4448188 - DNA, 17 bp, Homo sapiens
aggacaggcaggccaga

SEQ ID NO: 4448189 - DNA, 12 bp, Homo sapiens
aggacaggcccg

SEQ ID NO: 4448190 - DNA, 12 bp, Homo sapiens
aggacagtattt

SEQ ID NO: 4448191 - DNA, 19 bp, Homo sapiens
aggacagtatttgtgggga

SEQ ID NO: 4448192 - DNA, 17 bp, Homo sapiens
aggacagtccctgctgg

SEQ ID NO: 4448193 - DNA, 20 bp, Homo sapiens
aggacagtccctgctgggga

SEQ ID NO: 4448194 - DNA, 22 bp, Homo sapiens
aggacatagaggtatattggaa

SEQ ID NO: 4448195 - DNA, 22 bp, Homo sapiens
aggacatcagcaaacaggatca

SEQ ID NO: 4448196 - DNA, 21 bp, Homo sapiens
aggacatgcatgacacttcca

SEQ ID NO: 4448197 - DNA, 23 bp, Homo sapiens
aggacatggtgagtctattttta

SEQ ID NO: 4448198 - DNA, 22 bp, Homo sapiens
aggacattctgctaagattcct

SEQ ID NO: 4448199 - DNA, 18 bp, Homo sapiens
aggaccaacatccagtcc

SEQ ID NO: 4448200 - DNA, 22 bp, Homo sapiens
aggaccagaaaatgtaaggcaa

SEQ ID NO: 4448201 - DNA, 23 bp, Homo sapiens
aggaccagagcggtatctctggc

SEQ ID NO: 4448202 - DNA, 14 bp, Homo sapiens
aggaccagaggagc

SEQ ID NO: 4448203 - DNA, 12 bp, Homo sapiens
aggaccaggact

SEQ ID NO: 4448204 - DNA, 16 bp, Homo sapiens
aggaccaggactccct

SEQ ID NO: 4448205 - DNA, 18 bp, Homo sapiens
aggaccaggactccctcc

SEQ ID NO: 4448206 - DNA, 21 bp, Homo sapiens
aggaccaggactccctcctca

SEQ ID NO: 4448207 - DNA, 12 bp, Homo sapiens
aggacccagacc

SEQ ID NO: 4448208 - DNA, 14 bp, Homo sapiens
aggacccagaccca

SEQ ID NO: 4448209 - DNA, 12 bp, Homo sapiens
aggacccaggcg

SEQ ID NO: 4448210 - DNA, 16 bp, Homo sapiens
aggacccaggcgctgc

SEQ ID NO: 4448211 - DNA, 22 bp, Homo sapiens
aggacccccgaggggagggcag

SEQ ID NO: 4448212 - DNA, 23 bp, Homo sapiens
aggaccgttttgtattgcttcct

SEQ ID NO: 4448213 - DNA, 16 bp, Homo sapiens
aggacctgtggccaag

SEQ ID NO: 4448214 - DNA, 23 bp, Homo sapiens
aggacctttaggtcaaactccct

SEQ ID NO: 4448215 - DNA, 23 bp, Homo sapiens
aggacgccactcatttcatctca

SEQ ID NO: 4448216 - DNA, 14 bp, Homo sapiens
aggacgcctgcagg

SEQ ID NO: 4448217 - DNA, 17 bp, Homo sapiens
aggacgcctgcaggaga

SEQ ID NO: 4448218 - DNA, 13 bp, Homo sapiens
aggacggaagtgg

SEQ ID NO: 4448219 - DNA, 23 bp, Homo sapiens
aggacggctcctcagagcgccag

SEQ ID NO: 4448220 - DNA, 15 bp, Homo sapiens
aggacggctgagcat

SEQ ID NO: 4448221 - DNA, 15 bp, Homo sapiens
aggactattatgtgg

SEQ ID NO: 4448222 - DNA, 16 bp, Homo sapiens
aggactccaggcccaa

SEQ ID NO: 4448223 - DNA, 12 bp, Homo sapiens
aggactccctcc

SEQ ID NO: 4448224 - DNA, 19 bp, Homo sapiens
aggactcctcctttttcca

SEQ ID NO: 4448225 - DNA, 21 bp, Homo sapiens
aggactcctcctttttccatg

SEQ ID NO: 4448226 - DNA, 12 bp, Homo sapiens
aggactctcagg

SEQ ID NO: 4448227 - DNA, 14 bp, Homo sapiens
aggactctgcggga

SEQ ID NO: 4448228 - DNA, 20 bp, Homo sapiens
aggactctgcgggaggctgg

SEQ ID NO: 4448229 - DNA, 22 bp, Homo sapiens
aggactctgcgggaggctgggg

SEQ ID NO: 4448230 - DNA, 20 bp, Homo sapiens
aggactctttccgactgccc

SEQ ID NO: 4448231 - DNA, 22 bp, Homo sapiens
aggactctttccgactgcccag

SEQ ID NO: 4448232 - DNA, 21 bp, Homo sapiens
aggactgcacagcgtcctgtc

SEQ ID NO: 4448233 - DNA, 19 bp, Homo sapiens
aggactgcatggtaattta

SEQ ID NO: 4448234 - DNA, 14 bp, Homo sapiens
aggactggtgcctg

SEQ ID NO: 4448235 - DNA, 14 bp, Homo sapiens
aggacttcccgagc

SEQ ID NO: 4448236 - DNA, 15 bp, Homo sapiens
aggacttctgcagct

SEQ ID NO: 4448237 - DNA, 13 bp, Homo sapiens
aggacttgaaaga

SEQ ID NO: 4448238 - DNA, 13 bp, Homo sapiens
aggagaaactgag

SEQ ID NO: 4448239 - DNA, 12 bp, Homo sapiens
aggagaaatgca

SEQ ID NO: 4448240 - DNA, 18 bp, Homo sapiens
aggagaaatgcaataact

SEQ ID NO: 4448241 - DNA, 20 bp, Homo sapiens
aggagaaatgcaataactct

SEQ ID NO: 4448242 - DNA, 13 bp, Homo sapiens
aggagaagagaca

SEQ ID NO: 4448243 - DNA, 20 bp, Homo sapiens
aggagaattgcttgaacctg

SEQ ID NO: 4448244 - DNA, 20 bp, Homo sapiens
aggagacaggttagctgctc

SEQ ID NO: 4448245 - DNA, 11 bp, Homo sapiens
aggagacatat

SEQ ID NO: 4448246 - DNA, 15 bp, Homo sapiens
aggagacattgctct

SEQ ID NO: 4448247 - DNA, 14 bp, Homo sapiens
aggagactcacctc

SEQ ID NO: 4448248 - DNA, 19 bp, Homo sapiens
aggagactcacctctgcct

SEQ ID NO: 4448249 - DNA, 15 bp, Homo sapiens
aggagacttaatttc

SEQ ID NO: 4448250 - DNA, 16 bp, Homo sapiens
aggagagaaaatatat

SEQ ID NO: 4448251 - DNA, 17 bp, Homo sapiens
aggagagaaaatatatg

SEQ ID NO: 4448252 - DNA, 22 bp, Homo sapiens
aggagagaaaatatatgtattt

SEQ ID NO: 4448253 - DNA, 17 bp, Homo sapiens
aggagagattatttaca

SEQ ID NO: 4448254 - DNA, 14 bp, Homo sapiens
aggagagcctgctg

SEQ ID NO: 4448255 - DNA, 19 bp, Homo sapiens
aggagaggcaaagaaagga

SEQ ID NO: 4448256 - DNA, 19 bp, Homo sapiens
aggagagtgagtgcctttc

SEQ ID NO: 4448257 - DNA, 14 bp, Homo sapiens
aggagatgaccagg

SEQ ID NO: 4448258 - DNA, 21 bp, Homo sapiens
aggagattctgtgtattaaca

SEQ ID NO: 4448259 - DNA, 14 bp, Homo sapiens
aggagcagcagctt

SEQ ID NO: 4448260 - DNA, 14 bp, Homo sapiens
aggagcagccctgg

SEQ ID NO: 4448261 - DNA, 18 bp, Homo sapiens
aggagcagccctggcccc

SEQ ID NO: 4448262 - DNA, 15 bp, Homo sapiens
aggagccaccagttc

SEQ ID NO: 4448263 - DNA, 14 bp, Homo sapiens
aggagccccgccac

SEQ ID NO: 4448264 - DNA, 22 bp, Homo sapiens
aggagcctagcggagcccagcc

SEQ ID NO: 4448265 - DNA, 22 bp, Homo sapiens
aggagcctcactggggcagaca

SEQ ID NO: 4448266 - DNA, 14 bp, Homo sapiens
aggagcctctgatc

SEQ ID NO: 4448267 - DNA, 19 bp, Homo sapiens
aggagcctggtccttccct

SEQ ID NO: 4448268 - DNA, 19 bp, Homo sapiens
aggagccttttgctctctg

SEQ ID NO: 4448269 - DNA, 22 bp, Homo sapiens
aggagctacccttttcctttgt

SEQ ID NO: 4448270 - DNA, 18 bp, Homo sapiens
aggagctagtaggaatgt

SEQ ID NO: 4448271 - DNA, 15 bp, Homo sapiens
aggagctgatacttt

SEQ ID NO: 4448272 - DNA, 12 bp, Homo sapiens
aggagctgctgg

SEQ ID NO: 4448273 - DNA, 14 bp, Homo sapiens
aggagctgctggct

SEQ ID NO: 4448274 - DNA, 16 bp, Homo sapiens
aggagctgctggcttg

SEQ ID NO: 4448275 - DNA, 12 bp, Homo sapiens
aggagctgggcc

SEQ ID NO: 4448276 - DNA, 22 bp, Homo sapiens
aggagcttgggcagtgccccag

SEQ ID NO: 4448277 - DNA, 15 bp, Homo sapiens
aggagcttgggtctc

SEQ ID NO: 4448278 - DNA, 18 bp, Homo sapiens
aggcagagacctccaata

SEQ ID NO: 4448279 - DNA, 15 bp, Homo sapiens
aggcagaggttgcag

SEQ ID NO: 4448280 - DNA, 20 bp, Homo sapiens
aggcagaggttgcagtgagc

SEQ ID NO: 4448281 - DNA, 22 bp, Homo sapiens
aggcagaggttgcagtgagctg

SEQ ID NO: 4448282 - DNA, 23 bp, Homo sapiens
aggcagatctgtgccccatgcct

SEQ ID NO: 4448283 - DNA, 19 bp, Homo sapiens
aggcagcagtgtgaggcca

SEQ ID NO: 4448284 - DNA, 16 bp, Homo sapiens
aggcagcatgtatagt

SEQ ID NO: 4448285 - DNA, 21 bp, Homo sapiens
aggcagcatgtatagttgctt

SEQ ID NO: 4448286 - DNA, 13 bp, Homo sapiens
aggcagcccagca

SEQ ID NO: 4448287 - DNA, 15 bp, Homo sapiens
aggcagctcaggata

SEQ ID NO: 4448288 - DNA, 18 bp, Homo sapiens
aggcagctgatccaggca

SEQ ID NO: 4448289 - DNA, 11 bp, Homo sapiens
aggcagctgcc

SEQ ID NO: 4448290 - DNA, 20 bp, Homo sapiens
aggcagctgcctctgctccc

SEQ ID NO: 4448291 - DNA, 20 bp, Homo sapiens
aggcagcttctactcctgcc

SEQ ID NO: 4448292 - DNA, 15 bp, Homo sapiens
aggcagcttgaaact

SEQ ID NO: 4448293 - DNA, 19 bp, Homo sapiens
aggcaggaacaaacagggc

SEQ ID NO: 4448294 - DNA, 18 bp, Homo sapiens
aggcaggacttctcacca

SEQ ID NO: 4448295 - DNA, 16 bp, Homo sapiens
aggcaggaggatcact

SEQ ID NO: 4448296 - DNA, 12 bp, Homo sapiens
aggcaggctggg

SEQ ID NO: 4448297 - DNA, 13 bp, Homo sapiens
aggcaggctggga

SEQ ID NO: 4448298 - DNA, 21 bp, Homo sapiens
aggcagggcctggctccagtc

SEQ ID NO: 4448299 - DNA, 20 bp, Homo sapiens
aggcagggccttgcccagag

SEQ ID NO: 4448300 - DNA, 13 bp, Homo sapiens
aggcaggggcgga

SEQ ID NO: 4448301 - DNA, 18 bp, Homo sapiens
aggcagggggccctgccc

SEQ ID NO: 4448302 - DNA, 19 bp, Homo sapiens
aggcaggggtgggggtgga

SEQ ID NO: 4448303 - DNA, 22 bp, Homo sapiens
aggcaggggtgggggtggaggc

SEQ ID NO: 4448304 - DNA, 13 bp, Homo sapiens
aggcaggtcacag

SEQ ID NO: 4448305 - DNA, 12 bp, Homo sapiens
aggcaggtttca

SEQ ID NO: 4448306 - DNA, 19 bp, Homo sapiens
aggcagtccaggcctctct

SEQ ID NO: 4448307 - DNA, 22 bp, Homo sapiens
aggcagtccaggcctctctctg

SEQ ID NO: 4448308 - DNA, 20 bp, Homo sapiens
aggcatacgagagcagaggt

SEQ ID NO: 4448309 - DNA, 21 bp, Homo sapiens
aggcatacgagagcagaggtc

SEQ ID NO: 4448310 - DNA, 19 bp, Homo sapiens
aggcatattccctgcacac

SEQ ID NO: 4448311 - DNA, 21 bp, Homo sapiens
aggcatattccctgcacacac

SEQ ID NO: 4448312 - DNA, 14 bp, Homo sapiens
aggcatcttttcta

SEQ ID NO: 4448313 - DNA, 17 bp, Homo sapiens
aggcatgtcccacccac

SEQ ID NO: 4448314 - DNA, 20 bp, Homo sapiens
aggcattcagcagtttctga

SEQ ID NO: 4448315 - DNA, 13 bp, Homo sapiens
aggcattgccaag

SEQ ID NO: 4448316 - DNA, 21 bp, Homo sapiens
aggcatttgcagggtcctctt

SEQ ID NO: 4448317 - DNA, 14 bp, Homo sapiens
aggccaacagcacc

SEQ ID NO: 4448318 - DNA, 17 bp, Homo sapiens
aggccaagaaacgtctt

SEQ ID NO: 4448319 - DNA, 15 bp, Homo sapiens
aggccaagggaccag

SEQ ID NO: 4448320 - DNA, 18 bp, Homo sapiens
aggccaaggtctgagcca

SEQ ID NO: 4448321 - DNA, 15 bp, Homo sapiens
aggccacagagaacc

SEQ ID NO: 4448322 - DNA, 13 bp, Homo sapiens
aggccacagccag

SEQ ID NO: 4448323 - DNA, 14 bp, Homo sapiens
aggccacagccagg

SEQ ID NO: 4448324 - DNA, 20 bp, Homo sapiens
aggccaccccctatcctctg

SEQ ID NO: 4448325 - DNA, 16 bp, Homo sapiens
aggccagacatggtgt

SEQ ID NO: 4448326 - DNA, 20 bp, Homo sapiens
aggccagagcaaacagaaaa

SEQ ID NO: 4448327 - DNA, 16 bp, Homo sapiens
aggccagagtggcctg

SEQ ID NO: 4448328 - DNA, 20 bp, Homo sapiens
aggccagagtggcctggcca

SEQ ID NO: 4448329 - DNA, 22 bp, Homo sapiens
aggccagatggcccctccactg

SEQ ID NO: 4448330 - DNA, 14 bp, Homo sapiens
aggccagcaacatt

SEQ ID NO: 4448331 - DNA, 23 bp, Homo sapiens
aggccagcaggcgggctcctttg

SEQ ID NO: 4448332 - DNA, 11 bp, Homo sapiens
aggccagccca

SEQ ID NO: 4448333 - DNA, 19 bp, Homo sapiens
aggccagcccagccaggcc

SEQ ID NO: 4448334 - DNA, 17 bp, Homo sapiens
aggccagccccacccag

SEQ ID NO: 4448335 - DNA, 18 bp, Homo sapiens
aggccagccccacccagg

SEQ ID NO: 4448336 - DNA, 11 bp, Homo sapiens
aggccagcctc

SEQ ID NO: 4448337 - DNA, 13 bp, Homo sapiens
aggccagcctccg

SEQ ID NO: 4448338 - DNA, 18 bp, Homo sapiens
aggccagcctccgagagg

SEQ ID NO: 4448339 - DNA, 15 bp, Homo sapiens
aggccagctgcggcc

SEQ ID NO: 4448340 - DNA, 17 bp, Homo sapiens
aggccaggacgtctggg

SEQ ID NO: 4448341 - DNA, 11 bp, Homo sapiens
aggccaggtgc

SEQ ID NO: 4448342 - DNA, 15 bp, Homo sapiens
aggccaggtgcccag

SEQ ID NO: 4448343 - DNA, 20 bp, Homo sapiens
aggccagtccccatttctgc

SEQ ID NO: 4448344 - DNA, 22 bp, Homo sapiens
aggccagtccccatttctgcct

SEQ ID NO: 4448345 - DNA, 16 bp, Homo sapiens
aggccataaaacaggt

SEQ ID NO: 4448346 - DNA, 17 bp, Homo sapiens
aggccatctcaggagat

SEQ ID NO: 4448347 - DNA, 18 bp, Homo sapiens
aggccatctcaggagatg

SEQ ID NO: 4448348 - DNA, 13 bp, Homo sapiens
aggccattattgt

SEQ ID NO: 4448349 - DNA, 19 bp, Homo sapiens
aggccattctttcccaaca

SEQ ID NO: 4448350 - DNA, 20 bp, Homo sapiens
aggccattgtgaaccaatgc

SEQ ID NO: 4448351 - DNA, 12 bp, Homo sapiens
aggcccaaatga

SEQ ID NO: 4448352 - DNA, 18 bp, Homo sapiens
aggcccaaccaccagatg

SEQ ID NO: 4448353 - DNA, 14 bp, Homo sapiens
aggcccaacctcct

SEQ ID NO: 4448354 - DNA, 15 bp, Homo sapiens
aggcccaaggctccc

SEQ ID NO: 4448355 - DNA, 18 bp, Homo sapiens
aggcccactccccagccc

SEQ ID NO: 4448356 - DNA, 21 bp, Homo sapiens
aggcccactccccagccccag

SEQ ID NO: 4448357 - DNA, 20 bp, Homo sapiens
aggcccactgtgtctaggca

SEQ ID NO: 4448358 - DNA, 19 bp, Homo sapiens
aggcccaggagtccaggcc

SEQ ID NO: 4448359 - DNA, 16 bp, Homo sapiens
aggcccaggctgggaa

SEQ ID NO: 4448360 - DNA, 17 bp, Homo sapiens
aggcccaggctgggaac

SEQ ID NO: 4448361 - DNA, 23 bp, Homo sapiens
aggccccaatcttgcccactggc

SEQ ID NO: 4448362 - DNA, 13 bp, Homo sapiens
aggccccagcctc

SEQ ID NO: 4448363 - DNA, 16 bp, Homo sapiens
aggcccccagcccctc

SEQ ID NO: 4448364 - DNA, 19 bp, Homo sapiens
aggccccgaggacccagac

SEQ ID NO: 4448365 - DNA, 21 bp, Homo sapiens
aggccccgcttgtccagcgcc

SEQ ID NO: 4448366 - DNA, 13 bp, Homo sapiens
aggcccctggagg

SEQ ID NO: 4448367 - DNA, 14 bp, Homo sapiens
aggcccggggctgg

SEQ ID NO: 4448368 - DNA, 20 bp, Homo sapiens
aggcccgtcagcatcactga

SEQ ID NO: 4448369 - DNA, 22 bp, Homo sapiens
aggcccgtcagcatcactgatg

SEQ ID NO: 4448370 - DNA, 10 bp, Homo sapiens
aggccctccc

SEQ ID NO: 4448371 - DNA, 22 bp, Homo sapiens
aggccctccctgactccctgtg

SEQ ID NO: 4448372 - DNA, 16 bp, Homo sapiens
aggccctgactcctct

SEQ ID NO: 4448373 - DNA, 18 bp, Homo sapiens
aggccctgactcctctgg

SEQ ID NO: 4448374 - DNA, 15 bp, Homo sapiens
aggccctgaggcgga

SEQ ID NO: 4448375 - DNA, 14 bp, Homo sapiens
aggccgaggcaggt

SEQ ID NO: 4448376 - DNA, 18 bp, Homo sapiens
aggccgtgtctctgagga

SEQ ID NO: 4448377 - DNA, 14 bp, Homo sapiens
aggcctagactctg

SEQ ID NO: 4448378 - DNA, 21 bp, Homo sapiens
aggcctagactctgtctacct

SEQ ID NO: 4448379 - DNA, 15 bp, Homo sapiens
aggcctatctggaag

SEQ ID NO: 4448380 - DNA, 15 bp, Homo sapiens
aggcctatttaacaa

SEQ ID NO: 4448381 - DNA, 21 bp, Homo sapiens
aggcctatttaacaagatgtt

SEQ ID NO: 4448382 - DNA, 15 bp, Homo sapiens
aggcctcaactcctc

SEQ ID NO: 4448383 - DNA, 18 bp, Homo sapiens
aggcctcaactcctccca

SEQ ID NO: 4448384 - DNA, 17 bp, Homo sapiens
aggcctccactccttcc

SEQ ID NO: 4448385 - DNA, 21 bp, Homo sapiens
aggcctctcattccagaggaa

SEQ ID NO: 4448386 - DNA, 21 bp, Homo sapiens
aggcctctcggtgctccatct

SEQ ID NO: 4448387 - DNA, 12 bp, Homo sapiens
aggcctctctct

SEQ ID NO: 4448388 - DNA, 20 bp, Homo sapiens
aggcctctctctgctccatc

SEQ ID NO: 4448389 - DNA, 18 bp, Homo sapiens
aggcctctgctggctcag

SEQ ID NO: 4448390 - DNA, 12 bp, Homo sapiens
aggcctctggtt

SEQ ID NO: 4448391 - DNA, 17 bp, Homo sapiens
aggcctcttggagacct

SEQ ID NO: 4448392 - DNA, 21 bp, Homo sapiens
aggcctgaaatgacatttcac

SEQ ID NO: 4448393 - DNA, 16 bp, Homo sapiens
aggcctgactctcagc

SEQ ID NO: 4448394 - DNA, 16 bp, Homo sapiens
aggcctgacttctgct

SEQ ID NO: 4448395 - DNA, 12 bp, Homo sapiens
aggcctgagccc

SEQ ID NO: 4448396 - DNA, 14 bp, Homo sapiens
aggcctgagcccct

SEQ ID NO: 4448397 - DNA, 23 bp, Homo sapiens
agggcccccaataaaccagtgtg

SEQ ID NO: 4448398 - DNA, 13 bp, Homo sapiens
agggcccccaccg

SEQ ID NO: 4448399 - DNA, 23 bp, Homo sapiens
agggccccgtgggtgggcctggc

SEQ ID NO: 4448400 - DNA, 12 bp, Homo sapiens
agggcccctgcg

SEQ ID NO: 4448401 - DNA, 19 bp, Homo sapiens
agggcccctgcgtgggggc

SEQ ID NO: 4448402 - DNA, 18 bp, Homo sapiens
agggcccggccacaccca

SEQ ID NO: 4448403 - DNA, 13 bp, Homo sapiens
agggccctggtgt

SEQ ID NO: 4448404 - DNA, 24 bp, Homo sapiens
agggccctggtgtttctagcactg

SEQ ID NO: 4448405 - DNA, 18 bp, Homo sapiens
agggcctctccttggaag

SEQ ID NO: 4448406 - DNA, 18 bp, Homo sapiens
agggcctgacttgagcca

SEQ ID NO: 4448407 - DNA, 19 bp, Homo sapiens
agggcctgacttgagccac

SEQ ID NO: 4448408 - DNA, 15 bp, Homo sapiens
agggcctggctccag

SEQ ID NO: 4448409 - DNA, 17 bp, Homo sapiens
agggccttgcccagaga

SEQ ID NO: 4448410 - DNA, 23 bp, Homo sapiens
agggccttgcccagagatgcctc

SEQ ID NO: 4448411 - DNA, 20 bp, Homo sapiens
agggcgggcagagggctgga

SEQ ID NO: 4448412 - DNA, 22 bp, Homo sapiens
agggctaaaaaggtcctgtaag

SEQ ID NO: 4448413 - DNA, 14 bp, Homo sapiens
agggctaaatgttt

SEQ ID NO: 4448414 - DNA, 21 bp, Homo sapiens
agggctaagagctagcgctgc

SEQ ID NO: 4448415 - DNA, 18 bp, Homo sapiens
agggctagaacctggaga

SEQ ID NO: 4448416 - DNA, 19 bp, Homo sapiens
agggctagaacctggagag

SEQ ID NO: 4448417 - DNA, 20 bp, Homo sapiens
agggctagaacctggagagc

SEQ ID NO: 4448418 - DNA, 21 bp, Homo sapiens
agggctagaacctggaggggc

SEQ ID NO: 4448419 - DNA, 23 bp, Homo sapiens
agggctagaacctggaggggcta

SEQ ID NO: 4448420 - DNA, 18 bp, Homo sapiens
agggctagaatctggaga

SEQ ID NO: 4448421 - DNA, 17 bp, Homo sapiens
agggctgagctctctgt

SEQ ID NO: 4448422 - DNA, 12 bp, Homo sapiens
agggctgctccc

SEQ ID NO: 4448423 - DNA, 22 bp, Homo sapiens
agggctggaatctggagagcta

SEQ ID NO: 4448424 - DNA, 15 bp, Homo sapiens
agggctggactgagg

SEQ ID NO: 4448425 - DNA, 16 bp, Homo sapiens
agggctggactgaggc

SEQ ID NO: 4448426 - DNA, 20 bp, Homo sapiens
agggctggactgaggcctga

SEQ ID NO: 4448427 - DNA, 18 bp, Homo sapiens
agggctggaggcccaggc

SEQ ID NO: 4448428 - DNA, 21 bp, Homo sapiens
agggctggaggcccaggctgg

SEQ ID NO: 4448429 - DNA, 14 bp, Homo sapiens
agggctggcccagc

SEQ ID NO: 4448430 - DNA, 16 bp, Homo sapiens
agggctggcccagccc

SEQ ID NO: 4448431 - DNA, 20 bp, Homo sapiens
agggctggcccagccctgct

SEQ ID NO: 4448432 - DNA, 22 bp, Homo sapiens
agggctggcccagccctgctgg

SEQ ID NO: 4448433 - DNA, 16 bp, Homo sapiens
agggctggccgggact

SEQ ID NO: 4448434 - DNA, 22 bp, Homo sapiens
agggctggccgggactgctgct

SEQ ID NO: 4448435 - DNA, 22 bp, Homo sapiens
agggctggctccccctccccag

SEQ ID NO: 4448436 - DNA, 22 bp, Homo sapiens
agggctgggcaaggaaaaagaa

SEQ ID NO: 4448437 - DNA, 15 bp, Homo sapiens
agggctgggccacca

SEQ ID NO: 4448438 - DNA, 19 bp, Homo sapiens
agggctgggccaccaggga

SEQ ID NO: 4448439 - DNA, 21 bp, Homo sapiens
agggctgggccaccagggatc

SEQ ID NO: 4448440 - DNA, 21 bp, Homo sapiens
agggctggggttgccagaggc

SEQ ID NO: 4448441 - DNA, 13 bp, Homo sapiens
agggctgtcccag

SEQ ID NO: 4448442 - DNA, 14 bp, Homo sapiens
agggctgtcccagc

SEQ ID NO: 4448443 - DNA, 15 bp, Homo sapiens
agggctgtcccagcc

SEQ ID NO: 4448444 - DNA, 22 bp, Homo sapiens
agggcttcctcaaatacatgca

SEQ ID NO: 4448445 - DNA, 12 bp, Homo sapiens
agggcttcctct

SEQ ID NO: 4448446 - DNA, 21 bp, Homo sapiens
agggcttcctctagaagccaa

SEQ ID NO: 4448447 - DNA, 17 bp, Homo sapiens
agggcttggcccagcgc

SEQ ID NO: 4448448 - DNA, 21 bp, Homo sapiens
agggcttggcccagcgccaag

SEQ ID NO: 4448449 - DNA, 16 bp, Homo sapiens
agggcttggggctgca

SEQ ID NO: 4448450 - DNA, 21 bp, Homo sapiens
agggcttggggctgcacctcc

SEQ ID NO: 4448451 - DNA, 21 bp, Homo sapiens
agggcttgtttttcttcagca

SEQ ID NO: 4448452 - DNA, 19 bp, Homo sapiens
agggctttgaatctgggac

SEQ ID NO: 4448453 - DNA, 21 bp, Homo sapiens
agggctttgaatctgggactg

SEQ ID NO: 4448454 - DNA, 12 bp, Homo sapiens
agggctttttaa

SEQ ID NO: 4448455 - DNA, 16 bp, Homo sapiens
agggctttttaaattt

SEQ ID NO: 4448456 - DNA, 23 bp, Homo sapiens
aggggaagagggaaatgtacact

SEQ ID NO: 4448457 - DNA, 15 bp, Homo sapiens
aggggaagcaggacc

SEQ ID NO: 4448458 - DNA, 21 bp, Homo sapiens
aggggaaggccctgaggcgga

SEQ ID NO: 4448459 - DNA, 18 bp, Homo sapiens
aggggaagtaaaacagtc

SEQ ID NO: 4448460 - DNA, 19 bp, Homo sapiens
aggggaagtaaaacagtca

SEQ ID NO: 4448461 - DNA, 22 bp, Homo sapiens
aggggaattccctccccctcct

SEQ ID NO: 4448462 - DNA, 15 bp, Homo sapiens
aggggacgctgagga

SEQ ID NO: 4448463 - DNA, 15 bp, Homo sapiens
aggggagaaaattaa

SEQ ID NO: 4448464 - DNA, 16 bp, Homo sapiens
aggggagacaggagcc

SEQ ID NO: 4448465 - DNA, 14 bp, Homo sapiens
aggggagagacagg

SEQ ID NO: 4448466 - DNA, 13 bp, Homo sapiens
aggggagccaagg

SEQ ID NO: 4448467 - DNA, 14 bp, Homo sapiens
aggggaggcagatg

SEQ ID NO: 4448468 - DNA, 17 bp, Homo sapiens
aggggaggggcgcaccc

SEQ ID NO: 4448469 - DNA, 19 bp, Homo sapiens
aggggcaaccaactgcccc

SEQ ID NO: 4448470 - DNA, 13 bp, Homo sapiens
aggggcagccaca

SEQ ID NO: 4448471 - DNA, 16 bp, Homo sapiens
aggggcagccacacca

SEQ ID NO: 4448472 - DNA, 17 bp, Homo sapiens
aggggcatctgcccctc

SEQ ID NO: 4448473 - DNA, 21 bp, Homo sapiens
aggggcatctgcccctccccc

SEQ ID NO: 4448474 - DNA, 19 bp, Homo sapiens
aggggccaacctcaggctc

SEQ ID NO: 4448475 - DNA, 17 bp, Homo sapiens
aggggccaattttggat

SEQ ID NO: 4448476 - DNA, 12 bp, Homo sapiens
aggggccagagg

SEQ ID NO: 4448477 - DNA, 23 bp, Homo sapiens
aggggccggctgtttcctgacag

SEQ ID NO: 4448478 - DNA, 18 bp, Homo sapiens
aggggcctctctcctgcc

SEQ ID NO: 4448479 - DNA, 12 bp, Homo sapiens
aggggcgcaccc

SEQ ID NO: 4448480 - DNA, 22 bp, Homo sapiens
aggggcgcaccccacagctggg

SEQ ID NO: 4448481 - DNA, 16 bp, Homo sapiens
aggggcgggctcagag

SEQ ID NO: 4448482 - DNA, 20 bp, Homo sapiens
aggggcgttctcccaaagat

SEQ ID NO: 4448483 - DNA, 20 bp, Homo sapiens
aggggctagaacctagagaa

SEQ ID NO: 4448484 - DNA, 14 bp, Homo sapiens
aggggctggggact

SEQ ID NO: 4448485 - DNA, 21 bp, Homo sapiens
aggggcttataataaaggact

SEQ ID NO: 4448486 - DNA, 23 bp, Homo sapiens
aggggcttgactttttcaacttc

SEQ ID NO: 4448487 - DNA, 14 bp, Homo sapiens
aggggcttggattt

SEQ ID NO: 4448488 - DNA, 20 bp, Homo sapiens
aggggcttgggcctgcaccc

SEQ ID NO: 4448489 - DNA, 15 bp, Homo sapiens
agggggagagggctg

SEQ ID NO: 4448490 - DNA, 16 bp, Homo sapiens
agggggcaagaggaat

SEQ ID NO: 4448491 - DNA, 13 bp, Homo sapiens
agggggccccgcc

SEQ ID NO: 4448492 - DNA, 22 bp, Homo sapiens
agggggccccgccagggctggg

SEQ ID NO: 4448493 - DNA, 23 bp, Homo sapiens
agggggccccgccagggctgggg

SEQ ID NO: 4448494 - DNA, 17 bp, Homo sapiens
agggggccctgccccac

SEQ ID NO: 4448495 - DNA, 19 bp, Homo sapiens
agggggccctgccccaccc

SEQ ID NO: 4448496 - DNA, 15 bp, Homo sapiens
agggggcctggatgc

SEQ ID NO: 4448497 - DNA, 17 bp, Homo sapiens
agggggcctggatgccc

SEQ ID NO: 4448498 - DNA, 16 bp, Homo sapiens
agggggcttgaagcca

SEQ ID NO: 4448499 - DNA, 18 bp, Homo sapiens
agggggcttgaagccaaa

SEQ ID NO: 4448500 - DNA, 18 bp, Homo sapiens
agggggctttctggggcc

SEQ ID NO: 4448501 - DNA, 20 bp, Homo sapiens
agggggtgacctcttgcctc

SEQ ID NO: 4448502 - DNA, 18 bp, Homo sapiens
aggggtaggatgtacagg

SEQ ID NO: 4448503 - DNA, 16 bp, Homo sapiens
aggggtctccctggct

SEQ ID NO: 4448504 - DNA, 14 bp, Homo sapiens
aggggtgcacaata

SEQ ID NO: 4448505 - DNA, 15 bp, Homo sapiens
aggggtgctcctgtg

SEQ ID NO: 4448506 - DNA, 13 bp, Homo sapiens
aggggtggaggct

SEQ ID NO: 4448507 - DNA, 13 bp, Homo sapiens
aggggtggcccag

SEQ ID NO: 4448508 - DNA, 14 bp, Homo sapiens
aggggtggcccaga

SEQ ID NO: 4448509 - DNA, 21 bp, Homo sapiens
aggggtggccgggcacagtgg

SEQ ID NO: 4448510 - DNA, 24 bp, Homo sapiens
aggggtggtggggggcagggccac

SEQ ID NO: 4448511 - DNA, 16 bp, Homo sapiens
aggggtgtggcagtgg

SEQ ID NO: 4448512 - DNA, 18 bp, Homo sapiens
aggggttaacttggtcag

SEQ ID NO: 4448513 - DNA, 21 bp, Homo sapiens
agggtagccccctcatctgca

SEQ ID NO: 4448514 - DNA, 17 bp, Homo sapiens
aggtgccccaaaatgca

SEQ ID NO: 4448515 - DNA, 18 bp, Homo sapiens
aggtgcctgtgaggcagg

SEQ ID NO: 4448516 - DNA, 23 bp, Homo sapiens
aggtgccttggagggtcccaagc

SEQ ID NO: 4448517 - DNA, 18 bp, Homo sapiens
aggtgctaacatagattt

SEQ ID NO: 4448518 - DNA, 17 bp, Homo sapiens
aggtgctaatttgtttt

SEQ ID NO: 4448519 - DNA, 16 bp, Homo sapiens
aggtgctacaaaaaca

SEQ ID NO: 4448520 - DNA, 20 bp, Homo sapiens
aggtgctacaaaaacacagc

SEQ ID NO: 4448521 - DNA, 22 bp, Homo sapiens
aggtgctacaaaaacacagcaa

SEQ ID NO: 4448522 - DNA, 15 bp, Homo sapiens
aggtgctgtccccac

SEQ ID NO: 4448523 - DNA, 19 bp, Homo sapiens
aggtgctgtccccactgcc

SEQ ID NO: 4448524 - DNA, 23 bp, Homo sapiens
aggtgctgtccccactgccccac

SEQ ID NO: 4448525 - DNA, 22 bp, Homo sapiens
aggtgcttctagttctgccagg

SEQ ID NO: 4448526 - DNA, 16 bp, Homo sapiens
aggtgcttgatctatc

SEQ ID NO: 4448527 - DNA, 23 bp, Homo sapiens
aggtggaacaaacagaaatgact

SEQ ID NO: 4448528 - DNA, 17 bp, Homo sapiens
aggtggaagaagggaga

SEQ ID NO: 4448529 - DNA, 13 bp, Homo sapiens
aggtggaagcaga

SEQ ID NO: 4448530 - DNA, 15 bp, Homo sapiens
aggtggaagcagagg

SEQ ID NO: 4448531 - DNA, 19 bp, Homo sapiens
aggtggaagccctccttcc

SEQ ID NO: 4448532 - DNA, 21 bp, Homo sapiens
aggtggaagccctccttccac

SEQ ID NO: 4448533 - DNA, 20 bp, Homo sapiens
aggtggacgctgcagacccc

SEQ ID NO: 4448534 - DNA, 23 bp, Homo sapiens
aggtggagagacacacctgctcc

SEQ ID NO: 4448535 - DNA, 17 bp, Homo sapiens
aggtggagagcactaga

SEQ ID NO: 4448536 - DNA, 20 bp, Homo sapiens
aggtggaggttgcagtgagc

SEQ ID NO: 4448537 - DNA, 14 bp, Homo sapiens
aggtggcacctgca

SEQ ID NO: 4448538 - DNA, 23 bp, Homo sapiens
aggtggcacctgcagcggctgcc

SEQ ID NO: 4448539 - DNA, 15 bp, Homo sapiens
aggtggcagagtgaa

SEQ ID NO: 4448540 - DNA, 20 bp, Homo sapiens
aggtggcagatgtcttccct

SEQ ID NO: 4448541 - DNA, 13 bp, Homo sapiens
aggtggcctttgt

SEQ ID NO: 4448542 - DNA, 18 bp, Homo sapiens
aggtggctcagtgccacc

SEQ ID NO: 4448543 - DNA, 19 bp, Homo sapiens
aggtggctgacccagtccc

SEQ ID NO: 4448544 - DNA, 21 bp, Homo sapiens
aggtggctgacccagtccctg

SEQ ID NO: 4448545 - DNA, 23 bp, Homo sapiens
aggtggctgacccagtccctggg

SEQ ID NO: 4448546 - DNA, 21 bp, Homo sapiens
aggtggggtctttgtgagagt

SEQ ID NO: 4448547 - DNA, 22 bp, Homo sapiens
aggtggggtctttgtgagagtg

SEQ ID NO: 4448548 - DNA, 16 bp, Homo sapiens
aggtggtaggaggagg

SEQ ID NO: 4448549 - DNA, 17 bp, Homo sapiens
aggtgtcaggctgctgg

SEQ ID NO: 4448550 - DNA, 20 bp, Homo sapiens
aggtgtccagcattgctgga

SEQ ID NO: 4448551 - DNA, 23 bp, Homo sapiens
aggtgtccagcattgctggactc

SEQ ID NO: 4448552 - DNA, 21 bp, Homo sapiens
aggtgtccccaacgtcccctc

SEQ ID NO: 4448553 - DNA, 22 bp, Homo sapiens
aggtgtccccaacgtcccctcc

SEQ ID NO: 4448554 - DNA, 15 bp, Homo sapiens
aggtgtcctgagcac

SEQ ID NO: 4448555 - DNA, 20 bp, Homo sapiens
aggtgtctgccttcacaaat

SEQ ID NO: 4448556 - DNA, 22 bp, Homo sapiens
aggtgtctgccttcacaaatgt

SEQ ID NO: 4448557 - DNA, 16 bp, Homo sapiens
aggtgtgctctgagcc

SEQ ID NO: 4448558 - DNA, 16 bp, Homo sapiens
aggtgtgtgagactac

SEQ ID NO: 4448559 - DNA, 16 bp, Homo sapiens
aggtgttactgtaatt

SEQ ID NO: 4448560 - DNA, 12 bp, Homo sapiens
aggttaaaaaaa

SEQ ID NO: 4448561 - DNA, 18 bp, Homo sapiens
aggttaaacgtagcatgt

SEQ ID NO: 4448562 - DNA, 19 bp, Homo sapiens
aggttaaagctaaactgaa

SEQ ID NO: 4448563 - DNA, 20 bp, Homo sapiens
aggttactcagcagcagaga

SEQ ID NO: 4448564 - DNA, 20 bp, Homo sapiens
aggttagaacctagaagggc

SEQ ID NO: 4448565 - DNA, 22 bp, Homo sapiens
aggttagatatttcgaccctgg

SEQ ID NO: 4448566 - DNA, 19 bp, Homo sapiens
aggttataattttttttaa

SEQ ID NO: 4448567 - DNA, 21 bp, Homo sapiens
aggttattgcaataaagtata

SEQ ID NO: 4448568 - DNA, 14 bp, Homo sapiens
aggttccctcccag

SEQ ID NO: 4448569 - DNA, 20 bp, Homo sapiens
aggttcctctgcctgccccg

SEQ ID NO: 4448570 - DNA, 24 bp, Homo sapiens
aggttgagctcttcttaaagtatt

SEQ ID NO: 4448571 - DNA, 21 bp, Homo sapiens
aggttgcattggggttcctct

SEQ ID NO: 4448572 - DNA, 19 bp, Homo sapiens
aggttgggcttccatgcct

SEQ ID NO: 4448573 - DNA, 13 bp, Homo sapiens
aggtttaaaacta

SEQ ID NO: 4448574 - DNA, 20 bp, Homo sapiens
aggtttaagtagatttcatg

SEQ ID NO: 4448575 - DNA, 21 bp, Homo sapiens
aggtttatgaaaaagaagaat

SEQ ID NO: 4448576 - DNA, 23 bp, Homo sapiens
aggtttattctatctgtttttaa

SEQ ID NO: 4448577 - DNA, 17 bp, Homo sapiens
aggtttatttttctgtt

SEQ ID NO: 4448578 - DNA, 15 bp, Homo sapiens
aggtttcatttctta

SEQ ID NO: 4448579 - DNA, 23 bp, Homo sapiens
aggtttgtttagaagaagtgtgt

SEQ ID NO: 4448580 - DNA, 17 bp, Homo sapiens
aggtttgttttgtgaat

SEQ ID NO: 4448581 - DNA, 20 bp, Homo sapiens
aggtttgttttgtgaatttt

SEQ ID NO: 4448582 - DNA, 19 bp, Homo sapiens
aggttttacctttgaactt

SEQ ID NO: 4448583 - DNA, 18 bp, Homo sapiens
aggtttttttgtttttgt

SEQ ID NO: 4448584 - DNA, 16 bp, Homo sapiens
agtaaaaccacagcag

SEQ ID NO: 4448585 - DNA, 14 bp, Homo sapiens
agtaaaattcagtt

SEQ ID NO: 4448586 - DNA, 16 bp, Homo sapiens
agtaaaatttatttca

SEQ ID NO: 4448587 - DNA, 16 bp, Homo sapiens
agtaaacagggtacct

SEQ ID NO: 4448588 - DNA, 16 bp, Homo sapiens
agtaaacataaaaact

SEQ ID NO: 4448589 - DNA, 20 bp, Homo sapiens
agtaaacataaaaactgatt

SEQ ID NO: 4448590 - DNA, 20 bp, Homo sapiens
agtaaacggcccaggccagg

SEQ ID NO: 4448591 - DNA, 23 bp, Homo sapiens
agtaaacggcccaggccaggtgc

SEQ ID NO: 4448592 - DNA, 17 bp, Homo sapiens
agtaaactattcttaat

SEQ ID NO: 4448593 - DNA, 22 bp, Homo sapiens
agtaaagagaaactttgtgcta

SEQ ID NO: 4448594 - DNA, 14 bp, Homo sapiens
agtaaagagtacac

SEQ ID NO: 4448595 - DNA, 17 bp, Homo sapiens
agtaaagagtacactca

SEQ ID NO: 4448596 - DNA, 17 bp, Homo sapiens
agtaaagcagaggatgc

SEQ ID NO: 4448597 - DNA, 13 bp, Homo sapiens
agtaaagccatta

SEQ ID NO: 4448598 - DNA, 23 bp, Homo sapiens
agtaaagccattaaatgaatatt

SEQ ID NO: 4448599 - DNA, 21 bp, Homo sapiens
agtaaagtggttctctgcctt

SEQ ID NO: 4448600 - DNA, 19 bp, Homo sapiens
agtaaatcacgctttttga

SEQ ID NO: 4448601 - DNA, 23 bp, Homo sapiens
agtaaatgttatcttatactgta

SEQ ID NO: 4448602 - DNA, 21 bp, Homo sapiens
agtaacaatacatgagaaaga

SEQ ID NO: 4448603 - DNA, 13 bp, Homo sapiens
agtaacactaata

SEQ ID NO: 4448604 - DNA, 23 bp, Homo sapiens
agtaacactaatatatttaaaaa

SEQ ID NO: 4448605 - DNA, 21 bp, Homo sapiens
agtaacatgacttccttattt

SEQ ID NO: 4448606 - DNA, 17 bp, Homo sapiens
agtaacattttttggaa

SEQ ID NO: 4448607 - DNA, 20 bp, Homo sapiens
agtaaccaggccccagcctc

SEQ ID NO: 4448608 - DNA, 16 bp, Homo sapiens
agtaacctttaaaaat

SEQ ID NO: 4448609 - DNA, 20 bp, Homo sapiens
agtaacctttaaaaatgtat

SEQ ID NO: 4448610 - DNA, 19 bp, Homo sapiens
agtaacgtgctcactgtgt

SEQ ID NO: 4448611 - DNA, 22 bp, Homo sapiens
agtaacttatttgactatgaat

SEQ ID NO: 4448612 - DNA, 19 bp, Homo sapiens
agtaacttcttatggaatt

SEQ ID NO: 4448613 - DNA, 15 bp, Homo sapiens
agtaagaatggccaa

SEQ ID NO: 4448614 - DNA, 18 bp, Homo sapiens
agtaagatctctttctaa

SEQ ID NO: 4448615 - DNA, 18 bp, Homo sapiens
agtaaggaatgatattgc

SEQ ID NO: 4448616 - DNA, 21 bp, Homo sapiens
agtaaggctggtaagagaagt

SEQ ID NO: 4448617 - DNA, 23 bp, Homo sapiens
agtaaggctggtaagagaagtga

SEQ ID NO: 4448618 - DNA, 14 bp, Homo sapiens
agtaagtaattatg

SEQ ID NO: 4448619 - DNA, 20 bp, Homo sapiens
agtaagtaattatgcactaa

SEQ ID NO: 4448620 - DNA, 19 bp, Homo sapiens
agtaagttaatgtatataa

SEQ ID NO: 4448621 - DNA, 19 bp, Homo sapiens
agtaagtttttttagaaga

SEQ ID NO: 4448622 - DNA, 16 bp, Homo sapiens
agtaataaactgtgtt

SEQ ID NO: 4448623 - DNA, 13 bp, Homo sapiens
agtaatacaaact

SEQ ID NO: 4448624 - DNA, 19 bp, Homo sapiens
agtaatattttactttgag

SEQ ID NO: 4448625 - DNA, 13 bp, Homo sapiens
agtaatcacttaa

SEQ ID NO: 4448626 - DNA, 16 bp, Homo sapiens
agtaatcctgcacaga

SEQ ID NO: 4448627 - DNA, 14 bp, Homo sapiens
agtaatctgtataa

SEQ ID NO: 4448628 - DNA, 19 bp, Homo sapiens
agtaatctgtcagtgtttg

SEQ ID NO: 4448629 - DNA, 14 bp, Homo sapiens
agtaatgaaatgtt

SEQ ID NO: 4448630 - DNA, 15 bp, Homo sapiens
agtatttagaagcca

SEQ ID NO: 4448631 - DNA, 20 bp, Homo sapiens
agtatttataaaaatataaa

SEQ ID NO: 4448632 - DNA, 20 bp, Homo sapiens
agtatttctcctttgcaata

SEQ ID NO: 4448633 - DNA, 16 bp, Homo sapiens
agtatttgatgtacat

SEQ ID NO: 4448634 - DNA, 17 bp, Homo sapiens
agtatttgatgtacatt

SEQ ID NO: 4448635 - DNA, 20 bp, Homo sapiens
agtatttgattcaaaatatt

SEQ ID NO: 4448636 - DNA, 23 bp, Homo sapiens
agtatttgattcaaaatatttaa

SEQ ID NO: 4448637 - DNA, 13 bp, Homo sapiens
agtatttgttaat

SEQ ID NO: 4448638 - DNA, 14 bp, Homo sapiens
agtatttgttaatt

SEQ ID NO: 4448639 - DNA, 18 bp, Homo sapiens
agtatttgttaatttaga

SEQ ID NO: 4448640 - DNA, 19 bp, Homo sapiens
agtattttaattttaaaga

SEQ ID NO: 4448641 - DNA, 13 bp, Homo sapiens
agtattttcacac

SEQ ID NO: 4448642 - DNA, 21 bp, Homo sapiens
agtattttccagccttatgtg

SEQ ID NO: 4448643 - DNA, 17 bp, Homo sapiens
agtattttgctggaata

SEQ ID NO: 4448644 - DNA, 19 bp, Homo sapiens
agtattttttcaagttgta

SEQ ID NO: 4448645 - DNA, 20 bp, Homo sapiens
agtattttttgtataattgg

SEQ ID NO: 4448646 - DNA, 14 bp, Homo sapiens
agtcaaaaagaacc

SEQ ID NO: 4448647 - DNA, 13 bp, Homo sapiens
agtcaaaacttta

SEQ ID NO: 4448648 - DNA, 15 bp, Homo sapiens
agtcaaactgtgcca

SEQ ID NO: 4448649 - DNA, 13 bp, Homo sapiens
agtcaacagtaaa

SEQ ID NO: 4448650 - DNA, 20 bp, Homo sapiens
agtcaacagtaaaccactga

SEQ ID NO: 4448651 - DNA, 22 bp, Homo sapiens
agtcaacagtaaaccactgaaa

SEQ ID NO: 4448652 - DNA, 15 bp, Homo sapiens
agtcaacctgcctga

SEQ ID NO: 4448653 - DNA, 19 bp, Homo sapiens
agtcaacggggggctcctg

SEQ ID NO: 4448654 - DNA, 22 bp, Homo sapiens
agtcaacggggggctcctgccc

SEQ ID NO: 4448655 - DNA, 12 bp, Homo sapiens
agtcaactggct

SEQ ID NO: 4448656 - DNA, 17 bp, Homo sapiens
agtcaactggctggcca

SEQ ID NO: 4448657 - DNA, 17 bp, Homo sapiens
agtcaagatagaaaggg

SEQ ID NO: 4448658 - DNA, 12 bp, Homo sapiens
agtcaatacata

SEQ ID NO: 4448659 - DNA, 18 bp, Homo sapiens
agtcaatcccctcattca

SEQ ID NO: 4448660 - DNA, 17 bp, Homo sapiens
agtcacacagtgttgga

SEQ ID NO: 4448661 - DNA, 21 bp, Homo sapiens
agtcacagccgtttgaatata

SEQ ID NO: 4448662 - DNA, 20 bp, Homo sapiens
agtcacccctttctgtccca

SEQ ID NO: 4448663 - DNA, 21 bp, Homo sapiens
agtcacccctttctgtcccac

SEQ ID NO: 4448664 - DNA, 22 bp, Homo sapiens
agtcaccttttctgtggctggc

SEQ ID NO: 4448665 - DNA, 16 bp, Homo sapiens
agtcactaaaaggaag

SEQ ID NO: 4448666 - DNA, 17 bp, Homo sapiens
agtcactgagcatcact

SEQ ID NO: 4448667 - DNA, 16 bp, Homo sapiens
agtcactgatgtacaa

SEQ ID NO: 4448668 - DNA, 23 bp, Homo sapiens
agtcactgatgtacaattaaaaa

SEQ ID NO: 4448669 - DNA, 18 bp, Homo sapiens
agtcactgcatttgcctg

SEQ ID NO: 4448670 - DNA, 21 bp, Homo sapiens
agtcactggaggttgaagcca

SEQ ID NO: 4448671 - DNA, 23 bp, Homo sapiens
agtcactggaggttgaagccaag

SEQ ID NO: 4448672 - DNA, 20 bp, Homo sapiens
agtcagaatgtgaaaaagga

SEQ ID NO: 4448673 - DNA, 21 bp, Homo sapiens
agtcagaatgtgaaaaaggaa

SEQ ID NO: 4448674 - DNA, 16 bp, Homo sapiens
agtcagaggagaagag

SEQ ID NO: 4448675 - DNA, 15 bp, Homo sapiens
agtcagagtccagtg

SEQ ID NO: 4448676 - DNA, 18 bp, Homo sapiens
agtcagagtccagtgctc

SEQ ID NO: 4448677 - DNA, 20 bp, Homo sapiens
agtcagatggaaaattcatt

SEQ ID NO: 4448678 - DNA, 23 bp, Homo sapiens
agtcagatggaaaattcattttt

SEQ ID NO: 4448679 - DNA, 12 bp, Homo sapiens
agtcagatgttt

SEQ ID NO: 4448680 - DNA, 11 bp, Homo sapiens
agtcagcctct

SEQ ID NO: 4448681 - DNA, 18 bp, Homo sapiens
agtcagggacctgctgct

SEQ ID NO: 4448682 - DNA, 15 bp, Homo sapiens
agtcagttctctttg

SEQ ID NO: 4448683 - DNA, 23 bp, Homo sapiens
agtcagttgctcaaaaagaaatc

SEQ ID NO: 4448684 - DNA, 14 bp, Homo sapiens
agtcataccaatga

SEQ ID NO: 4448685 - DNA, 15 bp, Homo sapiens
agtcatcaatgcaat

SEQ ID NO: 4448686 - DNA, 23 bp, Homo sapiens
agtcatcttgctaccagtattta

SEQ ID NO: 4448687 - DNA, 15 bp, Homo sapiens
agtcatgatctccct

SEQ ID NO: 4448688 - DNA, 21 bp, Homo sapiens
agtcatggctaatttaacacc

SEQ ID NO: 4448689 - DNA, 16 bp, Homo sapiens
agtcattaaattacta

SEQ ID NO: 4448690 - DNA, 17 bp, Homo sapiens
agtcattaaattactat

SEQ ID NO: 4448691 - DNA, 22 bp, Homo sapiens
agtcattatgagaggcaatgat

SEQ ID NO: 4448692 - DNA, 17 bp, Homo sapiens
agtcattgacttcattt

SEQ ID NO: 4448693 - DNA, 18 bp, Homo sapiens
agtcattttattttgtaa

SEQ ID NO: 4448694 - DNA, 12 bp, Homo sapiens
agtcattttggg

SEQ ID NO: 4448695 - DNA, 12 bp, Homo sapiens
agtcatttttgt

SEQ ID NO: 4448696 - DNA, 11 bp, Homo sapiens
agtccaagcat

SEQ ID NO: 4448697 - DNA, 15 bp, Homo sapiens
agtccaattttaatt

SEQ ID NO: 4448698 - DNA, 14 bp, Homo sapiens
agtccacaaaataa

SEQ ID NO: 4448699 - DNA, 18 bp, Homo sapiens
agtccacaggacgcacag

SEQ ID NO: 4448700 - DNA, 22 bp, Homo sapiens
agtccacgcccaccagccttgc

SEQ ID NO: 4448701 - DNA, 11 bp, Homo sapiens
agtccagaccc

SEQ ID NO: 4448702 - DNA, 18 bp, Homo sapiens
agtccagaccccccagcc

SEQ ID NO: 4448703 - DNA, 22 bp, Homo sapiens
agtccagcaaataaagcagtca

SEQ ID NO: 4448704 - DNA, 13 bp, Homo sapiens
agtccagcccctc

SEQ ID NO: 4448705 - DNA, 18 bp, Homo sapiens
agtccagcccctcctccc

SEQ ID NO: 4448706 - DNA, 19 bp, Homo sapiens
agtccagcccctcctccct

SEQ ID NO: 4448707 - DNA, 22 bp, Homo sapiens
agtccagcccctcctccctcag

SEQ ID NO: 4448708 - DNA, 12 bp, Homo sapiens
agtccagctccc

SEQ ID NO: 4448709 - DNA, 16 bp, Homo sapiens
agtccaggcccccagc

SEQ ID NO: 4448710 - DNA, 17 bp, Homo sapiens
agtccaggcccccagcc

SEQ ID NO: 4448711 - DNA, 22 bp, Homo sapiens
agtccaggcccccagcccctcc

SEQ ID NO: 4448712 - DNA, 20 bp, Homo sapiens
agtccaggcctctctctgct

SEQ ID NO: 4448713 - DNA, 22 bp, Homo sapiens
agtccaggcctctctctgctcc

SEQ ID NO: 4448714 - DNA, 17 bp, Homo sapiens
agtccagggtttctctg

SEQ ID NO: 4448715 - DNA, 15 bp, Homo sapiens
agtccagtgctctgc

SEQ ID NO: 4448716 - DNA, 17 bp, Homo sapiens
agtccagtgctctgcct

SEQ ID NO: 4448717 - DNA, 15 bp, Homo sapiens
agtccataccttata

SEQ ID NO: 4448718 - DNA, 22 bp, Homo sapiens
agtccatgcatgacagcctcta

SEQ ID NO: 4448719 - DNA, 18 bp, Homo sapiens
agtccatgctccagggtc

SEQ ID NO: 4448720 - DNA, 16 bp, Homo sapiens
agtccattctcccagg

SEQ ID NO: 4448721 - DNA, 17 bp, Homo sapiens
agtccattctcccaggt

SEQ ID NO: 4448722 - DNA, 20 bp, Homo sapiens
agtccattttttaaaaatgt

SEQ ID NO: 4448723 - DNA, 20 bp, Homo sapiens
agtcccaggggcagccacac

SEQ ID NO: 4448724 - DNA, 14 bp, Homo sapiens
agtcccattcagtg

SEQ ID NO: 4448725 - DNA, 22 bp, Homo sapiens
agtccccacagataactgaaaa

SEQ ID NO: 4448726 - DNA, 11 bp, Homo sapiens
agtccccaccc

SEQ ID NO: 4448727 - DNA, 12 bp, Homo sapiens
agtccccacccc

SEQ ID NO: 4448728 - DNA, 13 bp, Homo sapiens
agtccccacccct

SEQ ID NO: 4448729 - DNA, 16 bp, Homo sapiens
agtccccacccctgcc

SEQ ID NO: 4448730 - DNA, 18 bp, Homo sapiens
agtccccagagctccccc

SEQ ID NO: 4448731 - DNA, 13 bp, Homo sapiens
agtccccctcctc

SEQ ID NO: 4448732 - DNA, 18 bp, Homo sapiens
agtccccctcctcagcca

SEQ ID NO: 4448733 - DNA, 22 bp, Homo sapiens
agtccccctcctcagccagcct

SEQ ID NO: 4448734 - DNA, 23 bp, Homo sapiens
agtccccctcctcagccagcctc

SEQ ID NO: 4448735 - DNA, 16 bp, Homo sapiens
agtccccgtggccatc

SEQ ID NO: 4448736 - DNA, 14 bp, Homo sapiens
agtccctccctgcc

SEQ ID NO: 4448737 - DNA, 15 bp, Homo sapiens
agtccctccctgcct

SEQ ID NO: 4448738 - DNA, 16 bp, Homo sapiens
agtccctccctgcctg

SEQ ID NO: 4448739 - DNA, 18 bp, Homo sapiens
agtccctccctgcctgag

SEQ ID NO: 4448740 - DNA, 13 bp, Homo sapiens
agtccctgcctgg

SEQ ID NO: 4448741 - DNA, 21 bp, Homo sapiens
agtccctgcctggaccagcct

SEQ ID NO: 4448742 - DNA, 14 bp, Homo sapiens
agtccctgggggaa

SEQ ID NO: 4448743 - DNA, 20 bp, Homo sapiens
agtccctgggggaagccctg

SEQ ID NO: 4448744 - DNA, 21 bp, Homo sapiens
agtccctgggggaagccctgg

SEQ ID NO: 4448745 - DNA, 17 bp, Homo sapiens
agtccctgtcacctctt

SEQ ID NO: 4448746 - DNA, 18 bp, Homo sapiens
agtccctgtcacctcttc

SEQ ID NO: 4448747 - DNA, 19 bp, Homo sapiens
agtccctgtcacctcttcc

SEQ ID NO: 4448748 - DNA, 14 bp, Homo sapiens
agtggccaggtgcc

SEQ ID NO: 4448749 - DNA, 17 bp, Homo sapiens
agtggcctgatctctgc

SEQ ID NO: 4448750 - DNA, 20 bp, Homo sapiens
agtggcctgatctctgctcc

SEQ ID NO: 4448751 - DNA, 13 bp, Homo sapiens
agtggcctggcca

SEQ ID NO: 4448752 - DNA, 14 bp, Homo sapiens
agtggcctggccag

SEQ ID NO: 4448753 - DNA, 19 bp, Homo sapiens
agtggcctggccaggagct

SEQ ID NO: 4448754 - DNA, 15 bp, Homo sapiens
agtggcgggcccact

SEQ ID NO: 4448755 - DNA, 15 bp, Homo sapiens
agtggcgttgttgca

SEQ ID NO: 4448756 - DNA, 24 bp, Homo sapiens
agtggctcccctgcccagcctgct

SEQ ID NO: 4448757 - DNA, 18 bp, Homo sapiens
agtggctgccacacccag

SEQ ID NO: 4448758 - DNA, 15 bp, Homo sapiens
agtggctgccttctt

SEQ ID NO: 4448759 - DNA, 13 bp, Homo sapiens
agtggctgctctg

SEQ ID NO: 4448760 - DNA, 15 bp, Homo sapiens
agtggctgctctggg

SEQ ID NO: 4448761 - DNA, 16 bp, Homo sapiens
agtggctgtccctgtg

SEQ ID NO: 4448762 - DNA, 22 bp, Homo sapiens
agtggctgtcttaaaagatata

SEQ ID NO: 4448763 - DNA, 14 bp, Homo sapiens
agtggcttctccag

SEQ ID NO: 4448764 - DNA, 12 bp, Homo sapiens
agtggctttcta

SEQ ID NO: 4448765 - DNA, 12 bp, Homo sapiens
agtgggaagccc

SEQ ID NO: 4448766 - DNA, 15 bp, Homo sapiens
agtgggacattagta

SEQ ID NO: 4448767 - DNA, 13 bp, Homo sapiens
agtgggagaaaac

SEQ ID NO: 4448768 - DNA, 16 bp, Homo sapiens
agtgggaggcgtgccc

SEQ ID NO: 4448769 - DNA, 24 bp, Homo sapiens
agtgggcaaaagcttacaaatact

SEQ ID NO: 4448770 - DNA, 13 bp, Homo sapiens
agtgggccaggac

SEQ ID NO: 4448771 - DNA, 20 bp, Homo sapiens
agtgggccaggacaggcccg

SEQ ID NO: 4448772 - DNA, 18 bp, Homo sapiens
agtgggccctctctctgg

SEQ ID NO: 4448773 - DNA, 15 bp, Homo sapiens
agtgggcgttgggag

SEQ ID NO: 4448774 - DNA, 18 bp, Homo sapiens
agtgggcgttgggagcct

SEQ ID NO: 4448775 - DNA, 22 bp, Homo sapiens
agtgggcttgattctgcagtaa

SEQ ID NO: 4448776 - DNA, 12 bp, Homo sapiens
agtggggaagag

SEQ ID NO: 4448777 - DNA, 13 bp, Homo sapiens
agtggggagagag

SEQ ID NO: 4448778 - DNA, 16 bp, Homo sapiens
agtggggcagagcctc

SEQ ID NO: 4448779 - DNA, 14 bp, Homo sapiens
agtggggcctttgc

SEQ ID NO: 4448780 - DNA, 21 bp, Homo sapiens
agtggggcctttgccagcaga

SEQ ID NO: 4448781 - DNA, 22 bp, Homo sapiens
agtggggcctttgccagcagag

SEQ ID NO: 4448782 - DNA, 23 bp, Homo sapiens
agtggggcctttgccagcagagc

SEQ ID NO: 4448783 - DNA, 18 bp, Homo sapiens
agtggggctaaatgaagt

SEQ ID NO: 4448784 - DNA, 16 bp, Homo sapiens
agtgggggtggaggac

SEQ ID NO: 4448785 - DNA, 19 bp, Homo sapiens
agtggggtctccctctcct

SEQ ID NO: 4448786 - DNA, 20 bp, Homo sapiens
agtggggtctccctctcctg

SEQ ID NO: 4448787 - DNA, 22 bp, Homo sapiens
agtggggtctccctctcctgcc

SEQ ID NO: 4448788 - DNA, 16 bp, Homo sapiens
agtggggtgctgggag

SEQ ID NO: 4448789 - DNA, 15 bp, Homo sapiens
agtgggtacatcaag

SEQ ID NO: 4448790 - DNA, 15 bp, Homo sapiens
agtgggttattctgg

SEQ ID NO: 4448791 - DNA, 19 bp, Homo sapiens
agtgggttattctggagtt

SEQ ID NO: 4448792 - DNA, 15 bp, Homo sapiens
agtggtaaatactgt

SEQ ID NO: 4448793 - DNA, 18 bp, Homo sapiens
agtggtatagaaatgctg

SEQ ID NO: 4448794 - DNA, 13 bp, Homo sapiens
agtggtctcccca

SEQ ID NO: 4448795 - DNA, 23 bp, Homo sapiens
agtggtggcctatttcagctgct

SEQ ID NO: 4448796 - DNA, 15 bp, Homo sapiens
agtggttctctgcct

SEQ ID NO: 4448797 - DNA, 13 bp, Homo sapiens
agtggtttagaaa

SEQ ID NO: 4448798 - DNA, 14 bp, Homo sapiens
agtgtaaaatattt

SEQ ID NO: 4448799 - DNA, 18 bp, Homo sapiens
agtgtaaaatattttgaa

SEQ ID NO: 4448800 - DNA, 16 bp, Homo sapiens
agtgtaacttgcttaa

SEQ ID NO: 4448801 - DNA, 15 bp, Homo sapiens
agtgtaagaactgta

SEQ ID NO: 4448802 - DNA, 21 bp, Homo sapiens
agtgtaagaactgtacattgt

SEQ ID NO: 4448803 - DNA, 15 bp, Homo sapiens
agtgtacagtcttgt

SEQ ID NO: 4448804 - DNA, 16 bp, Homo sapiens
agtgtaccaagtgctt

SEQ ID NO: 4448805 - DNA, 19 bp, Homo sapiens
agtgtaccaagtgcttcct

SEQ ID NO: 4448806 - DNA, 20 bp, Homo sapiens
agtgtaccaagtgcttccta

SEQ ID NO: 4448807 - DNA, 16 bp, Homo sapiens
agtgtaccatttgcct

SEQ ID NO: 4448808 - DNA, 14 bp, Homo sapiens
agtgtagattttat

SEQ ID NO: 4448809 - DNA, 15 bp, Homo sapiens
agtgtagattttata

SEQ ID NO: 4448810 - DNA, 15 bp, Homo sapiens
agtgtattaatcata

SEQ ID NO: 4448811 - DNA, 15 bp, Homo sapiens
agtgtcaagttgtgc

SEQ ID NO: 4448812 - DNA, 19 bp, Homo sapiens
agtgtcaatgcagccccca

SEQ ID NO: 4448813 - DNA, 14 bp, Homo sapiens
agtgtccagagacc

SEQ ID NO: 4448814 - DNA, 23 bp, Homo sapiens
agtgtcctatgcaataaaattat

SEQ ID NO: 4448815 - DNA, 22 bp, Homo sapiens
agtgtcctcttccctctctgca

SEQ ID NO: 4448816 - DNA, 12 bp, Homo sapiens
agtgtcctgccc

SEQ ID NO: 4448817 - DNA, 17 bp, Homo sapiens
agtgtcgggaattttcc

SEQ ID NO: 4448818 - DNA, 17 bp, Homo sapiens
agtgtctccccgtgtcc

SEQ ID NO: 4448819 - DNA, 21 bp, Homo sapiens
agtgtctgacttttgttaaat

SEQ ID NO: 4448820 - DNA, 18 bp, Homo sapiens
agtgtctggatcagtaaa

SEQ ID NO: 4448821 - DNA, 23 bp, Homo sapiens
agtgtctggatcagtaaaattat

SEQ ID NO: 4448822 - DNA, 18 bp, Homo sapiens
agtgtcttaattaaaaga

SEQ ID NO: 4448823 - DNA, 13 bp, Homo sapiens
agtgtctttccac

SEQ ID NO: 4448824 - DNA, 23 bp, Homo sapiens
agtgtctttccacggagccactc

SEQ ID NO: 4448825 - DNA, 13 bp, Homo sapiens
agtgtgaaccccc

SEQ ID NO: 4448826 - DNA, 17 bp, Homo sapiens
agtgtgaatagcctggc

SEQ ID NO: 4448827 - DNA, 18 bp, Homo sapiens
agtgtgaatagcctggcc

SEQ ID NO: 4448828 - DNA, 21 bp, Homo sapiens
agtgtgaatagcctggccacc

SEQ ID NO: 4448829 - DNA, 13 bp, Homo sapiens
agtgtgagctctt

SEQ ID NO: 4448830 - DNA, 18 bp, Homo sapiens
agtgtgaggccagggcag

SEQ ID NO: 4448831 - DNA, 16 bp, Homo sapiens
agtgtgctaaaaatga

SEQ ID NO: 4448832 - DNA, 17 bp, Homo sapiens
agtgtgctcggacacag

SEQ ID NO: 4448833 - DNA, 20 bp, Homo sapiens
agtgtggctgaggaggcctc

SEQ ID NO: 4448834 - DNA, 13 bp, Homo sapiens
agtgtggctggtg

SEQ ID NO: 4448835 - DNA, 16 bp, Homo sapiens
agtgtggctggtgtcc

SEQ ID NO: 4448836 - DNA, 18 bp, Homo sapiens
agtgtggctggtgtcccc

SEQ ID NO: 4448837 - DNA, 22 bp, Homo sapiens
agtgtggctggtgtccccttcc

SEQ ID NO: 4448838 - DNA, 15 bp, Homo sapiens
agtgtgggaagggag

SEQ ID NO: 4448839 - DNA, 17 bp, Homo sapiens
agtgtgggaagggagag

SEQ ID NO: 4448840 - DNA, 16 bp, Homo sapiens
agtgtgggtctgtgtg

SEQ ID NO: 4448841 - DNA, 17 bp, Homo sapiens
agtgtgggtctgtgtgt

SEQ ID NO: 4448842 - DNA, 14 bp, Homo sapiens
agtgtgtaaaatta

SEQ ID NO: 4448843 - DNA, 16 bp, Homo sapiens
agtgtgtaaaattaat

SEQ ID NO: 4448844 - DNA, 20 bp, Homo sapiens
agtgtgtaaaattaatgtaa

SEQ ID NO: 4448845 - DNA, 17 bp, Homo sapiens
agtgtgtataaaacatt

SEQ ID NO: 4448846 - DNA, 22 bp, Homo sapiens
agtgtgtataaaacattaattg

SEQ ID NO: 4448847 - DNA, 19 bp, Homo sapiens
agtgtgtcctgtgtaaatt

SEQ ID NO: 4448848 - DNA, 20 bp, Homo sapiens
agtgtgtcctgtgtaaatta

SEQ ID NO: 4448849 - DNA, 19 bp, Homo sapiens
agtgtgtgcataatagcta

SEQ ID NO: 4448850 - DNA, 13 bp, Homo sapiens
agtgtgtgccaag

SEQ ID NO: 4448851 - DNA, 13 bp, Homo sapiens
agtgtgtgtgggg

SEQ ID NO: 4448852 - DNA, 22 bp, Homo sapiens
agtgtgtgtttgtgtgtttcaa

SEQ ID NO: 4448853 - DNA, 16 bp, Homo sapiens
agtgttaatacatcac

SEQ ID NO: 4448854 - DNA, 17 bp, Homo sapiens
agtgttaatacatcaca

SEQ ID NO: 4448855 - DNA, 21 bp, Homo sapiens
agtgttaatacatcacatctt

SEQ ID NO: 4448856 - DNA, 18 bp, Homo sapiens
agtgttagggaagggcct

SEQ ID NO: 4448857 - DNA, 23 bp, Homo sapiens
agtgttagtgctggtcagagaga

SEQ ID NO: 4448858 - DNA, 15 bp, Homo sapiens
agtgttatgtatttc

SEQ ID NO: 4448859 - DNA, 15 bp, Homo sapiens
agtgttcacaaactg

SEQ ID NO: 4448860 - DNA, 16 bp, Homo sapiens
agtgttcacaaactgt

SEQ ID NO: 4448861 - DNA, 18 bp, Homo sapiens
agtgttcacaaactgtga

SEQ ID NO: 4448862 - DNA, 16 bp, Homo sapiens
agtgttcccgtgcctg

SEQ ID NO: 4448863 - DNA, 18 bp, Homo sapiens
agtgttcctgaagctgct

SEQ ID NO: 4448864 - DNA, 16 bp, Homo sapiens
agtgtttatgtaatag

SEQ ID NO: 4448865 - DNA, 13 bp, Homo sapiens
agtgtttatgtgc

SEQ ID NO: 4448866 - DNA, 16 bp, Homo sapiens
agtgtttatgtgctat

SEQ ID NO: 4448867 - DNA, 20 bp, Homo sapiens
agttgagattcaaacccagg

SEQ ID NO: 4448868 - DNA, 18 bp, Homo sapiens
agttgagcgtgcgcactg

SEQ ID NO: 4448869 - DNA, 16 bp, Homo sapiens
agttgaggaactgtac

SEQ ID NO: 4448870 - DNA, 15 bp, Homo sapiens
agttgaggagtttcc

SEQ ID NO: 4448871 - DNA, 20 bp, Homo sapiens
agttgattaagaaaggaagt

SEQ ID NO: 4448872 - DNA, 21 bp, Homo sapiens
agttgattccttgagtttcat

SEQ ID NO: 4448873 - DNA, 23 bp, Homo sapiens
agttgattccttgagtttcatat

SEQ ID NO: 4448874 - DNA, 14 bp, Homo sapiens
agttgattgagaag

SEQ ID NO: 4448875 - DNA, 23 bp, Homo sapiens
agttgatttttttttttttttcc

SEQ ID NO: 4448876 - DNA, 18 bp, Homo sapiens
agttgcaattgaattaaa

SEQ ID NO: 4448877 - DNA, 16 bp, Homo sapiens
agttgcagtattggac

SEQ ID NO: 4448878 - DNA, 19 bp, Homo sapiens
agttgcatgtagtaacact

SEQ ID NO: 4448879 - DNA, 13 bp, Homo sapiens
agttgcctccagg

SEQ ID NO: 4448880 - DNA, 23 bp, Homo sapiens
agttgctctgacctcctctgggc

SEQ ID NO: 4448881 - DNA, 14 bp, Homo sapiens
agttggactctcag

SEQ ID NO: 4448882 - DNA, 21 bp, Homo sapiens
agttggcagaaatacagtctt

SEQ ID NO: 4448883 - DNA, 20 bp, Homo sapiens
agttgggggtgtggctctgc

SEQ ID NO: 4448884 - DNA, 18 bp, Homo sapiens
agttgggtagaaaaatta

SEQ ID NO: 4448885 - DNA, 13 bp, Homo sapiens
agttggtaacttt

SEQ ID NO: 4448886 - DNA, 15 bp, Homo sapiens
agttggtaacttttg

SEQ ID NO: 4448887 - DNA, 19 bp, Homo sapiens
agttggtattaataaaaag

SEQ ID NO: 4448888 - DNA, 17 bp, Homo sapiens
agttggtgtaatcattt

SEQ ID NO: 4448889 - DNA, 13 bp, Homo sapiens
agttggtgtgttt

SEQ ID NO: 4448890 - DNA, 23 bp, Homo sapiens
agttggtgtgtttttgggatgtc

SEQ ID NO: 4448891 - DNA, 13 bp, Homo sapiens
agttgtaaagtat

SEQ ID NO: 4448892 - DNA, 18 bp, Homo sapiens
agttgtaaagtatgtatt

SEQ ID NO: 4448893 - DNA, 14 bp, Homo sapiens
agttgtacatgata

SEQ ID NO: 4448894 - DNA, 18 bp, Homo sapiens
agttgtaccgcaatgtga

SEQ ID NO: 4448895 - DNA, 19 bp, Homo sapiens
agttgtaccgcaatgtgac

SEQ ID NO: 4448896 - DNA, 18 bp, Homo sapiens
agttgtagacaaagtaca

SEQ ID NO: 4448897 - DNA, 23 bp, Homo sapiens
agttgtatcagcacgtgtggcct

SEQ ID NO: 4448898 - DNA, 17 bp, Homo sapiens
agttgtatttcaaatat

SEQ ID NO: 4448899 - DNA, 20 bp, Homo sapiens
agttgtcacagtcttgtgaa

SEQ ID NO: 4448900 - DNA, 15 bp, Homo sapiens
agttgtgcacgcaga

SEQ ID NO: 4448901 - DNA, 19 bp, Homo sapiens
agttgtgcttgtttacagc

SEQ ID NO: 4448902 - DNA, 17 bp, Homo sapiens
agttgtgttttttaaga

SEQ ID NO: 4448903 - DNA, 19 bp, Homo sapiens
agttgtgttttttaagatg

SEQ ID NO: 4448904 - DNA, 21 bp, Homo sapiens
agttgttcgccgcgtggaatg

SEQ ID NO: 4448905 - DNA, 18 bp, Homo sapiens
agttgttctttttagaaa

SEQ ID NO: 4448906 - DNA, 15 bp, Homo sapiens
agttgttgactgtga

SEQ ID NO: 4448907 - DNA, 18 bp, Homo sapiens
agttgttgactgtgatta

SEQ ID NO: 4448908 - DNA, 22 bp, Homo sapiens
agttgttggtttattttaatgg

SEQ ID NO: 4448909 - DNA, 17 bp, Homo sapiens
agttgttgtttgccaag

SEQ ID NO: 4448910 - DNA, 19 bp, Homo sapiens
agttgttttcagactcaga

SEQ ID NO: 4448911 - DNA, 20 bp, Homo sapiens
agtttaaaaaataacttcat

SEQ ID NO: 4448912 - DNA, 16 bp, Homo sapiens
agtttaaaaatcaact

SEQ ID NO: 4448913 - DNA, 17 bp, Homo sapiens
agtttaaaaatcaactt

SEQ ID NO: 4448914 - DNA, 15 bp, Homo sapiens
agtttaaaatcatca

SEQ ID NO: 4448915 - DNA, 19 bp, Homo sapiens
agtttaaatgtattttaca

SEQ ID NO: 4448916 - DNA, 23 bp, Homo sapiens
agtttaaccaaaaagaccagact

SEQ ID NO: 4448917 - DNA, 17 bp, Homo sapiens
agtttaataaatttatt

SEQ ID NO: 4448918 - DNA, 15 bp, Homo sapiens
agtttaatacaggaa

SEQ ID NO: 4448919 - DNA, 23 bp, Homo sapiens
agtttaatacaggaaattgactt

SEQ ID NO: 4448920 - DNA, 16 bp, Homo sapiens
agtttaatcagaggaa

SEQ ID NO: 4448921 - DNA, 15 bp, Homo sapiens
agtttaattgactta

SEQ ID NO: 4448922 - DNA, 14 bp, Homo sapiens
agtttacagatgtt

SEQ ID NO: 4448923 - DNA, 15 bp, Homo sapiens
agtttacagatgttt

SEQ ID NO: 4448924 - DNA, 12 bp, Homo sapiens
agtttaccatct

SEQ ID NO: 4448925 - DNA, 16 bp, Homo sapiens
agtttagaagcgctca

SEQ ID NO: 4448926 - DNA, 23 bp, Homo sapiens
agtttagaatggaggaagaacaa

SEQ ID NO: 4448927 - DNA, 22 bp, Homo sapiens
agtttatacagttttaaagaat

SEQ ID NO: 4448928 - DNA, 15 bp, Homo sapiens
agtttatcatgaagc

SEQ ID NO: 4448929 - DNA, 16 bp, Homo sapiens
agtttatcatgaagcc

SEQ ID NO: 4448930 - DNA, 22 bp, Homo sapiens
agtttatcttaagcatgtcaat

SEQ ID NO: 4448931 - DNA, 19 bp, Homo sapiens
agtttatggcaaagatttt

SEQ ID NO: 4448932 - DNA, 19 bp, Homo sapiens
agtttattacaatgtatct

SEQ ID NO: 4448933 - DNA, 22 bp, Homo sapiens
agtttattacaatgtatcttta

SEQ ID NO: 4448934 - DNA, 14 bp, Homo sapiens
agtttattattgta

SEQ ID NO: 4448935 - DNA, 22 bp, Homo sapiens
agtttcaagttttaaagttcat

SEQ ID NO: 4448936 - DNA, 20 bp, Homo sapiens
agtttcacaaatccttcaaa

SEQ ID NO: 4448937 - DNA, 12 bp, Homo sapiens
agtttcaccatg

SEQ ID NO: 4448938 - DNA, 15 bp, Homo sapiens
agtttcatgtacaag

SEQ ID NO: 4448939 - DNA, 18 bp, Homo sapiens
agtttcatgtacaagatg

SEQ ID NO: 4448940 - DNA, 21 bp, Homo sapiens
agtttcatgtacaagatgaag

SEQ ID NO: 4448941 - DNA, 19 bp, Homo sapiens
agtttcatgtatgtatata

SEQ ID NO: 4448942 - DNA, 17 bp, Homo sapiens
agtttcctaaaagttca

SEQ ID NO: 4448943 - DNA, 19 bp, Homo sapiens
agtttctatggattcactt

SEQ ID NO: 4448944 - DNA, 21 bp, Homo sapiens
agtttctatggattcacttct

SEQ ID NO: 4448945 - DNA, 17 bp, Homo sapiens
agtttctgtttgattct

SEQ ID NO: 4448946 - DNA, 15 bp, Homo sapiens
agtttcttgtgtaga

SEQ ID NO: 4448947 - DNA, 18 bp, Homo sapiens
agtttcttgtgtagattt

SEQ ID NO: 4448948 - DNA, 14 bp, Homo sapiens
agtttctttagaaa

SEQ ID NO: 4448949 - DNA, 14 bp, Homo sapiens
agtttctttcccca

SEQ ID NO: 4448950 - DNA, 13 bp, Homo sapiens
agtttgaaattct

SEQ ID NO: 4448951 - DNA, 18 bp, Homo sapiens
agtttgagaccaggctgg

SEQ ID NO: 4448952 - DNA, 19 bp, Homo sapiens
agtttgagaccaggctggg

SEQ ID NO: 4448953 - DNA, 21 bp, Homo sapiens
agtttgcagaaaagcacctgc

SEQ ID NO: 4448954 - DNA, 13 bp, Homo sapiens
agtttgccagaag

SEQ ID NO: 4448955 - DNA, 17 bp, Homo sapiens
agtttgccaggaggaac

SEQ ID NO: 4448956 - DNA, 18 bp, Homo sapiens
agtttgcttgatatattt

SEQ ID NO: 4448957 - DNA, 14 bp, Homo sapiens
agtttggaaataaa

SEQ ID NO: 4448958 - DNA, 22 bp, Homo sapiens
agtttggaaataaaaatgttct

SEQ ID NO: 4448959 - DNA, 22 bp, Homo sapiens
agtttggaattattgtagacat

SEQ ID NO: 4448960 - DNA, 16 bp, Homo sapiens
agtttggatatgtaaa

SEQ ID NO: 4448961 - DNA, 16 bp, Homo sapiens
agtttgggctggagct

SEQ ID NO: 4448962 - DNA, 20 bp, Homo sapiens
agtttgggctggagctcctc

SEQ ID NO: 4448963 - DNA, 21 bp, Homo sapiens
agtttgtgtatatattataaa

SEQ ID NO: 4448964 - DNA, 21 bp, Homo sapiens
agtttgttctccgggtgtggc

SEQ ID NO: 4448965 - DNA, 19 bp, Homo sapiens
agttttaaacccaaaatat

SEQ ID NO: 4448966 - DNA, 16 bp, Homo sapiens
agttttaaagaaattt

SEQ ID NO: 4448967 - DNA, 15 bp, Homo sapiens
agttttacagtgttt

SEQ ID NO: 4448968 - DNA, 15 bp, Homo sapiens
agttttacattttaa

SEQ ID NO: 4448969 - DNA, 23 bp, Homo sapiens
agttttactcttaaatcatttgg

SEQ ID NO: 4448970 - DNA, 18 bp, Homo sapiens
agttttagctgtagatca

SEQ ID NO: 4448971 - DNA, 17 bp, Homo sapiens
agttttagttaaaactc

SEQ ID NO: 4448972 - DNA, 21 bp, Homo sapiens
agttttatcctggccttgtac

SEQ ID NO: 4448973 - DNA, 14 bp, Homo sapiens
agttttattttaaa

SEQ ID NO: 4448974 - DNA, 17 bp, Homo sapiens
agttttattttaaatta

SEQ ID NO: 4448975 - DNA, 18 bp, Homo sapiens
agttttattttaaattat

SEQ ID NO: 4448976 - DNA, 16 bp, Homo sapiens
agttttcagaacctct

SEQ ID NO: 4448977 - DNA, 17 bp, Homo sapiens
agttttcagaacctctt

SEQ ID NO: 4448978 - DNA, 21 bp, Homo sapiens
agttttcagaacctcttcccc

SEQ ID NO: 4448979 - DNA, 13 bp, Homo sapiens
agttttcagcctt

SEQ ID NO: 4448980 - DNA, 12 bp, Homo sapiens
agttttcagtgg

SEQ ID NO: 4448981 - DNA, 14 bp, Homo sapiens
agttttctgagaaa

SEQ ID NO: 4448982 - DNA, 14 bp, Homo sapiens
agttttctttatga

SEQ ID NO: 4448983 - DNA, 17 bp, Homo sapiens
agttttgagtaattcaa

SEQ ID NO: 4448984 - DNA, 18 bp, Homo sapiens
agttttgagtaattcaag

SEQ ID NO: 4448985 - DNA, 17 bp, Homo sapiens
ataaatgtgtgtatgtg

SEQ ID NO: 4448986 - DNA, 10 bp, Homo sapiens
ataaatgttc

SEQ ID NO: 4448987 - DNA, 11 bp, Homo sapiens
ataaatgttca

SEQ ID NO: 4448988 - DNA, 13 bp, Homo sapiens
ataaatgttcaaa

SEQ ID NO: 4448989 - DNA, 17 bp, Homo sapiens
ataaatgttcaaactgt

SEQ ID NO: 4448990 - DNA, 15 bp, Homo sapiens
ataaatgtttatatt

SEQ ID NO: 4448991 - DNA, 18 bp, Homo sapiens
ataaatgtttatattgtt

SEQ ID NO: 4448992 - DNA, 19 bp, Homo sapiens
ataaattaaatatatgtat

SEQ ID NO: 4448993 - DNA, 15 bp, Homo sapiens
ataaattaagatcct

SEQ ID NO: 4448994 - DNA, 21 bp, Homo sapiens
ataaattaagatcctaaactc

SEQ ID NO: 4448995 - DNA, 22 bp, Homo sapiens
ataaattaagatcctaaactct

SEQ ID NO: 4448996 - DNA, 12 bp, Homo sapiens
ataaattatgaa

SEQ ID NO: 4448997 - DNA, 15 bp, Homo sapiens
ataaattatggcatt

SEQ ID NO: 4448998 - DNA, 13 bp, Homo sapiens
ataaattattact

SEQ ID NO: 4448999 - DNA, 18 bp, Homo sapiens
ataaattattactttaaa

SEQ ID NO: 4449000 - DNA, 14 bp, Homo sapiens
ataaattcactttc

SEQ ID NO: 4449001 - DNA, 16 bp, Homo sapiens
ataaattctataggaa

SEQ ID NO: 4449002 - DNA, 13 bp, Homo sapiens
ataaattgtacat

SEQ ID NO: 4449003 - DNA, 16 bp, Homo sapiens
ataaattgtacatttt

SEQ ID NO: 4449004 - DNA, 23 bp, Homo sapiens
ataaattgtacattttgtaaaat

SEQ ID NO: 4449005 - DNA, 13 bp, Homo sapiens
ataaattgtcttt

SEQ ID NO: 4449006 - DNA, 22 bp, Homo sapiens
ataaattgtttagtggaaaata

SEQ ID NO: 4449007 - DNA, 15 bp, Homo sapiens
ataaatttaagaaaa

SEQ ID NO: 4449008 - DNA, 17 bp, Homo sapiens
ataaatttaagaaaaca

SEQ ID NO: 4449009 - DNA, 22 bp, Homo sapiens
ataaatttcccagttaaagatt

SEQ ID NO: 4449010 - DNA, 12 bp, Homo sapiens
ataaatttgaat

SEQ ID NO: 4449011 - DNA, 20 bp, Homo sapiens
ataaatttgacttttctgta

SEQ ID NO: 4449012 - DNA, 16 bp, Homo sapiens
ataaattttaaaattg

SEQ ID NO: 4449013 - DNA, 12 bp, Homo sapiens
ataaattttaat

SEQ ID NO: 4449014 - DNA, 18 bp, Homo sapiens
ataaattttaattcaaga

SEQ ID NO: 4449015 - DNA, 23 bp, Homo sapiens
ataaattttaattcaagaaatga

SEQ ID NO: 4449016 - DNA, 22 bp, Homo sapiens
ataaattttttttgtttcatat

SEQ ID NO: 4449017 - DNA, 15 bp, Homo sapiens
ataacaattcctcta

SEQ ID NO: 4449018 - DNA, 21 bp, Homo sapiens
ataacactctaggatgtatat

SEQ ID NO: 4449019 - DNA, 14 bp, Homo sapiens
ataacactgtattt

SEQ ID NO: 4449020 - DNA, 22 bp, Homo sapiens
ataacagatggtgctgctaatt

SEQ ID NO: 4449021 - DNA, 13 bp, Homo sapiens
ataacagatgtga

SEQ ID NO: 4449022 - DNA, 22 bp, Homo sapiens
ataacagatgtgaaaatatact

SEQ ID NO: 4449023 - DNA, 17 bp, Homo sapiens
ataacagccttttcctt

SEQ ID NO: 4449024 - DNA, 22 bp, Homo sapiens
ataacagttttgagtaattcaa

SEQ ID NO: 4449025 - DNA, 13 bp, Homo sapiens
ataacataaaagc

SEQ ID NO: 4449026 - DNA, 17 bp, Homo sapiens
ataacatatcaaatgaa

SEQ ID NO: 4449027 - DNA, 17 bp, Homo sapiens
ataacatattttttctt

SEQ ID NO: 4449028 - DNA, 20 bp, Homo sapiens
ataacatctttattgaaatt

SEQ ID NO: 4449029 - DNA, 18 bp, Homo sapiens
ataacattaagaaaatat

SEQ ID NO: 4449030 - DNA, 20 bp, Homo sapiens
ataacattaagaaaatattt

SEQ ID NO: 4449031 - DNA, 12 bp, Homo sapiens
ataacatttaaa

SEQ ID NO: 4449032 - DNA, 17 bp, Homo sapiens
ataacatttaaattcca

SEQ ID NO: 4449033 - DNA, 14 bp, Homo sapiens
ataaccaatttgta

SEQ ID NO: 4449034 - DNA, 17 bp, Homo sapiens
ataaccaatttgtaatg

SEQ ID NO: 4449035 - DNA, 16 bp, Homo sapiens
ataaccatctgaaagt

SEQ ID NO: 4449036 - DNA, 16 bp, Homo sapiens
ataaccccattctttg

SEQ ID NO: 4449037 - DNA, 18 bp, Homo sapiens
ataaccccattctttgct

SEQ ID NO: 4449038 - DNA, 18 bp, Homo sapiens
ataacgtgttcaatattt

SEQ ID NO: 4449039 - DNA, 17 bp, Homo sapiens
ataacgtttaagccaaa

SEQ ID NO: 4449040 - DNA, 18 bp, Homo sapiens
ataacgtttaagccaaaa

SEQ ID NO: 4449041 - DNA, 15 bp, Homo sapiens
ataactaacatgtcc

SEQ ID NO: 4449042 - DNA, 20 bp, Homo sapiens
ataactaagcaagtatattt

SEQ ID NO: 4449043 - DNA, 19 bp, Homo sapiens
ataactcatttgttgtttg

SEQ ID NO: 4449044 - DNA, 21 bp, Homo sapiens
ataactcctgtcccttttccc

SEQ ID NO: 4449045 - DNA, 20 bp, Homo sapiens
ataactctgtataatagaga

SEQ ID NO: 4449046 - DNA, 18 bp, Homo sapiens
ataactgaaggagaaggt

SEQ ID NO: 4449047 - DNA, 15 bp, Homo sapiens
ataactgaatttgga

SEQ ID NO: 4449048 - DNA, 21 bp, Homo sapiens
ataactgatttctatggcttt

SEQ ID NO: 4449049 - DNA, 15 bp, Homo sapiens
ataactgtatttgaa

SEQ ID NO: 4449050 - DNA, 19 bp, Homo sapiens
ataactgtcttgtttcagt

SEQ ID NO: 4449051 - DNA, 20 bp, Homo sapiens
ataactgtcttgtttcagtg

SEQ ID NO: 4449052 - DNA, 15 bp, Homo sapiens
ataactgtgtactgt

SEQ ID NO: 4449053 - DNA, 16 bp, Homo sapiens
ataactgtttatatgt

SEQ ID NO: 4449054 - DNA, 14 bp, Homo sapiens
ataactgttttaga

SEQ ID NO: 4449055 - DNA, 15 bp, Homo sapiens
ataacttattgctga

SEQ ID NO: 4449056 - DNA, 13 bp, Homo sapiens
ataacttcattgt

SEQ ID NO: 4449057 - DNA, 19 bp, Homo sapiens
ataacttcattgtttggac

SEQ ID NO: 4449058 - DNA, 13 bp, Homo sapiens
ataacttcttaaa

SEQ ID NO: 4449059 - DNA, 15 bp, Homo sapiens
ataacttcttgaaaa

SEQ ID NO: 4449060 - DNA, 17 bp, Homo sapiens
ataacttggggaggcaa

SEQ ID NO: 4449061 - DNA, 18 bp, Homo sapiens
ataacttggggaggcaag

SEQ ID NO: 4449062 - DNA, 23 bp, Homo sapiens
ataactttctctgtgaaagcttt

SEQ ID NO: 4449063 - DNA, 17 bp, Homo sapiens
ataacttttttgagtca

SEQ ID NO: 4449064 - DNA, 11 bp, Homo sapiens
ataagaagaat

SEQ ID NO: 4449065 - DNA, 20 bp, Homo sapiens
ataagaagcaatctttgaaa

SEQ ID NO: 4449066 - DNA, 21 bp, Homo sapiens
ataagaagcaatctttgaaat

SEQ ID NO: 4449067 - DNA, 13 bp, Homo sapiens
ataagaaggcaat

SEQ ID NO: 4449068 - DNA, 15 bp, Homo sapiens
ataagaaggcaattt

SEQ ID NO: 4449069 - DNA, 15 bp, Homo sapiens
ataagactgctgcag

SEQ ID NO: 4449070 - DNA, 19 bp, Homo sapiens
ataagagaaagaggccaga

SEQ ID NO: 4449071 - DNA, 15 bp, Homo sapiens
ataagagagatgaga

SEQ ID NO: 4449072 - DNA, 18 bp, Homo sapiens
ataagagggctttttaaa

SEQ ID NO: 4449073 - DNA, 22 bp, Homo sapiens
ataagagggctttttaaatttg

SEQ ID NO: 4449074 - DNA, 18 bp, Homo sapiens
ataagataaaataaaatt

SEQ ID NO: 4449075 - DNA, 18 bp, Homo sapiens
ataagatacaataaaaca

SEQ ID NO: 4449076 - DNA, 19 bp, Homo sapiens
ataagatacaataaaacaa

SEQ ID NO: 4449077 - DNA, 19 bp, Homo sapiens
ataagatgatttaatgttg

SEQ ID NO: 4449078 - DNA, 13 bp, Homo sapiens
ataagattaataa

SEQ ID NO: 4449079 - DNA, 15 bp, Homo sapiens
ataagatttttcaaa

SEQ ID NO: 4449080 - DNA, 14 bp, Homo sapiens
ataagcagaacata

SEQ ID NO: 4449081 - DNA, 23 bp, Homo sapiens
ataagcagaacatactgttctca

SEQ ID NO: 4449082 - DNA, 18 bp, Homo sapiens
ataagcccttaataataa

SEQ ID NO: 4449083 - DNA, 20 bp, Homo sapiens
ataagcccttaataataatg

SEQ ID NO: 4449084 - DNA, 21 bp, Homo sapiens
ataagcccttaataataatgc

SEQ ID NO: 4449085 - DNA, 12 bp, Homo sapiens
ataaggaaactt

SEQ ID NO: 4449086 - DNA, 10 bp, Homo sapiens
ataaggaatt

SEQ ID NO: 4449087 - DNA, 12 bp, Homo sapiens
ataaggactgca

SEQ ID NO: 4449088 - DNA, 15 bp, Homo sapiens
ataaggactgcatgg

SEQ ID NO: 4449089 - DNA, 15 bp, Homo sapiens
ataaggagaaagaaa

SEQ ID NO: 4449090 - DNA, 23 bp, Homo sapiens
ataaggagttagaaccacagcag

SEQ ID NO: 4449091 - DNA, 14 bp, Homo sapiens
ataaggatgacttt

SEQ ID NO: 4449092 - DNA, 19 bp, Homo sapiens
ataaggccataaaacaggt

SEQ ID NO: 4449093 - DNA, 21 bp, Homo sapiens
ataaggggtcaaaatttgctg

SEQ ID NO: 4449094 - DNA, 13 bp, Homo sapiens
ataagggtagccc

SEQ ID NO: 4449095 - DNA, 13 bp, Homo sapiens
ataagtaatatct

SEQ ID NO: 4449096 - DNA, 19 bp, Homo sapiens
ataagtaatatctttcagt

SEQ ID NO: 4449097 - DNA, 18 bp, Homo sapiens
ataagtatttcaaattgg

SEQ ID NO: 4449098 - DNA, 15 bp, Homo sapiens
ataagtcaacagtaa

SEQ ID NO: 4449099 - DNA, 14 bp, Homo sapiens
ataagtcattgaaa

SEQ ID NO: 4449100 - DNA, 22 bp, Homo sapiens
ataagtccattttttaaaaatg

SEQ ID NO: 4449101 - DNA, 17 bp, Homo sapiens
ataagtgagagaaatga

SEQ ID NO: 4449102 - DNA, 18 bp, Homo sapiens
ataagtggctgtttcatc

SEQ ID NO: 4449103 - DNA, 18 bp, Homo sapiens
ataagttaatagaaagtt

SEQ ID NO: 4449104 - DNA, 23 bp, Homo sapiens
atagacaattcctccagagacac

SEQ ID NO: 4449105 - DNA, 21 bp, Homo sapiens
atagacaattgaggtaagttt

SEQ ID NO: 4449106 - DNA, 19 bp, Homo sapiens
atagacacagtattgactt

SEQ ID NO: 4449107 - DNA, 17 bp, Homo sapiens
atagacagaagaaacaa

SEQ ID NO: 4449108 - DNA, 15 bp, Homo sapiens
atagactagagaaac

SEQ ID NO: 4449109 - DNA, 20 bp, Homo sapiens
atagagacaggacagaatgt

SEQ ID NO: 4449110 - DNA, 18 bp, Homo sapiens
atagagcaaaatcaacat

SEQ ID NO: 4449111 - DNA, 22 bp, Homo sapiens
atagagcaaaatcaacatgact

SEQ ID NO: 4449112 - DNA, 15 bp, Homo sapiens
atagagcctgaggga

SEQ ID NO: 4449113 - DNA, 14 bp, Homo sapiens
atagagctttttaa

SEQ ID NO: 4449114 - DNA, 22 bp, Homo sapiens
atagagctttttaatagcacta

SEQ ID NO: 4449115 - DNA, 12 bp, Homo sapiens
atagaggaagaa

SEQ ID NO: 4449116 - DNA, 13 bp, Homo sapiens
atagaggaagaaa

SEQ ID NO: 4449117 - DNA, 14 bp, Homo sapiens
atagaggaagaaat

SEQ ID NO: 4449118 - DNA, 20 bp, Homo sapiens
atagaggctagcttctgctt

SEQ ID NO: 4449119 - DNA, 22 bp, Homo sapiens
atagaggcttctccgccagcct

SEQ ID NO: 4449120 - DNA, 18 bp, Homo sapiens
atagaggtatattggaag

SEQ ID NO: 4449121 - DNA, 17 bp, Homo sapiens
atagagtaatgatgtaa

SEQ ID NO: 4449122 - DNA, 21 bp, Homo sapiens
atagataccctacgctgtcca

SEQ ID NO: 4449123 - DNA, 13 bp, Homo sapiens
atagatataatga

SEQ ID NO: 4449124 - DNA, 14 bp, Homo sapiens
atagatataatgaa

SEQ ID NO: 4449125 - DNA, 23 bp, Homo sapiens
atagatggggcatataataaaga

SEQ ID NO: 4449126 - DNA, 12 bp, Homo sapiens
atagatgtgtgg

SEQ ID NO: 4449127 - DNA, 20 bp, Homo sapiens
atagattattataaactata

SEQ ID NO: 4449128 - DNA, 21 bp, Homo sapiens
atagattattataaactataa

SEQ ID NO: 4449129 - DNA, 22 bp, Homo sapiens
atagattcacctgtaaaacttt

SEQ ID NO: 4449130 - DNA, 16 bp, Homo sapiens
atagattgtcttaatg

SEQ ID NO: 4449131 - DNA, 13 bp, Homo sapiens
atagatttgaaaa

SEQ ID NO: 4449132 - DNA, 19 bp, Homo sapiens
atagatttgaaaaactttt

SEQ ID NO: 4449133 - DNA, 17 bp, Homo sapiens
atagattttattatgtt

SEQ ID NO: 4449134 - DNA, 17 bp, Homo sapiens
atagcaaaagaagaagt

SEQ ID NO: 4449135 - DNA, 14 bp, Homo sapiens
atagcaaagaattg

SEQ ID NO: 4449136 - DNA, 14 bp, Homo sapiens
atagcaaagtagta

SEQ ID NO: 4449137 - DNA, 16 bp, Homo sapiens
atagcaacaacaattg

SEQ ID NO: 4449138 - DNA, 15 bp, Homo sapiens
atagcaacagagcac

SEQ ID NO: 4449139 - DNA, 21 bp, Homo sapiens
atagcaataactgaaaatgaa

SEQ ID NO: 4449140 - DNA, 20 bp, Homo sapiens
atagcaatgtaaaaatggtt

SEQ ID NO: 4449141 - DNA, 19 bp, Homo sapiens
atagcactaaccaatgcct

SEQ ID NO: 4449142 - DNA, 18 bp, Homo sapiens
atagcagcttattcacaa

SEQ ID NO: 4449143 - DNA, 13 bp, Homo sapiens
atagcatgtaatg

SEQ ID NO: 4449144 - DNA, 13 bp, Homo sapiens
atagccaaaaata

SEQ ID NO: 4449145 - DNA, 16 bp, Homo sapiens
atagccaactctccca

SEQ ID NO: 4449146 - DNA, 22 bp, Homo sapiens
atagccacatttggaatacttt

SEQ ID NO: 4449147 - DNA, 18 bp, Homo sapiens
atagcccccactgcctgg

SEQ ID NO: 4449148 - DNA, 22 bp, Homo sapiens
atagccctgccctcccaagtcc

SEQ ID NO: 4449149 - DNA, 19 bp, Homo sapiens
atagccgatatcagaattt

SEQ ID NO: 4449150 - DNA, 14 bp, Homo sapiens
atagccgggcatgg

SEQ ID NO: 4449151 - DNA, 23 bp, Homo sapiens
atagcctggccaccagccatcct

SEQ ID NO: 4449152 - DNA, 22 bp, Homo sapiens
atagcctttaaatcatttttat

SEQ ID NO: 4449153 - DNA, 14 bp, Homo sapiens
atagcggccctgga

SEQ ID NO: 4449154 - DNA, 17 bp, Homo sapiens
atagcggccctggagga

SEQ ID NO: 4449155 - DNA, 17 bp, Homo sapiens
atagctaactgtaaatc

SEQ ID NO: 4449156 - DNA, 23 bp, Homo sapiens
atagctacaatttgtttttgcat

SEQ ID NO: 4449157 - DNA, 16 bp, Homo sapiens
atagctacaggaagca

SEQ ID NO: 4449158 - DNA, 17 bp, Homo sapiens
atagctatttttttcct

SEQ ID NO: 4449159 - DNA, 20 bp, Homo sapiens
atagctcactgcagcctcat

SEQ ID NO: 4449160 - DNA, 13 bp, Homo sapiens
atagctctggggt

SEQ ID NO: 4449161 - DNA, 17 bp, Homo sapiens
atagctggcaagaatgg

SEQ ID NO: 4449162 - DNA, 21 bp, Homo sapiens
atagctgtagttttccctgca

SEQ ID NO: 4449163 - DNA, 12 bp, Homo sapiens
atagctgtgact

SEQ ID NO: 4449164 - DNA, 18 bp, Homo sapiens
atagctgttctaatggat

SEQ ID NO: 4449165 - DNA, 21 bp, Homo sapiens
atagctttggaggagccatct

SEQ ID NO: 4449166 - DNA, 15 bp, Homo sapiens
ataggaaactgaagc

SEQ ID NO: 4449167 - DNA, 18 bp, Homo sapiens
ataggaacatatgaaaat

SEQ ID NO: 4449168 - DNA, 13 bp, Homo sapiens
ataggaaggaaac

SEQ ID NO: 4449169 - DNA, 14 bp, Homo sapiens
ataggaaggaaact

SEQ ID NO: 4449170 - DNA, 22 bp, Homo sapiens
ataggaattgacccacaagaaa

SEQ ID NO: 4449171 - DNA, 13 bp, Homo sapiens
ataggaccagagc

SEQ ID NO: 4449172 - DNA, 13 bp, Homo sapiens
ataggagcctgct

SEQ ID NO: 4449173 - DNA, 16 bp, Homo sapiens
ataggatttatttaaa

SEQ ID NO: 4449174 - DNA, 20 bp, Homo sapiens
ataggattttcacacattca

SEQ ID NO: 4449175 - DNA, 19 bp, Homo sapiens
ataggcagctgtcctgtga

SEQ ID NO: 4449176 - DNA, 22 bp, Homo sapiens
ataggcagggggccctgcccca

SEQ ID NO: 4449177 - DNA, 14 bp, Homo sapiens
ataggcattttaag

SEQ ID NO: 4449178 - DNA, 23 bp, Homo sapiens
ataggcctgtcccttgcctctgc

SEQ ID NO: 4449179 - DNA, 15 bp, Homo sapiens
ataggctttttaatc

SEQ ID NO: 4449180 - DNA, 16 bp, Homo sapiens
atagggaaaattctaa

SEQ ID NO: 4449181 - DNA, 14 bp, Homo sapiens
atagggctgagctc

SEQ ID NO: 4449182 - DNA, 21 bp, Homo sapiens
atagggctgggcaaggaaaaa

SEQ ID NO: 4449183 - DNA, 18 bp, Homo sapiens
ataggggagccaaggagg

SEQ ID NO: 4449184 - DNA, 14 bp, Homo sapiens
ataggggttccagg

SEQ ID NO: 4449185 - DNA, 15 bp, Homo sapiens
ataggtaaattttta

SEQ ID NO: 4449186 - DNA, 23 bp, Homo sapiens
ataggtaaatttttaggcaaaga

SEQ ID NO: 4449187 - DNA, 16 bp, Homo sapiens
ataggtctttctctca

SEQ ID NO: 4449188 - DNA, 17 bp, Homo sapiens
ataggtctttctctcag

SEQ ID NO: 4449189 - DNA, 21 bp, Homo sapiens
ataggtgctacaaaaacacag

SEQ ID NO: 4449190 - DNA, 21 bp, Homo sapiens
ataggttaaaaaaaaaagtca

SEQ ID NO: 4449191 - DNA, 22 bp, Homo sapiens
ataggttcttcttgttctgaga

SEQ ID NO: 4449192 - DNA, 13 bp, Homo sapiens
ataggttgagcaa

SEQ ID NO: 4449193 - DNA, 16 bp, Homo sapiens
ataggttgagcaattt

SEQ ID NO: 4449194 - DNA, 19 bp, Homo sapiens
atagtaaatcacgcttttt

SEQ ID NO: 4449195 - DNA, 19 bp, Homo sapiens
atagtaagacccccatctc

SEQ ID NO: 4449196 - DNA, 22 bp, Homo sapiens
atagtaataggatacaatgtat

SEQ ID NO: 4449197 - DNA, 17 bp, Homo sapiens
atagtaatgagtttaaa

SEQ ID NO: 4449198 - DNA, 23 bp, Homo sapiens
atagtaatgagtttaaaaatcaa

SEQ ID NO: 4449199 - DNA, 17 bp, Homo sapiens
atagtaatttgtaaagt

SEQ ID NO: 4449200 - DNA, 18 bp, Homo sapiens
atagtaccttcaatactt

SEQ ID NO: 4449201 - DNA, 17 bp, Homo sapiens
atagtagaaagacatct

SEQ ID NO: 4449202 - DNA, 23 bp, Homo sapiens
atagtagaaagacatctgcctgt

SEQ ID NO: 4449203 - DNA, 17 bp, Homo sapiens
atagtatacattgtctt

SEQ ID NO: 4449204 - DNA, 20 bp, Homo sapiens
atagtatgcactatatacat

SEQ ID NO: 4449205 - DNA, 20 bp, Homo sapiens
atagtatttctcctttgcaa

SEQ ID NO: 4449206 - DNA, 21 bp, Homo sapiens
atagtatttctcctttgcaat

SEQ ID NO: 4449207 - DNA, 18 bp, Homo sapiens
atagtcaaaaattaaata

SEQ ID NO: 4449208 - DNA, 17 bp, Homo sapiens
atagtcaatttctactt

SEQ ID NO: 4449209 - DNA, 15 bp, Homo sapiens
atagtcctttttcca

SEQ ID NO: 4449210 - DNA, 16 bp, Homo sapiens
atagtgaagtgttaat

SEQ ID NO: 4449211 - DNA, 20 bp, Homo sapiens
atagtgatgtaatcttgaat

SEQ ID NO: 4449212 - DNA, 15 bp, Homo sapiens
atagtgcacaaaatg

SEQ ID NO: 4449213 - DNA, 13 bp, Homo sapiens
atagtgccaggtg

SEQ ID NO: 4449214 - DNA, 16 bp, Homo sapiens
atagtgccaggtggct

SEQ ID NO: 4449215 - DNA, 18 bp, Homo sapiens
atagtgccaggtggctca

SEQ ID NO: 4449216 - DNA, 20 bp, Homo sapiens
atagtgcttcacaaaatgca

SEQ ID NO: 4449217 - DNA, 21 bp, Homo sapiens
atagtggatgatatacacagt

SEQ ID NO: 4449218 - DNA, 17 bp, Homo sapiens
atagtggcataccaaat

SEQ ID NO: 4449219 - DNA, 19 bp, Homo sapiens
atagtggcataccaaatgg

SEQ ID NO: 4449220 - DNA, 16 bp, Homo sapiens
atagtgggtacatcaa

SEQ ID NO: 4449221 - DNA, 15 bp, Homo sapiens
atagtggttaacaga

SEQ ID NO: 4449222 - DNA, 15 bp, Homo sapiens
atatattgaactttt

SEQ ID NO: 4449223 - DNA, 17 bp, Homo sapiens
atatattgaacttttgt

SEQ ID NO: 4449224 - DNA, 22 bp, Homo sapiens
atatattgaacttttgtactga

SEQ ID NO: 4449225 - DNA, 15 bp, Homo sapiens
atatattgtaaagaa

SEQ ID NO: 4449226 - DNA, 16 bp, Homo sapiens
atatattgtgttgact

SEQ ID NO: 4449227 - DNA, 14 bp, Homo sapiens
atatatttatatac

SEQ ID NO: 4449228 - DNA, 22 bp, Homo sapiens
atatatttatatactttttcat

SEQ ID NO: 4449229 - DNA, 22 bp, Homo sapiens
atatatttattttattctatgt

SEQ ID NO: 4449230 - DNA, 12 bp, Homo sapiens
atatatttcccc

SEQ ID NO: 4449231 - DNA, 14 bp, Homo sapiens
atatatttcccctt

SEQ ID NO: 4449232 - DNA, 13 bp, Homo sapiens
atatatttctatt

SEQ ID NO: 4449233 - DNA, 18 bp, Homo sapiens
atatattttacaattttt

SEQ ID NO: 4449234 - DNA, 15 bp, Homo sapiens
atatattttctgttt

SEQ ID NO: 4449235 - DNA, 18 bp, Homo sapiens
atatattttctttctagt

SEQ ID NO: 4449236 - DNA, 20 bp, Homo sapiens
atatattttctttctagttt

SEQ ID NO: 4449237 - DNA, 22 bp, Homo sapiens
atatattttgtactttgtggag

SEQ ID NO: 4449238 - DNA, 19 bp, Homo sapiens
atatcaaagcattttataa

SEQ ID NO: 4449239 - DNA, 16 bp, Homo sapiens
atatcactaaataaac

SEQ ID NO: 4449240 - DNA, 16 bp, Homo sapiens
atatcactcattaatt

SEQ ID NO: 4449241 - DNA, 15 bp, Homo sapiens
atatcagctactgta

SEQ ID NO: 4449242 - DNA, 19 bp, Homo sapiens
atatcagttactcagccct

SEQ ID NO: 4449243 - DNA, 20 bp, Homo sapiens
atatcagttactcagccctg

SEQ ID NO: 4449244 - DNA, 14 bp, Homo sapiens
atatcatacagttt

SEQ ID NO: 4449245 - DNA, 19 bp, Homo sapiens
atatcatacagttttcatt

SEQ ID NO: 4449246 - DNA, 18 bp, Homo sapiens
atatcatcacgtatgtta

SEQ ID NO: 4449247 - DNA, 22 bp, Homo sapiens
atatcatgttaaattagaatga

SEQ ID NO: 4449248 - DNA, 23 bp, Homo sapiens
atatcattataactgaaggagaa

SEQ ID NO: 4449249 - DNA, 19 bp, Homo sapiens
atatcattatctttgctgt

SEQ ID NO: 4449250 - DNA, 12 bp, Homo sapiens
atatccaaaagc

SEQ ID NO: 4449251 - DNA, 21 bp, Homo sapiens
atatccatgacctagttttcc

SEQ ID NO: 4449252 - DNA, 23 bp, Homo sapiens
atatccattctgtagacttttga

SEQ ID NO: 4449253 - DNA, 17 bp, Homo sapiens
atatcccgggggtgggg

SEQ ID NO: 4449254 - DNA, 22 bp, Homo sapiens
atatcctctccccctcctccag

SEQ ID NO: 4449255 - DNA, 13 bp, Homo sapiens
atatcctgtgtac

SEQ ID NO: 4449256 - DNA, 17 bp, Homo sapiens
atatcctttggtcctgg

SEQ ID NO: 4449257 - DNA, 15 bp, Homo sapiens
atatctaaatagtat

SEQ ID NO: 4449258 - DNA, 16 bp, Homo sapiens
atatctaactttgtaa

SEQ ID NO: 4449259 - DNA, 12 bp, Homo sapiens
atatctaagact

SEQ ID NO: 4449260 - DNA, 23 bp, Homo sapiens
atatctaccccagactagatgta

SEQ ID NO: 4449261 - DNA, 13 bp, Homo sapiens
atatctatctatt

SEQ ID NO: 4449262 - DNA, 18 bp, Homo sapiens
atatctatctatttgagg

SEQ ID NO: 4449263 - DNA, 13 bp, Homo sapiens
atatctatttgaa

SEQ ID NO: 4449264 - DNA, 15 bp, Homo sapiens
atatctatttgaata

SEQ ID NO: 4449265 - DNA, 22 bp, Homo sapiens
atatctccatggccctgtccca

SEQ ID NO: 4449266 - DNA, 22 bp, Homo sapiens
atatctcctgaaaaggtttatg

SEQ ID NO: 4449267 - DNA, 14 bp, Homo sapiens
atatctctatttga

SEQ ID NO: 4449268 - DNA, 16 bp, Homo sapiens
atatctctatttgaga

SEQ ID NO: 4449269 - DNA, 16 bp, Homo sapiens
atatctcttggaaaat

SEQ ID NO: 4449270 - DNA, 18 bp, Homo sapiens
atatctgaacatttacta

SEQ ID NO: 4449271 - DNA, 18 bp, Homo sapiens
atatctgctgtccagaca

SEQ ID NO: 4449272 - DNA, 14 bp, Homo sapiens
atatctgtaaagat

SEQ ID NO: 4449273 - DNA, 12 bp, Homo sapiens
atatctgtaatg

SEQ ID NO: 4449274 - DNA, 17 bp, Homo sapiens
atatctgtgaaatatca

SEQ ID NO: 4449275 - DNA, 16 bp, Homo sapiens
atatctgttattcaaa

SEQ ID NO: 4449276 - DNA, 16 bp, Homo sapiens
atatcttataactgtt

SEQ ID NO: 4449277 - DNA, 19 bp, Homo sapiens
atatcttataactgtttta

SEQ ID NO: 4449278 - DNA, 23 bp, Homo sapiens
atatcttcgttagtaatctgtat

SEQ ID NO: 4449279 - DNA, 13 bp, Homo sapiens
atatcttcttata

SEQ ID NO: 4449280 - DNA, 21 bp, Homo sapiens
atatcttgttattaatgtttc

SEQ ID NO: 4449281 - DNA, 13 bp, Homo sapiens
atatcttgtttac

SEQ ID NO: 4449282 - DNA, 22 bp, Homo sapiens
atatcttgtttacaataaagaa

SEQ ID NO: 4449283 - DNA, 13 bp, Homo sapiens
atatctttcagtt

SEQ ID NO: 4449284 - DNA, 23 bp, Homo sapiens
atatgaaaatacaacttaaataa

SEQ ID NO: 4449285 - DNA, 14 bp, Homo sapiens
atatgaaataagta

SEQ ID NO: 4449286 - DNA, 15 bp, Homo sapiens
atatgaacatattgt

SEQ ID NO: 4449287 - DNA, 19 bp, Homo sapiens
atatgaacatattgttgaa

SEQ ID NO: 4449288 - DNA, 12 bp, Homo sapiens
atatgaccagaa

SEQ ID NO: 4449289 - DNA, 13 bp, Homo sapiens
atatgagaagaat

SEQ ID NO: 4449290 - DNA, 18 bp, Homo sapiens
atatgagcttcaatataa

SEQ ID NO: 4449291 - DNA, 20 bp, Homo sapiens
atatgagcttcaatataaga

SEQ ID NO: 4449292 - DNA, 23 bp, Homo sapiens
atatgagcttcaatataagaagc

SEQ ID NO: 4449293 - DNA, 20 bp, Homo sapiens
atatgatacaccattatgtt

SEQ ID NO: 4449294 - DNA, 15 bp, Homo sapiens
atatgatactgatgc

SEQ ID NO: 4449295 - DNA, 19 bp, Homo sapiens
atatgatccctaatgtgtt

SEQ ID NO: 4449296 - DNA, 20 bp, Homo sapiens
atatgcaaaaatgacccaag

SEQ ID NO: 4449297 - DNA, 13 bp, Homo sapiens
atatgcaaagcac

SEQ ID NO: 4449298 - DNA, 14 bp, Homo sapiens
atatgcaaagcact

SEQ ID NO: 4449299 - DNA, 19 bp, Homo sapiens
atatgcaaggcggtacact

SEQ ID NO: 4449300 - DNA, 22 bp, Homo sapiens
atatgcaagtaagaaataatgc

SEQ ID NO: 4449301 - DNA, 20 bp, Homo sapiens
atatgcatgctgatttacca

SEQ ID NO: 4449302 - DNA, 14 bp, Homo sapiens
atatgcatgtagca

SEQ ID NO: 4449303 - DNA, 20 bp, Homo sapiens
atatgcatgtagcatataaa

SEQ ID NO: 4449304 - DNA, 17 bp, Homo sapiens
atatgctgaattgaaca

SEQ ID NO: 4449305 - DNA, 18 bp, Homo sapiens
atatggagaattgctgaa

SEQ ID NO: 4449306 - DNA, 21 bp, Homo sapiens
atatggaggattctttcccca

SEQ ID NO: 4449307 - DNA, 22 bp, Homo sapiens
atatggaggattctttccccag

SEQ ID NO: 4449308 - DNA, 14 bp, Homo sapiens
atatggatcagagg

SEQ ID NO: 4449309 - DNA, 23 bp, Homo sapiens
atatggccacagtagtcttgatg

SEQ ID NO: 4449310 - DNA, 17 bp, Homo sapiens
atatggctgcccaggag

SEQ ID NO: 4449311 - DNA, 19 bp, Homo sapiens
atatgggggaaaattattt

SEQ ID NO: 4449312 - DNA, 20 bp, Homo sapiens
atatgggtgggattttgcaa

SEQ ID NO: 4449313 - DNA, 15 bp, Homo sapiens
atatgtaaaacattt

SEQ ID NO: 4449314 - DNA, 12 bp, Homo sapiens
atatgtaaatgt

SEQ ID NO: 4449315 - DNA, 14 bp, Homo sapiens
atatgtaaatgtgt

SEQ ID NO: 4449316 - DNA, 16 bp, Homo sapiens
atatgtaaatgtgtta

SEQ ID NO: 4449317 - DNA, 14 bp, Homo sapiens
atatgtacatgaga

SEQ ID NO: 4449318 - DNA, 13 bp, Homo sapiens
atatgtactgtat

SEQ ID NO: 4449319 - DNA, 15 bp, Homo sapiens
atatgtatgtaaaaa

SEQ ID NO: 4449320 - DNA, 23 bp, Homo sapiens
atatgtatttaagatgtacattt

SEQ ID NO: 4449321 - DNA, 15 bp, Homo sapiens
atatgtgaatttgtt

SEQ ID NO: 4449322 - DNA, 16 bp, Homo sapiens
atatgtgatctgggca

SEQ ID NO: 4449323 - DNA, 16 bp, Homo sapiens
atatgtgtgccctgga

SEQ ID NO: 4449324 - DNA, 18 bp, Homo sapiens
atatgtgtgccctggact

SEQ ID NO: 4449325 - DNA, 14 bp, Homo sapiens
atatgttgaatact

SEQ ID NO: 4449326 - DNA, 16 bp, Homo sapiens
atatgttgtaatattt

SEQ ID NO: 4449327 - DNA, 20 bp, Homo sapiens
atatgtttagttttacattt

SEQ ID NO: 4449328 - DNA, 14 bp, Homo sapiens
atatgttttccaca

SEQ ID NO: 4449329 - DNA, 20 bp, Homo sapiens
atatgttttccacataaatt

SEQ ID NO: 4449330 - DNA, 17 bp, Homo sapiens
atattaaaaaacttcat

SEQ ID NO: 4449331 - DNA, 22 bp, Homo sapiens
atattaaacaaagtttcagagt

SEQ ID NO: 4449332 - DNA, 21 bp, Homo sapiens
atattaaaggtgaaaattgta

SEQ ID NO: 4449333 - DNA, 16 bp, Homo sapiens
atattaagagctattt

SEQ ID NO: 4449334 - DNA, 19 bp, Homo sapiens
atattaatagtaatttgta

SEQ ID NO: 4449335 - DNA, 22 bp, Homo sapiens
atattaatataagtttctttag

SEQ ID NO: 4449336 - DNA, 23 bp, Homo sapiens
atattaattagcaggttgggcta

SEQ ID NO: 4449337 - DNA, 20 bp, Homo sapiens
atattacaacatttatgtga

SEQ ID NO: 4449338 - DNA, 21 bp, Homo sapiens
atattacaacatttatgtgag

SEQ ID NO: 4449339 - DNA, 12 bp, Homo sapiens
atattacaatga

SEQ ID NO: 4449340 - DNA, 22 bp, Homo sapiens
atattttgtagttaatataaat

SEQ ID NO: 4449341 - DNA, 19 bp, Homo sapiens
atatttttagactatttct

SEQ ID NO: 4449342 - DNA, 18 bp, Homo sapiens
atatttttatatttcctt

SEQ ID NO: 4449343 - DNA, 15 bp, Homo sapiens
atatttttatctata

SEQ ID NO: 4449344 - DNA, 15 bp, Homo sapiens
atatttttatcttta

SEQ ID NO: 4449345 - DNA, 22 bp, Homo sapiens
atatttttatctttatatgaag

SEQ ID NO: 4449346 - DNA, 17 bp, Homo sapiens
atattttttgaaggttt

SEQ ID NO: 4449347 - DNA, 14 bp, Homo sapiens
atcaaaagaaagaa

SEQ ID NO: 4449348 - DNA, 12 bp, Homo sapiens
atcaaaatgctt

SEQ ID NO: 4449349 - DNA, 13 bp, Homo sapiens
atcaaaatgcttt

SEQ ID NO: 4449350 - DNA, 18 bp, Homo sapiens
atcaaagactccgagaag

SEQ ID NO: 4449351 - DNA, 15 bp, Homo sapiens
atcaaagagaagatg

SEQ ID NO: 4449352 - DNA, 17 bp, Homo sapiens
atcaaagcattttataa

SEQ ID NO: 4449353 - DNA, 17 bp, Homo sapiens
atcaaaggtagatttta

SEQ ID NO: 4449354 - DNA, 22 bp, Homo sapiens
atcaaagtggtaaatactgtga

SEQ ID NO: 4449355 - DNA, 17 bp, Homo sapiens
atcaaataaaaattcta

SEQ ID NO: 4449356 - DNA, 21 bp, Homo sapiens
atcaaataaaaattctagatt

SEQ ID NO: 4449357 - DNA, 20 bp, Homo sapiens
atcaaatagaaccactatga

SEQ ID NO: 4449358 - DNA, 20 bp, Homo sapiens
atcaaatctaccactgtatg

SEQ ID NO: 4449359 - DNA, 13 bp, Homo sapiens
atcaaatgaatga

SEQ ID NO: 4449360 - DNA, 14 bp, Homo sapiens
atcaaatgatttca

SEQ ID NO: 4449361 - DNA, 23 bp, Homo sapiens
atcaaatgatttcatattgatct

SEQ ID NO: 4449362 - DNA, 19 bp, Homo sapiens
atcaacaccttaatatgct

SEQ ID NO: 4449363 - DNA, 15 bp, Homo sapiens
atcaacatcttttct

SEQ ID NO: 4449364 - DNA, 14 bp, Homo sapiens
atcaacatttctca

SEQ ID NO: 4449365 - DNA, 20 bp, Homo sapiens
atcaactcccaacttcttcc

SEQ ID NO: 4449366 - DNA, 21 bp, Homo sapiens
atcaactcccaacttcttcct

SEQ ID NO: 4449367 - DNA, 11 bp, Homo sapiens
atcaactgaat

SEQ ID NO: 4449368 - DNA, 13 bp, Homo sapiens
atcaactgaatga

SEQ ID NO: 4449369 - DNA, 14 bp, Homo sapiens
atcaacttttatgc

SEQ ID NO: 4449370 - DNA, 19 bp, Homo sapiens
atcaactttttattgcctt

SEQ ID NO: 4449371 - DNA, 21 bp, Homo sapiens
atcaactttttattgccttct

SEQ ID NO: 4449372 - DNA, 16 bp, Homo sapiens
atcaagatatatgtgt

SEQ ID NO: 4449373 - DNA, 15 bp, Homo sapiens
atcaagcactaaaaa

SEQ ID NO: 4449374 - DNA, 22 bp, Homo sapiens
atcaaggaaaggctcatttaaa

SEQ ID NO: 4449375 - DNA, 16 bp, Homo sapiens
atcaagtaatacaaac

SEQ ID NO: 4449376 - DNA, 17 bp, Homo sapiens
atcaagtaatacaaact

SEQ ID NO: 4449377 - DNA, 13 bp, Homo sapiens
atcaagtaatgaa

SEQ ID NO: 4449378 - DNA, 20 bp, Homo sapiens
atcaagtattactaaattga

SEQ ID NO: 4449379 - DNA, 21 bp, Homo sapiens
atcaagtatttgggaagtgaa

SEQ ID NO: 4449380 - DNA, 16 bp, Homo sapiens
atcaagttgttgactg

SEQ ID NO: 4449381 - DNA, 20 bp, Homo sapiens
atcaagttgttgactgtgat

SEQ ID NO: 4449382 - DNA, 21 bp, Homo sapiens
atcaagttgttgactgtgatt

SEQ ID NO: 4449383 - DNA, 23 bp, Homo sapiens
atcaagttgttgactgtgattag

SEQ ID NO: 4449384 - DNA, 20 bp, Homo sapiens
atcaataatatattttctgt

SEQ ID NO: 4449385 - DNA, 14 bp, Homo sapiens
atcaatagttgaat

SEQ ID NO: 4449386 - DNA, 23 bp, Homo sapiens
atcaatattttctgcaatccaat

SEQ ID NO: 4449387 - DNA, 16 bp, Homo sapiens
atcaatcctttattat

SEQ ID NO: 4449388 - DNA, 18 bp, Homo sapiens
atcaatggttcaagtctt

SEQ ID NO: 4449389 - DNA, 14 bp, Homo sapiens
atcaatgtgtcttt

SEQ ID NO: 4449390 - DNA, 17 bp, Homo sapiens
atcaatgtgtctttcta

SEQ ID NO: 4449391 - DNA, 22 bp, Homo sapiens
atcaatgtgtctttctaagaaa

SEQ ID NO: 4449392 - DNA, 18 bp, Homo sapiens
atcaattagatctaaaca

SEQ ID NO: 4449393 - DNA, 17 bp, Homo sapiens
atcaatttctaatgttt

SEQ ID NO: 4449394 - DNA, 14 bp, Homo sapiens
atcaatttctccca

SEQ ID NO: 4449395 - DNA, 14 bp, Homo sapiens
atcaatttttctta

SEQ ID NO: 4449396 - DNA, 19 bp, Homo sapiens
atcaatttttcttatttca

SEQ ID NO: 4449397 - DNA, 15 bp, Homo sapiens
atcacaaactgaatg

SEQ ID NO: 4449398 - DNA, 14 bp, Homo sapiens
atcacaatattcag

SEQ ID NO: 4449399 - DNA, 17 bp, Homo sapiens
atcacaatttttaatgg

SEQ ID NO: 4449400 - DNA, 16 bp, Homo sapiens
atcacacaatatagtt

SEQ ID NO: 4449401 - DNA, 13 bp, Homo sapiens
atcacacagtgtt

SEQ ID NO: 4449402 - DNA, 15 bp, Homo sapiens
atcacacagtgttag

SEQ ID NO: 4449403 - DNA, 23 bp, Homo sapiens
atcacactcaaggacaggagcct

SEQ ID NO: 4449404 - DNA, 18 bp, Homo sapiens
atcacagaccacaggaag

SEQ ID NO: 4449405 - DNA, 16 bp, Homo sapiens
atcacagaccccagct

SEQ ID NO: 4449406 - DNA, 20 bp, Homo sapiens
atcacagcccaaaatttgat

SEQ ID NO: 4449407 - DNA, 20 bp, Homo sapiens
atcacagggttgggcccaga

SEQ ID NO: 4449408 - DNA, 14 bp, Homo sapiens
atcacagtcaatgg

SEQ ID NO: 4449409 - DNA, 19 bp, Homo sapiens
atcacataaagaaattcaa

SEQ ID NO: 4449410 - DNA, 13 bp, Homo sapiens
atcacatcttatt

SEQ ID NO: 4449411 - DNA, 17 bp, Homo sapiens
atcacatcttatttatt

SEQ ID NO: 4449412 - DNA, 20 bp, Homo sapiens
atcacatcttatttatttta

SEQ ID NO: 4449413 - DNA, 16 bp, Homo sapiens
atcaccaattaaaaac

SEQ ID NO: 4449414 - DNA, 18 bp, Homo sapiens
atcaccaattaaaaacct

SEQ ID NO: 4449415 - DNA, 15 bp, Homo sapiens
atcaccatgtaagca

SEQ ID NO: 4449416 - DNA, 18 bp, Homo sapiens
atcacccctctgcccctg

SEQ ID NO: 4449417 - DNA, 19 bp, Homo sapiens
atcacccctctgcccctgc

SEQ ID NO: 4449418 - DNA, 20 bp, Homo sapiens
atcaccgagagtagccgaga

SEQ ID NO: 4449419 - DNA, 20 bp, Homo sapiens
atcaccgtgggctccctgac

SEQ ID NO: 4449420 - DNA, 22 bp, Homo sapiens
atcaccgtgggctccctgactg

SEQ ID NO: 4449421 - DNA, 19 bp, Homo sapiens
atcacctaagcacttctag

SEQ ID NO: 4449422 - DNA, 16 bp, Homo sapiens
atcacctatttaatgt

SEQ ID NO: 4449423 - DNA, 22 bp, Homo sapiens
atcacctctctgtagtttatgg

SEQ ID NO: 4449424 - DNA, 20 bp, Homo sapiens
atcacctgaaccccagaggc

SEQ ID NO: 4449425 - DNA, 17 bp, Homo sapiens
atcacctgaggtcagga

SEQ ID NO: 4449426 - DNA, 21 bp, Homo sapiens
atcacgacacatttgccttca

SEQ ID NO: 4449427 - DNA, 22 bp, Homo sapiens
atcacgccattgtactccagcc

SEQ ID NO: 4449428 - DNA, 13 bp, Homo sapiens
atcacgctttcct

SEQ ID NO: 4449429 - DNA, 14 bp, Homo sapiens
atcacgctttcctg

SEQ ID NO: 4449430 - DNA, 18 bp, Homo sapiens
atcacgctttttgaaaaa

SEQ ID NO: 4449431 - DNA, 17 bp, Homo sapiens
atcacgttagaggaaaa

SEQ ID NO: 4449432 - DNA, 21 bp, Homo sapiens
atcacgttagaggaaaaatat

SEQ ID NO: 4449433 - DNA, 16 bp, Homo sapiens
atcactaacattatat

SEQ ID NO: 4449434 - DNA, 21 bp, Homo sapiens
atcactaacattatattgcaa

SEQ ID NO: 4449435 - DNA, 13 bp, Homo sapiens
atcactcattaat

SEQ ID NO: 4449436 - DNA, 16 bp, Homo sapiens
atcactcattaattaa

SEQ ID NO: 4449437 - DNA, 22 bp, Homo sapiens
atcactgatgggaataaaagta

SEQ ID NO: 4449438 - DNA, 17 bp, Homo sapiens
atcactgctccaggcct

SEQ ID NO: 4449439 - DNA, 14 bp, Homo sapiens
atcactgctgctgg

SEQ ID NO: 4449440 - DNA, 18 bp, Homo sapiens
atcactgctgctgggact

SEQ ID NO: 4449441 - DNA, 23 bp, Homo sapiens
atcactggagcaccaggcacgaa

SEQ ID NO: 4449442 - DNA, 12 bp, Homo sapiens
atcactgtaaag

SEQ ID NO: 4449443 - DNA, 15 bp, Homo sapiens
atcactgtaaagaca

SEQ ID NO: 4449444 - DNA, 20 bp, Homo sapiens
atcactgttgctttgaaaaa

SEQ ID NO: 4449445 - DNA, 19 bp, Homo sapiens
atcacttaaaggcacaaat

SEQ ID NO: 4449446 - DNA, 20 bp, Homo sapiens
atcacttaaaggcacaaata

SEQ ID NO: 4449447 - DNA, 23 bp, Homo sapiens
atcacttaacattcctaaaatgc

SEQ ID NO: 4449448 - DNA, 20 bp, Homo sapiens
atcacttaatttgaaatcta

SEQ ID NO: 4449449 - DNA, 16 bp, Homo sapiens
atcacttctccccgca

SEQ ID NO: 4449450 - DNA, 21 bp, Homo sapiens
atcactttctcagttttcata

SEQ ID NO: 4449451 - DNA, 13 bp, Homo sapiens
atcagaaaaccaa

SEQ ID NO: 4449452 - DNA, 17 bp, Homo sapiens
atcagaaaaccaaaggg

SEQ ID NO: 4449453 - DNA, 22 bp, Homo sapiens
atcagaaatcctctgttaatgt

SEQ ID NO: 4449454 - DNA, 16 bp, Homo sapiens
atcagaacctgagcta

SEQ ID NO: 4449455 - DNA, 22 bp, Homo sapiens
atcagaagaaaggccaaggtgc

SEQ ID NO: 4449456 - DNA, 18 bp, Homo sapiens
atcagaagtcatcttgct

SEQ ID NO: 4449457 - DNA, 15 bp, Homo sapiens
atcagaagtttcctg

SEQ ID NO: 4449458 - DNA, 16 bp, Homo sapiens
atcctgcaccccagca

SEQ ID NO: 4449459 - DNA, 17 bp, Homo sapiens
atcctgcccaaaatgtg

SEQ ID NO: 4449460 - DNA, 19 bp, Homo sapiens
atcctgcccaaaatgtgaa

SEQ ID NO: 4449461 - DNA, 18 bp, Homo sapiens
atcctgccctggaggaag

SEQ ID NO: 4449462 - DNA, 19 bp, Homo sapiens
atcctgccttagagccagg

SEQ ID NO: 4449463 - DNA, 12 bp, Homo sapiens
atcctgctcttt

SEQ ID NO: 4449464 - DNA, 20 bp, Homo sapiens
atcctggaaggacacagtga

SEQ ID NO: 4449465 - DNA, 23 bp, Homo sapiens
atcctggactgagggggcctgga

SEQ ID NO: 4449466 - DNA, 17 bp, Homo sapiens
atcctggcccagggcat

SEQ ID NO: 4449467 - DNA, 15 bp, Homo sapiens
atcctgtaggctaaa

SEQ ID NO: 4449468 - DNA, 15 bp, Homo sapiens
atcctgtattcttgt

SEQ ID NO: 4449469 - DNA, 20 bp, Homo sapiens
atcctgtattcttgtttgaa

SEQ ID NO: 4449470 - DNA, 22 bp, Homo sapiens
atcctgttacttgcttcagtgg

SEQ ID NO: 4449471 - DNA, 18 bp, Homo sapiens
atcctgtttgaagaaaaa

SEQ ID NO: 4449472 - DNA, 19 bp, Homo sapiens
atcctgttttacagctgcc

SEQ ID NO: 4449473 - DNA, 19 bp, Homo sapiens
atccttataggcctgtccc

SEQ ID NO: 4449474 - DNA, 23 bp, Homo sapiens
atccttcaaagtctcaatgaaat

SEQ ID NO: 4449475 - DNA, 17 bp, Homo sapiens
atccttccagtggctcg

SEQ ID NO: 4449476 - DNA, 22 bp, Homo sapiens
atccttccagtggctcgctccc

SEQ ID NO: 4449477 - DNA, 14 bp, Homo sapiens
atccttctttgtaa

SEQ ID NO: 4449478 - DNA, 13 bp, Homo sapiens
atccttgaatcct

SEQ ID NO: 4449479 - DNA, 20 bp, Homo sapiens
atccttggagtcccaggggc

SEQ ID NO: 4449480 - DNA, 21 bp, Homo sapiens
atccttgggccataattatga

SEQ ID NO: 4449481 - DNA, 12 bp, Homo sapiens
atccttgtaata

SEQ ID NO: 4449482 - DNA, 17 bp, Homo sapiens
atcctttggtcctggtg

SEQ ID NO: 4449483 - DNA, 20 bp, Homo sapiens
atccttttccttatttgcct

SEQ ID NO: 4449484 - DNA, 21 bp, Homo sapiens
atccttttccttatttgcctt

SEQ ID NO: 4449485 - DNA, 22 bp, Homo sapiens
atccttttgaaggtagttgcaa

SEQ ID NO: 4449486 - DNA, 13 bp, Homo sapiens
atcgaaaaaataa

SEQ ID NO: 4449487 - DNA, 13 bp, Homo sapiens
atcgaagtgttta

SEQ ID NO: 4449488 - DNA, 18 bp, Homo sapiens
atcgaagtgtttatgtaa

SEQ ID NO: 4449489 - DNA, 14 bp, Homo sapiens
atcgaatgaaatta

SEQ ID NO: 4449490 - DNA, 13 bp, Homo sapiens
atcgatgtgctca

SEQ ID NO: 4449491 - DNA, 13 bp, Homo sapiens
atcgcagcttcct

SEQ ID NO: 4449492 - DNA, 20 bp, Homo sapiens
atcgccaggactggtgaata

SEQ ID NO: 4449493 - DNA, 16 bp, Homo sapiens
atcgctcgtgtgttct

SEQ ID NO: 4449494 - DNA, 21 bp, Homo sapiens
atcgctcgtgtgttctatcca

SEQ ID NO: 4449495 - DNA, 23 bp, Homo sapiens
atcgctcgtgtgttctatccaaa

SEQ ID NO: 4449496 - DNA, 20 bp, Homo sapiens
atcgctgcacatggcctgag

SEQ ID NO: 4449497 - DNA, 22 bp, Homo sapiens
atcgctgttctgggcatggcag

SEQ ID NO: 4449498 - DNA, 21 bp, Homo sapiens
atcggaggctgggcccctggg

SEQ ID NO: 4449499 - DNA, 19 bp, Homo sapiens
atcggcccacagctcccac

SEQ ID NO: 4449500 - DNA, 20 bp, Homo sapiens
atcggcccacagctcccacc

SEQ ID NO: 4449501 - DNA, 13 bp, Homo sapiens
atcgggaaagaag

SEQ ID NO: 4449502 - DNA, 17 bp, Homo sapiens
atcgtcatgcacagtat

SEQ ID NO: 4449503 - DNA, 16 bp, Homo sapiens
atcgtccttcctctca

SEQ ID NO: 4449504 - DNA, 19 bp, Homo sapiens
atcgtgccgttactctcca

SEQ ID NO: 4449505 - DNA, 14 bp, Homo sapiens
atcgtgctactgca

SEQ ID NO: 4449506 - DNA, 19 bp, Homo sapiens
atcgtggcacgtattgctg

SEQ ID NO: 4449507 - DNA, 14 bp, Homo sapiens
atcgtttttgtttt

SEQ ID NO: 4449508 - DNA, 19 bp, Homo sapiens
atctaaagctttatctttg

SEQ ID NO: 4449509 - DNA, 18 bp, Homo sapiens
atctaaatagtattttgt

SEQ ID NO: 4449510 - DNA, 20 bp, Homo sapiens
atctaaattacagtgcagtt

SEQ ID NO: 4449511 - DNA, 20 bp, Homo sapiens
atctaacaataatatttcaa

SEQ ID NO: 4449512 - DNA, 22 bp, Homo sapiens
atctaacaataatatttcaagt

SEQ ID NO: 4449513 - DNA, 19 bp, Homo sapiens
atctaacattattactttt

SEQ ID NO: 4449514 - DNA, 15 bp, Homo sapiens
atctaacttcgaata

SEQ ID NO: 4449515 - DNA, 14 bp, Homo sapiens
atctaactttgtaa

SEQ ID NO: 4449516 - DNA, 15 bp, Homo sapiens
atctaagtatatgtg

SEQ ID NO: 4449517 - DNA, 23 bp, Homo sapiens
atctaagtatatgtgagaaatca

SEQ ID NO: 4449518 - DNA, 15 bp, Homo sapiens
atctaataaatcagt

SEQ ID NO: 4449519 - DNA, 23 bp, Homo sapiens
atctaatatggccacagtagtct

SEQ ID NO: 4449520 - DNA, 14 bp, Homo sapiens
atctaatctaaaag

SEQ ID NO: 4449521 - DNA, 13 bp, Homo sapiens
atctaatctgaac

SEQ ID NO: 4449522 - DNA, 23 bp, Homo sapiens
atctaatttataaaaaggtgttt

SEQ ID NO: 4449523 - DNA, 14 bp, Homo sapiens
atctaattttacac

SEQ ID NO: 4449524 - DNA, 12 bp, Homo sapiens
atctacacatgt

SEQ ID NO: 4449525 - DNA, 16 bp, Homo sapiens
atctacaccaatgaaa

SEQ ID NO: 4449526 - DNA, 14 bp, Homo sapiens
atctacagtaatga

SEQ ID NO: 4449527 - DNA, 18 bp, Homo sapiens
atctacagtaatgaaatg

SEQ ID NO: 4449528 - DNA, 21 bp, Homo sapiens
atctacagtaatgaaatgttt

SEQ ID NO: 4449529 - DNA, 23 bp, Homo sapiens
atctactgaattggcttccagat

SEQ ID NO: 4449530 - DNA, 22 bp, Homo sapiens
atctactggaaatgtagcactt

SEQ ID NO: 4449531 - DNA, 12 bp, Homo sapiens
atctactgtatc

SEQ ID NO: 4449532 - DNA, 20 bp, Homo sapiens
atctactgtatcaataaaat

SEQ ID NO: 4449533 - DNA, 19 bp, Homo sapiens
atctacttctgtaattgtg

SEQ ID NO: 4449534 - DNA, 13 bp, Homo sapiens
atctacttgcctc

SEQ ID NO: 4449535 - DNA, 18 bp, Homo sapiens
atctagaactatcatttt

SEQ ID NO: 4449536 - DNA, 19 bp, Homo sapiens
atctagaactatcattttt

SEQ ID NO: 4449537 - DNA, 20 bp, Homo sapiens
atctagaagagtctattgtc

SEQ ID NO: 4449538 - DNA, 14 bp, Homo sapiens
atctagaagatgtg

SEQ ID NO: 4449539 - DNA, 18 bp, Homo sapiens
atctagaattcactgagt

SEQ ID NO: 4449540 - DNA, 19 bp, Homo sapiens
atctagacattcttttaat

SEQ ID NO: 4449541 - DNA, 16 bp, Homo sapiens
atctagagcaaagcca

SEQ ID NO: 4449542 - DNA, 17 bp, Homo sapiens
atctagcgcaattgaag

SEQ ID NO: 4449543 - DNA, 16 bp, Homo sapiens
atctagtcacaaagac

SEQ ID NO: 4449544 - DNA, 18 bp, Homo sapiens
atctataacataaagaat

SEQ ID NO: 4449545 - DNA, 16 bp, Homo sapiens
atctataatttaccta

SEQ ID NO: 4449546 - DNA, 14 bp, Homo sapiens
atctatacctgcct

SEQ ID NO: 4449547 - DNA, 13 bp, Homo sapiens
atctatataaaat

SEQ ID NO: 4449548 - DNA, 16 bp, Homo sapiens
atctatattaaatgag

SEQ ID NO: 4449549 - DNA, 12 bp, Homo sapiens
atctatctacaa

SEQ ID NO: 4449550 - DNA, 17 bp, Homo sapiens
atctatctacaaagaaa

SEQ ID NO: 4449551 - DNA, 22 bp, Homo sapiens
atctatcttaatactaaggaac

SEQ ID NO: 4449552 - DNA, 18 bp, Homo sapiens
atctatgagggtgtttcc

SEQ ID NO: 4449553 - DNA, 17 bp, Homo sapiens
atctatgggaagatact

SEQ ID NO: 4449554 - DNA, 15 bp, Homo sapiens
atctatggttctaaa

SEQ ID NO: 4449555 - DNA, 13 bp, Homo sapiens
atctatgtgaata

SEQ ID NO: 4449556 - DNA, 17 bp, Homo sapiens
atctattgaaaatatat

SEQ ID NO: 4449557 - DNA, 15 bp, Homo sapiens
atctattgatttgaa

SEQ ID NO: 4449558 - DNA, 16 bp, Homo sapiens
atctattgatttgaaa

SEQ ID NO: 4449559 - DNA, 21 bp, Homo sapiens
atctattgcttggacttaact

SEQ ID NO: 4449560 - DNA, 18 bp, Homo sapiens
atctatttaaaaaactgt

SEQ ID NO: 4449561 - DNA, 19 bp, Homo sapiens
atctatttaaaaaactgta

SEQ ID NO: 4449562 - DNA, 16 bp, Homo sapiens
atctatttgaataaat

SEQ ID NO: 4449563 - DNA, 12 bp, Homo sapiens
atctatttgagg

SEQ ID NO: 4449564 - DNA, 14 bp, Homo sapiens
atctatttgtacaa

SEQ ID NO: 4449565 - DNA, 15 bp, Homo sapiens
atctattttatttta

SEQ ID NO: 4449566 - DNA, 20 bp, Homo sapiens
atctattttattttattgaa

SEQ ID NO: 4449567 - DNA, 20 bp, Homo sapiens
atctattttgatgcagcatt

SEQ ID NO: 4449568 - DNA, 19 bp, Homo sapiens
atctatttttggcagtctg

SEQ ID NO: 4449569 - DNA, 20 bp, Homo sapiens
atctcaaataggctattaaa

SEQ ID NO: 4449570 - DNA, 23 bp, Homo sapiens
atctcaaataggctattaaaaaa

SEQ ID NO: 4449571 - DNA, 22 bp, Homo sapiens
atctcaatcttggtttgtcagt

SEQ ID NO: 4449572 - DNA, 23 bp, Homo sapiens
atctcacctaatggttgtacata

SEQ ID NO: 4449573 - DNA, 14 bp, Homo sapiens
atctcactttgtaa

SEQ ID NO: 4449574 - DNA, 12 bp, Homo sapiens
atctcagaccct

SEQ ID NO: 4449575 - DNA, 14 bp, Homo sapiens
atctcagaccctgc

SEQ ID NO: 4449576 - DNA, 14 bp, Homo sapiens
atgaacaattgcta

SEQ ID NO: 4449577 - DNA, 16 bp, Homo sapiens
atgaacagaaactaca

SEQ ID NO: 4449578 - DNA, 19 bp, Homo sapiens
atgaacagaaactacattt

SEQ ID NO: 4449579 - DNA, 15 bp, Homo sapiens
atgaacatattcatg

SEQ ID NO: 4449580 - DNA, 17 bp, Homo sapiens
atgaacattgtactgtt

SEQ ID NO: 4449581 - DNA, 20 bp, Homo sapiens
atgaaccgcaatatgggagg

SEQ ID NO: 4449582 - DNA, 12 bp, Homo sapiens
atgaactgtccg

SEQ ID NO: 4449583 - DNA, 12 bp, Homo sapiens
atgaactttaaa

SEQ ID NO: 4449584 - DNA, 14 bp, Homo sapiens
atgaagaaagggag

SEQ ID NO: 4449585 - DNA, 20 bp, Homo sapiens
atgaagaaagggaggcccag

SEQ ID NO: 4449586 - DNA, 22 bp, Homo sapiens
atgaagaaagggaggcccagcc

SEQ ID NO: 4449587 - DNA, 15 bp, Homo sapiens
atgaagaactgagga

SEQ ID NO: 4449588 - DNA, 19 bp, Homo sapiens
atgaagaatcacgatttca

SEQ ID NO: 4449589 - DNA, 13 bp, Homo sapiens
atgaagcagtatt

SEQ ID NO: 4449590 - DNA, 22 bp, Homo sapiens
atgaagcctgtggatgatcaat

SEQ ID NO: 4449591 - DNA, 16 bp, Homo sapiens
atgaagccttttgaaa

SEQ ID NO: 4449592 - DNA, 19 bp, Homo sapiens
atgaagctgacaatttatg

SEQ ID NO: 4449593 - DNA, 14 bp, Homo sapiens
atgaagctgtataa

SEQ ID NO: 4449594 - DNA, 22 bp, Homo sapiens
atgaagctgtataattaattgt

SEQ ID NO: 4449595 - DNA, 21 bp, Homo sapiens
atgaaggagaggcaacatcca

SEQ ID NO: 4449596 - DNA, 19 bp, Homo sapiens
atgaaggctggaaggcagc

SEQ ID NO: 4449597 - DNA, 15 bp, Homo sapiens
atgaaggtaaataaa

SEQ ID NO: 4449598 - DNA, 17 bp, Homo sapiens
atgaaggtaaataaaaa

SEQ ID NO: 4449599 - DNA, 22 bp, Homo sapiens
atgaagtaaagccattaaatga

SEQ ID NO: 4449600 - DNA, 15 bp, Homo sapiens
atgaagtataaatct

SEQ ID NO: 4449601 - DNA, 20 bp, Homo sapiens
atgaagtattacatgattta

SEQ ID NO: 4449602 - DNA, 13 bp, Homo sapiens
atgaagtttttaa

SEQ ID NO: 4449603 - DNA, 18 bp, Homo sapiens
atgaataacatttaaatt

SEQ ID NO: 4449604 - DNA, 13 bp, Homo sapiens
atgaatatatggc

SEQ ID NO: 4449605 - DNA, 20 bp, Homo sapiens
atgaatatatggcatttgca

SEQ ID NO: 4449606 - DNA, 14 bp, Homo sapiens
atgaatattttcaa

SEQ ID NO: 4449607 - DNA, 13 bp, Homo sapiens
atgaatgaatggc

SEQ ID NO: 4449608 - DNA, 16 bp, Homo sapiens
atgaatgagaatctac

SEQ ID NO: 4449609 - DNA, 19 bp, Homo sapiens
atgaatgaggtctgggcta

SEQ ID NO: 4449610 - DNA, 19 bp, Homo sapiens
atgaatgtactatgtctga

SEQ ID NO: 4449611 - DNA, 15 bp, Homo sapiens
atgaattataaatgt

SEQ ID NO: 4449612 - DNA, 17 bp, Homo sapiens
atgaattcaagaaagga

SEQ ID NO: 4449613 - DNA, 19 bp, Homo sapiens
atgaattcaagaaaggaaa

SEQ ID NO: 4449614 - DNA, 20 bp, Homo sapiens
atgaattcaagaaaggaaat

SEQ ID NO: 4449615 - DNA, 21 bp, Homo sapiens
atgaattccactccttccaga

SEQ ID NO: 4449616 - DNA, 16 bp, Homo sapiens
atgaattgaaaaacaa

SEQ ID NO: 4449617 - DNA, 22 bp, Homo sapiens
atgaattgaaaaacaattttct

SEQ ID NO: 4449618 - DNA, 16 bp, Homo sapiens
atgaatttatctttac

SEQ ID NO: 4449619 - DNA, 17 bp, Homo sapiens
atgaattttaaagtatg

SEQ ID NO: 4449620 - DNA, 18 bp, Homo sapiens
atgaattttcaagtaatt

SEQ ID NO: 4449621 - DNA, 17 bp, Homo sapiens
atgacaaaaaatgtttt

SEQ ID NO: 4449622 - DNA, 20 bp, Homo sapiens
atgacaccatcttttattct

SEQ ID NO: 4449623 - DNA, 15 bp, Homo sapiens
atgacacccatgcca

SEQ ID NO: 4449624 - DNA, 21 bp, Homo sapiens
atgacacccatgccagagagg

SEQ ID NO: 4449625 - DNA, 14 bp, Homo sapiens
atgacaccctggcc

SEQ ID NO: 4449626 - DNA, 16 bp, Homo sapiens
atgacaccctggcctg

SEQ ID NO: 4449627 - DNA, 17 bp, Homo sapiens
atgacaccctggcctga

SEQ ID NO: 4449628 - DNA, 21 bp, Homo sapiens
atgacagaggctgcacccctg

SEQ ID NO: 4449629 - DNA, 17 bp, Homo sapiens
atgacagatttctgtaa

SEQ ID NO: 4449630 - DNA, 21 bp, Homo sapiens
atgacagctgtccctgtcacc

SEQ ID NO: 4449631 - DNA, 19 bp, Homo sapiens
atgacaggcctgaagatat

SEQ ID NO: 4449632 - DNA, 24 bp, Homo sapiens
atgacaggcctgaagatattacta

SEQ ID NO: 4449633 - DNA, 21 bp, Homo sapiens
atgacaggcgcctgccatcat

SEQ ID NO: 4449634 - DNA, 15 bp, Homo sapiens
atgacagtaatattg

SEQ ID NO: 4449635 - DNA, 15 bp, Homo sapiens
atgacagtcaaaaga

SEQ ID NO: 4449636 - DNA, 20 bp, Homo sapiens
atgacagtgaagcagcactg

SEQ ID NO: 4449637 - DNA, 17 bp, Homo sapiens
atgacagtgttccccga

SEQ ID NO: 4449638 - DNA, 14 bp, Homo sapiens
atgacatcttttta

SEQ ID NO: 4449639 - DNA, 21 bp, Homo sapiens
atgacatctttttaaagctta

SEQ ID NO: 4449640 - DNA, 15 bp, Homo sapiens
atgacattatgtgga

SEQ ID NO: 4449641 - DNA, 18 bp, Homo sapiens
atgacatttatttttcat

SEQ ID NO: 4449642 - DNA, 19 bp, Homo sapiens
atgaccagggatgctgggc

SEQ ID NO: 4449643 - DNA, 20 bp, Homo sapiens
atgaccagggatgctgggct

SEQ ID NO: 4449644 - DNA, 17 bp, Homo sapiens
atgaccatactgaggga

SEQ ID NO: 4449645 - DNA, 20 bp, Homo sapiens
atgaccatgttatattgctt

SEQ ID NO: 4449646 - DNA, 19 bp, Homo sapiens
atgacctaccaggacagaa

SEQ ID NO: 4449647 - DNA, 21 bp, Homo sapiens
atgacctgaaataatatattt

SEQ ID NO: 4449648 - DNA, 21 bp, Homo sapiens
atgacgacaaagctgctaaat

SEQ ID NO: 4449649 - DNA, 23 bp, Homo sapiens
atgacgacaaagctgctaaatct

SEQ ID NO: 4449650 - DNA, 19 bp, Homo sapiens
atgacgggatgctctttaa

SEQ ID NO: 4449651 - DNA, 17 bp, Homo sapiens
atgactatataatttat

SEQ ID NO: 4449652 - DNA, 16 bp, Homo sapiens
atgactatgtaaacta

SEQ ID NO: 4449653 - DNA, 17 bp, Homo sapiens
atgactattacttttct

SEQ ID NO: 4449654 - DNA, 23 bp, Homo sapiens
atgactattacttttctgtttag

SEQ ID NO: 4449655 - DNA, 15 bp, Homo sapiens
atgactctttattgt

SEQ ID NO: 4449656 - DNA, 21 bp, Homo sapiens
atgactctttctgaaggaaga

SEQ ID NO: 4449657 - DNA, 18 bp, Homo sapiens
atgactgacaaagacatc

SEQ ID NO: 4449658 - DNA, 14 bp, Homo sapiens
atgactggctcctg

SEQ ID NO: 4449659 - DNA, 15 bp, Homo sapiens
atgacttagaaactg

SEQ ID NO: 4449660 - DNA, 21 bp, Homo sapiens
atgacttagcgtcaagacatt

SEQ ID NO: 4449661 - DNA, 14 bp, Homo sapiens
atgacttatttctg

SEQ ID NO: 4449662 - DNA, 19 bp, Homo sapiens
atgacttatttctgctctg

SEQ ID NO: 4449663 - DNA, 21 bp, Homo sapiens
atgacttatttctgctctgga

SEQ ID NO: 4449664 - DNA, 13 bp, Homo sapiens
atgacttgagatg

SEQ ID NO: 4449665 - DNA, 21 bp, Homo sapiens
atgacttttaaaatttgtaga

SEQ ID NO: 4449666 - DNA, 11 bp, Homo sapiens
atgagaaactt

SEQ ID NO: 4449667 - DNA, 21 bp, Homo sapiens
atgagaaacttaaatgttatt

SEQ ID NO: 4449668 - DNA, 19 bp, Homo sapiens
atgagaaagcttttattcc

SEQ ID NO: 4449669 - DNA, 13 bp, Homo sapiens
atgagaacaaaca

SEQ ID NO: 4449670 - DNA, 13 bp, Homo sapiens
atgagaatagaaa

SEQ ID NO: 4449671 - DNA, 22 bp, Homo sapiens
atgagaatagaaacgtaaacta

SEQ ID NO: 4449672 - DNA, 14 bp, Homo sapiens
atgagaatatacct

SEQ ID NO: 4449673 - DNA, 17 bp, Homo sapiens
atgagaatataccttat

SEQ ID NO: 4449674 - DNA, 21 bp, Homo sapiens
atgagaatttgagtgctctga

SEQ ID NO: 4449675 - DNA, 21 bp, Homo sapiens
atgagacagggtcttgctctg

SEQ ID NO: 4449676 - DNA, 14 bp, Homo sapiens
atgagatacactga

SEQ ID NO: 4449677 - DNA, 16 bp, Homo sapiens
atgagatactttgcat

SEQ ID NO: 4449678 - DNA, 22 bp, Homo sapiens
atgagatactttgcattgtctg

SEQ ID NO: 4449679 - DNA, 17 bp, Homo sapiens
atgagatggccatgctc

SEQ ID NO: 4449680 - DNA, 19 bp, Homo sapiens
atgagcacatctctctgcc

SEQ ID NO: 4449681 - DNA, 13 bp, Homo sapiens
atgagcaggagct

SEQ ID NO: 4449682 - DNA, 17 bp, Homo sapiens
atgagccaaaccagcag

SEQ ID NO: 4449683 - DNA, 11 bp, Homo sapiens
atgagccctgg

SEQ ID NO: 4449684 - DNA, 21 bp, Homo sapiens
atgagccctggctcccacctg

SEQ ID NO: 4449685 - DNA, 16 bp, Homo sapiens
atgagccgcccaaggc

SEQ ID NO: 4449686 - DNA, 18 bp, Homo sapiens
atgagccgcccaaggcct

SEQ ID NO: 4449687 - DNA, 19 bp, Homo sapiens
atgagccgcccaaggcctt

SEQ ID NO: 4449688 - DNA, 23 bp, Homo sapiens
atgagctatcctttcaaacagct

SEQ ID NO: 4449689 - DNA, 16 bp, Homo sapiens
atgagctattaaaact

SEQ ID NO: 4449690 - DNA, 19 bp, Homo sapiens
atgagctccttaaggctct

SEQ ID NO: 4449691 - DNA, 19 bp, Homo sapiens
atgagctgtgcgctgctct

SEQ ID NO: 4449692 - DNA, 14 bp, Homo sapiens
atgagcttcaatat

SEQ ID NO: 4449693 - DNA, 19 bp, Homo sapiens
atgagcttcaatataagaa

SEQ ID NO: 4449694 - DNA, 23 bp, Homo sapiens
atgcagcctaaagtacagcctgg

SEQ ID NO: 4449695 - DNA, 15 bp, Homo sapiens
atgcagctactggaa

SEQ ID NO: 4449696 - DNA, 21 bp, Homo sapiens
atgcagctactggaatggtgt

SEQ ID NO: 4449697 - DNA, 13 bp, Homo sapiens
atgcagctcaact

SEQ ID NO: 4449698 - DNA, 21 bp, Homo sapiens
atgcagctcttcaacatgaca

SEQ ID NO: 4449699 - DNA, 21 bp, Homo sapiens
atgcaggcacttattgtaaat

SEQ ID NO: 4449700 - DNA, 13 bp, Homo sapiens
atgcagggctgca

SEQ ID NO: 4449701 - DNA, 16 bp, Homo sapiens
atgcaggggtcagtgc

SEQ ID NO: 4449702 - DNA, 17 bp, Homo sapiens
atgcaggtgtcctgagc

SEQ ID NO: 4449703 - DNA, 16 bp, Homo sapiens
atgcagtatctcttac

SEQ ID NO: 4449704 - DNA, 19 bp, Homo sapiens
atgcagtctcctctttaaa

SEQ ID NO: 4449705 - DNA, 23 bp, Homo sapiens
atgcagttctcacgaaagtattt

SEQ ID NO: 4449706 - DNA, 15 bp, Homo sapiens
atgcagtttgaaatt

SEQ ID NO: 4449707 - DNA, 16 bp, Homo sapiens
atgcagtttgaaattc

SEQ ID NO: 4449708 - DNA, 17 bp, Homo sapiens
atgcagtttgaaattct

SEQ ID NO: 4449709 - DNA, 19 bp, Homo sapiens
atgcagtttgaaattctga

SEQ ID NO: 4449710 - DNA, 15 bp, Homo sapiens
atgcataaactaaaa

SEQ ID NO: 4449711 - DNA, 19 bp, Homo sapiens
atgcataaatgcataattt

SEQ ID NO: 4449712 - DNA, 14 bp, Homo sapiens
atgcataatttatg

SEQ ID NO: 4449713 - DNA, 15 bp, Homo sapiens
atgcataatttatgg

SEQ ID NO: 4449714 - DNA, 19 bp, Homo sapiens
atgcatcacactcaaggac

SEQ ID NO: 4449715 - DNA, 23 bp, Homo sapiens
atgcatcacactcaaggacagga

SEQ ID NO: 4449716 - DNA, 18 bp, Homo sapiens
atgcatccattcctcagg

SEQ ID NO: 4449717 - DNA, 16 bp, Homo sapiens
atgcatgacagcctct

SEQ ID NO: 4449718 - DNA, 13 bp, Homo sapiens
atgcatgtagcat

SEQ ID NO: 4449719 - DNA, 14 bp, Homo sapiens
atgcatgtagcata

SEQ ID NO: 4449720 - DNA, 16 bp, Homo sapiens
atgcatgtagcatata

SEQ ID NO: 4449721 - DNA, 20 bp, Homo sapiens
atgcatgtagcatataaatg

SEQ ID NO: 4449722 - DNA, 17 bp, Homo sapiens
atgcatgtcctgtaaag

SEQ ID NO: 4449723 - DNA, 20 bp, Homo sapiens
atgcatgtctgccaaaatgc

SEQ ID NO: 4449724 - DNA, 23 bp, Homo sapiens
atgcatgtctgccaaaatgcaac

SEQ ID NO: 4449725 - DNA, 18 bp, Homo sapiens
atgcatgtcttttaaaat

SEQ ID NO: 4449726 - DNA, 16 bp, Homo sapiens
atgcatgttctcctct

SEQ ID NO: 4449727 - DNA, 21 bp, Homo sapiens
atgcattacctgggaatttat

SEQ ID NO: 4449728 - DNA, 13 bp, Homo sapiens
atgcattattaaa

SEQ ID NO: 4449729 - DNA, 17 bp, Homo sapiens
atgcattctttatagtg

SEQ ID NO: 4449730 - DNA, 19 bp, Homo sapiens
atgcattctttatagtgaa

SEQ ID NO: 4449731 - DNA, 21 bp, Homo sapiens
atgcattgctctggatctgtt

SEQ ID NO: 4449732 - DNA, 13 bp, Homo sapiens
atgcattgttgta

SEQ ID NO: 4449733 - DNA, 14 bp, Homo sapiens
atgcattgttgtaa

SEQ ID NO: 4449734 - DNA, 13 bp, Homo sapiens
atgcatttcaaat

SEQ ID NO: 4449735 - DNA, 16 bp, Homo sapiens
atgcatttttttagtt

SEQ ID NO: 4449736 - DNA, 18 bp, Homo sapiens
atgccaaagctagggtgg

SEQ ID NO: 4449737 - DNA, 22 bp, Homo sapiens
atgccaaggaccttttgctgcc

SEQ ID NO: 4449738 - DNA, 17 bp, Homo sapiens
atgccaatattaaatct

SEQ ID NO: 4449739 - DNA, 17 bp, Homo sapiens
atgccaatgaacatctc

SEQ ID NO: 4449740 - DNA, 21 bp, Homo sapiens
atgccaatgagtctgtaattt

SEQ ID NO: 4449741 - DNA, 17 bp, Homo sapiens
atgccaccaaaggagac

SEQ ID NO: 4449742 - DNA, 19 bp, Homo sapiens
atgccaccaacttacaaaa

SEQ ID NO: 4449743 - DNA, 13 bp, Homo sapiens
atgccacctagac

SEQ ID NO: 4449744 - DNA, 19 bp, Homo sapiens
atgccacctagactctccc

SEQ ID NO: 4449745 - DNA, 19 bp, Homo sapiens
atgccacttctcactcacc

SEQ ID NO: 4449746 - DNA, 17 bp, Homo sapiens
atgccagattctgcctc

SEQ ID NO: 4449747 - DNA, 21 bp, Homo sapiens
atgccagctccatgttctccc

SEQ ID NO: 4449748 - DNA, 12 bp, Homo sapiens
atgccaggtgca

SEQ ID NO: 4449749 - DNA, 17 bp, Homo sapiens
atgccaggttaggaagg

SEQ ID NO: 4449750 - DNA, 21 bp, Homo sapiens
atgccaggttaggaaggcagc

SEQ ID NO: 4449751 - DNA, 14 bp, Homo sapiens
atgccagtattttt

SEQ ID NO: 4449752 - DNA, 22 bp, Homo sapiens
atgccagtatttttaaaggcat

SEQ ID NO: 4449753 - DNA, 14 bp, Homo sapiens
atgccatcatctcc

SEQ ID NO: 4449754 - DNA, 15 bp, Homo sapiens
atgccatcatctcct

SEQ ID NO: 4449755 - DNA, 15 bp, Homo sapiens
atgccatcatgccca

SEQ ID NO: 4449756 - DNA, 16 bp, Homo sapiens
atgccattacagaacc

SEQ ID NO: 4449757 - DNA, 17 bp, Homo sapiens
atgccatttaaagctta

SEQ ID NO: 4449758 - DNA, 21 bp, Homo sapiens
atgccatttaaagcttattaa

SEQ ID NO: 4449759 - DNA, 15 bp, Homo sapiens
atgccatttctcacg

SEQ ID NO: 4449760 - DNA, 14 bp, Homo sapiens
atgcccaaaactta

SEQ ID NO: 4449761 - DNA, 15 bp, Homo sapiens
atgcccaccccctgc

SEQ ID NO: 4449762 - DNA, 18 bp, Homo sapiens
atgcccaccccctgccct

SEQ ID NO: 4449763 - DNA, 19 bp, Homo sapiens
atgcccaccccctgccctg

SEQ ID NO: 4449764 - DNA, 20 bp, Homo sapiens
atgcccaccccctgccctgc

SEQ ID NO: 4449765 - DNA, 16 bp, Homo sapiens
atgcccacctgcccat

SEQ ID NO: 4449766 - DNA, 13 bp, Homo sapiens
atgcccattcctg

SEQ ID NO: 4449767 - DNA, 16 bp, Homo sapiens
atgcccattcctgcct

SEQ ID NO: 4449768 - DNA, 17 bp, Homo sapiens
atgcccattcctgcctg

SEQ ID NO: 4449769 - DNA, 17 bp, Homo sapiens
atgcccatttttgctaa

SEQ ID NO: 4449770 - DNA, 16 bp, Homo sapiens
atgccccattccttgc

SEQ ID NO: 4449771 - DNA, 20 bp, Homo sapiens
atgccccattccttgcgcct

SEQ ID NO: 4449772 - DNA, 21 bp, Homo sapiens
atgccccctttcagatgtctt

SEQ ID NO: 4449773 - DNA, 16 bp, Homo sapiens
atgccccttggtcctg

SEQ ID NO: 4449774 - DNA, 20 bp, Homo sapiens
atgccccttggtcctggcag

SEQ ID NO: 4449775 - DNA, 17 bp, Homo sapiens
atgcccggcgccgggca

SEQ ID NO: 4449776 - DNA, 14 bp, Homo sapiens
atgccctgctccag

SEQ ID NO: 4449777 - DNA, 22 bp, Homo sapiens
atgccgaatttggtacacatgt

SEQ ID NO: 4449778 - DNA, 17 bp, Homo sapiens
atgccggtacacagcca

SEQ ID NO: 4449779 - DNA, 20 bp, Homo sapiens
atgccggttaaattccatat

SEQ ID NO: 4449780 - DNA, 16 bp, Homo sapiens
atgcctatggtggatc

SEQ ID NO: 4449781 - DNA, 16 bp, Homo sapiens
atgcctcactaatttt

SEQ ID NO: 4449782 - DNA, 23 bp, Homo sapiens
atgcctcagaagtgcatctggag

SEQ ID NO: 4449783 - DNA, 21 bp, Homo sapiens
atgcctccaccgctgcctaag

SEQ ID NO: 4449784 - DNA, 15 bp, Homo sapiens
atgcctcctgaggct

SEQ ID NO: 4449785 - DNA, 21 bp, Homo sapiens
atgcctctgacagtccacagg

SEQ ID NO: 4449786 - DNA, 20 bp, Homo sapiens
atgcctgactaatttttgta

SEQ ID NO: 4449787 - DNA, 23 bp, Homo sapiens
atgcctgctttttggaaagtcag

SEQ ID NO: 4449788 - DNA, 17 bp, Homo sapiens
atgcctggtgagcaggg

SEQ ID NO: 4449789 - DNA, 20 bp, Homo sapiens
atgcctgtaatcccagaact

SEQ ID NO: 4449790 - DNA, 19 bp, Homo sapiens
atgcctgtagtctcagcta

SEQ ID NO: 4449791 - DNA, 21 bp, Homo sapiens
atgcctgtggtgaagtgtggc

SEQ ID NO: 4449792 - DNA, 22 bp, Homo sapiens
atgcctgtggtgaagtgtggct

SEQ ID NO: 4449793 - DNA, 16 bp, Homo sapiens
atgcctgttaatttat

SEQ ID NO: 4449794 - DNA, 18 bp, Homo sapiens
atgccttactcttcttga

SEQ ID NO: 4449795 - DNA, 23 bp, Homo sapiens
atgccttgaataataagcaggat

SEQ ID NO: 4449796 - DNA, 21 bp, Homo sapiens
atgccttgattagacctaatt

SEQ ID NO: 4449797 - DNA, 20 bp, Homo sapiens
atgccttggaggaaatgtgc

SEQ ID NO: 4449798 - DNA, 21 bp, Homo sapiens
atgccttttcccaaaatgttg

SEQ ID NO: 4449799 - DNA, 15 bp, Homo sapiens
atgcgcaatgtggca

SEQ ID NO: 4449800 - DNA, 21 bp, Homo sapiens
atgcgcattctaacctggagg

SEQ ID NO: 4449801 - DNA, 15 bp, Homo sapiens
atgcggcccagcccg

SEQ ID NO: 4449802 - DNA, 18 bp, Homo sapiens
atgcggcccagcccggct

SEQ ID NO: 4449803 - DNA, 19 bp, Homo sapiens
atgcggccgcattccctga

SEQ ID NO: 4449804 - DNA, 18 bp, Homo sapiens
atgcggtgggtgctgcca

SEQ ID NO: 4449805 - DNA, 16 bp, Homo sapiens
atgcgtgtttctgact

SEQ ID NO: 4449806 - DNA, 15 bp, Homo sapiens
atgctaacaaagaca

SEQ ID NO: 4449807 - DNA, 15 bp, Homo sapiens
atgctaagagaagta

SEQ ID NO: 4449808 - DNA, 13 bp, Homo sapiens
atgctaagtgaaa

SEQ ID NO: 4449809 - DNA, 14 bp, Homo sapiens
atgctaatggaatt

SEQ ID NO: 4449810 - DNA, 22 bp, Homo sapiens
atgctatggaacataaagttgt

SEQ ID NO: 4449811 - DNA, 17 bp, Homo sapiens
atgctattgacaataaa

SEQ ID NO: 4449812 - DNA, 18 bp, Homo sapiens
atggttctggctgtttga

SEQ ID NO: 4449813 - DNA, 19 bp, Homo sapiens
atggttctggctgtttgag

SEQ ID NO: 4449814 - DNA, 21 bp, Homo sapiens
atggttctgtgacccatctgt

SEQ ID NO: 4449815 - DNA, 20 bp, Homo sapiens
atggttgggggaatgcacct

SEQ ID NO: 4449816 - DNA, 13 bp, Homo sapiens
atggtttgaaatt

SEQ ID NO: 4449817 - DNA, 14 bp, Homo sapiens
atggtttggagctg

SEQ ID NO: 4449818 - DNA, 15 bp, Homo sapiens
atggtttggagctga

SEQ ID NO: 4449819 - DNA, 14 bp, Homo sapiens
atggttttaaactt

SEQ ID NO: 4449820 - DNA, 15 bp, Homo sapiens
atggttttaaacttt

SEQ ID NO: 4449821 - DNA, 21 bp, Homo sapiens
atggttttctccaagagctac

SEQ ID NO: 4449822 - DNA, 16 bp, Homo sapiens
atggtttttaaatttt

SEQ ID NO: 4449823 - DNA, 21 bp, Homo sapiens
atggtttttaaattttgtaat

SEQ ID NO: 4449824 - DNA, 14 bp, Homo sapiens
atgtaaaacattta

SEQ ID NO: 4449825 - DNA, 21 bp, Homo sapiens
atgtaaaacatttattttgac

SEQ ID NO: 4449826 - DNA, 17 bp, Homo sapiens
atgtaaaagaaaatcca

SEQ ID NO: 4449827 - DNA, 17 bp, Homo sapiens
atgtaaacagtgcctgc

SEQ ID NO: 4449828 - DNA, 17 bp, Homo sapiens
atgtaaactatttgtgg

SEQ ID NO: 4449829 - DNA, 21 bp, Homo sapiens
atgtaaagatatttttatctt

SEQ ID NO: 4449830 - DNA, 14 bp, Homo sapiens
atgtaaataaacta

SEQ ID NO: 4449831 - DNA, 23 bp, Homo sapiens
atgtaaataaccccattctttgc

SEQ ID NO: 4449832 - DNA, 23 bp, Homo sapiens
atgtaaatattgttctgctgtct

SEQ ID NO: 4449833 - DNA, 15 bp, Homo sapiens
atgtaaatattttaa

SEQ ID NO: 4449834 - DNA, 23 bp, Homo sapiens
atgtaaatattttaaagaattgt

SEQ ID NO: 4449835 - DNA, 17 bp, Homo sapiens
atgtaagaaaatgttac

SEQ ID NO: 4449836 - DNA, 22 bp, Homo sapiens
atgtaagcatactttgtaaata

SEQ ID NO: 4449837 - DNA, 20 bp, Homo sapiens
atgtaagggaaactgccagc

SEQ ID NO: 4449838 - DNA, 11 bp, Homo sapiens
atgtaagggtc

SEQ ID NO: 4449839 - DNA, 17 bp, Homo sapiens
atgtaagggtctttggt

SEQ ID NO: 4449840 - DNA, 12 bp, Homo sapiens
atgtaataaagt

SEQ ID NO: 4449841 - DNA, 13 bp, Homo sapiens
atgtaataatcat

SEQ ID NO: 4449842 - DNA, 15 bp, Homo sapiens
atgtaatataatgta

SEQ ID NO: 4449843 - DNA, 19 bp, Homo sapiens
atgtaatataatgtatttt

SEQ ID NO: 4449844 - DNA, 19 bp, Homo sapiens
atgtaatcttgaattgtaa

SEQ ID NO: 4449845 - DNA, 16 bp, Homo sapiens
atgtaatgcactttgg

SEQ ID NO: 4449846 - DNA, 21 bp, Homo sapiens
atgtaatgttttctttgcaaa

SEQ ID NO: 4449847 - DNA, 19 bp, Homo sapiens
atgtaattaactgtaaact

SEQ ID NO: 4449848 - DNA, 19 bp, Homo sapiens
atgtaatttcagttctaaa

SEQ ID NO: 4449849 - DNA, 23 bp, Homo sapiens
atgtaatttctttaaatgtgtat

SEQ ID NO: 4449850 - DNA, 21 bp, Homo sapiens
atgtaatttgtgtaataaagt

SEQ ID NO: 4449851 - DNA, 13 bp, Homo sapiens
atgtacaaacatg

SEQ ID NO: 4449852 - DNA, 12 bp, Homo sapiens
atgtacaaccct

SEQ ID NO: 4449853 - DNA, 13 bp, Homo sapiens
atgtacaatacaa

SEQ ID NO: 4449854 - DNA, 14 bp, Homo sapiens
atgtacaatacaat

SEQ ID NO: 4449855 - DNA, 20 bp, Homo sapiens
atgtacaatacaatgtacaa

SEQ ID NO: 4449856 - DNA, 22 bp, Homo sapiens
atgtacaatacaatgtacaatt

SEQ ID NO: 4449857 - DNA, 21 bp, Homo sapiens
atgtacaccacatgctattgt

SEQ ID NO: 4449858 - DNA, 23 bp, Homo sapiens
atgtacaccacatgctattgtct

SEQ ID NO: 4449859 - DNA, 18 bp, Homo sapiens
atgtacactttttacagc

SEQ ID NO: 4449860 - DNA, 13 bp, Homo sapiens
atgtacagtctgt

SEQ ID NO: 4449861 - DNA, 18 bp, Homo sapiens
atgtacagttgagctcag

SEQ ID NO: 4449862 - DNA, 20 bp, Homo sapiens
atgtacagttgagctcaggt

SEQ ID NO: 4449863 - DNA, 14 bp, Homo sapiens
atgtacataactcc

SEQ ID NO: 4449864 - DNA, 15 bp, Homo sapiens
atgtacatgaagcaa

SEQ ID NO: 4449865 - DNA, 12 bp, Homo sapiens
atgtacatttaa

SEQ ID NO: 4449866 - DNA, 16 bp, Homo sapiens
atgtacatttaataat

SEQ ID NO: 4449867 - DNA, 18 bp, Homo sapiens
atgtactacagctatatt

SEQ ID NO: 4449868 - DNA, 21 bp, Homo sapiens
atgtactacagctatatttga

SEQ ID NO: 4449869 - DNA, 15 bp, Homo sapiens
atgtactatgtctga

SEQ ID NO: 4449870 - DNA, 20 bp, Homo sapiens
atgtactatgtctgaacata

SEQ ID NO: 4449871 - DNA, 17 bp, Homo sapiens
atgtactgaattcttta

SEQ ID NO: 4449872 - DNA, 19 bp, Homo sapiens
atgtactgaattctttatc

SEQ ID NO: 4449873 - DNA, 16 bp, Homo sapiens
atgtactgatttcagt

SEQ ID NO: 4449874 - DNA, 18 bp, Homo sapiens
atgtactgatttcagtaa

SEQ ID NO: 4449875 - DNA, 19 bp, Homo sapiens
atgtactgatttcagtaag

SEQ ID NO: 4449876 - DNA, 16 bp, Homo sapiens
atgtactgtataacat

SEQ ID NO: 4449877 - DNA, 18 bp, Homo sapiens
atgtactgttgaaaaaga

SEQ ID NO: 4449878 - DNA, 20 bp, Homo sapiens
atgtacttgaaaaatgtttt

SEQ ID NO: 4449879 - DNA, 17 bp, Homo sapiens
atgtacttgtttgaata

SEQ ID NO: 4449880 - DNA, 23 bp, Homo sapiens
atgtacttgtttgaatatttgtt

SEQ ID NO: 4449881 - DNA, 12 bp, Homo sapiens
atgtagaaagct

SEQ ID NO: 4449882 - DNA, 18 bp, Homo sapiens
atgtagaataaatgaaga

SEQ ID NO: 4449883 - DNA, 20 bp, Homo sapiens
atgtagaatattcagacaaa

SEQ ID NO: 4449884 - DNA, 17 bp, Homo sapiens
atgtagacataaagaag

SEQ ID NO: 4449885 - DNA, 22 bp, Homo sapiens
atgtagactgtgccagaggcca

SEQ ID NO: 4449886 - DNA, 17 bp, Homo sapiens
atgtagaggagaaactg

SEQ ID NO: 4449887 - DNA, 16 bp, Homo sapiens
atgtagatatttgaaa

SEQ ID NO: 4449888 - DNA, 21 bp, Homo sapiens
atgtagcaaaatacatgacat

SEQ ID NO: 4449889 - DNA, 16 bp, Homo sapiens
atgtagccagctgtgc

SEQ ID NO: 4449890 - DNA, 16 bp, Homo sapiens
atgtagccttcacaca

SEQ ID NO: 4449891 - DNA, 22 bp, Homo sapiens
atgtagcctttactgtttgata

SEQ ID NO: 4449892 - DNA, 15 bp, Homo sapiens
atgtagctgaaaata

SEQ ID NO: 4449893 - DNA, 19 bp, Homo sapiens
atgtagcttcagtcattaa

SEQ ID NO: 4449894 - DNA, 22 bp, Homo sapiens
atgtaggatgacaggctctcct

SEQ ID NO: 4449895 - DNA, 12 bp, Homo sapiens
atgtagtaacac

SEQ ID NO: 4449896 - DNA, 17 bp, Homo sapiens
atgtagtaacactaata

SEQ ID NO: 4449897 - DNA, 13 bp, Homo sapiens
atgtagtaattga

SEQ ID NO: 4449898 - DNA, 17 bp, Homo sapiens
atgtagtaattgacatg

SEQ ID NO: 4449899 - DNA, 16 bp, Homo sapiens
atgtagtatggtatat

SEQ ID NO: 4449900 - DNA, 18 bp, Homo sapiens
atgtagtatggtatatgc

SEQ ID NO: 4449901 - DNA, 23 bp, Homo sapiens
atgtagtattttttgtataattg

SEQ ID NO: 4449902 - DNA, 17 bp, Homo sapiens
atgtagtgattaaatat

SEQ ID NO: 4449903 - DNA, 15 bp, Homo sapiens
atgtagttttgtata

SEQ ID NO: 4449904 - DNA, 19 bp, Homo sapiens
atgtataaaaattatcaaa

SEQ ID NO: 4449905 - DNA, 21 bp, Homo sapiens
atgtataatgacttttaaaat

SEQ ID NO: 4449906 - DNA, 20 bp, Homo sapiens
atgtataatgtgcagaaaat

SEQ ID NO: 4449907 - DNA, 15 bp, Homo sapiens
atgtatacaatgcac

SEQ ID NO: 4449908 - DNA, 17 bp, Homo sapiens
atgtatacaatgcactt

SEQ ID NO: 4449909 - DNA, 14 bp, Homo sapiens
atgtatataaaaat

SEQ ID NO: 4449910 - DNA, 13 bp, Homo sapiens
atgtatatatcta

SEQ ID NO: 4449911 - DNA, 19 bp, Homo sapiens
atgtatattttatatcaat

SEQ ID NO: 4449912 - DNA, 18 bp, Homo sapiens
atgtatcagtgtcctttc

SEQ ID NO: 4449913 - DNA, 20 bp, Homo sapiens
atgtatcagtgtcctttcca

SEQ ID NO: 4449914 - DNA, 20 bp, Homo sapiens
atgtatctatttgtacaatt

SEQ ID NO: 4449915 - DNA, 21 bp, Homo sapiens
atgtatctatttgtacaattt

SEQ ID NO: 4449916 - DNA, 16 bp, Homo sapiens
atgtatctgcatatgt

SEQ ID NO: 4449917 - DNA, 17 bp, Homo sapiens
atgtatctgcatatgtt

SEQ ID NO: 4449918 - DNA, 16 bp, Homo sapiens
atgtatctttattaaa

SEQ ID NO: 4449919 - DNA, 14 bp, Homo sapiens
atgtatggatatat

SEQ ID NO: 4449920 - DNA, 15 bp, Homo sapiens
atgtatggatatatt

SEQ ID NO: 4449921 - DNA, 18 bp, Homo sapiens
atgtatggatatatttga

SEQ ID NO: 4449922 - DNA, 22 bp, Homo sapiens
atgtatgtacaatacaatgtac

SEQ ID NO: 4449923 - DNA, 13 bp, Homo sapiens
atgtatgttaatt

SEQ ID NO: 4449924 - DNA, 12 bp, Homo sapiens
atgtatgttacc

SEQ ID NO: 4449925 - DNA, 13 bp, Homo sapiens
atgtattagtgtc

SEQ ID NO: 4449926 - DNA, 20 bp, Homo sapiens
atgtattatgtcctgtgaga

SEQ ID NO: 4449927 - DNA, 17 bp, Homo sapiens
atgtattcctttaaaat

SEQ ID NO: 4449928 - DNA, 14 bp, Homo sapiens
atgtattgattcaa

SEQ ID NO: 4449929 - DNA, 17 bp, Homo sapiens
atgtatttaccaaaaat

SEQ ID NO: 4449930 - DNA, 13 bp, Homo sapiens
atgtgctgccctg

SEQ ID NO: 4449931 - DNA, 17 bp, Homo sapiens
atgtgctggaggggtgg

SEQ ID NO: 4449932 - DNA, 20 bp, Homo sapiens
atgtgctggaggggtggccc

SEQ ID NO: 4449933 - DNA, 21 bp, Homo sapiens
atgtgctggaggggtggccca

SEQ ID NO: 4449934 - DNA, 22 bp, Homo sapiens
atgtgctggaggggtggcccag

SEQ ID NO: 4449935 - DNA, 23 bp, Homo sapiens
atgtgctggaggggtggcccaga

SEQ ID NO: 4449936 - DNA, 17 bp, Homo sapiens
atgtgcttcatctgtgg

SEQ ID NO: 4449937 - DNA, 14 bp, Homo sapiens
atgtgctttgagaa

SEQ ID NO: 4449938 - DNA, 18 bp, Homo sapiens
atgtggaggaagagccac

SEQ ID NO: 4449939 - DNA, 14 bp, Homo sapiens
atgtggatctgggg

SEQ ID NO: 4449940 - DNA, 17 bp, Homo sapiens
atgtggattttgtagat

SEQ ID NO: 4449941 - DNA, 15 bp, Homo sapiens
atgtggcaaaacata

SEQ ID NO: 4449942 - DNA, 20 bp, Homo sapiens
atgtggcaaactgaagctgc

SEQ ID NO: 4449943 - DNA, 22 bp, Homo sapiens
atgtggcagatctacatgtcta

SEQ ID NO: 4449944 - DNA, 17 bp, Homo sapiens
atgtggcattggggggc

SEQ ID NO: 4449945 - DNA, 20 bp, Homo sapiens
atgtggccctggcctgctgg

SEQ ID NO: 4449946 - DNA, 15 bp, Homo sapiens
atgtggctgtaaaac

SEQ ID NO: 4449947 - DNA, 17 bp, Homo sapiens
atgtggctgtaaaactt

SEQ ID NO: 4449948 - DNA, 23 bp, Homo sapiens
atgtgggagctgaaccacagaaa

SEQ ID NO: 4449949 - DNA, 18 bp, Homo sapiens
atgtgggcagtgatgtca

SEQ ID NO: 4449950 - DNA, 16 bp, Homo sapiens
atgtgggggtctgtgt

SEQ ID NO: 4449951 - DNA, 19 bp, Homo sapiens
atgtggtcacagctgtata

SEQ ID NO: 4449952 - DNA, 22 bp, Homo sapiens
atgtggtcacagctgtatagct

SEQ ID NO: 4449953 - DNA, 20 bp, Homo sapiens
atgtggttgcaaggccgctg

SEQ ID NO: 4449954 - DNA, 16 bp, Homo sapiens
atgtggtttgtacata

SEQ ID NO: 4449955 - DNA, 21 bp, Homo sapiens
atgtggtttgtacatatcaaa

SEQ ID NO: 4449956 - DNA, 23 bp, Homo sapiens
atgtgtagttgtctctcttcaga

SEQ ID NO: 4449957 - DNA, 20 bp, Homo sapiens
atgtgtatacatacatgtat

SEQ ID NO: 4449958 - DNA, 21 bp, Homo sapiens
atgtgtatcagtgtttatgtg

SEQ ID NO: 4449959 - DNA, 11 bp, Homo sapiens
atgtgtcccct

SEQ ID NO: 4449960 - DNA, 13 bp, Homo sapiens
atgtgtcccctca

SEQ ID NO: 4449961 - DNA, 19 bp, Homo sapiens
atgtgtctgtgttgcttca

SEQ ID NO: 4449962 - DNA, 19 bp, Homo sapiens
atgtgtctttctaagaaat

SEQ ID NO: 4449963 - DNA, 18 bp, Homo sapiens
atgtgtgccctggactgt

SEQ ID NO: 4449964 - DNA, 20 bp, Homo sapiens
atgtgtgctcacaatgttct

SEQ ID NO: 4449965 - DNA, 16 bp, Homo sapiens
atgtgtgctttattga

SEQ ID NO: 4449966 - DNA, 14 bp, Homo sapiens
atgtgtgtatgtgt

SEQ ID NO: 4449967 - DNA, 22 bp, Homo sapiens
atgtgtgtccacgactgtctcc

SEQ ID NO: 4449968 - DNA, 18 bp, Homo sapiens
atgtgtgtgtgttgtgtg

SEQ ID NO: 4449969 - DNA, 14 bp, Homo sapiens
atgtgtgttttttc

SEQ ID NO: 4449970 - DNA, 17 bp, Homo sapiens
atgtgttaatcttaatg

SEQ ID NO: 4449971 - DNA, 20 bp, Homo sapiens
atgtgttaatcttaatgtat

SEQ ID NO: 4449972 - DNA, 15 bp, Homo sapiens
atgtgttttctgtag

SEQ ID NO: 4449973 - DNA, 13 bp, Homo sapiens
atgtgtttttctc

SEQ ID NO: 4449974 - DNA, 17 bp, Homo sapiens
atgtgtttttctccagt

SEQ ID NO: 4449975 - DNA, 15 bp, Homo sapiens
atgttaaaaaaataa

SEQ ID NO: 4449976 - DNA, 18 bp, Homo sapiens
atgttaaaataaatggtt

SEQ ID NO: 4449977 - DNA, 18 bp, Homo sapiens
atgttaacaatgcctatt

SEQ ID NO: 4449978 - DNA, 21 bp, Homo sapiens
atgttaagccctggcaggcag

SEQ ID NO: 4449979 - DNA, 14 bp, Homo sapiens
atgttaagttatat

SEQ ID NO: 4449980 - DNA, 22 bp, Homo sapiens
atgttaatattttaggtgtaaa

SEQ ID NO: 4449981 - DNA, 16 bp, Homo sapiens
atgttaatttatttag

SEQ ID NO: 4449982 - DNA, 20 bp, Homo sapiens
atgttaattttttggtacaa

SEQ ID NO: 4449983 - DNA, 14 bp, Homo sapiens
atgttaccttcaca

SEQ ID NO: 4449984 - DNA, 14 bp, Homo sapiens
atgttacttctgat

SEQ ID NO: 4449985 - DNA, 22 bp, Homo sapiens
atgttagactcatggtgtgtta

SEQ ID NO: 4449986 - DNA, 18 bp, Homo sapiens
atgttagacttgtgtgca

SEQ ID NO: 4449987 - DNA, 21 bp, Homo sapiens
atgttagttaccttatagtta

SEQ ID NO: 4449988 - DNA, 23 bp, Homo sapiens
atgttagttaccttatagttact

SEQ ID NO: 4449989 - DNA, 21 bp, Homo sapiens
atgttatactgaaccaggcca

SEQ ID NO: 4449990 - DNA, 15 bp, Homo sapiens
atgttatagaacttc

SEQ ID NO: 4449991 - DNA, 15 bp, Homo sapiens
atgttatattgcttc

SEQ ID NO: 4449992 - DNA, 19 bp, Homo sapiens
atgttatcggattactgaa

SEQ ID NO: 4449993 - DNA, 22 bp, Homo sapiens
atgttatcggattactgaattg

SEQ ID NO: 4449994 - DNA, 24 bp, Homo sapiens
atgttatgactatgtaaactactt

SEQ ID NO: 4449995 - DNA, 15 bp, Homo sapiens
atgttatttgtaata

SEQ ID NO: 4449996 - DNA, 21 bp, Homo sapiens
atgttattttctgttgaagtt

SEQ ID NO: 4449997 - DNA, 18 bp, Homo sapiens
atgttcatatttattgat

SEQ ID NO: 4449998 - DNA, 15 bp, Homo sapiens
atgttcattgtagat

SEQ ID NO: 4449999 - DNA, 16 bp, Homo sapiens
atgttcattttgaaaa

SEQ ID NO: 4450000 - DNA, 14 bp, Homo sapiens
atgttccactaacc

SEQ ID NO: 4450001 - DNA, 23 bp, Homo sapiens
atgttcccttgaccattggctgc

SEQ ID NO: 4450002 - DNA, 18 bp, Homo sapiens
atgttcctaataagtgaa

SEQ ID NO: 4450003 - DNA, 15 bp, Homo sapiens
atgttcctagtgaaa

SEQ ID NO: 4450004 - DNA, 12 bp, Homo sapiens
atgttcctcctt

SEQ ID NO: 4450005 - DNA, 23 bp, Homo sapiens
atgttccttttttgtatattaca

SEQ ID NO: 4450006 - DNA, 13 bp, Homo sapiens
atgttctcctcta

SEQ ID NO: 4450007 - DNA, 22 bp, Homo sapiens
atgttctggtatgcattcttta

SEQ ID NO: 4450008 - DNA, 15 bp, Homo sapiens
atgttcttggtgttt

SEQ ID NO: 4450009 - DNA, 19 bp, Homo sapiens
atgttcttggtgtttgact

SEQ ID NO: 4450010 - DNA, 15 bp, Homo sapiens
atgttctttccatga

SEQ ID NO: 4450011 - DNA, 19 bp, Homo sapiens
atgttctttggaaagtaca

SEQ ID NO: 4450012 - DNA, 12 bp, Homo sapiens
atgttgaacttt

SEQ ID NO: 4450013 - DNA, 15 bp, Homo sapiens
atgttgaatactttt

SEQ ID NO: 4450014 - DNA, 12 bp, Homo sapiens
atgttgataaac

SEQ ID NO: 4450015 - DNA, 21 bp, Homo sapiens
atgttgataaaccaaaaacat

SEQ ID NO: 4450016 - DNA, 22 bp, Homo sapiens
atgttgcaatgtgaaaaatctg

SEQ ID NO: 4450017 - DNA, 22 bp, Homo sapiens
atgttgctatgtgccttatgtt

SEQ ID NO: 4450018 - DNA, 15 bp, Homo sapiens
atgttgctggatcag

SEQ ID NO: 4450019 - DNA, 14 bp, Homo sapiens
atgttgctttgaaa

SEQ ID NO: 4450020 - DNA, 22 bp, Homo sapiens
atgttggataaggaattataga

SEQ ID NO: 4450021 - DNA, 19 bp, Homo sapiens
atgttggtcaggctggtct

SEQ ID NO: 4450022 - DNA, 20 bp, Homo sapiens
atgttggttgcactttgtag

SEQ ID NO: 4450023 - DNA, 17 bp, Homo sapiens
atgttgtaatatttctt

SEQ ID NO: 4450024 - DNA, 14 bp, Homo sapiens
atgttgtcaaggat

SEQ ID NO: 4450025 - DNA, 14 bp, Homo sapiens
atgttgttgaaagg

SEQ ID NO: 4450026 - DNA, 15 bp, Homo sapiens
atgtttacagaggac

SEQ ID NO: 4450027 - DNA, 12 bp, Homo sapiens
atgtttactgta

SEQ ID NO: 4450028 - DNA, 15 bp, Homo sapiens
atgtttactgtatca

SEQ ID NO: 4450029 - DNA, 13 bp, Homo sapiens
atgtttatattgt

SEQ ID NO: 4450030 - DNA, 23 bp, Homo sapiens
atgtttatggaaatattaagaac

SEQ ID NO: 4450031 - DNA, 19 bp, Homo sapiens
atgtttattaaatgcttca

SEQ ID NO: 4450032 - DNA, 18 bp, Homo sapiens
atgtttattccttctgta

SEQ ID NO: 4450033 - DNA, 14 bp, Homo sapiens
atgtttatttcagg

SEQ ID NO: 4450034 - DNA, 13 bp, Homo sapiens
atgtttatttcat

SEQ ID NO: 4450035 - DNA, 22 bp, Homo sapiens
atgtttcaaaatagacaagttt

SEQ ID NO: 4450036 - DNA, 17 bp, Homo sapiens
atgtttctacacattgc

SEQ ID NO: 4450037 - DNA, 23 bp, Homo sapiens
atgtttctctctctctacctttt

SEQ ID NO: 4450038 - DNA, 22 bp, Homo sapiens
atgtttgaaatgaggtctgttt

SEQ ID NO: 4450039 - DNA, 10 bp, Homo sapiens
atgtttgtgg

SEQ ID NO: 4450040 - DNA, 13 bp, Homo sapiens
atgtttgtggcct

SEQ ID NO: 4450041 - DNA, 22 bp, Homo sapiens
atgtttgtttatatcactgtct

SEQ ID NO: 4450042 - DNA, 13 bp, Homo sapiens
atgtttgttttca

SEQ ID NO: 4450043 - DNA, 21 bp, Homo sapiens
atgtttgttttcaaaatactt

SEQ ID NO: 4450044 - DNA, 12 bp, Homo sapiens
atgttttaaaga

SEQ ID NO: 4450045 - DNA, 21 bp, Homo sapiens
atgttttattggggaattaaa

SEQ ID NO: 4450046 - DNA, 22 bp, Homo sapiens
atgttttccaatattttaataa

SEQ ID NO: 4450047 - DNA, 17 bp, Homo sapiens
atgttttccacataaat

SEQ ID NO: 4450048 - DNA, 21 bp, Homo sapiens
attaattaaatgaacttatgt

SEQ ID NO: 4450049 - DNA, 20 bp, Homo sapiens
attaattcctgtttgtctac

SEQ ID NO: 4450050 - DNA, 21 bp, Homo sapiens
attaattgtgctgtttgcttg

SEQ ID NO: 4450051 - DNA, 10 bp, Homo sapiens
attaatttat

SEQ ID NO: 4450052 - DNA, 23 bp, Homo sapiens
attaatttgttaattaaatattt

SEQ ID NO: 4450053 - DNA, 21 bp, Homo sapiens
attaattttcttggttctttc

SEQ ID NO: 4450054 - DNA, 17 bp, Homo sapiens
attaatttttatttatt

SEQ ID NO: 4450055 - DNA, 22 bp, Homo sapiens
attaatttttatttatttttct

SEQ ID NO: 4450056 - DNA, 14 bp, Homo sapiens
attacaaatattgt

SEQ ID NO: 4450057 - DNA, 21 bp, Homo sapiens
attacaaatcagaagtcatct

SEQ ID NO: 4450058 - DNA, 18 bp, Homo sapiens
attacaaatgcaaatttc

SEQ ID NO: 4450059 - DNA, 19 bp, Homo sapiens
attacaaatgcaaatttct

SEQ ID NO: 4450060 - DNA, 16 bp, Homo sapiens
attacaacatttatgt

SEQ ID NO: 4450061 - DNA, 15 bp, Homo sapiens
attacaagccctggg

SEQ ID NO: 4450062 - DNA, 21 bp, Homo sapiens
attacaatgtatctttattaa

SEQ ID NO: 4450063 - DNA, 15 bp, Homo sapiens
attacagattaaaga

SEQ ID NO: 4450064 - DNA, 14 bp, Homo sapiens
attacagcttttat

SEQ ID NO: 4450065 - DNA, 16 bp, Homo sapiens
attacagggtgactca

SEQ ID NO: 4450066 - DNA, 15 bp, Homo sapiens
attacagtgcagttt

SEQ ID NO: 4450067 - DNA, 20 bp, Homo sapiens
attacatgatttaaagacta

SEQ ID NO: 4450068 - DNA, 15 bp, Homo sapiens
attacattttcagtg

SEQ ID NO: 4450069 - DNA, 19 bp, Homo sapiens
attaccacgccttgacctt

SEQ ID NO: 4450070 - DNA, 23 bp, Homo sapiens
attaccagggactatctttgctg

SEQ ID NO: 4450071 - DNA, 23 bp, Homo sapiens
attacccagtgccgaggacatgc

SEQ ID NO: 4450072 - DNA, 14 bp, Homo sapiens
attacctaatgaaa

SEQ ID NO: 4450073 - DNA, 20 bp, Homo sapiens
attacctcaggtgccaaccc

SEQ ID NO: 4450074 - DNA, 21 bp, Homo sapiens
attacctcaggtgccaaccca

SEQ ID NO: 4450075 - DNA, 13 bp, Homo sapiens
attacctcctgag

SEQ ID NO: 4450076 - DNA, 20 bp, Homo sapiens
attacctgccaattgctacc

SEQ ID NO: 4450077 - DNA, 11 bp, Homo sapiens
attacctgtac

SEQ ID NO: 4450078 - DNA, 16 bp, Homo sapiens
attacctgtggatatt

SEQ ID NO: 4450079 - DNA, 14 bp, Homo sapiens
attacctttacata

SEQ ID NO: 4450080 - DNA, 17 bp, Homo sapiens
attacctttacatatat

SEQ ID NO: 4450081 - DNA, 14 bp, Homo sapiens
attacgatgtaaat

SEQ ID NO: 4450082 - DNA, 14 bp, Homo sapiens
attactagtgttta

SEQ ID NO: 4450083 - DNA, 20 bp, Homo sapiens
attactagtgtttaagtcat

SEQ ID NO: 4450084 - DNA, 16 bp, Homo sapiens
attactattaactctg

SEQ ID NO: 4450085 - DNA, 19 bp, Homo sapiens
attactcctatttttgtaa

SEQ ID NO: 4450086 - DNA, 20 bp, Homo sapiens
attactcctatttttgtaaa

SEQ ID NO: 4450087 - DNA, 21 bp, Homo sapiens
attactcctatttttgtaaac

SEQ ID NO: 4450088 - DNA, 15 bp, Homo sapiens
attactccttcagct

SEQ ID NO: 4450089 - DNA, 18 bp, Homo sapiens
attactctagtttattct

SEQ ID NO: 4450090 - DNA, 18 bp, Homo sapiens
attactctttgctttgta

SEQ ID NO: 4450091 - DNA, 15 bp, Homo sapiens
attactgatgtgata

SEQ ID NO: 4450092 - DNA, 19 bp, Homo sapiens
attactgcactcttaaaca

SEQ ID NO: 4450093 - DNA, 20 bp, Homo sapiens
attactgccattcacttcat

SEQ ID NO: 4450094 - DNA, 22 bp, Homo sapiens
attactggcctttttcatttat

SEQ ID NO: 4450095 - DNA, 14 bp, Homo sapiens
attacttatttaac

SEQ ID NO: 4450096 - DNA, 19 bp, Homo sapiens
attactttaaattatatga

SEQ ID NO: 4450097 - DNA, 17 bp, Homo sapiens
attactttattataaaa

SEQ ID NO: 4450098 - DNA, 21 bp, Homo sapiens
attactttggggctaatttaa

SEQ ID NO: 4450099 - DNA, 23 bp, Homo sapiens
attactttggggctaatttaaca

SEQ ID NO: 4450100 - DNA, 14 bp, Homo sapiens
attactttttatgg

SEQ ID NO: 4450101 - DNA, 11 bp, Homo sapiens
attagaaaaaa

SEQ ID NO: 4450102 - DNA, 15 bp, Homo sapiens
attagaaaatattct

SEQ ID NO: 4450103 - DNA, 21 bp, Homo sapiens
attagaaaatattctctattt

SEQ ID NO: 4450104 - DNA, 19 bp, Homo sapiens
attagaaaggacaacagtt

SEQ ID NO: 4450105 - DNA, 14 bp, Homo sapiens
attagaaatatttt

SEQ ID NO: 4450106 - DNA, 22 bp, Homo sapiens
attagaaattacctgtggatat

SEQ ID NO: 4450107 - DNA, 12 bp, Homo sapiens
attagaatgccg

SEQ ID NO: 4450108 - DNA, 17 bp, Homo sapiens
attagaattaccatttg

SEQ ID NO: 4450109 - DNA, 19 bp, Homo sapiens
attagaattaccatttgtt

SEQ ID NO: 4450110 - DNA, 18 bp, Homo sapiens
attagacactttggaaga

SEQ ID NO: 4450111 - DNA, 14 bp, Homo sapiens
attagactgtgatt

SEQ ID NO: 4450112 - DNA, 23 bp, Homo sapiens
attagagtcaactacacaaagca

SEQ ID NO: 4450113 - DNA, 17 bp, Homo sapiens
attagagtgtctttcca

SEQ ID NO: 4450114 - DNA, 23 bp, Homo sapiens
attagagtgtctttccacggagc

SEQ ID NO: 4450115 - DNA, 19 bp, Homo sapiens
attagatcaaatagttgca

SEQ ID NO: 4450116 - DNA, 23 bp, Homo sapiens
attagatcacatcttaaattcat

SEQ ID NO: 4450117 - DNA, 19 bp, Homo sapiens
attagatcctaagatgtgt

SEQ ID NO: 4450118 - DNA, 22 bp, Homo sapiens
attagcaaagcaaaaggctgag

SEQ ID NO: 4450119 - DNA, 15 bp, Homo sapiens
attagccctgcattt

SEQ ID NO: 4450120 - DNA, 18 bp, Homo sapiens
attagccgggcatggtgg

SEQ ID NO: 4450121 - DNA, 20 bp, Homo sapiens
attagctggttggagagcta

SEQ ID NO: 4450122 - DNA, 17 bp, Homo sapiens
attaggctgtaactact

SEQ ID NO: 4450123 - DNA, 16 bp, Homo sapiens
attagggagagaagat

SEQ ID NO: 4450124 - DNA, 15 bp, Homo sapiens
attagggccctgtgt

SEQ ID NO: 4450125 - DNA, 21 bp, Homo sapiens
attaggtcgttttccaaagag

SEQ ID NO: 4450126 - DNA, 17 bp, Homo sapiens
attagtaacatgtgtta

SEQ ID NO: 4450127 - DNA, 12 bp, Homo sapiens
attagtaagatc

SEQ ID NO: 4450128 - DNA, 17 bp, Homo sapiens
attagtattcaggcact

SEQ ID NO: 4450129 - DNA, 13 bp, Homo sapiens
attagtctgaaac

SEQ ID NO: 4450130 - DNA, 15 bp, Homo sapiens
attagtctgaaactg

SEQ ID NO: 4450131 - DNA, 18 bp, Homo sapiens
attagtgaccattattca

SEQ ID NO: 4450132 - DNA, 23 bp, Homo sapiens
attagtgcagccaagtagcctct

SEQ ID NO: 4450133 - DNA, 18 bp, Homo sapiens
attagtgccacttaatgt

SEQ ID NO: 4450134 - DNA, 22 bp, Homo sapiens
attagtgccacttaatgtatgt

SEQ ID NO: 4450135 - DNA, 17 bp, Homo sapiens
attagttctttttgcca

SEQ ID NO: 4450136 - DNA, 14 bp, Homo sapiens
attagttgctttgt

SEQ ID NO: 4450137 - DNA, 15 bp, Homo sapiens
attagttgctttgtt

SEQ ID NO: 4450138 - DNA, 17 bp, Homo sapiens
attagttggctttcata

SEQ ID NO: 4450139 - DNA, 20 bp, Homo sapiens
attagttggctttcataaat

SEQ ID NO: 4450140 - DNA, 19 bp, Homo sapiens
attataaaaaattaactta

SEQ ID NO: 4450141 - DNA, 21 bp, Homo sapiens
attataaaaaattaacttagt

SEQ ID NO: 4450142 - DNA, 11 bp, Homo sapiens
attataaaaat

SEQ ID NO: 4450143 - DNA, 13 bp, Homo sapiens
attataaaaatat

SEQ ID NO: 4450144 - DNA, 16 bp, Homo sapiens
attataaaatgctcct

SEQ ID NO: 4450145 - DNA, 15 bp, Homo sapiens
attataaactataaa

SEQ ID NO: 4450146 - DNA, 19 bp, Homo sapiens
attataaagttcagatgtt

SEQ ID NO: 4450147 - DNA, 16 bp, Homo sapiens
attataaagttttcta

SEQ ID NO: 4450148 - DNA, 15 bp, Homo sapiens
attataacaactatt

SEQ ID NO: 4450149 - DNA, 16 bp, Homo sapiens
attataacaactattt

SEQ ID NO: 4450150 - DNA, 13 bp, Homo sapiens
attataacataaa

SEQ ID NO: 4450151 - DNA, 14 bp, Homo sapiens
attataacataaaa

SEQ ID NO: 4450152 - DNA, 16 bp, Homo sapiens
attataactcatttgt

SEQ ID NO: 4450153 - DNA, 17 bp, Homo sapiens
attataaggactgcatg

SEQ ID NO: 4450154 - DNA, 13 bp, Homo sapiens
attataagttgac

SEQ ID NO: 4450155 - DNA, 14 bp, Homo sapiens
attataataaaatt

SEQ ID NO: 4450156 - DNA, 18 bp, Homo sapiens
attataatcttataattg

SEQ ID NO: 4450157 - DNA, 13 bp, Homo sapiens
attatacaaaaga

SEQ ID NO: 4450158 - DNA, 19 bp, Homo sapiens
attataccatgtgtgctaa

SEQ ID NO: 4450159 - DNA, 14 bp, Homo sapiens
attatacgctggca

SEQ ID NO: 4450160 - DNA, 13 bp, Homo sapiens
attatactttata

SEQ ID NO: 4450161 - DNA, 14 bp, Homo sapiens
attatactttatat

SEQ ID NO: 4450162 - DNA, 23 bp, Homo sapiens
attatactttatatctgtaatga

SEQ ID NO: 4450163 - DNA, 16 bp, Homo sapiens
attatagacaaaagaa

SEQ ID NO: 4450164 - DNA, 17 bp, Homo sapiens
attatagtgaaacatgt

SEQ ID NO: 4450165 - DNA, 19 bp, Homo sapiens
attatataacaaaaaaggt

SEQ ID NO: 4450166 - DNA, 22 bp, Homo sapiens
attctagataaccttgtttatt

SEQ ID NO: 4450167 - DNA, 22 bp, Homo sapiens
attctagatcctgcaccccagc

SEQ ID NO: 4450168 - DNA, 16 bp, Homo sapiens
attctagattaccatg

SEQ ID NO: 4450169 - DNA, 16 bp, Homo sapiens
attctagttttgtcaa

SEQ ID NO: 4450170 - DNA, 18 bp, Homo sapiens
attctataagttttatgt

SEQ ID NO: 4450171 - DNA, 14 bp, Homo sapiens
attctatgtgtcat

SEQ ID NO: 4450172 - DNA, 20 bp, Homo sapiens
attctatttatatgtacatg

SEQ ID NO: 4450173 - DNA, 18 bp, Homo sapiens
attctattttagaataaa

SEQ ID NO: 4450174 - DNA, 17 bp, Homo sapiens
attctcaaaggagcgag

SEQ ID NO: 4450175 - DNA, 13 bp, Homo sapiens
attctcacaatag

SEQ ID NO: 4450176 - DNA, 17 bp, Homo sapiens
attctcactccaccacc

SEQ ID NO: 4450177 - DNA, 13 bp, Homo sapiens
attctcagaattc

SEQ ID NO: 4450178 - DNA, 18 bp, Homo sapiens
attctcataattcctaca

SEQ ID NO: 4450179 - DNA, 21 bp, Homo sapiens
attctccaggggtttacagtg

SEQ ID NO: 4450180 - DNA, 20 bp, Homo sapiens
attctcccaggtaccagctg

SEQ ID NO: 4450181 - DNA, 14 bp, Homo sapiens
attctcccctccct

SEQ ID NO: 4450182 - DNA, 18 bp, Homo sapiens
attctcctcagtggcttc

SEQ ID NO: 4450183 - DNA, 20 bp, Homo sapiens
attctcctcagtggcttctc

SEQ ID NO: 4450184 - DNA, 14 bp, Homo sapiens
attctcctgcctca

SEQ ID NO: 4450185 - DNA, 23 bp, Homo sapiens
attctcctgcctcagcctcccat

SEQ ID NO: 4450186 - DNA, 15 bp, Homo sapiens
attctccttcagccc

SEQ ID NO: 4450187 - DNA, 20 bp, Homo sapiens
attctctatttgaattattt

SEQ ID NO: 4450188 - DNA, 22 bp, Homo sapiens
attctctatttgaattatttct

SEQ ID NO: 4450189 - DNA, 20 bp, Homo sapiens
attctctcatagaacattga

SEQ ID NO: 4450190 - DNA, 11 bp, Homo sapiens
attctctgagc

SEQ ID NO: 4450191 - DNA, 18 bp, Homo sapiens
attctctgagctgtgcag

SEQ ID NO: 4450192 - DNA, 13 bp, Homo sapiens
attctctgtctca

SEQ ID NO: 4450193 - DNA, 14 bp, Homo sapiens
attctctgtctcat

SEQ ID NO: 4450194 - DNA, 17 bp, Homo sapiens
attctctgtctcatcca

SEQ ID NO: 4450195 - DNA, 18 bp, Homo sapiens
attctctgtctcatccat

SEQ ID NO: 4450196 - DNA, 14 bp, Homo sapiens
attctgaacaattg

SEQ ID NO: 4450197 - DNA, 16 bp, Homo sapiens
attctgaaggagcccc

SEQ ID NO: 4450198 - DNA, 22 bp, Homo sapiens
attctgaagtttcctatgacta

SEQ ID NO: 4450199 - DNA, 20 bp, Homo sapiens
attctgaatcaccaattaaa

SEQ ID NO: 4450200 - DNA, 22 bp, Homo sapiens
attctgaatcaccaattaaaaa

SEQ ID NO: 4450201 - DNA, 20 bp, Homo sapiens
attctgaattggctaaaaga

SEQ ID NO: 4450202 - DNA, 14 bp, Homo sapiens
attctgaatttgca

SEQ ID NO: 4450203 - DNA, 17 bp, Homo sapiens
attctgaatttgcaaag

SEQ ID NO: 4450204 - DNA, 18 bp, Homo sapiens
attctgaatttgcaaagt

SEQ ID NO: 4450205 - DNA, 20 bp, Homo sapiens
attctgaatttgcaaagtac

SEQ ID NO: 4450206 - DNA, 23 bp, Homo sapiens
attctgaatttgcaaagtactgt

SEQ ID NO: 4450207 - DNA, 14 bp, Homo sapiens
attctgacatgtaa

SEQ ID NO: 4450208 - DNA, 14 bp, Homo sapiens
attctgacttcctc

SEQ ID NO: 4450209 - DNA, 20 bp, Homo sapiens
attctgagcaaaggccctgg

SEQ ID NO: 4450210 - DNA, 18 bp, Homo sapiens
attctgcagtaaatcttt

SEQ ID NO: 4450211 - DNA, 21 bp, Homo sapiens
attctgcagtaaatcttttac

SEQ ID NO: 4450212 - DNA, 15 bp, Homo sapiens
attctgcctctctgg

SEQ ID NO: 4450213 - DNA, 24 bp, Homo sapiens
attctgggcaccacaaaatataca

SEQ ID NO: 4450214 - DNA, 12 bp, Homo sapiens
attctgtaattt

SEQ ID NO: 4450215 - DNA, 23 bp, Homo sapiens
attctgtgcaggctgcagtggct

SEQ ID NO: 4450216 - DNA, 20 bp, Homo sapiens
attctgtgccttgttttttg

SEQ ID NO: 4450217 - DNA, 15 bp, Homo sapiens
attctgttatctcag

SEQ ID NO: 4450218 - DNA, 19 bp, Homo sapiens
attctgttctgcaactcca

SEQ ID NO: 4450219 - DNA, 17 bp, Homo sapiens
attctgttttgttaata

SEQ ID NO: 4450220 - DNA, 23 bp, Homo sapiens
attcttaaaactttctaaatgca

SEQ ID NO: 4450221 - DNA, 13 bp, Homo sapiens
attcttaaaatgc

SEQ ID NO: 4450222 - DNA, 17 bp, Homo sapiens
attcttaaaatgcaata

SEQ ID NO: 4450223 - DNA, 22 bp, Homo sapiens
attcttaaaatgcaatatttgt

SEQ ID NO: 4450224 - DNA, 19 bp, Homo sapiens
attcttaataaaactcact

SEQ ID NO: 4450225 - DNA, 20 bp, Homo sapiens
attcttagcctgtggcagta

SEQ ID NO: 4450226 - DNA, 13 bp, Homo sapiens
attcttcatgaaa

SEQ ID NO: 4450227 - DNA, 20 bp, Homo sapiens
attcttccatcatcactgta

SEQ ID NO: 4450228 - DNA, 21 bp, Homo sapiens
attcttccttccctcctttta

SEQ ID NO: 4450229 - DNA, 22 bp, Homo sapiens
attcttctaaagcactggtttc

SEQ ID NO: 4450230 - DNA, 23 bp, Homo sapiens
attcttctaaagcactggtttca

SEQ ID NO: 4450231 - DNA, 21 bp, Homo sapiens
attcttctcttccttttatca

SEQ ID NO: 4450232 - DNA, 22 bp, Homo sapiens
attcttctggtgctactccatg

SEQ ID NO: 4450233 - DNA, 13 bp, Homo sapiens
attcttcttgaaa

SEQ ID NO: 4450234 - DNA, 18 bp, Homo sapiens
attcttcttgaaaataaa

SEQ ID NO: 4450235 - DNA, 21 bp, Homo sapiens
attcttcttgaaaataaaaaa

SEQ ID NO: 4450236 - DNA, 21 bp, Homo sapiens
attcttgatttatttgcttct

SEQ ID NO: 4450237 - DNA, 17 bp, Homo sapiens
attcttggaccatgcca

SEQ ID NO: 4450238 - DNA, 19 bp, Homo sapiens
attcttggaccatgccaga

SEQ ID NO: 4450239 - DNA, 20 bp, Homo sapiens
attcttggaccatgccagat

SEQ ID NO: 4450240 - DNA, 13 bp, Homo sapiens
attcttggttgtt

SEQ ID NO: 4450241 - DNA, 19 bp, Homo sapiens
attcttggttgttaattta

SEQ ID NO: 4450242 - DNA, 13 bp, Homo sapiens
attcttgtaaatc

SEQ ID NO: 4450243 - DNA, 15 bp, Homo sapiens
attcttgtaaatctt

SEQ ID NO: 4450244 - DNA, 19 bp, Homo sapiens
attcttgtaaatctttttg

SEQ ID NO: 4450245 - DNA, 14 bp, Homo sapiens
attcttgtttgaat

SEQ ID NO: 4450246 - DNA, 14 bp, Homo sapiens
attctttatagtga

SEQ ID NO: 4450247 - DNA, 22 bp, Homo sapiens
attctttatagtgaagtgttaa

SEQ ID NO: 4450248 - DNA, 22 bp, Homo sapiens
attctttatcccattttatcat

SEQ ID NO: 4450249 - DNA, 15 bp, Homo sapiens
attctttcccagtga

SEQ ID NO: 4450250 - DNA, 20 bp, Homo sapiens
attctttcccagtgagtctc

SEQ ID NO: 4450251 - DNA, 16 bp, Homo sapiens
attctttctgttgaaa

SEQ ID NO: 4450252 - DNA, 20 bp, Homo sapiens
attctttctgttgaaaagca

SEQ ID NO: 4450253 - DNA, 16 bp, Homo sapiens
attcttttgaattgtt

SEQ ID NO: 4450254 - DNA, 16 bp, Homo sapiens
attctttttgaaatgt

SEQ ID NO: 4450255 - DNA, 17 bp, Homo sapiens
attcttttttaaatttt

SEQ ID NO: 4450256 - DNA, 19 bp, Homo sapiens
attcttttttaaattttct

SEQ ID NO: 4450257 - DNA, 18 bp, Homo sapiens
attgaaaaaatagagcct

SEQ ID NO: 4450258 - DNA, 19 bp, Homo sapiens
attgaaaaaatagagcctg

SEQ ID NO: 4450259 - DNA, 15 bp, Homo sapiens
attgaaaaacaattt

SEQ ID NO: 4450260 - DNA, 22 bp, Homo sapiens
attgaaaaacaattttctgtaa

SEQ ID NO: 4450261 - DNA, 21 bp, Homo sapiens
attgaaaaggaacttgccctg

SEQ ID NO: 4450262 - DNA, 17 bp, Homo sapiens
attgaaaatatatatta

SEQ ID NO: 4450263 - DNA, 22 bp, Homo sapiens
attgaaaatgtccaggaaagtg

SEQ ID NO: 4450264 - DNA, 18 bp, Homo sapiens
attgaaaattgaaaagta

SEQ ID NO: 4450265 - DNA, 15 bp, Homo sapiens
attgaaacacagagt

SEQ ID NO: 4450266 - DNA, 16 bp, Homo sapiens
attgaaagcttttaaa

SEQ ID NO: 4450267 - DNA, 20 bp, Homo sapiens
attgaaagcttttaaaatgt

SEQ ID NO: 4450268 - DNA, 14 bp, Homo sapiens
attgaaagttgctt

SEQ ID NO: 4450269 - DNA, 15 bp, Homo sapiens
attgaaagttgcttt

SEQ ID NO: 4450270 - DNA, 19 bp, Homo sapiens
attgaaagttgcttttatt

SEQ ID NO: 4450271 - DNA, 19 bp, Homo sapiens
attgaaataaataaaaatg

SEQ ID NO: 4450272 - DNA, 22 bp, Homo sapiens
attgaaataaataaaaatgcat

SEQ ID NO: 4450273 - DNA, 14 bp, Homo sapiens
attgaaatgctgta

SEQ ID NO: 4450274 - DNA, 17 bp, Homo sapiens
attgaaatttactgtga

SEQ ID NO: 4450275 - DNA, 19 bp, Homo sapiens
attgaacacaaactgtaaa

SEQ ID NO: 4450276 - DNA, 18 bp, Homo sapiens
attgaacgactgtatatt

SEQ ID NO: 4450277 - DNA, 20 bp, Homo sapiens
attgaacgactgtatattgc

SEQ ID NO: 4450278 - DNA, 23 bp, Homo sapiens
attgaacgactgtatattgctaa

SEQ ID NO: 4450279 - DNA, 14 bp, Homo sapiens
attgaacttttgta

SEQ ID NO: 4450280 - DNA, 17 bp, Homo sapiens
attgaacttttgtactg

SEQ ID NO: 4450281 - DNA, 18 bp, Homo sapiens
attgaacttttgtactga

SEQ ID NO: 4450282 - DNA, 23 bp, Homo sapiens
attgaacttttgtactgaatttt

SEQ ID NO: 4450283 - DNA, 20 bp, Homo sapiens
attggggaattaaatagtgt

SEQ ID NO: 4450284 - DNA, 21 bp, Homo sapiens
attggggctcccagccaggcc

SEQ ID NO: 4450285 - DNA, 19 bp, Homo sapiens
attgggggggccaaaagga

SEQ ID NO: 4450286 - DNA, 23 bp, Homo sapiens
attgggggggccaaaaggaaaaa

SEQ ID NO: 4450287 - DNA, 14 bp, Homo sapiens
attgggtggggctc

SEQ ID NO: 4450288 - DNA, 14 bp, Homo sapiens
attgggttcatgat

SEQ ID NO: 4450289 - DNA, 19 bp, Homo sapiens
attggtatagccatgattt

SEQ ID NO: 4450290 - DNA, 17 bp, Homo sapiens
attggtccagcttgctc

SEQ ID NO: 4450291 - DNA, 15 bp, Homo sapiens
attggtgactcactt

SEQ ID NO: 4450292 - DNA, 22 bp, Homo sapiens
attggtgttcgtttccatcatg

SEQ ID NO: 4450293 - DNA, 23 bp, Homo sapiens
attggtgttcgtttccatcatgt

SEQ ID NO: 4450294 - DNA, 14 bp, Homo sapiens
attggtttgcacaa

SEQ ID NO: 4450295 - DNA, 17 bp, Homo sapiens
attggtttgcacaagtt

SEQ ID NO: 4450296 - DNA, 21 bp, Homo sapiens
attggttttatcgcagatttt

SEQ ID NO: 4450297 - DNA, 13 bp, Homo sapiens
attggttttccat

SEQ ID NO: 4450298 - DNA, 21 bp, Homo sapiens
attggttttgaaatgtttcct

SEQ ID NO: 4450299 - DNA, 13 bp, Homo sapiens
attgtaaaatggt

SEQ ID NO: 4450300 - DNA, 14 bp, Homo sapiens
attgtaaaatggtg

SEQ ID NO: 4450301 - DNA, 17 bp, Homo sapiens
attgtaaactagtacta

SEQ ID NO: 4450302 - DNA, 12 bp, Homo sapiens
attgtaaactgt

SEQ ID NO: 4450303 - DNA, 23 bp, Homo sapiens
attgtaaatgtggattttgtaga

SEQ ID NO: 4450304 - DNA, 19 bp, Homo sapiens
attgtaactgttcttgaat

SEQ ID NO: 4450305 - DNA, 14 bp, Homo sapiens
attgtacagttttt

SEQ ID NO: 4450306 - DNA, 15 bp, Homo sapiens
attgtacagttttta

SEQ ID NO: 4450307 - DNA, 20 bp, Homo sapiens
attgtacattttgtaaaata

SEQ ID NO: 4450308 - DNA, 14 bp, Homo sapiens
attgtactccagcc

SEQ ID NO: 4450309 - DNA, 23 bp, Homo sapiens
attgtactgtgtttttaaatttt

SEQ ID NO: 4450310 - DNA, 20 bp, Homo sapiens
attgtactgttgctttaata

SEQ ID NO: 4450311 - DNA, 21 bp, Homo sapiens
attgtactgttgctttaatat

SEQ ID NO: 4450312 - DNA, 16 bp, Homo sapiens
attgtagtaaactatt

SEQ ID NO: 4450313 - DNA, 13 bp, Homo sapiens
attgtagtaatct

SEQ ID NO: 4450314 - DNA, 19 bp, Homo sapiens
attgtagtggcctgtgctt

SEQ ID NO: 4450315 - DNA, 19 bp, Homo sapiens
attgtataccaatgtgttt

SEQ ID NO: 4450316 - DNA, 18 bp, Homo sapiens
attgtatattacaatgat

SEQ ID NO: 4450317 - DNA, 15 bp, Homo sapiens
attgtatattgtaat

SEQ ID NO: 4450318 - DNA, 17 bp, Homo sapiens
attgtatattgtaattt

SEQ ID NO: 4450319 - DNA, 19 bp, Homo sapiens
attgtatatttttatctat

SEQ ID NO: 4450320 - DNA, 12 bp, Homo sapiens
attgtattgctg

SEQ ID NO: 4450321 - DNA, 22 bp, Homo sapiens
attgtcagccatcgtcctggga

SEQ ID NO: 4450322 - DNA, 14 bp, Homo sapiens
attgtcagccttgc

SEQ ID NO: 4450323 - DNA, 23 bp, Homo sapiens
attgtcatctttttctagagtta

SEQ ID NO: 4450324 - DNA, 15 bp, Homo sapiens
attgtccaggaaaga

SEQ ID NO: 4450325 - DNA, 21 bp, Homo sapiens
attgtcctcccctattttaag

SEQ ID NO: 4450326 - DNA, 22 bp, Homo sapiens
attgtccttttctaggaagcac

SEQ ID NO: 4450327 - DNA, 14 bp, Homo sapiens
attgtccttttctc

SEQ ID NO: 4450328 - DNA, 18 bp, Homo sapiens
attgtcgctatgtgactt

SEQ ID NO: 4450329 - DNA, 17 bp, Homo sapiens
attgtctaaaatgtcag

SEQ ID NO: 4450330 - DNA, 20 bp, Homo sapiens
attgtctactcctagaagaa

SEQ ID NO: 4450331 - DNA, 21 bp, Homo sapiens
attgtctactcctagaagaac

SEQ ID NO: 4450332 - DNA, 14 bp, Homo sapiens
attgtctcaacgcc

SEQ ID NO: 4450333 - DNA, 18 bp, Homo sapiens
attgtctcctatatattt

SEQ ID NO: 4450334 - DNA, 23 bp, Homo sapiens
attgtctcctatatatttctatt

SEQ ID NO: 4450335 - DNA, 16 bp, Homo sapiens
attgtctgctgatgca

SEQ ID NO: 4450336 - DNA, 12 bp, Homo sapiens
attgtctgtaaa

SEQ ID NO: 4450337 - DNA, 16 bp, Homo sapiens
attgtcttaatattgt

SEQ ID NO: 4450338 - DNA, 19 bp, Homo sapiens
attgtctttaaaaactgtt

SEQ ID NO: 4450339 - DNA, 14 bp, Homo sapiens
attgtctttatatg

SEQ ID NO: 4450340 - DNA, 20 bp, Homo sapiens
attgtctttatatgaacata

SEQ ID NO: 4450341 - DNA, 23 bp, Homo sapiens
attgtgacttcactgtatataaa

SEQ ID NO: 4450342 - DNA, 13 bp, Homo sapiens
attgtgatgtgtc

SEQ ID NO: 4450343 - DNA, 20 bp, Homo sapiens
attgtgcagtactttgtgca

SEQ ID NO: 4450344 - DNA, 13 bp, Homo sapiens
attgtgcccctgc

SEQ ID NO: 4450345 - DNA, 21 bp, Homo sapiens
attgtgctttcaccagaattt

SEQ ID NO: 4450346 - DNA, 15 bp, Homo sapiens
attgtggaatgttgg

SEQ ID NO: 4450347 - DNA, 12 bp, Homo sapiens
attgtggctcct

SEQ ID NO: 4450348 - DNA, 20 bp, Homo sapiens
attgtggtggttgagatgga

SEQ ID NO: 4450349 - DNA, 17 bp, Homo sapiens
attgtgtatagatattt

SEQ ID NO: 4450350 - DNA, 12 bp, Homo sapiens
attgtgtatctg

SEQ ID NO: 4450351 - DNA, 14 bp, Homo sapiens
attgtgtatctgtg

SEQ ID NO: 4450352 - DNA, 19 bp, Homo sapiens
attgtgtattatgttgttc

SEQ ID NO: 4450353 - DNA, 17 bp, Homo sapiens
attgtgtcagactgttt

SEQ ID NO: 4450354 - DNA, 19 bp, Homo sapiens
attgtgttgactttataaa

SEQ ID NO: 4450355 - DNA, 12 bp, Homo sapiens
attgtgtttatt

SEQ ID NO: 4450356 - DNA, 15 bp, Homo sapiens
attgttacaaggaca

SEQ ID NO: 4450357 - DNA, 21 bp, Homo sapiens
attgttagaaaatgacttatt

SEQ ID NO: 4450358 - DNA, 22 bp, Homo sapiens
attgttagcaaatgacagattt

SEQ ID NO: 4450359 - DNA, 17 bp, Homo sapiens
attgttataaataaaat

SEQ ID NO: 4450360 - DNA, 14 bp, Homo sapiens
attgttattaaatg

SEQ ID NO: 4450361 - DNA, 20 bp, Homo sapiens
attgttcacttctaaaccaa

SEQ ID NO: 4450362 - DNA, 22 bp, Homo sapiens
attgttccaggcatccatcttg

SEQ ID NO: 4450363 - DNA, 17 bp, Homo sapiens
attgttgaaaaagtttg

SEQ ID NO: 4450364 - DNA, 20 bp, Homo sapiens
attgttgaaaaagtttgttt

SEQ ID NO: 4450365 - DNA, 22 bp, Homo sapiens
attgtttatgtgttatgaacat

SEQ ID NO: 4450366 - DNA, 12 bp, Homo sapiens
attgtttctgca

SEQ ID NO: 4450367 - DNA, 19 bp, Homo sapiens
attgtttcttcttcatgct

SEQ ID NO: 4450368 - DNA, 15 bp, Homo sapiens
attgtttgctgttgg

SEQ ID NO: 4450369 - DNA, 20 bp, Homo sapiens
attgtttgctgttgggtttt

SEQ ID NO: 4450370 - DNA, 23 bp, Homo sapiens
attgtttgctgttgggtttttgc

SEQ ID NO: 4450371 - DNA, 13 bp, Homo sapiens
attgttttacaat

SEQ ID NO: 4450372 - DNA, 15 bp, Homo sapiens
attgttttacaatag

SEQ ID NO: 4450373 - DNA, 19 bp, Homo sapiens
attgttttatctgaatttt

SEQ ID NO: 4450374 - DNA, 14 bp, Homo sapiens
attgttttgaatat

SEQ ID NO: 4450375 - DNA, 15 bp, Homo sapiens
attgttttgaatatt

SEQ ID NO: 4450376 - DNA, 22 bp, Homo sapiens
attgttttgaatattactccta

SEQ ID NO: 4450377 - DNA, 16 bp, Homo sapiens
attgtttttatatatt

SEQ ID NO: 4450378 - DNA, 15 bp, Homo sapiens
attgtttttctttct

SEQ ID NO: 4450379 - DNA, 15 bp, Homo sapiens
attgtttttgtatat

SEQ ID NO: 4450380 - DNA, 17 bp, Homo sapiens
atttaaaaaaaaacctg

SEQ ID NO: 4450381 - DNA, 13 bp, Homo sapiens
atttaaaaaacta

SEQ ID NO: 4450382 - DNA, 13 bp, Homo sapiens
atttaaaaaatta

SEQ ID NO: 4450383 - DNA, 20 bp, Homo sapiens
atttaaaaaattaaaaatga

SEQ ID NO: 4450384 - DNA, 18 bp, Homo sapiens
atttaaaaaattatggaa

SEQ ID NO: 4450385 - DNA, 12 bp, Homo sapiens
atttaaaaataa

SEQ ID NO: 4450386 - DNA, 12 bp, Homo sapiens
atttaaaaatgt

SEQ ID NO: 4450387 - DNA, 15 bp, Homo sapiens
atttaaaaatgtctt

SEQ ID NO: 4450388 - DNA, 14 bp, Homo sapiens
atttaaaacagaca

SEQ ID NO: 4450389 - DNA, 16 bp, Homo sapiens
atttaaaactctggtg

SEQ ID NO: 4450390 - DNA, 20 bp, Homo sapiens
atttaaaatagcaaaagaag

SEQ ID NO: 4450391 - DNA, 22 bp, Homo sapiens
atttaaaatagcaaaagaagaa

SEQ ID NO: 4450392 - DNA, 20 bp, Homo sapiens
atttaaaatgctcaatttca

SEQ ID NO: 4450393 - DNA, 15 bp, Homo sapiens
atttaaaattgtgat

SEQ ID NO: 4450394 - DNA, 16 bp, Homo sapiens
atttaaacatgcagaa

SEQ ID NO: 4450395 - DNA, 19 bp, Homo sapiens
atttaaaccgctaaaagaa

SEQ ID NO: 4450396 - DNA, 24 bp, Homo sapiens
atttaaaccgctaaaagaaacttt

SEQ ID NO: 4450397 - DNA, 14 bp, Homo sapiens
atttaaacctttta

SEQ ID NO: 4450398 - DNA, 20 bp, Homo sapiens
atttaaaccttttattataa

SEQ ID NO: 4450399 - DNA, 12 bp, Homo sapiens
atttaaactata

SEQ ID NO: 4450400 - DNA, 20 bp, Homo sapiens
atttaaactataagcaagaa

SEQ ID NO: 4450401 - DNA, 18 bp, Homo sapiens
atttattaaacttcagca

SEQ ID NO: 4450402 - DNA, 19 bp, Homo sapiens
atttattagccctgcattt

SEQ ID NO: 4450403 - DNA, 18 bp, Homo sapiens
atttattatatatttaca

SEQ ID NO: 4450404 - DNA, 20 bp, Homo sapiens
atttattatatatttacaga

SEQ ID NO: 4450405 - DNA, 10 bp, Homo sapiens
atttattatg

SEQ ID NO: 4450406 - DNA, 13 bp, Homo sapiens
atttattattaat

SEQ ID NO: 4450407 - DNA, 17 bp, Homo sapiens
atttattctacttttaa

SEQ ID NO: 4450408 - DNA, 22 bp, Homo sapiens
atttattgaaatgatttcacag

SEQ ID NO: 4450409 - DNA, 13 bp, Homo sapiens
atttattggggtg

SEQ ID NO: 4450410 - DNA, 16 bp, Homo sapiens
atttatttaaaactct

SEQ ID NO: 4450411 - DNA, 19 bp, Homo sapiens
atttatttaaaactctggt

SEQ ID NO: 4450412 - DNA, 15 bp, Homo sapiens
atttatttacactct

SEQ ID NO: 4450413 - DNA, 18 bp, Homo sapiens
atttatttcaataaatct

SEQ ID NO: 4450414 - DNA, 19 bp, Homo sapiens
atttatttccaatgtttca

SEQ ID NO: 4450415 - DNA, 21 bp, Homo sapiens
atttatttccactaaaaatat

SEQ ID NO: 4450416 - DNA, 12 bp, Homo sapiens
atttatttcctc

SEQ ID NO: 4450417 - DNA, 17 bp, Homo sapiens
atttatttcctccctct

SEQ ID NO: 4450418 - DNA, 13 bp, Homo sapiens
atttatttctctg

SEQ ID NO: 4450419 - DNA, 13 bp, Homo sapiens
atttatttcttaa

SEQ ID NO: 4450420 - DNA, 13 bp, Homo sapiens
atttatttgcaaa

SEQ ID NO: 4450421 - DNA, 15 bp, Homo sapiens
atttatttgcttctt

SEQ ID NO: 4450422 - DNA, 14 bp, Homo sapiens
atttattttagcaa

SEQ ID NO: 4450423 - DNA, 15 bp, Homo sapiens
atttattttagcaaa

SEQ ID NO: 4450424 - DNA, 20 bp, Homo sapiens
atttattttagcaaatcagt

SEQ ID NO: 4450425 - DNA, 15 bp, Homo sapiens
atttattttattcta

SEQ ID NO: 4450426 - DNA, 16 bp, Homo sapiens
atttattttattctat

SEQ ID NO: 4450427 - DNA, 21 bp, Homo sapiens
atttattttgacataaagttg

SEQ ID NO: 4450428 - DNA, 19 bp, Homo sapiens
atttcaaaccattgctctt

SEQ ID NO: 4450429 - DNA, 11 bp, Homo sapiens
atttcaaatat

SEQ ID NO: 4450430 - DNA, 21 bp, Homo sapiens
atttcaaatctgtaattacca

SEQ ID NO: 4450431 - DNA, 14 bp, Homo sapiens
atttcaaatgttag

SEQ ID NO: 4450432 - DNA, 17 bp, Homo sapiens
atttcaaattggagctt

SEQ ID NO: 4450433 - DNA, 20 bp, Homo sapiens
atttcaatgtaattaaactg

SEQ ID NO: 4450434 - DNA, 17 bp, Homo sapiens
atttcacagtgtgtggt

SEQ ID NO: 4450435 - DNA, 20 bp, Homo sapiens
atttcacatcagctttagga

SEQ ID NO: 4450436 - DNA, 15 bp, Homo sapiens
atttcacattattct

SEQ ID NO: 4450437 - DNA, 14 bp, Homo sapiens
atttcacatttcta

SEQ ID NO: 4450438 - DNA, 19 bp, Homo sapiens
atttcacatttttgtaatg

SEQ ID NO: 4450439 - DNA, 14 bp, Homo sapiens
atttcacctgtaaa

SEQ ID NO: 4450440 - DNA, 19 bp, Homo sapiens
atttcagaaggagaaggaa

SEQ ID NO: 4450441 - DNA, 23 bp, Homo sapiens
atttcagagtgactacacacagt

SEQ ID NO: 4450442 - DNA, 14 bp, Homo sapiens
atttcagatgtaat

SEQ ID NO: 4450443 - DNA, 18 bp, Homo sapiens
atttcagatgtaatgttt

SEQ ID NO: 4450444 - DNA, 22 bp, Homo sapiens
atttcagattttgataactgtt

SEQ ID NO: 4450445 - DNA, 21 bp, Homo sapiens
atttcaggaaaatgtattgat

SEQ ID NO: 4450446 - DNA, 18 bp, Homo sapiens
atttcagtaagtctcata

SEQ ID NO: 4450447 - DNA, 18 bp, Homo sapiens
atttcagtgataatgttc

SEQ ID NO: 4450448 - DNA, 20 bp, Homo sapiens
atttcagtgataatgttcat

SEQ ID NO: 4450449 - DNA, 22 bp, Homo sapiens
atttcagtgataatgttcattt

SEQ ID NO: 4450450 - DNA, 15 bp, Homo sapiens
atttcataattcaga

SEQ ID NO: 4450451 - DNA, 17 bp, Homo sapiens
atttcataattctgaaa

SEQ ID NO: 4450452 - DNA, 16 bp, Homo sapiens
atttcataatttgttt

SEQ ID NO: 4450453 - DNA, 23 bp, Homo sapiens
atttcataatttgtttccagcat

SEQ ID NO: 4450454 - DNA, 22 bp, Homo sapiens
atttcatacaacagaaaccaga

SEQ ID NO: 4450455 - DNA, 16 bp, Homo sapiens
atttcatactaaactg

SEQ ID NO: 4450456 - DNA, 13 bp, Homo sapiens
atttcatatctaa

SEQ ID NO: 4450457 - DNA, 16 bp, Homo sapiens
atttcatattgatctt

SEQ ID NO: 4450458 - DNA, 19 bp, Homo sapiens
atttcatccagtttgttct

SEQ ID NO: 4450459 - DNA, 17 bp, Homo sapiens
atttcatccttgaatcc

SEQ ID NO: 4450460 - DNA, 14 bp, Homo sapiens
atttcatctatttt

SEQ ID NO: 4450461 - DNA, 21 bp, Homo sapiens
atttcatctcatttaagggaa

SEQ ID NO: 4450462 - DNA, 15 bp, Homo sapiens
atttcatctgctctc

SEQ ID NO: 4450463 - DNA, 19 bp, Homo sapiens
atttcatctgctctccttc

SEQ ID NO: 4450464 - DNA, 14 bp, Homo sapiens
atttcattatgctt

SEQ ID NO: 4450465 - DNA, 15 bp, Homo sapiens
atttcattatgcttt

SEQ ID NO: 4450466 - DNA, 22 bp, Homo sapiens
atttcattatgctttgaacttt

SEQ ID NO: 4450467 - DNA, 14 bp, Homo sapiens
atttcatttaaata

SEQ ID NO: 4450468 - DNA, 20 bp, Homo sapiens
atttcattttagtattttag

SEQ ID NO: 4450469 - DNA, 15 bp, Homo sapiens
atttccaaaagcaca

SEQ ID NO: 4450470 - DNA, 21 bp, Homo sapiens
atttccaaacctggttcatat

SEQ ID NO: 4450471 - DNA, 18 bp, Homo sapiens
atttccaccaggccgtgc

SEQ ID NO: 4450472 - DNA, 20 bp, Homo sapiens
atttccaccaggccgtgcct

SEQ ID NO: 4450473 - DNA, 14 bp, Homo sapiens
atttcccatctgca

SEQ ID NO: 4450474 - DNA, 17 bp, Homo sapiens
atttccccaccccagct

SEQ ID NO: 4450475 - DNA, 16 bp, Homo sapiens
atttccccagccacag

SEQ ID NO: 4450476 - DNA, 21 bp, Homo sapiens
atttccccagccacaggccaa

SEQ ID NO: 4450477 - DNA, 23 bp, Homo sapiens
atttcccccctccgcctccagga

SEQ ID NO: 4450478 - DNA, 11 bp, Homo sapiens
atttccctgca

SEQ ID NO: 4450479 - DNA, 20 bp, Homo sapiens
atttcccttccttcctctcc

SEQ ID NO: 4450480 - DNA, 17 bp, Homo sapiens
atttcctaatactgtca

SEQ ID NO: 4450481 - DNA, 11 bp, Homo sapiens
atttcctcctt

SEQ ID NO: 4450482 - DNA, 19 bp, Homo sapiens
atttcctgacagcaggtgt

SEQ ID NO: 4450483 - DNA, 22 bp, Homo sapiens
atttcctgagctaaatgcttca

SEQ ID NO: 4450484 - DNA, 14 bp, Homo sapiens
atttcctggatgtt

SEQ ID NO: 4450485 - DNA, 13 bp, Homo sapiens
atttcctggccct

SEQ ID NO: 4450486 - DNA, 13 bp, Homo sapiens
atttcctgtaata

SEQ ID NO: 4450487 - DNA, 18 bp, Homo sapiens
atttcctgtaatatattt

SEQ ID NO: 4450488 - DNA, 19 bp, Homo sapiens
atttcctgtttgaaatatc

SEQ ID NO: 4450489 - DNA, 23 bp, Homo sapiens
atttccttgaatgtggcttgaga

SEQ ID NO: 4450490 - DNA, 15 bp, Homo sapiens
atttccttgtgcaaa

SEQ ID NO: 4450491 - DNA, 14 bp, Homo sapiens
atttcctttatgtg

SEQ ID NO: 4450492 - DNA, 19 bp, Homo sapiens
atttcctttatgtgaattt

SEQ ID NO: 4450493 - DNA, 15 bp, Homo sapiens
atttcctttttgaca

SEQ ID NO: 4450494 - DNA, 15 bp, Homo sapiens
atttcgaccctgggg

SEQ ID NO: 4450495 - DNA, 13 bp, Homo sapiens
atttcgccttaaa

SEQ ID NO: 4450496 - DNA, 18 bp, Homo sapiens
atttcgccttaaactctg

SEQ ID NO: 4450497 - DNA, 14 bp, Homo sapiens
atttctaagactac

SEQ ID NO: 4450498 - DNA, 13 bp, Homo sapiens
atttctaattgca

SEQ ID NO: 4450499 - DNA, 13 bp, Homo sapiens
atttctataaatt

SEQ ID NO: 4450500 - DNA, 23 bp, Homo sapiens
atttctatagccaaaaatagcta

SEQ ID NO: 4450501 - DNA, 22 bp, Homo sapiens
atttctatcttgaatttcatgc

SEQ ID NO: 4450502 - DNA, 13 bp, Homo sapiens
atttctatgtcat

SEQ ID NO: 4450503 - DNA, 22 bp, Homo sapiens
atttctattattaattgcaaaa

SEQ ID NO: 4450504 - DNA, 20 bp, Homo sapiens
atttctcaaagatctgaatt

SEQ ID NO: 4450505 - DNA, 23 bp, Homo sapiens
atttctcacactctaactgtata

SEQ ID NO: 4450506 - DNA, 19 bp, Homo sapiens
atttctcataattttgcaa

SEQ ID NO: 4450507 - DNA, 23 bp, Homo sapiens
atttctcatagcaggaaatgtag

SEQ ID NO: 4450508 - DNA, 17 bp, Homo sapiens
atttctcattgcctctt

SEQ ID NO: 4450509 - DNA, 12 bp, Homo sapiens
atttctcctccc

SEQ ID NO: 4450510 - DNA, 17 bp, Homo sapiens
atttctcctttcctaca

SEQ ID NO: 4450511 - DNA, 18 bp, Homo sapiens
atttctctgagcagtcag

SEQ ID NO: 4450512 - DNA, 21 bp, Homo sapiens
atttctgaaaacctaccagcc

SEQ ID NO: 4450513 - DNA, 15 bp, Homo sapiens
atttctgaagtgctt

SEQ ID NO: 4450514 - DNA, 19 bp, Homo sapiens
atttctgaatctagagaac

SEQ ID NO: 4450515 - DNA, 22 bp, Homo sapiens
atttctgcatatgttgaatact

SEQ ID NO: 4450516 - DNA, 15 bp, Homo sapiens
atttctgccatttca

SEQ ID NO: 4450517 - DNA, 16 bp, Homo sapiens
atttctgccatttcat

SEQ ID NO: 4450518 - DNA, 18 bp, Homo sapiens
atttctgccatttcatgt

SEQ ID NO: 4450519 - DNA, 18 bp, Homo sapiens
attttatgtcatagaaat

SEQ ID NO: 4450520 - DNA, 15 bp, Homo sapiens
attttatgtctatat

SEQ ID NO: 4450521 - DNA, 22 bp, Homo sapiens
attttattaagctttttggaat

SEQ ID NO: 4450522 - DNA, 19 bp, Homo sapiens
attttatttagacaagaga

SEQ ID NO: 4450523 - DNA, 21 bp, Homo sapiens
attttatttcaatgtaattaa

SEQ ID NO: 4450524 - DNA, 19 bp, Homo sapiens
attttattttaaaatttca

SEQ ID NO: 4450525 - DNA, 16 bp, Homo sapiens
attttattttgacaga

SEQ ID NO: 4450526 - DNA, 15 bp, Homo sapiens
attttcaaaagataa

SEQ ID NO: 4450527 - DNA, 19 bp, Homo sapiens
attttcaaaagataatatt

SEQ ID NO: 4450528 - DNA, 14 bp, Homo sapiens
attttcaaatgtaa

SEQ ID NO: 4450529 - DNA, 19 bp, Homo sapiens
attttcaagtaattgtgaa

SEQ ID NO: 4450530 - DNA, 13 bp, Homo sapiens
attttcaagtttt

SEQ ID NO: 4450531 - DNA, 15 bp, Homo sapiens
attttcaagtttttc

SEQ ID NO: 4450532 - DNA, 18 bp, Homo sapiens
attttcaagtttttcata

SEQ ID NO: 4450533 - DNA, 18 bp, Homo sapiens
attttcacagaggaagaa

SEQ ID NO: 4450534 - DNA, 12 bp, Homo sapiens
attttcagaatc

SEQ ID NO: 4450535 - DNA, 17 bp, Homo sapiens
attttcagaatctgaat

SEQ ID NO: 4450536 - DNA, 21 bp, Homo sapiens
attttcagaatctgaatgtaa

SEQ ID NO: 4450537 - DNA, 12 bp, Homo sapiens
attttcagaccc

SEQ ID NO: 4450538 - DNA, 12 bp, Homo sapiens
attttcagagac

SEQ ID NO: 4450539 - DNA, 12 bp, Homo sapiens
attttcagcatt

SEQ ID NO: 4450540 - DNA, 18 bp, Homo sapiens
attttcagtaatgttatt

SEQ ID NO: 4450541 - DNA, 19 bp, Homo sapiens
attttcataacttattgct

SEQ ID NO: 4450542 - DNA, 21 bp, Homo sapiens
attttcataacttattgctga

SEQ ID NO: 4450543 - DNA, 21 bp, Homo sapiens
attttcatcccgtatcacagt

SEQ ID NO: 4450544 - DNA, 12 bp, Homo sapiens
attttcattgtg

SEQ ID NO: 4450545 - DNA, 14 bp, Homo sapiens
attttcattgtgat

SEQ ID NO: 4450546 - DNA, 15 bp, Homo sapiens
attttcattgtgatt

SEQ ID NO: 4450547 - DNA, 15 bp, Homo sapiens
attttccagccttat

SEQ ID NO: 4450548 - DNA, 20 bp, Homo sapiens
attttcccactcattctgaa

SEQ ID NO: 4450549 - DNA, 14 bp, Homo sapiens
attttccccccact

SEQ ID NO: 4450550 - DNA, 20 bp, Homo sapiens
attttccccccactctcccc

SEQ ID NO: 4450551 - DNA, 21 bp, Homo sapiens
attttcctaataaagttctgt

SEQ ID NO: 4450552 - DNA, 18 bp, Homo sapiens
attttcctaatgtgatca

SEQ ID NO: 4450553 - DNA, 19 bp, Homo sapiens
attttcctgacatttgttt

SEQ ID NO: 4450554 - DNA, 19 bp, Homo sapiens
attttcgatgaagttctga

SEQ ID NO: 4450555 - DNA, 19 bp, Homo sapiens
attttctaaaagctttcat

SEQ ID NO: 4450556 - DNA, 22 bp, Homo sapiens
attttctattgtggaattttat

SEQ ID NO: 4450557 - DNA, 16 bp, Homo sapiens
attttctattttaaga

SEQ ID NO: 4450558 - DNA, 23 bp, Homo sapiens
attttctattttaagactgattt

SEQ ID NO: 4450559 - DNA, 22 bp, Homo sapiens
attttctctggcagcataattt

SEQ ID NO: 4450560 - DNA, 18 bp, Homo sapiens
attttctgcaatccaatg

SEQ ID NO: 4450561 - DNA, 13 bp, Homo sapiens
attttctgtattt

SEQ ID NO: 4450562 - DNA, 15 bp, Homo sapiens
attttctgtatttaa

SEQ ID NO: 4450563 - DNA, 16 bp, Homo sapiens
attttctgtgcctgaa

SEQ ID NO: 4450564 - DNA, 15 bp, Homo sapiens
attttcttactttta

SEQ ID NO: 4450565 - DNA, 16 bp, Homo sapiens
attttcttacttttat

SEQ ID NO: 4450566 - DNA, 17 bp, Homo sapiens
attttcttcagttggtg

SEQ ID NO: 4450567 - DNA, 13 bp, Homo sapiens
attttcttctaag

SEQ ID NO: 4450568 - DNA, 16 bp, Homo sapiens
attttcttgatgtcac

SEQ ID NO: 4450569 - DNA, 17 bp, Homo sapiens
attttctttctagtttg

SEQ ID NO: 4450570 - DNA, 17 bp, Homo sapiens
attttctttttaacttt

SEQ ID NO: 4450571 - DNA, 22 bp, Homo sapiens
attttctttttaactttaccaa

SEQ ID NO: 4450572 - DNA, 17 bp, Homo sapiens
attttgaaccaaaacat

SEQ ID NO: 4450573 - DNA, 20 bp, Homo sapiens
attttgaaccaaaacatata

SEQ ID NO: 4450574 - DNA, 19 bp, Homo sapiens
attttgaagtgctgtttat

SEQ ID NO: 4450575 - DNA, 22 bp, Homo sapiens
attttgaagtgctgtttattaa

SEQ ID NO: 4450576 - DNA, 13 bp, Homo sapiens
attttgaatcaat

SEQ ID NO: 4450577 - DNA, 15 bp, Homo sapiens
attttgaatcaataa

SEQ ID NO: 4450578 - DNA, 14 bp, Homo sapiens
attttgaatctgtg

SEQ ID NO: 4450579 - DNA, 23 bp, Homo sapiens
attttgaatctgtgtgcatattt

SEQ ID NO: 4450580 - DNA, 16 bp, Homo sapiens
attttgacactgaaat

SEQ ID NO: 4450581 - DNA, 17 bp, Homo sapiens
attttgacagaagctat

SEQ ID NO: 4450582 - DNA, 19 bp, Homo sapiens
attttgacagaagctattt

SEQ ID NO: 4450583 - DNA, 17 bp, Homo sapiens
attttgaggtaaagata

SEQ ID NO: 4450584 - DNA, 16 bp, Homo sapiens
attttgataataatat

SEQ ID NO: 4450585 - DNA, 12 bp, Homo sapiens
attttgatgcag

SEQ ID NO: 4450586 - DNA, 17 bp, Homo sapiens
attttgatgcagcattt

SEQ ID NO: 4450587 - DNA, 24 bp, Homo sapiens
attttgatgcagcatttgataatg

SEQ ID NO: 4450588 - DNA, 22 bp, Homo sapiens
attttgcaaaaatcctattctg

SEQ ID NO: 4450589 - DNA, 16 bp, Homo sapiens
attttgcaaagattta

SEQ ID NO: 4450590 - DNA, 21 bp, Homo sapiens
attttgcaatcccttaatatc

SEQ ID NO: 4450591 - DNA, 11 bp, Homo sapiens
attttgcacaa

SEQ ID NO: 4450592 - DNA, 16 bp, Homo sapiens
attttgccatttagcg

SEQ ID NO: 4450593 - DNA, 14 bp, Homo sapiens
attttgctggaata

SEQ ID NO: 4450594 - DNA, 20 bp, Homo sapiens
attttggaaactcaaggaaa

SEQ ID NO: 4450595 - DNA, 14 bp, Homo sapiens
attttggaactgtg

SEQ ID NO: 4450596 - DNA, 13 bp, Homo sapiens
attttggatgagc

SEQ ID NO: 4450597 - DNA, 17 bp, Homo sapiens
attttggattttgcaag

SEQ ID NO: 4450598 - DNA, 16 bp, Homo sapiens
attttgggacttctac

SEQ ID NO: 4450599 - DNA, 18 bp, Homo sapiens
attttggtgcacaaatac

SEQ ID NO: 4450600 - DNA, 20 bp, Homo sapiens
attttggtgcacaaatacaa

SEQ ID NO: 4450601 - DNA, 17 bp, Homo sapiens
attttggttttgttccc

SEQ ID NO: 4450602 - DNA, 17 bp, Homo sapiens
attttggtttttcctca

SEQ ID NO: 4450603 - DNA, 11 bp, Homo sapiens
attttgtaaaa

SEQ ID NO: 4450604 - DNA, 16 bp, Homo sapiens
attttgtaagaaggca

SEQ ID NO: 4450605 - DNA, 20 bp, Homo sapiens
attttgtaatattctgtttt

SEQ ID NO: 4450606 - DNA, 20 bp, Homo sapiens
attttgtacaaatttgttat

SEQ ID NO: 4450607 - DNA, 17 bp, Homo sapiens
attttgtagttaatata

SEQ ID NO: 4450608 - DNA, 14 bp, Homo sapiens
attttgtatggagt

SEQ ID NO: 4450609 - DNA, 21 bp, Homo sapiens
attttgtatggagttaaataa

SEQ ID NO: 4450610 - DNA, 17 bp, Homo sapiens
attttgtattttaagat

SEQ ID NO: 4450611 - DNA, 20 bp, Homo sapiens
attttgtctaggagatgctt

SEQ ID NO: 4450612 - DNA, 20 bp, Homo sapiens
attttgtgtaaatttctcaa

SEQ ID NO: 4450613 - DNA, 12 bp, Homo sapiens
attttgttatgt

SEQ ID NO: 4450614 - DNA, 15 bp, Homo sapiens
attttgttggcatag

SEQ ID NO: 4450615 - DNA, 21 bp, Homo sapiens
attttgttggcatagctctgg

SEQ ID NO: 4450616 - DNA, 21 bp, Homo sapiens
attttgtttttactgtatgtt

SEQ ID NO: 4450617 - DNA, 15 bp, Homo sapiens
atttttaaaaaatat

SEQ ID NO: 4450618 - DNA, 19 bp, Homo sapiens
atttttaaaaaatattttc

SEQ ID NO: 4450619 - DNA, 16 bp, Homo sapiens
atttttaaaacccatt

SEQ ID NO: 4450620 - DNA, 17 bp, Homo sapiens
atttttaaaacccattt

SEQ ID NO: 4450621 - DNA, 15 bp, Homo sapiens
atttttaaaatgaat

SEQ ID NO: 4450622 - DNA, 15 bp, Homo sapiens
atttttaaacaagta

SEQ ID NO: 4450623 - DNA, 15 bp, Homo sapiens
atttttaagatgcat

SEQ ID NO: 4450624 - DNA, 15 bp, Homo sapiens
atttttaattttatg

SEQ ID NO: 4450625 - DNA, 18 bp, Homo sapiens
atttttacagctacttta

SEQ ID NO: 4450626 - DNA, 17 bp, Homo sapiens
atttttagactatttct

SEQ ID NO: 4450627 - DNA, 17 bp, Homo sapiens
atttttaggcaaagata

SEQ ID NO: 4450628 - DNA, 22 bp, Homo sapiens
atttttagtaacctttaaaaat

SEQ ID NO: 4450629 - DNA, 16 bp, Homo sapiens
atttttataaatactg

SEQ ID NO: 4450630 - DNA, 15 bp, Homo sapiens
atttttatactttat

SEQ ID NO: 4450631 - DNA, 16 bp, Homo sapiens
atttttatactttatt

SEQ ID NO: 4450632 - DNA, 17 bp, Homo sapiens
atttttatataatatct

SEQ ID NO: 4450633 - DNA, 20 bp, Homo sapiens
atttttatattagttgcttt

SEQ ID NO: 4450634 - DNA, 14 bp, Homo sapiens
atttttatatttcc

SEQ ID NO: 4450635 - DNA, 19 bp, Homo sapiens
atttttatctatataaaat

SEQ ID NO: 4450636 - DNA, 18 bp, Homo sapiens
atttttattatatttatg

SEQ ID NO: 4450637 - DNA, 20 bp, Homo sapiens
atttttatttatttttcttg

SEQ ID NO: 4450638 - DNA, 21 bp, Homo sapiens
caaagaaggcatttgcagggt

SEQ ID NO: 4450639 - DNA, 19 bp, Homo sapiens
caaagacaaaagtctgtct

SEQ ID NO: 4450640 - DNA, 15 bp, Homo sapiens
caaagactcaaattt

SEQ ID NO: 4450641 - DNA, 14 bp, Homo sapiens
caaagagaaaacat

SEQ ID NO: 4450642 - DNA, 16 bp, Homo sapiens
caaagagaagatgcct

SEQ ID NO: 4450643 - DNA, 13 bp, Homo sapiens
caaagagacattt

SEQ ID NO: 4450644 - DNA, 18 bp, Homo sapiens
caaagagacatttcaaaa

SEQ ID NO: 4450645 - DNA, 12 bp, Homo sapiens
caaagaggctgc

SEQ ID NO: 4450646 - DNA, 13 bp, Homo sapiens
caaagaggctgcc

SEQ ID NO: 4450647 - DNA, 15 bp, Homo sapiens
caaagaggctgcccc

SEQ ID NO: 4450648 - DNA, 16 bp, Homo sapiens
caaagaggctgcccct

SEQ ID NO: 4450649 - DNA, 21 bp, Homo sapiens
caaagaggctgcccctctcac

SEQ ID NO: 4450650 - DNA, 15 bp, Homo sapiens
caaagagggcttcct

SEQ ID NO: 4450651 - DNA, 16 bp, Homo sapiens
caaagaggtgaacatt

SEQ ID NO: 4450652 - DNA, 14 bp, Homo sapiens
caaagatgataatt

SEQ ID NO: 4450653 - DNA, 12 bp, Homo sapiens
caaagatggctt

SEQ ID NO: 4450654 - DNA, 17 bp, Homo sapiens
caaagattaggtcgttt

SEQ ID NO: 4450655 - DNA, 20 bp, Homo sapiens
caaagattaggtcgttttcc

SEQ ID NO: 4450656 - DNA, 14 bp, Homo sapiens
caaagattgagaag

SEQ ID NO: 4450657 - DNA, 16 bp, Homo sapiens
caaagattgagaagcc

SEQ ID NO: 4450658 - DNA, 16 bp, Homo sapiens
caaagatttaatctgc

SEQ ID NO: 4450659 - DNA, 15 bp, Homo sapiens
caaagcaaaaccaga

SEQ ID NO: 4450660 - DNA, 15 bp, Homo sapiens
caaagcaacctttcc

SEQ ID NO: 4450661 - DNA, 13 bp, Homo sapiens
caaagcaaggaaa

SEQ ID NO: 4450662 - DNA, 15 bp, Homo sapiens
caaagcaaggaaact

SEQ ID NO: 4450663 - DNA, 18 bp, Homo sapiens
caaagcaattgaaatgca

SEQ ID NO: 4450664 - DNA, 21 bp, Homo sapiens
caaagcacccatttcaatgtg

SEQ ID NO: 4450665 - DNA, 11 bp, Homo sapiens
caaagcatgcc

SEQ ID NO: 4450666 - DNA, 17 bp, Homo sapiens
caaagcatggacattta

SEQ ID NO: 4450667 - DNA, 24 bp, Homo sapiens
caaagcatggacatttagaagaaa

SEQ ID NO: 4450668 - DNA, 17 bp, Homo sapiens
caaagccccccagctcc

SEQ ID NO: 4450669 - DNA, 21 bp, Homo sapiens
caaagccccccagctcccaca

SEQ ID NO: 4450670 - DNA, 21 bp, Homo sapiens
caaagctagggtggcccttgc

SEQ ID NO: 4450671 - DNA, 21 bp, Homo sapiens
caaaggaatttgcatccagca

SEQ ID NO: 4450672 - DNA, 16 bp, Homo sapiens
caaaggaggaatttac

SEQ ID NO: 4450673 - DNA, 19 bp, Homo sapiens
caaaggaggggaaacaatg

SEQ ID NO: 4450674 - DNA, 15 bp, Homo sapiens
caaaggataaatttt

SEQ ID NO: 4450675 - DNA, 18 bp, Homo sapiens
caaaggataaattttttg

SEQ ID NO: 4450676 - DNA, 20 bp, Homo sapiens
caaaggccacaggcagtcca

SEQ ID NO: 4450677 - DNA, 20 bp, Homo sapiens
caaaggctcagcttggattt

SEQ ID NO: 4450678 - DNA, 17 bp, Homo sapiens
caaaggctgacattcac

SEQ ID NO: 4450679 - DNA, 20 bp, Homo sapiens
caaagggaagtaacagacac

SEQ ID NO: 4450680 - DNA, 17 bp, Homo sapiens
caaagggccatcgttca

SEQ ID NO: 4450681 - DNA, 21 bp, Homo sapiens
caaaggtcgggacagctgtgc

SEQ ID NO: 4450682 - DNA, 22 bp, Homo sapiens
caaaggtcgggacagctgtgcc

SEQ ID NO: 4450683 - DNA, 19 bp, Homo sapiens
caaaggttcagaaaattaa

SEQ ID NO: 4450684 - DNA, 21 bp, Homo sapiens
caaagtagtacttcttctgta

SEQ ID NO: 4450685 - DNA, 15 bp, Homo sapiens
caaagtattgtaaat

SEQ ID NO: 4450686 - DNA, 18 bp, Homo sapiens
caaagtattgtaaattat

SEQ ID NO: 4450687 - DNA, 20 bp, Homo sapiens
caaagtattgtaaattatat

SEQ ID NO: 4450688 - DNA, 15 bp, Homo sapiens
caaagtcacagtcgt

SEQ ID NO: 4450689 - DNA, 14 bp, Homo sapiens
caaagtcctttttt

SEQ ID NO: 4450690 - DNA, 17 bp, Homo sapiens
caaagtcctttttttcc

SEQ ID NO: 4450691 - DNA, 19 bp, Homo sapiens
caaagtcctttttttccat

SEQ ID NO: 4450692 - DNA, 19 bp, Homo sapiens
caaagtgctgggattacag

SEQ ID NO: 4450693 - DNA, 14 bp, Homo sapiens
caaagtggaacgaa

SEQ ID NO: 4450694 - DNA, 18 bp, Homo sapiens
caaagtggtaaatactgt

SEQ ID NO: 4450695 - DNA, 14 bp, Homo sapiens
caaagttagagaac

SEQ ID NO: 4450696 - DNA, 24 bp, Homo sapiens
caaagttagagaactaaactagtt

SEQ ID NO: 4450697 - DNA, 13 bp, Homo sapiens
caaagttcagtgt

SEQ ID NO: 4450698 - DNA, 13 bp, Homo sapiens
caaagttctcaga

SEQ ID NO: 4450699 - DNA, 22 bp, Homo sapiens
caaagttgattaagaaaggaag

SEQ ID NO: 4450700 - DNA, 20 bp, Homo sapiens
caaagtttaataaatttatt

SEQ ID NO: 4450701 - DNA, 16 bp, Homo sapiens
caaagtttcagagtat

SEQ ID NO: 4450702 - DNA, 16 bp, Homo sapiens
caaagttttacagaga

SEQ ID NO: 4450703 - DNA, 12 bp, Homo sapiens
caaataaaacat

SEQ ID NO: 4450704 - DNA, 13 bp, Homo sapiens
caaataaaacatg

SEQ ID NO: 4450705 - DNA, 11 bp, Homo sapiens
caaataaacac

SEQ ID NO: 4450706 - DNA, 15 bp, Homo sapiens
caaataaacactgtg

SEQ ID NO: 4450707 - DNA, 20 bp, Homo sapiens
caaataaacactgtgtaagc

SEQ ID NO: 4450708 - DNA, 18 bp, Homo sapiens
caaataaagcagtcatga

SEQ ID NO: 4450709 - DNA, 15 bp, Homo sapiens
caaataaatatgaaa

SEQ ID NO: 4450710 - DNA, 12 bp, Homo sapiens
caaataaatgat

SEQ ID NO: 4450711 - DNA, 21 bp, Homo sapiens
caaataaatgattatattcac

SEQ ID NO: 4450712 - DNA, 19 bp, Homo sapiens
caaataaattcaataaaaa

SEQ ID NO: 4450713 - DNA, 19 bp, Homo sapiens
caaataatgcttttctaat

SEQ ID NO: 4450714 - DNA, 19 bp, Homo sapiens
caaatacatgcacagtcat

SEQ ID NO: 4450715 - DNA, 22 bp, Homo sapiens
caaatacatgcacagtcataca

SEQ ID NO: 4450716 - DNA, 13 bp, Homo sapiens
caaatacatttta

SEQ ID NO: 4450717 - DNA, 13 bp, Homo sapiens
caaatacctcaat

SEQ ID NO: 4450718 - DNA, 15 bp, Homo sapiens
caaatacctcaattt

SEQ ID NO: 4450719 - DNA, 20 bp, Homo sapiens
caaatacctcaatttttgtt

SEQ ID NO: 4450720 - DNA, 19 bp, Homo sapiens
caaatacttagcaaaaagt

SEQ ID NO: 4450721 - DNA, 21 bp, Homo sapiens
caaataggatgtactgttgaa

SEQ ID NO: 4450722 - DNA, 15 bp, Homo sapiens
caaatagtgtgaaat

SEQ ID NO: 4450723 - DNA, 19 bp, Homo sapiens
caaatagttgcatagcagt

SEQ ID NO: 4450724 - DNA, 17 bp, Homo sapiens
caaatatactttacttt

SEQ ID NO: 4450725 - DNA, 12 bp, Homo sapiens
caaatatgcaaa

SEQ ID NO: 4450726 - DNA, 13 bp, Homo sapiens
caaatatgcaaag

SEQ ID NO: 4450727 - DNA, 17 bp, Homo sapiens
caaatatgcaaagcact

SEQ ID NO: 4450728 - DNA, 21 bp, Homo sapiens
caaatatgcaaagcactgact

SEQ ID NO: 4450729 - DNA, 19 bp, Homo sapiens
caaatattagcaaagaagc

SEQ ID NO: 4450730 - DNA, 21 bp, Homo sapiens
caaatattagcaaagaagctt

SEQ ID NO: 4450731 - DNA, 12 bp, Homo sapiens
caaatattattt

SEQ ID NO: 4450732 - DNA, 22 bp, Homo sapiens
caaatatttcacttaaactttg

SEQ ID NO: 4450733 - DNA, 17 bp, Homo sapiens
caaatcaatacactagt

SEQ ID NO: 4450734 - DNA, 14 bp, Homo sapiens
caaatcacatattt

SEQ ID NO: 4450735 - DNA, 19 bp, Homo sapiens
caaatcacatattttaaaa

SEQ ID NO: 4450736 - DNA, 15 bp, Homo sapiens
caaatcagaagtcat

SEQ ID NO: 4450737 - DNA, 16 bp, Homo sapiens
caaatcaggcttttgt

SEQ ID NO: 4450738 - DNA, 17 bp, Homo sapiens
caaatcagtatattttc

SEQ ID NO: 4450739 - DNA, 18 bp, Homo sapiens
caaatcagtatattttct

SEQ ID NO: 4450740 - DNA, 17 bp, Homo sapiens
caaatcagtgataattg

SEQ ID NO: 4450741 - DNA, 16 bp, Homo sapiens
caaatcatttgtttaa

SEQ ID NO: 4450742 - DNA, 18 bp, Homo sapiens
caaatcatttgtttaaaa

SEQ ID NO: 4450743 - DNA, 17 bp, Homo sapiens
caaatcctatttaaaga

SEQ ID NO: 4450744 - DNA, 20 bp, Homo sapiens
caaatcctctgttttctctc

SEQ ID NO: 4450745 - DNA, 14 bp, Homo sapiens
caaatcctcttttg

SEQ ID NO: 4450746 - DNA, 19 bp, Homo sapiens
caaatcctggaaggacaca

SEQ ID NO: 4450747 - DNA, 14 bp, Homo sapiens
caaatccttggagt

SEQ ID NO: 4450748 - DNA, 14 bp, Homo sapiens
caaatcgaatgaaa

SEQ ID NO: 4450749 - DNA, 16 bp, Homo sapiens
caaatctaaaatgcaa

SEQ ID NO: 4450750 - DNA, 17 bp, Homo sapiens
caaatctagaatttagt

SEQ ID NO: 4450751 - DNA, 20 bp, Homo sapiens
caaatctgggtatctttcca

SEQ ID NO: 4450752 - DNA, 13 bp, Homo sapiens
caaatctgtaatt

SEQ ID NO: 4450753 - DNA, 13 bp, Homo sapiens
caaatgaaatgta

SEQ ID NO: 4450754 - DNA, 16 bp, Homo sapiens
caaatgaactttaaaa

SEQ ID NO: 4450755 - DNA, 22 bp, Homo sapiens
caaatgaataatgcctttgtaa

SEQ ID NO: 4450756 - DNA, 17 bp, Homo sapiens
caaatgaatgattaaat

SEQ ID NO: 4450757 - DNA, 18 bp, Homo sapiens
caagacagatgagcagga

SEQ ID NO: 4450758 - DNA, 19 bp, Homo sapiens
caagacagatgagcaggag

SEQ ID NO: 4450759 - DNA, 21 bp, Homo sapiens
caagacagatgagcaggagct

SEQ ID NO: 4450760 - DNA, 12 bp, Homo sapiens
caagacagcagc

SEQ ID NO: 4450761 - DNA, 14 bp, Homo sapiens
caagacagcagcag

SEQ ID NO: 4450762 - DNA, 18 bp, Homo sapiens
caagacagcagcagcctg

SEQ ID NO: 4450763 - DNA, 19 bp, Homo sapiens
caagacagcagcagcctgc

SEQ ID NO: 4450764 - DNA, 20 bp, Homo sapiens
caagacagcagcagcctgca

SEQ ID NO: 4450765 - DNA, 13 bp, Homo sapiens
caagacaggcaga

SEQ ID NO: 4450766 - DNA, 13 bp, Homo sapiens
caagacatttgct

SEQ ID NO: 4450767 - DNA, 15 bp, Homo sapiens
caagacatttgctga

SEQ ID NO: 4450768 - DNA, 18 bp, Homo sapiens
caagaccacggagggagc

SEQ ID NO: 4450769 - DNA, 22 bp, Homo sapiens
caagaccacggagggagcgaca

SEQ ID NO: 4450770 - DNA, 15 bp, Homo sapiens
caagacccccagcac

SEQ ID NO: 4450771 - DNA, 20 bp, Homo sapiens
caagactcagatgatgccag

SEQ ID NO: 4450772 - DNA, 11 bp, Homo sapiens
caagactcctc

SEQ ID NO: 4450773 - DNA, 22 bp, Homo sapiens
caagactgaagatggcttttcc

SEQ ID NO: 4450774 - DNA, 14 bp, Homo sapiens
caagactgcaagag

SEQ ID NO: 4450775 - DNA, 20 bp, Homo sapiens
caagagaaaagaaaaatcaa

SEQ ID NO: 4450776 - DNA, 13 bp, Homo sapiens
caagagaaacttc

SEQ ID NO: 4450777 - DNA, 19 bp, Homo sapiens
caagagaactaaagctgga

SEQ ID NO: 4450778 - DNA, 22 bp, Homo sapiens
caagagaataggggagccaagg

SEQ ID NO: 4450779 - DNA, 23 bp, Homo sapiens
caagagaataggggagccaagga

SEQ ID NO: 4450780 - DNA, 17 bp, Homo sapiens
caagagatctacacatg

SEQ ID NO: 4450781 - DNA, 15 bp, Homo sapiens
caagagatggaaaaa

SEQ ID NO: 4450782 - DNA, 20 bp, Homo sapiens
caagagcagcctgtggcatc

SEQ ID NO: 4450783 - DNA, 21 bp, Homo sapiens
caagagcatgcacatgctgtc

SEQ ID NO: 4450784 - DNA, 21 bp, Homo sapiens
caagagccttggtgtccacct

SEQ ID NO: 4450785 - DNA, 22 bp, Homo sapiens
caagagccttggtgtccacctg

SEQ ID NO: 4450786 - DNA, 23 bp, Homo sapiens
caagagccttggtgtccacctgg

SEQ ID NO: 4450787 - DNA, 18 bp, Homo sapiens
caagagctgccctccttg

SEQ ID NO: 4450788 - DNA, 19 bp, Homo sapiens
caagaggaagttcagatct

SEQ ID NO: 4450789 - DNA, 20 bp, Homo sapiens
caagaggaagttcagatctt

SEQ ID NO: 4450790 - DNA, 15 bp, Homo sapiens
caagaggcaagctga

SEQ ID NO: 4450791 - DNA, 19 bp, Homo sapiens
caagaggctgtagaaaggg

SEQ ID NO: 4450792 - DNA, 23 bp, Homo sapiens
caagaggggcgggctcagagctt

SEQ ID NO: 4450793 - DNA, 19 bp, Homo sapiens
caagagtagttatataatt

SEQ ID NO: 4450794 - DNA, 22 bp, Homo sapiens
caagagtagttatataattgtt

SEQ ID NO: 4450795 - DNA, 23 bp, Homo sapiens
caagagtatgtggcaaaacatat

SEQ ID NO: 4450796 - DNA, 21 bp, Homo sapiens
caagatatatgtgtatacata

SEQ ID NO: 4450797 - DNA, 21 bp, Homo sapiens
caagatattattaatttttat

SEQ ID NO: 4450798 - DNA, 13 bp, Homo sapiens
caagatcgcacca

SEQ ID NO: 4450799 - DNA, 21 bp, Homo sapiens
caagatcgcaccactgcactc

SEQ ID NO: 4450800 - DNA, 23 bp, Homo sapiens
caagatgaatgcagattacactg

SEQ ID NO: 4450801 - DNA, 13 bp, Homo sapiens
caagatgagctgt

SEQ ID NO: 4450802 - DNA, 18 bp, Homo sapiens
caagatggacacgagcca

SEQ ID NO: 4450803 - DNA, 16 bp, Homo sapiens
caagatgggcatcttt

SEQ ID NO: 4450804 - DNA, 20 bp, Homo sapiens
caagatgggcatcttttgta

SEQ ID NO: 4450805 - DNA, 22 bp, Homo sapiens
caagatgtgaattattgacact

SEQ ID NO: 4450806 - DNA, 23 bp, Homo sapiens
caagatgtgaattattgacactg

SEQ ID NO: 4450807 - DNA, 15 bp, Homo sapiens
caagattatgtgact

SEQ ID NO: 4450808 - DNA, 14 bp, Homo sapiens
caagattcccagag

SEQ ID NO: 4450809 - DNA, 16 bp, Homo sapiens
caagattcccagagac

SEQ ID NO: 4450810 - DNA, 19 bp, Homo sapiens
caagattgtccttttctcc

SEQ ID NO: 4450811 - DNA, 18 bp, Homo sapiens
caagattttccacaagat

SEQ ID NO: 4450812 - DNA, 18 bp, Homo sapiens
caagattttcctcttgtg

SEQ ID NO: 4450813 - DNA, 16 bp, Homo sapiens
caagatttttttcctg

SEQ ID NO: 4450814 - DNA, 21 bp, Homo sapiens
caagattttttttttaagtga

SEQ ID NO: 4450815 - DNA, 18 bp, Homo sapiens
caagcaacattcttgtta

SEQ ID NO: 4450816 - DNA, 19 bp, Homo sapiens
caagcaatccacctgcctt

SEQ ID NO: 4450817 - DNA, 14 bp, Homo sapiens
caagcaatcctcct

SEQ ID NO: 4450818 - DNA, 21 bp, Homo sapiens
caagcaatcctcctgcctcag

SEQ ID NO: 4450819 - DNA, 16 bp, Homo sapiens
caagcacagagcctgg

SEQ ID NO: 4450820 - DNA, 16 bp, Homo sapiens
caagcacttcccagga

SEQ ID NO: 4450821 - DNA, 19 bp, Homo sapiens
caagcagagcgggtaaagt

SEQ ID NO: 4450822 - DNA, 23 bp, Homo sapiens
caagcagagcgggtaaagtgcaa

SEQ ID NO: 4450823 - DNA, 18 bp, Homo sapiens
caagcagagtaacaggat

SEQ ID NO: 4450824 - DNA, 21 bp, Homo sapiens
caagcagcctgagcaactctt

SEQ ID NO: 4450825 - DNA, 16 bp, Homo sapiens
caagcataccaacacg

SEQ ID NO: 4450826 - DNA, 10 bp, Homo sapiens
caagcatctc

SEQ ID NO: 4450827 - DNA, 21 bp, Homo sapiens
caagcatgaagataaacacag

SEQ ID NO: 4450828 - DNA, 19 bp, Homo sapiens
caagcatgaataaaattag

SEQ ID NO: 4450829 - DNA, 21 bp, Homo sapiens
caagcatggctattttatatt

SEQ ID NO: 4450830 - DNA, 13 bp, Homo sapiens
caagcatgtaact

SEQ ID NO: 4450831 - DNA, 19 bp, Homo sapiens
caagcatttcatgaaaaag

SEQ ID NO: 4450832 - DNA, 20 bp, Homo sapiens
caagcatttcatgaaaaagc

SEQ ID NO: 4450833 - DNA, 15 bp, Homo sapiens
caagccaaagagcct

SEQ ID NO: 4450834 - DNA, 20 bp, Homo sapiens
caagccaaagagcctcccac

SEQ ID NO: 4450835 - DNA, 19 bp, Homo sapiens
caagccacaagctgacccc

SEQ ID NO: 4450836 - DNA, 14 bp, Homo sapiens
caagccagacctag

SEQ ID NO: 4450837 - DNA, 14 bp, Homo sapiens
caagccatcatcct

SEQ ID NO: 4450838 - DNA, 23 bp, Homo sapiens
caagcccacgtcaggcctggcct

SEQ ID NO: 4450839 - DNA, 13 bp, Homo sapiens
caagccctgccca

SEQ ID NO: 4450840 - DNA, 16 bp, Homo sapiens
caagccgaccttccct

SEQ ID NO: 4450841 - DNA, 22 bp, Homo sapiens
caagcctcatgccaaccctggg

SEQ ID NO: 4450842 - DNA, 14 bp, Homo sapiens
caagcctcctgtac

SEQ ID NO: 4450843 - DNA, 23 bp, Homo sapiens
caagcctgcacaataaaaatgtt

SEQ ID NO: 4450844 - DNA, 13 bp, Homo sapiens
caagcctgctggc

SEQ ID NO: 4450845 - DNA, 14 bp, Homo sapiens
caagcctgctggct

SEQ ID NO: 4450846 - DNA, 19 bp, Homo sapiens
caagcctgtgcaaaaaaat

SEQ ID NO: 4450847 - DNA, 21 bp, Homo sapiens
caagcctgtgcaaaaaaatta

SEQ ID NO: 4450848 - DNA, 13 bp, Homo sapiens
caagcctgtggga

SEQ ID NO: 4450849 - DNA, 17 bp, Homo sapiens
caagccttactcacctc

SEQ ID NO: 4450850 - DNA, 18 bp, Homo sapiens
caagccttactcacctct

SEQ ID NO: 4450851 - DNA, 17 bp, Homo sapiens
caagcgaggtcaacaga

SEQ ID NO: 4450852 - DNA, 14 bp, Homo sapiens
caagcgtgttctca

SEQ ID NO: 4450853 - DNA, 17 bp, Homo sapiens
caagcgtgttctcagca

SEQ ID NO: 4450854 - DNA, 17 bp, Homo sapiens
caagcgttcctggcctt

SEQ ID NO: 4450855 - DNA, 19 bp, Homo sapiens
caagcgttcctggccttct

SEQ ID NO: 4450856 - DNA, 21 bp, Homo sapiens
caagctaatctgcctggtttt

SEQ ID NO: 4450857 - DNA, 17 bp, Homo sapiens
caagctagaacctggag

SEQ ID NO: 4450858 - DNA, 21 bp, Homo sapiens
caagctaggtgctatttgtca

SEQ ID NO: 4450859 - DNA, 16 bp, Homo sapiens
caagctatgggaattt

SEQ ID NO: 4450860 - DNA, 16 bp, Homo sapiens
caagctcatccctgga

SEQ ID NO: 4450861 - DNA, 18 bp, Homo sapiens
caagctcatccctggact

SEQ ID NO: 4450862 - DNA, 20 bp, Homo sapiens
caagctccgcctcccgggtt

SEQ ID NO: 4450863 - DNA, 20 bp, Homo sapiens
caagctgaaattttagaaat

SEQ ID NO: 4450864 - DNA, 16 bp, Homo sapiens
caagctgcactgtgaa

SEQ ID NO: 4450865 - DNA, 13 bp, Homo sapiens
caagctgcccagc

SEQ ID NO: 4450866 - DNA, 18 bp, Homo sapiens
caagctgcccagccctgg

SEQ ID NO: 4450867 - DNA, 23 bp, Homo sapiens
caagctgcccagccctggcccag

SEQ ID NO: 4450868 - DNA, 19 bp, Homo sapiens
caagctgctctccttcact

SEQ ID NO: 4450869 - DNA, 11 bp, Homo sapiens
caagctgggcc

SEQ ID NO: 4450870 - DNA, 16 bp, Homo sapiens
caagctgggccccagc

SEQ ID NO: 4450871 - DNA, 20 bp, Homo sapiens
caagctgggccccagcccac

SEQ ID NO: 4450872 - DNA, 22 bp, Homo sapiens
caagctgggccccagcccaccc

SEQ ID NO: 4450873 - DNA, 21 bp, Homo sapiens
caagctgttatttcttccctg

SEQ ID NO: 4450874 - DNA, 16 bp, Homo sapiens
caagttctatttcttg

SEQ ID NO: 4450875 - DNA, 23 bp, Homo sapiens
caagttgaaaaatagcatatgcc

SEQ ID NO: 4450876 - DNA, 14 bp, Homo sapiens
caagttgttgactg

SEQ ID NO: 4450877 - DNA, 18 bp, Homo sapiens
caagttgttgactgtgat

SEQ ID NO: 4450878 - DNA, 15 bp, Homo sapiens
caagttttaaagttc

SEQ ID NO: 4450879 - DNA, 12 bp, Homo sapiens
caagtttttcat

SEQ ID NO: 4450880 - DNA, 21 bp, Homo sapiens
caagttttttaattaagcaga

SEQ ID NO: 4450881 - DNA, 20 bp, Homo sapiens
caataaaaacattgcctttg

SEQ ID NO: 4450882 - DNA, 18 bp, Homo sapiens
caataaaaacattttgaa

SEQ ID NO: 4450883 - DNA, 14 bp, Homo sapiens
caataaaatattat

SEQ ID NO: 4450884 - DNA, 17 bp, Homo sapiens
caataaaatattattga

SEQ ID NO: 4450885 - DNA, 22 bp, Homo sapiens
caataaaattatttgcaggtct

SEQ ID NO: 4450886 - DNA, 15 bp, Homo sapiens
caataaaattctgta

SEQ ID NO: 4450887 - DNA, 12 bp, Homo sapiens
caataaacagtc

SEQ ID NO: 4450888 - DNA, 14 bp, Homo sapiens
caataaacagtcac

SEQ ID NO: 4450889 - DNA, 19 bp, Homo sapiens
caataaaccacaagcatct

SEQ ID NO: 4450890 - DNA, 11 bp, Homo sapiens
caataaaccag

SEQ ID NO: 4450891 - DNA, 14 bp, Homo sapiens
caataaaccagtgt

SEQ ID NO: 4450892 - DNA, 17 bp, Homo sapiens
caataaaccagtgtgaa

SEQ ID NO: 4450893 - DNA, 14 bp, Homo sapiens
caataaaccctcct

SEQ ID NO: 4450894 - DNA, 16 bp, Homo sapiens
caataaagatacatga

SEQ ID NO: 4450895 - DNA, 15 bp, Homo sapiens
caataaagcctttta

SEQ ID NO: 4450896 - DNA, 16 bp, Homo sapiens
caataaagccttttaa

SEQ ID NO: 4450897 - DNA, 14 bp, Homo sapiens
caataaaggcagct

SEQ ID NO: 4450898 - DNA, 18 bp, Homo sapiens
caataaaggcagctgcct

SEQ ID NO: 4450899 - DNA, 20 bp, Homo sapiens
caataaaggcagctgcctct

SEQ ID NO: 4450900 - DNA, 21 bp, Homo sapiens
caataaaggcagctgcctctg

SEQ ID NO: 4450901 - DNA, 14 bp, Homo sapiens
caataaataaatgt

SEQ ID NO: 4450902 - DNA, 15 bp, Homo sapiens
caataaattgctaat

SEQ ID NO: 4450903 - DNA, 18 bp, Homo sapiens
caataacaaaacgaaact

SEQ ID NO: 4450904 - DNA, 15 bp, Homo sapiens
caataacactgtatt

SEQ ID NO: 4450905 - DNA, 16 bp, Homo sapiens
caataacactgtattt

SEQ ID NO: 4450906 - DNA, 18 bp, Homo sapiens
caataactatttttcctc

SEQ ID NO: 4450907 - DNA, 14 bp, Homo sapiens
caataactctggga

SEQ ID NO: 4450908 - DNA, 17 bp, Homo sapiens
caataactctgggaggg

SEQ ID NO: 4450909 - DNA, 21 bp, Homo sapiens
caataagaaaatgtaaaggtt

SEQ ID NO: 4450910 - DNA, 20 bp, Homo sapiens
caataagattggtgttcgtt

SEQ ID NO: 4450911 - DNA, 12 bp, Homo sapiens
caataagcaaaa

SEQ ID NO: 4450912 - DNA, 18 bp, Homo sapiens
caataatatattttctgt

SEQ ID NO: 4450913 - DNA, 14 bp, Homo sapiens
caataatatttcaa

SEQ ID NO: 4450914 - DNA, 21 bp, Homo sapiens
caataatatttcaagtgccta

SEQ ID NO: 4450915 - DNA, 17 bp, Homo sapiens
caatacaatgtacaatt

SEQ ID NO: 4450916 - DNA, 12 bp, Homo sapiens
caatacagggag

SEQ ID NO: 4450917 - DNA, 14 bp, Homo sapiens
caatacattaaaat

SEQ ID NO: 4450918 - DNA, 15 bp, Homo sapiens
caatagaaagaaact

SEQ ID NO: 4450919 - DNA, 18 bp, Homo sapiens
caatagattactgatgtg

SEQ ID NO: 4450920 - DNA, 21 bp, Homo sapiens
caatagatttaggagcagaaa

SEQ ID NO: 4450921 - DNA, 16 bp, Homo sapiens
caatagcacatatgga

SEQ ID NO: 4450922 - DNA, 21 bp, Homo sapiens
caatagcactttcattgccag

SEQ ID NO: 4450923 - DNA, 19 bp, Homo sapiens
caatagcagttataacaga

SEQ ID NO: 4450924 - DNA, 21 bp, Homo sapiens
caatagcagttataacagatg

SEQ ID NO: 4450925 - DNA, 16 bp, Homo sapiens
caatagcgtgtgtaga

SEQ ID NO: 4450926 - DNA, 18 bp, Homo sapiens
caataggtctttctctca

SEQ ID NO: 4450927 - DNA, 23 bp, Homo sapiens
caataggtgcctagtaaatgtta

SEQ ID NO: 4450928 - DNA, 17 bp, Homo sapiens
caataggtttgtaaaat

SEQ ID NO: 4450929 - DNA, 20 bp, Homo sapiens
caatatagttttttctttcc

SEQ ID NO: 4450930 - DNA, 14 bp, Homo sapiens
caatatattgaact

SEQ ID NO: 4450931 - DNA, 14 bp, Homo sapiens
caatatgcaagcag

SEQ ID NO: 4450932 - DNA, 15 bp, Homo sapiens
caatatgcaagcagc

SEQ ID NO: 4450933 - DNA, 18 bp, Homo sapiens
caatatgcaagcagcttt

SEQ ID NO: 4450934 - DNA, 22 bp, Homo sapiens
caatatgggaggaacaaagaca

SEQ ID NO: 4450935 - DNA, 14 bp, Homo sapiens
caatattaaatctg

SEQ ID NO: 4450936 - DNA, 19 bp, Homo sapiens
caatattactttgtctttt

SEQ ID NO: 4450937 - DNA, 21 bp, Homo sapiens
caatattcagtggtgaaatct

SEQ ID NO: 4450938 - DNA, 15 bp, Homo sapiens
caatattctctctta

SEQ ID NO: 4450939 - DNA, 14 bp, Homo sapiens
caatattgaatttt

SEQ ID NO: 4450940 - DNA, 14 bp, Homo sapiens
caatattgtacagt

SEQ ID NO: 4450941 - DNA, 14 bp, Homo sapiens
caatattgtatatt

SEQ ID NO: 4450942 - DNA, 22 bp, Homo sapiens
caatatttttatatcatgcaaa

SEQ ID NO: 4450943 - DNA, 18 bp, Homo sapiens
caatcaaggttataattt

SEQ ID NO: 4450944 - DNA, 19 bp, Homo sapiens
caatcaaggttataatttt

SEQ ID NO: 4450945 - DNA, 15 bp, Homo sapiens
caatcagctccttcc

SEQ ID NO: 4450946 - DNA, 20 bp, Homo sapiens
caatcagcttttgttctaga

SEQ ID NO: 4450947 - DNA, 21 bp, Homo sapiens
caatcagcttttgttctagac

SEQ ID NO: 4450948 - DNA, 12 bp, Homo sapiens
caatcattgttt

SEQ ID NO: 4450949 - DNA, 12 bp, Homo sapiens
caatcattttat

SEQ ID NO: 4450950 - DNA, 13 bp, Homo sapiens
caatcattttatg

SEQ ID NO: 4450951 - DNA, 17 bp, Homo sapiens
caatccaggctgttctc

SEQ ID NO: 4450952 - DNA, 19 bp, Homo sapiens
caatccaggctgttctcag

SEQ ID NO: 4450953 - DNA, 20 bp, Homo sapiens
caatccaggctgttctcagc

SEQ ID NO: 4450954 - DNA, 16 bp, Homo sapiens
caatccatgcttcact

SEQ ID NO: 4450955 - DNA, 20 bp, Homo sapiens
caatcctaatttctcctccc

SEQ ID NO: 4450956 - DNA, 17 bp, Homo sapiens
caatcctcctgcctcag

SEQ ID NO: 4450957 - DNA, 14 bp, Homo sapiens
caatcggactgcca

SEQ ID NO: 4450958 - DNA, 15 bp, Homo sapiens
caatcggactgccaa

SEQ ID NO: 4450959 - DNA, 17 bp, Homo sapiens
caatcggactgccaaat

SEQ ID NO: 4450960 - DNA, 19 bp, Homo sapiens
caatctaacaataatattt

SEQ ID NO: 4450961 - DNA, 14 bp, Homo sapiens
caatctaatctgaa

SEQ ID NO: 4450962 - DNA, 11 bp, Homo sapiens
caatctactgg

SEQ ID NO: 4450963 - DNA, 15 bp, Homo sapiens
caatctactggaaat

SEQ ID NO: 4450964 - DNA, 14 bp, Homo sapiens
caatctatttaaaa

SEQ ID NO: 4450965 - DNA, 14 bp, Homo sapiens
caatctcccctcaa

SEQ ID NO: 4450966 - DNA, 16 bp, Homo sapiens
caatctggattcatat

SEQ ID NO: 4450967 - DNA, 18 bp, Homo sapiens
caatctggcttagtgcca

SEQ ID NO: 4450968 - DNA, 15 bp, Homo sapiens
caatctgtaaactgt

SEQ ID NO: 4450969 - DNA, 16 bp, Homo sapiens
caatcttcaatgaata

SEQ ID NO: 4450970 - DNA, 21 bp, Homo sapiens
caatcttcctgtttaaaaaac

SEQ ID NO: 4450971 - DNA, 17 bp, Homo sapiens
caatcttgcccactggc

SEQ ID NO: 4450972 - DNA, 14 bp, Homo sapiens
caatcttgccttct

SEQ ID NO: 4450973 - DNA, 17 bp, Homo sapiens
caatcttggagctgctt

SEQ ID NO: 4450974 - DNA, 19 bp, Homo sapiens
caatcttggagctgcttgg

SEQ ID NO: 4450975 - DNA, 22 bp, Homo sapiens
caatcttggtttgtcagtttat

SEQ ID NO: 4450976 - DNA, 15 bp, Homo sapiens
caatcttgttactgc

SEQ ID NO: 4450977 - DNA, 23 bp, Homo sapiens
caatcttgttactgctgattctt

SEQ ID NO: 4450978 - DNA, 19 bp, Homo sapiens
caatcttgtttatagcaaa

SEQ ID NO: 4450979 - DNA, 12 bp, Homo sapiens
caatctttgaaa

SEQ ID NO: 4450980 - DNA, 14 bp, Homo sapiens
caatctttgaaata

SEQ ID NO: 4450981 - DNA, 19 bp, Homo sapiens
caatctttgaaataaaaaa

SEQ ID NO: 4450982 - DNA, 15 bp, Homo sapiens
caatgaaaaaatgta

SEQ ID NO: 4450983 - DNA, 22 bp, Homo sapiens
caatgaaaacaaataaaagttg

SEQ ID NO: 4450984 - DNA, 20 bp, Homo sapiens
caatgaaaacatgtactaca

SEQ ID NO: 4450985 - DNA, 20 bp, Homo sapiens
caatgaaaactctttgctgc

SEQ ID NO: 4450986 - DNA, 19 bp, Homo sapiens
caatgaaaaggtgattgtc

SEQ ID NO: 4450987 - DNA, 13 bp, Homo sapiens
caatgaaatgaat

SEQ ID NO: 4450988 - DNA, 23 bp, Homo sapiens
caatgacacccatgccagagagg

SEQ ID NO: 4450989 - DNA, 23 bp, Homo sapiens
caatgacataaccaatttgtaat

SEQ ID NO: 4450990 - DNA, 11 bp, Homo sapiens
caatgagccat

SEQ ID NO: 4450991 - DNA, 20 bp, Homo sapiens
caatgaggtgtccaactggc

SEQ ID NO: 4450992 - DNA, 16 bp, Homo sapiens
caatgagtctgtaatt

SEQ ID NO: 4450993 - DNA, 16 bp, Homo sapiens
cacagatttttttgta

SEQ ID NO: 4450994 - DNA, 17 bp, Homo sapiens
cacagatttttttgtaa

SEQ ID NO: 4450995 - DNA, 18 bp, Homo sapiens
cacagatttttttgtaag

SEQ ID NO: 4450996 - DNA, 13 bp, Homo sapiens
cacagcaagccat

SEQ ID NO: 4450997 - DNA, 19 bp, Homo sapiens
cacagcaagtacagcggct

SEQ ID NO: 4450998 - DNA, 20 bp, Homo sapiens
cacagcaagtacagcggctc

SEQ ID NO: 4450999 - DNA, 20 bp, Homo sapiens
cacagcaggctgccagtgcc

SEQ ID NO: 4451000 - DNA, 21 bp, Homo sapiens
cacagcaggctgccagtgcct

SEQ ID NO: 4451001 - DNA, 18 bp, Homo sapiens
cacagcagtgtcacagac

SEQ ID NO: 4451002 - DNA, 21 bp, Homo sapiens
cacagcagttgaaaagactcc

SEQ ID NO: 4451003 - DNA, 14 bp, Homo sapiens
cacagcatcgggag

SEQ ID NO: 4451004 - DNA, 15 bp, Homo sapiens
cacagcatcgggagc

SEQ ID NO: 4451005 - DNA, 22 bp, Homo sapiens
cacagcatcgggagcacccaga

SEQ ID NO: 4451006 - DNA, 16 bp, Homo sapiens
cacagccaacgagaca

SEQ ID NO: 4451007 - DNA, 18 bp, Homo sapiens
cacagccaacgagacaca

SEQ ID NO: 4451008 - DNA, 19 bp, Homo sapiens
cacagccaacgagacacat

SEQ ID NO: 4451009 - DNA, 14 bp, Homo sapiens
cacagccaaggact

SEQ ID NO: 4451010 - DNA, 11 bp, Homo sapiens
cacagccacac

SEQ ID NO: 4451011 - DNA, 18 bp, Homo sapiens
cacagccagactggcaca

SEQ ID NO: 4451012 - DNA, 11 bp, Homo sapiens
cacagccagag

SEQ ID NO: 4451013 - DNA, 16 bp, Homo sapiens
cacagccagaggaggg

SEQ ID NO: 4451014 - DNA, 19 bp, Homo sapiens
cacagccagaggagggcag

SEQ ID NO: 4451015 - DNA, 17 bp, Homo sapiens
cacagccaggtgccttg

SEQ ID NO: 4451016 - DNA, 17 bp, Homo sapiens
cacagcccaaaatttga

SEQ ID NO: 4451017 - DNA, 13 bp, Homo sapiens
cacagcccaagag

SEQ ID NO: 4451018 - DNA, 22 bp, Homo sapiens
cacagcccctatagcactgagc

SEQ ID NO: 4451019 - DNA, 19 bp, Homo sapiens
cacagccgcgggccaggag

SEQ ID NO: 4451020 - DNA, 17 bp, Homo sapiens
cacagcctcccctgcca

SEQ ID NO: 4451021 - DNA, 19 bp, Homo sapiens
cacagcctcccctgccagg

SEQ ID NO: 4451022 - DNA, 21 bp, Homo sapiens
cacagcctcccctgccagggc

SEQ ID NO: 4451023 - DNA, 23 bp, Homo sapiens
cacagcctcccctgccagggcag

SEQ ID NO: 4451024 - DNA, 13 bp, Homo sapiens
cacagccttcgga

SEQ ID NO: 4451025 - DNA, 21 bp, Homo sapiens
cacagccttgcagcggctcct

SEQ ID NO: 4451026 - DNA, 23 bp, Homo sapiens
cacagccttgcagcggctcctgc

SEQ ID NO: 4451027 - DNA, 19 bp, Homo sapiens
cacagcgctcgatggacct

SEQ ID NO: 4451028 - DNA, 19 bp, Homo sapiens
cacagcgtccctggcgcag

SEQ ID NO: 4451029 - DNA, 19 bp, Homo sapiens
cacagcgtcctgtccacac

SEQ ID NO: 4451030 - DNA, 19 bp, Homo sapiens
cacagctaaccacttcgca

SEQ ID NO: 4451031 - DNA, 16 bp, Homo sapiens
cacagctactctcccc

SEQ ID NO: 4451032 - DNA, 15 bp, Homo sapiens
cacagctcccacccc

SEQ ID NO: 4451033 - DNA, 17 bp, Homo sapiens
cacagctcccaccccac

SEQ ID NO: 4451034 - DNA, 19 bp, Homo sapiens
cacagctcccaccccaccc

SEQ ID NO: 4451035 - DNA, 22 bp, Homo sapiens
cacagctcccaccccaccccct

SEQ ID NO: 4451036 - DNA, 22 bp, Homo sapiens
cacagctgctggagaataaatt

SEQ ID NO: 4451037 - DNA, 19 bp, Homo sapiens
cacagctgctgttctcagg

SEQ ID NO: 4451038 - DNA, 20 bp, Homo sapiens
cacagctgtatagctgcttc

SEQ ID NO: 4451039 - DNA, 19 bp, Homo sapiens
cacagcttagatttcatag

SEQ ID NO: 4451040 - DNA, 15 bp, Homo sapiens
cacagcttcctgagg

SEQ ID NO: 4451041 - DNA, 17 bp, Homo sapiens
cacagcttcctgagggc

SEQ ID NO: 4451042 - DNA, 22 bp, Homo sapiens
cacaggaaatgggaaaaaactt

SEQ ID NO: 4451043 - DNA, 18 bp, Homo sapiens
cacaggaagatgggaggt

SEQ ID NO: 4451044 - DNA, 19 bp, Homo sapiens
cacaggaagatgggaggtg

SEQ ID NO: 4451045 - DNA, 22 bp, Homo sapiens
cacaggaagatgggaggtggaa

SEQ ID NO: 4451046 - DNA, 23 bp, Homo sapiens
cacaggaaggaggggagagacag

SEQ ID NO: 4451047 - DNA, 15 bp, Homo sapiens
cacaggaagtagagg

SEQ ID NO: 4451048 - DNA, 15 bp, Homo sapiens
cacaggagcatttgg

SEQ ID NO: 4451049 - DNA, 12 bp, Homo sapiens
cacaggagggcc

SEQ ID NO: 4451050 - DNA, 22 bp, Homo sapiens
cacaggagtgtcctcttccctc

SEQ ID NO: 4451051 - DNA, 15 bp, Homo sapiens
cacaggcagccagcc

SEQ ID NO: 4451052 - DNA, 18 bp, Homo sapiens
cacaggcagccagccgtg

SEQ ID NO: 4451053 - DNA, 14 bp, Homo sapiens
cacaggcagggcct

SEQ ID NO: 4451054 - DNA, 17 bp, Homo sapiens
cacaggcagggcctggc

SEQ ID NO: 4451055 - DNA, 21 bp, Homo sapiens
cacaggcagggcctggctcca

SEQ ID NO: 4451056 - DNA, 22 bp, Homo sapiens
cacaggcagtccaggcctctct

SEQ ID NO: 4451057 - DNA, 23 bp, Homo sapiens
cacaggcatattccctgcacaca

SEQ ID NO: 4451058 - DNA, 23 bp, Homo sapiens
cacaggccaaatccttggagtcc

SEQ ID NO: 4451059 - DNA, 19 bp, Homo sapiens
cacaggcctgagatttcat

SEQ ID NO: 4451060 - DNA, 17 bp, Homo sapiens
cacaggctgagaactcg

SEQ ID NO: 4451061 - DNA, 20 bp, Homo sapiens
cacagggagtgcacatatcc

SEQ ID NO: 4451062 - DNA, 20 bp, Homo sapiens
cacagggattctcacaatag

SEQ ID NO: 4451063 - DNA, 16 bp, Homo sapiens
cacagggcagctgggc

SEQ ID NO: 4451064 - DNA, 17 bp, Homo sapiens
cacagggcagctgggcc

SEQ ID NO: 4451065 - DNA, 18 bp, Homo sapiens
cacagggcagctgggccc

SEQ ID NO: 4451066 - DNA, 23 bp, Homo sapiens
cacaggggccaccacctttggct

SEQ ID NO: 4451067 - DNA, 22 bp, Homo sapiens
cacaggtagcacagattttgaa

SEQ ID NO: 4451068 - DNA, 14 bp, Homo sapiens
cacaggtccaagga

SEQ ID NO: 4451069 - DNA, 21 bp, Homo sapiens
cacaggtctcattgcttctga

SEQ ID NO: 4451070 - DNA, 19 bp, Homo sapiens
cacaggtgcaacagacttg

SEQ ID NO: 4451071 - DNA, 17 bp, Homo sapiens
cacagtaccggattctc

SEQ ID NO: 4451072 - DNA, 13 bp, Homo sapiens
cacagtagaactg

SEQ ID NO: 4451073 - DNA, 20 bp, Homo sapiens
cacagtagaactgtctgtga

SEQ ID NO: 4451074 - DNA, 13 bp, Homo sapiens
cacagtatatttt

SEQ ID NO: 4451075 - DNA, 19 bp, Homo sapiens
cacagtatattttatttca

SEQ ID NO: 4451076 - DNA, 23 bp, Homo sapiens
cacagtattatttctccatcccc

SEQ ID NO: 4451077 - DNA, 14 bp, Homo sapiens
cacagtatttgtaa

SEQ ID NO: 4451078 - DNA, 14 bp, Homo sapiens
cacagtcagaagga

SEQ ID NO: 4451079 - DNA, 15 bp, Homo sapiens
cacagtcatacaagt

SEQ ID NO: 4451080 - DNA, 19 bp, Homo sapiens
cacagtccagacccaagtc

SEQ ID NO: 4451081 - DNA, 17 bp, Homo sapiens
cacagtcccactgtgca

SEQ ID NO: 4451082 - DNA, 20 bp, Homo sapiens
cacagtctccatgtgtgtgc

SEQ ID NO: 4451083 - DNA, 18 bp, Homo sapiens
cacagtgagactgtacat

SEQ ID NO: 4451084 - DNA, 19 bp, Homo sapiens
cacagtgagactgtacata

SEQ ID NO: 4451085 - DNA, 21 bp, Homo sapiens
cacagtgagactgtacataat

SEQ ID NO: 4451086 - DNA, 18 bp, Homo sapiens
cacagtgctcttttctcc

SEQ ID NO: 4451087 - DNA, 16 bp, Homo sapiens
cacagtgcttagaagt

SEQ ID NO: 4451088 - DNA, 15 bp, Homo sapiens
cacagtggctcacgc

SEQ ID NO: 4451089 - DNA, 16 bp, Homo sapiens
cacagtggttcctggc

SEQ ID NO: 4451090 - DNA, 23 bp, Homo sapiens
cacagtgtgtggtcaacatttct

SEQ ID NO: 4451091 - DNA, 22 bp, Homo sapiens
cacagtgtttttattgctcgcc

SEQ ID NO: 4451092 - DNA, 16 bp, Homo sapiens
cacagttcctcgccct

SEQ ID NO: 4451093 - DNA, 23 bp, Homo sapiens
cacagttgaagggaggggctgtg

SEQ ID NO: 4451094 - DNA, 13 bp, Homo sapiens
cacagtttagaac

SEQ ID NO: 4451095 - DNA, 18 bp, Homo sapiens
cacagttttaataagaac

SEQ ID NO: 4451096 - DNA, 22 bp, Homo sapiens
cacagttttaataagaacagat

SEQ ID NO: 4451097 - DNA, 15 bp, Homo sapiens
cacagttttctgaga

SEQ ID NO: 4451098 - DNA, 17 bp, Homo sapiens
cacagttttctgagaaa

SEQ ID NO: 4451099 - DNA, 20 bp, Homo sapiens
cacagttttctgagaaagac

SEQ ID NO: 4451100 - DNA, 15 bp, Homo sapiens
cacataaaagtctgt

SEQ ID NO: 4451101 - DNA, 12 bp, Homo sapiens
cacataaagaaa

SEQ ID NO: 4451102 - DNA, 14 bp, Homo sapiens
cacataatttctgt

SEQ ID NO: 4451103 - DNA, 13 bp, Homo sapiens
cacatagagcttt

SEQ ID NO: 4451104 - DNA, 20 bp, Homo sapiens
cacatagagctttttaatag

SEQ ID NO: 4451105 - DNA, 17 bp, Homo sapiens
cacatagattcacctgt

SEQ ID NO: 4451106 - DNA, 22 bp, Homo sapiens
cacatagattcacctgtaaaac

SEQ ID NO: 4451107 - DNA, 20 bp, Homo sapiens
cacatagtttttcagtctat

SEQ ID NO: 4451108 - DNA, 13 bp, Homo sapiens
cacatatacatat

SEQ ID NO: 4451109 - DNA, 15 bp, Homo sapiens
cacatatccaggcac

SEQ ID NO: 4451110 - DNA, 21 bp, Homo sapiens
cacatattagtgcagccaagt

SEQ ID NO: 4451111 - DNA, 15 bp, Homo sapiens
cacatattttaaaat

SEQ ID NO: 4451112 - DNA, 17 bp, Homo sapiens
cacatattttaaaattt

SEQ ID NO: 4451113 - DNA, 12 bp, Homo sapiens
cacatcaacatt

SEQ ID NO: 4451114 - DNA, 13 bp, Homo sapiens
cacatcagcttgc

SEQ ID NO: 4451115 - DNA, 23 bp, Homo sapiens
cacatcagcttgccctgttaaaa

SEQ ID NO: 4451116 - DNA, 14 bp, Homo sapiens
cacatcaggaaaga

SEQ ID NO: 4451117 - DNA, 16 bp, Homo sapiens
cacatcccattgggac

SEQ ID NO: 4451118 - DNA, 19 bp, Homo sapiens
cacatctaaagctttatct

SEQ ID NO: 4451119 - DNA, 20 bp, Homo sapiens
cacatctacatgccatgcct

SEQ ID NO: 4451120 - DNA, 23 bp, Homo sapiens
cacatctctctgccctctccctg

SEQ ID NO: 4451121 - DNA, 16 bp, Homo sapiens
cacatctgtgtcttgt

SEQ ID NO: 4451122 - DNA, 14 bp, Homo sapiens
cacatcttaaaagt

SEQ ID NO: 4451123 - DNA, 15 bp, Homo sapiens
cacatgaacagcttg

SEQ ID NO: 4451124 - DNA, 22 bp, Homo sapiens
cacatgaacagcttgccaggga

SEQ ID NO: 4451125 - DNA, 23 bp, Homo sapiens
cacatgaggccatctcaggagat

SEQ ID NO: 4451126 - DNA, 19 bp, Homo sapiens
cacatgataccagcagcaa

SEQ ID NO: 4451127 - DNA, 21 bp, Homo sapiens
cacatgataccagcagcaact

SEQ ID NO: 4451128 - DNA, 18 bp, Homo sapiens
cacatgcagaataatcct

SEQ ID NO: 4451129 - DNA, 17 bp, Homo sapiens
cacatgcatgtctgcct

SEQ ID NO: 4451130 - DNA, 16 bp, Homo sapiens
cacatgccacctggca

SEQ ID NO: 4451131 - DNA, 16 bp, Homo sapiens
cacatgccccaggctc

SEQ ID NO: 4451132 - DNA, 21 bp, Homo sapiens
cacatgcctgcgcctgctgcc

SEQ ID NO: 4451133 - DNA, 20 bp, Homo sapiens
cacatgcttgaatggagctg

SEQ ID NO: 4451134 - DNA, 20 bp, Homo sapiens
cacatggagccccctctgcc

SEQ ID NO: 4451135 - DNA, 13 bp, Homo sapiens
cacatggcctgag

SEQ ID NO: 4451136 - DNA, 14 bp, Homo sapiens
cacatggcctgagc

SEQ ID NO: 4451137 - DNA, 15 bp, Homo sapiens
cacatgggactggga

SEQ ID NO: 4451138 - DNA, 21 bp, Homo sapiens
cacatgggagcagtccatgca

SEQ ID NO: 4451139 - DNA, 14 bp, Homo sapiens
cacatggtgtctcc

SEQ ID NO: 4451140 - DNA, 16 bp, Homo sapiens
cacatggtgtctccca

SEQ ID NO: 4451141 - DNA, 20 bp, Homo sapiens
cacatgtcagtaccttcaaa

SEQ ID NO: 4451142 - DNA, 12 bp, Homo sapiens
cacatgtgtggt

SEQ ID NO: 4451143 - DNA, 12 bp, Homo sapiens
cacatgttactg

SEQ ID NO: 4451144 - DNA, 14 bp, Homo sapiens
cacatgtttaactt

SEQ ID NO: 4451145 - DNA, 15 bp, Homo sapiens
cacatgttttctctg

SEQ ID NO: 4451146 - DNA, 18 bp, Homo sapiens
cacatgtttttatttcct

SEQ ID NO: 4451147 - DNA, 17 bp, Homo sapiens
cacattaaaaaggaaag

SEQ ID NO: 4451148 - DNA, 23 bp, Homo sapiens
cacattaacttctggactgccgg

SEQ ID NO: 4451149 - DNA, 15 bp, Homo sapiens
cacattagaaatatt

SEQ ID NO: 4451150 - DNA, 15 bp, Homo sapiens
cacattaggctgttg

SEQ ID NO: 4451151 - DNA, 18 bp, Homo sapiens
cacattataaagttcaga

SEQ ID NO: 4451152 - DNA, 14 bp, Homo sapiens
cacattcttcagtt

SEQ ID NO: 4451153 - DNA, 16 bp, Homo sapiens
cacattcttcagtttt

SEQ ID NO: 4451154 - DNA, 23 bp, Homo sapiens
cacattgaatagtggaacatttt

SEQ ID NO: 4451155 - DNA, 19 bp, Homo sapiens
cacattgagactttcttct

SEQ ID NO: 4451156 - DNA, 18 bp, Homo sapiens
cacattgcccctctgcct

SEQ ID NO: 4451157 - DNA, 19 bp, Homo sapiens
cacattgcccctctgcctt

SEQ ID NO: 4451158 - DNA, 16 bp, Homo sapiens
cacattgccttctgga

SEQ ID NO: 4451159 - DNA, 13 bp, Homo sapiens
cacattgctacct

SEQ ID NO: 4451160 - DNA, 17 bp, Homo sapiens
cacattggaatgccttg

SEQ ID NO: 4451161 - DNA, 21 bp, Homo sapiens
cacattgggtggggctcctgg

SEQ ID NO: 4451162 - DNA, 18 bp, Homo sapiens
cacattgtgcttggcccc

SEQ ID NO: 4451163 - DNA, 18 bp, Homo sapiens
cacattgttcaactccct

SEQ ID NO: 4451164 - DNA, 21 bp, Homo sapiens
cacatttcttaaaacacatga

SEQ ID NO: 4451165 - DNA, 14 bp, Homo sapiens
cacatttgactcca

SEQ ID NO: 4451166 - DNA, 18 bp, Homo sapiens
cacattttccttttcaaa

SEQ ID NO: 4451167 - DNA, 19 bp, Homo sapiens
cacattttgtatggagtta

SEQ ID NO: 4451168 - DNA, 17 bp, Homo sapiens
cacatttttaagatgca

SEQ ID NO: 4451169 - DNA, 14 bp, Homo sapiens
cacatttttcagat

SEQ ID NO: 4451170 - DNA, 13 bp, Homo sapiens
cacatttttgtaa

SEQ ID NO: 4451171 - DNA, 15 bp, Homo sapiens
caccaaaagaagtaa

SEQ ID NO: 4451172 - DNA, 14 bp, Homo sapiens
caccaaagacatca

SEQ ID NO: 4451173 - DNA, 23 bp, Homo sapiens
caccaacatcccattgccctggt

SEQ ID NO: 4451174 - DNA, 15 bp, Homo sapiens
caccaacttacaaaa

SEQ ID NO: 4451175 - DNA, 21 bp, Homo sapiens
caccaagcaggaaatgaaaat

SEQ ID NO: 4451176 - DNA, 20 bp, Homo sapiens
caccaagctcacagttcctc

SEQ ID NO: 4451177 - DNA, 14 bp, Homo sapiens
caccaatacaaatt

SEQ ID NO: 4451178 - DNA, 14 bp, Homo sapiens
caccaatcagcact

SEQ ID NO: 4451179 - DNA, 16 bp, Homo sapiens
caccaatcagcactct

SEQ ID NO: 4451180 - DNA, 17 bp, Homo sapiens
caccaatcagcgctctg

SEQ ID NO: 4451181 - DNA, 19 bp, Homo sapiens
caccaatcttgtttatagc

SEQ ID NO: 4451182 - DNA, 21 bp, Homo sapiens
caccaatcttgtttatagcaa

SEQ ID NO: 4451183 - DNA, 16 bp, Homo sapiens
caccaattatcatctt

SEQ ID NO: 4451184 - DNA, 23 bp, Homo sapiens
caccaatttggtaaaaatgctgc

SEQ ID NO: 4451185 - DNA, 19 bp, Homo sapiens
caccacaaacacagccctg

SEQ ID NO: 4451186 - DNA, 21 bp, Homo sapiens
caccacatcctccgtccagcc

SEQ ID NO: 4451187 - DNA, 23 bp, Homo sapiens
caccaccatttaatttcatgtat

SEQ ID NO: 4451188 - DNA, 14 bp, Homo sapiens
caccaccttcccag

SEQ ID NO: 4451189 - DNA, 19 bp, Homo sapiens
caccaccttcccagctctc

SEQ ID NO: 4451190 - DNA, 21 bp, Homo sapiens
caccaccttcccagctctccc

SEQ ID NO: 4451191 - DNA, 22 bp, Homo sapiens
caccaccttcccagctctccct

SEQ ID NO: 4451192 - DNA, 15 bp, Homo sapiens
caccacgatgtggcc

SEQ ID NO: 4451193 - DNA, 18 bp, Homo sapiens
caccacgatgtggccctg

SEQ ID NO: 4451194 - DNA, 20 bp, Homo sapiens
caccacgatgtggccctggc

SEQ ID NO: 4451195 - DNA, 17 bp, Homo sapiens
caccacggctcactgca

SEQ ID NO: 4451196 - DNA, 17 bp, Homo sapiens
caccacggtagtgcctg

SEQ ID NO: 4451197 - DNA, 18 bp, Homo sapiens
caccactaaccatcccca

SEQ ID NO: 4451198 - DNA, 19 bp, Homo sapiens
caccactaaccatccccaa

SEQ ID NO: 4451199 - DNA, 21 bp, Homo sapiens
caccactaaccatccccaact

SEQ ID NO: 4451200 - DNA, 16 bp, Homo sapiens
caccactaccagccag

SEQ ID NO: 4451201 - DNA, 20 bp, Homo sapiens
caccactaggaatcccagag

SEQ ID NO: 4451202 - DNA, 16 bp, Homo sapiens
caccactgatatcatg

SEQ ID NO: 4451203 - DNA, 22 bp, Homo sapiens
caccactgccattacccagtgc

SEQ ID NO: 4451204 - DNA, 18 bp, Homo sapiens
caccagaacgcaccccac

SEQ ID NO: 4451205 - DNA, 20 bp, Homo sapiens
caccagaacgcaccccactg

SEQ ID NO: 4451206 - DNA, 19 bp, Homo sapiens
caccagacgtcaggccctg

SEQ ID NO: 4451207 - DNA, 20 bp, Homo sapiens
caccagagtcttaagggtca

SEQ ID NO: 4451208 - DNA, 14 bp, Homo sapiens
caccagatgagaat

SEQ ID NO: 4451209 - DNA, 10 bp, Homo sapiens
caccagcagc

SEQ ID NO: 4451210 - DNA, 19 bp, Homo sapiens
caccagccaggctctgtgc

SEQ ID NO: 4451211 - DNA, 21 bp, Homo sapiens
caccagccaggctctgtgctg

SEQ ID NO: 4451212 - DNA, 16 bp, Homo sapiens
caccagccatcctccc

SEQ ID NO: 4451213 - DNA, 16 bp, Homo sapiens
caccagcccctcccca

SEQ ID NO: 4451214 - DNA, 22 bp, Homo sapiens
caccagcctagcctggctctgc

SEQ ID NO: 4451215 - DNA, 13 bp, Homo sapiens
caccagccttgct

SEQ ID NO: 4451216 - DNA, 15 bp, Homo sapiens
caccagccttgctct

SEQ ID NO: 4451217 - DNA, 14 bp, Homo sapiens
caccagctatctgt

SEQ ID NO: 4451218 - DNA, 10 bp, Homo sapiens
caccagctgc

SEQ ID NO: 4451219 - DNA, 12 bp, Homo sapiens
caccaggaatgt

SEQ ID NO: 4451220 - DNA, 17 bp, Homo sapiens
caccaggaatgttaaag

SEQ ID NO: 4451221 - DNA, 16 bp, Homo sapiens
caccaggactagggct

SEQ ID NO: 4451222 - DNA, 17 bp, Homo sapiens
caccaggagaaccacta

SEQ ID NO: 4451223 - DNA, 21 bp, Homo sapiens
caccaggcacgaacccacctg

SEQ ID NO: 4451224 - DNA, 22 bp, Homo sapiens
caccaggcacgaacccacctgc

SEQ ID NO: 4451225 - DNA, 15 bp, Homo sapiens
caccaggccagctca

SEQ ID NO: 4451226 - DNA, 17 bp, Homo sapiens
caccaggccagctcagg

SEQ ID NO: 4451227 - DNA, 18 bp, Homo sapiens
caccaggccagctcagga

SEQ ID NO: 4451228 - DNA, 13 bp, Homo sapiens
cacgagccacaag

SEQ ID NO: 4451229 - DNA, 16 bp, Homo sapiens
cacgagccacaagctg

SEQ ID NO: 4451230 - DNA, 17 bp, Homo sapiens
cacgagccacaagctgc

SEQ ID NO: 4451231 - DNA, 12 bp, Homo sapiens
cacgagccacct

SEQ ID NO: 4451232 - DNA, 11 bp, Homo sapiens
cacgagggctg

SEQ ID NO: 4451233 - DNA, 17 bp, Homo sapiens
cacgagggctggctggc

SEQ ID NO: 4451234 - DNA, 15 bp, Homo sapiens
cacgatgtggccctg

SEQ ID NO: 4451235 - DNA, 16 bp, Homo sapiens
cacgatgtggccctgg

SEQ ID NO: 4451236 - DNA, 17 bp, Homo sapiens
cacgatgtggccctggc

SEQ ID NO: 4451237 - DNA, 18 bp, Homo sapiens
cacgatgtggccctggcc

SEQ ID NO: 4451238 - DNA, 22 bp, Homo sapiens
cacgatgtggccctggcctgct

SEQ ID NO: 4451239 - DNA, 15 bp, Homo sapiens
cacgattcatttttg

SEQ ID NO: 4451240 - DNA, 15 bp, Homo sapiens
cacgccaggccagca

SEQ ID NO: 4451241 - DNA, 18 bp, Homo sapiens
cacgccattctcctgcct

SEQ ID NO: 4451242 - DNA, 22 bp, Homo sapiens
cacgccattctcctgcctcagc

SEQ ID NO: 4451243 - DNA, 23 bp, Homo sapiens
cacgccattctcctgcctcagcc

SEQ ID NO: 4451244 - DNA, 18 bp, Homo sapiens
cacgccattgtactccag

SEQ ID NO: 4451245 - DNA, 18 bp, Homo sapiens
cacgcccaccagccttgc

SEQ ID NO: 4451246 - DNA, 21 bp, Homo sapiens
cacgcccaccagccttgctct

SEQ ID NO: 4451247 - DNA, 21 bp, Homo sapiens
cacgccccggtcccccagagc

SEQ ID NO: 4451248 - DNA, 15 bp, Homo sapiens
cacgccctccctgct

SEQ ID NO: 4451249 - DNA, 23 bp, Homo sapiens
cacgccggccacacccctctgct

SEQ ID NO: 4451250 - DNA, 21 bp, Homo sapiens
cacgcctctccctaggagaag

SEQ ID NO: 4451251 - DNA, 18 bp, Homo sapiens
cacgcctgtaatcccagc

SEQ ID NO: 4451252 - DNA, 21 bp, Homo sapiens
cacgcctgtaatcccagcact

SEQ ID NO: 4451253 - DNA, 22 bp, Homo sapiens
cacgcctgtaatcccagcactt

SEQ ID NO: 4451254 - DNA, 21 bp, Homo sapiens
cacgcctgtaatcccagcagt

SEQ ID NO: 4451255 - DNA, 17 bp, Homo sapiens
cacgcgccctttctacc

SEQ ID NO: 4451256 - DNA, 14 bp, Homo sapiens
cacgctgtcctctc

SEQ ID NO: 4451257 - DNA, 18 bp, Homo sapiens
cacgctgtcctctcgagc

SEQ ID NO: 4451258 - DNA, 15 bp, Homo sapiens
cacgctttgtttact

SEQ ID NO: 4451259 - DNA, 16 bp, Homo sapiens
cacgctttgtttactc

SEQ ID NO: 4451260 - DNA, 20 bp, Homo sapiens
cacggaaggcgggctgagga

SEQ ID NO: 4451261 - DNA, 22 bp, Homo sapiens
cacggaccactcgaggcctgca

SEQ ID NO: 4451262 - DNA, 19 bp, Homo sapiens
cacggagacagaggaaagg

SEQ ID NO: 4451263 - DNA, 21 bp, Homo sapiens
cacggagccactcctctgact

SEQ ID NO: 4451264 - DNA, 23 bp, Homo sapiens
cacggatccatgtagcaggactg

SEQ ID NO: 4451265 - DNA, 16 bp, Homo sapiens
cacggatggtgcatgg

SEQ ID NO: 4451266 - DNA, 17 bp, Homo sapiens
cacggatggtgcatggg

SEQ ID NO: 4451267 - DNA, 23 bp, Homo sapiens
cacggcgggatcctccacagaga

SEQ ID NO: 4451268 - DNA, 17 bp, Homo sapiens
cacggcgtttttttaca

SEQ ID NO: 4451269 - DNA, 16 bp, Homo sapiens
cacgggaccactccag

SEQ ID NO: 4451270 - DNA, 15 bp, Homo sapiens
cacgggagatttctt

SEQ ID NO: 4451271 - DNA, 21 bp, Homo sapiens
cacggggttccctcctagctc

SEQ ID NO: 4451272 - DNA, 22 bp, Homo sapiens
cacggggttccctcctagctct

SEQ ID NO: 4451273 - DNA, 21 bp, Homo sapiens
cacggggttggctgttccaga

SEQ ID NO: 4451274 - DNA, 18 bp, Homo sapiens
cacggtcccccaggaggc

SEQ ID NO: 4451275 - DNA, 14 bp, Homo sapiens
cacggtgggccttg

SEQ ID NO: 4451276 - DNA, 14 bp, Homo sapiens
cacggttatttaag

SEQ ID NO: 4451277 - DNA, 14 bp, Homo sapiens
cacgtcaggcctgg

SEQ ID NO: 4451278 - DNA, 22 bp, Homo sapiens
cacgtcccagcatccctggagc

SEQ ID NO: 4451279 - DNA, 21 bp, Homo sapiens
cacgtcgggcttccctggcct

SEQ ID NO: 4451280 - DNA, 16 bp, Homo sapiens
cacgtgccaggcccgg

SEQ ID NO: 4451281 - DNA, 13 bp, Homo sapiens
cacgtggggccca

SEQ ID NO: 4451282 - DNA, 14 bp, Homo sapiens
cacgtggggcccac

SEQ ID NO: 4451283 - DNA, 15 bp, Homo sapiens
cacgtggggcccact

SEQ ID NO: 4451284 - DNA, 13 bp, Homo sapiens
cacgttgtccctg

SEQ ID NO: 4451285 - DNA, 17 bp, Homo sapiens
cacgtttaatcccagca

SEQ ID NO: 4451286 - DNA, 19 bp, Homo sapiens
cacgtttaatcccagcact

SEQ ID NO: 4451287 - DNA, 20 bp, Homo sapiens
cactaacattatattgcaat

SEQ ID NO: 4451288 - DNA, 23 bp, Homo sapiens
cactaaccaatgcctttttagat

SEQ ID NO: 4451289 - DNA, 13 bp, Homo sapiens
cactaacctgacc

SEQ ID NO: 4451290 - DNA, 20 bp, Homo sapiens
cactaactgggaggacattc

SEQ ID NO: 4451291 - DNA, 19 bp, Homo sapiens
cactaagagggcagactgt

SEQ ID NO: 4451292 - DNA, 14 bp, Homo sapiens
cactaataaagtgc

SEQ ID NO: 4451293 - DNA, 16 bp, Homo sapiens
cactaatatatttaaa

SEQ ID NO: 4451294 - DNA, 21 bp, Homo sapiens
cactaatcacaaactgaatga

SEQ ID NO: 4451295 - DNA, 23 bp, Homo sapiens
cactaatttttgtattatttttg

SEQ ID NO: 4451296 - DNA, 22 bp, Homo sapiens
cactacaggtgaaggctctcac

SEQ ID NO: 4451297 - DNA, 21 bp, Homo sapiens
cactacatgcagcccatgccc

SEQ ID NO: 4451298 - DNA, 15 bp, Homo sapiens
cactacattcattta

SEQ ID NO: 4451299 - DNA, 17 bp, Homo sapiens
cactaccagccagcctc

SEQ ID NO: 4451300 - DNA, 13 bp, Homo sapiens
cactaccctgaga

SEQ ID NO: 4451301 - DNA, 13 bp, Homo sapiens
cactactctgtgc

SEQ ID NO: 4451302 - DNA, 13 bp, Homo sapiens
cactactgggtgt

SEQ ID NO: 4451303 - DNA, 15 bp, Homo sapiens
cactactgggtgtca

SEQ ID NO: 4451304 - DNA, 22 bp, Homo sapiens
cactactgggtgtcatttcatt

SEQ ID NO: 4451305 - DNA, 19 bp, Homo sapiens
cactactgtactccagcca

SEQ ID NO: 4451306 - DNA, 23 bp, Homo sapiens
cactagagaatgcacagatatac

SEQ ID NO: 4451307 - DNA, 13 bp, Homo sapiens
cactagcttactg

SEQ ID NO: 4451308 - DNA, 16 bp, Homo sapiens
cactaggaaacgtgtt

SEQ ID NO: 4451309 - DNA, 20 bp, Homo sapiens
cactaggaatcccagaggtg

SEQ ID NO: 4451310 - DNA, 16 bp, Homo sapiens
cactaggcacccagct

SEQ ID NO: 4451311 - DNA, 17 bp, Homo sapiens
cactaggcctgaaatga

SEQ ID NO: 4451312 - DNA, 23 bp, Homo sapiens
cactagtgcaattccaagaaaat

SEQ ID NO: 4451313 - DNA, 16 bp, Homo sapiens
cactataatgtgaaat

SEQ ID NO: 4451314 - DNA, 15 bp, Homo sapiens
cactatacaaacaaa

SEQ ID NO: 4451315 - DNA, 19 bp, Homo sapiens
cactatacaggctgggaag

SEQ ID NO: 4451316 - DNA, 16 bp, Homo sapiens
cactatatatatttct

SEQ ID NO: 4451317 - DNA, 19 bp, Homo sapiens
cactatcatagttaacata

SEQ ID NO: 4451318 - DNA, 17 bp, Homo sapiens
cactattacttgaactt

SEQ ID NO: 4451319 - DNA, 14 bp, Homo sapiens
cactatttccaaaa

SEQ ID NO: 4451320 - DNA, 21 bp, Homo sapiens
cactattttcagaatctgaat

SEQ ID NO: 4451321 - DNA, 13 bp, Homo sapiens
cactcaaggacag

SEQ ID NO: 4451322 - DNA, 19 bp, Homo sapiens
cactcaaggacaggagcct

SEQ ID NO: 4451323 - DNA, 22 bp, Homo sapiens
cactcaaggacaggagcctggt

SEQ ID NO: 4451324 - DNA, 24 bp, Homo sapiens
cactcaaggacaggagcctggtcc

SEQ ID NO: 4451325 - DNA, 16 bp, Homo sapiens
cactcaataaacagtc

SEQ ID NO: 4451326 - DNA, 16 bp, Homo sapiens
cactcacacagccagg

SEQ ID NO: 4451327 - DNA, 21 bp, Homo sapiens
cactcacatagccaactctcc

SEQ ID NO: 4451328 - DNA, 23 bp, Homo sapiens
cactcacatagccaactctccca

SEQ ID NO: 4451329 - DNA, 12 bp, Homo sapiens
cactcactcctg

SEQ ID NO: 4451330 - DNA, 15 bp, Homo sapiens
cactcactcctgaga

SEQ ID NO: 4451331 - DNA, 19 bp, Homo sapiens
cactcactgtttataaatg

SEQ ID NO: 4451332 - DNA, 21 bp, Homo sapiens
cactcagccactgtcacaggc

SEQ ID NO: 4451333 - DNA, 23 bp, Homo sapiens
cactcagccactgtcacaggcat

SEQ ID NO: 4451334 - DNA, 19 bp, Homo sapiens
cactcagtgagcctcctgt

SEQ ID NO: 4451335 - DNA, 20 bp, Homo sapiens
cactcagtgagcctcctgtg

SEQ ID NO: 4451336 - DNA, 22 bp, Homo sapiens
cactcatgcaaactgctttatt

SEQ ID NO: 4451337 - DNA, 19 bp, Homo sapiens
cactcatgggaatgcattt

SEQ ID NO: 4451338 - DNA, 18 bp, Homo sapiens
cactcatttcatctcatt

SEQ ID NO: 4451339 - DNA, 19 bp, Homo sapiens
cactcatttcatctcattt

SEQ ID NO: 4451340 - DNA, 12 bp, Homo sapiens
cactccagagaa

SEQ ID NO: 4451341 - DNA, 14 bp, Homo sapiens
cactccagcctgag

SEQ ID NO: 4451342 - DNA, 23 bp, Homo sapiens
cactccagcctgagcgacagtga

SEQ ID NO: 4451343 - DNA, 13 bp, Homo sapiens
cactccagcctgg

SEQ ID NO: 4451344 - DNA, 16 bp, Homo sapiens
cactccagtgagacag

SEQ ID NO: 4451345 - DNA, 14 bp, Homo sapiens
cactggctcaccca

SEQ ID NO: 4451346 - DNA, 18 bp, Homo sapiens
cactggctcacccagtcc

SEQ ID NO: 4451347 - DNA, 22 bp, Homo sapiens
cactggctgtcagtatgacatt

SEQ ID NO: 4451348 - DNA, 14 bp, Homo sapiens
cactgggccagtca

SEQ ID NO: 4451349 - DNA, 17 bp, Homo sapiens
cactgggcccgagcctg

SEQ ID NO: 4451350 - DNA, 23 bp, Homo sapiens
cactggggactttatttatttct

SEQ ID NO: 4451351 - DNA, 13 bp, Homo sapiens
cactggggcaggg

SEQ ID NO: 4451352 - DNA, 23 bp, Homo sapiens
cactggggctgacacccaggccc

SEQ ID NO: 4451353 - DNA, 15 bp, Homo sapiens
cactggggtgccgcc

SEQ ID NO: 4451354 - DNA, 18 bp, Homo sapiens
cactggggtgccgcctgc

SEQ ID NO: 4451355 - DNA, 19 bp, Homo sapiens
cactggggtgccttcactg

SEQ ID NO: 4451356 - DNA, 22 bp, Homo sapiens
cactggggtgccttcactgggc

SEQ ID NO: 4451357 - DNA, 18 bp, Homo sapiens
cactgggtggtggcctgg

SEQ ID NO: 4451358 - DNA, 23 bp, Homo sapiens
cactgggtttggcaaaactcagg

SEQ ID NO: 4451359 - DNA, 22 bp, Homo sapiens
cactggtacccgcccttccgag

SEQ ID NO: 4451360 - DNA, 21 bp, Homo sapiens
cactggtacttagagtttctg

SEQ ID NO: 4451361 - DNA, 15 bp, Homo sapiens
cactggtgaactgag

SEQ ID NO: 4451362 - DNA, 20 bp, Homo sapiens
cactggtgtgacctgagggc

SEQ ID NO: 4451363 - DNA, 17 bp, Homo sapiens
cactggtttgtttctca

SEQ ID NO: 4451364 - DNA, 13 bp, Homo sapiens
cactgtaaatatc

SEQ ID NO: 4451365 - DNA, 23 bp, Homo sapiens
cactgtaaatatccctcccctct

SEQ ID NO: 4451366 - DNA, 20 bp, Homo sapiens
cactgtaaggtgcttgctcc

SEQ ID NO: 4451367 - DNA, 18 bp, Homo sapiens
cactgtacacacccgcct

SEQ ID NO: 4451368 - DNA, 11 bp, Homo sapiens
cactgtatata

SEQ ID NO: 4451369 - DNA, 13 bp, Homo sapiens
cactgtatataaa

SEQ ID NO: 4451370 - DNA, 20 bp, Homo sapiens
cactgtatataaacatattt

SEQ ID NO: 4451371 - DNA, 17 bp, Homo sapiens
cactgtatgttatagaa

SEQ ID NO: 4451372 - DNA, 16 bp, Homo sapiens
cactgtattttaatgt

SEQ ID NO: 4451373 - DNA, 14 bp, Homo sapiens
cactgtcaagatga

SEQ ID NO: 4451374 - DNA, 11 bp, Homo sapiens
cactgtcaccg

SEQ ID NO: 4451375 - DNA, 18 bp, Homo sapiens
cactgtccaatatgaaaa

SEQ ID NO: 4451376 - DNA, 16 bp, Homo sapiens
cactgtcctattatat

SEQ ID NO: 4451377 - DNA, 13 bp, Homo sapiens
cactgtctcaact

SEQ ID NO: 4451378 - DNA, 16 bp, Homo sapiens
cactgtgatacagttt

SEQ ID NO: 4451379 - DNA, 18 bp, Homo sapiens
cactgtgatacagttttg

SEQ ID NO: 4451380 - DNA, 19 bp, Homo sapiens
cactgtgatcaatattttt

SEQ ID NO: 4451381 - DNA, 21 bp, Homo sapiens
cactgtgatcaatatttttat

SEQ ID NO: 4451382 - DNA, 22 bp, Homo sapiens
cactgtgattactctttgcttt

SEQ ID NO: 4451383 - DNA, 16 bp, Homo sapiens
cactgtgatttatctt

SEQ ID NO: 4451384 - DNA, 22 bp, Homo sapiens
cactgtgcaggtgctattgtta

SEQ ID NO: 4451385 - DNA, 19 bp, Homo sapiens
cactgtgcgtcttggtgta

SEQ ID NO: 4451386 - DNA, 15 bp, Homo sapiens
cactgtgctggggca

SEQ ID NO: 4451387 - DNA, 22 bp, Homo sapiens
cactgtgctttctattgtacag

SEQ ID NO: 4451388 - DNA, 20 bp, Homo sapiens
cactgtgggaaggccagctg

SEQ ID NO: 4451389 - DNA, 23 bp, Homo sapiens
cactgtggggcacttgatattta

SEQ ID NO: 4451390 - DNA, 18 bp, Homo sapiens
cactgtgtactggagcct

SEQ ID NO: 4451391 - DNA, 19 bp, Homo sapiens
cactgtgtactggagcctg

SEQ ID NO: 4451392 - DNA, 17 bp, Homo sapiens
cactgtgtataggaatt

SEQ ID NO: 4451393 - DNA, 13 bp, Homo sapiens
cactgttagaaca

SEQ ID NO: 4451394 - DNA, 18 bp, Homo sapiens
cactgttagaacactatt

SEQ ID NO: 4451395 - DNA, 19 bp, Homo sapiens
cactgttagaacactattt

SEQ ID NO: 4451396 - DNA, 23 bp, Homo sapiens
cactgttagaacactattttcag

SEQ ID NO: 4451397 - DNA, 20 bp, Homo sapiens
cactgttcaaacctctgccg

SEQ ID NO: 4451398 - DNA, 21 bp, Homo sapiens
cactgttctgaaaggagacat

SEQ ID NO: 4451399 - DNA, 16 bp, Homo sapiens
cactgttgctttgaaa

SEQ ID NO: 4451400 - DNA, 11 bp, Homo sapiens
cactgtttaag

SEQ ID NO: 4451401 - DNA, 14 bp, Homo sapiens
cactgtttccatgt

SEQ ID NO: 4451402 - DNA, 17 bp, Homo sapiens
cacttaaacagaagcag

SEQ ID NO: 4451403 - DNA, 21 bp, Homo sapiens
cacttaacattcctaaaatgc

SEQ ID NO: 4451404 - DNA, 23 bp, Homo sapiens
cacttaaccaagacaaaaagcca

SEQ ID NO: 4451405 - DNA, 13 bp, Homo sapiens
cacttaagactgt

SEQ ID NO: 4451406 - DNA, 12 bp, Homo sapiens
cacttaagcctg

SEQ ID NO: 4451407 - DNA, 12 bp, Homo sapiens
cacttaatagca

SEQ ID NO: 4451408 - DNA, 21 bp, Homo sapiens
cacttaatagcaacagagcac

SEQ ID NO: 4451409 - DNA, 14 bp, Homo sapiens
cacttaatgtttct

SEQ ID NO: 4451410 - DNA, 18 bp, Homo sapiens
cacttaatttgaaatcta

SEQ ID NO: 4451411 - DNA, 23 bp, Homo sapiens
cacttagcaggcaccgccacgtc

SEQ ID NO: 4451412 - DNA, 14 bp, Homo sapiens
cacttatattttat

SEQ ID NO: 4451413 - DNA, 15 bp, Homo sapiens
cacttatctgatact

SEQ ID NO: 4451414 - DNA, 17 bp, Homo sapiens
cacttatcttctggatt

SEQ ID NO: 4451415 - DNA, 18 bp, Homo sapiens
cacttatcttctggatta

SEQ ID NO: 4451416 - DNA, 22 bp, Homo sapiens
cacttattggaactctgcttga

SEQ ID NO: 4451417 - DNA, 18 bp, Homo sapiens
cacttatttgtcaaaata

SEQ ID NO: 4451418 - DNA, 20 bp, Homo sapiens
cacttatttgtcaaaataaa

SEQ ID NO: 4451419 - DNA, 16 bp, Homo sapiens
cacttcacccccaact

SEQ ID NO: 4451420 - DNA, 21 bp, Homo sapiens
cacttcactgcgaagaccctc

SEQ ID NO: 4451421 - DNA, 19 bp, Homo sapiens
cacttcagggctttactcc

SEQ ID NO: 4451422 - DNA, 15 bp, Homo sapiens
cacttcataatccag

SEQ ID NO: 4451423 - DNA, 13 bp, Homo sapiens
cacttccatggga

SEQ ID NO: 4451424 - DNA, 20 bp, Homo sapiens
cacttcgttcgcagagcttt

SEQ ID NO: 4451425 - DNA, 20 bp, Homo sapiens
cacttctagatctcagccat

SEQ ID NO: 4451426 - DNA, 21 bp, Homo sapiens
cacttctagatctcagccatt

SEQ ID NO: 4451427 - DNA, 19 bp, Homo sapiens
cacttctatttatttatta

SEQ ID NO: 4451428 - DNA, 16 bp, Homo sapiens
cacttctccccagaaa

SEQ ID NO: 4451429 - DNA, 12 bp, Homo sapiens
cacttctccccg

SEQ ID NO: 4451430 - DNA, 17 bp, Homo sapiens
cacttctccccgcagcc

SEQ ID NO: 4451431 - DNA, 23 bp, Homo sapiens
cacttctccccgcagcccgcctg

SEQ ID NO: 4451432 - DNA, 20 bp, Homo sapiens
cacttctgggcttcatctgg

SEQ ID NO: 4451433 - DNA, 18 bp, Homo sapiens
cacttctttgcagagcct

SEQ ID NO: 4451434 - DNA, 20 bp, Homo sapiens
cacttgaacccgggaggcag

SEQ ID NO: 4451435 - DNA, 18 bp, Homo sapiens
cacttgaatttattgata

SEQ ID NO: 4451436 - DNA, 21 bp, Homo sapiens
cacttgagaaccagtctcctc

SEQ ID NO: 4451437 - DNA, 19 bp, Homo sapiens
cacttgagccccggaggtc

SEQ ID NO: 4451438 - DNA, 14 bp, Homo sapiens
cacttgatatttat

SEQ ID NO: 4451439 - DNA, 23 bp, Homo sapiens
cacttgccacatggtgtctccca

SEQ ID NO: 4451440 - DNA, 16 bp, Homo sapiens
cacttgggggactggg

SEQ ID NO: 4451441 - DNA, 20 bp, Homo sapiens
cacttgggggttcaggcccg

SEQ ID NO: 4451442 - DNA, 19 bp, Homo sapiens
cacttgtatatatggatca

SEQ ID NO: 4451443 - DNA, 14 bp, Homo sapiens
cacttgtcaaagaa

SEQ ID NO: 4451444 - DNA, 22 bp, Homo sapiens
cacttgtctcattttaatgtaa

SEQ ID NO: 4451445 - DNA, 20 bp, Homo sapiens
cactttaattaccaacctgt

SEQ ID NO: 4451446 - DNA, 23 bp, Homo sapiens
cactttattgccttttaattttt

SEQ ID NO: 4451447 - DNA, 14 bp, Homo sapiens
cactttatttactt

SEQ ID NO: 4451448 - DNA, 14 bp, Homo sapiens
cactttcaagacag

SEQ ID NO: 4451449 - DNA, 15 bp, Homo sapiens
cactttcataatctt

SEQ ID NO: 4451450 - DNA, 17 bp, Homo sapiens
cactttcattgccagtg

SEQ ID NO: 4451451 - DNA, 13 bp, Homo sapiens
cactttgacactt

SEQ ID NO: 4451452 - DNA, 16 bp, Homo sapiens
cactttggcccagggt

SEQ ID NO: 4451453 - DNA, 13 bp, Homo sapiens
cactttgggaggc

SEQ ID NO: 4451454 - DNA, 13 bp, Homo sapiens
cactttgtaaata

SEQ ID NO: 4451455 - DNA, 15 bp, Homo sapiens
cactttgtaaataaa

SEQ ID NO: 4451456 - DNA, 18 bp, Homo sapiens
cactttgtaaataaaaac

SEQ ID NO: 4451457 - DNA, 17 bp, Homo sapiens
cactttgtaatttttgc

SEQ ID NO: 4451458 - DNA, 20 bp, Homo sapiens
cactttgtcgcccaggctgg

SEQ ID NO: 4451459 - DNA, 22 bp, Homo sapiens
cactttgttgcaagatgtgaat

SEQ ID NO: 4451460 - DNA, 23 bp, Homo sapiens
cactttgttgcaagatgtgaatt

SEQ ID NO: 4451461 - DNA, 15 bp, Homo sapiens
cactttgtttagaaa

SEQ ID NO: 4451462 - DNA, 15 bp, Homo sapiens
cagaatgctcctgag

SEQ ID NO: 4451463 - DNA, 11 bp, Homo sapiens
cagaatgctgt

SEQ ID NO: 4451464 - DNA, 19 bp, Homo sapiens
cagaatggaagagagaaag

SEQ ID NO: 4451465 - DNA, 13 bp, Homo sapiens
cagaatgtcagat

SEQ ID NO: 4451466 - DNA, 18 bp, Homo sapiens
cagaatgtgaaaaaggaa

SEQ ID NO: 4451467 - DNA, 12 bp, Homo sapiens
cagaatgtgttc

SEQ ID NO: 4451468 - DNA, 14 bp, Homo sapiens
cagaattatacagt

SEQ ID NO: 4451469 - DNA, 14 bp, Homo sapiens
cagaattcattcat

SEQ ID NO: 4451470 - DNA, 17 bp, Homo sapiens
cagaattcggtgtgctg

SEQ ID NO: 4451471 - DNA, 19 bp, Homo sapiens
cagaattcggtgtgctgcc

SEQ ID NO: 4451472 - DNA, 20 bp, Homo sapiens
cagaattcggtgtgctgcca

SEQ ID NO: 4451473 - DNA, 23 bp, Homo sapiens
cagaattcggtgtgctgccaact

SEQ ID NO: 4451474 - DNA, 22 bp, Homo sapiens
cagaattttctggcctttcatg

SEQ ID NO: 4451475 - DNA, 22 bp, Homo sapiens
cagacaacaccttcctcctgca

SEQ ID NO: 4451476 - DNA, 18 bp, Homo sapiens
cagacaataaaccctcag

SEQ ID NO: 4451477 - DNA, 20 bp, Homo sapiens
cagacaataaaccctcagag

SEQ ID NO: 4451478 - DNA, 14 bp, Homo sapiens
cagacaattagaaa

SEQ ID NO: 4451479 - DNA, 12 bp, Homo sapiens
cagacaccatgt

SEQ ID NO: 4451480 - DNA, 18 bp, Homo sapiens
cagacaccattcattcca

SEQ ID NO: 4451481 - DNA, 18 bp, Homo sapiens
cagacacctaaccccagg

SEQ ID NO: 4451482 - DNA, 19 bp, Homo sapiens
cagacacctaaccccaggg

SEQ ID NO: 4451483 - DNA, 16 bp, Homo sapiens
cagacacctggactga

SEQ ID NO: 4451484 - DNA, 17 bp, Homo sapiens
cagacacctggactgag

SEQ ID NO: 4451485 - DNA, 19 bp, Homo sapiens
cagacacctggactgagcc

SEQ ID NO: 4451486 - DNA, 20 bp, Homo sapiens
cagacactccagtttgccca

SEQ ID NO: 4451487 - DNA, 16 bp, Homo sapiens
cagacagccctggcaa

SEQ ID NO: 4451488 - DNA, 14 bp, Homo sapiens
cagacagcctgtat

SEQ ID NO: 4451489 - DNA, 20 bp, Homo sapiens
cagacaggccctccctgtct

SEQ ID NO: 4451490 - DNA, 20 bp, Homo sapiens
cagacagtcgctcagtctgt

SEQ ID NO: 4451491 - DNA, 14 bp, Homo sapiens
cagacatatttaac

SEQ ID NO: 4451492 - DNA, 16 bp, Homo sapiens
cagacatggtgtctca

SEQ ID NO: 4451493 - DNA, 19 bp, Homo sapiens
cagacatggtgtctcacac

SEQ ID NO: 4451494 - DNA, 15 bp, Homo sapiens
cagacatttatcttt

SEQ ID NO: 4451495 - DNA, 20 bp, Homo sapiens
cagacatttatctttgtatt

SEQ ID NO: 4451496 - DNA, 24 bp, Homo sapiens
cagacatttatctttgtattcttc

SEQ ID NO: 4451497 - DNA, 14 bp, Homo sapiens
cagaccacttgcca

SEQ ID NO: 4451498 - DNA, 18 bp, Homo sapiens
cagaccagagctgtctga

SEQ ID NO: 4451499 - DNA, 21 bp, Homo sapiens
cagaccattggggctcccagc

SEQ ID NO: 4451500 - DNA, 14 bp, Homo sapiens
cagacccagaggtc

SEQ ID NO: 4451501 - DNA, 20 bp, Homo sapiens
cagacccagaggtccaggtc

SEQ ID NO: 4451502 - DNA, 14 bp, Homo sapiens
cagacccaggagtc

SEQ ID NO: 4451503 - DNA, 22 bp, Homo sapiens
cagacccaggagtccagacccc

SEQ ID NO: 4451504 - DNA, 18 bp, Homo sapiens
cagacccaggagtccagc

SEQ ID NO: 4451505 - DNA, 12 bp, Homo sapiens
cagacccagtgg

SEQ ID NO: 4451506 - DNA, 13 bp, Homo sapiens
cagaccccagctg

SEQ ID NO: 4451507 - DNA, 16 bp, Homo sapiens
cagaccccagctgggg

SEQ ID NO: 4451508 - DNA, 17 bp, Homo sapiens
cagaccccagctggggc

SEQ ID NO: 4451509 - DNA, 16 bp, Homo sapiens
cagaccccccagcccc

SEQ ID NO: 4451510 - DNA, 17 bp, Homo sapiens
cagaccccccagcccct

SEQ ID NO: 4451511 - DNA, 12 bp, Homo sapiens
cagacccctgcc

SEQ ID NO: 4451512 - DNA, 17 bp, Homo sapiens
cagaccgcagagaggct

SEQ ID NO: 4451513 - DNA, 16 bp, Homo sapiens
cagacctagcaggctg

SEQ ID NO: 4451514 - DNA, 16 bp, Homo sapiens
cagacctcaagccatc

SEQ ID NO: 4451515 - DNA, 16 bp, Homo sapiens
cagacctcgagtttct

SEQ ID NO: 4451516 - DNA, 17 bp, Homo sapiens
cagacgctgccgctgcc

SEQ ID NO: 4451517 - DNA, 23 bp, Homo sapiens
cagacggatgcccattcctgcct

SEQ ID NO: 4451518 - DNA, 15 bp, Homo sapiens
cagacgtcaggccct

SEQ ID NO: 4451519 - DNA, 14 bp, Homo sapiens
cagacgtctgcctt

SEQ ID NO: 4451520 - DNA, 17 bp, Homo sapiens
cagacgtgaaagccaga

SEQ ID NO: 4451521 - DNA, 14 bp, Homo sapiens
cagacgtgtgacct

SEQ ID NO: 4451522 - DNA, 19 bp, Homo sapiens
cagacgtgtgacctccata

SEQ ID NO: 4451523 - DNA, 19 bp, Homo sapiens
cagactagatgtagtattt

SEQ ID NO: 4451524 - DNA, 15 bp, Homo sapiens
cagactagccactcc

SEQ ID NO: 4451525 - DNA, 20 bp, Homo sapiens
cagactatttttagattttc

SEQ ID NO: 4451526 - DNA, 16 bp, Homo sapiens
cagactcagaggtcca

SEQ ID NO: 4451527 - DNA, 15 bp, Homo sapiens
cagactcaggttcca

SEQ ID NO: 4451528 - DNA, 22 bp, Homo sapiens
cagactcaggttccagaacagc

SEQ ID NO: 4451529 - DNA, 13 bp, Homo sapiens
cagactccatctc

SEQ ID NO: 4451530 - DNA, 14 bp, Homo sapiens
cagactccatctct

SEQ ID NO: 4451531 - DNA, 15 bp, Homo sapiens
cagactccatctctt

SEQ ID NO: 4451532 - DNA, 17 bp, Homo sapiens
cagactccatctcttct

SEQ ID NO: 4451533 - DNA, 20 bp, Homo sapiens
cagactccatctcttctgca

SEQ ID NO: 4451534 - DNA, 15 bp, Homo sapiens
cagactctcagccca

SEQ ID NO: 4451535 - DNA, 11 bp, Homo sapiens
cagactgaaag

SEQ ID NO: 4451536 - DNA, 16 bp, Homo sapiens
cagactgatgagcaca

SEQ ID NO: 4451537 - DNA, 13 bp, Homo sapiens
cagactgcaatat

SEQ ID NO: 4451538 - DNA, 16 bp, Homo sapiens
cagactggaatagtgg

SEQ ID NO: 4451539 - DNA, 22 bp, Homo sapiens
cagactggcacagttttctgag

SEQ ID NO: 4451540 - DNA, 20 bp, Homo sapiens
cagactggcggagaaggaga

SEQ ID NO: 4451541 - DNA, 13 bp, Homo sapiens
cagactgtccagg

SEQ ID NO: 4451542 - DNA, 14 bp, Homo sapiens
cagactgtccaggg

SEQ ID NO: 4451543 - DNA, 15 bp, Homo sapiens
cagactgtccaggga

SEQ ID NO: 4451544 - DNA, 23 bp, Homo sapiens
cagactgtccagggaaacagcct

SEQ ID NO: 4451545 - DNA, 15 bp, Homo sapiens
cagacttcccagcta

SEQ ID NO: 4451546 - DNA, 15 bp, Homo sapiens
cagacttctggccta

SEQ ID NO: 4451547 - DNA, 21 bp, Homo sapiens
cagacttctggcctaggaccc

SEQ ID NO: 4451548 - DNA, 13 bp, Homo sapiens
cagacttgtcaag

SEQ ID NO: 4451549 - DNA, 15 bp, Homo sapiens
cagactttctttttc

SEQ ID NO: 4451550 - DNA, 19 bp, Homo sapiens
cagactttctttttctaca

SEQ ID NO: 4451551 - DNA, 20 bp, Homo sapiens
cagactttgcttcccattgt

SEQ ID NO: 4451552 - DNA, 22 bp, Homo sapiens
cagactttgtgttcatttcatt

SEQ ID NO: 4451553 - DNA, 20 bp, Homo sapiens
cagagaaaatgagaaaggac

SEQ ID NO: 4451554 - DNA, 22 bp, Homo sapiens
cagagaaaatgagaaaggacag

SEQ ID NO: 4451555 - DNA, 14 bp, Homo sapiens
cagagaacctgagt

SEQ ID NO: 4451556 - DNA, 13 bp, Homo sapiens
cagagaagaaaac

SEQ ID NO: 4451557 - DNA, 15 bp, Homo sapiens
cagagaaggaaaaga

SEQ ID NO: 4451558 - DNA, 17 bp, Homo sapiens
cagagaaggcaggaatg

SEQ ID NO: 4451559 - DNA, 23 bp, Homo sapiens
cagagacaacaggtaaaacaggg

SEQ ID NO: 4451560 - DNA, 17 bp, Homo sapiens
cagagacacctgcacct

SEQ ID NO: 4451561 - DNA, 20 bp, Homo sapiens
cagagacacctgcacctccc

SEQ ID NO: 4451562 - DNA, 22 bp, Homo sapiens
cagagacagaggatgtggcctg

SEQ ID NO: 4451563 - DNA, 13 bp, Homo sapiens
cagagacaggaaa

SEQ ID NO: 4451564 - DNA, 22 bp, Homo sapiens
cagagacaggaaaatcctctgg

SEQ ID NO: 4451565 - DNA, 12 bp, Homo sapiens
cagagacctcca

SEQ ID NO: 4451566 - DNA, 10 bp, Homo sapiens
cagagactca

SEQ ID NO: 4451567 - DNA, 12 bp, Homo sapiens
cagagactcaga

SEQ ID NO: 4451568 - DNA, 19 bp, Homo sapiens
cagagagacctcatcctgc

SEQ ID NO: 4451569 - DNA, 20 bp, Homo sapiens
cagagagacctcatcctgct

SEQ ID NO: 4451570 - DNA, 21 bp, Homo sapiens
cagagagcaaaggagaaatct

SEQ ID NO: 4451571 - DNA, 19 bp, Homo sapiens
cagagagcagctccctttc

SEQ ID NO: 4451572 - DNA, 15 bp, Homo sapiens
cagagaggaatcaga

SEQ ID NO: 4451573 - DNA, 13 bp, Homo sapiens
cagagaggagggg

SEQ ID NO: 4451574 - DNA, 17 bp, Homo sapiens
cagagaggatacattta

SEQ ID NO: 4451575 - DNA, 18 bp, Homo sapiens
cagagaggatacatttaa

SEQ ID NO: 4451576 - DNA, 19 bp, Homo sapiens
cagagaggatacatttaat

SEQ ID NO: 4451577 - DNA, 20 bp, Homo sapiens
cagagaggatacatttaata

SEQ ID NO: 4451578 - DNA, 15 bp, Homo sapiens
cagagatgcctccac

SEQ ID NO: 4451579 - DNA, 22 bp, Homo sapiens
cagagatgtccatttttacaag

SEQ ID NO: 4451580 - DNA, 19 bp, Homo sapiens
cagagattcattttctaga

SEQ ID NO: 4451581 - DNA, 15 bp, Homo sapiens
cagcacctttctagc

SEQ ID NO: 4451582 - DNA, 19 bp, Homo sapiens
cagcactaaggccgtgtct

SEQ ID NO: 4451583 - DNA, 19 bp, Homo sapiens
cagcactactgggtgtcat

SEQ ID NO: 4451584 - DNA, 20 bp, Homo sapiens
cagcactagaaattgggcag

SEQ ID NO: 4451585 - DNA, 11 bp, Homo sapiens
cagcactgagg

SEQ ID NO: 4451586 - DNA, 16 bp, Homo sapiens
cagcacttagacctgc

SEQ ID NO: 4451587 - DNA, 17 bp, Homo sapiens
cagcacttagacctgcc

SEQ ID NO: 4451588 - DNA, 13 bp, Homo sapiens
cagcacttccatg

SEQ ID NO: 4451589 - DNA, 23 bp, Homo sapiens
cagcacttgggggttcaggcccg

SEQ ID NO: 4451590 - DNA, 17 bp, Homo sapiens
cagcacttgtctcattt

SEQ ID NO: 4451591 - DNA, 21 bp, Homo sapiens
cagcacttgtctcattttaat

SEQ ID NO: 4451592 - DNA, 18 bp, Homo sapiens
cagcactttgagaggctg

SEQ ID NO: 4451593 - DNA, 20 bp, Homo sapiens
cagcactttgagaggctgag

SEQ ID NO: 4451594 - DNA, 19 bp, Homo sapiens
cagcactttgggaggcagg

SEQ ID NO: 4451595 - DNA, 20 bp, Homo sapiens
cagcactttgggaggcaggg

SEQ ID NO: 4451596 - DNA, 17 bp, Homo sapiens
cagcactttgggaggct

SEQ ID NO: 4451597 - DNA, 12 bp, Homo sapiens
cagcagaagcct

SEQ ID NO: 4451598 - DNA, 21 bp, Homo sapiens
cagcagacaccattcattcca

SEQ ID NO: 4451599 - DNA, 17 bp, Homo sapiens
cagcagagagccctggg

SEQ ID NO: 4451600 - DNA, 16 bp, Homo sapiens
cagcagagccagggca

SEQ ID NO: 4451601 - DNA, 21 bp, Homo sapiens
cagcagagccagggcagggcg

SEQ ID NO: 4451602 - DNA, 23 bp, Homo sapiens
cagcagagggggagtagccaagc

SEQ ID NO: 4451603 - DNA, 15 bp, Homo sapiens
cagcagcaaattttc

SEQ ID NO: 4451604 - DNA, 14 bp, Homo sapiens
cagcagcagagagc

SEQ ID NO: 4451605 - DNA, 16 bp, Homo sapiens
cagcagcagcctgcac

SEQ ID NO: 4451606 - DNA, 17 bp, Homo sapiens
cagcagcagcctgcacc

SEQ ID NO: 4451607 - DNA, 13 bp, Homo sapiens
cagcagcccccca

SEQ ID NO: 4451608 - DNA, 14 bp, Homo sapiens
cagcagccctcctc

SEQ ID NO: 4451609 - DNA, 12 bp, Homo sapiens
cagcagcctgca

SEQ ID NO: 4451610 - DNA, 13 bp, Homo sapiens
cagcagcctgcac

SEQ ID NO: 4451611 - DNA, 16 bp, Homo sapiens
cagcagcctgcacctg

SEQ ID NO: 4451612 - DNA, 20 bp, Homo sapiens
cagcagcgaccacccctgcc

SEQ ID NO: 4451613 - DNA, 19 bp, Homo sapiens
cagcagctctggctctgcc

SEQ ID NO: 4451614 - DNA, 17 bp, Homo sapiens
cagcagcttaagtccag

SEQ ID NO: 4451615 - DNA, 22 bp, Homo sapiens
cagcaggaaggaacaaagacag

SEQ ID NO: 4451616 - DNA, 21 bp, Homo sapiens
cagcaggagagactgagcagc

SEQ ID NO: 4451617 - DNA, 13 bp, Homo sapiens
cagcaggcgggct

SEQ ID NO: 4451618 - DNA, 19 bp, Homo sapiens
cagcaggcgggctcctttg

SEQ ID NO: 4451619 - DNA, 15 bp, Homo sapiens
cagcaggctcaggca

SEQ ID NO: 4451620 - DNA, 17 bp, Homo sapiens
cagcaggctcaggcaca

SEQ ID NO: 4451621 - DNA, 19 bp, Homo sapiens
cagcaggctgccagtgcct

SEQ ID NO: 4451622 - DNA, 21 bp, Homo sapiens
cagcagggctaccctgagctg

SEQ ID NO: 4451623 - DNA, 17 bp, Homo sapiens
cagcaggtgtacacatg

SEQ ID NO: 4451624 - DNA, 18 bp, Homo sapiens
cagcagtcgcccaagcag

SEQ ID NO: 4451625 - DNA, 21 bp, Homo sapiens
cagcagtcgcccaagcagaca

SEQ ID NO: 4451626 - DNA, 18 bp, Homo sapiens
cagcagtgtccagagacc

SEQ ID NO: 4451627 - DNA, 21 bp, Homo sapiens
cagcagtgtgaatagcctggc

SEQ ID NO: 4451628 - DNA, 17 bp, Homo sapiens
cagcagtgtgaggccag

SEQ ID NO: 4451629 - DNA, 19 bp, Homo sapiens
cagcagtgtgaggccaggg

SEQ ID NO: 4451630 - DNA, 18 bp, Homo sapiens
cagcagtgtggagaccct

SEQ ID NO: 4451631 - DNA, 23 bp, Homo sapiens
cagcagttcacaaaaaaatgttc

SEQ ID NO: 4451632 - DNA, 22 bp, Homo sapiens
cagcagttgaaaagactccaaa

SEQ ID NO: 4451633 - DNA, 16 bp, Homo sapiens
cagcatcagaaatcct

SEQ ID NO: 4451634 - DNA, 20 bp, Homo sapiens
cagcatccctggagcaggag

SEQ ID NO: 4451635 - DNA, 22 bp, Homo sapiens
cagcatccctggagcaggagcc

SEQ ID NO: 4451636 - DNA, 16 bp, Homo sapiens
cagcatcccttcccac

SEQ ID NO: 4451637 - DNA, 23 bp, Homo sapiens
cagcatccgcaggtgctggtccc

SEQ ID NO: 4451638 - DNA, 21 bp, Homo sapiens
cagcatcggacaagaccccca

SEQ ID NO: 4451639 - DNA, 22 bp, Homo sapiens
cagcatcggacaagacccccag

SEQ ID NO: 4451640 - DNA, 15 bp, Homo sapiens
cagcatcgggagcac

SEQ ID NO: 4451641 - DNA, 18 bp, Homo sapiens
cagcatcgggagcaccca

SEQ ID NO: 4451642 - DNA, 19 bp, Homo sapiens
cagcatcgggagcacccag

SEQ ID NO: 4451643 - DNA, 22 bp, Homo sapiens
cagcatcgggagcacccagagc

SEQ ID NO: 4451644 - DNA, 18 bp, Homo sapiens
cagcatgtatagttgctt

SEQ ID NO: 4451645 - DNA, 20 bp, Homo sapiens
cagcatgtgttaatcttaat

SEQ ID NO: 4451646 - DNA, 14 bp, Homo sapiens
cagcattccagact

SEQ ID NO: 4451647 - DNA, 12 bp, Homo sapiens
cagcattccagc

SEQ ID NO: 4451648 - DNA, 16 bp, Homo sapiens
cagcattccagctctg

SEQ ID NO: 4451649 - DNA, 16 bp, Homo sapiens
cagcatttacttgaag

SEQ ID NO: 4451650 - DNA, 20 bp, Homo sapiens
cagcatttccacaccaagca

SEQ ID NO: 4451651 - DNA, 23 bp, Homo sapiens
cagcatttccacaccaagcagca

SEQ ID NO: 4451652 - DNA, 11 bp, Homo sapiens
cagcatttgat

SEQ ID NO: 4451653 - DNA, 12 bp, Homo sapiens
cagcatttgata

SEQ ID NO: 4451654 - DNA, 15 bp, Homo sapiens
cagcatttgataatg

SEQ ID NO: 4451655 - DNA, 13 bp, Homo sapiens
cagcatttgatga

SEQ ID NO: 4451656 - DNA, 11 bp, Homo sapiens
cagccaaagtc

SEQ ID NO: 4451657 - DNA, 14 bp, Homo sapiens
cagccaaatttaaa

SEQ ID NO: 4451658 - DNA, 17 bp, Homo sapiens
cagccaacgagacacat

SEQ ID NO: 4451659 - DNA, 20 bp, Homo sapiens
cagccaacgagacacattgc

SEQ ID NO: 4451660 - DNA, 16 bp, Homo sapiens
cagccaactagcccct

SEQ ID NO: 4451661 - DNA, 20 bp, Homo sapiens
cagccaagattttcctcttg

SEQ ID NO: 4451662 - DNA, 22 bp, Homo sapiens
cagccaagattttcctcttgtg

SEQ ID NO: 4451663 - DNA, 17 bp, Homo sapiens
cagccaagggtcctcac

SEQ ID NO: 4451664 - DNA, 14 bp, Homo sapiens
cagccaagtgcaga

SEQ ID NO: 4451665 - DNA, 16 bp, Homo sapiens
cagccacatgccccag

SEQ ID NO: 4451666 - DNA, 19 bp, Homo sapiens
cagccacccaagcctgctg

SEQ ID NO: 4451667 - DNA, 20 bp, Homo sapiens
cagccacccaagcctgctgg

SEQ ID NO: 4451668 - DNA, 17 bp, Homo sapiens
cagccaccccgggctct

SEQ ID NO: 4451669 - DNA, 20 bp, Homo sapiens
cagccaccccgggctctctg

SEQ ID NO: 4451670 - DNA, 14 bp, Homo sapiens
cagccactgtcaca

SEQ ID NO: 4451671 - DNA, 16 bp, Homo sapiens
cagccactgtcacagg

SEQ ID NO: 4451672 - DNA, 17 bp, Homo sapiens
cagccactgtcacaggc

SEQ ID NO: 4451673 - DNA, 18 bp, Homo sapiens
cagccactgtcacaggca

SEQ ID NO: 4451674 - DNA, 16 bp, Homo sapiens
cagccagaccagcagg

SEQ ID NO: 4451675 - DNA, 18 bp, Homo sapiens
cagccagaccccacgctg

SEQ ID NO: 4451676 - DNA, 22 bp, Homo sapiens
cagccagatggactccagcctg

SEQ ID NO: 4451677 - DNA, 13 bp, Homo sapiens
cagccagcccagc

SEQ ID NO: 4451678 - DNA, 14 bp, Homo sapiens
cagccagcccagcc

SEQ ID NO: 4451679 - DNA, 21 bp, Homo sapiens
cagccagcccatggcccccaa

SEQ ID NO: 4451680 - DNA, 16 bp, Homo sapiens
cagccagccgccctgg

SEQ ID NO: 4451681 - DNA, 17 bp, Homo sapiens
cagccagcgcctccctc

SEQ ID NO: 4451682 - DNA, 14 bp, Homo sapiens
cagccaggctctgt

SEQ ID NO: 4451683 - DNA, 17 bp, Homo sapiens
cagccaggctctgtgct

SEQ ID NO: 4451684 - DNA, 17 bp, Homo sapiens
cagccagggcaagagag

SEQ ID NO: 4451685 - DNA, 13 bp, Homo sapiens
cagccagggctgg

SEQ ID NO: 4451686 - DNA, 14 bp, Homo sapiens
cagccagggctggg

SEQ ID NO: 4451687 - DNA, 15 bp, Homo sapiens
cagccaggtgccttg

SEQ ID NO: 4451688 - DNA, 18 bp, Homo sapiens
cagccaggtggcacctgc

SEQ ID NO: 4451689 - DNA, 16 bp, Homo sapiens
cagccagtagcctaaa

SEQ ID NO: 4451690 - DNA, 20 bp, Homo sapiens
cagccatcgtcctgggactc

SEQ ID NO: 4451691 - DNA, 18 bp, Homo sapiens
cagccatgaggagttgct

SEQ ID NO: 4451692 - DNA, 12 bp, Homo sapiens
cagcccacagag

SEQ ID NO: 4451693 - DNA, 14 bp, Homo sapiens
cagcccacagagcc

SEQ ID NO: 4451694 - DNA, 15 bp, Homo sapiens
cagcccacagagcct

SEQ ID NO: 4451695 - DNA, 17 bp, Homo sapiens
cagcccacagagcctga

SEQ ID NO: 4451696 - DNA, 12 bp, Homo sapiens
cagcccaccctc

SEQ ID NO: 4451697 - DNA, 16 bp, Homo sapiens
cagcccaccctcctgt

SEQ ID NO: 4451698 - DNA, 21 bp, Homo sapiens
cagcccaccctcctgtcttcc

SEQ ID NO: 4451699 - DNA, 12 bp, Homo sapiens
cagcctgggcca

SEQ ID NO: 4451700 - DNA, 15 bp, Homo sapiens
cagcctgggtcacag

SEQ ID NO: 4451701 - DNA, 21 bp, Homo sapiens
cagcctgtggcatctttgcct

SEQ ID NO: 4451702 - DNA, 12 bp, Homo sapiens
cagcctgtggcg

SEQ ID NO: 4451703 - DNA, 19 bp, Homo sapiens
cagcctgtggcggtgcctg

SEQ ID NO: 4451704 - DNA, 21 bp, Homo sapiens
cagcctgtggcggtgcctggg

SEQ ID NO: 4451705 - DNA, 18 bp, Homo sapiens
cagccttatgtgttacat

SEQ ID NO: 4451706 - DNA, 18 bp, Homo sapiens
cagccttcaagaatcaga

SEQ ID NO: 4451707 - DNA, 22 bp, Homo sapiens
cagccttcaagaatcagaagaa

SEQ ID NO: 4451708 - DNA, 14 bp, Homo sapiens
cagccttcccctcc

SEQ ID NO: 4451709 - DNA, 19 bp, Homo sapiens
cagccttccgggaactgga

SEQ ID NO: 4451710 - DNA, 16 bp, Homo sapiens
cagccttcctgggtgt

SEQ ID NO: 4451711 - DNA, 22 bp, Homo sapiens
cagccttctccatatctccatg

SEQ ID NO: 4451712 - DNA, 15 bp, Homo sapiens
cagccttgagccctg

SEQ ID NO: 4451713 - DNA, 16 bp, Homo sapiens
cagccttgagccctgg

SEQ ID NO: 4451714 - DNA, 20 bp, Homo sapiens
cagccttgcagcggctcctg

SEQ ID NO: 4451715 - DNA, 21 bp, Homo sapiens
cagccttgcagcggctcctgc

SEQ ID NO: 4451716 - DNA, 22 bp, Homo sapiens
cagccttgcagcggctcctgca

SEQ ID NO: 4451717 - DNA, 14 bp, Homo sapiens
cagccttgcccagc

SEQ ID NO: 4451718 - DNA, 15 bp, Homo sapiens
cagccttgcccagct

SEQ ID NO: 4451719 - DNA, 21 bp, Homo sapiens
cagccttgctacttgaaggta

SEQ ID NO: 4451720 - DNA, 14 bp, Homo sapiens
cagccttgctctct

SEQ ID NO: 4451721 - DNA, 23 bp, Homo sapiens
cagccttgctctcttcaataaac

SEQ ID NO: 4451722 - DNA, 13 bp, Homo sapiens
cagccttttcctt

SEQ ID NO: 4451723 - DNA, 23 bp, Homo sapiens
cagccttttttcctgggccagaa

SEQ ID NO: 4451724 - DNA, 21 bp, Homo sapiens
cagcgaaaggatgtaaacagt

SEQ ID NO: 4451725 - DNA, 16 bp, Homo sapiens
cagcgaccacccctgc

SEQ ID NO: 4451726 - DNA, 16 bp, Homo sapiens
cagcgaggaggctcca

SEQ ID NO: 4451727 - DNA, 17 bp, Homo sapiens
cagcgaggaggctccag

SEQ ID NO: 4451728 - DNA, 20 bp, Homo sapiens
cagcgatggtgctgcccagg

SEQ ID NO: 4451729 - DNA, 22 bp, Homo sapiens
cagcgatggtgctgcccaggcc

SEQ ID NO: 4451730 - DNA, 21 bp, Homo sapiens
cagcgcagactggcggagaag

SEQ ID NO: 4451731 - DNA, 21 bp, Homo sapiens
cagcgccaagtaaacagggta

SEQ ID NO: 4451732 - DNA, 14 bp, Homo sapiens
cagcgccccaccac

SEQ ID NO: 4451733 - DNA, 18 bp, Homo sapiens
cagcgcctccctccaccc

SEQ ID NO: 4451734 - DNA, 16 bp, Homo sapiens
cagcgcggtcctgact

SEQ ID NO: 4451735 - DNA, 22 bp, Homo sapiens
cagcgctcgatggacctcagca

SEQ ID NO: 4451736 - DNA, 13 bp, Homo sapiens
cagcgctcgctga

SEQ ID NO: 4451737 - DNA, 16 bp, Homo sapiens
cagcggctcccctctg

SEQ ID NO: 4451738 - DNA, 22 bp, Homo sapiens
cagcggctcccctctgcttctc

SEQ ID NO: 4451739 - DNA, 14 bp, Homo sapiens
cagcggctgccctc

SEQ ID NO: 4451740 - DNA, 21 bp, Homo sapiens
cagcgggctggcgggcctttt

SEQ ID NO: 4451741 - DNA, 23 bp, Homo sapiens
cagcggtgcagcgtgtgtgccac

SEQ ID NO: 4451742 - DNA, 13 bp, Homo sapiens
cagcgtcagaagt

SEQ ID NO: 4451743 - DNA, 14 bp, Homo sapiens
cagcgtcccctgct

SEQ ID NO: 4451744 - DNA, 14 bp, Homo sapiens
cagcgtccctggcg

SEQ ID NO: 4451745 - DNA, 16 bp, Homo sapiens
cagcgtcctcctctgt

SEQ ID NO: 4451746 - DNA, 19 bp, Homo sapiens
cagcgtttttacctaggca

SEQ ID NO: 4451747 - DNA, 22 bp, Homo sapiens
cagctaaccacttcgcacacac

SEQ ID NO: 4451748 - DNA, 23 bp, Homo sapiens
cagctaaccacttcgcacacacc

SEQ ID NO: 4451749 - DNA, 17 bp, Homo sapiens
cagctaacccgtgcaga

SEQ ID NO: 4451750 - DNA, 13 bp, Homo sapiens
cagctaatgtcac

SEQ ID NO: 4451751 - DNA, 17 bp, Homo sapiens
cagctacaaacttttaa

SEQ ID NO: 4451752 - DNA, 16 bp, Homo sapiens
cagctaccaagtcaga

SEQ ID NO: 4451753 - DNA, 16 bp, Homo sapiens
cagctactcaggaggc

SEQ ID NO: 4451754 - DNA, 18 bp, Homo sapiens
cagctactcaggaggctg

SEQ ID NO: 4451755 - DNA, 15 bp, Homo sapiens
cagctactggaatgg

SEQ ID NO: 4451756 - DNA, 18 bp, Homo sapiens
cagctactggaatggtgt

SEQ ID NO: 4451757 - DNA, 19 bp, Homo sapiens
cagctactggggaggctga

SEQ ID NO: 4451758 - DNA, 19 bp, Homo sapiens
cagctacttgggaggctga

SEQ ID NO: 4451759 - DNA, 16 bp, Homo sapiens
cagctagaatttctgg

SEQ ID NO: 4451760 - DNA, 21 bp, Homo sapiens
cagctaggaagagcaggactc

SEQ ID NO: 4451761 - DNA, 15 bp, Homo sapiens
cagctagtgccaaat

SEQ ID NO: 4451762 - DNA, 13 bp, Homo sapiens
cagctatatttga

SEQ ID NO: 4451763 - DNA, 15 bp, Homo sapiens
cagctatatttgatt

SEQ ID NO: 4451764 - DNA, 21 bp, Homo sapiens
cagctatatttgattatgtat

SEQ ID NO: 4451765 - DNA, 21 bp, Homo sapiens
cagctatgcgcaatgtggcat

SEQ ID NO: 4451766 - DNA, 14 bp, Homo sapiens
cagctattttgtga

SEQ ID NO: 4451767 - DNA, 18 bp, Homo sapiens
cagctcacctcaacctcc

SEQ ID NO: 4451768 - DNA, 16 bp, Homo sapiens
cagctcattaaacttt

SEQ ID NO: 4451769 - DNA, 13 bp, Homo sapiens
cagctccacacgc

SEQ ID NO: 4451770 - DNA, 15 bp, Homo sapiens
cagctccacacgccc

SEQ ID NO: 4451771 - DNA, 12 bp, Homo sapiens
cagctcccaccc

SEQ ID NO: 4451772 - DNA, 22 bp, Homo sapiens
cagctcccaccccacccccttc

SEQ ID NO: 4451773 - DNA, 20 bp, Homo sapiens
cagctcccctcggagaagag

SEQ ID NO: 4451774 - DNA, 12 bp, Homo sapiens
cagctcccctct

SEQ ID NO: 4451775 - DNA, 13 bp, Homo sapiens
cagctcccctctt

SEQ ID NO: 4451776 - DNA, 14 bp, Homo sapiens
cagctccctttctc

SEQ ID NO: 4451777 - DNA, 16 bp, Homo sapiens
cagctccgggatcagc

SEQ ID NO: 4451778 - DNA, 21 bp, Homo sapiens
cagctcctggaccaggcccat

SEQ ID NO: 4451779 - DNA, 16 bp, Homo sapiens
cagctcctttctcctg

SEQ ID NO: 4451780 - DNA, 22 bp, Homo sapiens
cagctcgatccaaattgtgctt

SEQ ID NO: 4451781 - DNA, 18 bp, Homo sapiens
cagctcgtgtgtcctcat

SEQ ID NO: 4451782 - DNA, 12 bp, Homo sapiens
cagctctaggct

SEQ ID NO: 4451783 - DNA, 18 bp, Homo sapiens
cagctctaggctgttctg

SEQ ID NO: 4451784 - DNA, 23 bp, Homo sapiens
cagctctaggctgttctgtagct

SEQ ID NO: 4451785 - DNA, 20 bp, Homo sapiens
cagctctagttttcagcctt

SEQ ID NO: 4451786 - DNA, 12 bp, Homo sapiens
cagctctccctc

SEQ ID NO: 4451787 - DNA, 14 bp, Homo sapiens
cagctctccctctg

SEQ ID NO: 4451788 - DNA, 19 bp, Homo sapiens
cagctctccctctggccct

SEQ ID NO: 4451789 - DNA, 20 bp, Homo sapiens
cagctctctgggacctcctt

SEQ ID NO: 4451790 - DNA, 18 bp, Homo sapiens
cagctctgaaaccagtgt

SEQ ID NO: 4451791 - DNA, 22 bp, Homo sapiens
cagctctgagccagattacagg

SEQ ID NO: 4451792 - DNA, 20 bp, Homo sapiens
cagctctgcatactcattag

SEQ ID NO: 4451793 - DNA, 14 bp, Homo sapiens
cagctctgcccccg

SEQ ID NO: 4451794 - DNA, 12 bp, Homo sapiens
cagctctggctc

SEQ ID NO: 4451795 - DNA, 19 bp, Homo sapiens
cagctctggctctgcctca

SEQ ID NO: 4451796 - DNA, 17 bp, Homo sapiens
cagctctggggcagagg

SEQ ID NO: 4451797 - DNA, 22 bp, Homo sapiens
cagctctttgaaatagtctgtg

SEQ ID NO: 4451798 - DNA, 14 bp, Homo sapiens
cagctgaccgggct

SEQ ID NO: 4451799 - DNA, 13 bp, Homo sapiens
cagctgcaaagtg

SEQ ID NO: 4451800 - DNA, 19 bp, Homo sapiens
cagctgcaaggtactctgg

SEQ ID NO: 4451801 - DNA, 22 bp, Homo sapiens
cagctgcaaggtactctggtga

SEQ ID NO: 4451802 - DNA, 15 bp, Homo sapiens
cagctgccccagcca

SEQ ID NO: 4451803 - DNA, 18 bp, Homo sapiens
cagctgcccttgcagggt

SEQ ID NO: 4451804 - DNA, 14 bp, Homo sapiens
cagctgcctctgct

SEQ ID NO: 4451805 - DNA, 17 bp, Homo sapiens
cagctgcctctgctccc

SEQ ID NO: 4451806 - DNA, 19 bp, Homo sapiens
cagctgccttagcttcagg

SEQ ID NO: 4451807 - DNA, 18 bp, Homo sapiens
cagctgcggccaggcctg

SEQ ID NO: 4451808 - DNA, 22 bp, Homo sapiens
cagctgcggccaggcctgcggg

SEQ ID NO: 4451809 - DNA, 16 bp, Homo sapiens
cagctgctatccccat

SEQ ID NO: 4451810 - DNA, 18 bp, Homo sapiens
cagctgctatccccatct

SEQ ID NO: 4451811 - DNA, 23 bp, Homo sapiens
cagctgctatccccatctccctg

SEQ ID NO: 4451812 - DNA, 15 bp, Homo sapiens
cagctgctcccctgg

SEQ ID NO: 4451813 - DNA, 21 bp, Homo sapiens
cagctgctgagatcctggact

SEQ ID NO: 4451814 - DNA, 22 bp, Homo sapiens
cagctgctggagaataaatttg

SEQ ID NO: 4451815 - DNA, 18 bp, Homo sapiens
cagctgctggatgacttg

SEQ ID NO: 4451816 - DNA, 17 bp, Homo sapiens
cagctgctgtctgagta

SEQ ID NO: 4451817 - DNA, 15 bp, Homo sapiens
caggccagcccagcc

SEQ ID NO: 4451818 - DNA, 18 bp, Homo sapiens
caggccagcccagccagg

SEQ ID NO: 4451819 - DNA, 11 bp, Homo sapiens
caggccagcct

SEQ ID NO: 4451820 - DNA, 15 bp, Homo sapiens
caggccagcctccga

SEQ ID NO: 4451821 - DNA, 21 bp, Homo sapiens
caggccagcctccgagaggga

SEQ ID NO: 4451822 - DNA, 14 bp, Homo sapiens
caggccagctcagg

SEQ ID NO: 4451823 - DNA, 15 bp, Homo sapiens
caggccagctcagga

SEQ ID NO: 4451824 - DNA, 12 bp, Homo sapiens
caggccagctgc

SEQ ID NO: 4451825 - DNA, 18 bp, Homo sapiens
caggccagctgcggccag

SEQ ID NO: 4451826 - DNA, 20 bp, Homo sapiens
caggccattgtgaaccaatg

SEQ ID NO: 4451827 - DNA, 14 bp, Homo sapiens
caggcccactcccc

SEQ ID NO: 4451828 - DNA, 23 bp, Homo sapiens
caggcccactccccagccccagc

SEQ ID NO: 4451829 - DNA, 16 bp, Homo sapiens
caggcccaggagtcca

SEQ ID NO: 4451830 - DNA, 17 bp, Homo sapiens
caggcccaggagtccag

SEQ ID NO: 4451831 - DNA, 15 bp, Homo sapiens
caggccccagcctcc

SEQ ID NO: 4451832 - DNA, 19 bp, Homo sapiens
caggccccagcctccaggc

SEQ ID NO: 4451833 - DNA, 19 bp, Homo sapiens
caggccccaggggagaaag

SEQ ID NO: 4451834 - DNA, 19 bp, Homo sapiens
caggcccccaacccctcct

SEQ ID NO: 4451835 - DNA, 22 bp, Homo sapiens
caggcccccaacccctcctccc

SEQ ID NO: 4451836 - DNA, 21 bp, Homo sapiens
caggcccccagcccctcctcc

SEQ ID NO: 4451837 - DNA, 23 bp, Homo sapiens
caggcccccagcccctcctccct

SEQ ID NO: 4451838 - DNA, 20 bp, Homo sapiens
caggcccccaggtgccagtt

SEQ ID NO: 4451839 - DNA, 22 bp, Homo sapiens
caggccccgaggacccagaccc

SEQ ID NO: 4451840 - DNA, 23 bp, Homo sapiens
caggccccgcttgtccagcgcct

SEQ ID NO: 4451841 - DNA, 13 bp, Homo sapiens
caggcccctggag

SEQ ID NO: 4451842 - DNA, 23 bp, Homo sapiens
caggcccctggaggctgcctccc

SEQ ID NO: 4451843 - DNA, 19 bp, Homo sapiens
caggcccgagcgcctgcgt

SEQ ID NO: 4451844 - DNA, 18 bp, Homo sapiens
caggcccggcgcggtggc

SEQ ID NO: 4451845 - DNA, 14 bp, Homo sapiens
caggcccggggctg

SEQ ID NO: 4451846 - DNA, 15 bp, Homo sapiens
caggcccggggctgg

SEQ ID NO: 4451847 - DNA, 20 bp, Homo sapiens
caggcccgtcagcatcactg

SEQ ID NO: 4451848 - DNA, 16 bp, Homo sapiens
caggccctccctgact

SEQ ID NO: 4451849 - DNA, 22 bp, Homo sapiens
caggccctccctgactccctgt

SEQ ID NO: 4451850 - DNA, 14 bp, Homo sapiens
caggccctccctgt

SEQ ID NO: 4451851 - DNA, 16 bp, Homo sapiens
caggccctccctgtct

SEQ ID NO: 4451852 - DNA, 17 bp, Homo sapiens
caggccctccctgtctc

SEQ ID NO: 4451853 - DNA, 20 bp, Homo sapiens
caggccctgactcctctggc

SEQ ID NO: 4451854 - DNA, 13 bp, Homo sapiens
caggccgagagcc

SEQ ID NO: 4451855 - DNA, 16 bp, Homo sapiens
caggccggcccagatg

SEQ ID NO: 4451856 - DNA, 16 bp, Homo sapiens
caggccgtgccttgtt

SEQ ID NO: 4451857 - DNA, 12 bp, Homo sapiens
caggcctccctc

SEQ ID NO: 4451858 - DNA, 13 bp, Homo sapiens
caggcctccctct

SEQ ID NO: 4451859 - DNA, 18 bp, Homo sapiens
caggcctccctctctctt

SEQ ID NO: 4451860 - DNA, 19 bp, Homo sapiens
caggcctctcggtgctcca

SEQ ID NO: 4451861 - DNA, 20 bp, Homo sapiens
caggcctctggttgcctccc

SEQ ID NO: 4451862 - DNA, 15 bp, Homo sapiens
caggcctcttggcag

SEQ ID NO: 4451863 - DNA, 15 bp, Homo sapiens
caggcctgactctca

SEQ ID NO: 4451864 - DNA, 14 bp, Homo sapiens
caggcctgagattt

SEQ ID NO: 4451865 - DNA, 21 bp, Homo sapiens
caggcctgagatttcatctgc

SEQ ID NO: 4451866 - DNA, 22 bp, Homo sapiens
caggcctgcattactccttcag

SEQ ID NO: 4451867 - DNA, 15 bp, Homo sapiens
caggcctgcctccca

SEQ ID NO: 4451868 - DNA, 16 bp, Homo sapiens
caggcctgcctcccac

SEQ ID NO: 4451869 - DNA, 17 bp, Homo sapiens
caggcctgcctcccact

SEQ ID NO: 4451870 - DNA, 18 bp, Homo sapiens
caggcctgcgggcccctg

SEQ ID NO: 4451871 - DNA, 21 bp, Homo sapiens
caggcctgcgggcccctggtg

SEQ ID NO: 4451872 - DNA, 17 bp, Homo sapiens
caggcctgctagtcact

SEQ ID NO: 4451873 - DNA, 14 bp, Homo sapiens
caggcctggcctca

SEQ ID NO: 4451874 - DNA, 15 bp, Homo sapiens
caggcctggcctcat

SEQ ID NO: 4451875 - DNA, 21 bp, Homo sapiens
caggcctggctggaggagcag

SEQ ID NO: 4451876 - DNA, 22 bp, Homo sapiens
caggcggagctgctgagtgaca

SEQ ID NO: 4451877 - DNA, 17 bp, Homo sapiens
caggcgggacagtgctg

SEQ ID NO: 4451878 - DNA, 22 bp, Homo sapiens
caggcggtgaggagtccagcac

SEQ ID NO: 4451879 - DNA, 22 bp, Homo sapiens
caggctaatttttttgtatttt

SEQ ID NO: 4451880 - DNA, 17 bp, Homo sapiens
caggctactgttcttga

SEQ ID NO: 4451881 - DNA, 18 bp, Homo sapiens
caggctactgttcttgac

SEQ ID NO: 4451882 - DNA, 16 bp, Homo sapiens
caggctcaagttttta

SEQ ID NO: 4451883 - DNA, 13 bp, Homo sapiens
caggctcactgcc

SEQ ID NO: 4451884 - DNA, 14 bp, Homo sapiens
caggctcactgcca

SEQ ID NO: 4451885 - DNA, 16 bp, Homo sapiens
caggctcactgccagg

SEQ ID NO: 4451886 - DNA, 18 bp, Homo sapiens
caggctcactgccaggcc

SEQ ID NO: 4451887 - DNA, 20 bp, Homo sapiens
caggctcactgccaggccag

SEQ ID NO: 4451888 - DNA, 21 bp, Homo sapiens
caggctcactgccaggccagc

SEQ ID NO: 4451889 - DNA, 16 bp, Homo sapiens
caggctccctttctct

SEQ ID NO: 4451890 - DNA, 21 bp, Homo sapiens
caggctccgggcaccaggggc

SEQ ID NO: 4451891 - DNA, 22 bp, Homo sapiens
caggctccgggcaccaggggcc

SEQ ID NO: 4451892 - DNA, 14 bp, Homo sapiens
caggctctcctggc

SEQ ID NO: 4451893 - DNA, 18 bp, Homo sapiens
caggctctgtgctgaccc

SEQ ID NO: 4451894 - DNA, 19 bp, Homo sapiens
caggctctgtgctgaccct

SEQ ID NO: 4451895 - DNA, 23 bp, Homo sapiens
caggctgagagccggccgtggaa

SEQ ID NO: 4451896 - DNA, 21 bp, Homo sapiens
caggctgagtccctccatgca

SEQ ID NO: 4451897 - DNA, 15 bp, Homo sapiens
caggctgcagaggca

SEQ ID NO: 4451898 - DNA, 21 bp, Homo sapiens
caggctgccaaggccagagtg

SEQ ID NO: 4451899 - DNA, 19 bp, Homo sapiens
caggctgcctcctgccctt

SEQ ID NO: 4451900 - DNA, 11 bp, Homo sapiens
caggctgctgg

SEQ ID NO: 4451901 - DNA, 13 bp, Homo sapiens
caggctgctggcg

SEQ ID NO: 4451902 - DNA, 18 bp, Homo sapiens
caggctgctggcgcctct

SEQ ID NO: 4451903 - DNA, 15 bp, Homo sapiens
caggctggactgcag

SEQ ID NO: 4451904 - DNA, 21 bp, Homo sapiens
caggctggccagtgctgccca

SEQ ID NO: 4451905 - DNA, 24 bp, Homo sapiens
caggctggccagtgctgcccatga

SEQ ID NO: 4451906 - DNA, 15 bp, Homo sapiens
caggctgggaagtgt

SEQ ID NO: 4451907 - DNA, 14 bp, Homo sapiens
caggctgggacgga

SEQ ID NO: 4451908 - DNA, 20 bp, Homo sapiens
caggctgggacggaccagca

SEQ ID NO: 4451909 - DNA, 10 bp, Homo sapiens
caggctgggc

SEQ ID NO: 4451910 - DNA, 13 bp, Homo sapiens
caggctgggccat

SEQ ID NO: 4451911 - DNA, 17 bp, Homo sapiens
caggctggggaggtgct

SEQ ID NO: 4451912 - DNA, 21 bp, Homo sapiens
caggctggggaggtgctgggg

SEQ ID NO: 4451913 - DNA, 16 bp, Homo sapiens
caggctgggtcctgcc

SEQ ID NO: 4451914 - DNA, 19 bp, Homo sapiens
caggctgggtcctgccagc

SEQ ID NO: 4451915 - DNA, 21 bp, Homo sapiens
caggcttactgagctgtccag

SEQ ID NO: 4451916 - DNA, 22 bp, Homo sapiens
caggctttatgtacaaacatgt

SEQ ID NO: 4451917 - DNA, 14 bp, Homo sapiens
caggcttttgtttc

SEQ ID NO: 4451918 - DNA, 17 bp, Homo sapiens
cagggaaaattgcccca

SEQ ID NO: 4451919 - DNA, 20 bp, Homo sapiens
cagggaaacagcctctctct

SEQ ID NO: 4451920 - DNA, 14 bp, Homo sapiens
cagggaagcctggg

SEQ ID NO: 4451921 - DNA, 14 bp, Homo sapiens
cagggaagctggcc

SEQ ID NO: 4451922 - DNA, 16 bp, Homo sapiens
cagggaaggcctgact

SEQ ID NO: 4451923 - DNA, 23 bp, Homo sapiens
cagggaaggcctgacttctgctg

SEQ ID NO: 4451924 - DNA, 19 bp, Homo sapiens
cagggaaggtggccacagc

SEQ ID NO: 4451925 - DNA, 16 bp, Homo sapiens
cagggaatgcagcagg

SEQ ID NO: 4451926 - DNA, 17 bp, Homo sapiens
cagggacaccagccagg

SEQ ID NO: 4451927 - DNA, 22 bp, Homo sapiens
cagggacaccagccaggctctg

SEQ ID NO: 4451928 - DNA, 18 bp, Homo sapiens
cagggacagagacacctg

SEQ ID NO: 4451929 - DNA, 17 bp, Homo sapiens
cagggacatgccctgtg

SEQ ID NO: 4451930 - DNA, 20 bp, Homo sapiens
cagggaccactgggtgagag

SEQ ID NO: 4451931 - DNA, 18 bp, Homo sapiens
cagggaccatcaagaacc

SEQ ID NO: 4451932 - DNA, 23 bp, Homo sapiens
cagggaccggcggaccccagcca

SEQ ID NO: 4451933 - DNA, 15 bp, Homo sapiens
cagggaccggtgctg

SEQ ID NO: 4451934 - DNA, 13 bp, Homo sapiens
cagggacctgctg

SEQ ID NO: 4451935 - DNA, 17 bp, Homo sapiens
cagggtgggaagaaaga

SEQ ID NO: 4451936 - DNA, 17 bp, Homo sapiens
cagggtgggagggagga

SEQ ID NO: 4451937 - DNA, 21 bp, Homo sapiens
cagggtgggagggaggaggga

SEQ ID NO: 4451938 - DNA, 18 bp, Homo sapiens
cagggtgggatggaggag

SEQ ID NO: 4451939 - DNA, 18 bp, Homo sapiens
cagggtgggcttcctgcc

SEQ ID NO: 4451940 - DNA, 19 bp, Homo sapiens
cagggtgggcttcctgccc

SEQ ID NO: 4451941 - DNA, 15 bp, Homo sapiens
cagggtggggggtga

SEQ ID NO: 4451942 - DNA, 22 bp, Homo sapiens
cagggtgggtgagctctcaggc

SEQ ID NO: 4451943 - DNA, 14 bp, Homo sapiens
cagggttgggccca

SEQ ID NO: 4451944 - DNA, 16 bp, Homo sapiens
cagggttgggcccaga

SEQ ID NO: 4451945 - DNA, 19 bp, Homo sapiens
cagggtttacccagtggga

SEQ ID NO: 4451946 - DNA, 14 bp, Homo sapiens
cagggtttctctgc

SEQ ID NO: 4451947 - DNA, 19 bp, Homo sapiens
caggtaaagggcaaataat

SEQ ID NO: 4451948 - DNA, 16 bp, Homo sapiens
caggtacacctccccc

SEQ ID NO: 4451949 - DNA, 19 bp, Homo sapiens
caggtacacctccccctgc

SEQ ID NO: 4451950 - DNA, 20 bp, Homo sapiens
caggtacacctccccctgcg

SEQ ID NO: 4451951 - DNA, 21 bp, Homo sapiens
caggtacacctccccctgcgc

SEQ ID NO: 4451952 - DNA, 18 bp, Homo sapiens
caggtaccagctgcgctt

SEQ ID NO: 4451953 - DNA, 23 bp, Homo sapiens
caggtatggaagggtttgtggct

SEQ ID NO: 4451954 - DNA, 14 bp, Homo sapiens
caggtattaaaggt

SEQ ID NO: 4451955 - DNA, 20 bp, Homo sapiens
caggtattaaaggttaaatt

SEQ ID NO: 4451956 - DNA, 20 bp, Homo sapiens
caggtatttttttaaatcaa

SEQ ID NO: 4451957 - DNA, 22 bp, Homo sapiens
caggtatttttttaaatcaagg

SEQ ID NO: 4451958 - DNA, 20 bp, Homo sapiens
caggtcagttgtaataaatc

SEQ ID NO: 4451959 - DNA, 19 bp, Homo sapiens
caggtcccacgccaggcca

SEQ ID NO: 4451960 - DNA, 15 bp, Homo sapiens
caggtcccagcccct

SEQ ID NO: 4451961 - DNA, 21 bp, Homo sapiens
caggtcccagcccctcctccc

SEQ ID NO: 4451962 - DNA, 16 bp, Homo sapiens
caggtcccccccaggt

SEQ ID NO: 4451963 - DNA, 16 bp, Homo sapiens
caggtccgtagctccc

SEQ ID NO: 4451964 - DNA, 13 bp, Homo sapiens
caggtcctgccca

SEQ ID NO: 4451965 - DNA, 13 bp, Homo sapiens
caggtctgcctgg

SEQ ID NO: 4451966 - DNA, 14 bp, Homo sapiens
caggtgacagtggc

SEQ ID NO: 4451967 - DNA, 16 bp, Homo sapiens
caggtgacagtggctg

SEQ ID NO: 4451968 - DNA, 16 bp, Homo sapiens
caggtgacctcctgca

SEQ ID NO: 4451969 - DNA, 22 bp, Homo sapiens
caggtgcagggaagtgcagagc

SEQ ID NO: 4451970 - DNA, 15 bp, Homo sapiens
caggtgccgacactg

SEQ ID NO: 4451971 - DNA, 14 bp, Homo sapiens
caggtgcctttcaa

SEQ ID NO: 4451972 - DNA, 15 bp, Homo sapiens
caggtgcctttcaaa

SEQ ID NO: 4451973 - DNA, 19 bp, Homo sapiens
caggtggaacaaacagaaa

SEQ ID NO: 4451974 - DNA, 21 bp, Homo sapiens
caggtggacgctgcagacccc

SEQ ID NO: 4451975 - DNA, 20 bp, Homo sapiens
caggtggagagcactagaag

SEQ ID NO: 4451976 - DNA, 17 bp, Homo sapiens
caggtggaggcaacagg

SEQ ID NO: 4451977 - DNA, 12 bp, Homo sapiens
caggtggcacct

SEQ ID NO: 4451978 - DNA, 16 bp, Homo sapiens
caggtggcacctgcag

SEQ ID NO: 4451979 - DNA, 20 bp, Homo sapiens
caggtggctcagtgccacct

SEQ ID NO: 4451980 - DNA, 23 bp, Homo sapiens
caggtggggagactgggctgagg

SEQ ID NO: 4451981 - DNA, 18 bp, Homo sapiens
caggtggttaccaggcac

SEQ ID NO: 4451982 - DNA, 20 bp, Homo sapiens
caggtggttaccaggcactg

SEQ ID NO: 4451983 - DNA, 15 bp, Homo sapiens
caggtgttactagaa

SEQ ID NO: 4451984 - DNA, 23 bp, Homo sapiens
caggttagatatttcgaccctgg

SEQ ID NO: 4451985 - DNA, 17 bp, Homo sapiens
caggttataacagtgtt

SEQ ID NO: 4451986 - DNA, 12 bp, Homo sapiens
caggttccagaa

SEQ ID NO: 4451987 - DNA, 18 bp, Homo sapiens
caggttgggctagagaaa

SEQ ID NO: 4451988 - DNA, 21 bp, Homo sapiens
caggtttaagtagatttcatg

SEQ ID NO: 4451989 - DNA, 15 bp, Homo sapiens
caggtttcatttctt

SEQ ID NO: 4451990 - DNA, 21 bp, Homo sapiens
caggtttgcaggagcccccct

SEQ ID NO: 4451991 - DNA, 11 bp, Homo sapiens
caggtttttcc

SEQ ID NO: 4451992 - DNA, 16 bp, Homo sapiens
caggtttttgaggaaa

SEQ ID NO: 4451993 - DNA, 17 bp, Homo sapiens
cagtaaaattatactgt

SEQ ID NO: 4451994 - DNA, 14 bp, Homo sapiens
cagtaaaccactga

SEQ ID NO: 4451995 - DNA, 16 bp, Homo sapiens
cagtaaagagaaactt

SEQ ID NO: 4451996 - DNA, 18 bp, Homo sapiens
cagtaaagagaaactttg

SEQ ID NO: 4451997 - DNA, 15 bp, Homo sapiens
cagtaaagcacttgc

SEQ ID NO: 4451998 - DNA, 12 bp, Homo sapiens
cagtaaatgtta

SEQ ID NO: 4451999 - DNA, 20 bp, Homo sapiens
cagtaacataactgcttctt

SEQ ID NO: 4452000 - DNA, 18 bp, Homo sapiens
cagtaagtatctggagga

SEQ ID NO: 4452001 - DNA, 15 bp, Homo sapiens
cagtaatctgtcagt

SEQ ID NO: 4452002 - DNA, 23 bp, Homo sapiens
cagtaatgcagtttttaaaaacc

SEQ ID NO: 4452003 - DNA, 18 bp, Homo sapiens
cagtaatgtcataaagtg

SEQ ID NO: 4452004 - DNA, 14 bp, Homo sapiens
cagtaatttagaaa

SEQ ID NO: 4452005 - DNA, 13 bp, Homo sapiens
cagtacagaattg

SEQ ID NO: 4452006 - DNA, 16 bp, Homo sapiens
cagtacatttaaattt

SEQ ID NO: 4452007 - DNA, 19 bp, Homo sapiens
cagtacccgactgtttatt

SEQ ID NO: 4452008 - DNA, 18 bp, Homo sapiens
cagtacgtcccgctgctg

SEQ ID NO: 4452009 - DNA, 17 bp, Homo sapiens
cagtactggttactttc

SEQ ID NO: 4452010 - DNA, 14 bp, Homo sapiens
cagtacttttctct

SEQ ID NO: 4452011 - DNA, 13 bp, Homo sapiens
cagtagaaagcta

SEQ ID NO: 4452012 - DNA, 12 bp, Homo sapiens
cagtagaactgt

SEQ ID NO: 4452013 - DNA, 14 bp, Homo sapiens
cagtagaactgtct

SEQ ID NO: 4452014 - DNA, 15 bp, Homo sapiens
cagtagaactgtctg

SEQ ID NO: 4452015 - DNA, 18 bp, Homo sapiens
cagtagccagtatctatt

SEQ ID NO: 4452016 - DNA, 21 bp, Homo sapiens
cagtagcctaaatctccagta

SEQ ID NO: 4452017 - DNA, 20 bp, Homo sapiens
cagtagcctcctcctgggct

SEQ ID NO: 4452018 - DNA, 13 bp, Homo sapiens
cagtagcttccca

SEQ ID NO: 4452019 - DNA, 19 bp, Homo sapiens
cagtagcttcccaaaaaca

SEQ ID NO: 4452020 - DNA, 12 bp, Homo sapiens
cagtaggagccc

SEQ ID NO: 4452021 - DNA, 14 bp, Homo sapiens
cagtagttcacata

SEQ ID NO: 4452022 - DNA, 22 bp, Homo sapiens
cagtataatctcctctgctcat

SEQ ID NO: 4452023 - DNA, 14 bp, Homo sapiens
cagtatataagctt

SEQ ID NO: 4452024 - DNA, 14 bp, Homo sapiens
cagtatattagtat

SEQ ID NO: 4452025 - DNA, 20 bp, Homo sapiens
cagtatattttatttcaatg

SEQ ID NO: 4452026 - DNA, 18 bp, Homo sapiens
cagtatattttctgtatt

SEQ ID NO: 4452027 - DNA, 17 bp, Homo sapiens
cagtatctcttacatca

SEQ ID NO: 4452028 - DNA, 13 bp, Homo sapiens
cagtatgaactat

SEQ ID NO: 4452029 - DNA, 22 bp, Homo sapiens
cagtatgcaaagcaatctttta

SEQ ID NO: 4452030 - DNA, 16 bp, Homo sapiens
cagtatggtacatttt

SEQ ID NO: 4452031 - DNA, 17 bp, Homo sapiens
cagtatggtacattttt

SEQ ID NO: 4452032 - DNA, 20 bp, Homo sapiens
cagtatggtacatttttcaa

SEQ ID NO: 4452033 - DNA, 19 bp, Homo sapiens
cagtattatagacaaaaga

SEQ ID NO: 4452034 - DNA, 22 bp, Homo sapiens
cagtattatttctccatcccct

SEQ ID NO: 4452035 - DNA, 16 bp, Homo sapiens
cagtattcagagtctc

SEQ ID NO: 4452036 - DNA, 14 bp, Homo sapiens
cagtattctgacat

SEQ ID NO: 4452037 - DNA, 16 bp, Homo sapiens
cagtattgggcaggag

SEQ ID NO: 4452038 - DNA, 20 bp, Homo sapiens
cagtatttctcttttattct

SEQ ID NO: 4452039 - DNA, 13 bp, Homo sapiens
cagtatttgtaat

SEQ ID NO: 4452040 - DNA, 23 bp, Homo sapiens
cagtatttgtaattaaaagcaaa

SEQ ID NO: 4452041 - DNA, 15 bp, Homo sapiens
cagtatttgtgggga

SEQ ID NO: 4452042 - DNA, 14 bp, Homo sapiens
cagtatttttaaag

SEQ ID NO: 4452043 - DNA, 17 bp, Homo sapiens
cagtatttttaaaggca

SEQ ID NO: 4452044 - DNA, 18 bp, Homo sapiens
cagtatttttaaaggcat

SEQ ID NO: 4452045 - DNA, 14 bp, Homo sapiens
cagtcaacctgggc

SEQ ID NO: 4452046 - DNA, 16 bp, Homo sapiens
cagtcaacctgggcaa

SEQ ID NO: 4452047 - DNA, 21 bp, Homo sapiens
cagtcaacggggggctcctgc

SEQ ID NO: 4452048 - DNA, 21 bp, Homo sapiens
cagtcaatggaagaaatggct

SEQ ID NO: 4452049 - DNA, 16 bp, Homo sapiens
cagtcacatcacaata

SEQ ID NO: 4452050 - DNA, 14 bp, Homo sapiens
cagtcacctcacaa

SEQ ID NO: 4452051 - DNA, 23 bp, Homo sapiens
cagtcactgcatttgcctgcttc

SEQ ID NO: 4452052 - DNA, 13 bp, Homo sapiens
cagtcagagtcca

SEQ ID NO: 4452053 - DNA, 21 bp, Homo sapiens
cagtcagagtccagtgctctg

SEQ ID NO: 4452054 - DNA, 18 bp, Homo sapiens
cagtgctctgtaaaacac

SEQ ID NO: 4452055 - DNA, 14 bp, Homo sapiens
cagtgctcttttct

SEQ ID NO: 4452056 - DNA, 13 bp, Homo sapiens
cagtgctgcccat

SEQ ID NO: 4452057 - DNA, 15 bp, Homo sapiens
cagtgctgcccatga

SEQ ID NO: 4452058 - DNA, 19 bp, Homo sapiens
cagtgctggatttgatgag

SEQ ID NO: 4452059 - DNA, 21 bp, Homo sapiens
cagtgctggatttgatgagtt

SEQ ID NO: 4452060 - DNA, 19 bp, Homo sapiens
cagtgctgtctgatctgtg

SEQ ID NO: 4452061 - DNA, 22 bp, Homo sapiens
cagtgctgtctgatctgtgctt

SEQ ID NO: 4452062 - DNA, 16 bp, Homo sapiens
cagtgcttagcaaaaa

SEQ ID NO: 4452063 - DNA, 23 bp, Homo sapiens
cagtgcttctccaacactgaagt

SEQ ID NO: 4452064 - DNA, 17 bp, Homo sapiens
cagtgcttgggctccac

SEQ ID NO: 4452065 - DNA, 14 bp, Homo sapiens
cagtggcctacaaa

SEQ ID NO: 4452066 - DNA, 14 bp, Homo sapiens
cagtggcgcatgcc

SEQ ID NO: 4452067 - DNA, 20 bp, Homo sapiens
cagtggcgggtgatggccag

SEQ ID NO: 4452068 - DNA, 20 bp, Homo sapiens
cagtggctcacacctgtaat

SEQ ID NO: 4452069 - DNA, 14 bp, Homo sapiens
cagtggctcacgcc

SEQ ID NO: 4452070 - DNA, 18 bp, Homo sapiens
cagtggctcccctgccca

SEQ ID NO: 4452071 - DNA, 20 bp, Homo sapiens
cagtggctcgctccctgtag

SEQ ID NO: 4452072 - DNA, 13 bp, Homo sapiens
cagtggctgctct

SEQ ID NO: 4452073 - DNA, 14 bp, Homo sapiens
cagtggctgctctg

SEQ ID NO: 4452074 - DNA, 17 bp, Homo sapiens
cagtggctgctctggga

SEQ ID NO: 4452075 - DNA, 20 bp, Homo sapiens
cagtggctgctctgggaagg

SEQ ID NO: 4452076 - DNA, 21 bp, Homo sapiens
cagtggctgctctgggaaggg

SEQ ID NO: 4452077 - DNA, 20 bp, Homo sapiens
cagtggctggaagaaccact

SEQ ID NO: 4452078 - DNA, 19 bp, Homo sapiens
cagtggcttcatctgtcaa

SEQ ID NO: 4452079 - DNA, 15 bp, Homo sapiens
cagtggcttctccag

SEQ ID NO: 4452080 - DNA, 21 bp, Homo sapiens
cagtgggaacgtgactgcccc

SEQ ID NO: 4452081 - DNA, 18 bp, Homo sapiens
cagtgggcgttgggagcc

SEQ ID NO: 4452082 - DNA, 18 bp, Homo sapiens
cagtggggaacaggtccc

SEQ ID NO: 4452083 - DNA, 15 bp, Homo sapiens
cagtggggcagtcat

SEQ ID NO: 4452084 - DNA, 13 bp, Homo sapiens
cagtggtaagcta

SEQ ID NO: 4452085 - DNA, 17 bp, Homo sapiens
cagtggtcagcaggtgt

SEQ ID NO: 4452086 - DNA, 19 bp, Homo sapiens
cagtggtgaaatcttgttt

SEQ ID NO: 4452087 - DNA, 15 bp, Homo sapiens
cagtggttttatact

SEQ ID NO: 4452088 - DNA, 20 bp, Homo sapiens
cagtggttttatactgaagg

SEQ ID NO: 4452089 - DNA, 21 bp, Homo sapiens
cagtggttttatactgaagga

SEQ ID NO: 4452090 - DNA, 16 bp, Homo sapiens
cagtgtacacgtctgg

SEQ ID NO: 4452091 - DNA, 19 bp, Homo sapiens
cagtgtacacgtctggacc

SEQ ID NO: 4452092 - DNA, 21 bp, Homo sapiens
cagtgtacacgtctggacccc

SEQ ID NO: 4452093 - DNA, 17 bp, Homo sapiens
cagtgtacagtcttgta

SEQ ID NO: 4452094 - DNA, 18 bp, Homo sapiens
cagtgtacagtcttgtat

SEQ ID NO: 4452095 - DNA, 13 bp, Homo sapiens
cagtgtagatttt

SEQ ID NO: 4452096 - DNA, 16 bp, Homo sapiens
cagtgtcaaataaaca

SEQ ID NO: 4452097 - DNA, 17 bp, Homo sapiens
cagtgtcaaataaacac

SEQ ID NO: 4452098 - DNA, 18 bp, Homo sapiens
cagtgtcaaataaacact

SEQ ID NO: 4452099 - DNA, 14 bp, Homo sapiens
cagtgtcaatgcag

SEQ ID NO: 4452100 - DNA, 17 bp, Homo sapiens
cagtgtcacatgaggaa

SEQ ID NO: 4452101 - DNA, 14 bp, Homo sapiens
cagtgtcattttga

SEQ ID NO: 4452102 - DNA, 14 bp, Homo sapiens
cagtgtcctttcca

SEQ ID NO: 4452103 - DNA, 13 bp, Homo sapiens
cagtgtctgtgtt

SEQ ID NO: 4452104 - DNA, 16 bp, Homo sapiens
cagtgtctttctagcc

SEQ ID NO: 4452105 - DNA, 15 bp, Homo sapiens
cagtgtctttctttg

SEQ ID NO: 4452106 - DNA, 11 bp, Homo sapiens
cagtgtgaacc

SEQ ID NO: 4452107 - DNA, 18 bp, Homo sapiens
cagtgtgaggccagggca

SEQ ID NO: 4452108 - DNA, 17 bp, Homo sapiens
cagtgtgagtcagaatg

SEQ ID NO: 4452109 - DNA, 20 bp, Homo sapiens
cagtgtggggggacagacag

SEQ ID NO: 4452110 - DNA, 21 bp, Homo sapiens
cagtgtgtggtcaacatttct

SEQ ID NO: 4452111 - DNA, 14 bp, Homo sapiens
cagtgttagtattc

SEQ ID NO: 4452112 - DNA, 17 bp, Homo sapiens
cagtgttagtattcacc

SEQ ID NO: 4452113 - DNA, 21 bp, Homo sapiens
cagtgttcctgaagctgctgt

SEQ ID NO: 4452114 - DNA, 13 bp, Homo sapiens
cagtgttctattt

SEQ ID NO: 4452115 - DNA, 17 bp, Homo sapiens
cagtgtttgggaaatta

SEQ ID NO: 4452116 - DNA, 12 bp, Homo sapiens
cagtgtttgtat

SEQ ID NO: 4452117 - DNA, 20 bp, Homo sapiens
cagtgtttttattgctcgcc

SEQ ID NO: 4452118 - DNA, 20 bp, Homo sapiens
cagttaaataaatagaaaga

SEQ ID NO: 4452119 - DNA, 22 bp, Homo sapiens
cagttaagctaaagcagtgttt

SEQ ID NO: 4452120 - DNA, 13 bp, Homo sapiens
cagttaatttttc

SEQ ID NO: 4452121 - DNA, 19 bp, Homo sapiens
cagttaatttttccaacta

SEQ ID NO: 4452122 - DNA, 14 bp, Homo sapiens
cagttactcagccc

SEQ ID NO: 4452123 - DNA, 16 bp, Homo sapiens
cagttactcagccctg

SEQ ID NO: 4452124 - DNA, 15 bp, Homo sapiens
cagttacttaatgac

SEQ ID NO: 4452125 - DNA, 23 bp, Homo sapiens
cagttacttaatgaccatgttat

SEQ ID NO: 4452126 - DNA, 19 bp, Homo sapiens
cagttaggctagagacaga

SEQ ID NO: 4452127 - DNA, 23 bp, Homo sapiens
cagttaggctagagacagatgct

SEQ ID NO: 4452128 - DNA, 15 bp, Homo sapiens
cagttataacagatg

SEQ ID NO: 4452129 - DNA, 13 bp, Homo sapiens
cagttatggctat

SEQ ID NO: 4452130 - DNA, 15 bp, Homo sapiens
cagttattacatgta

SEQ ID NO: 4452131 - DNA, 18 bp, Homo sapiens
cagttattacatgtaatt

SEQ ID NO: 4452132 - DNA, 12 bp, Homo sapiens
cagttatttctg

SEQ ID NO: 4452133 - DNA, 15 bp, Homo sapiens
cagttatttctgttt

SEQ ID NO: 4452134 - DNA, 21 bp, Homo sapiens
cagttcaacataaagagcaat

SEQ ID NO: 4452135 - DNA, 17 bp, Homo sapiens
cagttcaacctggtggc

SEQ ID NO: 4452136 - DNA, 19 bp, Homo sapiens
cagttcatcaccatttcct

SEQ ID NO: 4452137 - DNA, 23 bp, Homo sapiens
cagttcatcaccatttcctcctt

SEQ ID NO: 4452138 - DNA, 16 bp, Homo sapiens
cagttcatcgattttc

SEQ ID NO: 4452139 - DNA, 17 bp, Homo sapiens
cagttcattagaaatat

SEQ ID NO: 4452140 - DNA, 15 bp, Homo sapiens
cagttccacagcagt

SEQ ID NO: 4452141 - DNA, 17 bp, Homo sapiens
cagttccagccttctct

SEQ ID NO: 4452142 - DNA, 16 bp, Homo sapiens
cagttcccttggcctc

SEQ ID NO: 4452143 - DNA, 12 bp, Homo sapiens
cagttcctagca

SEQ ID NO: 4452144 - DNA, 16 bp, Homo sapiens
cagttcctagcactgc

SEQ ID NO: 4452145 - DNA, 16 bp, Homo sapiens
cagttcctcccaggaa

SEQ ID NO: 4452146 - DNA, 17 bp, Homo sapiens
cagttcctcgccctggg

SEQ ID NO: 4452147 - DNA, 15 bp, Homo sapiens
cagttcctgggaaca

SEQ ID NO: 4452148 - DNA, 19 bp, Homo sapiens
cagttctcctgcctcagcc

SEQ ID NO: 4452149 - DNA, 23 bp, Homo sapiens
cagttctctcccttcctctctcc

SEQ ID NO: 4452150 - DNA, 12 bp, Homo sapiens
cagttctctggg

SEQ ID NO: 4452151 - DNA, 11 bp, Homo sapiens
cagttctctgt

SEQ ID NO: 4452152 - DNA, 21 bp, Homo sapiens
cagttctggatggtgtgcctt

SEQ ID NO: 4452153 - DNA, 16 bp, Homo sapiens
cagttcttggtgactg

SEQ ID NO: 4452154 - DNA, 23 bp, Homo sapiens
cagttcttggtgactgtcccacc

SEQ ID NO: 4452155 - DNA, 14 bp, Homo sapiens
cagttgagctcagg

SEQ ID NO: 4452156 - DNA, 13 bp, Homo sapiens
cagttgatttttc

SEQ ID NO: 4452157 - DNA, 16 bp, Homo sapiens
cagttgcatgtagtaa

SEQ ID NO: 4452158 - DNA, 21 bp, Homo sapiens
cagttgcatgtagtaacacta

SEQ ID NO: 4452159 - DNA, 23 bp, Homo sapiens
cagttgcatgtagtaacactaat

SEQ ID NO: 4452160 - DNA, 15 bp, Homo sapiens
cagttgccccccatc

SEQ ID NO: 4452161 - DNA, 14 bp, Homo sapiens
cagttgcctccagg

SEQ ID NO: 4452162 - DNA, 15 bp, Homo sapiens
cagttgcctccaggg

SEQ ID NO: 4452163 - DNA, 17 bp, Homo sapiens
cagttgctcaaaaagaa

SEQ ID NO: 4452164 - DNA, 19 bp, Homo sapiens
cagttgcttcttcagctga

SEQ ID NO: 4452165 - DNA, 15 bp, Homo sapiens
cagttggacttttta

SEQ ID NO: 4452166 - DNA, 18 bp, Homo sapiens
cagttggcactgtaaggt

SEQ ID NO: 4452167 - DNA, 20 bp, Homo sapiens
cagttggtctttaaccactt

SEQ ID NO: 4452168 - DNA, 17 bp, Homo sapiens
cagttgtgtggcccagc

SEQ ID NO: 4452169 - DNA, 19 bp, Homo sapiens
cagttgttatttattgaaa

SEQ ID NO: 4452170 - DNA, 21 bp, Homo sapiens
cagttgttatttattgaaatg

SEQ ID NO: 4452171 - DNA, 16 bp, Homo sapiens
cagttgttctgagcac

SEQ ID NO: 4452172 - DNA, 12 bp, Homo sapiens
cagttgttcttt

SEQ ID NO: 4452173 - DNA, 17 bp, Homo sapiens
catagaaggaagtgtgt

SEQ ID NO: 4452174 - DNA, 22 bp, Homo sapiens
catagaaggaagtgtgtttgcc

SEQ ID NO: 4452175 - DNA, 12 bp, Homo sapiens
catagaagtgtt

SEQ ID NO: 4452176 - DNA, 20 bp, Homo sapiens
catagacaaaggccttaaca

SEQ ID NO: 4452177 - DNA, 21 bp, Homo sapiens
catagacaaaggccttaacaa

SEQ ID NO: 4452178 - DNA, 18 bp, Homo sapiens
catagacaattcctccag

SEQ ID NO: 4452179 - DNA, 13 bp, Homo sapiens
catagacacagta

SEQ ID NO: 4452180 - DNA, 15 bp, Homo sapiens
catagacacagtatt

SEQ ID NO: 4452181 - DNA, 22 bp, Homo sapiens
catagacacagtattgacttct

SEQ ID NO: 4452182 - DNA, 19 bp, Homo sapiens
catagacagaagaaacaag

SEQ ID NO: 4452183 - DNA, 14 bp, Homo sapiens
catagaccctgagg

SEQ ID NO: 4452184 - DNA, 21 bp, Homo sapiens
catagaccctgaggccctggg

SEQ ID NO: 4452185 - DNA, 15 bp, Homo sapiens
catagactagagaaa

SEQ ID NO: 4452186 - DNA, 12 bp, Homo sapiens
catagaggcttc

SEQ ID NO: 4452187 - DNA, 15 bp, Homo sapiens
catagaggcttctcc

SEQ ID NO: 4452188 - DNA, 23 bp, Homo sapiens
catagaggcttctccgccagcct

SEQ ID NO: 4452189 - DNA, 17 bp, Homo sapiens
catagattattataaac

SEQ ID NO: 4452190 - DNA, 23 bp, Homo sapiens
catagattattataaactataaa

SEQ ID NO: 4452191 - DNA, 16 bp, Homo sapiens
catagcagatctgttt

SEQ ID NO: 4452192 - DNA, 17 bp, Homo sapiens
catagcagatctgtttt

SEQ ID NO: 4452193 - DNA, 20 bp, Homo sapiens
catagcagcttattcacaag

SEQ ID NO: 4452194 - DNA, 17 bp, Homo sapiens
catagcaggaaatgtag

SEQ ID NO: 4452195 - DNA, 17 bp, Homo sapiens
catagccataaatgatg

SEQ ID NO: 4452196 - DNA, 18 bp, Homo sapiens
catagcgggggcctaaaa

SEQ ID NO: 4452197 - DNA, 15 bp, Homo sapiens
catagctaaaggcta

SEQ ID NO: 4452198 - DNA, 18 bp, Homo sapiens
catagctcaagaattgtt

SEQ ID NO: 4452199 - DNA, 15 bp, Homo sapiens
catagctcactgcag

SEQ ID NO: 4452200 - DNA, 17 bp, Homo sapiens
catagctcactgcagcc

SEQ ID NO: 4452201 - DNA, 18 bp, Homo sapiens
catagctcactgcagcct

SEQ ID NO: 4452202 - DNA, 21 bp, Homo sapiens
catagctgggactacaggcgc

SEQ ID NO: 4452203 - DNA, 14 bp, Homo sapiens
cataggaaggctgt

SEQ ID NO: 4452204 - DNA, 17 bp, Homo sapiens
catagggtcactttgcc

SEQ ID NO: 4452205 - DNA, 21 bp, Homo sapiens
catagggtcactttgccatta

SEQ ID NO: 4452206 - DNA, 23 bp, Homo sapiens
catagggtcggaggtgctgtccc

SEQ ID NO: 4452207 - DNA, 15 bp, Homo sapiens
cataggttaaaaaaa

SEQ ID NO: 4452208 - DNA, 21 bp, Homo sapiens
catagtaacttcttatggaat

SEQ ID NO: 4452209 - DNA, 22 bp, Homo sapiens
catagtaacttcttatggaatt

SEQ ID NO: 4452210 - DNA, 24 bp, Homo sapiens
catagtaacttcttatggaattga

SEQ ID NO: 4452211 - DNA, 21 bp, Homo sapiens
catagtaagttcagcacttgt

SEQ ID NO: 4452212 - DNA, 21 bp, Homo sapiens
catagtactctttgtagcaaa

SEQ ID NO: 4452213 - DNA, 22 bp, Homo sapiens
catagtcaatgatggtttaata

SEQ ID NO: 4452214 - DNA, 14 bp, Homo sapiens
catagtccccagag

SEQ ID NO: 4452215 - DNA, 15 bp, Homo sapiens
catagtccccagagc

SEQ ID NO: 4452216 - DNA, 16 bp, Homo sapiens
catagtcttgaaatga

SEQ ID NO: 4452217 - DNA, 18 bp, Homo sapiens
catagtcttgaaatgaaa

SEQ ID NO: 4452218 - DNA, 14 bp, Homo sapiens
catagtctttgttt

SEQ ID NO: 4452219 - DNA, 19 bp, Homo sapiens
catagtgcttcacaaaatg

SEQ ID NO: 4452220 - DNA, 21 bp, Homo sapiens
catagtgtgctcggacacagt

SEQ ID NO: 4452221 - DNA, 18 bp, Homo sapiens
catagttatttttctctt

SEQ ID NO: 4452222 - DNA, 13 bp, Homo sapiens
catagttcagaat

SEQ ID NO: 4452223 - DNA, 13 bp, Homo sapiens
catagttctgtaa

SEQ ID NO: 4452224 - DNA, 12 bp, Homo sapiens
catataaatgtt

SEQ ID NO: 4452225 - DNA, 14 bp, Homo sapiens
catataaccaaaat

SEQ ID NO: 4452226 - DNA, 16 bp, Homo sapiens
catatacatattgtat

SEQ ID NO: 4452227 - DNA, 21 bp, Homo sapiens
catatacatattgtatatata

SEQ ID NO: 4452228 - DNA, 22 bp, Homo sapiens
catataccaaaaacaagtctat

SEQ ID NO: 4452229 - DNA, 19 bp, Homo sapiens
catataccacccatagtgc

SEQ ID NO: 4452230 - DNA, 19 bp, Homo sapiens
catatataggggttccagg

SEQ ID NO: 4452231 - DNA, 19 bp, Homo sapiens
catatatgaccagaagcct

SEQ ID NO: 4452232 - DNA, 20 bp, Homo sapiens
catatatgctgtatttcttt

SEQ ID NO: 4452233 - DNA, 19 bp, Homo sapiens
catatattaattagcaggt

SEQ ID NO: 4452234 - DNA, 16 bp, Homo sapiens
catatcacacacattg

SEQ ID NO: 4452235 - DNA, 14 bp, Homo sapiens
catatcatccacac

SEQ ID NO: 4452236 - DNA, 17 bp, Homo sapiens
catatccaaaataatga

SEQ ID NO: 4452237 - DNA, 13 bp, Homo sapiens
catatctaaatag

SEQ ID NO: 4452238 - DNA, 16 bp, Homo sapiens
catatctaactttgta

SEQ ID NO: 4452239 - DNA, 21 bp, Homo sapiens
catatctccatggccctgtcc

SEQ ID NO: 4452240 - DNA, 22 bp, Homo sapiens
catatctccatggccctgtccc

SEQ ID NO: 4452241 - DNA, 16 bp, Homo sapiens
catatgaaaggtgcca

SEQ ID NO: 4452242 - DNA, 20 bp, Homo sapiens
catatgaaaggtgccatgga

SEQ ID NO: 4452243 - DNA, 17 bp, Homo sapiens
catatgagaatatacct

SEQ ID NO: 4452244 - DNA, 20 bp, Homo sapiens
catatgagaatataccttat

SEQ ID NO: 4452245 - DNA, 23 bp, Homo sapiens
catatgagaatataccttattta

SEQ ID NO: 4452246 - DNA, 15 bp, Homo sapiens
catatgatctgtctg

SEQ ID NO: 4452247 - DNA, 13 bp, Homo sapiens
catatgcagaaat

SEQ ID NO: 4452248 - DNA, 14 bp, Homo sapiens
catatgctccagga

SEQ ID NO: 4452249 - DNA, 20 bp, Homo sapiens
catatggcccagtgtcaagt

SEQ ID NO: 4452250 - DNA, 21 bp, Homo sapiens
catatgtctataacaaaagca

SEQ ID NO: 4452251 - DNA, 18 bp, Homo sapiens
catatgttgaatactttt

SEQ ID NO: 4452252 - DNA, 19 bp, Homo sapiens
catatgttttccacataaa

SEQ ID NO: 4452253 - DNA, 20 bp, Homo sapiens
catatgttttccacataaat

SEQ ID NO: 4452254 - DNA, 20 bp, Homo sapiens
catattaatataagtttctt

SEQ ID NO: 4452255 - DNA, 21 bp, Homo sapiens
catattaatataagtttcttt

SEQ ID NO: 4452256 - DNA, 17 bp, Homo sapiens
catattactccacacct

SEQ ID NO: 4452257 - DNA, 22 bp, Homo sapiens
catattattttagtgtgtaaaa

SEQ ID NO: 4452258 - DNA, 12 bp, Homo sapiens
catattcaatgt

SEQ ID NO: 4452259 - DNA, 16 bp, Homo sapiens
catattcagacatcaa

SEQ ID NO: 4452260 - DNA, 20 bp, Homo sapiens
catattcatgaaatgtggaa

SEQ ID NO: 4452261 - DNA, 17 bp, Homo sapiens
catattccctgcacaca

SEQ ID NO: 4452262 - DNA, 23 bp, Homo sapiens
catattccctgcacacacatgca

SEQ ID NO: 4452263 - DNA, 12 bp, Homo sapiens
catattgacttt

SEQ ID NO: 4452264 - DNA, 13 bp, Homo sapiens
catattgactttt

SEQ ID NO: 4452265 - DNA, 16 bp, Homo sapiens
catattggaaaaatca

SEQ ID NO: 4452266 - DNA, 13 bp, Homo sapiens
catattgtaaaac

SEQ ID NO: 4452267 - DNA, 16 bp, Homo sapiens
catattgtaaaacagg

SEQ ID NO: 4452268 - DNA, 18 bp, Homo sapiens
catattgtgattctgcct

SEQ ID NO: 4452269 - DNA, 18 bp, Homo sapiens
catattgttttaaaataa

SEQ ID NO: 4452270 - DNA, 13 bp, Homo sapiens
catatttaactgg

SEQ ID NO: 4452271 - DNA, 14 bp, Homo sapiens
catatttaactggt

SEQ ID NO: 4452272 - DNA, 13 bp, Homo sapiens
catatttaatgtt

SEQ ID NO: 4452273 - DNA, 16 bp, Homo sapiens
catatttaatgtttta

SEQ ID NO: 4452274 - DNA, 14 bp, Homo sapiens
catatttagctgtt

SEQ ID NO: 4452275 - DNA, 10 bp, Homo sapiens
catatttgag

SEQ ID NO: 4452276 - DNA, 15 bp, Homo sapiens
catatttgagactag

SEQ ID NO: 4452277 - DNA, 19 bp, Homo sapiens
catatttgtatgtttttct

SEQ ID NO: 4452278 - DNA, 15 bp, Homo sapiens
catattttaatcatt

SEQ ID NO: 4452279 - DNA, 18 bp, Homo sapiens
catattttaatcattatt

SEQ ID NO: 4452280 - DNA, 23 bp, Homo sapiens
catattttaatcattatttgaga

SEQ ID NO: 4452281 - DNA, 17 bp, Homo sapiens
catattttcttactttt

SEQ ID NO: 4452282 - DNA, 20 bp, Homo sapiens
catattttcttacttttatt

SEQ ID NO: 4452283 - DNA, 16 bp, Homo sapiens
catattttgagaaact

SEQ ID NO: 4452284 - DNA, 11 bp, Homo sapiens
catatttttaa

SEQ ID NO: 4452285 - DNA, 14 bp, Homo sapiens
catatttttatact

SEQ ID NO: 4452286 - DNA, 13 bp, Homo sapiens
catcaaaatgctt

SEQ ID NO: 4452287 - DNA, 19 bp, Homo sapiens
catcaaagtggtaaatact

SEQ ID NO: 4452288 - DNA, 21 bp, Homo sapiens
catcaaatgaataatgccttt

SEQ ID NO: 4452289 - DNA, 15 bp, Homo sapiens
catcaacaaaaattg

SEQ ID NO: 4452290 - DNA, 15 bp, Homo sapiens
catcaacaagaagaa

SEQ ID NO: 4452291 - DNA, 19 bp, Homo sapiens
catgacaagatgggacagc

SEQ ID NO: 4452292 - DNA, 14 bp, Homo sapiens
catgacagaggctg

SEQ ID NO: 4452293 - DNA, 15 bp, Homo sapiens
catgacagaggctgc

SEQ ID NO: 4452294 - DNA, 13 bp, Homo sapiens
catgacagcctcc

SEQ ID NO: 4452295 - DNA, 20 bp, Homo sapiens
catgacataacagtgcaggg

SEQ ID NO: 4452296 - DNA, 15 bp, Homo sapiens
catgacctaaaacac

SEQ ID NO: 4452297 - DNA, 19 bp, Homo sapiens
catgacctaccaggacaga

SEQ ID NO: 4452298 - DNA, 18 bp, Homo sapiens
catgacctagttttccat

SEQ ID NO: 4452299 - DNA, 19 bp, Homo sapiens
catgacctagttttccatg

SEQ ID NO: 4452300 - DNA, 17 bp, Homo sapiens
catgacgtggtaaaatg

SEQ ID NO: 4452301 - DNA, 18 bp, Homo sapiens
catgactctttattgtct

SEQ ID NO: 4452302 - DNA, 19 bp, Homo sapiens
catgactctttattgtctg

SEQ ID NO: 4452303 - DNA, 17 bp, Homo sapiens
catgactggctaatttt

SEQ ID NO: 4452304 - DNA, 19 bp, Homo sapiens
catgagcactactctacca

SEQ ID NO: 4452305 - DNA, 16 bp, Homo sapiens
catgagccgcccaagg

SEQ ID NO: 4452306 - DNA, 22 bp, Homo sapiens
catgagccgcccaaggccttcc

SEQ ID NO: 4452307 - DNA, 15 bp, Homo sapiens
catgaggaaggaaca

SEQ ID NO: 4452308 - DNA, 12 bp, Homo sapiens
catgaggagggt

SEQ ID NO: 4452309 - DNA, 15 bp, Homo sapiens
catgaggccatctca

SEQ ID NO: 4452310 - DNA, 19 bp, Homo sapiens
catgaggccatctcaggag

SEQ ID NO: 4452311 - DNA, 18 bp, Homo sapiens
catgagtcagatacacaa

SEQ ID NO: 4452312 - DNA, 16 bp, Homo sapiens
catgagttatcatgaa

SEQ ID NO: 4452313 - DNA, 18 bp, Homo sapiens
catgagttccagaaagta

SEQ ID NO: 4452314 - DNA, 19 bp, Homo sapiens
catgagttggctgggaata

SEQ ID NO: 4452315 - DNA, 18 bp, Homo sapiens
catgataagacattttgt

SEQ ID NO: 4452316 - DNA, 14 bp, Homo sapiens
catgatacattttt

SEQ ID NO: 4452317 - DNA, 16 bp, Homo sapiens
catgatacatttttat

SEQ ID NO: 4452318 - DNA, 17 bp, Homo sapiens
catgatagaaagaataa

SEQ ID NO: 4452319 - DNA, 15 bp, Homo sapiens
catgatataacttta

SEQ ID NO: 4452320 - DNA, 18 bp, Homo sapiens
catgatataactttagaa

SEQ ID NO: 4452321 - DNA, 19 bp, Homo sapiens
catgatcaagatatatgtg

SEQ ID NO: 4452322 - DNA, 17 bp, Homo sapiens
catgatcacttatcagt

SEQ ID NO: 4452323 - DNA, 19 bp, Homo sapiens
catgatctccctgccgcct

SEQ ID NO: 4452324 - DNA, 11 bp, Homo sapiens
catgatgcagt

SEQ ID NO: 4452325 - DNA, 13 bp, Homo sapiens
catgatggagctg

SEQ ID NO: 4452326 - DNA, 15 bp, Homo sapiens
catgatggagctgat

SEQ ID NO: 4452327 - DNA, 16 bp, Homo sapiens
catgatggtgcatgcc

SEQ ID NO: 4452328 - DNA, 17 bp, Homo sapiens
catgatggtgcatgcct

SEQ ID NO: 4452329 - DNA, 22 bp, Homo sapiens
catgatttcccactgcactcca

SEQ ID NO: 4452330 - DNA, 16 bp, Homo sapiens
catgattttacaagta

SEQ ID NO: 4452331 - DNA, 16 bp, Homo sapiens
catgcaaactgcttta

SEQ ID NO: 4452332 - DNA, 23 bp, Homo sapiens
catgcaaactgctttattttccc

SEQ ID NO: 4452333 - DNA, 16 bp, Homo sapiens
catgcaacagaagtga

SEQ ID NO: 4452334 - DNA, 21 bp, Homo sapiens
catgcaacagaagtgacttct

SEQ ID NO: 4452335 - DNA, 16 bp, Homo sapiens
catgcaatttgaagta

SEQ ID NO: 4452336 - DNA, 22 bp, Homo sapiens
catgcacacaattagatttctc

SEQ ID NO: 4452337 - DNA, 16 bp, Homo sapiens
catgcacactgagaat

SEQ ID NO: 4452338 - DNA, 14 bp, Homo sapiens
catgcacagtattt

SEQ ID NO: 4452339 - DNA, 17 bp, Homo sapiens
catgcacagtatttgta

SEQ ID NO: 4452340 - DNA, 13 bp, Homo sapiens
catgcacagtcat

SEQ ID NO: 4452341 - DNA, 22 bp, Homo sapiens
catgcacccctgagccagcagg

SEQ ID NO: 4452342 - DNA, 12 bp, Homo sapiens
catgcagtttga

SEQ ID NO: 4452343 - DNA, 14 bp, Homo sapiens
catgcagtttgaaa

SEQ ID NO: 4452344 - DNA, 18 bp, Homo sapiens
catgcatgtcctgtaaag

SEQ ID NO: 4452345 - DNA, 13 bp, Homo sapiens
catgcatgtctgc

SEQ ID NO: 4452346 - DNA, 15 bp, Homo sapiens
catgcattatatacc

SEQ ID NO: 4452347 - DNA, 13 bp, Homo sapiens
catgcattgaaaa

SEQ ID NO: 4452348 - DNA, 15 bp, Homo sapiens
catgcatttttaaaa

SEQ ID NO: 4452349 - DNA, 22 bp, Homo sapiens
catgccaagtactaaagcacct

SEQ ID NO: 4452350 - DNA, 14 bp, Homo sapiens
catgccacctggca

SEQ ID NO: 4452351 - DNA, 15 bp, Homo sapiens
catgccacctggcaa

SEQ ID NO: 4452352 - DNA, 13 bp, Homo sapiens
catgccagagagg

SEQ ID NO: 4452353 - DNA, 22 bp, Homo sapiens
catgccagattctgcctctctg

SEQ ID NO: 4452354 - DNA, 23 bp, Homo sapiens
catgccagattctgcctctctgg

SEQ ID NO: 4452355 - DNA, 19 bp, Homo sapiens
catgccaggaacctgtcct

SEQ ID NO: 4452356 - DNA, 17 bp, Homo sapiens
catgcccaccccctgcc

SEQ ID NO: 4452357 - DNA, 23 bp, Homo sapiens
catgcccaccccctgccctgcac

SEQ ID NO: 4452358 - DNA, 21 bp, Homo sapiens
catgcccacctgcccatcaca

SEQ ID NO: 4452359 - DNA, 20 bp, Homo sapiens
catgcccagctaatttttgt

SEQ ID NO: 4452360 - DNA, 14 bp, Homo sapiens
catgccccaggctc

SEQ ID NO: 4452361 - DNA, 15 bp, Homo sapiens
catgccccttggtcc

SEQ ID NO: 4452362 - DNA, 20 bp, Homo sapiens
catgccccttggtcctggca

SEQ ID NO: 4452363 - DNA, 13 bp, Homo sapiens
catgccctgtgtg

SEQ ID NO: 4452364 - DNA, 12 bp, Homo sapiens
catgcccttctg

SEQ ID NO: 4452365 - DNA, 14 bp, Homo sapiens
catgcccttctgat

SEQ ID NO: 4452366 - DNA, 19 bp, Homo sapiens
catgccggtacacagccag

SEQ ID NO: 4452367 - DNA, 21 bp, Homo sapiens
catgcctatatgagaagaata

SEQ ID NO: 4452368 - DNA, 19 bp, Homo sapiens
catgcctatgggccagagt

SEQ ID NO: 4452369 - DNA, 16 bp, Homo sapiens
catgcctcagaagtgc

SEQ ID NO: 4452370 - DNA, 20 bp, Homo sapiens
catgcctgcgcctgctgcct

SEQ ID NO: 4452371 - DNA, 17 bp, Homo sapiens
catgcctgtaatcccag

SEQ ID NO: 4452372 - DNA, 18 bp, Homo sapiens
catgcctgtaatcccaga

SEQ ID NO: 4452373 - DNA, 21 bp, Homo sapiens
catgcctgtaatcccagaact

SEQ ID NO: 4452374 - DNA, 17 bp, Homo sapiens
catgcctgtccagcctg

SEQ ID NO: 4452375 - DNA, 21 bp, Homo sapiens
catgcctgtccagcctgggca

SEQ ID NO: 4452376 - DNA, 23 bp, Homo sapiens
catgcctgtccagcctgggcagc

SEQ ID NO: 4452377 - DNA, 19 bp, Homo sapiens
catgcgccttcgtgcctga

SEQ ID NO: 4452378 - DNA, 15 bp, Homo sapiens
catgcggcccagccc

SEQ ID NO: 4452379 - DNA, 18 bp, Homo sapiens
catgcggcccagcccggc

SEQ ID NO: 4452380 - DNA, 22 bp, Homo sapiens
catgcggcccagcccggctccc

SEQ ID NO: 4452381 - DNA, 16 bp, Homo sapiens
catgcgtgtttctgac

SEQ ID NO: 4452382 - DNA, 13 bp, Homo sapiens
catgctaagagaa

SEQ ID NO: 4452383 - DNA, 22 bp, Homo sapiens
catgctaagcaagctaacctta

SEQ ID NO: 4452384 - DNA, 13 bp, Homo sapiens
catgctacagtta

SEQ ID NO: 4452385 - DNA, 18 bp, Homo sapiens
catgctattcacaattat

SEQ ID NO: 4452386 - DNA, 13 bp, Homo sapiens
catgctattgtct

SEQ ID NO: 4452387 - DNA, 22 bp, Homo sapiens
catgctcaacccccctcccaga

SEQ ID NO: 4452388 - DNA, 15 bp, Homo sapiens
catgctccagggtca

SEQ ID NO: 4452389 - DNA, 18 bp, Homo sapiens
catgctccagggtcaggc

SEQ ID NO: 4452390 - DNA, 14 bp, Homo sapiens
catgctcctcacct

SEQ ID NO: 4452391 - DNA, 17 bp, Homo sapiens
catgctccttgagagga

SEQ ID NO: 4452392 - DNA, 16 bp, Homo sapiens
catgctctctcacctg

SEQ ID NO: 4452393 - DNA, 15 bp, Homo sapiens
catgctctctgcagc

SEQ ID NO: 4452394 - DNA, 21 bp, Homo sapiens
catgctctctgcagccagccc

SEQ ID NO: 4452395 - DNA, 15 bp, Homo sapiens
catgctgatttacca

SEQ ID NO: 4452396 - DNA, 19 bp, Homo sapiens
catgctgggccactgggga

SEQ ID NO: 4452397 - DNA, 21 bp, Homo sapiens
catgctgggccactggggact

SEQ ID NO: 4452398 - DNA, 22 bp, Homo sapiens
catgcttctcatcttgtgaaat

SEQ ID NO: 4452399 - DNA, 18 bp, Homo sapiens
catgcttgacatacctac

SEQ ID NO: 4452400 - DNA, 15 bp, Homo sapiens
catgctttgagtcca

SEQ ID NO: 4452401 - DNA, 19 bp, Homo sapiens
catgctttgagtccacgcc

SEQ ID NO: 4452402 - DNA, 20 bp, Homo sapiens
catgctttgagtccacgccc

SEQ ID NO: 4452403 - DNA, 16 bp, Homo sapiens
catggaaaaatgccat

SEQ ID NO: 4452404 - DNA, 20 bp, Homo sapiens
catggaagaggctacagggc

SEQ ID NO: 4452405 - DNA, 17 bp, Homo sapiens
catggaatcgaagtgtt

SEQ ID NO: 4452406 - DNA, 18 bp, Homo sapiens
catggacatttagaagaa

SEQ ID NO: 4452407 - DNA, 15 bp, Homo sapiens
catggagaaaccctg

SEQ ID NO: 4452408 - DNA, 14 bp, Homo sapiens
catggagagctaga

SEQ ID NO: 4452409 - DNA, 15 bp, Homo sapiens
cattcgaatctctgc

SEQ ID NO: 4452410 - DNA, 13 bp, Homo sapiens
cattcggtgtgaa

SEQ ID NO: 4452411 - DNA, 20 bp, Homo sapiens
cattcggtgtgaacttttct

SEQ ID NO: 4452412 - DNA, 15 bp, Homo sapiens
cattcgtgagctggg

SEQ ID NO: 4452413 - DNA, 14 bp, Homo sapiens
cattctaaaacaca

SEQ ID NO: 4452414 - DNA, 16 bp, Homo sapiens
cattctacacagagca

SEQ ID NO: 4452415 - DNA, 17 bp, Homo sapiens
cattctacacagagcag

SEQ ID NO: 4452416 - DNA, 18 bp, Homo sapiens
cattctagatcctgcacc

SEQ ID NO: 4452417 - DNA, 14 bp, Homo sapiens
cattctatctactg

SEQ ID NO: 4452418 - DNA, 23 bp, Homo sapiens
cattctcataattcctacagcac

SEQ ID NO: 4452419 - DNA, 22 bp, Homo sapiens
cattctccaggggtttacagtg

SEQ ID NO: 4452420 - DNA, 23 bp, Homo sapiens
cattctccccctctttgggcagt

SEQ ID NO: 4452421 - DNA, 21 bp, Homo sapiens
cattctcctcagtggcttctc

SEQ ID NO: 4452422 - DNA, 17 bp, Homo sapiens
cattctcgcttccctga

SEQ ID NO: 4452423 - DNA, 23 bp, Homo sapiens
cattctcgtgagtcatttaaatg

SEQ ID NO: 4452424 - DNA, 21 bp, Homo sapiens
cattctctagacaaaatcaaa

SEQ ID NO: 4452425 - DNA, 12 bp, Homo sapiens
cattctctctcc

SEQ ID NO: 4452426 - DNA, 20 bp, Homo sapiens
cattctctctcctgtccaac

SEQ ID NO: 4452427 - DNA, 14 bp, Homo sapiens
cattctctgtctca

SEQ ID NO: 4452428 - DNA, 23 bp, Homo sapiens
cattctctgtctcatccatcatc

SEQ ID NO: 4452429 - DNA, 16 bp, Homo sapiens
cattctgaaggagccc

SEQ ID NO: 4452430 - DNA, 15 bp, Homo sapiens
cattctgaattaatt

SEQ ID NO: 4452431 - DNA, 17 bp, Homo sapiens
cattctgccaaagtaaa

SEQ ID NO: 4452432 - DNA, 11 bp, Homo sapiens
cattctgcctt

SEQ ID NO: 4452433 - DNA, 12 bp, Homo sapiens
cattctgccttg

SEQ ID NO: 4452434 - DNA, 12 bp, Homo sapiens
cattctgtgcag

SEQ ID NO: 4452435 - DNA, 22 bp, Homo sapiens
cattctgtgtcccatgtcccgt

SEQ ID NO: 4452436 - DNA, 15 bp, Homo sapiens
cattcttagcctgtg

SEQ ID NO: 4452437 - DNA, 20 bp, Homo sapiens
cattcttcagtttttcactt

SEQ ID NO: 4452438 - DNA, 15 bp, Homo sapiens
cattcttccatcatc

SEQ ID NO: 4452439 - DNA, 23 bp, Homo sapiens
cattcttccatcatcactgtaaa

SEQ ID NO: 4452440 - DNA, 16 bp, Homo sapiens
cattcttctctgttgt

SEQ ID NO: 4452441 - DNA, 18 bp, Homo sapiens
cattcttctctgttgtcg

SEQ ID NO: 4452442 - DNA, 18 bp, Homo sapiens
cattcttctggtgctact

SEQ ID NO: 4452443 - DNA, 14 bp, Homo sapiens
cattcttgcttgtg

SEQ ID NO: 4452444 - DNA, 16 bp, Homo sapiens
cattcttggttgttaa

SEQ ID NO: 4452445 - DNA, 20 bp, Homo sapiens
cattctttatagtgaagtgt

SEQ ID NO: 4452446 - DNA, 12 bp, Homo sapiens
cattctttccca

SEQ ID NO: 4452447 - DNA, 13 bp, Homo sapiens
cattctttcccag

SEQ ID NO: 4452448 - DNA, 13 bp, Homo sapiens
cattctttgcagg

SEQ ID NO: 4452449 - DNA, 15 bp, Homo sapiens
cattcttttgccaca

SEQ ID NO: 4452450 - DNA, 21 bp, Homo sapiens
cattcttttgccacatcccta

SEQ ID NO: 4452451 - DNA, 18 bp, Homo sapiens
cattgaaaaatttctaac

SEQ ID NO: 4452452 - DNA, 12 bp, Homo sapiens
cattgaaagaag

SEQ ID NO: 4452453 - DNA, 22 bp, Homo sapiens
cattgaaagcttcaaagtttat

SEQ ID NO: 4452454 - DNA, 16 bp, Homo sapiens
cattgaacacaaactg

SEQ ID NO: 4452455 - DNA, 17 bp, Homo sapiens
cattgaacacaaactgt

SEQ ID NO: 4452456 - DNA, 19 bp, Homo sapiens
cattgacttcattttatat

SEQ ID NO: 4452457 - DNA, 17 bp, Homo sapiens
cattgagagtaagcacg

SEQ ID NO: 4452458 - DNA, 21 bp, Homo sapiens
cattgatctgttttacaggaa

SEQ ID NO: 4452459 - DNA, 14 bp, Homo sapiens
cattgcacctatct

SEQ ID NO: 4452460 - DNA, 21 bp, Homo sapiens
cattgcacctatctcagccat

SEQ ID NO: 4452461 - DNA, 20 bp, Homo sapiens
cattgcagcagataactttt

SEQ ID NO: 4452462 - DNA, 15 bp, Homo sapiens
cattgccaaaaagga

SEQ ID NO: 4452463 - DNA, 17 bp, Homo sapiens
cattgcccagtgagccc

SEQ ID NO: 4452464 - DNA, 19 bp, Homo sapiens
cattgcccagtgagccctg

SEQ ID NO: 4452465 - DNA, 20 bp, Homo sapiens
cattgcccagtgagccctgc

SEQ ID NO: 4452466 - DNA, 22 bp, Homo sapiens
cattgccgctgtataaagcatg

SEQ ID NO: 4452467 - DNA, 18 bp, Homo sapiens
cattgctacctcagtgct

SEQ ID NO: 4452468 - DNA, 20 bp, Homo sapiens
cattgctactgctcagcttc

SEQ ID NO: 4452469 - DNA, 21 bp, Homo sapiens
cattgctctatgtctgccttc

SEQ ID NO: 4452470 - DNA, 16 bp, Homo sapiens
cattgctggactctga

SEQ ID NO: 4452471 - DNA, 19 bp, Homo sapiens
cattgctggtagagacccc

SEQ ID NO: 4452472 - DNA, 15 bp, Homo sapiens
cattgctgtccttgg

SEQ ID NO: 4452473 - DNA, 16 bp, Homo sapiens
cattgctgtccttggg

SEQ ID NO: 4452474 - DNA, 18 bp, Homo sapiens
cattgctgtccttgggta

SEQ ID NO: 4452475 - DNA, 17 bp, Homo sapiens
cattggaatgccttgga

SEQ ID NO: 4452476 - DNA, 14 bp, Homo sapiens
cattggacagaaaa

SEQ ID NO: 4452477 - DNA, 21 bp, Homo sapiens
cattggacagaaaatgcaatg

SEQ ID NO: 4452478 - DNA, 11 bp, Homo sapiens
cattggatatt

SEQ ID NO: 4452479 - DNA, 13 bp, Homo sapiens
cattggccgagct

SEQ ID NO: 4452480 - DNA, 19 bp, Homo sapiens
cattggccgagctcctggg

SEQ ID NO: 4452481 - DNA, 15 bp, Homo sapiens
cattggggctcccag

SEQ ID NO: 4452482 - DNA, 23 bp, Homo sapiens
cattggggtagttgtgtttcaac

SEQ ID NO: 4452483 - DNA, 22 bp, Homo sapiens
cattggtgaagtaaattaggca

SEQ ID NO: 4452484 - DNA, 14 bp, Homo sapiens
cattggtgactcac

SEQ ID NO: 4452485 - DNA, 13 bp, Homo sapiens
cattgtactccag

SEQ ID NO: 4452486 - DNA, 22 bp, Homo sapiens
cattgtactgttgctttaatat

SEQ ID NO: 4452487 - DNA, 21 bp, Homo sapiens
cattgtccaatcctatgtttt

SEQ ID NO: 4452488 - DNA, 21 bp, Homo sapiens
cattgtctttatatgaacata

SEQ ID NO: 4452489 - DNA, 13 bp, Homo sapiens
cattgtggctcct

SEQ ID NO: 4452490 - DNA, 15 bp, Homo sapiens
cattgttcaactccc

SEQ ID NO: 4452491 - DNA, 14 bp, Homo sapiens
cattgttcacttct

SEQ ID NO: 4452492 - DNA, 13 bp, Homo sapiens
cattgttgagcta

SEQ ID NO: 4452493 - DNA, 14 bp, Homo sapiens
cattgttgtaaagt

SEQ ID NO: 4452494 - DNA, 17 bp, Homo sapiens
cattgttgtaaagtatt

SEQ ID NO: 4452495 - DNA, 12 bp, Homo sapiens
cattgttttgaa

SEQ ID NO: 4452496 - DNA, 12 bp, Homo sapiens
cattgtttttgt

SEQ ID NO: 4452497 - DNA, 17 bp, Homo sapiens
catttaaaacagacact

SEQ ID NO: 4452498 - DNA, 20 bp, Homo sapiens
catttaaatacagtcttcca

SEQ ID NO: 4452499 - DNA, 20 bp, Homo sapiens
catttaaatgtgtacaatgt

SEQ ID NO: 4452500 - DNA, 21 bp, Homo sapiens
catttaaatgtgtacaatgta

SEQ ID NO: 4452501 - DNA, 17 bp, Homo sapiens
catttaaattttttggc

SEQ ID NO: 4452502 - DNA, 18 bp, Homo sapiens
catttaaatttttttcct

SEQ ID NO: 4452503 - DNA, 14 bp, Homo sapiens
catttaacattgtt

SEQ ID NO: 4452504 - DNA, 15 bp, Homo sapiens
catttaacattgttt

SEQ ID NO: 4452505 - DNA, 18 bp, Homo sapiens
catttaacattgtttttg

SEQ ID NO: 4452506 - DNA, 14 bp, Homo sapiens
catttaagggaaaa

SEQ ID NO: 4452507 - DNA, 16 bp, Homo sapiens
catttaagggaaaaat

SEQ ID NO: 4452508 - DNA, 14 bp, Homo sapiens
catttaatcaatat

SEQ ID NO: 4452509 - DNA, 13 bp, Homo sapiens
catttaatttcat

SEQ ID NO: 4452510 - DNA, 16 bp, Homo sapiens
catttaatttcatgta

SEQ ID NO: 4452511 - DNA, 17 bp, Homo sapiens
catttaatttcatgtat

SEQ ID NO: 4452512 - DNA, 18 bp, Homo sapiens
catttacaaaagatttat

SEQ ID NO: 4452513 - DNA, 12 bp, Homo sapiens
catttacacttt

SEQ ID NO: 4452514 - DNA, 19 bp, Homo sapiens
catttacacttttgagact

SEQ ID NO: 4452515 - DNA, 24 bp, Homo sapiens
catttacattaggtattacaagta

SEQ ID NO: 4452516 - DNA, 15 bp, Homo sapiens
catttaccactgtat

SEQ ID NO: 4452517 - DNA, 13 bp, Homo sapiens
catttactgacca

SEQ ID NO: 4452518 - DNA, 22 bp, Homo sapiens
catttagctaaacggattccaa

SEQ ID NO: 4452519 - DNA, 17 bp, Homo sapiens
catttagtaaggatttt

SEQ ID NO: 4452520 - DNA, 13 bp, Homo sapiens
catttagtgtgaa

SEQ ID NO: 4452521 - DNA, 15 bp, Homo sapiens
catttataatactgt

SEQ ID NO: 4452522 - DNA, 19 bp, Homo sapiens
catttataccagttttctt

SEQ ID NO: 4452523 - DNA, 21 bp, Homo sapiens
catttataccagttttcttta

SEQ ID NO: 4452524 - DNA, 20 bp, Homo sapiens
catttatatgggtttatttt

SEQ ID NO: 4452525 - DNA, 23 bp, Homo sapiens
catttatctttgtattcttcatg

SEQ ID NO: 4452526 - DNA, 22 bp, Homo sapiens
catttatgtgaggtaattattg

SEQ ID NO: 4452527 - DNA, 12 bp, Homo sapiens
catttcaaatgt

SEQ ID NO: 4452528 - DNA, 15 bp, Homo sapiens
catttttttccaggc

SEQ ID NO: 4452529 - DNA, 23 bp, Homo sapiens
ccaaaaacatttgattaataaaa

SEQ ID NO: 4452530 - DNA, 14 bp, Homo sapiens
ccaaaaagcacata

SEQ ID NO: 4452531 - DNA, 15 bp, Homo sapiens
ccaaaaatagaaatt

SEQ ID NO: 4452532 - DNA, 13 bp, Homo sapiens
ccaaaaatagcta

SEQ ID NO: 4452533 - DNA, 19 bp, Homo sapiens
ccaaaaatagtcaaaaatt

SEQ ID NO: 4452534 - DNA, 17 bp, Homo sapiens
ccaaaaatctgcctggg

SEQ ID NO: 4452535 - DNA, 19 bp, Homo sapiens
ccaaaaatgtgtaagaaca

SEQ ID NO: 4452536 - DNA, 18 bp, Homo sapiens
ccaaaacaagccaaagag

SEQ ID NO: 4452537 - DNA, 14 bp, Homo sapiens
ccaaaacaatgttt

SEQ ID NO: 4452538 - DNA, 21 bp, Homo sapiens
ccaaaacatttctaagactac

SEQ ID NO: 4452539 - DNA, 18 bp, Homo sapiens
ccaaaacattttaaatga

SEQ ID NO: 4452540 - DNA, 16 bp, Homo sapiens
ccaaaagattgctgaa

SEQ ID NO: 4452541 - DNA, 15 bp, Homo sapiens
ccaaaagcgccctca

SEQ ID NO: 4452542 - DNA, 15 bp, Homo sapiens
ccaaaagctttttat

SEQ ID NO: 4452543 - DNA, 17 bp, Homo sapiens
ccaaaaggaaaaagctc

SEQ ID NO: 4452544 - DNA, 22 bp, Homo sapiens
ccaaaagtcaaaaggtgcctgt

SEQ ID NO: 4452545 - DNA, 22 bp, Homo sapiens
ccaaaagtccctccctgcctga

SEQ ID NO: 4452546 - DNA, 17 bp, Homo sapiens
ccaaaataccagagcct

SEQ ID NO: 4452547 - DNA, 19 bp, Homo sapiens
ccaaaatattaacattctt

SEQ ID NO: 4452548 - DNA, 16 bp, Homo sapiens
ccaaaatccaaaaagc

SEQ ID NO: 4452549 - DNA, 19 bp, Homo sapiens
ccaaaatgacatcttttta

SEQ ID NO: 4452550 - DNA, 17 bp, Homo sapiens
ccaaaatgttgaaatat

SEQ ID NO: 4452551 - DNA, 16 bp, Homo sapiens
ccaaacaatgcagatc

SEQ ID NO: 4452552 - DNA, 14 bp, Homo sapiens
ccaaacacccagag

SEQ ID NO: 4452553 - DNA, 14 bp, Homo sapiens
ccaaacaggacagc

SEQ ID NO: 4452554 - DNA, 16 bp, Homo sapiens
ccaaacaggctcagag

SEQ ID NO: 4452555 - DNA, 13 bp, Homo sapiens
ccaaacatctggc

SEQ ID NO: 4452556 - DNA, 13 bp, Homo sapiens
ccaaaccagcagg

SEQ ID NO: 4452557 - DNA, 23 bp, Homo sapiens
ccaaacccaggttcatgaatatg

SEQ ID NO: 4452558 - DNA, 13 bp, Homo sapiens
ccaaaccccagcc

SEQ ID NO: 4452559 - DNA, 14 bp, Homo sapiens
ccaaaccccagccc

SEQ ID NO: 4452560 - DNA, 13 bp, Homo sapiens
ccaaacctggttc

SEQ ID NO: 4452561 - DNA, 15 bp, Homo sapiens
ccaaacgctgagcca

SEQ ID NO: 4452562 - DNA, 16 bp, Homo sapiens
ccaaactactgaatga

SEQ ID NO: 4452563 - DNA, 21 bp, Homo sapiens
ccaaactgactcaacagtcat

SEQ ID NO: 4452564 - DNA, 20 bp, Homo sapiens
ccaaactgggtcttcagctt

SEQ ID NO: 4452565 - DNA, 12 bp, Homo sapiens
ccaaagaaagtt

SEQ ID NO: 4452566 - DNA, 20 bp, Homo sapiens
ccaaagaaatgaacattcca

SEQ ID NO: 4452567 - DNA, 16 bp, Homo sapiens
ccaaagaattggaatc

SEQ ID NO: 4452568 - DNA, 13 bp, Homo sapiens
ccaaagaggctgc

SEQ ID NO: 4452569 - DNA, 21 bp, Homo sapiens
ccaaagaggctgcccctctca

SEQ ID NO: 4452570 - DNA, 14 bp, Homo sapiens
ccaaagatttcata

SEQ ID NO: 4452571 - DNA, 21 bp, Homo sapiens
ccaaagcaaccacaaatgcat

SEQ ID NO: 4452572 - DNA, 16 bp, Homo sapiens
ccaaagcggtccctgt

SEQ ID NO: 4452573 - DNA, 23 bp, Homo sapiens
ccaaagctagggtggcccttgca

SEQ ID NO: 4452574 - DNA, 18 bp, Homo sapiens
ccaaagctctgaatagtt

SEQ ID NO: 4452575 - DNA, 19 bp, Homo sapiens
ccaaagtgctgggattaca

SEQ ID NO: 4452576 - DNA, 22 bp, Homo sapiens
ccaaagtgctgggattacaggt

SEQ ID NO: 4452577 - DNA, 16 bp, Homo sapiens
ccaaagttcaacttgg

SEQ ID NO: 4452578 - DNA, 23 bp, Homo sapiens
ccaaataatattttagattacag

SEQ ID NO: 4452579 - DNA, 15 bp, Homo sapiens
ccaaataatgtctct

SEQ ID NO: 4452580 - DNA, 17 bp, Homo sapiens
ccaaataatgtctctgt

SEQ ID NO: 4452581 - DNA, 19 bp, Homo sapiens
ccaaatagtgtgaaatata

SEQ ID NO: 4452582 - DNA, 21 bp, Homo sapiens
ccaaatccttggagtcccagg

SEQ ID NO: 4452583 - DNA, 22 bp, Homo sapiens
ccaaatccttggagtcccaggg

SEQ ID NO: 4452584 - DNA, 22 bp, Homo sapiens
ccaaatcgtggcacgtattgct

SEQ ID NO: 4452585 - DNA, 19 bp, Homo sapiens
ccaaatctagaatttagtg

SEQ ID NO: 4452586 - DNA, 16 bp, Homo sapiens
ccaaatgaaatgccaa

SEQ ID NO: 4452587 - DNA, 23 bp, Homo sapiens
ccaaatgcagggaggggaggcag

SEQ ID NO: 4452588 - DNA, 18 bp, Homo sapiens
ccaaatgtcctttctcag

SEQ ID NO: 4452589 - DNA, 19 bp, Homo sapiens
ccaaatgtcctttctcaga

SEQ ID NO: 4452590 - DNA, 17 bp, Homo sapiens
ccaaatgttcatcaatg

SEQ ID NO: 4452591 - DNA, 13 bp, Homo sapiens
ccaaattcagttt

SEQ ID NO: 4452592 - DNA, 19 bp, Homo sapiens
ccaaattcagtttcataaa

SEQ ID NO: 4452593 - DNA, 23 bp, Homo sapiens
ccaaattgagtttaacaataata

SEQ ID NO: 4452594 - DNA, 14 bp, Homo sapiens
ccaaattgcttcta

SEQ ID NO: 4452595 - DNA, 16 bp, Homo sapiens
ccaaattgcttctagg

SEQ ID NO: 4452596 - DNA, 19 bp, Homo sapiens
ccaaattgcttctaggagt

SEQ ID NO: 4452597 - DNA, 17 bp, Homo sapiens
ccaaattgtgcttctcc

SEQ ID NO: 4452598 - DNA, 16 bp, Homo sapiens
ccaaattgtgtatata

SEQ ID NO: 4452599 - DNA, 23 bp, Homo sapiens
ccaaatttcatacctatcatctt

SEQ ID NO: 4452600 - DNA, 20 bp, Homo sapiens
ccaaatttgattgatttgaa

SEQ ID NO: 4452601 - DNA, 14 bp, Homo sapiens
ccaacacgagcagg

SEQ ID NO: 4452602 - DNA, 15 bp, Homo sapiens
ccaacacgcctggct

SEQ ID NO: 4452603 - DNA, 15 bp, Homo sapiens
ccaacactgccagca

SEQ ID NO: 4452604 - DNA, 17 bp, Homo sapiens
ccaacagaacccacagt

SEQ ID NO: 4452605 - DNA, 12 bp, Homo sapiens
ccaacagttgta

SEQ ID NO: 4452606 - DNA, 20 bp, Homo sapiens
ccaacagttgtatgtttgct

SEQ ID NO: 4452607 - DNA, 15 bp, Homo sapiens
ccaacataaaaatga

SEQ ID NO: 4452608 - DNA, 21 bp, Homo sapiens
ccaacatcccattgccctggt

SEQ ID NO: 4452609 - DNA, 13 bp, Homo sapiens
ccaacatgcactg

SEQ ID NO: 4452610 - DNA, 19 bp, Homo sapiens
ccaacatgggagggatcag

SEQ ID NO: 4452611 - DNA, 22 bp, Homo sapiens
ccaacatgggagggatcagccc

SEQ ID NO: 4452612 - DNA, 15 bp, Homo sapiens
ccaacatgtggctcc

SEQ ID NO: 4452613 - DNA, 17 bp, Homo sapiens
ccaacatttcttaaatt

SEQ ID NO: 4452614 - DNA, 13 bp, Homo sapiens
ccaacccccaccc

SEQ ID NO: 4452615 - DNA, 16 bp, Homo sapiens
ccaacccccaccccac

SEQ ID NO: 4452616 - DNA, 19 bp, Homo sapiens
ccaacccccaccccacact

SEQ ID NO: 4452617 - DNA, 15 bp, Homo sapiens
ccaaccccccagcac

SEQ ID NO: 4452618 - DNA, 18 bp, Homo sapiens
ccaaccccccagcactga

SEQ ID NO: 4452619 - DNA, 19 bp, Homo sapiens
ccaaccccccagcactgag

SEQ ID NO: 4452620 - DNA, 13 bp, Homo sapiens
ccaacccctcctc

SEQ ID NO: 4452621 - DNA, 20 bp, Homo sapiens
ccaacccctcctccctcaga

SEQ ID NO: 4452622 - DNA, 21 bp, Homo sapiens
ccaacccctcctccctcagac

SEQ ID NO: 4452623 - DNA, 14 bp, Homo sapiens
ccaaccctgtctgt

SEQ ID NO: 4452624 - DNA, 18 bp, Homo sapiens
ccaacctcagggctccca

SEQ ID NO: 4452625 - DNA, 16 bp, Homo sapiens
ccaacctgaccaacat

SEQ ID NO: 4452626 - DNA, 13 bp, Homo sapiens
ccaacctggacaa

SEQ ID NO: 4452627 - DNA, 23 bp, Homo sapiens
ccaaccttagatgttctaagtct

SEQ ID NO: 4452628 - DNA, 16 bp, Homo sapiens
ccaacctttccctcac

SEQ ID NO: 4452629 - DNA, 17 bp, Homo sapiens
ccaacctttccctcacc

SEQ ID NO: 4452630 - DNA, 19 bp, Homo sapiens
ccaacctttccctcacccc

SEQ ID NO: 4452631 - DNA, 23 bp, Homo sapiens
ccaacctttccctcaccccctcc

SEQ ID NO: 4452632 - DNA, 16 bp, Homo sapiens
ccaacgtcccctccgc

SEQ ID NO: 4452633 - DNA, 19 bp, Homo sapiens
ccaactaatgccttactct

SEQ ID NO: 4452634 - DNA, 22 bp, Homo sapiens
ccaactactaatagaataaagg

SEQ ID NO: 4452635 - DNA, 15 bp, Homo sapiens
ccaactagctgggac

SEQ ID NO: 4452636 - DNA, 17 bp, Homo sapiens
ccaactagctgggacta

SEQ ID NO: 4452637 - DNA, 14 bp, Homo sapiens
ccaactatgattat

SEQ ID NO: 4452638 - DNA, 15 bp, Homo sapiens
ccaactccaggggca

SEQ ID NO: 4452639 - DNA, 23 bp, Homo sapiens
ccaactccatggggttcgagact

SEQ ID NO: 4452640 - DNA, 14 bp, Homo sapiens
ccaactccctctct

SEQ ID NO: 4452641 - DNA, 20 bp, Homo sapiens
ccaactcctttcagccacat

SEQ ID NO: 4452642 - DNA, 12 bp, Homo sapiens
ccaactctcccc

SEQ ID NO: 4452643 - DNA, 18 bp, Homo sapiens
ccaactctccccagtgcc

SEQ ID NO: 4452644 - DNA, 22 bp, Homo sapiens
ccaactctccccagtgcctgcc

SEQ ID NO: 4452645 - DNA, 14 bp, Homo sapiens
ccaactctcctggc

SEQ ID NO: 4452646 - DNA, 20 bp, Homo sapiens
ccaattattgatatatatta

SEQ ID NO: 4452647 - DNA, 14 bp, Homo sapiens
ccaattctcccctc

SEQ ID NO: 4452648 - DNA, 18 bp, Homo sapiens
ccaattgcctcttgcagg

SEQ ID NO: 4452649 - DNA, 22 bp, Homo sapiens
ccaattgcctcttgcaggctga

SEQ ID NO: 4452650 - DNA, 11 bp, Homo sapiens
ccaatttcccc

SEQ ID NO: 4452651 - DNA, 20 bp, Homo sapiens
ccaatttcggattttttcca

SEQ ID NO: 4452652 - DNA, 23 bp, Homo sapiens
ccaatttggtaaaaatgctgctc

SEQ ID NO: 4452653 - DNA, 12 bp, Homo sapiens
ccaatttgtaat

SEQ ID NO: 4452654 - DNA, 18 bp, Homo sapiens
ccacaaaattagaaagga

SEQ ID NO: 4452655 - DNA, 19 bp, Homo sapiens
ccacaaacacagccctgga

SEQ ID NO: 4452656 - DNA, 17 bp, Homo sapiens
ccacaaacactgtgggg

SEQ ID NO: 4452657 - DNA, 21 bp, Homo sapiens
ccacaaacctggattttttat

SEQ ID NO: 4452658 - DNA, 17 bp, Homo sapiens
ccacaaagccccccagc

SEQ ID NO: 4452659 - DNA, 16 bp, Homo sapiens
ccacaaatgcaggtgt

SEQ ID NO: 4452660 - DNA, 12 bp, Homo sapiens
ccacaacatgag

SEQ ID NO: 4452661 - DNA, 17 bp, Homo sapiens
ccacaacatgaggccac

SEQ ID NO: 4452662 - DNA, 19 bp, Homo sapiens
ccacaactaacaatgcctt

SEQ ID NO: 4452663 - DNA, 22 bp, Homo sapiens
ccacaagaaatgaaagcaggga

SEQ ID NO: 4452664 - DNA, 19 bp, Homo sapiens
ccacaagattcccagagac

SEQ ID NO: 4452665 - DNA, 17 bp, Homo sapiens
ccacaagcctgagaact

SEQ ID NO: 4452666 - DNA, 14 bp, Homo sapiens
ccacaagctgcact

SEQ ID NO: 4452667 - DNA, 17 bp, Homo sapiens
ccacaagtccagctggg

SEQ ID NO: 4452668 - DNA, 13 bp, Homo sapiens
ccacaatctggct

SEQ ID NO: 4452669 - DNA, 20 bp, Homo sapiens
ccacaatctggcttagtgcc

SEQ ID NO: 4452670 - DNA, 21 bp, Homo sapiens
ccacaatctggcttagtgcca

SEQ ID NO: 4452671 - DNA, 20 bp, Homo sapiens
ccacacagacttgggcaggg

SEQ ID NO: 4452672 - DNA, 11 bp, Homo sapiens
ccacacaggca

SEQ ID NO: 4452673 - DNA, 14 bp, Homo sapiens
ccacacaggcaggg

SEQ ID NO: 4452674 - DNA, 15 bp, Homo sapiens
ccacacaggcagggc

SEQ ID NO: 4452675 - DNA, 19 bp, Homo sapiens
ccacacaggcagggcctgg

SEQ ID NO: 4452676 - DNA, 14 bp, Homo sapiens
ccacaccactgcca

SEQ ID NO: 4452677 - DNA, 20 bp, Homo sapiens
ccacaccataagctactgcc

SEQ ID NO: 4452678 - DNA, 21 bp, Homo sapiens
ccacaccataagctactgcca

SEQ ID NO: 4452679 - DNA, 12 bp, Homo sapiens
ccacacccagga

SEQ ID NO: 4452680 - DNA, 15 bp, Homo sapiens
ccacacccaggaagg

SEQ ID NO: 4452681 - DNA, 17 bp, Homo sapiens
ccacacccaggaaggga

SEQ ID NO: 4452682 - DNA, 18 bp, Homo sapiens
ccacacctcagttccctt

SEQ ID NO: 4452683 - DNA, 18 bp, Homo sapiens
ccacacctgaacttgcct

SEQ ID NO: 4452684 - DNA, 19 bp, Homo sapiens
ccacacctgaacttgccta

SEQ ID NO: 4452685 - DNA, 24 bp, Homo sapiens
ccacacgccccggtcccccagagc

SEQ ID NO: 4452686 - DNA, 17 bp, Homo sapiens
ccacactccttgtcaac

SEQ ID NO: 4452687 - DNA, 19 bp, Homo sapiens
ccacactggggtgccgcct

SEQ ID NO: 4452688 - DNA, 23 bp, Homo sapiens
ccacacttgaagcctaaatttgt

SEQ ID NO: 4452689 - DNA, 21 bp, Homo sapiens
ccacacttgttccagctcttt

SEQ ID NO: 4452690 - DNA, 12 bp, Homo sapiens
ccacagaacctt

SEQ ID NO: 4452691 - DNA, 23 bp, Homo sapiens
ccacagaaccttcaacccagtgg

SEQ ID NO: 4452692 - DNA, 17 bp, Homo sapiens
ccacagacaactcacat

SEQ ID NO: 4452693 - DNA, 14 bp, Homo sapiens
ccacagaggcccca

SEQ ID NO: 4452694 - DNA, 15 bp, Homo sapiens
ccacagaggccccac

SEQ ID NO: 4452695 - DNA, 19 bp, Homo sapiens
ccacagagtgctggactgt

SEQ ID NO: 4452696 - DNA, 21 bp, Homo sapiens
ccacagcaagccatcatcctc

SEQ ID NO: 4452697 - DNA, 21 bp, Homo sapiens
ccacagcaagtacagcggctc

SEQ ID NO: 4452698 - DNA, 15 bp, Homo sapiens
ccacagcagcatttt

SEQ ID NO: 4452699 - DNA, 18 bp, Homo sapiens
ccacagcagttgaaaaga

SEQ ID NO: 4452700 - DNA, 19 bp, Homo sapiens
ccacagcctcccctgccag

SEQ ID NO: 4452701 - DNA, 21 bp, Homo sapiens
ccacagccttgcagcggctcc

SEQ ID NO: 4452702 - DNA, 12 bp, Homo sapiens
ccacagcgtccc

SEQ ID NO: 4452703 - DNA, 15 bp, Homo sapiens
ccacagcgtccctgg

SEQ ID NO: 4452704 - DNA, 16 bp, Homo sapiens
ccacagcgtccctggc

SEQ ID NO: 4452705 - DNA, 17 bp, Homo sapiens
ccacagcgtccctggcg

SEQ ID NO: 4452706 - DNA, 15 bp, Homo sapiens
ccacagctatttaga

SEQ ID NO: 4452707 - DNA, 21 bp, Homo sapiens
ccacagctatttagaagcatc

SEQ ID NO: 4452708 - DNA, 13 bp, Homo sapiens
ccacagctcccac

SEQ ID NO: 4452709 - DNA, 19 bp, Homo sapiens
ccacagctcccaccccacc

SEQ ID NO: 4452710 - DNA, 17 bp, Homo sapiens
ccacagctgctggagaa

SEQ ID NO: 4452711 - DNA, 19 bp, Homo sapiens
ccacagctgctgttctcag

SEQ ID NO: 4452712 - DNA, 21 bp, Homo sapiens
ccacagctgctgttctcagga

SEQ ID NO: 4452713 - DNA, 13 bp, Homo sapiens
ccacagctggcct

SEQ ID NO: 4452714 - DNA, 16 bp, Homo sapiens
ccacagctggggccgg

SEQ ID NO: 4452715 - DNA, 17 bp, Homo sapiens
ccacagctggggccggt

SEQ ID NO: 4452716 - DNA, 19 bp, Homo sapiens
ccacaggagggccagcgct

SEQ ID NO: 4452717 - DNA, 19 bp, Homo sapiens
ccacaggcacacaggtctc

SEQ ID NO: 4452718 - DNA, 14 bp, Homo sapiens
ccacaggcctgaga

SEQ ID NO: 4452719 - DNA, 14 bp, Homo sapiens
ccacagggctaaga

SEQ ID NO: 4452720 - DNA, 17 bp, Homo sapiens
ccacagggctaagagct

SEQ ID NO: 4452721 - DNA, 15 bp, Homo sapiens
ccacagtagtcttga

SEQ ID NO: 4452722 - DNA, 17 bp, Homo sapiens
ccacagtagtcttgatg

SEQ ID NO: 4452723 - DNA, 12 bp, Homo sapiens
ccacagtgctgt

SEQ ID NO: 4452724 - DNA, 13 bp, Homo sapiens
ccacagttttaat

SEQ ID NO: 4452725 - DNA, 20 bp, Homo sapiens
ccacataaattttaattcaa

SEQ ID NO: 4452726 - DNA, 16 bp, Homo sapiens
ccacataggaaaatgc

SEQ ID NO: 4452727 - DNA, 13 bp, Homo sapiens
ccacatcagggcg

SEQ ID NO: 4452728 - DNA, 22 bp, Homo sapiens
ccacatcagggcggcctcccag

SEQ ID NO: 4452729 - DNA, 17 bp, Homo sapiens
ccacatcccatgttgaa

SEQ ID NO: 4452730 - DNA, 13 bp, Homo sapiens
ccacatctgcctt

SEQ ID NO: 4452731 - DNA, 22 bp, Homo sapiens
ccacatctgccttaaaaccaaa

SEQ ID NO: 4452732 - DNA, 17 bp, Homo sapiens
ccacatgaggccatctc

SEQ ID NO: 4452733 - DNA, 22 bp, Homo sapiens
ccacatgaggccatctcaggag

SEQ ID NO: 4452734 - DNA, 14 bp, Homo sapiens
ccacatgcatgtct

SEQ ID NO: 4452735 - DNA, 22 bp, Homo sapiens
ccacatgcctgcgcctgctgcc

SEQ ID NO: 4452736 - DNA, 15 bp, Homo sapiens
ccacatggcacagag

SEQ ID NO: 4452737 - DNA, 17 bp, Homo sapiens
ccacatgggagcagtcc

SEQ ID NO: 4452738 - DNA, 18 bp, Homo sapiens
ccacatgggagcagtcca

SEQ ID NO: 4452739 - DNA, 20 bp, Homo sapiens
ccacatggtgtctcccaaca

SEQ ID NO: 4452740 - DNA, 22 bp, Homo sapiens
ccacattcttcagtttttcact

SEQ ID NO: 4452741 - DNA, 23 bp, Homo sapiens
ccacattcttcagtttttcactt

SEQ ID NO: 4452742 - DNA, 14 bp, Homo sapiens
ccacattttttgag

SEQ ID NO: 4452743 - DNA, 15 bp, Homo sapiens
ccaccaacatcccat

SEQ ID NO: 4452744 - DNA, 22 bp, Homo sapiens
ccaccaagctgctctccttcac

SEQ ID NO: 4452745 - DNA, 12 bp, Homo sapiens
ccaccacctagg

SEQ ID NO: 4452746 - DNA, 20 bp, Homo sapiens
ccaccacctaggccactcct

SEQ ID NO: 4452747 - DNA, 21 bp, Homo sapiens
ccaccagaacgcaccccactg

SEQ ID NO: 4452748 - DNA, 23 bp, Homo sapiens
ccaccagaacgcaccccactggg

SEQ ID NO: 4452749 - DNA, 12 bp, Homo sapiens
ccaccagcagca

SEQ ID NO: 4452750 - DNA, 20 bp, Homo sapiens
ccaccagccatcctccctcc

SEQ ID NO: 4452751 - DNA, 11 bp, Homo sapiens
ccaccagcccc

SEQ ID NO: 4452752 - DNA, 18 bp, Homo sapiens
ccaccagccttgctctct

SEQ ID NO: 4452753 - DNA, 21 bp, Homo sapiens
ccaccagccttgctctcttca

SEQ ID NO: 4452754 - DNA, 13 bp, Homo sapiens
ccaccagggctcc

SEQ ID NO: 4452755 - DNA, 20 bp, Homo sapiens
ccaccagggctccaggagcc

SEQ ID NO: 4452756 - DNA, 13 bp, Homo sapiens
ccaccagtgcctc

SEQ ID NO: 4452757 - DNA, 17 bp, Homo sapiens
ccaccagtgcctctccc

SEQ ID NO: 4452758 - DNA, 19 bp, Homo sapiens
ccaccagtgcctctccctg

SEQ ID NO: 4452759 - DNA, 14 bp, Homo sapiens
ccaccatccccacc

SEQ ID NO: 4452760 - DNA, 22 bp, Homo sapiens
ccaccatgctctctcacctgct

SEQ ID NO: 4452761 - DNA, 13 bp, Homo sapiens
ccaccatggacca

SEQ ID NO: 4452762 - DNA, 15 bp, Homo sapiens
ccaccatttctgggg

SEQ ID NO: 4452763 - DNA, 21 bp, Homo sapiens
ccaccatttctgggggccgca

SEQ ID NO: 4452764 - DNA, 14 bp, Homo sapiens
ccagaggctgggag

SEQ ID NO: 4452765 - DNA, 18 bp, Homo sapiens
ccagaggggacgctgagg

SEQ ID NO: 4452766 - DNA, 19 bp, Homo sapiens
ccagaggggacgctgagga

SEQ ID NO: 4452767 - DNA, 17 bp, Homo sapiens
ccagagggtgtggcttt

SEQ ID NO: 4452768 - DNA, 15 bp, Homo sapiens
ccagaggtccaggtc

SEQ ID NO: 4452769 - DNA, 22 bp, Homo sapiens
ccagaggtccaggtcccagccc

SEQ ID NO: 4452770 - DNA, 20 bp, Homo sapiens
ccagaggtctcatctcccag

SEQ ID NO: 4452771 - DNA, 20 bp, Homo sapiens
ccagaggtgggatcctccct

SEQ ID NO: 4452772 - DNA, 17 bp, Homo sapiens
ccagagtccctgcctgg

SEQ ID NO: 4452773 - DNA, 19 bp, Homo sapiens
ccagagtccctgcctggac

SEQ ID NO: 4452774 - DNA, 18 bp, Homo sapiens
ccagagtcttaagggtca

SEQ ID NO: 4452775 - DNA, 15 bp, Homo sapiens
ccagagtggagtctg

SEQ ID NO: 4452776 - DNA, 17 bp, Homo sapiens
ccagagtggagtctgag

SEQ ID NO: 4452777 - DNA, 19 bp, Homo sapiens
ccagagtggagtctgagtc

SEQ ID NO: 4452778 - DNA, 21 bp, Homo sapiens
ccagagtggagtctgagtctg

SEQ ID NO: 4452779 - DNA, 15 bp, Homo sapiens
ccagagtggcctggc

SEQ ID NO: 4452780 - DNA, 18 bp, Homo sapiens
ccagagtggcctggccag

SEQ ID NO: 4452781 - DNA, 19 bp, Homo sapiens
ccagagtggcctggccagg

SEQ ID NO: 4452782 - DNA, 21 bp, Homo sapiens
ccagagtggcctggccaggag

SEQ ID NO: 4452783 - DNA, 18 bp, Homo sapiens
ccagagtgtgggaaggga

SEQ ID NO: 4452784 - DNA, 20 bp, Homo sapiens
ccagatagtgtagctgagga

SEQ ID NO: 4452785 - DNA, 15 bp, Homo sapiens
ccagatataactgtc

SEQ ID NO: 4452786 - DNA, 15 bp, Homo sapiens
ccagatcaaggatgt

SEQ ID NO: 4452787 - DNA, 13 bp, Homo sapiens
ccagatcccaggc

SEQ ID NO: 4452788 - DNA, 18 bp, Homo sapiens
ccagatggaaaaataaca

SEQ ID NO: 4452789 - DNA, 16 bp, Homo sapiens
ccagatggactccagc

SEQ ID NO: 4452790 - DNA, 22 bp, Homo sapiens
ccagattcagggagaatgttgt

SEQ ID NO: 4452791 - DNA, 19 bp, Homo sapiens
ccagattggctcacactga

SEQ ID NO: 4452792 - DNA, 22 bp, Homo sapiens
ccagattggctcacactgagaa

SEQ ID NO: 4452793 - DNA, 19 bp, Homo sapiens
ccagcaaataaagcagtca

SEQ ID NO: 4452794 - DNA, 20 bp, Homo sapiens
ccagcaagcgggagcccgtg

SEQ ID NO: 4452795 - DNA, 20 bp, Homo sapiens
ccagcacagcttagatttca

SEQ ID NO: 4452796 - DNA, 19 bp, Homo sapiens
ccagcaccaacaccacggt

SEQ ID NO: 4452797 - DNA, 16 bp, Homo sapiens
ccagcaccctctcctg

SEQ ID NO: 4452798 - DNA, 18 bp, Homo sapiens
ccagcaccctctcctggg

SEQ ID NO: 4452799 - DNA, 22 bp, Homo sapiens
ccagcaccttctttctggactg

SEQ ID NO: 4452800 - DNA, 20 bp, Homo sapiens
ccagcactatgctttccttc

SEQ ID NO: 4452801 - DNA, 15 bp, Homo sapiens
ccagcactgaggaag

SEQ ID NO: 4452802 - DNA, 19 bp, Homo sapiens
ccagcactgcttgaggaaa

SEQ ID NO: 4452803 - DNA, 20 bp, Homo sapiens
ccagcactttgagaggctga

SEQ ID NO: 4452804 - DNA, 21 bp, Homo sapiens
ccagcactttgagaggctgag

SEQ ID NO: 4452805 - DNA, 15 bp, Homo sapiens
ccagcactttgggag

SEQ ID NO: 4452806 - DNA, 16 bp, Homo sapiens
ccagcactttgggagg

SEQ ID NO: 4452807 - DNA, 17 bp, Homo sapiens
ccagcactttgggaggc

SEQ ID NO: 4452808 - DNA, 14 bp, Homo sapiens
ccagcactttgtat

SEQ ID NO: 4452809 - DNA, 12 bp, Homo sapiens
ccagcagagcca

SEQ ID NO: 4452810 - DNA, 13 bp, Homo sapiens
ccagcagagccag

SEQ ID NO: 4452811 - DNA, 15 bp, Homo sapiens
ccagcagagccaggg

SEQ ID NO: 4452812 - DNA, 20 bp, Homo sapiens
ccagcagagccagggcaggg

SEQ ID NO: 4452813 - DNA, 14 bp, Homo sapiens
ccagcagaggcagg

SEQ ID NO: 4452814 - DNA, 17 bp, Homo sapiens
ccagcagaggcaggctg

SEQ ID NO: 4452815 - DNA, 23 bp, Homo sapiens
ccagcagcagcacttagacctgc

SEQ ID NO: 4452816 - DNA, 12 bp, Homo sapiens
ccagcagcatgg

SEQ ID NO: 4452817 - DNA, 22 bp, Homo sapiens
ccagcagcccccactgcacccc

SEQ ID NO: 4452818 - DNA, 15 bp, Homo sapiens
ccagcagcccctgag

SEQ ID NO: 4452819 - DNA, 23 bp, Homo sapiens
ccagcagcttaagtccagctcat

SEQ ID NO: 4452820 - DNA, 22 bp, Homo sapiens
ccagcaggccagggactcagcg

SEQ ID NO: 4452821 - DNA, 15 bp, Homo sapiens
ccagcagtacaataa

SEQ ID NO: 4452822 - DNA, 15 bp, Homo sapiens
ccagcagtgtggaga

SEQ ID NO: 4452823 - DNA, 12 bp, Homo sapiens
ccagcagtttct

SEQ ID NO: 4452824 - DNA, 15 bp, Homo sapiens
ccagcatccctggag

SEQ ID NO: 4452825 - DNA, 18 bp, Homo sapiens
ccagcatgacataacagt

SEQ ID NO: 4452826 - DNA, 20 bp, Homo sapiens
ccagcatgacataacagtgc

SEQ ID NO: 4452827 - DNA, 19 bp, Homo sapiens
ccagcattccagctctgcc

SEQ ID NO: 4452828 - DNA, 23 bp, Homo sapiens
ccagcattccagctctgcccccg

SEQ ID NO: 4452829 - DNA, 22 bp, Homo sapiens
ccagccaagggtcctcacccct

SEQ ID NO: 4452830 - DNA, 12 bp, Homo sapiens
ccagccacaggc

SEQ ID NO: 4452831 - DNA, 13 bp, Homo sapiens
ccagccaccccgg

SEQ ID NO: 4452832 - DNA, 17 bp, Homo sapiens
ccagccacttgactggc

SEQ ID NO: 4452833 - DNA, 19 bp, Homo sapiens
ccagccagatcctcttggt

SEQ ID NO: 4452834 - DNA, 19 bp, Homo sapiens
ccagccagcctcagaaggc

SEQ ID NO: 4452835 - DNA, 14 bp, Homo sapiens
ccagccagcgcctc

SEQ ID NO: 4452836 - DNA, 17 bp, Homo sapiens
ccagccagcgcctccct

SEQ ID NO: 4452837 - DNA, 14 bp, Homo sapiens
ccagccaggctctg

SEQ ID NO: 4452838 - DNA, 15 bp, Homo sapiens
ccagccaggctctgt

SEQ ID NO: 4452839 - DNA, 18 bp, Homo sapiens
ccagccaggctctgtgct

SEQ ID NO: 4452840 - DNA, 19 bp, Homo sapiens
ccagccaggctctgtgctg

SEQ ID NO: 4452841 - DNA, 19 bp, Homo sapiens
ccagccagggcaagagagc

SEQ ID NO: 4452842 - DNA, 13 bp, Homo sapiens
ccagcccaccccc

SEQ ID NO: 4452843 - DNA, 23 bp, Homo sapiens
ccagcccaccccctttgactctg

SEQ ID NO: 4452844 - DNA, 19 bp, Homo sapiens
ccagcccaccctcctgtct

SEQ ID NO: 4452845 - DNA, 12 bp, Homo sapiens
ccagcccagcca

SEQ ID NO: 4452846 - DNA, 13 bp, Homo sapiens
ccagcccagccag

SEQ ID NO: 4452847 - DNA, 12 bp, Homo sapiens
ccagcccaggag

SEQ ID NO: 4452848 - DNA, 23 bp, Homo sapiens
ccagcccaggagtttgaggctgc

SEQ ID NO: 4452849 - DNA, 21 bp, Homo sapiens
ccagcccatggcccccaataa

SEQ ID NO: 4452850 - DNA, 19 bp, Homo sapiens
ccagcccattggccgagct

SEQ ID NO: 4452851 - DNA, 20 bp, Homo sapiens
ccagcccattggccgagctc

SEQ ID NO: 4452852 - DNA, 14 bp, Homo sapiens
ccagccccacccag

SEQ ID NO: 4452853 - DNA, 23 bp, Homo sapiens
ccagccccatcagaacctgagct

SEQ ID NO: 4452854 - DNA, 16 bp, Homo sapiens
ccagccccccgcgcgc

SEQ ID NO: 4452855 - DNA, 11 bp, Homo sapiens
ccagccccctc

SEQ ID NO: 4452856 - DNA, 14 bp, Homo sapiens
ccagccccctccca

SEQ ID NO: 4452857 - DNA, 15 bp, Homo sapiens
ccagccccctcccac

SEQ ID NO: 4452858 - DNA, 20 bp, Homo sapiens
ccagccccctttgggcccag

SEQ ID NO: 4452859 - DNA, 16 bp, Homo sapiens
ccagccccgactccag

SEQ ID NO: 4452860 - DNA, 21 bp, Homo sapiens
ccagccccgactccagccagc

SEQ ID NO: 4452861 - DNA, 21 bp, Homo sapiens
ccagccccggcaagccacagg

SEQ ID NO: 4452862 - DNA, 16 bp, Homo sapiens
ccagcccctcctccct

SEQ ID NO: 4452863 - DNA, 19 bp, Homo sapiens
ccagcccctcctccctcaa

SEQ ID NO: 4452864 - DNA, 20 bp, Homo sapiens
ccagcccctcctccctcagg

SEQ ID NO: 4452865 - DNA, 21 bp, Homo sapiens
ccagcccctcctccctcaggc

SEQ ID NO: 4452866 - DNA, 10 bp, Homo sapiens
ccagcccctg

SEQ ID NO: 4452867 - DNA, 13 bp, Homo sapiens
ccagcccctgcag

SEQ ID NO: 4452868 - DNA, 18 bp, Homo sapiens
ccagcccctgcagattct

SEQ ID NO: 4452869 - DNA, 14 bp, Homo sapiens
ccagcccctggggc

SEQ ID NO: 4452870 - DNA, 16 bp, Homo sapiens
ccagcccctggggccc

SEQ ID NO: 4452871 - DNA, 18 bp, Homo sapiens
ccagcccctggggcccag

SEQ ID NO: 4452872 - DNA, 21 bp, Homo sapiens
ccagcccctggggcccagccc

SEQ ID NO: 4452873 - DNA, 12 bp, Homo sapiens
ccagccccttcc

SEQ ID NO: 4452874 - DNA, 18 bp, Homo sapiens
ccagccctccctgtcctc

SEQ ID NO: 4452875 - DNA, 14 bp, Homo sapiens
ccagccctgcacga

SEQ ID NO: 4452876 - DNA, 15 bp, Homo sapiens
ccagccctgctggcc

SEQ ID NO: 4452877 - DNA, 18 bp, Homo sapiens
ccagccctgctggccgcc

SEQ ID NO: 4452878 - DNA, 15 bp, Homo sapiens
ccagccctggcccag

SEQ ID NO: 4452879 - DNA, 18 bp, Homo sapiens
ccagccctggcccaggtg

SEQ ID NO: 4452880 - DNA, 16 bp, Homo sapiens
ccagcccttccctggc

SEQ ID NO: 4452881 - DNA, 23 bp, Homo sapiens
ccagccgccattgccaccaggag

SEQ ID NO: 4452882 - DNA, 23 bp, Homo sapiens
ccaggagctcttcaggcctccct

SEQ ID NO: 4452883 - DNA, 15 bp, Homo sapiens
ccaggaggaacaaag

SEQ ID NO: 4452884 - DNA, 14 bp, Homo sapiens
ccaggagtccagac

SEQ ID NO: 4452885 - DNA, 15 bp, Homo sapiens
ccaggagtccagacc

SEQ ID NO: 4452886 - DNA, 13 bp, Homo sapiens
ccaggagtccagc

SEQ ID NO: 4452887 - DNA, 15 bp, Homo sapiens
ccaggagtccagccc

SEQ ID NO: 4452888 - DNA, 20 bp, Homo sapiens
ccaggagtccaggcccccag

SEQ ID NO: 4452889 - DNA, 15 bp, Homo sapiens
ccaggatactggcac

SEQ ID NO: 4452890 - DNA, 20 bp, Homo sapiens
ccaggatactggcacagagg

SEQ ID NO: 4452891 - DNA, 17 bp, Homo sapiens
ccaggatctgctccaac

SEQ ID NO: 4452892 - DNA, 18 bp, Homo sapiens
ccaggatctgctccaaca

SEQ ID NO: 4452893 - DNA, 13 bp, Homo sapiens
ccaggatctttga

SEQ ID NO: 4452894 - DNA, 19 bp, Homo sapiens
ccaggatctttgactgaaa

SEQ ID NO: 4452895 - DNA, 23 bp, Homo sapiens
ccaggatggtctcgatctcctga

SEQ ID NO: 4452896 - DNA, 19 bp, Homo sapiens
ccaggcacacacagcccct

SEQ ID NO: 4452897 - DNA, 22 bp, Homo sapiens
ccaggcacacactgtgctttct

SEQ ID NO: 4452898 - DNA, 17 bp, Homo sapiens
ccaggcaccaaaagaag

SEQ ID NO: 4452899 - DNA, 17 bp, Homo sapiens
ccaggcaccaggactag

SEQ ID NO: 4452900 - DNA, 15 bp, Homo sapiens
ccaggcaccctcagg

SEQ ID NO: 4452901 - DNA, 18 bp, Homo sapiens
ccaggcaggagcccttct

SEQ ID NO: 4452902 - DNA, 22 bp, Homo sapiens
ccaggcaggtgcagggaagtgc

SEQ ID NO: 4452903 - DNA, 16 bp, Homo sapiens
ccaggccaacagcacc

SEQ ID NO: 4452904 - DNA, 16 bp, Homo sapiens
ccaggccacagccagg

SEQ ID NO: 4452905 - DNA, 20 bp, Homo sapiens
ccaggccagagcaaacagaa

SEQ ID NO: 4452906 - DNA, 15 bp, Homo sapiens
ccaggccagcctccg

SEQ ID NO: 4452907 - DNA, 19 bp, Homo sapiens
ccaggccagcctccgagag

SEQ ID NO: 4452908 - DNA, 20 bp, Homo sapiens
ccaggccagcctccgagagg

SEQ ID NO: 4452909 - DNA, 12 bp, Homo sapiens
ccaggccagctc

SEQ ID NO: 4452910 - DNA, 13 bp, Homo sapiens
ccaggccaggtgc

SEQ ID NO: 4452911 - DNA, 17 bp, Homo sapiens
ccaggccaggtgcccag

SEQ ID NO: 4452912 - DNA, 19 bp, Homo sapiens
ccaggccaggtgcccagga

SEQ ID NO: 4452913 - DNA, 20 bp, Homo sapiens
ccaggccccagacagggtgg

SEQ ID NO: 4452914 - DNA, 22 bp, Homo sapiens
ccaggcccccaacccctcctcc

SEQ ID NO: 4452915 - DNA, 14 bp, Homo sapiens
ccaggcccccagcc

SEQ ID NO: 4452916 - DNA, 20 bp, Homo sapiens
ccaggcccccagcccctcct

SEQ ID NO: 4452917 - DNA, 23 bp, Homo sapiens
ccaggcccccagcccctcctccc

SEQ ID NO: 4452918 - DNA, 19 bp, Homo sapiens
ccaggccccgaggacccag

SEQ ID NO: 4452919 - DNA, 23 bp, Homo sapiens
ccaggccccgaggacccagaccc

SEQ ID NO: 4452920 - DNA, 21 bp, Homo sapiens
ccaggcccctggaggctgcct

SEQ ID NO: 4452921 - DNA, 23 bp, Homo sapiens
ccaggcccctggaggctgcctcc

SEQ ID NO: 4452922 - DNA, 14 bp, Homo sapiens
ccaggccctccctg

SEQ ID NO: 4452923 - DNA, 16 bp, Homo sapiens
ccaggccggcccagat

SEQ ID NO: 4452924 - DNA, 22 bp, Homo sapiens
ccaggcctctcggtgctccatc

SEQ ID NO: 4452925 - DNA, 15 bp, Homo sapiens
ccaggcctctctctg

SEQ ID NO: 4452926 - DNA, 20 bp, Homo sapiens
ccaggcctctctctgctcca

SEQ ID NO: 4452927 - DNA, 17 bp, Homo sapiens
ccaggcctctgctggct

SEQ ID NO: 4452928 - DNA, 20 bp, Homo sapiens
ccaggcctctgctggctcag

SEQ ID NO: 4452929 - DNA, 22 bp, Homo sapiens
ccaggcctctgctggctcagga

SEQ ID NO: 4452930 - DNA, 13 bp, Homo sapiens
ccaggcctgcctc

SEQ ID NO: 4452931 - DNA, 16 bp, Homo sapiens
ccaggcctgcctgcat

SEQ ID NO: 4452932 - DNA, 13 bp, Homo sapiens
ccaggcctgcggg

SEQ ID NO: 4452933 - DNA, 12 bp, Homo sapiens
ccaggccttgtc

SEQ ID NO: 4452934 - DNA, 16 bp, Homo sapiens
ccaggcgctaattcaa

SEQ ID NO: 4452935 - DNA, 15 bp, Homo sapiens
ccaggcgctgcatac

SEQ ID NO: 4452936 - DNA, 21 bp, Homo sapiens
ccaggctcgtggactgagtgg

SEQ ID NO: 4452937 - DNA, 13 bp, Homo sapiens
ccaggctgccaag

SEQ ID NO: 4452938 - DNA, 13 bp, Homo sapiens
ccaggctgcctcc

SEQ ID NO: 4452939 - DNA, 16 bp, Homo sapiens
ccaggctgcctcctgc

SEQ ID NO: 4452940 - DNA, 13 bp, Homo sapiens
ccaggctggccag

SEQ ID NO: 4452941 - DNA, 18 bp, Homo sapiens
ccaggctggccagtgctg

SEQ ID NO: 4452942 - DNA, 22 bp, Homo sapiens
ccaggctggccagtgctgccca

SEQ ID NO: 4452943 - DNA, 21 bp, Homo sapiens
ccaggctggtttcgaactcct

SEQ ID NO: 4452944 - DNA, 16 bp, Homo sapiens
ccaggctgttctcagc

SEQ ID NO: 4452945 - DNA, 16 bp, Homo sapiens
ccaggcttactgagct

SEQ ID NO: 4452946 - DNA, 16 bp, Homo sapiens
ccagggaaacagcctc

SEQ ID NO: 4452947 - DNA, 18 bp, Homo sapiens
ccagggaaacagcctctc

SEQ ID NO: 4452948 - DNA, 19 bp, Homo sapiens
ccagggaaggtggccacag

SEQ ID NO: 4452949 - DNA, 16 bp, Homo sapiens
ccagggacaccagcca

SEQ ID NO: 4452950 - DNA, 20 bp, Homo sapiens
ccagggacaccagccaggct

SEQ ID NO: 4452951 - DNA, 14 bp, Homo sapiens
ccagggaccggcgg

SEQ ID NO: 4452952 - DNA, 15 bp, Homo sapiens
ccagggagattttga

SEQ ID NO: 4452953 - DNA, 13 bp, Homo sapiens
ccagggaggggtc

SEQ ID NO: 4452954 - DNA, 13 bp, Homo sapiens
ccagggagtccag

SEQ ID NO: 4452955 - DNA, 14 bp, Homo sapiens
ccagggagtccagg

SEQ ID NO: 4452956 - DNA, 18 bp, Homo sapiens
ccagggatcacagaccac

SEQ ID NO: 4452957 - DNA, 15 bp, Homo sapiens
ccagggatgagccaa

SEQ ID NO: 4452958 - DNA, 12 bp, Homo sapiens
ccagggatgctg

SEQ ID NO: 4452959 - DNA, 14 bp, Homo sapiens
ccagggatgctggg

SEQ ID NO: 4452960 - DNA, 15 bp, Homo sapiens
ccagggatgctgggc

SEQ ID NO: 4452961 - DNA, 14 bp, Homo sapiens
ccagggatgggcag

SEQ ID NO: 4452962 - DNA, 15 bp, Homo sapiens
ccagggcacccaggc

SEQ ID NO: 4452963 - DNA, 18 bp, Homo sapiens
ccagggcactgccagccc

SEQ ID NO: 4452964 - DNA, 20 bp, Homo sapiens
ccagggcactgccagcccac

SEQ ID NO: 4452965 - DNA, 13 bp, Homo sapiens
ccagggcagggcg

SEQ ID NO: 4452966 - DNA, 16 bp, Homo sapiens
ccagggcagggcgagc

SEQ ID NO: 4452967 - DNA, 19 bp, Homo sapiens
ccagggcagggcgagctgc

SEQ ID NO: 4452968 - DNA, 21 bp, Homo sapiens
ccagggcagggcgagctgcag

SEQ ID NO: 4452969 - DNA, 16 bp, Homo sapiens
ccagggccacgctcca

SEQ ID NO: 4452970 - DNA, 18 bp, Homo sapiens
ccagggccacgctccagc

SEQ ID NO: 4452971 - DNA, 13 bp, Homo sapiens
ccagggccacgtg

SEQ ID NO: 4452972 - DNA, 17 bp, Homo sapiens
ccagggccacgtgccag

SEQ ID NO: 4452973 - DNA, 18 bp, Homo sapiens
ccagggcctctccttgga

SEQ ID NO: 4452974 - DNA, 14 bp, Homo sapiens
ccagggcctgactt

SEQ ID NO: 4452975 - DNA, 18 bp, Homo sapiens
ccagggcctgacttgagc

SEQ ID NO: 4452976 - DNA, 18 bp, Homo sapiens
ccagggctccaggagcct

SEQ ID NO: 4452977 - DNA, 17 bp, Homo sapiens
ccagggctcttccagat

SEQ ID NO: 4452978 - DNA, 15 bp, Homo sapiens
ccagggctcttctca

SEQ ID NO: 4452979 - DNA, 17 bp, Homo sapiens
ccagggctggactgagg

SEQ ID NO: 4452980 - DNA, 22 bp, Homo sapiens
ccagggctggactgaggcctga

SEQ ID NO: 4452981 - DNA, 19 bp, Homo sapiens
ccagggctggagacttcct

SEQ ID NO: 4452982 - DNA, 23 bp, Homo sapiens
ccagggctggagacttcctctgg

SEQ ID NO: 4452983 - DNA, 13 bp, Homo sapiens
ccagggctgggga

SEQ ID NO: 4452984 - DNA, 19 bp, Homo sapiens
ccagggctggggacagagg

SEQ ID NO: 4452985 - DNA, 20 bp, Homo sapiens
ccagggctggggttgccaga

SEQ ID NO: 4452986 - DNA, 12 bp, Homo sapiens
ccaggggaacct

SEQ ID NO: 4452987 - DNA, 24 bp, Homo sapiens
ccaggggaacctgccatgccagga

SEQ ID NO: 4452988 - DNA, 20 bp, Homo sapiens
ccaggggagagggtctggag

SEQ ID NO: 4452989 - DNA, 16 bp, Homo sapiens
ccaggggcagccacac

SEQ ID NO: 4452990 - DNA, 22 bp, Homo sapiens
ccaggggccaattttggatgag

SEQ ID NO: 4452991 - DNA, 15 bp, Homo sapiens
ccagggggcaagagg

SEQ ID NO: 4452992 - DNA, 16 bp, Homo sapiens
ccaggggtccaggccc

SEQ ID NO: 4452993 - DNA, 16 bp, Homo sapiens
ccaggggtctccctgg

SEQ ID NO: 4452994 - DNA, 21 bp, Homo sapiens
ccaggggtctccctggctccc

SEQ ID NO: 4452995 - DNA, 15 bp, Homo sapiens
ccaggggtctgtctg

SEQ ID NO: 4452996 - DNA, 19 bp, Homo sapiens
ccaggggtctgtctgcttt

SEQ ID NO: 4452997 - DNA, 12 bp, Homo sapiens
ccaggggtgctc

SEQ ID NO: 4452998 - DNA, 17 bp, Homo sapiens
ccaggggtgctcctgtg

SEQ ID NO: 4452999 - DNA, 23 bp, Homo sapiens
ccagggtagcccgcctgccagtc

SEQ ID NO: 4453000 - DNA, 23 bp, Homo sapiens
ccatgcgccttcgtgcctgagac

SEQ ID NO: 4453001 - DNA, 14 bp, Homo sapiens
ccatgctacagtta

SEQ ID NO: 4453002 - DNA, 17 bp, Homo sapiens
ccatgctcaacccccct

SEQ ID NO: 4453003 - DNA, 15 bp, Homo sapiens
ccatgctcctcacct

SEQ ID NO: 4453004 - DNA, 20 bp, Homo sapiens
ccatgctccttgagaggaga

SEQ ID NO: 4453005 - DNA, 18 bp, Homo sapiens
ccatgctgccttcaggga

SEQ ID NO: 4453006 - DNA, 20 bp, Homo sapiens
ccatgctggctgaagaggac

SEQ ID NO: 4453007 - DNA, 19 bp, Homo sapiens
ccatgcttacgtgatcctc

SEQ ID NO: 4453008 - DNA, 13 bp, Homo sapiens
ccatgcttcactc

SEQ ID NO: 4453009 - DNA, 17 bp, Homo sapiens
ccatgcttgcctgaagc

SEQ ID NO: 4453010 - DNA, 14 bp, Homo sapiens
ccatgctttatgtg

SEQ ID NO: 4453011 - DNA, 17 bp, Homo sapiens
ccatggaactgtttcct

SEQ ID NO: 4453012 - DNA, 21 bp, Homo sapiens
ccatggaagaggctacagggc

SEQ ID NO: 4453013 - DNA, 17 bp, Homo sapiens
ccatggaccagcccatt

SEQ ID NO: 4453014 - DNA, 13 bp, Homo sapiens
ccatggagcccca

SEQ ID NO: 4453015 - DNA, 15 bp, Homo sapiens
ccatggagccccagc

SEQ ID NO: 4453016 - DNA, 18 bp, Homo sapiens
ccatggagccccagcccc

SEQ ID NO: 4453017 - DNA, 15 bp, Homo sapiens
ccatggccccaggcc

SEQ ID NO: 4453018 - DNA, 22 bp, Homo sapiens
ccatggcccccaataaaggcag

SEQ ID NO: 4453019 - DNA, 24 bp, Homo sapiens
ccatggcccccaataaaggcagct

SEQ ID NO: 4453020 - DNA, 22 bp, Homo sapiens
ccatggcctcagccctgctccc

SEQ ID NO: 4453021 - DNA, 21 bp, Homo sapiens
ccatgggaagacgaggccctc

SEQ ID NO: 4453022 - DNA, 14 bp, Homo sapiens
ccatgggcagagcc

SEQ ID NO: 4453023 - DNA, 16 bp, Homo sapiens
ccatggggttcgagac

SEQ ID NO: 4453024 - DNA, 16 bp, Homo sapiens
ccatggtactgtagca

SEQ ID NO: 4453025 - DNA, 19 bp, Homo sapiens
ccatggtactgtagcaggg

SEQ ID NO: 4453026 - DNA, 15 bp, Homo sapiens
ccatggtgtcccggt

SEQ ID NO: 4453027 - DNA, 12 bp, Homo sapiens
ccatggttctgc

SEQ ID NO: 4453028 - DNA, 11 bp, Homo sapiens
ccatgtaaata

SEQ ID NO: 4453029 - DNA, 18 bp, Homo sapiens
ccatgtaaataagatgat

SEQ ID NO: 4453030 - DNA, 17 bp, Homo sapiens
ccatgtaaccactgcac

SEQ ID NO: 4453031 - DNA, 15 bp, Homo sapiens
ccatgtaagcactct

SEQ ID NO: 4453032 - DNA, 19 bp, Homo sapiens
ccatgtagaataaatgaag

SEQ ID NO: 4453033 - DNA, 20 bp, Homo sapiens
ccatgtagaataaatgaaga

SEQ ID NO: 4453034 - DNA, 16 bp, Homo sapiens
ccatgtagcaggactg

SEQ ID NO: 4453035 - DNA, 21 bp, Homo sapiens
ccatgtcaccggtcagtgcct

SEQ ID NO: 4453036 - DNA, 19 bp, Homo sapiens
ccatgtccaaagaggctgc

SEQ ID NO: 4453037 - DNA, 20 bp, Homo sapiens
ccatgtcccaccctccctag

SEQ ID NO: 4453038 - DNA, 13 bp, Homo sapiens
ccatgtcggcctc

SEQ ID NO: 4453039 - DNA, 15 bp, Homo sapiens
ccatgtcggcctcta

SEQ ID NO: 4453040 - DNA, 17 bp, Homo sapiens
ccatgtgcaataagatt

SEQ ID NO: 4453041 - DNA, 23 bp, Homo sapiens
ccatgtgcctttctttgcctctg

SEQ ID NO: 4453042 - DNA, 14 bp, Homo sapiens
ccatgtgtgctaat

SEQ ID NO: 4453043 - DNA, 21 bp, Homo sapiens
ccatgtgtgctaatatacttt

SEQ ID NO: 4453044 - DNA, 17 bp, Homo sapiens
ccatgtgtgtgccaagc

SEQ ID NO: 4453045 - DNA, 21 bp, Homo sapiens
ccatgttaagtcctccctgac

SEQ ID NO: 4453046 - DNA, 20 bp, Homo sapiens
ccatgttaatatttgaattg

SEQ ID NO: 4453047 - DNA, 23 bp, Homo sapiens
ccatgttatattgcttcctgtgt

SEQ ID NO: 4453048 - DNA, 21 bp, Homo sapiens
ccatgttgaagtaattcttct

SEQ ID NO: 4453049 - DNA, 18 bp, Homo sapiens
ccatgttggcctcttcag

SEQ ID NO: 4453050 - DNA, 22 bp, Homo sapiens
ccatgttggttgcactttgtag

SEQ ID NO: 4453051 - DNA, 12 bp, Homo sapiens
ccatgtttattg

SEQ ID NO: 4453052 - DNA, 23 bp, Homo sapiens
ccatgtttattgttttttaaaga

SEQ ID NO: 4453053 - DNA, 16 bp, Homo sapiens
ccatgtttgagctcag

SEQ ID NO: 4453054 - DNA, 19 bp, Homo sapiens
ccattaaagtcagaagttt

SEQ ID NO: 4453055 - DNA, 15 bp, Homo sapiens
ccattaaatgaatat

SEQ ID NO: 4453056 - DNA, 17 bp, Homo sapiens
ccattaaatgaatattt

SEQ ID NO: 4453057 - DNA, 19 bp, Homo sapiens
ccattaaatgaatattttg

SEQ ID NO: 4453058 - DNA, 15 bp, Homo sapiens
ccattaattaatgag

SEQ ID NO: 4453059 - DNA, 14 bp, Homo sapiens
ccattaccaaaata

SEQ ID NO: 4453060 - DNA, 19 bp, Homo sapiens
ccattacccagtgccgagg

SEQ ID NO: 4453061 - DNA, 13 bp, Homo sapiens
ccattacctgtac

SEQ ID NO: 4453062 - DNA, 16 bp, Homo sapiens
ccattacctgtacctg

SEQ ID NO: 4453063 - DNA, 17 bp, Homo sapiens
ccattatactttatatc

SEQ ID NO: 4453064 - DNA, 19 bp, Homo sapiens
ccattatactttatatctg

SEQ ID NO: 4453065 - DNA, 21 bp, Homo sapiens
ccattatccctgaatccccct

SEQ ID NO: 4453066 - DNA, 14 bp, Homo sapiens
ccattatgaaaatc

SEQ ID NO: 4453067 - DNA, 13 bp, Homo sapiens
ccattatgcaaat

SEQ ID NO: 4453068 - DNA, 19 bp, Homo sapiens
ccattatgcaaatggagat

SEQ ID NO: 4453069 - DNA, 18 bp, Homo sapiens
ccattatttttaggatgt

SEQ ID NO: 4453070 - DNA, 17 bp, Homo sapiens
ccattcacaagcctcct

SEQ ID NO: 4453071 - DNA, 20 bp, Homo sapiens
ccattcacttcataatccag

SEQ ID NO: 4453072 - DNA, 23 bp, Homo sapiens
ccattcatctctaacatatgata

SEQ ID NO: 4453073 - DNA, 13 bp, Homo sapiens
ccattccaggtag

SEQ ID NO: 4453074 - DNA, 12 bp, Homo sapiens
ccattcctcagg

SEQ ID NO: 4453075 - DNA, 13 bp, Homo sapiens
ccattcctccctc

SEQ ID NO: 4453076 - DNA, 22 bp, Homo sapiens
ccattcctgggaaatattccct

SEQ ID NO: 4453077 - DNA, 18 bp, Homo sapiens
ccattccttgcgcctcag

SEQ ID NO: 4453078 - DNA, 21 bp, Homo sapiens
ccattccttgcgcctcagccc

SEQ ID NO: 4453079 - DNA, 14 bp, Homo sapiens
ccattctacacaga

SEQ ID NO: 4453080 - DNA, 18 bp, Homo sapiens
ccattctagatcctgcac

SEQ ID NO: 4453081 - DNA, 14 bp, Homo sapiens
ccattctcccaggt

SEQ ID NO: 4453082 - DNA, 22 bp, Homo sapiens
ccattctcccaggtaccagctg

SEQ ID NO: 4453083 - DNA, 19 bp, Homo sapiens
ccattctcctcagtggctt

SEQ ID NO: 4453084 - DNA, 14 bp, Homo sapiens
ccattctctctcct

SEQ ID NO: 4453085 - DNA, 22 bp, Homo sapiens
ccattctgtgcaggctgcagtg

SEQ ID NO: 4453086 - DNA, 12 bp, Homo sapiens
ccattctttccc

SEQ ID NO: 4453087 - DNA, 20 bp, Homo sapiens
ccattctttcccaacacctc

SEQ ID NO: 4453088 - DNA, 20 bp, Homo sapiens
ccattctttgcttgaacaca

SEQ ID NO: 4453089 - DNA, 16 bp, Homo sapiens
ccattgaactggaaga

SEQ ID NO: 4453090 - DNA, 12 bp, Homo sapiens
ccattgaaggct

SEQ ID NO: 4453091 - DNA, 17 bp, Homo sapiens
ccattgagatcttcctg

SEQ ID NO: 4453092 - DNA, 12 bp, Homo sapiens
ccattgcccagt

SEQ ID NO: 4453093 - DNA, 13 bp, Homo sapiens
ccattgcccagtg

SEQ ID NO: 4453094 - DNA, 14 bp, Homo sapiens
ccattgcccagtga

SEQ ID NO: 4453095 - DNA, 16 bp, Homo sapiens
ccattgcccagtgagc

SEQ ID NO: 4453096 - DNA, 18 bp, Homo sapiens
ccattgcccagtgagccc

SEQ ID NO: 4453097 - DNA, 22 bp, Homo sapiens
ccattgctcttagtcccaagct

SEQ ID NO: 4453098 - DNA, 15 bp, Homo sapiens
ccattggatctcatt

SEQ ID NO: 4453099 - DNA, 17 bp, Homo sapiens
ccattggccgagctcct

SEQ ID NO: 4453100 - DNA, 11 bp, Homo sapiens
ccattgggacc

SEQ ID NO: 4453101 - DNA, 19 bp, Homo sapiens
ccattggggctcccagcca

SEQ ID NO: 4453102 - DNA, 22 bp, Homo sapiens
ccattggggctcccagccaggc

SEQ ID NO: 4453103 - DNA, 15 bp, Homo sapiens
ccattgtactccagc

SEQ ID NO: 4453104 - DNA, 18 bp, Homo sapiens
ccattgtactccagcctg

SEQ ID NO: 4453105 - DNA, 23 bp, Homo sapiens
ccattgtctttatatgaacatag

SEQ ID NO: 4453106 - DNA, 20 bp, Homo sapiens
ccattgtggctcctatctgt

SEQ ID NO: 4453107 - DNA, 19 bp, Homo sapiens
ccatttaaatttttttcct

SEQ ID NO: 4453108 - DNA, 18 bp, Homo sapiens
ccatttagtgtgaatatt

SEQ ID NO: 4453109 - DNA, 15 bp, Homo sapiens
ccatttcatgtccat

SEQ ID NO: 4453110 - DNA, 13 bp, Homo sapiens
ccatttcccatct

SEQ ID NO: 4453111 - DNA, 16 bp, Homo sapiens
ccatttcccatctgca

SEQ ID NO: 4453112 - DNA, 18 bp, Homo sapiens
ccatttcccatctgcacc

SEQ ID NO: 4453113 - DNA, 13 bp, Homo sapiens
ccatttctgcctc

SEQ ID NO: 4453114 - DNA, 16 bp, Homo sapiens
ccatttcttgctagct

SEQ ID NO: 4453115 - DNA, 22 bp, Homo sapiens
ccatttcttggcattggaattc

SEQ ID NO: 4453116 - DNA, 17 bp, Homo sapiens
ccatttgtcccagacta

SEQ ID NO: 4453117 - DNA, 14 bp, Homo sapiens
ccattttaagtccc

SEQ ID NO: 4453118 - DNA, 20 bp, Homo sapiens
ccattttaagtccctgtcac

SEQ ID NO: 4453119 - DNA, 23 bp, Homo sapiens
ccattttaagtccctgtcacctc

SEQ ID NO: 4453120 - DNA, 15 bp, Homo sapiens
ccattttcattctgt

SEQ ID NO: 4453121 - DNA, 18 bp, Homo sapiens
ccattttcctacaggcag

SEQ ID NO: 4453122 - DNA, 18 bp, Homo sapiens
ccattttgttattgacta

SEQ ID NO: 4453123 - DNA, 22 bp, Homo sapiens
ccattttgttattgactaacag

SEQ ID NO: 4453124 - DNA, 23 bp, Homo sapiens
ccattttgttattgactaacagg

SEQ ID NO: 4453125 - DNA, 18 bp, Homo sapiens
ccatttttcaaagcaatt

SEQ ID NO: 4453126 - DNA, 22 bp, Homo sapiens
ccatttttctcccaagaaacct

SEQ ID NO: 4453127 - DNA, 18 bp, Homo sapiens
ccatttttgctaattatc

SEQ ID NO: 4453128 - DNA, 15 bp, Homo sapiens
ccatttttttcttta

SEQ ID NO: 4453129 - DNA, 22 bp, Homo sapiens
cccaaaaatgttcccttgacca

SEQ ID NO: 4453130 - DNA, 15 bp, Homo sapiens
cccaaaatgtgaagc

SEQ ID NO: 4453131 - DNA, 16 bp, Homo sapiens
cccaaacaggacagca

SEQ ID NO: 4453132 - DNA, 15 bp, Homo sapiens
cccaaaccccagccc

SEQ ID NO: 4453133 - DNA, 23 bp, Homo sapiens
cccaaagattaggtcgttttcca

SEQ ID NO: 4453134 - DNA, 20 bp, Homo sapiens
cccaaaggtccgcaccctgt

SEQ ID NO: 4453135 - DNA, 20 bp, Homo sapiens
cccaaagtggtatagaaatg

SEQ ID NO: 4453136 - DNA, 21 bp, Homo sapiens
cccaaagtggtatagaaatgc

SEQ ID NO: 4453137 - DNA, 16 bp, Homo sapiens
cccaaatcaatacact

SEQ ID NO: 4453138 - DNA, 23 bp, Homo sapiens
cccaaattagggcaattggaaca

SEQ ID NO: 4453139 - DNA, 19 bp, Homo sapiens
cccaaatttgattgatttg

SEQ ID NO: 4453140 - DNA, 11 bp, Homo sapiens
cccaacagcac

SEQ ID NO: 4453141 - DNA, 13 bp, Homo sapiens
cccaacagcactt

SEQ ID NO: 4453142 - DNA, 14 bp, Homo sapiens
cccaacagcacttt

SEQ ID NO: 4453143 - DNA, 16 bp, Homo sapiens
cccaacatgggaggga

SEQ ID NO: 4453144 - DNA, 15 bp, Homo sapiens
cccaacatgttcaga

SEQ ID NO: 4453145 - DNA, 20 bp, Homo sapiens
cccaacccattcactacagg

SEQ ID NO: 4453146 - DNA, 17 bp, Homo sapiens
cccaacccctcctccct

SEQ ID NO: 4453147 - DNA, 22 bp, Homo sapiens
cccaacccctcctccctcagac

SEQ ID NO: 4453148 - DNA, 23 bp, Homo sapiens
cccaacccctcctccctcagact

SEQ ID NO: 4453149 - DNA, 22 bp, Homo sapiens
cccaacccctccttccccagac

SEQ ID NO: 4453150 - DNA, 14 bp, Homo sapiens
cccaacctcaccct

SEQ ID NO: 4453151 - DNA, 13 bp, Homo sapiens
cccaacctcaggg

SEQ ID NO: 4453152 - DNA, 15 bp, Homo sapiens
cccaacctttccctc

SEQ ID NO: 4453153 - DNA, 15 bp, Homo sapiens
cccaacgtcccctcc

SEQ ID NO: 4453154 - DNA, 15 bp, Homo sapiens
cccaactccacaggg

SEQ ID NO: 4453155 - DNA, 18 bp, Homo sapiens
cccaactccaggggcacc

SEQ ID NO: 4453156 - DNA, 17 bp, Homo sapiens
cccaactcctggaagct

SEQ ID NO: 4453157 - DNA, 23 bp, Homo sapiens
cccaactcctggaagctgtgtcc

SEQ ID NO: 4453158 - DNA, 14 bp, Homo sapiens
cccaactctcccca

SEQ ID NO: 4453159 - DNA, 16 bp, Homo sapiens
cccaactctccccagt

SEQ ID NO: 4453160 - DNA, 23 bp, Homo sapiens
cccaactctccccagtgcctgcc

SEQ ID NO: 4453161 - DNA, 20 bp, Homo sapiens
cccaactgctccagcctctg

SEQ ID NO: 4453162 - DNA, 20 bp, Homo sapiens
cccaactggttcaggctcaa

SEQ ID NO: 4453163 - DNA, 20 bp, Homo sapiens
cccaacttctcttgctttct

SEQ ID NO: 4453164 - DNA, 18 bp, Homo sapiens
cccaagacagatgcccca

SEQ ID NO: 4453165 - DNA, 19 bp, Homo sapiens
cccaagacagatgccccag

SEQ ID NO: 4453166 - DNA, 18 bp, Homo sapiens
cccaagatgagctgcagc

SEQ ID NO: 4453167 - DNA, 19 bp, Homo sapiens
cccaagatgagctgcagcc

SEQ ID NO: 4453168 - DNA, 20 bp, Homo sapiens
cccaagcgttcctggccttc

SEQ ID NO: 4453169 - DNA, 21 bp, Homo sapiens
cccaagctgggccccagccca

SEQ ID NO: 4453170 - DNA, 21 bp, Homo sapiens
cccaaggcctaccccagttcc

SEQ ID NO: 4453171 - DNA, 19 bp, Homo sapiens
cccaaggctcccggaattc

SEQ ID NO: 4453172 - DNA, 18 bp, Homo sapiens
cccaagggttattagaaa

SEQ ID NO: 4453173 - DNA, 21 bp, Homo sapiens
cccaaggtgctgatgtcaaag

SEQ ID NO: 4453174 - DNA, 23 bp, Homo sapiens
cccaaggttactcagcagcagag

SEQ ID NO: 4453175 - DNA, 15 bp, Homo sapiens
cccaaggttgcacag

SEQ ID NO: 4453176 - DNA, 20 bp, Homo sapiens
cccaagtagctgggattaca

SEQ ID NO: 4453177 - DNA, 13 bp, Homo sapiens
cccaagtgccaaa

SEQ ID NO: 4453178 - DNA, 15 bp, Homo sapiens
cccaagtgccaaaga

SEQ ID NO: 4453179 - DNA, 23 bp, Homo sapiens
cccaagtgggggcagagggcaga

SEQ ID NO: 4453180 - DNA, 16 bp, Homo sapiens
cccaataaaggcagct

SEQ ID NO: 4453181 - DNA, 18 bp, Homo sapiens
cccaataaaggcagctgc

SEQ ID NO: 4453182 - DNA, 19 bp, Homo sapiens
cccaataaaggcagctgcc

SEQ ID NO: 4453183 - DNA, 17 bp, Homo sapiens
cccaatcggactgccaa

SEQ ID NO: 4453184 - DNA, 17 bp, Homo sapiens
cccaatcgggtccagag

SEQ ID NO: 4453185 - DNA, 16 bp, Homo sapiens
cccaatcttgcccact

SEQ ID NO: 4453186 - DNA, 18 bp, Homo sapiens
cccaatgacacccatgcc

SEQ ID NO: 4453187 - DNA, 14 bp, Homo sapiens
cccaattaaaatac

SEQ ID NO: 4453188 - DNA, 19 bp, Homo sapiens
cccaattacagggtgactc

SEQ ID NO: 4453189 - DNA, 18 bp, Homo sapiens
cccaattttgcagggagc

SEQ ID NO: 4453190 - DNA, 13 bp, Homo sapiens
cccacaaactgat

SEQ ID NO: 4453191 - DNA, 21 bp, Homo sapiens
cccacaagccttactcacctc

SEQ ID NO: 4453192 - DNA, 22 bp, Homo sapiens
cccacaattaaaccgcatgtga

SEQ ID NO: 4453193 - DNA, 17 bp, Homo sapiens
cccacaccataagctac

SEQ ID NO: 4453194 - DNA, 21 bp, Homo sapiens
cccacaccataagctactgcc

SEQ ID NO: 4453195 - DNA, 20 bp, Homo sapiens
cccacaccgcgtcccagctc

SEQ ID NO: 4453196 - DNA, 13 bp, Homo sapiens
cccacacctcagt

SEQ ID NO: 4453197 - DNA, 18 bp, Homo sapiens
cccacacctccctactcc

SEQ ID NO: 4453198 - DNA, 15 bp, Homo sapiens
cccacacctctgcca

SEQ ID NO: 4453199 - DNA, 16 bp, Homo sapiens
cccacacctctgccag

SEQ ID NO: 4453200 - DNA, 13 bp, Homo sapiens
cccacactcactc

SEQ ID NO: 4453201 - DNA, 19 bp, Homo sapiens
cccacacttgttccagctc

SEQ ID NO: 4453202 - DNA, 13 bp, Homo sapiens
cccacagaacctt

SEQ ID NO: 4453203 - DNA, 12 bp, Homo sapiens
cccacagagcct

SEQ ID NO: 4453204 - DNA, 13 bp, Homo sapiens
cccacagagcctg

SEQ ID NO: 4453205 - DNA, 19 bp, Homo sapiens
cccacagagtgctggactg

SEQ ID NO: 4453206 - DNA, 16 bp, Homo sapiens
cccacagccccatctg

SEQ ID NO: 4453207 - DNA, 18 bp, Homo sapiens
cccacagcgtccctggcg

SEQ ID NO: 4453208 - DNA, 14 bp, Homo sapiens
cccacagctcccac

SEQ ID NO: 4453209 - DNA, 19 bp, Homo sapiens
cccacagctcccaccccac

SEQ ID NO: 4453210 - DNA, 19 bp, Homo sapiens
cccacaggacatttctcta

SEQ ID NO: 4453211 - DNA, 17 bp, Homo sapiens
cccacaggagggccagc

SEQ ID NO: 4453212 - DNA, 21 bp, Homo sapiens
cccacaggagggccagcgctg

SEQ ID NO: 4453213 - DNA, 16 bp, Homo sapiens
cccacataagcactag

SEQ ID NO: 4453214 - DNA, 14 bp, Homo sapiens
cccacatgcatgtc

SEQ ID NO: 4453215 - DNA, 13 bp, Homo sapiens
cccacatgcctgc

SEQ ID NO: 4453216 - DNA, 18 bp, Homo sapiens
cccacatgcctgcgcctg

SEQ ID NO: 4453217 - DNA, 13 bp, Homo sapiens
cccaccacctagg

SEQ ID NO: 4453218 - DNA, 20 bp, Homo sapiens
cccaccacctaggccactcc

SEQ ID NO: 4453219 - DNA, 19 bp, Homo sapiens
cccaccacgatgtggccct

SEQ ID NO: 4453220 - DNA, 20 bp, Homo sapiens
cccaccacgatgtggccctg

SEQ ID NO: 4453221 - DNA, 20 bp, Homo sapiens
cccaccagaacgcaccccac

SEQ ID NO: 4453222 - DNA, 22 bp, Homo sapiens
cccaccagaacgcaccccactg

SEQ ID NO: 4453223 - DNA, 15 bp, Homo sapiens
cccaccagccttgct

SEQ ID NO: 4453224 - DNA, 16 bp, Homo sapiens
cccaccagccttgctc

SEQ ID NO: 4453225 - DNA, 22 bp, Homo sapiens
cccaccagccttgctctcttca

SEQ ID NO: 4453226 - DNA, 17 bp, Homo sapiens
cccaccaggccagctca

SEQ ID NO: 4453227 - DNA, 19 bp, Homo sapiens
cccaccaggccagctcagg

SEQ ID NO: 4453228 - DNA, 20 bp, Homo sapiens
cccaccaggccagctcagga

SEQ ID NO: 4453229 - DNA, 13 bp, Homo sapiens
cccaccagtgcct

SEQ ID NO: 4453230 - DNA, 14 bp, Homo sapiens
cccaccagtgcctc

SEQ ID NO: 4453231 - DNA, 15 bp, Homo sapiens
cccaccagtgcctct

SEQ ID NO: 4453232 - DNA, 16 bp, Homo sapiens
cccaccagtgcctctc

SEQ ID NO: 4453233 - DNA, 20 bp, Homo sapiens
cccaccatggaccagcccat

SEQ ID NO: 4453234 - DNA, 16 bp, Homo sapiens
cccaccattctacctg

SEQ ID NO: 4453235 - DNA, 15 bp, Homo sapiens
cccaggttcagtgcg

SEQ ID NO: 4453236 - DNA, 19 bp, Homo sapiens
cccaggttcccccagcaag

SEQ ID NO: 4453237 - DNA, 21 bp, Homo sapiens
cccagtacctagctggctctg

SEQ ID NO: 4453238 - DNA, 16 bp, Homo sapiens
cccagtcagcctctct

SEQ ID NO: 4453239 - DNA, 18 bp, Homo sapiens
cccagtcagcctctctcc

SEQ ID NO: 4453240 - DNA, 22 bp, Homo sapiens
cccagtcagcctctctcccagt

SEQ ID NO: 4453241 - DNA, 16 bp, Homo sapiens
cccagtccatgctcca

SEQ ID NO: 4453242 - DNA, 23 bp, Homo sapiens
cccagtccatgctccagggtcag

SEQ ID NO: 4453243 - DNA, 13 bp, Homo sapiens
cccagtccccacc

SEQ ID NO: 4453244 - DNA, 23 bp, Homo sapiens
cccagtccccacccctgccccca

SEQ ID NO: 4453245 - DNA, 12 bp, Homo sapiens
cccagtcctgcc

SEQ ID NO: 4453246 - DNA, 14 bp, Homo sapiens
cccagtcctgcctg

SEQ ID NO: 4453247 - DNA, 15 bp, Homo sapiens
cccagtctacccaga

SEQ ID NO: 4453248 - DNA, 16 bp, Homo sapiens
cccagtctacccagag

SEQ ID NO: 4453249 - DNA, 17 bp, Homo sapiens
cccagtctacccagaga

SEQ ID NO: 4453250 - DNA, 11 bp, Homo sapiens
cccagtctgtc

SEQ ID NO: 4453251 - DNA, 20 bp, Homo sapiens
cccagtgaactcctgccagg

SEQ ID NO: 4453252 - DNA, 15 bp, Homo sapiens
cccagtgacaacatc

SEQ ID NO: 4453253 - DNA, 13 bp, Homo sapiens
cccagtgagccct

SEQ ID NO: 4453254 - DNA, 18 bp, Homo sapiens
cccagtgagccctgctct

SEQ ID NO: 4453255 - DNA, 15 bp, Homo sapiens
cccagtgccactgcc

SEQ ID NO: 4453256 - DNA, 18 bp, Homo sapiens
cccagtgccactgccccc

SEQ ID NO: 4453257 - DNA, 13 bp, Homo sapiens
cccagtgcctgcc

SEQ ID NO: 4453258 - DNA, 14 bp, Homo sapiens
cccagtgctcacca

SEQ ID NO: 4453259 - DNA, 16 bp, Homo sapiens
cccagtgctcaccagc

SEQ ID NO: 4453260 - DNA, 17 bp, Homo sapiens
cccagtgctcaccagcc

SEQ ID NO: 4453261 - DNA, 14 bp, Homo sapiens
cccagtgcttctcc

SEQ ID NO: 4453262 - DNA, 14 bp, Homo sapiens
cccagtgggacaga

SEQ ID NO: 4453263 - DNA, 16 bp, Homo sapiens
cccagtgggacagagg

SEQ ID NO: 4453264 - DNA, 21 bp, Homo sapiens
cccagttcatcaccatttcct

SEQ ID NO: 4453265 - DNA, 15 bp, Homo sapiens
cccagttccacagca

SEQ ID NO: 4453266 - DNA, 15 bp, Homo sapiens
cccagtttgcagaaa

SEQ ID NO: 4453267 - DNA, 16 bp, Homo sapiens
cccagtttgcagaaaa

SEQ ID NO: 4453268 - DNA, 22 bp, Homo sapiens
cccagtttgcagaaaagcacct

SEQ ID NO: 4453269 - DNA, 23 bp, Homo sapiens
cccataaggggtcaaaatttgct

SEQ ID NO: 4453270 - DNA, 20 bp, Homo sapiens
cccatacaatgtatgtacaa

SEQ ID NO: 4453271 - DNA, 22 bp, Homo sapiens
cccatacaatgtatgtacaata

SEQ ID NO: 4453272 - DNA, 13 bp, Homo sapiens
cccatagctggga

SEQ ID NO: 4453273 - DNA, 18 bp, Homo sapiens
cccataggccacccccta

SEQ ID NO: 4453274 - DNA, 18 bp, Homo sapiens
cccatatataaattatta

SEQ ID NO: 4453275 - DNA, 11 bp, Homo sapiens
cccatatcatg

SEQ ID NO: 4453276 - DNA, 18 bp, Homo sapiens
cccatcacccaagccaca

SEQ ID NO: 4453277 - DNA, 20 bp, Homo sapiens
cccatcactggagcaccagg

SEQ ID NO: 4453278 - DNA, 18 bp, Homo sapiens
cccatcagaacctgagct

SEQ ID NO: 4453279 - DNA, 12 bp, Homo sapiens
cccatcagcact

SEQ ID NO: 4453280 - DNA, 18 bp, Homo sapiens
cccatcagcactctgtaa

SEQ ID NO: 4453281 - DNA, 13 bp, Homo sapiens
cccatcagccctg

SEQ ID NO: 4453282 - DNA, 14 bp, Homo sapiens
cccatcagccctgc

SEQ ID NO: 4453283 - DNA, 16 bp, Homo sapiens
cccatcagccctgcta

SEQ ID NO: 4453284 - DNA, 16 bp, Homo sapiens
cccatcagtgctctgt

SEQ ID NO: 4453285 - DNA, 17 bp, Homo sapiens
cccatcagttccagcct

SEQ ID NO: 4453286 - DNA, 12 bp, Homo sapiens
cccatcatgtgg

SEQ ID NO: 4453287 - DNA, 13 bp, Homo sapiens
cccatccagccag

SEQ ID NO: 4453288 - DNA, 16 bp, Homo sapiens
cccatccagccagacc

SEQ ID NO: 4453289 - DNA, 12 bp, Homo sapiens
cccatccctacc

SEQ ID NO: 4453290 - DNA, 15 bp, Homo sapiens
cccatccctaccact

SEQ ID NO: 4453291 - DNA, 12 bp, Homo sapiens
cccatccctgct

SEQ ID NO: 4453292 - DNA, 16 bp, Homo sapiens
cccatcctcatccctg

SEQ ID NO: 4453293 - DNA, 17 bp, Homo sapiens
cccatcctcatccctga

SEQ ID NO: 4453294 - DNA, 18 bp, Homo sapiens
cccatcctcatccctgac

SEQ ID NO: 4453295 - DNA, 15 bp, Homo sapiens
cccatcctgccatcc

SEQ ID NO: 4453296 - DNA, 18 bp, Homo sapiens
cccatctctgaactggta

SEQ ID NO: 4453297 - DNA, 19 bp, Homo sapiens
cccatctgcaccccttctc

SEQ ID NO: 4453298 - DNA, 23 bp, Homo sapiens
cccatcttgatctttgagcccat

SEQ ID NO: 4453299 - DNA, 22 bp, Homo sapiens
cccatgaaattgacccccaaat

SEQ ID NO: 4453300 - DNA, 13 bp, Homo sapiens
cccatgaagcctt

SEQ ID NO: 4453301 - DNA, 23 bp, Homo sapiens
cccatgaaggctggaaggcagca

SEQ ID NO: 4453302 - DNA, 19 bp, Homo sapiens
cccatgaccatactgaggg

SEQ ID NO: 4453303 - DNA, 21 bp, Homo sapiens
cccatgccaaagctagggtgg

SEQ ID NO: 4453304 - DNA, 15 bp, Homo sapiens
cccatgcccacctgc

SEQ ID NO: 4453305 - DNA, 18 bp, Homo sapiens
cccatgcccacctgccca

SEQ ID NO: 4453306 - DNA, 13 bp, Homo sapiens
cccatgcctgtcc

SEQ ID NO: 4453307 - DNA, 19 bp, Homo sapiens
cccatgcctgtccagcctg

SEQ ID NO: 4453308 - DNA, 20 bp, Homo sapiens
cccatgcgccttcgtgcctg

SEQ ID NO: 4453309 - DNA, 17 bp, Homo sapiens
cccatggaaaaatgcca

SEQ ID NO: 4453310 - DNA, 15 bp, Homo sapiens
cccatggagccccag

SEQ ID NO: 4453311 - DNA, 14 bp, Homo sapiens
cccatggcccccaa

SEQ ID NO: 4453312 - DNA, 17 bp, Homo sapiens
cccatggcccccaataa

SEQ ID NO: 4453313 - DNA, 22 bp, Homo sapiens
cccatggcccccaataaaggca

SEQ ID NO: 4453314 - DNA, 24 bp, Homo sapiens
cccatggcctcagccctgctccct

SEQ ID NO: 4453315 - DNA, 22 bp, Homo sapiens
cccatgggaagacgaggccctc

SEQ ID NO: 4453316 - DNA, 17 bp, Homo sapiens
cccatgggctctgacag

SEQ ID NO: 4453317 - DNA, 23 bp, Homo sapiens
cccatgggctgtgtcctaaggcc

SEQ ID NO: 4453318 - DNA, 16 bp, Homo sapiens
cccatgtctctcagaa

SEQ ID NO: 4453319 - DNA, 17 bp, Homo sapiens
cccatgtgtcccctcac

SEQ ID NO: 4453320 - DNA, 14 bp, Homo sapiens
cccattcctccctc

SEQ ID NO: 4453321 - DNA, 12 bp, Homo sapiens
cccattcctgcc

SEQ ID NO: 4453322 - DNA, 16 bp, Homo sapiens
cccattcctgcctggt

SEQ ID NO: 4453323 - DNA, 18 bp, Homo sapiens
cccattccttgcgcctca

SEQ ID NO: 4453324 - DNA, 18 bp, Homo sapiens
cccattctagatcctgca

SEQ ID NO: 4453325 - DNA, 19 bp, Homo sapiens
cccattctctctcctgtcc

SEQ ID NO: 4453326 - DNA, 20 bp, Homo sapiens
cccattctctctcctgtcca

SEQ ID NO: 4453327 - DNA, 21 bp, Homo sapiens
cccattctttgcttgaacaca

SEQ ID NO: 4453328 - DNA, 20 bp, Homo sapiens
cccattgagatcttcctgct

SEQ ID NO: 4453329 - DNA, 12 bp, Homo sapiens
cccattgcccag

SEQ ID NO: 4453330 - DNA, 13 bp, Homo sapiens
cccattgcccagt

SEQ ID NO: 4453331 - DNA, 15 bp, Homo sapiens
cccattgcccagtga

SEQ ID NO: 4453332 - DNA, 17 bp, Homo sapiens
cccatttctgcctcgct

SEQ ID NO: 4453333 - DNA, 13 bp, Homo sapiens
cccatttgtccca

SEQ ID NO: 4453334 - DNA, 14 bp, Homo sapiens
cccatttgtcccag

SEQ ID NO: 4453335 - DNA, 22 bp, Homo sapiens
cccattttattaataatattta

SEQ ID NO: 4453336 - DNA, 22 bp, Homo sapiens
cccatttttgctaattatcaat

SEQ ID NO: 4453337 - DNA, 20 bp, Homo sapiens
ccccaaaccccagccccaac

SEQ ID NO: 4453338 - DNA, 21 bp, Homo sapiens
ccccaaagcagcaggcctctg

SEQ ID NO: 4453339 - DNA, 22 bp, Homo sapiens
ccccaaaggacgcctgcaggag

SEQ ID NO: 4453340 - DNA, 16 bp, Homo sapiens
ccccaacatgcactga

SEQ ID NO: 4453341 - DNA, 15 bp, Homo sapiens
ccccaacccctcctc

SEQ ID NO: 4453342 - DNA, 16 bp, Homo sapiens
ccccaacccctcctcc

SEQ ID NO: 4453343 - DNA, 13 bp, Homo sapiens
ccccaacctcagg

SEQ ID NO: 4453344 - DNA, 20 bp, Homo sapiens
ccccaacctcagggctccca

SEQ ID NO: 4453345 - DNA, 19 bp, Homo sapiens
ccccaacctttccctcacc

SEQ ID NO: 4453346 - DNA, 20 bp, Homo sapiens
ccccaacgtcccctccgccg

SEQ ID NO: 4453347 - DNA, 17 bp, Homo sapiens
ccccaactccaggaaag

SEQ ID NO: 4453348 - DNA, 19 bp, Homo sapiens
ccccaactccatggggttc

SEQ ID NO: 4453349 - DNA, 18 bp, Homo sapiens
ccccaactctccccagtg

SEQ ID NO: 4453350 - DNA, 20 bp, Homo sapiens
ccccaactctccccagtgcc

SEQ ID NO: 4453351 - DNA, 17 bp, Homo sapiens
ccccaactgctccagcc

SEQ ID NO: 4453352 - DNA, 18 bp, Homo sapiens
ccccaactgctccagcct

SEQ ID NO: 4453353 - DNA, 20 bp, Homo sapiens
ccccaactgctccagcctct

SEQ ID NO: 4453354 - DNA, 23 bp, Homo sapiens
cctatttttgacatggaaatgaa

SEQ ID NO: 4453355 - DNA, 18 bp, Homo sapiens
cctcaaaaagcagaagga

SEQ ID NO: 4453356 - DNA, 19 bp, Homo sapiens
cctcaaacaggatggaaca

SEQ ID NO: 4453357 - DNA, 17 bp, Homo sapiens
cctcaaactcattgcag

SEQ ID NO: 4453358 - DNA, 14 bp, Homo sapiens
cctcaaagaaagtg

SEQ ID NO: 4453359 - DNA, 16 bp, Homo sapiens
cctcaaattttttgac

SEQ ID NO: 4453360 - DNA, 17 bp, Homo sapiens
cctcaaattttttgact

SEQ ID NO: 4453361 - DNA, 17 bp, Homo sapiens
cctcaacagtgttttca

SEQ ID NO: 4453362 - DNA, 20 bp, Homo sapiens
cctcaacctgtaaattattt

SEQ ID NO: 4453363 - DNA, 23 bp, Homo sapiens
cctcaacctgtaaattattttaa

SEQ ID NO: 4453364 - DNA, 12 bp, Homo sapiens
cctcaagccatc

SEQ ID NO: 4453365 - DNA, 13 bp, Homo sapiens
cctcaatccagct

SEQ ID NO: 4453366 - DNA, 22 bp, Homo sapiens
cctcaatgtgaatcagacccta

SEQ ID NO: 4453367 - DNA, 14 bp, Homo sapiens
cctcaatttttgtt

SEQ ID NO: 4453368 - DNA, 16 bp, Homo sapiens
cctcacaatgaggcta

SEQ ID NO: 4453369 - DNA, 19 bp, Homo sapiens
cctcacagtcccactgtgc

SEQ ID NO: 4453370 - DNA, 16 bp, Homo sapiens
cctcaccccctcccac

SEQ ID NO: 4453371 - DNA, 17 bp, Homo sapiens
cctcaccccctcccacc

SEQ ID NO: 4453372 - DNA, 20 bp, Homo sapiens
cctcaccccctcccaccccc

SEQ ID NO: 4453373 - DNA, 21 bp, Homo sapiens
cctcaccccctcccaccccca

SEQ ID NO: 4453374 - DNA, 17 bp, Homo sapiens
cctcaccccctccttca

SEQ ID NO: 4453375 - DNA, 22 bp, Homo sapiens
cctcacccctcgccacctttca

SEQ ID NO: 4453376 - DNA, 19 bp, Homo sapiens
cctcacccttcccggcccc

SEQ ID NO: 4453377 - DNA, 16 bp, Homo sapiens
cctcacctcatgccca

SEQ ID NO: 4453378 - DNA, 19 bp, Homo sapiens
cctcacctcatgcccaccc

SEQ ID NO: 4453379 - DNA, 22 bp, Homo sapiens
cctcacctctggactggctaga

SEQ ID NO: 4453380 - DNA, 17 bp, Homo sapiens
cctcacggggttggctg

SEQ ID NO: 4453381 - DNA, 18 bp, Homo sapiens
cctcacggggttggctgt

SEQ ID NO: 4453382 - DNA, 21 bp, Homo sapiens
cctcacggggttggctgttcc

SEQ ID NO: 4453383 - DNA, 21 bp, Homo sapiens
cctcactatggtatgctggcc

SEQ ID NO: 4453384 - DNA, 23 bp, Homo sapiens
cctcactatggtatgctggccag

SEQ ID NO: 4453385 - DNA, 21 bp, Homo sapiens
cctcactatgttgcctaggct

SEQ ID NO: 4453386 - DNA, 19 bp, Homo sapiens
cctcactcccttctacctg

SEQ ID NO: 4453387 - DNA, 12 bp, Homo sapiens
cctcactcctcc

SEQ ID NO: 4453388 - DNA, 17 bp, Homo sapiens
cctcactcctccgtgag

SEQ ID NO: 4453389 - DNA, 20 bp, Homo sapiens
cctcactctgtcagccagcc

SEQ ID NO: 4453390 - DNA, 22 bp, Homo sapiens
cctcactctgtcagccagccgc

SEQ ID NO: 4453391 - DNA, 14 bp, Homo sapiens
cctcagaaggcccc

SEQ ID NO: 4453392 - DNA, 16 bp, Homo sapiens
cctcagaaggccccag

SEQ ID NO: 4453393 - DNA, 18 bp, Homo sapiens
cctcagacccaggagtcc

SEQ ID NO: 4453394 - DNA, 21 bp, Homo sapiens
cctcagacccaggagtccaga

SEQ ID NO: 4453395 - DNA, 22 bp, Homo sapiens
cctcagacccaggggtccaggc

SEQ ID NO: 4453396 - DNA, 17 bp, Homo sapiens
cctcagacgttgcctga

SEQ ID NO: 4453397 - DNA, 15 bp, Homo sapiens
cctcagactcagagg

SEQ ID NO: 4453398 - DNA, 19 bp, Homo sapiens
cctcagactcagaggtcca

SEQ ID NO: 4453399 - DNA, 21 bp, Homo sapiens
cctcagactcagaggtccagg

SEQ ID NO: 4453400 - DNA, 17 bp, Homo sapiens
cctcagagcgccaggaa

SEQ ID NO: 4453401 - DNA, 19 bp, Homo sapiens
cctcagagcgccaggaagc

SEQ ID NO: 4453402 - DNA, 14 bp, Homo sapiens
cctcagatgatctc

SEQ ID NO: 4453403 - DNA, 21 bp, Homo sapiens
cctcagatgatctctccacgg

SEQ ID NO: 4453404 - DNA, 13 bp, Homo sapiens
cctcagattcttc

SEQ ID NO: 4453405 - DNA, 15 bp, Homo sapiens
cctcagcaagctgcc

SEQ ID NO: 4453406 - DNA, 17 bp, Homo sapiens
cctcagcaagctgccca

SEQ ID NO: 4453407 - DNA, 11 bp, Homo sapiens
cctcagcactg

SEQ ID NO: 4453408 - DNA, 15 bp, Homo sapiens
cctcagcagctctgg

SEQ ID NO: 4453409 - DNA, 13 bp, Homo sapiens
cctcagccagcct

SEQ ID NO: 4453410 - DNA, 16 bp, Homo sapiens
cctcagccaggccctg

SEQ ID NO: 4453411 - DNA, 21 bp, Homo sapiens
cctcagccatgaggagttgct

SEQ ID NO: 4453412 - DNA, 11 bp, Homo sapiens
cctcagccctc

SEQ ID NO: 4453413 - DNA, 13 bp, Homo sapiens
cctcagccctcag

SEQ ID NO: 4453414 - DNA, 14 bp, Homo sapiens
cctcagccctcaga

SEQ ID NO: 4453415 - DNA, 15 bp, Homo sapiens
cctcagccctcagtt

SEQ ID NO: 4453416 - DNA, 14 bp, Homo sapiens
cctcagccctgctc

SEQ ID NO: 4453417 - DNA, 17 bp, Homo sapiens
cctcagccctgctccct

SEQ ID NO: 4453418 - DNA, 22 bp, Homo sapiens
cctcagcctcccaagtagctgg

SEQ ID NO: 4453419 - DNA, 22 bp, Homo sapiens
cctcagcctcccatagctggga

SEQ ID NO: 4453420 - DNA, 21 bp, Homo sapiens
cctcagcctgctttcctgcag

SEQ ID NO: 4453421 - DNA, 14 bp, Homo sapiens
cctcagctctctgg

SEQ ID NO: 4453422 - DNA, 13 bp, Homo sapiens
cctcagctgcctc

SEQ ID NO: 4453423 - DNA, 14 bp, Homo sapiens
cctcagctgcctca

SEQ ID NO: 4453424 - DNA, 23 bp, Homo sapiens
cctcagctgtacaaatcctctgt

SEQ ID NO: 4453425 - DNA, 19 bp, Homo sapiens
cctcaggaaagaatagaaa

SEQ ID NO: 4453426 - DNA, 21 bp, Homo sapiens
cctcaggaaagaatagaaaga

SEQ ID NO: 4453427 - DNA, 16 bp, Homo sapiens
cctcaggcacacagct

SEQ ID NO: 4453428 - DNA, 13 bp, Homo sapiens
cctcaggcaggaa

SEQ ID NO: 4453429 - DNA, 15 bp, Homo sapiens
cctcaggccaaggga

SEQ ID NO: 4453430 - DNA, 15 bp, Homo sapiens
cctcaggcccaggag

SEQ ID NO: 4453431 - DNA, 20 bp, Homo sapiens
cctcaggcccaggagtccag

SEQ ID NO: 4453432 - DNA, 21 bp, Homo sapiens
cctcaggcccaggagtccagg

SEQ ID NO: 4453433 - DNA, 11 bp, Homo sapiens
cctcaggctcc

SEQ ID NO: 4453434 - DNA, 12 bp, Homo sapiens
cctcaggctcct

SEQ ID NO: 4453435 - DNA, 16 bp, Homo sapiens
cctcaggctcctaaag

SEQ ID NO: 4453436 - DNA, 22 bp, Homo sapiens
cctcagggacagagacacctgc

SEQ ID NO: 4453437 - DNA, 17 bp, Homo sapiens
cctcagggagcagggaa

SEQ ID NO: 4453438 - DNA, 21 bp, Homo sapiens
cctcagggagcagggaaggcc

SEQ ID NO: 4453439 - DNA, 23 bp, Homo sapiens
cctcagggagcagggaaggcctg

SEQ ID NO: 4453440 - DNA, 16 bp, Homo sapiens
cctcagggagcctccc

SEQ ID NO: 4453441 - DNA, 15 bp, Homo sapiens
cctcagggctcccag

SEQ ID NO: 4453442 - DNA, 16 bp, Homo sapiens
cctcaggggcctctct

SEQ ID NO: 4453443 - DNA, 11 bp, Homo sapiens
cctcaggtgcc

SEQ ID NO: 4453444 - DNA, 21 bp, Homo sapiens
cctcagtaagtatctggagga

SEQ ID NO: 4453445 - DNA, 14 bp, Homo sapiens
cctcagtgactcag

SEQ ID NO: 4453446 - DNA, 18 bp, Homo sapiens
cctcagtggatcttcaga

SEQ ID NO: 4453447 - DNA, 21 bp, Homo sapiens
cctcagtggatcttcagaact

SEQ ID NO: 4453448 - DNA, 13 bp, Homo sapiens
cctcagtggcttc

SEQ ID NO: 4453449 - DNA, 16 bp, Homo sapiens
cctcagttcccttggc

SEQ ID NO: 4453450 - DNA, 19 bp, Homo sapiens
cctcagttcccttggcctc

SEQ ID NO: 4453451 - DNA, 22 bp, Homo sapiens
cctcagttcccttggcctcaga

SEQ ID NO: 4453452 - DNA, 18 bp, Homo sapiens
cctcagttgtcctgccct

SEQ ID NO: 4453453 - DNA, 12 bp, Homo sapiens
cctcatacagaa

SEQ ID NO: 4453454 - DNA, 14 bp, Homo sapiens
cctcatactcctgg

SEQ ID NO: 4453455 - DNA, 22 bp, Homo sapiens
cctcatactcctgggctcaagc

SEQ ID NO: 4453456 - DNA, 15 bp, Homo sapiens
cctcatcatcagagc

SEQ ID NO: 4453457 - DNA, 16 bp, Homo sapiens
cctcatccagcctcag

SEQ ID NO: 4453458 - DNA, 18 bp, Homo sapiens
cctcatctatggttctaa

SEQ ID NO: 4453459 - DNA, 17 bp, Homo sapiens
cctcatctcagaccctg

SEQ ID NO: 4453460 - DNA, 15 bp, Homo sapiens
cctcatctgtccctc

SEQ ID NO: 4453461 - DNA, 15 bp, Homo sapiens
cctcatcttcttcac

SEQ ID NO: 4453462 - DNA, 15 bp, Homo sapiens
cctcatgccaaccct

SEQ ID NO: 4453463 - DNA, 13 bp, Homo sapiens
cctcatgcccacc

SEQ ID NO: 4453464 - DNA, 13 bp, Homo sapiens
cctcatgggtcct

SEQ ID NO: 4453465 - DNA, 15 bp, Homo sapiens
cctcatgtccactgg

SEQ ID NO: 4453466 - DNA, 15 bp, Homo sapiens
cctcatgttgctgaa

SEQ ID NO: 4453467 - DNA, 13 bp, Homo sapiens
cctcattcaggaa

SEQ ID NO: 4453468 - DNA, 11 bp, Homo sapiens
cctccaaatgg

SEQ ID NO: 4453469 - DNA, 11 bp, Homo sapiens
cctccaaatgt

SEQ ID NO: 4453470 - DNA, 13 bp, Homo sapiens
cctccaagcacag

SEQ ID NO: 4453471 - DNA, 16 bp, Homo sapiens
cctccaagcacagagc

SEQ ID NO: 4453472 - DNA, 18 bp, Homo sapiens
cctccaagcacagagcct

SEQ ID NO: 4453473 - DNA, 14 bp, Homo sapiens
cctctacagccgtc

SEQ ID NO: 4453474 - DNA, 15 bp, Homo sapiens
cctctacagccgtcc

SEQ ID NO: 4453475 - DNA, 16 bp, Homo sapiens
cctctaccagaactaa

SEQ ID NO: 4453476 - DNA, 15 bp, Homo sapiens
cctctaccccaattt

SEQ ID NO: 4453477 - DNA, 22 bp, Homo sapiens
cctctagtgtaccaagtgcttc

SEQ ID NO: 4453478 - DNA, 14 bp, Homo sapiens
cctctatggaagga

SEQ ID NO: 4453479 - DNA, 19 bp, Homo sapiens
cctctcaaattcagctctg

SEQ ID NO: 4453480 - DNA, 14 bp, Homo sapiens
cctctcacctcagc

SEQ ID NO: 4453481 - DNA, 15 bp, Homo sapiens
cctctcagctgctgg

SEQ ID NO: 4453482 - DNA, 16 bp, Homo sapiens
cctctcagctgctgga

SEQ ID NO: 4453483 - DNA, 19 bp, Homo sapiens
cctctcagctgctggatga

SEQ ID NO: 4453484 - DNA, 12 bp, Homo sapiens
cctctccaagac

SEQ ID NO: 4453485 - DNA, 19 bp, Homo sapiens
cctctccaagacagcagca

SEQ ID NO: 4453486 - DNA, 23 bp, Homo sapiens
cctctccaagacagcagcagcct

SEQ ID NO: 4453487 - DNA, 23 bp, Homo sapiens
cctctcccacagagtgctggact

SEQ ID NO: 4453488 - DNA, 22 bp, Homo sapiens
cctctccccaatccatgcttca

SEQ ID NO: 4453489 - DNA, 14 bp, Homo sapiens
cctctccctgcctg

SEQ ID NO: 4453490 - DNA, 17 bp, Homo sapiens
cctctccctgctgctcc

SEQ ID NO: 4453491 - DNA, 19 bp, Homo sapiens
cctctccctgctgctccta

SEQ ID NO: 4453492 - DNA, 12 bp, Homo sapiens
cctctcctcccc

SEQ ID NO: 4453493 - DNA, 18 bp, Homo sapiens
cctctcctccccttcctg

SEQ ID NO: 4453494 - DNA, 19 bp, Homo sapiens
cctctcctccccttcctgt

SEQ ID NO: 4453495 - DNA, 13 bp, Homo sapiens
cctctcctgccta

SEQ ID NO: 4453496 - DNA, 16 bp, Homo sapiens
cctctcctgcctactc

SEQ ID NO: 4453497 - DNA, 13 bp, Homo sapiens
cctctcctggagg

SEQ ID NO: 4453498 - DNA, 14 bp, Homo sapiens
cctctcctggagga

SEQ ID NO: 4453499 - DNA, 12 bp, Homo sapiens
cctctccttgga

SEQ ID NO: 4453500 - DNA, 20 bp, Homo sapiens
cctctcgccccatccctgct

SEQ ID NO: 4453501 - DNA, 15 bp, Homo sapiens
cctctctcccagtct

SEQ ID NO: 4453502 - DNA, 15 bp, Homo sapiens
cctctctccctgcct

SEQ ID NO: 4453503 - DNA, 17 bp, Homo sapiens
cctctctccctgcctca

SEQ ID NO: 4453504 - DNA, 23 bp, Homo sapiens
cctctctccttatagacacttgc

SEQ ID NO: 4453505 - DNA, 23 bp, Homo sapiens
cctctctctgggcccaggggctg

SEQ ID NO: 4453506 - DNA, 21 bp, Homo sapiens
cctctctcttctgctccaccc

SEQ ID NO: 4453507 - DNA, 22 bp, Homo sapiens
cctctctcttctgctccaccct

SEQ ID NO: 4453508 - DNA, 18 bp, Homo sapiens
cctctctgatgtcccagt

SEQ ID NO: 4453509 - DNA, 10 bp, Homo sapiens
cctctctgct

SEQ ID NO: 4453510 - DNA, 12 bp, Homo sapiens
cctctctgctct

SEQ ID NO: 4453511 - DNA, 13 bp, Homo sapiens
cctctctgcttca

SEQ ID NO: 4453512 - DNA, 18 bp, Homo sapiens
cctctctggggctgtgtt

SEQ ID NO: 4453513 - DNA, 23 bp, Homo sapiens
cctctctgtagtttatggcagaa

SEQ ID NO: 4453514 - DNA, 15 bp, Homo sapiens
cctctcttccacagt

SEQ ID NO: 4453515 - DNA, 16 bp, Homo sapiens
cctctcttccacagtg

SEQ ID NO: 4453516 - DNA, 12 bp, Homo sapiens
cctctcttcccc

SEQ ID NO: 4453517 - DNA, 16 bp, Homo sapiens
cctctcttccccttcc

SEQ ID NO: 4453518 - DNA, 12 bp, Homo sapiens
cctctgaaacag

SEQ ID NO: 4453519 - DNA, 13 bp, Homo sapiens
cctctgaaacagc

SEQ ID NO: 4453520 - DNA, 18 bp, Homo sapiens
cctctgaaacagctgcct

SEQ ID NO: 4453521 - DNA, 21 bp, Homo sapiens
cctctgaatttaattctttca

SEQ ID NO: 4453522 - DNA, 17 bp, Homo sapiens
cctctgactcagggctc

SEQ ID NO: 4453523 - DNA, 19 bp, Homo sapiens
cctctgactcagggctcct

SEQ ID NO: 4453524 - DNA, 15 bp, Homo sapiens
cctctgagctttgca

SEQ ID NO: 4453525 - DNA, 20 bp, Homo sapiens
cctctgatagctgtttcaaa

SEQ ID NO: 4453526 - DNA, 24 bp, Homo sapiens
cctctgattttggcatgtggagac

SEQ ID NO: 4453527 - DNA, 17 bp, Homo sapiens
cctctgcacccagaaca

SEQ ID NO: 4453528 - DNA, 19 bp, Homo sapiens
cctctgcagtctcatttct

SEQ ID NO: 4453529 - DNA, 12 bp, Homo sapiens
cctctgccacct

SEQ ID NO: 4453530 - DNA, 16 bp, Homo sapiens
cctctgccacctcccc

SEQ ID NO: 4453531 - DNA, 11 bp, Homo sapiens
cctctgccaga

SEQ ID NO: 4453532 - DNA, 17 bp, Homo sapiens
cctctgcccctgcagct

SEQ ID NO: 4453533 - DNA, 19 bp, Homo sapiens
cctctgcccctgcagctgg

SEQ ID NO: 4453534 - DNA, 13 bp, Homo sapiens
cctctgccctgga

SEQ ID NO: 4453535 - DNA, 14 bp, Homo sapiens
cctctgccctggat

SEQ ID NO: 4453536 - DNA, 19 bp, Homo sapiens
cctctgcccttcctgcagg

SEQ ID NO: 4453537 - DNA, 19 bp, Homo sapiens
cctctgccggtcgggcagc

SEQ ID NO: 4453538 - DNA, 18 bp, Homo sapiens
cctctgcctacagccagg

SEQ ID NO: 4453539 - DNA, 13 bp, Homo sapiens
cctctgcctcaat

SEQ ID NO: 4453540 - DNA, 13 bp, Homo sapiens
cctctgcctgccc

SEQ ID NO: 4453541 - DNA, 21 bp, Homo sapiens
cctctgcctgccccgccccca

SEQ ID NO: 4453542 - DNA, 16 bp, Homo sapiens
cctctgccttgccctc

SEQ ID NO: 4453543 - DNA, 13 bp, Homo sapiens
cctctgctcaccg

SEQ ID NO: 4453544 - DNA, 15 bp, Homo sapiens
cctctgctcaccgcc

SEQ ID NO: 4453545 - DNA, 20 bp, Homo sapiens
cctctgctcaccgcccatca

SEQ ID NO: 4453546 - DNA, 23 bp, Homo sapiens
cctctgctcaccgcccatcaggg

SEQ ID NO: 4453547 - DNA, 20 bp, Homo sapiens
cctctgctcattaaactgat

SEQ ID NO: 4453548 - DNA, 14 bp, Homo sapiens
cctctgctccctct

SEQ ID NO: 4453549 - DNA, 21 bp, Homo sapiens
cctctgctggagaaagccacg

SEQ ID NO: 4453550 - DNA, 15 bp, Homo sapiens
cctctgcttctcacg

SEQ ID NO: 4453551 - DNA, 14 bp, Homo sapiens
cctctgcttctcat

SEQ ID NO: 4453552 - DNA, 22 bp, Homo sapiens
cctctgctttctcctttaattg

SEQ ID NO: 4453553 - DNA, 15 bp, Homo sapiens
cctctgcttttatct

SEQ ID NO: 4453554 - DNA, 22 bp, Homo sapiens
cctctggacagccagtgacctt

SEQ ID NO: 4453555 - DNA, 16 bp, Homo sapiens
cctctggacggcaggc

SEQ ID NO: 4453556 - DNA, 14 bp, Homo sapiens
cctctggactggct

SEQ ID NO: 4453557 - DNA, 15 bp, Homo sapiens
cctctggcccctcac

SEQ ID NO: 4453558 - DNA, 15 bp, Homo sapiens
cctctggccctgcct

SEQ ID NO: 4453559 - DNA, 23 bp, Homo sapiens
cctctggctggctaactggaagc

SEQ ID NO: 4453560 - DNA, 16 bp, Homo sapiens
cctctggctttcccag

SEQ ID NO: 4453561 - DNA, 17 bp, Homo sapiens
cctctggctttcccagg

SEQ ID NO: 4453562 - DNA, 18 bp, Homo sapiens
cctctgggcacgcctgct

SEQ ID NO: 4453563 - DNA, 23 bp, Homo sapiens
cctctgggcacgcctgctggccg

SEQ ID NO: 4453564 - DNA, 21 bp, Homo sapiens
cctctggggccttcgggaccc

SEQ ID NO: 4453565 - DNA, 16 bp, Homo sapiens
cctctgtacagcaaga

SEQ ID NO: 4453566 - DNA, 19 bp, Homo sapiens
cctctgtccaggcactgag

SEQ ID NO: 4453567 - DNA, 19 bp, Homo sapiens
cctctgtccccttctctca

SEQ ID NO: 4453568 - DNA, 16 bp, Homo sapiens
cctctgtctgcccttc

SEQ ID NO: 4453569 - DNA, 19 bp, Homo sapiens
cctcttaaattatatattt

SEQ ID NO: 4453570 - DNA, 16 bp, Homo sapiens
cctcttcaggcctgct

SEQ ID NO: 4453571 - DNA, 14 bp, Homo sapiens
cctcttccagtctt

SEQ ID NO: 4453572 - DNA, 11 bp, Homo sapiens
cctcttcccca

SEQ ID NO: 4453573 - DNA, 22 bp, Homo sapiens
cctcttcccttagcctctccca

SEQ ID NO: 4453574 - DNA, 21 bp, Homo sapiens
cctcttctaaaatagcaataa

SEQ ID NO: 4453575 - DNA, 20 bp, Homo sapiens
cctcttctacttgtaaaatg

SEQ ID NO: 4453576 - DNA, 20 bp, Homo sapiens
cctcttctagatggacccca

SEQ ID NO: 4453577 - DNA, 19 bp, Homo sapiens
cctcttctgctcttttcct

SEQ ID NO: 4453578 - DNA, 21 bp, Homo sapiens
cctcttctgggagggcagcag

SEQ ID NO: 4453579 - DNA, 13 bp, Homo sapiens
cctcttgaccagg

SEQ ID NO: 4453580 - DNA, 14 bp, Homo sapiens
cctcttgaccaggc

SEQ ID NO: 4453581 - DNA, 13 bp, Homo sapiens
cctcttgcctcga

SEQ ID NO: 4453582 - DNA, 12 bp, Homo sapiens
cctcttggagac

SEQ ID NO: 4453583 - DNA, 11 bp, Homo sapiens
cctctttaaaa

SEQ ID NO: 4453584 - DNA, 17 bp, Homo sapiens
cctctttaaaacaaaac

SEQ ID NO: 4453585 - DNA, 18 bp, Homo sapiens
cctctttaaaacaaaaca

SEQ ID NO: 4453586 - DNA, 17 bp, Homo sapiens
cctctttcttcccatga

SEQ ID NO: 4453587 - DNA, 18 bp, Homo sapiens
cctctttgggcagtgcca

SEQ ID NO: 4453588 - DNA, 18 bp, Homo sapiens
cctcttttacctgctgct

SEQ ID NO: 4453589 - DNA, 18 bp, Homo sapiens
cctcttttcctggcagct

SEQ ID NO: 4453590 - DNA, 11 bp, Homo sapiens
cctcttttgta

SEQ ID NO: 4453591 - DNA, 12 bp, Homo sapiens
cctcttttgtgc

SEQ ID NO: 4453592 - DNA, 20 bp, Homo sapiens
cctgcacattgggtggggct

SEQ ID NO: 4453593 - DNA, 12 bp, Homo sapiens
cctgcaccccag

SEQ ID NO: 4453594 - DNA, 17 bp, Homo sapiens
cctgcaccccagcattc

SEQ ID NO: 4453595 - DNA, 21 bp, Homo sapiens
cctgcaccccagcattccagc

SEQ ID NO: 4453596 - DNA, 22 bp, Homo sapiens
cctgcacccttccacagctggc

SEQ ID NO: 4453597 - DNA, 19 bp, Homo sapiens
cctgcacctccccccactg

SEQ ID NO: 4453598 - DNA, 20 bp, Homo sapiens
cctgcacggtgggccttgct

SEQ ID NO: 4453599 - DNA, 19 bp, Homo sapiens
cctgcacgtcatgggaggg

SEQ ID NO: 4453600 - DNA, 19 bp, Homo sapiens
cctgcactttgatgtcatg

SEQ ID NO: 4453601 - DNA, 19 bp, Homo sapiens
cctgcagacacctggactg

SEQ ID NO: 4453602 - DNA, 21 bp, Homo sapiens
cctgcagacctcaagccatca

SEQ ID NO: 4453603 - DNA, 15 bp, Homo sapiens
cctgcagcaggcagc

SEQ ID NO: 4453604 - DNA, 20 bp, Homo sapiens
cctgcagcaggcagcttcta

SEQ ID NO: 4453605 - DNA, 15 bp, Homo sapiens
cctgcagcagtcgcc

SEQ ID NO: 4453606 - DNA, 16 bp, Homo sapiens
cctgcagccagggctg

SEQ ID NO: 4453607 - DNA, 20 bp, Homo sapiens
cctgcagcccaccagacgtc

SEQ ID NO: 4453608 - DNA, 14 bp, Homo sapiens
cctgcagctggaat

SEQ ID NO: 4453609 - DNA, 16 bp, Homo sapiens
cctgcaggcagagctg

SEQ ID NO: 4453610 - DNA, 20 bp, Homo sapiens
cctgcaggcagagctggagc

SEQ ID NO: 4453611 - DNA, 23 bp, Homo sapiens
cctgcaggcaggaacaaacaggg

SEQ ID NO: 4453612 - DNA, 16 bp, Homo sapiens
cctgcagggagccttc

SEQ ID NO: 4453613 - DNA, 18 bp, Homo sapiens
cctgcagggagccttctg

SEQ ID NO: 4453614 - DNA, 23 bp, Homo sapiens
cctgcaggtcagttgtaataaat

SEQ ID NO: 4453615 - DNA, 18 bp, Homo sapiens
cctgcagtttttaatttg

SEQ ID NO: 4453616 - DNA, 18 bp, Homo sapiens
cctgcattactccttcag

SEQ ID NO: 4453617 - DNA, 14 bp, Homo sapiens
cctgcattgtaaat

SEQ ID NO: 4453618 - DNA, 12 bp, Homo sapiens
cctgcattgtta

SEQ ID NO: 4453619 - DNA, 17 bp, Homo sapiens
cctgccaagactcctca

SEQ ID NO: 4453620 - DNA, 23 bp, Homo sapiens
cctgccacaaaccaccaggactg

SEQ ID NO: 4453621 - DNA, 11 bp, Homo sapiens
cctgccacagc

SEQ ID NO: 4453622 - DNA, 18 bp, Homo sapiens
cctgccacagccagagga

SEQ ID NO: 4453623 - DNA, 22 bp, Homo sapiens
cctgccaccggaggtcactcca

SEQ ID NO: 4453624 - DNA, 16 bp, Homo sapiens
cctgccactcacacag

SEQ ID NO: 4453625 - DNA, 20 bp, Homo sapiens
cctgccactcacacagccag

SEQ ID NO: 4453626 - DNA, 22 bp, Homo sapiens
cctgccactcacacagccaggt

SEQ ID NO: 4453627 - DNA, 15 bp, Homo sapiens
cctgccactctctgg

SEQ ID NO: 4453628 - DNA, 22 bp, Homo sapiens
cctgccactctctgggactctc

SEQ ID NO: 4453629 - DNA, 13 bp, Homo sapiens
cctgccaggcaca

SEQ ID NO: 4453630 - DNA, 19 bp, Homo sapiens
cctgccaggcaggggtggg

SEQ ID NO: 4453631 - DNA, 16 bp, Homo sapiens
cctgccagtcctagct

SEQ ID NO: 4453632 - DNA, 19 bp, Homo sapiens
cctgccagtcctagctgca

SEQ ID NO: 4453633 - DNA, 20 bp, Homo sapiens
cctgccagtcctagctgcac

SEQ ID NO: 4453634 - DNA, 21 bp, Homo sapiens
cctgccagtgaagtccttcag

SEQ ID NO: 4453635 - DNA, 13 bp, Homo sapiens
cctgccagtgcct

SEQ ID NO: 4453636 - DNA, 17 bp, Homo sapiens
cctgccagtgccttacc

SEQ ID NO: 4453637 - DNA, 21 bp, Homo sapiens
cctgccagtgccttacctcct

SEQ ID NO: 4453638 - DNA, 18 bp, Homo sapiens
cctgccatcatgtttaca

SEQ ID NO: 4453639 - DNA, 13 bp, Homo sapiens
cctgccatcctca

SEQ ID NO: 4453640 - DNA, 16 bp, Homo sapiens
cctgccattcttctgg

SEQ ID NO: 4453641 - DNA, 18 bp, Homo sapiens
cctgccattcttctggtg

SEQ ID NO: 4453642 - DNA, 21 bp, Homo sapiens
cctgccattcttctggtgcta

SEQ ID NO: 4453643 - DNA, 17 bp, Homo sapiens
cctgcccaaacccttaa

SEQ ID NO: 4453644 - DNA, 21 bp, Homo sapiens
cctgcccaaacccttaactga

SEQ ID NO: 4453645 - DNA, 23 bp, Homo sapiens
cctgcccaaacccttaactgaca

SEQ ID NO: 4453646 - DNA, 21 bp, Homo sapiens
cctgcccacagaaagccagga

SEQ ID NO: 4453647 - DNA, 14 bp, Homo sapiens
cctgcccacttctg

SEQ ID NO: 4453648 - DNA, 18 bp, Homo sapiens
cctgcccacttctgtttt

SEQ ID NO: 4453649 - DNA, 13 bp, Homo sapiens
cctgcccagactg

SEQ ID NO: 4453650 - DNA, 17 bp, Homo sapiens
cctgcccagactgatga

SEQ ID NO: 4453651 - DNA, 17 bp, Homo sapiens
cctgcccagagctgagt

SEQ ID NO: 4453652 - DNA, 16 bp, Homo sapiens
cctgcccagttgcact

SEQ ID NO: 4453653 - DNA, 22 bp, Homo sapiens
cctgcccagttgcactcaggtg

SEQ ID NO: 4453654 - DNA, 16 bp, Homo sapiens
cctgcccatgccccag

SEQ ID NO: 4453655 - DNA, 19 bp, Homo sapiens
cctgcccatgtgtcccctc

SEQ ID NO: 4453656 - DNA, 21 bp, Homo sapiens
cctgccccaccccatccagcc

SEQ ID NO: 4453657 - DNA, 22 bp, Homo sapiens
cctgccccaccccatccagcca

SEQ ID NO: 4453658 - DNA, 14 bp, Homo sapiens
cctgcccccagccc

SEQ ID NO: 4453659 - DNA, 15 bp, Homo sapiens
cctgcccccaggact

SEQ ID NO: 4453660 - DNA, 19 bp, Homo sapiens
cctgccccttctacactct

SEQ ID NO: 4453661 - DNA, 23 bp, Homo sapiens
cctgccccttctacactctcctg

SEQ ID NO: 4453662 - DNA, 10 bp, Homo sapiens
cctgcccggg

SEQ ID NO: 4453663 - DNA, 22 bp, Homo sapiens
cctgcccgtctctctcccatgg

SEQ ID NO: 4453664 - DNA, 13 bp, Homo sapiens
cctgccctcaagg

SEQ ID NO: 4453665 - DNA, 13 bp, Homo sapiens
cctgccctcccaa

SEQ ID NO: 4453666 - DNA, 13 bp, Homo sapiens
cctgccctgtcca

SEQ ID NO: 4453667 - DNA, 20 bp, Homo sapiens
cctgcccttttttctgcctc

SEQ ID NO: 4453668 - DNA, 16 bp, Homo sapiens
cctgccgacacgctcc

SEQ ID NO: 4453669 - DNA, 20 bp, Homo sapiens
cctgccgacacgctccctcc

SEQ ID NO: 4453670 - DNA, 14 bp, Homo sapiens
cctgccgcagagct

SEQ ID NO: 4453671 - DNA, 17 bp, Homo sapiens
cctgccggaatgaactg

SEQ ID NO: 4453672 - DNA, 22 bp, Homo sapiens
cctgccggtgggaccctgtccg

SEQ ID NO: 4453673 - DNA, 15 bp, Homo sapiens
cctgccgtgcatggc

SEQ ID NO: 4453674 - DNA, 20 bp, Homo sapiens
cctgccgtgcatggctcctg

SEQ ID NO: 4453675 - DNA, 19 bp, Homo sapiens
cctgcctatgtctcctcta

SEQ ID NO: 4453676 - DNA, 15 bp, Homo sapiens
cctgcctcagccagg

SEQ ID NO: 4453677 - DNA, 16 bp, Homo sapiens
cctgcctcagccttcc

SEQ ID NO: 4453678 - DNA, 13 bp, Homo sapiens
cctgcctccaaga

SEQ ID NO: 4453679 - DNA, 19 bp, Homo sapiens
cctgcctccaccctctgag

SEQ ID NO: 4453680 - DNA, 20 bp, Homo sapiens
cctgcctccaccctctgagc

SEQ ID NO: 4453681 - DNA, 20 bp, Homo sapiens
cctgcctcccacttcactgc

SEQ ID NO: 4453682 - DNA, 13 bp, Homo sapiens
cctgcctcctgcc

SEQ ID NO: 4453683 - DNA, 14 bp, Homo sapiens
cctgcctcctgcct

SEQ ID NO: 4453684 - DNA, 13 bp, Homo sapiens
cctgcctgagggc

SEQ ID NO: 4453685 - DNA, 18 bp, Homo sapiens
cctgcctgcagccagggc

SEQ ID NO: 4453686 - DNA, 20 bp, Homo sapiens
cctgcctgcatggcatcaga

SEQ ID NO: 4453687 - DNA, 18 bp, Homo sapiens
cctgcctgccctgcctca

SEQ ID NO: 4453688 - DNA, 12 bp, Homo sapiens
cctgcctgctcc

SEQ ID NO: 4453689 - DNA, 19 bp, Homo sapiens
cctgcctggaccagcctct

SEQ ID NO: 4453690 - DNA, 12 bp, Homo sapiens
cctgcctggagc

SEQ ID NO: 4453691 - DNA, 12 bp, Homo sapiens
cctgcctggcca

SEQ ID NO: 4453692 - DNA, 15 bp, Homo sapiens
cctgcctggccccca

SEQ ID NO: 4453693 - DNA, 19 bp, Homo sapiens
cctgcctgttggcaggccc

SEQ ID NO: 4453694 - DNA, 20 bp, Homo sapiens
cctgcctgttggcaggccca

SEQ ID NO: 4453695 - DNA, 21 bp, Homo sapiens
cctgcctgttggcaggcccac

SEQ ID NO: 4453696 - DNA, 22 bp, Homo sapiens
cctgcctgttggcaggcccact

SEQ ID NO: 4453697 - DNA, 19 bp, Homo sapiens
cctgccttagagccaggca

SEQ ID NO: 4453698 - DNA, 16 bp, Homo sapiens
cctgccttcctcctgg

SEQ ID NO: 4453699 - DNA, 22 bp, Homo sapiens
cctgccttcctcctgggccctc

SEQ ID NO: 4453700 - DNA, 11 bp, Homo sapiens
cctgccttggc

SEQ ID NO: 4453701 - DNA, 20 bp, Homo sapiens
cctgccttggcctcccaaag

SEQ ID NO: 4453702 - DNA, 17 bp, Homo sapiens
cctgccttttaagtttg

SEQ ID NO: 4453703 - DNA, 13 bp, Homo sapiens
cctgcgagacgca

SEQ ID NO: 4453704 - DNA, 18 bp, Homo sapiens
cctgcgagacgcacacag

SEQ ID NO: 4453705 - DNA, 23 bp, Homo sapiens
cctgcgagacgcacacagctgag

SEQ ID NO: 4453706 - DNA, 17 bp, Homo sapiens
cctgcgccctgtgcccg

SEQ ID NO: 4453707 - DNA, 13 bp, Homo sapiens
cctgcgcctgctg

SEQ ID NO: 4453708 - DNA, 22 bp, Homo sapiens
cctgcggaaggaattcaggaat

SEQ ID NO: 4453709 - DNA, 23 bp, Homo sapiens
cctgcggaaggaattcaggaata

SEQ ID NO: 4453710 - DNA, 13 bp, Homo sapiens
cctggtttaattc

SEQ ID NO: 4453711 - DNA, 19 bp, Homo sapiens
cctggtttaattcagcaga

SEQ ID NO: 4453712 - DNA, 20 bp, Homo sapiens
cctggtttaattcagcagag

SEQ ID NO: 4453713 - DNA, 13 bp, Homo sapiens
cctgtaaaacttt

SEQ ID NO: 4453714 - DNA, 16 bp, Homo sapiens
cctgtaacctcttcag

SEQ ID NO: 4453715 - DNA, 21 bp, Homo sapiens
cctgtaacctcttcagaggcc

SEQ ID NO: 4453716 - DNA, 13 bp, Homo sapiens
cctgtaagaaaaa

SEQ ID NO: 4453717 - DNA, 18 bp, Homo sapiens
cctgtaagccaaagaaat

SEQ ID NO: 4453718 - DNA, 23 bp, Homo sapiens
cctgtaagccaaagaaatgaaca

SEQ ID NO: 4453719 - DNA, 13 bp, Homo sapiens
cctgtaatcccag

SEQ ID NO: 4453720 - DNA, 17 bp, Homo sapiens
cctgtaatcccagcact

SEQ ID NO: 4453721 - DNA, 19 bp, Homo sapiens
cctgtaatcccagcacttt

SEQ ID NO: 4453722 - DNA, 16 bp, Homo sapiens
cctgtacattcttcca

SEQ ID NO: 4453723 - DNA, 21 bp, Homo sapiens
cctgtagattcaggtaataca

SEQ ID NO: 4453724 - DNA, 19 bp, Homo sapiens
cctgtagcaatggccagag

SEQ ID NO: 4453725 - DNA, 20 bp, Homo sapiens
cctgtagcaatggccagagc

SEQ ID NO: 4453726 - DNA, 15 bp, Homo sapiens
cctgtagctctgcct

SEQ ID NO: 4453727 - DNA, 18 bp, Homo sapiens
cctgtagctttcctggtc

SEQ ID NO: 4453728 - DNA, 22 bp, Homo sapiens
cctgtagggcacccaaaactca

SEQ ID NO: 4453729 - DNA, 15 bp, Homo sapiens
cctgtagtctcagct

SEQ ID NO: 4453730 - DNA, 14 bp, Homo sapiens
cctgtatacagtgc

SEQ ID NO: 4453731 - DNA, 18 bp, Homo sapiens
cctgtatacagtgcagag

SEQ ID NO: 4453732 - DNA, 16 bp, Homo sapiens
cctgtatactcttgaa

SEQ ID NO: 4453733 - DNA, 22 bp, Homo sapiens
cctgtatcctccctggcagaca

SEQ ID NO: 4453734 - DNA, 14 bp, Homo sapiens
cctgtattcttgtt

SEQ ID NO: 4453735 - DNA, 18 bp, Homo sapiens
cctgtattcttgtttgaa

SEQ ID NO: 4453736 - DNA, 16 bp, Homo sapiens
cctgtatttaagcaaa

SEQ ID NO: 4453737 - DNA, 17 bp, Homo sapiens
cctgtatttaagcaaat

SEQ ID NO: 4453738 - DNA, 19 bp, Homo sapiens
cctgtatttaagcaaatac

SEQ ID NO: 4453739 - DNA, 20 bp, Homo sapiens
cctgtatttaagcaaatact

SEQ ID NO: 4453740 - DNA, 12 bp, Homo sapiens
cctgtcacctct

SEQ ID NO: 4453741 - DNA, 21 bp, Homo sapiens
cctgtcagcctgactcttccc

SEQ ID NO: 4453742 - DNA, 17 bp, Homo sapiens
cctgtcagtgaggactc

SEQ ID NO: 4453743 - DNA, 19 bp, Homo sapiens
cctgtcagtgtcaccttgg

SEQ ID NO: 4453744 - DNA, 19 bp, Homo sapiens
cctgtccaacctaacccct

SEQ ID NO: 4453745 - DNA, 23 bp, Homo sapiens
cctgtccaacctaacccctttcc

SEQ ID NO: 4453746 - DNA, 22 bp, Homo sapiens
cctgtccacacccagctcagca

SEQ ID NO: 4453747 - DNA, 16 bp, Homo sapiens
cctgtccagcctgggc

SEQ ID NO: 4453748 - DNA, 21 bp, Homo sapiens
cctgtcccaattctgcccgct

SEQ ID NO: 4453749 - DNA, 14 bp, Homo sapiens
cctgtcccaggccg

SEQ ID NO: 4453750 - DNA, 16 bp, Homo sapiens
cctgtcccaggccggc

SEQ ID NO: 4453751 - DNA, 18 bp, Homo sapiens
cctgtcccattctagatc

SEQ ID NO: 4453752 - DNA, 20 bp, Homo sapiens
cctgtccccaaacaggacag

SEQ ID NO: 4453753 - DNA, 13 bp, Homo sapiens
cctgtccctctag

SEQ ID NO: 4453754 - DNA, 13 bp, Homo sapiens
cctgtccctggga

SEQ ID NO: 4453755 - DNA, 16 bp, Homo sapiens
cctgtccctgggagtg

SEQ ID NO: 4453756 - DNA, 23 bp, Homo sapiens
cctgtcccttgcctctgccctgg

SEQ ID NO: 4453757 - DNA, 13 bp, Homo sapiens
cctgtcccttttc

SEQ ID NO: 4453758 - DNA, 16 bp, Homo sapiens
cctgtcccttttccct

SEQ ID NO: 4453759 - DNA, 19 bp, Homo sapiens
cctgtccggcccagtgcca

SEQ ID NO: 4453760 - DNA, 21 bp, Homo sapiens
cctgtcctaaggaaccttcct

SEQ ID NO: 4453761 - DNA, 14 bp, Homo sapiens
cctgtcctcctcgg

SEQ ID NO: 4453762 - DNA, 15 bp, Homo sapiens
cctgtcctcctcgga

SEQ ID NO: 4453763 - DNA, 23 bp, Homo sapiens
cctgtcctcctcggatcaccgag

SEQ ID NO: 4453764 - DNA, 13 bp, Homo sapiens
cctgtccttccct

SEQ ID NO: 4453765 - DNA, 18 bp, Homo sapiens
cctgtccttccctgttct

SEQ ID NO: 4453766 - DNA, 13 bp, Homo sapiens
cctgtcgcccctc

SEQ ID NO: 4453767 - DNA, 16 bp, Homo sapiens
cctgtcgcccctcctt

SEQ ID NO: 4453768 - DNA, 14 bp, Homo sapiens
cctgtctaggtctc

SEQ ID NO: 4453769 - DNA, 21 bp, Homo sapiens
cctgtctaggtctcctcaggg

SEQ ID NO: 4453770 - DNA, 16 bp, Homo sapiens
cctgtctagtctctcc

SEQ ID NO: 4453771 - DNA, 21 bp, Homo sapiens
cctgtctagtctctcctgtaa

SEQ ID NO: 4453772 - DNA, 12 bp, Homo sapiens
cctgtctctaaa

SEQ ID NO: 4453773 - DNA, 14 bp, Homo sapiens
cctgtctctgcctg

SEQ ID NO: 4453774 - DNA, 15 bp, Homo sapiens
cctgtctctgcctgc

SEQ ID NO: 4453775 - DNA, 13 bp, Homo sapiens
cctgtctgcttgc

SEQ ID NO: 4453776 - DNA, 13 bp, Homo sapiens
cctgtctggaaga

SEQ ID NO: 4453777 - DNA, 22 bp, Homo sapiens
cctgtctggaagacgtggctct

SEQ ID NO: 4453778 - DNA, 22 bp, Homo sapiens
cctgtctggctcggacccaccc

SEQ ID NO: 4453779 - DNA, 22 bp, Homo sapiens
cctgtctgtagagggccctggt

SEQ ID NO: 4453780 - DNA, 17 bp, Homo sapiens
cctgtctgttcccagcc

SEQ ID NO: 4453781 - DNA, 15 bp, Homo sapiens
cctgtcttcccaggg

SEQ ID NO: 4453782 - DNA, 17 bp, Homo sapiens
cctgtgacatggtgcct

SEQ ID NO: 4453783 - DNA, 23 bp, Homo sapiens
cctgtgacatggtgcctgagagg

SEQ ID NO: 4453784 - DNA, 18 bp, Homo sapiens
cctgtgaccacaacatga

SEQ ID NO: 4453785 - DNA, 14 bp, Homo sapiens
cctgtgagatgtgt

SEQ ID NO: 4453786 - DNA, 14 bp, Homo sapiens
cctgtgaggcaggg

SEQ ID NO: 4453787 - DNA, 17 bp, Homo sapiens
cctgtgatgtcagcggt

SEQ ID NO: 4453788 - DNA, 22 bp, Homo sapiens
cctgtgatgtcagcggtgcagc

SEQ ID NO: 4453789 - DNA, 20 bp, Homo sapiens
cctgtgcagccgctgagcga

SEQ ID NO: 4453790 - DNA, 18 bp, Homo sapiens
cctgtgctctggaggctg

SEQ ID NO: 4453791 - DNA, 13 bp, Homo sapiens
cctgtgctgtgag

SEQ ID NO: 4453792 - DNA, 24 bp, Homo sapiens
cctgtggaacataaaaaggacatc

SEQ ID NO: 4453793 - DNA, 13 bp, Homo sapiens
cctgtggaataaa

SEQ ID NO: 4453794 - DNA, 14 bp, Homo sapiens
cctgtggcctgctc

SEQ ID NO: 4453795 - DNA, 15 bp, Homo sapiens
cctgtggcctgctca

SEQ ID NO: 4453796 - DNA, 15 bp, Homo sapiens
cctgtggcggtgcct

SEQ ID NO: 4453797 - DNA, 17 bp, Homo sapiens
cctgtggcggtgcctgg

SEQ ID NO: 4453798 - DNA, 12 bp, Homo sapiens
cctgtgggcttc

SEQ ID NO: 4453799 - DNA, 18 bp, Homo sapiens
cctgtggggactgaacct

SEQ ID NO: 4453800 - DNA, 14 bp, Homo sapiens
cctgtggggcctgg

SEQ ID NO: 4453801 - DNA, 22 bp, Homo sapiens
cctgtggtgaagtgtggctggt

SEQ ID NO: 4453802 - DNA, 15 bp, Homo sapiens
cctgtgtaacatctg

SEQ ID NO: 4453803 - DNA, 15 bp, Homo sapiens
cctgtgtacctcact

SEQ ID NO: 4453804 - DNA, 19 bp, Homo sapiens
cctgtgtacctcactgtcc

SEQ ID NO: 4453805 - DNA, 18 bp, Homo sapiens
cctgtgtattcaccacca

SEQ ID NO: 4453806 - DNA, 14 bp, Homo sapiens
cctgtgttctgggc

SEQ ID NO: 4453807 - DNA, 17 bp, Homo sapiens
cctgtgttctgggctgg

SEQ ID NO: 4453808 - DNA, 18 bp, Homo sapiens
cctgtgtttttttctaaa

SEQ ID NO: 4453809 - DNA, 20 bp, Homo sapiens
cctgttaaaagatgaaaata

SEQ ID NO: 4453810 - DNA, 16 bp, Homo sapiens
cctgttaatttataat

SEQ ID NO: 4453811 - DNA, 17 bp, Homo sapiens
cctgttacctactttga

SEQ ID NO: 4453812 - DNA, 19 bp, Homo sapiens
cctgttacctactttgact

SEQ ID NO: 4453813 - DNA, 18 bp, Homo sapiens
cctgttacttgcttcagt

SEQ ID NO: 4453814 - DNA, 20 bp, Homo sapiens
cctgttacttgcttcagtgg

SEQ ID NO: 4453815 - DNA, 15 bp, Homo sapiens
cctgttcagcattct

SEQ ID NO: 4453816 - DNA, 17 bp, Homo sapiens
cctgttcccaagcaaag

SEQ ID NO: 4453817 - DNA, 20 bp, Homo sapiens
cctgttcggttccagacact

SEQ ID NO: 4453818 - DNA, 13 bp, Homo sapiens
cctgttctccctt

SEQ ID NO: 4453819 - DNA, 14 bp, Homo sapiens
cctgttctcccttt

SEQ ID NO: 4453820 - DNA, 17 bp, Homo sapiens
cctgttctccctttctc

SEQ ID NO: 4453821 - DNA, 19 bp, Homo sapiens
cctgttctccctttctctc

SEQ ID NO: 4453822 - DNA, 21 bp, Homo sapiens
cctgttctccctttctctctc

SEQ ID NO: 4453823 - DNA, 24 bp, Homo sapiens
cctgttctccctttctctctcctc

SEQ ID NO: 4453824 - DNA, 22 bp, Homo sapiens
cctgttgattaatttctgccat

SEQ ID NO: 4453825 - DNA, 15 bp, Homo sapiens
cctgttgcacccagc

SEQ ID NO: 4453826 - DNA, 16 bp, Homo sapiens
cctgttgcacccagcc

SEQ ID NO: 4453827 - DNA, 17 bp, Homo sapiens
cctgttgcacccagccc

SEQ ID NO: 4453828 - DNA, 12 bp, Homo sapiens
ccttcctgggag

SEQ ID NO: 4453829 - DNA, 14 bp, Homo sapiens
ccttcctgggagga

SEQ ID NO: 4453830 - DNA, 21 bp, Homo sapiens
ccttcctgggaggacaggcag

SEQ ID NO: 4453831 - DNA, 22 bp, Homo sapiens
ccttcctgggaggacaggcagg

SEQ ID NO: 4453832 - DNA, 16 bp, Homo sapiens
ccttcctgtccctgag

SEQ ID NO: 4453833 - DNA, 16 bp, Homo sapiens
ccttcctgtctcactc

SEQ ID NO: 4453834 - DNA, 17 bp, Homo sapiens
ccttcctgtttttcaca

SEQ ID NO: 4453835 - DNA, 19 bp, Homo sapiens
ccttcctgtttttcacatt

SEQ ID NO: 4453836 - DNA, 15 bp, Homo sapiens
ccttccttccctggc

SEQ ID NO: 4453837 - DNA, 16 bp, Homo sapiens
ccttccttttccctgc

SEQ ID NO: 4453838 - DNA, 17 bp, Homo sapiens
ccttcgggaccctgggg

SEQ ID NO: 4453839 - DNA, 20 bp, Homo sapiens
ccttcgtgcctgagaccagg

SEQ ID NO: 4453840 - DNA, 23 bp, Homo sapiens
ccttcgtgcctgagaccagggtg

SEQ ID NO: 4453841 - DNA, 19 bp, Homo sapiens
ccttctaccccaaggccag

SEQ ID NO: 4453842 - DNA, 12 bp, Homo sapiens
ccttctacctgc

SEQ ID NO: 4453843 - DNA, 18 bp, Homo sapiens
ccttctacctgccactca

SEQ ID NO: 4453844 - DNA, 20 bp, Homo sapiens
ccttctagaacacctgcctt

SEQ ID NO: 4453845 - DNA, 19 bp, Homo sapiens
ccttctatacccacccaga

SEQ ID NO: 4453846 - DNA, 15 bp, Homo sapiens
ccttctattggtctc

SEQ ID NO: 4453847 - DNA, 11 bp, Homo sapiens
ccttctcacca

SEQ ID NO: 4453848 - DNA, 12 bp, Homo sapiens
ccttctcaccag

SEQ ID NO: 4453849 - DNA, 15 bp, Homo sapiens
ccttctcaccagctg

SEQ ID NO: 4453850 - DNA, 16 bp, Homo sapiens
ccttctcaccagctgc

SEQ ID NO: 4453851 - DNA, 17 bp, Homo sapiens
ccttctcaccagctgca

SEQ ID NO: 4453852 - DNA, 22 bp, Homo sapiens
ccttctccatccacatgggagc

SEQ ID NO: 4453853 - DNA, 16 bp, Homo sapiens
ccttctcctgcccttt

SEQ ID NO: 4453854 - DNA, 23 bp, Homo sapiens
ccttctcgtgtttgcttaaaata

SEQ ID NO: 4453855 - DNA, 22 bp, Homo sapiens
ccttctctattgggcacagcct

SEQ ID NO: 4453856 - DNA, 15 bp, Homo sapiens
ccttctctcatctct

SEQ ID NO: 4453857 - DNA, 20 bp, Homo sapiens
ccttctctcctccccaaatc

SEQ ID NO: 4453858 - DNA, 15 bp, Homo sapiens
ccttctgaactccat

SEQ ID NO: 4453859 - DNA, 16 bp, Homo sapiens
ccttctggccttgtaa

SEQ ID NO: 4453860 - DNA, 18 bp, Homo sapiens
ccttctgggtccagggag

SEQ ID NO: 4453861 - DNA, 12 bp, Homo sapiens
ccttctgtgtca

SEQ ID NO: 4453862 - DNA, 22 bp, Homo sapiens
ccttcttattctcactccacca

SEQ ID NO: 4453863 - DNA, 21 bp, Homo sapiens
ccttcttcggggaactcctgg

SEQ ID NO: 4453864 - DNA, 22 bp, Homo sapiens
ccttcttcggggaactcctgga

SEQ ID NO: 4453865 - DNA, 18 bp, Homo sapiens
ccttctttattgcccctt

SEQ ID NO: 4453866 - DNA, 14 bp, Homo sapiens
ccttctttctggac

SEQ ID NO: 4453867 - DNA, 15 bp, Homo sapiens
ccttctttctggact

SEQ ID NO: 4453868 - DNA, 20 bp, Homo sapiens
ccttgaaaactttatgctaa

SEQ ID NO: 4453869 - DNA, 21 bp, Homo sapiens
ccttgaaaataagaatagaaa

SEQ ID NO: 4453870 - DNA, 13 bp, Homo sapiens
ccttgaaaggaag

SEQ ID NO: 4453871 - DNA, 13 bp, Homo sapiens
ccttgaataataa

SEQ ID NO: 4453872 - DNA, 14 bp, Homo sapiens
ccttgagacctcag

SEQ ID NO: 4453873 - DNA, 19 bp, Homo sapiens
ccttgagacctcagccatg

SEQ ID NO: 4453874 - DNA, 14 bp, Homo sapiens
ccttgagccctggc

SEQ ID NO: 4453875 - DNA, 17 bp, Homo sapiens
ccttgagccctggctgt

SEQ ID NO: 4453876 - DNA, 16 bp, Homo sapiens
ccttgataatatattg

SEQ ID NO: 4453877 - DNA, 12 bp, Homo sapiens
ccttgcacctgc

SEQ ID NO: 4453878 - DNA, 16 bp, Homo sapiens
ccttgcacctgcatcc

SEQ ID NO: 4453879 - DNA, 19 bp, Homo sapiens
ccttgcagcggctcctgca

SEQ ID NO: 4453880 - DNA, 18 bp, Homo sapiens
ccttgcaggggtcccccc

SEQ ID NO: 4453881 - DNA, 19 bp, Homo sapiens
ccttgcaggggtcccccct

SEQ ID NO: 4453882 - DNA, 21 bp, Homo sapiens
ccttgcagggtgggtgagctc

SEQ ID NO: 4453883 - DNA, 17 bp, Homo sapiens
ccttgcagttcagcacc

SEQ ID NO: 4453884 - DNA, 22 bp, Homo sapiens
ccttgcagttcagcaccaccct

SEQ ID NO: 4453885 - DNA, 20 bp, Homo sapiens
ccttgcccagactacagggc

SEQ ID NO: 4453886 - DNA, 12 bp, Homo sapiens
ccttgcccagag

SEQ ID NO: 4453887 - DNA, 19 bp, Homo sapiens
ccttgccccccgccctcat

SEQ ID NO: 4453888 - DNA, 15 bp, Homo sapiens
ccttgccctcctggg

SEQ ID NO: 4453889 - DNA, 18 bp, Homo sapiens
ccttgccctcctgggccc

SEQ ID NO: 4453890 - DNA, 20 bp, Homo sapiens
ccttgccctcctgggccctg

SEQ ID NO: 4453891 - DNA, 23 bp, Homo sapiens
ccttgccctcctgggccctgggc

SEQ ID NO: 4453892 - DNA, 14 bp, Homo sapiens
ccttgcctccccat

SEQ ID NO: 4453893 - DNA, 23 bp, Homo sapiens
ccttgcctccccatttcccatct

SEQ ID NO: 4453894 - DNA, 18 bp, Homo sapiens
ccttgcctgaactccaga

SEQ ID NO: 4453895 - DNA, 13 bp, Homo sapiens
ccttgcgcctcag

SEQ ID NO: 4453896 - DNA, 15 bp, Homo sapiens
ccttgcgcctcagcc

SEQ ID NO: 4453897 - DNA, 20 bp, Homo sapiens
ccttgcgcctcagccctcag

SEQ ID NO: 4453898 - DNA, 21 bp, Homo sapiens
ccttgcgcctcagccctcagt

SEQ ID NO: 4453899 - DNA, 14 bp, Homo sapiens
ccttgctctcctca

SEQ ID NO: 4453900 - DNA, 19 bp, Homo sapiens
ccttgctctcttcaataaa

SEQ ID NO: 4453901 - DNA, 21 bp, Homo sapiens
ccttgctctcttcaataaacc

SEQ ID NO: 4453902 - DNA, 13 bp, Homo sapiens
ccttgctgcccgc

SEQ ID NO: 4453903 - DNA, 13 bp, Homo sapiens
ccttgctttcctg

SEQ ID NO: 4453904 - DNA, 17 bp, Homo sapiens
ccttgctttcctgggcc

SEQ ID NO: 4453905 - DNA, 18 bp, Homo sapiens
ccttgctttcctgggcct

SEQ ID NO: 4453906 - DNA, 18 bp, Homo sapiens
ccttggaatatggccaag

SEQ ID NO: 4453907 - DNA, 16 bp, Homo sapiens
ccttggacattttatg

SEQ ID NO: 4453908 - DNA, 16 bp, Homo sapiens
ccttggaggaatgaca

SEQ ID NO: 4453909 - DNA, 23 bp, Homo sapiens
ccttggagggtcccaagctgggc

SEQ ID NO: 4453910 - DNA, 15 bp, Homo sapiens
ccttggagtcccagg

SEQ ID NO: 4453911 - DNA, 22 bp, Homo sapiens
ccttggataatgctgttgcctc

SEQ ID NO: 4453912 - DNA, 14 bp, Homo sapiens
ccttggcccagaga

SEQ ID NO: 4453913 - DNA, 17 bp, Homo sapiens
ccttggcctcccaaagt

SEQ ID NO: 4453914 - DNA, 22 bp, Homo sapiens
ccttggctatgaaaatgagccc

SEQ ID NO: 4453915 - DNA, 19 bp, Homo sapiens
ccttggctttcagagccag

SEQ ID NO: 4453916 - DNA, 12 bp, Homo sapiens
ccttgggctccc

SEQ ID NO: 4453917 - DNA, 18 bp, Homo sapiens
ccttgggctgctcctcat

SEQ ID NO: 4453918 - DNA, 23 bp, Homo sapiens
ccttggggaatttcctctattga

SEQ ID NO: 4453919 - DNA, 16 bp, Homo sapiens
ccttggggtccctcca

SEQ ID NO: 4453920 - DNA, 19 bp, Homo sapiens
ccttggggtccctccaccc

SEQ ID NO: 4453921 - DNA, 21 bp, Homo sapiens
ccttggggtccctccacccca

SEQ ID NO: 4453922 - DNA, 18 bp, Homo sapiens
ccttgggtgttccacctg

SEQ ID NO: 4453923 - DNA, 19 bp, Homo sapiens
ccttggtgtccacctggcc

SEQ ID NO: 4453924 - DNA, 17 bp, Homo sapiens
ccttgtacttgcttgta

SEQ ID NO: 4453925 - DNA, 22 bp, Homo sapiens
ccttgtcaacaaagtgcttttt

SEQ ID NO: 4453926 - DNA, 18 bp, Homo sapiens
ccttgtcacgccagactt

SEQ ID NO: 4453927 - DNA, 21 bp, Homo sapiens
ccttgtccgcaaggggtgatg

SEQ ID NO: 4453928 - DNA, 21 bp, Homo sapiens
ccttgtcggccccaccagtgc

SEQ ID NO: 4453929 - DNA, 21 bp, Homo sapiens
ccttgtgagagtggctttcta

SEQ ID NO: 4453930 - DNA, 21 bp, Homo sapiens
ccttgtggcacgttgacccaa

SEQ ID NO: 4453931 - DNA, 16 bp, Homo sapiens
ccttgtttataaatag

SEQ ID NO: 4453932 - DNA, 20 bp, Homo sapiens
ccttgtttgagtttttcctc

SEQ ID NO: 4453933 - DNA, 21 bp, Homo sapiens
ccttgtttgagtttttcctcc

SEQ ID NO: 4453934 - DNA, 23 bp, Homo sapiens
ccttgtttgagtttttcctccca

SEQ ID NO: 4453935 - DNA, 12 bp, Homo sapiens
cctttaaaaata

SEQ ID NO: 4453936 - DNA, 18 bp, Homo sapiens
cctttaacttttttttct

SEQ ID NO: 4453937 - DNA, 16 bp, Homo sapiens
cctttaagaaccttaa

SEQ ID NO: 4453938 - DNA, 13 bp, Homo sapiens
cctttaatatttt

SEQ ID NO: 4453939 - DNA, 15 bp, Homo sapiens
cctttacaactaaat

SEQ ID NO: 4453940 - DNA, 16 bp, Homo sapiens
cctttagaaaatataa

SEQ ID NO: 4453941 - DNA, 19 bp, Homo sapiens
cctttaggtcaaactccct

SEQ ID NO: 4453942 - DNA, 16 bp, Homo sapiens
cctttatctttcacct

SEQ ID NO: 4453943 - DNA, 13 bp, Homo sapiens
cctttatgtgaat

SEQ ID NO: 4453944 - DNA, 14 bp, Homo sapiens
cctttatgtgaatt

SEQ ID NO: 4453945 - DNA, 19 bp, Homo sapiens
cctttatttccactgtgca

SEQ ID NO: 4453946 - DNA, 16 bp, Homo sapiens
cttgatctatctacaa

SEQ ID NO: 4453947 - DNA, 17 bp, Homo sapiens
cttgatctatctacaaa

SEQ ID NO: 4453948 - DNA, 19 bp, Homo sapiens
cttgatctatctacaaaga

SEQ ID NO: 4453949 - DNA, 14 bp, Homo sapiens
cttgatctctcttg

SEQ ID NO: 4453950 - DNA, 16 bp, Homo sapiens
cttgatctctcttgtc

SEQ ID NO: 4453951 - DNA, 17 bp, Homo sapiens
cttgatctttgagccca

SEQ ID NO: 4453952 - DNA, 21 bp, Homo sapiens
cttgatgaccaaagtcctttt

SEQ ID NO: 4453953 - DNA, 13 bp, Homo sapiens
cttgatgtacata

SEQ ID NO: 4453954 - DNA, 19 bp, Homo sapiens
cttgatgttccacctgcca

SEQ ID NO: 4453955 - DNA, 17 bp, Homo sapiens
cttgattctgcagtaaa

SEQ ID NO: 4453956 - DNA, 24 bp, Homo sapiens
cttgatttgagttgattgagaaga

SEQ ID NO: 4453957 - DNA, 22 bp, Homo sapiens
cttgatttgatctttgtttaaa

SEQ ID NO: 4453958 - DNA, 16 bp, Homo sapiens
cttgcaaatgggagct

SEQ ID NO: 4453959 - DNA, 18 bp, Homo sapiens
cttgcaatccaggctgtt

SEQ ID NO: 4453960 - DNA, 19 bp, Homo sapiens
cttgcaatccaggctgttc

SEQ ID NO: 4453961 - DNA, 14 bp, Homo sapiens
cttgcacagccaac

SEQ ID NO: 4453962 - DNA, 18 bp, Homo sapiens
cttgcacagccaacgaga

SEQ ID NO: 4453963 - DNA, 23 bp, Homo sapiens
cttgcacagccaacgagacacat

SEQ ID NO: 4453964 - DNA, 19 bp, Homo sapiens
cttgcactggccttctgat

SEQ ID NO: 4453965 - DNA, 17 bp, Homo sapiens
cttgcagatcatctggg

SEQ ID NO: 4453966 - DNA, 15 bp, Homo sapiens
cttgcagcggctcct

SEQ ID NO: 4453967 - DNA, 16 bp, Homo sapiens
cttgcagcggctcctg

SEQ ID NO: 4453968 - DNA, 19 bp, Homo sapiens
cttgcagcggctcctgcaa

SEQ ID NO: 4453969 - DNA, 18 bp, Homo sapiens
cttgcagctaaggagggg

SEQ ID NO: 4453970 - DNA, 18 bp, Homo sapiens
cttgcagttcagcaccac

SEQ ID NO: 4453971 - DNA, 16 bp, Homo sapiens
cttgcatccattgttg

SEQ ID NO: 4453972 - DNA, 15 bp, Homo sapiens
cttgcatctgcacat

SEQ ID NO: 4453973 - DNA, 19 bp, Homo sapiens
cttgcatggtttggagctg

SEQ ID NO: 4453974 - DNA, 20 bp, Homo sapiens
cttgcattttggaaggctga

SEQ ID NO: 4453975 - DNA, 21 bp, Homo sapiens
cttgccacatggtgtctccca

SEQ ID NO: 4453976 - DNA, 22 bp, Homo sapiens
cttgccacatggtgtctcccaa

SEQ ID NO: 4453977 - DNA, 18 bp, Homo sapiens
cttgccaccccaccctcc

SEQ ID NO: 4453978 - DNA, 11 bp, Homo sapiens
cttgccatcac

SEQ ID NO: 4453979 - DNA, 14 bp, Homo sapiens
cttgccatcactgg

SEQ ID NO: 4453980 - DNA, 13 bp, Homo sapiens
cttgcccagagat

SEQ ID NO: 4453981 - DNA, 19 bp, Homo sapiens
cttgcccagagatgcctcc

SEQ ID NO: 4453982 - DNA, 21 bp, Homo sapiens
cttgcccagagatgcctccac

SEQ ID NO: 4453983 - DNA, 22 bp, Homo sapiens
cttgcccagagatgcctccacc

SEQ ID NO: 4453984 - DNA, 13 bp, Homo sapiens
cttgcccagcctg

SEQ ID NO: 4453985 - DNA, 15 bp, Homo sapiens
cttgcccagcctgga

SEQ ID NO: 4453986 - DNA, 18 bp, Homo sapiens
cttgcccagcctggatgc

SEQ ID NO: 4453987 - DNA, 12 bp, Homo sapiens
cttgcccatcct

SEQ ID NO: 4453988 - DNA, 18 bp, Homo sapiens
cttgccccccgccctcat

SEQ ID NO: 4453989 - DNA, 19 bp, Homo sapiens
cttgccccccgccctcatg

SEQ ID NO: 4453990 - DNA, 15 bp, Homo sapiens
cttgcccgctcccac

SEQ ID NO: 4453991 - DNA, 15 bp, Homo sapiens
cttgccctcctgggc

SEQ ID NO: 4453992 - DNA, 20 bp, Homo sapiens
cttgccctcctgggccctgg

SEQ ID NO: 4453993 - DNA, 22 bp, Homo sapiens
cttgccctgttaaaagatgaaa

SEQ ID NO: 4453994 - DNA, 21 bp, Homo sapiens
cttgcctaactaactggcagg

SEQ ID NO: 4453995 - DNA, 14 bp, Homo sapiens
cttgcctccccatt

SEQ ID NO: 4453996 - DNA, 15 bp, Homo sapiens
cttgcctctgcacac

SEQ ID NO: 4453997 - DNA, 20 bp, Homo sapiens
cttgccttattagagtgtct

SEQ ID NO: 4453998 - DNA, 13 bp, Homo sapiens
cttgccttttgtt

SEQ ID NO: 4453999 - DNA, 14 bp, Homo sapiens
cttgcgaataacag

SEQ ID NO: 4454000 - DNA, 17 bp, Homo sapiens
cttgcgagtccaaggcc

SEQ ID NO: 4454001 - DNA, 13 bp, Homo sapiens
cttgcgcctcagc

SEQ ID NO: 4454002 - DNA, 22 bp, Homo sapiens
cttgcggtatccgcccccaata

SEQ ID NO: 4454003 - DNA, 22 bp, Homo sapiens
cttgctaaactgttgggaaagc

SEQ ID NO: 4454004 - DNA, 18 bp, Homo sapiens
cttgctaccagtatttag

SEQ ID NO: 4454005 - DNA, 13 bp, Homo sapiens
cttgctatttcaa

SEQ ID NO: 4454006 - DNA, 15 bp, Homo sapiens
cttgctatttcaata

SEQ ID NO: 4454007 - DNA, 13 bp, Homo sapiens
cttgctccctctc

SEQ ID NO: 4454008 - DNA, 21 bp, Homo sapiens
cttgctcgcttgctggaacac

SEQ ID NO: 4454009 - DNA, 16 bp, Homo sapiens
cttgctctcctcatct

SEQ ID NO: 4454010 - DNA, 19 bp, Homo sapiens
cttgctctcctcatctcca

SEQ ID NO: 4454011 - DNA, 12 bp, Homo sapiens
cttgctctgtcc

SEQ ID NO: 4454012 - DNA, 18 bp, Homo sapiens
cttgctctgtcccccagg

SEQ ID NO: 4454013 - DNA, 19 bp, Homo sapiens
cttgctctgtcccccaggc

SEQ ID NO: 4454014 - DNA, 20 bp, Homo sapiens
cttgctctgtcccccaggct

SEQ ID NO: 4454015 - DNA, 17 bp, Homo sapiens
cttgctgacttagcctc

SEQ ID NO: 4454016 - DNA, 20 bp, Homo sapiens
cttgctggaacacaggggcc

SEQ ID NO: 4454017 - DNA, 19 bp, Homo sapiens
cttgctggatctgtagtga

SEQ ID NO: 4454018 - DNA, 15 bp, Homo sapiens
cttgctgtttttccg

SEQ ID NO: 4454019 - DNA, 16 bp, Homo sapiens
cttgcttaaatttctt

SEQ ID NO: 4454020 - DNA, 12 bp, Homo sapiens
cttgcttcagtg

SEQ ID NO: 4454021 - DNA, 12 bp, Homo sapiens
cttgctttcctg

SEQ ID NO: 4454022 - DNA, 14 bp, Homo sapiens
cttgctttcctgca

SEQ ID NO: 4454023 - DNA, 15 bp, Homo sapiens
cttgctttcctgggc

SEQ ID NO: 4454024 - DNA, 19 bp, Homo sapiens
cttgctttcctgggccttt

SEQ ID NO: 4454025 - DNA, 17 bp, Homo sapiens
cttgcttttctgtattt

SEQ ID NO: 4454026 - DNA, 17 bp, Homo sapiens
cttggaaaacaaaagtt

SEQ ID NO: 4454027 - DNA, 23 bp, Homo sapiens
cttggaaaacaaaagttttaatt

SEQ ID NO: 4454028 - DNA, 20 bp, Homo sapiens
cttggaaatagaaagaagcc

SEQ ID NO: 4454029 - DNA, 23 bp, Homo sapiens
cttggaaatagaaagaagccata

SEQ ID NO: 4454030 - DNA, 15 bp, Homo sapiens
cttggaagctgtttg

SEQ ID NO: 4454031 - DNA, 14 bp, Homo sapiens
cttggaaggtcttt

SEQ ID NO: 4454032 - DNA, 15 bp, Homo sapiens
cttggaatgggagag

SEQ ID NO: 4454033 - DNA, 20 bp, Homo sapiens
cttggaattacaagccctgg

SEQ ID NO: 4454034 - DNA, 18 bp, Homo sapiens
cttggaattggaattact

SEQ ID NO: 4454035 - DNA, 15 bp, Homo sapiens
cttggacagtctgag

SEQ ID NO: 4454036 - DNA, 17 bp, Homo sapiens
cttggacagtctgagct

SEQ ID NO: 4454037 - DNA, 19 bp, Homo sapiens
cttggacattttatgtctt

SEQ ID NO: 4454038 - DNA, 16 bp, Homo sapiens
cttggaccatgccaga

SEQ ID NO: 4454039 - DNA, 19 bp, Homo sapiens
cttggaccatgccagattc

SEQ ID NO: 4454040 - DNA, 14 bp, Homo sapiens
cttggacccacctg

SEQ ID NO: 4454041 - DNA, 13 bp, Homo sapiens
cttggactacaca

SEQ ID NO: 4454042 - DNA, 14 bp, Homo sapiens
cttggactacacaa

SEQ ID NO: 4454043 - DNA, 21 bp, Homo sapiens
cttggactacacaatacagta

SEQ ID NO: 4454044 - DNA, 14 bp, Homo sapiens
cttggagactcctg

SEQ ID NO: 4454045 - DNA, 14 bp, Homo sapiens
cttggagctgcttg

SEQ ID NO: 4454046 - DNA, 15 bp, Homo sapiens
cttggagctttggaa

SEQ ID NO: 4454047 - DNA, 17 bp, Homo sapiens
cttggagctttggaata

SEQ ID NO: 4454048 - DNA, 18 bp, Homo sapiens
cttggagctttggaatat

SEQ ID NO: 4454049 - DNA, 21 bp, Homo sapiens
cttggagggtcccaagctggg

SEQ ID NO: 4454050 - DNA, 19 bp, Homo sapiens
cttggagtgccaagtttgc

SEQ ID NO: 4454051 - DNA, 22 bp, Homo sapiens
cttggataatgctgttgcctca

SEQ ID NO: 4454052 - DNA, 16 bp, Homo sapiens
cttggattactttaca

SEQ ID NO: 4454053 - DNA, 16 bp, Homo sapiens
cttggatttagtttca

SEQ ID NO: 4454054 - DNA, 18 bp, Homo sapiens
cttggcacccccatgctg

SEQ ID NO: 4454055 - DNA, 14 bp, Homo sapiens
cttggccctttcct

SEQ ID NO: 4454056 - DNA, 11 bp, Homo sapiens
cttggcctcag

SEQ ID NO: 4454057 - DNA, 12 bp, Homo sapiens
cttggcctcaga

SEQ ID NO: 4454058 - DNA, 13 bp, Homo sapiens
cttggcctgctgt

SEQ ID NO: 4454059 - DNA, 22 bp, Homo sapiens
cttggcctgtctcatccccagg

SEQ ID NO: 4454060 - DNA, 23 bp, Homo sapiens
cttggcctgtctcatccccaggg

SEQ ID NO: 4454061 - DNA, 21 bp, Homo sapiens
cttggctatgaaaatgagccc

SEQ ID NO: 4454062 - DNA, 21 bp, Homo sapiens
cttggctgcctgtgggcttcc

SEQ ID NO: 4454063 - DNA, 18 bp, Homo sapiens
cttgggaccagaagtgtt

SEQ ID NO: 4454064 - DNA, 19 bp, Homo sapiens
cttgggagcctgtggccag

SEQ ID NO: 4454065 - DNA, 22 bp, Homo sapiens
cttgggaggttttattctgact

SEQ ID NO: 4454066 - DNA, 14 bp, Homo sapiens
cttgggccctttga

SEQ ID NO: 4454067 - DNA, 16 bp, Homo sapiens
cttgggccctttgagt

SEQ ID NO: 4454068 - DNA, 19 bp, Homo sapiens
cttgggccctttgagtgca

SEQ ID NO: 4454069 - DNA, 12 bp, Homo sapiens
cttgggcctgca

SEQ ID NO: 4454070 - DNA, 16 bp, Homo sapiens
cttgggcctgcaccct

SEQ ID NO: 4454071 - DNA, 17 bp, Homo sapiens
cttggggaatttcctct

SEQ ID NO: 4454072 - DNA, 23 bp, Homo sapiens
cttgggggacagggctggcccag

SEQ ID NO: 4454073 - DNA, 14 bp, Homo sapiens
cttgggtcagagaa

SEQ ID NO: 4454074 - DNA, 21 bp, Homo sapiens
cttgggtctctctcggcccct

SEQ ID NO: 4454075 - DNA, 15 bp, Homo sapiens
cttgggtgttccacc

SEQ ID NO: 4454076 - DNA, 16 bp, Homo sapiens
cttggtaaaacattac

SEQ ID NO: 4454077 - DNA, 21 bp, Homo sapiens
cttggtagttctgtgcctccc

SEQ ID NO: 4454078 - DNA, 18 bp, Homo sapiens
cttggtctttctgtgctt

SEQ ID NO: 4454079 - DNA, 21 bp, Homo sapiens
cttggtgacaaaattcatttg

SEQ ID NO: 4454080 - DNA, 15 bp, Homo sapiens
cttggtgactgtccc

SEQ ID NO: 4454081 - DNA, 14 bp, Homo sapiens
cttggtgcctctgg

SEQ ID NO: 4454082 - DNA, 18 bp, Homo sapiens
cttggtgcttattgatat

SEQ ID NO: 4454083 - DNA, 13 bp, Homo sapiens
cttggtgtaattt

SEQ ID NO: 4454084 - DNA, 18 bp, Homo sapiens
cttggtgtaatttgaaga

SEQ ID NO: 4454085 - DNA, 15 bp, Homo sapiens
cttggtgtccacctg

SEQ ID NO: 4454086 - DNA, 16 bp, Homo sapiens
cttggttggctggcag

SEQ ID NO: 4454087 - DNA, 15 bp, Homo sapiens
cttggttgtctggca

SEQ ID NO: 4454088 - DNA, 21 bp, Homo sapiens
cttggtttgttatatcaggga

SEQ ID NO: 4454089 - DNA, 22 bp, Homo sapiens
cttggtttgttatatcagggaa

SEQ ID NO: 4454090 - DNA, 15 bp, Homo sapiens
cttgtaaagactggt

SEQ ID NO: 4454091 - DNA, 18 bp, Homo sapiens
cttgtaaatctttttgct

SEQ ID NO: 4454092 - DNA, 15 bp, Homo sapiens
cttgtaactccacca

SEQ ID NO: 4454093 - DNA, 22 bp, Homo sapiens
cttgtaatacctgattgatcac

SEQ ID NO: 4454094 - DNA, 14 bp, Homo sapiens
cttgtaatatgtat

SEQ ID NO: 4454095 - DNA, 18 bp, Homo sapiens
cttgtaccatagaaaaat

SEQ ID NO: 4454096 - DNA, 13 bp, Homo sapiens
cttgtacttgctt

SEQ ID NO: 4454097 - DNA, 20 bp, Homo sapiens
cttgtatagcttttatctgc

SEQ ID NO: 4454098 - DNA, 22 bp, Homo sapiens
cttgtatgcttttataggcctg

SEQ ID NO: 4454099 - DNA, 18 bp, Homo sapiens
cttgtattgtaaatgtgg

SEQ ID NO: 4454100 - DNA, 21 bp, Homo sapiens
cttgtattgtaaatgtggatt

SEQ ID NO: 4454101 - DNA, 15 bp, Homo sapiens
cttgtatttccaaac

SEQ ID NO: 4454102 - DNA, 23 bp, Homo sapiens
cttgtcaagcctgtgcaaaaaaa

SEQ ID NO: 4454103 - DNA, 13 bp, Homo sapiens
cttgtcacgccag

SEQ ID NO: 4454104 - DNA, 18 bp, Homo sapiens
cttgtcacgccagacttc

SEQ ID NO: 4454105 - DNA, 20 bp, Homo sapiens
cttgtcatatgtagccttca

SEQ ID NO: 4454106 - DNA, 13 bp, Homo sapiens
cttgtcattttga

SEQ ID NO: 4454107 - DNA, 18 bp, Homo sapiens
cttgtccagcgcctagtg

SEQ ID NO: 4454108 - DNA, 18 bp, Homo sapiens
cttgtcccaattaaaata

SEQ ID NO: 4454109 - DNA, 20 bp, Homo sapiens
cttgtcccaattaaaatact

SEQ ID NO: 4454110 - DNA, 21 bp, Homo sapiens
cttgtcccgtctggacctggg

SEQ ID NO: 4454111 - DNA, 18 bp, Homo sapiens
cttgtcctacgtccaagg

SEQ ID NO: 4454112 - DNA, 22 bp, Homo sapiens
cttgtcggccccaccagtgcct

SEQ ID NO: 4454113 - DNA, 15 bp, Homo sapiens
cttgtctcattttaa

SEQ ID NO: 4454114 - DNA, 18 bp, Homo sapiens
cttgtctcattttaatgt

SEQ ID NO: 4454115 - DNA, 19 bp, Homo sapiens
cttgtctcttcatctaata

SEQ ID NO: 4454116 - DNA, 20 bp, Homo sapiens
cttgtctggcaaaagaaaaa

SEQ ID NO: 4454117 - DNA, 12 bp, Homo sapiens
cttgtctggctt

SEQ ID NO: 4454118 - DNA, 14 bp, Homo sapiens
cttgtcttttcaga

SEQ ID NO: 4454119 - DNA, 18 bp, Homo sapiens
cttgtcttttcagaagca

SEQ ID NO: 4454120 - DNA, 23 bp, Homo sapiens
cttgtgaactttgaatgaaattc

SEQ ID NO: 4454121 - DNA, 16 bp, Homo sapiens
cttgtgaatgcttctc

SEQ ID NO: 4454122 - DNA, 17 bp, Homo sapiens
cttgtgaatgcttctca

SEQ ID NO: 4454123 - DNA, 23 bp, Homo sapiens
cttgtgagagcccattcccacca

SEQ ID NO: 4454124 - DNA, 22 bp, Homo sapiens
cttgtgagcatcagagggctga

SEQ ID NO: 4454125 - DNA, 16 bp, Homo sapiens
cttgtgatttctttaa

SEQ ID NO: 4454126 - DNA, 21 bp, Homo sapiens
cttgtgatttctttaaaagaa

SEQ ID NO: 4454127 - DNA, 19 bp, Homo sapiens
cttgtgcaaggtggccttt

SEQ ID NO: 4454128 - DNA, 16 bp, Homo sapiens
cttgtggcagcaacgg

SEQ ID NO: 4454129 - DNA, 19 bp, Homo sapiens
cttgtgggcactgtgccaa

SEQ ID NO: 4454130 - DNA, 24 bp, Homo sapiens
cttgtgggtccatgctaacaaaga

SEQ ID NO: 4454131 - DNA, 22 bp, Homo sapiens
cttgtggttagcaagactgcaa

SEQ ID NO: 4454132 - DNA, 13 bp, Homo sapiens
cttgtgtagattt

SEQ ID NO: 4454133 - DNA, 18 bp, Homo sapiens
cttgtgtagatttgaaaa

SEQ ID NO: 4454134 - DNA, 20 bp, Homo sapiens
cttgtgtagatttgaaaatt

SEQ ID NO: 4454135 - DNA, 16 bp, Homo sapiens
cttgtgtattagatat

SEQ ID NO: 4454136 - DNA, 19 bp, Homo sapiens
cttgtgtcaagacatttct

SEQ ID NO: 4454137 - DNA, 17 bp, Homo sapiens
cttgtgtgtctgtgtgt

SEQ ID NO: 4454138 - DNA, 14 bp, Homo sapiens
cttgtgttctgctc

SEQ ID NO: 4454139 - DNA, 19 bp, Homo sapiens
cttgtgttttactgtcaga

SEQ ID NO: 4454140 - DNA, 22 bp, Homo sapiens
cttgtgttttactgtcagatta

SEQ ID NO: 4454141 - DNA, 21 bp, Homo sapiens
cttgttacaaattttttaatt

SEQ ID NO: 4454142 - DNA, 19 bp, Homo sapiens
cttgttactgctgattctt

SEQ ID NO: 4454143 - DNA, 23 bp, Homo sapiens
cttgttactgctgattcttgtaa

SEQ ID NO: 4454144 - DNA, 14 bp, Homo sapiens
cttgttagagagaa

SEQ ID NO: 4454145 - DNA, 16 bp, Homo sapiens
cttgttagagagaaag

SEQ ID NO: 4454146 - DNA, 18 bp, Homo sapiens
cttgttatggtagaaaaa

SEQ ID NO: 4454147 - DNA, 14 bp, Homo sapiens
cttgttcaggaaaa

SEQ ID NO: 4454148 - DNA, 13 bp, Homo sapiens
cttgttcatttgg

SEQ ID NO: 4454149 - DNA, 16 bp, Homo sapiens
cttgttccagctcttt

SEQ ID NO: 4454150 - DNA, 16 bp, Homo sapiens
cttgttccagctttga

SEQ ID NO: 4454151 - DNA, 20 bp, Homo sapiens
cttgttgctcaaaaaatgag

SEQ ID NO: 4454152 - DNA, 18 bp, Homo sapiens
cttgttgtattcctgcct

SEQ ID NO: 4454153 - DNA, 19 bp, Homo sapiens
cttgttgtctccacttgta

SEQ ID NO: 4454154 - DNA, 21 bp, Homo sapiens
cttgttgtttgttgacagctt

SEQ ID NO: 4454155 - DNA, 16 bp, Homo sapiens
cttgtttatagcaaaa

SEQ ID NO: 4454156 - DNA, 23 bp, Homo sapiens
cttgtttatagcaaaaatgtttt

SEQ ID NO: 4454157 - DNA, 13 bp, Homo sapiens
cttgtttatgata

SEQ ID NO: 4454158 - DNA, 23 bp, Homo sapiens
cttgtttattgagtttgtaggta

SEQ ID NO: 4454159 - DNA, 17 bp, Homo sapiens
cttgtttgaatatttgt

SEQ ID NO: 4454160 - DNA, 20 bp, Homo sapiens
cttgtttgagtttttcctcc

SEQ ID NO: 4454161 - DNA, 15 bp, Homo sapiens
cttgtttttataata

SEQ ID NO: 4454162 - DNA, 14 bp, Homo sapiens
cttgtttttcttca

SEQ ID NO: 4454163 - DNA, 19 bp, Homo sapiens
cttgtttttcttcagcatt

SEQ ID NO: 4454164 - DNA, 23 bp, Homo sapiens
cttgttttttgtttgtttgttgc

SEQ ID NO: 4454165 - DNA, 13 bp, Homo sapiens
ctttaaaaactgt

SEQ ID NO: 4454166 - DNA, 22 bp, Homo sapiens
ctttaaaaatacatagcattaa

SEQ ID NO: 4454167 - DNA, 12 bp, Homo sapiens
ctttaaaagaat

SEQ ID NO: 4454168 - DNA, 19 bp, Homo sapiens
ctttaaaagtcattattcc

SEQ ID NO: 4454169 - DNA, 21 bp, Homo sapiens
ctttaaaagtcattattcctg

SEQ ID NO: 4454170 - DNA, 21 bp, Homo sapiens
ctttaaaataataatagtact

SEQ ID NO: 4454171 - DNA, 17 bp, Homo sapiens
ctttaaaatatctacat

SEQ ID NO: 4454172 - DNA, 14 bp, Homo sapiens
ctttaaagataagt

SEQ ID NO: 4454173 - DNA, 21 bp, Homo sapiens
ctttaaagataagtctacatt

SEQ ID NO: 4454174 - DNA, 21 bp, Homo sapiens
ctttaaataaattaagatcct

SEQ ID NO: 4454175 - DNA, 16 bp, Homo sapiens
ctttaaataatttaac

SEQ ID NO: 4454176 - DNA, 18 bp, Homo sapiens
ctttaaataatttaacta

SEQ ID NO: 4454177 - DNA, 22 bp, Homo sapiens
ctttaaatcatttttatattat

SEQ ID NO: 4454178 - DNA, 19 bp, Homo sapiens
ctttaaatgacagtaatat

SEQ ID NO: 4454179 - DNA, 13 bp, Homo sapiens
ctttaaattatat

SEQ ID NO: 4454180 - DNA, 14 bp, Homo sapiens
ctttaaattatatg

SEQ ID NO: 4454181 - DNA, 21 bp, Homo sapiens
ctttaaattatatgatatgca

SEQ ID NO: 4454182 - DNA, 22 bp, Homo sapiens
ctttaaattatatgatatgcat

SEQ ID NO: 4454183 - DNA, 13 bp, Homo sapiens
ctttaaattgtgt

SEQ ID NO: 4454184 - DNA, 22 bp, Homo sapiens
ctttaacttttttttctctctt

SEQ ID NO: 4454185 - DNA, 18 bp, Homo sapiens
ctttaagaaccttaatga

SEQ ID NO: 4454186 - DNA, 20 bp, Homo sapiens
ctttaagaaccttaatgaca

SEQ ID NO: 4454187 - DNA, 15 bp, Homo sapiens
ctttaagaactaaaa

SEQ ID NO: 4454188 - DNA, 20 bp, Homo sapiens
ctttaagagtttaaaatcat

SEQ ID NO: 4454189 - DNA, 14 bp, Homo sapiens
ctttaatattttgt

SEQ ID NO: 4454190 - DNA, 22 bp, Homo sapiens
ctttaatcacttaacattccta

SEQ ID NO: 4454191 - DNA, 18 bp, Homo sapiens
ctttaattaccaacctgt

SEQ ID NO: 4454192 - DNA, 17 bp, Homo sapiens
ctttaattactggaatt

SEQ ID NO: 4454193 - DNA, 22 bp, Homo sapiens
ctttaattatatattttcatcc

SEQ ID NO: 4454194 - DNA, 17 bp, Homo sapiens
ctttaattttaactgat

SEQ ID NO: 4454195 - DNA, 14 bp, Homo sapiens
ctttacaaaccttt

SEQ ID NO: 4454196 - DNA, 23 bp, Homo sapiens
ctttacagttagcagggatgttc

SEQ ID NO: 4454197 - DNA, 14 bp, Homo sapiens
ctttaccatgctca

SEQ ID NO: 4454198 - DNA, 14 bp, Homo sapiens
ctttacctgtatac

SEQ ID NO: 4454199 - DNA, 15 bp, Homo sapiens
ctttactcgtgcatt

SEQ ID NO: 4454200 - DNA, 13 bp, Homo sapiens
ctttactggccat

SEQ ID NO: 4454201 - DNA, 21 bp, Homo sapiens
ctttactttttccatttggca

SEQ ID NO: 4454202 - DNA, 16 bp, Homo sapiens
ctttagaccctgggtg

SEQ ID NO: 4454203 - DNA, 23 bp, Homo sapiens
ctttagaccctgggtgggctctg

SEQ ID NO: 4454204 - DNA, 12 bp, Homo sapiens
ctttagatttca

SEQ ID NO: 4454205 - DNA, 17 bp, Homo sapiens
ctttagcacgtttaaag

SEQ ID NO: 4454206 - DNA, 20 bp, Homo sapiens
ctttagcacgtttaaagttc

SEQ ID NO: 4454207 - DNA, 21 bp, Homo sapiens
ctttagcacgtttaaagttct

SEQ ID NO: 4454208 - DNA, 23 bp, Homo sapiens
ctttagcacgtttaaagttctgt

SEQ ID NO: 4454209 - DNA, 17 bp, Homo sapiens
ctttagccatcataact

SEQ ID NO: 4454210 - DNA, 23 bp, Homo sapiens
ctttaggggaagtaaaacagtca

SEQ ID NO: 4454211 - DNA, 22 bp, Homo sapiens
ctttaggtttttttaatgatat

SEQ ID NO: 4454212 - DNA, 17 bp, Homo sapiens
ctttagtacaatttcaa

SEQ ID NO: 4454213 - DNA, 14 bp, Homo sapiens
ctttagtagctcaa

SEQ ID NO: 4454214 - DNA, 16 bp, Homo sapiens
ctttagtgctttgtga

SEQ ID NO: 4454215 - DNA, 23 bp, Homo sapiens
ctttagtgttctgtttgaaacta

SEQ ID NO: 4454216 - DNA, 13 bp, Homo sapiens
ctttagtttttgt

SEQ ID NO: 4454217 - DNA, 20 bp, Homo sapiens
ctttataaagctgttcttga

SEQ ID NO: 4454218 - DNA, 21 bp, Homo sapiens
ctttataaagctgttcttgaa

SEQ ID NO: 4454219 - DNA, 16 bp, Homo sapiens
ctttataaatctttct

SEQ ID NO: 4454220 - DNA, 17 bp, Homo sapiens
ctttataattgaattgg

SEQ ID NO: 4454221 - DNA, 19 bp, Homo sapiens
ctttatagtgaagtgttaa

SEQ ID NO: 4454222 - DNA, 15 bp, Homo sapiens
ctttatcattgctaa

SEQ ID NO: 4454223 - DNA, 15 bp, Homo sapiens
ctttatctttgtgta

SEQ ID NO: 4454224 - DNA, 16 bp, Homo sapiens
ctttatgattttcata

SEQ ID NO: 4454225 - DNA, 21 bp, Homo sapiens
ctttatgattttcataactta

SEQ ID NO: 4454226 - DNA, 20 bp, Homo sapiens
ctttatgtagtttttatatg

SEQ ID NO: 4454227 - DNA, 13 bp, Homo sapiens
ctttatgtgaatt

SEQ ID NO: 4454228 - DNA, 13 bp, Homo sapiens
ctttattataaaa

SEQ ID NO: 4454229 - DNA, 13 bp, Homo sapiens
ctttattattcct

SEQ ID NO: 4454230 - DNA, 20 bp, Homo sapiens
ctttattccagaatgctgta

SEQ ID NO: 4454231 - DNA, 23 bp, Homo sapiens
ctttattccagaatgctgtacat

SEQ ID NO: 4454232 - DNA, 13 bp, Homo sapiens
ctttattgaatta

SEQ ID NO: 4454233 - DNA, 13 bp, Homo sapiens
ctttattgcccct

SEQ ID NO: 4454234 - DNA, 16 bp, Homo sapiens
ctttattggctgagat

SEQ ID NO: 4454235 - DNA, 21 bp, Homo sapiens
ctttattggcttgataaacat

SEQ ID NO: 4454236 - DNA, 18 bp, Homo sapiens
ctttatttattaaacttc

SEQ ID NO: 4454237 - DNA, 21 bp, Homo sapiens
ctttatttattaaacttcagc

SEQ ID NO: 4454238 - DNA, 15 bp, Homo sapiens
ctttatttatttcta

SEQ ID NO: 4454239 - DNA, 15 bp, Homo sapiens
ctttcaaaccagctt

SEQ ID NO: 4454240 - DNA, 16 bp, Homo sapiens
ctttcaaaccagcttc

SEQ ID NO: 4454241 - DNA, 13 bp, Homo sapiens
ctttcaaccacct

SEQ ID NO: 4454242 - DNA, 15 bp, Homo sapiens
ctttcaagacagatg

SEQ ID NO: 4454243 - DNA, 21 bp, Homo sapiens
ctttcacaagcaacagactct

SEQ ID NO: 4454244 - DNA, 15 bp, Homo sapiens
ctttcaccagaattt

SEQ ID NO: 4454245 - DNA, 20 bp, Homo sapiens
ctttcactaaaacacacagg

SEQ ID NO: 4454246 - DNA, 19 bp, Homo sapiens
ctttcagagccagcctggc

SEQ ID NO: 4454247 - DNA, 21 bp, Homo sapiens
ctttcagagccagcctggctc

SEQ ID NO: 4454248 - DNA, 17 bp, Homo sapiens
ctttcagatgtcttctg

SEQ ID NO: 4454249 - DNA, 23 bp, Homo sapiens
ctttcagatgtcttctgcctgtt

SEQ ID NO: 4454250 - DNA, 17 bp, Homo sapiens
ctttcagtgcagtttct

SEQ ID NO: 4454251 - DNA, 21 bp, Homo sapiens
ctttcagtgcagtttcttttc

SEQ ID NO: 4454252 - DNA, 22 bp, Homo sapiens
ctttcagtgcagtttcttttca

SEQ ID NO: 4454253 - DNA, 17 bp, Homo sapiens
ctttcagttattaaatg

SEQ ID NO: 4454254 - DNA, 19 bp, Homo sapiens
ctttcatcacactgggtgg

SEQ ID NO: 4454255 - DNA, 20 bp, Homo sapiens
ctttcatcctgactctgccc

SEQ ID NO: 4454256 - DNA, 21 bp, Homo sapiens
ctttcatcctgactctgcccc

SEQ ID NO: 4454257 - DNA, 21 bp, Homo sapiens
ctttcatgtaaactgtgcacc

SEQ ID NO: 4454258 - DNA, 22 bp, Homo sapiens
ctttcatgtcttgtcatacaaa

SEQ ID NO: 4454259 - DNA, 15 bp, Homo sapiens
ctttcatttttttcc

SEQ ID NO: 4454260 - DNA, 19 bp, Homo sapiens
ctttcatttttttccaggc

SEQ ID NO: 4454261 - DNA, 15 bp, Homo sapiens
ctttccaaattattt

SEQ ID NO: 4454262 - DNA, 20 bp, Homo sapiens
ctttccaaattatttcttaa

SEQ ID NO: 4454263 - DNA, 22 bp, Homo sapiens
ctttccaatagaaagaaactaa

SEQ ID NO: 4454264 - DNA, 15 bp, Homo sapiens
ctttccaatgccaca

SEQ ID NO: 4454265 - DNA, 17 bp, Homo sapiens
ctttccaatgccacaga

SEQ ID NO: 4454266 - DNA, 13 bp, Homo sapiens
ctttccagctcac

SEQ ID NO: 4454267 - DNA, 20 bp, Homo sapiens
ctttccaggcaccctcaggg

SEQ ID NO: 4454268 - DNA, 13 bp, Homo sapiens
ctttccatcaact

SEQ ID NO: 4454269 - DNA, 13 bp, Homo sapiens
ctttcccaacacc

SEQ ID NO: 4454270 - DNA, 13 bp, Homo sapiens
ctttcccaggaga

SEQ ID NO: 4454271 - DNA, 21 bp, Homo sapiens
ctttcccaggtaatttaaatt

SEQ ID NO: 4454272 - DNA, 22 bp, Homo sapiens
ctttcccaggtaatttaaattg

SEQ ID NO: 4454273 - DNA, 15 bp, Homo sapiens
ctttcccagtctgtc

SEQ ID NO: 4454274 - DNA, 15 bp, Homo sapiens
ctttccccagaggct

SEQ ID NO: 4454275 - DNA, 20 bp, Homo sapiens
ctttccccagaggctcccaa

SEQ ID NO: 4454276 - DNA, 22 bp, Homo sapiens
ctttccccagaggctcccaatc

SEQ ID NO: 4454277 - DNA, 23 bp, Homo sapiens
ctttccccagcagtttctgtcct

SEQ ID NO: 4454278 - DNA, 18 bp, Homo sapiens
ctttcccccaactcagga

SEQ ID NO: 4454279 - DNA, 16 bp, Homo sapiens
ctttccctcaccccct

SEQ ID NO: 4454280 - DNA, 14 bp, Homo sapiens
ctttccgactgccc

SEQ ID NO: 4454281 - DNA, 20 bp, Homo sapiens
ctttcctaaagtctctgctg

SEQ ID NO: 4454282 - DNA, 22 bp, Homo sapiens
ctttcctaaagtctctgctgct

SEQ ID NO: 4454283 - DNA, 18 bp, Homo sapiens
ctttcctacagttgggta

SEQ ID NO: 4454284 - DNA, 15 bp, Homo sapiens
ctttcctcacatttg

SEQ ID NO: 4454285 - DNA, 17 bp, Homo sapiens
ctttcctccccctgcaa

SEQ ID NO: 4454286 - DNA, 19 bp, Homo sapiens
ctttcctccccctgcaact

SEQ ID NO: 4454287 - DNA, 22 bp, Homo sapiens
ctttcctcctcaggcacacagc

SEQ ID NO: 4454288 - DNA, 17 bp, Homo sapiens
ctttcctcctctgactt

SEQ ID NO: 4454289 - DNA, 13 bp, Homo sapiens
ctttcctgcatct

SEQ ID NO: 4454290 - DNA, 17 bp, Homo sapiens
ctttcctgccctgtcca

SEQ ID NO: 4454291 - DNA, 18 bp, Homo sapiens
ctttcctgggcctttgca

SEQ ID NO: 4454292 - DNA, 16 bp, Homo sapiens
ctttcctgttcagcat

SEQ ID NO: 4454293 - DNA, 18 bp, Homo sapiens
ctttcctgttcagcattc

SEQ ID NO: 4454294 - DNA, 19 bp, Homo sapiens
ctttcctgttcagcattct

SEQ ID NO: 4454295 - DNA, 17 bp, Homo sapiens
ctttccttagttaaaaa

SEQ ID NO: 4454296 - DNA, 11 bp, Homo sapiens
ctttccttccc

SEQ ID NO: 4454297 - DNA, 13 bp, Homo sapiens
ctttccttccctc

SEQ ID NO: 4454298 - DNA, 11 bp, Homo sapiens
ctttccttcct

SEQ ID NO: 4454299 - DNA, 16 bp, Homo sapiens
ctttccttccttccct

SEQ ID NO: 4454300 - DNA, 17 bp, Homo sapiens
ctttccttttttgagat

SEQ ID NO: 4454301 - DNA, 20 bp, Homo sapiens
ctttccttttttgagatttt

SEQ ID NO: 4454302 - DNA, 18 bp, Homo sapiens
ctttcgtaatagctcaga

SEQ ID NO: 4454303 - DNA, 22 bp, Homo sapiens
ctttcgtgatcttattgcttgc

SEQ ID NO: 4454304 - DNA, 16 bp, Homo sapiens
ctttctaagaaatcaa

SEQ ID NO: 4454305 - DNA, 23 bp, Homo sapiens
ctttctacaaagcactagagaat

SEQ ID NO: 4454306 - DNA, 17 bp, Homo sapiens
ctttctaccacacacag

SEQ ID NO: 4454307 - DNA, 17 bp, Homo sapiens
ctttctagatgtctctg

SEQ ID NO: 4454308 - DNA, 19 bp, Homo sapiens
ctttctagccataataaaa

SEQ ID NO: 4454309 - DNA, 13 bp, Homo sapiens
ctttctagtttgt

SEQ ID NO: 4454310 - DNA, 22 bp, Homo sapiens
ctttctcactaaatcttttata

SEQ ID NO: 4454311 - DNA, 13 bp, Homo sapiens
ctttctcagaggg

SEQ ID NO: 4454312 - DNA, 16 bp, Homo sapiens
ctttctcagttttcat

SEQ ID NO: 4454313 - DNA, 17 bp, Homo sapiens
ctttctcccagtatgtt

SEQ ID NO: 4454314 - DNA, 19 bp, Homo sapiens
ctttctcccctgcccccag

SEQ ID NO: 4454315 - DNA, 23 bp, Homo sapiens
ctttctcccctgcccccaggact

SEQ ID NO: 4454316 - DNA, 15 bp, Homo sapiens
ctttctcctgtgaat

SEQ ID NO: 4454317 - DNA, 15 bp, Homo sapiens
ctttctctcagtgaa

SEQ ID NO: 4454318 - DNA, 22 bp, Homo sapiens
ctttctctcccctcctctgaat

SEQ ID NO: 4454319 - DNA, 21 bp, Homo sapiens
ctttctctggtggtcttcctt

SEQ ID NO: 4454320 - DNA, 13 bp, Homo sapiens
ctttctctgtgaa

SEQ ID NO: 4454321 - DNA, 21 bp, Homo sapiens
ctttctgaaggaagagaagac

SEQ ID NO: 4454322 - DNA, 19 bp, Homo sapiens
ctttctgagtgagttttac

SEQ ID NO: 4454323 - DNA, 16 bp, Homo sapiens
ctttctgagtgccttc

SEQ ID NO: 4454324 - DNA, 20 bp, Homo sapiens
ctttctgagtgccttctgtg

SEQ ID NO: 4454325 - DNA, 23 bp, Homo sapiens
ctttctggactggcgttcacctc

SEQ ID NO: 4454326 - DNA, 18 bp, Homo sapiens
ctttctgtatatactttt

SEQ ID NO: 4454327 - DNA, 14 bp, Homo sapiens
ctttctgtctcaaa

SEQ ID NO: 4454328 - DNA, 15 bp, Homo sapiens
ctttctgtcttgtta

SEQ ID NO: 4454329 - DNA, 14 bp, Homo sapiens
ctttctgttccaaa

SEQ ID NO: 4454330 - DNA, 15 bp, Homo sapiens
ctttctgttccaaat

SEQ ID NO: 4454331 - DNA, 23 bp, Homo sapiens
ctttcttacctactattggccct

SEQ ID NO: 4454332 - DNA, 16 bp, Homo sapiens
ctttcttcctcttctt

SEQ ID NO: 4454333 - DNA, 21 bp, Homo sapiens
ctttcttgatcaacatctttt

SEQ ID NO: 4454334 - DNA, 22 bp, Homo sapiens
ctttcttgatcaacatcttttc

SEQ ID NO: 4454335 - DNA, 21 bp, Homo sapiens
ctttcttgtcttttcagaagc

SEQ ID NO: 4454336 - DNA, 17 bp, Homo sapiens
ctttctttgattctcct

SEQ ID NO: 4454337 - DNA, 21 bp, Homo sapiens
ctttctttgcaacagcagtgt

SEQ ID NO: 4454338 - DNA, 21 bp, Homo sapiens
ctttctttgcaccaaagacat

SEQ ID NO: 4454339 - DNA, 13 bp, Homo sapiens
ctttctttggtgc

SEQ ID NO: 4454340 - DNA, 21 bp, Homo sapiens
ctttctttggtgcctttcctg

SEQ ID NO: 4454341 - DNA, 18 bp, Homo sapiens
ctttctttgtttctttct

SEQ ID NO: 4454342 - DNA, 23 bp, Homo sapiens
ctttctttgtttctttcttcctc

SEQ ID NO: 4454343 - DNA, 18 bp, Homo sapiens
ctttcttttattaatata

SEQ ID NO: 4454344 - DNA, 16 bp, Homo sapiens
ctttctttttctacat

SEQ ID NO: 4454345 - DNA, 16 bp, Homo sapiens
ctttctttttcttctt

SEQ ID NO: 4454346 - DNA, 22 bp, Homo sapiens
ctttcttttttttttattatgg

SEQ ID NO: 4454347 - DNA, 20 bp, Homo sapiens
ctttgaaaaatctcattatt

SEQ ID NO: 4454348 - DNA, 19 bp, Homo sapiens
ctttgaaacctgctctgta

SEQ ID NO: 4454349 - DNA, 20 bp, Homo sapiens
ctttgaaaggttagagaata

SEQ ID NO: 4454350 - DNA, 15 bp, Homo sapiens
ctttgaaataaaaaa

SEQ ID NO: 4454351 - DNA, 22 bp, Homo sapiens
ctttgaagcatagctacaattt

SEQ ID NO: 4454352 - DNA, 23 bp, Homo sapiens
ctttgaagcatagctacaatttg

SEQ ID NO: 4454353 - DNA, 17 bp, Homo sapiens
ctttgaataaagaatac

SEQ ID NO: 4454354 - DNA, 18 bp, Homo sapiens
ctttgaataaagaatact

SEQ ID NO: 4454355 - DNA, 16 bp, Homo sapiens
ctttgaatctgggact

SEQ ID NO: 4454356 - DNA, 13 bp, Homo sapiens
ctttgaatgttaa

SEQ ID NO: 4454357 - DNA, 18 bp, Homo sapiens
ctttgacaaaatgactgg

SEQ ID NO: 4454358 - DNA, 21 bp, Homo sapiens
ctttgacaaaatgactggctc

SEQ ID NO: 4454359 - DNA, 18 bp, Homo sapiens
ctttgacaattgggagct

SEQ ID NO: 4454360 - DNA, 22 bp, Homo sapiens
ctttgacaattgggagctgcca

SEQ ID NO: 4454361 - DNA, 19 bp, Homo sapiens
ctttgacacccaggctgga

SEQ ID NO: 4454362 - DNA, 19 bp, Homo sapiens
ctttgacatggtgccttag

SEQ ID NO: 4454363 - DNA, 20 bp, Homo sapiens
ctttgactctataagcaaat

SEQ ID NO: 4454364 - DNA, 17 bp, Homo sapiens
ctttgactttttgcatt

SEQ ID NO: 4454365 - DNA, 15 bp, Homo sapiens
ctttgagagacgcca

SEQ ID NO: 4454366 - DNA, 22 bp, Homo sapiens
ctttgagagacgccactccctg

SEQ ID NO: 4454367 - DNA, 17 bp, Homo sapiens
ctttgagaggctgaggt

SEQ ID NO: 4454368 - DNA, 11 bp, Homo sapiens
ctttgagccca

SEQ ID NO: 4454369 - DNA, 23 bp, Homo sapiens
ctttgagcccattcttctgggtg

SEQ ID NO: 4454370 - DNA, 21 bp, Homo sapiens
ctttgagtgcagtcctgatca

SEQ ID NO: 4454371 - DNA, 21 bp, Homo sapiens
ctttgagtgtcttaattaaaa

SEQ ID NO: 4454372 - DNA, 19 bp, Homo sapiens
ctttgagttaagtctatct

SEQ ID NO: 4454373 - DNA, 16 bp, Homo sapiens
ctttgatgcacaaaat

SEQ ID NO: 4454374 - DNA, 18 bp, Homo sapiens
ctttgatgtcatgtgttc

SEQ ID NO: 4454375 - DNA, 19 bp, Homo sapiens
ctttgattccattttaagt

SEQ ID NO: 4454376 - DNA, 13 bp, Homo sapiens
ctttgattctcct

SEQ ID NO: 4454377 - DNA, 14 bp, Homo sapiens
ctttgattctcctt

SEQ ID NO: 4454378 - DNA, 16 bp, Homo sapiens
ctttgattctccttca

SEQ ID NO: 4454379 - DNA, 22 bp, Homo sapiens
ctttgattctccttcagccctc

SEQ ID NO: 4454380 - DNA, 23 bp, Homo sapiens
ctttgattctccttttatgtgta

SEQ ID NO: 4454381 - DNA, 16 bp, Homo sapiens
ctttgattttaaattt

SEQ ID NO: 4454382 - DNA, 15 bp, Homo sapiens
ctttgcaaagtattg

SEQ ID NO: 4454383 - DNA, 14 bp, Homo sapiens
ctttgcaatagcag

SEQ ID NO: 4454384 - DNA, 15 bp, Homo sapiens
ctttgcacactttgg

SEQ ID NO: 4454385 - DNA, 13 bp, Homo sapiens
ctttgcaccaaag

SEQ ID NO: 4454386 - DNA, 17 bp, Homo sapiens
ctttgcaccaaagacat

SEQ ID NO: 4454387 - DNA, 18 bp, Homo sapiens
ctttgcagctgctgtctg

SEQ ID NO: 4454388 - DNA, 11 bp, Homo sapiens
ctttgccacaa

SEQ ID NO: 4454389 - DNA, 13 bp, Homo sapiens
ctttgccagcaga

SEQ ID NO: 4454390 - DNA, 22 bp, Homo sapiens
ctttgccagcagagccagggca

SEQ ID NO: 4454391 - DNA, 16 bp, Homo sapiens
ctttgccgtgagcatg

SEQ ID NO: 4454392 - DNA, 13 bp, Homo sapiens
ctttgcctcttct

SEQ ID NO: 4454393 - DNA, 13 bp, Homo sapiens
ctttgccttgggc

SEQ ID NO: 4454394 - DNA, 16 bp, Homo sapiens
ctttgccttgggctgc

SEQ ID NO: 4454395 - DNA, 18 bp, Homo sapiens
ctttgccttgggctgctc

SEQ ID NO: 4454396 - DNA, 19 bp, Homo sapiens
ctttgccttgggctgctcc

SEQ ID NO: 4454397 - DNA, 16 bp, Homo sapiens
ctttgcgggatattta

SEQ ID NO: 4454398 - DNA, 16 bp, Homo sapiens
ctttgctatgtaaggg

SEQ ID NO: 4454399 - DNA, 19 bp, Homo sapiens
ctttgctgcagagatcaag

SEQ ID NO: 4454400 - DNA, 17 bp, Homo sapiens
ctttgctgcattccttt

SEQ ID NO: 4454401 - DNA, 21 bp, Homo sapiens
ctttgctgccagctctcagga

SEQ ID NO: 4454402 - DNA, 15 bp, Homo sapiens
ctttgctgcccctgt

SEQ ID NO: 4454403 - DNA, 16 bp, Homo sapiens
ctttgctgcccctgtc

SEQ ID NO: 4454404 - DNA, 16 bp, Homo sapiens
ctttgcttgaacacag

SEQ ID NO: 4454405 - DNA, 17 bp, Homo sapiens
ctttgcttgaacacagt

SEQ ID NO: 4454406 - DNA, 21 bp, Homo sapiens
ctttgcttgaacacagtattt

SEQ ID NO: 4454407 - DNA, 12 bp, Homo sapiens
ctttggaaaaat

SEQ ID NO: 4454408 - DNA, 22 bp, Homo sapiens
ctttggaaaaatgggtctttta

SEQ ID NO: 4454409 - DNA, 22 bp, Homo sapiens
ctttggaaagtacactctgctg

SEQ ID NO: 4454410 - DNA, 23 bp, Homo sapiens
ctttggaaagtacactctgctgt

SEQ ID NO: 4454411 - DNA, 16 bp, Homo sapiens
ctttggacccagggcc

SEQ ID NO: 4454412 - DNA, 16 bp, Homo sapiens
ctttggacctaatcca

SEQ ID NO: 4454413 - DNA, 14 bp, Homo sapiens
ctttggagttaaaa

SEQ ID NO: 4454414 - DNA, 17 bp, Homo sapiens
ctttggatttgacattg

SEQ ID NO: 4454415 - DNA, 20 bp, Homo sapiens
ctttggcctggggtgcatct

SEQ ID NO: 4454416 - DNA, 22 bp, Homo sapiens
ctttggcctggggtgcatctcc

SEQ ID NO: 4454417 - DNA, 24 bp, Homo sapiens
ctttggcctggggtgcatctcctc

SEQ ID NO: 4454418 - DNA, 15 bp, Homo sapiens
ctttggctggtagca

SEQ ID NO: 4454419 - DNA, 15 bp, Homo sapiens
ctttgggaggcaggg

SEQ ID NO: 4454420 - DNA, 18 bp, Homo sapiens
ctttgggaggccgaggca

SEQ ID NO: 4454421 - DNA, 14 bp, Homo sapiens
ctttgggcagtgcc

SEQ ID NO: 4454422 - DNA, 22 bp, Homo sapiens
ctttgggcccagggacaccagc

SEQ ID NO: 4454423 - DNA, 23 bp, Homo sapiens
ctttgggcccagggacaccagcc

SEQ ID NO: 4454424 - DNA, 22 bp, Homo sapiens
ctttgggttaagcattaccact

SEQ ID NO: 4454425 - DNA, 20 bp, Homo sapiens
ctttgggttggagctgttcc

SEQ ID NO: 4454426 - DNA, 14 bp, Homo sapiens
ctttggtaaaacag

SEQ ID NO: 4454427 - DNA, 12 bp, Homo sapiens
ctttggtcctgg

SEQ ID NO: 4454428 - DNA, 19 bp, Homo sapiens
ctttggtcctggtgctgcc

SEQ ID NO: 4454429 - DNA, 16 bp, Homo sapiens
ctttggtgcctttcct

SEQ ID NO: 4454430 - DNA, 18 bp, Homo sapiens
ctttggtgcctttcctgt

SEQ ID NO: 4454431 - DNA, 19 bp, Homo sapiens
ctttggtgcctttcctgtt

SEQ ID NO: 4454432 - DNA, 17 bp, Homo sapiens
ctttggttaatacatct

SEQ ID NO: 4454433 - DNA, 22 bp, Homo sapiens
ctttggttatcctgtttgaaga

SEQ ID NO: 4454434 - DNA, 18 bp, Homo sapiens
ctttgtaaccacaacttt

SEQ ID NO: 4454435 - DNA, 21 bp, Homo sapiens
ctttgtaaccagaattataca

SEQ ID NO: 4454436 - DNA, 20 bp, Homo sapiens
ctttgtaatattttccataa

SEQ ID NO: 4454437 - DNA, 15 bp, Homo sapiens
ctttgtacagagtgc

SEQ ID NO: 4454438 - DNA, 18 bp, Homo sapiens
ctttgtagaataaatggt

SEQ ID NO: 4454439 - DNA, 20 bp, Homo sapiens
ctttgtagtgtttggtgctc

SEQ ID NO: 4454440 - DNA, 15 bp, Homo sapiens
ctttgtagtttgctt

SEQ ID NO: 4454441 - DNA, 20 bp, Homo sapiens
ctttgtatactttaaataat

SEQ ID NO: 4454442 - DNA, 21 bp, Homo sapiens
ctttgtatataggcttctcac

SEQ ID NO: 4454443 - DNA, 18 bp, Homo sapiens
ctttgtatctttctttct

SEQ ID NO: 4454444 - DNA, 15 bp, Homo sapiens
ctttgtattcttcat

SEQ ID NO: 4454445 - DNA, 19 bp, Homo sapiens
ctttgtatttttgtcattg

SEQ ID NO: 4454446 - DNA, 13 bp, Homo sapiens
ctttgtcacttct

SEQ ID NO: 4454447 - DNA, 15 bp, Homo sapiens
ctttgtcacttctgc

SEQ ID NO: 4454448 - DNA, 17 bp, Homo sapiens
ctttgtcacttctgctg

SEQ ID NO: 4454449 - DNA, 16 bp, Homo sapiens
ctttgtcacttgccac

SEQ ID NO: 4454450 - DNA, 18 bp, Homo sapiens
ctttgtcacttgccacat

SEQ ID NO: 4454451 - DNA, 22 bp, Homo sapiens
ctttgtgaatagaactctgaaa

SEQ ID NO: 4454452 - DNA, 23 bp, Homo sapiens
ctttgtgacaggaaagccctccc

SEQ ID NO: 4454453 - DNA, 13 bp, Homo sapiens
ctttgtgagtcaa

SEQ ID NO: 4454454 - DNA, 19 bp, Homo sapiens
ctttgtgagtcaatacata

SEQ ID NO: 4454455 - DNA, 13 bp, Homo sapiens
ctttgtgcattct

SEQ ID NO: 4454456 - DNA, 14 bp, Homo sapiens
ctttgtgcctttgg

SEQ ID NO: 4454457 - DNA, 17 bp, Homo sapiens
ctttgtgcctttggcct

SEQ ID NO: 4454458 - DNA, 18 bp, Homo sapiens
ctttgtggtttcttgttt

SEQ ID NO: 4454459 - DNA, 16 bp, Homo sapiens
ctttgtgttcatttca

SEQ ID NO: 4454460 - DNA, 17 bp, Homo sapiens
ctttgtgttcatttcat

SEQ ID NO: 4454461 - DNA, 24 bp, Homo sapiens
ctttgttattataacataaaagca

SEQ ID NO: 4454462 - DNA, 20 bp, Homo sapiens
ctttgttattgcaaattgag

SEQ ID NO: 4454463 - DNA, 21 bp, Homo sapiens
ctttgttgcaagtactgctgt

SEQ ID NO: 4454464 - DNA, 17 bp, Homo sapiens
ctttgtttaaatgccaa

SEQ ID NO: 4454465 - DNA, 17 bp, Homo sapiens
ctttgtttcaactttct

SEQ ID NO: 4454466 - DNA, 17 bp, Homo sapiens
ctttgtttcttgtttat

SEQ ID NO: 4454467 - DNA, 23 bp, Homo sapiens
ctttgttttgatgtttgtggcct

SEQ ID NO: 4454468 - DNA, 19 bp, Homo sapiens
ctttgttttgcacactttg

SEQ ID NO: 4454469 - DNA, 17 bp, Homo sapiens
cttttaaaagccccagt

SEQ ID NO: 4454470 - DNA, 18 bp, Homo sapiens
cttttaaaatgaagcttt

SEQ ID NO: 4454471 - DNA, 22 bp, Homo sapiens
cttttaaaatttgtagaattga

SEQ ID NO: 4454472 - DNA, 16 bp, Homo sapiens
cttttaaacattattt

SEQ ID NO: 4454473 - DNA, 17 bp, Homo sapiens
cttttaaacattatttt

SEQ ID NO: 4454474 - DNA, 13 bp, Homo sapiens
cttttaaactgtg

SEQ ID NO: 4454475 - DNA, 17 bp, Homo sapiens
cttttaaagatttgttt

SEQ ID NO: 4454476 - DNA, 17 bp, Homo sapiens
cttttaaataaattatg

SEQ ID NO: 4454477 - DNA, 15 bp, Homo sapiens
cttttaaccatctga

SEQ ID NO: 4454478 - DNA, 23 bp, Homo sapiens
cttttaactatgtaataatgtac

SEQ ID NO: 4454479 - DNA, 18 bp, Homo sapiens
cttttaactgttttaggt

SEQ ID NO: 4454480 - DNA, 14 bp, Homo sapiens
cttttaaggataaa

SEQ ID NO: 4454481 - DNA, 18 bp, Homo sapiens
cttttaaggataaatcat

SEQ ID NO: 4454482 - DNA, 19 bp, Homo sapiens
cttttaagttgagcgtgcg

SEQ ID NO: 4454483 - DNA, 22 bp, Homo sapiens
cttttaatccaatccactaaca

SEQ ID NO: 4454484 - DNA, 14 bp, Homo sapiens
cttttaattttcct

SEQ ID NO: 4454485 - DNA, 20 bp, Homo sapiens
cttttacctgctgcttctcc

SEQ ID NO: 4454486 - DNA, 23 bp, Homo sapiens
cttttagaaaagggagtttaaaa

SEQ ID NO: 4454487 - DNA, 15 bp, Homo sapiens
cttttagagagggga

SEQ ID NO: 4454488 - DNA, 14 bp, Homo sapiens
cttttataaattaa

SEQ ID NO: 4454489 - DNA, 16 bp, Homo sapiens
cttttataaattaaat

SEQ ID NO: 4454490 - DNA, 12 bp, Homo sapiens
cttttatactct

SEQ ID NO: 4454491 - DNA, 20 bp, Homo sapiens
cttttatactctttctgtat

SEQ ID NO: 4454492 - DNA, 21 bp, Homo sapiens
cttttataggatttatttaaa

SEQ ID NO: 4454493 - DNA, 15 bp, Homo sapiens
cttttatagtggaaa

SEQ ID NO: 4454494 - DNA, 13 bp, Homo sapiens
cttttatctcaga

SEQ ID NO: 4454495 - DNA, 17 bp, Homo sapiens
cttttatctggtgcctc

SEQ ID NO: 4454496 - DNA, 12 bp, Homo sapiens
cttttatggatg

SEQ ID NO: 4454497 - DNA, 19 bp, Homo sapiens
cttttatggatgattaaat

SEQ ID NO: 4454498 - DNA, 21 bp, Homo sapiens
cttttatgtaatttctttaaa

SEQ ID NO: 4454499 - DNA, 23 bp, Homo sapiens
cttttatgtagtaattgacatgt

SEQ ID NO: 4454500 - DNA, 14 bp, Homo sapiens
cttttatgtgagat

SEQ ID NO: 4454501 - DNA, 18 bp, Homo sapiens
cttttatgtgagatttcc

SEQ ID NO: 4454502 - DNA, 12 bp, Homo sapiens
cttttattattt

SEQ ID NO: 4454503 - DNA, 17 bp, Homo sapiens
cttttattcctttgaat

SEQ ID NO: 4454504 - DNA, 18 bp, Homo sapiens
cttttattcttctttctt

SEQ ID NO: 4454505 - DNA, 18 bp, Homo sapiens
cttttattgacacagaaa

SEQ ID NO: 4454506 - DNA, 14 bp, Homo sapiens
cttttattttcatt

SEQ ID NO: 4454507 - DNA, 16 bp, Homo sapiens
cttttattttcattgt

SEQ ID NO: 4454508 - DNA, 18 bp, Homo sapiens
cttttcaatcttctactt

SEQ ID NO: 4454509 - DNA, 21 bp, Homo sapiens
cttttcaatcttctactttta

SEQ ID NO: 4454510 - DNA, 20 bp, Homo sapiens
cttttcacattaggctgttg

SEQ ID NO: 4454511 - DNA, 22 bp, Homo sapiens
cttttcagtgttcccaaagtga

SEQ ID NO: 4454512 - DNA, 19 bp, Homo sapiens
cttttcattttaatatata

SEQ ID NO: 4454513 - DNA, 19 bp, Homo sapiens
cttttccactccattgtcg

SEQ ID NO: 4454514 - DNA, 18 bp, Homo sapiens
cttttcccaaaatgttga

SEQ ID NO: 4454515 - DNA, 19 bp, Homo sapiens
cttttcccccattaatcag

SEQ ID NO: 4454516 - DNA, 19 bp, Homo sapiens
cttttccctttgtgagtca

SEQ ID NO: 4454517 - DNA, 15 bp, Homo sapiens
cttttcctgccctgt

SEQ ID NO: 4454518 - DNA, 14 bp, Homo sapiens
cttttcctgctgcc

SEQ ID NO: 4454519 - DNA, 17 bp, Homo sapiens
cttttcctggcagctgc

SEQ ID NO: 4454520 - DNA, 23 bp, Homo sapiens
cttttccttatttgccttctact

SEQ ID NO: 4454521 - DNA, 20 bp, Homo sapiens
cttttccttcccttttctgt

SEQ ID NO: 4454522 - DNA, 18 bp, Homo sapiens
cttttcgcttgcttctgc

SEQ ID NO: 4454523 - DNA, 24 bp, Homo sapiens
cttttcgcttgcttctgcagcaac

SEQ ID NO: 4454524 - DNA, 21 bp, Homo sapiens
cttttcgtttagaatcagaat

SEQ ID NO: 4454525 - DNA, 19 bp, Homo sapiens
cttttctaaaatctaaaat

SEQ ID NO: 4454526 - DNA, 15 bp, Homo sapiens
cttttctaaactgca

SEQ ID NO: 4454527 - DNA, 21 bp, Homo sapiens
cttttctacacactcagccac

SEQ ID NO: 4454528 - DNA, 22 bp, Homo sapiens
cttttctacacactcagccaca

SEQ ID NO: 4454529 - DNA, 23 bp, Homo sapiens
cttttctacacactcagccacaa

SEQ ID NO: 4454530 - DNA, 15 bp, Homo sapiens
cttttctgatggtat

SEQ ID NO: 4454531 - DNA, 16 bp, Homo sapiens
cttttctgccaaaata

SEQ ID NO: 4454532 - DNA, 13 bp, Homo sapiens
cttttctgccctg

SEQ ID NO: 4454533 - DNA, 14 bp, Homo sapiens
cttttctgccctgg

SEQ ID NO: 4454534 - DNA, 15 bp, Homo sapiens
cttttctgccctggc

SEQ ID NO: 4454535 - DNA, 20 bp, Homo sapiens
cttttctgctgttgcctctc

SEQ ID NO: 4454536 - DNA, 13 bp, Homo sapiens
cttttctggaatt

SEQ ID NO: 4454537 - DNA, 13 bp, Homo sapiens
cttttctgtaatt

SEQ ID NO: 4454538 - DNA, 15 bp, Homo sapiens
cttttctgtaattca

SEQ ID NO: 4454539 - DNA, 16 bp, Homo sapiens
cttttctgttctagtt

SEQ ID NO: 4454540 - DNA, 16 bp, Homo sapiens
cttttcttattccttt

SEQ ID NO: 4454541 - DNA, 17 bp, Homo sapiens
cttttcttattcctttt

SEQ ID NO: 4454542 - DNA, 17 bp, Homo sapiens
cttttcttatttttgta

SEQ ID NO: 4454543 - DNA, 23 bp, Homo sapiens
cttttcttggaactgtcccagct

SEQ ID NO: 4454544 - DNA, 17 bp, Homo sapiens
cttttgaaaaaaaagtt

SEQ ID NO: 4454545 - DNA, 18 bp, Homo sapiens
cttttgaaagatgtatgg

SEQ ID NO: 4454546 - DNA, 21 bp, Homo sapiens
cttttgaatcaatctggcttc

SEQ ID NO: 4454547 - DNA, 19 bp, Homo sapiens
cttttgaatgatgccttta

SEQ ID NO: 4454548 - DNA, 17 bp, Homo sapiens
cttttgaattcttgata

SEQ ID NO: 4454549 - DNA, 15 bp, Homo sapiens
cttttgagacttttt

SEQ ID NO: 4454550 - DNA, 18 bp, Homo sapiens
cttttgagactttttggt

SEQ ID NO: 4454551 - DNA, 20 bp, Homo sapiens
cttttgagactttttggtgg

SEQ ID NO: 4454552 - DNA, 20 bp, Homo sapiens
cttttgagggctaaaaaggt

SEQ ID NO: 4454553 - DNA, 21 bp, Homo sapiens
cttttgagtatggctatctat

SEQ ID NO: 4454554 - DNA, 22 bp, Homo sapiens
cttttgagtgttcccaatctga

SEQ ID NO: 4454555 - DNA, 18 bp, Homo sapiens
cttttgatgaaataaaat

SEQ ID NO: 4454556 - DNA, 16 bp, Homo sapiens
cttttgcaaccaggaa

SEQ ID NO: 4454557 - DNA, 17 bp, Homo sapiens
cttttgcaaccaggaac

SEQ ID NO: 4454558 - DNA, 15 bp, Homo sapiens
cttttgccctttgat

SEQ ID NO: 4454559 - DNA, 16 bp, Homo sapiens
cttttgctgtttatac

SEQ ID NO: 4454560 - DNA, 17 bp, Homo sapiens
cttttgcttgatccaga

SEQ ID NO: 4454561 - DNA, 19 bp, Homo sapiens
cttttggaaccatgccttc

SEQ ID NO: 4454562 - DNA, 23 bp, Homo sapiens
cttttggagaaccagggctcttc

SEQ ID NO: 4454563 - DNA, 14 bp, Homo sapiens
cttttggcctgggg

SEQ ID NO: 4454564 - DNA, 11 bp, Homo sapiens
cttttgggaag

SEQ ID NO: 4454565 - DNA, 15 bp, Homo sapiens
cttttggggaatgag

SEQ ID NO: 4454566 - DNA, 15 bp, Homo sapiens
cttttgggggagggc

SEQ ID NO: 4454567 - DNA, 20 bp, Homo sapiens
cttttggtaaagactggctt

SEQ ID NO: 4454568 - DNA, 14 bp, Homo sapiens
cttttgtaagtatg

SEQ ID NO: 4454569 - DNA, 14 bp, Homo sapiens
cttttgtatctttt

SEQ ID NO: 4454570 - DNA, 11 bp, Homo sapiens
cttttgtatta

SEQ ID NO: 4454571 - DNA, 14 bp, Homo sapiens
cttttgtcccagaa

SEQ ID NO: 4454572 - DNA, 21 bp, Homo sapiens
cttttgtgatgaacatattca

SEQ ID NO: 4454573 - DNA, 17 bp, Homo sapiens
cttttgttaatgcattg

SEQ ID NO: 4454574 - DNA, 19 bp, Homo sapiens
cttttgttaatgcattgtt

SEQ ID NO: 4454575 - DNA, 13 bp, Homo sapiens
cttttgttcgcat

SEQ ID NO: 4454576 - DNA, 13 bp, Homo sapiens
cttttgttctaga

SEQ ID NO: 4454577 - DNA, 14 bp, Homo sapiens
cttttgttctagac

SEQ ID NO: 4454578 - DNA, 15 bp, Homo sapiens
cttttgttctagact

SEQ ID NO: 4454579 - DNA, 23 bp, Homo sapiens
cttttgttgtactttatatcttg

SEQ ID NO: 4454580 - DNA, 13 bp, Homo sapiens
ctttttaaaatac

SEQ ID NO: 4454581 - DNA, 21 bp, Homo sapiens
ctttttaaagtaaattattaa

SEQ ID NO: 4454582 - DNA, 21 bp, Homo sapiens
ctttttaaatgtaaagatatt

SEQ ID NO: 4454583 - DNA, 16 bp, Homo sapiens
ctttttaaattacctt

SEQ ID NO: 4454584 - DNA, 17 bp, Homo sapiens
ctttttaagaatatttt

SEQ ID NO: 4454585 - DNA, 17 bp, Homo sapiens
ctttttaatagcactaa

SEQ ID NO: 4454586 - DNA, 21 bp, Homo sapiens
ctttttaatcatgaatatgat

SEQ ID NO: 4454587 - DNA, 17 bp, Homo sapiens
ctttttacagcagcaat

SEQ ID NO: 4454588 - DNA, 15 bp, Homo sapiens
ctttttacctttcat

SEQ ID NO: 4454589 - DNA, 16 bp, Homo sapiens
ctttttacctttcata

SEQ ID NO: 4454590 - DNA, 20 bp, Homo sapiens
ctttttagatgtatttttga

SEQ ID NO: 4454591 - DNA, 16 bp, Homo sapiens
ctttttagtaatttct

SEQ ID NO: 4454592 - DNA, 13 bp, Homo sapiens
ctttttataaaaa

SEQ ID NO: 4454593 - DNA, 18 bp, Homo sapiens
ctttttattattttaagt

SEQ ID NO: 4454594 - DNA, 17 bp, Homo sapiens
ctttttattccctgccc

SEQ ID NO: 4454595 - DNA, 15 bp, Homo sapiens
ctttttatttgcatg

SEQ ID NO: 4454596 - DNA, 20 bp, Homo sapiens
ctttttcaatgaattttata

SEQ ID NO: 4454597 - DNA, 12 bp, Homo sapiens
ctttttcagtga

SEQ ID NO: 4454598 - DNA, 12 bp, Homo sapiens
ctttttcataat

SEQ ID NO: 4454599 - DNA, 22 bp, Homo sapiens
ctttttccaactcagaaattca

SEQ ID NO: 4454600 - DNA, 17 bp, Homo sapiens
ctttttccagtgttcta

SEQ ID NO: 4454601 - DNA, 22 bp, Homo sapiens
ctttttcctgcgtcccagcctg

SEQ ID NO: 4454602 - DNA, 14 bp, Homo sapiens
ctttttccttactg

SEQ ID NO: 4454603 - DNA, 14 bp, Homo sapiens
ctttttctacatgt

SEQ ID NO: 4454604 - DNA, 19 bp, Homo sapiens
ctttttctgaactccattt

SEQ ID NO: 4454605 - DNA, 13 bp, Homo sapiens
ctttttctgttga

SEQ ID NO: 4454606 - DNA, 12 bp, Homo sapiens
ctttttcttccc

SEQ ID NO: 4454607 - DNA, 13 bp, Homo sapiens
ctttttcttccct

SEQ ID NO: 4454608 - DNA, 18 bp, Homo sapiens
ctttttctttttctttct

SEQ ID NO: 4454609 - DNA, 19 bp, Homo sapiens
ctttttctttttctttctt

SEQ ID NO: 4454610 - DNA, 17 bp, Homo sapiens
ctttttgaccagtttct

SEQ ID NO: 4454611 - DNA, 12 bp, Homo sapiens
ctttttggaatc

SEQ ID NO: 4454612 - DNA, 17 bp, Homo sapiens
ctttttggtggatgtaa

SEQ ID NO: 4454613 - DNA, 23 bp, Homo sapiens
ctttttgtttgtactggttcatt

SEQ ID NO: 4454614 - DNA, 21 bp, Homo sapiens
cttttttaaaataaaataagt

SEQ ID NO: 4454615 - DNA, 15 bp, Homo sapiens
cttttttaaactgta

SEQ ID NO: 4454616 - DNA, 12 bp, Homo sapiens
cttttttaaagt

SEQ ID NO: 4454617 - DNA, 13 bp, Homo sapiens
cttttttaaagta

SEQ ID NO: 4454618 - DNA, 18 bp, Homo sapiens
cttttttaaagtaaactt

SEQ ID NO: 4454619 - DNA, 17 bp, Homo sapiens
cttttttaaatattttc

SEQ ID NO: 4454620 - DNA, 22 bp, Homo sapiens
cttttttaaatattttctattt

SEQ ID NO: 4454621 - DNA, 20 bp, Homo sapiens
cttttttaaattttcttcag

SEQ ID NO: 4454622 - DNA, 21 bp, Homo sapiens
cttttttaaattttcttcagt

SEQ ID NO: 4454623 - DNA, 16 bp, Homo sapiens
cttttttaataaacta

SEQ ID NO: 4454624 - DNA, 19 bp, Homo sapiens
cttttttatgttggttgat

SEQ ID NO: 4454625 - DNA, 16 bp, Homo sapiens
cttttttcaatatgca

SEQ ID NO: 4454626 - DNA, 17 bp, Homo sapiens
cttttttcaatatgcaa

SEQ ID NO: 4454627 - DNA, 18 bp, Homo sapiens
cttttttgtttgaatgtt

SEQ ID NO: 4454628 - DNA, 17 bp, Homo sapiens
cttttttgtttgtttct

SEQ ID NO: 4454629 - DNA, 22 bp, Homo sapiens
cttttttgttttttcaaaatag

SEQ ID NO: 4454630 - DNA, 19 bp, Homo sapiens
ctttttttccatctttaca

SEQ ID NO: 4454631 - DNA, 18 bp, Homo sapiens
ctttttttctatattatt

SEQ ID NO: 4454632 - DNA, 14 bp, Homo sapiens
ctttttttctgtac

SEQ ID NO: 4454633 - DNA, 17 bp, Homo sapiens
ctttttttgtatgtgtg

SEQ ID NO: 4454634 - DNA, 22 bp, Homo sapiens
ctttttttgtgtgtatttgcta

SEQ ID NO: 4454635 - DNA, 17 bp, Homo sapiens
cttttttttctctcttt

SEQ ID NO: 4454636 - DNA, 15 bp, Homo sapiens
cttttttttctgatt

SEQ ID NO: 4454637 - DNA, 13 bp, Homo sapiens
ctttttttttaag

SEQ ID NO: 4454638 - DNA, 21 bp, Homo sapiens
ctttttttttaagttcttatg

SEQ ID NO: 4454639 - DNA, 17 bp, Homo sapiens
ctttttttttctctttc

SEQ ID NO: 4454640 - DNA, 19 bp, Homo sapiens
ctttttttttctttttcca

SEQ ID NO: 4454641 - DNA, 16 bp, Homo sapiens
cttttttttttttcca

SEQ ID NO: 4454642 - DNA, 23 bp, Homo sapiens
ctttttttttttttttttttccg

SEQ ID NO: 4454643 - DNA, 17 bp, Homo sapiens
gaaaaaaaaaacacttg

SEQ ID NO: 4454644 - DNA, 16 bp, Homo sapiens
gaaaaaaaacagtgga

SEQ ID NO: 4454645 - DNA, 14 bp, Homo sapiens
gaaaaaaaatgtac

SEQ ID NO: 4454646 - DNA, 19 bp, Homo sapiens
gaaaaaaactgggataact

SEQ ID NO: 4454647 - DNA, 13 bp, Homo sapiens
gaaaaaaactttt

SEQ ID NO: 4454648 - DNA, 21 bp, Homo sapiens
gaaaaaaagggaaaacaaata

SEQ ID NO: 4454649 - DNA, 20 bp, Homo sapiens
gaaaaaaagtagtttgaatg

SEQ ID NO: 4454650 - DNA, 15 bp, Homo sapiens
gaaaaaaatcatcta

SEQ ID NO: 4454651 - DNA, 21 bp, Homo sapiens
gaaaaaaatgttgtttcctaa

SEQ ID NO: 4454652 - DNA, 14 bp, Homo sapiens
gaaaaaaattgaaa

SEQ ID NO: 4454653 - DNA, 21 bp, Homo sapiens
gaaaaaagatttttaaaatga

SEQ ID NO: 4454654 - DNA, 10 bp, Homo sapiens
gaaaaaagct

SEQ ID NO: 4454655 - DNA, 13 bp, Homo sapiens
gaaaaaagctcat

SEQ ID NO: 4454656 - DNA, 11 bp, Homo sapiens
gaaaaaatata

SEQ ID NO: 4454657 - DNA, 12 bp, Homo sapiens
gaaaaaatatat

SEQ ID NO: 4454658 - DNA, 14 bp, Homo sapiens
gaaaaaatttaaaa

SEQ ID NO: 4454659 - DNA, 16 bp, Homo sapiens
gaaaaacaataaagat

SEQ ID NO: 4454660 - DNA, 22 bp, Homo sapiens
gaaaaacaataaagatacatga

SEQ ID NO: 4454661 - DNA, 15 bp, Homo sapiens
gaaaaacacaagcaa

SEQ ID NO: 4454662 - DNA, 14 bp, Homo sapiens
gaaaaagaaaataa

SEQ ID NO: 4454663 - DNA, 11 bp, Homo sapiens
gaaaaagctcc

SEQ ID NO: 4454664 - DNA, 21 bp, Homo sapiens
gaaaaaggacaaataaaacat

SEQ ID NO: 4454665 - DNA, 12 bp, Homo sapiens
gaaaaagggtca

SEQ ID NO: 4454666 - DNA, 16 bp, Homo sapiens
gaaaaataacaactat

SEQ ID NO: 4454667 - DNA, 12 bp, Homo sapiens
gaaaaatagagc

SEQ ID NO: 4454668 - DNA, 16 bp, Homo sapiens
gaaaaatatttattca

SEQ ID NO: 4454669 - DNA, 20 bp, Homo sapiens
gaaaaatctcaattgaaagc

SEQ ID NO: 4454670 - DNA, 17 bp, Homo sapiens
gaaaaatctcattattt

SEQ ID NO: 4454671 - DNA, 22 bp, Homo sapiens
gaaaaatctcattatttcaaaa

SEQ ID NO: 4454672 - DNA, 20 bp, Homo sapiens
gaaaaatgggagacagcctc

SEQ ID NO: 4454673 - DNA, 21 bp, Homo sapiens
gaaaaattattagaacattca

SEQ ID NO: 4454674 - DNA, 16 bp, Homo sapiens
gaaaaattccactcaa

SEQ ID NO: 4454675 - DNA, 19 bp, Homo sapiens
gaaaaattggggaggaggg

SEQ ID NO: 4454676 - DNA, 14 bp, Homo sapiens
gaaaaatttcacga

SEQ ID NO: 4454677 - DNA, 15 bp, Homo sapiens
gaaaaatttcacgat

SEQ ID NO: 4454678 - DNA, 16 bp, Homo sapiens
gaaaacaatggggctg

SEQ ID NO: 4454679 - DNA, 14 bp, Homo sapiens
gaaaacactgtgca

SEQ ID NO: 4454680 - DNA, 14 bp, Homo sapiens
gaaaacagaaaacc

SEQ ID NO: 4454681 - DNA, 21 bp, Homo sapiens
gaaaacaggaaaaaaactttt

SEQ ID NO: 4454682 - DNA, 19 bp, Homo sapiens
gaaaacagggtccaggaat

SEQ ID NO: 4454683 - DNA, 21 bp, Homo sapiens
gaaaacagggtccaggaatgg

SEQ ID NO: 4454684 - DNA, 14 bp, Homo sapiens
gaaaacagtacaga

SEQ ID NO: 4454685 - DNA, 11 bp, Homo sapiens
gaaaaccaaaa

SEQ ID NO: 4454686 - DNA, 16 bp, Homo sapiens
gaaaacccaaggccag

SEQ ID NO: 4454687 - DNA, 16 bp, Homo sapiens
gaaaacccaagttttt

SEQ ID NO: 4454688 - DNA, 13 bp, Homo sapiens
gaaaacccagaga

SEQ ID NO: 4454689 - DNA, 14 bp, Homo sapiens
gaaaacccagagag

SEQ ID NO: 4454690 - DNA, 16 bp, Homo sapiens
gaaaaccgtaaagtgc

SEQ ID NO: 4454691 - DNA, 11 bp, Homo sapiens
gaaaacctttc

SEQ ID NO: 4454692 - DNA, 20 bp, Homo sapiens
gaaaacgggcagtctgctct

SEQ ID NO: 4454693 - DNA, 17 bp, Homo sapiens
gaaaacgtcttccttct

SEQ ID NO: 4454694 - DNA, 17 bp, Homo sapiens
gaaaactacaaacgttt

SEQ ID NO: 4454695 - DNA, 22 bp, Homo sapiens
gaaaactagcattacattatta

SEQ ID NO: 4454696 - DNA, 13 bp, Homo sapiens
gaaaactcccaat

SEQ ID NO: 4454697 - DNA, 18 bp, Homo sapiens
gaaaactgtgcaactttt

SEQ ID NO: 4454698 - DNA, 13 bp, Homo sapiens
gaaaactgtgttg

SEQ ID NO: 4454699 - DNA, 19 bp, Homo sapiens
gaaaactgtgttgccacag

SEQ ID NO: 4454700 - DNA, 16 bp, Homo sapiens
gaaaactttaaagcgt

SEQ ID NO: 4454701 - DNA, 21 bp, Homo sapiens
gaaaactttatgctaagtgaa

SEQ ID NO: 4454702 - DNA, 15 bp, Homo sapiens
gaaaagaaaacaaaa

SEQ ID NO: 4454703 - DNA, 15 bp, Homo sapiens
gaaaagaagtagtgt

SEQ ID NO: 4454704 - DNA, 11 bp, Homo sapiens
gaaaagaattt

SEQ ID NO: 4454705 - DNA, 14 bp, Homo sapiens
gaaaagactccaaa

SEQ ID NO: 4454706 - DNA, 16 bp, Homo sapiens
gaaaagcaacattcat

SEQ ID NO: 4454707 - DNA, 16 bp, Homo sapiens
gaaaagcacctgccga

SEQ ID NO: 4454708 - DNA, 20 bp, Homo sapiens
gaaaagcctccgcctgctgt

SEQ ID NO: 4454709 - DNA, 17 bp, Homo sapiens
gaaaaggagaggaaact

SEQ ID NO: 4454710 - DNA, 19 bp, Homo sapiens
gaaaaggctaagaaaaagg

SEQ ID NO: 4454711 - DNA, 17 bp, Homo sapiens
gaaaagggagtttaaaa

SEQ ID NO: 4454712 - DNA, 22 bp, Homo sapiens
gaaaagggagtttaaaaatggt

SEQ ID NO: 4454713 - DNA, 13 bp, Homo sapiens
gaaaaggttgaat

SEQ ID NO: 4454714 - DNA, 17 bp, Homo sapiens
gaaaaggtttatgaaaa

SEQ ID NO: 4454715 - DNA, 21 bp, Homo sapiens
gaaaagtgatgtattttcata

SEQ ID NO: 4454716 - DNA, 10 bp, Homo sapiens
gaaaagttat

SEQ ID NO: 4454717 - DNA, 13 bp, Homo sapiens
gaaaataaaacac

SEQ ID NO: 4454718 - DNA, 15 bp, Homo sapiens
gaaaataaaacacac

SEQ ID NO: 4454719 - DNA, 16 bp, Homo sapiens
gaaaataaaacacacc

SEQ ID NO: 4454720 - DNA, 21 bp, Homo sapiens
gaaaataaatcttagtgttca

SEQ ID NO: 4454721 - DNA, 22 bp, Homo sapiens
gaaaataaatcttagtgttcaa

SEQ ID NO: 4454722 - DNA, 23 bp, Homo sapiens
gaaaataaatcttagtgttcaaa

SEQ ID NO: 4454723 - DNA, 18 bp, Homo sapiens
gaaaataactgaatttgg

SEQ ID NO: 4454724 - DNA, 23 bp, Homo sapiens
gaaaataagacaatagtatttct

SEQ ID NO: 4454725 - DNA, 19 bp, Homo sapiens
gaaaatacaacttaaataa

SEQ ID NO: 4454726 - DNA, 23 bp, Homo sapiens
gaaaataccacctcgagatgggt

SEQ ID NO: 4454727 - DNA, 21 bp, Homo sapiens
gaaaatagtgtaagaactgta

SEQ ID NO: 4454728 - DNA, 12 bp, Homo sapiens
gaaaatatactt

SEQ ID NO: 4454729 - DNA, 22 bp, Homo sapiens
gaaaatatatattatatacata

SEQ ID NO: 4454730 - DNA, 15 bp, Homo sapiens
gaaaatatatgtatt

SEQ ID NO: 4454731 - DNA, 16 bp, Homo sapiens
gaaaatatgtactgta

SEQ ID NO: 4454732 - DNA, 19 bp, Homo sapiens
gaaaatattctctatttga

SEQ ID NO: 4454733 - DNA, 15 bp, Homo sapiens
gaaaatattgtttta

SEQ ID NO: 4454734 - DNA, 14 bp, Homo sapiens
gaaaatatttaaag

SEQ ID NO: 4454735 - DNA, 15 bp, Homo sapiens
gaaaatatttaatat

SEQ ID NO: 4454736 - DNA, 14 bp, Homo sapiens
gaaaatcctctggc

SEQ ID NO: 4454737 - DNA, 21 bp, Homo sapiens
gaaaatctagaggaaaagaaa

SEQ ID NO: 4454738 - DNA, 22 bp, Homo sapiens
gaaaatctagaggaaaagaaag

SEQ ID NO: 4454739 - DNA, 22 bp, Homo sapiens
gaaaatcttagtatagtagaaa

SEQ ID NO: 4454740 - DNA, 19 bp, Homo sapiens
gaaaatctttataaatgta

SEQ ID NO: 4454741 - DNA, 15 bp, Homo sapiens
gaaaatgacttattt

SEQ ID NO: 4454742 - DNA, 18 bp, Homo sapiens
gaaaatgacttatttctg

SEQ ID NO: 4454743 - DNA, 15 bp, Homo sapiens
gaaaatgagaaagga

SEQ ID NO: 4454744 - DNA, 24 bp, Homo sapiens
gaaaatgagaaaggacagagccag

SEQ ID NO: 4454745 - DNA, 13 bp, Homo sapiens
gaaaatgagccct

SEQ ID NO: 4454746 - DNA, 14 bp, Homo sapiens
gaaaatgagccctg

SEQ ID NO: 4454747 - DNA, 16 bp, Homo sapiens
gaaaatgtaaaggttt

SEQ ID NO: 4454748 - DNA, 22 bp, Homo sapiens
gaaaatgtattcctttaaaata

SEQ ID NO: 4454749 - DNA, 21 bp, Homo sapiens
gaaaatgttctgtttgctgtg

SEQ ID NO: 4454750 - DNA, 14 bp, Homo sapiens
gaaaattaaactac

SEQ ID NO: 4454751 - DNA, 14 bp, Homo sapiens
gaaaattagactgt

SEQ ID NO: 4454752 - DNA, 22 bp, Homo sapiens
gaaaattagtgaccattattca

SEQ ID NO: 4454753 - DNA, 15 bp, Homo sapiens
gaaaattatttgcat

SEQ ID NO: 4454754 - DNA, 13 bp, Homo sapiens
gaaaattattttg

SEQ ID NO: 4454755 - DNA, 13 bp, Homo sapiens
gaaaattcatttt

SEQ ID NO: 4454756 - DNA, 13 bp, Homo sapiens
gaaaattcctaga

SEQ ID NO: 4454757 - DNA, 13 bp, Homo sapiens
gaaaattctgtgc

SEQ ID NO: 4454758 - DNA, 22 bp, Homo sapiens
gaaaattctgtgccttgttttt

SEQ ID NO: 4454759 - DNA, 18 bp, Homo sapiens
gaaaattgaaacacagag

SEQ ID NO: 4454760 - DNA, 23 bp, Homo sapiens
gaaaattgtataccaatgtgttt

SEQ ID NO: 4454761 - DNA, 14 bp, Homo sapiens
gaaaatttaacagt

SEQ ID NO: 4454762 - DNA, 17 bp, Homo sapiens
gaaaatttgttattttg

SEQ ID NO: 4454763 - DNA, 21 bp, Homo sapiens
gaaaatttgttattttgcaac

SEQ ID NO: 4454764 - DNA, 13 bp, Homo sapiens
gaaaatttttgta

SEQ ID NO: 4454765 - DNA, 18 bp, Homo sapiens
gaaacaaaaaaaaaatga

SEQ ID NO: 4454766 - DNA, 23 bp, Homo sapiens
gaaacaaagagttcaagaaataa

SEQ ID NO: 4454767 - DNA, 13 bp, Homo sapiens
gaaacaacagaga

SEQ ID NO: 4454768 - DNA, 14 bp, Homo sapiens
gaaacaatgaaaac

SEQ ID NO: 4454769 - DNA, 16 bp, Homo sapiens
gaaacaatgaaatttt

SEQ ID NO: 4454770 - DNA, 18 bp, Homo sapiens
gaaacaccgagtctctgt

SEQ ID NO: 4454771 - DNA, 23 bp, Homo sapiens
gaaacactgcaaattttaactgt

SEQ ID NO: 4454772 - DNA, 15 bp, Homo sapiens
gaaacagctgcctta

SEQ ID NO: 4454773 - DNA, 19 bp, Homo sapiens
gaaacagctgccttagctt

SEQ ID NO: 4454774 - DNA, 22 bp, Homo sapiens
gaaacaggttgggatgggatag

SEQ ID NO: 4454775 - DNA, 19 bp, Homo sapiens
gaaacagttgcatgtagta

SEQ ID NO: 4454776 - DNA, 20 bp, Homo sapiens
gaaacagttgcatgtagtaa

SEQ ID NO: 4454777 - DNA, 23 bp, Homo sapiens
gaaacagttgcatgtagtaacac

SEQ ID NO: 4454778 - DNA, 19 bp, Homo sapiens
gaaacagttggtaactttt

SEQ ID NO: 4454779 - DNA, 13 bp, Homo sapiens
gaaaccagaaaag

SEQ ID NO: 4454780 - DNA, 13 bp, Homo sapiens
gaaaccagtattt

SEQ ID NO: 4454781 - DNA, 19 bp, Homo sapiens
gaaacccccttttcccttc

SEQ ID NO: 4454782 - DNA, 15 bp, Homo sapiens
gaaacccgccctcag

SEQ ID NO: 4454783 - DNA, 15 bp, Homo sapiens
gaaaccctatttccc

SEQ ID NO: 4454784 - DNA, 14 bp, Homo sapiens
gaaacctcttccta

SEQ ID NO: 4454785 - DNA, 15 bp, Homo sapiens
gaaacctcttcctag

SEQ ID NO: 4454786 - DNA, 18 bp, Homo sapiens
gaaacctcttcctaggcc

SEQ ID NO: 4454787 - DNA, 17 bp, Homo sapiens
gaaaccttccacccagt

SEQ ID NO: 4454788 - DNA, 21 bp, Homo sapiens
gaaacgcagttgtgtggccca

SEQ ID NO: 4454789 - DNA, 23 bp, Homo sapiens
gaaacgcagttgtgtggcccagc

SEQ ID NO: 4454790 - DNA, 16 bp, Homo sapiens
gaaacgtcttctaaac

SEQ ID NO: 4454791 - DNA, 23 bp, Homo sapiens
gaaactaagagacagttctctgt

SEQ ID NO: 4454792 - DNA, 13 bp, Homo sapiens
gaaactaagccag

SEQ ID NO: 4454793 - DNA, 23 bp, Homo sapiens
gaaactaagccaggcctggctgg

SEQ ID NO: 4454794 - DNA, 21 bp, Homo sapiens
gaaactaattgactttagaaa

SEQ ID NO: 4454795 - DNA, 23 bp, Homo sapiens
gaaactactgcctttagaaaata

SEQ ID NO: 4454796 - DNA, 17 bp, Homo sapiens
gaaactcaaggaaaagt

SEQ ID NO: 4454797 - DNA, 18 bp, Homo sapiens
gaaactccgaagaaaaga

SEQ ID NO: 4454798 - DNA, 19 bp, Homo sapiens
gaaactccgaagaaaagaa

SEQ ID NO: 4454799 - DNA, 22 bp, Homo sapiens
gaaactgagtcactcacattga

SEQ ID NO: 4454800 - DNA, 15 bp, Homo sapiens
gaaactgctgcagat

SEQ ID NO: 4454801 - DNA, 13 bp, Homo sapiens
gaaactgggaaac

SEQ ID NO: 4454802 - DNA, 11 bp, Homo sapiens
gaaacttctga

SEQ ID NO: 4454803 - DNA, 18 bp, Homo sapiens
gaaacttctgatgtttat

SEQ ID NO: 4454804 - DNA, 16 bp, Homo sapiens
gaaactttctttctca

SEQ ID NO: 4454805 - DNA, 13 bp, Homo sapiens
gaaactttgtgct

SEQ ID NO: 4454806 - DNA, 17 bp, Homo sapiens
gaaacttttttatttaa

SEQ ID NO: 4454807 - DNA, 18 bp, Homo sapiens
gaaacttttttatttaaa

SEQ ID NO: 4454808 - DNA, 13 bp, Homo sapiens
gaaagaaaaaatt

SEQ ID NO: 4454809 - DNA, 18 bp, Homo sapiens
gaaagaaaatcaggctgg

SEQ ID NO: 4454810 - DNA, 13 bp, Homo sapiens
gaaagaagccata

SEQ ID NO: 4454811 - DNA, 13 bp, Homo sapiens
gaaagaatagaaa

SEQ ID NO: 4454812 - DNA, 14 bp, Homo sapiens
gaaagaatagaaag

SEQ ID NO: 4454813 - DNA, 15 bp, Homo sapiens
gaaagacatctgcct

SEQ ID NO: 4454814 - DNA, 21 bp, Homo sapiens
gaaagacatctgcctgtaatt

SEQ ID NO: 4454815 - DNA, 19 bp, Homo sapiens
gaaagactattcaaacagt

SEQ ID NO: 4454816 - DNA, 14 bp, Homo sapiens
gaaagaggccagac

SEQ ID NO: 4454817 - DNA, 18 bp, Homo sapiens
gaaagaggttaggagtag

SEQ ID NO: 4454818 - DNA, 19 bp, Homo sapiens
gaaagatggttaaacattt

SEQ ID NO: 4454819 - DNA, 17 bp, Homo sapiens
gaaagatttaaagtatt

SEQ ID NO: 4454820 - DNA, 20 bp, Homo sapiens
gaaagatttaaagtatttta

SEQ ID NO: 4454821 - DNA, 22 bp, Homo sapiens
gaaagcaacaaagattgagaag

SEQ ID NO: 4454822 - DNA, 20 bp, Homo sapiens
gaaagcaagaatcagagaag

SEQ ID NO: 4454823 - DNA, 21 bp, Homo sapiens
gaaagcacttaaacagaagca

SEQ ID NO: 4454824 - DNA, 17 bp, Homo sapiens
gaaagcagaacagtgat

SEQ ID NO: 4454825 - DNA, 20 bp, Homo sapiens
gaaagcagatacctcaccct

SEQ ID NO: 4454826 - DNA, 22 bp, Homo sapiens
gaaagcagatacctcaccctgc

SEQ ID NO: 4454827 - DNA, 22 bp, Homo sapiens
gaaagcataaagctcaaatgaa

SEQ ID NO: 4454828 - DNA, 14 bp, Homo sapiens
gaaagcatattgac

SEQ ID NO: 4454829 - DNA, 18 bp, Homo sapiens
gaaagcatattgactttt

SEQ ID NO: 4454830 - DNA, 24 bp, Homo sapiens
gaaagcatccattaattaatgaga

SEQ ID NO: 4454831 - DNA, 17 bp, Homo sapiens
gaaagccacgccctccc

SEQ ID NO: 4454832 - DNA, 13 bp, Homo sapiens
gaaagcccaaggt

SEQ ID NO: 4454833 - DNA, 14 bp, Homo sapiens
gaaagccctccccc

SEQ ID NO: 4454834 - DNA, 15 bp, Homo sapiens
gaaagcctcctgccc

SEQ ID NO: 4454835 - DNA, 21 bp, Homo sapiens
gaaagcctcctgccccctgcc

SEQ ID NO: 4454836 - DNA, 15 bp, Homo sapiens
gaaagcgggcagccc

SEQ ID NO: 4454837 - DNA, 16 bp, Homo sapiens
gaaagcgggcagcccc

SEQ ID NO: 4454838 - DNA, 15 bp, Homo sapiens
gaaagctaaagtgat

SEQ ID NO: 4454839 - DNA, 20 bp, Homo sapiens
gaaagcttcaaagtttatat

SEQ ID NO: 4454840 - DNA, 20 bp, Homo sapiens
gaaagctttggaaaaatctt

SEQ ID NO: 4454841 - DNA, 15 bp, Homo sapiens
gaaagcttttaaaat

SEQ ID NO: 4454842 - DNA, 22 bp, Homo sapiens
gaaagcttttcagtgttcccaa

SEQ ID NO: 4454843 - DNA, 12 bp, Homo sapiens
gaaaggatttta

SEQ ID NO: 4454844 - DNA, 19 bp, Homo sapiens
gaaaggattttaccaaagc

SEQ ID NO: 4454845 - DNA, 16 bp, Homo sapiens
gaaaggccccaatctt

SEQ ID NO: 4454846 - DNA, 19 bp, Homo sapiens
gaaaggccccaatcttgcc

SEQ ID NO: 4454847 - DNA, 19 bp, Homo sapiens
gaaaggctatcctgctgaa

SEQ ID NO: 4454848 - DNA, 17 bp, Homo sapiens
gaaaggctcatttaaaa

SEQ ID NO: 4454849 - DNA, 13 bp, Homo sapiens
gaaagggaaactg

SEQ ID NO: 4454850 - DNA, 14 bp, Homo sapiens
gaaagggaaactgg

SEQ ID NO: 4454851 - DNA, 16 bp, Homo sapiens
gaaagggaaactggct

SEQ ID NO: 4454852 - DNA, 18 bp, Homo sapiens
gaaagggagacagccagg

SEQ ID NO: 4454853 - DNA, 21 bp, Homo sapiens
gaaagggagacagccaggtgg

SEQ ID NO: 4454854 - DNA, 15 bp, Homo sapiens
gaaagggctggctcc

SEQ ID NO: 4454855 - DNA, 15 bp, Homo sapiens
gaaagggggtgacct

SEQ ID NO: 4454856 - DNA, 22 bp, Homo sapiens
gaaaggtgagtttgagctgcct

SEQ ID NO: 4454857 - DNA, 16 bp, Homo sapiens
gaaaggtgtgaacagc

SEQ ID NO: 4454858 - DNA, 15 bp, Homo sapiens
gaaaggttctgcccg

SEQ ID NO: 4454859 - DNA, 17 bp, Homo sapiens
gaaagtacactctgctg

SEQ ID NO: 4454860 - DNA, 19 bp, Homo sapiens
gaaagtacactctgctgtt

SEQ ID NO: 4454861 - DNA, 15 bp, Homo sapiens
gaaagtacccagcaa

SEQ ID NO: 4454862 - DNA, 19 bp, Homo sapiens
gaaagtatttactttttaa

SEQ ID NO: 4454863 - DNA, 21 bp, Homo sapiens
gaaagtcagaatcagaagata

SEQ ID NO: 4454864 - DNA, 19 bp, Homo sapiens
gaaagtgaagcaaatcaga

SEQ ID NO: 4454865 - DNA, 18 bp, Homo sapiens
gaaagtgggcaaaagctt

SEQ ID NO: 4454866 - DNA, 15 bp, Homo sapiens
gaaagtgggggtgga

SEQ ID NO: 4454867 - DNA, 18 bp, Homo sapiens
gaaagtgggggtggagga

SEQ ID NO: 4454868 - DNA, 17 bp, Homo sapiens
gaaagttaacattaatg

SEQ ID NO: 4454869 - DNA, 16 bp, Homo sapiens
gaaagttgtacatgat

SEQ ID NO: 4454870 - DNA, 19 bp, Homo sapiens
gaaagttgtacatgataag

SEQ ID NO: 4454871 - DNA, 20 bp, Homo sapiens
gaaagttttgtaaaagaaat

SEQ ID NO: 4454872 - DNA, 21 bp, Homo sapiens
gaaagttttgtaaaagaaatc

SEQ ID NO: 4454873 - DNA, 15 bp, Homo sapiens
gaaataaaaaagtct

SEQ ID NO: 4454874 - DNA, 17 bp, Homo sapiens
gaaataaaaaagtctct

SEQ ID NO: 4454875 - DNA, 22 bp, Homo sapiens
gaaataaaaaagtctctattta

SEQ ID NO: 4454876 - DNA, 22 bp, Homo sapiens
gaaataaaccttaatatttctt

SEQ ID NO: 4454877 - DNA, 14 bp, Homo sapiens
gaaataaagtcaga

SEQ ID NO: 4454878 - DNA, 19 bp, Homo sapiens
gaaataaagtcagatggaa

SEQ ID NO: 4454879 - DNA, 16 bp, Homo sapiens
gaaatacagtcttcca

SEQ ID NO: 4454880 - DNA, 18 bp, Homo sapiens
gaaatacagttatttcat

SEQ ID NO: 4454881 - DNA, 22 bp, Homo sapiens
gaaataccacaagcctgagaac

SEQ ID NO: 4454882 - DNA, 16 bp, Homo sapiens
gaaatagaaagaagcc

SEQ ID NO: 4454883 - DNA, 19 bp, Homo sapiens
gaaatagaaagaagccata

SEQ ID NO: 4454884 - DNA, 20 bp, Homo sapiens
gaaatagatatcctctcccc

SEQ ID NO: 4454885 - DNA, 22 bp, Homo sapiens
gaaatagatatcctctccccct

SEQ ID NO: 4454886 - DNA, 17 bp, Homo sapiens
gaaatagcggccctgga

SEQ ID NO: 4454887 - DNA, 20 bp, Homo sapiens
gaaatagcggccctggagga

SEQ ID NO: 4454888 - DNA, 17 bp, Homo sapiens
gaaatagtatacattgt

SEQ ID NO: 4454889 - DNA, 15 bp, Homo sapiens
gaaatagtctgtgtg

SEQ ID NO: 4454890 - DNA, 17 bp, Homo sapiens
gaaatagtctgtgtgaa

SEQ ID NO: 4454891 - DNA, 20 bp, Homo sapiens
gaaatatacagtttgacttt

SEQ ID NO: 4454892 - DNA, 11 bp, Homo sapiens
gaaatatataa

SEQ ID NO: 4454893 - DNA, 20 bp, Homo sapiens
gaaatatattacttaactgt

SEQ ID NO: 4454894 - DNA, 18 bp, Homo sapiens
gaaatatcccgggggtgg

SEQ ID NO: 4454895 - DNA, 19 bp, Homo sapiens
gaaatattaagaacatttt

SEQ ID NO: 4454896 - DNA, 18 bp, Homo sapiens
gaaatattcttattactc

SEQ ID NO: 4454897 - DNA, 18 bp, Homo sapiens
gaaatcaaatatgcaaag

SEQ ID NO: 4454898 - DNA, 19 bp, Homo sapiens
gaaatcaaatatgcaaagc

SEQ ID NO: 4454899 - DNA, 21 bp, Homo sapiens
gaaatcaaatatgcaaagcac

SEQ ID NO: 4454900 - DNA, 23 bp, Homo sapiens
gaaatcaaatatgcaaagcactg

SEQ ID NO: 4454901 - DNA, 21 bp, Homo sapiens
gaaatcacaattttcctgtgg

SEQ ID NO: 4454902 - DNA, 22 bp, Homo sapiens
gaaatcacaattttcctgtgga

SEQ ID NO: 4454903 - DNA, 20 bp, Homo sapiens
gaaatcagtagaaagctaaa

SEQ ID NO: 4454904 - DNA, 18 bp, Homo sapiens
gaaatcctgccctggagg

SEQ ID NO: 4454905 - DNA, 23 bp, Homo sapiens
gaaatcgctgctcaaaaatgatt

SEQ ID NO: 4454906 - DNA, 20 bp, Homo sapiens
gaaatctcagattcttcact

SEQ ID NO: 4454907 - DNA, 14 bp, Homo sapiens
gaaatctgaacatt

SEQ ID NO: 4454908 - DNA, 20 bp, Homo sapiens
gaaatctgtcaagagtagtt

SEQ ID NO: 4454909 - DNA, 17 bp, Homo sapiens
gaaatcttgcttcagac

SEQ ID NO: 4454910 - DNA, 17 bp, Homo sapiens
gaaatgaaagcagggac

SEQ ID NO: 4454911 - DNA, 18 bp, Homo sapiens
gaaatgaaagcagggact

SEQ ID NO: 4454912 - DNA, 15 bp, Homo sapiens
gaaatgaaagggaaa

SEQ ID NO: 4454913 - DNA, 16 bp, Homo sapiens
gaaatgaggtctgttt

SEQ ID NO: 4454914 - DNA, 14 bp, Homo sapiens
gaaatgaggtgcca

SEQ ID NO: 4454915 - DNA, 20 bp, Homo sapiens
gaaatgattcaaattgctgc

SEQ ID NO: 4454916 - DNA, 16 bp, Homo sapiens
gaaatgcataccagta

SEQ ID NO: 4454917 - DNA, 22 bp, Homo sapiens
gaaatgctgttagtaaatttct

SEQ ID NO: 4454918 - DNA, 16 bp, Homo sapiens
gaaatggctttgtgat

SEQ ID NO: 4454919 - DNA, 23 bp, Homo sapiens
gaaatgggaattgcgctcagggg

SEQ ID NO: 4454920 - DNA, 21 bp, Homo sapiens
gaaatggtttcacttgctctt

SEQ ID NO: 4454921 - DNA, 14 bp, Homo sapiens
gaaatgtacacttt

SEQ ID NO: 4454922 - DNA, 15 bp, Homo sapiens
gaaatgtacactttt

SEQ ID NO: 4454923 - DNA, 21 bp, Homo sapiens
gaaatgtacactttttacagc

SEQ ID NO: 4454924 - DNA, 22 bp, Homo sapiens
gaaatgtagcacttacgtaaaa

SEQ ID NO: 4454925 - DNA, 22 bp, Homo sapiens
gaaatgtcccctcaaactcatt

SEQ ID NO: 4454926 - DNA, 17 bp, Homo sapiens
gaaattaagaaggcaaa

SEQ ID NO: 4454927 - DNA, 16 bp, Homo sapiens
gaaattacctgtggat

SEQ ID NO: 4454928 - DNA, 22 bp, Homo sapiens
gaaattatgtgacattttacat

SEQ ID NO: 4454929 - DNA, 13 bp, Homo sapiens
gaaattcaaaatg

SEQ ID NO: 4454930 - DNA, 16 bp, Homo sapiens
gaaattcaagaagtat

SEQ ID NO: 4454931 - DNA, 19 bp, Homo sapiens
gaaattcaagaagtatttt

SEQ ID NO: 4454932 - DNA, 19 bp, Homo sapiens
gaaattcgtgtgttttttt

SEQ ID NO: 4454933 - DNA, 20 bp, Homo sapiens
gaaattctatttataataca

SEQ ID NO: 4454934 - DNA, 17 bp, Homo sapiens
gaaattctgaatttgca

SEQ ID NO: 4454935 - DNA, 19 bp, Homo sapiens
gaaattctgaatttgcaaa

SEQ ID NO: 4454936 - DNA, 21 bp, Homo sapiens
gaaattctgaatttgcaaagt

SEQ ID NO: 4454937 - DNA, 22 bp, Homo sapiens
gaaattctttcccagtctgtcg

SEQ ID NO: 4454938 - DNA, 14 bp, Homo sapiens
gaaatttaaactat

SEQ ID NO: 4454939 - DNA, 18 bp, Homo sapiens
gaaatttacacagtgaga

SEQ ID NO: 4454940 - DNA, 17 bp, Homo sapiens
gaaatttgttgtttgtt

SEQ ID NO: 4454941 - DNA, 15 bp, Homo sapiens
gaaattttatatgct

SEQ ID NO: 4454942 - DNA, 19 bp, Homo sapiens
gaaattttatatgcttact

SEQ ID NO: 4454943 - DNA, 16 bp, Homo sapiens
gaaattttatatgtaa

SEQ ID NO: 4454944 - DNA, 19 bp, Homo sapiens
gaaattttatatgtaaatg

SEQ ID NO: 4454945 - DNA, 23 bp, Homo sapiens
gaaattttatatgtaaatgtgtt

SEQ ID NO: 4454946 - DNA, 20 bp, Homo sapiens
gaaattttcttgatttgagt

SEQ ID NO: 4454947 - DNA, 13 bp, Homo sapiens
gaaattttgtaag

SEQ ID NO: 4454948 - DNA, 20 bp, Homo sapiens
gaaattttgtaagaaggcaa

SEQ ID NO: 4454949 - DNA, 19 bp, Homo sapiens
gaaatttttacctttatct

SEQ ID NO: 4454950 - DNA, 13 bp, Homo sapiens
gaaatttttgtaa

SEQ ID NO: 4454951 - DNA, 15 bp, Homo sapiens
gaaattttttagtat

SEQ ID NO: 4454952 - DNA, 14 bp, Homo sapiens
gaacaaaattattt

SEQ ID NO: 4454953 - DNA, 12 bp, Homo sapiens
gaacaaagacaa

SEQ ID NO: 4454954 - DNA, 13 bp, Homo sapiens
gaacaaagacaac

SEQ ID NO: 4454955 - DNA, 13 bp, Homo sapiens
gaacaaagacatt

SEQ ID NO: 4454956 - DNA, 16 bp, Homo sapiens
gaacaaattttctggt

SEQ ID NO: 4454957 - DNA, 15 bp, Homo sapiens
gaacaacaaagacat

SEQ ID NO: 4454958 - DNA, 15 bp, Homo sapiens
gaacaacttgtagca

SEQ ID NO: 4454959 - DNA, 13 bp, Homo sapiens
gaacaagaaatgg

SEQ ID NO: 4454960 - DNA, 20 bp, Homo sapiens
gaacaaggaaggaaagatgt

SEQ ID NO: 4454961 - DNA, 19 bp, Homo sapiens
gaacacaaactgtaaataa

SEQ ID NO: 4454962 - DNA, 15 bp, Homo sapiens
gaacacagtattttc

SEQ ID NO: 4454963 - DNA, 19 bp, Homo sapiens
gaacaccattgaaggctta

SEQ ID NO: 4454964 - DNA, 23 bp, Homo sapiens
gaacacctgatcttacagaaaat

SEQ ID NO: 4454965 - DNA, 22 bp, Homo sapiens
gaacacctgccttctaccctct

SEQ ID NO: 4454966 - DNA, 22 bp, Homo sapiens
gaacactaacctgaccgtgggc

SEQ ID NO: 4454967 - DNA, 16 bp, Homo sapiens
gaacactattttcaga

SEQ ID NO: 4454968 - DNA, 18 bp, Homo sapiens
gaacactattttcagaat

SEQ ID NO: 4454969 - DNA, 23 bp, Homo sapiens
gaacagaacatagacagaagaaa

SEQ ID NO: 4454970 - DNA, 15 bp, Homo sapiens
gaacagacaggagaa

SEQ ID NO: 4454971 - DNA, 18 bp, Homo sapiens
gaacagacaggagaaatg

SEQ ID NO: 4454972 - DNA, 17 bp, Homo sapiens
gaacagatttcaaaaaa

SEQ ID NO: 4454973 - DNA, 23 bp, Homo sapiens
gaacagccagttttactgtgatt

SEQ ID NO: 4454974 - DNA, 24 bp, Homo sapiens
gaacagccctcggcctccgaggct

SEQ ID NO: 4454975 - DNA, 15 bp, Homo sapiens
gaacagccctctctc

SEQ ID NO: 4454976 - DNA, 20 bp, Homo sapiens
gaacagccctctctctcact

SEQ ID NO: 4454977 - DNA, 21 bp, Homo sapiens
gaacagctatgggagccccag

SEQ ID NO: 4454978 - DNA, 22 bp, Homo sapiens
gaacagctatgggagccccagg

SEQ ID NO: 4454979 - DNA, 16 bp, Homo sapiens
gaacagctttgtatgt

SEQ ID NO: 4454980 - DNA, 21 bp, Homo sapiens
gaacagctttgtatgtttatg

SEQ ID NO: 4454981 - DNA, 20 bp, Homo sapiens
gaacaggtcccacgccaggc

SEQ ID NO: 4454982 - DNA, 19 bp, Homo sapiens
gaacaggttcttaaaaagg

SEQ ID NO: 4454983 - DNA, 17 bp, Homo sapiens
gaacagtgcatgtgcat

SEQ ID NO: 4454984 - DNA, 21 bp, Homo sapiens
gaacagtggtggcaacattca

SEQ ID NO: 4454985 - DNA, 14 bp, Homo sapiens
gaacataaaaagga

SEQ ID NO: 4454986 - DNA, 14 bp, Homo sapiens
gaacatacatgata

SEQ ID NO: 4454987 - DNA, 16 bp, Homo sapiens
gaacatagacagaaga

SEQ ID NO: 4454988 - DNA, 12 bp, Homo sapiens
gaacatattgtt

SEQ ID NO: 4454989 - DNA, 20 bp, Homo sapiens
gaacatccaagtctttcttc

SEQ ID NO: 4454990 - DNA, 17 bp, Homo sapiens
gaacatccctttttcaa

SEQ ID NO: 4454991 - DNA, 22 bp, Homo sapiens
gaacatgcagtttgaaattctg

SEQ ID NO: 4454992 - DNA, 17 bp, Homo sapiens
gaacatggagctgtcat

SEQ ID NO: 4454993 - DNA, 19 bp, Homo sapiens
gaacatgtgagaggtttga

SEQ ID NO: 4454994 - DNA, 15 bp, Homo sapiens
gaacattcacttttg

SEQ ID NO: 4454995 - DNA, 18 bp, Homo sapiens
gaacattgatctgtttta

SEQ ID NO: 4454996 - DNA, 14 bp, Homo sapiens
gaacattgtactgt

SEQ ID NO: 4454997 - DNA, 15 bp, Homo sapiens
gaacattgtactgtt

SEQ ID NO: 4454998 - DNA, 16 bp, Homo sapiens
gaaccaaaaatagaaa

SEQ ID NO: 4454999 - DNA, 19 bp, Homo sapiens
gaaccaaaaatagaaatta

SEQ ID NO: 4455000 - DNA, 15 bp, Homo sapiens
gaaccaaatacctca

SEQ ID NO: 4455001 - DNA, 19 bp, Homo sapiens
gaaccaacccccatctccc

SEQ ID NO: 4455002 - DNA, 19 bp, Homo sapiens
gaaccactacatgcagccc

SEQ ID NO: 4455003 - DNA, 21 bp, Homo sapiens
gaaccactgtgtactggagcc

SEQ ID NO: 4455004 - DNA, 19 bp, Homo sapiens
gaaccagcactaaggtgga

SEQ ID NO: 4455005 - DNA, 16 bp, Homo sapiens
gaaccagccgtatttt

SEQ ID NO: 4455006 - DNA, 18 bp, Homo sapiens
gaaccagggctcttctca

SEQ ID NO: 4455007 - DNA, 21 bp, Homo sapiens
gaaccatgttggttgcacttt

SEQ ID NO: 4455008 - DNA, 23 bp, Homo sapiens
gaaccattatactttatatctgt

SEQ ID NO: 4455009 - DNA, 16 bp, Homo sapiens
gaacccaagtccaagc

SEQ ID NO: 4455010 - DNA, 17 bp, Homo sapiens
gaacccaagtccaagca

SEQ ID NO: 4455011 - DNA, 12 bp, Homo sapiens
gaacccacctgc

SEQ ID NO: 4455012 - DNA, 15 bp, Homo sapiens
gaacccacctgctga

SEQ ID NO: 4455013 - DNA, 17 bp, Homo sapiens
gaacccgggaggcagag

SEQ ID NO: 4455014 - DNA, 18 bp, Homo sapiens
gaacccgggggacagagg

SEQ ID NO: 4455015 - DNA, 22 bp, Homo sapiens
gaaccctagaaatatatcctgt

SEQ ID NO: 4455016 - DNA, 20 bp, Homo sapiens
gaaccctatacttggtttgc

SEQ ID NO: 4455017 - DNA, 22 bp, Homo sapiens
gaacccttgcatccattgttgt

SEQ ID NO: 4455018 - DNA, 12 bp, Homo sapiens
gaaccctttgtt

SEQ ID NO: 4455019 - DNA, 20 bp, Homo sapiens
gaaccgagggggctgctccc

SEQ ID NO: 4455020 - DNA, 20 bp, Homo sapiens
gaacctaatgcactctgggt

SEQ ID NO: 4455021 - DNA, 21 bp, Homo sapiens
gaacctacagactccatctct

SEQ ID NO: 4455022 - DNA, 18 bp, Homo sapiens
gaacctacctgccttgga

SEQ ID NO: 4455023 - DNA, 15 bp, Homo sapiens
gaacctcagattctt

SEQ ID NO: 4455024 - DNA, 15 bp, Homo sapiens
gaacctcgagtactg

SEQ ID NO: 4455025 - DNA, 16 bp, Homo sapiens
gaacctcgagtactgt

SEQ ID NO: 4455026 - DNA, 17 bp, Homo sapiens
gaacctcgagtactgtg

SEQ ID NO: 4455027 - DNA, 12 bp, Homo sapiens
gaacctgagcta

SEQ ID NO: 4455028 - DNA, 23 bp, Homo sapiens
gaacctgagttcccgggagctgg

SEQ ID NO: 4455029 - DNA, 13 bp, Homo sapiens
gaacctgcaagcc

SEQ ID NO: 4455030 - DNA, 20 bp, Homo sapiens
gaacctgcaagccttctaaa

SEQ ID NO: 4455031 - DNA, 23 bp, Homo sapiens
gaacctggaagatcatggacctg

SEQ ID NO: 4455032 - DNA, 12 bp, Homo sapiens
gaacctggagag

SEQ ID NO: 4455033 - DNA, 17 bp, Homo sapiens
gaacctggaggggctag

SEQ ID NO: 4455034 - DNA, 17 bp, Homo sapiens
gaacctggatccagcac

SEQ ID NO: 4455035 - DNA, 14 bp, Homo sapiens
gaaccttaatgaca

SEQ ID NO: 4455036 - DNA, 10 bp, Homo sapiens
gaaccttccc

SEQ ID NO: 4455037 - DNA, 19 bp, Homo sapiens
gaacgaggtttatattttc

SEQ ID NO: 4455038 - DNA, 13 bp, Homo sapiens
gaacgcaccccac

SEQ ID NO: 4455039 - DNA, 15 bp, Homo sapiens
gaacgcaccccactg

SEQ ID NO: 4455040 - DNA, 15 bp, Homo sapiens
gaacggaggaggaca

SEQ ID NO: 4455041 - DNA, 22 bp, Homo sapiens
gaacggggctcttctcatttca

SEQ ID NO: 4455042 - DNA, 13 bp, Homo sapiens
gaacgtgcatcct

SEQ ID NO: 4455043 - DNA, 23 bp, Homo sapiens
gaactaaactagtttttcctatc

SEQ ID NO: 4455044 - DNA, 15 bp, Homo sapiens
gaactaaagctggag

SEQ ID NO: 4455045 - DNA, 20 bp, Homo sapiens
gaactaaggactccaatgtc

SEQ ID NO: 4455046 - DNA, 19 bp, Homo sapiens
gaactaccttggttccccc

SEQ ID NO: 4455047 - DNA, 18 bp, Homo sapiens
gaactagccaaaccagga

SEQ ID NO: 4455048 - DNA, 15 bp, Homo sapiens
gaactaggctgagca

SEQ ID NO: 4455049 - DNA, 17 bp, Homo sapiens
gaactcaccctgggagc

SEQ ID NO: 4455050 - DNA, 22 bp, Homo sapiens
gaactcaccctgggagccagtc

SEQ ID NO: 4455051 - DNA, 20 bp, Homo sapiens
gaactcagcacattcgggac

SEQ ID NO: 4455052 - DNA, 19 bp, Homo sapiens
gaactcatcccttgtttat

SEQ ID NO: 4455053 - DNA, 18 bp, Homo sapiens
gaactccatacagaaaac

SEQ ID NO: 4455054 - DNA, 15 bp, Homo sapiens
gaactcctgacctca

SEQ ID NO: 4455055 - DNA, 12 bp, Homo sapiens
gaactcctgcca

SEQ ID NO: 4455056 - DNA, 18 bp, Homo sapiens
gaactctggtggcacagg

SEQ ID NO: 4455057 - DNA, 23 bp, Homo sapiens
gaactgagccccagcgggctggc

SEQ ID NO: 4455058 - DNA, 22 bp, Homo sapiens
gaactgaggagatgaccaggga

SEQ ID NO: 4455059 - DNA, 18 bp, Homo sapiens
gaactgcagacctgtcct

SEQ ID NO: 4455060 - DNA, 19 bp, Homo sapiens
gaactgcccttgctgcccg

SEQ ID NO: 4455061 - DNA, 22 bp, Homo sapiens
gaactgctagtcaagtgcgtcc

SEQ ID NO: 4455062 - DNA, 16 bp, Homo sapiens
gaactggaagaaagca

SEQ ID NO: 4455063 - DNA, 17 bp, Homo sapiens
gaactggaagaaagcaa

SEQ ID NO: 4455064 - DNA, 14 bp, Homo sapiens
gaactgggctgggc

SEQ ID NO: 4455065 - DNA, 16 bp, Homo sapiens
gaactgtacattgtga

SEQ ID NO: 4455066 - DNA, 12 bp, Homo sapiens
gaactgtcccag

SEQ ID NO: 4455067 - DNA, 17 bp, Homo sapiens
gaactgtctgtgaacag

SEQ ID NO: 4455068 - DNA, 17 bp, Homo sapiens
gaactgtgtatttattt

SEQ ID NO: 4455069 - DNA, 19 bp, Homo sapiens
gaactgtgtatttatttaa

SEQ ID NO: 4455070 - DNA, 14 bp, Homo sapiens
gaactgtgtttcaa

SEQ ID NO: 4455071 - DNA, 19 bp, Homo sapiens
gaactgttgcctaattgga

SEQ ID NO: 4455072 - DNA, 22 bp, Homo sapiens
gaacttagccatttttcaaagc

SEQ ID NO: 4455073 - DNA, 13 bp, Homo sapiens
gaacttataatga

SEQ ID NO: 4455074 - DNA, 16 bp, Homo sapiens
gaacttatgtacagaa

SEQ ID NO: 4455075 - DNA, 15 bp, Homo sapiens
gaacttctgcctcta

SEQ ID NO: 4455076 - DNA, 19 bp, Homo sapiens
gaacttgcgagtccaaggc

SEQ ID NO: 4455077 - DNA, 14 bp, Homo sapiens
gaactttgaaggac

SEQ ID NO: 4455078 - DNA, 16 bp, Homo sapiens
gaacttttgtactgaa

SEQ ID NO: 4455079 - DNA, 20 bp, Homo sapiens
gaacttttgtactgaatttt

SEQ ID NO: 4455080 - DNA, 21 bp, Homo sapiens
gaacttttgtactgaattttt

SEQ ID NO: 4455081 - DNA, 17 bp, Homo sapiens
gaagaaactcagattta

SEQ ID NO: 4455082 - DNA, 12 bp, Homo sapiens
gaagaaagcctg

SEQ ID NO: 4455083 - DNA, 12 bp, Homo sapiens
gaagaaaggcca

SEQ ID NO: 4455084 - DNA, 16 bp, Homo sapiens
gaagaaatgtcagatg

SEQ ID NO: 4455085 - DNA, 22 bp, Homo sapiens
gaagaacggggctcttctcatt

SEQ ID NO: 4455086 - DNA, 22 bp, Homo sapiens
gaagaacgttttttcctcagtg

SEQ ID NO: 4455087 - DNA, 19 bp, Homo sapiens
gaagaactcaccagggttt

SEQ ID NO: 4455088 - DNA, 17 bp, Homo sapiens
gaagaagggagaagaaa

SEQ ID NO: 4455089 - DNA, 18 bp, Homo sapiens
gaagaagggagaagaaag

SEQ ID NO: 4455090 - DNA, 13 bp, Homo sapiens
gaagaagtggctg

SEQ ID NO: 4455091 - DNA, 13 bp, Homo sapiens
gaagaagtgtgtc

SEQ ID NO: 4455092 - DNA, 15 bp, Homo sapiens
gaagaataaattcta

SEQ ID NO: 4455093 - DNA, 23 bp, Homo sapiens
gaagaatacttctcattttttaa

SEQ ID NO: 4455094 - DNA, 14 bp, Homo sapiens
gaagaatattgtat

SEQ ID NO: 4455095 - DNA, 21 bp, Homo sapiens
gaagaatctcatctcagtgaa

SEQ ID NO: 4455096 - DNA, 18 bp, Homo sapiens
gaagaattgaacccagga

SEQ ID NO: 4455097 - DNA, 19 bp, Homo sapiens
gaagaattgaacccaggag

SEQ ID NO: 4455098 - DNA, 13 bp, Homo sapiens
gaagaatttgaag

SEQ ID NO: 4455099 - DNA, 20 bp, Homo sapiens
gaagacaacagaaagaggga

SEQ ID NO: 4455100 - DNA, 20 bp, Homo sapiens
gaagacattttgttacataa

SEQ ID NO: 4455101 - DNA, 21 bp, Homo sapiens
gaagactcaggagtctgccac

SEQ ID NO: 4455102 - DNA, 12 bp, Homo sapiens
gaagactgctcc

SEQ ID NO: 4455103 - DNA, 14 bp, Homo sapiens
gaagagaagacaaa

SEQ ID NO: 4455104 - DNA, 18 bp, Homo sapiens
gaagagcaggactccagg

SEQ ID NO: 4455105 - DNA, 22 bp, Homo sapiens
gaagagcaggactccaggccca

SEQ ID NO: 4455106 - DNA, 23 bp, Homo sapiens
gaagagcaggactccaggcccaa

SEQ ID NO: 4455107 - DNA, 17 bp, Homo sapiens
gaagagccacctgcaag

SEQ ID NO: 4455108 - DNA, 20 bp, Homo sapiens
gaagagccacctgcaagatg

SEQ ID NO: 4455109 - DNA, 18 bp, Homo sapiens
gaagagccatcttggcag

SEQ ID NO: 4455110 - DNA, 20 bp, Homo sapiens
gaagagccatcttggcaggg

SEQ ID NO: 4455111 - DNA, 22 bp, Homo sapiens
gaagagcgagagatcaaagatg

SEQ ID NO: 4455112 - DNA, 17 bp, Homo sapiens
gaagagctattatataa

SEQ ID NO: 4455113 - DNA, 15 bp, Homo sapiens
gaagagctgttcaca

SEQ ID NO: 4455114 - DNA, 16 bp, Homo sapiens
gaagaggaccagagga

SEQ ID NO: 4455115 - DNA, 19 bp, Homo sapiens
gaagaggaccagaggagca

SEQ ID NO: 4455116 - DNA, 20 bp, Homo sapiens
gaagagggaaaacagaaaac

SEQ ID NO: 4455117 - DNA, 16 bp, Homo sapiens
gaagagggcccagccc

SEQ ID NO: 4455118 - DNA, 23 bp, Homo sapiens
gaagagtcattttcacttttaaa

SEQ ID NO: 4455119 - DNA, 17 bp, Homo sapiens
gaagagtctattgtctc

SEQ ID NO: 4455120 - DNA, 23 bp, Homo sapiens
gaagagttgaggaactgtacaga

SEQ ID NO: 4455121 - DNA, 16 bp, Homo sapiens
gaagatagctgtgact

SEQ ID NO: 4455122 - DNA, 21 bp, Homo sapiens
gaagatagtcttggaagctgt

SEQ ID NO: 4455123 - DNA, 13 bp, Homo sapiens
gaagatattattt

SEQ ID NO: 4455124 - DNA, 13 bp, Homo sapiens
gaagatccccaac

SEQ ID NO: 4455125 - DNA, 15 bp, Homo sapiens
gaagatcccctcagg

SEQ ID NO: 4455126 - DNA, 14 bp, Homo sapiens
gaagatgaaatata

SEQ ID NO: 4455127 - DNA, 13 bp, Homo sapiens
gaagatggagggg

SEQ ID NO: 4455128 - DNA, 19 bp, Homo sapiens
gaagatgggaggtggaagc

SEQ ID NO: 4455129 - DNA, 17 bp, Homo sapiens
gaagattctcgcccctt

SEQ ID NO: 4455130 - DNA, 20 bp, Homo sapiens
gaagcaacctcagtaattta

SEQ ID NO: 4455131 - DNA, 13 bp, Homo sapiens
gaagcaagacgta

SEQ ID NO: 4455132 - DNA, 14 bp, Homo sapiens
gaagcaagccagac

SEQ ID NO: 4455133 - DNA, 17 bp, Homo sapiens
gaagcaagccagaccta

SEQ ID NO: 4455134 - DNA, 19 bp, Homo sapiens
gaagcaatctttgaaataa

SEQ ID NO: 4455135 - DNA, 15 bp, Homo sapiens
gaagcacaactccct

SEQ ID NO: 4455136 - DNA, 16 bp, Homo sapiens
gaagcaccccatgcca

SEQ ID NO: 4455137 - DNA, 19 bp, Homo sapiens
gaagcacttctgctgcatc

SEQ ID NO: 4455138 - DNA, 20 bp, Homo sapiens
gaagcagaggccctgccccc

SEQ ID NO: 4455139 - DNA, 15 bp, Homo sapiens
gaagcagtcttgctc

SEQ ID NO: 4455140 - DNA, 15 bp, Homo sapiens
gaagcagtgagccgc

SEQ ID NO: 4455141 - DNA, 16 bp, Homo sapiens
gaagcagtgagccgca

SEQ ID NO: 4455142 - DNA, 14 bp, Homo sapiens
gaagcagtggcctt

SEQ ID NO: 4455143 - DNA, 21 bp, Homo sapiens
gaagcatagctacaatttgtt

SEQ ID NO: 4455144 - DNA, 22 bp, Homo sapiens
gaagcatgaataacatttaaat

SEQ ID NO: 4455145 - DNA, 13 bp, Homo sapiens
gaagcattgtaaa

SEQ ID NO: 4455146 - DNA, 20 bp, Homo sapiens
gaagcattgtaaaataattc

SEQ ID NO: 4455147 - DNA, 13 bp, Homo sapiens
gaagccaaagaaa

SEQ ID NO: 4455148 - DNA, 19 bp, Homo sapiens
gaagccaagggaaaggggt

SEQ ID NO: 4455149 - DNA, 19 bp, Homo sapiens
gaagccaagtggggtgctg

SEQ ID NO: 4455150 - DNA, 22 bp, Homo sapiens
gaagccaagtggggtgctggga

SEQ ID NO: 4455151 - DNA, 18 bp, Homo sapiens
gaagccacaggcctgaga

SEQ ID NO: 4455152 - DNA, 17 bp, Homo sapiens
gaagccacgctgtcctc

SEQ ID NO: 4455153 - DNA, 20 bp, Homo sapiens
gaagccacgggtgccagaag

SEQ ID NO: 4455154 - DNA, 13 bp, Homo sapiens
gaagccagagccc

SEQ ID NO: 4455155 - DNA, 18 bp, Homo sapiens
gaagccagagccccaagc

SEQ ID NO: 4455156 - DNA, 21 bp, Homo sapiens
gaagccatatatgaccagaag

SEQ ID NO: 4455157 - DNA, 23 bp, Homo sapiens
gaagccatatatgaccagaagcc

SEQ ID NO: 4455158 - DNA, 22 bp, Homo sapiens
gaagccatcacttctccccgca

SEQ ID NO: 4455159 - DNA, 23 bp, Homo sapiens
gaagccatgagttccagaaagta

SEQ ID NO: 4455160 - DNA, 18 bp, Homo sapiens
gaagcccctgggcccagt

SEQ ID NO: 4455161 - DNA, 17 bp, Homo sapiens
gaagccccttccccatg

SEQ ID NO: 4455162 - DNA, 19 bp, Homo sapiens
gaagccctccttccacgga

SEQ ID NO: 4455163 - DNA, 11 bp, Homo sapiens
gaagccctgga

SEQ ID NO: 4455164 - DNA, 22 bp, Homo sapiens
gaagccctggatttcagaaaga

SEQ ID NO: 4455165 - DNA, 19 bp, Homo sapiens
gaagcctccaagcacagag

SEQ ID NO: 4455166 - DNA, 21 bp, Homo sapiens
gaagcctccaagcacagagcc

SEQ ID NO: 4455167 - DNA, 20 bp, Homo sapiens
gaagcctccaagcctgcctc

SEQ ID NO: 4455168 - DNA, 20 bp, Homo sapiens
gaagccttggaaccagcccc

SEQ ID NO: 4455169 - DNA, 16 bp, Homo sapiens
gaagctaatttgcatt

SEQ ID NO: 4455170 - DNA, 19 bp, Homo sapiens
gaagctactattttggaaa

SEQ ID NO: 4455171 - DNA, 20 bp, Homo sapiens
gaagctactgtgtgtgtgaa

SEQ ID NO: 4455172 - DNA, 22 bp, Homo sapiens
gaagctactgtgtgtgtgaatg

SEQ ID NO: 4455173 - DNA, 18 bp, Homo sapiens
gaagctagacacatgaag

SEQ ID NO: 4455174 - DNA, 22 bp, Homo sapiens
gaagctagacacatgaaggtaa

SEQ ID NO: 4455175 - DNA, 16 bp, Homo sapiens
gaagctcacacatcct

SEQ ID NO: 4455176 - DNA, 19 bp, Homo sapiens
gaagctcacacatcctgtc

SEQ ID NO: 4455177 - DNA, 20 bp, Homo sapiens
gaagctcacacatcctgtca

SEQ ID NO: 4455178 - DNA, 23 bp, Homo sapiens
gaagctcacacatcctgtcagtg

SEQ ID NO: 4455179 - DNA, 20 bp, Homo sapiens
gaagctcatatccttttgaa

SEQ ID NO: 4455180 - DNA, 17 bp, Homo sapiens
gaagctgagggcaaatc

SEQ ID NO: 4455181 - DNA, 10 bp, Homo sapiens
gaagctgctg

SEQ ID NO: 4455182 - DNA, 15 bp, Homo sapiens
gaagctgctgtgtcc

SEQ ID NO: 4455183 - DNA, 23 bp, Homo sapiens
gaagctggccgagggtcctggct

SEQ ID NO: 4455184 - DNA, 15 bp, Homo sapiens
gaagctggctttgaa

SEQ ID NO: 4455185 - DNA, 23 bp, Homo sapiens
gaagctggctttgaaacctcagg

SEQ ID NO: 4455186 - DNA, 23 bp, Homo sapiens
gaagctgtgtccttgcacctgca

SEQ ID NO: 4455187 - DNA, 13 bp, Homo sapiens
gaagcttcagcag

SEQ ID NO: 4455188 - DNA, 17 bp, Homo sapiens
gaaggaaataaaaaagt

SEQ ID NO: 4455189 - DNA, 23 bp, Homo sapiens
gaaggaaataaaaaagtctctat

SEQ ID NO: 4455190 - DNA, 15 bp, Homo sapiens
gaaggaaataaacat

SEQ ID NO: 4455191 - DNA, 23 bp, Homo sapiens
gaaggaacttgtctcttcatcta

SEQ ID NO: 4455192 - DNA, 18 bp, Homo sapiens
gaaggaagtgtgtttgcc

SEQ ID NO: 4455193 - DNA, 15 bp, Homo sapiens
gaaggacagtccctg

SEQ ID NO: 4455194 - DNA, 17 bp, Homo sapiens
gaaggagaaggaaggag

SEQ ID NO: 4455195 - DNA, 21 bp, Homo sapiens
gaaggagatgagtgggcttcg

SEQ ID NO: 4455196 - DNA, 22 bp, Homo sapiens
gaaggagccccattcctgggaa

SEQ ID NO: 4455197 - DNA, 12 bp, Homo sapiens
gaaggagggatg

SEQ ID NO: 4455198 - DNA, 21 bp, Homo sapiens
gaaggagggatgcgtgttcca

SEQ ID NO: 4455199 - DNA, 23 bp, Homo sapiens
gaaggaggggagagacaggcagc

SEQ ID NO: 4455200 - DNA, 20 bp, Homo sapiens
gaaggcaaagtttacagatg

SEQ ID NO: 4455201 - DNA, 17 bp, Homo sapiens
gaaggcaagagggggtg

SEQ ID NO: 4455202 - DNA, 21 bp, Homo sapiens
gaaggcaatgctcacctcttc

SEQ ID NO: 4455203 - DNA, 12 bp, Homo sapiens
gaaggcacagct

SEQ ID NO: 4455204 - DNA, 14 bp, Homo sapiens
gaaggcagagaaat

SEQ ID NO: 4455205 - DNA, 16 bp, Homo sapiens
gaaggcagccaccagc

SEQ ID NO: 4455206 - DNA, 17 bp, Homo sapiens
gaaggcatttgcagggt

SEQ ID NO: 4455207 - DNA, 22 bp, Homo sapiens
gaaggcccaactggttcaggct

SEQ ID NO: 4455208 - DNA, 22 bp, Homo sapiens
gaaggccccagagagaccctgc

SEQ ID NO: 4455209 - DNA, 18 bp, Homo sapiens
gaaggcctcttggagacc

SEQ ID NO: 4455210 - DNA, 16 bp, Homo sapiens
gaaggctaaaaagcaa

SEQ ID NO: 4455211 - DNA, 15 bp, Homo sapiens
gaagggaagagacag

SEQ ID NO: 4455212 - DNA, 23 bp, Homo sapiens
gaagggaattgctcagagaagga

SEQ ID NO: 4455213 - DNA, 16 bp, Homo sapiens
gaagggagaagaaagg

SEQ ID NO: 4455214 - DNA, 23 bp, Homo sapiens
gaagggcaggaaggagagcctgc

SEQ ID NO: 4455215 - DNA, 19 bp, Homo sapiens
gaagggccagtcctgcctg

SEQ ID NO: 4455216 - DNA, 12 bp, Homo sapiens
gaagggctgggc

SEQ ID NO: 4455217 - DNA, 16 bp, Homo sapiens
gaagggtcctgccggt

SEQ ID NO: 4455218 - DNA, 22 bp, Homo sapiens
gaagggtggatgtgctggaggg

SEQ ID NO: 4455219 - DNA, 18 bp, Homo sapiens
gaagggtgggagtggggc

SEQ ID NO: 4455220 - DNA, 13 bp, Homo sapiens
gaagggtttctct

SEQ ID NO: 4455221 - DNA, 14 bp, Homo sapiens
gaagggtttctcta

SEQ ID NO: 4455222 - DNA, 20 bp, Homo sapiens
gaaggtagaatgttttcaaa

SEQ ID NO: 4455223 - DNA, 19 bp, Homo sapiens
gaaggtagcattctttgga

SEQ ID NO: 4455224 - DNA, 14 bp, Homo sapiens
gaaggtcaccagca

SEQ ID NO: 4455225 - DNA, 21 bp, Homo sapiens
gaaggtccttgcctgaactcc

SEQ ID NO: 4455226 - DNA, 23 bp, Homo sapiens
gaaggtccttgcctgaactccag

SEQ ID NO: 4455227 - DNA, 21 bp, Homo sapiens
gaaggtgatttaagggcccag

SEQ ID NO: 4455228 - DNA, 20 bp, Homo sapiens
gaaggtggaagttgcagtga

SEQ ID NO: 4455229 - DNA, 23 bp, Homo sapiens
gaaggtggccacagcaagtacag

SEQ ID NO: 4455230 - DNA, 17 bp, Homo sapiens
gaaggtttcagatgagg

SEQ ID NO: 4455231 - DNA, 15 bp, Homo sapiens
gaagtaaagccatta

SEQ ID NO: 4455232 - DNA, 19 bp, Homo sapiens
gaagtaaagccattaaatg

SEQ ID NO: 4455233 - DNA, 16 bp, Homo sapiens
gaagtaagcctcatca

SEQ ID NO: 4455234 - DNA, 13 bp, Homo sapiens
gaagtaatgaatt

SEQ ID NO: 4455235 - DNA, 19 bp, Homo sapiens
gaagtaattaaggtacatc

SEQ ID NO: 4455236 - DNA, 13 bp, Homo sapiens
gaagtacaaacat

SEQ ID NO: 4455237 - DNA, 14 bp, Homo sapiens
gaagtagctagtag

SEQ ID NO: 4455238 - DNA, 13 bp, Homo sapiens
gaagtaggaagta

SEQ ID NO: 4455239 - DNA, 14 bp, Homo sapiens
gaagtatccttcag

SEQ ID NO: 4455240 - DNA, 20 bp, Homo sapiens
gaagtcaaaatatgtaagaa

SEQ ID NO: 4455241 - DNA, 15 bp, Homo sapiens
gaagtcaaagcaagg

SEQ ID NO: 4455242 - DNA, 16 bp, Homo sapiens
gaagtcaaagcaagga

SEQ ID NO: 4455243 - DNA, 22 bp, Homo sapiens
gaagtcaataggcctatttatt

SEQ ID NO: 4455244 - DNA, 13 bp, Homo sapiens
gaagtcagtacga

SEQ ID NO: 4455245 - DNA, 19 bp, Homo sapiens
gaagtcagtacgatcaagt

SEQ ID NO: 4455246 - DNA, 18 bp, Homo sapiens
gaagtcatcttgctacca

SEQ ID NO: 4455247 - DNA, 17 bp, Homo sapiens
gaagtccaatgtggcaa

SEQ ID NO: 4455248 - DNA, 15 bp, Homo sapiens
gaagtccacaggacg

SEQ ID NO: 4455249 - DNA, 23 bp, Homo sapiens
gaagtccttcagtgagcccctcc

SEQ ID NO: 4455250 - DNA, 22 bp, Homo sapiens
gaagtcggaatgtcatagtctt

SEQ ID NO: 4455251 - DNA, 15 bp, Homo sapiens
gaagtctagaatcat

SEQ ID NO: 4455252 - DNA, 14 bp, Homo sapiens
gaagtgcagagctt

SEQ ID NO: 4455253 - DNA, 21 bp, Homo sapiens
gaagtgctgccgcgcagtgtg

SEQ ID NO: 4455254 - DNA, 18 bp, Homo sapiens
gaagtgctgtttattaat

SEQ ID NO: 4455255 - DNA, 16 bp, Homo sapiens
gaagtggaccaggaca

SEQ ID NO: 4455256 - DNA, 18 bp, Homo sapiens
gaagtggaccaggacagg

SEQ ID NO: 4455257 - DNA, 21 bp, Homo sapiens
gaagtggctcagacccctcag

SEQ ID NO: 4455258 - DNA, 23 bp, Homo sapiens
gaagtggctgccacacccagggg

SEQ ID NO: 4455259 - DNA, 17 bp, Homo sapiens
gaagtgtggctggtgtc

SEQ ID NO: 4455260 - DNA, 21 bp, Homo sapiens
gaagtgtgggtctgtgtgtgt

SEQ ID NO: 4455261 - DNA, 18 bp, Homo sapiens
gaagtgtgtgccaagagc

SEQ ID NO: 4455262 - DNA, 13 bp, Homo sapiens
gaagtgtgtttgc

SEQ ID NO: 4455263 - DNA, 11 bp, Homo sapiens
gaagtgttaat

SEQ ID NO: 4455264 - DNA, 19 bp, Homo sapiens
gaagttagctttaacttaa

SEQ ID NO: 4455265 - DNA, 15 bp, Homo sapiens
gaagttagtttgtat

SEQ ID NO: 4455266 - DNA, 16 bp, Homo sapiens
gaagttagtttgtata

SEQ ID NO: 4455267 - DNA, 17 bp, Homo sapiens
gaagttagtttgtatat

SEQ ID NO: 4455268 - DNA, 21 bp, Homo sapiens
gaagttattttctacagtggt

SEQ ID NO: 4455269 - DNA, 21 bp, Homo sapiens
gaagttgacttatagtacatg

SEQ ID NO: 4455270 - DNA, 23 bp, Homo sapiens
gaagtttcctatgactaattcac

SEQ ID NO: 4455271 - DNA, 22 bp, Homo sapiens
gaagttttaactttaatacagc

SEQ ID NO: 4455272 - DNA, 18 bp, Homo sapiens
gaataaaaattgatgaga

SEQ ID NO: 4455273 - DNA, 15 bp, Homo sapiens
gaataaagaatactt

SEQ ID NO: 4455274 - DNA, 13 bp, Homo sapiens
gaataaagcaatt

SEQ ID NO: 4455275 - DNA, 20 bp, Homo sapiens
gaataaaggcagttttctaa

SEQ ID NO: 4455276 - DNA, 14 bp, Homo sapiens
gaataaagttgcag

SEQ ID NO: 4455277 - DNA, 12 bp, Homo sapiens
gaataaatgaag

SEQ ID NO: 4455278 - DNA, 12 bp, Homo sapiens
gaataaatgttc

SEQ ID NO: 4455279 - DNA, 21 bp, Homo sapiens
gaataaattatggcatttcta

SEQ ID NO: 4455280 - DNA, 22 bp, Homo sapiens
gaataaattatggcatttctat

SEQ ID NO: 4455281 - DNA, 23 bp, Homo sapiens
gaataaattatggcatttctatt

SEQ ID NO: 4455282 - DNA, 16 bp, Homo sapiens
gaataaattgattttt

SEQ ID NO: 4455283 - DNA, 18 bp, Homo sapiens
gaataaattttcaaatcc

SEQ ID NO: 4455284 - DNA, 17 bp, Homo sapiens
gaataaggtacaagaag

SEQ ID NO: 4455285 - DNA, 20 bp, Homo sapiens
gaataaggtacaagaagcat

SEQ ID NO: 4455286 - DNA, 23 bp, Homo sapiens
gaataaggtacaagaagcatttt

SEQ ID NO: 4455287 - DNA, 19 bp, Homo sapiens
gaataagttattgcagttt

SEQ ID NO: 4455288 - DNA, 14 bp, Homo sapiens
gaataataaaatca

SEQ ID NO: 4455289 - DNA, 23 bp, Homo sapiens
gaataataagcaggatgttggcc

SEQ ID NO: 4455290 - DNA, 20 bp, Homo sapiens
gaataatacatactaatgaa

SEQ ID NO: 4455291 - DNA, 20 bp, Homo sapiens
gaataatcacgctttcctga

SEQ ID NO: 4455292 - DNA, 16 bp, Homo sapiens
gaatacacttacagtt

SEQ ID NO: 4455293 - DNA, 21 bp, Homo sapiens
gaataccccaagactcccatg

SEQ ID NO: 4455294 - DNA, 15 bp, Homo sapiens
gaatagaaagaaagt

SEQ ID NO: 4455295 - DNA, 14 bp, Homo sapiens
gaatagaggaagaa

SEQ ID NO: 4455296 - DNA, 16 bp, Homo sapiens
gaatagatatgaaagc

SEQ ID NO: 4455297 - DNA, 15 bp, Homo sapiens
gaatagccacatttg

SEQ ID NO: 4455298 - DNA, 22 bp, Homo sapiens
gaatagcctggccaccagccat

SEQ ID NO: 4455299 - DNA, 16 bp, Homo sapiens
gaatagtaaactaaag

SEQ ID NO: 4455300 - DNA, 13 bp, Homo sapiens
gaatataaatgtg

SEQ ID NO: 4455301 - DNA, 22 bp, Homo sapiens
gaatataagaaaagtaatgaag

SEQ ID NO: 4455302 - DNA, 14 bp, Homo sapiens
gaatatatggcatt

SEQ ID NO: 4455303 - DNA, 19 bp, Homo sapiens
gaatatatggcatttgcag

SEQ ID NO: 4455304 - DNA, 22 bp, Homo sapiens
gaatatcatctgtcattatatt

SEQ ID NO: 4455305 - DNA, 13 bp, Homo sapiens
gaatatcatgcaa

SEQ ID NO: 4455306 - DNA, 18 bp, Homo sapiens
gaatatctgttcccagcc

SEQ ID NO: 4455307 - DNA, 15 bp, Homo sapiens
gaatatgtatgtata

SEQ ID NO: 4455308 - DNA, 13 bp, Homo sapiens
gaatattaaaaaa

SEQ ID NO: 4455309 - DNA, 14 bp, Homo sapiens
gaatattaaaaaac

SEQ ID NO: 4455310 - DNA, 19 bp, Homo sapiens
gaatattcatggatggctc

SEQ ID NO: 4455311 - DNA, 17 bp, Homo sapiens
gaatattgcccaaataa

SEQ ID NO: 4455312 - DNA, 16 bp, Homo sapiens
gaatattttaacttcc

SEQ ID NO: 4455313 - DNA, 12 bp, Homo sapiens
gaatattttatc

SEQ ID NO: 4455314 - DNA, 22 bp, Homo sapiens
gaatatttttagactatttctt

SEQ ID NO: 4455315 - DNA, 17 bp, Homo sapiens
gaatattttttgaaggt

SEQ ID NO: 4455316 - DNA, 14 bp, Homo sapiens
gaatcaagagctgc

SEQ ID NO: 4455317 - DNA, 20 bp, Homo sapiens
gaatcaatctggcttctgca

SEQ ID NO: 4455318 - DNA, 18 bp, Homo sapiens
gaatcaccaattaaaaac

SEQ ID NO: 4455319 - DNA, 15 bp, Homo sapiens
gaatcacccctctgc

SEQ ID NO: 4455320 - DNA, 17 bp, Homo sapiens
gaatcacccctctgccc

SEQ ID NO: 4455321 - DNA, 19 bp, Homo sapiens
gaatcacctgaaccccaga

SEQ ID NO: 4455322 - DNA, 20 bp, Homo sapiens
gaatcacctgaaccccagag

SEQ ID NO: 4455323 - DNA, 16 bp, Homo sapiens
gaatcactgctccagg

SEQ ID NO: 4455324 - DNA, 12 bp, Homo sapiens
gaatcagaagaa

SEQ ID NO: 4455325 - DNA, 15 bp, Homo sapiens
gaatcagaagaaagg

SEQ ID NO: 4455326 - DNA, 13 bp, Homo sapiens
gaatcagaataaa

SEQ ID NO: 4455327 - DNA, 17 bp, Homo sapiens
gaatcagaataaagttg

SEQ ID NO: 4455328 - DNA, 19 bp, Homo sapiens
gaatcagacttcacactgc

SEQ ID NO: 4455329 - DNA, 18 bp, Homo sapiens
gaatcagatggtgtcatt

SEQ ID NO: 4455330 - DNA, 17 bp, Homo sapiens
gaatcagtttaaaagca

SEQ ID NO: 4455331 - DNA, 13 bp, Homo sapiens
gaatcattattta

SEQ ID NO: 4455332 - DNA, 13 bp, Homo sapiens
gaatcatttagca

SEQ ID NO: 4455333 - DNA, 24 bp, Homo sapiens
gaatcatttagcatgttgttgaaa

SEQ ID NO: 4455334 - DNA, 16 bp, Homo sapiens
gaatccagtttctttc

SEQ ID NO: 4455335 - DNA, 17 bp, Homo sapiens
gaatcccaaatttgatt

SEQ ID NO: 4455336 - DNA, 17 bp, Homo sapiens
gaatcccagaggtggga

SEQ ID NO: 4455337 - DNA, 17 bp, Homo sapiens
gaatcccccttgccacc

SEQ ID NO: 4455338 - DNA, 18 bp, Homo sapiens
gaatcccccttgccaccc

SEQ ID NO: 4455339 - DNA, 19 bp, Homo sapiens
gaatcccttaacagttgta

SEQ ID NO: 4455340 - DNA, 18 bp, Homo sapiens
gaatccgtattgaatttg

SEQ ID NO: 4455341 - DNA, 16 bp, Homo sapiens
gaatctagaagatgtg

SEQ ID NO: 4455342 - DNA, 20 bp, Homo sapiens
gaatctatggctttaaataa

SEQ ID NO: 4455343 - DNA, 18 bp, Homo sapiens
gaatctctttttgctttc

SEQ ID NO: 4455344 - DNA, 13 bp, Homo sapiens
gaatctgctgaga

SEQ ID NO: 4455345 - DNA, 17 bp, Homo sapiens
gaatctgctgagaggca

SEQ ID NO: 4455346 - DNA, 22 bp, Homo sapiens
gaatctgctgagaggcaccagt

SEQ ID NO: 4455347 - DNA, 19 bp, Homo sapiens
gaatctgcttttcctctgc

SEQ ID NO: 4455348 - DNA, 19 bp, Homo sapiens
gaatctgggactgtgcctg

SEQ ID NO: 4455349 - DNA, 15 bp, Homo sapiens
gaatctgtttctctg

SEQ ID NO: 4455350 - DNA, 20 bp, Homo sapiens
gaatcttgttttgaaaataa

SEQ ID NO: 4455351 - DNA, 13 bp, Homo sapiens
gaatctttaaggg

SEQ ID NO: 4455352 - DNA, 20 bp, Homo sapiens
gaatgaaaataactgaattt

SEQ ID NO: 4455353 - DNA, 16 bp, Homo sapiens
gaatgaaattaacaca

SEQ ID NO: 4455354 - DNA, 17 bp, Homo sapiens
gaatgaagcagtatttt

SEQ ID NO: 4455355 - DNA, 14 bp, Homo sapiens
gaatgaagggccag

SEQ ID NO: 4455356 - DNA, 14 bp, Homo sapiens
gaatgaatggctaa

SEQ ID NO: 4455357 - DNA, 14 bp, Homo sapiens
gaatgacagccttt

SEQ ID NO: 4455358 - DNA, 15 bp, Homo sapiens
gaatgacttgggttt

SEQ ID NO: 4455359 - DNA, 15 bp, Homo sapiens
gaatgagacatccag

SEQ ID NO: 4455360 - DNA, 13 bp, Homo sapiens
gaatgaggggaag

SEQ ID NO: 4455361 - DNA, 22 bp, Homo sapiens
gaatgaggtgggaggtggaaga

SEQ ID NO: 4455362 - DNA, 15 bp, Homo sapiens
gaatgagtttttaat

SEQ ID NO: 4455363 - DNA, 23 bp, Homo sapiens
gaatgatgctcaaaatctttcca

SEQ ID NO: 4455364 - DNA, 16 bp, Homo sapiens
gaatgatttccaaaga

SEQ ID NO: 4455365 - DNA, 20 bp, Homo sapiens
gaatgatttccaaagagaaa

SEQ ID NO: 4455366 - DNA, 22 bp, Homo sapiens
gaatgcacagatatactttgtg

SEQ ID NO: 4455367 - DNA, 18 bp, Homo sapiens
gaatgcaccatggagacg

SEQ ID NO: 4455368 - DNA, 15 bp, Homo sapiens
gaatgcacctcccca

SEQ ID NO: 4455369 - DNA, 16 bp, Homo sapiens
gaatgcacctccccaa

SEQ ID NO: 4455370 - DNA, 18 bp, Homo sapiens
gaatgcacctccccaaag

SEQ ID NO: 4455371 - DNA, 14 bp, Homo sapiens
gaatgcagtacaga

SEQ ID NO: 4455372 - DNA, 21 bp, Homo sapiens
gaatgccatagtcaaagagag

SEQ ID NO: 4455373 - DNA, 15 bp, Homo sapiens
gaatgccgaatttgg

SEQ ID NO: 4455374 - DNA, 19 bp, Homo sapiens
gaatgccgcgatgggtcag

SEQ ID NO: 4455375 - DNA, 20 bp, Homo sapiens
gaatgccggttaaattccat

SEQ ID NO: 4455376 - DNA, 19 bp, Homo sapiens
gaatgctcccagctgtgct

SEQ ID NO: 4455377 - DNA, 13 bp, Homo sapiens
gaatgctgagacc

SEQ ID NO: 4455378 - DNA, 20 bp, Homo sapiens
gaatgctgtacatctatttt

SEQ ID NO: 4455379 - DNA, 19 bp, Homo sapiens
gaatggaaatttataatat

SEQ ID NO: 4455380 - DNA, 17 bp, Homo sapiens
gaatggaggcagagacc

SEQ ID NO: 4455381 - DNA, 19 bp, Homo sapiens
gaatggctatgtttttaat

SEQ ID NO: 4455382 - DNA, 19 bp, Homo sapiens
gaatgggtctgcacagatt

SEQ ID NO: 4455383 - DNA, 16 bp, Homo sapiens
gaatggtgcgtggctt

SEQ ID NO: 4455384 - DNA, 13 bp, Homo sapiens
gaatgtaatttgt

SEQ ID NO: 4455385 - DNA, 14 bp, Homo sapiens
gaatgtaatttgtg

SEQ ID NO: 4455386 - DNA, 21 bp, Homo sapiens
gaatgtacgttgagaatcact

SEQ ID NO: 4455387 - DNA, 11 bp, Homo sapiens
gaatgtagtta

SEQ ID NO: 4455388 - DNA, 22 bp, Homo sapiens
gaatgtcagttgttatttattg

SEQ ID NO: 4455389 - DNA, 22 bp, Homo sapiens
gaatgtcatagtcttgaaatga

SEQ ID NO: 4455390 - DNA, 18 bp, Homo sapiens
gaatgtcttgttcctgtg

SEQ ID NO: 4455391 - DNA, 19 bp, Homo sapiens
gaatgtcttgttcctgtgc

SEQ ID NO: 4455392 - DNA, 13 bp, Homo sapiens
gaatgtgaaacat

SEQ ID NO: 4455393 - DNA, 22 bp, Homo sapiens
gaatgtgccacagaggccccac

SEQ ID NO: 4455394 - DNA, 18 bp, Homo sapiens
gaatgtgctgaagcaaag

SEQ ID NO: 4455395 - DNA, 21 bp, Homo sapiens
gaatgtgtgtgtgtggcaggg

SEQ ID NO: 4455396 - DNA, 13 bp, Homo sapiens
gaatgtgttcttt

SEQ ID NO: 4455397 - DNA, 16 bp, Homo sapiens
gaatgtgttcttttct

SEQ ID NO: 4455398 - DNA, 22 bp, Homo sapiens
gaatgttaattttttggtacaa

SEQ ID NO: 4455399 - DNA, 23 bp, Homo sapiens
gaatgttaattttttggtacaaa

SEQ ID NO: 4455400 - DNA, 16 bp, Homo sapiens
gaatgttgaaaagtaa

SEQ ID NO: 4455401 - DNA, 20 bp, Homo sapiens
gaatgttgttgtctatttgt

SEQ ID NO: 4455402 - DNA, 15 bp, Homo sapiens
gaatgtttcatttgc

SEQ ID NO: 4455403 - DNA, 19 bp, Homo sapiens
gaattaaaaggatagtatt

SEQ ID NO: 4455404 - DNA, 13 bp, Homo sapiens
gaattaaaattta

SEQ ID NO: 4455405 - DNA, 22 bp, Homo sapiens
gaattaaagtggaccaataggg

SEQ ID NO: 4455406 - DNA, 14 bp, Homo sapiens
gaattaaatagtgt

SEQ ID NO: 4455407 - DNA, 15 bp, Homo sapiens
gaattaaatagtgtg

SEQ ID NO: 4455408 - DNA, 20 bp, Homo sapiens
gaattaaattaggaataaat

SEQ ID NO: 4455409 - DNA, 14 bp, Homo sapiens
gaattaacacatga

SEQ ID NO: 4455410 - DNA, 17 bp, Homo sapiens
gaattaattaatttgga

SEQ ID NO: 4455411 - DNA, 18 bp, Homo sapiens
gaattaccatagagtaat

SEQ ID NO: 4455412 - DNA, 14 bp, Homo sapiens
gaattaccatttgt

SEQ ID NO: 4455413 - DNA, 19 bp, Homo sapiens
gaattacgtgctctgtggg

SEQ ID NO: 4455414 - DNA, 10 bp, Homo sapiens
gaattagaaa

SEQ ID NO: 4455415 - DNA, 15 bp, Homo sapiens
gaattaggctgtaac

SEQ ID NO: 4455416 - DNA, 20 bp, Homo sapiens
gaattataaatgtgtttata

SEQ ID NO: 4455417 - DNA, 14 bp, Homo sapiens
gaattataactgta

SEQ ID NO: 4455418 - DNA, 20 bp, Homo sapiens
gaattatcagcaaagaaaaa

SEQ ID NO: 4455419 - DNA, 20 bp, Homo sapiens
gaattatcttggttgaaaat

SEQ ID NO: 4455420 - DNA, 12 bp, Homo sapiens
gaattattgaca

SEQ ID NO: 4455421 - DNA, 17 bp, Homo sapiens
gaattattgacactgaa

SEQ ID NO: 4455422 - DNA, 22 bp, Homo sapiens
gaattcaaaagtgattatctct

SEQ ID NO: 4455423 - DNA, 17 bp, Homo sapiens
gaattcaaatcctcttt

SEQ ID NO: 4455424 - DNA, 23 bp, Homo sapiens
gaattcaccagtgttcctgaagc

SEQ ID NO: 4455425 - DNA, 13 bp, Homo sapiens
gaattcagcagtt

SEQ ID NO: 4455426 - DNA, 15 bp, Homo sapiens
gaattcataataaat

SEQ ID NO: 4455427 - DNA, 14 bp, Homo sapiens
gaattccctccccc

SEQ ID NO: 4455428 - DNA, 18 bp, Homo sapiens
gaattcctcctctattta

SEQ ID NO: 4455429 - DNA, 14 bp, Homo sapiens
gaattcctttacaa

SEQ ID NO: 4455430 - DNA, 23 bp, Homo sapiens
gaattcctttacaactaaataac

SEQ ID NO: 4455431 - DNA, 22 bp, Homo sapiens
gaattctaacattaaatcacag

SEQ ID NO: 4455432 - DNA, 15 bp, Homo sapiens
gaattctatttgctg

SEQ ID NO: 4455433 - DNA, 18 bp, Homo sapiens
gaattcttacagccaagt

SEQ ID NO: 4455434 - DNA, 14 bp, Homo sapiens
gaattcttctgcaa

SEQ ID NO: 4455435 - DNA, 14 bp, Homo sapiens
gaattcttgctgtt

SEQ ID NO: 4455436 - DNA, 14 bp, Homo sapiens
gaattgaaatgagg

SEQ ID NO: 4455437 - DNA, 15 bp, Homo sapiens
gaattgaacccagga

SEQ ID NO: 4455438 - DNA, 18 bp, Homo sapiens
gaattgaacccaggaggt

SEQ ID NO: 4455439 - DNA, 16 bp, Homo sapiens
gaattgacccacaaga

SEQ ID NO: 4455440 - DNA, 21 bp, Homo sapiens
gaattgacccacaagaaatga

SEQ ID NO: 4455441 - DNA, 19 bp, Homo sapiens
gaattgagaataagaattt

SEQ ID NO: 4455442 - DNA, 21 bp, Homo sapiens
gaattgatcattttcccccca

SEQ ID NO: 4455443 - DNA, 14 bp, Homo sapiens
gaattgatttgcat

SEQ ID NO: 4455444 - DNA, 15 bp, Homo sapiens
gaattgatttgcatt

SEQ ID NO: 4455445 - DNA, 18 bp, Homo sapiens
gaattgatttgcattgaa

SEQ ID NO: 4455446 - DNA, 14 bp, Homo sapiens
gaattgcagtcatt

SEQ ID NO: 4455447 - DNA, 13 bp, Homo sapiens
gaattgcattgac

SEQ ID NO: 4455448 - DNA, 15 bp, Homo sapiens
gaattgccagtcttt

SEQ ID NO: 4455449 - DNA, 18 bp, Homo sapiens
gaattgccagtcttttgt

SEQ ID NO: 4455450 - DNA, 19 bp, Homo sapiens
gaattgcgctcaggggctc

SEQ ID NO: 4455451 - DNA, 15 bp, Homo sapiens
gaattggtgattctg

SEQ ID NO: 4455452 - DNA, 15 bp, Homo sapiens
gaattgtccttttct

SEQ ID NO: 4455453 - DNA, 19 bp, Homo sapiens
gaattgtgctttcaccaga

SEQ ID NO: 4455454 - DNA, 22 bp, Homo sapiens
gaatttagtgatactggctcag

SEQ ID NO: 4455455 - DNA, 18 bp, Homo sapiens
gaatttcaaaccattgct

SEQ ID NO: 4455456 - DNA, 21 bp, Homo sapiens
gaatttcacctgtaaacctga

SEQ ID NO: 4455457 - DNA, 20 bp, Homo sapiens
gaatttcagtgggtctctgt

SEQ ID NO: 4455458 - DNA, 12 bp, Homo sapiens
gaatttcctgta

SEQ ID NO: 4455459 - DNA, 16 bp, Homo sapiens
gaatttctaaagtaaa

SEQ ID NO: 4455460 - DNA, 23 bp, Homo sapiens
gaatttctaaagtaaaattgaag

SEQ ID NO: 4455461 - DNA, 14 bp, Homo sapiens
gaatttcttaactt

SEQ ID NO: 4455462 - DNA, 21 bp, Homo sapiens
gaatttgaagacttcaaaata

SEQ ID NO: 4455463 - DNA, 18 bp, Homo sapiens
gaatttgcatccagcagc

SEQ ID NO: 4455464 - DNA, 17 bp, Homo sapiens
gaatttgggatggaagc

SEQ ID NO: 4455465 - DNA, 14 bp, Homo sapiens
gaatttggtacaca

SEQ ID NO: 4455466 - DNA, 20 bp, Homo sapiens
gaatttggtacacatgtgtt

SEQ ID NO: 4455467 - DNA, 23 bp, Homo sapiens
gaatttggtacacatgtgttatc

SEQ ID NO: 4455468 - DNA, 23 bp, Homo sapiens
gaatttgtttcatctattttatt

SEQ ID NO: 4455469 - DNA, 12 bp, Homo sapiens
gaattttcatcc

SEQ ID NO: 4455470 - DNA, 15 bp, Homo sapiens
gaattttctaaaagc

SEQ ID NO: 4455471 - DNA, 21 bp, Homo sapiens
gaattttgcaaagatttaatc

SEQ ID NO: 4455472 - DNA, 20 bp, Homo sapiens
gaattttggggattttcaaa

SEQ ID NO: 4455473 - DNA, 12 bp, Homo sapiens
gaatttttaagc

SEQ ID NO: 4455474 - DNA, 13 bp, Homo sapiens
gaatttttgcaat

SEQ ID NO: 4455475 - DNA, 14 bp, Homo sapiens
gaatttttgcaata

SEQ ID NO: 4455476 - DNA, 15 bp, Homo sapiens
gaatttttgcaataa

SEQ ID NO: 4455477 - DNA, 17 bp, Homo sapiens
gaatttttgcaataatg

SEQ ID NO: 4455478 - DNA, 19 bp, Homo sapiens
gaatttttgcaataatgca

SEQ ID NO: 4455479 - DNA, 16 bp, Homo sapiens
gacaaaaacagcctca

SEQ ID NO: 4455480 - DNA, 22 bp, Homo sapiens
gacaaaaagtatattaaacaaa

SEQ ID NO: 4455481 - DNA, 18 bp, Homo sapiens
gacaaaagaaaattttcc

SEQ ID NO: 4455482 - DNA, 12 bp, Homo sapiens
gacaaaaggaat

SEQ ID NO: 4455483 - DNA, 14 bp, Homo sapiens
gacaaaaggaatgt

SEQ ID NO: 4455484 - DNA, 14 bp, Homo sapiens
gacaaaagtctgtc

SEQ ID NO: 4455485 - DNA, 14 bp, Homo sapiens
gacaaaattgctta

SEQ ID NO: 4455486 - DNA, 19 bp, Homo sapiens
gacaaactgtaaaaaatgt

SEQ ID NO: 4455487 - DNA, 16 bp, Homo sapiens
gacaaagaattccaaa

SEQ ID NO: 4455488 - DNA, 19 bp, Homo sapiens
gacaaagctgctaaatctc

SEQ ID NO: 4455489 - DNA, 17 bp, Homo sapiens
gacaaaggccttaacaa

SEQ ID NO: 4455490 - DNA, 13 bp, Homo sapiens
gacaaataaaaca

SEQ ID NO: 4455491 - DNA, 23 bp, Homo sapiens
gacaaataaatagttgctcttct

SEQ ID NO: 4455492 - DNA, 16 bp, Homo sapiens
gacaaatcacatattt

SEQ ID NO: 4455493 - DNA, 20 bp, Homo sapiens
gacaaatcacatattttaaa

SEQ ID NO: 4455494 - DNA, 22 bp, Homo sapiens
gacaaatctaaaatgcaaagaa

SEQ ID NO: 4455495 - DNA, 14 bp, Homo sapiens
gacaaattttaatt

SEQ ID NO: 4455496 - DNA, 21 bp, Homo sapiens
gacaacaccttcctcctgcag

SEQ ID NO: 4455497 - DNA, 17 bp, Homo sapiens
gacaacacttaatagca

SEQ ID NO: 4455498 - DNA, 20 bp, Homo sapiens
gacaacaggtaaaacagggc

SEQ ID NO: 4455499 - DNA, 16 bp, Homo sapiens
gacaaccattaaagtc

SEQ ID NO: 4455500 - DNA, 13 bp, Homo sapiens
gacaagaaaatca

SEQ ID NO: 4455501 - DNA, 15 bp, Homo sapiens
gacaagaaaatcagg

SEQ ID NO: 4455502 - DNA, 15 bp, Homo sapiens
gacaagacccccagc

SEQ ID NO: 4455503 - DNA, 14 bp, Homo sapiens
gacaagagatctac

SEQ ID NO: 4455504 - DNA, 19 bp, Homo sapiens
gacaagagatctacacatg

SEQ ID NO: 4455505 - DNA, 20 bp, Homo sapiens
gacaagagatctacacatgt

SEQ ID NO: 4455506 - DNA, 18 bp, Homo sapiens
gacaagagatgggaatga

SEQ ID NO: 4455507 - DNA, 15 bp, Homo sapiens
gacaagatgggacag

SEQ ID NO: 4455508 - DNA, 16 bp, Homo sapiens
gacaataaaccctcag

SEQ ID NO: 4455509 - DNA, 22 bp, Homo sapiens
gacaataaaccctcagagcctc

SEQ ID NO: 4455510 - DNA, 14 bp, Homo sapiens
gacaataacttctt

SEQ ID NO: 4455511 - DNA, 17 bp, Homo sapiens
gacaatagtatttctcc

SEQ ID NO: 4455512 - DNA, 18 bp, Homo sapiens
gacaatcatctccaatgg

SEQ ID NO: 4455513 - DNA, 23 bp, Homo sapiens
gacaatcatctccaatggaaagc

SEQ ID NO: 4455514 - DNA, 20 bp, Homo sapiens
gacaattcctccagagacac

SEQ ID NO: 4455515 - DNA, 22 bp, Homo sapiens
gacaattgaggtaagttttttg

SEQ ID NO: 4455516 - DNA, 20 bp, Homo sapiens
gacaattttttttcaaatgt

SEQ ID NO: 4455517 - DNA, 22 bp, Homo sapiens
gacaattttttttcaaatgtgc

SEQ ID NO: 4455518 - DNA, 22 bp, Homo sapiens
gacacaactgtgtgattaaaag

SEQ ID NO: 4455519 - DNA, 21 bp, Homo sapiens
gacacaataggtctttctctc

SEQ ID NO: 4455520 - DNA, 19 bp, Homo sapiens
gacacaatttcatttccag

SEQ ID NO: 4455521 - DNA, 20 bp, Homo sapiens
gacacaatttcatttccagc

SEQ ID NO: 4455522 - DNA, 18 bp, Homo sapiens
gacacaccaggcgctaat

SEQ ID NO: 4455523 - DNA, 18 bp, Homo sapiens
gacacagacccaggaccc

SEQ ID NO: 4455524 - DNA, 22 bp, Homo sapiens
gacacagtgatgaatgtactat

SEQ ID NO: 4455525 - DNA, 15 bp, Homo sapiens
gacacagttcctggg

SEQ ID NO: 4455526 - DNA, 15 bp, Homo sapiens
gacacatttaaggat

SEQ ID NO: 4455527 - DNA, 15 bp, Homo sapiens
gacaccagagctgcc

SEQ ID NO: 4455528 - DNA, 23 bp, Homo sapiens
gacaccagccaggctctgtgctg

SEQ ID NO: 4455529 - DNA, 17 bp, Homo sapiens
gacaccatgtgcaataa

SEQ ID NO: 4455530 - DNA, 23 bp, Homo sapiens
gacaccattaccaaaataataaa

SEQ ID NO: 4455531 - DNA, 22 bp, Homo sapiens
gacaccattcattccatgtcca

SEQ ID NO: 4455532 - DNA, 14 bp, Homo sapiens
gacacccaggcccg

SEQ ID NO: 4455533 - DNA, 16 bp, Homo sapiens
gacacccaggcccgag

SEQ ID NO: 4455534 - DNA, 13 bp, Homo sapiens
gacacccatgcca

SEQ ID NO: 4455535 - DNA, 23 bp, Homo sapiens
gacaccctccctccagggtcctc

SEQ ID NO: 4455536 - DNA, 14 bp, Homo sapiens
gacaccctggcctg

SEQ ID NO: 4455537 - DNA, 19 bp, Homo sapiens
gacacctaaccccagggca

SEQ ID NO: 4455538 - DNA, 20 bp, Homo sapiens
gacacctaggctagggtggg

SEQ ID NO: 4455539 - DNA, 12 bp, Homo sapiens
gacacctccccc

SEQ ID NO: 4455540 - DNA, 22 bp, Homo sapiens
gacacctccccctttcacactg

SEQ ID NO: 4455541 - DNA, 16 bp, Homo sapiens
gacacctgcacctccc

SEQ ID NO: 4455542 - DNA, 19 bp, Homo sapiens
gacacctgcacctcccccc

SEQ ID NO: 4455543 - DNA, 22 bp, Homo sapiens
gacacctgcacctccccccact

SEQ ID NO: 4455544 - DNA, 14 bp, Homo sapiens
gacacctggactga

SEQ ID NO: 4455545 - DNA, 13 bp, Homo sapiens
gacacgagccaca

SEQ ID NO: 4455546 - DNA, 14 bp, Homo sapiens
gacacgagccacaa

SEQ ID NO: 4455547 - DNA, 18 bp, Homo sapiens
gacacgcttctgagcagg

SEQ ID NO: 4455548 - DNA, 22 bp, Homo sapiens
gacactaccctgagatctgcac

SEQ ID NO: 4455549 - DNA, 21 bp, Homo sapiens
gacactccccgaagtcttttg

SEQ ID NO: 4455550 - DNA, 21 bp, Homo sapiens
gacactcctagagaacgcagc

SEQ ID NO: 4455551 - DNA, 16 bp, Homo sapiens
gacactcgtcacccca

SEQ ID NO: 4455552 - DNA, 14 bp, Homo sapiens
gacactctatatgt

SEQ ID NO: 4455553 - DNA, 13 bp, Homo sapiens
gacactgaaataa

SEQ ID NO: 4455554 - DNA, 12 bp, Homo sapiens
gacactgagcca

SEQ ID NO: 4455555 - DNA, 20 bp, Homo sapiens
gacactgagctgtgacccag

SEQ ID NO: 4455556 - DNA, 14 bp, Homo sapiens
gacactgctctaac

SEQ ID NO: 4455557 - DNA, 20 bp, Homo sapiens
gacactgctctaacagccct

SEQ ID NO: 4455558 - DNA, 15 bp, Homo sapiens
gacactggcagagag

SEQ ID NO: 4455559 - DNA, 20 bp, Homo sapiens
gacacttaatactaccttga

SEQ ID NO: 4455560 - DNA, 17 bp, Homo sapiens
gacacttttcatatcat

SEQ ID NO: 4455561 - DNA, 16 bp, Homo sapiens
gacagaaaacatgttt

SEQ ID NO: 4455562 - DNA, 20 bp, Homo sapiens
gacagaaagcagaacagtga

SEQ ID NO: 4455563 - DNA, 19 bp, Homo sapiens
gacagaagctatttcattt

SEQ ID NO: 4455564 - DNA, 15 bp, Homo sapiens
gacagaatgtgttct

SEQ ID NO: 4455565 - DNA, 23 bp, Homo sapiens
gacagacccacccccagccttgc

SEQ ID NO: 4455566 - DNA, 22 bp, Homo sapiens
gacagacgagacaacagcacac

SEQ ID NO: 4455567 - DNA, 14 bp, Homo sapiens
gacagactatttgc

SEQ ID NO: 4455568 - DNA, 15 bp, Homo sapiens
gacagactatttgct

SEQ ID NO: 4455569 - DNA, 15 bp, Homo sapiens
gacagagacacctgc

SEQ ID NO: 4455570 - DNA, 17 bp, Homo sapiens
gacagagacacctgcac

SEQ ID NO: 4455571 - DNA, 18 bp, Homo sapiens
gacagagacacctgcacc

SEQ ID NO: 4455572 - DNA, 21 bp, Homo sapiens
gacagagacacctgcacctcc

SEQ ID NO: 4455573 - DNA, 22 bp, Homo sapiens
gacagagacacctgcacctccc

SEQ ID NO: 4455574 - DNA, 14 bp, Homo sapiens
gacagagcaggggc

SEQ ID NO: 4455575 - DNA, 14 bp, Homo sapiens
gacagagcccccct

SEQ ID NO: 4455576 - DNA, 17 bp, Homo sapiens
gacagaggaaagggctg

SEQ ID NO: 4455577 - DNA, 18 bp, Homo sapiens
gacagaggaaagggctgg

SEQ ID NO: 4455578 - DNA, 18 bp, Homo sapiens
gacagaggagcttttctg

SEQ ID NO: 4455579 - DNA, 14 bp, Homo sapiens
gacagaggatgtgg

SEQ ID NO: 4455580 - DNA, 23 bp, Homo sapiens
gacagaggttgtagtgagccaag

SEQ ID NO: 4455581 - DNA, 22 bp, Homo sapiens
gacagagtgagaccctgtctca

SEQ ID NO: 4455582 - DNA, 16 bp, Homo sapiens
gacagagttgattttt

SEQ ID NO: 4455583 - DNA, 17 bp, Homo sapiens
gacagatgagcaggagc

SEQ ID NO: 4455584 - DNA, 19 bp, Homo sapiens
gacagatgccccagagctg

SEQ ID NO: 4455585 - DNA, 20 bp, Homo sapiens
gacagatgccccagagctgt

SEQ ID NO: 4455586 - DNA, 17 bp, Homo sapiens
gacagatgcctggtgag

SEQ ID NO: 4455587 - DNA, 16 bp, Homo sapiens
gacagatgctggtgga

SEQ ID NO: 4455588 - DNA, 19 bp, Homo sapiens
gacagatgctggtggagga

SEQ ID NO: 4455589 - DNA, 20 bp, Homo sapiens
gacagatgctggtggaggaa

SEQ ID NO: 4455590 - DNA, 15 bp, Homo sapiens
gacagcaaagcagca

SEQ ID NO: 4455591 - DNA, 21 bp, Homo sapiens
gacagcaaagcagcagtgtcc

SEQ ID NO: 4455592 - DNA, 13 bp, Homo sapiens
gacagcagaagcc

SEQ ID NO: 4455593 - DNA, 20 bp, Homo sapiens
gacagcagaagcctccaagc

SEQ ID NO: 4455594 - DNA, 17 bp, Homo sapiens
gacagcagcagcctgca

SEQ ID NO: 4455595 - DNA, 22 bp, Homo sapiens
gacagcagcagcctgcacctgc

SEQ ID NO: 4455596 - DNA, 19 bp, Homo sapiens
gacagcaggtgtacacatg

SEQ ID NO: 4455597 - DNA, 15 bp, Homo sapiens
gacagcatcagaaat

SEQ ID NO: 4455598 - DNA, 17 bp, Homo sapiens
gacagcatcccttccca

SEQ ID NO: 4455599 - DNA, 17 bp, Homo sapiens
gacagccaggtggcacc

SEQ ID NO: 4455600 - DNA, 20 bp, Homo sapiens
gacagccaggtggcacctgc

SEQ ID NO: 4455601 - DNA, 22 bp, Homo sapiens
gacagccaggtggcacctgcag

SEQ ID NO: 4455602 - DNA, 21 bp, Homo sapiens
gacagcccaggatactggcac

SEQ ID NO: 4455603 - DNA, 18 bp, Homo sapiens
gacagccctgcggagacc

SEQ ID NO: 4455604 - DNA, 22 bp, Homo sapiens
gacagcgctgtatttacagaca

SEQ ID NO: 4455605 - DNA, 12 bp, Homo sapiens
gacagctctgca

SEQ ID NO: 4455606 - DNA, 18 bp, Homo sapiens
gacagctgataaatttaa

SEQ ID NO: 4455607 - DNA, 18 bp, Homo sapiens
gacagctgtccctgtcac

SEQ ID NO: 4455608 - DNA, 22 bp, Homo sapiens
gacagctgtccctgtcaccaag

SEQ ID NO: 4455609 - DNA, 13 bp, Homo sapiens
gacagctgtgccg

SEQ ID NO: 4455610 - DNA, 22 bp, Homo sapiens
gacagctgtgccgggaggcagc

SEQ ID NO: 4455611 - DNA, 14 bp, Homo sapiens
gacagcttctctgc

SEQ ID NO: 4455612 - DNA, 15 bp, Homo sapiens
gacagcttgagaagg

SEQ ID NO: 4455613 - DNA, 16 bp, Homo sapiens
gacagcttggaaaggg

SEQ ID NO: 4455614 - DNA, 15 bp, Homo sapiens
gacaggaaagccctc

SEQ ID NO: 4455615 - DNA, 17 bp, Homo sapiens
gacaggaaagccctccc

SEQ ID NO: 4455616 - DNA, 24 bp, Homo sapiens
gacaggagaaatgcatccattcct

SEQ ID NO: 4455617 - DNA, 23 bp, Homo sapiens
gacaggagcctagcggagcccag

SEQ ID NO: 4455618 - DNA, 17 bp, Homo sapiens
gacaggatttggccaca

SEQ ID NO: 4455619 - DNA, 22 bp, Homo sapiens
gacaggatttggccacactggg

SEQ ID NO: 4455620 - DNA, 15 bp, Homo sapiens
gacaggcagggaggg

SEQ ID NO: 4455621 - DNA, 19 bp, Homo sapiens
gacaggccctccctgtctc

SEQ ID NO: 4455622 - DNA, 20 bp, Homo sapiens
gacaggcgggctcggaggct

SEQ ID NO: 4455623 - DNA, 21 bp, Homo sapiens
gacaggctggaagatagctgt

SEQ ID NO: 4455624 - DNA, 12 bp, Homo sapiens
gacaggctgggt

SEQ ID NO: 4455625 - DNA, 14 bp, Homo sapiens
gacaggctgggtcc

SEQ ID NO: 4455626 - DNA, 15 bp, Homo sapiens
gacaggctgggtcct

SEQ ID NO: 4455627 - DNA, 15 bp, Homo sapiens
gacagggctgctccc

SEQ ID NO: 4455628 - DNA, 15 bp, Homo sapiens
gacagggctggccca

SEQ ID NO: 4455629 - DNA, 19 bp, Homo sapiens
gacagggctggcccagccc

SEQ ID NO: 4455630 - DNA, 22 bp, Homo sapiens
gacagggtcttgctctgtcccc

SEQ ID NO: 4455631 - DNA, 15 bp, Homo sapiens
gacagggtgggaggg

SEQ ID NO: 4455632 - DNA, 23 bp, Homo sapiens
gacagggtgggagggaggaggga

SEQ ID NO: 4455633 - DNA, 16 bp, Homo sapiens
gacagggtgggcttcc

SEQ ID NO: 4455634 - DNA, 20 bp, Homo sapiens
gacagggtgggcttcctgcc

SEQ ID NO: 4455635 - DNA, 13 bp, Homo sapiens
gacaggtgacagt

SEQ ID NO: 4455636 - DNA, 18 bp, Homo sapiens
gacaggtgacagtggctg

SEQ ID NO: 4455637 - DNA, 21 bp, Homo sapiens
gacaggtgacagtggctgctc

SEQ ID NO: 4455638 - DNA, 13 bp, Homo sapiens
gacagtcaaaaga

SEQ ID NO: 4455639 - DNA, 13 bp, Homo sapiens
gacagtccctgct

SEQ ID NO: 4455640 - DNA, 16 bp, Homo sapiens
gacagtccctgctggg

SEQ ID NO: 4455641 - DNA, 18 bp, Homo sapiens
gacagtcgctcagtctgt

SEQ ID NO: 4455642 - DNA, 13 bp, Homo sapiens
gacagtctggaga

SEQ ID NO: 4455643 - DNA, 15 bp, Homo sapiens
gacagtctggagaag

SEQ ID NO: 4455644 - DNA, 21 bp, Homo sapiens
gacagtgaagcagcactgtga

SEQ ID NO: 4455645 - DNA, 15 bp, Homo sapiens
gacagtgaatttggg

SEQ ID NO: 4455646 - DNA, 21 bp, Homo sapiens
gacagtgagactctgtctcag

SEQ ID NO: 4455647 - DNA, 10 bp, Homo sapiens
gacagtgccc

SEQ ID NO: 4455648 - DNA, 16 bp, Homo sapiens
gacagtgcccttggtg

SEQ ID NO: 4455649 - DNA, 21 bp, Homo sapiens
gacagtgctgcagctccctgg

SEQ ID NO: 4455650 - DNA, 18 bp, Homo sapiens
gacagtggctgctctggg

SEQ ID NO: 4455651 - DNA, 21 bp, Homo sapiens
gacagttccagaagtgtgact

SEQ ID NO: 4455652 - DNA, 17 bp, Homo sapiens
gacataaagttgataaa

SEQ ID NO: 4455653 - DNA, 15 bp, Homo sapiens
gacataattgtccag

SEQ ID NO: 4455654 - DNA, 20 bp, Homo sapiens
gacatagaattaacacatga

SEQ ID NO: 4455655 - DNA, 17 bp, Homo sapiens
gacatatcactgctgct

SEQ ID NO: 4455656 - DNA, 21 bp, Homo sapiens
gacatatgggatattcccaag

SEQ ID NO: 4455657 - DNA, 20 bp, Homo sapiens
gacatatttaatgttttaaa

SEQ ID NO: 4455658 - DNA, 22 bp, Homo sapiens
gacatatttaatgttttaaatg

SEQ ID NO: 4455659 - DNA, 23 bp, Homo sapiens
gacatatttaatgttttaaatgt

SEQ ID NO: 4455660 - DNA, 16 bp, Homo sapiens
gacatctgcctgtaat

SEQ ID NO: 4455661 - DNA, 13 bp, Homo sapiens
gacatctttttaa

SEQ ID NO: 4455662 - DNA, 20 bp, Homo sapiens
gacatgaagattctttccca

SEQ ID NO: 4455663 - DNA, 20 bp, Homo sapiens
gacatgacgtggtaaaatgt

SEQ ID NO: 4455664 - DNA, 16 bp, Homo sapiens
gacatgatttccttga

SEQ ID NO: 4455665 - DNA, 19 bp, Homo sapiens
gacatgatttccttgaatg

SEQ ID NO: 4455666 - DNA, 17 bp, Homo sapiens
gacatgccctgtgtggc

SEQ ID NO: 4455667 - DNA, 22 bp, Homo sapiens
gacatgcctatatgagaagaat

SEQ ID NO: 4455668 - DNA, 14 bp, Homo sapiens
gacatggaaatgaa

SEQ ID NO: 4455669 - DNA, 15 bp, Homo sapiens
gacatggaaatgaag

SEQ ID NO: 4455670 - DNA, 22 bp, Homo sapiens
gacatggtgagtctatttttaa

SEQ ID NO: 4455671 - DNA, 20 bp, Homo sapiens
gacatggtgcctgagaggca

SEQ ID NO: 4455672 - DNA, 21 bp, Homo sapiens
gacatggtgcctgagaggcag

SEQ ID NO: 4455673 - DNA, 23 bp, Homo sapiens
gacatggtgcctgagaggcaggc

SEQ ID NO: 4455674 - DNA, 13 bp, Homo sapiens
gacatgtcaatta

SEQ ID NO: 4455675 - DNA, 17 bp, Homo sapiens
gacatgtctgttctaca

SEQ ID NO: 4455676 - DNA, 14 bp, Homo sapiens
gacattcttttaat

SEQ ID NO: 4455677 - DNA, 16 bp, Homo sapiens
gacattcttttaatgc

SEQ ID NO: 4455678 - DNA, 14 bp, Homo sapiens
gacattgcgtttga

SEQ ID NO: 4455679 - DNA, 21 bp, Homo sapiens
gacattgcgtttgacctttta

SEQ ID NO: 4455680 - DNA, 22 bp, Homo sapiens
gacattgctctatgtctgcctt

SEQ ID NO: 4455681 - DNA, 14 bp, Homo sapiens
gacatttatatatt

SEQ ID NO: 4455682 - DNA, 13 bp, Homo sapiens
gacatttatcttt

SEQ ID NO: 4455683 - DNA, 18 bp, Homo sapiens
gacatttcactaaaagtc

SEQ ID NO: 4455684 - DNA, 13 bp, Homo sapiens
gacatttctttct

SEQ ID NO: 4455685 - DNA, 21 bp, Homo sapiens
gacatttgctgaactcagcac

SEQ ID NO: 4455686 - DNA, 20 bp, Homo sapiens
gacattttaaaaaatggtca

SEQ ID NO: 4455687 - DNA, 13 bp, Homo sapiens
gacattttacatt

SEQ ID NO: 4455688 - DNA, 14 bp, Homo sapiens
gacattttacatta

SEQ ID NO: 4455689 - DNA, 15 bp, Homo sapiens
gacattttacattaa

SEQ ID NO: 4455690 - DNA, 17 bp, Homo sapiens
gacattttgtttttact

SEQ ID NO: 4455691 - DNA, 14 bp, Homo sapiens
gaccaaattgcttc

SEQ ID NO: 4455692 - DNA, 18 bp, Homo sapiens
gaccaaattgcttctagg

SEQ ID NO: 4455693 - DNA, 17 bp, Homo sapiens
gaccaacatggagaaac

SEQ ID NO: 4455694 - DNA, 21 bp, Homo sapiens
gaccaacatggagaaaccctg

SEQ ID NO: 4455695 - DNA, 13 bp, Homo sapiens
gaccaacctgacc

SEQ ID NO: 4455696 - DNA, 20 bp, Homo sapiens
gaccaacctgctctgtcccc

SEQ ID NO: 4455697 - DNA, 13 bp, Homo sapiens
gaccaactgggcc

SEQ ID NO: 4455698 - DNA, 20 bp, Homo sapiens
gaccaatatatagtgggtac

SEQ ID NO: 4455699 - DNA, 17 bp, Homo sapiens
gaccaatattgtacagt

SEQ ID NO: 4455700 - DNA, 19 bp, Homo sapiens
gaccaatattgtacagttt

SEQ ID NO: 4455701 - DNA, 18 bp, Homo sapiens
gaccaattattgatatat

SEQ ID NO: 4455702 - DNA, 22 bp, Homo sapiens
gaccacaccactaaccatcccc

SEQ ID NO: 4455703 - DNA, 23 bp, Homo sapiens
gaccacaccactaaccatcccca

SEQ ID NO: 4455704 - DNA, 22 bp, Homo sapiens
gaccacccctgcctccaccctc

SEQ ID NO: 4455705 - DNA, 14 bp, Homo sapiens
gaccaccctgagcc

SEQ ID NO: 4455706 - DNA, 14 bp, Homo sapiens
gaccactccagaga

SEQ ID NO: 4455707 - DNA, 15 bp, Homo sapiens
gaccactccagagaa

SEQ ID NO: 4455708 - DNA, 21 bp, Homo sapiens
gaccactcttctttaagccat

SEQ ID NO: 4455709 - DNA, 16 bp, Homo sapiens
gaccactgcagaagac

SEQ ID NO: 4455710 - DNA, 18 bp, Homo sapiens
gaccactgcagaagacag

SEQ ID NO: 4455711 - DNA, 22 bp, Homo sapiens
gaccacttccaggggaacctgc

SEQ ID NO: 4455712 - DNA, 23 bp, Homo sapiens
gaccacttccaggggaacctgcc

SEQ ID NO: 4455713 - DNA, 16 bp, Homo sapiens
gaccacttgccacgct

SEQ ID NO: 4455714 - DNA, 20 bp, Homo sapiens
gaccagaaaatgtaaggcaa

SEQ ID NO: 4455715 - DNA, 17 bp, Homo sapiens
gaccagaaacagggaca

SEQ ID NO: 4455716 - DNA, 13 bp, Homo sapiens
gaccagaagcctt

SEQ ID NO: 4455717 - DNA, 15 bp, Homo sapiens
gaccagaagccttgg

SEQ ID NO: 4455718 - DNA, 11 bp, Homo sapiens
gaccagactaa

SEQ ID NO: 4455719 - DNA, 20 bp, Homo sapiens
gaccagctgctccgaggacc

SEQ ID NO: 4455720 - DNA, 23 bp, Homo sapiens
gaccagctgctccgaggacccag

SEQ ID NO: 4455721 - DNA, 15 bp, Homo sapiens
gaccaggctgcctcc

SEQ ID NO: 4455722 - DNA, 15 bp, Homo sapiens
gaccaggctgggcat

SEQ ID NO: 4455723 - DNA, 22 bp, Homo sapiens
gaccaggctgggcatcatagca

SEQ ID NO: 4455724 - DNA, 16 bp, Homo sapiens
gaccagggatgctggg

SEQ ID NO: 4455725 - DNA, 19 bp, Homo sapiens
gaccagggatgctgggctg

SEQ ID NO: 4455726 - DNA, 22 bp, Homo sapiens
gaccagggatgctgggctgggc

SEQ ID NO: 4455727 - DNA, 15 bp, Homo sapiens
gaccagggtggccac

SEQ ID NO: 4455728 - DNA, 21 bp, Homo sapiens
gaccagggtggccacacaggc

SEQ ID NO: 4455729 - DNA, 18 bp, Homo sapiens
gaccaggtttgcaggagc

SEQ ID NO: 4455730 - DNA, 19 bp, Homo sapiens
gaccaggtttgcaggagcc

SEQ ID NO: 4455731 - DNA, 17 bp, Homo sapiens
gaccagtcaacctgggc

SEQ ID NO: 4455732 - DNA, 13 bp, Homo sapiens
gaccagtttctta

SEQ ID NO: 4455733 - DNA, 22 bp, Homo sapiens
gaccatcactgagagtcaggag

SEQ ID NO: 4455734 - DNA, 23 bp, Homo sapiens
gaccatccactctaccctcccac

SEQ ID NO: 4455735 - DNA, 22 bp, Homo sapiens
gaccatccattctcctcagtgg

SEQ ID NO: 4455736 - DNA, 12 bp, Homo sapiens
gaccatcctggc

SEQ ID NO: 4455737 - DNA, 12 bp, Homo sapiens
gaccatgccaga

SEQ ID NO: 4455738 - DNA, 15 bp, Homo sapiens
gaccatgccagattc

SEQ ID NO: 4455739 - DNA, 15 bp, Homo sapiens
gaccattgaactagg

SEQ ID NO: 4455740 - DNA, 17 bp, Homo sapiens
gaccattggggctccca

SEQ ID NO: 4455741 - DNA, 20 bp, Homo sapiens
gaccattggggctcccagcc

SEQ ID NO: 4455742 - DNA, 15 bp, Homo sapiens
gacccaaaggaagaa

SEQ ID NO: 4455743 - DNA, 13 bp, Homo sapiens
gacccaaggagga

SEQ ID NO: 4455744 - DNA, 17 bp, Homo sapiens
gacccaagtcaaagatg

SEQ ID NO: 4455745 - DNA, 14 bp, Homo sapiens
gacccaccccaact

SEQ ID NO: 4455746 - DNA, 23 bp, Homo sapiens
gacccaccccaactctccccagt

SEQ ID NO: 4455747 - DNA, 19 bp, Homo sapiens
gacccacctgtggggcctg

SEQ ID NO: 4455748 - DNA, 20 bp, Homo sapiens
gacccacctgtggggcctgg

SEQ ID NO: 4455749 - DNA, 23 bp, Homo sapiens
gacccacctgtggggcctgggga

SEQ ID NO: 4455750 - DNA, 20 bp, Homo sapiens
gacccacgaaactgccctgg

SEQ ID NO: 4455751 - DNA, 22 bp, Homo sapiens
gacccacgaaactgccctggct

SEQ ID NO: 4455752 - DNA, 18 bp, Homo sapiens
gacccacgtgctagggga

SEQ ID NO: 4455753 - DNA, 15 bp, Homo sapiens
gacccactctgcttc

SEQ ID NO: 4455754 - DNA, 20 bp, Homo sapiens
gacccagaatggagcctgct

SEQ ID NO: 4455755 - DNA, 19 bp, Homo sapiens
gacccagaggtccaggtcc

SEQ ID NO: 4455756 - DNA, 22 bp, Homo sapiens
gacccagagtggagtctgagtc

SEQ ID NO: 4455757 - DNA, 15 bp, Homo sapiens
gacccaggaaaggca

SEQ ID NO: 4455758 - DNA, 21 bp, Homo sapiens
gacccaggaaaggcaggattg

SEQ ID NO: 4455759 - DNA, 14 bp, Homo sapiens
gacccaggagtcca

SEQ ID NO: 4455760 - DNA, 15 bp, Homo sapiens
gacccaggagtccag

SEQ ID NO: 4455761 - DNA, 18 bp, Homo sapiens
gacccaggagtccagacc

SEQ ID NO: 4455762 - DNA, 17 bp, Homo sapiens
gacccaggagtccagcc

SEQ ID NO: 4455763 - DNA, 14 bp, Homo sapiens
gacccagggcctga

SEQ ID NO: 4455764 - DNA, 20 bp, Homo sapiens
gacccaggggtccaggcccc

SEQ ID NO: 4455765 - DNA, 15 bp, Homo sapiens
gacccagtccctggg

SEQ ID NO: 4455766 - DNA, 14 bp, Homo sapiens
gacccagtggggag

SEQ ID NO: 4455767 - DNA, 11 bp, Homo sapiens
gacccatctgt

SEQ ID NO: 4455768 - DNA, 12 bp, Homo sapiens
gaccccagagga

SEQ ID NO: 4455769 - DNA, 15 bp, Homo sapiens
gaccccagccatcca

SEQ ID NO: 4455770 - DNA, 23 bp, Homo sapiens
gaccccagtcgtgatgtggagga

SEQ ID NO: 4455771 - DNA, 13 bp, Homo sapiens
gacccccacacct

SEQ ID NO: 4455772 - DNA, 15 bp, Homo sapiens
gacccccacacctca

SEQ ID NO: 4455773 - DNA, 23 bp, Homo sapiens
gacccccactctcattccccagg

SEQ ID NO: 4455774 - DNA, 16 bp, Homo sapiens
gaccccccagcccctc

SEQ ID NO: 4455775 - DNA, 21 bp, Homo sapiens
gaccccccagcccctcctccc

SEQ ID NO: 4455776 - DNA, 17 bp, Homo sapiens
gaccccgcccctgggga

SEQ ID NO: 4455777 - DNA, 22 bp, Homo sapiens
gacccctcagccccagcccaga

SEQ ID NO: 4455778 - DNA, 19 bp, Homo sapiens
gacccctcgccccagcctc

SEQ ID NO: 4455779 - DNA, 14 bp, Homo sapiens
gacccgtctccagc

SEQ ID NO: 4455780 - DNA, 11 bp, Homo sapiens
gaccctacccc

SEQ ID NO: 4455781 - DNA, 16 bp, Homo sapiens
gaccctaccccaccac

SEQ ID NO: 4455782 - DNA, 11 bp, Homo sapiens
gaccctcagca

SEQ ID NO: 4455783 - DNA, 15 bp, Homo sapiens
gaccctcagcagctc

SEQ ID NO: 4455784 - DNA, 19 bp, Homo sapiens
gaccctcagcagctctggc

SEQ ID NO: 4455785 - DNA, 15 bp, Homo sapiens
gaccctcatctttct

SEQ ID NO: 4455786 - DNA, 18 bp, Homo sapiens
gaccctcctgttgcaccc

SEQ ID NO: 4455787 - DNA, 21 bp, Homo sapiens
gaccctcctgttgcacccagc

SEQ ID NO: 4455788 - DNA, 22 bp, Homo sapiens
gaccctcctgttgcacccagcc

SEQ ID NO: 4455789 - DNA, 20 bp, Homo sapiens
gaccctcgggccccatcctc

SEQ ID NO: 4455790 - DNA, 17 bp, Homo sapiens
gaccctcttgcccatcc

SEQ ID NO: 4455791 - DNA, 19 bp, Homo sapiens
gaccctcttgcccatcctg

SEQ ID NO: 4455792 - DNA, 22 bp, Homo sapiens
gaccctgacctccgcccctgcc

SEQ ID NO: 4455793 - DNA, 11 bp, Homo sapiens
gaccctgaggc

SEQ ID NO: 4455794 - DNA, 13 bp, Homo sapiens
gaccctgaggccc

SEQ ID NO: 4455795 - DNA, 17 bp, Homo sapiens
gaccctgaggccctggg

SEQ ID NO: 4455796 - DNA, 18 bp, Homo sapiens
gaccctgcaagaccacgg

SEQ ID NO: 4455797 - DNA, 15 bp, Homo sapiens
gaccctgggagagaa

SEQ ID NO: 4455798 - DNA, 16 bp, Homo sapiens
gaccctgggagagaag

SEQ ID NO: 4455799 - DNA, 12 bp, Homo sapiens
gaccctgggcag

SEQ ID NO: 4455800 - DNA, 18 bp, Homo sapiens
gaccctggggcaggggtg

SEQ ID NO: 4455801 - DNA, 12 bp, Homo sapiens
gaccctgtctca

SEQ ID NO: 4455802 - DNA, 21 bp, Homo sapiens
gaccctgtgacatggtgcctg

SEQ ID NO: 4455803 - DNA, 22 bp, Homo sapiens
gaccctgtgacatggtgcctga

SEQ ID NO: 4455804 - DNA, 16 bp, Homo sapiens
gacccttattgctgtc

SEQ ID NO: 4455805 - DNA, 15 bp, Homo sapiens
gacccttctgggtcc

SEQ ID NO: 4455806 - DNA, 21 bp, Homo sapiens
gacccttctgggtccagggag

SEQ ID NO: 4455807 - DNA, 16 bp, Homo sapiens
gacccttggaaaacaa

SEQ ID NO: 4455808 - DNA, 20 bp, Homo sapiens
gaccctttccttccttccct

SEQ ID NO: 4455809 - DNA, 15 bp, Homo sapiens
gaccgcaggagggca

SEQ ID NO: 4455810 - DNA, 19 bp, Homo sapiens
gaccggcggaccccagcca

SEQ ID NO: 4455811 - DNA, 20 bp, Homo sapiens
gaccggcggaccccagccat

SEQ ID NO: 4455812 - DNA, 19 bp, Homo sapiens
gaccgggcccctctctagg

SEQ ID NO: 4455813 - DNA, 15 bp, Homo sapiens
gaccggtacagaaag

SEQ ID NO: 4455814 - DNA, 16 bp, Homo sapiens
gaccggtgctgcagga

SEQ ID NO: 4455815 - DNA, 21 bp, Homo sapiens
gaccgtgggcggggccttgcg

SEQ ID NO: 4455816 - DNA, 23 bp, Homo sapiens
gaccgtttgtccacttcattttg

SEQ ID NO: 4455817 - DNA, 14 bp, Homo sapiens
gacctagcaggctg

SEQ ID NO: 4455818 - DNA, 14 bp, Homo sapiens
gacctcaagccatc

SEQ ID NO: 4455819 - DNA, 14 bp, Homo sapiens
gacctcagcaagct

SEQ ID NO: 4455820 - DNA, 18 bp, Homo sapiens
gacctcagcaagctgccc

SEQ ID NO: 4455821 - DNA, 21 bp, Homo sapiens
gacctcagcaagctgcccagc

SEQ ID NO: 4455822 - DNA, 22 bp, Homo sapiens
gacctcagcaagctgcccagcc

SEQ ID NO: 4455823 - DNA, 23 bp, Homo sapiens
gacctcagcaagctgcccagccc

SEQ ID NO: 4455824 - DNA, 19 bp, Homo sapiens
gacctcagttttatgcccc

SEQ ID NO: 4455825 - DNA, 13 bp, Homo sapiens
gacctcatcctgc

SEQ ID NO: 4455826 - DNA, 17 bp, Homo sapiens
gacctcatcctgctctt

SEQ ID NO: 4455827 - DNA, 21 bp, Homo sapiens
gacctcatcctgctcttttgt

SEQ ID NO: 4455828 - DNA, 14 bp, Homo sapiens
gacctccccacccg

SEQ ID NO: 4455829 - DNA, 16 bp, Homo sapiens
gacctccgcccctgcc

SEQ ID NO: 4455830 - DNA, 18 bp, Homo sapiens
gacctcctctgggccctg

SEQ ID NO: 4455831 - DNA, 17 bp, Homo sapiens
gacctcgactggttttt

SEQ ID NO: 4455832 - DNA, 16 bp, Homo sapiens
gacctcggacagagcc

SEQ ID NO: 4455833 - DNA, 20 bp, Homo sapiens
gacctcggacagagcccccc

SEQ ID NO: 4455834 - DNA, 21 bp, Homo sapiens
gacctcggacagagcccccct

SEQ ID NO: 4455835 - DNA, 15 bp, Homo sapiens
gacctcgtcctcccc

SEQ ID NO: 4455836 - DNA, 16 bp, Homo sapiens
gacctcgtcctccccc

SEQ ID NO: 4455837 - DNA, 21 bp, Homo sapiens
gacctcgtgatgggcccgcct

SEQ ID NO: 4455838 - DNA, 14 bp, Homo sapiens
gacctctaggagga

SEQ ID NO: 4455839 - DNA, 18 bp, Homo sapiens
gacctgaaataatatatt

SEQ ID NO: 4455840 - DNA, 15 bp, Homo sapiens
gacctgacagcttga

SEQ ID NO: 4455841 - DNA, 16 bp, Homo sapiens
gacctgcattgtaaat

SEQ ID NO: 4455842 - DNA, 15 bp, Homo sapiens
gacctgccaggcagg

SEQ ID NO: 4455843 - DNA, 12 bp, Homo sapiens
gacctgctcagg

SEQ ID NO: 4455844 - DNA, 16 bp, Homo sapiens
gacctggcactgggag

SEQ ID NO: 4455845 - DNA, 20 bp, Homo sapiens
gacctggcactgggaggcag

SEQ ID NO: 4455846 - DNA, 16 bp, Homo sapiens
gacctggcgtgctcag

SEQ ID NO: 4455847 - DNA, 16 bp, Homo sapiens
gacctggctccactct

SEQ ID NO: 4455848 - DNA, 15 bp, Homo sapiens
gacctggtgcccctg

SEQ ID NO: 4455849 - DNA, 16 bp, Homo sapiens
gacctggtgcccctgc

SEQ ID NO: 4455850 - DNA, 19 bp, Homo sapiens
gacctggtttgaatggaga

SEQ ID NO: 4455851 - DNA, 22 bp, Homo sapiens
gaccttacccctggctgtttgg

SEQ ID NO: 4455852 - DNA, 22 bp, Homo sapiens
gaccttactcctctttccttcc

SEQ ID NO: 4455853 - DNA, 23 bp, Homo sapiens
gaccttggaaacagttggcactg

SEQ ID NO: 4455854 - DNA, 11 bp, Homo sapiens
gacctttattt

SEQ ID NO: 4455855 - DNA, 18 bp, Homo sapiens
gaccttttgggggagggc

SEQ ID NO: 4455856 - DNA, 16 bp, Homo sapiens
gacgcaaggtgtgctc

SEQ ID NO: 4455857 - DNA, 22 bp, Homo sapiens
gacgcaccgcctgaaggcacag

SEQ ID NO: 4455858 - DNA, 24 bp, Homo sapiens
gacgcaccgcctgaaggcacagct

SEQ ID NO: 4455859 - DNA, 17 bp, Homo sapiens
gacgccactcatttcat

SEQ ID NO: 4455860 - DNA, 21 bp, Homo sapiens
gacgccactcatttcatctca

SEQ ID NO: 4455861 - DNA, 23 bp, Homo sapiens
gacgccactcatttcatctcatt

SEQ ID NO: 4455862 - DNA, 15 bp, Homo sapiens
gacgccactccctgg

SEQ ID NO: 4455863 - DNA, 23 bp, Homo sapiens
gacgccctatttctatgtcattt

SEQ ID NO: 4455864 - DNA, 21 bp, Homo sapiens
gacgccggggacagaggcctg

SEQ ID NO: 4455865 - DNA, 14 bp, Homo sapiens
gacgcctgaggaac

SEQ ID NO: 4455866 - DNA, 12 bp, Homo sapiens
gacgcctgcagg

SEQ ID NO: 4455867 - DNA, 21 bp, Homo sapiens
gacgcctgggggtgccaggac

SEQ ID NO: 4455868 - DNA, 22 bp, Homo sapiens
gacggatgcccattcctgcctg

SEQ ID NO: 4455869 - DNA, 16 bp, Homo sapiens
gacggcaggctcactg

SEQ ID NO: 4455870 - DNA, 19 bp, Homo sapiens
gacggcaggctcactgcca

SEQ ID NO: 4455871 - DNA, 23 bp, Homo sapiens
gacggctcctcagagcgccagga

SEQ ID NO: 4455872 - DNA, 15 bp, Homo sapiens
gacgggatgctcttt

SEQ ID NO: 4455873 - DNA, 17 bp, Homo sapiens
gacgggatgctctttaa

SEQ ID NO: 4455874 - DNA, 22 bp, Homo sapiens
gacgggatgctctttaaataat

SEQ ID NO: 4455875 - DNA, 16 bp, Homo sapiens
gacggtctgtgtgctg

SEQ ID NO: 4455876 - DNA, 14 bp, Homo sapiens
gacgtattatctgt

SEQ ID NO: 4455877 - DNA, 19 bp, Homo sapiens
gacgtcatcggaggctggg

SEQ ID NO: 4455878 - DNA, 18 bp, Homo sapiens
gacgtctgtcaggggctt

SEQ ID NO: 4455879 - DNA, 22 bp, Homo sapiens
gacgtgaacgttttaataattt

SEQ ID NO: 4455880 - DNA, 18 bp, Homo sapiens
gacgtgaatgtctcagcg

SEQ ID NO: 4455881 - DNA, 17 bp, Homo sapiens
gacgtgattttgctgta

SEQ ID NO: 4455882 - DNA, 24 bp, Homo sapiens
gacgtggtgggactccagctcgtg

SEQ ID NO: 4455883 - DNA, 12 bp, Homo sapiens
gacgttccagcc

SEQ ID NO: 4455884 - DNA, 13 bp, Homo sapiens
gacgttccagccg

SEQ ID NO: 4455885 - DNA, 14 bp, Homo sapiens
gacgttgcctgaga

SEQ ID NO: 4455886 - DNA, 14 bp, Homo sapiens
gacgttgctgagcc

SEQ ID NO: 4455887 - DNA, 21 bp, Homo sapiens
gacgttgctgagccagctgca

SEQ ID NO: 4455888 - DNA, 23 bp, Homo sapiens
gacgtttttgtgctgtgggcagc

SEQ ID NO: 4455889 - DNA, 18 bp, Homo sapiens
gactaaactttttttctg

SEQ ID NO: 4455890 - DNA, 19 bp, Homo sapiens
gactaaactttttttctgt

SEQ ID NO: 4455891 - DNA, 19 bp, Homo sapiens
gactaaaggatccagagag

SEQ ID NO: 4455892 - DNA, 14 bp, Homo sapiens
gactaacttgaaaa

SEQ ID NO: 4455893 - DNA, 23 bp, Homo sapiens
gactaagagaagttgtaaagtat

SEQ ID NO: 4455894 - DNA, 15 bp, Homo sapiens
gactaagcctacctg

SEQ ID NO: 4455895 - DNA, 23 bp, Homo sapiens
gactaattttacatgtttataaa

SEQ ID NO: 4455896 - DNA, 17 bp, Homo sapiens
gactacaaaataaaact

SEQ ID NO: 4455897 - DNA, 22 bp, Homo sapiens
gactacacaatacagtattata

SEQ ID NO: 4455898 - DNA, 23 bp, Homo sapiens
gactactaaggccttttatgtaa

SEQ ID NO: 4455899 - DNA, 20 bp, Homo sapiens
gactagaacctggagggctg

SEQ ID NO: 4455900 - DNA, 23 bp, Homo sapiens
gactagaagggccagtcctgcct

SEQ ID NO: 4455901 - DNA, 17 bp, Homo sapiens
gactagatgtagtattt

SEQ ID NO: 4455902 - DNA, 17 bp, Homo sapiens
gactagcaatctcttca

SEQ ID NO: 4455903 - DNA, 14 bp, Homo sapiens
gactagcctggcca

SEQ ID NO: 4455904 - DNA, 22 bp, Homo sapiens
gactaggatattgaatgtgaaa

SEQ ID NO: 4455905 - DNA, 18 bp, Homo sapiens
gactagggattcaggctg

SEQ ID NO: 4455906 - DNA, 12 bp, Homo sapiens
gactataaatgt

SEQ ID NO: 4455907 - DNA, 15 bp, Homo sapiens
gactatctacaaaaa

SEQ ID NO: 4455908 - DNA, 16 bp, Homo sapiens
gactatctacaaaaat

SEQ ID NO: 4455909 - DNA, 19 bp, Homo sapiens
gactatcttactatttcac

SEQ ID NO: 4455910 - DNA, 13 bp, Homo sapiens
gactatctttgct

SEQ ID NO: 4455911 - DNA, 15 bp, Homo sapiens
gactatggagctgag

SEQ ID NO: 4455912 - DNA, 20 bp, Homo sapiens
gactatggagtcttgtgaaa

SEQ ID NO: 4455913 - DNA, 15 bp, Homo sapiens
gactattcaaacagt

SEQ ID NO: 4455914 - DNA, 22 bp, Homo sapiens
gactattcaaacagtctcagga

SEQ ID NO: 4455915 - DNA, 15 bp, Homo sapiens
gactattcatggcta

SEQ ID NO: 4455916 - DNA, 17 bp, Homo sapiens
gactattgtgccaactg

SEQ ID NO: 4455917 - DNA, 13 bp, Homo sapiens
gactatttctttt

SEQ ID NO: 4455918 - DNA, 21 bp, Homo sapiens
gactcaaggtggacgtgcgtt

SEQ ID NO: 4455919 - DNA, 22 bp, Homo sapiens
gactcaatgtggaaaaaatatt

SEQ ID NO: 4455920 - DNA, 13 bp, Homo sapiens
gactcagaggtcc

SEQ ID NO: 4455921 - DNA, 14 bp, Homo sapiens
gactcagaggtcca

SEQ ID NO: 4455922 - DNA, 15 bp, Homo sapiens
gactcagaggtccag

SEQ ID NO: 4455923 - DNA, 19 bp, Homo sapiens
gactcagaggtccaggccc

SEQ ID NO: 4455924 - DNA, 18 bp, Homo sapiens
gactcagatgaggacaga

SEQ ID NO: 4455925 - DNA, 13 bp, Homo sapiens
gactcagccctga

SEQ ID NO: 4455926 - DNA, 13 bp, Homo sapiens
gactcagcctctg

SEQ ID NO: 4455927 - DNA, 17 bp, Homo sapiens
gactcagcctctgctgg

SEQ ID NO: 4455928 - DNA, 18 bp, Homo sapiens
gactcagccttcctcctc

SEQ ID NO: 4455929 - DNA, 18 bp, Homo sapiens
gactcaggagtctgccac

SEQ ID NO: 4455930 - DNA, 18 bp, Homo sapiens
gactcagggaccggtgct

SEQ ID NO: 4455931 - DNA, 20 bp, Homo sapiens
gactcagggaccggtgctgc

SEQ ID NO: 4455932 - DNA, 23 bp, Homo sapiens
gactcagggaccggtgctgcagg

SEQ ID NO: 4455933 - DNA, 12 bp, Homo sapiens
gactcagggctc

SEQ ID NO: 4455934 - DNA, 14 bp, Homo sapiens
gactcagggctcct

SEQ ID NO: 4455935 - DNA, 17 bp, Homo sapiens
gactcagggctcctggg

SEQ ID NO: 4455936 - DNA, 17 bp, Homo sapiens
gactcaggttccagaac

SEQ ID NO: 4455937 - DNA, 18 bp, Homo sapiens
gactcagtgaccagtgcc

SEQ ID NO: 4455938 - DNA, 21 bp, Homo sapiens
gactcagtgtctgcctttaaa

SEQ ID NO: 4455939 - DNA, 23 bp, Homo sapiens
gactcatcctgatttttactatc

SEQ ID NO: 4455940 - DNA, 21 bp, Homo sapiens
gactcattttaaaaaatggaa

SEQ ID NO: 4455941 - DNA, 10 bp, Homo sapiens
gactccagcc

SEQ ID NO: 4455942 - DNA, 20 bp, Homo sapiens
gactccagccagcgcctccc

SEQ ID NO: 4455943 - DNA, 20 bp, Homo sapiens
gactccagcctgcctggcag

SEQ ID NO: 4455944 - DNA, 12 bp, Homo sapiens
gactccaggccc

SEQ ID NO: 4455945 - DNA, 12 bp, Homo sapiens
gactccatctca

SEQ ID NO: 4455946 - DNA, 14 bp, Homo sapiens
gactccatctcttc

SEQ ID NO: 4455947 - DNA, 21 bp, Homo sapiens
gactcccatgaagccttttga

SEQ ID NO: 4455948 - DNA, 12 bp, Homo sapiens
gactccctcctc

SEQ ID NO: 4455949 - DNA, 13 bp, Homo sapiens
gactccctgtggg

SEQ ID NO: 4455950 - DNA, 18 bp, Homo sapiens
gactccgagaagctctcg

SEQ ID NO: 4455951 - DNA, 13 bp, Homo sapiens
gactccggaggac

SEQ ID NO: 4455952 - DNA, 15 bp, Homo sapiens
gactccggaggactg

SEQ ID NO: 4455953 - DNA, 19 bp, Homo sapiens
gactccggaggactgagcc

SEQ ID NO: 4455954 - DNA, 16 bp, Homo sapiens
gactccggctgtgctg

SEQ ID NO: 4455955 - DNA, 16 bp, Homo sapiens
gactcctcctttttcc

SEQ ID NO: 4455956 - DNA, 17 bp, Homo sapiens
gactcctcctttttcca

SEQ ID NO: 4455957 - DNA, 13 bp, Homo sapiens
gactcctctggct

SEQ ID NO: 4455958 - DNA, 22 bp, Homo sapiens
gactcctgaaacctcttcctag

SEQ ID NO: 4455959 - DNA, 20 bp, Homo sapiens
gactcgatttaaactccagc

SEQ ID NO: 4455960 - DNA, 21 bp, Homo sapiens
gactcggagactatggcctcg

SEQ ID NO: 4455961 - DNA, 16 bp, Homo sapiens
gactctagcaaggctc

SEQ ID NO: 4455962 - DNA, 13 bp, Homo sapiens
gactctaggcttc

SEQ ID NO: 4455963 - DNA, 15 bp, Homo sapiens
gactctcagcccaga

SEQ ID NO: 4455964 - DNA, 21 bp, Homo sapiens
gactctcagcccagaagaaaa

SEQ ID NO: 4455965 - DNA, 16 bp, Homo sapiens
gactctcagtctctga

SEQ ID NO: 4455966 - DNA, 23 bp, Homo sapiens
gactctccctgtacacagtgccc

SEQ ID NO: 4455967 - DNA, 13 bp, Homo sapiens
gactctcctcctc

SEQ ID NO: 4455968 - DNA, 14 bp, Homo sapiens
gactctcctcctcc

SEQ ID NO: 4455969 - DNA, 20 bp, Homo sapiens
gactctcctcctcccctcct

SEQ ID NO: 4455970 - DNA, 15 bp, Homo sapiens
gactctgaagcctct

SEQ ID NO: 4455971 - DNA, 16 bp, Homo sapiens
gactctgaagcctctg

SEQ ID NO: 4455972 - DNA, 21 bp, Homo sapiens
gactctgcacccgcctcgacc

SEQ ID NO: 4455973 - DNA, 19 bp, Homo sapiens
gactctgccccctgctggc

SEQ ID NO: 4455974 - DNA, 22 bp, Homo sapiens
gactctgccccctgctggctct

SEQ ID NO: 4455975 - DNA, 23 bp, Homo sapiens
gactctgcgggaggctggggccc

SEQ ID NO: 4455976 - DNA, 19 bp, Homo sapiens
gactctgtctacctggtct

SEQ ID NO: 4455977 - DNA, 22 bp, Homo sapiens
gactcttctaaaaatgaagatg

SEQ ID NO: 4455978 - DNA, 20 bp, Homo sapiens
gactctttccgactgcccag

SEQ ID NO: 4455979 - DNA, 19 bp, Homo sapiens
gactctttctgagtgcctt

SEQ ID NO: 4455980 - DNA, 21 bp, Homo sapiens
gactctttctgagtgccttct

SEQ ID NO: 4455981 - DNA, 22 bp, Homo sapiens
gactgaaaaaaaaaaagaagaa

SEQ ID NO: 4455982 - DNA, 23 bp, Homo sapiens
gactgaaaggtgtgaacagcttt

SEQ ID NO: 4455983 - DNA, 15 bp, Homo sapiens
gactgaaagtagggg

SEQ ID NO: 4455984 - DNA, 21 bp, Homo sapiens
gactgaccaatattgtacagt

SEQ ID NO: 4455985 - DNA, 22 bp, Homo sapiens
gactgagactggcacttagccc

SEQ ID NO: 4455986 - DNA, 19 bp, Homo sapiens
gactgagcagccgccagct

SEQ ID NO: 4455987 - DNA, 14 bp, Homo sapiens
gactgaggcctgag

SEQ ID NO: 4455988 - DNA, 23 bp, Homo sapiens
gactgaggcctgagcgctcctgc

SEQ ID NO: 4455989 - DNA, 21 bp, Homo sapiens
gactgagggactctgaagcct

SEQ ID NO: 4455990 - DNA, 16 bp, Homo sapiens
gactgaggggagggga

SEQ ID NO: 4455991 - DNA, 15 bp, Homo sapiens
gactgagggggcctg

SEQ ID NO: 4455992 - DNA, 19 bp, Homo sapiens
gactgagggggcctggatg

SEQ ID NO: 4455993 - DNA, 14 bp, Homo sapiens
gactgagtgggaag

SEQ ID NO: 4455994 - DNA, 22 bp, Homo sapiens
gactgagtgggaagcccatcct

SEQ ID NO: 4455995 - DNA, 20 bp, Homo sapiens
gactgatgttcatgatagaa

SEQ ID NO: 4455996 - DNA, 16 bp, Homo sapiens
gactgatttcagagtg

SEQ ID NO: 4455997 - DNA, 18 bp, Homo sapiens
gactgcatggtaatttat

SEQ ID NO: 4455998 - DNA, 16 bp, Homo sapiens
gactgccaggctgttt

SEQ ID NO: 4455999 - DNA, 21 bp, Homo sapiens
gactgcccagaaagtgggggt

SEQ ID NO: 4456000 - DNA, 14 bp, Homo sapiens
gactgcccccagaa

SEQ ID NO: 4456001 - DNA, 16 bp, Homo sapiens
gactgcccggcacaga

SEQ ID NO: 4456002 - DNA, 15 bp, Homo sapiens
gactgcctgtctgct

SEQ ID NO: 4456003 - DNA, 16 bp, Homo sapiens
gactgcgttctgcaag

SEQ ID NO: 4456004 - DNA, 12 bp, Homo sapiens
gactgctaaata

SEQ ID NO: 4456005 - DNA, 14 bp, Homo sapiens
gactgctaaataaa

SEQ ID NO: 4456006 - DNA, 18 bp, Homo sapiens
gactgctacctctgagaa

SEQ ID NO: 4456007 - DNA, 23 bp, Homo sapiens
gactgctacctctgagaagacac

SEQ ID NO: 4456008 - DNA, 19 bp, Homo sapiens
gactgctggacataaatca

SEQ ID NO: 4456009 - DNA, 21 bp, Homo sapiens
gactggaaggtccttgcctga

SEQ ID NO: 4456010 - DNA, 14 bp, Homo sapiens
gactggaggaggcc

SEQ ID NO: 4456011 - DNA, 16 bp, Homo sapiens
gactggaggaggcctg

SEQ ID NO: 4456012 - DNA, 18 bp, Homo sapiens
gactggcacagttttctg

SEQ ID NO: 4456013 - DNA, 16 bp, Homo sapiens
gactggcacttagccc

SEQ ID NO: 4456014 - DNA, 20 bp, Homo sapiens
gactggcacttagcccaaga

SEQ ID NO: 4456015 - DNA, 16 bp, Homo sapiens
gactggcccctgggtc

SEQ ID NO: 4456016 - DNA, 14 bp, Homo sapiens
gactggcggagaag

SEQ ID NO: 4456017 - DNA, 21 bp, Homo sapiens
gactggcgttcacctccctgc

SEQ ID NO: 4456018 - DNA, 23 bp, Homo sapiens
gactggctagagtcctcactccc

SEQ ID NO: 4456019 - DNA, 11 bp, Homo sapiens
gactggctcct

SEQ ID NO: 4456020 - DNA, 10 bp, Homo sapiens
gactggcttt

SEQ ID NO: 4456021 - DNA, 21 bp, Homo sapiens
gactggcttttattaatgcac

SEQ ID NO: 4456022 - DNA, 14 bp, Homo sapiens
gactgggaacccat

SEQ ID NO: 4456023 - DNA, 22 bp, Homo sapiens
gactgggagccacttctcccca

SEQ ID NO: 4456024 - DNA, 15 bp, Homo sapiens
gactgggccccacat

SEQ ID NO: 4456025 - DNA, 21 bp, Homo sapiens
gactgggctgagggagcctgg

SEQ ID NO: 4456026 - DNA, 14 bp, Homo sapiens
gactggttttctgc

SEQ ID NO: 4456027 - DNA, 15 bp, Homo sapiens
gactggttttctgcc

SEQ ID NO: 4456028 - DNA, 18 bp, Homo sapiens
gactgtacacactttatt

SEQ ID NO: 4456029 - DNA, 11 bp, Homo sapiens
gactgtacata

SEQ ID NO: 4456030 - DNA, 22 bp, Homo sapiens
gactgtacataattgcatgaaa

SEQ ID NO: 4456031 - DNA, 16 bp, Homo sapiens
gactgtagccacagct

SEQ ID NO: 4456032 - DNA, 17 bp, Homo sapiens
gactgtagccacagctg

SEQ ID NO: 4456033 - DNA, 20 bp, Homo sapiens
gactgtagccacagctgctg

SEQ ID NO: 4456034 - DNA, 16 bp, Homo sapiens
gactgtatattgctaa

SEQ ID NO: 4456035 - DNA, 22 bp, Homo sapiens
gactgtcacggggttccctcct

SEQ ID NO: 4456036 - DNA, 13 bp, Homo sapiens
gactgtcagttct

SEQ ID NO: 4456037 - DNA, 13 bp, Homo sapiens
gactgtccaggga

SEQ ID NO: 4456038 - DNA, 21 bp, Homo sapiens
gactgtgaacttgactgggtg

SEQ ID NO: 4456039 - DNA, 16 bp, Homo sapiens
gactgtgccagaggcc

SEQ ID NO: 4456040 - DNA, 17 bp, Homo sapiens
gactgtgccagaggcca

SEQ ID NO: 4456041 - DNA, 13 bp, Homo sapiens
gactgtgcctggc

SEQ ID NO: 4456042 - DNA, 16 bp, Homo sapiens
gactgtgcctggctcc

SEQ ID NO: 4456043 - DNA, 15 bp, Homo sapiens
gactgtgctggtgca

SEQ ID NO: 4456044 - DNA, 19 bp, Homo sapiens
gactgtgtaactttctctt

SEQ ID NO: 4456045 - DNA, 18 bp, Homo sapiens
gactgttacagactgaaa

SEQ ID NO: 4456046 - DNA, 19 bp, Homo sapiens
gactgttacagactgaaag

SEQ ID NO: 4456047 - DNA, 22 bp, Homo sapiens
gactgttactttggcaatttcc

SEQ ID NO: 4456048 - DNA, 22 bp, Homo sapiens
gactgttccaggccctccagtg

SEQ ID NO: 4456049 - DNA, 18 bp, Homo sapiens
gactgttgtacaagctca

SEQ ID NO: 4456050 - DNA, 21 bp, Homo sapiens
gacttaacgttctataaatga

SEQ ID NO: 4456051 - DNA, 22 bp, Homo sapiens
gacttaacgttctataaatgaa

SEQ ID NO: 4456052 - DNA, 20 bp, Homo sapiens
gacttaactgcatttttaga

SEQ ID NO: 4456053 - DNA, 22 bp, Homo sapiens
gacttaagcatctggctctaat

SEQ ID NO: 4456054 - DNA, 21 bp, Homo sapiens
gacttaaggggctgggatgct

SEQ ID NO: 4456055 - DNA, 11 bp, Homo sapiens
gacttacaatt

SEQ ID NO: 4456056 - DNA, 17 bp, Homo sapiens
gacttagcgtcaagaca

SEQ ID NO: 4456057 - DNA, 20 bp, Homo sapiens
gacttagcgtcaagacattt

SEQ ID NO: 4456058 - DNA, 21 bp, Homo sapiens
gacttagcgtcaagacatttg

SEQ ID NO: 4456059 - DNA, 18 bp, Homo sapiens
gacttatagtacatgata

SEQ ID NO: 4456060 - DNA, 13 bp, Homo sapiens
gacttatttctgc

SEQ ID NO: 4456061 - DNA, 17 bp, Homo sapiens
gacttatttctgctctg

SEQ ID NO: 4456062 - DNA, 18 bp, Homo sapiens
gacttatttctgctctgg

SEQ ID NO: 4456063 - DNA, 20 bp, Homo sapiens
gacttatttctgctctggaa

SEQ ID NO: 4456064 - DNA, 13 bp, Homo sapiens
gacttcacactgc

SEQ ID NO: 4456065 - DNA, 14 bp, Homo sapiens
gacttcacactgca

SEQ ID NO: 4456066 - DNA, 13 bp, Homo sapiens
gacttcactgtat

SEQ ID NO: 4456067 - DNA, 15 bp, Homo sapiens
gacttcactgtatat

SEQ ID NO: 4456068 - DNA, 17 bp, Homo sapiens
gacttcactgtatataa

SEQ ID NO: 4456069 - DNA, 19 bp, Homo sapiens
gacttcactgtatataaac

SEQ ID NO: 4456070 - DNA, 18 bp, Homo sapiens
gacttcattttatattta

SEQ ID NO: 4456071 - DNA, 19 bp, Homo sapiens
gacttccaaatcctggaag

SEQ ID NO: 4456072 - DNA, 20 bp, Homo sapiens
gacttccaaatcctggaagg

SEQ ID NO: 4456073 - DNA, 18 bp, Homo sapiens
gacttcccacggctcctc

SEQ ID NO: 4456074 - DNA, 18 bp, Homo sapiens
gacttcccagctaggaag

SEQ ID NO: 4456075 - DNA, 11 bp, Homo sapiens
gacttccccat

SEQ ID NO: 4456076 - DNA, 19 bp, Homo sapiens
gacttctaagtaaaaccac

SEQ ID NO: 4456077 - DNA, 15 bp, Homo sapiens
gacttctacctgccc

SEQ ID NO: 4456078 - DNA, 22 bp, Homo sapiens
gacttctcggaattcataataa

SEQ ID NO: 4456079 - DNA, 13 bp, Homo sapiens
gacttctgcagct

SEQ ID NO: 4456080 - DNA, 14 bp, Homo sapiens
gacttctggcctag

SEQ ID NO: 4456081 - DNA, 20 bp, Homo sapiens
gacttctgtcttcacaacag

SEQ ID NO: 4456082 - DNA, 16 bp, Homo sapiens
gacttcttcctctaga

SEQ ID NO: 4456083 - DNA, 13 bp, Homo sapiens
gacttgaaagaaa

SEQ ID NO: 4456084 - DNA, 18 bp, Homo sapiens
gacttgctccctctccaa

SEQ ID NO: 4456085 - DNA, 12 bp, Homo sapiens
gacttgctttaa

SEQ ID NO: 4456086 - DNA, 19 bp, Homo sapiens
gacttggagactcctggtc

SEQ ID NO: 4456087 - DNA, 18 bp, Homo sapiens
gacttgtcccgggacacc

SEQ ID NO: 4456088 - DNA, 16 bp, Homo sapiens
gactttacaaaccttt

SEQ ID NO: 4456089 - DNA, 20 bp, Homo sapiens
gactttacaaacctttgttt

SEQ ID NO: 4456090 - DNA, 19 bp, Homo sapiens
gactttagaaagctgacat

SEQ ID NO: 4456091 - DNA, 13 bp, Homo sapiens
gactttatattta

SEQ ID NO: 4456092 - DNA, 19 bp, Homo sapiens
gactttatgaataatttca

SEQ ID NO: 4456093 - DNA, 19 bp, Homo sapiens
gactttcttctagtgcttt

SEQ ID NO: 4456094 - DNA, 18 bp, Homo sapiens
gactttctttttctacat

SEQ ID NO: 4456095 - DNA, 21 bp, Homo sapiens
gactttctttttctacatgtg

SEQ ID NO: 4456096 - DNA, 12 bp, Homo sapiens
gactttgctgtt

SEQ ID NO: 4456097 - DNA, 20 bp, Homo sapiens
gactttgtgttcatttcatt

SEQ ID NO: 4456098 - DNA, 15 bp, Homo sapiens
gacttttgaaaaaaa

SEQ ID NO: 4456099 - DNA, 23 bp, Homo sapiens
gacttttgatagttctataagaa

SEQ ID NO: 4456100 - DNA, 16 bp, Homo sapiens
gactttttataaaatg

SEQ ID NO: 4456101 - DNA, 19 bp, Homo sapiens
gagaaacactgaaaagaag

SEQ ID NO: 4456102 - DNA, 18 bp, Homo sapiens
gagaaacagttggtaact

SEQ ID NO: 4456103 - DNA, 19 bp, Homo sapiens
gagaaacagttggtaactt

SEQ ID NO: 4456104 - DNA, 22 bp, Homo sapiens
gagaaaccgtcctctttttcca

SEQ ID NO: 4456105 - DNA, 24 bp, Homo sapiens
gagaaacttaaatgttattatctg

SEQ ID NO: 4456106 - DNA, 14 bp, Homo sapiens
gagaaagaggccag

SEQ ID NO: 4456107 - DNA, 16 bp, Homo sapiens
gagaaagcatattgac

SEQ ID NO: 4456108 - DNA, 20 bp, Homo sapiens
gagaaagcatattgactttt

SEQ ID NO: 4456109 - DNA, 18 bp, Homo sapiens
gagaaagccacgccctcc

SEQ ID NO: 4456110 - DNA, 18 bp, Homo sapiens
gagaaagcttaatatatt

SEQ ID NO: 4456111 - DNA, 15 bp, Homo sapiens
gagaaagcttttatt

SEQ ID NO: 4456112 - DNA, 18 bp, Homo sapiens
gagaaagcttttattcct

SEQ ID NO: 4456113 - DNA, 13 bp, Homo sapiens
gagaaaggacaga

SEQ ID NO: 4456114 - DNA, 18 bp, Homo sapiens
gagaaatacaaaataaag

SEQ ID NO: 4456115 - DNA, 18 bp, Homo sapiens
gagaaatctggctgtcct

SEQ ID NO: 4456116 - DNA, 13 bp, Homo sapiens
gagaaatgcaata

SEQ ID NO: 4456117 - DNA, 22 bp, Homo sapiens
gagaaatgcaataactctggga

SEQ ID NO: 4456118 - DNA, 17 bp, Homo sapiens
gagaaattcgtgtgttt

SEQ ID NO: 4456119 - DNA, 11 bp, Homo sapiens
gagaaattggg

SEQ ID NO: 4456120 - DNA, 12 bp, Homo sapiens
gagaacaaatat

SEQ ID NO: 4456121 - DNA, 20 bp, Homo sapiens
gagaacagtattgggcagga

SEQ ID NO: 4456122 - DNA, 23 bp, Homo sapiens
gagaacagtattgggcaggagga

SEQ ID NO: 4456123 - DNA, 17 bp, Homo sapiens
gagaacctcagattctt

SEQ ID NO: 4456124 - DNA, 14 bp, Homo sapiens
gagaacgcagccct

SEQ ID NO: 4456125 - DNA, 15 bp, Homo sapiens
gagaactttcatttt

SEQ ID NO: 4456126 - DNA, 17 bp, Homo sapiens
gagaactttcatttttt

SEQ ID NO: 4456127 - DNA, 13 bp, Homo sapiens
gagaagagctgtt

SEQ ID NO: 4456128 - DNA, 19 bp, Homo sapiens
gagaagagggcccagccca

SEQ ID NO: 4456129 - DNA, 15 bp, Homo sapiens
gagaagccatgtact

SEQ ID NO: 4456130 - DNA, 21 bp, Homo sapiens
gagaagccatgtactcaagta

SEQ ID NO: 4456131 - DNA, 20 bp, Homo sapiens
gagaagctaaaacctgagct

SEQ ID NO: 4456132 - DNA, 16 bp, Homo sapiens
gagaaggaaaaagaaa

SEQ ID NO: 4456133 - DNA, 22 bp, Homo sapiens
gagaaggataggccttcattaa

SEQ ID NO: 4456134 - DNA, 12 bp, Homo sapiens
gagaaggcagga

SEQ ID NO: 4456135 - DNA, 21 bp, Homo sapiens
gagaagtcttctatttattta

SEQ ID NO: 4456136 - DNA, 17 bp, Homo sapiens
gagaagtggaaatttat

SEQ ID NO: 4456137 - DNA, 17 bp, Homo sapiens
gagaatcactgctccag

SEQ ID NO: 4456138 - DNA, 21 bp, Homo sapiens
gagaatccaagggttgagagc

SEQ ID NO: 4456139 - DNA, 16 bp, Homo sapiens
gagaatgaacccgagg

SEQ ID NO: 4456140 - DNA, 12 bp, Homo sapiens
gagaatgcacag

SEQ ID NO: 4456141 - DNA, 16 bp, Homo sapiens
gagaatgcacagatat

SEQ ID NO: 4456142 - DNA, 19 bp, Homo sapiens
gagaatgctttgaaaatgt

SEQ ID NO: 4456143 - DNA, 21 bp, Homo sapiens
gagaatggtgtgaacccggga

SEQ ID NO: 4456144 - DNA, 16 bp, Homo sapiens
gagaatgtaagaacta

SEQ ID NO: 4456145 - DNA, 13 bp, Homo sapiens
gagaattgcttga

SEQ ID NO: 4456146 - DNA, 20 bp, Homo sapiens
gagaatttctactgagcgag

SEQ ID NO: 4456147 - DNA, 20 bp, Homo sapiens
gagacaacagcacacaggca

SEQ ID NO: 4456148 - DNA, 16 bp, Homo sapiens
gagacaaggtgctaac

SEQ ID NO: 4456149 - DNA, 14 bp, Homo sapiens
gagacaatgaaaca

SEQ ID NO: 4456150 - DNA, 20 bp, Homo sapiens
gagacacctgcacctccccc

SEQ ID NO: 4456151 - DNA, 17 bp, Homo sapiens
gagacacgctggcgaca

SEQ ID NO: 4456152 - DNA, 12 bp, Homo sapiens
gagacactgagc

SEQ ID NO: 4456153 - DNA, 22 bp, Homo sapiens
gagacagaccacttgccacgct

SEQ ID NO: 4456154 - DNA, 15 bp, Homo sapiens
gagacagaggaaagg

SEQ ID NO: 4456155 - DNA, 14 bp, Homo sapiens
gagacagatgctgg

SEQ ID NO: 4456156 - DNA, 12 bp, Homo sapiens
gagacagccagg

SEQ ID NO: 4456157 - DNA, 20 bp, Homo sapiens
gagacagccaggtggcacct

SEQ ID NO: 4456158 - DNA, 13 bp, Homo sapiens
gagacagcccagg

SEQ ID NO: 4456159 - DNA, 13 bp, Homo sapiens
gagacagctctgc

SEQ ID NO: 4456160 - DNA, 15 bp, Homo sapiens
gagacagctctgcat

SEQ ID NO: 4456161 - DNA, 14 bp, Homo sapiens
gagacaggaacggc

SEQ ID NO: 4456162 - DNA, 19 bp, Homo sapiens
gagacaggacagaatgtgt

SEQ ID NO: 4456163 - DNA, 23 bp, Homo sapiens
gagacaggacagaatgtgttctt

SEQ ID NO: 4456164 - DNA, 20 bp, Homo sapiens
gagacaggagaatcacctga

SEQ ID NO: 4456165 - DNA, 13 bp, Homo sapiens
gagacaggcagcc

SEQ ID NO: 4456166 - DNA, 15 bp, Homo sapiens
gagacaggctgggtc

SEQ ID NO: 4456167 - DNA, 16 bp, Homo sapiens
gagacagggctgctcc

SEQ ID NO: 4456168 - DNA, 18 bp, Homo sapiens
gagacaggtcagtagtca

SEQ ID NO: 4456169 - DNA, 15 bp, Homo sapiens
gagacagttctctgt

SEQ ID NO: 4456170 - DNA, 21 bp, Homo sapiens
gagacatctgcacccctgagt

SEQ ID NO: 4456171 - DNA, 14 bp, Homo sapiens
gagacatctggaaa

SEQ ID NO: 4456172 - DNA, 14 bp, Homo sapiens
gagaccaacctgac

SEQ ID NO: 4456173 - DNA, 16 bp, Homo sapiens
gagaccagggtggcca

SEQ ID NO: 4456174 - DNA, 16 bp, Homo sapiens
gagaccatcctggcta

SEQ ID NO: 4456175 - DNA, 13 bp, Homo sapiens
gagacccccacac

SEQ ID NO: 4456176 - DNA, 23 bp, Homo sapiens
gagacccccacacctcagttccc

SEQ ID NO: 4456177 - DNA, 13 bp, Homo sapiens
gagacccctggcc

SEQ ID NO: 4456178 - DNA, 14 bp, Homo sapiens
gagacccctggcct

SEQ ID NO: 4456179 - DNA, 14 bp, Homo sapiens
gagaccctgcaaga

SEQ ID NO: 4456180 - DNA, 16 bp, Homo sapiens
gagaccctgcaagacc

SEQ ID NO: 4456181 - DNA, 15 bp, Homo sapiens
gagaccctgccacag

SEQ ID NO: 4456182 - DNA, 16 bp, Homo sapiens
gagacctcatcctgct

SEQ ID NO: 4456183 - DNA, 21 bp, Homo sapiens
gagacctcatcctgctctttt

SEQ ID NO: 4456184 - DNA, 12 bp, Homo sapiens
gagaccttaccc

SEQ ID NO: 4456185 - DNA, 14 bp, Homo sapiens
gagacgaggcattc

SEQ ID NO: 4456186 - DNA, 16 bp, Homo sapiens
gagacgaggcattcgg

SEQ ID NO: 4456187 - DNA, 19 bp, Homo sapiens
gagacgcacacagctgagc

SEQ ID NO: 4456188 - DNA, 15 bp, Homo sapiens
gagacggtcgagcag

SEQ ID NO: 4456189 - DNA, 18 bp, Homo sapiens
gagacggtgttttgccat

SEQ ID NO: 4456190 - DNA, 15 bp, Homo sapiens
gagacgtggtgggac

SEQ ID NO: 4456191 - DNA, 12 bp, Homo sapiens
gagactcagcct

SEQ ID NO: 4456192 - DNA, 15 bp, Homo sapiens
gagactcagcctctg

SEQ ID NO: 4456193 - DNA, 14 bp, Homo sapiens
gagactccatctca

SEQ ID NO: 4456194 - DNA, 19 bp, Homo sapiens
gagactcccatgaagcctt

SEQ ID NO: 4456195 - DNA, 14 bp, Homo sapiens
gagactcgagaact

SEQ ID NO: 4456196 - DNA, 15 bp, Homo sapiens
gagactcgagaactt

SEQ ID NO: 4456197 - DNA, 17 bp, Homo sapiens
gagactcgagaactttc

SEQ ID NO: 4456198 - DNA, 19 bp, Homo sapiens
gagactctagggtccagtg

SEQ ID NO: 4456199 - DNA, 22 bp, Homo sapiens
gagactgataacttggggaggc

SEQ ID NO: 4456200 - DNA, 15 bp, Homo sapiens
gagactgcccagcta

SEQ ID NO: 4456201 - DNA, 17 bp, Homo sapiens
gagactgcgttctgcaa

SEQ ID NO: 4456202 - DNA, 23 bp, Homo sapiens
gagactgcgttctgcaagcatca

SEQ ID NO: 4456203 - DNA, 16 bp, Homo sapiens
gagactgggagccact

SEQ ID NO: 4456204 - DNA, 22 bp, Homo sapiens
gagactgtacataattgcatga

SEQ ID NO: 4456205 - DNA, 13 bp, Homo sapiens
gagactgtccctg

SEQ ID NO: 4456206 - DNA, 14 bp, Homo sapiens
gagacttcctctgg

SEQ ID NO: 4456207 - DNA, 22 bp, Homo sapiens
gagacttctgtttgatcactgt

SEQ ID NO: 4456208 - DNA, 13 bp, Homo sapiens
gagactttcttct

SEQ ID NO: 4456209 - DNA, 21 bp, Homo sapiens
gagactttttggtggatgtaa

SEQ ID NO: 4456210 - DNA, 17 bp, Homo sapiens
gagagaaaatatatgta

SEQ ID NO: 4456211 - DNA, 22 bp, Homo sapiens
gagagaaagtgtgagcaaacta

SEQ ID NO: 4456212 - DNA, 20 bp, Homo sapiens
gagagaagccacgctgtcct

SEQ ID NO: 4456213 - DNA, 13 bp, Homo sapiens
gagagacaggcag

SEQ ID NO: 4456214 - DNA, 20 bp, Homo sapiens
gagagacttgtgctcaagga

SEQ ID NO: 4456215 - DNA, 14 bp, Homo sapiens
gagagagagaggac

SEQ ID NO: 4456216 - DNA, 14 bp, Homo sapiens
gagagagtgtgtgt

SEQ ID NO: 4456217 - DNA, 14 bp, Homo sapiens
gagagatgagaaag

SEQ ID NO: 4456218 - DNA, 12 bp, Homo sapiens
gagagcagcagc

SEQ ID NO: 4456219 - DNA, 13 bp, Homo sapiens
gagagcagcagca

SEQ ID NO: 4456220 - DNA, 14 bp, Homo sapiens
gagagcagctccct

SEQ ID NO: 4456221 - DNA, 14 bp, Homo sapiens
gagagccagccctc

SEQ ID NO: 4456222 - DNA, 14 bp, Homo sapiens
gagagcccattccc

SEQ ID NO: 4456223 - DNA, 19 bp, Homo sapiens
gagagccctgctgtgggag

SEQ ID NO: 4456224 - DNA, 15 bp, Homo sapiens
gagagcccttcccag

SEQ ID NO: 4456225 - DNA, 13 bp, Homo sapiens
gagagcctgctgc

SEQ ID NO: 4456226 - DNA, 21 bp, Homo sapiens
gagagcctgtggaggggcttg

SEQ ID NO: 4456227 - DNA, 22 bp, Homo sapiens
gagagcctgtggaggggcttgg

SEQ ID NO: 4456228 - DNA, 16 bp, Homo sapiens
gagagctagaacctgg

SEQ ID NO: 4456229 - DNA, 18 bp, Homo sapiens
gagagctagaacctggag

SEQ ID NO: 4456230 - DNA, 19 bp, Homo sapiens
gagagctagaacctggaga

SEQ ID NO: 4456231 - DNA, 20 bp, Homo sapiens
gagagctagaacctggagag

SEQ ID NO: 4456232 - DNA, 18 bp, Homo sapiens
gagagcttggactacaca

SEQ ID NO: 4456233 - DNA, 15 bp, Homo sapiens
gagaggatgaacatc

SEQ ID NO: 4456234 - DNA, 21 bp, Homo sapiens
gagaggcaataaataaatgtt

SEQ ID NO: 4456235 - DNA, 17 bp, Homo sapiens
gagaggcaccagtccag

SEQ ID NO: 4456236 - DNA, 13 bp, Homo sapiens
gagaggcactcag

SEQ ID NO: 4456237 - DNA, 11 bp, Homo sapiens
gagaggcaggc

SEQ ID NO: 4456238 - DNA, 15 bp, Homo sapiens
gagaggcaggcatag

SEQ ID NO: 4456239 - DNA, 24 bp, Homo sapiens
gagaggctgtcatatatcaaagca

SEQ ID NO: 4456240 - DNA, 14 bp, Homo sapiens
gagagggaggcagg

SEQ ID NO: 4456241 - DNA, 21 bp, Homo sapiens
gagagggctggtccttattta

SEQ ID NO: 4456242 - DNA, 15 bp, Homo sapiens
gagaggggaaagtgt

SEQ ID NO: 4456243 - DNA, 14 bp, Homo sapiens
gagaggtaaagggt

SEQ ID NO: 4456244 - DNA, 14 bp, Homo sapiens
gagagtaagcacgt

SEQ ID NO: 4456245 - DNA, 18 bp, Homo sapiens
gagagtagccgagagcct

SEQ ID NO: 4456246 - DNA, 13 bp, Homo sapiens
gagagtcaggagt

SEQ ID NO: 4456247 - DNA, 23 bp, Homo sapiens
gagagtcaggagttttactgcct

SEQ ID NO: 4456248 - DNA, 19 bp, Homo sapiens
gagagtcattcaggtgacc

SEQ ID NO: 4456249 - DNA, 15 bp, Homo sapiens
gagagtgcacatgcc

SEQ ID NO: 4456250 - DNA, 20 bp, Homo sapiens
gagagtgtgaaatagacatt

SEQ ID NO: 4456251 - DNA, 14 bp, Homo sapiens
gagagttaaatggt

SEQ ID NO: 4456252 - DNA, 18 bp, Homo sapiens
gagagtttttaatagaac

SEQ ID NO: 4456253 - DNA, 19 bp, Homo sapiens
gagataaaagcaattctga

SEQ ID NO: 4456254 - DNA, 23 bp, Homo sapiens
gagataaaaggtggagtttctct

SEQ ID NO: 4456255 - DNA, 18 bp, Homo sapiens
gagatagttttcatttta

SEQ ID NO: 4456256 - DNA, 17 bp, Homo sapiens
gagatatggcagcgaaa

SEQ ID NO: 4456257 - DNA, 19 bp, Homo sapiens
gagatatttaggaaaatgc

SEQ ID NO: 4456258 - DNA, 21 bp, Homo sapiens
gagatatttaggaaaatgctt

SEQ ID NO: 4456259 - DNA, 20 bp, Homo sapiens
gagatattttgtaaaatgta

SEQ ID NO: 4456260 - DNA, 13 bp, Homo sapiens
gagatcaaagatg

SEQ ID NO: 4456261 - DNA, 19 bp, Homo sapiens
gagatcccaacactgccag

SEQ ID NO: 4456262 - DNA, 20 bp, Homo sapiens
gagatcccaacactgccagc

SEQ ID NO: 4456263 - DNA, 18 bp, Homo sapiens
gagatcgagaccatcctg

SEQ ID NO: 4456264 - DNA, 22 bp, Homo sapiens
gagatcgtgccgttactctcca

SEQ ID NO: 4456265 - DNA, 15 bp, Homo sapiens
gagatctctgtagaa

SEQ ID NO: 4456266 - DNA, 19 bp, Homo sapiens
gagatctgcacagtcagaa

SEQ ID NO: 4456267 - DNA, 18 bp, Homo sapiens
gagatctttctttccaaa

SEQ ID NO: 4456268 - DNA, 15 bp, Homo sapiens
gagatgaaaagacag

SEQ ID NO: 4456269 - DNA, 14 bp, Homo sapiens
gagatgaccaggga

SEQ ID NO: 4456270 - DNA, 21 bp, Homo sapiens
gagatgaccagggatgctggg

SEQ ID NO: 4456271 - DNA, 22 bp, Homo sapiens
gagatgaccagggatgctgggc

SEQ ID NO: 4456272 - DNA, 20 bp, Homo sapiens
gagatgactattacttttct

SEQ ID NO: 4456273 - DNA, 14 bp, Homo sapiens
gagatgaggagggg

SEQ ID NO: 4456274 - DNA, 16 bp, Homo sapiens
gagatgaggagtaaaa

SEQ ID NO: 4456275 - DNA, 14 bp, Homo sapiens
gagatgcctccacc

SEQ ID NO: 4456276 - DNA, 19 bp, Homo sapiens
gagatgcctccaccgctgc

SEQ ID NO: 4456277 - DNA, 22 bp, Homo sapiens
gagatgcctccaccgctgccta

SEQ ID NO: 4456278 - DNA, 13 bp, Homo sapiens
gagatgcttctct

SEQ ID NO: 4456279 - DNA, 14 bp, Homo sapiens
gagatgcttctctc

SEQ ID NO: 4456280 - DNA, 14 bp, Homo sapiens
gagatgcttggagc

SEQ ID NO: 4456281 - DNA, 14 bp, Homo sapiens
gagatgtgcaccca

SEQ ID NO: 4456282 - DNA, 16 bp, Homo sapiens
gagatgtgtatcagtg

SEQ ID NO: 4456283 - DNA, 13 bp, Homo sapiens
gagattatatttc

SEQ ID NO: 4456284 - DNA, 12 bp, Homo sapiens
gagattcatttt

SEQ ID NO: 4456285 - DNA, 16 bp, Homo sapiens
gagattggatcaagta

SEQ ID NO: 4456286 - DNA, 19 bp, Homo sapiens
gagattggatcaagtatta

SEQ ID NO: 4456287 - DNA, 17 bp, Homo sapiens
gagattgggatactgta

SEQ ID NO: 4456288 - DNA, 20 bp, Homo sapiens
gagattgtggtggtgctaaa

SEQ ID NO: 4456289 - DNA, 20 bp, Homo sapiens
gagatttcatctgctctcct

SEQ ID NO: 4456290 - DNA, 20 bp, Homo sapiens
gagattttttagatcttcct

SEQ ID NO: 4456291 - DNA, 14 bp, Homo sapiens
gagcaaacagaaaa

SEQ ID NO: 4456292 - DNA, 15 bp, Homo sapiens
gagcaaacagaaaaa

SEQ ID NO: 4456293 - DNA, 20 bp, Homo sapiens
gagcaaacctaacaggagaa

SEQ ID NO: 4456294 - DNA, 20 bp, Homo sapiens
gagcaaagatggcttccgtg

SEQ ID NO: 4456295 - DNA, 15 bp, Homo sapiens
gagcaaaggccctgg

SEQ ID NO: 4456296 - DNA, 22 bp, Homo sapiens
gagcacaaaattcaaagcatgg

SEQ ID NO: 4456297 - DNA, 15 bp, Homo sapiens
gagcacactggctca

SEQ ID NO: 4456298 - DNA, 13 bp, Homo sapiens
gagcaccaggcac

SEQ ID NO: 4456299 - DNA, 22 bp, Homo sapiens
gagcacccagagcaccccctgc

SEQ ID NO: 4456300 - DNA, 17 bp, Homo sapiens
gagcaccgaatattgag

SEQ ID NO: 4456301 - DNA, 23 bp, Homo sapiens
gagcaccttttaaacccctccct

SEQ ID NO: 4456302 - DNA, 14 bp, Homo sapiens
gagcactcctggtg

SEQ ID NO: 4456303 - DNA, 22 bp, Homo sapiens
gagcactgcatgtcagagcact

SEQ ID NO: 4456304 - DNA, 17 bp, Homo sapiens
gagcactttaaaaacag

SEQ ID NO: 4456305 - DNA, 21 bp, Homo sapiens
gagcactttaaaaacaggcca

SEQ ID NO: 4456306 - DNA, 16 bp, Homo sapiens
gagcagaaggaaggat

SEQ ID NO: 4456307 - DNA, 17 bp, Homo sapiens
gagcagaccagcacttc

SEQ ID NO: 4456308 - DNA, 16 bp, Homo sapiens
gagcagagagcaaagg

SEQ ID NO: 4456309 - DNA, 19 bp, Homo sapiens
gagcagagagcaaaggaga

SEQ ID NO: 4456310 - DNA, 13 bp, Homo sapiens
gagcagaggaggg

SEQ ID NO: 4456311 - DNA, 16 bp, Homo sapiens
gagcagaggggctgaa

SEQ ID NO: 4456312 - DNA, 15 bp, Homo sapiens
gagcagaggtggaaa

SEQ ID NO: 4456313 - DNA, 16 bp, Homo sapiens
gagcagcagcttgggg

SEQ ID NO: 4456314 - DNA, 17 bp, Homo sapiens
gagcagcattcccaggg

SEQ ID NO: 4456315 - DNA, 19 bp, Homo sapiens
gagcagcccccgggccgct

SEQ ID NO: 4456316 - DNA, 23 bp, Homo sapiens
gagcagcccccgggccgctggct

SEQ ID NO: 4456317 - DNA, 13 bp, Homo sapiens
gagcagccctggc

SEQ ID NO: 4456318 - DNA, 14 bp, Homo sapiens
gagcagccctggcc

SEQ ID NO: 4456319 - DNA, 24 bp, Homo sapiens
gagcagccctggcccccatcagcc

SEQ ID NO: 4456320 - DNA, 20 bp, Homo sapiens
gagcaggactccaggcccaa

SEQ ID NO: 4456321 - DNA, 20 bp, Homo sapiens
gagcaggagccccgccacag

SEQ ID NO: 4456322 - DNA, 13 bp, Homo sapiens
gagcaggagcttg

SEQ ID NO: 4456323 - DNA, 14 bp, Homo sapiens
gagcaggagcttgg

SEQ ID NO: 4456324 - DNA, 15 bp, Homo sapiens
gagcaggagcttggg

SEQ ID NO: 4456325 - DNA, 21 bp, Homo sapiens
gagcaggctactgtcagctcc

SEQ ID NO: 4456326 - DNA, 13 bp, Homo sapiens
gagcagggaaggc

SEQ ID NO: 4456327 - DNA, 14 bp, Homo sapiens
gagcagggaaggcc

SEQ ID NO: 4456328 - DNA, 19 bp, Homo sapiens
gagcaggggcccctgggga

SEQ ID NO: 4456329 - DNA, 16 bp, Homo sapiens
gagcagggtgctgtgg

SEQ ID NO: 4456330 - DNA, 16 bp, Homo sapiens
gagcagtcagagtcca

SEQ ID NO: 4456331 - DNA, 21 bp, Homo sapiens
gagcagtcagagtccagtgct

SEQ ID NO: 4456332 - DNA, 17 bp, Homo sapiens
gagcagtcagggtggga

SEQ ID NO: 4456333 - DNA, 21 bp, Homo sapiens
gagcagtcgcctgcctgcagc

SEQ ID NO: 4456334 - DNA, 13 bp, Homo sapiens
gagcatcaatctt

SEQ ID NO: 4456335 - DNA, 21 bp, Homo sapiens
gagcatcactagtgacaagtc

SEQ ID NO: 4456336 - DNA, 14 bp, Homo sapiens
gagcatccagacct

SEQ ID NO: 4456337 - DNA, 13 bp, Homo sapiens
gagcatctgcccc

SEQ ID NO: 4456338 - DNA, 16 bp, Homo sapiens
gagcatgcacactgag

SEQ ID NO: 4456339 - DNA, 20 bp, Homo sapiens
gagcatgcacactgagaatg

SEQ ID NO: 4456340 - DNA, 21 bp, Homo sapiens
gagcatggagctgtcacctct

SEQ ID NO: 4456341 - DNA, 19 bp, Homo sapiens
gagcatggatgcatttcaa

SEQ ID NO: 4456342 - DNA, 16 bp, Homo sapiens
gagcatggctgtgagg

SEQ ID NO: 4456343 - DNA, 19 bp, Homo sapiens
gagcatggctgtgaggatg

SEQ ID NO: 4456344 - DNA, 20 bp, Homo sapiens
gagcattaactaaatgctca

SEQ ID NO: 4456345 - DNA, 17 bp, Homo sapiens
gagcatttaatggcagc

SEQ ID NO: 4456346 - DNA, 20 bp, Homo sapiens
gagcatttctcatcagtagt

SEQ ID NO: 4456347 - DNA, 17 bp, Homo sapiens
gagcatttggcagagtc

SEQ ID NO: 4456348 - DNA, 19 bp, Homo sapiens
gagccaaaccagcagggag

SEQ ID NO: 4456349 - DNA, 16 bp, Homo sapiens
gagccacaagctgcac

SEQ ID NO: 4456350 - DNA, 20 bp, Homo sapiens
gagccacagcagcattttta

SEQ ID NO: 4456351 - DNA, 12 bp, Homo sapiens
gagccaccagtt

SEQ ID NO: 4456352 - DNA, 14 bp, Homo sapiens
gagccaccagttct

SEQ ID NO: 4456353 - DNA, 23 bp, Homo sapiens
gagccaccgtgcctggccagatt

SEQ ID NO: 4456354 - DNA, 11 bp, Homo sapiens
gagccacctgc

SEQ ID NO: 4456355 - DNA, 12 bp, Homo sapiens
gagccacctgca

SEQ ID NO: 4456356 - DNA, 18 bp, Homo sapiens
gagccacctgcaagatgg

SEQ ID NO: 4456357 - DNA, 13 bp, Homo sapiens
gagccacctggat

SEQ ID NO: 4456358 - DNA, 15 bp, Homo sapiens
gagccacctggatct

SEQ ID NO: 4456359 - DNA, 23 bp, Homo sapiens
gagccacctggatctatccctgc

SEQ ID NO: 4456360 - DNA, 21 bp, Homo sapiens
gagccactccttccttcagga

SEQ ID NO: 4456361 - DNA, 21 bp, Homo sapiens
gagccactgcgcccggcccaa

SEQ ID NO: 4456362 - DNA, 14 bp, Homo sapiens
gagccacttctccc

SEQ ID NO: 4456363 - DNA, 21 bp, Homo sapiens
gagccagaacctggagggcta

SEQ ID NO: 4456364 - DNA, 19 bp, Homo sapiens
gagccagactgtccaggga

SEQ ID NO: 4456365 - DNA, 12 bp, Homo sapiens
gagccagccctc

SEQ ID NO: 4456366 - DNA, 15 bp, Homo sapiens
gagccagggcagggc

SEQ ID NO: 4456367 - DNA, 17 bp, Homo sapiens
gagccagggcagggcga

SEQ ID NO: 4456368 - DNA, 23 bp, Homo sapiens
gagccatactgcgtccaccctga

SEQ ID NO: 4456369 - DNA, 18 bp, Homo sapiens
gagccatttgtcccaagt

SEQ ID NO: 4456370 - DNA, 20 bp, Homo sapiens
gagccatttgtcccaagtgc

SEQ ID NO: 4456371 - DNA, 15 bp, Homo sapiens
gagccattttggtaa

SEQ ID NO: 4456372 - DNA, 15 bp, Homo sapiens
gagcccacactgcca

SEQ ID NO: 4456373 - DNA, 22 bp, Homo sapiens
gagcccagaggagggcagcaga

SEQ ID NO: 4456374 - DNA, 13 bp, Homo sapiens
gagcccagcccag

SEQ ID NO: 4456375 - DNA, 21 bp, Homo sapiens
gagcccagcctgggagcccag

SEQ ID NO: 4456376 - DNA, 21 bp, Homo sapiens
gagcccagcgtcagaagtcta

SEQ ID NO: 4456377 - DNA, 17 bp, Homo sapiens
gagcccagtgaagcctc

SEQ ID NO: 4456378 - DNA, 20 bp, Homo sapiens
gagcccagtgaagcctctga

SEQ ID NO: 4456379 - DNA, 13 bp, Homo sapiens
gagcccattccca

SEQ ID NO: 4456380 - DNA, 16 bp, Homo sapiens
gagcccattcttctgg

SEQ ID NO: 4456381 - DNA, 17 bp, Homo sapiens
gagcccattcttctggg

SEQ ID NO: 4456382 - DNA, 19 bp, Homo sapiens
gagcccattcttctgggtg

SEQ ID NO: 4456383 - DNA, 12 bp, Homo sapiens
gagccccacact

SEQ ID NO: 4456384 - DNA, 22 bp, Homo sapiens
gagccccacactggggtgccgc

SEQ ID NO: 4456385 - DNA, 13 bp, Homo sapiens
gagccccacagcc

SEQ ID NO: 4456386 - DNA, 14 bp, Homo sapiens
gagccccacagccc

SEQ ID NO: 4456387 - DNA, 12 bp, Homo sapiens
gagccccagccc

SEQ ID NO: 4456388 - DNA, 13 bp, Homo sapiens
gagccccagcccc

SEQ ID NO: 4456389 - DNA, 17 bp, Homo sapiens
gagccccagcgggctgg

SEQ ID NO: 4456390 - DNA, 24 bp, Homo sapiens
gagccccagggtcttccctacctc

SEQ ID NO: 4456391 - DNA, 16 bp, Homo sapiens
gagccccattcctggg

SEQ ID NO: 4456392 - DNA, 22 bp, Homo sapiens
gagcccccaccggaactgggct

SEQ ID NO: 4456393 - DNA, 18 bp, Homo sapiens
gagcccccagcagaggca

SEQ ID NO: 4456394 - DNA, 19 bp, Homo sapiens
gagcccccagcagaggcag

SEQ ID NO: 4456395 - DNA, 22 bp, Homo sapiens
gagcccgatattctccctgacc

SEQ ID NO: 4456396 - DNA, 12 bp, Homo sapiens
gagccctgactc

SEQ ID NO: 4456397 - DNA, 22 bp, Homo sapiens
gagccctgactcctggactccg

SEQ ID NO: 4456398 - DNA, 15 bp, Homo sapiens
gagccctgctcttct

SEQ ID NO: 4456399 - DNA, 19 bp, Homo sapiens
gagccctgctcttctctcc

SEQ ID NO: 4456400 - DNA, 23 bp, Homo sapiens
gagccctgctcttctctccccag

SEQ ID NO: 4456401 - DNA, 17 bp, Homo sapiens
gagccctgctgtgggag

SEQ ID NO: 4456402 - DNA, 18 bp, Homo sapiens
gagcccttcccagggcac

SEQ ID NO: 4456403 - DNA, 22 bp, Homo sapiens
gagcccttctatacccacccag

SEQ ID NO: 4456404 - DNA, 15 bp, Homo sapiens
gagcccttgcctccc

SEQ ID NO: 4456405 - DNA, 22 bp, Homo sapiens
gagcccttgcctccccatttcc

SEQ ID NO: 4456406 - DNA, 13 bp, Homo sapiens
gagccgcccaagg

SEQ ID NO: 4456407 - DNA, 12 bp, Homo sapiens
gagccgcgggga

SEQ ID NO: 4456408 - DNA, 21 bp, Homo sapiens
gagccgcggggaagctggctt

SEQ ID NO: 4456409 - DNA, 23 bp, Homo sapiens
gagccgggtccggcctctccctg

SEQ ID NO: 4456410 - DNA, 17 bp, Homo sapiens
gagccgggtctgcctct

SEQ ID NO: 4456411 - DNA, 21 bp, Homo sapiens
gagccgggtctgcctcttctg

SEQ ID NO: 4456412 - DNA, 17 bp, Homo sapiens
gagccgtggtcctttgg

SEQ ID NO: 4456413 - DNA, 19 bp, Homo sapiens
gagcctacagaagggcagt

SEQ ID NO: 4456414 - DNA, 18 bp, Homo sapiens
gagcctagcggagcccag

SEQ ID NO: 4456415 - DNA, 19 bp, Homo sapiens
gagcctagcggagcccagc

SEQ ID NO: 4456416 - DNA, 20 bp, Homo sapiens
gagcctagcggagcccagcc

SEQ ID NO: 4456417 - DNA, 14 bp, Homo sapiens
gagcctagctcctg

SEQ ID NO: 4456418 - DNA, 20 bp, Homo sapiens
gagcctcatccagcctcaga

SEQ ID NO: 4456419 - DNA, 20 bp, Homo sapiens
gagcctcccaaggagaacaa

SEQ ID NO: 4456420 - DNA, 21 bp, Homo sapiens
gagcctcccaaggagaacaaa

SEQ ID NO: 4456421 - DNA, 13 bp, Homo sapiens
gagcctcccacca

SEQ ID NO: 4456422 - DNA, 18 bp, Homo sapiens
gagcctcccaccagagcc

SEQ ID NO: 4456423 - DNA, 19 bp, Homo sapiens
gagcctcccaccagagccg

SEQ ID NO: 4456424 - DNA, 20 bp, Homo sapiens
gagcctccccatctgtccag

SEQ ID NO: 4456425 - DNA, 12 bp, Homo sapiens
gagcctccccct

SEQ ID NO: 4456426 - DNA, 13 bp, Homo sapiens
gagcctccccctc

SEQ ID NO: 4456427 - DNA, 14 bp, Homo sapiens
gagcctccccctca

SEQ ID NO: 4456428 - DNA, 22 bp, Homo sapiens
gagcctcctgaagttgctgctg

SEQ ID NO: 4456429 - DNA, 23 bp, Homo sapiens
gagcctcctgtgcctggccccag

SEQ ID NO: 4456430 - DNA, 15 bp, Homo sapiens
gagcctctgatcaaa

SEQ ID NO: 4456431 - DNA, 15 bp, Homo sapiens
gagcctctggcccct

SEQ ID NO: 4456432 - DNA, 21 bp, Homo sapiens
gagcctgaactgagccccagc

SEQ ID NO: 4456433 - DNA, 22 bp, Homo sapiens
gagcctgaactgagccccagcg

SEQ ID NO: 4456434 - DNA, 12 bp, Homo sapiens
gagcctgaggga

SEQ ID NO: 4456435 - DNA, 14 bp, Homo sapiens
gagcctgcctggag

SEQ ID NO: 4456436 - DNA, 15 bp, Homo sapiens
gagcctgcctggagc

SEQ ID NO: 4456437 - DNA, 18 bp, Homo sapiens
gagcctgctcccccaccc

SEQ ID NO: 4456438 - DNA, 11 bp, Homo sapiens
gagcctgctgg

SEQ ID NO: 4456439 - DNA, 13 bp, Homo sapiens
gagcctgctggca

SEQ ID NO: 4456440 - DNA, 15 bp, Homo sapiens
gagcctggtcctggc

SEQ ID NO: 4456441 - DNA, 15 bp, Homo sapiens
gagcctgtggccagc

SEQ ID NO: 4456442 - DNA, 23 bp, Homo sapiens
gagccttagaggtctttaatcat

SEQ ID NO: 4456443 - DNA, 21 bp, Homo sapiens
gagccttagcagccctggatg

SEQ ID NO: 4456444 - DNA, 20 bp, Homo sapiens
gagccttatttacctagtgc

SEQ ID NO: 4456445 - DNA, 18 bp, Homo sapiens
gagccttcaagtgccaaa

SEQ ID NO: 4456446 - DNA, 19 bp, Homo sapiens
gagccttcaagtgccaaac

SEQ ID NO: 4456447 - DNA, 21 bp, Homo sapiens
gagccttcagaatgctcctga

SEQ ID NO: 4456448 - DNA, 13 bp, Homo sapiens
gagccttctcaga

SEQ ID NO: 4456449 - DNA, 12 bp, Homo sapiens
gagccttctgcc

SEQ ID NO: 4456450 - DNA, 15 bp, Homo sapiens
gagccttctgccacc

SEQ ID NO: 4456451 - DNA, 23 bp, Homo sapiens
gagccttctgccaccagcccctc

SEQ ID NO: 4456452 - DNA, 19 bp, Homo sapiens
gagccttggtgtccacctg

SEQ ID NO: 4456453 - DNA, 22 bp, Homo sapiens
gagccttggtgtccacctggcc

SEQ ID NO: 4456454 - DNA, 15 bp, Homo sapiens
gagcctttatacaat

SEQ ID NO: 4456455 - DNA, 18 bp, Homo sapiens
gagccttttgcaggaaaa

SEQ ID NO: 4456456 - DNA, 17 bp, Homo sapiens
gagccttttgctctctg

SEQ ID NO: 4456457 - DNA, 15 bp, Homo sapiens
gagcgagaccctgtc

SEQ ID NO: 4456458 - DNA, 17 bp, Homo sapiens
gagcgagagggaggcag

SEQ ID NO: 4456459 - DNA, 13 bp, Homo sapiens
gagcgaggaaagg

SEQ ID NO: 4456460 - DNA, 18 bp, Homo sapiens
gagcgaggagatgctcct

SEQ ID NO: 4456461 - DNA, 17 bp, Homo sapiens
gagcgccaggaagccag

SEQ ID NO: 4456462 - DNA, 18 bp, Homo sapiens
gagcgccaggaagccaga

SEQ ID NO: 4456463 - DNA, 19 bp, Homo sapiens
gagcgccaggaagccagag

SEQ ID NO: 4456464 - DNA, 15 bp, Homo sapiens
gagcgcccccgagcc

SEQ ID NO: 4456465 - DNA, 22 bp, Homo sapiens
gagcgcccccgagccctgactc

SEQ ID NO: 4456466 - DNA, 23 bp, Homo sapiens
gagcgggaggcagcgccccacca

SEQ ID NO: 4456467 - DNA, 15 bp, Homo sapiens
gagcgggtgcaagca

SEQ ID NO: 4456468 - DNA, 17 bp, Homo sapiens
gagcgtaaatgggtcat

SEQ ID NO: 4456469 - DNA, 21 bp, Homo sapiens
gagcgtgcgcactgcatggga

SEQ ID NO: 4456470 - DNA, 17 bp, Homo sapiens
gagcgtttggttaaagt

SEQ ID NO: 4456471 - DNA, 22 bp, Homo sapiens
gagctaatttactggacaaaga

SEQ ID NO: 4456472 - DNA, 15 bp, Homo sapiens
gagctacgtatttaa

SEQ ID NO: 4456473 - DNA, 16 bp, Homo sapiens
gagctactcccacagc

SEQ ID NO: 4456474 - DNA, 19 bp, Homo sapiens
gagctagaacctggagagc

SEQ ID NO: 4456475 - DNA, 21 bp, Homo sapiens
gagctagaacctggagggcta

SEQ ID NO: 4456476 - DNA, 17 bp, Homo sapiens
gagctagttctcagctt

SEQ ID NO: 4456477 - DNA, 20 bp, Homo sapiens
gagctattaaaactcagcct

SEQ ID NO: 4456478 - DNA, 20 bp, Homo sapiens
gagctattttagaaagctaa

SEQ ID NO: 4456479 - DNA, 14 bp, Homo sapiens
gagctattttcctc

SEQ ID NO: 4456480 - DNA, 14 bp, Homo sapiens
gagctcagaccccc

SEQ ID NO: 4456481 - DNA, 20 bp, Homo sapiens
gagctcaggaaccgaggcag

SEQ ID NO: 4456482 - DNA, 22 bp, Homo sapiens
gagctcccccgtggtgcctgca

SEQ ID NO: 4456483 - DNA, 22 bp, Homo sapiens
gagctccgtcagcttctcccaa

SEQ ID NO: 4456484 - DNA, 21 bp, Homo sapiens
gagctcctccctccagctgcg

SEQ ID NO: 4456485 - DNA, 22 bp, Homo sapiens
gagctcctccctccagctgcga

SEQ ID NO: 4456486 - DNA, 15 bp, Homo sapiens
gagctcctctcctgg

SEQ ID NO: 4456487 - DNA, 16 bp, Homo sapiens
gagctcctctcctgga

SEQ ID NO: 4456488 - DNA, 12 bp, Homo sapiens
gagctcctgggg

SEQ ID NO: 4456489 - DNA, 14 bp, Homo sapiens
gagctcggggacag

SEQ ID NO: 4456490 - DNA, 16 bp, Homo sapiens
gagctcggggacaggt

SEQ ID NO: 4456491 - DNA, 13 bp, Homo sapiens
gagctctcaggcc

SEQ ID NO: 4456492 - DNA, 16 bp, Homo sapiens
gagctctcaggccgag

SEQ ID NO: 4456493 - DNA, 19 bp, Homo sapiens
gagctctcaggccgagagc

SEQ ID NO: 4456494 - DNA, 18 bp, Homo sapiens
gagctctgtatggtcagg

SEQ ID NO: 4456495 - DNA, 22 bp, Homo sapiens
gagctcttcaggcctccctctc

SEQ ID NO: 4456496 - DNA, 22 bp, Homo sapiens
gagctcttcccttattcctaat

SEQ ID NO: 4456497 - DNA, 13 bp, Homo sapiens
gagctgagatcgt

SEQ ID NO: 4456498 - DNA, 14 bp, Homo sapiens
gagctgagcagcct

SEQ ID NO: 4456499 - DNA, 17 bp, Homo sapiens
gagctgagttgggggtg

SEQ ID NO: 4456500 - DNA, 16 bp, Homo sapiens
gagctgcagcccccca

SEQ ID NO: 4456501 - DNA, 23 bp, Homo sapiens
gagctgcaggaatcacccctctg

SEQ ID NO: 4456502 - DNA, 15 bp, Homo sapiens
gagctgccctccttg

SEQ ID NO: 4456503 - DNA, 23 bp, Homo sapiens
gagctgccctccttgtccaccca

SEQ ID NO: 4456504 - DNA, 23 bp, Homo sapiens
gagctgccttccctagctttaga

SEQ ID NO: 4456505 - DNA, 16 bp, Homo sapiens
gagctgctggcttgca

SEQ ID NO: 4456506 - DNA, 18 bp, Homo sapiens
gagctggcgctcagcagc

SEQ ID NO: 4456507 - DNA, 16 bp, Homo sapiens
gagctgggagacaaag

SEQ ID NO: 4456508 - DNA, 14 bp, Homo sapiens
gagctgggaggaaa

SEQ ID NO: 4456509 - DNA, 17 bp, Homo sapiens
gagctgggaggaaaaga

SEQ ID NO: 4456510 - DNA, 16 bp, Homo sapiens
gagctgggcaggaagg

SEQ ID NO: 4456511 - DNA, 15 bp, Homo sapiens
gagctgggcccctgc

SEQ ID NO: 4456512 - DNA, 14 bp, Homo sapiens
gagctgggccctgc

SEQ ID NO: 4456513 - DNA, 17 bp, Homo sapiens
gagctgggccctgcctg

SEQ ID NO: 4456514 - DNA, 21 bp, Homo sapiens
gagctgggccctgcctgcagc

SEQ ID NO: 4456515 - DNA, 17 bp, Homo sapiens
gagctggggactcaggg

SEQ ID NO: 4456516 - DNA, 15 bp, Homo sapiens
gagctggtgcccgga

SEQ ID NO: 4456517 - DNA, 21 bp, Homo sapiens
gagctgtaatttcgccttaaa

SEQ ID NO: 4456518 - DNA, 20 bp, Homo sapiens
gagctgtcacctctcagctg

SEQ ID NO: 4456519 - DNA, 15 bp, Homo sapiens
gagctgtgacccaga

SEQ ID NO: 4456520 - DNA, 15 bp, Homo sapiens
gagctgtgcgctgct

SEQ ID NO: 4456521 - DNA, 19 bp, Homo sapiens
gagctgtgcgctgctctgc

SEQ ID NO: 4456522 - DNA, 20 bp, Homo sapiens
gagctgtttatggcctcagc

SEQ ID NO: 4456523 - DNA, 16 bp, Homo sapiens
gagctgtttatgtttt

SEQ ID NO: 4456524 - DNA, 21 bp, Homo sapiens
gagcttaatctttgaaaggtt

SEQ ID NO: 4456525 - DNA, 16 bp, Homo sapiens
gagcttcatggcagaa

SEQ ID NO: 4456526 - DNA, 19 bp, Homo sapiens
gagcttcatggcagaaggc

SEQ ID NO: 4456527 - DNA, 13 bp, Homo sapiens
gagcttccctgac

SEQ ID NO: 4456528 - DNA, 17 bp, Homo sapiens
gagcttccctgactcat

SEQ ID NO: 4456529 - DNA, 13 bp, Homo sapiens
gagcttggacagt

SEQ ID NO: 4456530 - DNA, 13 bp, Homo sapiens
gagcttgggcagt

SEQ ID NO: 4456531 - DNA, 11 bp, Homo sapiens
gagctttatgg

SEQ ID NO: 4456532 - DNA, 23 bp, Homo sapiens
gagctttatggtcctaaaagcaa

SEQ ID NO: 4456533 - DNA, 19 bp, Homo sapiens
gagctttgcatgttccact

SEQ ID NO: 4456534 - DNA, 14 bp, Homo sapiens
gagctttggaatat

SEQ ID NO: 4456535 - DNA, 18 bp, Homo sapiens
gaggaaaaggcccctgca

SEQ ID NO: 4456536 - DNA, 16 bp, Homo sapiens
gaggaaaagtgcaatg

SEQ ID NO: 4456537 - DNA, 22 bp, Homo sapiens
gaggaaactactgcctttagaa

SEQ ID NO: 4456538 - DNA, 16 bp, Homo sapiens
gaggaaactgagtcac

SEQ ID NO: 4456539 - DNA, 13 bp, Homo sapiens
gaggaaaggattt

SEQ ID NO: 4456540 - DNA, 17 bp, Homo sapiens
gaggaaagggctggctc

SEQ ID NO: 4456541 - DNA, 12 bp, Homo sapiens
gaggaacacctg

SEQ ID NO: 4456542 - DNA, 13 bp, Homo sapiens
gaggaacacctga

SEQ ID NO: 4456543 - DNA, 15 bp, Homo sapiens
gaggaactgtacaga

SEQ ID NO: 4456544 - DNA, 23 bp, Homo sapiens
gaggaagaacggggctcttctca

SEQ ID NO: 4456545 - DNA, 13 bp, Homo sapiens
gaggaagagccac

SEQ ID NO: 4456546 - DNA, 14 bp, Homo sapiens
gaggaagagccacc

SEQ ID NO: 4456547 - DNA, 15 bp, Homo sapiens
gaggaagagccacct

SEQ ID NO: 4456548 - DNA, 18 bp, Homo sapiens
gaggaagagccacctgca

SEQ ID NO: 4456549 - DNA, 21 bp, Homo sapiens
gaggaagagccacctgcaaga

SEQ ID NO: 4456550 - DNA, 13 bp, Homo sapiens
gaggaaggaggcc

SEQ ID NO: 4456551 - DNA, 13 bp, Homo sapiens
gaggaagggctgg

SEQ ID NO: 4456552 - DNA, 17 bp, Homo sapiens
gaggaagggctgggcca

SEQ ID NO: 4456553 - DNA, 21 bp, Homo sapiens
gaggaagggctgggccaccag

SEQ ID NO: 4456554 - DNA, 19 bp, Homo sapiens
gaggaaggggccagaggct

SEQ ID NO: 4456555 - DNA, 18 bp, Homo sapiens
gaggaagtggctgtccct

SEQ ID NO: 4456556 - DNA, 17 bp, Homo sapiens
gaggaatacattttatt

SEQ ID NO: 4456557 - DNA, 13 bp, Homo sapiens
gaggaatcctgga

SEQ ID NO: 4456558 - DNA, 17 bp, Homo sapiens
gaggacagagggcacat

SEQ ID NO: 4456559 - DNA, 18 bp, Homo sapiens
gaggacagcttgagccgg

SEQ ID NO: 4456560 - DNA, 18 bp, Homo sapiens
gaggacaggcaggccaga

SEQ ID NO: 4456561 - DNA, 22 bp, Homo sapiens
gaggacagtatttgtggggagg

SEQ ID NO: 4456562 - DNA, 15 bp, Homo sapiens
gaggacagtctggag

SEQ ID NO: 4456563 - DNA, 16 bp, Homo sapiens
gaggacatcaaagtgg

SEQ ID NO: 4456564 - DNA, 19 bp, Homo sapiens
gaggacatcaaagtggtaa

SEQ ID NO: 4456565 - DNA, 17 bp, Homo sapiens
gaggaccagaggagcag

SEQ ID NO: 4456566 - DNA, 16 bp, Homo sapiens
gaggacccagacccag

SEQ ID NO: 4456567 - DNA, 21 bp, Homo sapiens
gaggaccgaggctacagctcc

SEQ ID NO: 4456568 - DNA, 19 bp, Homo sapiens
gaggacctggcgtgctcag

SEQ ID NO: 4456569 - DNA, 22 bp, Homo sapiens
gaggacctggcgtgctcagacc

SEQ ID NO: 4456570 - DNA, 18 bp, Homo sapiens
gaggacctgtatttaagc

SEQ ID NO: 4456571 - DNA, 23 bp, Homo sapiens
gaggacctgtatttaagcaaata

SEQ ID NO: 4456572 - DNA, 12 bp, Homo sapiens
gaggacctttct

SEQ ID NO: 4456573 - DNA, 16 bp, Homo sapiens
gaggacggtgcaaccc

SEQ ID NO: 4456574 - DNA, 17 bp, Homo sapiens
gaggacggtgcaaccca

SEQ ID NO: 4456575 - DNA, 22 bp, Homo sapiens
gaggacgtcatcggaggctggg

SEQ ID NO: 4456576 - DNA, 16 bp, Homo sapiens
gaggactagaacctgg

SEQ ID NO: 4456577 - DNA, 13 bp, Homo sapiens
gaggactgagact

SEQ ID NO: 4456578 - DNA, 12 bp, Homo sapiens
gaggactgagcc

SEQ ID NO: 4456579 - DNA, 13 bp, Homo sapiens
gaggactgagccc

SEQ ID NO: 4456580 - DNA, 14 bp, Homo sapiens
gaggagaaactgga

SEQ ID NO: 4456581 - DNA, 22 bp, Homo sapiens
gaggagaagaattttcagaccc

SEQ ID NO: 4456582 - DNA, 18 bp, Homo sapiens
gaggagcagcagcttggg

SEQ ID NO: 4456583 - DNA, 18 bp, Homo sapiens
gaggagccaccagttctc

SEQ ID NO: 4456584 - DNA, 13 bp, Homo sapiens
gaggagcctctga

SEQ ID NO: 4456585 - DNA, 11 bp, Homo sapiens
gaggagctgct

SEQ ID NO: 4456586 - DNA, 15 bp, Homo sapiens
gaggagctgctggct

SEQ ID NO: 4456587 - DNA, 16 bp, Homo sapiens
gaggaggaaggcaaga

SEQ ID NO: 4456588 - DNA, 22 bp, Homo sapiens
gaggaggcctgtcccaattctg

SEQ ID NO: 4456589 - DNA, 15 bp, Homo sapiens
gaggagggcaggcat

SEQ ID NO: 4456590 - DNA, 11 bp, Homo sapiens
gaggaggggag

SEQ ID NO: 4456591 - DNA, 12 bp, Homo sapiens
gaggaggggagg

SEQ ID NO: 4456592 - DNA, 13 bp, Homo sapiens
gaggaggggaggg

SEQ ID NO: 4456593 - DNA, 14 bp, Homo sapiens
gaggaggggtgaga

SEQ ID NO: 4456594 - DNA, 12 bp, Homo sapiens
gaggagggtggg

SEQ ID NO: 4456595 - DNA, 15 bp, Homo sapiens
gaggagggtggggga

SEQ ID NO: 4456596 - DNA, 16 bp, Homo sapiens
gaggagtgcagccttc

SEQ ID NO: 4456597 - DNA, 18 bp, Homo sapiens
gaggagtttcctaaaagt

SEQ ID NO: 4456598 - DNA, 13 bp, Homo sapiens
gaggatacagagg

SEQ ID NO: 4456599 - DNA, 18 bp, Homo sapiens
gaggatggtgtcctgagg

SEQ ID NO: 4456600 - DNA, 20 bp, Homo sapiens
gaggatggtgtcctgaggcc

SEQ ID NO: 4456601 - DNA, 22 bp, Homo sapiens
gaggatggtgtcctgaggcctc

SEQ ID NO: 4456602 - DNA, 21 bp, Homo sapiens
gaggatgttagacttgctccc

SEQ ID NO: 4456603 - DNA, 18 bp, Homo sapiens
gaggcaataaataaatgt

SEQ ID NO: 4456604 - DNA, 17 bp, Homo sapiens
gaggcaccaggaagccg

SEQ ID NO: 4456605 - DNA, 20 bp, Homo sapiens
gaggcagcagtgtgaggcca

SEQ ID NO: 4456606 - DNA, 22 bp, Homo sapiens
gaggcagcagtgtgaggccagg

SEQ ID NO: 4456607 - DNA, 22 bp, Homo sapiens
gaggcagccacagggaagctca

SEQ ID NO: 4456608 - DNA, 14 bp, Homo sapiens
gaggcaggctccag

SEQ ID NO: 4456609 - DNA, 12 bp, Homo sapiens
gaggcaggctgg

SEQ ID NO: 4456610 - DNA, 14 bp, Homo sapiens
gaggcaggctggga

SEQ ID NO: 4456611 - DNA, 14 bp, Homo sapiens
gaggcagggaagga

SEQ ID NO: 4456612 - DNA, 19 bp, Homo sapiens
gaggcaggtggacgctgca

SEQ ID NO: 4456613 - DNA, 21 bp, Homo sapiens
gaggcaggtggacgctgcaga

SEQ ID NO: 4456614 - DNA, 19 bp, Homo sapiens
gaggcatacacacagcagt

SEQ ID NO: 4456615 - DNA, 13 bp, Homo sapiens
gaggccaccccaa

SEQ ID NO: 4456616 - DNA, 22 bp, Homo sapiens
gaggccacggagcgggaggcag

SEQ ID NO: 4456617 - DNA, 16 bp, Homo sapiens
gaggccacttagggaa

SEQ ID NO: 4456618 - DNA, 16 bp, Homo sapiens
gaggccagccccaccc

SEQ ID NO: 4456619 - DNA, 18 bp, Homo sapiens
gaggccagccccacccag

SEQ ID NO: 4456620 - DNA, 20 bp, Homo sapiens
gaggccagccccacccagga

SEQ ID NO: 4456621 - DNA, 21 bp, Homo sapiens
gaggccagccccacccaggag

SEQ ID NO: 4456622 - DNA, 13 bp, Homo sapiens
gaggccagggcag

SEQ ID NO: 4456623 - DNA, 16 bp, Homo sapiens
gaggccatctcaggag

SEQ ID NO: 4456624 - DNA, 17 bp, Homo sapiens
gaggccatctcaggaga

SEQ ID NO: 4456625 - DNA, 17 bp, Homo sapiens
gaggcccaggctgggaa

SEQ ID NO: 4456626 - DNA, 16 bp, Homo sapiens
gaggccccacctgaag

SEQ ID NO: 4456627 - DNA, 12 bp, Homo sapiens
gaggcccctgcc

SEQ ID NO: 4456628 - DNA, 14 bp, Homo sapiens
gaggcccctgcctc

SEQ ID NO: 4456629 - DNA, 21 bp, Homo sapiens
gaggccctcgggcccagcccc

SEQ ID NO: 4456630 - DNA, 13 bp, Homo sapiens
gaggccctgcccc

SEQ ID NO: 4456631 - DNA, 14 bp, Homo sapiens
gaggccctgccccc

SEQ ID NO: 4456632 - DNA, 19 bp, Homo sapiens
gaggccctggagggaagga

SEQ ID NO: 4456633 - DNA, 14 bp, Homo sapiens
gaggccctgggctg

SEQ ID NO: 4456634 - DNA, 14 bp, Homo sapiens
gaggccgaggcggg

SEQ ID NO: 4456635 - DNA, 21 bp, Homo sapiens
gaggcctgcaaaccttcctgg

SEQ ID NO: 4456636 - DNA, 23 bp, Homo sapiens
gaggcctgcaaaccttcctggga

SEQ ID NO: 4456637 - DNA, 16 bp, Homo sapiens
gaggcctgcccgggcg

SEQ ID NO: 4456638 - DNA, 19 bp, Homo sapiens
gaggcctgcctccagggct

SEQ ID NO: 4456639 - DNA, 21 bp, Homo sapiens
gaggcctgcctccagggctgg

SEQ ID NO: 4456640 - DNA, 22 bp, Homo sapiens
gaggcctgcctccagggctgga

SEQ ID NO: 4456641 - DNA, 15 bp, Homo sapiens
gaggcgaataaatgt

SEQ ID NO: 4456642 - DNA, 20 bp, Homo sapiens
gaggcgaataaatgttcaaa

SEQ ID NO: 4456643 - DNA, 19 bp, Homo sapiens
gaggcggacgttccagccg

SEQ ID NO: 4456644 - DNA, 16 bp, Homo sapiens
gaggcgtgcccccctc

SEQ ID NO: 4456645 - DNA, 18 bp, Homo sapiens
gaggcgtgcccccctcct

SEQ ID NO: 4456646 - DNA, 22 bp, Homo sapiens
gaggcgtgcccccctcctccag

SEQ ID NO: 4456647 - DNA, 15 bp, Homo sapiens
gaggctacagctcca

SEQ ID NO: 4456648 - DNA, 17 bp, Homo sapiens
gaggctacccgctgtgg

SEQ ID NO: 4456649 - DNA, 19 bp, Homo sapiens
gaggctacccgctgtggcc

SEQ ID NO: 4456650 - DNA, 16 bp, Homo sapiens
gaggctcatcctgtag

SEQ ID NO: 4456651 - DNA, 13 bp, Homo sapiens
gaggctccccgcc

SEQ ID NO: 4456652 - DNA, 14 bp, Homo sapiens
gaggctccccgcct

SEQ ID NO: 4456653 - DNA, 17 bp, Homo sapiens
gaggctcccggggcctg

SEQ ID NO: 4456654 - DNA, 22 bp, Homo sapiens
gaggctcccggggcctggacag

SEQ ID NO: 4456655 - DNA, 14 bp, Homo sapiens
gaggctctggacag

SEQ ID NO: 4456656 - DNA, 16 bp, Homo sapiens
gaggctgaataaagcc

SEQ ID NO: 4456657 - DNA, 18 bp, Homo sapiens
gaggctgaggcagaagaa

SEQ ID NO: 4456658 - DNA, 18 bp, Homo sapiens
gaggctgcaatgagccat

SEQ ID NO: 4456659 - DNA, 21 bp, Homo sapiens
gaggctgccccattgagatct

SEQ ID NO: 4456660 - DNA, 12 bp, Homo sapiens
gaggctgccccc

SEQ ID NO: 4456661 - DNA, 17 bp, Homo sapiens
gaggctgcccccggccc

SEQ ID NO: 4456662 - DNA, 14 bp, Homo sapiens
gaggctgcctccca

SEQ ID NO: 4456663 - DNA, 15 bp, Homo sapiens
gaggctgcctcccaa

SEQ ID NO: 4456664 - DNA, 11 bp, Homo sapiens
gaggctgctag

SEQ ID NO: 4456665 - DNA, 14 bp, Homo sapiens
gaggctggaggcag

SEQ ID NO: 4456666 - DNA, 12 bp, Homo sapiens
gaggctggcagg

SEQ ID NO: 4456667 - DNA, 14 bp, Homo sapiens
gaggctgggcccct

SEQ ID NO: 4456668 - DNA, 14 bp, Homo sapiens
gaggctgtgctccg

SEQ ID NO: 4456669 - DNA, 13 bp, Homo sapiens
gaggcttcctgcg

SEQ ID NO: 4456670 - DNA, 21 bp, Homo sapiens
gaggcttcctgcgtcctcctc

SEQ ID NO: 4456671 - DNA, 18 bp, Homo sapiens
gaggcttctccgccagcc

SEQ ID NO: 4456672 - DNA, 22 bp, Homo sapiens
gaggcttctccgccagcctcct

SEQ ID NO: 4456673 - DNA, 23 bp, Homo sapiens
gaggcttctccgccagcctcctc

SEQ ID NO: 4456674 - DNA, 14 bp, Homo sapiens
gaggcttctcctgt

SEQ ID NO: 4456675 - DNA, 15 bp, Homo sapiens
gaggcttgaaggcca

SEQ ID NO: 4456676 - DNA, 14 bp, Homo sapiens
gaggctttggattt

SEQ ID NO: 4456677 - DNA, 14 bp, Homo sapiens
gaggctttggccca

SEQ ID NO: 4456678 - DNA, 17 bp, Homo sapiens
gagggaaaacagaaaac

SEQ ID NO: 4456679 - DNA, 16 bp, Homo sapiens
gagggaaaagggaagt

SEQ ID NO: 4456680 - DNA, 13 bp, Homo sapiens
gagggaaaccttt

SEQ ID NO: 4456681 - DNA, 18 bp, Homo sapiens
gagggaacagacaggaga

SEQ ID NO: 4456682 - DNA, 19 bp, Homo sapiens
gagggaacagacaggagaa

SEQ ID NO: 4456683 - DNA, 17 bp, Homo sapiens
gagggaagccagtcagg

SEQ ID NO: 4456684 - DNA, 19 bp, Homo sapiens
gagggaaggacagtccctg

SEQ ID NO: 4456685 - DNA, 19 bp, Homo sapiens
gagggaagggtttctctat

SEQ ID NO: 4456686 - DNA, 18 bp, Homo sapiens
gagggaccaactgggccc

SEQ ID NO: 4456687 - DNA, 16 bp, Homo sapiens
gagggacgcctggggg

SEQ ID NO: 4456688 - DNA, 23 bp, Homo sapiens
gagggacgcctgggggtgccagg

SEQ ID NO: 4456689 - DNA, 19 bp, Homo sapiens
gagggactctgaagcctct

SEQ ID NO: 4456690 - DNA, 22 bp, Homo sapiens
gagggactctgaagcctctggg

SEQ ID NO: 4456691 - DNA, 23 bp, Homo sapiens
gagggactctgaagcctctggga

SEQ ID NO: 4456692 - DNA, 13 bp, Homo sapiens
gagggagcgacac

SEQ ID NO: 4456693 - DNA, 19 bp, Homo sapiens
gagggagtgagccagcagc

SEQ ID NO: 4456694 - DNA, 13 bp, Homo sapiens
gagggatcagccc

SEQ ID NO: 4456695 - DNA, 14 bp, Homo sapiens
gagggatcagcccc

SEQ ID NO: 4456696 - DNA, 13 bp, Homo sapiens
gagggatggagag

SEQ ID NO: 4456697 - DNA, 15 bp, Homo sapiens
gagggatttccctgc

SEQ ID NO: 4456698 - DNA, 21 bp, Homo sapiens
gagggatttccctgcagacct

SEQ ID NO: 4456699 - DNA, 16 bp, Homo sapiens
gagggcaagccctgcc

SEQ ID NO: 4456700 - DNA, 20 bp, Homo sapiens
gagggcagaaaggttctgcc

SEQ ID NO: 4456701 - DNA, 23 bp, Homo sapiens
gagggcagaaaggttctgcccgg

SEQ ID NO: 4456702 - DNA, 16 bp, Homo sapiens
gagggcagaggctgga

SEQ ID NO: 4456703 - DNA, 20 bp, Homo sapiens
gagggcagagggagaatcca

SEQ ID NO: 4456704 - DNA, 21 bp, Homo sapiens
gagggcagcagaagggggtgg

SEQ ID NO: 4456705 - DNA, 14 bp, Homo sapiens
gagggcccagccca

SEQ ID NO: 4456706 - DNA, 22 bp, Homo sapiens
gagggccctggtgtttctagca

SEQ ID NO: 4456707 - DNA, 20 bp, Homo sapiens
gagggccggttctaaggctc

SEQ ID NO: 4456708 - DNA, 19 bp, Homo sapiens
gagggctaattctgggaag

SEQ ID NO: 4456709 - DNA, 20 bp, Homo sapiens
gagggctagaacctggaagg

SEQ ID NO: 4456710 - DNA, 19 bp, Homo sapiens
gagggctagaactggagag

SEQ ID NO: 4456711 - DNA, 18 bp, Homo sapiens
gagggctagaatctggag

SEQ ID NO: 4456712 - DNA, 10 bp, Homo sapiens
gagggctgga

SEQ ID NO: 4456713 - DNA, 18 bp, Homo sapiens
gagggctggaatctggag

SEQ ID NO: 4456714 - DNA, 20 bp, Homo sapiens
gagggctggaatctggagag

SEQ ID NO: 4456715 - DNA, 13 bp, Homo sapiens
gagggctggccgg

SEQ ID NO: 4456716 - DNA, 22 bp, Homo sapiens
gagggctggccgggactgctgc

SEQ ID NO: 4456717 - DNA, 21 bp, Homo sapiens
gagggctttgaatctgggact

SEQ ID NO: 4456718 - DNA, 19 bp, Homo sapiens
gaggggaaacaatgaaaac

SEQ ID NO: 4456719 - DNA, 15 bp, Homo sapiens
gaggggacgctgagg

SEQ ID NO: 4456720 - DNA, 17 bp, Homo sapiens
gaggggcgcaccccaca

SEQ ID NO: 4456721 - DNA, 19 bp, Homo sapiens
gaggggcgggctcagagct

SEQ ID NO: 4456722 - DNA, 16 bp, Homo sapiens
gaggggctgcagggcc

SEQ ID NO: 4456723 - DNA, 23 bp, Homo sapiens
gaggggctggggacttgtgtctg

SEQ ID NO: 4456724 - DNA, 21 bp, Homo sapiens
gagggggcttgaagccaaaga

SEQ ID NO: 4456725 - DNA, 14 bp, Homo sapiens
gaggggtctcggat

SEQ ID NO: 4456726 - DNA, 16 bp, Homo sapiens
gaggggtctcggatga

SEQ ID NO: 4456727 - DNA, 14 bp, Homo sapiens
gaggggtgtggcag

SEQ ID NO: 4456728 - DNA, 18 bp, Homo sapiens
gagggtcccaagctgggc

SEQ ID NO: 4456729 - DNA, 17 bp, Homo sapiens
gagggtcctggctcctg

SEQ ID NO: 4456730 - DNA, 21 bp, Homo sapiens
gagggtcctggctcctgaggg

SEQ ID NO: 4456731 - DNA, 14 bp, Homo sapiens
gagggtgggggagg

SEQ ID NO: 4456732 - DNA, 17 bp, Homo sapiens
gagggtgggggagggag

SEQ ID NO: 4456733 - DNA, 13 bp, Homo sapiens
gagggtgtcctgc

SEQ ID NO: 4456734 - DNA, 22 bp, Homo sapiens
gagggtgtggctttccaggcac

SEQ ID NO: 4456735 - DNA, 23 bp, Homo sapiens
gagggttgggcgtgctacctgca

SEQ ID NO: 4456736 - DNA, 13 bp, Homo sapiens
gagggtttctgat

SEQ ID NO: 4456737 - DNA, 21 bp, Homo sapiens
gaggtaactatcaatatttaa

SEQ ID NO: 4456738 - DNA, 21 bp, Homo sapiens
gaggtaggcgggaaaggatgg

SEQ ID NO: 4456739 - DNA, 17 bp, Homo sapiens
gaggtaggggtggggag

SEQ ID NO: 4456740 - DNA, 18 bp, Homo sapiens
gaggtatcttactttcct

SEQ ID NO: 4456741 - DNA, 23 bp, Homo sapiens
gaggtcaacagagaaggcaggaa

SEQ ID NO: 4456742 - DNA, 20 bp, Homo sapiens
gaggtcacctgccgccctgt

SEQ ID NO: 4456743 - DNA, 17 bp, Homo sapiens
gaggtcagcatttgatc

SEQ ID NO: 4456744 - DNA, 13 bp, Homo sapiens
gaggtccagaccc

SEQ ID NO: 4456745 - DNA, 16 bp, Homo sapiens
gaggtccaggtcccag

SEQ ID NO: 4456746 - DNA, 20 bp, Homo sapiens
gaggtcgggagttcgagacc

SEQ ID NO: 4456747 - DNA, 18 bp, Homo sapiens
gaggtctcatctcccagg

SEQ ID NO: 4456748 - DNA, 13 bp, Homo sapiens
gaggtctgagccc

SEQ ID NO: 4456749 - DNA, 21 bp, Homo sapiens
gaggtgccacccagtagccca

SEQ ID NO: 4456750 - DNA, 21 bp, Homo sapiens
gaggtgctgggggagccctgg

SEQ ID NO: 4456751 - DNA, 15 bp, Homo sapiens
gaggtgctgtcccca

SEQ ID NO: 4456752 - DNA, 12 bp, Homo sapiens
gaggtgcttgat

SEQ ID NO: 4456753 - DNA, 17 bp, Homo sapiens
gaggtggaagcagaggc

SEQ ID NO: 4456754 - DNA, 19 bp, Homo sapiens
gaggtggaagcagaggccc

SEQ ID NO: 4456755 - DNA, 21 bp, Homo sapiens
gaggtggaagcagaggccctg

SEQ ID NO: 4456756 - DNA, 20 bp, Homo sapiens
gaggtggaggttgcagtgag

SEQ ID NO: 4456757 - DNA, 17 bp, Homo sapiens
gaggtgggatcctccct

SEQ ID NO: 4456758 - DNA, 17 bp, Homo sapiens
gaggtgggccacaccca

SEQ ID NO: 4456759 - DNA, 23 bp, Homo sapiens
gaggtgggccacacccaggaagg

SEQ ID NO: 4456760 - DNA, 22 bp, Homo sapiens
gaggtggtaggatcacctgagg

SEQ ID NO: 4456761 - DNA, 14 bp, Homo sapiens
gaggtgtcaggctg

SEQ ID NO: 4456762 - DNA, 22 bp, Homo sapiens
gaggtgtcaggctgctggcgcc

SEQ ID NO: 4456763 - DNA, 15 bp, Homo sapiens
gaggtgtccaactgg

SEQ ID NO: 4456764 - DNA, 18 bp, Homo sapiens
gaggttaaacggtgccca

SEQ ID NO: 4456765 - DNA, 18 bp, Homo sapiens
gaggttcctctgcctgcc

SEQ ID NO: 4456766 - DNA, 19 bp, Homo sapiens
gaggttcctctgcctgccc

SEQ ID NO: 4456767 - DNA, 13 bp, Homo sapiens
gaggttgaagcca

SEQ ID NO: 4456768 - DNA, 15 bp, Homo sapiens
gaggttgaagccaag

SEQ ID NO: 4456769 - DNA, 12 bp, Homo sapiens
gaggttgggctt

SEQ ID NO: 4456770 - DNA, 19 bp, Homo sapiens
gaggttgtagtgagccaag

SEQ ID NO: 4456771 - DNA, 18 bp, Homo sapiens
gaggttgtggggcctcag

SEQ ID NO: 4456772 - DNA, 23 bp, Homo sapiens
gaggttgtggggcctcaggctcc

SEQ ID NO: 4456773 - DNA, 17 bp, Homo sapiens
gaggtttggtttcctgt

SEQ ID NO: 4456774 - DNA, 22 bp, Homo sapiens
gaggtttgtttagaagaagtgt

SEQ ID NO: 4456775 - DNA, 16 bp, Homo sapiens
gaggttttatttcatt

SEQ ID NO: 4456776 - DNA, 21 bp, Homo sapiens
gaggttttatttcatttttca

SEQ ID NO: 4456777 - DNA, 17 bp, Homo sapiens
gagtaaacggcccaggc

SEQ ID NO: 4456778 - DNA, 16 bp, Homo sapiens
gagtaaactgaggccc

SEQ ID NO: 4456779 - DNA, 18 bp, Homo sapiens
gagtaaataattggaaaa

SEQ ID NO: 4456780 - DNA, 19 bp, Homo sapiens
gagtaacacataacattgt

SEQ ID NO: 4456781 - DNA, 18 bp, Homo sapiens
gagtaatactttttaaat

SEQ ID NO: 4456782 - DNA, 20 bp, Homo sapiens
gagtaatactttttaaatta

SEQ ID NO: 4456783 - DNA, 19 bp, Homo sapiens
gagtaataggaccagagcg

SEQ ID NO: 4456784 - DNA, 14 bp, Homo sapiens
gagtaatgatgtaa

SEQ ID NO: 4456785 - DNA, 19 bp, Homo sapiens
gagtaattctgtcattcct

SEQ ID NO: 4456786 - DNA, 19 bp, Homo sapiens
gagtacggctggtgtgtca

SEQ ID NO: 4456787 - DNA, 23 bp, Homo sapiens
gagtactgtgggcaatttagaaa

SEQ ID NO: 4456788 - DNA, 19 bp, Homo sapiens
gagtagaaactgcagggaa

SEQ ID NO: 4456789 - DNA, 19 bp, Homo sapiens
gagtagctgggactacagg

SEQ ID NO: 4456790 - DNA, 14 bp, Homo sapiens
gagtagtggccact

SEQ ID NO: 4456791 - DNA, 22 bp, Homo sapiens
gagtagttgttggtctgtagca

SEQ ID NO: 4456792 - DNA, 18 bp, Homo sapiens
gagtatgtggcaaaacat

SEQ ID NO: 4456793 - DNA, 19 bp, Homo sapiens
gagtcaaatggtaggcatt

SEQ ID NO: 4456794 - DNA, 18 bp, Homo sapiens
gagtcacagatgaggccc

SEQ ID NO: 4456795 - DNA, 20 bp, Homo sapiens
gagtcaccttttctgtggct

SEQ ID NO: 4456796 - DNA, 22 bp, Homo sapiens
gagtcaccttttctgtggctgg

SEQ ID NO: 4456797 - DNA, 16 bp, Homo sapiens
gagtcagaggagaaga

SEQ ID NO: 4456798 - DNA, 21 bp, Homo sapiens
gagtcaggagttttactgcct

SEQ ID NO: 4456799 - DNA, 18 bp, Homo sapiens
gagtcagggacctgctgc

SEQ ID NO: 4456800 - DNA, 18 bp, Homo sapiens
gagtcagggagagctgaa

SEQ ID NO: 4456801 - DNA, 23 bp, Homo sapiens
gagtcataacggttaagaaagca

SEQ ID NO: 4456802 - DNA, 22 bp, Homo sapiens
gagtcattcaggtgacctcctg

SEQ ID NO: 4456803 - DNA, 13 bp, Homo sapiens
gagtcatttaaat

SEQ ID NO: 4456804 - DNA, 14 bp, Homo sapiens
gagtcatttaaatg

SEQ ID NO: 4456805 - DNA, 16 bp, Homo sapiens
gagtcatttaaatgtg

SEQ ID NO: 4456806 - DNA, 16 bp, Homo sapiens
gagtccacgcccacca

SEQ ID NO: 4456807 - DNA, 18 bp, Homo sapiens
gagtccacgcccaccagc

SEQ ID NO: 4456808 - DNA, 19 bp, Homo sapiens
gagtccacgcccaccagcc

SEQ ID NO: 4456809 - DNA, 20 bp, Homo sapiens
gagtccacgcccaccagcct

SEQ ID NO: 4456810 - DNA, 17 bp, Homo sapiens
gagtccactgtggcact

SEQ ID NO: 4456811 - DNA, 11 bp, Homo sapiens
gagtccagacc

SEQ ID NO: 4456812 - DNA, 14 bp, Homo sapiens
gagtccagcccctc

SEQ ID NO: 4456813 - DNA, 18 bp, Homo sapiens
gagtccagcccctcctcc

SEQ ID NO: 4456814 - DNA, 14 bp, Homo sapiens
gagtccagctcccc

SEQ ID NO: 4456815 - DNA, 15 bp, Homo sapiens
gagtccagctccccc

SEQ ID NO: 4456816 - DNA, 21 bp, Homo sapiens
gagtccagctccccccaagat

SEQ ID NO: 4456817 - DNA, 18 bp, Homo sapiens
gagtccagggtttctctg

SEQ ID NO: 4456818 - DNA, 21 bp, Homo sapiens
gagtccagtgctctgcctcag

SEQ ID NO: 4456819 - DNA, 13 bp, Homo sapiens
gagtccatcagcc

SEQ ID NO: 4456820 - DNA, 14 bp, Homo sapiens
gagtccatcagcct

SEQ ID NO: 4456821 - DNA, 16 bp, Homo sapiens
gagtccatcagcctcc

SEQ ID NO: 4456822 - DNA, 15 bp, Homo sapiens
gagtccattctccca

SEQ ID NO: 4456823 - DNA, 17 bp, Homo sapiens
gagtcccaggggcagcc

SEQ ID NO: 4456824 - DNA, 22 bp, Homo sapiens
gagtcccaggggcagccacacc

SEQ ID NO: 4456825 - DNA, 23 bp, Homo sapiens
gagtcccaggggcagccacacca

SEQ ID NO: 4456826 - DNA, 21 bp, Homo sapiens
gagtccctgcctggaccagcc

SEQ ID NO: 4456827 - DNA, 17 bp, Homo sapiens
gagtcctcactcccagt

SEQ ID NO: 4456828 - DNA, 18 bp, Homo sapiens
gagtctaatagtctttgc

SEQ ID NO: 4456829 - DNA, 17 bp, Homo sapiens
gagtctcatttgggcta

SEQ ID NO: 4456830 - DNA, 20 bp, Homo sapiens
gagtctcgctctgtcgccca

SEQ ID NO: 4456831 - DNA, 21 bp, Homo sapiens
gagtctggggacctggcactg

SEQ ID NO: 4456832 - DNA, 23 bp, Homo sapiens
gagtctggtgaagctcacttctg

SEQ ID NO: 4456833 - DNA, 22 bp, Homo sapiens
gagtcttaactgtatttcagta

SEQ ID NO: 4456834 - DNA, 23 bp, Homo sapiens
gagtcttaactgtatttcagtat

SEQ ID NO: 4456835 - DNA, 21 bp, Homo sapiens
gagtcttaagggtcactggcc

SEQ ID NO: 4456836 - DNA, 22 bp, Homo sapiens
gagtcttaagggtcactggcct

SEQ ID NO: 4456837 - DNA, 20 bp, Homo sapiens
gagtcttactctgccgccca

SEQ ID NO: 4456838 - DNA, 20 bp, Homo sapiens
gagtcttgctctgtcaccca

SEQ ID NO: 4456839 - DNA, 18 bp, Homo sapiens
gagtcttgtgaaagtgta

SEQ ID NO: 4456840 - DNA, 23 bp, Homo sapiens
gagtctttcattcggtgtgaact

SEQ ID NO: 4456841 - DNA, 22 bp, Homo sapiens
gagtgaacaaatttacagagac

SEQ ID NO: 4456842 - DNA, 17 bp, Homo sapiens
gagtgaatgtggcagtt

SEQ ID NO: 4456843 - DNA, 18 bp, Homo sapiens
gagtgacctcggacagag

SEQ ID NO: 4456844 - DNA, 19 bp, Homo sapiens
gagtgacctcggacagagc

SEQ ID NO: 4456845 - DNA, 20 bp, Homo sapiens
gagtgacctcggacagagcc

SEQ ID NO: 4456846 - DNA, 21 bp, Homo sapiens
gagtgacctcggacagagccc

SEQ ID NO: 4456847 - DNA, 17 bp, Homo sapiens
gagtgagacaggctggg

SEQ ID NO: 4456848 - DNA, 23 bp, Homo sapiens
gagtgagacccagccctcatccc

SEQ ID NO: 4456849 - DNA, 14 bp, Homo sapiens
gagtgagggagaca

SEQ ID NO: 4456850 - DNA, 19 bp, Homo sapiens
gagtgcaggcctgctcagg

SEQ ID NO: 4456851 - DNA, 17 bp, Homo sapiens
gagtgcaggtgcagttt

SEQ ID NO: 4456852 - DNA, 15 bp, Homo sapiens
gagtgccttctgtgg

SEQ ID NO: 4456853 - DNA, 16 bp, Homo sapiens
gagtgccttctgtggg

SEQ ID NO: 4456854 - DNA, 16 bp, Homo sapiens
gagtgcgggctgaggc

SEQ ID NO: 4456855 - DNA, 21 bp, Homo sapiens
gagtgctggactgttccaggc

SEQ ID NO: 4456856 - DNA, 13 bp, Homo sapiens
gagtggacctgtg

SEQ ID NO: 4456857 - DNA, 13 bp, Homo sapiens
gagtggcctggcc

SEQ ID NO: 4456858 - DNA, 16 bp, Homo sapiens
gagtggggggacagag

SEQ ID NO: 4456859 - DNA, 15 bp, Homo sapiens
gagtgggttgatttc

SEQ ID NO: 4456860 - DNA, 18 bp, Homo sapiens
gagtgtagcaactacagt

SEQ ID NO: 4456861 - DNA, 19 bp, Homo sapiens
gagtgtcctcttccctctc

SEQ ID NO: 4456862 - DNA, 17 bp, Homo sapiens
gagtgtcctggctgtga

SEQ ID NO: 4456863 - DNA, 23 bp, Homo sapiens
gagtgtgagccacctaagatctc

SEQ ID NO: 4456864 - DNA, 13 bp, Homo sapiens
gagtgtgtaattt

SEQ ID NO: 4456865 - DNA, 15 bp, Homo sapiens
gagtgttatgtattt

SEQ ID NO: 4456866 - DNA, 19 bp, Homo sapiens
gagtgttccccttccactg

SEQ ID NO: 4456867 - DNA, 19 bp, Homo sapiens
gagtgttcccgtgcctggg

SEQ ID NO: 4456868 - DNA, 12 bp, Homo sapiens
gagttaaataaa

SEQ ID NO: 4456869 - DNA, 12 bp, Homo sapiens
gagttaaatggt

SEQ ID NO: 4456870 - DNA, 19 bp, Homo sapiens
gagttaataggagtatttt

SEQ ID NO: 4456871 - DNA, 13 bp, Homo sapiens
gagttacagttct

SEQ ID NO: 4456872 - DNA, 22 bp, Homo sapiens
gagttacttagaatgccataaa

SEQ ID NO: 4456873 - DNA, 18 bp, Homo sapiens
gagttagaaccacagcag

SEQ ID NO: 4456874 - DNA, 18 bp, Homo sapiens
gagttatcatgaatttta

SEQ ID NO: 4456875 - DNA, 20 bp, Homo sapiens
gagttatcatgaattttaaa

SEQ ID NO: 4456876 - DNA, 23 bp, Homo sapiens
gagttatcatgaattttaaagta

SEQ ID NO: 4456877 - DNA, 15 bp, Homo sapiens
gagttatcttcttta

SEQ ID NO: 4456878 - DNA, 19 bp, Homo sapiens
gagttccagaccccctgag

SEQ ID NO: 4456879 - DNA, 15 bp, Homo sapiens
gagttccagttgaag

SEQ ID NO: 4456880 - DNA, 21 bp, Homo sapiens
gagttcccgggagctgggccc

SEQ ID NO: 4456881 - DNA, 23 bp, Homo sapiens
gagttcccgggagctgggccctg

SEQ ID NO: 4456882 - DNA, 17 bp, Homo sapiens
gagttccttatccctct

SEQ ID NO: 4456883 - DNA, 19 bp, Homo sapiens
gagttccttatccctctct

SEQ ID NO: 4456884 - DNA, 22 bp, Homo sapiens
gagttccttatccctctcttcc

SEQ ID NO: 4456885 - DNA, 23 bp, Homo sapiens
gagttctatggagactttgctgt

SEQ ID NO: 4456886 - DNA, 17 bp, Homo sapiens
gagttctgggtttctag

SEQ ID NO: 4456887 - DNA, 15 bp, Homo sapiens
gagttcttcctgtaa

SEQ ID NO: 4456888 - DNA, 12 bp, Homo sapiens
gagttctttgct

SEQ ID NO: 4456889 - DNA, 16 bp, Homo sapiens
gagttctttgctgccc

SEQ ID NO: 4456890 - DNA, 23 bp, Homo sapiens
gagttctttgctgcccctgtctg

SEQ ID NO: 4456891 - DNA, 19 bp, Homo sapiens
gagttgaggaactgtacag

SEQ ID NO: 4456892 - DNA, 18 bp, Homo sapiens
gagttgttgtttgccaag

SEQ ID NO: 4456893 - DNA, 16 bp, Homo sapiens
gagttgttttcagact

SEQ ID NO: 4456894 - DNA, 14 bp, Homo sapiens
gagtttagggtggg

SEQ ID NO: 4456895 - DNA, 23 bp, Homo sapiens
gagtttattacaatgtatcttta

SEQ ID NO: 4456896 - DNA, 18 bp, Homo sapiens
gagtttcatgtacaagat

SEQ ID NO: 4456897 - DNA, 15 bp, Homo sapiens
gagtttctgtttgat

SEQ ID NO: 4456898 - DNA, 17 bp, Homo sapiens
gagtttgagaccaggct

SEQ ID NO: 4456899 - DNA, 14 bp, Homo sapiens
gagtttgggctgga

SEQ ID NO: 4456900 - DNA, 15 bp, Homo sapiens
gagtttgggctggag

SEQ ID NO: 4456901 - DNA, 15 bp, Homo sapiens
gagtttggtccctgg

SEQ ID NO: 4456902 - DNA, 14 bp, Homo sapiens
gagttttattcctt

SEQ ID NO: 4456903 - DNA, 15 bp, Homo sapiens
gagttttgtgtttgt

SEQ ID NO: 4456904 - DNA, 18 bp, Homo sapiens
gagttttgtgtttgttgt

SEQ ID NO: 4456905 - DNA, 18 bp, Homo sapiens
gagtttttatggggctga

SEQ ID NO: 4456906 - DNA, 14 bp, Homo sapiens
gagtttttcctccc

SEQ ID NO: 4456907 - DNA, 14 bp, Homo sapiens
gataaaaataaagc

SEQ ID NO: 4456908 - DNA, 13 bp, Homo sapiens
gataaaagatggc

SEQ ID NO: 4456909 - DNA, 19 bp, Homo sapiens
gataaaataaaattttatt

SEQ ID NO: 4456910 - DNA, 13 bp, Homo sapiens
gataaaatatttt

SEQ ID NO: 4456911 - DNA, 13 bp, Homo sapiens
gataaacagtagt

SEQ ID NO: 4456912 - DNA, 17 bp, Homo sapiens
gataaacataattattt

SEQ ID NO: 4456913 - DNA, 18 bp, Homo sapiens
gataaaccaaaaacattt

SEQ ID NO: 4456914 - DNA, 16 bp, Homo sapiens
gataaagaccagaaat

SEQ ID NO: 4456915 - DNA, 12 bp, Homo sapiens
gataaagacttt

SEQ ID NO: 4456916 - DNA, 13 bp, Homo sapiens
gataaagactttt

SEQ ID NO: 4456917 - DNA, 19 bp, Homo sapiens
gataaagatttctagtagg

SEQ ID NO: 4456918 - DNA, 19 bp, Homo sapiens
gataaagattttttaataa

SEQ ID NO: 4456919 - DNA, 11 bp, Homo sapiens
gataaaggtga

SEQ ID NO: 4456920 - DNA, 21 bp, Homo sapiens
gataaataacttttttttaag

SEQ ID NO: 4456921 - DNA, 20 bp, Homo sapiens
gataaatcagtcaagctgtt

SEQ ID NO: 4456922 - DNA, 18 bp, Homo sapiens
gataaatcataaagtcag

SEQ ID NO: 4456923 - DNA, 13 bp, Homo sapiens
gataaatttaatc

SEQ ID NO: 4456924 - DNA, 17 bp, Homo sapiens
gataacaacctggagac

SEQ ID NO: 4456925 - DNA, 16 bp, Homo sapiens
gataaccaattttcag

SEQ ID NO: 4456926 - DNA, 16 bp, Homo sapiens
gataaccttgaaaaaa

SEQ ID NO: 4456927 - DNA, 14 bp, Homo sapiens
gataactgatttct

SEQ ID NO: 4456928 - DNA, 16 bp, Homo sapiens
gataactgatttctat

SEQ ID NO: 4456929 - DNA, 23 bp, Homo sapiens
gataactgatttctatggctttc

SEQ ID NO: 4456930 - DNA, 15 bp, Homo sapiens
gataacttcttgaaa

SEQ ID NO: 4456931 - DNA, 18 bp, Homo sapiens
gataacttcttgaaaaag

SEQ ID NO: 4456932 - DNA, 19 bp, Homo sapiens
gataactttacagaaatgg

SEQ ID NO: 4456933 - DNA, 19 bp, Homo sapiens
gataacttttttgagtcat

SEQ ID NO: 4456934 - DNA, 16 bp, Homo sapiens
gataagacattttgtt

SEQ ID NO: 4456935 - DNA, 23 bp, Homo sapiens
gataagacattttgtttttactg

SEQ ID NO: 4456936 - DNA, 14 bp, Homo sapiens
gataagggaaaaga

SEQ ID NO: 4456937 - DNA, 16 bp, Homo sapiens
gataagggaaaagata

SEQ ID NO: 4456938 - DNA, 21 bp, Homo sapiens
gataataaatgcttcttaaag

SEQ ID NO: 4456939 - DNA, 20 bp, Homo sapiens
gataatatgtttagttttac

SEQ ID NO: 4456940 - DNA, 16 bp, Homo sapiens
gataatcctagagtct

SEQ ID NO: 4456941 - DNA, 19 bp, Homo sapiens
gataatctcagtgctttcc

SEQ ID NO: 4456942 - DNA, 13 bp, Homo sapiens
gataatgaacaga

SEQ ID NO: 4456943 - DNA, 14 bp, Homo sapiens
gataatgaacagaa

SEQ ID NO: 4456944 - DNA, 11 bp, Homo sapiens
gataatgccac

SEQ ID NO: 4456945 - DNA, 22 bp, Homo sapiens
gataatttaaaatccattttag

SEQ ID NO: 4456946 - DNA, 15 bp, Homo sapiens
gataatttatttcaa

SEQ ID NO: 4456947 - DNA, 22 bp, Homo sapiens
gataatttatttcaataaatct

SEQ ID NO: 4456948 - DNA, 18 bp, Homo sapiens
gataattttaaattctct

SEQ ID NO: 4456949 - DNA, 14 bp, Homo sapiens
gatacactgcactt

SEQ ID NO: 4456950 - DNA, 17 bp, Homo sapiens
gatacactgcactttgt

SEQ ID NO: 4456951 - DNA, 13 bp, Homo sapiens
gatacatttaata

SEQ ID NO: 4456952 - DNA, 14 bp, Homo sapiens
gatacatttaataa

SEQ ID NO: 4456953 - DNA, 18 bp, Homo sapiens
gataccaaggtacaactg

SEQ ID NO: 4456954 - DNA, 15 bp, Homo sapiens
gataccagcgaggag

SEQ ID NO: 4456955 - DNA, 13 bp, Homo sapiens
gataccagctgga

SEQ ID NO: 4456956 - DNA, 19 bp, Homo sapiens
gataccatgctgtaaggat

SEQ ID NO: 4456957 - DNA, 18 bp, Homo sapiens
gatacctgctttggaagc

SEQ ID NO: 4456958 - DNA, 21 bp, Homo sapiens
gatactgacagaagttatttc

SEQ ID NO: 4456959 - DNA, 19 bp, Homo sapiens
gatactgattatgaaatgt

SEQ ID NO: 4456960 - DNA, 13 bp, Homo sapiens
gatactggcacag

SEQ ID NO: 4456961 - DNA, 20 bp, Homo sapiens
gatacttaagtgctgcaatt

SEQ ID NO: 4456962 - DNA, 16 bp, Homo sapiens
gatacttgaataacca

SEQ ID NO: 4456963 - DNA, 20 bp, Homo sapiens
gatactttagtacaatttca

SEQ ID NO: 4456964 - DNA, 19 bp, Homo sapiens
gatagaaagaataaaatgt

SEQ ID NO: 4456965 - DNA, 13 bp, Homo sapiens
gatagacatatac

SEQ ID NO: 4456966 - DNA, 19 bp, Homo sapiens
gatagcagacattgttaca

SEQ ID NO: 4456967 - DNA, 14 bp, Homo sapiens
gataggaaactgaa

SEQ ID NO: 4456968 - DNA, 15 bp, Homo sapiens
gataggaaactgaag

SEQ ID NO: 4456969 - DNA, 15 bp, Homo sapiens
gatagggctgggcaa

SEQ ID NO: 4456970 - DNA, 14 bp, Homo sapiens
gatagtgccaggtg

SEQ ID NO: 4456971 - DNA, 15 bp, Homo sapiens
gatagttttcatttt

SEQ ID NO: 4456972 - DNA, 22 bp, Homo sapiens
gatataacacaaagagatattt

SEQ ID NO: 4456973 - DNA, 14 bp, Homo sapiens
gatataatctttca

SEQ ID NO: 4456974 - DNA, 14 bp, Homo sapiens
gatataatgaacaa

SEQ ID NO: 4456975 - DNA, 20 bp, Homo sapiens
gatataattgtactgtgttt

SEQ ID NO: 4456976 - DNA, 12 bp, Homo sapiens
gatatacacagt

SEQ ID NO: 4456977 - DNA, 16 bp, Homo sapiens
gatatactttgtggac

SEQ ID NO: 4456978 - DNA, 18 bp, Homo sapiens
gatatatttgaaatagta

SEQ ID NO: 4456979 - DNA, 11 bp, Homo sapiens
gatatcctctc

SEQ ID NO: 4456980 - DNA, 16 bp, Homo sapiens
gatatcctctccccct

SEQ ID NO: 4456981 - DNA, 12 bp, Homo sapiens
gatatggctgcc

SEQ ID NO: 4456982 - DNA, 16 bp, Homo sapiens
gatatggctgcccagg

SEQ ID NO: 4456983 - DNA, 20 bp, Homo sapiens
gatatggctgcccaggagac

SEQ ID NO: 4456984 - DNA, 21 bp, Homo sapiens
gatatggcttaggaatgactt

SEQ ID NO: 4456985 - DNA, 16 bp, Homo sapiens
gatatgggtcctctgg

SEQ ID NO: 4456986 - DNA, 15 bp, Homo sapiens
gatatgtctgctgag

SEQ ID NO: 4456987 - DNA, 16 bp, Homo sapiens
gatatgttatactgaa

SEQ ID NO: 4456988 - DNA, 13 bp, Homo sapiens
gatattaagaatc

SEQ ID NO: 4456989 - DNA, 20 bp, Homo sapiens
gatattaggccagttgaagt

SEQ ID NO: 4456990 - DNA, 16 bp, Homo sapiens
gatattatagaaaatt

SEQ ID NO: 4456991 - DNA, 23 bp, Homo sapiens
gatattctaagaaatatctgtga

SEQ ID NO: 4456992 - DNA, 19 bp, Homo sapiens
gatattgccttatttgtct

SEQ ID NO: 4456993 - DNA, 20 bp, Homo sapiens
gatattgttataaataaaat

SEQ ID NO: 4456994 - DNA, 11 bp, Homo sapiens
gatattgtttg

SEQ ID NO: 4456995 - DNA, 19 bp, Homo sapiens
gatatttatggggggagaa

SEQ ID NO: 4456996 - DNA, 18 bp, Homo sapiens
gatatttcgaccctgggg

SEQ ID NO: 4456997 - DNA, 17 bp, Homo sapiens
gatatttcttgctttca

SEQ ID NO: 4456998 - DNA, 18 bp, Homo sapiens
gatatttgcagtttttca

SEQ ID NO: 4456999 - DNA, 22 bp, Homo sapiens
gatatttgtcatgctgggattt

SEQ ID NO: 4457000 - DNA, 11 bp, Homo sapiens
gatatttttat

SEQ ID NO: 4457001 - DNA, 17 bp, Homo sapiens
gatatttttatctttat

SEQ ID NO: 4457002 - DNA, 12 bp, Homo sapiens
gatcaaagatga

SEQ ID NO: 4457003 - DNA, 16 bp, Homo sapiens
gatcaaatagttgcat

SEQ ID NO: 4457004 - DNA, 13 bp, Homo sapiens
gatcaagttgttg

SEQ ID NO: 4457005 - DNA, 14 bp, Homo sapiens
gatcaatttctccc

SEQ ID NO: 4457006 - DNA, 13 bp, Homo sapiens
gatcacaaaaaca

SEQ ID NO: 4457007 - DNA, 12 bp, Homo sapiens
gatcacacagtg

SEQ ID NO: 4457008 - DNA, 15 bp, Homo sapiens
gatcacacagtgtta

SEQ ID NO: 4457009 - DNA, 17 bp, Homo sapiens
gatcacagaccacagga

SEQ ID NO: 4457010 - DNA, 14 bp, Homo sapiens
gatcacagagcagc

SEQ ID NO: 4457011 - DNA, 16 bp, Homo sapiens
gatcacagagcagcaa

SEQ ID NO: 4457012 - DNA, 21 bp, Homo sapiens
gatcacagagcagcaagttca

SEQ ID NO: 4457013 - DNA, 13 bp, Homo sapiens
gatcacagaggct

SEQ ID NO: 4457014 - DNA, 17 bp, Homo sapiens
gatcacatcttaaattc

SEQ ID NO: 4457015 - DNA, 23 bp, Homo sapiens
gatcaccgactgaaaatattgtt

SEQ ID NO: 4457016 - DNA, 19 bp, Homo sapiens
gatcacctgaggtcaggag

SEQ ID NO: 4457017 - DNA, 22 bp, Homo sapiens
gatcacgccattgtactccagc

SEQ ID NO: 4457018 - DNA, 20 bp, Homo sapiens
gatcactgtgaaccaacccc

SEQ ID NO: 4457019 - DNA, 11 bp, Homo sapiens
gatcagacagc

SEQ ID NO: 4457020 - DNA, 23 bp, Homo sapiens
gatcagagccgtggtcctttggg

SEQ ID NO: 4457021 - DNA, 19 bp, Homo sapiens
gatcagccccgcctgtcac

SEQ ID NO: 4457022 - DNA, 20 bp, Homo sapiens
gatcagccccgcctgtcaca

SEQ ID NO: 4457023 - DNA, 16 bp, Homo sapiens
gatcaggagagcaagg

SEQ ID NO: 4457024 - DNA, 15 bp, Homo sapiens
gatcaggctagccct

SEQ ID NO: 4457025 - DNA, 19 bp, Homo sapiens
gatcaggctagccctgccc

SEQ ID NO: 4457026 - DNA, 23 bp, Homo sapiens
gatcagtaaaattatactgtgtg

SEQ ID NO: 4457027 - DNA, 21 bp, Homo sapiens
gatcatagctcactgcagcct

SEQ ID NO: 4457028 - DNA, 22 bp, Homo sapiens
gatcatagctcactgcagcctc

SEQ ID NO: 4457029 - DNA, 15 bp, Homo sapiens
gatcatcaacaagat

SEQ ID NO: 4457030 - DNA, 15 bp, Homo sapiens
gatcatgtacttttt

SEQ ID NO: 4457031 - DNA, 14 bp, Homo sapiens
gatcattatcagcc

SEQ ID NO: 4457032 - DNA, 20 bp, Homo sapiens
gatcatttataatactgttt

SEQ ID NO: 4457033 - DNA, 21 bp, Homo sapiens
gatcatttataatactgtttt

SEQ ID NO: 4457034 - DNA, 18 bp, Homo sapiens
gatcatttggagctcttg

SEQ ID NO: 4457035 - DNA, 19 bp, Homo sapiens
gatcattttccccccactc

SEQ ID NO: 4457036 - DNA, 23 bp, Homo sapiens
gatcattttccccccactctccc

SEQ ID NO: 4457037 - DNA, 16 bp, Homo sapiens
gatccagaagagccca

SEQ ID NO: 4457038 - DNA, 14 bp, Homo sapiens
gatccagagagcag

SEQ ID NO: 4457039 - DNA, 16 bp, Homo sapiens
gatccagtataagact

SEQ ID NO: 4457040 - DNA, 14 bp, Homo sapiens
gatcccaaagcaag

SEQ ID NO: 4457041 - DNA, 16 bp, Homo sapiens
gatcccaaagcaagga

SEQ ID NO: 4457042 - DNA, 19 bp, Homo sapiens
gatcccaacactgccagca

SEQ ID NO: 4457043 - DNA, 11 bp, Homo sapiens
gatcccacccc

SEQ ID NO: 4457044 - DNA, 13 bp, Homo sapiens
gatcccaccccct

SEQ ID NO: 4457045 - DNA, 17 bp, Homo sapiens
gatcccaccccctcctc

SEQ ID NO: 4457046 - DNA, 20 bp, Homo sapiens
gatcccaccccctcctcccc

SEQ ID NO: 4457047 - DNA, 22 bp, Homo sapiens
gatcccaccccctcctccccca

SEQ ID NO: 4457048 - DNA, 23 bp, Homo sapiens
gatcccaccccctcctcccccag

SEQ ID NO: 4457049 - DNA, 22 bp, Homo sapiens
gatcccagcacctattgaatta

SEQ ID NO: 4457050 - DNA, 23 bp, Homo sapiens
gatcccaggggcccaaggcggcc

SEQ ID NO: 4457051 - DNA, 13 bp, Homo sapiens
gatccccaactgc

SEQ ID NO: 4457052 - DNA, 15 bp, Homo sapiens
gatccccaactgctc

SEQ ID NO: 4457053 - DNA, 21 bp, Homo sapiens
gatccccaactgctccagcct

SEQ ID NO: 4457054 - DNA, 19 bp, Homo sapiens
gatccccagcccctcctcc

SEQ ID NO: 4457055 - DNA, 22 bp, Homo sapiens
gatccccagcccctcctccctc

SEQ ID NO: 4457056 - DNA, 23 bp, Homo sapiens
gatccccagcccctcctccctca

SEQ ID NO: 4457057 - DNA, 13 bp, Homo sapiens
gatcccctcagga

SEQ ID NO: 4457058 - DNA, 17 bp, Homo sapiens
gatcccctcaggactgc

SEQ ID NO: 4457059 - DNA, 17 bp, Homo sapiens
gatcctaaactctctag

SEQ ID NO: 4457060 - DNA, 16 bp, Homo sapiens
gatcctccacagagag

SEQ ID NO: 4457061 - DNA, 11 bp, Homo sapiens
gatcctcccac

SEQ ID NO: 4457062 - DNA, 22 bp, Homo sapiens
gatcctcccacctcagcctcct

SEQ ID NO: 4457063 - DNA, 15 bp, Homo sapiens
gatcctccctatcaa

SEQ ID NO: 4457064 - DNA, 16 bp, Homo sapiens
gatcctccctcatggc

SEQ ID NO: 4457065 - DNA, 16 bp, Homo sapiens
gatcctctcacctcag

SEQ ID NO: 4457066 - DNA, 16 bp, Homo sapiens
gatcctctctggggct

SEQ ID NO: 4457067 - DNA, 22 bp, Homo sapiens
gatcctgaatctgtgcaaacag

SEQ ID NO: 4457068 - DNA, 16 bp, Homo sapiens
gatcctgactaagcct

SEQ ID NO: 4457069 - DNA, 18 bp, Homo sapiens
gatcctgagtccagaatg

SEQ ID NO: 4457070 - DNA, 16 bp, Homo sapiens
gatcctgcaccccagc

SEQ ID NO: 4457071 - DNA, 17 bp, Homo sapiens
gatcctgcaccccagca

SEQ ID NO: 4457072 - DNA, 22 bp, Homo sapiens
gatcctgcaccccagcattcca

SEQ ID NO: 4457073 - DNA, 21 bp, Homo sapiens
gatcctgctgctttgggctgg

SEQ ID NO: 4457074 - DNA, 24 bp, Homo sapiens
gatcctgctgctttgggctgggat

SEQ ID NO: 4457075 - DNA, 22 bp, Homo sapiens
gatcctgtaggctaaaaggctt

SEQ ID NO: 4457076 - DNA, 12 bp, Homo sapiens
gatcctgtctct

SEQ ID NO: 4457077 - DNA, 13 bp, Homo sapiens
gatccttcaaagt

SEQ ID NO: 4457078 - DNA, 23 bp, Homo sapiens
gatccttcaaagtctcaatgaaa

SEQ ID NO: 4457079 - DNA, 13 bp, Homo sapiens
gatccttcatttt

SEQ ID NO: 4457080 - DNA, 16 bp, Homo sapiens
gatccttccattccat

SEQ ID NO: 4457081 - DNA, 19 bp, Homo sapiens
gatcgctgcacatggcctg

SEQ ID NO: 4457082 - DNA, 17 bp, Homo sapiens
gatcggactctgcccct

SEQ ID NO: 4457083 - DNA, 13 bp, Homo sapiens
gatctaaacagtt

SEQ ID NO: 4457084 - DNA, 11 bp, Homo sapiens
gatctacacat

SEQ ID NO: 4457085 - DNA, 20 bp, Homo sapiens
gatctacttctgtaattgtg

SEQ ID NO: 4457086 - DNA, 21 bp, Homo sapiens
gatctacttgcctcatttccc

SEQ ID NO: 4457087 - DNA, 21 bp, Homo sapiens
gatctatccctgcggcctcca

SEQ ID NO: 4457088 - DNA, 15 bp, Homo sapiens
gatctatgtttcatc

SEQ ID NO: 4457089 - DNA, 17 bp, Homo sapiens
gatctccaattgcctct

SEQ ID NO: 4457090 - DNA, 15 bp, Homo sapiens
gatctccctgccgcc

SEQ ID NO: 4457091 - DNA, 14 bp, Homo sapiens
gatctcccttctca

SEQ ID NO: 4457092 - DNA, 17 bp, Homo sapiens
gatctcgtttactccat

SEQ ID NO: 4457093 - DNA, 14 bp, Homo sapiens
gatctctcctggcc

SEQ ID NO: 4457094 - DNA, 22 bp, Homo sapiens
gatctctcttgtcctcttctgc

SEQ ID NO: 4457095 - DNA, 13 bp, Homo sapiens
gatctctgctggg

SEQ ID NO: 4457096 - DNA, 18 bp, Homo sapiens
gatctctgtagaaggagt

SEQ ID NO: 4457097 - DNA, 20 bp, Homo sapiens
gatctctttctaaagacagg

SEQ ID NO: 4457098 - DNA, 17 bp, Homo sapiens
gatctgcacagtcagaa

SEQ ID NO: 4457099 - DNA, 17 bp, Homo sapiens
gatctgccattgggacc

SEQ ID NO: 4457100 - DNA, 22 bp, Homo sapiens
gatctgggaccctttccttcct

SEQ ID NO: 4457101 - DNA, 19 bp, Homo sapiens
gatctgggcattttcctcc

SEQ ID NO: 4457102 - DNA, 22 bp, Homo sapiens
gatctgggcattttcctcctct

SEQ ID NO: 4457103 - DNA, 17 bp, Homo sapiens
gatctgtactttgtgtt

SEQ ID NO: 4457104 - DNA, 20 bp, Homo sapiens
gatctgtatttaatggtttt

SEQ ID NO: 4457105 - DNA, 16 bp, Homo sapiens
gatctgtcacaccagc

SEQ ID NO: 4457106 - DNA, 14 bp, Homo sapiens
gatctgtctgtgca

SEQ ID NO: 4457107 - DNA, 16 bp, Homo sapiens
gatctgtctgtgcaca

SEQ ID NO: 4457108 - DNA, 13 bp, Homo sapiens
gatctgtctgtgg

SEQ ID NO: 4457109 - DNA, 13 bp, Homo sapiens
gatctgtgcccca

SEQ ID NO: 4457110 - DNA, 14 bp, Homo sapiens
gatctgtgccccat

SEQ ID NO: 4457111 - DNA, 17 bp, Homo sapiens
gatctgttttacaggaa

SEQ ID NO: 4457112 - DNA, 18 bp, Homo sapiens
gatctgttttacaggaaa

SEQ ID NO: 4457113 - DNA, 23 bp, Homo sapiens
gatcttaagcagtaatctgtcag

SEQ ID NO: 4457114 - DNA, 19 bp, Homo sapiens
gatcttatattggtttgca

SEQ ID NO: 4457115 - DNA, 13 bp, Homo sapiens
gatcttcagaact

SEQ ID NO: 4457116 - DNA, 18 bp, Homo sapiens
gatcttcattaccaatag

SEQ ID NO: 4457117 - DNA, 17 bp, Homo sapiens
gatcttccgtggtcaga

SEQ ID NO: 4457118 - DNA, 18 bp, Homo sapiens
gatcttccgtggtcagag

SEQ ID NO: 4457119 - DNA, 19 bp, Homo sapiens
gatcttcctgctgagtcct

SEQ ID NO: 4457120 - DNA, 16 bp, Homo sapiens
gatcttggaaaaacag

SEQ ID NO: 4457121 - DNA, 13 bp, Homo sapiens
gatctttaaaata

SEQ ID NO: 4457122 - DNA, 20 bp, Homo sapiens
gatctttctttccaaaacat

SEQ ID NO: 4457123 - DNA, 16 bp, Homo sapiens
gatctttgactgaaaa

SEQ ID NO: 4457124 - DNA, 14 bp, Homo sapiens
gatctttgagccca

SEQ ID NO: 4457125 - DNA, 19 bp, Homo sapiens
gatctttgtttaaatgcca

SEQ ID NO: 4457126 - DNA, 18 bp, Homo sapiens
gatgaaaactaaggattt

SEQ ID NO: 4457127 - DNA, 21 bp, Homo sapiens
gatgaaaagtatattgataac

SEQ ID NO: 4457128 - DNA, 14 bp, Homo sapiens
gatgaaaatatttg

SEQ ID NO: 4457129 - DNA, 16 bp, Homo sapiens
gatgaaacatcatttc

SEQ ID NO: 4457130 - DNA, 22 bp, Homo sapiens
gatgaagagctatttaatgaca

SEQ ID NO: 4457131 - DNA, 17 bp, Homo sapiens
gatgaagttttacattg

SEQ ID NO: 4457132 - DNA, 23 bp, Homo sapiens
gatgaagttttacattgttgagc

SEQ ID NO: 4457133 - DNA, 13 bp, Homo sapiens
gatgaatgagaat

SEQ ID NO: 4457134 - DNA, 16 bp, Homo sapiens
gatgaatgtactatgt

SEQ ID NO: 4457135 - DNA, 15 bp, Homo sapiens
gatgacaccctggcc

SEQ ID NO: 4457136 - DNA, 18 bp, Homo sapiens
gatgacaccctggcctga

SEQ ID NO: 4457137 - DNA, 13 bp, Homo sapiens
gatgacaggctct

SEQ ID NO: 4457138 - DNA, 17 bp, Homo sapiens
gatgaccagggatgctg

SEQ ID NO: 4457139 - DNA, 11 bp, Homo sapiens
gatgactggtc

SEQ ID NO: 4457140 - DNA, 12 bp, Homo sapiens
gatgagaagtgt

SEQ ID NO: 4457141 - DNA, 14 bp, Homo sapiens
gatgagaggccagc

SEQ ID NO: 4457142 - DNA, 19 bp, Homo sapiens
gatgagcacatctctctgc

SEQ ID NO: 4457143 - DNA, 12 bp, Homo sapiens
gatgaggccaac

SEQ ID NO: 4457144 - DNA, 19 bp, Homo sapiens
gatgaggtcagttgtgttt

SEQ ID NO: 4457145 - DNA, 15 bp, Homo sapiens
gatgatatacacagt

SEQ ID NO: 4457146 - DNA, 17 bp, Homo sapiens
gatgatatacacagtgg

SEQ ID NO: 4457147 - DNA, 16 bp, Homo sapiens
gatgattaaaggcagc

SEQ ID NO: 4457148 - DNA, 11 bp, Homo sapiens
gatgattaaat

SEQ ID NO: 4457149 - DNA, 19 bp, Homo sapiens
gatgattgcttgagctcag

SEQ ID NO: 4457150 - DNA, 18 bp, Homo sapiens
gatgcaaagtacaatgtg

SEQ ID NO: 4457151 - DNA, 23 bp, Homo sapiens
gatgcaaagtacaatgtgttttt

SEQ ID NO: 4457152 - DNA, 14 bp, Homo sapiens
gatgcaaggaccag

SEQ ID NO: 4457153 - DNA, 13 bp, Homo sapiens
gatgcaatgaaca

SEQ ID NO: 4457154 - DNA, 15 bp, Homo sapiens
gatgcagcatttgat

SEQ ID NO: 4457155 - DNA, 23 bp, Homo sapiens
gatgcagcatttgataatgataa

SEQ ID NO: 4457156 - DNA, 17 bp, Homo sapiens
gatgcatcgggaaagaa

SEQ ID NO: 4457157 - DNA, 20 bp, Homo sapiens
gatgcatcgggaaagaagaa

SEQ ID NO: 4457158 - DNA, 22 bp, Homo sapiens
gatgcatgtctgccaaaatgca

SEQ ID NO: 4457159 - DNA, 14 bp, Homo sapiens
gatgcatgtctttt

SEQ ID NO: 4457160 - DNA, 13 bp, Homo sapiens
gatgcatttcaaa

SEQ ID NO: 4457161 - DNA, 13 bp, Homo sapiens
gatgccaccggcc

SEQ ID NO: 4457162 - DNA, 21 bp, Homo sapiens
gatgccattacagaaccaaat

SEQ ID NO: 4457163 - DNA, 18 bp, Homo sapiens
gatgcccattcctgcctg

SEQ ID NO: 4457164 - DNA, 12 bp, Homo sapiens
gatgcctccacc

SEQ ID NO: 4457165 - DNA, 18 bp, Homo sapiens
gatgctatggaacataaa

SEQ ID NO: 4457166 - DNA, 20 bp, Homo sapiens
gatgctccctcccctgccct

SEQ ID NO: 4457167 - DNA, 23 bp, Homo sapiens
gatgctccctcccctgccctggt

SEQ ID NO: 4457168 - DNA, 21 bp, Homo sapiens
gatgctccttgggccctttga

SEQ ID NO: 4457169 - DNA, 14 bp, Homo sapiens
gatgctgatggagc

SEQ ID NO: 4457170 - DNA, 15 bp, Homo sapiens
gatgctgggctgggc

SEQ ID NO: 4457171 - DNA, 14 bp, Homo sapiens
gatgcttctctcct

SEQ ID NO: 4457172 - DNA, 18 bp, Homo sapiens
gatggaaaagaactagga

SEQ ID NO: 4457173 - DNA, 15 bp, Homo sapiens
gatggaaactgccaa

SEQ ID NO: 4457174 - DNA, 17 bp, Homo sapiens
gatggaacatcagtgga

SEQ ID NO: 4457175 - DNA, 21 bp, Homo sapiens
gatggaactgtgtatttattt

SEQ ID NO: 4457176 - DNA, 14 bp, Homo sapiens
gatggaccccagca

SEQ ID NO: 4457177 - DNA, 13 bp, Homo sapiens
gatggagagaata

SEQ ID NO: 4457178 - DNA, 12 bp, Homo sapiens
gatggagcccat

SEQ ID NO: 4457179 - DNA, 12 bp, Homo sapiens
gatggagctgat

SEQ ID NO: 4457180 - DNA, 12 bp, Homo sapiens
gatggagctttg

SEQ ID NO: 4457181 - DNA, 16 bp, Homo sapiens
gatggagggggctggg

SEQ ID NO: 4457182 - DNA, 16 bp, Homo sapiens
gatggatcaccattat

SEQ ID NO: 4457183 - DNA, 23 bp, Homo sapiens
gatggatgccaatattaaatctg

SEQ ID NO: 4457184 - DNA, 13 bp, Homo sapiens
gatggccagcccc

SEQ ID NO: 4457185 - DNA, 16 bp, Homo sapiens
gatggccagcccctgg

SEQ ID NO: 4457186 - DNA, 20 bp, Homo sapiens
gatggccagcccctggggcc

SEQ ID NO: 4457187 - DNA, 14 bp, Homo sapiens
gatggccatgctca

SEQ ID NO: 4457188 - DNA, 13 bp, Homo sapiens
gatggcccctcca

SEQ ID NO: 4457189 - DNA, 15 bp, Homo sapiens
gatggcccctccact

SEQ ID NO: 4457190 - DNA, 13 bp, Homo sapiens
gatggccggctgg

SEQ ID NO: 4457191 - DNA, 14 bp, Homo sapiens
gatggccttaattt

SEQ ID NO: 4457192 - DNA, 18 bp, Homo sapiens
gatggcctttccttccct

SEQ ID NO: 4457193 - DNA, 21 bp, Homo sapiens
gatggcctttccttccctctc

SEQ ID NO: 4457194 - DNA, 21 bp, Homo sapiens
gatggcctttggacccagggc

SEQ ID NO: 4457195 - DNA, 23 bp, Homo sapiens
gatggcctttggacccagggcct

SEQ ID NO: 4457196 - DNA, 19 bp, Homo sapiens
gatggctggaaggggtcca

SEQ ID NO: 4457197 - DNA, 16 bp, Homo sapiens
gatggctgtcgcctgt

SEQ ID NO: 4457198 - DNA, 15 bp, Homo sapiens
gatgggacagcaaca

SEQ ID NO: 4457199 - DNA, 20 bp, Homo sapiens
gatgggagctcctctcctgg

SEQ ID NO: 4457200 - DNA, 21 bp, Homo sapiens
gatgggagctcctctcctgga

SEQ ID NO: 4457201 - DNA, 23 bp, Homo sapiens
gatgggagctcctctcctggagg

SEQ ID NO: 4457202 - DNA, 21 bp, Homo sapiens
gatgggcaaaccctggtgctt

SEQ ID NO: 4457203 - DNA, 16 bp, Homo sapiens
gatgggcagcccaaca

SEQ ID NO: 4457204 - DNA, 22 bp, Homo sapiens
gatgggcagcccaacagcactt

SEQ ID NO: 4457205 - DNA, 12 bp, Homo sapiens
gatggggagggg

SEQ ID NO: 4457206 - DNA, 20 bp, Homo sapiens
gatggggcatataataaaga

SEQ ID NO: 4457207 - DNA, 15 bp, Homo sapiens
gatggggctcccagc

SEQ ID NO: 4457208 - DNA, 16 bp, Homo sapiens
gatgggggatgggcca

SEQ ID NO: 4457209 - DNA, 15 bp, Homo sapiens
gatgggtcagttgta

SEQ ID NO: 4457210 - DNA, 18 bp, Homo sapiens
gatggtaagagaaaagag

SEQ ID NO: 4457211 - DNA, 23 bp, Homo sapiens
gatggtatctgggtaagaagaaa

SEQ ID NO: 4457212 - DNA, 17 bp, Homo sapiens
gatggtcttacagcagg

SEQ ID NO: 4457213 - DNA, 15 bp, Homo sapiens
gatggtgctgcccag

SEQ ID NO: 4457214 - DNA, 17 bp, Homo sapiens
gatggtgctgcccaggc

SEQ ID NO: 4457215 - DNA, 15 bp, Homo sapiens
gatggtggagggcca

SEQ ID NO: 4457216 - DNA, 18 bp, Homo sapiens
gatggtgtcctgaggcct

SEQ ID NO: 4457217 - DNA, 14 bp, Homo sapiens
gatggtgttatctt

SEQ ID NO: 4457218 - DNA, 17 bp, Homo sapiens
gatggttacactgttag

SEQ ID NO: 4457219 - DNA, 18 bp, Homo sapiens
gatggttacactgttaga

SEQ ID NO: 4457220 - DNA, 23 bp, Homo sapiens
gatggttacactgttagaacact

SEQ ID NO: 4457221 - DNA, 12 bp, Homo sapiens
gatggttttgat

SEQ ID NO: 4457222 - DNA, 21 bp, Homo sapiens
gatgtaaacagtgcctgctga

SEQ ID NO: 4457223 - DNA, 23 bp, Homo sapiens
gatgtaaataaccccattctttg

SEQ ID NO: 4457224 - DNA, 22 bp, Homo sapiens
gatgtaacagtgcaagattttt

SEQ ID NO: 4457225 - DNA, 16 bp, Homo sapiens
gatgtacagtctgtca

SEQ ID NO: 4457226 - DNA, 18 bp, Homo sapiens
gatgtacagtctgtcatg

SEQ ID NO: 4457227 - DNA, 18 bp, Homo sapiens
gatgtacattacagatta

SEQ ID NO: 4457228 - DNA, 16 bp, Homo sapiens
gatgtacatttaataa

SEQ ID NO: 4457229 - DNA, 19 bp, Homo sapiens
gatgtacatttaataatat

SEQ ID NO: 4457230 - DNA, 18 bp, Homo sapiens
gatgtagaggagaaactg

SEQ ID NO: 4457231 - DNA, 15 bp, Homo sapiens
gatgtatgtaaatat

SEQ ID NO: 4457232 - DNA, 14 bp, Homo sapiens
gatgtattttcata

SEQ ID NO: 4457233 - DNA, 18 bp, Homo sapiens
gatgtattttcatagtga

SEQ ID NO: 4457234 - DNA, 22 bp, Homo sapiens
gatgtcccagtgctcaccagcc

SEQ ID NO: 4457235 - DNA, 15 bp, Homo sapiens
gatgtcccctgcggg

SEQ ID NO: 4457236 - DNA, 16 bp, Homo sapiens
gatgtcccctgcgggc

SEQ ID NO: 4457237 - DNA, 20 bp, Homo sapiens
gatgtcttatttttagatgg

SEQ ID NO: 4457238 - DNA, 15 bp, Homo sapiens
gatgtcttccctggg

SEQ ID NO: 4457239 - DNA, 15 bp, Homo sapiens
gatgtcttctgcctg

SEQ ID NO: 4457240 - DNA, 13 bp, Homo sapiens
gatgtgaaaatat

SEQ ID NO: 4457241 - DNA, 19 bp, Homo sapiens
gatgtgaaacactttgcct

SEQ ID NO: 4457242 - DNA, 19 bp, Homo sapiens
gatgtgctataatctgttt

SEQ ID NO: 4457243 - DNA, 12 bp, Homo sapiens
gatgtgctcagc

SEQ ID NO: 4457244 - DNA, 13 bp, Homo sapiens
gatgtgctcagcc

SEQ ID NO: 4457245 - DNA, 18 bp, Homo sapiens
gatgtgctggaggggtgg

SEQ ID NO: 4457246 - DNA, 19 bp, Homo sapiens
gatgtgctgttttctgtaa

SEQ ID NO: 4457247 - DNA, 13 bp, Homo sapiens
gatgtggaggaag

SEQ ID NO: 4457248 - DNA, 20 bp, Homo sapiens
gatgtggaggaagagccacc

SEQ ID NO: 4457249 - DNA, 12 bp, Homo sapiens
gatgtggccctg

SEQ ID NO: 4457250 - DNA, 13 bp, Homo sapiens
gatgtggccctgg

SEQ ID NO: 4457251 - DNA, 15 bp, Homo sapiens
gatgtgtatcagtgt

SEQ ID NO: 4457252 - DNA, 21 bp, Homo sapiens
gatgtgtcccccccaggcctt

SEQ ID NO: 4457253 - DNA, 18 bp, Homo sapiens
gatgtgtcctcagggagc

SEQ ID NO: 4457254 - DNA, 21 bp, Homo sapiens
gatgtgtcctgataagctgag

SEQ ID NO: 4457255 - DNA, 22 bp, Homo sapiens
gatgttaaaaaaataagaagaa

SEQ ID NO: 4457256 - DNA, 20 bp, Homo sapiens
gatgttaaaataaatggttt

SEQ ID NO: 4457257 - DNA, 20 bp, Homo sapiens
gatgttagacttgctccctc

SEQ ID NO: 4457258 - DNA, 14 bp, Homo sapiens
gatgttccttacca

SEQ ID NO: 4457259 - DNA, 22 bp, Homo sapiens
gatgttccttaccaaggatttt

SEQ ID NO: 4457260 - DNA, 19 bp, Homo sapiens
gatgttgaaaaagttctgc

SEQ ID NO: 4457261 - DNA, 12 bp, Homo sapiens
gatgttgaactt

SEQ ID NO: 4457262 - DNA, 13 bp, Homo sapiens
gatgtttgtggcc

SEQ ID NO: 4457263 - DNA, 15 bp, Homo sapiens
gatgtttgtggcctc

SEQ ID NO: 4457264 - DNA, 16 bp, Homo sapiens
gatgtttgtggcctca

SEQ ID NO: 4457265 - DNA, 17 bp, Homo sapiens
gatgtttgtggcctcag

SEQ ID NO: 4457266 - DNA, 14 bp, Homo sapiens
gattaaattacagc

SEQ ID NO: 4457267 - DNA, 20 bp, Homo sapiens
gattaactttcaaaagcaaa

SEQ ID NO: 4457268 - DNA, 19 bp, Homo sapiens
gattaagggacatttctat

SEQ ID NO: 4457269 - DNA, 14 bp, Homo sapiens
gattaataaaatat

SEQ ID NO: 4457270 - DNA, 21 bp, Homo sapiens
gattaataagatttttcaaaa

SEQ ID NO: 4457271 - DNA, 18 bp, Homo sapiens
gattaatatattgaacac

SEQ ID NO: 4457272 - DNA, 23 bp, Homo sapiens
gattaatccattttaacaaacaa

SEQ ID NO: 4457273 - DNA, 19 bp, Homo sapiens
gattacaaatcagaagtca

SEQ ID NO: 4457274 - DNA, 21 bp, Homo sapiens
gattacaaatcagaagtcatc

SEQ ID NO: 4457275 - DNA, 18 bp, Homo sapiens
gattacaggaatgaagaa

SEQ ID NO: 4457276 - DNA, 22 bp, Homo sapiens
gattacaggaatgaagaactgt

SEQ ID NO: 4457277 - DNA, 14 bp, Homo sapiens
gattaccagggact

SEQ ID NO: 4457278 - DNA, 23 bp, Homo sapiens
gattactctccatatcccttcct

SEQ ID NO: 4457279 - DNA, 22 bp, Homo sapiens
gattactgatgtgatattctgt

SEQ ID NO: 4457280 - DNA, 22 bp, Homo sapiens
gattactggcctttttcattta

SEQ ID NO: 4457281 - DNA, 19 bp, Homo sapiens
gattacttctctataaaaa

SEQ ID NO: 4457282 - DNA, 16 bp, Homo sapiens
gattagaccaattact

SEQ ID NO: 4457283 - DNA, 14 bp, Homo sapiens
gattagacctttat

SEQ ID NO: 4457284 - DNA, 20 bp, Homo sapiens
gattagggaaaatggatata

SEQ ID NO: 4457285 - DNA, 17 bp, Homo sapiens
gattagggagagaagat

SEQ ID NO: 4457286 - DNA, 17 bp, Homo sapiens
gattagtattcaggcac

SEQ ID NO: 4457287 - DNA, 16 bp, Homo sapiens
gattatagtaactata

SEQ ID NO: 4457288 - DNA, 21 bp, Homo sapiens
gattatctctttgatctactt

SEQ ID NO: 4457289 - DNA, 20 bp, Homo sapiens
gattatggaaaaataaaact

SEQ ID NO: 4457290 - DNA, 16 bp, Homo sapiens
gattatgtaagcattt

SEQ ID NO: 4457291 - DNA, 19 bp, Homo sapiens
gattatgtagcaaaataca

SEQ ID NO: 4457292 - DNA, 12 bp, Homo sapiens
gattattataaa

SEQ ID NO: 4457293 - DNA, 14 bp, Homo sapiens
gattattataaact

SEQ ID NO: 4457294 - DNA, 15 bp, Homo sapiens
gattattataaacta

SEQ ID NO: 4457295 - DNA, 21 bp, Homo sapiens
gattatttacaagaagaactc

SEQ ID NO: 4457296 - DNA, 13 bp, Homo sapiens
gattcaaaatatt

SEQ ID NO: 4457297 - DNA, 22 bp, Homo sapiens
gattcaaaatatttaaaaatgt

SEQ ID NO: 4457298 - DNA, 16 bp, Homo sapiens
gattcaaaatggcttg

SEQ ID NO: 4457299 - DNA, 18 bp, Homo sapiens
gattcaaattgctgcttg

SEQ ID NO: 4457300 - DNA, 13 bp, Homo sapiens
gattcaagccatt

SEQ ID NO: 4457301 - DNA, 17 bp, Homo sapiens
gattcaagccattccaa

SEQ ID NO: 4457302 - DNA, 17 bp, Homo sapiens
gattcaaggctcagaag

SEQ ID NO: 4457303 - DNA, 14 bp, Homo sapiens
gattcaatctgtaa

SEQ ID NO: 4457304 - DNA, 19 bp, Homo sapiens
gattcaatctgtaaactgt

SEQ ID NO: 4457305 - DNA, 20 bp, Homo sapiens
gattcaatctgtaaactgtg

SEQ ID NO: 4457306 - DNA, 21 bp, Homo sapiens
gattcaatctgtaaactgtgt

SEQ ID NO: 4457307 - DNA, 22 bp, Homo sapiens
gattcaatctgtaaactgtgta

SEQ ID NO: 4457308 - DNA, 20 bp, Homo sapiens
gattcacctgtaaaacttta

SEQ ID NO: 4457309 - DNA, 22 bp, Homo sapiens
gattcacctgtaaaactttatt

SEQ ID NO: 4457310 - DNA, 16 bp, Homo sapiens
gattcaggccagccca

SEQ ID NO: 4457311 - DNA, 19 bp, Homo sapiens
gattcaggccagcccagcc

SEQ ID NO: 4457312 - DNA, 20 bp, Homo sapiens
gattcaggccagcccagcca

SEQ ID NO: 4457313 - DNA, 21 bp, Homo sapiens
gattcaggccagcccagccag

SEQ ID NO: 4457314 - DNA, 22 bp, Homo sapiens
gattcaggccagcccagccagg

SEQ ID NO: 4457315 - DNA, 18 bp, Homo sapiens
gattcatttttgaaactg

SEQ ID NO: 4457316 - DNA, 21 bp, Homo sapiens
gattccactacacctggctga

SEQ ID NO: 4457317 - DNA, 19 bp, Homo sapiens
gattcccttgaaatttaga

SEQ ID NO: 4457318 - DNA, 18 bp, Homo sapiens
gattccttagactctttt

SEQ ID NO: 4457319 - DNA, 20 bp, Homo sapiens
gattctatgttaatatttta

SEQ ID NO: 4457320 - DNA, 18 bp, Homo sapiens
gattctcaaaggagcgag

SEQ ID NO: 4457321 - DNA, 16 bp, Homo sapiens
gattctcctgcctcag

SEQ ID NO: 4457322 - DNA, 12 bp, Homo sapiens
gattctccttca

SEQ ID NO: 4457323 - DNA, 16 bp, Homo sapiens
gattctctgcccagcc

SEQ ID NO: 4457324 - DNA, 18 bp, Homo sapiens
gattctgagcaaaggccc

SEQ ID NO: 4457325 - DNA, 20 bp, Homo sapiens
gattctgagcaaaggccctg

SEQ ID NO: 4457326 - DNA, 16 bp, Homo sapiens
gattctgcagtaaatc

SEQ ID NO: 4457327 - DNA, 13 bp, Homo sapiens
gattctgcctctc

SEQ ID NO: 4457328 - DNA, 17 bp, Homo sapiens
gattctgcctctctgga

SEQ ID NO: 4457329 - DNA, 21 bp, Homo sapiens
gattctgtgtcagagcccagc

SEQ ID NO: 4457330 - DNA, 22 bp, Homo sapiens
gattctgtgtcagagcccagcc

SEQ ID NO: 4457331 - DNA, 21 bp, Homo sapiens
gattctgtgttttcagactgc

SEQ ID NO: 4457332 - DNA, 17 bp, Homo sapiens
gattcttaccctttctt

SEQ ID NO: 4457333 - DNA, 20 bp, Homo sapiens
gattcttttaaattagaaaa

SEQ ID NO: 4457334 - DNA, 23 bp, Homo sapiens
gattgaaaaaaagggcactctga

SEQ ID NO: 4457335 - DNA, 15 bp, Homo sapiens
gattgaaaattcgcc

SEQ ID NO: 4457336 - DNA, 21 bp, Homo sapiens
gattgaagtattttgctggaa

SEQ ID NO: 4457337 - DNA, 16 bp, Homo sapiens
gattgaatttttaagc

SEQ ID NO: 4457338 - DNA, 19 bp, Homo sapiens
gattgaatttttaagcaaa

SEQ ID NO: 4457339 - DNA, 16 bp, Homo sapiens
gattgagaagaggaca

SEQ ID NO: 4457340 - DNA, 14 bp, Homo sapiens
gattgatatcgtga

SEQ ID NO: 4457341 - DNA, 17 bp, Homo sapiens
gattgatatcgtgaaat

SEQ ID NO: 4457342 - DNA, 15 bp, Homo sapiens
gattgatcacacagt

SEQ ID NO: 4457343 - DNA, 22 bp, Homo sapiens
gattgcaaatattggttagtat

SEQ ID NO: 4457344 - DNA, 14 bp, Homo sapiens
gattgcccctggct

SEQ ID NO: 4457345 - DNA, 16 bp, Homo sapiens
gattgcctttaatatt

SEQ ID NO: 4457346 - DNA, 16 bp, Homo sapiens
gattgcttgagctcag

SEQ ID NO: 4457347 - DNA, 17 bp, Homo sapiens
gattgcttgagctcagg

SEQ ID NO: 4457348 - DNA, 16 bp, Homo sapiens
gattggacggcctgat

SEQ ID NO: 4457349 - DNA, 23 bp, Homo sapiens
gattggacggcctgatgctccct

SEQ ID NO: 4457350 - DNA, 19 bp, Homo sapiens
gattggatattctcctcgg

SEQ ID NO: 4457351 - DNA, 16 bp, Homo sapiens
gattggatttgctgtg

SEQ ID NO: 4457352 - DNA, 14 bp, Homo sapiens
gattggccactgga

SEQ ID NO: 4457353 - DNA, 16 bp, Homo sapiens
gattggccactggatc

SEQ ID NO: 4457354 - DNA, 22 bp, Homo sapiens
gattggccactggatcctgctg

SEQ ID NO: 4457355 - DNA, 12 bp, Homo sapiens
gattggtgttcg

SEQ ID NO: 4457356 - DNA, 18 bp, Homo sapiens
gattggttaaaatgtgat

SEQ ID NO: 4457357 - DNA, 20 bp, Homo sapiens
gattgtattgttgaaaaagt

SEQ ID NO: 4457358 - DNA, 15 bp, Homo sapiens
gattgtcttaatatt

SEQ ID NO: 4457359 - DNA, 22 bp, Homo sapiens
gattgtgaggcttctaataaag

SEQ ID NO: 4457360 - DNA, 19 bp, Homo sapiens
gattgtgccagtgcactcc

SEQ ID NO: 4457361 - DNA, 18 bp, Homo sapiens
gattgtgcctaatgtgtt

SEQ ID NO: 4457362 - DNA, 21 bp, Homo sapiens
gattgtggaatgttggataag

SEQ ID NO: 4457363 - DNA, 16 bp, Homo sapiens
gattgtggtggtgcta

SEQ ID NO: 4457364 - DNA, 20 bp, Homo sapiens
gattgtgtgactattcatgg

SEQ ID NO: 4457365 - DNA, 23 bp, Homo sapiens
gattgtgtgactattcatggcta

SEQ ID NO: 4457366 - DNA, 14 bp, Homo sapiens
gattgttattaaat

SEQ ID NO: 4457367 - DNA, 18 bp, Homo sapiens
gatttaaaagcctgctca

SEQ ID NO: 4457368 - DNA, 18 bp, Homo sapiens
gatttaaagtattttaat

SEQ ID NO: 4457369 - DNA, 14 bp, Homo sapiens
gatttaacactttt

SEQ ID NO: 4457370 - DNA, 21 bp, Homo sapiens
gatttaacctgttatttctat

SEQ ID NO: 4457371 - DNA, 17 bp, Homo sapiens
gatttaagtgaatacat

SEQ ID NO: 4457372 - DNA, 19 bp, Homo sapiens
gatttaatctgccaagggc

SEQ ID NO: 4457373 - DNA, 17 bp, Homo sapiens
gatttataaaactttgg

SEQ ID NO: 4457374 - DNA, 14 bp, Homo sapiens
gatttatatataag

SEQ ID NO: 4457375 - DNA, 12 bp, Homo sapiens
gatttattgtaa

SEQ ID NO: 4457376 - DNA, 12 bp, Homo sapiens
gatttatttaaa

SEQ ID NO: 4457377 - DNA, 13 bp, Homo sapiens
gatttatttgctt

SEQ ID NO: 4457378 - DNA, 12 bp, Homo sapiens
gatttcacattt

SEQ ID NO: 4457379 - DNA, 12 bp, Homo sapiens
gatttcataatt

SEQ ID NO: 4457380 - DNA, 15 bp, Homo sapiens
gatttcatagttcag

SEQ ID NO: 4457381 - DNA, 17 bp, Homo sapiens
gatttcatagttcagaa

SEQ ID NO: 4457382 - DNA, 18 bp, Homo sapiens
gatttcatagttcagaat

SEQ ID NO: 4457383 - DNA, 22 bp, Homo sapiens
gatttcatatctaactttgtaa

SEQ ID NO: 4457384 - DNA, 14 bp, Homo sapiens
gatttcatattgat

SEQ ID NO: 4457385 - DNA, 17 bp, Homo sapiens
gatttcatctgctctcc

SEQ ID NO: 4457386 - DNA, 20 bp, Homo sapiens
gatttcatctgctctccttc

SEQ ID NO: 4457387 - DNA, 22 bp, Homo sapiens
gatttccagtttttctttactt

SEQ ID NO: 4457388 - DNA, 22 bp, Homo sapiens
gatttcccactgcactccagcc

SEQ ID NO: 4457389 - DNA, 13 bp, Homo sapiens
gatttcctaatac

SEQ ID NO: 4457390 - DNA, 20 bp, Homo sapiens
gatttctatggctttcaaag

SEQ ID NO: 4457391 - DNA, 20 bp, Homo sapiens
gatttctgacatcaaaactt

SEQ ID NO: 4457392 - DNA, 19 bp, Homo sapiens
gatttctgcccttgttcca

SEQ ID NO: 4457393 - DNA, 11 bp, Homo sapiens
gatttctggga

SEQ ID NO: 4457394 - DNA, 20 bp, Homo sapiens
gatttctttaaaagaatgac

SEQ ID NO: 4457395 - DNA, 23 bp, Homo sapiens
gatttctttctttgcaccaaaga

SEQ ID NO: 4457396 - DNA, 13 bp, Homo sapiens
gatttgaaaattg

SEQ ID NO: 4457397 - DNA, 14 bp, Homo sapiens
gatttgaaaattgt

SEQ ID NO: 4457398 - DNA, 13 bp, Homo sapiens
gatttgatctttg

SEQ ID NO: 4457399 - DNA, 14 bp, Homo sapiens
gatttgatctttgt

SEQ ID NO: 4457400 - DNA, 17 bp, Homo sapiens
gatttgcccatttacac

SEQ ID NO: 4457401 - DNA, 19 bp, Homo sapiens
gatttgcccatttacactt

SEQ ID NO: 4457402 - DNA, 20 bp, Homo sapiens
gatttgcgtggaaatctcag

SEQ ID NO: 4457403 - DNA, 14 bp, Homo sapiens
gatttgctggattt

SEQ ID NO: 4457404 - DNA, 20 bp, Homo sapiens
gatttggcttgacaaaggca

SEQ ID NO: 4457405 - DNA, 17 bp, Homo sapiens
gatttgggctgaatgta

SEQ ID NO: 4457406 - DNA, 17 bp, Homo sapiens
gatttgtcccagaattt

SEQ ID NO: 4457407 - DNA, 22 bp, Homo sapiens
gatttgtgaactggaagaaagc

SEQ ID NO: 4457408 - DNA, 23 bp, Homo sapiens
gattttaatagggaatatatctc

SEQ ID NO: 4457409 - DNA, 13 bp, Homo sapiens
gattttacaagta

SEQ ID NO: 4457410 - DNA, 14 bp, Homo sapiens
gattttaccaaagc

SEQ ID NO: 4457411 - DNA, 16 bp, Homo sapiens
gattttagaaaaacat

SEQ ID NO: 4457412 - DNA, 18 bp, Homo sapiens
gattttcacacattcacg

SEQ ID NO: 4457413 - DNA, 14 bp, Homo sapiens
gattttcataactt

SEQ ID NO: 4457414 - DNA, 17 bp, Homo sapiens
gattttcttttgccttt

SEQ ID NO: 4457415 - DNA, 18 bp, Homo sapiens
gattttctttttaacttt

SEQ ID NO: 4457416 - DNA, 12 bp, Homo sapiens
gattttgataac

SEQ ID NO: 4457417 - DNA, 11 bp, Homo sapiens
gattttgcaaa

SEQ ID NO: 4457418 - DNA, 22 bp, Homo sapiens
gatttttatattagttgctttg

SEQ ID NO: 4457419 - DNA, 22 bp, Homo sapiens
gatttttcttcaggtaacacta

SEQ ID NO: 4457420 - DNA, 21 bp, Homo sapiens
gattttttaaaattttggaat

SEQ ID NO: 4457421 - DNA, 11 bp, Homo sapiens
gattttttcca

SEQ ID NO: 4457422 - DNA, 14 bp, Homo sapiens
gattttttccaaaa

SEQ ID NO: 4457423 - DNA, 18 bp, Homo sapiens
gattttttccttcaaagt

SEQ ID NO: 4457424 - DNA, 17 bp, Homo sapiens
gattttttttccgtgtg

SEQ ID NO: 4457425 - DNA, 19 bp, Homo sapiens
gattttttttttaagtgac

SEQ ID NO: 4457426 - DNA, 18 bp, Homo sapiens
gatttttttttttaattt

SEQ ID NO: 4457427 - DNA, 16 bp, Homo sapiens
gcaaaaaagtccaatt

SEQ ID NO: 4457428 - DNA, 21 bp, Homo sapiens
gcaaaaaatactttttctaat

SEQ ID NO: 4457429 - DNA, 14 bp, Homo sapiens
gcaaaaactgtaaa

SEQ ID NO: 4457430 - DNA, 20 bp, Homo sapiens
gcaaaaaggagccttttgct

SEQ ID NO: 4457431 - DNA, 18 bp, Homo sapiens
gcaaaacaaaagtacatt

SEQ ID NO: 4457432 - DNA, 15 bp, Homo sapiens
gcaaaaccaaactgg

SEQ ID NO: 4457433 - DNA, 15 bp, Homo sapiens
gcaaaagaagaagtt

SEQ ID NO: 4457434 - DNA, 19 bp, Homo sapiens
gcaaaagcttacaaatact

SEQ ID NO: 4457435 - DNA, 13 bp, Homo sapiens
gcaaaaggctgag

SEQ ID NO: 4457436 - DNA, 16 bp, Homo sapiens
gcaaaaggctgagaag

SEQ ID NO: 4457437 - DNA, 15 bp, Homo sapiens
gcaaaataaaaacta

SEQ ID NO: 4457438 - DNA, 16 bp, Homo sapiens
gcaaaataaaaactat

SEQ ID NO: 4457439 - DNA, 20 bp, Homo sapiens
gcaaaatattcactgggcca

SEQ ID NO: 4457440 - DNA, 21 bp, Homo sapiens
gcaaaatcaacatgactggtg

SEQ ID NO: 4457441 - DNA, 14 bp, Homo sapiens
gcaaaattaaatct

SEQ ID NO: 4457442 - DNA, 15 bp, Homo sapiens
gcaaaattaaatcta

SEQ ID NO: 4457443 - DNA, 13 bp, Homo sapiens
gcaaacacttgaa

SEQ ID NO: 4457444 - DNA, 13 bp, Homo sapiens
gcaaacagggcct

SEQ ID NO: 4457445 - DNA, 16 bp, Homo sapiens
gcaaacagggcctctg

SEQ ID NO: 4457446 - DNA, 16 bp, Homo sapiens
gcaaaccctggtgctt

SEQ ID NO: 4457447 - DNA, 20 bp, Homo sapiens
gcaaacctgcagtttttaat

SEQ ID NO: 4457448 - DNA, 23 bp, Homo sapiens
gcaaacctgcagtttttaatttg

SEQ ID NO: 4457449 - DNA, 21 bp, Homo sapiens
gcaaaccttcctgggaggaca

SEQ ID NO: 4457450 - DNA, 14 bp, Homo sapiens
gcaaacgctaaaga

SEQ ID NO: 4457451 - DNA, 21 bp, Homo sapiens
gcaaactgaagctgcacagtg

SEQ ID NO: 4457452 - DNA, 21 bp, Homo sapiens
gcaaactgctttattttccct

SEQ ID NO: 4457453 - DNA, 14 bp, Homo sapiens
gcaaagaaaggaga

SEQ ID NO: 4457454 - DNA, 18 bp, Homo sapiens
gcaaagaaaggagataca

SEQ ID NO: 4457455 - DNA, 14 bp, Homo sapiens
gcaaagaattgact

SEQ ID NO: 4457456 - DNA, 19 bp, Homo sapiens
gcaaagagacatttcaaaa

SEQ ID NO: 4457457 - DNA, 22 bp, Homo sapiens
gcaaagagacatttcaaaactg

SEQ ID NO: 4457458 - DNA, 21 bp, Homo sapiens
gcaaagcaaaaggctgagaag

SEQ ID NO: 4457459 - DNA, 14 bp, Homo sapiens
gcaaaggccctggg

SEQ ID NO: 4457460 - DNA, 11 bp, Homo sapiens
gcaaagtactg

SEQ ID NO: 4457461 - DNA, 17 bp, Homo sapiens
gcaaagtgattccctgc

SEQ ID NO: 4457462 - DNA, 17 bp, Homo sapiens
gcaaagtggaattaaag

SEQ ID NO: 4457463 - DNA, 12 bp, Homo sapiens
gcaaagtgtttt

SEQ ID NO: 4457464 - DNA, 20 bp, Homo sapiens
gcaaagtttaaatgtatttt

SEQ ID NO: 4457465 - DNA, 15 bp, Homo sapiens
gcaaagttttacaga

SEQ ID NO: 4457466 - DNA, 20 bp, Homo sapiens
gcaaataagtcatctgatga

SEQ ID NO: 4457467 - DNA, 21 bp, Homo sapiens
gcaaatagccacaattatata

SEQ ID NO: 4457468 - DNA, 23 bp, Homo sapiens
gcaaatagccacaattatataaa

SEQ ID NO: 4457469 - DNA, 22 bp, Homo sapiens
gcaaatatactttactttttcc

SEQ ID NO: 4457470 - DNA, 14 bp, Homo sapiens
gcaaatatatgatt

SEQ ID NO: 4457471 - DNA, 13 bp, Homo sapiens
gcaaatcagaaac

SEQ ID NO: 4457472 - DNA, 17 bp, Homo sapiens
gcaaatcaggcttttgt

SEQ ID NO: 4457473 - DNA, 16 bp, Homo sapiens
gcaaatcagtatattt

SEQ ID NO: 4457474 - DNA, 19 bp, Homo sapiens
gcaaatgacagatttctgt

SEQ ID NO: 4457475 - DNA, 21 bp, Homo sapiens
gcaaatgacagatttctgtaa

SEQ ID NO: 4457476 - DNA, 23 bp, Homo sapiens
gcaaatggagataaaagcaattc

SEQ ID NO: 4457477 - DNA, 14 bp, Homo sapiens
gcaaatgtttactg

SEQ ID NO: 4457478 - DNA, 16 bp, Homo sapiens
gcaaatgtttactgta

SEQ ID NO: 4457479 - DNA, 17 bp, Homo sapiens
gcaaattcttttgaatt

SEQ ID NO: 4457480 - DNA, 20 bp, Homo sapiens
gcaaattcttttgaattgtt

SEQ ID NO: 4457481 - DNA, 18 bp, Homo sapiens
gcaaatttagtttgttaa

SEQ ID NO: 4457482 - DNA, 20 bp, Homo sapiens
gcaaatttagtttgttaaag

SEQ ID NO: 4457483 - DNA, 21 bp, Homo sapiens
gcaaatttagtttgttaaagc

SEQ ID NO: 4457484 - DNA, 21 bp, Homo sapiens
gcaaatttctataaatttaag

SEQ ID NO: 4457485 - DNA, 22 bp, Homo sapiens
gcaaatttctataaatttaaga

SEQ ID NO: 4457486 - DNA, 18 bp, Homo sapiens
gcaacaaagacttgcttt

SEQ ID NO: 4457487 - DNA, 18 bp, Homo sapiens
gcaacaagctcatccctg

SEQ ID NO: 4457488 - DNA, 18 bp, Homo sapiens
gcaacactggtctgctgt

SEQ ID NO: 4457489 - DNA, 18 bp, Homo sapiens
gcaacaggaatcaagagc

SEQ ID NO: 4457490 - DNA, 21 bp, Homo sapiens
gcaacaggaatcaagagctgc

SEQ ID NO: 4457491 - DNA, 13 bp, Homo sapiens
gcaacatccaaaa

SEQ ID NO: 4457492 - DNA, 14 bp, Homo sapiens
gcaacattggcaca

SEQ ID NO: 4457493 - DNA, 15 bp, Homo sapiens
gcaaccaactgcccc

SEQ ID NO: 4457494 - DNA, 20 bp, Homo sapiens
gcaacccaaggactgaggga

SEQ ID NO: 4457495 - DNA, 13 bp, Homo sapiens
gcaacccagaatg

SEQ ID NO: 4457496 - DNA, 12 bp, Homo sapiens
gcaacctcacct

SEQ ID NO: 4457497 - DNA, 14 bp, Homo sapiens
gcaacgtagcctgg

SEQ ID NO: 4457498 - DNA, 19 bp, Homo sapiens
gcaactcttatttctttcc

SEQ ID NO: 4457499 - DNA, 18 bp, Homo sapiens
gcaactcttttaagtgcc

SEQ ID NO: 4457500 - DNA, 21 bp, Homo sapiens
gcaacttagatctctcctgca

SEQ ID NO: 4457501 - DNA, 15 bp, Homo sapiens
gcaacttccgctgag

SEQ ID NO: 4457502 - DNA, 15 bp, Homo sapiens
gcaacttgcttctaa

SEQ ID NO: 4457503 - DNA, 17 bp, Homo sapiens
gcaacttttcttggaac

SEQ ID NO: 4457504 - DNA, 11 bp, Homo sapiens
gcaagaatgaa

SEQ ID NO: 4457505 - DNA, 19 bp, Homo sapiens
gcaagaatgaaatgaatga

SEQ ID NO: 4457506 - DNA, 20 bp, Homo sapiens
gcaagaatggtggcttcttt

SEQ ID NO: 4457507 - DNA, 14 bp, Homo sapiens
gcaagactgcaaga

SEQ ID NO: 4457508 - DNA, 16 bp, Homo sapiens
gcaagactgcaagaga

SEQ ID NO: 4457509 - DNA, 20 bp, Homo sapiens
gcaagactgggccccacatg

SEQ ID NO: 4457510 - DNA, 18 bp, Homo sapiens
gcaagagatggaaaaaaa

SEQ ID NO: 4457511 - DNA, 18 bp, Homo sapiens
gcaagaggcaagctgaaa

SEQ ID NO: 4457512 - DNA, 21 bp, Homo sapiens
gcaagatggacacgagccaca

SEQ ID NO: 4457513 - DNA, 21 bp, Homo sapiens
gcaagatgtgaattattgaca

SEQ ID NO: 4457514 - DNA, 22 bp, Homo sapiens
gcaagattttccacaagattcc

SEQ ID NO: 4457515 - DNA, 17 bp, Homo sapiens
gcaagcaaaattatttt

SEQ ID NO: 4457516 - DNA, 15 bp, Homo sapiens
gcaagccacaggaag

SEQ ID NO: 4457517 - DNA, 17 bp, Homo sapiens
gcaagccacaggaagga

SEQ ID NO: 4457518 - DNA, 19 bp, Homo sapiens
gcaagccacaggaaggagg

SEQ ID NO: 4457519 - DNA, 17 bp, Homo sapiens
gcaagccatcatcctcc

SEQ ID NO: 4457520 - DNA, 11 bp, Homo sapiens
gcaagccctgc

SEQ ID NO: 4457521 - DNA, 16 bp, Homo sapiens
gcaagccctgcccaca

SEQ ID NO: 4457522 - DNA, 17 bp, Homo sapiens
gcaagccctgcccacag

SEQ ID NO: 4457523 - DNA, 20 bp, Homo sapiens
gcaagcctgtaatcccagct

SEQ ID NO: 4457524 - DNA, 18 bp, Homo sapiens
gcaagcgtgttctcagca

SEQ ID NO: 4457525 - DNA, 18 bp, Homo sapiens
gcaagctgcccagccctg

SEQ ID NO: 4457526 - DNA, 20 bp, Homo sapiens
gcaagctgcccagccctggc

SEQ ID NO: 4457527 - DNA, 14 bp, Homo sapiens
gcaaggaaaaagaa

SEQ ID NO: 4457528 - DNA, 19 bp, Homo sapiens
gcaaggaaaaagaaaataa

SEQ ID NO: 4457529 - DNA, 14 bp, Homo sapiens
gcaaggactttgta

SEQ ID NO: 4457530 - DNA, 16 bp, Homo sapiens
gcaaggactttgtaca

SEQ ID NO: 4457531 - DNA, 19 bp, Homo sapiens
gcaaggactttgtacattt

SEQ ID NO: 4457532 - DNA, 19 bp, Homo sapiens
gcaaggagtttaaatgaga

SEQ ID NO: 4457533 - DNA, 20 bp, Homo sapiens
gcaaggagtttattacaatg

SEQ ID NO: 4457534 - DNA, 21 bp, Homo sapiens
gcaaggagtttattacaatgt

SEQ ID NO: 4457535 - DNA, 22 bp, Homo sapiens
gcaaggattacacatttcactg

SEQ ID NO: 4457536 - DNA, 15 bp, Homo sapiens
gcaaggtactctggt

SEQ ID NO: 4457537 - DNA, 17 bp, Homo sapiens
gcaaggtactctggtga

SEQ ID NO: 4457538 - DNA, 13 bp, Homo sapiens
gcaaggtgtgctc

SEQ ID NO: 4457539 - DNA, 21 bp, Homo sapiens
gcaaggtgtgctctgagccac

SEQ ID NO: 4457540 - DNA, 23 bp, Homo sapiens
gcaaggtgtgctctgagccacag

SEQ ID NO: 4457541 - DNA, 17 bp, Homo sapiens
gcaagtgagagagatgg

SEQ ID NO: 4457542 - DNA, 22 bp, Homo sapiens
gcaagtgagagagatgggagct

SEQ ID NO: 4457543 - DNA, 16 bp, Homo sapiens
gcaagtgtgcactcca

SEQ ID NO: 4457544 - DNA, 22 bp, Homo sapiens
gcaagttttaaacccaaaatat

SEQ ID NO: 4457545 - DNA, 16 bp, Homo sapiens
gcaataaaattatttg

SEQ ID NO: 4457546 - DNA, 19 bp, Homo sapiens
gcaataaaattatttgcag

SEQ ID NO: 4457547 - DNA, 13 bp, Homo sapiens
gcaataaagtata

SEQ ID NO: 4457548 - DNA, 20 bp, Homo sapiens
gcaataacaagcatgcataa

SEQ ID NO: 4457549 - DNA, 13 bp, Homo sapiens
gcaatacatacca

SEQ ID NO: 4457550 - DNA, 22 bp, Homo sapiens
gcaatactgtccagttttcttg

SEQ ID NO: 4457551 - DNA, 17 bp, Homo sapiens
gcaatagcagttataac

SEQ ID NO: 4457552 - DNA, 20 bp, Homo sapiens
gcaatagcagttataacaga

SEQ ID NO: 4457553 - DNA, 23 bp, Homo sapiens
gcaatagcagttataacagatgt

SEQ ID NO: 4457554 - DNA, 16 bp, Homo sapiens
gcaatagttttttact

SEQ ID NO: 4457555 - DNA, 23 bp, Homo sapiens
gcaatattttgtatattatgttt

SEQ ID NO: 4457556 - DNA, 19 bp, Homo sapiens
gcaatcaaggttataattt

SEQ ID NO: 4457557 - DNA, 14 bp, Homo sapiens
gcaatcacaaaggc

SEQ ID NO: 4457558 - DNA, 15 bp, Homo sapiens
gcaatcacaaaggct

SEQ ID NO: 4457559 - DNA, 23 bp, Homo sapiens
gcaatcacacgactgtcatctaa

SEQ ID NO: 4457560 - DNA, 15 bp, Homo sapiens
gcaatccacctgcct

SEQ ID NO: 4457561 - DNA, 18 bp, Homo sapiens
gcaatccacctgccttgg

SEQ ID NO: 4457562 - DNA, 20 bp, Homo sapiens
gcaatccacctgccttggcc

SEQ ID NO: 4457563 - DNA, 17 bp, Homo sapiens
gcaatctcttcattatt

SEQ ID NO: 4457564 - DNA, 15 bp, Homo sapiens
gcaatctttgaaata

SEQ ID NO: 4457565 - DNA, 16 bp, Homo sapiens
gcaatctttgaaataa

SEQ ID NO: 4457566 - DNA, 18 bp, Homo sapiens
gcaatgaaaattttaaga

SEQ ID NO: 4457567 - DNA, 17 bp, Homo sapiens
gcaatggccagagcctc

SEQ ID NO: 4457568 - DNA, 18 bp, Homo sapiens
gcaatggccagagcctct

SEQ ID NO: 4457569 - DNA, 16 bp, Homo sapiens
gcaatgggtcactcat

SEQ ID NO: 4457570 - DNA, 19 bp, Homo sapiens
gcaatgggtcactcattaa

SEQ ID NO: 4457571 - DNA, 15 bp, Homo sapiens
gcaatgtaaatattt

SEQ ID NO: 4457572 - DNA, 14 bp, Homo sapiens
gcaatgtgaaaaat

SEQ ID NO: 4457573 - DNA, 17 bp, Homo sapiens
gcaatgtgaaaaatctg

SEQ ID NO: 4457574 - DNA, 18 bp, Homo sapiens
gcaatgtgccttgattga

SEQ ID NO: 4457575 - DNA, 19 bp, Homo sapiens
gcaatgtggtgacacctcc

SEQ ID NO: 4457576 - DNA, 21 bp, Homo sapiens
gcaattaaacttccaaagaaa

SEQ ID NO: 4457577 - DNA, 21 bp, Homo sapiens
gcaattagtctgaaactggct

SEQ ID NO: 4457578 - DNA, 18 bp, Homo sapiens
gcaatttaaatgttatga

SEQ ID NO: 4457579 - DNA, 16 bp, Homo sapiens
gcaatttccccctaaa

SEQ ID NO: 4457580 - DNA, 18 bp, Homo sapiens
gcaatttcctggccctcc

SEQ ID NO: 4457581 - DNA, 11 bp, Homo sapiens
gcacaaaatga

SEQ ID NO: 4457582 - DNA, 22 bp, Homo sapiens
gcacaaacttgtgagcatcaga

SEQ ID NO: 4457583 - DNA, 16 bp, Homo sapiens
gcacaaggggccaagg

SEQ ID NO: 4457584 - DNA, 16 bp, Homo sapiens
gcacaataaaaatgtt

SEQ ID NO: 4457585 - DNA, 17 bp, Homo sapiens
gcacaataaaaatgttt

SEQ ID NO: 4457586 - DNA, 14 bp, Homo sapiens
gcacacaaatatta

SEQ ID NO: 4457587 - DNA, 12 bp, Homo sapiens
gcacacactgtg

SEQ ID NO: 4457588 - DNA, 17 bp, Homo sapiens
gcacacactgtgctttc

SEQ ID NO: 4457589 - DNA, 12 bp, Homo sapiens
gcacacagcagc

SEQ ID NO: 4457590 - DNA, 22 bp, Homo sapiens
gcacacagctgagcacttagca

SEQ ID NO: 4457591 - DNA, 15 bp, Homo sapiens
gcacacaggcagcca

SEQ ID NO: 4457592 - DNA, 17 bp, Homo sapiens
gcacacaggcagccagc

SEQ ID NO: 4457593 - DNA, 12 bp, Homo sapiens
gcacaccagaga

SEQ ID NO: 4457594 - DNA, 16 bp, Homo sapiens
gcacacccctggggct

SEQ ID NO: 4457595 - DNA, 12 bp, Homo sapiens
gcacaccctggg

SEQ ID NO: 4457596 - DNA, 13 bp, Homo sapiens
gcacaccctgggc

SEQ ID NO: 4457597 - DNA, 22 bp, Homo sapiens
gcacactttgccatattttcac

SEQ ID NO: 4457598 - DNA, 18 bp, Homo sapiens
gcacactttggcccaggg

SEQ ID NO: 4457599 - DNA, 16 bp, Homo sapiens
gcacagagcctggccc

SEQ ID NO: 4457600 - DNA, 22 bp, Homo sapiens
gcacagagcctggccccaggcc

SEQ ID NO: 4457601 - DNA, 12 bp, Homo sapiens
gcacagaggcct

SEQ ID NO: 4457602 - DNA, 13 bp, Homo sapiens
gcacagaggcctg

SEQ ID NO: 4457603 - DNA, 14 bp, Homo sapiens
gcacagaggcctga

SEQ ID NO: 4457604 - DNA, 16 bp, Homo sapiens
gcacagaggcctgact

SEQ ID NO: 4457605 - DNA, 17 bp, Homo sapiens
gcacagagggctaggga

SEQ ID NO: 4457606 - DNA, 19 bp, Homo sapiens
gcacagagggctagggagg

SEQ ID NO: 4457607 - DNA, 18 bp, Homo sapiens
gcacagcaggctgccagt

SEQ ID NO: 4457608 - DNA, 20 bp, Homo sapiens
gcacagccaacgagacacat

SEQ ID NO: 4457609 - DNA, 14 bp, Homo sapiens
gcacagccacccgt

SEQ ID NO: 4457610 - DNA, 16 bp, Homo sapiens
gcacagccacccgtgg

SEQ ID NO: 4457611 - DNA, 23 bp, Homo sapiens
gcacagccacccgtggggtgctg

SEQ ID NO: 4457612 - DNA, 12 bp, Homo sapiens
gcacagcctggc

SEQ ID NO: 4457613 - DNA, 13 bp, Homo sapiens
gcacagctaacca

SEQ ID NO: 4457614 - DNA, 17 bp, Homo sapiens
gcacagcttagatttca

SEQ ID NO: 4457615 - DNA, 19 bp, Homo sapiens
gcacagcttagatttcata

SEQ ID NO: 4457616 - DNA, 20 bp, Homo sapiens
gcacaggagtgtcctcttcc

SEQ ID NO: 4457617 - DNA, 15 bp, Homo sapiens
gcacaggctaatttt

SEQ ID NO: 4457618 - DNA, 23 bp, Homo sapiens
gcacagggaaaattgccccatcc

SEQ ID NO: 4457619 - DNA, 17 bp, Homo sapiens
gcacagggagtgcacat

SEQ ID NO: 4457620 - DNA, 16 bp, Homo sapiens
gcacagggcagctggg

SEQ ID NO: 4457621 - DNA, 18 bp, Homo sapiens
gcacagggcagctgggcc

SEQ ID NO: 4457622 - DNA, 18 bp, Homo sapiens
gcacagtcatacaagtca

SEQ ID NO: 4457623 - DNA, 16 bp, Homo sapiens
gcacagtctccatgtg

SEQ ID NO: 4457624 - DNA, 17 bp, Homo sapiens
gcacagtctccatgtgt

SEQ ID NO: 4457625 - DNA, 20 bp, Homo sapiens
gcacagtggctcacacctgt

SEQ ID NO: 4457626 - DNA, 22 bp, Homo sapiens
gcacagtggctcacgcctgtaa

SEQ ID NO: 4457627 - DNA, 22 bp, Homo sapiens
gcacagtttagaacagagggac

SEQ ID NO: 4457628 - DNA, 14 bp, Homo sapiens
gcacagttttctga

SEQ ID NO: 4457629 - DNA, 18 bp, Homo sapiens
gcacagttttctgagaaa

SEQ ID NO: 4457630 - DNA, 22 bp, Homo sapiens
gcacagttttctgagaaagact

SEQ ID NO: 4457631 - DNA, 23 bp, Homo sapiens
gcacagttttctgagaaagacta

SEQ ID NO: 4457632 - DNA, 22 bp, Homo sapiens
gcacatacacctcgtcaagagc

SEQ ID NO: 4457633 - DNA, 16 bp, Homo sapiens
gcacatagagcttttt

SEQ ID NO: 4457634 - DNA, 23 bp, Homo sapiens
gcacatctacatgccatgcctat

SEQ ID NO: 4457635 - DNA, 18 bp, Homo sapiens
gcacatctgtgtcttgtt

SEQ ID NO: 4457636 - DNA, 16 bp, Homo sapiens
gcacatgaaaaatttt

SEQ ID NO: 4457637 - DNA, 19 bp, Homo sapiens
gcacatgaacagcttgcca

SEQ ID NO: 4457638 - DNA, 20 bp, Homo sapiens
gcacatgctgtctggccctg

SEQ ID NO: 4457639 - DNA, 21 bp, Homo sapiens
gcacatgctgtctggccctgg

SEQ ID NO: 4457640 - DNA, 22 bp, Homo sapiens
gcacatgctgtctggccctggg

SEQ ID NO: 4457641 - DNA, 14 bp, Homo sapiens
gcacatggcctgag

SEQ ID NO: 4457642 - DNA, 21 bp, Homo sapiens
gcacattcgggaccaatatat

SEQ ID NO: 4457643 - DNA, 20 bp, Homo sapiens
gcacattgcccctctgcctt

SEQ ID NO: 4457644 - DNA, 13 bp, Homo sapiens
gcaccaaagacat

SEQ ID NO: 4457645 - DNA, 13 bp, Homo sapiens
gcaccaaccacag

SEQ ID NO: 4457646 - DNA, 13 bp, Homo sapiens
gcaccaccagggc

SEQ ID NO: 4457647 - DNA, 20 bp, Homo sapiens
gcaccaccctagtcccttcc

SEQ ID NO: 4457648 - DNA, 22 bp, Homo sapiens
gcaccaccctagtcccttcccc

SEQ ID NO: 4457649 - DNA, 20 bp, Homo sapiens
gcaccacggcgtttttttac

SEQ ID NO: 4457650 - DNA, 21 bp, Homo sapiens
gcaccacggcgtttttttaca

SEQ ID NO: 4457651 - DNA, 14 bp, Homo sapiens
gcaccactgcactc

SEQ ID NO: 4457652 - DNA, 17 bp, Homo sapiens
gcaccactgcactccag

SEQ ID NO: 4457653 - DNA, 14 bp, Homo sapiens
gcaccaggaagccg

SEQ ID NO: 4457654 - DNA, 18 bp, Homo sapiens
gcaccaggaagccgtcct

SEQ ID NO: 4457655 - DNA, 20 bp, Homo sapiens
gcaccaggcacgaacccacc

SEQ ID NO: 4457656 - DNA, 21 bp, Homo sapiens
gcaccaggggccaacctcagg

SEQ ID NO: 4457657 - DNA, 19 bp, Homo sapiens
gcaccaggggtgcacaata

SEQ ID NO: 4457658 - DNA, 20 bp, Homo sapiens
gcaccatggtatcatatatt

SEQ ID NO: 4457659 - DNA, 19 bp, Homo sapiens
gcaccatgttggcctcttc

SEQ ID NO: 4457660 - DNA, 19 bp, Homo sapiens
gcaccattttaagtccctg

SEQ ID NO: 4457661 - DNA, 20 bp, Homo sapiens
gcacccaccgtggaggagga

SEQ ID NO: 4457662 - DNA, 12 bp, Homo sapiens
gcacccagaaca

SEQ ID NO: 4457663 - DNA, 17 bp, Homo sapiens
gcacccagagcaccccc

SEQ ID NO: 4457664 - DNA, 13 bp, Homo sapiens
gcacccaggcagg

SEQ ID NO: 4457665 - DNA, 12 bp, Homo sapiens
gcaccccacagc

SEQ ID NO: 4457666 - DNA, 19 bp, Homo sapiens
gcaccccacagctggggcc

SEQ ID NO: 4457667 - DNA, 20 bp, Homo sapiens
gcacccctccgtgtggagca

SEQ ID NO: 4457668 - DNA, 20 bp, Homo sapiens
gcacccctgagccagcaggg

SEQ ID NO: 4457669 - DNA, 18 bp, Homo sapiens
gcacccctgggccagcgg

SEQ ID NO: 4457670 - DNA, 13 bp, Homo sapiens
gcaccccttctct

SEQ ID NO: 4457671 - DNA, 19 bp, Homo sapiens
gcaccccttctctcctccc

SEQ ID NO: 4457672 - DNA, 22 bp, Homo sapiens
gcaccccttctctcctccccaa

SEQ ID NO: 4457673 - DNA, 14 bp, Homo sapiens
gcaccctataaatc

SEQ ID NO: 4457674 - DNA, 19 bp, Homo sapiens
gcaccctcagggagcctcc

SEQ ID NO: 4457675 - DNA, 15 bp, Homo sapiens
gcaccctctcctggg

SEQ ID NO: 4457676 - DNA, 16 bp, Homo sapiens
gcaccctctcctgggg

SEQ ID NO: 4457677 - DNA, 18 bp, Homo sapiens
gcaccctctcctgggggt

SEQ ID NO: 4457678 - DNA, 22 bp, Homo sapiens
gcaccctctcctgggggtggca

SEQ ID NO: 4457679 - DNA, 20 bp, Homo sapiens
gcaccggggcctgggcagga

SEQ ID NO: 4457680 - DNA, 14 bp, Homo sapiens
gcacctaaagaaaa

SEQ ID NO: 4457681 - DNA, 18 bp, Homo sapiens
gcacctacagtgtacagt

SEQ ID NO: 4457682 - DNA, 21 bp, Homo sapiens
gcacctatgagatggccatgc

SEQ ID NO: 4457683 - DNA, 23 bp, Homo sapiens
gcacctatgagatggccatgctc

SEQ ID NO: 4457684 - DNA, 24 bp, Homo sapiens
gcacctatgagatggccatgctca

SEQ ID NO: 4457685 - DNA, 17 bp, Homo sapiens
gcacctccccccactgc

SEQ ID NO: 4457686 - DNA, 21 bp, Homo sapiens
gcacctccccccactgcaggc

SEQ ID NO: 4457687 - DNA, 16 bp, Homo sapiens
gcacctccccgctggg

SEQ ID NO: 4457688 - DNA, 20 bp, Homo sapiens
gcacctcctaccctcccacc

SEQ ID NO: 4457689 - DNA, 14 bp, Homo sapiens
gcacctcggggaca

SEQ ID NO: 4457690 - DNA, 22 bp, Homo sapiens
gcacctcggggacaccagagct

SEQ ID NO: 4457691 - DNA, 23 bp, Homo sapiens
gcacctcggggacaccagagctg

SEQ ID NO: 4457692 - DNA, 23 bp, Homo sapiens
gcacctgcatccgtagttccctg

SEQ ID NO: 4457693 - DNA, 13 bp, Homo sapiens
gcacctgccccgt

SEQ ID NO: 4457694 - DNA, 15 bp, Homo sapiens
gcaccttcagggctg

SEQ ID NO: 4457695 - DNA, 15 bp, Homo sapiens
gcaccttctttctgg

SEQ ID NO: 4457696 - DNA, 11 bp, Homo sapiens
gcaccttttca

SEQ ID NO: 4457697 - DNA, 17 bp, Homo sapiens
gcacgaacccacctgct

SEQ ID NO: 4457698 - DNA, 19 bp, Homo sapiens
gcacgactgcgggagccag

SEQ ID NO: 4457699 - DNA, 18 bp, Homo sapiens
gcacgcgccctttctacc

SEQ ID NO: 4457700 - DNA, 20 bp, Homo sapiens
gcacggcgggatcctccaca

SEQ ID NO: 4457701 - DNA, 14 bp, Homo sapiens
gcacgggggagtga

SEQ ID NO: 4457702 - DNA, 20 bp, Homo sapiens
gcacggtcccccaggaggca

SEQ ID NO: 4457703 - DNA, 21 bp, Homo sapiens
gcacggtcccccaggaggcag

SEQ ID NO: 4457704 - DNA, 22 bp, Homo sapiens
gcacggtcccccaggaggcagc

SEQ ID NO: 4457705 - DNA, 19 bp, Homo sapiens
gcacggtgggccttgctgg

SEQ ID NO: 4457706 - DNA, 14 bp, Homo sapiens
gcacgttgacccaa

SEQ ID NO: 4457707 - DNA, 13 bp, Homo sapiens
gcacgttgcccaa

SEQ ID NO: 4457708 - DNA, 15 bp, Homo sapiens
gcacgtttaaagttc

SEQ ID NO: 4457709 - DNA, 20 bp, Homo sapiens
gcactaaaaagttgaaccat

SEQ ID NO: 4457710 - DNA, 20 bp, Homo sapiens
gcactaaccaatgccttttt

SEQ ID NO: 4457711 - DNA, 14 bp, Homo sapiens
gcactaaggccgtg

SEQ ID NO: 4457712 - DNA, 20 bp, Homo sapiens
gcactaaggccgtgtctctg

SEQ ID NO: 4457713 - DNA, 16 bp, Homo sapiens
gcactactcctctgca

SEQ ID NO: 4457714 - DNA, 19 bp, Homo sapiens
gcactactcctctgcagtg

SEQ ID NO: 4457715 - DNA, 15 bp, Homo sapiens
gcactactctgtgcc

SEQ ID NO: 4457716 - DNA, 12 bp, Homo sapiens
gcactactgggt

SEQ ID NO: 4457717 - DNA, 16 bp, Homo sapiens
gcactagagaatgcac

SEQ ID NO: 4457718 - DNA, 17 bp, Homo sapiens
gcactaggcacccagct

SEQ ID NO: 4457719 - DNA, 23 bp, Homo sapiens
gcactatgcccttttatataagt

SEQ ID NO: 4457720 - DNA, 14 bp, Homo sapiens
gcactcagaaaatg

SEQ ID NO: 4457721 - DNA, 22 bp, Homo sapiens
gcactcagtgagcctcctgtgc

SEQ ID NO: 4457722 - DNA, 11 bp, Homo sapiens
gcactccagcc

SEQ ID NO: 4457723 - DNA, 12 bp, Homo sapiens
gcactccagcct

SEQ ID NO: 4457724 - DNA, 14 bp, Homo sapiens
gcactccagcctga

SEQ ID NO: 4457725 - DNA, 18 bp, Homo sapiens
gcactccagcctgggtca

SEQ ID NO: 4457726 - DNA, 17 bp, Homo sapiens
gcactcccacctgacac

SEQ ID NO: 4457727 - DNA, 18 bp, Homo sapiens
gcactcccacctgacaca

SEQ ID NO: 4457728 - DNA, 18 bp, Homo sapiens
gcactccgcgccgatgcc

SEQ ID NO: 4457729 - DNA, 23 bp, Homo sapiens
gcactccgcgccgatgccaccgg

SEQ ID NO: 4457730 - DNA, 12 bp, Homo sapiens
gcactcctactg

SEQ ID NO: 4457731 - DNA, 15 bp, Homo sapiens
gcactcctttatctg

SEQ ID NO: 4457732 - DNA, 19 bp, Homo sapiens
gcactcctttatctgtaat

SEQ ID NO: 4457733 - DNA, 22 bp, Homo sapiens
gcactcggggtccctggagggc

SEQ ID NO: 4457734 - DNA, 13 bp, Homo sapiens
gcactctctgcca

SEQ ID NO: 4457735 - DNA, 20 bp, Homo sapiens
gcactctctgccattctgtg

SEQ ID NO: 4457736 - DNA, 20 bp, Homo sapiens
gcactctgggtctggccagg

SEQ ID NO: 4457737 - DNA, 22 bp, Homo sapiens
gcactctgggtctggccagggc

SEQ ID NO: 4457738 - DNA, 13 bp, Homo sapiens
gcactgaagagct

SEQ ID NO: 4457739 - DNA, 17 bp, Homo sapiens
gcactgaagagctcttg

SEQ ID NO: 4457740 - DNA, 15 bp, Homo sapiens
gcactgacttctaag

SEQ ID NO: 4457741 - DNA, 18 bp, Homo sapiens
gcactgacttctaagtaa

SEQ ID NO: 4457742 - DNA, 21 bp, Homo sapiens
gcactgagataccagcgagga

SEQ ID NO: 4457743 - DNA, 16 bp, Homo sapiens
gcactgagctcacatg

SEQ ID NO: 4457744 - DNA, 18 bp, Homo sapiens
gcactgaggaagaacggg

SEQ ID NO: 4457745 - DNA, 13 bp, Homo sapiens
gcactgatagtcc

SEQ ID NO: 4457746 - DNA, 17 bp, Homo sapiens
gcactgatgtgtgaagt

SEQ ID NO: 4457747 - DNA, 18 bp, Homo sapiens
gcactgatgttgtgtttt

SEQ ID NO: 4457748 - DNA, 15 bp, Homo sapiens
gcactgcagaaacct

SEQ ID NO: 4457749 - DNA, 20 bp, Homo sapiens
gcactgcatgtcagagcact

SEQ ID NO: 4457750 - DNA, 18 bp, Homo sapiens
gcactgcattcctgtgcc

SEQ ID NO: 4457751 - DNA, 12 bp, Homo sapiens
gcactgccagcc

SEQ ID NO: 4457752 - DNA, 15 bp, Homo sapiens
gcactgccagcccac

SEQ ID NO: 4457753 - DNA, 16 bp, Homo sapiens
gcactgccccacatgc

SEQ ID NO: 4457754 - DNA, 22 bp, Homo sapiens
gcactggcaaacagggcctctg

SEQ ID NO: 4457755 - DNA, 20 bp, Homo sapiens
gcactggccacccctcccca

SEQ ID NO: 4457756 - DNA, 11 bp, Homo sapiens
gcactggcctg

SEQ ID NO: 4457757 - DNA, 15 bp, Homo sapiens
gcactggcctgcacg

SEQ ID NO: 4457758 - DNA, 14 bp, Homo sapiens
gcactgggaggcag

SEQ ID NO: 4457759 - DNA, 15 bp, Homo sapiens
gcactgggaggcagg

SEQ ID NO: 4457760 - DNA, 19 bp, Homo sapiens
gcactgggaggcagggctc

SEQ ID NO: 4457761 - DNA, 23 bp, Homo sapiens
gcactggggcaggggccgggggc

SEQ ID NO: 4457762 - DNA, 19 bp, Homo sapiens
gcactggtttgtttctcaa

SEQ ID NO: 4457763 - DNA, 12 bp, Homo sapiens
gcactgtaaata

SEQ ID NO: 4457764 - DNA, 19 bp, Homo sapiens
gcactgtaaatatccctcc

SEQ ID NO: 4457765 - DNA, 22 bp, Homo sapiens
gcactgtaaatatccctcccct

SEQ ID NO: 4457766 - DNA, 18 bp, Homo sapiens
gcactgttccccctgtgc

SEQ ID NO: 4457767 - DNA, 19 bp, Homo sapiens
gcactgttccccctgtgca

SEQ ID NO: 4457768 - DNA, 20 bp, Homo sapiens
gcactgttccccctgtgcag

SEQ ID NO: 4457769 - DNA, 12 bp, Homo sapiens
gcactgtttgca

SEQ ID NO: 4457770 - DNA, 23 bp, Homo sapiens
gcacttaaacagaagcagaggct

SEQ ID NO: 4457771 - DNA, 18 bp, Homo sapiens
gcacttagacctgccagc

SEQ ID NO: 4457772 - DNA, 15 bp, Homo sapiens
gcacttagcaggcac

SEQ ID NO: 4457773 - DNA, 14 bp, Homo sapiens
gcacttattgtaaa

SEQ ID NO: 4457774 - DNA, 18 bp, Homo sapiens
gcacttatttaatgccga

SEQ ID NO: 4457775 - DNA, 13 bp, Homo sapiens
gcacttctattta

SEQ ID NO: 4457776 - DNA, 13 bp, Homo sapiens
gcacttctgctgc

SEQ ID NO: 4457777 - DNA, 17 bp, Homo sapiens
gcacttctgctgcatcg

SEQ ID NO: 4457778 - DNA, 21 bp, Homo sapiens
gcacttgagaaccagtctcct

SEQ ID NO: 4457779 - DNA, 17 bp, Homo sapiens
gcacttgatatttatta

SEQ ID NO: 4457780 - DNA, 22 bp, Homo sapiens
gcacttgggggttcaggcccgg

SEQ ID NO: 4457781 - DNA, 13 bp, Homo sapiens
gcactttcattgc

SEQ ID NO: 4457782 - DNA, 15 bp, Homo sapiens
gcactttccaatgcc

SEQ ID NO: 4457783 - DNA, 19 bp, Homo sapiens
gcactttccaatgccacag

SEQ ID NO: 4457784 - DNA, 22 bp, Homo sapiens
gcactttccaatgccacagaca

SEQ ID NO: 4457785 - DNA, 14 bp, Homo sapiens
gcactttgtaaatt

SEQ ID NO: 4457786 - DNA, 17 bp, Homo sapiens
gcactttgtagtgtttg

SEQ ID NO: 4457787 - DNA, 18 bp, Homo sapiens
gcactttgtttagaaaaa

SEQ ID NO: 4457788 - DNA, 20 bp, Homo sapiens
gcactttgtttagaaaaaaa

SEQ ID NO: 4457789 - DNA, 16 bp, Homo sapiens
gcacttttgatgaaat

SEQ ID NO: 4457790 - DNA, 17 bp, Homo sapiens
gcactttttccttactg

SEQ ID NO: 4457791 - DNA, 20 bp, Homo sapiens
gcactttttccttactgtgc

SEQ ID NO: 4457792 - DNA, 21 bp, Homo sapiens
gcactttttccttactgtgca

SEQ ID NO: 4457793 - DNA, 20 bp, Homo sapiens
gcagaaagcatccctcaccc

SEQ ID NO: 4457794 - DNA, 18 bp, Homo sapiens
gcagaaaggttctgcccg

SEQ ID NO: 4457795 - DNA, 18 bp, Homo sapiens
gcagaaagtaagcatttc

SEQ ID NO: 4457796 - DNA, 14 bp, Homo sapiens
gcagaacactaacc

SEQ ID NO: 4457797 - DNA, 13 bp, Homo sapiens
gcagaacagtgat

SEQ ID NO: 4457798 - DNA, 18 bp, Homo sapiens
gcagaacagtgattacca

SEQ ID NO: 4457799 - DNA, 22 bp, Homo sapiens
gcagaacagtgattaccaggga

SEQ ID NO: 4457800 - DNA, 15 bp, Homo sapiens
gcagaaccagcacta

SEQ ID NO: 4457801 - DNA, 16 bp, Homo sapiens
gcagaagagaaaggac

SEQ ID NO: 4457802 - DNA, 22 bp, Homo sapiens
gcagaagccccacagcctggca

SEQ ID NO: 4457803 - DNA, 22 bp, Homo sapiens
gcagaagggggtggtgtctcca

SEQ ID NO: 4457804 - DNA, 17 bp, Homo sapiens
gcagaagtaagcctcat

SEQ ID NO: 4457805 - DNA, 16 bp, Homo sapiens
gcagaataatcctgtt

SEQ ID NO: 4457806 - DNA, 23 bp, Homo sapiens
gcagacaacaccttcctcctgca

SEQ ID NO: 4457807 - DNA, 20 bp, Homo sapiens
gcagacaagagggcaagcct

SEQ ID NO: 4457808 - DNA, 14 bp, Homo sapiens
gcagacaataaacc

SEQ ID NO: 4457809 - DNA, 19 bp, Homo sapiens
gcagacacctaaccccagg

SEQ ID NO: 4457810 - DNA, 20 bp, Homo sapiens
gcagacacctaaccccaggg

SEQ ID NO: 4457811 - DNA, 22 bp, Homo sapiens
gcagacacctaaccccagggca

SEQ ID NO: 4457812 - DNA, 22 bp, Homo sapiens
gcagacacctggactgagccaa

SEQ ID NO: 4457813 - DNA, 21 bp, Homo sapiens
gcagacatttatctttgtatt

SEQ ID NO: 4457814 - DNA, 14 bp, Homo sapiens
gcagaccccaggtt

SEQ ID NO: 4457815 - DNA, 17 bp, Homo sapiens
gcagacctcaagccatc

SEQ ID NO: 4457816 - DNA, 14 bp, Homo sapiens
gcagacgccgggga

SEQ ID NO: 4457817 - DNA, 18 bp, Homo sapiens
gcagacggtctgtgtgct

SEQ ID NO: 4457818 - DNA, 21 bp, Homo sapiens
gcagacggtctgtgtgctgtt

SEQ ID NO: 4457819 - DNA, 22 bp, Homo sapiens
gcagacggtctgtgtgctgttt

SEQ ID NO: 4457820 - DNA, 23 bp, Homo sapiens
gcagacggtctgtgtgctgtttg

SEQ ID NO: 4457821 - DNA, 19 bp, Homo sapiens
gcagacgtctgccttggca

SEQ ID NO: 4457822 - DNA, 21 bp, Homo sapiens
gcagactggcggagaaggaga

SEQ ID NO: 4457823 - DNA, 23 bp, Homo sapiens
gcagagaaagaaagggaaactgg

SEQ ID NO: 4457824 - DNA, 19 bp, Homo sapiens
gcagagaggtaaagggtgg

SEQ ID NO: 4457825 - DNA, 13 bp, Homo sapiens
gcagagccagggc

SEQ ID NO: 4457826 - DNA, 14 bp, Homo sapiens
gcagagccagggca

SEQ ID NO: 4457827 - DNA, 19 bp, Homo sapiens
gcagagccagggcagggcg

SEQ ID NO: 4457828 - DNA, 21 bp, Homo sapiens
gcagagccagggcagggcgag

SEQ ID NO: 4457829 - DNA, 22 bp, Homo sapiens
gcagagccagggcagggcgagc

SEQ ID NO: 4457830 - DNA, 13 bp, Homo sapiens
gcagagctggagc

SEQ ID NO: 4457831 - DNA, 14 bp, Homo sapiens
gcagagctggagcc

SEQ ID NO: 4457832 - DNA, 16 bp, Homo sapiens
gcagagcttttcagat

SEQ ID NO: 4457833 - DNA, 15 bp, Homo sapiens
gcagaggcaggctgg

SEQ ID NO: 4457834 - DNA, 15 bp, Homo sapiens
gcagaggccctgccc

SEQ ID NO: 4457835 - DNA, 21 bp, Homo sapiens
gcagaggccctgcccccaccc

SEQ ID NO: 4457836 - DNA, 11 bp, Homo sapiens
gcagaggctgg

SEQ ID NO: 4457837 - DNA, 21 bp, Homo sapiens
gcagagggagaatccaagggt

SEQ ID NO: 4457838 - DNA, 12 bp, Homo sapiens
gcagagggctgg

SEQ ID NO: 4457839 - DNA, 17 bp, Homo sapiens
gcagagggctggaggcc

SEQ ID NO: 4457840 - DNA, 21 bp, Homo sapiens
gcagagggctggaggcccagg

SEQ ID NO: 4457841 - DNA, 23 bp, Homo sapiens
gcagagggctggaggcccaggct

SEQ ID NO: 4457842 - DNA, 24 bp, Homo sapiens
gcagagggctggaggcccaggctg

SEQ ID NO: 4457843 - DNA, 17 bp, Homo sapiens
gcagaggggcgttctcc

SEQ ID NO: 4457844 - DNA, 18 bp, Homo sapiens
gcagaggttgcagtgagc

SEQ ID NO: 4457845 - DNA, 20 bp, Homo sapiens
gcagagttacagttctgtgg

SEQ ID NO: 4457846 - DNA, 14 bp, Homo sapiens
gcagataacttttt

SEQ ID NO: 4457847 - DNA, 20 bp, Homo sapiens
gcagatcacttgagctcagg

SEQ ID NO: 4457848 - DNA, 13 bp, Homo sapiens
gcagatctgtgcc

SEQ ID NO: 4457849 - DNA, 20 bp, Homo sapiens
gcagatcttccgtggtcaga

SEQ ID NO: 4457850 - DNA, 21 bp, Homo sapiens
gcagatgtcttccctgggctg

SEQ ID NO: 4457851 - DNA, 22 bp, Homo sapiens
gcagatgtgagccaccgtgcct

SEQ ID NO: 4457852 - DNA, 14 bp, Homo sapiens
gcagattctgagca

SEQ ID NO: 4457853 - DNA, 23 bp, Homo sapiens
gcagatttagtgaaagctagaga

SEQ ID NO: 4457854 - DNA, 21 bp, Homo sapiens
gcagatttttatgttttgaaa

SEQ ID NO: 4457855 - DNA, 15 bp, Homo sapiens
gcagcaactcccacg

SEQ ID NO: 4457856 - DNA, 16 bp, Homo sapiens
gcagcaactcccacga

SEQ ID NO: 4457857 - DNA, 16 bp, Homo sapiens
gcagcaatttaaatgt

SEQ ID NO: 4457858 - DNA, 17 bp, Homo sapiens
gcagcaccaaccacagc

SEQ ID NO: 4457859 - DNA, 21 bp, Homo sapiens
gcagcaccaaccacagcatcg

SEQ ID NO: 4457860 - DNA, 17 bp, Homo sapiens
gcagcaccctataaatc

SEQ ID NO: 4457861 - DNA, 20 bp, Homo sapiens
gcagcaccctcccccgcagc

SEQ ID NO: 4457862 - DNA, 16 bp, Homo sapiens
gcagcacttagacctg

SEQ ID NO: 4457863 - DNA, 17 bp, Homo sapiens
gcagcacttagacctgc

SEQ ID NO: 4457864 - DNA, 13 bp, Homo sapiens
gcagcagaaaact

SEQ ID NO: 4457865 - DNA, 15 bp, Homo sapiens
gcagcagaagggggt

SEQ ID NO: 4457866 - DNA, 22 bp, Homo sapiens
gcagcagaagggggtggtgtct

SEQ ID NO: 4457867 - DNA, 14 bp, Homo sapiens
gcagcagagagccc

SEQ ID NO: 4457868 - DNA, 22 bp, Homo sapiens
gcagcagagagccctgggtgac

SEQ ID NO: 4457869 - DNA, 22 bp, Homo sapiens
gcagcagaggacagtctggaga

SEQ ID NO: 4457870 - DNA, 23 bp, Homo sapiens
gcagcagaggacagtctggagaa

SEQ ID NO: 4457871 - DNA, 12 bp, Homo sapiens
gcagcagcctgc

SEQ ID NO: 4457872 - DNA, 15 bp, Homo sapiens
gcagcagctctgagc

SEQ ID NO: 4457873 - DNA, 13 bp, Homo sapiens
gcagcaggcagct

SEQ ID NO: 4457874 - DNA, 21 bp, Homo sapiens
gcagcaggcatttgctaaggc

SEQ ID NO: 4457875 - DNA, 18 bp, Homo sapiens
gcagcaggctcaggcaca

SEQ ID NO: 4457876 - DNA, 19 bp, Homo sapiens
gcagcagtgtgaggccagg

SEQ ID NO: 4457877 - DNA, 20 bp, Homo sapiens
gcagcagtgtgaggccaggg

SEQ ID NO: 4457878 - DNA, 21 bp, Homo sapiens
gcagcagtgtgaggccagggc

SEQ ID NO: 4457879 - DNA, 23 bp, Homo sapiens
gcagcagtgtgaggccagggcag

SEQ ID NO: 4457880 - DNA, 13 bp, Homo sapiens
gcagcatgtatag

SEQ ID NO: 4457881 - DNA, 16 bp, Homo sapiens
gcagcattcccaggga

SEQ ID NO: 4457882 - DNA, 13 bp, Homo sapiens
gcagccaccagcg

SEQ ID NO: 4457883 - DNA, 20 bp, Homo sapiens
gcagccacccaagcctgctg

SEQ ID NO: 4457884 - DNA, 22 bp, Homo sapiens
gcagccacccaagcctgctggc

SEQ ID NO: 4457885 - DNA, 23 bp, Homo sapiens
gcagccacccaagcctgctggct

SEQ ID NO: 4457886 - DNA, 15 bp, Homo sapiens
gcagccagcccagcc

SEQ ID NO: 4457887 - DNA, 17 bp, Homo sapiens
gcagccagcccagccca

SEQ ID NO: 4457888 - DNA, 18 bp, Homo sapiens
gcagccagccgtggccag

SEQ ID NO: 4457889 - DNA, 20 bp, Homo sapiens
gcagccaggagtgcccccgg

SEQ ID NO: 4457890 - DNA, 13 bp, Homo sapiens
gcagccaggctgc

SEQ ID NO: 4457891 - DNA, 17 bp, Homo sapiens
gcagccaggctgccaag

SEQ ID NO: 4457892 - DNA, 17 bp, Homo sapiens
gcagcccaacagcactt

SEQ ID NO: 4457893 - DNA, 13 bp, Homo sapiens
gcagcccatgccc

SEQ ID NO: 4457894 - DNA, 18 bp, Homo sapiens
gcagcccatgcccacctg

SEQ ID NO: 4457895 - DNA, 20 bp, Homo sapiens
gcagccccacttcaccccca

SEQ ID NO: 4457896 - DNA, 23 bp, Homo sapiens
gcagccccacttcacccccaact

SEQ ID NO: 4457897 - DNA, 22 bp, Homo sapiens
gcagcccccactgcacccctgc

SEQ ID NO: 4457898 - DNA, 13 bp, Homo sapiens
gcagccctcctca

SEQ ID NO: 4457899 - DNA, 14 bp, Homo sapiens
gcagccgccagctg

SEQ ID NO: 4457900 - DNA, 17 bp, Homo sapiens
gcagccgctgagcgagg

SEQ ID NO: 4457901 - DNA, 15 bp, Homo sapiens
gcagcctccagggcc

SEQ ID NO: 4457902 - DNA, 19 bp, Homo sapiens
gcagcctctccgactctgc

SEQ ID NO: 4457903 - DNA, 18 bp, Homo sapiens
gcagcctctggacagcca

SEQ ID NO: 4457904 - DNA, 12 bp, Homo sapiens
gcagcctgcacc

SEQ ID NO: 4457905 - DNA, 13 bp, Homo sapiens
gcagcctgcacct

SEQ ID NO: 4457906 - DNA, 18 bp, Homo sapiens
gcagcctgcacctgcccc

SEQ ID NO: 4457907 - DNA, 14 bp, Homo sapiens
gcagcctgtggcat

SEQ ID NO: 4457908 - DNA, 19 bp, Homo sapiens
gcagccttcccctccctgt

SEQ ID NO: 4457909 - DNA, 13 bp, Homo sapiens
gcagcgccccacc

SEQ ID NO: 4457910 - DNA, 14 bp, Homo sapiens
gcagcgccccacca

SEQ ID NO: 4457911 - DNA, 15 bp, Homo sapiens
gcagcggctcctgca

SEQ ID NO: 4457912 - DNA, 22 bp, Homo sapiens
gcagcggggtggggggggagag

SEQ ID NO: 4457913 - DNA, 15 bp, Homo sapiens
gcagcgtgtgtgcca

SEQ ID NO: 4457914 - DNA, 12 bp, Homo sapiens
gcagctagtgcc

SEQ ID NO: 4457915 - DNA, 14 bp, Homo sapiens
gcagctagtgcctt

SEQ ID NO: 4457916 - DNA, 14 bp, Homo sapiens
gcagctagttttct

SEQ ID NO: 4457917 - DNA, 17 bp, Homo sapiens
gcagctcaactttctgt

SEQ ID NO: 4457918 - DNA, 15 bp, Homo sapiens
gcagctcccattcta

SEQ ID NO: 4457919 - DNA, 13 bp, Homo sapiens
gcagctccctggc

SEQ ID NO: 4457920 - DNA, 22 bp, Homo sapiens
gcagctccctttctcaggagct

SEQ ID NO: 4457921 - DNA, 19 bp, Homo sapiens
gcagctctggctctgcctc

SEQ ID NO: 4457922 - DNA, 16 bp, Homo sapiens
gcagctgagagccctg

SEQ ID NO: 4457923 - DNA, 14 bp, Homo sapiens
gcagctgcctctgc

SEQ ID NO: 4457924 - DNA, 17 bp, Homo sapiens
gcagctgcctctgctcc

SEQ ID NO: 4457925 - DNA, 18 bp, Homo sapiens
gcagctgcctctgctccc

SEQ ID NO: 4457926 - DNA, 16 bp, Homo sapiens
gcagcttaagtccagc

SEQ ID NO: 4457927 - DNA, 20 bp, Homo sapiens
gcagcttaagtccagctcat

SEQ ID NO: 4457928 - DNA, 14 bp, Homo sapiens
gcagcttcgaggac

SEQ ID NO: 4457929 - DNA, 17 bp, Homo sapiens
gcagcttcgaggacagg

SEQ ID NO: 4457930 - DNA, 15 bp, Homo sapiens
gcagcttggggagag

SEQ ID NO: 4457931 - DNA, 22 bp, Homo sapiens
gcagcttttggttaatatgtct

SEQ ID NO: 4457932 - DNA, 16 bp, Homo sapiens
gcaggaactgggctgg

SEQ ID NO: 4457933 - DNA, 19 bp, Homo sapiens
gcaggaactgggctgggcc

SEQ ID NO: 4457934 - DNA, 22 bp, Homo sapiens
gcaggaaggaacaaagacaggc

SEQ ID NO: 4457935 - DNA, 23 bp, Homo sapiens
gcaggaaggactatgaaaagcta

SEQ ID NO: 4457936 - DNA, 15 bp, Homo sapiens
gcaggaaggagagcc

SEQ ID NO: 4457937 - DNA, 16 bp, Homo sapiens
gcaggaaggagagcct

SEQ ID NO: 4457938 - DNA, 23 bp, Homo sapiens
gcaggaaggagagcctgctgcat

SEQ ID NO: 4457939 - DNA, 14 bp, Homo sapiens
gcaggaatcacccc

SEQ ID NO: 4457940 - DNA, 16 bp, Homo sapiens
gcaggaatcacccctc

SEQ ID NO: 4457941 - DNA, 18 bp, Homo sapiens
gcaggaatcacccctctg

SEQ ID NO: 4457942 - DNA, 19 bp, Homo sapiens
gcaggaatcacccctctgc

SEQ ID NO: 4457943 - DNA, 22 bp, Homo sapiens
gcaggaatcacccctctgcccc

SEQ ID NO: 4457944 - DNA, 11 bp, Homo sapiens
gcaggacagag

SEQ ID NO: 4457945 - DNA, 14 bp, Homo sapiens
gcaggacagctcct

SEQ ID NO: 4457946 - DNA, 21 bp, Homo sapiens
gcaggacccagtggtcagcag

SEQ ID NO: 4457947 - DNA, 13 bp, Homo sapiens
gcaggactccagg

SEQ ID NO: 4457948 - DNA, 23 bp, Homo sapiens
gcaggagaatttctactgagcga

SEQ ID NO: 4457949 - DNA, 20 bp, Homo sapiens
gcaggagagactgagcagcc

SEQ ID NO: 4457950 - DNA, 16 bp, Homo sapiens
gcaggagccccgccac

SEQ ID NO: 4457951 - DNA, 19 bp, Homo sapiens
gcaggagccccgccacagc

SEQ ID NO: 4457952 - DNA, 22 bp, Homo sapiens
gcaggagtgtcctgcccatgcc

SEQ ID NO: 4457953 - DNA, 13 bp, Homo sapiens
gcaggatctgtct

SEQ ID NO: 4457954 - DNA, 18 bp, Homo sapiens
gcaggatctgtctgtgca

SEQ ID NO: 4457955 - DNA, 19 bp, Homo sapiens
gcaggatctgtctgtgcac

SEQ ID NO: 4457956 - DNA, 22 bp, Homo sapiens
gcaggatggcctttccttccct

SEQ ID NO: 4457957 - DNA, 22 bp, Homo sapiens
gcaggattgaaaatgtccagga

SEQ ID NO: 4457958 - DNA, 19 bp, Homo sapiens
gcaggcacttattgtaaat

SEQ ID NO: 4457959 - DNA, 13 bp, Homo sapiens
gcaggcagagctg

SEQ ID NO: 4457960 - DNA, 22 bp, Homo sapiens
gcaggcagcttctactcctgcc

SEQ ID NO: 4457961 - DNA, 23 bp, Homo sapiens
gcaggcccactccccagccccag

SEQ ID NO: 4457962 - DNA, 14 bp, Homo sapiens
gcaggcctctggtt

SEQ ID NO: 4457963 - DNA, 19 bp, Homo sapiens
gcaggcctctggttgcctc

SEQ ID NO: 4457964 - DNA, 19 bp, Homo sapiens
gcaggcctgtccctgggag

SEQ ID NO: 4457965 - DNA, 20 bp, Homo sapiens
gcaggcctgtccctgggagt

SEQ ID NO: 4457966 - DNA, 16 bp, Homo sapiens
gcaggctagaacctgg

SEQ ID NO: 4457967 - DNA, 17 bp, Homo sapiens
gcaggctcactgccagg

SEQ ID NO: 4457968 - DNA, 23 bp, Homo sapiens
gcaggctcactgccaggccagcc

SEQ ID NO: 4457969 - DNA, 23 bp, Homo sapiens
gcaggctgggccatgtccaaaga

SEQ ID NO: 4457970 - DNA, 14 bp, Homo sapiens
gcaggctggggagg

SEQ ID NO: 4457971 - DNA, 17 bp, Homo sapiens
gcaggctgtctggccag

SEQ ID NO: 4457972 - DNA, 22 bp, Homo sapiens
gcagggagaggagtgactgagc

SEQ ID NO: 4457973 - DNA, 17 bp, Homo sapiens
gcagggagccttctgcc

SEQ ID NO: 4457974 - DNA, 13 bp, Homo sapiens
gcagggagggctt

SEQ ID NO: 4457975 - DNA, 20 bp, Homo sapiens
gcagggaggggaggcagatg

SEQ ID NO: 4457976 - DNA, 19 bp, Homo sapiens
gcagggccactcaacagag

SEQ ID NO: 4457977 - DNA, 23 bp, Homo sapiens
gcagggccactcaacagagagga

SEQ ID NO: 4457978 - DNA, 14 bp, Homo sapiens
gcagggccaggcct

SEQ ID NO: 4457979 - DNA, 21 bp, Homo sapiens
gcagggccaggcctctgctgg

SEQ ID NO: 4457980 - DNA, 22 bp, Homo sapiens
gcagggcccccaataaaccagt

SEQ ID NO: 4457981 - DNA, 23 bp, Homo sapiens
gcagggcccccaataaaccagtg

SEQ ID NO: 4457982 - DNA, 13 bp, Homo sapiens
gcagggcctggct

SEQ ID NO: 4457983 - DNA, 19 bp, Homo sapiens
gcagggccttgcccagaga

SEQ ID NO: 4457984 - DNA, 14 bp, Homo sapiens
gcagggcgagctgc

SEQ ID NO: 4457985 - DNA, 16 bp, Homo sapiens
gcagggcgagctgcag

SEQ ID NO: 4457986 - DNA, 17 bp, Homo sapiens
gcagggcgagctgcagg

SEQ ID NO: 4457987 - DNA, 19 bp, Homo sapiens
gcagggcgagctgcaggaa

SEQ ID NO: 4457988 - DNA, 17 bp, Homo sapiens
gcagggcgccaagtctg

SEQ ID NO: 4457989 - DNA, 20 bp, Homo sapiens
gcagggcgggcagagggctg

SEQ ID NO: 4457990 - DNA, 21 bp, Homo sapiens
gcagggcgggcagagggctgg

SEQ ID NO: 4457991 - DNA, 14 bp, Homo sapiens
gcagggctgtgcac

SEQ ID NO: 4457992 - DNA, 13 bp, Homo sapiens
gcagggcttctcc

SEQ ID NO: 4457993 - DNA, 18 bp, Homo sapiens
gcaggggagacaggagcc

SEQ ID NO: 4457994 - DNA, 13 bp, Homo sapiens
gcaggggcccctg

SEQ ID NO: 4457995 - DNA, 18 bp, Homo sapiens
gcaggggcccctggggac

SEQ ID NO: 4457996 - DNA, 23 bp, Homo sapiens
gcaggggcgggtggatcacctga

SEQ ID NO: 4457997 - DNA, 21 bp, Homo sapiens
gcagggggccccgccagggct

SEQ ID NO: 4457998 - DNA, 22 bp, Homo sapiens
gcagggggccccgccagggctg

SEQ ID NO: 4457999 - DNA, 23 bp, Homo sapiens
gcagggggccccgccagggctgg

SEQ ID NO: 4458000 - DNA, 14 bp, Homo sapiens
gcaggggtctgagc

SEQ ID NO: 4458001 - DNA, 15 bp, Homo sapiens
gcaggggtctgagcc

SEQ ID NO: 4458002 - DNA, 17 bp, Homo sapiens
gcaggggtctgagccac

SEQ ID NO: 4458003 - DNA, 22 bp, Homo sapiens
gcagggtgggtgagctctcagg

SEQ ID NO: 4458004 - DNA, 18 bp, Homo sapiens
gcagggttacacaaaaat

SEQ ID NO: 4458005 - DNA, 14 bp, Homo sapiens
gcaggtaccactga

SEQ ID NO: 4458006 - DNA, 15 bp, Homo sapiens
gcaggtcctgcccat

SEQ ID NO: 4458007 - DNA, 16 bp, Homo sapiens
gcaggtcctgcccatg

SEQ ID NO: 4458008 - DNA, 21 bp, Homo sapiens
gcaggtctttaaatcatttta

SEQ ID NO: 4458009 - DNA, 16 bp, Homo sapiens
gcaggtgctattgtta

SEQ ID NO: 4458010 - DNA, 21 bp, Homo sapiens
gcaggtggggagactgggctg

SEQ ID NO: 4458011 - DNA, 13 bp, Homo sapiens
gcaggttctcttt

SEQ ID NO: 4458012 - DNA, 15 bp, Homo sapiens
gcaggtttcatttct

SEQ ID NO: 4458013 - DNA, 17 bp, Homo sapiens
gcaggtttcatttctta

SEQ ID NO: 4458014 - DNA, 19 bp, Homo sapiens
gcaggtttcatttcttatc

SEQ ID NO: 4458015 - DNA, 15 bp, Homo sapiens
gcagtaaagagaaac

SEQ ID NO: 4458016 - DNA, 16 bp, Homo sapiens
gcagtaaagagaaact

SEQ ID NO: 4458017 - DNA, 17 bp, Homo sapiens
gcagtaaagagaaactt

SEQ ID NO: 4458018 - DNA, 18 bp, Homo sapiens
gcagtaaagagaaacttt

SEQ ID NO: 4458019 - DNA, 17 bp, Homo sapiens
gcagtacaataaaagta

SEQ ID NO: 4458020 - DNA, 18 bp, Homo sapiens
gcagtatctcttacatca

SEQ ID NO: 4458021 - DNA, 13 bp, Homo sapiens
gcagtatggtaca

SEQ ID NO: 4458022 - DNA, 17 bp, Homo sapiens
gcagtcacatcacaata

SEQ ID NO: 4458023 - DNA, 13 bp, Homo sapiens
gcagtcacctctt

SEQ ID NO: 4458024 - DNA, 19 bp, Homo sapiens
gcagtcagagtccagtgct

SEQ ID NO: 4458025 - DNA, 13 bp, Homo sapiens
gcagtcagccctg

SEQ ID NO: 4458026 - DNA, 21 bp, Homo sapiens
gcagtccaggcctctctctgc

SEQ ID NO: 4458027 - DNA, 22 bp, Homo sapiens
gcagtccaggcctctctctgct

SEQ ID NO: 4458028 - DNA, 18 bp, Homo sapiens
gcagtcctggaagccagc

SEQ ID NO: 4458029 - DNA, 20 bp, Homo sapiens
gcagtcctggaagccagctt

SEQ ID NO: 4458030 - DNA, 19 bp, Homo sapiens
gcagtcgcccaagcagaca

SEQ ID NO: 4458031 - DNA, 12 bp, Homo sapiens
gcagtcgcctgc

SEQ ID NO: 4458032 - DNA, 22 bp, Homo sapiens
gcagtcgcctgcctgcagcagg

SEQ ID NO: 4458033 - DNA, 23 bp, Homo sapiens
gcagtcgtggggaacggaggagg

SEQ ID NO: 4458034 - DNA, 16 bp, Homo sapiens
gcagtctccccttcct

SEQ ID NO: 4458035 - DNA, 16 bp, Homo sapiens
gcagtctcctctttaa

SEQ ID NO: 4458036 - DNA, 17 bp, Homo sapiens
gcagtctcctctttaaa

SEQ ID NO: 4458037 - DNA, 12 bp, Homo sapiens
gcagtctgctct

SEQ ID NO: 4458038 - DNA, 12 bp, Homo sapiens
gcagtcttgctc

SEQ ID NO: 4458039 - DNA, 20 bp, Homo sapiens
gcagtgaatgattcagtgtt

SEQ ID NO: 4458040 - DNA, 20 bp, Homo sapiens
gcagtgactcgacaaaggcc

SEQ ID NO: 4458041 - DNA, 14 bp, Homo sapiens
gcagtgagctgaga

SEQ ID NO: 4458042 - DNA, 15 bp, Homo sapiens
gcagtgagctgagat

SEQ ID NO: 4458043 - DNA, 22 bp, Homo sapiens
gcagtgagtcgagattgcactg

SEQ ID NO: 4458044 - DNA, 15 bp, Homo sapiens
gcagtgccttgggga

SEQ ID NO: 4458045 - DNA, 14 bp, Homo sapiens
gcagtgctcaccca

SEQ ID NO: 4458046 - DNA, 19 bp, Homo sapiens
gcagtggcgcattctaggc

SEQ ID NO: 4458047 - DNA, 18 bp, Homo sapiens
gcagtggtgtggagaagc

SEQ ID NO: 4458048 - DNA, 24 bp, Homo sapiens
gcagtggttttggcaaacgctaaa

SEQ ID NO: 4458049 - DNA, 21 bp, Homo sapiens
gcagtgtgaggccagggcaga

SEQ ID NO: 4458050 - DNA, 12 bp, Homo sapiens
gcagtgtggaga

SEQ ID NO: 4458051 - DNA, 16 bp, Homo sapiens
gcagttaagctaaagc

SEQ ID NO: 4458052 - DNA, 14 bp, Homo sapiens
gcagttataacaga

SEQ ID NO: 4458053 - DNA, 20 bp, Homo sapiens
gcagttcacaaaaaaatgtt

SEQ ID NO: 4458054 - DNA, 19 bp, Homo sapiens
gcagttcagcaccacccta

SEQ ID NO: 4458055 - DNA, 15 bp, Homo sapiens
gcagttccatcaggt

SEQ ID NO: 4458056 - DNA, 11 bp, Homo sapiens
gcagttctgca

SEQ ID NO: 4458057 - DNA, 20 bp, Homo sapiens
gcagttgattccttgagttt

SEQ ID NO: 4458058 - DNA, 12 bp, Homo sapiens
gcagttgcagtg

SEQ ID NO: 4458059 - DNA, 18 bp, Homo sapiens
gcagttgcagtgctgctg

SEQ ID NO: 4458060 - DNA, 19 bp, Homo sapiens
gcagttggactctcaggga

SEQ ID NO: 4458061 - DNA, 20 bp, Homo sapiens
gcagttgtgtggcccagcac

SEQ ID NO: 4458062 - DNA, 20 bp, Homo sapiens
gcagtttatcattcaagtgt

SEQ ID NO: 4458063 - DNA, 20 bp, Homo sapiens
gcagtttctgacaattaaca

SEQ ID NO: 4458064 - DNA, 13 bp, Homo sapiens
gcagtttcttgtg

SEQ ID NO: 4458065 - DNA, 13 bp, Homo sapiens
gcagtttgaaatt

SEQ ID NO: 4458066 - DNA, 14 bp, Homo sapiens
gcagtttgaaattc

SEQ ID NO: 4458067 - DNA, 22 bp, Homo sapiens
gcagtttgaaattctgaatttg

SEQ ID NO: 4458068 - DNA, 14 bp, Homo sapiens
gcagtttgggaggt

SEQ ID NO: 4458069 - DNA, 19 bp, Homo sapiens
gcataaaatggaataacat

SEQ ID NO: 4458070 - DNA, 22 bp, Homo sapiens
gcataaagcaaggcaaaaatgt

SEQ ID NO: 4458071 - DNA, 22 bp, Homo sapiens
gcataaggagttagaaccacag

SEQ ID NO: 4458072 - DNA, 14 bp, Homo sapiens
gcataatctgaaaa

SEQ ID NO: 4458073 - DNA, 17 bp, Homo sapiens
gcataatgctttggaaa

SEQ ID NO: 4458074 - DNA, 15 bp, Homo sapiens
gcataatttgtctta

SEQ ID NO: 4458075 - DNA, 23 bp, Homo sapiens
gcatagaaggaagtgtgtttgcc

SEQ ID NO: 4458076 - DNA, 20 bp, Homo sapiens
gcatagcagtatatgttaat

SEQ ID NO: 4458077 - DNA, 18 bp, Homo sapiens
gcatagcccatgttaagt

SEQ ID NO: 4458078 - DNA, 18 bp, Homo sapiens
gcatagttgtagacaaag

SEQ ID NO: 4458079 - DNA, 19 bp, Homo sapiens
gcatataaatgtttatatt

SEQ ID NO: 4458080 - DNA, 18 bp, Homo sapiens
gcatatcattaaacaaat

SEQ ID NO: 4458081 - DNA, 17 bp, Homo sapiens
gcatatgttacaattct

SEQ ID NO: 4458082 - DNA, 21 bp, Homo sapiens
gcatatgttgaatacttttta

SEQ ID NO: 4458083 - DNA, 18 bp, Homo sapiens
gcatattccctgcacaca

SEQ ID NO: 4458084 - DNA, 20 bp, Homo sapiens
gcatattctctattttactt

SEQ ID NO: 4458085 - DNA, 23 bp, Homo sapiens
gcatatttagctgttttggaacg

SEQ ID NO: 4458086 - DNA, 21 bp, Homo sapiens
gcatatttattgcattgctgg

SEQ ID NO: 4458087 - DNA, 23 bp, Homo sapiens
gcatatttattgcattgctggta

SEQ ID NO: 4458088 - DNA, 22 bp, Homo sapiens
gcatattttaatcattatttga

SEQ ID NO: 4458089 - DNA, 14 bp, Homo sapiens
gcatcacagacccc

SEQ ID NO: 4458090 - DNA, 19 bp, Homo sapiens
gcatcacagaccccagctg

SEQ ID NO: 4458091 - DNA, 16 bp, Homo sapiens
gcatcacctcaccaag

SEQ ID NO: 4458092 - DNA, 17 bp, Homo sapiens
gcatcacctcaccaagg

SEQ ID NO: 4458093 - DNA, 22 bp, Homo sapiens
gcatcagaaatcctctgttaat

SEQ ID NO: 4458094 - DNA, 23 bp, Homo sapiens
gcatccagagtccctgcctggac

SEQ ID NO: 4458095 - DNA, 17 bp, Homo sapiens
gcatccagcagcagcac

SEQ ID NO: 4458096 - DNA, 13 bp, Homo sapiens
gcatccaggctgg

SEQ ID NO: 4458097 - DNA, 14 bp, Homo sapiens
gcatccaggctggc

SEQ ID NO: 4458098 - DNA, 16 bp, Homo sapiens
gcatccatcttggaag

SEQ ID NO: 4458099 - DNA, 12 bp, Homo sapiens
gcatccattcct

SEQ ID NO: 4458100 - DNA, 14 bp, Homo sapiens
gcatccattcctca

SEQ ID NO: 4458101 - DNA, 18 bp, Homo sapiens
gcatcccccacctactct

SEQ ID NO: 4458102 - DNA, 22 bp, Homo sapiens
gcatcccccacctactctcagg

SEQ ID NO: 4458103 - DNA, 18 bp, Homo sapiens
gcatcccccctgctcagc

SEQ ID NO: 4458104 - DNA, 16 bp, Homo sapiens
gcatccctggagcagg

SEQ ID NO: 4458105 - DNA, 23 bp, Homo sapiens
gcatcccttcccacatgcctgcg

SEQ ID NO: 4458106 - DNA, 15 bp, Homo sapiens
gcatccgcaggtgct

SEQ ID NO: 4458107 - DNA, 16 bp, Homo sapiens
gcatccgcaggtgctg

SEQ ID NO: 4458108 - DNA, 22 bp, Homo sapiens
gcatccgcctgaaagtgttttg

SEQ ID NO: 4458109 - DNA, 20 bp, Homo sapiens
gcatcctgcagggcttctcc

SEQ ID NO: 4458110 - DNA, 20 bp, Homo sapiens
gcatccttgtaatacctgat

SEQ ID NO: 4458111 - DNA, 20 bp, Homo sapiens
gcatcgggagcacccagagc

SEQ ID NO: 4458112 - DNA, 17 bp, Homo sapiens
gcatcggggagccggga

SEQ ID NO: 4458113 - DNA, 15 bp, Homo sapiens
gcatctataatgtca

SEQ ID NO: 4458114 - DNA, 13 bp, Homo sapiens
gcatctcccagat

SEQ ID NO: 4458115 - DNA, 16 bp, Homo sapiens
gcatctcttccccaga

SEQ ID NO: 4458116 - DNA, 18 bp, Homo sapiens
gcatctgagtccagctcc

SEQ ID NO: 4458117 - DNA, 17 bp, Homo sapiens
gcatctgccccaggtac

SEQ ID NO: 4458118 - DNA, 14 bp, Homo sapiens
gcatctgcccctcc

SEQ ID NO: 4458119 - DNA, 15 bp, Homo sapiens
gcatctgcccctccc

SEQ ID NO: 4458120 - DNA, 15 bp, Homo sapiens
gcatctggagagaac

SEQ ID NO: 4458121 - DNA, 16 bp, Homo sapiens
gcatctggagagaaca

SEQ ID NO: 4458122 - DNA, 16 bp, Homo sapiens
gcatctggattgaaag

SEQ ID NO: 4458123 - DNA, 15 bp, Homo sapiens
gcatcttctggcttg

SEQ ID NO: 4458124 - DNA, 13 bp, Homo sapiens
gcatctttgcctt

SEQ ID NO: 4458125 - DNA, 18 bp, Homo sapiens
gcatctttgccttgggct

SEQ ID NO: 4458126 - DNA, 16 bp, Homo sapiens
gcatcttttgtattaa

SEQ ID NO: 4458127 - DNA, 16 bp, Homo sapiens
gcatgaaattgtatct

SEQ ID NO: 4458128 - DNA, 13 bp, Homo sapiens
gcatgacagcctc

SEQ ID NO: 4458129 - DNA, 21 bp, Homo sapiens
gcatgacctaccaggacagaa

SEQ ID NO: 4458130 - DNA, 22 bp, Homo sapiens
gcatgacctaccaggacagaac

SEQ ID NO: 4458131 - DNA, 14 bp, Homo sapiens
gcatgcaatttgaa

SEQ ID NO: 4458132 - DNA, 16 bp, Homo sapiens
gcatgcacactgagaa

SEQ ID NO: 4458133 - DNA, 15 bp, Homo sapiens
gcatgcataaatcaa

SEQ ID NO: 4458134 - DNA, 18 bp, Homo sapiens
gcatgcctgtaatcccag

SEQ ID NO: 4458135 - DNA, 21 bp, Homo sapiens
gcatgcctgtagtctcagcta

SEQ ID NO: 4458136 - DNA, 17 bp, Homo sapiens
gcatgcggcccagcccg

SEQ ID NO: 4458137 - DNA, 19 bp, Homo sapiens
gcatgcggcccagcccggc

SEQ ID NO: 4458138 - DNA, 14 bp, Homo sapiens
gcatgctctctgca

SEQ ID NO: 4458139 - DNA, 15 bp, Homo sapiens
gcatgctctctgcag

SEQ ID NO: 4458140 - DNA, 18 bp, Homo sapiens
gcatgctctctgcagcca

SEQ ID NO: 4458141 - DNA, 23 bp, Homo sapiens
gcatgctctctgcagccagccca

SEQ ID NO: 4458142 - DNA, 23 bp, Homo sapiens
gcatggaagtaattaaggtacat

SEQ ID NO: 4458143 - DNA, 16 bp, Homo sapiens
gcatggcatattttaa

SEQ ID NO: 4458144 - DNA, 15 bp, Homo sapiens
gcatggctattttat

SEQ ID NO: 4458145 - DNA, 19 bp, Homo sapiens
gcatggctcctgtctggct

SEQ ID NO: 4458146 - DNA, 15 bp, Homo sapiens
gcatggggccaggaa

SEQ ID NO: 4458147 - DNA, 23 bp, Homo sapiens
gcatgggtgagacctgaccagtc

SEQ ID NO: 4458148 - DNA, 15 bp, Homo sapiens
gcatggtcacacact

SEQ ID NO: 4458149 - DNA, 15 bp, Homo sapiens
gcatggtggcaggcg

SEQ ID NO: 4458150 - DNA, 19 bp, Homo sapiens
gcatggtggcgcaagcctg

SEQ ID NO: 4458151 - DNA, 17 bp, Homo sapiens
gcatggtggctcatgcc

SEQ ID NO: 4458152 - DNA, 19 bp, Homo sapiens
gcatggtggtgtgtgccta

SEQ ID NO: 4458153 - DNA, 13 bp, Homo sapiens
gcatgtagtaaca

SEQ ID NO: 4458154 - DNA, 16 bp, Homo sapiens
gcatgtagtaacacta

SEQ ID NO: 4458155 - DNA, 17 bp, Homo sapiens
gcatgtagtaacactaa

SEQ ID NO: 4458156 - DNA, 23 bp, Homo sapiens
gcatgtagtaacactaatatatt

SEQ ID NO: 4458157 - DNA, 16 bp, Homo sapiens
gcatgtatagttgctt

SEQ ID NO: 4458158 - DNA, 15 bp, Homo sapiens
gcatgtcatttgcac

SEQ ID NO: 4458159 - DNA, 18 bp, Homo sapiens
gcatgtcatttgcacaca

SEQ ID NO: 4458160 - DNA, 16 bp, Homo sapiens
gcatgtcccacccacc

SEQ ID NO: 4458161 - DNA, 19 bp, Homo sapiens
gcatgtcctgtaaaggtta

SEQ ID NO: 4458162 - DNA, 20 bp, Homo sapiens
gcatgtctgccaaaatgcaa

SEQ ID NO: 4458163 - DNA, 12 bp, Homo sapiens
gcatgtctgcct

SEQ ID NO: 4458164 - DNA, 14 bp, Homo sapiens
gcatgtcttttaaa

SEQ ID NO: 4458165 - DNA, 17 bp, Homo sapiens
gcatgtcttttaaaatg

SEQ ID NO: 4458166 - DNA, 18 bp, Homo sapiens
gcatgtgtgactttcagg

SEQ ID NO: 4458167 - DNA, 16 bp, Homo sapiens
gcattaattgtgctgt

SEQ ID NO: 4458168 - DNA, 15 bp, Homo sapiens
gcattactattaact

SEQ ID NO: 4458169 - DNA, 17 bp, Homo sapiens
gcattagaatggaggaa

SEQ ID NO: 4458170 - DNA, 18 bp, Homo sapiens
gcattatctctttctctc

SEQ ID NO: 4458171 - DNA, 19 bp, Homo sapiens
gcattatggtctaatgatt

SEQ ID NO: 4458172 - DNA, 14 bp, Homo sapiens
gcattattaaattg

SEQ ID NO: 4458173 - DNA, 22 bp, Homo sapiens
gcattattggaatataattgtt

SEQ ID NO: 4458174 - DNA, 15 bp, Homo sapiens
gcattattttttgtt

SEQ ID NO: 4458175 - DNA, 14 bp, Homo sapiens
gcattcaaaatctt

SEQ ID NO: 4458176 - DNA, 18 bp, Homo sapiens
gcattcaggcagcactga

SEQ ID NO: 4458177 - DNA, 14 bp, Homo sapiens
gcattccagctctg

SEQ ID NO: 4458178 - DNA, 15 bp, Homo sapiens
gcattccatgaccag

SEQ ID NO: 4458179 - DNA, 15 bp, Homo sapiens
gcattcccagggacc

SEQ ID NO: 4458180 - DNA, 14 bp, Homo sapiens
gcattccctgagtc

SEQ ID NO: 4458181 - DNA, 22 bp, Homo sapiens
gcattccctgagtcaccaggaa

SEQ ID NO: 4458182 - DNA, 17 bp, Homo sapiens
gcattctaacctggagg

SEQ ID NO: 4458183 - DNA, 17 bp, Homo sapiens
gcattctggcataattt

SEQ ID NO: 4458184 - DNA, 22 bp, Homo sapiens
gcattcttagcctgtggcagta

SEQ ID NO: 4458185 - DNA, 18 bp, Homo sapiens
gcattctttcccagtgag

SEQ ID NO: 4458186 - DNA, 18 bp, Homo sapiens
gcattgaaaaatttctaa

SEQ ID NO: 4458187 - DNA, 21 bp, Homo sapiens
gcattgaaagaagagatgaga

SEQ ID NO: 4458188 - DNA, 16 bp, Homo sapiens
gcattgaacacaaact

SEQ ID NO: 4458189 - DNA, 18 bp, Homo sapiens
gcattgaacacaaactgt

SEQ ID NO: 4458190 - DNA, 19 bp, Homo sapiens
gcattgaacacaaactgta

SEQ ID NO: 4458191 - DNA, 23 bp, Homo sapiens
gcattgaacacaaactgtaaata

SEQ ID NO: 4458192 - DNA, 21 bp, Homo sapiens
gcattgagaatggaggctccc

SEQ ID NO: 4458193 - DNA, 17 bp, Homo sapiens
gcattgctgtccttggg

SEQ ID NO: 4458194 - DNA, 21 bp, Homo sapiens
gcattggaaaccctatttccc

SEQ ID NO: 4458195 - DNA, 12 bp, Homo sapiens
gcattggatatt

SEQ ID NO: 4458196 - DNA, 16 bp, Homo sapiens
gcattggggggccggg

SEQ ID NO: 4458197 - DNA, 19 bp, Homo sapiens
gcattggggggccgggcag

SEQ ID NO: 4458198 - DNA, 17 bp, Homo sapiens
gcattggggttcctctg

SEQ ID NO: 4458199 - DNA, 22 bp, Homo sapiens
gcattggggttcctctgtacag

SEQ ID NO: 4458200 - DNA, 16 bp, Homo sapiens
gcattgtaaaataatt

SEQ ID NO: 4458201 - DNA, 11 bp, Homo sapiens
gcattgtaaat

SEQ ID NO: 4458202 - DNA, 16 bp, Homo sapiens
gcattgtaaatgtgct

SEQ ID NO: 4458203 - DNA, 18 bp, Homo sapiens
gcatttaaaacagacact

SEQ ID NO: 4458204 - DNA, 16 bp, Homo sapiens
gcatttaaacatgttt

SEQ ID NO: 4458205 - DNA, 17 bp, Homo sapiens
gcatttcaaatgttaga

SEQ ID NO: 4458206 - DNA, 18 bp, Homo sapiens
gcatttcatattatttta

SEQ ID NO: 4458207 - DNA, 16 bp, Homo sapiens
gcatttcattatgctt

SEQ ID NO: 4458208 - DNA, 14 bp, Homo sapiens
gcatttccagagca

SEQ ID NO: 4458209 - DNA, 19 bp, Homo sapiens
gcatttccagagcagagcc

SEQ ID NO: 4458210 - DNA, 18 bp, Homo sapiens
gcatttcccttccttcct

SEQ ID NO: 4458211 - DNA, 12 bp, Homo sapiens
gcatttctattg

SEQ ID NO: 4458212 - DNA, 13 bp, Homo sapiens
gcatttcttttct

SEQ ID NO: 4458213 - DNA, 17 bp, Homo sapiens
gcatttgatctgttgca

SEQ ID NO: 4458214 - DNA, 17 bp, Homo sapiens
gcatttgcagattttta

SEQ ID NO: 4458215 - DNA, 18 bp, Homo sapiens
gcatttgtcaatgacagt

SEQ ID NO: 4458216 - DNA, 17 bp, Homo sapiens
gcatttgtgctagaaat

SEQ ID NO: 4458217 - DNA, 15 bp, Homo sapiens
gcattttaaaagcaa

SEQ ID NO: 4458218 - DNA, 12 bp, Homo sapiens
gcattttaccat

SEQ ID NO: 4458219 - DNA, 13 bp, Homo sapiens
gcattttcctcct

SEQ ID NO: 4458220 - DNA, 16 bp, Homo sapiens
gcattttcctcctctg

SEQ ID NO: 4458221 - DNA, 14 bp, Homo sapiens
gcatttttaaactt

SEQ ID NO: 4458222 - DNA, 23 bp, Homo sapiens
gcatttttatttcagattttgat

SEQ ID NO: 4458223 - DNA, 21 bp, Homo sapiens
gcatttttcaatatattgaac

SEQ ID NO: 4458224 - DNA, 11 bp, Homo sapiens
gcatttttgtt

SEQ ID NO: 4458225 - DNA, 19 bp, Homo sapiens
gcatttttgttttgaaagt

SEQ ID NO: 4458226 - DNA, 22 bp, Homo sapiens
gcatttttgttttgaaagttta

SEQ ID NO: 4458227 - DNA, 13 bp, Homo sapiens
gccaaaaaggata

SEQ ID NO: 4458228 - DNA, 16 bp, Homo sapiens
gccaaaaaggatacat

SEQ ID NO: 4458229 - DNA, 17 bp, Homo sapiens
gccaaaaggaaaaagct

SEQ ID NO: 4458230 - DNA, 18 bp, Homo sapiens
gccaaaaggaaaaagctc

SEQ ID NO: 4458231 - DNA, 15 bp, Homo sapiens
gccaaaagtccctcc

SEQ ID NO: 4458232 - DNA, 23 bp, Homo sapiens
gccaaaataaacctgttcttcct

SEQ ID NO: 4458233 - DNA, 20 bp, Homo sapiens
gccaaaatgtacttaaatga

SEQ ID NO: 4458234 - DNA, 21 bp, Homo sapiens
gccaaaatgtacttaaatgag

SEQ ID NO: 4458235 - DNA, 18 bp, Homo sapiens
gccaaaccagcagggagt

SEQ ID NO: 4458236 - DNA, 18 bp, Homo sapiens
gccaaaccaggaccctgt

SEQ ID NO: 4458237 - DNA, 21 bp, Homo sapiens
gccaaaccaggaccctgtcca

SEQ ID NO: 4458238 - DNA, 15 bp, Homo sapiens
gccaaacctcctgtc

SEQ ID NO: 4458239 - DNA, 16 bp, Homo sapiens
gccaaagaagcagacc

SEQ ID NO: 4458240 - DNA, 19 bp, Homo sapiens
gccaaagagcctcccacca

SEQ ID NO: 4458241 - DNA, 18 bp, Homo sapiens
gccaaagatttcatatct

SEQ ID NO: 4458242 - DNA, 23 bp, Homo sapiens
gccaaaggaccgttttgtattgc

SEQ ID NO: 4458243 - DNA, 18 bp, Homo sapiens
gccaaataatgtctctgt

SEQ ID NO: 4458244 - DNA, 21 bp, Homo sapiens
gccaaatctagaatttagtga

SEQ ID NO: 4458245 - DNA, 21 bp, Homo sapiens
gccaaatgcagggaggggagg

SEQ ID NO: 4458246 - DNA, 15 bp, Homo sapiens
gccaacagcacctcc

SEQ ID NO: 4458247 - DNA, 13 bp, Homo sapiens
gccaacagttgta

SEQ ID NO: 4458248 - DNA, 23 bp, Homo sapiens
gccaacagttgtatgtttgctga

SEQ ID NO: 4458249 - DNA, 16 bp, Homo sapiens
gccaacctcaggctcc

SEQ ID NO: 4458250 - DNA, 17 bp, Homo sapiens
gccaacgagacacattg

SEQ ID NO: 4458251 - DNA, 18 bp, Homo sapiens
gccaacggcaacagcatg

SEQ ID NO: 4458252 - DNA, 15 bp, Homo sapiens
gccaactagcccctg

SEQ ID NO: 4458253 - DNA, 17 bp, Homo sapiens
gccaactagcccctggg

SEQ ID NO: 4458254 - DNA, 22 bp, Homo sapiens
gccaactgccaggctgcctcct

SEQ ID NO: 4458255 - DNA, 21 bp, Homo sapiens
gccaacttgatgttccacctg

SEQ ID NO: 4458256 - DNA, 19 bp, Homo sapiens
gccaagaaagatgtatata

SEQ ID NO: 4458257 - DNA, 15 bp, Homo sapiens
gccaagaagcagtgg

SEQ ID NO: 4458258 - DNA, 20 bp, Homo sapiens
gccaagaagcagtggcctta

SEQ ID NO: 4458259 - DNA, 18 bp, Homo sapiens
gccaagatcgcaccactg

SEQ ID NO: 4458260 - DNA, 20 bp, Homo sapiens
gccaagatcgcaccactgca

SEQ ID NO: 4458261 - DNA, 16 bp, Homo sapiens
gccaagcaggctggtt

SEQ ID NO: 4458262 - DNA, 14 bp, Homo sapiens
gccaagccctggcc

SEQ ID NO: 4458263 - DNA, 18 bp, Homo sapiens
gccaagctaatctgcctg

SEQ ID NO: 4458264 - DNA, 14 bp, Homo sapiens
gccaaggacccagg

SEQ ID NO: 4458265 - DNA, 19 bp, Homo sapiens
gccaaggacccaggcgctg

SEQ ID NO: 4458266 - DNA, 21 bp, Homo sapiens
gccaaggacccaggcgctgca

SEQ ID NO: 4458267 - DNA, 15 bp, Homo sapiens
gccaaggaggcctgg

SEQ ID NO: 4458268 - DNA, 17 bp, Homo sapiens
gccaaggagggaagagt

SEQ ID NO: 4458269 - DNA, 12 bp, Homo sapiens
gccaagggaaag

SEQ ID NO: 4458270 - DNA, 22 bp, Homo sapiens
gccaagggaaaggggtgctttt

SEQ ID NO: 4458271 - DNA, 22 bp, Homo sapiens
gccaagggcaacagatcagtaa

SEQ ID NO: 4458272 - DNA, 20 bp, Homo sapiens
gccaagggcccaaagaaaga

SEQ ID NO: 4458273 - DNA, 15 bp, Homo sapiens
gccaaggtctgagcc

SEQ ID NO: 4458274 - DNA, 22 bp, Homo sapiens
gccaaggtctgagccacagcag

SEQ ID NO: 4458275 - DNA, 20 bp, Homo sapiens
gccaagtaaacagggtacct

SEQ ID NO: 4458276 - DNA, 19 bp, Homo sapiens
gccaagtaagagtggtggc

SEQ ID NO: 4458277 - DNA, 21 bp, Homo sapiens
gccaagtccgcagaagccctg

SEQ ID NO: 4458278 - DNA, 16 bp, Homo sapiens
gccaagtctcagaaga

SEQ ID NO: 4458279 - DNA, 16 bp, Homo sapiens
gccaagtctggcacca

SEQ ID NO: 4458280 - DNA, 19 bp, Homo sapiens
gccaagtggggtgctggga

SEQ ID NO: 4458281 - DNA, 20 bp, Homo sapiens
gccaagtggggtgctgggag

SEQ ID NO: 4458282 - DNA, 23 bp, Homo sapiens
gccaagtggggtgctgggaggag

SEQ ID NO: 4458283 - DNA, 17 bp, Homo sapiens
gccaagtgtcttttaaa

SEQ ID NO: 4458284 - DNA, 18 bp, Homo sapiens
gccaagtgttttgtattt

SEQ ID NO: 4458285 - DNA, 15 bp, Homo sapiens
gccaataaaatgtat

SEQ ID NO: 4458286 - DNA, 21 bp, Homo sapiens
gccaataggtgcctagtaaat

SEQ ID NO: 4458287 - DNA, 16 bp, Homo sapiens
gccaatagtgtcatcc

SEQ ID NO: 4458288 - DNA, 18 bp, Homo sapiens
gccaatgttatgccagct

SEQ ID NO: 4458289 - DNA, 22 bp, Homo sapiens
gccaatgttatgccagctccat

SEQ ID NO: 4458290 - DNA, 23 bp, Homo sapiens
gccaatgttatgccagctccatg

SEQ ID NO: 4458291 - DNA, 21 bp, Homo sapiens
gccaattcagtttcactttgg

SEQ ID NO: 4458292 - DNA, 13 bp, Homo sapiens
gccaattgctacc

SEQ ID NO: 4458293 - DNA, 16 bp, Homo sapiens
gccaattttggatgag

SEQ ID NO: 4458294 - DNA, 16 bp, Homo sapiens
gccacaaaccaccagg

SEQ ID NO: 4458295 - DNA, 21 bp, Homo sapiens
gccacaaagccccccagctcc

SEQ ID NO: 4458296 - DNA, 15 bp, Homo sapiens
gccacaagctgcact

SEQ ID NO: 4458297 - DNA, 17 bp, Homo sapiens
gccacaagctgcactgt

SEQ ID NO: 4458298 - DNA, 22 bp, Homo sapiens
gccacaagctgcactgtgaacc

SEQ ID NO: 4458299 - DNA, 18 bp, Homo sapiens
gccacacactgcacatct

SEQ ID NO: 4458300 - DNA, 22 bp, Homo sapiens
gccacacaggcagggcctggct

SEQ ID NO: 4458301 - DNA, 13 bp, Homo sapiens
gccacaccactgc

SEQ ID NO: 4458302 - DNA, 12 bp, Homo sapiens
gccacacccagc

SEQ ID NO: 4458303 - DNA, 14 bp, Homo sapiens
gccacacccagggg

SEQ ID NO: 4458304 - DNA, 23 bp, Homo sapiens
gccacacccaggggaaggccctg

SEQ ID NO: 4458305 - DNA, 19 bp, Homo sapiens
gccacacctctatcccggc

SEQ ID NO: 4458306 - DNA, 21 bp, Homo sapiens
gccacacctggactgaccctg

SEQ ID NO: 4458307 - DNA, 16 bp, Homo sapiens
gccacactggggctga

SEQ ID NO: 4458308 - DNA, 18 bp, Homo sapiens
gccacactggggctgaca

SEQ ID NO: 4458309 - DNA, 20 bp, Homo sapiens
gccacagaaagctccttcca

SEQ ID NO: 4458310 - DNA, 14 bp, Homo sapiens
gccacagaggcccc

SEQ ID NO: 4458311 - DNA, 20 bp, Homo sapiens
gccacagaggccccacctga

SEQ ID NO: 4458312 - DNA, 14 bp, Homo sapiens
gccacagcagcatt

SEQ ID NO: 4458313 - DNA, 14 bp, Homo sapiens
gccacagccagagg

SEQ ID NO: 4458314 - DNA, 16 bp, Homo sapiens
gccacagcctcccctg

SEQ ID NO: 4458315 - DNA, 21 bp, Homo sapiens
gccacagcctcccctgccagg

SEQ ID NO: 4458316 - DNA, 14 bp, Homo sapiens
gccacagctgctgg

SEQ ID NO: 4458317 - DNA, 20 bp, Homo sapiens
gccacagctgctgttctcag

SEQ ID NO: 4458318 - DNA, 20 bp, Homo sapiens
gccacaggaaggaggggaga

SEQ ID NO: 4458319 - DNA, 18 bp, Homo sapiens
gccacaggcaggtcacag

SEQ ID NO: 4458320 - DNA, 19 bp, Homo sapiens
gccacaggcaggtcacaga

SEQ ID NO: 4458321 - DNA, 20 bp, Homo sapiens
gccacaggcaggtcacagaa

SEQ ID NO: 4458322 - DNA, 13 bp, Homo sapiens
gccacaggcctga

SEQ ID NO: 4458323 - DNA, 15 bp, Homo sapiens
gccacaggcctgaga

SEQ ID NO: 4458324 - DNA, 16 bp, Homo sapiens
gccacagggaagctca

SEQ ID NO: 4458325 - DNA, 15 bp, Homo sapiens
gccacagggagctcc

SEQ ID NO: 4458326 - DNA, 16 bp, Homo sapiens
gccacagtcactggat

SEQ ID NO: 4458327 - DNA, 17 bp, Homo sapiens
gccacatacttgcagct

SEQ ID NO: 4458328 - DNA, 13 bp, Homo sapiens
gccacatggagcc

SEQ ID NO: 4458329 - DNA, 16 bp, Homo sapiens
gccacatggtgtctcc

SEQ ID NO: 4458330 - DNA, 18 bp, Homo sapiens
gccacatggtgtctccca

SEQ ID NO: 4458331 - DNA, 18 bp, Homo sapiens
gccaccaaaggagacata

SEQ ID NO: 4458332 - DNA, 18 bp, Homo sapiens
gccaccaacttacaaaaa

SEQ ID NO: 4458333 - DNA, 18 bp, Homo sapiens
gccaccacctttggctgg

SEQ ID NO: 4458334 - DNA, 23 bp, Homo sapiens
gccaccacctttggctggtagca

SEQ ID NO: 4458335 - DNA, 20 bp, Homo sapiens
gccaccagccatcctccctc

SEQ ID NO: 4458336 - DNA, 22 bp, Homo sapiens
gccaccagcccccgccccagag

SEQ ID NO: 4458337 - DNA, 23 bp, Homo sapiens
gccaccagcccctccccagactc

SEQ ID NO: 4458338 - DNA, 13 bp, Homo sapiens
gccaccagggatc

SEQ ID NO: 4458339 - DNA, 17 bp, Homo sapiens
gccaccatgcttgcctg

SEQ ID NO: 4458340 - DNA, 21 bp, Homo sapiens
gccaccatgcttgcctgaagc

SEQ ID NO: 4458341 - DNA, 17 bp, Homo sapiens
gccacccaagcctgctg

SEQ ID NO: 4458342 - DNA, 15 bp, Homo sapiens
gccaccccaccctcc

SEQ ID NO: 4458343 - DNA, 20 bp, Homo sapiens
gccaccccaccctccctgga

SEQ ID NO: 4458344 - DNA, 21 bp, Homo sapiens
gccaccccaccctccctggag

SEQ ID NO: 4458345 - DNA, 22 bp, Homo sapiens
gccaccccaccctccctggagt

SEQ ID NO: 4458346 - DNA, 13 bp, Homo sapiens
gccacccctcccc

SEQ ID NO: 4458347 - DNA, 15 bp, Homo sapiens
gccacccgggcaagg

SEQ ID NO: 4458348 - DNA, 22 bp, Homo sapiens
gccacccgtggggtgctgccct

SEQ ID NO: 4458349 - DNA, 21 bp, Homo sapiens
gccaccggcctgtgggtctct

SEQ ID NO: 4458350 - DNA, 13 bp, Homo sapiens
gccaccgtgcctg

SEQ ID NO: 4458351 - DNA, 14 bp, Homo sapiens
gccaccgtgcctgg

SEQ ID NO: 4458352 - DNA, 15 bp, Homo sapiens
gccaccgtgcctggc

SEQ ID NO: 4458353 - DNA, 16 bp, Homo sapiens
gccaccgtgcctggcc

SEQ ID NO: 4458354 - DNA, 17 bp, Homo sapiens
gccaccgtgcctggcca

SEQ ID NO: 4458355 - DNA, 16 bp, Homo sapiens
gccaccgtgcctggct

SEQ ID NO: 4458356 - DNA, 17 bp, Homo sapiens
gccaccgtgcctggcta

SEQ ID NO: 4458357 - DNA, 16 bp, Homo sapiens
gccacctatgcctgtg

SEQ ID NO: 4458358 - DNA, 20 bp, Homo sapiens
gccacctcccctatccaccc

SEQ ID NO: 4458359 - DNA, 21 bp, Homo sapiens
gccacctcccctatccaccca

SEQ ID NO: 4458360 - DNA, 18 bp, Homo sapiens
gccacgccctccctgcta

SEQ ID NO: 4458361 - DNA, 14 bp, Homo sapiens
gccacgctccagct

SEQ ID NO: 4458362 - DNA, 22 bp, Homo sapiens
gccacgctgtcctctcgagccc

SEQ ID NO: 4458363 - DNA, 22 bp, Homo sapiens
gccacgtcccagcatccctgga

SEQ ID NO: 4458364 - DNA, 13 bp, Homo sapiens
gccacgtgccagg

SEQ ID NO: 4458365 - DNA, 17 bp, Homo sapiens
gccacgtgccaggcccg

SEQ ID NO: 4458366 - DNA, 18 bp, Homo sapiens
gccacgtgccaggcccgg

SEQ ID NO: 4458367 - DNA, 20 bp, Homo sapiens
gccactaagaacccctctgc

SEQ ID NO: 4458368 - DNA, 19 bp, Homo sapiens
gccactaggtgtccccaac

SEQ ID NO: 4458369 - DNA, 16 bp, Homo sapiens
gccactagtaagtaat

SEQ ID NO: 4458370 - DNA, 16 bp, Homo sapiens
gccactcaacagagag

SEQ ID NO: 4458371 - DNA, 14 bp, Homo sapiens
gccactcacacagc

SEQ ID NO: 4458372 - DNA, 18 bp, Homo sapiens
gccactcacacagccagg

SEQ ID NO: 4458373 - DNA, 13 bp, Homo sapiens
gccactcagcttc

SEQ ID NO: 4458374 - DNA, 13 bp, Homo sapiens
gccactcatttca

SEQ ID NO: 4458375 - DNA, 14 bp, Homo sapiens
gccactcatttcat

SEQ ID NO: 4458376 - DNA, 16 bp, Homo sapiens
gccactcatttcatct

SEQ ID NO: 4458377 - DNA, 13 bp, Homo sapiens
gccactcctctga

SEQ ID NO: 4458378 - DNA, 15 bp, Homo sapiens
gccactcctctgact

SEQ ID NO: 4458379 - DNA, 23 bp, Homo sapiens
gccactcctctgactcagggctc

SEQ ID NO: 4458380 - DNA, 18 bp, Homo sapiens
gccactcctgccaggccg

SEQ ID NO: 4458381 - DNA, 18 bp, Homo sapiens
gccactcgccttcttaga

SEQ ID NO: 4458382 - DNA, 13 bp, Homo sapiens
gccactgcccccc

SEQ ID NO: 4458383 - DNA, 16 bp, Homo sapiens
gccactggaaggaaca

SEQ ID NO: 4458384 - DNA, 20 bp, Homo sapiens
gccactggcatcgcagcttc

SEQ ID NO: 4458385 - DNA, 19 bp, Homo sapiens
gccactgttcagcggagct

SEQ ID NO: 4458386 - DNA, 20 bp, Homo sapiens
gccactgttcagcggagctg

SEQ ID NO: 4458387 - DNA, 19 bp, Homo sapiens
gccacttaatgtatgttac

SEQ ID NO: 4458388 - DNA, 18 bp, Homo sapiens
gccacttctcactcacca

SEQ ID NO: 4458389 - DNA, 14 bp, Homo sapiens
gccacttctgggtg

SEQ ID NO: 4458390 - DNA, 20 bp, Homo sapiens
gccacttctgggtggggcag

SEQ ID NO: 4458391 - DNA, 13 bp, Homo sapiens
gccacttggagtg

SEQ ID NO: 4458392 - DNA, 16 bp, Homo sapiens
gccagaccagcaggct

SEQ ID NO: 4458393 - DNA, 18 bp, Homo sapiens
gccagaccagcaggctgg

SEQ ID NO: 4458394 - DNA, 22 bp, Homo sapiens
gccagacccacgggctcatgca

SEQ ID NO: 4458395 - DNA, 16 bp, Homo sapiens
gccagaccccacgctg

SEQ ID NO: 4458396 - DNA, 13 bp, Homo sapiens
gccagaccgcaga

SEQ ID NO: 4458397 - DNA, 16 bp, Homo sapiens
gccagacctagcaggc

SEQ ID NO: 4458398 - DNA, 14 bp, Homo sapiens
gccagactgtccag

SEQ ID NO: 4458399 - DNA, 16 bp, Homo sapiens
gccagactgtccaggg

SEQ ID NO: 4458400 - DNA, 18 bp, Homo sapiens
gccagactgtccagggaa

SEQ ID NO: 4458401 - DNA, 20 bp, Homo sapiens
gccagagcctctggcccctc

SEQ ID NO: 4458402 - DNA, 21 bp, Homo sapiens
gccagagcctctggcccctca

SEQ ID NO: 4458403 - DNA, 17 bp, Homo sapiens
gccagaggccctggagg

SEQ ID NO: 4458404 - DNA, 18 bp, Homo sapiens
gccagaggccctggaggg

SEQ ID NO: 4458405 - DNA, 13 bp, Homo sapiens
gccagagtggcct

SEQ ID NO: 4458406 - DNA, 19 bp, Homo sapiens
gccagagtggcctggccag

SEQ ID NO: 4458407 - DNA, 15 bp, Homo sapiens
gccagatcctcttgg

SEQ ID NO: 4458408 - DNA, 16 bp, Homo sapiens
gccagatcctcttggt

SEQ ID NO: 4458409 - DNA, 19 bp, Homo sapiens
gccagattctgcctctctg

SEQ ID NO: 4458410 - DNA, 20 bp, Homo sapiens
gccagattctgcctctctgg

SEQ ID NO: 4458411 - DNA, 15 bp, Homo sapiens
gccagatttgtcttt

SEQ ID NO: 4458412 - DNA, 15 bp, Homo sapiens
gccagcaacattggc

SEQ ID NO: 4458413 - DNA, 19 bp, Homo sapiens
gccagcaacattggcacat

SEQ ID NO: 4458414 - DNA, 13 bp, Homo sapiens
gccagcaccctct

SEQ ID NO: 4458415 - DNA, 18 bp, Homo sapiens
gccagcaccctctcctgg

SEQ ID NO: 4458416 - DNA, 19 bp, Homo sapiens
gccagcaccctctcctggg

SEQ ID NO: 4458417 - DNA, 20 bp, Homo sapiens
gccagcaccctctcctgggg

SEQ ID NO: 4458418 - DNA, 12 bp, Homo sapiens
gccagcagagcc

SEQ ID NO: 4458419 - DNA, 15 bp, Homo sapiens
gccagcaggcgggct

SEQ ID NO: 4458420 - DNA, 18 bp, Homo sapiens
gccagcattccagacttc

SEQ ID NO: 4458421 - DNA, 12 bp, Homo sapiens
gccagccactgt

SEQ ID NO: 4458422 - DNA, 13 bp, Homo sapiens
gccagcccagccc

SEQ ID NO: 4458423 - DNA, 17 bp, Homo sapiens
gccagcccatggccccc

SEQ ID NO: 4458424 - DNA, 19 bp, Homo sapiens
gccagccccacccaggagg

SEQ ID NO: 4458425 - DNA, 17 bp, Homo sapiens
gccagccccggccctgg

SEQ ID NO: 4458426 - DNA, 19 bp, Homo sapiens
gccagccccggccctgggc

SEQ ID NO: 4458427 - DNA, 15 bp, Homo sapiens
gccagcccctggggc

SEQ ID NO: 4458428 - DNA, 16 bp, Homo sapiens
gccagcccctggggcc

SEQ ID NO: 4458429 - DNA, 21 bp, Homo sapiens
gccagcccctggggcccagcc

SEQ ID NO: 4458430 - DNA, 17 bp, Homo sapiens
gccagccctccctgtcc

SEQ ID NO: 4458431 - DNA, 20 bp, Homo sapiens
gccagccctccctgtcctcc

SEQ ID NO: 4458432 - DNA, 20 bp, Homo sapiens
gccagcccttccctggcccc

SEQ ID NO: 4458433 - DNA, 16 bp, Homo sapiens
gccagcctcagaaggc

SEQ ID NO: 4458434 - DNA, 12 bp, Homo sapiens
gccagcctcctc

SEQ ID NO: 4458435 - DNA, 15 bp, Homo sapiens
gccagcctcctctgg

SEQ ID NO: 4458436 - DNA, 18 bp, Homo sapiens
gccagcctggctctgccc

SEQ ID NO: 4458437 - DNA, 19 bp, Homo sapiens
gccagcctggctctgcccc

SEQ ID NO: 4458438 - DNA, 22 bp, Homo sapiens
gccagcctggctctgccccctc

SEQ ID NO: 4458439 - DNA, 17 bp, Homo sapiens
gccagccttgagccctg

SEQ ID NO: 4458440 - DNA, 19 bp, Homo sapiens
gccagccttgagccctggc

SEQ ID NO: 4458441 - DNA, 20 bp, Homo sapiens
gccagccttgagccctggct

SEQ ID NO: 4458442 - DNA, 22 bp, Homo sapiens
gccagccttgagccctggctgt

SEQ ID NO: 4458443 - DNA, 13 bp, Homo sapiens
gccagcgctgtgg

SEQ ID NO: 4458444 - DNA, 22 bp, Homo sapiens
gccagcgctgtggaccttacaa

SEQ ID NO: 4458445 - DNA, 16 bp, Homo sapiens
gccagcggggctgctc

SEQ ID NO: 4458446 - DNA, 17 bp, Homo sapiens
gccagcggggctgctca

SEQ ID NO: 4458447 - DNA, 13 bp, Homo sapiens
gccagcgtcctcc

SEQ ID NO: 4458448 - DNA, 22 bp, Homo sapiens
gccagcgtcctcctctgtgacc

SEQ ID NO: 4458449 - DNA, 22 bp, Homo sapiens
gccagctaatttttgtattttt

SEQ ID NO: 4458450 - DNA, 16 bp, Homo sapiens
gccagctccatgttct

SEQ ID NO: 4458451 - DNA, 11 bp, Homo sapiens
gccagctgcag

SEQ ID NO: 4458452 - DNA, 17 bp, Homo sapiens
gccagctgccccagcca

SEQ ID NO: 4458453 - DNA, 16 bp, Homo sapiens
gccagctgcccttgca

SEQ ID NO: 4458454 - DNA, 17 bp, Homo sapiens
gccagctggatcgctgc

SEQ ID NO: 4458455 - DNA, 17 bp, Homo sapiens
gccagctgggagcactg

SEQ ID NO: 4458456 - DNA, 14 bp, Homo sapiens
gccagctgtgcact

SEQ ID NO: 4458457 - DNA, 17 bp, Homo sapiens
gccagctgtgcactttc

SEQ ID NO: 4458458 - DNA, 20 bp, Homo sapiens
gccaggaagccagagcccca

SEQ ID NO: 4458459 - DNA, 23 bp, Homo sapiens
gccaggaccctgacctccgcccc

SEQ ID NO: 4458460 - DNA, 18 bp, Homo sapiens
gccaggagcagccctggc

SEQ ID NO: 4458461 - DNA, 20 bp, Homo sapiens
gccaggagctcttcaggcct

SEQ ID NO: 4458462 - DNA, 15 bp, Homo sapiens
gccaggaggctgcca

SEQ ID NO: 4458463 - DNA, 15 bp, Homo sapiens
gccaggagtgccccc

SEQ ID NO: 4458464 - DNA, 14 bp, Homo sapiens
gccaggatggaatg

SEQ ID NO: 4458465 - DNA, 20 bp, Homo sapiens
gccaggcacacacagcccct

SEQ ID NO: 4458466 - DNA, 15 bp, Homo sapiens
gccaggcagatctgt

SEQ ID NO: 4458467 - DNA, 21 bp, Homo sapiens
gccaggcagatctgtgcccca

SEQ ID NO: 4458468 - DNA, 23 bp, Homo sapiens
gccaggcagatctgtgccccatg

SEQ ID NO: 4458469 - DNA, 15 bp, Homo sapiens
gccaggccagcctcc

SEQ ID NO: 4458470 - DNA, 16 bp, Homo sapiens
gccaggcccggggctg

SEQ ID NO: 4458471 - DNA, 21 bp, Homo sapiens
gccaggcccttgtcggcccca

SEQ ID NO: 4458472 - DNA, 16 bp, Homo sapiens
gccaggcctctgctgg

SEQ ID NO: 4458473 - DNA, 19 bp, Homo sapiens
gccaggcctctgctggctc

SEQ ID NO: 4458474 - DNA, 11 bp, Homo sapiens
gccaggcctgg

SEQ ID NO: 4458475 - DNA, 15 bp, Homo sapiens
gccaggcctggctgg

SEQ ID NO: 4458476 - DNA, 20 bp, Homo sapiens
gccaggctgcctcctgccct

SEQ ID NO: 4458477 - DNA, 11 bp, Homo sapiens
gccagggagct

SEQ ID NO: 4458478 - DNA, 23 bp, Homo sapiens
gccagggaggaaggaggccacgg

SEQ ID NO: 4458479 - DNA, 23 bp, Homo sapiens
gccagggatgggcagcccaacag

SEQ ID NO: 4458480 - DNA, 20 bp, Homo sapiens
gccagggcaagagagcgaga

SEQ ID NO: 4458481 - DNA, 16 bp, Homo sapiens
gccagggcagagtgag

SEQ ID NO: 4458482 - DNA, 21 bp, Homo sapiens
gccagggcagggcgagctgca

SEQ ID NO: 4458483 - DNA, 19 bp, Homo sapiens
gccagggccacgctccagc

SEQ ID NO: 4458484 - DNA, 24 bp, Homo sapiens
gccagggctggggttgccagaggc

SEQ ID NO: 4458485 - DNA, 13 bp, Homo sapiens
gccaggggtgctc

SEQ ID NO: 4458486 - DNA, 18 bp, Homo sapiens
gccaggggtgctcctgtg

SEQ ID NO: 4458487 - DNA, 19 bp, Homo sapiens
gccagggtttacccagtgg

SEQ ID NO: 4458488 - DNA, 15 bp, Homo sapiens
gccaggtaatgtgaa

SEQ ID NO: 4458489 - DNA, 19 bp, Homo sapiens
gccaggtgcaatctactgg

SEQ ID NO: 4458490 - DNA, 12 bp, Homo sapiens
gccaggtgcctt

SEQ ID NO: 4458491 - DNA, 17 bp, Homo sapiens
gccaggtggcacctgca

SEQ ID NO: 4458492 - DNA, 18 bp, Homo sapiens
gccaggtggcacctgcag

SEQ ID NO: 4458493 - DNA, 18 bp, Homo sapiens
gccaggttaggaaggcag

SEQ ID NO: 4458494 - DNA, 22 bp, Homo sapiens
gccagtagcctaaatctccagt

SEQ ID NO: 4458495 - DNA, 17 bp, Homo sapiens
gccagtatttttaaagg

SEQ ID NO: 4458496 - DNA, 22 bp, Homo sapiens
gccagtccccgaggagctgggc

SEQ ID NO: 4458497 - DNA, 23 bp, Homo sapiens
gccagtccccgaggagctgggcc

SEQ ID NO: 4458498 - DNA, 22 bp, Homo sapiens
gccagtcctagctgcacagggc

SEQ ID NO: 4458499 - DNA, 17 bp, Homo sapiens
gccagtcctgcctggcc

SEQ ID NO: 4458500 - DNA, 21 bp, Homo sapiens
gccagtgaagtccttcagtga

SEQ ID NO: 4458501 - DNA, 14 bp, Homo sapiens
gccagtgcagccac

SEQ ID NO: 4458502 - DNA, 12 bp, Homo sapiens
gccagtgcctgg

SEQ ID NO: 4458503 - DNA, 13 bp, Homo sapiens
gccagtgccttat

SEQ ID NO: 4458504 - DNA, 14 bp, Homo sapiens
gccagtggctggat

SEQ ID NO: 4458505 - DNA, 17 bp, Homo sapiens
gccagtgtttaaaactt

SEQ ID NO: 4458506 - DNA, 22 bp, Homo sapiens
gccataaaattgcagtttcatg

SEQ ID NO: 4458507 - DNA, 13 bp, Homo sapiens
gccataattatga

SEQ ID NO: 4458508 - DNA, 15 bp, Homo sapiens
gccatactgcgtcca

SEQ ID NO: 4458509 - DNA, 23 bp, Homo sapiens
gccatactgcgtccaccctgagc

SEQ ID NO: 4458510 - DNA, 20 bp, Homo sapiens
gccatacttatctctctgtg

SEQ ID NO: 4458511 - DNA, 17 bp, Homo sapiens
gccatagtcaaagagag

SEQ ID NO: 4458512 - DNA, 19 bp, Homo sapiens
gccatatatgaccagaagc

SEQ ID NO: 4458513 - DNA, 23 bp, Homo sapiens
gccatatatgaccagaagccttg

SEQ ID NO: 4458514 - DNA, 18 bp, Homo sapiens
gccatatatgctgtattt

SEQ ID NO: 4458515 - DNA, 17 bp, Homo sapiens
gccatattttcaccatt

SEQ ID NO: 4458516 - DNA, 19 bp, Homo sapiens
gccatcaagcacttcccag

SEQ ID NO: 4458517 - DNA, 21 bp, Homo sapiens
gccatcaagcacttcccagga

SEQ ID NO: 4458518 - DNA, 17 bp, Homo sapiens
gccatcacttctccccg

SEQ ID NO: 4458519 - DNA, 12 bp, Homo sapiens
gccatcatcctc

SEQ ID NO: 4458520 - DNA, 23 bp, Homo sapiens
gccatcatctcctgccttcctcc

SEQ ID NO: 4458521 - DNA, 21 bp, Homo sapiens
gccatcatgtttacagaggac

SEQ ID NO: 4458522 - DNA, 16 bp, Homo sapiens
gccatccctgggcccc

SEQ ID NO: 4458523 - DNA, 23 bp, Homo sapiens
gccatcctcaaacgacagaggag

SEQ ID NO: 4458524 - DNA, 13 bp, Homo sapiens
gccatcctccctc

SEQ ID NO: 4458525 - DNA, 15 bp, Homo sapiens
gccatcctccctcca

SEQ ID NO: 4458526 - DNA, 18 bp, Homo sapiens
gccatcctggcccagggc

SEQ ID NO: 4458527 - DNA, 13 bp, Homo sapiens
gccatcgtcctgg

SEQ ID NO: 4458528 - DNA, 16 bp, Homo sapiens
gccatcgtcctgggac

SEQ ID NO: 4458529 - DNA, 15 bp, Homo sapiens
gccatctccctcccc

SEQ ID NO: 4458530 - DNA, 22 bp, Homo sapiens
gccatctccctccccagaaaca

SEQ ID NO: 4458531 - DNA, 17 bp, Homo sapiens
gccatgacagaggctgc

SEQ ID NO: 4458532 - DNA, 18 bp, Homo sapiens
gccatgagccgcccaagg

SEQ ID NO: 4458533 - DNA, 20 bp, Homo sapiens
gccatgagttccagaaagta

SEQ ID NO: 4458534 - DNA, 19 bp, Homo sapiens
gccatgatttcccactgca

SEQ ID NO: 4458535 - DNA, 15 bp, Homo sapiens
gccatgcagaaagca

SEQ ID NO: 4458536 - DNA, 16 bp, Homo sapiens
gccatgccaggaacct

SEQ ID NO: 4458537 - DNA, 18 bp, Homo sapiens
gccatgccaggaacctgt

SEQ ID NO: 4458538 - DNA, 21 bp, Homo sapiens
gccatgcctatgggccagagt

SEQ ID NO: 4458539 - DNA, 13 bp, Homo sapiens
gccatgctgggcc

SEQ ID NO: 4458540 - DNA, 15 bp, Homo sapiens
gccatgctttgagtc

SEQ ID NO: 4458541 - DNA, 20 bp, Homo sapiens
gccatggcaggacagctcct

SEQ ID NO: 4458542 - DNA, 16 bp, Homo sapiens
gccatggggtccatcc

SEQ ID NO: 4458543 - DNA, 19 bp, Homo sapiens
gccatgttaatatttgaat

SEQ ID NO: 4458544 - DNA, 14 bp, Homo sapiens
gccattacccagtg

SEQ ID NO: 4458545 - DNA, 14 bp, Homo sapiens
gccattctgtgcag

SEQ ID NO: 4458546 - DNA, 18 bp, Homo sapiens
gccattctgtgcaggctg

SEQ ID NO: 4458547 - DNA, 23 bp, Homo sapiens
gccattctgtgcaggctgcagtg

SEQ ID NO: 4458548 - DNA, 22 bp, Homo sapiens
gccattgggaccctccagtgct

SEQ ID NO: 4458549 - DNA, 19 bp, Homo sapiens
gccattgtactccagcctg

SEQ ID NO: 4458550 - DNA, 20 bp, Homo sapiens
gccattgtactccagcctgg

SEQ ID NO: 4458551 - DNA, 14 bp, Homo sapiens
gccatttatttcct

SEQ ID NO: 4458552 - DNA, 16 bp, Homo sapiens
gccatttctgaactgt

SEQ ID NO: 4458553 - DNA, 20 bp, Homo sapiens
gccatttctgaactgttaca

SEQ ID NO: 4458554 - DNA, 14 bp, Homo sapiens
gccatttgtcccaa

SEQ ID NO: 4458555 - DNA, 15 bp, Homo sapiens
gccattttggtgctt

SEQ ID NO: 4458556 - DNA, 22 bp, Homo sapiens
gcccaaacagctgtatttatat

SEQ ID NO: 4458557 - DNA, 19 bp, Homo sapiens
gcccaaccatcggtccaca

SEQ ID NO: 4458558 - DNA, 14 bp, Homo sapiens
gcccaaccctgtct

SEQ ID NO: 4458559 - DNA, 19 bp, Homo sapiens
gcccaagacagatgcccca

SEQ ID NO: 4458560 - DNA, 19 bp, Homo sapiens
gcccaagaggtctgagccc

SEQ ID NO: 4458561 - DNA, 16 bp, Homo sapiens
gcccaaggccttcccc

SEQ ID NO: 4458562 - DNA, 16 bp, Homo sapiens
gcccaaggcggcccct

SEQ ID NO: 4458563 - DNA, 17 bp, Homo sapiens
gcccaaggcggcccctc

SEQ ID NO: 4458564 - DNA, 14 bp, Homo sapiens
gcccaaggctcccg

SEQ ID NO: 4458565 - DNA, 17 bp, Homo sapiens
gcccaaggtcagggagg

SEQ ID NO: 4458566 - DNA, 17 bp, Homo sapiens
gcccaaggtgctgatgt

SEQ ID NO: 4458567 - DNA, 14 bp, Homo sapiens
gcccaatgaaatga

SEQ ID NO: 4458568 - DNA, 14 bp, Homo sapiens
gcccaatgaattat

SEQ ID NO: 4458569 - DNA, 14 bp, Homo sapiens
gcccaattggagga

SEQ ID NO: 4458570 - DNA, 15 bp, Homo sapiens
gcccaattggaggaa

SEQ ID NO: 4458571 - DNA, 14 bp, Homo sapiens
gcccacaaactgat

SEQ ID NO: 4458572 - DNA, 21 bp, Homo sapiens
gcccacaaactgatttctcac

SEQ ID NO: 4458573 - DNA, 20 bp, Homo sapiens
gcccacaagccttactcacc

SEQ ID NO: 4458574 - DNA, 20 bp, Homo sapiens
gcccacagaaagccaggagc

SEQ ID NO: 4458575 - DNA, 15 bp, Homo sapiens
gcccacagagcctga

SEQ ID NO: 4458576 - DNA, 16 bp, Homo sapiens
gcccacagctcccacc

SEQ ID NO: 4458577 - DNA, 15 bp, Homo sapiens
gcccacagtatattt

SEQ ID NO: 4458578 - DNA, 17 bp, Homo sapiens
gcccaccaacatcccat

SEQ ID NO: 4458579 - DNA, 21 bp, Homo sapiens
gcccaccagacgtcaggccct

SEQ ID NO: 4458580 - DNA, 15 bp, Homo sapiens
gcccaccagccttgc

SEQ ID NO: 4458581 - DNA, 17 bp, Homo sapiens
gcccaccagccttgctc

SEQ ID NO: 4458582 - DNA, 19 bp, Homo sapiens
gcccaccagccttgctctc

SEQ ID NO: 4458583 - DNA, 22 bp, Homo sapiens
gcccacccagtccatgctccag

SEQ ID NO: 4458584 - DNA, 17 bp, Homo sapiens
gcccacccccctcccca

SEQ ID NO: 4458585 - DNA, 14 bp, Homo sapiens
gcccaccccctgcc

SEQ ID NO: 4458586 - DNA, 19 bp, Homo sapiens
gcccaccccctgccctgca

SEQ ID NO: 4458587 - DNA, 13 bp, Homo sapiens
gcccaccccgctc

SEQ ID NO: 4458588 - DNA, 18 bp, Homo sapiens
gcccaccccgctctgcat

SEQ ID NO: 4458589 - DNA, 19 bp, Homo sapiens
gcccaccctcctgtcttcc

SEQ ID NO: 4458590 - DNA, 20 bp, Homo sapiens
gcccaccctcctgtcttccc

SEQ ID NO: 4458591 - DNA, 14 bp, Homo sapiens
gcccacctgcccat

SEQ ID NO: 4458592 - DNA, 15 bp, Homo sapiens
gcccacctgcccatc

SEQ ID NO: 4458593 - DNA, 20 bp, Homo sapiens
gcccacctgcccatcacagg

SEQ ID NO: 4458594 - DNA, 22 bp, Homo sapiens
gcccacgtcaggcctggcctca

SEQ ID NO: 4458595 - DNA, 18 bp, Homo sapiens
gcccactccccagcccca

SEQ ID NO: 4458596 - DNA, 19 bp, Homo sapiens
gcccactccccagccccag

SEQ ID NO: 4458597 - DNA, 12 bp, Homo sapiens
gcccactcctgg

SEQ ID NO: 4458598 - DNA, 20 bp, Homo sapiens
gcccactgaggggccaggga

SEQ ID NO: 4458599 - DNA, 22 bp, Homo sapiens
gcccactgctcgtggactgtgc

SEQ ID NO: 4458600 - DNA, 14 bp, Homo sapiens
gcccagaagcctga

SEQ ID NO: 4458601 - DNA, 20 bp, Homo sapiens
gcccagaataagttattgca

SEQ ID NO: 4458602 - DNA, 23 bp, Homo sapiens
gcccagaataagttattgcagtt

SEQ ID NO: 4458603 - DNA, 18 bp, Homo sapiens
gcccagacaccatgtgca

SEQ ID NO: 4458604 - DNA, 22 bp, Homo sapiens
gcccagactgatgagcacatct

SEQ ID NO: 4458605 - DNA, 18 bp, Homo sapiens
gcccagagatgcctccac

SEQ ID NO: 4458606 - DNA, 19 bp, Homo sapiens
gcccagagatgcctccacc

SEQ ID NO: 4458607 - DNA, 13 bp, Homo sapiens
gcccagagctgag

SEQ ID NO: 4458608 - DNA, 14 bp, Homo sapiens
gcccagagctgagt

SEQ ID NO: 4458609 - DNA, 16 bp, Homo sapiens
gcccagaggagggcag

SEQ ID NO: 4458610 - DNA, 12 bp, Homo sapiens
gcccagagtgag

SEQ ID NO: 4458611 - DNA, 20 bp, Homo sapiens
gcccagagtgagctttagct

SEQ ID NO: 4458612 - DNA, 20 bp, Homo sapiens
gcccagcactgcttgaggaa

SEQ ID NO: 4458613 - DNA, 21 bp, Homo sapiens
gcccagcactgcttgaggaaa

SEQ ID NO: 4458614 - DNA, 22 bp, Homo sapiens
gcccagcagtgtggagaccctg

SEQ ID NO: 4458615 - DNA, 13 bp, Homo sapiens
gcccagccaggcc

SEQ ID NO: 4458616 - DNA, 13 bp, Homo sapiens
gcccagcccagag

SEQ ID NO: 4458617 - DNA, 17 bp, Homo sapiens
gcccagcccagagccac

SEQ ID NO: 4458618 - DNA, 21 bp, Homo sapiens
gcccagcccccacagtgctgt

SEQ ID NO: 4458619 - DNA, 19 bp, Homo sapiens
gcccagcccctgtttactg

SEQ ID NO: 4458620 - DNA, 13 bp, Homo sapiens
gcccagccctgct

SEQ ID NO: 4458621 - DNA, 21 bp, Homo sapiens
gcccagccctgctggccgcct

SEQ ID NO: 4458622 - DNA, 12 bp, Homo sapiens
gcccagccctgg

SEQ ID NO: 4458623 - DNA, 13 bp, Homo sapiens
gcccagccctggc

SEQ ID NO: 4458624 - DNA, 13 bp, Homo sapiens
gcccagccgggca

SEQ ID NO: 4458625 - DNA, 12 bp, Homo sapiens
gcccagcctctc

SEQ ID NO: 4458626 - DNA, 13 bp, Homo sapiens
gcccagcctctcc

SEQ ID NO: 4458627 - DNA, 14 bp, Homo sapiens
gcccagcctggatg

SEQ ID NO: 4458628 - DNA, 21 bp, Homo sapiens
gcccagcctgggagcccagag

SEQ ID NO: 4458629 - DNA, 14 bp, Homo sapiens
gcccagctgctccc

SEQ ID NO: 4458630 - DNA, 23 bp, Homo sapiens
gcccaggaaaggacggctgagca

SEQ ID NO: 4458631 - DNA, 15 bp, Homo sapiens
gcccaggagagccag

SEQ ID NO: 4458632 - DNA, 14 bp, Homo sapiens
gcccaggagcctca

SEQ ID NO: 4458633 - DNA, 18 bp, Homo sapiens
gcccaggagcctcactgg

SEQ ID NO: 4458634 - DNA, 15 bp, Homo sapiens
gcccaggagtccagg

SEQ ID NO: 4458635 - DNA, 20 bp, Homo sapiens
gcccaggagtttgaggctgc

SEQ ID NO: 4458636 - DNA, 22 bp, Homo sapiens
gcccaggatactggcacagagg

SEQ ID NO: 4458637 - DNA, 15 bp, Homo sapiens
gcccaggccacagag

SEQ ID NO: 4458638 - DNA, 15 bp, Homo sapiens
gcccaggccaggtgc

SEQ ID NO: 4458639 - DNA, 22 bp, Homo sapiens
gcccaggctggactgcagtggc

SEQ ID NO: 4458640 - DNA, 13 bp, Homo sapiens
gcccaggctggga

SEQ ID NO: 4458641 - DNA, 15 bp, Homo sapiens
gcccaggctgggaac

SEQ ID NO: 4458642 - DNA, 17 bp, Homo sapiens
gcccagggaagcctggg

SEQ ID NO: 4458643 - DNA, 14 bp, Homo sapiens
gcccagggaataag

SEQ ID NO: 4458644 - DNA, 19 bp, Homo sapiens
gcccagggacaccagccag

SEQ ID NO: 4458645 - DNA, 20 bp, Homo sapiens
gcccagggacaccagccagg

SEQ ID NO: 4458646 - DNA, 14 bp, Homo sapiens
gcccagggcatctg

SEQ ID NO: 4458647 - DNA, 14 bp, Homo sapiens
gcccagtacattta

SEQ ID NO: 4458648 - DNA, 14 bp, Homo sapiens
gcccagtgaagcct

SEQ ID NO: 4458649 - DNA, 17 bp, Homo sapiens
gcccagtgaagcctctg

SEQ ID NO: 4458650 - DNA, 13 bp, Homo sapiens
gcccagtgagccc

SEQ ID NO: 4458651 - DNA, 18 bp, Homo sapiens
gcccagtgagccctgctc

SEQ ID NO: 4458652 - DNA, 22 bp, Homo sapiens
gcccagtgagccctgctcttct

SEQ ID NO: 4458653 - DNA, 22 bp, Homo sapiens
gcccatcacagggttgggccca

SEQ ID NO: 4458654 - DNA, 18 bp, Homo sapiens
gcccatgatataacttta

SEQ ID NO: 4458655 - DNA, 17 bp, Homo sapiens
gcccatggcccccaata

SEQ ID NO: 4458656 - DNA, 23 bp, Homo sapiens
gcccatggcccccaataaaggca

SEQ ID NO: 4458657 - DNA, 18 bp, Homo sapiens
gcccatgtgtcccctcac

SEQ ID NO: 4458658 - DNA, 19 bp, Homo sapiens
gcccatgtgtcccctcact

SEQ ID NO: 4458659 - DNA, 12 bp, Homo sapiens
gcccattcctgc

SEQ ID NO: 4458660 - DNA, 16 bp, Homo sapiens
gcccattcctgcctgg

SEQ ID NO: 4458661 - DNA, 14 bp, Homo sapiens
gcccattctctctc

SEQ ID NO: 4458662 - DNA, 15 bp, Homo sapiens
gcccattctctctcc

SEQ ID NO: 4458663 - DNA, 14 bp, Homo sapiens
gcccattcttctgg

SEQ ID NO: 4458664 - DNA, 16 bp, Homo sapiens
gcccattggccgagct

SEQ ID NO: 4458665 - DNA, 20 bp, Homo sapiens
gcccattggccgagctcctg

SEQ ID NO: 4458666 - DNA, 21 bp, Homo sapiens
gcccattggccgagctcctgg

SEQ ID NO: 4458667 - DNA, 22 bp, Homo sapiens
gcccattggccgagctcctggg

SEQ ID NO: 4458668 - DNA, 11 bp, Homo sapiens
gccccaaaagg

SEQ ID NO: 4458669 - DNA, 14 bp, Homo sapiens
gccccaactcctgg

SEQ ID NO: 4458670 - DNA, 17 bp, Homo sapiens
gccccaactcctggaag

SEQ ID NO: 4458671 - DNA, 22 bp, Homo sapiens
gccccaagaggggcgggctcag

SEQ ID NO: 4458672 - DNA, 23 bp, Homo sapiens
gccccaagaggggcgggctcaga

SEQ ID NO: 4458673 - DNA, 19 bp, Homo sapiens
gccccaaggtttacatagt

SEQ ID NO: 4458674 - DNA, 19 bp, Homo sapiens
gccccaatcttgcccactg

SEQ ID NO: 4458675 - DNA, 21 bp, Homo sapiens
gccccacagcctggcacgaag

SEQ ID NO: 4458676 - DNA, 20 bp, Homo sapiens
gccccacatgcatgtctgcc

SEQ ID NO: 4458677 - DNA, 20 bp, Homo sapiens
gccccaccacgtcgggcttc

SEQ ID NO: 4458678 - DNA, 17 bp, Homo sapiens
gccccaccagtgcctct

SEQ ID NO: 4458679 - DNA, 21 bp, Homo sapiens
gccccaccccatccagccaga

SEQ ID NO: 4458680 - DNA, 22 bp, Homo sapiens
gccccaccccatccagccagac

SEQ ID NO: 4458681 - DNA, 18 bp, Homo sapiens
gccccacctgaagggtgg

SEQ ID NO: 4458682 - DNA, 20 bp, Homo sapiens
gccccacggagacagaggaa

SEQ ID NO: 4458683 - DNA, 23 bp, Homo sapiens
gccccacggagacagaggaaagg

SEQ ID NO: 4458684 - DNA, 14 bp, Homo sapiens
gccccacttcaccc

SEQ ID NO: 4458685 - DNA, 17 bp, Homo sapiens
gccccacttcaccccca

SEQ ID NO: 4458686 - DNA, 18 bp, Homo sapiens
gccccacttcacccccaa

SEQ ID NO: 4458687 - DNA, 21 bp, Homo sapiens
gccccagacagggtgggcttc

SEQ ID NO: 4458688 - DNA, 12 bp, Homo sapiens
gccccagagctg

SEQ ID NO: 4458689 - DNA, 22 bp, Homo sapiens
gccccagagctgtttatggcct

SEQ ID NO: 4458690 - DNA, 17 bp, Homo sapiens
gccccagagtggcccac

SEQ ID NO: 4458691 - DNA, 14 bp, Homo sapiens
gccccagcccaccc

SEQ ID NO: 4458692 - DNA, 15 bp, Homo sapiens
gccccagcccaccct

SEQ ID NO: 4458693 - DNA, 21 bp, Homo sapiens
gccccagcccaccctcctgtc

SEQ ID NO: 4458694 - DNA, 10 bp, Homo sapiens
gccccagcct

SEQ ID NO: 4458695 - DNA, 16 bp, Homo sapiens
gccccagcctccaggc

SEQ ID NO: 4458696 - DNA, 14 bp, Homo sapiens
gccccagcctgggc

SEQ ID NO: 4458697 - DNA, 15 bp, Homo sapiens
gccccagcctgggcc

SEQ ID NO: 4458698 - DNA, 11 bp, Homo sapiens
gccccaggaga

SEQ ID NO: 4458699 - DNA, 13 bp, Homo sapiens
gccccaggagaag

SEQ ID NO: 4458700 - DNA, 15 bp, Homo sapiens
gccccaggccagctg

SEQ ID NO: 4458701 - DNA, 18 bp, Homo sapiens
gccccaggccccagacag

SEQ ID NO: 4458702 - DNA, 19 bp, Homo sapiens
gccccaggccccagacagg

SEQ ID NO: 4458703 - DNA, 13 bp, Homo sapiens
gccccaggccctc

SEQ ID NO: 4458704 - DNA, 14 bp, Homo sapiens
gccccaggccctcc

SEQ ID NO: 4458705 - DNA, 15 bp, Homo sapiens
gccccaggccctccc

SEQ ID NO: 4458706 - DNA, 17 bp, Homo sapiens
gccccagggagtccagg

SEQ ID NO: 4458707 - DNA, 20 bp, Homo sapiens
gccccagggagtccagggtt

SEQ ID NO: 4458708 - DNA, 16 bp, Homo sapiens
gccccagggtcttccc

SEQ ID NO: 4458709 - DNA, 20 bp, Homo sapiens
gccccagggtcttccctacc

SEQ ID NO: 4458710 - DNA, 16 bp, Homo sapiens
gccccatcagaacctg

SEQ ID NO: 4458711 - DNA, 19 bp, Homo sapiens
gccccatcagaacctgagc

SEQ ID NO: 4458712 - DNA, 15 bp, Homo sapiens
gccccatccctgctt

SEQ ID NO: 4458713 - DNA, 17 bp, Homo sapiens
gccccatcctcatccct

SEQ ID NO: 4458714 - DNA, 16 bp, Homo sapiens
gccccatcggccaaga

SEQ ID NO: 4458715 - DNA, 20 bp, Homo sapiens
gccccatcttgatctttgag

SEQ ID NO: 4458716 - DNA, 15 bp, Homo sapiens
gccccatgtctctca

SEQ ID NO: 4458717 - DNA, 16 bp, Homo sapiens
gccccatgtctctcag

SEQ ID NO: 4458718 - DNA, 15 bp, Homo sapiens
gccccattcctggga

SEQ ID NO: 4458719 - DNA, 19 bp, Homo sapiens
gccccattccttgcgcctc

SEQ ID NO: 4458720 - DNA, 17 bp, Homo sapiens
gcccccaacccctcctc

SEQ ID NO: 4458721 - DNA, 20 bp, Homo sapiens
gcccccaacccctcctccct

SEQ ID NO: 4458722 - DNA, 16 bp, Homo sapiens
gcccccaacctcaggg

SEQ ID NO: 4458723 - DNA, 19 bp, Homo sapiens
gcccccaacctcagggctc

SEQ ID NO: 4458724 - DNA, 20 bp, Homo sapiens
gcccccaactccgcccagcc

SEQ ID NO: 4458725 - DNA, 17 bp, Homo sapiens
gcccccaataaaccagt

SEQ ID NO: 4458726 - DNA, 18 bp, Homo sapiens
gcccccaataaaccagtg

SEQ ID NO: 4458727 - DNA, 13 bp, Homo sapiens
gcccccaataaag

SEQ ID NO: 4458728 - DNA, 15 bp, Homo sapiens
gcccccacagtgctg

SEQ ID NO: 4458729 - DNA, 21 bp, Homo sapiens
gcccccaccccttcctgtctc

SEQ ID NO: 4458730 - DNA, 20 bp, Homo sapiens
gcccccaccgaggttcccag

SEQ ID NO: 4458731 - DNA, 21 bp, Homo sapiens
gcccccaccgaggttcccagg

SEQ ID NO: 4458732 - DNA, 20 bp, Homo sapiens
gcccccaccggaactgggct

SEQ ID NO: 4458733 - DNA, 19 bp, Homo sapiens
gcccccagaaagcctcctg

SEQ ID NO: 4458734 - DNA, 12 bp, Homo sapiens
gcccccaggact

SEQ ID NO: 4458735 - DNA, 17 bp, Homo sapiens
gcccccaggactgggcc

SEQ ID NO: 4458736 - DNA, 22 bp, Homo sapiens
gcccccagtccccacccctgcc

SEQ ID NO: 4458737 - DNA, 17 bp, Homo sapiens
gcccccatcagccctgc

SEQ ID NO: 4458738 - DNA, 19 bp, Homo sapiens
gcccccatcagccctgcta

SEQ ID NO: 4458739 - DNA, 13 bp, Homo sapiens
gccccccagctcc

SEQ ID NO: 4458740 - DNA, 14 bp, Homo sapiens
gccccccagctccc

SEQ ID NO: 4458741 - DNA, 15 bp, Homo sapiens
gccccccagctccca

SEQ ID NO: 4458742 - DNA, 20 bp, Homo sapiens
gccccccgcgcgcccaccct

SEQ ID NO: 4458743 - DNA, 23 bp, Homo sapiens
gccccccgcgctcgcccagcagg

SEQ ID NO: 4458744 - DNA, 21 bp, Homo sapiens
gcccccctagcaatacaggga

SEQ ID NO: 4458745 - DNA, 22 bp, Homo sapiens
gcccccctagcaatacagggag

SEQ ID NO: 4458746 - DNA, 14 bp, Homo sapiens
gcccccctcctcca

SEQ ID NO: 4458747 - DNA, 15 bp, Homo sapiens
gcccccctcctccag

SEQ ID NO: 4458748 - DNA, 16 bp, Homo sapiens
gcccccctcctccagt

SEQ ID NO: 4458749 - DNA, 13 bp, Homo sapiens
gcccccctgctgc

SEQ ID NO: 4458750 - DNA, 17 bp, Homo sapiens
gcccccgagccctgact

SEQ ID NO: 4458751 - DNA, 20 bp, Homo sapiens
gcccccgagccctgactcct

SEQ ID NO: 4458752 - DNA, 13 bp, Homo sapiens
gcccccgccccag

SEQ ID NO: 4458753 - DNA, 21 bp, Homo sapiens
gcccccgccccagagtggccc

SEQ ID NO: 4458754 - DNA, 18 bp, Homo sapiens
gcccccgcgggttctaga

SEQ ID NO: 4458755 - DNA, 21 bp, Homo sapiens
gcccccgctcccgctcccagg

SEQ ID NO: 4458756 - DNA, 16 bp, Homo sapiens
gcccccggccaaggac

SEQ ID NO: 4458757 - DNA, 17 bp, Homo sapiens
gcccccggccaaggacc

SEQ ID NO: 4458758 - DNA, 16 bp, Homo sapiens
gccccctcatctgcag

SEQ ID NO: 4458759 - DNA, 22 bp, Homo sapiens
gccccctcccaccgctgcctcg

SEQ ID NO: 4458760 - DNA, 17 bp, Homo sapiens
gccccctgtggatgctg

SEQ ID NO: 4458761 - DNA, 18 bp, Homo sapiens
gccccctttcagatgtct

SEQ ID NO: 4458762 - DNA, 18 bp, Homo sapiens
gccccctttgggcccagg

SEQ ID NO: 4458763 - DNA, 17 bp, Homo sapiens
gccccgactccagccag

SEQ ID NO: 4458764 - DNA, 21 bp, Homo sapiens
gccccgaggacccagacccag

SEQ ID NO: 4458765 - DNA, 14 bp, Homo sapiens
gccccgcacgactg

SEQ ID NO: 4458766 - DNA, 22 bp, Homo sapiens
gccccgcacgactgcgggagcc

SEQ ID NO: 4458767 - DNA, 13 bp, Homo sapiens
gccccgccagggc

SEQ ID NO: 4458768 - DNA, 20 bp, Homo sapiens
gccccgccagggctggggac

SEQ ID NO: 4458769 - DNA, 16 bp, Homo sapiens
gccccgcccctgcccc

SEQ ID NO: 4458770 - DNA, 21 bp, Homo sapiens
gccccggaggagctgggccag

SEQ ID NO: 4458771 - DNA, 15 bp, Homo sapiens
gccccggcaagccac

SEQ ID NO: 4458772 - DNA, 16 bp, Homo sapiens
gccccggggccccctg

SEQ ID NO: 4458773 - DNA, 14 bp, Homo sapiens
gccccggtccccca

SEQ ID NO: 4458774 - DNA, 18 bp, Homo sapiens
gccccggtcccccagagc

SEQ ID NO: 4458775 - DNA, 20 bp, Homo sapiens
gccccggtcccccagagcat

SEQ ID NO: 4458776 - DNA, 23 bp, Homo sapiens
gccccgtcggactgcccccagaa

SEQ ID NO: 4458777 - DNA, 23 bp, Homo sapiens
gccccgtctctcttggacccacc

SEQ ID NO: 4458778 - DNA, 17 bp, Homo sapiens
gccccgtggggttcctc

SEQ ID NO: 4458779 - DNA, 23 bp, Homo sapiens
gccccgtgggtgggcctggccct

SEQ ID NO: 4458780 - DNA, 14 bp, Homo sapiens
gccccgtgtttgcg

SEQ ID NO: 4458781 - DNA, 18 bp, Homo sapiens
gcccctatagcactgagc

SEQ ID NO: 4458782 - DNA, 15 bp, Homo sapiens
gcccctccacgcctc

SEQ ID NO: 4458783 - DNA, 21 bp, Homo sapiens
gcccctccacgcctcctggcc

SEQ ID NO: 4458784 - DNA, 13 bp, Homo sapiens
gcccctccaggag

SEQ ID NO: 4458785 - DNA, 14 bp, Homo sapiens
gcccctccatccac

SEQ ID NO: 4458786 - DNA, 13 bp, Homo sapiens
gcccctcccacgc

SEQ ID NO: 4458787 - DNA, 16 bp, Homo sapiens
gcccctccccagactc

SEQ ID NO: 4458788 - DNA, 20 bp, Homo sapiens
gcccctccccagactctcag

SEQ ID NO: 4458789 - DNA, 13 bp, Homo sapiens
gcccctccccagc

SEQ ID NO: 4458790 - DNA, 22 bp, Homo sapiens
gcccctcccccaacccccaccc

SEQ ID NO: 4458791 - DNA, 16 bp, Homo sapiens
gcccctcccctgcaga

SEQ ID NO: 4458792 - DNA, 14 bp, Homo sapiens
gcccctccctacct

SEQ ID NO: 4458793 - DNA, 18 bp, Homo sapiens
gcccctccctacctcaac

SEQ ID NO: 4458794 - DNA, 13 bp, Homo sapiens
gcccctcctccct

SEQ ID NO: 4458795 - DNA, 22 bp, Homo sapiens
gcccctcctccctcagacccag

SEQ ID NO: 4458796 - DNA, 18 bp, Homo sapiens
gcccctcctctgccacct

SEQ ID NO: 4458797 - DNA, 22 bp, Homo sapiens
gcccctccttttggcctggggg

SEQ ID NO: 4458798 - DNA, 14 bp, Homo sapiens
gcccctctcaccaa

SEQ ID NO: 4458799 - DNA, 16 bp, Homo sapiens
gcccctctgccttgcc

SEQ ID NO: 4458800 - DNA, 19 bp, Homo sapiens
gcccctgagagcctgtgga

SEQ ID NO: 4458801 - DNA, 15 bp, Homo sapiens
gcccctgcacaggca

SEQ ID NO: 4458802 - DNA, 16 bp, Homo sapiens
gcccctgcacaggcac

SEQ ID NO: 4458803 - DNA, 19 bp, Homo sapiens
gcccctgcagattctgagc

SEQ ID NO: 4458804 - DNA, 15 bp, Homo sapiens
gcccctgcagctgga

SEQ ID NO: 4458805 - DNA, 14 bp, Homo sapiens
gcccctgcctccaa

SEQ ID NO: 4458806 - DNA, 19 bp, Homo sapiens
gcccctgcctgtgcccgca

SEQ ID NO: 4458807 - DNA, 17 bp, Homo sapiens
gcccctgctcactgggc

SEQ ID NO: 4458808 - DNA, 20 bp, Homo sapiens
gcccctgctcactgggcccg

SEQ ID NO: 4458809 - DNA, 19 bp, Homo sapiens
gcccctggaggctgcctcc

SEQ ID NO: 4458810 - DNA, 22 bp, Homo sapiens
gcccctggaggctgcctcccaa

SEQ ID NO: 4458811 - DNA, 19 bp, Homo sapiens
gcccctggctttgcctctt

SEQ ID NO: 4458812 - DNA, 20 bp, Homo sapiens
gcccctggctttgcctcttc

SEQ ID NO: 4458813 - DNA, 15 bp, Homo sapiens
gcccctgggatggga

SEQ ID NO: 4458814 - DNA, 22 bp, Homo sapiens
gcccctgggatgggaccaggga

SEQ ID NO: 4458815 - DNA, 18 bp, Homo sapiens
gcccctgggcttggcctg

SEQ ID NO: 4458816 - DNA, 20 bp, Homo sapiens
gcccctgggcttggcctgct

SEQ ID NO: 4458817 - DNA, 12 bp, Homo sapiens
gcccctggggac

SEQ ID NO: 4458818 - DNA, 16 bp, Homo sapiens
gcccctggggcccagc

SEQ ID NO: 4458819 - DNA, 20 bp, Homo sapiens
gcccctggggcccagcccct

SEQ ID NO: 4458820 - DNA, 20 bp, Homo sapiens
gcccctggtaagcagaggct

SEQ ID NO: 4458821 - DNA, 20 bp, Homo sapiens
gcccctgtctgttcccagcc

SEQ ID NO: 4458822 - DNA, 21 bp, Homo sapiens
gccccttaaacacaggctgtc

SEQ ID NO: 4458823 - DNA, 20 bp, Homo sapiens
gccccttccctctctccctg

SEQ ID NO: 4458824 - DNA, 23 bp, Homo sapiens
gccccttccctctctccctgcct

SEQ ID NO: 4458825 - DNA, 21 bp, Homo sapiens
gccccttctacactctcctgg

SEQ ID NO: 4458826 - DNA, 23 bp, Homo sapiens
gccccttctacactctcctgggc

SEQ ID NO: 4458827 - DNA, 13 bp, Homo sapiens
gccccttggtcct

SEQ ID NO: 4458828 - DNA, 18 bp, Homo sapiens
gccccttggtcctggcag

SEQ ID NO: 4458829 - DNA, 22 bp, Homo sapiens
gccccttggtcctggcagggcg

SEQ ID NO: 4458830 - DNA, 15 bp, Homo sapiens
gcccctttgcctgtc

SEQ ID NO: 4458831 - DNA, 17 bp, Homo sapiens
gcccgactgactggagg

SEQ ID NO: 4458832 - DNA, 21 bp, Homo sapiens
gcccgagcgcctgcgttccca

SEQ ID NO: 4458833 - DNA, 15 bp, Homo sapiens
gcccgcatgtgtgcc

SEQ ID NO: 4458834 - DNA, 13 bp, Homo sapiens
gcccgcctgccag

SEQ ID NO: 4458835 - DNA, 17 bp, Homo sapiens
gcccgcctgccagtcct

SEQ ID NO: 4458836 - DNA, 22 bp, Homo sapiens
gcccgcgggagacagcttctct

SEQ ID NO: 4458837 - DNA, 14 bp, Homo sapiens
gcccgctcccacag

SEQ ID NO: 4458838 - DNA, 15 bp, Homo sapiens
gcccgctgagtgggg

SEQ ID NO: 4458839 - DNA, 22 bp, Homo sapiens
gcccggagattggacggcctga

SEQ ID NO: 4458840 - DNA, 21 bp, Homo sapiens
gcccggcgccgggcaccaact

SEQ ID NO: 4458841 - DNA, 21 bp, Homo sapiens
gcccggcgcggtggctcacgc

SEQ ID NO: 4458842 - DNA, 17 bp, Homo sapiens
gcccggctgagccctgc

SEQ ID NO: 4458843 - DNA, 21 bp, Homo sapiens
gcccggctgagccctgcccca

SEQ ID NO: 4458844 - DNA, 20 bp, Homo sapiens
gcccgggaaggtcaccagca

SEQ ID NO: 4458845 - DNA, 18 bp, Homo sapiens
gcccgggcgcggccagcc

SEQ ID NO: 4458846 - DNA, 14 bp, Homo sapiens
gcccggtccacagg

SEQ ID NO: 4458847 - DNA, 15 bp, Homo sapiens
gcccggtccacaggt

SEQ ID NO: 4458848 - DNA, 16 bp, Homo sapiens
gcccgtaatcccagct

SEQ ID NO: 4458849 - DNA, 17 bp, Homo sapiens
gcccgtaatcccagcta

SEQ ID NO: 4458850 - DNA, 22 bp, Homo sapiens
gcccgtcagcatcactgatggg

SEQ ID NO: 4458851 - DNA, 23 bp, Homo sapiens
gcccgtcagcatcactgatggga

SEQ ID NO: 4458852 - DNA, 15 bp, Homo sapiens
gcccgtctctctccc

SEQ ID NO: 4458853 - DNA, 19 bp, Homo sapiens
gcccgtctctctcccatgg

SEQ ID NO: 4458854 - DNA, 16 bp, Homo sapiens
gcccgtctctttctca

SEQ ID NO: 4458855 - DNA, 16 bp, Homo sapiens
gcccgtgcccgcagga

SEQ ID NO: 4458856 - DNA, 18 bp, Homo sapiens
gccctaaaccctgttcct

SEQ ID NO: 4458857 - DNA, 14 bp, Homo sapiens
gccctaagggactt

SEQ ID NO: 4458858 - DNA, 20 bp, Homo sapiens
gccctaagtggctgccttct

SEQ ID NO: 4458859 - DNA, 14 bp, Homo sapiens
gccctagagcctgc

SEQ ID NO: 4458860 - DNA, 21 bp, Homo sapiens
gccctagagcctgcctggagc

SEQ ID NO: 4458861 - DNA, 23 bp, Homo sapiens
gccctagagcctgcctggagcgt

SEQ ID NO: 4458862 - DNA, 18 bp, Homo sapiens
gccctatatacctcacta

SEQ ID NO: 4458863 - DNA, 14 bp, Homo sapiens
gccctatttctatg

SEQ ID NO: 4458864 - DNA, 19 bp, Homo sapiens
gccctcaaagaagtcggaa

SEQ ID NO: 4458865 - DNA, 12 bp, Homo sapiens
gccctcagaaca

SEQ ID NO: 4458866 - DNA, 13 bp, Homo sapiens
gccctcaggggcc

SEQ ID NO: 4458867 - DNA, 22 bp, Homo sapiens
gccctcaggggcctctctcctg

SEQ ID NO: 4458868 - DNA, 22 bp, Homo sapiens
gccctccaaatgtcctttctca

SEQ ID NO: 4458869 - DNA, 23 bp, Homo sapiens
gccctccaaatgtcctttctcag

SEQ ID NO: 4458870 - DNA, 20 bp, Homo sapiens
gccctccagagccccacagc

SEQ ID NO: 4458871 - DNA, 13 bp, Homo sapiens
gccctcccaagtc

SEQ ID NO: 4458872 - DNA, 14 bp, Homo sapiens
gccctcccaagtcc

SEQ ID NO: 4458873 - DNA, 15 bp, Homo sapiens
gccctcccccttccc

SEQ ID NO: 4458874 - DNA, 22 bp, Homo sapiens
gccctcccctgcccctcacaac

SEQ ID NO: 4458875 - DNA, 17 bp, Homo sapiens
gccctccctgactccct

SEQ ID NO: 4458876 - DNA, 12 bp, Homo sapiens
gccctccctgct

SEQ ID NO: 4458877 - DNA, 16 bp, Homo sapiens
gccctccctgtcctcc

SEQ ID NO: 4458878 - DNA, 13 bp, Homo sapiens
gccctccctgtct

SEQ ID NO: 4458879 - DNA, 17 bp, Homo sapiens
gccctcctccccagagc

SEQ ID NO: 4458880 - DNA, 10 bp, Homo sapiens
gccctcctgg

SEQ ID NO: 4458881 - DNA, 18 bp, Homo sapiens
gccctcctgggccctggg

SEQ ID NO: 4458882 - DNA, 10 bp, Homo sapiens
gccctccttc

SEQ ID NO: 4458883 - DNA, 16 bp, Homo sapiens
gccctccttgtccacc

SEQ ID NO: 4458884 - DNA, 17 bp, Homo sapiens
gccctccttgtccaccc

SEQ ID NO: 4458885 - DNA, 15 bp, Homo sapiens
gccctcgggcccagc

SEQ ID NO: 4458886 - DNA, 22 bp, Homo sapiens
gccctcgggcccagcccccaca

SEQ ID NO: 4458887 - DNA, 13 bp, Homo sapiens
gccctctccctgt

SEQ ID NO: 4458888 - DNA, 14 bp, Homo sapiens
gccctctctctggg

SEQ ID NO: 4458889 - DNA, 13 bp, Homo sapiens
gccctctggggcc

SEQ ID NO: 4458890 - DNA, 13 bp, Homo sapiens
gccctctttccct

SEQ ID NO: 4458891 - DNA, 16 bp, Homo sapiens
gccctctttccctgcg

SEQ ID NO: 4458892 - DNA, 20 bp, Homo sapiens
gccctctttccctgcgagac

SEQ ID NO: 4458893 - DNA, 15 bp, Homo sapiens
gccctgactcctctg

SEQ ID NO: 4458894 - DNA, 16 bp, Homo sapiens
gccctgactcctctgg

SEQ ID NO: 4458895 - DNA, 19 bp, Homo sapiens
gccctgactcctctggctt

SEQ ID NO: 4458896 - DNA, 18 bp, Homo sapiens
gccctgactcctggactc

SEQ ID NO: 4458897 - DNA, 12 bp, Homo sapiens
gccctgagacct

SEQ ID NO: 4458898 - DNA, 22 bp, Homo sapiens
gccctgagacctctagagaaaa

SEQ ID NO: 4458899 - DNA, 20 bp, Homo sapiens
gccctgaggcctagactctg

SEQ ID NO: 4458900 - DNA, 20 bp, Homo sapiens
gccctgaggcggaggctgtg

SEQ ID NO: 4458901 - DNA, 23 bp, Homo sapiens
gccctgaggcggaggctgtgctc

SEQ ID NO: 4458902 - DNA, 18 bp, Homo sapiens
gccctgcaaaaggactct

SEQ ID NO: 4458903 - DNA, 19 bp, Homo sapiens
gccctgcacagacctggag

SEQ ID NO: 4458904 - DNA, 13 bp, Homo sapiens
gccctgcccacag

SEQ ID NO: 4458905 - DNA, 15 bp, Homo sapiens
gccctgccccacccc

SEQ ID NO: 4458906 - DNA, 23 bp, Homo sapiens
gccctgccccaccccatccagcc

SEQ ID NO: 4458907 - DNA, 14 bp, Homo sapiens
gccctgccctccca

SEQ ID NO: 4458908 - DNA, 15 bp, Homo sapiens
gccctgccctcccaa

SEQ ID NO: 4458909 - DNA, 18 bp, Homo sapiens
gccctgcctcagccaggc

SEQ ID NO: 4458910 - DNA, 16 bp, Homo sapiens
gccctgcctgcagcca

SEQ ID NO: 4458911 - DNA, 19 bp, Homo sapiens
gccctgcctgcagccaggg

SEQ ID NO: 4458912 - DNA, 21 bp, Homo sapiens
gccctgctagacgcaccgcct

SEQ ID NO: 4458913 - DNA, 16 bp, Homo sapiens
gccctgctccctgcct

SEQ ID NO: 4458914 - DNA, 22 bp, Homo sapiens
gccctgctcttctctccccagc

SEQ ID NO: 4458915 - DNA, 20 bp, Homo sapiens
gccctgctggccgcctcacc

SEQ ID NO: 4458916 - DNA, 21 bp, Homo sapiens
gccctgctggccgcctcaccc

SEQ ID NO: 4458917 - DNA, 22 bp, Homo sapiens
gccctgctggccgcctcacccc

SEQ ID NO: 4458918 - DNA, 16 bp, Homo sapiens
gccctggaaagggggt

SEQ ID NO: 4458919 - DNA, 13 bp, Homo sapiens
gccctggaggaag

SEQ ID NO: 4458920 - DNA, 19 bp, Homo sapiens
gccctggagggaaggacag

SEQ ID NO: 4458921 - DNA, 23 bp, Homo sapiens
gccctggagggaaggacagtccc

SEQ ID NO: 4458922 - DNA, 15 bp, Homo sapiens
gccctggcccaggtg

SEQ ID NO: 4458923 - DNA, 17 bp, Homo sapiens
gccctggcccaggtgcc

SEQ ID NO: 4458924 - DNA, 16 bp, Homo sapiens
gccctggctgctgccc

SEQ ID NO: 4458925 - DNA, 22 bp, Homo sapiens
gccctggctgctgcccccaccc

SEQ ID NO: 4458926 - DNA, 12 bp, Homo sapiens
gccctgggcctc

SEQ ID NO: 4458927 - DNA, 13 bp, Homo sapiens
gccctgggcctca

SEQ ID NO: 4458928 - DNA, 14 bp, Homo sapiens
gccctgggcctcag

SEQ ID NO: 4458929 - DNA, 17 bp, Homo sapiens
gccctgggctcggaggc

SEQ ID NO: 4458930 - DNA, 21 bp, Homo sapiens
gccctgggctcggaggctgcc

SEQ ID NO: 4458931 - DNA, 19 bp, Homo sapiens
gccctggggatcttcccac

SEQ ID NO: 4458932 - DNA, 21 bp, Homo sapiens
gccctggggatcttcccacag

SEQ ID NO: 4458933 - DNA, 23 bp, Homo sapiens
gccctggggatcttcccacagga

SEQ ID NO: 4458934 - DNA, 17 bp, Homo sapiens
gccctggtccagggaag

SEQ ID NO: 4458935 - DNA, 16 bp, Homo sapiens
gccctggtgtgtttcc

SEQ ID NO: 4458936 - DNA, 18 bp, Homo sapiens
gccctggtgtttctagca

SEQ ID NO: 4458937 - DNA, 17 bp, Homo sapiens
gccctgtcaagcttctc

SEQ ID NO: 4458938 - DNA, 23 bp, Homo sapiens
gccctgtccaaaagcgccctcac

SEQ ID NO: 4458939 - DNA, 24 bp, Homo sapiens
gccctgtggacaggatgaggacag

SEQ ID NO: 4458940 - DNA, 14 bp, Homo sapiens
gccctgttaaaaga

SEQ ID NO: 4458941 - DNA, 20 bp, Homo sapiens
gccctgttgccgagcccagc

SEQ ID NO: 4458942 - DNA, 22 bp, Homo sapiens
gccctgttgccgagcccagctg

SEQ ID NO: 4458943 - DNA, 23 bp, Homo sapiens
gcccttacagccctaagtggctg

SEQ ID NO: 4458944 - DNA, 19 bp, Homo sapiens
gcccttatgcccggcgccg

SEQ ID NO: 4458945 - DNA, 16 bp, Homo sapiens
gcccttccatgtgcct

SEQ ID NO: 4458946 - DNA, 13 bp, Homo sapiens
gcccttcccaggg

SEQ ID NO: 4458947 - DNA, 17 bp, Homo sapiens
gcccttcccagggcacc

SEQ ID NO: 4458948 - DNA, 18 bp, Homo sapiens
gcccttccctctgggcac

SEQ ID NO: 4458949 - DNA, 19 bp, Homo sapiens
gcccttccctctgggcacg

SEQ ID NO: 4458950 - DNA, 22 bp, Homo sapiens
gcccttccctctgggcacgcct

SEQ ID NO: 4458951 - DNA, 22 bp, Homo sapiens
gcccttccctgagtgcgggctg

SEQ ID NO: 4458952 - DNA, 21 bp, Homo sapiens
gcccttctgattcccctccac

SEQ ID NO: 4458953 - DNA, 16 bp, Homo sapiens
gcccttgcagggtggg

SEQ ID NO: 4458954 - DNA, 14 bp, Homo sapiens
gcccttgcctcccc

SEQ ID NO: 4458955 - DNA, 21 bp, Homo sapiens
gcccttggggtaagccagagc

SEQ ID NO: 4458956 - DNA, 13 bp, Homo sapiens
gcccttggtgcga

SEQ ID NO: 4458957 - DNA, 14 bp, Homo sapiens
gcccttgttccagc

SEQ ID NO: 4458958 - DNA, 22 bp, Homo sapiens
gccctttcccaggtaatttaaa

SEQ ID NO: 4458959 - DNA, 12 bp, Homo sapiens
gccgacactgag

SEQ ID NO: 4458960 - DNA, 13 bp, Homo sapiens
gccgacctcgtcc

SEQ ID NO: 4458961 - DNA, 15 bp, Homo sapiens
gccgacttggagact

SEQ ID NO: 4458962 - DNA, 18 bp, Homo sapiens
gccgacttggagactcct

SEQ ID NO: 4458963 - DNA, 15 bp, Homo sapiens
gccgagagcctgctc

SEQ ID NO: 4458964 - DNA, 19 bp, Homo sapiens
gccgagagcctgctccccc

SEQ ID NO: 4458965 - DNA, 13 bp, Homo sapiens
gccgagagcctta

SEQ ID NO: 4458966 - DNA, 13 bp, Homo sapiens
gccgagcccagct

SEQ ID NO: 4458967 - DNA, 13 bp, Homo sapiens
gccgagctcctgg

SEQ ID NO: 4458968 - DNA, 19 bp, Homo sapiens
gccgagctcctggggagct

SEQ ID NO: 4458969 - DNA, 22 bp, Homo sapiens
gccgaggacatgcatgacactt

SEQ ID NO: 4458970 - DNA, 18 bp, Homo sapiens
gccgaggcttgggctccc

SEQ ID NO: 4458971 - DNA, 21 bp, Homo sapiens
gccgaggcttgggctcccaca

SEQ ID NO: 4458972 - DNA, 13 bp, Homo sapiens
gccgagggctggc

SEQ ID NO: 4458973 - DNA, 19 bp, Homo sapiens
gccgagggctggccgggac

SEQ ID NO: 4458974 - DNA, 21 bp, Homo sapiens
gccgagggctggccgggactg

SEQ ID NO: 4458975 - DNA, 12 bp, Homo sapiens
gccgatgccacc

SEQ ID NO: 4458976 - DNA, 22 bp, Homo sapiens
gccgcaaattgtaccttttttg

SEQ ID NO: 4458977 - DNA, 23 bp, Homo sapiens
gccgcaccccagagtgtgggaag

SEQ ID NO: 4458978 - DNA, 23 bp, Homo sapiens
gccgcagagcctgacgctcagcc

SEQ ID NO: 4458979 - DNA, 21 bp, Homo sapiens
gccgcagaggtgtaggggtgg

SEQ ID NO: 4458980 - DNA, 18 bp, Homo sapiens
gccgcagggcggggctgg

SEQ ID NO: 4458981 - DNA, 20 bp, Homo sapiens
gccgcatcttctccatctgg

SEQ ID NO: 4458982 - DNA, 18 bp, Homo sapiens
gccgcattggtgactcac

SEQ ID NO: 4458983 - DNA, 16 bp, Homo sapiens
gccgccatagccccag

SEQ ID NO: 4458984 - DNA, 21 bp, Homo sapiens
gccgcccacccccacccccag

SEQ ID NO: 4458985 - DNA, 23 bp, Homo sapiens
gccgccctgggctgtctgtcacc

SEQ ID NO: 4458986 - DNA, 15 bp, Homo sapiens
gccgccgccgctgcc

SEQ ID NO: 4458987 - DNA, 14 bp, Homo sapiens
gccgcctcaccccc

SEQ ID NO: 4458988 - DNA, 16 bp, Homo sapiens
gccgcgggccaggagg

SEQ ID NO: 4458989 - DNA, 15 bp, Homo sapiens
gccgctgagcgagga

SEQ ID NO: 4458990 - DNA, 21 bp, Homo sapiens
gccgctgagcgcccccgagcc

SEQ ID NO: 4458991 - DNA, 23 bp, Homo sapiens
gccgctgagcgcccccgagccct

SEQ ID NO: 4458992 - DNA, 14 bp, Homo sapiens
gccgctgccatgct

SEQ ID NO: 4458993 - DNA, 12 bp, Homo sapiens
gccgctggaggc

SEQ ID NO: 4458994 - DNA, 15 bp, Homo sapiens
gccggatctgaggga

SEQ ID NO: 4458995 - DNA, 15 bp, Homo sapiens
gccggcaagcgagca

SEQ ID NO: 4458996 - DNA, 15 bp, Homo sapiens
gccggcctcctcctc

SEQ ID NO: 4458997 - DNA, 17 bp, Homo sapiens
gccggcggctactctgg

SEQ ID NO: 4458998 - DNA, 15 bp, Homo sapiens
gccggcttcctcctt

SEQ ID NO: 4458999 - DNA, 18 bp, Homo sapiens
gccggcttcctccttcca

SEQ ID NO: 4459000 - DNA, 20 bp, Homo sapiens
gccgggaccaccctgagccg

SEQ ID NO: 4459001 - DNA, 14 bp, Homo sapiens
gccgggactgctgc

SEQ ID NO: 4459002 - DNA, 15 bp, Homo sapiens
gccgggactgctgct

SEQ ID NO: 4459003 - DNA, 17 bp, Homo sapiens
gccgggactgctgctct

SEQ ID NO: 4459004 - DNA, 19 bp, Homo sapiens
gccgggactgctgctctcc

SEQ ID NO: 4459005 - DNA, 13 bp, Homo sapiens
gccgggagcctga

SEQ ID NO: 4459006 - DNA, 19 bp, Homo sapiens
gccgggagcctgaccctca

SEQ ID NO: 4459007 - DNA, 14 bp, Homo sapiens
gccgggcaggtcct

SEQ ID NO: 4459008 - DNA, 17 bp, Homo sapiens
gccgggcaggtcctgcc

SEQ ID NO: 4459009 - DNA, 19 bp, Homo sapiens
gccgggcatggtggcaggc

SEQ ID NO: 4459010 - DNA, 23 bp, Homo sapiens
gccgggcatggtggcgcaagcct

SEQ ID NO: 4459011 - DNA, 12 bp, Homo sapiens
gccgggccagga

SEQ ID NO: 4459012 - DNA, 18 bp, Homo sapiens
gccgggcgcggtggctca

SEQ ID NO: 4459013 - DNA, 21 bp, Homo sapiens
gccggggacagaggcctgccc

SEQ ID NO: 4459014 - DNA, 23 bp, Homo sapiens
gccggggacagaggcctgcccgg

SEQ ID NO: 4459015 - DNA, 21 bp, Homo sapiens
gccgggtctgcctcttctggg

SEQ ID NO: 4459016 - DNA, 14 bp, Homo sapiens
gccggtacacagcc

SEQ ID NO: 4459017 - DNA, 16 bp, Homo sapiens
gccggtacacagccag

SEQ ID NO: 4459018 - DNA, 18 bp, Homo sapiens
gccggtgccagctgccct

SEQ ID NO: 4459019 - DNA, 22 bp, Homo sapiens
gccggtgccagctgcccttgca

SEQ ID NO: 4459020 - DNA, 15 bp, Homo sapiens
gccggttttcctcag

SEQ ID NO: 4459021 - DNA, 14 bp, Homo sapiens
gccgtaatttaact

SEQ ID NO: 4459022 - DNA, 23 bp, Homo sapiens
gccgtcctaacctcgggcctgct

SEQ ID NO: 4459023 - DNA, 13 bp, Homo sapiens
gccgtccttgtct

SEQ ID NO: 4459024 - DNA, 21 bp, Homo sapiens
gccgtctaggattgggcctcc

SEQ ID NO: 4459025 - DNA, 17 bp, Homo sapiens
gccgtctcctccctcag

SEQ ID NO: 4459026 - DNA, 14 bp, Homo sapiens
gccgtgagcatgca

SEQ ID NO: 4459027 - DNA, 17 bp, Homo sapiens
gccgtgcatggctcctg

SEQ ID NO: 4459028 - DNA, 23 bp, Homo sapiens
gccgtgctcgcccacaaactgat

SEQ ID NO: 4459029 - DNA, 18 bp, Homo sapiens
gccgtgtctcagcctctg

SEQ ID NO: 4459030 - DNA, 15 bp, Homo sapiens
gccgttactctccaa

SEQ ID NO: 4459031 - DNA, 22 bp, Homo sapiens
gcctaaaagtgggcttgattct

SEQ ID NO: 4459032 - DNA, 19 bp, Homo sapiens
gcctaaagctaaaaatatt

SEQ ID NO: 4459033 - DNA, 15 bp, Homo sapiens
gcctaaatttgtgct

SEQ ID NO: 4459034 - DNA, 12 bp, Homo sapiens
gcctaataaaga

SEQ ID NO: 4459035 - DNA, 15 bp, Homo sapiens
gcctaatggagaaga

SEQ ID NO: 4459036 - DNA, 16 bp, Homo sapiens
gcctaatggagaagac

SEQ ID NO: 4459037 - DNA, 15 bp, Homo sapiens
gcctaattggaaagt

SEQ ID NO: 4459038 - DNA, 18 bp, Homo sapiens
gcctacaaagagatgctt

SEQ ID NO: 4459039 - DNA, 17 bp, Homo sapiens
gcctacaaatcagtaat

SEQ ID NO: 4459040 - DNA, 15 bp, Homo sapiens
gcctacagccaggtt

SEQ ID NO: 4459041 - DNA, 17 bp, Homo sapiens
gcctaccccagttccta

SEQ ID NO: 4459042 - DNA, 14 bp, Homo sapiens
gcctacctgctctc

SEQ ID NO: 4459043 - DNA, 19 bp, Homo sapiens
gcctactgaaaatgcattt

SEQ ID NO: 4459044 - DNA, 17 bp, Homo sapiens
gcctagcctggctctgc

SEQ ID NO: 4459045 - DNA, 21 bp, Homo sapiens
gcctagcgatctctcctggcc

SEQ ID NO: 4459046 - DNA, 16 bp, Homo sapiens
gcctagcggagcccag

SEQ ID NO: 4459047 - DNA, 20 bp, Homo sapiens
gcctagcggagcccagcctg

SEQ ID NO: 4459048 - DNA, 21 bp, Homo sapiens
gcctagcggagcccagcctgg

SEQ ID NO: 4459049 - DNA, 15 bp, Homo sapiens
gcctagctcctgcca

SEQ ID NO: 4459050 - DNA, 17 bp, Homo sapiens
gcctagtaaatgttaac

SEQ ID NO: 4459051 - DNA, 19 bp, Homo sapiens
gcctagtgaaggcttctct

SEQ ID NO: 4459052 - DNA, 15 bp, Homo sapiens
gcctagtgggagtta

SEQ ID NO: 4459053 - DNA, 17 bp, Homo sapiens
gcctataaaatgcccat

SEQ ID NO: 4459054 - DNA, 17 bp, Homo sapiens
gcctataatcccagcta

SEQ ID NO: 4459055 - DNA, 19 bp, Homo sapiens
gcctatatgagaagaatag

SEQ ID NO: 4459056 - DNA, 17 bp, Homo sapiens
gcctatgcactgaagag

SEQ ID NO: 4459057 - DNA, 20 bp, Homo sapiens
gcctatgcactgaagagctc

SEQ ID NO: 4459058 - DNA, 21 bp, Homo sapiens
gcctatgcactgaagagctct

SEQ ID NO: 4459059 - DNA, 22 bp, Homo sapiens
gcctatgcactgaagagctctt

SEQ ID NO: 4459060 - DNA, 23 bp, Homo sapiens
gcctatgcactgaagagctcttg

SEQ ID NO: 4459061 - DNA, 23 bp, Homo sapiens
gcctatttttttagattgagaaa

SEQ ID NO: 4459062 - DNA, 17 bp, Homo sapiens
gcctcaactcctcccat

SEQ ID NO: 4459063 - DNA, 16 bp, Homo sapiens
gcctcaccccctcggg

SEQ ID NO: 4459064 - DNA, 23 bp, Homo sapiens
gcctcacggggttggctgttcca

SEQ ID NO: 4459065 - DNA, 15 bp, Homo sapiens
gcctcagaaggcccc

SEQ ID NO: 4459066 - DNA, 22 bp, Homo sapiens
gcctcagaaggccccagagaga

SEQ ID NO: 4459067 - DNA, 19 bp, Homo sapiens
gcctcagacgttgcctgag

SEQ ID NO: 4459068 - DNA, 14 bp, Homo sapiens
gcctcagccctcag

SEQ ID NO: 4459069 - DNA, 15 bp, Homo sapiens
gcctcagccctcaga

SEQ ID NO: 4459070 - DNA, 14 bp, Homo sapiens
gcctcagccctgct

SEQ ID NO: 4459071 - DNA, 18 bp, Homo sapiens
gcctcagccctgctccct

SEQ ID NO: 4459072 - DNA, 21 bp, Homo sapiens
gcctcagccctgctccctgcc

SEQ ID NO: 4459073 - DNA, 13 bp, Homo sapiens
gcctcagccttcc

SEQ ID NO: 4459074 - DNA, 14 bp, Homo sapiens
gcctcagctatgta

SEQ ID NO: 4459075 - DNA, 22 bp, Homo sapiens
gcctcaggaggtcacctgccgc

SEQ ID NO: 4459076 - DNA, 16 bp, Homo sapiens
gcctcagttcaacctg

SEQ ID NO: 4459077 - DNA, 20 bp, Homo sapiens
gcctcatactcctgggctca

SEQ ID NO: 4459078 - DNA, 13 bp, Homo sapiens
gcctcatccagcc

SEQ ID NO: 4459079 - DNA, 16 bp, Homo sapiens
gcctcatccagcctca

SEQ ID NO: 4459080 - DNA, 22 bp, Homo sapiens
gcctcatctataacatgcattt

SEQ ID NO: 4459081 - DNA, 14 bp, Homo sapiens
gcctcatctcagac

SEQ ID NO: 4459082 - DNA, 18 bp, Homo sapiens
gcctcatctcagaccctg

SEQ ID NO: 4459083 - DNA, 13 bp, Homo sapiens
gcctcatttccct

SEQ ID NO: 4459084 - DNA, 21 bp, Homo sapiens
gcctccaaaatattaacattc

SEQ ID NO: 4459085 - DNA, 15 bp, Homo sapiens
gcctccaccctctga

SEQ ID NO: 4459086 - DNA, 17 bp, Homo sapiens
gcctccaccctctgagc

SEQ ID NO: 4459087 - DNA, 18 bp, Homo sapiens
gcctccaccctctgagct

SEQ ID NO: 4459088 - DNA, 13 bp, Homo sapiens
gcctccactcctt

SEQ ID NO: 4459089 - DNA, 15 bp, Homo sapiens
gcctccactctagtt

SEQ ID NO: 4459090 - DNA, 19 bp, Homo sapiens
gcctccactctagttctag

SEQ ID NO: 4459091 - DNA, 21 bp, Homo sapiens
gcctccactctagttctagat

SEQ ID NO: 4459092 - DNA, 22 bp, Homo sapiens
gcctccactctagttctagatg

SEQ ID NO: 4459093 - DNA, 21 bp, Homo sapiens
gcctccagggctggactgagg

SEQ ID NO: 4459094 - DNA, 16 bp, Homo sapiens
gcctccagtcatggta

SEQ ID NO: 4459095 - DNA, 17 bp, Homo sapiens
gcctccagtcatggtac

SEQ ID NO: 4459096 - DNA, 23 bp, Homo sapiens
gcctccagtcatggtactacccc

SEQ ID NO: 4459097 - DNA, 15 bp, Homo sapiens
gcctccagtgcagtc

SEQ ID NO: 4459098 - DNA, 16 bp, Homo sapiens
gcctcccaaagtgctg

SEQ ID NO: 4459099 - DNA, 20 bp, Homo sapiens
gcctcccaaggtcctctcag

SEQ ID NO: 4459100 - DNA, 17 bp, Homo sapiens
gcctcccattctgcacc

SEQ ID NO: 4459101 - DNA, 17 bp, Homo sapiens
gcctccccaccctcctc

SEQ ID NO: 4459102 - DNA, 19 bp, Homo sapiens
gcctccccaccctcctctt

SEQ ID NO: 4459103 - DNA, 20 bp, Homo sapiens
gcctccccatctgtccagct

SEQ ID NO: 4459104 - DNA, 15 bp, Homo sapiens
gcctccccccagacc

SEQ ID NO: 4459105 - DNA, 14 bp, Homo sapiens
gcctccccctcaga

SEQ ID NO: 4459106 - DNA, 15 bp, Homo sapiens
gcctccccctcagat

SEQ ID NO: 4459107 - DNA, 22 bp, Homo sapiens
gcctccccctcagatgatctct

SEQ ID NO: 4459108 - DNA, 22 bp, Homo sapiens
gcctccccctcccccattccct

SEQ ID NO: 4459109 - DNA, 12 bp, Homo sapiens
gcctcccctccc

SEQ ID NO: 4459110 - DNA, 13 bp, Homo sapiens
gcctcccctcccc

SEQ ID NO: 4459111 - DNA, 20 bp, Homo sapiens
gcctcccctcccctggggac

SEQ ID NO: 4459112 - DNA, 22 bp, Homo sapiens
gcctcccgccactcgccttctt

SEQ ID NO: 4459113 - DNA, 20 bp, Homo sapiens
gcctccctagttagcatcca

SEQ ID NO: 4459114 - DNA, 14 bp, Homo sapiens
gcctccctccaccc

SEQ ID NO: 4459115 - DNA, 17 bp, Homo sapiens
gcctccctccaccccag

SEQ ID NO: 4459116 - DNA, 21 bp, Homo sapiens
gcctccctccaccccaggacg

SEQ ID NO: 4459117 - DNA, 23 bp, Homo sapiens
gcctccctctcagaggcctgctg

SEQ ID NO: 4459118 - DNA, 21 bp, Homo sapiens
gcctccctctccatatctcct

SEQ ID NO: 4459119 - DNA, 23 bp, Homo sapiens
gcctccctctctcttctgctcca

SEQ ID NO: 4459120 - DNA, 15 bp, Homo sapiens
gcctcccttttctcc

SEQ ID NO: 4459121 - DNA, 16 bp, Homo sapiens
gcctccgagagggaga

SEQ ID NO: 4459122 - DNA, 19 bp, Homo sapiens
gcctccgaggctccccgcc

SEQ ID NO: 4459123 - DNA, 22 bp, Homo sapiens
gcctccgcctgctgtgtggact

SEQ ID NO: 4459124 - DNA, 23 bp, Homo sapiens
gcctccggcgtcagcctccagcc

SEQ ID NO: 4459125 - DNA, 14 bp, Homo sapiens
gcctcctcccaaag

SEQ ID NO: 4459126 - DNA, 13 bp, Homo sapiens
gcctcctcctcac

SEQ ID NO: 4459127 - DNA, 15 bp, Homo sapiens
gcctcctcctcaccc

SEQ ID NO: 4459128 - DNA, 16 bp, Homo sapiens
gcctcctcctcaccct

SEQ ID NO: 4459129 - DNA, 17 bp, Homo sapiens
gcctcctcctgggctcc

SEQ ID NO: 4459130 - DNA, 20 bp, Homo sapiens
gcctcctcctgggctccaga

SEQ ID NO: 4459131 - DNA, 21 bp, Homo sapiens
gcctcctctgtctgcccttca

SEQ ID NO: 4459132 - DNA, 13 bp, Homo sapiens
gcctcctgaggct

SEQ ID NO: 4459133 - DNA, 16 bp, Homo sapiens
gcctcctgaggctgtt

SEQ ID NO: 4459134 - DNA, 16 bp, Homo sapiens
gcctcctgccccctgc

SEQ ID NO: 4459135 - DNA, 18 bp, Homo sapiens
gcctcctgccccctgcca

SEQ ID NO: 4459136 - DNA, 14 bp, Homo sapiens
gcctcctggccaga

SEQ ID NO: 4459137 - DNA, 15 bp, Homo sapiens
gcctcctggccagac

SEQ ID NO: 4459138 - DNA, 15 bp, Homo sapiens
gcctcctgtacctca

SEQ ID NO: 4459139 - DNA, 19 bp, Homo sapiens
gcctcctgtgcctcccttt

SEQ ID NO: 4459140 - DNA, 15 bp, Homo sapiens
gcctcctgtgcctgg

SEQ ID NO: 4459141 - DNA, 18 bp, Homo sapiens
gcctcctgtgtactgtgt

SEQ ID NO: 4459142 - DNA, 19 bp, Homo sapiens
gcctcgctcaccgctggcc

SEQ ID NO: 4459143 - DNA, 13 bp, Homo sapiens
gcctcggcctccc

SEQ ID NO: 4459144 - DNA, 15 bp, Homo sapiens
gcctcggcctcccaa

SEQ ID NO: 4459145 - DNA, 17 bp, Homo sapiens
gcctcggcctcccaaag

SEQ ID NO: 4459146 - DNA, 14 bp, Homo sapiens
gcctcgtgccatga

SEQ ID NO: 4459147 - DNA, 19 bp, Homo sapiens
gcctcgtgccatgatctgt

SEQ ID NO: 4459148 - DNA, 20 bp, Homo sapiens
gcctcgttggaagaggaaca

SEQ ID NO: 4459149 - DNA, 17 bp, Homo sapiens
gcctctaaccccaggcc

SEQ ID NO: 4459150 - DNA, 21 bp, Homo sapiens
gcctctaaccccaggccccga

SEQ ID NO: 4459151 - DNA, 17 bp, Homo sapiens
gcctctacagccgtccc

SEQ ID NO: 4459152 - DNA, 15 bp, Homo sapiens
gcctctagtgtacca

SEQ ID NO: 4459153 - DNA, 16 bp, Homo sapiens
gcctctcatcaactga

SEQ ID NO: 4459154 - DNA, 18 bp, Homo sapiens
gcctctcatcaactgaat

SEQ ID NO: 4459155 - DNA, 24 bp, Homo sapiens
gcctctccactcatgtgactcttt

SEQ ID NO: 4459156 - DNA, 22 bp, Homo sapiens
gcctctcccacccggccacagc

SEQ ID NO: 4459157 - DNA, 12 bp, Homo sapiens
gcctctccctgc

SEQ ID NO: 4459158 - DNA, 13 bp, Homo sapiens
gcctctccctgcc

SEQ ID NO: 4459159 - DNA, 15 bp, Homo sapiens
gcctctccctgcctg

SEQ ID NO: 4459160 - DNA, 15 bp, Homo sapiens
gcctctctcccagtc

SEQ ID NO: 4459161 - DNA, 14 bp, Homo sapiens
gcctctctccttgg

SEQ ID NO: 4459162 - DNA, 21 bp, Homo sapiens
gcctctctccttggccacaga

SEQ ID NO: 4459163 - DNA, 22 bp, Homo sapiens
gcctctctccttggccacagac

SEQ ID NO: 4459164 - DNA, 16 bp, Homo sapiens
gcctctctctgctcca

SEQ ID NO: 4459165 - DNA, 21 bp, Homo sapiens
gcctctctggaaagaggctct

SEQ ID NO: 4459166 - DNA, 23 bp, Homo sapiens
gcctctctggaaagaggctctgg

SEQ ID NO: 4459167 - DNA, 19 bp, Homo sapiens
gcctctgagaagctctgaa

SEQ ID NO: 4459168 - DNA, 21 bp, Homo sapiens
gcctctgcacaccctccagag

SEQ ID NO: 4459169 - DNA, 20 bp, Homo sapiens
gcctctgcagtctcatttct

SEQ ID NO: 4459170 - DNA, 16 bp, Homo sapiens
gcctctgccagcgcca

SEQ ID NO: 4459171 - DNA, 13 bp, Homo sapiens
gcctctgccctgg

SEQ ID NO: 4459172 - DNA, 14 bp, Homo sapiens
gcctctgccctgga

SEQ ID NO: 4459173 - DNA, 15 bp, Homo sapiens
gcctctgccctggat

SEQ ID NO: 4459174 - DNA, 21 bp, Homo sapiens
gcctctgccgctgccatgctt

SEQ ID NO: 4459175 - DNA, 14 bp, Homo sapiens
gcctctgctccctc

SEQ ID NO: 4459176 - DNA, 16 bp, Homo sapiens
gcctctgctggctcag

SEQ ID NO: 4459177 - DNA, 17 bp, Homo sapiens
gcctctgctggctcagg

SEQ ID NO: 4459178 - DNA, 22 bp, Homo sapiens
gcctctgctggctcaggaggag

SEQ ID NO: 4459179 - DNA, 23 bp, Homo sapiens
gcctctggctagaggccagcccc

SEQ ID NO: 4459180 - DNA, 22 bp, Homo sapiens
gcctctggttgcctcccccgcc

SEQ ID NO: 4459181 - DNA, 20 bp, Homo sapiens
gcctctgtccccttctctca

SEQ ID NO: 4459182 - DNA, 22 bp, Homo sapiens
gcctctgtccccttctctcatc

SEQ ID NO: 4459183 - DNA, 22 bp, Homo sapiens
gcctctgttcagttcattccca

SEQ ID NO: 4459184 - DNA, 23 bp, Homo sapiens
gcctcttaggactggtgcctggc

SEQ ID NO: 4459185 - DNA, 21 bp, Homo sapiens
gcctcttccagtcttcctgac

SEQ ID NO: 4459186 - DNA, 17 bp, Homo sapiens
gcctcttctacttgtaa

SEQ ID NO: 4459187 - DNA, 21 bp, Homo sapiens
gcctcttctcaacttttttcc

SEQ ID NO: 4459188 - DNA, 22 bp, Homo sapiens
gcctcttctcttgacagtctga

SEQ ID NO: 4459189 - DNA, 14 bp, Homo sapiens
gcctcttctgggag

SEQ ID NO: 4459190 - DNA, 13 bp, Homo sapiens
gcctcttctttgt

SEQ ID NO: 4459191 - DNA, 16 bp, Homo sapiens
gcctcttctttgtgcc

SEQ ID NO: 4459192 - DNA, 18 bp, Homo sapiens
gcctcttctttgtgcctt

SEQ ID NO: 4459193 - DNA, 17 bp, Homo sapiens
gcctcttgaccaggctg

SEQ ID NO: 4459194 - DNA, 22 bp, Homo sapiens
gcctcttgaccaggctgcctcc

SEQ ID NO: 4459195 - DNA, 17 bp, Homo sapiens
gcctcttgtaaagactg

SEQ ID NO: 4459196 - DNA, 17 bp, Homo sapiens
gcctcttttacctgctg

SEQ ID NO: 4459197 - DNA, 19 bp, Homo sapiens
gcctcttttacctgctgct

SEQ ID NO: 4459198 - DNA, 22 bp, Homo sapiens
gcctcttttacctgctgcttct

SEQ ID NO: 4459199 - DNA, 15 bp, Homo sapiens
gcctgaaaaatggga

SEQ ID NO: 4459200 - DNA, 22 bp, Homo sapiens
gcctgaaacccgccctcagggg

SEQ ID NO: 4459201 - DNA, 18 bp, Homo sapiens
gcctgaaatttcaccatt

SEQ ID NO: 4459202 - DNA, 15 bp, Homo sapiens
gcctgaactgagccc

SEQ ID NO: 4459203 - DNA, 15 bp, Homo sapiens
gcctgaactgaggag

SEQ ID NO: 4459204 - DNA, 14 bp, Homo sapiens
gcctgaaggcacag

SEQ ID NO: 4459205 - DNA, 16 bp, Homo sapiens
gcctgaaggcacagct

SEQ ID NO: 4459206 - DNA, 22 bp, Homo sapiens
gcctgacatttggagtgttccc

SEQ ID NO: 4459207 - DNA, 15 bp, Homo sapiens
gcctgacgctcagcc

SEQ ID NO: 4459208 - DNA, 17 bp, Homo sapiens
gcctgacgctcagcccc

SEQ ID NO: 4459209 - DNA, 22 bp, Homo sapiens
gcctgacgctcagccccaggcc

SEQ ID NO: 4459210 - DNA, 16 bp, Homo sapiens
gcctgacttcacatct

SEQ ID NO: 4459211 - DNA, 17 bp, Homo sapiens
gcctgacttgagccact

SEQ ID NO: 4459212 - DNA, 17 bp, Homo sapiens
gcctgagaagaagtggc

SEQ ID NO: 4459213 - DNA, 20 bp, Homo sapiens
gcctgagaagaagtggctgc

SEQ ID NO: 4459214 - DNA, 23 bp, Homo sapiens
gcctgagaccagggtggccacac

SEQ ID NO: 4459215 - DNA, 13 bp, Homo sapiens
gcctgagaggcag

SEQ ID NO: 4459216 - DNA, 15 bp, Homo sapiens
gcctgagaggcaggc

SEQ ID NO: 4459217 - DNA, 18 bp, Homo sapiens
gcctgagaggcaggcata

SEQ ID NO: 4459218 - DNA, 19 bp, Homo sapiens
gcctgagaggcaggcatag

SEQ ID NO: 4459219 - DNA, 20 bp, Homo sapiens
gcctgagaggcaggcataga

SEQ ID NO: 4459220 - DNA, 21 bp, Homo sapiens
gcctgagatacaaggcccaga

SEQ ID NO: 4459221 - DNA, 17 bp, Homo sapiens
gcctgagatgcaggtga

SEQ ID NO: 4459222 - DNA, 23 bp, Homo sapiens
gcctgagatttcatctgctctcc

SEQ ID NO: 4459223 - DNA, 20 bp, Homo sapiens
gcctgagcgacagtgagact

SEQ ID NO: 4459224 - DNA, 22 bp, Homo sapiens
gcctgagcgctcctgccgcaga

SEQ ID NO: 4459225 - DNA, 21 bp, Homo sapiens
gcctgaggtcaggagttcaag

SEQ ID NO: 4459226 - DNA, 21 bp, Homo sapiens
gcctgatctctgctccctgca

SEQ ID NO: 4459227 - DNA, 17 bp, Homo sapiens
gcctgcaaaccttcctg

SEQ ID NO: 4459228 - DNA, 21 bp, Homo sapiens
gcctgcaaaccttcctgggag

SEQ ID NO: 4459229 - DNA, 20 bp, Homo sapiens
gcctgcacccttccacagct

SEQ ID NO: 4459230 - DNA, 14 bp, Homo sapiens
gcctgcacctgccc

SEQ ID NO: 4459231 - DNA, 18 bp, Homo sapiens
gcctgcacctgccccgtg

SEQ ID NO: 4459232 - DNA, 13 bp, Homo sapiens
gcctgcagccagg

SEQ ID NO: 4459233 - DNA, 14 bp, Homo sapiens
gcctgcagccaggg

SEQ ID NO: 4459234 - DNA, 21 bp, Homo sapiens
gcctgcagccagggctggggt

SEQ ID NO: 4459235 - DNA, 16 bp, Homo sapiens
gcctgcaggagagagc

SEQ ID NO: 4459236 - DNA, 18 bp, Homo sapiens
gcctgcaggagagagcag

SEQ ID NO: 4459237 - DNA, 13 bp, Homo sapiens
gcctgcaggcaga

SEQ ID NO: 4459238 - DNA, 17 bp, Homo sapiens
gcctgcaggcagagctg

SEQ ID NO: 4459239 - DNA, 19 bp, Homo sapiens
gcctgcaggcagagctgga

SEQ ID NO: 4459240 - DNA, 11 bp, Homo sapiens
gcctgcagttt

SEQ ID NO: 4459241 - DNA, 20 bp, Homo sapiens
gcctgcagtttcttgtgtag

SEQ ID NO: 4459242 - DNA, 20 bp, Homo sapiens
gcctgccactctctgggact

SEQ ID NO: 4459243 - DNA, 15 bp, Homo sapiens
gcctgccagtcctag

SEQ ID NO: 4459244 - DNA, 20 bp, Homo sapiens
gcctgccagtcctagctgca

SEQ ID NO: 4459245 - DNA, 23 bp, Homo sapiens
gcctgccagtcctagctgcacag

SEQ ID NO: 4459246 - DNA, 19 bp, Homo sapiens
gcctgcccagttgcactca

SEQ ID NO: 4459247 - DNA, 21 bp, Homo sapiens
gcctgcccctaccctggactt

SEQ ID NO: 4459248 - DNA, 15 bp, Homo sapiens
gcctgccctgcctca

SEQ ID NO: 4459249 - DNA, 14 bp, Homo sapiens
gcctgccgtgcatg

SEQ ID NO: 4459250 - DNA, 18 bp, Homo sapiens
gcctgcctcccaaggtcc

SEQ ID NO: 4459251 - DNA, 17 bp, Homo sapiens
gcctgcctggcaggctg

SEQ ID NO: 4459252 - DNA, 13 bp, Homo sapiens
gcctgcgcctgct

SEQ ID NO: 4459253 - DNA, 18 bp, Homo sapiens
gcctgcgcctgctgcctg

SEQ ID NO: 4459254 - DNA, 16 bp, Homo sapiens
gcctgcgggcccctgg

SEQ ID NO: 4459255 - DNA, 23 bp, Homo sapiens
gcctgcgttcccagaccatggga

SEQ ID NO: 4459256 - DNA, 16 bp, Homo sapiens
gcctgctcccccaccc

SEQ ID NO: 4459257 - DNA, 19 bp, Homo sapiens
gcctgctcccccaccccct

SEQ ID NO: 4459258 - DNA, 21 bp, Homo sapiens
gcctgctccttggcaccccca

SEQ ID NO: 4459259 - DNA, 12 bp, Homo sapiens
gcctgctctccc

SEQ ID NO: 4459260 - DNA, 18 bp, Homo sapiens
gcctgctgagatgaggag

SEQ ID NO: 4459261 - DNA, 10 bp, Homo sapiens
gcctgctgca

SEQ ID NO: 4459262 - DNA, 14 bp, Homo sapiens
gcctgctgccagtg

SEQ ID NO: 4459263 - DNA, 22 bp, Homo sapiens
gcctgctgccagtgcagccact

SEQ ID NO: 4459264 - DNA, 23 bp, Homo sapiens
gcctgctgccagtgcagccactg

SEQ ID NO: 4459265 - DNA, 17 bp, Homo sapiens
gcctgctgcctgctgag

SEQ ID NO: 4459266 - DNA, 17 bp, Homo sapiens
gcctgctggcacccacc

SEQ ID NO: 4459267 - DNA, 22 bp, Homo sapiens
gcctgctggcacccaccgtgga

SEQ ID NO: 4459268 - DNA, 20 bp, Homo sapiens
gcctgctggccgacccactg

SEQ ID NO: 4459269 - DNA, 13 bp, Homo sapiens
gcctgctggctgc

SEQ ID NO: 4459270 - DNA, 19 bp, Homo sapiens
gcctgctggctgcggcccc

SEQ ID NO: 4459271 - DNA, 20 bp, Homo sapiens
gcctgctgggctctccacct

SEQ ID NO: 4459272 - DNA, 21 bp, Homo sapiens
gcctgctgggctctccacctc

SEQ ID NO: 4459273 - DNA, 19 bp, Homo sapiens
gcctgctggtcacagcctc

SEQ ID NO: 4459274 - DNA, 21 bp, Homo sapiens
gcctgctggtcacagcctcct

SEQ ID NO: 4459275 - DNA, 23 bp, Homo sapiens
gcctgctggttttatctgagtga

SEQ ID NO: 4459276 - DNA, 22 bp, Homo sapiens
gcctgctgtgattccactacac

SEQ ID NO: 4459277 - DNA, 18 bp, Homo sapiens
gcctgcttctttccagaa

SEQ ID NO: 4459278 - DNA, 17 bp, Homo sapiens
gcctggacaggcgggct

SEQ ID NO: 4459279 - DNA, 16 bp, Homo sapiens
gcctggaccacccctg

SEQ ID NO: 4459280 - DNA, 18 bp, Homo sapiens
gcctggagccccatcggc

SEQ ID NO: 4459281 - DNA, 20 bp, Homo sapiens
gcctggcaatagaccgagac

SEQ ID NO: 4459282 - DNA, 13 bp, Homo sapiens
gcctggcacgaag

SEQ ID NO: 4459283 - DNA, 14 bp, Homo sapiens
gcctggcaggctgt

SEQ ID NO: 4459284 - DNA, 19 bp, Homo sapiens
gcctggccaggagctcttc

SEQ ID NO: 4459285 - DNA, 15 bp, Homo sapiens
gcctggccaggcaga

SEQ ID NO: 4459286 - DNA, 14 bp, Homo sapiens
gcctggccatctcc

SEQ ID NO: 4459287 - DNA, 21 bp, Homo sapiens
gcctggccatctccctcccca

SEQ ID NO: 4459288 - DNA, 10 bp, Homo sapiens
gcctggcccc

SEQ ID NO: 4459289 - DNA, 13 bp, Homo sapiens
gcctggccccagc

SEQ ID NO: 4459290 - DNA, 19 bp, Homo sapiens
gcctggccccagcctgggc

SEQ ID NO: 4459291 - DNA, 14 bp, Homo sapiens
gcctggccccaggc

SEQ ID NO: 4459292 - DNA, 17 bp, Homo sapiens
gcctggccccaggcccc

SEQ ID NO: 4459293 - DNA, 18 bp, Homo sapiens
gcctggccccaggcccca

SEQ ID NO: 4459294 - DNA, 20 bp, Homo sapiens
gcctggccccaggccccaga

SEQ ID NO: 4459295 - DNA, 22 bp, Homo sapiens
gcctggcccccaacctcagggc

SEQ ID NO: 4459296 - DNA, 14 bp, Homo sapiens
gcctggccctgctt

SEQ ID NO: 4459297 - DNA, 16 bp, Homo sapiens
gcctggcctcatctca

SEQ ID NO: 4459298 - DNA, 13 bp, Homo sapiens
gcctggctccctg

SEQ ID NO: 4459299 - DNA, 23 bp, Homo sapiens
gcctggctctgccccctccccca

SEQ ID NO: 4459300 - DNA, 17 bp, Homo sapiens
gcctggctctgccccgc

SEQ ID NO: 4459301 - DNA, 23 bp, Homo sapiens
gcctggctggaggagcagcagct

SEQ ID NO: 4459302 - DNA, 16 bp, Homo sapiens
gcctgggagcccagag

SEQ ID NO: 4459303 - DNA, 14 bp, Homo sapiens
gcctgggcctgggt

SEQ ID NO: 4459304 - DNA, 19 bp, Homo sapiens
gcctgggctcactgtgctg

SEQ ID NO: 4459305 - DNA, 20 bp, Homo sapiens
gcctgggggacagaaagaga

SEQ ID NO: 4459306 - DNA, 15 bp, Homo sapiens
gcctgggtcacagag

SEQ ID NO: 4459307 - DNA, 18 bp, Homo sapiens
gcctgggtcacagagtga

SEQ ID NO: 4459308 - DNA, 23 bp, Homo sapiens
gcctgggtcacagagtgagactc

SEQ ID NO: 4459309 - DNA, 13 bp, Homo sapiens
gcctgggtcatgg

SEQ ID NO: 4459310 - DNA, 22 bp, Homo sapiens
gcctgggtgacagagtgagacc

SEQ ID NO: 4459311 - DNA, 16 bp, Homo sapiens
gcctgggtggggctgc

SEQ ID NO: 4459312 - DNA, 20 bp, Homo sapiens
gcctgggtggggctgctcct

SEQ ID NO: 4459313 - DNA, 24 bp, Homo sapiens
gcctgggtggggctgctcctccag

SEQ ID NO: 4459314 - DNA, 21 bp, Homo sapiens
gcctgggtgtcaagtgcctgc

SEQ ID NO: 4459315 - DNA, 22 bp, Homo sapiens
gcctggtccagtggggaacagg

SEQ ID NO: 4459316 - DNA, 20 bp, Homo sapiens
gcctggtccttccctgatgg

SEQ ID NO: 4459317 - DNA, 21 bp, Homo sapiens
gcctggtccttccctgatggc

SEQ ID NO: 4459318 - DNA, 17 bp, Homo sapiens
gcctggtttcctcgaga

SEQ ID NO: 4459319 - DNA, 18 bp, Homo sapiens
gcctgtaatcacagctac

SEQ ID NO: 4459320 - DNA, 16 bp, Homo sapiens
gcctgtaatcccagca

SEQ ID NO: 4459321 - DNA, 18 bp, Homo sapiens
gcctgtaatcccagctac

SEQ ID NO: 4459322 - DNA, 19 bp, Homo sapiens
gcctgtagcaatggccaga

SEQ ID NO: 4459323 - DNA, 17 bp, Homo sapiens
gcctgtagtctcagcta

SEQ ID NO: 4459324 - DNA, 15 bp, Homo sapiens
gcctgtccaccctgc

SEQ ID NO: 4459325 - DNA, 13 bp, Homo sapiens
gcctgtccagcct

SEQ ID NO: 4459326 - DNA, 17 bp, Homo sapiens
gcctgtcccaattctgc

SEQ ID NO: 4459327 - DNA, 12 bp, Homo sapiens
gcctgtccctgg

SEQ ID NO: 4459328 - DNA, 14 bp, Homo sapiens
gcctgtcccttgcc

SEQ ID NO: 4459329 - DNA, 20 bp, Homo sapiens
gcctgtcccttgcctctgcc

SEQ ID NO: 4459330 - DNA, 13 bp, Homo sapiens
gcctgtgcccgca

SEQ ID NO: 4459331 - DNA, 22 bp, Homo sapiens
gcctgtggcagtaaagagaaac

SEQ ID NO: 4459332 - DNA, 22 bp, Homo sapiens
gcctgtggcatctttgccttgg

SEQ ID NO: 4459333 - DNA, 21 bp, Homo sapiens
gcctgtggcccctcccctgca

SEQ ID NO: 4459334 - DNA, 18 bp, Homo sapiens
gcctgtggcggtgcctgg

SEQ ID NO: 4459335 - DNA, 15 bp, Homo sapiens
gcctgtgggagtaga

SEQ ID NO: 4459336 - DNA, 17 bp, Homo sapiens
gcctgtgggtctctgaa

SEQ ID NO: 4459337 - DNA, 12 bp, Homo sapiens
gcctgtggtgaa

SEQ ID NO: 4459338 - DNA, 13 bp, Homo sapiens
gcctgtggtgaag

SEQ ID NO: 4459339 - DNA, 22 bp, Homo sapiens
gcctgtggtgaagtgtggctgg

SEQ ID NO: 4459340 - DNA, 19 bp, Homo sapiens
gcctgttaatttataatgt

SEQ ID NO: 4459341 - DNA, 21 bp, Homo sapiens
gcctgttaatttataatgtat

SEQ ID NO: 4459342 - DNA, 17 bp, Homo sapiens
gcctgttggcaggccca

SEQ ID NO: 4459343 - DNA, 21 bp, Homo sapiens
gccttaaaaaaacacggaagc

SEQ ID NO: 4459344 - DNA, 14 bp, Homo sapiens
gccttaaaaccaaa

SEQ ID NO: 4459345 - DNA, 22 bp, Homo sapiens
gccttaaactctggacactcta

SEQ ID NO: 4459346 - DNA, 14 bp, Homo sapiens
gccttacctcctgc

SEQ ID NO: 4459347 - DNA, 16 bp, Homo sapiens
gccttacctcctgccc

SEQ ID NO: 4459348 - DNA, 18 bp, Homo sapiens
gccttacctcctgcccag

SEQ ID NO: 4459349 - DNA, 15 bp, Homo sapiens
gccttactcacctct

SEQ ID NO: 4459350 - DNA, 17 bp, Homo sapiens
gccttagagccaggcac

SEQ ID NO: 4459351 - DNA, 14 bp, Homo sapiens
gccttagcagccct

SEQ ID NO: 4459352 - DNA, 15 bp, Homo sapiens
gccttagcagccctg

SEQ ID NO: 4459353 - DNA, 16 bp, Homo sapiens
gccttagcagccctgg

SEQ ID NO: 4459354 - DNA, 12 bp, Homo sapiens
gccttagcttca

SEQ ID NO: 4459355 - DNA, 15 bp, Homo sapiens
gccttagcttcagga

SEQ ID NO: 4459356 - DNA, 17 bp, Homo sapiens
gccttagcttcaggaac

SEQ ID NO: 4459357 - DNA, 22 bp, Homo sapiens
gccttagggaagctggcctgag

SEQ ID NO: 4459358 - DNA, 21 bp, Homo sapiens
gccttagtagtcaaaaacaaa

SEQ ID NO: 4459359 - DNA, 18 bp, Homo sapiens
gccttatgaaaattatac

SEQ ID NO: 4459360 - DNA, 16 bp, Homo sapiens
gccttatgttgaaaaa

SEQ ID NO: 4459361 - DNA, 19 bp, Homo sapiens
gccttattcccccaaactt

SEQ ID NO: 4459362 - DNA, 14 bp, Homo sapiens
gccttatttctcat

SEQ ID NO: 4459363 - DNA, 15 bp, Homo sapiens
gccttatttgtctgt

SEQ ID NO: 4459364 - DNA, 16 bp, Homo sapiens
gccttatttgtctgta

SEQ ID NO: 4459365 - DNA, 14 bp, Homo sapiens
gccttcactgggcc

SEQ ID NO: 4459366 - DNA, 16 bp, Homo sapiens
gccttcactgggccag

SEQ ID NO: 4459367 - DNA, 17 bp, Homo sapiens
gccttcactgggccagt

SEQ ID NO: 4459368 - DNA, 16 bp, Homo sapiens
gccttccagatcctct

SEQ ID NO: 4459369 - DNA, 23 bp, Homo sapiens
gccttccagatcctctctggggc

SEQ ID NO: 4459370 - DNA, 12 bp, Homo sapiens
gccttccagttt

SEQ ID NO: 4459371 - DNA, 14 bp, Homo sapiens
gccttccagttttg

SEQ ID NO: 4459372 - DNA, 18 bp, Homo sapiens
gccttccatttcccctct

SEQ ID NO: 4459373 - DNA, 21 bp, Homo sapiens
gccttcccaagttgtgcttga

SEQ ID NO: 4459374 - DNA, 13 bp, Homo sapiens
gccttcccccaac

SEQ ID NO: 4459375 - DNA, 20 bp, Homo sapiens
gccttcccctggcactggca

SEQ ID NO: 4459376 - DNA, 23 bp, Homo sapiens
gccttccctagctttagaccctg

SEQ ID NO: 4459377 - DNA, 13 bp, Homo sapiens
gccttcctcctca

SEQ ID NO: 4459378 - DNA, 19 bp, Homo sapiens
gccttcctgtttttcacat

SEQ ID NO: 4459379 - DNA, 15 bp, Homo sapiens
gccttcggagggaaa

SEQ ID NO: 4459380 - DNA, 16 bp, Homo sapiens
gccttcgtgcctgaga

SEQ ID NO: 4459381 - DNA, 12 bp, Homo sapiens
gccttctcacca

SEQ ID NO: 4459382 - DNA, 15 bp, Homo sapiens
gccttctcagaagca

SEQ ID NO: 4459383 - DNA, 19 bp, Homo sapiens
gccttctgccaccagcccc

SEQ ID NO: 4459384 - DNA, 14 bp, Homo sapiens
gccttctggccttg

SEQ ID NO: 4459385 - DNA, 17 bp, Homo sapiens
gccttctggtttcttcc

SEQ ID NO: 4459386 - DNA, 13 bp, Homo sapiens
gccttctgtgggg

SEQ ID NO: 4459387 - DNA, 12 bp, Homo sapiens
gccttctttcca

SEQ ID NO: 4459388 - DNA, 21 bp, Homo sapiens
gccttctttccatcaactccc

SEQ ID NO: 4459389 - DNA, 23 bp, Homo sapiens
gccttctttccatcaactcccaa

SEQ ID NO: 4459390 - DNA, 15 bp, Homo sapiens
gccttgagccctggc

SEQ ID NO: 4459391 - DNA, 14 bp, Homo sapiens
gccttgcaagatgg

SEQ ID NO: 4459392 - DNA, 20 bp, Homo sapiens
gccttgcagcggctcctgca

SEQ ID NO: 4459393 - DNA, 12 bp, Homo sapiens
gccttgcccaga

SEQ ID NO: 4459394 - DNA, 14 bp, Homo sapiens
gccttgcccagcct

SEQ ID NO: 4459395 - DNA, 17 bp, Homo sapiens
gccttgcccagcctgga

SEQ ID NO: 4459396 - DNA, 19 bp, Homo sapiens
gccttgcccagcctggatg

SEQ ID NO: 4459397 - DNA, 18 bp, Homo sapiens
gccttgccctcctgggcc

SEQ ID NO: 4459398 - DNA, 15 bp, Homo sapiens
gccttgctctcttca

SEQ ID NO: 4459399 - DNA, 21 bp, Homo sapiens
gccttgctctcttcaataaac

SEQ ID NO: 4459400 - DNA, 19 bp, Homo sapiens
gccttggaaatagaaagaa

SEQ ID NO: 4459401 - DNA, 20 bp, Homo sapiens
gccttggagggtcccaagct

SEQ ID NO: 4459402 - DNA, 21 bp, Homo sapiens
gccttggataatgctgttgcc

SEQ ID NO: 4459403 - DNA, 12 bp, Homo sapiens
gccttggcctcc

SEQ ID NO: 4459404 - DNA, 17 bp, Homo sapiens
gccttggcctcccaaag

SEQ ID NO: 4459405 - DNA, 20 bp, Homo sapiens
gccttggctgacatgaagct

SEQ ID NO: 4459406 - DNA, 18 bp, Homo sapiens
gccttgggctgctcctca

SEQ ID NO: 4459407 - DNA, 19 bp, Homo sapiens
gccttggggaatttcctct

SEQ ID NO: 4459408 - DNA, 16 bp, Homo sapiens
gccttggtatcatttt

SEQ ID NO: 4459409 - DNA, 21 bp, Homo sapiens
gccttgtataatattgaaaat

SEQ ID NO: 4459410 - DNA, 16 bp, Homo sapiens
gccttgtcacgccaga

SEQ ID NO: 4459411 - DNA, 23 bp, Homo sapiens
gccttgtttaatggtagttttac

SEQ ID NO: 4459412 - DNA, 19 bp, Homo sapiens
gccttgtttgagtttttcc

SEQ ID NO: 4459413 - DNA, 17 bp, Homo sapiens
gcctttaaatctgtgat

SEQ ID NO: 4459414 - DNA, 17 bp, Homo sapiens
gcctttaagaaccttaa

SEQ ID NO: 4459415 - DNA, 18 bp, Homo sapiens
gcctttaagaaccttaat

SEQ ID NO: 4459416 - DNA, 20 bp, Homo sapiens
gcctttacgttcatcacctg

SEQ ID NO: 4459417 - DNA, 23 bp, Homo sapiens
gcctttatttttggcgtggctga

SEQ ID NO: 4459418 - DNA, 21 bp, Homo sapiens
gcctttcatggcaatgaaaat

SEQ ID NO: 4459419 - DNA, 20 bp, Homo sapiens
gcctttcctcaaaactggag

SEQ ID NO: 4459420 - DNA, 20 bp, Homo sapiens
gcctttcctgttcagcattc

SEQ ID NO: 4459421 - DNA, 13 bp, Homo sapiens
gcctttccttccc

SEQ ID NO: 4459422 - DNA, 13 bp, Homo sapiens
gcctttctttgcc

SEQ ID NO: 4459423 - DNA, 16 bp, Homo sapiens
gcctttctttgcctct

SEQ ID NO: 4459424 - DNA, 18 bp, Homo sapiens
gcctttctttgcctctgc

SEQ ID NO: 4459425 - DNA, 14 bp, Homo sapiens
gcctttgcaagatg

SEQ ID NO: 4459426 - DNA, 21 bp, Homo sapiens
gcctttgcagttggactctca

SEQ ID NO: 4459427 - DNA, 23 bp, Homo sapiens
gcctttgcagttggactctcagg

SEQ ID NO: 4459428 - DNA, 15 bp, Homo sapiens
gcctttgccagcaga

SEQ ID NO: 4459429 - DNA, 18 bp, Homo sapiens
gcctttgccagcagagcc

SEQ ID NO: 4459430 - DNA, 20 bp, Homo sapiens
gcctttgccagcagagccag

SEQ ID NO: 4459431 - DNA, 22 bp, Homo sapiens
gcctttgccagcagagccaggg

SEQ ID NO: 4459432 - DNA, 23 bp, Homo sapiens
gcctttgccagcagagccagggc

SEQ ID NO: 4459433 - DNA, 16 bp, Homo sapiens
gcctttgccgtgagca

SEQ ID NO: 4459434 - DNA, 19 bp, Homo sapiens
gcctttggacccagggcct

SEQ ID NO: 4459435 - DNA, 12 bp, Homo sapiens
gcctttggcctg

SEQ ID NO: 4459436 - DNA, 16 bp, Homo sapiens
gcctttgtgctgcgcc

SEQ ID NO: 4459437 - DNA, 22 bp, Homo sapiens
gcctttgtgctgcgcctgcagg

SEQ ID NO: 4459438 - DNA, 20 bp, Homo sapiens
gccttttacccctgcacagt

SEQ ID NO: 4459439 - DNA, 17 bp, Homo sapiens
gccttttccacacgcat

SEQ ID NO: 4459440 - DNA, 22 bp, Homo sapiens
gccttttccttctggttctaac

SEQ ID NO: 4459441 - DNA, 15 bp, Homo sapiens
gccttttgctctctg

SEQ ID NO: 4459442 - DNA, 13 bp, Homo sapiens
gccttttgttaat

SEQ ID NO: 4459443 - DNA, 14 bp, Homo sapiens
gccttttgttaatg

SEQ ID NO: 4459444 - DNA, 15 bp, Homo sapiens
gcctttttcatttat

SEQ ID NO: 4459445 - DNA, 13 bp, Homo sapiens
gcctttttcctgc

SEQ ID NO: 4459446 - DNA, 22 bp, Homo sapiens
gcgaaaaaatcaggtggctttt

SEQ ID NO: 4459447 - DNA, 14 bp, Homo sapiens
gcgaataaatgttc

SEQ ID NO: 4459448 - DNA, 16 bp, Homo sapiens
gcgaataaatgttcaa

SEQ ID NO: 4459449 - DNA, 22 bp, Homo sapiens
gcgacagtgagactctgtctca

SEQ ID NO: 4459450 - DNA, 22 bp, Homo sapiens
gcgaccaataaacagctcccag

SEQ ID NO: 4459451 - DNA, 16 bp, Homo sapiens
gcgaccacccctgcct

SEQ ID NO: 4459452 - DNA, 14 bp, Homo sapiens
gcgacttccacaaa

SEQ ID NO: 4459453 - DNA, 22 bp, Homo sapiens
gcgagacgcacacagctgagca

SEQ ID NO: 4459454 - DNA, 24 bp, Homo sapiens
gcgagccatttgtcccaagtgcca

SEQ ID NO: 4459455 - DNA, 12 bp, Homo sapiens
gcgagctgcagg

SEQ ID NO: 4459456 - DNA, 20 bp, Homo sapiens
gcgaggagatgctccttggg

SEQ ID NO: 4459457 - DNA, 17 bp, Homo sapiens
gcgaggtcaacagagaa

SEQ ID NO: 4459458 - DNA, 18 bp, Homo sapiens
gcgaggtcaacagagaag

SEQ ID NO: 4459459 - DNA, 22 bp, Homo sapiens
gcgaggtcaacagagaaggcag

SEQ ID NO: 4459460 - DNA, 23 bp, Homo sapiens
gcgaggtcaacagagaaggcagg

SEQ ID NO: 4459461 - DNA, 13 bp, Homo sapiens
gcgaggtgtaaag

SEQ ID NO: 4459462 - DNA, 17 bp, Homo sapiens
gcgagtctggggacctg

SEQ ID NO: 4459463 - DNA, 22 bp, Homo sapiens
gcgatgggtcaggtagggggga

SEQ ID NO: 4459464 - DNA, 15 bp, Homo sapiens
gcgcaccccacagct

SEQ ID NO: 4459465 - DNA, 20 bp, Homo sapiens
gcgcaccccacagctggggc

SEQ ID NO: 4459466 - DNA, 21 bp, Homo sapiens
gcgcaccccacagctggggcc

SEQ ID NO: 4459467 - DNA, 15 bp, Homo sapiens
gcgcagaatgaaggg

SEQ ID NO: 4459468 - DNA, 16 bp, Homo sapiens
gcgcagcctccagggc

SEQ ID NO: 4459469 - DNA, 19 bp, Homo sapiens
gcgcaggtgggctggactt

SEQ ID NO: 4459470 - DNA, 18 bp, Homo sapiens
gcgcagtgtggaggccac

SEQ ID NO: 4459471 - DNA, 18 bp, Homo sapiens
gcgccaagtctggcacca

SEQ ID NO: 4459472 - DNA, 17 bp, Homo sapiens
gcgccaccgtgcctggc

SEQ ID NO: 4459473 - DNA, 17 bp, Homo sapiens
gcgcccacccggcccgg

SEQ ID NO: 4459474 - DNA, 20 bp, Homo sapiens
gcgccccgcacgactgcggg

SEQ ID NO: 4459475 - DNA, 19 bp, Homo sapiens
gcgcccctctttttcccct

SEQ ID NO: 4459476 - DNA, 18 bp, Homo sapiens
gcgcccgccaacacgcct

SEQ ID NO: 4459477 - DNA, 22 bp, Homo sapiens
gcgcccttaactgcatccagcc

SEQ ID NO: 4459478 - DNA, 13 bp, Homo sapiens
gcgccgatgccac

SEQ ID NO: 4459479 - DNA, 15 bp, Homo sapiens
gcgccgatgccaccg

SEQ ID NO: 4459480 - DNA, 14 bp, Homo sapiens
gcgcctaagccttt

SEQ ID NO: 4459481 - DNA, 24 bp, Homo sapiens
gcgcctacccttcccgcctccctc

SEQ ID NO: 4459482 - DNA, 14 bp, Homo sapiens
gcgcctcagccctc

SEQ ID NO: 4459483 - DNA, 15 bp, Homo sapiens
gcgcctcagccctca

SEQ ID NO: 4459484 - DNA, 12 bp, Homo sapiens
gcgcctccctcc

SEQ ID NO: 4459485 - DNA, 14 bp, Homo sapiens
gcgcctccctccac

SEQ ID NO: 4459486 - DNA, 17 bp, Homo sapiens
gcgcctccctccacccc

SEQ ID NO: 4459487 - DNA, 18 bp, Homo sapiens
gcgcctccctccacccca

SEQ ID NO: 4459488 - DNA, 23 bp, Homo sapiens
gcgcctccctccaccccaggacg

SEQ ID NO: 4459489 - DNA, 12 bp, Homo sapiens
gcgcctctgcaa

SEQ ID NO: 4459490 - DNA, 19 bp, Homo sapiens
gcgcctgcaggcagagctg

SEQ ID NO: 4459491 - DNA, 17 bp, Homo sapiens
gcgcctgcgttcccaga

SEQ ID NO: 4459492 - DNA, 19 bp, Homo sapiens
gcgcctgctgcctgctgag

SEQ ID NO: 4459493 - DNA, 17 bp, Homo sapiens
gcgcgccaccgtgcctg

SEQ ID NO: 4459494 - DNA, 14 bp, Homo sapiens
gcgcggccagcccc

SEQ ID NO: 4459495 - DNA, 23 bp, Homo sapiens
gcgcggccagccccggccctggg

SEQ ID NO: 4459496 - DNA, 20 bp, Homo sapiens
gcgcggtggctcacgcctgt

SEQ ID NO: 4459497 - DNA, 11 bp, Homo sapiens
gcgctcagggg

SEQ ID NO: 4459498 - DNA, 22 bp, Homo sapiens
gcgctcaggggctccatgctgg

SEQ ID NO: 4459499 - DNA, 15 bp, Homo sapiens
gcgctcatctggctt

SEQ ID NO: 4459500 - DNA, 21 bp, Homo sapiens
gcgctccgggaacagtgcatg

SEQ ID NO: 4459501 - DNA, 20 bp, Homo sapiens
gcgctcgatggacctcagca

SEQ ID NO: 4459502 - DNA, 14 bp, Homo sapiens
gcgctcgcccagca

SEQ ID NO: 4459503 - DNA, 15 bp, Homo sapiens
gcgctcgcccagcag

SEQ ID NO: 4459504 - DNA, 17 bp, Homo sapiens
gcgctcggtctccaccc

SEQ ID NO: 4459505 - DNA, 22 bp, Homo sapiens
gcgctcggtctccaccccaggg

SEQ ID NO: 4459506 - DNA, 20 bp, Homo sapiens
gcgctgcatacaggggaggg

SEQ ID NO: 4459507 - DNA, 19 bp, Homo sapiens
gcgctgccgcaccccagag

SEQ ID NO: 4459508 - DNA, 13 bp, Homo sapiens
gcgctggggagac

SEQ ID NO: 4459509 - DNA, 18 bp, Homo sapiens
gcgctgtatttacagaca

SEQ ID NO: 4459510 - DNA, 20 bp, Homo sapiens
gcgcttggtctttctgtgct

SEQ ID NO: 4459511 - DNA, 12 bp, Homo sapiens
gcggaaggaggt

SEQ ID NO: 4459512 - DNA, 14 bp, Homo sapiens
gcggacgttccagc

SEQ ID NO: 4459513 - DNA, 17 bp, Homo sapiens
gcggagcacactggctc

SEQ ID NO: 4459514 - DNA, 19 bp, Homo sapiens
gcggagcccagcctgggag

SEQ ID NO: 4459515 - DNA, 21 bp, Homo sapiens
gcggagcccagcctgggagcc

SEQ ID NO: 4459516 - DNA, 23 bp, Homo sapiens
gcggagcgggaggcggtggtaga

SEQ ID NO: 4459517 - DNA, 21 bp, Homo sapiens
gcggagctgctgagtgacagc

SEQ ID NO: 4459518 - DNA, 15 bp, Homo sapiens
gcggaggctgtgctc

SEQ ID NO: 4459519 - DNA, 19 bp, Homo sapiens
gcggaggttgcagtgagct

SEQ ID NO: 4459520 - DNA, 19 bp, Homo sapiens
gcggccagccccggccctg

SEQ ID NO: 4459521 - DNA, 18 bp, Homo sapiens
gcggccaggcctgcgggc

SEQ ID NO: 4459522 - DNA, 18 bp, Homo sapiens
gcggcccagcccggctcc

SEQ ID NO: 4459523 - DNA, 16 bp, Homo sapiens
gcggcccctcccgccc

SEQ ID NO: 4459524 - DNA, 14 bp, Homo sapiens
gcggccctggagga

SEQ ID NO: 4459525 - DNA, 16 bp, Homo sapiens
gcggccgcattccctg

SEQ ID NO: 4459526 - DNA, 17 bp, Homo sapiens
gcggccgcattccctga

SEQ ID NO: 4459527 - DNA, 18 bp, Homo sapiens
gcggccgcattccctgag

SEQ ID NO: 4459528 - DNA, 22 bp, Homo sapiens
gcggcctcgtgccatgatctgt

SEQ ID NO: 4459529 - DNA, 22 bp, Homo sapiens
gcggcggtggactgcgctggac

SEQ ID NO: 4459530 - DNA, 13 bp, Homo sapiens
gcggctactcagc

SEQ ID NO: 4459531 - DNA, 19 bp, Homo sapiens
gcggctactcagcagccct

SEQ ID NO: 4459532 - DNA, 14 bp, Homo sapiens
gcggctactctgga

SEQ ID NO: 4459533 - DNA, 18 bp, Homo sapiens
gcggctcccctctgcttc

SEQ ID NO: 4459534 - DNA, 15 bp, Homo sapiens
gcggctcctggtgct

SEQ ID NO: 4459535 - DNA, 22 bp, Homo sapiens
gcggctgagtcatgatctccct

SEQ ID NO: 4459536 - DNA, 13 bp, Homo sapiens
gcggctgggagga

SEQ ID NO: 4459537 - DNA, 14 bp, Homo sapiens
gcggctgggaggag

SEQ ID NO: 4459538 - DNA, 17 bp, Homo sapiens
gcggctgggaggagggc

SEQ ID NO: 4459539 - DNA, 18 bp, Homo sapiens
gcggctgggaggagggca

SEQ ID NO: 4459540 - DNA, 15 bp, Homo sapiens
gcgggagccagactg

SEQ ID NO: 4459541 - DNA, 20 bp, Homo sapiens
gcgggagccagactgtccag

SEQ ID NO: 4459542 - DNA, 15 bp, Homo sapiens
gcgggagctctgtat

SEQ ID NO: 4459543 - DNA, 17 bp, Homo sapiens
gcgggatcctccacaga

SEQ ID NO: 4459544 - DNA, 18 bp, Homo sapiens
gcgggatcctccacagag

SEQ ID NO: 4459545 - DNA, 17 bp, Homo sapiens
gcgggcagagggctgga

SEQ ID NO: 4459546 - DNA, 21 bp, Homo sapiens
gcgggcagccccgttttgggg

SEQ ID NO: 4459547 - DNA, 13 bp, Homo sapiens
gcgggccaggagg

SEQ ID NO: 4459548 - DNA, 15 bp, Homo sapiens
gcgggctcagagctt

SEQ ID NO: 4459549 - DNA, 16 bp, Homo sapiens
gcgggctcagagcttt

SEQ ID NO: 4459550 - DNA, 15 bp, Homo sapiens
gcgggctgaggagac

SEQ ID NO: 4459551 - DNA, 18 bp, Homo sapiens
gcgggctgaggccagagt

SEQ ID NO: 4459552 - DNA, 19 bp, Homo sapiens
gcgggctggcgggcctttt

SEQ ID NO: 4459553 - DNA, 12 bp, Homo sapiens
gcggggccttgc

SEQ ID NO: 4459554 - DNA, 22 bp, Homo sapiens
gcggggggtgtcttccctgcct

SEQ ID NO: 4459555 - DNA, 23 bp, Homo sapiens
gcggggggtgtcttccctgcctg

SEQ ID NO: 4459556 - DNA, 15 bp, Homo sapiens
gcgggtgatggccag

SEQ ID NO: 4459557 - DNA, 19 bp, Homo sapiens
gcgggtggatcacctgagg

SEQ ID NO: 4459558 - DNA, 18 bp, Homo sapiens
gcggtggactgcgctgga

SEQ ID NO: 4459559 - DNA, 16 bp, Homo sapiens
gcggtggctgccccgg

SEQ ID NO: 4459560 - DNA, 17 bp, Homo sapiens
gcggtggctgccccggc

SEQ ID NO: 4459561 - DNA, 20 bp, Homo sapiens
gcggtttactcactgctgca

SEQ ID NO: 4459562 - DNA, 13 bp, Homo sapiens
gcgtaaggatgtg

SEQ ID NO: 4459563 - DNA, 15 bp, Homo sapiens
gcgtcagcctccagc

SEQ ID NO: 4459564 - DNA, 15 bp, Homo sapiens
gcgtccaccctgagc

SEQ ID NO: 4459565 - DNA, 23 bp, Homo sapiens
gcgtcccagctcccctcttttgt

SEQ ID NO: 4459566 - DNA, 19 bp, Homo sapiens
gcgtcccctgctactcctg

SEQ ID NO: 4459567 - DNA, 14 bp, Homo sapiens
gcgtcctcctctgt

SEQ ID NO: 4459568 - DNA, 15 bp, Homo sapiens
gcgtcctcctctgtg

SEQ ID NO: 4459569 - DNA, 19 bp, Homo sapiens
gcgtcctgtccacacccag

SEQ ID NO: 4459570 - DNA, 14 bp, Homo sapiens
gcgtgactcaccca

SEQ ID NO: 4459571 - DNA, 13 bp, Homo sapiens
gcgtgcgcactgc

SEQ ID NO: 4459572 - DNA, 15 bp, Homo sapiens
gcgtgcgcactgcat

SEQ ID NO: 4459573 - DNA, 19 bp, Homo sapiens
gcgtgcgcactgcatggga

SEQ ID NO: 4459574 - DNA, 12 bp, Homo sapiens
gcgtggctgact

SEQ ID NO: 4459575 - DNA, 12 bp, Homo sapiens
gcgtgggtcaga

SEQ ID NO: 4459576 - DNA, 14 bp, Homo sapiens
gcgtgggtcagaag

SEQ ID NO: 4459577 - DNA, 21 bp, Homo sapiens
gcgtgttccagccaaagcatg

SEQ ID NO: 4459578 - DNA, 18 bp, Homo sapiens
gcgttatgaagagctaat

SEQ ID NO: 4459579 - DNA, 13 bp, Homo sapiens
gcgttcacctccc

SEQ ID NO: 4459580 - DNA, 18 bp, Homo sapiens
gcgttcacctccctgctc

SEQ ID NO: 4459581 - DNA, 14 bp, Homo sapiens
gcgttctcaagaat

SEQ ID NO: 4459582 - DNA, 14 bp, Homo sapiens
gcgttgggagccta

SEQ ID NO: 4459583 - DNA, 17 bp, Homo sapiens
gcgttgggagcctagct

SEQ ID NO: 4459584 - DNA, 18 bp, Homo sapiens
gcgttgtgtatattacac

SEQ ID NO: 4459585 - DNA, 22 bp, Homo sapiens
gcgtttgaccttttatgtagta

SEQ ID NO: 4459586 - DNA, 20 bp, Homo sapiens
gctaaaaaggtcctgtaaga

SEQ ID NO: 4459587 - DNA, 22 bp, Homo sapiens
gctaaaaatgagcttgattaaa

SEQ ID NO: 4459588 - DNA, 18 bp, Homo sapiens
gctaaaaggcttccaggc

SEQ ID NO: 4459589 - DNA, 14 bp, Homo sapiens
gctaaaatatataa

SEQ ID NO: 4459590 - DNA, 23 bp, Homo sapiens
gctaaaattaaaaagaaaatatt

SEQ ID NO: 4459591 - DNA, 15 bp, Homo sapiens
gctaaactgaatcta

SEQ ID NO: 4459592 - DNA, 15 bp, Homo sapiens
gctaaagacatgaag

SEQ ID NO: 4459593 - DNA, 18 bp, Homo sapiens
gctaaagagcccttgcct

SEQ ID NO: 4459594 - DNA, 22 bp, Homo sapiens
gctaaagagcccttgcctcccc

SEQ ID NO: 4459595 - DNA, 16 bp, Homo sapiens
gctaaagcctgaattt

SEQ ID NO: 4459596 - DNA, 12 bp, Homo sapiens
gctaaagcctgt

SEQ ID NO: 4459597 - DNA, 16 bp, Homo sapiens
gctaaatctcctattt

SEQ ID NO: 4459598 - DNA, 20 bp, Homo sapiens
gctaaccacttcgcacacac

SEQ ID NO: 4459599 - DNA, 22 bp, Homo sapiens
gctaaccatcgaaaagaacatg

SEQ ID NO: 4459600 - DNA, 21 bp, Homo sapiens
gctaacccccagcccacagag

SEQ ID NO: 4459601 - DNA, 19 bp, Homo sapiens
gctaaccttatcctgcatt

SEQ ID NO: 4459602 - DNA, 21 bp, Homo sapiens
gctaaccttatcctgcattgt

SEQ ID NO: 4459603 - DNA, 12 bp, Homo sapiens
gctaagaaaaag

SEQ ID NO: 4459604 - DNA, 14 bp, Homo sapiens
gctaagaaaaagga

SEQ ID NO: 4459605 - DNA, 21 bp, Homo sapiens
gctaagcggaacatgtgcttc

SEQ ID NO: 4459606 - DNA, 12 bp, Homo sapiens
gctaaggcagct

SEQ ID NO: 4459607 - DNA, 17 bp, Homo sapiens
gctaaggctcctccttg

SEQ ID NO: 4459608 - DNA, 19 bp, Homo sapiens
gctaaggctcctccttgcc

SEQ ID NO: 4459609 - DNA, 14 bp, Homo sapiens
gctaagtgcttatt

SEQ ID NO: 4459610 - DNA, 18 bp, Homo sapiens
gctaataatgagctatta

SEQ ID NO: 4459611 - DNA, 21 bp, Homo sapiens
gctaataatgagctattaaaa

SEQ ID NO: 4459612 - DNA, 13 bp, Homo sapiens
gctaatatacttt

SEQ ID NO: 4459613 - DNA, 20 bp, Homo sapiens
gctaatctgcctggttttat

SEQ ID NO: 4459614 - DNA, 23 bp, Homo sapiens
gctaatctgcctggttttattta

SEQ ID NO: 4459615 - DNA, 11 bp, Homo sapiens
gctaatgtgca

SEQ ID NO: 4459616 - DNA, 18 bp, Homo sapiens
gctaattctgggaaggga

SEQ ID NO: 4459617 - DNA, 16 bp, Homo sapiens
gctaatttttgtaatt

SEQ ID NO: 4459618 - DNA, 17 bp, Homo sapiens
gctaatttttgtaattt

SEQ ID NO: 4459619 - DNA, 19 bp, Homo sapiens
gctacaaaaacacagcaag

SEQ ID NO: 4459620 - DNA, 17 bp, Homo sapiens
gctacacccttttccag

SEQ ID NO: 4459621 - DNA, 19 bp, Homo sapiens
gctacacccttttccagct

SEQ ID NO: 4459622 - DNA, 12 bp, Homo sapiens
gctacagctcca

SEQ ID NO: 4459623 - DNA, 19 bp, Homo sapiens
gctacagctccacacgccc

SEQ ID NO: 4459624 - DNA, 19 bp, Homo sapiens
gctacaggaagcaccccat

SEQ ID NO: 4459625 - DNA, 23 bp, Homo sapiens
gctacaggaagcaccccatgcca

SEQ ID NO: 4459626 - DNA, 16 bp, Homo sapiens
gctacatcagactcta

SEQ ID NO: 4459627 - DNA, 15 bp, Homo sapiens
gctacatcagccttc

SEQ ID NO: 4459628 - DNA, 17 bp, Homo sapiens
gctacatcagccttcaa

SEQ ID NO: 4459629 - DNA, 19 bp, Homo sapiens
gctacatgttgcaacaaat

SEQ ID NO: 4459630 - DNA, 14 bp, Homo sapiens
gctaccaagtcaga

SEQ ID NO: 4459631 - DNA, 14 bp, Homo sapiens
gctaccagtattta

SEQ ID NO: 4459632 - DNA, 18 bp, Homo sapiens
gctaccagtatttagaag

SEQ ID NO: 4459633 - DNA, 19 bp, Homo sapiens
gctaccagtatttagaagc

SEQ ID NO: 4459634 - DNA, 22 bp, Homo sapiens
gctaccagtatttagaagccaa

SEQ ID NO: 4459635 - DNA, 23 bp, Homo sapiens
gctacccgctgtggccggtgcca

SEQ ID NO: 4459636 - DNA, 19 bp, Homo sapiens
gctaccctgagctgaggca

SEQ ID NO: 4459637 - DNA, 20 bp, Homo sapiens
gctaccctgagctgaggcag

SEQ ID NO: 4459638 - DNA, 20 bp, Homo sapiens
gctacccttttcctttgtgg

SEQ ID NO: 4459639 - DNA, 15 bp, Homo sapiens
gctacctttttatat

SEQ ID NO: 4459640 - DNA, 21 bp, Homo sapiens
gctactataatcaaatgattt

SEQ ID NO: 4459641 - DNA, 17 bp, Homo sapiens
gctactcagcagccctc

SEQ ID NO: 4459642 - DNA, 18 bp, Homo sapiens
gctactcagcagccctcc

SEQ ID NO: 4459643 - DNA, 22 bp, Homo sapiens
gctactcagcagccctcctcac

SEQ ID NO: 4459644 - DNA, 24 bp, Homo sapiens
gctactcagcagccctcctcaccc

SEQ ID NO: 4459645 - DNA, 12 bp, Homo sapiens
gctactcaggag

SEQ ID NO: 4459646 - DNA, 18 bp, Homo sapiens
gctactcaggaggctgag

SEQ ID NO: 4459647 - DNA, 22 bp, Homo sapiens
gctactcaggaggctgagacag

SEQ ID NO: 4459648 - DNA, 23 bp, Homo sapiens
gctactcaggaggctgagacagg

SEQ ID NO: 4459649 - DNA, 14 bp, Homo sapiens
gctactcccacagc

SEQ ID NO: 4459650 - DNA, 13 bp, Homo sapiens
gctactcctgtgc

SEQ ID NO: 4459651 - DNA, 14 bp, Homo sapiens
gctactctggaatg

SEQ ID NO: 4459652 - DNA, 18 bp, Homo sapiens
gctactgcactccagcct

SEQ ID NO: 4459653 - DNA, 21 bp, Homo sapiens
gctactgcactccagcctggg

SEQ ID NO: 4459654 - DNA, 17 bp, Homo sapiens
gctactgccatcctggc

SEQ ID NO: 4459655 - DNA, 20 bp, Homo sapiens
gctactgccatcctggccca

SEQ ID NO: 4459656 - DNA, 20 bp, Homo sapiens
gctactggaatggtgttttg

SEQ ID NO: 4459657 - DNA, 15 bp, Homo sapiens
gctactggattctta

SEQ ID NO: 4459658 - DNA, 17 bp, Homo sapiens
gctactggggaggctga

SEQ ID NO: 4459659 - DNA, 19 bp, Homo sapiens
gctactggggaggctgagg

SEQ ID NO: 4459660 - DNA, 14 bp, Homo sapiens
gctactgtcttact

SEQ ID NO: 4459661 - DNA, 21 bp, Homo sapiens
gctactgtgtgtgtgaatgaa

SEQ ID NO: 4459662 - DNA, 18 bp, Homo sapiens
gctagaacctagaagggc

SEQ ID NO: 4459663 - DNA, 20 bp, Homo sapiens
gctagaacctgtagagctag

SEQ ID NO: 4459664 - DNA, 15 bp, Homo sapiens
gctagaatttctggt

SEQ ID NO: 4459665 - DNA, 22 bp, Homo sapiens
gctagacacatgaaggtaaata

SEQ ID NO: 4459666 - DNA, 17 bp, Homo sapiens
gctagagacagatgctg

SEQ ID NO: 4459667 - DNA, 13 bp, Homo sapiens
gctagagcagaca

SEQ ID NO: 4459668 - DNA, 14 bp, Homo sapiens
gctagagcagacag

SEQ ID NO: 4459669 - DNA, 17 bp, Homo sapiens
gctagaggattagtaag

SEQ ID NO: 4459670 - DNA, 19 bp, Homo sapiens
gctagaggccagccccacc

SEQ ID NO: 4459671 - DNA, 13 bp, Homo sapiens
gctagagtcctca

SEQ ID NO: 4459672 - DNA, 18 bp, Homo sapiens
gctagagtcctcactccc

SEQ ID NO: 4459673 - DNA, 12 bp, Homo sapiens
gctagcacagag

SEQ ID NO: 4459674 - DNA, 13 bp, Homo sapiens
gctagcacagagg

SEQ ID NO: 4459675 - DNA, 16 bp, Homo sapiens
gctagcacagaggcct

SEQ ID NO: 4459676 - DNA, 18 bp, Homo sapiens
gctagcacagaggcctga

SEQ ID NO: 4459677 - DNA, 13 bp, Homo sapiens
gctagccctgccc

SEQ ID NO: 4459678 - DNA, 19 bp, Homo sapiens
gctagccctgccctccacc

SEQ ID NO: 4459679 - DNA, 20 bp, Homo sapiens
gctagcgctgccgcacccca

SEQ ID NO: 4459680 - DNA, 12 bp, Homo sapiens
gctagcttctgc

SEQ ID NO: 4459681 - DNA, 18 bp, Homo sapiens
gctagtcagagagagtgt

SEQ ID NO: 4459682 - DNA, 13 bp, Homo sapiens
gctagtgccaaat

SEQ ID NO: 4459683 - DNA, 18 bp, Homo sapiens
gctagtgccaaataattg

SEQ ID NO: 4459684 - DNA, 22 bp, Homo sapiens
gctagtgggccctctctctggg

SEQ ID NO: 4459685 - DNA, 15 bp, Homo sapiens
gctagttctcagctt

SEQ ID NO: 4459686 - DNA, 20 bp, Homo sapiens
gctagttctcagcttgcagc

SEQ ID NO: 4459687 - DNA, 19 bp, Homo sapiens
gctataaagcagtattttt

SEQ ID NO: 4459688 - DNA, 20 bp, Homo sapiens
gctataagtgctcaatagct

SEQ ID NO: 4459689 - DNA, 21 bp, Homo sapiens
gctatagggtgtgatgaagtc

SEQ ID NO: 4459690 - DNA, 16 bp, Homo sapiens
gctatagtatttgatt

SEQ ID NO: 4459691 - DNA, 19 bp, Homo sapiens
gctatattcctttttctat

SEQ ID NO: 4459692 - DNA, 20 bp, Homo sapiens
gctatattcctttttctatg

SEQ ID NO: 4459693 - DNA, 22 bp, Homo sapiens
gctatccacagaacctttgtca

SEQ ID NO: 4459694 - DNA, 23 bp, Homo sapiens
gctatccccatctccctgcctgg

SEQ ID NO: 4459695 - DNA, 13 bp, Homo sapiens
gctatcctgctga

SEQ ID NO: 4459696 - DNA, 17 bp, Homo sapiens
gctatcctgctgaaagt

SEQ ID NO: 4459697 - DNA, 16 bp, Homo sapiens
gctatctgtcatctct

SEQ ID NO: 4459698 - DNA, 21 bp, Homo sapiens
gctatctgtcatctctctggg

SEQ ID NO: 4459699 - DNA, 20 bp, Homo sapiens
gctatctgttcctatctgca

SEQ ID NO: 4459700 - DNA, 13 bp, Homo sapiens
gctatcttcatgt

SEQ ID NO: 4459701 - DNA, 15 bp, Homo sapiens
gctatcttcatgtaa

SEQ ID NO: 4459702 - DNA, 17 bp, Homo sapiens
gctatgaaaatgagccc

SEQ ID NO: 4459703 - DNA, 18 bp, Homo sapiens
gctatgaaaatgagccct

SEQ ID NO: 4459704 - DNA, 20 bp, Homo sapiens
gctatgaaaatgagccctgg

SEQ ID NO: 4459705 - DNA, 13 bp, Homo sapiens
gctatgaacagaa

SEQ ID NO: 4459706 - DNA, 21 bp, Homo sapiens
gctatgaagagctagagaaat

SEQ ID NO: 4459707 - DNA, 18 bp, Homo sapiens
gctatgcgcaatgtggca

SEQ ID NO: 4459708 - DNA, 19 bp, Homo sapiens
gctatgcgcaatgtggcat

SEQ ID NO: 4459709 - DNA, 14 bp, Homo sapiens
gctatgggagcccc

SEQ ID NO: 4459710 - DNA, 18 bp, Homo sapiens
gctatgggagccccaggg

SEQ ID NO: 4459711 - DNA, 13 bp, Homo sapiens
gctatggttttct

SEQ ID NO: 4459712 - DNA, 12 bp, Homo sapiens
gctatgtaaggg

SEQ ID NO: 4459713 - DNA, 13 bp, Homo sapiens
gctatgtaagggt

SEQ ID NO: 4459714 - DNA, 17 bp, Homo sapiens
gctatgtagacataaag

SEQ ID NO: 4459715 - DNA, 15 bp, Homo sapiens
gctattaaaactcag

SEQ ID NO: 4459716 - DNA, 20 bp, Homo sapiens
gctattaaaactcagcctgg

SEQ ID NO: 4459717 - DNA, 15 bp, Homo sapiens
gctattaatatttgt

SEQ ID NO: 4459718 - DNA, 14 bp, Homo sapiens
gctatttcatctat

SEQ ID NO: 4459719 - DNA, 15 bp, Homo sapiens
gctatttcatctatt

SEQ ID NO: 4459720 - DNA, 16 bp, Homo sapiens
gctatttcatttgctg

SEQ ID NO: 4459721 - DNA, 14 bp, Homo sapiens
gctattttagaaag

SEQ ID NO: 4459722 - DNA, 18 bp, Homo sapiens
gctattttatattacact

SEQ ID NO: 4459723 - DNA, 18 bp, Homo sapiens
gctattttcatcacagtt

SEQ ID NO: 4459724 - DNA, 13 bp, Homo sapiens
gctattttgtgaa

SEQ ID NO: 4459725 - DNA, 15 bp, Homo sapiens
gctcaaaatctgtga

SEQ ID NO: 4459726 - DNA, 12 bp, Homo sapiens
gctcaaaatctt

SEQ ID NO: 4459727 - DNA, 16 bp, Homo sapiens
gctcaaatgatcctcc

SEQ ID NO: 4459728 - DNA, 17 bp, Homo sapiens
gctcaaatgatcctccc

SEQ ID NO: 4459729 - DNA, 19 bp, Homo sapiens
gctcaaatgatcctcccac

SEQ ID NO: 4459730 - DNA, 18 bp, Homo sapiens
gctcaacccccctcccag

SEQ ID NO: 4459731 - DNA, 19 bp, Homo sapiens
gctcaacccccctcccaga

SEQ ID NO: 4459732 - DNA, 22 bp, Homo sapiens
gctcaaccttccaacttcctgt

SEQ ID NO: 4459733 - DNA, 18 bp, Homo sapiens
gctcaagcgattctcctg

SEQ ID NO: 4459734 - DNA, 22 bp, Homo sapiens
gctcaaggccacaggcacacag

SEQ ID NO: 4459735 - DNA, 13 bp, Homo sapiens
gctcacagttcct

SEQ ID NO: 4459736 - DNA, 15 bp, Homo sapiens
gctcacagttcctcg

SEQ ID NO: 4459737 - DNA, 16 bp, Homo sapiens
gctcacagttcctcgc

SEQ ID NO: 4459738 - DNA, 17 bp, Homo sapiens
gctcacagttcctcgcc

SEQ ID NO: 4459739 - DNA, 21 bp, Homo sapiens
gctcacagttcctcgccctgg

SEQ ID NO: 4459740 - DNA, 22 bp, Homo sapiens
gctcacagttcctcgccctggg

SEQ ID NO: 4459741 - DNA, 14 bp, Homo sapiens
gctcaccagccctg

SEQ ID NO: 4459742 - DNA, 15 bp, Homo sapiens
gctcaccagccctgc

SEQ ID NO: 4459743 - DNA, 16 bp, Homo sapiens
gctcaccagccctgca

SEQ ID NO: 4459744 - DNA, 18 bp, Homo sapiens
gctcacccccttctccat

SEQ ID NO: 4459745 - DNA, 14 bp, Homo sapiens
gctcaccctctctt

SEQ ID NO: 4459746 - DNA, 15 bp, Homo sapiens
gctcaccgctggccc

SEQ ID NO: 4459747 - DNA, 21 bp, Homo sapiens
gctcaccgctggcccttagag

SEQ ID NO: 4459748 - DNA, 14 bp, Homo sapiens
gctcacctcaacct

SEQ ID NO: 4459749 - DNA, 21 bp, Homo sapiens
gctcacctcttctttaccaga

SEQ ID NO: 4459750 - DNA, 16 bp, Homo sapiens
gctcactgcagcctca

SEQ ID NO: 4459751 - DNA, 12 bp, Homo sapiens
gctcactgccag

SEQ ID NO: 4459752 - DNA, 21 bp, Homo sapiens
gctcactgccaggccagcctc

SEQ ID NO: 4459753 - DNA, 20 bp, Homo sapiens
gctcactgtgtataggaatt

SEQ ID NO: 4459754 - DNA, 14 bp, Homo sapiens
gctcagacccctca

SEQ ID NO: 4459755 - DNA, 14 bp, Homo sapiens
gctcagactgggca

SEQ ID NO: 4459756 - DNA, 17 bp, Homo sapiens
gctcagagaaggaaaag

SEQ ID NO: 4459757 - DNA, 14 bp, Homo sapiens
gctcagagctttgt

SEQ ID NO: 4459758 - DNA, 19 bp, Homo sapiens
gctcagagctttgtcactt

SEQ ID NO: 4459759 - DNA, 18 bp, Homo sapiens
gctcagagggtgtcctgc

SEQ ID NO: 4459760 - DNA, 18 bp, Homo sapiens
gctcagcaattcagaccc

SEQ ID NO: 4459761 - DNA, 16 bp, Homo sapiens
gctcagcagccctagc

SEQ ID NO: 4459762 - DNA, 19 bp, Homo sapiens
gctcagccaaatttcctgt

SEQ ID NO: 4459763 - DNA, 19 bp, Homo sapiens
gctcagccccaggccagct

SEQ ID NO: 4459764 - DNA, 23 bp, Homo sapiens
gctcagccccaggccagctgcgg

SEQ ID NO: 4459765 - DNA, 18 bp, Homo sapiens
gctcagcccgctgagtgg

SEQ ID NO: 4459766 - DNA, 14 bp, Homo sapiens
gctcaggaggaggg

SEQ ID NO: 4459767 - DNA, 19 bp, Homo sapiens
gctcaggaggcgaataaat

SEQ ID NO: 4459768 - DNA, 21 bp, Homo sapiens
gctcaggagtttgagaccagg

SEQ ID NO: 4459769 - DNA, 22 bp, Homo sapiens
gctcaggctactataggtccag

SEQ ID NO: 4459770 - DNA, 17 bp, Homo sapiens
gctcaggggctccatgc

SEQ ID NO: 4459771 - DNA, 20 bp, Homo sapiens
gctcaggggctccatgctgg

SEQ ID NO: 4459772 - DNA, 21 bp, Homo sapiens
gctcaggggctccatgctggg

SEQ ID NO: 4459773 - DNA, 17 bp, Homo sapiens
gctcagtaacataactg

SEQ ID NO: 4459774 - DNA, 18 bp, Homo sapiens
gctcagtctgttcactgc

SEQ ID NO: 4459775 - DNA, 14 bp, Homo sapiens
gctcagtgccacct

SEQ ID NO: 4459776 - DNA, 23 bp, Homo sapiens
gctcagtgccacctatgcctgtg

SEQ ID NO: 4459777 - DNA, 20 bp, Homo sapiens
gctcagtgcttgggctccac

SEQ ID NO: 4459778 - DNA, 16 bp, Homo sapiens
gctcatcattctctgt

SEQ ID NO: 4459779 - DNA, 22 bp, Homo sapiens
gctcatccctggacttctggga

SEQ ID NO: 4459780 - DNA, 23 bp, Homo sapiens
gctcatccctggacttctgggag

SEQ ID NO: 4459781 - DNA, 23 bp, Homo sapiens
gctcatcctgtagggcacccaaa

SEQ ID NO: 4459782 - DNA, 14 bp, Homo sapiens
gctcatttaaaaca

SEQ ID NO: 4459783 - DNA, 17 bp, Homo sapiens
gctcatttcagtttcta

SEQ ID NO: 4459784 - DNA, 12 bp, Homo sapiens
gctcatttcatg

SEQ ID NO: 4459785 - DNA, 12 bp, Homo sapiens
gctccaacagaa

SEQ ID NO: 4459786 - DNA, 14 bp, Homo sapiens
gctccaatttcccc

SEQ ID NO: 4459787 - DNA, 13 bp, Homo sapiens
gctccacacgccc

SEQ ID NO: 4459788 - DNA, 16 bp, Homo sapiens
gctccacacgccccgg

SEQ ID NO: 4459789 - DNA, 17 bp, Homo sapiens
gctccacacgccccggt

SEQ ID NO: 4459790 - DNA, 12 bp, Homo sapiens
gctccaccacat

SEQ ID NO: 4459791 - DNA, 15 bp, Homo sapiens
gctccaccagcagca

SEQ ID NO: 4459792 - DNA, 15 bp, Homo sapiens
gctccacgggcaggg

SEQ ID NO: 4459793 - DNA, 14 bp, Homo sapiens
gctccagcctctgc

SEQ ID NO: 4459794 - DNA, 22 bp, Homo sapiens
gctccagcctctgccgctgcca

SEQ ID NO: 4459795 - DNA, 23 bp, Homo sapiens
gctccagcgatggtgctgcccag

SEQ ID NO: 4459796 - DNA, 17 bp, Homo sapiens
gctccagctctggcaca

SEQ ID NO: 4459797 - DNA, 13 bp, Homo sapiens
gctccagctgccc

SEQ ID NO: 4459798 - DNA, 18 bp, Homo sapiens
gctccagggagattttga

SEQ ID NO: 4459799 - DNA, 18 bp, Homo sapiens
gctccagggtcaggcgga

SEQ ID NO: 4459800 - DNA, 22 bp, Homo sapiens
gctccagggtcaggcggagctg

SEQ ID NO: 4459801 - DNA, 15 bp, Homo sapiens
gctccagtctcatcc

SEQ ID NO: 4459802 - DNA, 22 bp, Homo sapiens
gctccataccttttctcttttc

SEQ ID NO: 4459803 - DNA, 15 bp, Homo sapiens
gctccatgctgggtc

SEQ ID NO: 4459804 - DNA, 17 bp, Homo sapiens
gctccatgctgggtctg

SEQ ID NO: 4459805 - DNA, 17 bp, Homo sapiens
gctcccaatcagctttt

SEQ ID NO: 4459806 - DNA, 16 bp, Homo sapiens
gctcccacctggctct

SEQ ID NO: 4459807 - DNA, 18 bp, Homo sapiens
gctcccacctggctctgt

SEQ ID NO: 4459808 - DNA, 16 bp, Homo sapiens
gctcccagccaggccc

SEQ ID NO: 4459809 - DNA, 13 bp, Homo sapiens
gctcccagctgtg

SEQ ID NO: 4459810 - DNA, 15 bp, Homo sapiens
gctcccagctgtgct

SEQ ID NO: 4459811 - DNA, 16 bp, Homo sapiens
gctcccaggggtctcc

SEQ ID NO: 4459812 - DNA, 18 bp, Homo sapiens
gctcccaggggtctccct

SEQ ID NO: 4459813 - DNA, 19 bp, Homo sapiens
gctcccaggggtctccctg

SEQ ID NO: 4459814 - DNA, 20 bp, Homo sapiens
gctcccaggggtctccctgg

SEQ ID NO: 4459815 - DNA, 18 bp, Homo sapiens
gctcccagtcctgcctga

SEQ ID NO: 4459816 - DNA, 19 bp, Homo sapiens
gctccccacagcgtccctg

SEQ ID NO: 4459817 - DNA, 20 bp, Homo sapiens
gctccccacagcgtccctgg

SEQ ID NO: 4459818 - DNA, 22 bp, Homo sapiens
gctccccacagcgtccctggcg

SEQ ID NO: 4459819 - DNA, 15 bp, Homo sapiens
gctcccccaccccct

SEQ ID NO: 4459820 - DNA, 20 bp, Homo sapiens
gctcccccaccccctcccca

SEQ ID NO: 4459821 - DNA, 19 bp, Homo sapiens
gctcccccgtggtgcctgc

SEQ ID NO: 4459822 - DNA, 15 bp, Homo sapiens
gctccccgcctccac

SEQ ID NO: 4459823 - DNA, 16 bp, Homo sapiens
gctccccgcctccact

SEQ ID NO: 4459824 - DNA, 20 bp, Homo sapiens
gctccccgcctccactctag

SEQ ID NO: 4459825 - DNA, 12 bp, Homo sapiens
gctcccctccaa

SEQ ID NO: 4459826 - DNA, 14 bp, Homo sapiens
gctcccgctcccag

SEQ ID NO: 4459827 - DNA, 16 bp, Homo sapiens
gctcccggggcctgga

SEQ ID NO: 4459828 - DNA, 21 bp, Homo sapiens
gctccctaaactttggccttt

SEQ ID NO: 4459829 - DNA, 22 bp, Homo sapiens
gctccctcaaatgacagaccta

SEQ ID NO: 4459830 - DNA, 13 bp, Homo sapiens
gctccctccccct

SEQ ID NO: 4459831 - DNA, 18 bp, Homo sapiens
gctccctcctccaggcct

SEQ ID NO: 4459832 - DNA, 14 bp, Homo sapiens
gctccctctccaag

SEQ ID NO: 4459833 - DNA, 15 bp, Homo sapiens
gctccctctccaaga

SEQ ID NO: 4459834 - DNA, 17 bp, Homo sapiens
gctccctgcctcctgcc

SEQ ID NO: 4459835 - DNA, 21 bp, Homo sapiens
gctccctgcctcctgcctatg

SEQ ID NO: 4459836 - DNA, 17 bp, Homo sapiens
gctccctttctcaggag

SEQ ID NO: 4459837 - DNA, 15 bp, Homo sapiens
gctccgaggacccag

SEQ ID NO: 4459838 - DNA, 16 bp, Homo sapiens
gctccgaggacccagg

SEQ ID NO: 4459839 - DNA, 20 bp, Homo sapiens
gctccgccatggtgtcccgg

SEQ ID NO: 4459840 - DNA, 15 bp, Homo sapiens
gctccgggaacagtg

SEQ ID NO: 4459841 - DNA, 17 bp, Homo sapiens
gctccgggggtacagcc

SEQ ID NO: 4459842 - DNA, 16 bp, Homo sapiens
gctcctagcaccctgg

SEQ ID NO: 4459843 - DNA, 21 bp, Homo sapiens
gctcctaggacccgtctccag

SEQ ID NO: 4459844 - DNA, 14 bp, Homo sapiens
gctcctatctgtgt

SEQ ID NO: 4459845 - DNA, 15 bp, Homo sapiens
gctcctatctgtgtt

SEQ ID NO: 4459846 - DNA, 14 bp, Homo sapiens
gctcctccagggcc

SEQ ID NO: 4459847 - DNA, 22 bp, Homo sapiens
gctcctccagggccacgtgcca

SEQ ID NO: 4459848 - DNA, 23 bp, Homo sapiens
gctcctccagggccacgtgccag

SEQ ID NO: 4459849 - DNA, 12 bp, Homo sapiens
gctcctccctcc

SEQ ID NO: 4459850 - DNA, 14 bp, Homo sapiens
gctcctctcctgga

SEQ ID NO: 4459851 - DNA, 21 bp, Homo sapiens
gctcctgcaaaaggaggtgaa

SEQ ID NO: 4459852 - DNA, 20 bp, Homo sapiens
gctcctgcatctcatgagtg

SEQ ID NO: 4459853 - DNA, 13 bp, Homo sapiens
gctcctgcccagg

SEQ ID NO: 4459854 - DNA, 17 bp, Homo sapiens
gctcctgcccaggccac

SEQ ID NO: 4459855 - DNA, 19 bp, Homo sapiens
gctcctgcccaggccacag

SEQ ID NO: 4459856 - DNA, 17 bp, Homo sapiens
gctcctgccgcagagct

SEQ ID NO: 4459857 - DNA, 19 bp, Homo sapiens
gctcctgccgcagagctgg

SEQ ID NO: 4459858 - DNA, 12 bp, Homo sapiens
gctcctgggacc

SEQ ID NO: 4459859 - DNA, 12 bp, Homo sapiens
gctcctgggagg

SEQ ID NO: 4459860 - DNA, 13 bp, Homo sapiens
gctcctgggaggg

SEQ ID NO: 4459861 - DNA, 12 bp, Homo sapiens
gctcctggtgct

SEQ ID NO: 4459862 - DNA, 21 bp, Homo sapiens
gctccttggcacccccatgct

SEQ ID NO: 4459863 - DNA, 22 bp, Homo sapiens
gctccttggcacccccatgctg

SEQ ID NO: 4459864 - DNA, 19 bp, Homo sapiens
gctccttgggccctttgag

SEQ ID NO: 4459865 - DNA, 14 bp, Homo sapiens
gctcctttctcctg

SEQ ID NO: 4459866 - DNA, 18 bp, Homo sapiens
gctcgatggacctcagca

SEQ ID NO: 4459867 - DNA, 22 bp, Homo sapiens
gctcgatgtggtcacagctgta

SEQ ID NO: 4459868 - DNA, 16 bp, Homo sapiens
gctcgcatccagacag

SEQ ID NO: 4459869 - DNA, 23 bp, Homo sapiens
gctcgcccagacaccatgtgcaa

SEQ ID NO: 4459870 - DNA, 13 bp, Homo sapiens
gctcggacacagt

SEQ ID NO: 4459871 - DNA, 22 bp, Homo sapiens
gctcggaggctacccgctgtgg

SEQ ID NO: 4459872 - DNA, 14 bp, Homo sapiens
gctcggaggctgcc

SEQ ID NO: 4459873 - DNA, 17 bp, Homo sapiens
gctcggaggctgccccc

SEQ ID NO: 4459874 - DNA, 18 bp, Homo sapiens
gctcggaggctgcccccg

SEQ ID NO: 4459875 - DNA, 23 bp, Homo sapiens
gctcggaggctgcccccggcccc

SEQ ID NO: 4459876 - DNA, 14 bp, Homo sapiens
gctcggggacaggt

SEQ ID NO: 4459877 - DNA, 21 bp, Homo sapiens
gctcggggacaggtgacagtg

SEQ ID NO: 4459878 - DNA, 20 bp, Homo sapiens
gctcggtctccaccccaggg

SEQ ID NO: 4459879 - DNA, 12 bp, Homo sapiens
gctcgtgcagta

SEQ ID NO: 4459880 - DNA, 15 bp, Homo sapiens
gctctaattcacagt

SEQ ID NO: 4459881 - DNA, 16 bp, Homo sapiens
gctctaattcacagtg

SEQ ID NO: 4459882 - DNA, 12 bp, Homo sapiens
gctctagaaagt

SEQ ID NO: 4459883 - DNA, 15 bp, Homo sapiens
gctctaggctgttct

SEQ ID NO: 4459884 - DNA, 19 bp, Homo sapiens
gctctaggctgttctgtag

SEQ ID NO: 4459885 - DNA, 16 bp, Homo sapiens
gctctatgtctgcctt

SEQ ID NO: 4459886 - DNA, 17 bp, Homo sapiens
gctctatgtctgccttc

SEQ ID NO: 4459887 - DNA, 14 bp, Homo sapiens
gctctcacccccat

SEQ ID NO: 4459888 - DNA, 17 bp, Homo sapiens
gctctcacccccatccc

SEQ ID NO: 4459889 - DNA, 16 bp, Homo sapiens
gctctcagcctcccac

SEQ ID NO: 4459890 - DNA, 17 bp, Homo sapiens
gctctcagcctcccaca

SEQ ID NO: 4459891 - DNA, 18 bp, Homo sapiens
gctctcagcctcccacaa

SEQ ID NO: 4459892 - DNA, 17 bp, Homo sapiens
gctctcaggccgagagc

SEQ ID NO: 4459893 - DNA, 18 bp, Homo sapiens
gctctcaggccgagagcc

SEQ ID NO: 4459894 - DNA, 19 bp, Homo sapiens
gctctcaggccgagagcct

SEQ ID NO: 4459895 - DNA, 20 bp, Homo sapiens
gctctcaggccgagagcctt

SEQ ID NO: 4459896 - DNA, 14 bp, Homo sapiens
gctctccacctcag

SEQ ID NO: 4459897 - DNA, 19 bp, Homo sapiens
gctctccacctcagccttg

SEQ ID NO: 4459898 - DNA, 13 bp, Homo sapiens
gctctcccagtga

SEQ ID NO: 4459899 - DNA, 22 bp, Homo sapiens
gctctcccagtgaactcctgcc

SEQ ID NO: 4459900 - DNA, 23 bp, Homo sapiens
gctctcccagtgaactcctgcca

SEQ ID NO: 4459901 - DNA, 23 bp, Homo sapiens
gctctcccgtgcatcccccctgc

SEQ ID NO: 4459902 - DNA, 14 bp, Homo sapiens
gctctccctctggc

SEQ ID NO: 4459903 - DNA, 16 bp, Homo sapiens
gctctcctcatctcca

SEQ ID NO: 4459904 - DNA, 14 bp, Homo sapiens
gctctcctggctgt

SEQ ID NO: 4459905 - DNA, 14 bp, Homo sapiens
gctctccttcactc

SEQ ID NO: 4459906 - DNA, 18 bp, Homo sapiens
gctctcgaggaaagtggt

SEQ ID NO: 4459907 - DNA, 20 bp, Homo sapiens
gctctctatccaaaataaag

SEQ ID NO: 4459908 - DNA, 14 bp, Homo sapiens
gctctctctagaat

SEQ ID NO: 4459909 - DNA, 14 bp, Homo sapiens
gctctctctgtccc

SEQ ID NO: 4459910 - DNA, 13 bp, Homo sapiens
gctctctgcagcc

SEQ ID NO: 4459911 - DNA, 14 bp, Homo sapiens
gctctctgcagcca

SEQ ID NO: 4459912 - DNA, 19 bp, Homo sapiens
gctctctgcagccagccca

SEQ ID NO: 4459913 - DNA, 11 bp, Homo sapiens
gctctctgctg

SEQ ID NO: 4459914 - DNA, 20 bp, Homo sapiens
gctctctgtgggctggcagt

SEQ ID NO: 4459915 - DNA, 15 bp, Homo sapiens
gctctcttcaataaa

SEQ ID NO: 4459916 - DNA, 16 bp, Homo sapiens
gctctcttcaataaac

SEQ ID NO: 4459917 - DNA, 18 bp, Homo sapiens
gctctcttcaataaacca

SEQ ID NO: 4459918 - DNA, 14 bp, Homo sapiens
gctctgaaaacaag

SEQ ID NO: 4459919 - DNA, 14 bp, Homo sapiens
gctctgacctcctc

SEQ ID NO: 4459920 - DNA, 15 bp, Homo sapiens
gctctgacctcctct

SEQ ID NO: 4459921 - DNA, 13 bp, Homo sapiens
gctctgagccaca

SEQ ID NO: 4459922 - DNA, 14 bp, Homo sapiens
gctctgagccagat

SEQ ID NO: 4459923 - DNA, 23 bp, Homo sapiens
gctctgatccctctacagagctt

SEQ ID NO: 4459924 - DNA, 15 bp, Homo sapiens
gctctgcaaaaggag

SEQ ID NO: 4459925 - DNA, 15 bp, Homo sapiens
gctctgcaggctggg

SEQ ID NO: 4459926 - DNA, 11 bp, Homo sapiens
gctctgcatgc

SEQ ID NO: 4459927 - DNA, 16 bp, Homo sapiens
gctctgcatgcggccc

SEQ ID NO: 4459928 - DNA, 21 bp, Homo sapiens
gctctgcatgcggcccagccc

SEQ ID NO: 4459929 - DNA, 22 bp, Homo sapiens
gctctgcatgcggcccagcccg

SEQ ID NO: 4459930 - DNA, 18 bp, Homo sapiens
gctctgccccctccccca

SEQ ID NO: 4459931 - DNA, 11 bp, Homo sapiens
gctctgcctca

SEQ ID NO: 4459932 - DNA, 17 bp, Homo sapiens
gctctgctgctctgacc

SEQ ID NO: 4459933 - DNA, 23 bp, Homo sapiens
gctctggacagcagaagcctcca

SEQ ID NO: 4459934 - DNA, 16 bp, Homo sapiens
gctctgggaaggggct

SEQ ID NO: 4459935 - DNA, 21 bp, Homo sapiens
gctctggggtgggcagttttt

SEQ ID NO: 4459936 - DNA, 21 bp, Homo sapiens
gctctggttgtttctgttcca

SEQ ID NO: 4459937 - DNA, 17 bp, Homo sapiens
gctctgtacctgtcaaa

SEQ ID NO: 4459938 - DNA, 23 bp, Homo sapiens
gctctgtatcaggacccagagga

SEQ ID NO: 4459939 - DNA, 15 bp, Homo sapiens
gctctgtccccaaag

SEQ ID NO: 4459940 - DNA, 16 bp, Homo sapiens
gctctgtcccccaggc

SEQ ID NO: 4459941 - DNA, 17 bp, Homo sapiens
gctctgtcgcccaggct

SEQ ID NO: 4459942 - DNA, 23 bp, Homo sapiens
gctctgtcgcccaggctggactg

SEQ ID NO: 4459943 - DNA, 14 bp, Homo sapiens
gctctgtgcagtca

SEQ ID NO: 4459944 - DNA, 15 bp, Homo sapiens
gctctgtgctgaccc

SEQ ID NO: 4459945 - DNA, 16 bp, Homo sapiens
gctctgtgctgaccct

SEQ ID NO: 4459946 - DNA, 21 bp, Homo sapiens
gctctgtgctgaccctcctgt

SEQ ID NO: 4459947 - DNA, 20 bp, Homo sapiens
gctctgtggcgagccatttg

SEQ ID NO: 4459948 - DNA, 16 bp, Homo sapiens
gctctgtgtatatctc

SEQ ID NO: 4459949 - DNA, 18 bp, Homo sapiens
gctctgtttgtggggtga

SEQ ID NO: 4459950 - DNA, 12 bp, Homo sapiens
gctcttctcatt

SEQ ID NO: 4459951 - DNA, 20 bp, Homo sapiens
gctcttctcatttcacccct

SEQ ID NO: 4459952 - DNA, 22 bp, Homo sapiens
gctcttctcatttcacccctcc

SEQ ID NO: 4459953 - DNA, 16 bp, Homo sapiens
gctcttctctccccag

SEQ ID NO: 4459954 - DNA, 21 bp, Homo sapiens
gctcttgaaatattcagaaat

SEQ ID NO: 4459955 - DNA, 22 bp, Homo sapiens
gctcttgaaatattcagaaatt

SEQ ID NO: 4459956 - DNA, 11 bp, Homo sapiens
gctcttggccc

SEQ ID NO: 4459957 - DNA, 19 bp, Homo sapiens
gctctttattgcagaatgt

SEQ ID NO: 4459958 - DNA, 21 bp, Homo sapiens
gctctttgactgtcagcaaga

SEQ ID NO: 4459959 - DNA, 13 bp, Homo sapiens
gctcttttcctgg

SEQ ID NO: 4459960 - DNA, 19 bp, Homo sapiens
gctcttttcctggtgctct

SEQ ID NO: 4459961 - DNA, 15 bp, Homo sapiens
gctcttttgtgatga

SEQ ID NO: 4459962 - DNA, 16 bp, Homo sapiens
gctgaaagtcctgctt

SEQ ID NO: 4459963 - DNA, 17 bp, Homo sapiens
gctgaacggggagaaaa

SEQ ID NO: 4459964 - DNA, 15 bp, Homo sapiens
gctgaactcagcaca

SEQ ID NO: 4459965 - DNA, 18 bp, Homo sapiens
gctgaactgacaatgaag

SEQ ID NO: 4459966 - DNA, 14 bp, Homo sapiens
gctgaagatggagg

SEQ ID NO: 4459967 - DNA, 17 bp, Homo sapiens
gctgaatgttcttgaat

SEQ ID NO: 4459968 - DNA, 22 bp, Homo sapiens
gctgaatgttcttgaattatat

SEQ ID NO: 4459969 - DNA, 17 bp, Homo sapiens
gctgaatgttgggactg

SEQ ID NO: 4459970 - DNA, 23 bp, Homo sapiens
gctgaatgttgggactgctaaat

SEQ ID NO: 4459971 - DNA, 21 bp, Homo sapiens
gctgaattcctttacaactaa

SEQ ID NO: 4459972 - DNA, 20 bp, Homo sapiens
gctgacaaccattaaagtca

SEQ ID NO: 4459973 - DNA, 15 bp, Homo sapiens
gctgacacccaggcc

SEQ ID NO: 4459974 - DNA, 20 bp, Homo sapiens
gctgacacccaggcccgagc

SEQ ID NO: 4459975 - DNA, 19 bp, Homo sapiens
gctgacacgctcagttgaa

SEQ ID NO: 4459976 - DNA, 17 bp, Homo sapiens
gctgacatgaagctgtt

SEQ ID NO: 4459977 - DNA, 20 bp, Homo sapiens
gctgaccatgcgtcaggggc

SEQ ID NO: 4459978 - DNA, 15 bp, Homo sapiens
gctgacccagtccct

SEQ ID NO: 4459979 - DNA, 17 bp, Homo sapiens
gctgacccagtccctgg

SEQ ID NO: 4459980 - DNA, 16 bp, Homo sapiens
gctgaccccttcgtgg

SEQ ID NO: 4459981 - DNA, 14 bp, Homo sapiens
gctgaccctcctgt

SEQ ID NO: 4459982 - DNA, 20 bp, Homo sapiens
gctgactaaactttttttct

SEQ ID NO: 4459983 - DNA, 15 bp, Homo sapiens
gctgactagaagggc

SEQ ID NO: 4459984 - DNA, 23 bp, Homo sapiens
gctgactagaagggccagtcctg

SEQ ID NO: 4459985 - DNA, 20 bp, Homo sapiens
gctgactgatgttgagggaa

SEQ ID NO: 4459986 - DNA, 18 bp, Homo sapiens
gctgactggtttctcctg

SEQ ID NO: 4459987 - DNA, 22 bp, Homo sapiens
gctgactggtttctcctggtag

SEQ ID NO: 4459988 - DNA, 21 bp, Homo sapiens
gctgacttagcctcctcccaa

SEQ ID NO: 4459989 - DNA, 17 bp, Homo sapiens
gctgagagacccaagga

SEQ ID NO: 4459990 - DNA, 20 bp, Homo sapiens
gctgagagacccaaggagga

SEQ ID NO: 4459991 - DNA, 16 bp, Homo sapiens
gctgagaggcaccagt

SEQ ID NO: 4459992 - DNA, 19 bp, Homo sapiens
gctgagaggcaccagtcca

SEQ ID NO: 4459993 - DNA, 16 bp, Homo sapiens
gctgagatcctggact

SEQ ID NO: 4459994 - DNA, 22 bp, Homo sapiens
gctgagatcctggactgagggg

SEQ ID NO: 4459995 - DNA, 22 bp, Homo sapiens
gctgagcacttagcaggcaccg

SEQ ID NO: 4459996 - DNA, 12 bp, Homo sapiens
gctgagcagcct

SEQ ID NO: 4459997 - DNA, 16 bp, Homo sapiens
gctgagcagcctctgg

SEQ ID NO: 4459998 - DNA, 16 bp, Homo sapiens
gctgagccacctgccc

SEQ ID NO: 4459999 - DNA, 15 bp, Homo sapiens
gctgagccctcctga

SEQ ID NO: 4460000 - DNA, 19 bp, Homo sapiens
gctgagccctcctgagggc

SEQ ID NO: 4460001 - DNA, 21 bp, Homo sapiens
gctgagcgcccccgagccctg

SEQ ID NO: 4460002 - DNA, 18 bp, Homo sapiens
gctgaggagacaaccaga

SEQ ID NO: 4460003 - DNA, 14 bp, Homo sapiens
gctgaggaggcctc

SEQ ID NO: 4460004 - DNA, 13 bp, Homo sapiens
gctgaggcagaag

SEQ ID NO: 4460005 - DNA, 16 bp, Homo sapiens
gctgaggcagaagaat

SEQ ID NO: 4460006 - DNA, 20 bp, Homo sapiens
gctgaggtgaacaaggtaaa

SEQ ID NO: 4460007 - DNA, 23 bp, Homo sapiens
gctgaggtggtaggatcacctga

SEQ ID NO: 4460008 - DNA, 13 bp, Homo sapiens
gctgaggttcctc

SEQ ID NO: 4460009 - DNA, 21 bp, Homo sapiens
gctgaggttcctctgcctgcc

SEQ ID NO: 4460010 - DNA, 21 bp, Homo sapiens
gctgagtcatgatctccctgc

SEQ ID NO: 4460011 - DNA, 15 bp, Homo sapiens
gctgagtcctttcca

SEQ ID NO: 4460012 - DNA, 21 bp, Homo sapiens
gctgagtcctttccaggggcc

SEQ ID NO: 4460013 - DNA, 17 bp, Homo sapiens
gctgagtgggaaccgga

SEQ ID NO: 4460014 - DNA, 23 bp, Homo sapiens
gctgagttgggggtgtggctctg

SEQ ID NO: 4460015 - DNA, 20 bp, Homo sapiens
gctgagtttggatgtctgta

SEQ ID NO: 4460016 - DNA, 16 bp, Homo sapiens
gctgataaatttaatc

SEQ ID NO: 4460017 - DNA, 16 bp, Homo sapiens
gctgatcagtgggcct

SEQ ID NO: 4460018 - DNA, 14 bp, Homo sapiens
gctgatccaggcaa

SEQ ID NO: 4460019 - DNA, 21 bp, Homo sapiens
gctgatccagtaacctcggag

SEQ ID NO: 4460020 - DNA, 18 bp, Homo sapiens
gctgatcctaagaatttt

SEQ ID NO: 4460021 - DNA, 23 bp, Homo sapiens
gctgatgcagccgtccatagcag

SEQ ID NO: 4460022 - DNA, 20 bp, Homo sapiens
gctgatggattccaaaccag

SEQ ID NO: 4460023 - DNA, 14 bp, Homo sapiens
gctgatgtcaaagt

SEQ ID NO: 4460024 - DNA, 16 bp, Homo sapiens
gctgattcttgtaaat

SEQ ID NO: 4460025 - DNA, 19 bp, Homo sapiens
gctgattcttgtaaatctt

SEQ ID NO: 4460026 - DNA, 22 bp, Homo sapiens
gctgattcttgtaaatcttttt

SEQ ID NO: 4460027 - DNA, 14 bp, Homo sapiens
gctgattttaatgg

SEQ ID NO: 4460028 - DNA, 11 bp, Homo sapiens
gctgatttttt

SEQ ID NO: 4460029 - DNA, 20 bp, Homo sapiens
gctgcaatacattaaaataa

SEQ ID NO: 4460030 - DNA, 18 bp, Homo sapiens
gctgcacaaaagcagata

SEQ ID NO: 4460031 - DNA, 18 bp, Homo sapiens
gctgcacagggcagctgg

SEQ ID NO: 4460032 - DNA, 19 bp, Homo sapiens
gctgcacagggcagctggg

SEQ ID NO: 4460033 - DNA, 23 bp, Homo sapiens
gctgcacagggcagctgggccca

SEQ ID NO: 4460034 - DNA, 16 bp, Homo sapiens
gctgcacatggcctga

SEQ ID NO: 4460035 - DNA, 18 bp, Homo sapiens
gctgcacatggcctgagc

SEQ ID NO: 4460036 - DNA, 17 bp, Homo sapiens
gctgcacccctgggcca

SEQ ID NO: 4460037 - DNA, 20 bp, Homo sapiens
gctgcacctcctaccctccc

SEQ ID NO: 4460038 - DNA, 23 bp, Homo sapiens
gctgcacctcctaccctcccacc

SEQ ID NO: 4460039 - DNA, 15 bp, Homo sapiens
gctgcagaagggtgg

SEQ ID NO: 4460040 - DNA, 18 bp, Homo sapiens
gctgcagaggcacctcaa

SEQ ID NO: 4460041 - DNA, 14 bp, Homo sapiens
gctgcagctccctg

SEQ ID NO: 4460042 - DNA, 12 bp, Homo sapiens
gctgcaggagtg

SEQ ID NO: 4460043 - DNA, 17 bp, Homo sapiens
gctgcagggccactgga

SEQ ID NO: 4460044 - DNA, 17 bp, Homo sapiens
gctgcagtcacatcaca

SEQ ID NO: 4460045 - DNA, 14 bp, Homo sapiens
gctgcagtggctcc

SEQ ID NO: 4460046 - DNA, 21 bp, Homo sapiens
gctgcagttttgctatctggg

SEQ ID NO: 4460047 - DNA, 17 bp, Homo sapiens
gctgcatacaggggagg

SEQ ID NO: 4460048 - DNA, 23 bp, Homo sapiens
gctgcatgacctaccaggacaga

SEQ ID NO: 4460049 - DNA, 22 bp, Homo sapiens
gctgcatggggtggggtagggc

SEQ ID NO: 4460050 - DNA, 18 bp, Homo sapiens
gctgccaaggccagagtg

SEQ ID NO: 4460051 - DNA, 16 bp, Homo sapiens
gctgccaccagccccc

SEQ ID NO: 4460052 - DNA, 23 bp, Homo sapiens
gctgccagccttgagccctggct

SEQ ID NO: 4460053 - DNA, 19 bp, Homo sapiens
gctgccagtgcagccactg

SEQ ID NO: 4460054 - DNA, 20 bp, Homo sapiens
gctgccagtgcagccactgg

SEQ ID NO: 4460055 - DNA, 14 bp, Homo sapiens
gctgccatgctttg

SEQ ID NO: 4460056 - DNA, 14 bp, Homo sapiens
gctgcccagccctg

SEQ ID NO: 4460057 - DNA, 24 bp, Homo sapiens
gctgcccagccctggcccaggtgc

SEQ ID NO: 4460058 - DNA, 12 bp, Homo sapiens
gctgcccaggag

SEQ ID NO: 4460059 - DNA, 13 bp, Homo sapiens
gctgcccaggaga

SEQ ID NO: 4460060 - DNA, 14 bp, Homo sapiens
gctgccccagccag

SEQ ID NO: 4460061 - DNA, 23 bp, Homo sapiens
gctgccccattgagatcttcctg

SEQ ID NO: 4460062 - DNA, 22 bp, Homo sapiens
gctgccccggcccctccccctg

SEQ ID NO: 4460063 - DNA, 18 bp, Homo sapiens
gctgcccctctcaccaaa

SEQ ID NO: 4460064 - DNA, 20 bp, Homo sapiens
gctgcccctgcacagcaggc

SEQ ID NO: 4460065 - DNA, 20 bp, Homo sapiens
gctgccctccttgtccaccc

SEQ ID NO: 4460066 - DNA, 21 bp, Homo sapiens
gctgccctccttgtccaccca

SEQ ID NO: 4460067 - DNA, 15 bp, Homo sapiens
gctgcccttgcaggg

SEQ ID NO: 4460068 - DNA, 18 bp, Homo sapiens
gctgccgacttggagact

SEQ ID NO: 4460069 - DNA, 13 bp, Homo sapiens
gctgccgagccac

SEQ ID NO: 4460070 - DNA, 15 bp, Homo sapiens
gctgccgagggctgg

SEQ ID NO: 4460071 - DNA, 17 bp, Homo sapiens
gctgccgagggctggcc

SEQ ID NO: 4460072 - DNA, 19 bp, Homo sapiens
gctgccgagggctggccgg

SEQ ID NO: 4460073 - DNA, 21 bp, Homo sapiens
gctgccgagggctggccggga

SEQ ID NO: 4460074 - DNA, 15 bp, Homo sapiens
gctgccgcaccccag

SEQ ID NO: 4460075 - DNA, 16 bp, Homo sapiens
gctgccgcgcagtgtg

SEQ ID NO: 4460076 - DNA, 13 bp, Homo sapiens
gctgccgctgcac

SEQ ID NO: 4460077 - DNA, 14 bp, Homo sapiens
gctgccgctgcacc

SEQ ID NO: 4460078 - DNA, 19 bp, Homo sapiens
gctgccgtctggccgggct

SEQ ID NO: 4460079 - DNA, 17 bp, Homo sapiens
gctgcctaagtggctgc

SEQ ID NO: 4460080 - DNA, 12 bp, Homo sapiens
gctgcctcactt

SEQ ID NO: 4460081 - DNA, 14 bp, Homo sapiens
gctgcctctgctcc

SEQ ID NO: 4460082 - DNA, 15 bp, Homo sapiens
gctgcctctgctccc

SEQ ID NO: 4460083 - DNA, 14 bp, Homo sapiens
gctgccttagcttc

SEQ ID NO: 4460084 - DNA, 12 bp, Homo sapiens
gctgccttcagg

SEQ ID NO: 4460085 - DNA, 14 bp, Homo sapiens
gctgccttcaggga

SEQ ID NO: 4460086 - DNA, 15 bp, Homo sapiens
gctgccttcagggag

SEQ ID NO: 4460087 - DNA, 13 bp, Homo sapiens
gctgccttcccta

SEQ ID NO: 4460088 - DNA, 14 bp, Homo sapiens
gctgcgcctgcagg

SEQ ID NO: 4460089 - DNA, 17 bp, Homo sapiens
gctgcgcctgcaggcag

SEQ ID NO: 4460090 - DNA, 22 bp, Homo sapiens
gctgcgctaacccccagcccac

SEQ ID NO: 4460091 - DNA, 16 bp, Homo sapiens
gctgcgcttgcttttc

SEQ ID NO: 4460092 - DNA, 13 bp, Homo sapiens
gctgctactgctg

SEQ ID NO: 4460093 - DNA, 21 bp, Homo sapiens
gctgctatccccatctccctg

SEQ ID NO: 4460094 - DNA, 11 bp, Homo sapiens
gctgctcccac

SEQ ID NO: 4460095 - DNA, 20 bp, Homo sapiens
gctgctcccacctggctctg

SEQ ID NO: 4460096 - DNA, 22 bp, Homo sapiens
gctgctcccacctggctctgtg

SEQ ID NO: 4460097 - DNA, 12 bp, Homo sapiens
gctgctcctcca

SEQ ID NO: 4460098 - DNA, 23 bp, Homo sapiens
gctgctctgcaggctggggaggt

SEQ ID NO: 4460099 - DNA, 11 bp, Homo sapiens
gctgctctggg

SEQ ID NO: 4460100 - DNA, 14 bp, Homo sapiens
gctgctctgggaag

SEQ ID NO: 4460101 - DNA, 13 bp, Homo sapiens
gctgctgaggccc

SEQ ID NO: 4460102 - DNA, 13 bp, Homo sapiens
gctgctgcccctg

SEQ ID NO: 4460103 - DNA, 14 bp, Homo sapiens
gctgctgcccctgc

SEQ ID NO: 4460104 - DNA, 14 bp, Homo sapiens
gctgctgccgccgc

SEQ ID NO: 4460105 - DNA, 14 bp, Homo sapiens
gctgctgctgctgc

SEQ ID NO: 4460106 - DNA, 16 bp, Homo sapiens
gctgctggcgcctctg

SEQ ID NO: 4460107 - DNA, 11 bp, Homo sapiens
gctgctggctt

SEQ ID NO: 4460108 - DNA, 15 bp, Homo sapiens
gctgctgtctcgggg

SEQ ID NO: 4460109 - DNA, 18 bp, Homo sapiens
gctgctgtgtgtgagcag

SEQ ID NO: 4460110 - DNA, 13 bp, Homo sapiens
gctgctgttctca

SEQ ID NO: 4460111 - DNA, 19 bp, Homo sapiens
gctgctgttctcaggacag

SEQ ID NO: 4460112 - DNA, 13 bp, Homo sapiens
gctggaaatagga

SEQ ID NO: 4460113 - DNA, 17 bp, Homo sapiens
gctggaacacaggggcc

SEQ ID NO: 4460114 - DNA, 19 bp, Homo sapiens
gctggaagaaccactgtct

SEQ ID NO: 4460115 - DNA, 13 bp, Homo sapiens
gctggaaggcagc

SEQ ID NO: 4460116 - DNA, 16 bp, Homo sapiens
gctggaatctggagag

SEQ ID NO: 4460117 - DNA, 21 bp, Homo sapiens
gctggaatctggagagctaga

SEQ ID NO: 4460118 - DNA, 21 bp, Homo sapiens
gctggactctcagtctctgag

SEQ ID NO: 4460119 - DNA, 13 bp, Homo sapiens
gctggactgaggc

SEQ ID NO: 4460120 - DNA, 14 bp, Homo sapiens
gctggactgaggcc

SEQ ID NO: 4460121 - DNA, 20 bp, Homo sapiens
gctggacttctacctgccct

SEQ ID NO: 4460122 - DNA, 23 bp, Homo sapiens
gctggacttctacctgccctcaa

SEQ ID NO: 4460123 - DNA, 16 bp, Homo sapiens
gctggagaaagccacg

SEQ ID NO: 4460124 - DNA, 17 bp, Homo sapiens
gctggagaaagccacgc

SEQ ID NO: 4460125 - DNA, 23 bp, Homo sapiens
gctggagcccagcgtcagaagtc

SEQ ID NO: 4460126 - DNA, 18 bp, Homo sapiens
gctggagcccccagcaga

SEQ ID NO: 4460127 - DNA, 12 bp, Homo sapiens
gctggagctcct

SEQ ID NO: 4460128 - DNA, 13 bp, Homo sapiens
gctggagctcctc

SEQ ID NO: 4460129 - DNA, 17 bp, Homo sapiens
gctggagctcctccctc

SEQ ID NO: 4460130 - DNA, 18 bp, Homo sapiens
gctggagctcctccctcc

SEQ ID NO: 4460131 - DNA, 13 bp, Homo sapiens
gctggaggcaggg

SEQ ID NO: 4460132 - DNA, 15 bp, Homo sapiens
gctggaggcagggcc

SEQ ID NO: 4460133 - DNA, 20 bp, Homo sapiens
gctggaggcccaggctggga

SEQ ID NO: 4460134 - DNA, 13 bp, Homo sapiens
gctggaggggtgg

SEQ ID NO: 4460135 - DNA, 17 bp, Homo sapiens
gctggaggggtggccca

SEQ ID NO: 4460136 - DNA, 21 bp, Homo sapiens
gctggaggggtggcccagagc

SEQ ID NO: 4460137 - DNA, 24 bp, Homo sapiens
gctggaggggtggcccagagccat

SEQ ID NO: 4460138 - DNA, 20 bp, Homo sapiens
gctggagtgcagtggtgtga

SEQ ID NO: 4460139 - DNA, 16 bp, Homo sapiens
gctggatctgtagtga

SEQ ID NO: 4460140 - DNA, 14 bp, Homo sapiens
gctggcaacacaga

SEQ ID NO: 4460141 - DNA, 16 bp, Homo sapiens
gctggcacagcccctg

SEQ ID NO: 4460142 - DNA, 20 bp, Homo sapiens
gctggcacagcccctggagc

SEQ ID NO: 4460143 - DNA, 23 bp, Homo sapiens
gctggccagcaccctctcctggg

SEQ ID NO: 4460144 - DNA, 13 bp, Homo sapiens
gctggcccagccc

SEQ ID NO: 4460145 - DNA, 19 bp, Homo sapiens
gctggccctacttccagga

SEQ ID NO: 4460146 - DNA, 14 bp, Homo sapiens
gctggcccttagag

SEQ ID NO: 4460147 - DNA, 18 bp, Homo sapiens
gctggcccttagagaccc

SEQ ID NO: 4460148 - DNA, 24 bp, Homo sapiens
gctggccgagggtcctggctcctg

SEQ ID NO: 4460149 - DNA, 20 bp, Homo sapiens
gctggccgcctcaccccctc

SEQ ID NO: 4460150 - DNA, 14 bp, Homo sapiens
gctggccgggactg

SEQ ID NO: 4460151 - DNA, 17 bp, Homo sapiens
gctggccgggactgctg

SEQ ID NO: 4460152 - DNA, 16 bp, Homo sapiens
gctggcgcctctgcaa

SEQ ID NO: 4460153 - DNA, 14 bp, Homo sapiens
gctggcgctcagca

SEQ ID NO: 4460154 - DNA, 17 bp, Homo sapiens
gctggcgctcagcagcc

SEQ ID NO: 4460155 - DNA, 16 bp, Homo sapiens
gctggcggctactcag

SEQ ID NO: 4460156 - DNA, 15 bp, Homo sapiens
gctggcgggcctttt

SEQ ID NO: 4460157 - DNA, 12 bp, Homo sapiens
gctggctcagga

SEQ ID NO: 4460158 - DNA, 13 bp, Homo sapiens
gctggctcaggag

SEQ ID NO: 4460159 - DNA, 21 bp, Homo sapiens
gctggctccccctccccaggc

SEQ ID NO: 4460160 - DNA, 22 bp, Homo sapiens
gctggctctaccttcctgtccc

SEQ ID NO: 4460161 - DNA, 13 bp, Homo sapiens
gctggctcttctg

SEQ ID NO: 4460162 - DNA, 11 bp, Homo sapiens
gctggctgaag

SEQ ID NO: 4460163 - DNA, 21 bp, Homo sapiens
gctggctgaagaggaccagag

SEQ ID NO: 4460164 - DNA, 13 bp, Homo sapiens
gctggctgcggcc

SEQ ID NO: 4460165 - DNA, 17 bp, Homo sapiens
gctggctgcggccccct

SEQ ID NO: 4460166 - DNA, 14 bp, Homo sapiens
gctggctggcctca

SEQ ID NO: 4460167 - DNA, 15 bp, Homo sapiens
gctgggaactgcaga

SEQ ID NO: 4460168 - DNA, 18 bp, Homo sapiens
gctgggaggagggagagg

SEQ ID NO: 4460169 - DNA, 13 bp, Homo sapiens
gctgggagtccct

SEQ ID NO: 4460170 - DNA, 22 bp, Homo sapiens
gctgggatggtgactcctgaaa

SEQ ID NO: 4460171 - DNA, 13 bp, Homo sapiens
gctgggcaggaag

SEQ ID NO: 4460172 - DNA, 13 bp, Homo sapiens
gctgggccaccag

SEQ ID NO: 4460173 - DNA, 17 bp, Homo sapiens
gctgggccaccagggat

SEQ ID NO: 4460174 - DNA, 15 bp, Homo sapiens
gctgggccccagccc

SEQ ID NO: 4460175 - DNA, 17 bp, Homo sapiens
gctgggccccagcccac

SEQ ID NO: 4460176 - DNA, 20 bp, Homo sapiens
gctgggccccagcccaccct

SEQ ID NO: 4460177 - DNA, 15 bp, Homo sapiens
gctgggcccctggga

SEQ ID NO: 4460178 - DNA, 17 bp, Homo sapiens
gctgggcccctgggatg

SEQ ID NO: 4460179 - DNA, 19 bp, Homo sapiens
gctgggccctctttccctg

SEQ ID NO: 4460180 - DNA, 21 bp, Homo sapiens
gctgggccctctttccctgcg

SEQ ID NO: 4460181 - DNA, 24 bp, Homo sapiens
gctgggccctctttccctgcgaga

SEQ ID NO: 4460182 - DNA, 13 bp, Homo sapiens
gctgggccctgcc

SEQ ID NO: 4460183 - DNA, 23 bp, Homo sapiens
gctgggccctgcctgcagccagg

SEQ ID NO: 4460184 - DNA, 20 bp, Homo sapiens
gctgggctctccacctcagc

SEQ ID NO: 4460185 - DNA, 18 bp, Homo sapiens
gctgggctgggccctctt

SEQ ID NO: 4460186 - DNA, 20 bp, Homo sapiens
gctggggaagaacagccccg

SEQ ID NO: 4460187 - DNA, 13 bp, Homo sapiens
gctggggacagag

SEQ ID NO: 4460188 - DNA, 13 bp, Homo sapiens
gctggggactcag

SEQ ID NO: 4460189 - DNA, 14 bp, Homo sapiens
gctggggactcagg

SEQ ID NO: 4460190 - DNA, 16 bp, Homo sapiens
gctggggactcaggga

SEQ ID NO: 4460191 - DNA, 20 bp, Homo sapiens
gctgggggcaggagggccct

SEQ ID NO: 4460192 - DNA, 23 bp, Homo sapiens
gctgggggcaggagggccctacc

SEQ ID NO: 4460193 - DNA, 16 bp, Homo sapiens
gctggggtcacagagg

SEQ ID NO: 4460194 - DNA, 12 bp, Homo sapiens
gctggggtgtca

SEQ ID NO: 4460195 - DNA, 19 bp, Homo sapiens
gctggggttgccagaggcc

SEQ ID NO: 4460196 - DNA, 23 bp, Homo sapiens
gctggggttgccagaggccctgg

SEQ ID NO: 4460197 - DNA, 12 bp, Homo sapiens
gctgggtcctgc

SEQ ID NO: 4460198 - DNA, 15 bp, Homo sapiens
gctgggtcctgccag

SEQ ID NO: 4460199 - DNA, 18 bp, Homo sapiens
gctgggtcctgccagctg

SEQ ID NO: 4460200 - DNA, 20 bp, Homo sapiens
gctgggtctgaggcccctgc

SEQ ID NO: 4460201 - DNA, 15 bp, Homo sapiens
gctggtaagagaagt

SEQ ID NO: 4460202 - DNA, 15 bp, Homo sapiens
gctggtagcagcagg

SEQ ID NO: 4460203 - DNA, 20 bp, Homo sapiens
gctggtcacagcctcctctg

SEQ ID NO: 4460204 - DNA, 13 bp, Homo sapiens
gctggtggaggaa

SEQ ID NO: 4460205 - DNA, 18 bp, Homo sapiens
gctggtggaggaagggct

SEQ ID NO: 4460206 - DNA, 21 bp, Homo sapiens
gctggtggaggaagggctggg

SEQ ID NO: 4460207 - DNA, 21 bp, Homo sapiens
gctggtgggaagcgtctgtcc

SEQ ID NO: 4460208 - DNA, 18 bp, Homo sapiens
gctggtgtccccttcccc

SEQ ID NO: 4460209 - DNA, 21 bp, Homo sapiens
gctggtgtccccttcccctgc

SEQ ID NO: 4460210 - DNA, 12 bp, Homo sapiens
gctggtgtgtca

SEQ ID NO: 4460211 - DNA, 14 bp, Homo sapiens
gctggttaatgtag

SEQ ID NO: 4460212 - DNA, 16 bp, Homo sapiens
gctggttggagagcta

SEQ ID NO: 4460213 - DNA, 14 bp, Homo sapiens
gctggtttttcagt

SEQ ID NO: 4460214 - DNA, 15 bp, Homo sapiens
gctggtttttcagtt

SEQ ID NO: 4460215 - DNA, 18 bp, Homo sapiens
gctgtaaaacttattcca

SEQ ID NO: 4460216 - DNA, 13 bp, Homo sapiens
gctgtaaaatttg

SEQ ID NO: 4460217 - DNA, 15 bp, Homo sapiens
gctgtaaataaatgc

SEQ ID NO: 4460218 - DNA, 22 bp, Homo sapiens
gctgtaatcatttgtttacatt

SEQ ID NO: 4460219 - DNA, 12 bp, Homo sapiens
gctgtacatcta

SEQ ID NO: 4460220 - DNA, 22 bp, Homo sapiens
gctgtacatctattttggattg

SEQ ID NO: 4460221 - DNA, 20 bp, Homo sapiens
gctgtagacatttgctatga

SEQ ID NO: 4460222 - DNA, 13 bp, Homo sapiens
gctgtaggtgtgc

SEQ ID NO: 4460223 - DNA, 16 bp, Homo sapiens
gctgtataaagcatgt

SEQ ID NO: 4460224 - DNA, 13 bp, Homo sapiens
gctgtatggtata

SEQ ID NO: 4460225 - DNA, 17 bp, Homo sapiens
gctgtatttacagacac

SEQ ID NO: 4460226 - DNA, 17 bp, Homo sapiens
gctgtcagatgtcacat

SEQ ID NO: 4460227 - DNA, 12 bp, Homo sapiens
gctgtccagaca

SEQ ID NO: 4460228 - DNA, 13 bp, Homo sapiens
gctgtccagacag

SEQ ID NO: 4460229 - DNA, 14 bp, Homo sapiens
gctgtccagacagc

SEQ ID NO: 4460230 - DNA, 16 bp, Homo sapiens
gctgtccatgcttctc

SEQ ID NO: 4460231 - DNA, 16 bp, Homo sapiens
gctgtcccagccccgg

SEQ ID NO: 4460232 - DNA, 15 bp, Homo sapiens
gctgtccctgtcacc

SEQ ID NO: 4460233 - DNA, 21 bp, Homo sapiens
gctgtcctaccatcagctctg

SEQ ID NO: 4460234 - DNA, 15 bp, Homo sapiens
gctgtcctggagggg

SEQ ID NO: 4460235 - DNA, 22 bp, Homo sapiens
gctgtcctgtgatgtcagcggt

SEQ ID NO: 4460236 - DNA, 20 bp, Homo sapiens
gctgtcgccccaggccctcc

SEQ ID NO: 4460237 - DNA, 21 bp, Homo sapiens
gctgtcgccccaggccctccc

SEQ ID NO: 4460238 - DNA, 23 bp, Homo sapiens
gctgtcgccccaggccctccctg

SEQ ID NO: 4460239 - DNA, 17 bp, Homo sapiens
gctgtctgatctgtgct

SEQ ID NO: 4460240 - DNA, 17 bp, Homo sapiens
gctgtctggccaggcct

SEQ ID NO: 4460241 - DNA, 15 bp, Homo sapiens
gctgtctggccctgg

SEQ ID NO: 4460242 - DNA, 12 bp, Homo sapiens
gctgtctgtcac

SEQ ID NO: 4460243 - DNA, 21 bp, Homo sapiens
gctgtcttaaactaaatgtgc

SEQ ID NO: 4460244 - DNA, 20 bp, Homo sapiens
gctgtcttttgttctctgaa

SEQ ID NO: 4460245 - DNA, 16 bp, Homo sapiens
gctgtgctatgaattt

SEQ ID NO: 4460246 - DNA, 24 bp, Homo sapiens
gctgtggccggtgccagctgccct

SEQ ID NO: 4460247 - DNA, 19 bp, Homo sapiens
gctgtggccgtctcctccc

SEQ ID NO: 4460248 - DNA, 18 bp, Homo sapiens
gctgtgggcaagcctaag

SEQ ID NO: 4460249 - DNA, 16 bp, Homo sapiens
gctgtgggcagcaccc

SEQ ID NO: 4460250 - DNA, 20 bp, Homo sapiens
gctgtgggcagcaccctccc

SEQ ID NO: 4460251 - DNA, 19 bp, Homo sapiens
gctgtgtcctaaggcccat

SEQ ID NO: 4460252 - DNA, 14 bp, Homo sapiens
gctgtgtccttgca

SEQ ID NO: 4460253 - DNA, 20 bp, Homo sapiens
gctgtgtccttgcacctgca

SEQ ID NO: 4460254 - DNA, 21 bp, Homo sapiens
gctgtgtccttgcacctgcat

SEQ ID NO: 4460255 - DNA, 23 bp, Homo sapiens
gctgtgtccttgcacctgcatcc

SEQ ID NO: 4460256 - DNA, 16 bp, Homo sapiens
gctgtgtgtctgcttg

SEQ ID NO: 4460257 - DNA, 19 bp, Homo sapiens
gctgtgtgtcttctgcccc

SEQ ID NO: 4460258 - DNA, 13 bp, Homo sapiens
gctgtgtgtgagc

SEQ ID NO: 4460259 - DNA, 16 bp, Homo sapiens
gctgtgttcacagacc

SEQ ID NO: 4460260 - DNA, 18 bp, Homo sapiens
gctgtgttttagtctctt

SEQ ID NO: 4460261 - DNA, 23 bp, Homo sapiens
gctgttaaatacaggaaacagtt

SEQ ID NO: 4460262 - DNA, 15 bp, Homo sapiens
gctgttaccattcac

SEQ ID NO: 4460263 - DNA, 18 bp, Homo sapiens
gctgttaccattcacaat

SEQ ID NO: 4460264 - DNA, 15 bp, Homo sapiens
gctgttactgcttct

SEQ ID NO: 4460265 - DNA, 22 bp, Homo sapiens
gctgttactgcttctctttgtg

SEQ ID NO: 4460266 - DNA, 18 bp, Homo sapiens
gctgttatttcttccctg

SEQ ID NO: 4460267 - DNA, 19 bp, Homo sapiens
gctgttccagactcaggtt

SEQ ID NO: 4460268 - DNA, 19 bp, Homo sapiens
gctgttctgggcatggcag

SEQ ID NO: 4460269 - DNA, 21 bp, Homo sapiens
gctgttctgtggttcctctgc

SEQ ID NO: 4460270 - DNA, 14 bp, Homo sapiens
gctgttgacatatt

SEQ ID NO: 4460271 - DNA, 21 bp, Homo sapiens
gctgttgggtttttgctgttt

SEQ ID NO: 4460272 - DNA, 23 bp, Homo sapiens
gctgtttaaagtcacatccctgt

SEQ ID NO: 4460273 - DNA, 15 bp, Homo sapiens
gctgtttactaggga

SEQ ID NO: 4460274 - DNA, 20 bp, Homo sapiens
gctgtttactcccttctgta

SEQ ID NO: 4460275 - DNA, 23 bp, Homo sapiens
gctgtttactcccttctgtagtt

SEQ ID NO: 4460276 - DNA, 14 bp, Homo sapiens
gctgtttatggcct

SEQ ID NO: 4460277 - DNA, 15 bp, Homo sapiens
gctgtttatggcctc

SEQ ID NO: 4460278 - DNA, 17 bp, Homo sapiens
gctgtttatggcctcag

SEQ ID NO: 4460279 - DNA, 22 bp, Homo sapiens
gctgtttatggcctcagctgcc

SEQ ID NO: 4460280 - DNA, 20 bp, Homo sapiens
gctgtttgtttgacaaagaa

SEQ ID NO: 4460281 - DNA, 13 bp, Homo sapiens
gctgttttccctc

SEQ ID NO: 4460282 - DNA, 19 bp, Homo sapiens
gctgttttccctctgctgc

SEQ ID NO: 4460283 - DNA, 21 bp, Homo sapiens
gctgttttccctctgctgctt

SEQ ID NO: 4460284 - DNA, 15 bp, Homo sapiens
gctgttttgcctccc

SEQ ID NO: 4460285 - DNA, 15 bp, Homo sapiens
gctgtttttggctgt

SEQ ID NO: 4460286 - DNA, 13 bp, Homo sapiens
gcttaaaaaataa

SEQ ID NO: 4460287 - DNA, 23 bp, Homo sapiens
gcttaaaatatatagtgaaaaat

SEQ ID NO: 4460288 - DNA, 20 bp, Homo sapiens
gcttaaaatatgtgaagttt

SEQ ID NO: 4460289 - DNA, 23 bp, Homo sapiens
gcttaaacccatacaatgtatgt

SEQ ID NO: 4460290 - DNA, 17 bp, Homo sapiens
gcttaaacttgacccag

SEQ ID NO: 4460291 - DNA, 20 bp, Homo sapiens
gcttaaacttgacccaggtg

SEQ ID NO: 4460292 - DNA, 23 bp, Homo sapiens
gcttaaaggtgtcttcctcccaa

SEQ ID NO: 4460293 - DNA, 13 bp, Homo sapiens
gcttaaattttaa

SEQ ID NO: 4460294 - DNA, 22 bp, Homo sapiens
gcttaacctttccgctgtcgcc

SEQ ID NO: 4460295 - DNA, 14 bp, Homo sapiens
gcttaatatattcc

SEQ ID NO: 4460296 - DNA, 17 bp, Homo sapiens
gcttaatcagatagata

SEQ ID NO: 4460297 - DNA, 15 bp, Homo sapiens
gcttaatcattttca

SEQ ID NO: 4460298 - DNA, 16 bp, Homo sapiens
gcttaatcattttcat

SEQ ID NO: 4460299 - DNA, 21 bp, Homo sapiens
gcttaatcattttcattccta

SEQ ID NO: 4460300 - DNA, 18 bp, Homo sapiens
gcttaattgttctgcttt

SEQ ID NO: 4460301 - DNA, 22 bp, Homo sapiens
gcttaattgttctgctttttct

SEQ ID NO: 4460302 - DNA, 16 bp, Homo sapiens
gcttacaactttctaa

SEQ ID NO: 4460303 - DNA, 22 bp, Homo sapiens
gcttacctaatttcattttagt

SEQ ID NO: 4460304 - DNA, 21 bp, Homo sapiens
gcttactgatatattttacaa

SEQ ID NO: 4460305 - DNA, 23 bp, Homo sapiens
gcttagctttagaaacagtgcaa

SEQ ID NO: 4460306 - DNA, 17 bp, Homo sapiens
gcttataataaaggact

SEQ ID NO: 4460307 - DNA, 14 bp, Homo sapiens
gcttatctgcccct

SEQ ID NO: 4460308 - DNA, 20 bp, Homo sapiens
gcttatctgcccctccccca

SEQ ID NO: 4460309 - DNA, 15 bp, Homo sapiens
gcttattacatttta

SEQ ID NO: 4460310 - DNA, 19 bp, Homo sapiens
gcttattgatgaggtttat

SEQ ID NO: 4460311 - DNA, 18 bp, Homo sapiens
gcttattgcttagtaaaa

SEQ ID NO: 4460312 - DNA, 13 bp, Homo sapiens
gcttcaatataag

SEQ ID NO: 4460313 - DNA, 14 bp, Homo sapiens
gcttcacagccaca

SEQ ID NO: 4460314 - DNA, 19 bp, Homo sapiens
gcttcacccaccaggccag

SEQ ID NO: 4460315 - DNA, 20 bp, Homo sapiens
gcttcacccaccaggccagc

SEQ ID NO: 4460316 - DNA, 22 bp, Homo sapiens
gcttcacccaccaggccagctc

SEQ ID NO: 4460317 - DNA, 23 bp, Homo sapiens
gcttcagaccatcagttacagag

SEQ ID NO: 4460318 - DNA, 16 bp, Homo sapiens
gcttcagcaggaggca

SEQ ID NO: 4460319 - DNA, 23 bp, Homo sapiens
gcttcaggaacctcgagtactgt

SEQ ID NO: 4460320 - DNA, 14 bp, Homo sapiens
gcttcatccacagc

SEQ ID NO: 4460321 - DNA, 18 bp, Homo sapiens
gcttcatctgtcaagtgg

SEQ ID NO: 4460322 - DNA, 18 bp, Homo sapiens
gcttcattttatttttga

SEQ ID NO: 4460323 - DNA, 11 bp, Homo sapiens
gcttccaggct

SEQ ID NO: 4460324 - DNA, 16 bp, Homo sapiens
gcttccaggctgagag

SEQ ID NO: 4460325 - DNA, 20 bp, Homo sapiens
gcttccatagctgctgccct

SEQ ID NO: 4460326 - DNA, 19 bp, Homo sapiens
gcttccatgattctattta

SEQ ID NO: 4460327 - DNA, 22 bp, Homo sapiens
gcttccatgcctgtagctttcc

SEQ ID NO: 4460328 - DNA, 13 bp, Homo sapiens
gcttcccatgccg

SEQ ID NO: 4460329 - DNA, 11 bp, Homo sapiens
gcttccctgaa

SEQ ID NO: 4460330 - DNA, 21 bp, Homo sapiens
gcttccgggaaaacagctatt

SEQ ID NO: 4460331 - DNA, 22 bp, Homo sapiens
gcttcctacccacacctctgcc

SEQ ID NO: 4460332 - DNA, 20 bp, Homo sapiens
gcttcctccttccagatgcc

SEQ ID NO: 4460333 - DNA, 21 bp, Homo sapiens
gcttcctccttccagatgccc

SEQ ID NO: 4460334 - DNA, 23 bp, Homo sapiens
gcttcctctagaagccaagggaa

SEQ ID NO: 4460335 - DNA, 13 bp, Homo sapiens
gcttcctgagggc

SEQ ID NO: 4460336 - DNA, 15 bp, Homo sapiens
gcttcctgagggcta

SEQ ID NO: 4460337 - DNA, 20 bp, Homo sapiens
gcttcctgcgtcctcctcac

SEQ ID NO: 4460338 - DNA, 20 bp, Homo sapiens
gcttcctggaacttgctctc

SEQ ID NO: 4460339 - DNA, 11 bp, Homo sapiens
gcttcctgggt

SEQ ID NO: 4460340 - DNA, 15 bp, Homo sapiens
gcttcctgtctgttt

SEQ ID NO: 4460341 - DNA, 23 bp, Homo sapiens
gcttcctgtgtaacatctgccat

SEQ ID NO: 4460342 - DNA, 13 bp, Homo sapiens
gcttcgaggacag

SEQ ID NO: 4460343 - DNA, 17 bp, Homo sapiens
gcttcgaggacaggaaa

SEQ ID NO: 4460344 - DNA, 16 bp, Homo sapiens
gcttcggagtgaatgt

SEQ ID NO: 4460345 - DNA, 17 bp, Homo sapiens
gcttctaaatgcccagt

SEQ ID NO: 4460346 - DNA, 18 bp, Homo sapiens
gcttctactcctgcctca

SEQ ID NO: 4460347 - DNA, 22 bp, Homo sapiens
gcttctactttcatcttaaact

SEQ ID NO: 4460348 - DNA, 20 bp, Homo sapiens
gcttctaggagtcaactggc

SEQ ID NO: 4460349 - DNA, 18 bp, Homo sapiens
gcttctagttctgccagg

SEQ ID NO: 4460350 - DNA, 22 bp, Homo sapiens
gcttctcacgctttgtttactc

SEQ ID NO: 4460351 - DNA, 18 bp, Homo sapiens
gcttctcatcttgtgaaa

SEQ ID NO: 4460352 - DNA, 20 bp, Homo sapiens
gcttctccaaaaatctgcct

SEQ ID NO: 4460353 - DNA, 23 bp, Homo sapiens
gcttctccaaaaatctgcctggg

SEQ ID NO: 4460354 - DNA, 22 bp, Homo sapiens
gcttctccagggaattcttaca

SEQ ID NO: 4460355 - DNA, 13 bp, Homo sapiens
gcttctccccaga

SEQ ID NO: 4460356 - DNA, 22 bp, Homo sapiens
gcttctcccccaccccctaggg

SEQ ID NO: 4460357 - DNA, 17 bp, Homo sapiens
gcttctccgccagcctc

SEQ ID NO: 4460358 - DNA, 18 bp, Homo sapiens
gcttctccgccagcctcc

SEQ ID NO: 4460359 - DNA, 20 bp, Homo sapiens
gcttctccgccagcctcctc

SEQ ID NO: 4460360 - DNA, 16 bp, Homo sapiens
gcttctctcttttaaa

SEQ ID NO: 4460361 - DNA, 19 bp, Homo sapiens
gcttctctcttttaaagta

SEQ ID NO: 4460362 - DNA, 11 bp, Homo sapiens
gcttctctgca

SEQ ID NO: 4460363 - DNA, 13 bp, Homo sapiens
gcttctctgcagt

SEQ ID NO: 4460364 - DNA, 15 bp, Homo sapiens
gcttctctgcagtaa

SEQ ID NO: 4460365 - DNA, 16 bp, Homo sapiens
gcttctctgcagtaaa

SEQ ID NO: 4460366 - DNA, 23 bp, Homo sapiens
gcttctctgcagtaaaacacatt

SEQ ID NO: 4460367 - DNA, 12 bp, Homo sapiens
gcttctgcagca

SEQ ID NO: 4460368 - DNA, 15 bp, Homo sapiens
gcttctgcagcaact

SEQ ID NO: 4460369 - DNA, 19 bp, Homo sapiens
gcttctgcagcaactccca

SEQ ID NO: 4460370 - DNA, 23 bp, Homo sapiens
gcttctgcagcaactcccacgac

SEQ ID NO: 4460371 - DNA, 18 bp, Homo sapiens
gcttctgcggggctgaga

SEQ ID NO: 4460372 - DNA, 13 bp, Homo sapiens
gcttctgcttttc

SEQ ID NO: 4460373 - DNA, 14 bp, Homo sapiens
gcttctgcttttct

SEQ ID NO: 4460374 - DNA, 20 bp, Homo sapiens
gcttctgcttttctgccctg

SEQ ID NO: 4460375 - DNA, 18 bp, Homo sapiens
gcttcttcacaggcactc

SEQ ID NO: 4460376 - DNA, 19 bp, Homo sapiens
gcttcttcagatcagtgct

SEQ ID NO: 4460377 - DNA, 14 bp, Homo sapiens
gcttcttggagctt

SEQ ID NO: 4460378 - DNA, 20 bp, Homo sapiens
gcttcttttctttgtatcat

SEQ ID NO: 4460379 - DNA, 11 bp, Homo sapiens
gcttgaagcca

SEQ ID NO: 4460380 - DNA, 14 bp, Homo sapiens
gcttgaagccaaag

SEQ ID NO: 4460381 - DNA, 20 bp, Homo sapiens
gcttgaagccaaagaaaaat

SEQ ID NO: 4460382 - DNA, 17 bp, Homo sapiens
gcttgacatacctacca

SEQ ID NO: 4460383 - DNA, 21 bp, Homo sapiens
gcttgacatacctaccagtat

SEQ ID NO: 4460384 - DNA, 14 bp, Homo sapiens
gcttgactgcattg

SEQ ID NO: 4460385 - DNA, 12 bp, Homo sapiens
gcttgagccggg

SEQ ID NO: 4460386 - DNA, 17 bp, Homo sapiens
gcttgagccgggcccct

SEQ ID NO: 4460387 - DNA, 21 bp, Homo sapiens
gcttgagccgggcccctgggc

SEQ ID NO: 4460388 - DNA, 22 bp, Homo sapiens
gcttgagccgggcccctgggct

SEQ ID NO: 4460389 - DNA, 12 bp, Homo sapiens
gcttgagctcag

SEQ ID NO: 4460390 - DNA, 13 bp, Homo sapiens
gcttgatacagga

SEQ ID NO: 4460391 - DNA, 13 bp, Homo sapiens
gcttgatccagaa

SEQ ID NO: 4460392 - DNA, 16 bp, Homo sapiens
gcttgatctatctaca

SEQ ID NO: 4460393 - DNA, 23 bp, Homo sapiens
gcttgcacagccaacgagacaca

SEQ ID NO: 4460394 - DNA, 21 bp, Homo sapiens
gcttgccaaagtacagaattt

SEQ ID NO: 4460395 - DNA, 19 bp, Homo sapiens
gcttgccagggatgggcag

SEQ ID NO: 4460396 - DNA, 19 bp, Homo sapiens
gcttgcccgctcccacagc

SEQ ID NO: 4460397 - DNA, 18 bp, Homo sapiens
gcttgccctgttaaaaga

SEQ ID NO: 4460398 - DNA, 15 bp, Homo sapiens
gcttgctcgcttgct

SEQ ID NO: 4460399 - DNA, 12 bp, Homo sapiens
gcttgctggaac

SEQ ID NO: 4460400 - DNA, 12 bp, Homo sapiens
gcttgcttctgc

SEQ ID NO: 4460401 - DNA, 16 bp, Homo sapiens
gcttggaccagatcta

SEQ ID NO: 4460402 - DNA, 14 bp, Homo sapiens
gcttggagcagagg

SEQ ID NO: 4460403 - DNA, 16 bp, Homo sapiens
gcttggagcagagggg

SEQ ID NO: 4460404 - DNA, 18 bp, Homo sapiens
gcttggagcagaggggct

SEQ ID NO: 4460405 - DNA, 16 bp, Homo sapiens
gcttggagggatggag

SEQ ID NO: 4460406 - DNA, 15 bp, Homo sapiens
gcttggatctggggt

SEQ ID NO: 4460407 - DNA, 14 bp, Homo sapiens
gcttggatttcgtg

SEQ ID NO: 4460408 - DNA, 12 bp, Homo sapiens
gcttggcccagc

SEQ ID NO: 4460409 - DNA, 15 bp, Homo sapiens
gcttggcctgctgtg

SEQ ID NO: 4460410 - DNA, 13 bp, Homo sapiens
gcttgggagcctg

SEQ ID NO: 4460411 - DNA, 20 bp, Homo sapiens
gcttgggaggaaacctgaga

SEQ ID NO: 4460412 - DNA, 17 bp, Homo sapiens
gcttgggcagtgcccca

SEQ ID NO: 4460413 - DNA, 14 bp, Homo sapiens
gcttggggacctga

SEQ ID NO: 4460414 - DNA, 23 bp, Homo sapiens
gcttggggctgcacctcctaccc

SEQ ID NO: 4460415 - DNA, 20 bp, Homo sapiens
gcttggggtgtggggtgggg

SEQ ID NO: 4460416 - DNA, 18 bp, Homo sapiens
gcttgggtctctctcggc

SEQ ID NO: 4460417 - DNA, 17 bp, Homo sapiens
gcttggttgactgatgt

SEQ ID NO: 4460418 - DNA, 15 bp, Homo sapiens
gcttggttggctggc

SEQ ID NO: 4460419 - DNA, 15 bp, Homo sapiens
gcttgtaactccacc

SEQ ID NO: 4460420 - DNA, 14 bp, Homo sapiens
gcttgtattgtaaa

SEQ ID NO: 4460421 - DNA, 16 bp, Homo sapiens
gcttgtccagcgccta

SEQ ID NO: 4460422 - DNA, 19 bp, Homo sapiens
gcttgtggagccccacact

SEQ ID NO: 4460423 - DNA, 16 bp, Homo sapiens
gcttgttagagagaaa

SEQ ID NO: 4460424 - DNA, 19 bp, Homo sapiens
gcttgttagagagaaagag

SEQ ID NO: 4460425 - DNA, 14 bp, Homo sapiens
gcttgttggatttt

SEQ ID NO: 4460426 - DNA, 13 bp, Homo sapiens
gcttgtttacagc

SEQ ID NO: 4460427 - DNA, 21 bp, Homo sapiens
gctttaaaagtcattattcct

SEQ ID NO: 4460428 - DNA, 18 bp, Homo sapiens
gctttaacttaaatagta

SEQ ID NO: 4460429 - DNA, 20 bp, Homo sapiens
gctttaagtgtgctgggcag

SEQ ID NO: 4460430 - DNA, 20 bp, Homo sapiens
gctttaatatgagcttcaat

SEQ ID NO: 4460431 - DNA, 11 bp, Homo sapiens
gctttaatgag

SEQ ID NO: 4460432 - DNA, 19 bp, Homo sapiens
gctttaatgagaatagaaa

SEQ ID NO: 4460433 - DNA, 21 bp, Homo sapiens
gctttaatgagaatagaaacg

SEQ ID NO: 4460434 - DNA, 22 bp, Homo sapiens
gctttaggactgacatttctat

SEQ ID NO: 4460435 - DNA, 13 bp, Homo sapiens
gctttaggcagag

SEQ ID NO: 4460436 - DNA, 21 bp, Homo sapiens
gctttagtacaatagtataca

SEQ ID NO: 4460437 - DNA, 15 bp, Homo sapiens
gctttatctttgtgt

SEQ ID NO: 4460438 - DNA, 14 bp, Homo sapiens
gctttatgattttc

SEQ ID NO: 4460439 - DNA, 17 bp, Homo sapiens
gctttattccagaatgc

SEQ ID NO: 4460440 - DNA, 18 bp, Homo sapiens
gctttcatgattagcaag

SEQ ID NO: 4460441 - DNA, 20 bp, Homo sapiens
gctttcatgtaaactgtgca

SEQ ID NO: 4460442 - DNA, 21 bp, Homo sapiens
gctttcatgtaaactgtgcac

SEQ ID NO: 4460443 - DNA, 14 bp, Homo sapiens
gctttcctatctag

SEQ ID NO: 4460444 - DNA, 18 bp, Homo sapiens
gctttcctcaaaaagcag

SEQ ID NO: 4460445 - DNA, 11 bp, Homo sapiens
gctttcctgaa

SEQ ID NO: 4460446 - DNA, 16 bp, Homo sapiens
gctttcctggtccctc

SEQ ID NO: 4460447 - DNA, 13 bp, Homo sapiens
gctttccttcatc

SEQ ID NO: 4460448 - DNA, 16 bp, Homo sapiens
gctttcgaactgctag

SEQ ID NO: 4460449 - DNA, 20 bp, Homo sapiens
gctttctaccacacacagcc

SEQ ID NO: 4460450 - DNA, 13 bp, Homo sapiens
gctttctgccacc

SEQ ID NO: 4460451 - DNA, 19 bp, Homo sapiens
gctttctttgattctcctt

SEQ ID NO: 4460452 - DNA, 19 bp, Homo sapiens
gctttgactctataagcaa

SEQ ID NO: 4460453 - DNA, 20 bp, Homo sapiens
gctttgactctataagcaaa

SEQ ID NO: 4460454 - DNA, 15 bp, Homo sapiens
gctttgattcatagt

SEQ ID NO: 4460455 - DNA, 16 bp, Homo sapiens
gctttgcagaccgcat

SEQ ID NO: 4460456 - DNA, 15 bp, Homo sapiens
gctttgcagctgctg

SEQ ID NO: 4460457 - DNA, 21 bp, Homo sapiens
gctttgcagctgctgtctgag

SEQ ID NO: 4460458 - DNA, 18 bp, Homo sapiens
gctttgccaaaataccag

SEQ ID NO: 4460459 - DNA, 11 bp, Homo sapiens
gctttgcctct

SEQ ID NO: 4460460 - DNA, 21 bp, Homo sapiens
gctttgcttatggtaataaaa

SEQ ID NO: 4460461 - DNA, 11 bp, Homo sapiens
gctttgctttg

SEQ ID NO: 4460462 - DNA, 15 bp, Homo sapiens
gctttggaaaaatct

SEQ ID NO: 4460463 - DNA, 12 bp, Homo sapiens
gctttggaaaca

SEQ ID NO: 4460464 - DNA, 22 bp, Homo sapiens
gctttggaatattttatcctgt

SEQ ID NO: 4460465 - DNA, 17 bp, Homo sapiens
gctttggcactctctgc

SEQ ID NO: 4460466 - DNA, 12 bp, Homo sapiens
gctttggcccaa

SEQ ID NO: 4460467 - DNA, 16 bp, Homo sapiens
gctttggcccaatgcc

SEQ ID NO: 4460468 - DNA, 16 bp, Homo sapiens
gctttggttctctgat

SEQ ID NO: 4460469 - DNA, 13 bp, Homo sapiens
gctttgtagtttg

SEQ ID NO: 4460470 - DNA, 13 bp, Homo sapiens
gctttgtcacttg

SEQ ID NO: 4460471 - DNA, 20 bp, Homo sapiens
gctttgtgaccagaaagctt

SEQ ID NO: 4460472 - DNA, 14 bp, Homo sapiens
gctttgtggcactg

SEQ ID NO: 4460473 - DNA, 22 bp, Homo sapiens
gctttgtggcactggggcaggg

SEQ ID NO: 4460474 - DNA, 22 bp, Homo sapiens
gcttttaaaaacaaatgagttt

SEQ ID NO: 4460475 - DNA, 15 bp, Homo sapiens
gcttttaaaatgtag

SEQ ID NO: 4460476 - DNA, 15 bp, Homo sapiens
gcttttaagtttttc

SEQ ID NO: 4460477 - DNA, 17 bp, Homo sapiens
gcttttagatgtaacct

SEQ ID NO: 4460478 - DNA, 16 bp, Homo sapiens
gcttttatagaggcta

SEQ ID NO: 4460479 - DNA, 22 bp, Homo sapiens
gcttttatagaggctagcttct

SEQ ID NO: 4460480 - DNA, 12 bp, Homo sapiens
gcttttatctgc

SEQ ID NO: 4460481 - DNA, 19 bp, Homo sapiens
gcttttatggatgattaaa

SEQ ID NO: 4460482 - DNA, 13 bp, Homo sapiens
gcttttattcctt

SEQ ID NO: 4460483 - DNA, 19 bp, Homo sapiens
gcttttattcctttgaata

SEQ ID NO: 4460484 - DNA, 15 bp, Homo sapiens
gcttttcactttctg

SEQ ID NO: 4460485 - DNA, 20 bp, Homo sapiens
gcttttcattttaatatata

SEQ ID NO: 4460486 - DNA, 18 bp, Homo sapiens
gcttttccccggtccctt

SEQ ID NO: 4460487 - DNA, 13 bp, Homo sapiens
gcttttcctctgc

SEQ ID NO: 4460488 - DNA, 18 bp, Homo sapiens
gcttttctgccctggctg

SEQ ID NO: 4460489 - DNA, 14 bp, Homo sapiens
gcttttctgtattt

SEQ ID NO: 4460490 - DNA, 13 bp, Homo sapiens
gcttttgccatta

SEQ ID NO: 4460491 - DNA, 15 bp, Homo sapiens
gcttttgcctgtaag

SEQ ID NO: 4460492 - DNA, 23 bp, Homo sapiens
gcttttgcggttcaggaaaattg

SEQ ID NO: 4460493 - DNA, 18 bp, Homo sapiens
gcttttgcttgatccaga

SEQ ID NO: 4460494 - DNA, 14 bp, Homo sapiens
gcttttgttctaga

SEQ ID NO: 4460495 - DNA, 15 bp, Homo sapiens
gcttttgttctagac

SEQ ID NO: 4460496 - DNA, 21 bp, Homo sapiens
gcttttgtttcctttttcaga

SEQ ID NO: 4460497 - DNA, 18 bp, Homo sapiens
gctttttaagaatatttt

SEQ ID NO: 4460498 - DNA, 13 bp, Homo sapiens
gctttttaattaa

SEQ ID NO: 4460499 - DNA, 19 bp, Homo sapiens
gctttttattccctgccca

SEQ ID NO: 4460500 - DNA, 17 bp, Homo sapiens
gctttttttgtgtgtat

SEQ ID NO: 4460501 - DNA, 24 bp, Homo sapiens
gctttttttttctctttctctcct

SEQ ID NO: 4460502 - DNA, 14 bp, Homo sapiens
ggaaaaaaactttt

SEQ ID NO: 4460503 - DNA, 14 bp, Homo sapiens
ggaaaaaaggaata

SEQ ID NO: 4460504 - DNA, 14 bp, Homo sapiens
ggaaaaaatatttt

SEQ ID NO: 4460505 - DNA, 23 bp, Homo sapiens
ggaaaaagctccatgtgcctctt

SEQ ID NO: 4460506 - DNA, 13 bp, Homo sapiens
ggaaaacagctat

SEQ ID NO: 4460507 - DNA, 20 bp, Homo sapiens
ggaaaagaggacagaaaaat

SEQ ID NO: 4460508 - DNA, 18 bp, Homo sapiens
ggaaaagataaagaccag

SEQ ID NO: 4460509 - DNA, 22 bp, Homo sapiens
ggaaaagataaagaccagaaat

SEQ ID NO: 4460510 - DNA, 10 bp, Homo sapiens
ggaaaagctt

SEQ ID NO: 4460511 - DNA, 14 bp, Homo sapiens
ggaaaaggcccctg

SEQ ID NO: 4460512 - DNA, 15 bp, Homo sapiens
ggaaacaaaccttgc

SEQ ID NO: 4460513 - DNA, 21 bp, Homo sapiens
ggaaacaaaccttgccttgaa

SEQ ID NO: 4460514 - DNA, 15 bp, Homo sapiens
ggaaacaggttggga

SEQ ID NO: 4460515 - DNA, 17 bp, Homo sapiens
ggaaacagttgcatgta

SEQ ID NO: 4460516 - DNA, 23 bp, Homo sapiens
ggaaacgcagttgtgtggcccag

SEQ ID NO: 4460517 - DNA, 13 bp, Homo sapiens
ggaaactgccagc

SEQ ID NO: 4460518 - DNA, 20 bp, Homo sapiens
ggaaactgggtttctcatta

SEQ ID NO: 4460519 - DNA, 18 bp, Homo sapiens
ggaaacttagcttttgat

SEQ ID NO: 4460520 - DNA, 20 bp, Homo sapiens
ggaaagatttgtgaactgga

SEQ ID NO: 4460521 - DNA, 16 bp, Homo sapiens
ggaaagcaagaatcag

SEQ ID NO: 4460522 - DNA, 15 bp, Homo sapiens
ggaaagcgggcagcc

SEQ ID NO: 4460523 - DNA, 18 bp, Homo sapiens
ggaaagcgggcagccccg

SEQ ID NO: 4460524 - DNA, 21 bp, Homo sapiens
ggaaagcttttcagtgttccc

SEQ ID NO: 4460525 - DNA, 19 bp, Homo sapiens
ggaaaggattttaccaaag

SEQ ID NO: 4460526 - DNA, 18 bp, Homo sapiens
ggaaaggcctcttctcaa

SEQ ID NO: 4460527 - DNA, 20 bp, Homo sapiens
ggaaagggctggctccccct

SEQ ID NO: 4460528 - DNA, 12 bp, Homo sapiens
ggaaaggggaga

SEQ ID NO: 4460529 - DNA, 19 bp, Homo sapiens
ggaaaggggagagcctgct

SEQ ID NO: 4460530 - DNA, 21 bp, Homo sapiens
ggaaaggggagagcctgctgg

SEQ ID NO: 4460531 - DNA, 23 bp, Homo sapiens
ggaaagtggccaagaagcagtgg

SEQ ID NO: 4460532 - DNA, 22 bp, Homo sapiens
ggaaagttttctccactggaaa

SEQ ID NO: 4460533 - DNA, 12 bp, Homo sapiens
ggaaagttttta

SEQ ID NO: 4460534 - DNA, 19 bp, Homo sapiens
ggaaataaaaaagtctcta

SEQ ID NO: 4460535 - DNA, 15 bp, Homo sapiens
ggaaataaaaatgtt

SEQ ID NO: 4460536 - DNA, 20 bp, Homo sapiens
ggaaataaaagataaaagag

SEQ ID NO: 4460537 - DNA, 11 bp, Homo sapiens
ggaaatacagt

SEQ ID NO: 4460538 - DNA, 13 bp, Homo sapiens
ggaaatagaaaga

SEQ ID NO: 4460539 - DNA, 23 bp, Homo sapiens
ggaaataggcccaaccaccagat

SEQ ID NO: 4460540 - DNA, 18 bp, Homo sapiens
ggaaatcagtagaaagct

SEQ ID NO: 4460541 - DNA, 19 bp, Homo sapiens
ggaaatcagtagaaagcta

SEQ ID NO: 4460542 - DNA, 22 bp, Homo sapiens
ggaaatcagtagaaagctaaag

SEQ ID NO: 4460543 - DNA, 19 bp, Homo sapiens
ggaaatcctgccctggagg

SEQ ID NO: 4460544 - DNA, 13 bp, Homo sapiens
ggaaatcttaaac

SEQ ID NO: 4460545 - DNA, 14 bp, Homo sapiens
ggaaatgaaattgt

SEQ ID NO: 4460546 - DNA, 23 bp, Homo sapiens
ggaaatgggaattgcgctcaggg

SEQ ID NO: 4460547 - DNA, 15 bp, Homo sapiens
ggaaatgtagcactt

SEQ ID NO: 4460548 - DNA, 21 bp, Homo sapiens
ggaaattgtaaatcctgtgtt

SEQ ID NO: 4460549 - DNA, 17 bp, Homo sapiens
ggaaattgtttatgtgt

SEQ ID NO: 4460550 - DNA, 20 bp, Homo sapiens
ggaaattttatatgtaaatg

SEQ ID NO: 4460551 - DNA, 19 bp, Homo sapiens
ggaacaaacagaaatgact

SEQ ID NO: 4460552 - DNA, 14 bp, Homo sapiens
ggaacaaacagggc

SEQ ID NO: 4460553 - DNA, 15 bp, Homo sapiens
ggaacaaagacaacc

SEQ ID NO: 4460554 - DNA, 15 bp, Homo sapiens
ggaacaaattatttt

SEQ ID NO: 4460555 - DNA, 13 bp, Homo sapiens
ggaacaaggaagg

SEQ ID NO: 4460556 - DNA, 23 bp, Homo sapiens
ggaacagaagaggaaagagagac

SEQ ID NO: 4460557 - DNA, 17 bp, Homo sapiens
ggaacagacaggagaaa

SEQ ID NO: 4460558 - DNA, 21 bp, Homo sapiens
ggaacagcactggggagtctt

SEQ ID NO: 4460559 - DNA, 19 bp, Homo sapiens
ggaacagctatgggagccc

SEQ ID NO: 4460560 - DNA, 11 bp, Homo sapiens
ggaacattttc

SEQ ID NO: 4460561 - DNA, 12 bp, Homo sapiens
ggaaccagcccc

SEQ ID NO: 4460562 - DNA, 15 bp, Homo sapiens
ggaacccccaaattt

SEQ ID NO: 4460563 - DNA, 18 bp, Homo sapiens
ggaacctcgagtactgtg

SEQ ID NO: 4460564 - DNA, 12 bp, Homo sapiens
ggaaccttccct

SEQ ID NO: 4460565 - DNA, 21 bp, Homo sapiens
ggaaccttccttcctgcttga

SEQ ID NO: 4460566 - DNA, 14 bp, Homo sapiens
ggaacgcagttgat

SEQ ID NO: 4460567 - DNA, 16 bp, Homo sapiens
ggaacgtgactgcccc

SEQ ID NO: 4460568 - DNA, 17 bp, Homo sapiens
ggaactcatctggttga

SEQ ID NO: 4460569 - DNA, 17 bp, Homo sapiens
ggaactcgtgtctggca

SEQ ID NO: 4460570 - DNA, 17 bp, Homo sapiens
ggaactgcagacctgtc

SEQ ID NO: 4460571 - DNA, 21 bp, Homo sapiens
ggaactgcagacctgtcctcc

SEQ ID NO: 4460572 - DNA, 16 bp, Homo sapiens
ggaactgggctgggcc

SEQ ID NO: 4460573 - DNA, 12 bp, Homo sapiens
ggaactgtccca

SEQ ID NO: 4460574 - DNA, 15 bp, Homo sapiens
ggaactgtcccagct

SEQ ID NO: 4460575 - DNA, 16 bp, Homo sapiens
ggaactgtgtatttat

SEQ ID NO: 4460576 - DNA, 20 bp, Homo sapiens
ggaactgtgtatttatttaa

SEQ ID NO: 4460577 - DNA, 19 bp, Homo sapiens
ggaacttgcgagtccaagg

SEQ ID NO: 4460578 - DNA, 17 bp, Homo sapiens
ggaagaaactttctggt

SEQ ID NO: 4460579 - DNA, 15 bp, Homo sapiens
ggaagaacagccccg

SEQ ID NO: 4460580 - DNA, 22 bp, Homo sapiens
ggaagaacgaggtttatatttt

SEQ ID NO: 4460581 - DNA, 21 bp, Homo sapiens
ggaagaacggggctcttctca

SEQ ID NO: 4460582 - DNA, 15 bp, Homo sapiens
ggaagaagggagaag

SEQ ID NO: 4460583 - DNA, 21 bp, Homo sapiens
ggaagacttttggtagagaag

SEQ ID NO: 4460584 - DNA, 20 bp, Homo sapiens
ggaagagaagagggcccagc

SEQ ID NO: 4460585 - DNA, 23 bp, Homo sapiens
ggaagagaagagggcccagccca

SEQ ID NO: 4460586 - DNA, 13 bp, Homo sapiens
ggaagagacaaag

SEQ ID NO: 4460587 - DNA, 16 bp, Homo sapiens
ggaagagacagcccag

SEQ ID NO: 4460588 - DNA, 12 bp, Homo sapiens
ggaagagccacc

SEQ ID NO: 4460589 - DNA, 16 bp, Homo sapiens
ggaagagccacctgca

SEQ ID NO: 4460590 - DNA, 12 bp, Homo sapiens
ggaagagccttt

SEQ ID NO: 4460591 - DNA, 14 bp, Homo sapiens
ggaagagcctttat

SEQ ID NO: 4460592 - DNA, 19 bp, Homo sapiens
ggaagaggctacagggcca

SEQ ID NO: 4460593 - DNA, 16 bp, Homo sapiens
ggaagagggaaatgta

SEQ ID NO: 4460594 - DNA, 23 bp, Homo sapiens
ggaagagtgtgggggaggcgcac

SEQ ID NO: 4460595 - DNA, 15 bp, Homo sapiens
ggaagatcagatgca

SEQ ID NO: 4460596 - DNA, 13 bp, Homo sapiens
ggaagcaccccat

SEQ ID NO: 4460597 - DNA, 15 bp, Homo sapiens
ggaagcaccccatgc

SEQ ID NO: 4460598 - DNA, 22 bp, Homo sapiens
ggaagcaccccatgccaaagct

SEQ ID NO: 4460599 - DNA, 16 bp, Homo sapiens
ggaagcacgggggagt

SEQ ID NO: 4460600 - DNA, 13 bp, Homo sapiens
ggaagcagaggcc

SEQ ID NO: 4460601 - DNA, 14 bp, Homo sapiens
ggaagcagaggccc

SEQ ID NO: 4460602 - DNA, 16 bp, Homo sapiens
ggaagcagaggccctg

SEQ ID NO: 4460603 - DNA, 15 bp, Homo sapiens
ggaagcaggacccag

SEQ ID NO: 4460604 - DNA, 22 bp, Homo sapiens
ggaagcatgtttattctgttcc

SEQ ID NO: 4460605 - DNA, 22 bp, Homo sapiens
ggaagcattgtaaaataattct

SEQ ID NO: 4460606 - DNA, 23 bp, Homo sapiens
ggaagccagagccccaagcagga

SEQ ID NO: 4460607 - DNA, 14 bp, Homo sapiens
ggaagcccatcctg

SEQ ID NO: 4460608 - DNA, 11 bp, Homo sapiens
ggaagccctcc

SEQ ID NO: 4460609 - DNA, 16 bp, Homo sapiens
ggaagccctccttcca

SEQ ID NO: 4460610 - DNA, 17 bp, Homo sapiens
ggaagccctccttccac

SEQ ID NO: 4460611 - DNA, 11 bp, Homo sapiens
ggaagccctgg

SEQ ID NO: 4460612 - DNA, 23 bp, Homo sapiens
ggaagccctggatttcagaaaga

SEQ ID NO: 4460613 - DNA, 19 bp, Homo sapiens
ggaagctagacacatgaag

SEQ ID NO: 4460614 - DNA, 16 bp, Homo sapiens
ggaagctgctgaggcc

SEQ ID NO: 4460615 - DNA, 23 bp, Homo sapiens
ggaagctgctgaggcccccaagt

SEQ ID NO: 4460616 - DNA, 15 bp, Homo sapiens
ggaagctggcctgag

SEQ ID NO: 4460617 - DNA, 21 bp, Homo sapiens
ggaagctgtgtccttgcacct

SEQ ID NO: 4460618 - DNA, 23 bp, Homo sapiens
ggaagctgtgtccttgcacctgc

SEQ ID NO: 4460619 - DNA, 23 bp, Homo sapiens
ggaaggaataaagggagaagagg

SEQ ID NO: 4460620 - DNA, 15 bp, Homo sapiens
ggaaggacagtccct

SEQ ID NO: 4460621 - DNA, 21 bp, Homo sapiens
ggaaggacagtccctgctggg

SEQ ID NO: 4460622 - DNA, 22 bp, Homo sapiens
ggaaggacagtccctgctgggg

SEQ ID NO: 4460623 - DNA, 22 bp, Homo sapiens
ggaaggagactcacctctgcct

SEQ ID NO: 4460624 - DNA, 14 bp, Homo sapiens
ggaaggagagcctg

SEQ ID NO: 4460625 - DNA, 16 bp, Homo sapiens
ggaaggagagcctgct

SEQ ID NO: 4460626 - DNA, 17 bp, Homo sapiens
ggaaggagagcctgctg

SEQ ID NO: 4460627 - DNA, 22 bp, Homo sapiens
ggaaggatcccatgagctcctt

SEQ ID NO: 4460628 - DNA, 14 bp, Homo sapiens
ggaaggccctgagg

SEQ ID NO: 4460629 - DNA, 12 bp, Homo sapiens
ggaaggcctgac

SEQ ID NO: 4460630 - DNA, 13 bp, Homo sapiens
ggaagggctgggc

SEQ ID NO: 4460631 - DNA, 22 bp, Homo sapiens
ggaagggctgggccaccaggga

SEQ ID NO: 4460632 - DNA, 21 bp, Homo sapiens
ggaaggggttcctcaaatttt

SEQ ID NO: 4460633 - DNA, 22 bp, Homo sapiens
ggaaggggttcctcaaattttt

SEQ ID NO: 4460634 - DNA, 15 bp, Homo sapiens
ggaagggtttctcta

SEQ ID NO: 4460635 - DNA, 18 bp, Homo sapiens
ggaagggtttgtggctgg

SEQ ID NO: 4460636 - DNA, 15 bp, Homo sapiens
ggaaggtcttttgag

SEQ ID NO: 4460637 - DNA, 15 bp, Homo sapiens
ggaaggtggccacag

SEQ ID NO: 4460638 - DNA, 16 bp, Homo sapiens
ggaagtaacagacaca

SEQ ID NO: 4460639 - DNA, 13 bp, Homo sapiens
ggaagtcaaagca

SEQ ID NO: 4460640 - DNA, 20 bp, Homo sapiens
ggaagtcgaggctgcagtca

SEQ ID NO: 4460641 - DNA, 14 bp, Homo sapiens
ggaagtctaggagc

SEQ ID NO: 4460642 - DNA, 20 bp, Homo sapiens
ggaagtgaagactggaagct

SEQ ID NO: 4460643 - DNA, 17 bp, Homo sapiens
ggaagtggctgtccctg

SEQ ID NO: 4460644 - DNA, 18 bp, Homo sapiens
ggaagttgacttatagta

SEQ ID NO: 4460645 - DNA, 14 bp, Homo sapiens
ggaagtttatttcc

SEQ ID NO: 4460646 - DNA, 11 bp, Homo sapiens
ggaagttttat

SEQ ID NO: 4460647 - DNA, 18 bp, Homo sapiens
ggaataaagttgcagatg

SEQ ID NO: 4460648 - DNA, 14 bp, Homo sapiens
ggaatagaggaaga

SEQ ID NO: 4460649 - DNA, 16 bp, Homo sapiens
ggaatagaggaagaaa

SEQ ID NO: 4460650 - DNA, 22 bp, Homo sapiens
ggaatataagaaaagtaatgaa

SEQ ID NO: 4460651 - DNA, 23 bp, Homo sapiens
ggaatataaggaaagcaataaat

SEQ ID NO: 4460652 - DNA, 18 bp, Homo sapiens
ggaatatcatctgtcatt

SEQ ID NO: 4460653 - DNA, 20 bp, Homo sapiens
ggaatatcatctgtcattat

SEQ ID NO: 4460654 - DNA, 16 bp, Homo sapiens
ggaatcaagagctgcc

SEQ ID NO: 4460655 - DNA, 19 bp, Homo sapiens
ggaatcaagagctgccctc

SEQ ID NO: 4460656 - DNA, 13 bp, Homo sapiens
ggaatcacccctc

SEQ ID NO: 4460657 - DNA, 18 bp, Homo sapiens
ggaatcacccctctgccc

SEQ ID NO: 4460658 - DNA, 19 bp, Homo sapiens
ggaatcacccctctgcccc

SEQ ID NO: 4460659 - DNA, 23 bp, Homo sapiens
ggaatcagacttcacactgcaag

SEQ ID NO: 4460660 - DNA, 23 bp, Homo sapiens
ggaatcattaatttcaaaattta

SEQ ID NO: 4460661 - DNA, 13 bp, Homo sapiens
ggaatcctggacc

SEQ ID NO: 4460662 - DNA, 21 bp, Homo sapiens
ggaatctgtttctctgctgtc

SEQ ID NO: 4460663 - DNA, 14 bp, Homo sapiens
ggaatgcacctccc

SEQ ID NO: 4460664 - DNA, 22 bp, Homo sapiens
ggaatgcggccgcattccctga

SEQ ID NO: 4460665 - DNA, 20 bp, Homo sapiens
ggaatggatttttctttaac

SEQ ID NO: 4460666 - DNA, 22 bp, Homo sapiens
ggaatggatttttctttaactg

SEQ ID NO: 4460667 - DNA, 11 bp, Homo sapiens
ggaatgggaga

SEQ ID NO: 4460668 - DNA, 16 bp, Homo sapiens
ggaatgggagaggggt

SEQ ID NO: 4460669 - DNA, 18 bp, Homo sapiens
ggaatgtgccacagaggc

SEQ ID NO: 4460670 - DNA, 20 bp, Homo sapiens
ggaatgttggataaggaatt

SEQ ID NO: 4460671 - DNA, 15 bp, Homo sapiens
ggaattaaatagtgt

SEQ ID NO: 4460672 - DNA, 13 bp, Homo sapiens
ggaattacatttt

SEQ ID NO: 4460673 - DNA, 19 bp, Homo sapiens
ggaattacgtgctctgtgg

SEQ ID NO: 4460674 - DNA, 15 bp, Homo sapiens
ggaattccctccccc

SEQ ID NO: 4460675 - DNA, 17 bp, Homo sapiens
ggaattgatttgcattg

SEQ ID NO: 4460676 - DNA, 17 bp, Homo sapiens
ggaattgcgctcagggg

SEQ ID NO: 4460677 - DNA, 15 bp, Homo sapiens
ggaatttactttctt

SEQ ID NO: 4460678 - DNA, 16 bp, Homo sapiens
ggaatttgcctgctgg

SEQ ID NO: 4460679 - DNA, 22 bp, Homo sapiens
ggacaagagggttcacacagcc

SEQ ID NO: 4460680 - DNA, 15 bp, Homo sapiens
ggacaatatgtgcca

SEQ ID NO: 4460681 - DNA, 15 bp, Homo sapiens
ggacacacattctgc

SEQ ID NO: 4460682 - DNA, 18 bp, Homo sapiens
ggacacacattctgcctt

SEQ ID NO: 4460683 - DNA, 19 bp, Homo sapiens
ggacacacattctgccttg

SEQ ID NO: 4460684 - DNA, 13 bp, Homo sapiens
ggacacagaccca

SEQ ID NO: 4460685 - DNA, 18 bp, Homo sapiens
ggacacagcatcagctca

SEQ ID NO: 4460686 - DNA, 17 bp, Homo sapiens
ggacacagttcctggga

SEQ ID NO: 4460687 - DNA, 19 bp, Homo sapiens
ggacacagttcctgggaac

SEQ ID NO: 4460688 - DNA, 13 bp, Homo sapiens
ggacaccagagct

SEQ ID NO: 4460689 - DNA, 16 bp, Homo sapiens
ggacaccagccaggct

SEQ ID NO: 4460690 - DNA, 19 bp, Homo sapiens
ggacaccagccaggctctg

SEQ ID NO: 4460691 - DNA, 14 bp, Homo sapiens
ggacactcctagag

SEQ ID NO: 4460692 - DNA, 20 bp, Homo sapiens
ggacactcgtcaccccagcc

SEQ ID NO: 4460693 - DNA, 12 bp, Homo sapiens
ggacacttttat

SEQ ID NO: 4460694 - DNA, 15 bp, Homo sapiens
ggacagaaaatgcaa

SEQ ID NO: 4460695 - DNA, 14 bp, Homo sapiens
ggacagaaagagac

SEQ ID NO: 4460696 - DNA, 20 bp, Homo sapiens
ggacagacccacccccagcc

SEQ ID NO: 4460697 - DNA, 20 bp, Homo sapiens
ggacagacgagacaacagca

SEQ ID NO: 4460698 - DNA, 17 bp, Homo sapiens
ggacagagacacctgca

SEQ ID NO: 4460699 - DNA, 21 bp, Homo sapiens
ggacagagacacctgcacctc

SEQ ID NO: 4460700 - DNA, 17 bp, Homo sapiens
ggacagagcaggggctc

SEQ ID NO: 4460701 - DNA, 22 bp, Homo sapiens
ggacagagcaggggctccagca

SEQ ID NO: 4460702 - DNA, 16 bp, Homo sapiens
ggacagagccagcggc

SEQ ID NO: 4460703 - DNA, 11 bp, Homo sapiens
ggacagagccc

SEQ ID NO: 4460704 - DNA, 13 bp, Homo sapiens
ggacagagccccc

SEQ ID NO: 4460705 - DNA, 14 bp, Homo sapiens
ggacagagcccccc

SEQ ID NO: 4460706 - DNA, 15 bp, Homo sapiens
ggacagagcccccct

SEQ ID NO: 4460707 - DNA, 19 bp, Homo sapiens
ggacagagcccccctagca

SEQ ID NO: 4460708 - DNA, 14 bp, Homo sapiens
ggacagaggcctgc

SEQ ID NO: 4460709 - DNA, 16 bp, Homo sapiens
ggacagaggcctgccc

SEQ ID NO: 4460710 - DNA, 17 bp, Homo sapiens
ggacagaggcctgcccg

SEQ ID NO: 4460711 - DNA, 22 bp, Homo sapiens
ggacagagtggtttccaatgtg

SEQ ID NO: 4460712 - DNA, 12 bp, Homo sapiens
ggacagcaacaa

SEQ ID NO: 4460713 - DNA, 17 bp, Homo sapiens
ggacagcatcccttccc

SEQ ID NO: 4460714 - DNA, 21 bp, Homo sapiens
ggacagcctgtggcggtgcct

SEQ ID NO: 4460715 - DNA, 23 bp, Homo sapiens
ggacagcctgtggcggtgcctgg

SEQ ID NO: 4460716 - DNA, 17 bp, Homo sapiens
ggacagctgataaattt

SEQ ID NO: 4460717 - DNA, 19 bp, Homo sapiens
ggacagctgataaatttaa

SEQ ID NO: 4460718 - DNA, 11 bp, Homo sapiens
ggacaggagcc

SEQ ID NO: 4460719 - DNA, 14 bp, Homo sapiens
ggacaggagcctgg

SEQ ID NO: 4460720 - DNA, 22 bp, Homo sapiens
ggacaggcccggcgcggtggct

SEQ ID NO: 4460721 - DNA, 18 bp, Homo sapiens
ggacaggtgacagtggct

SEQ ID NO: 4460722 - DNA, 19 bp, Homo sapiens
ggacaggtgacagtggctg

SEQ ID NO: 4460723 - DNA, 20 bp, Homo sapiens
ggacaggtgacagtggctgc

SEQ ID NO: 4460724 - DNA, 19 bp, Homo sapiens
ggacagtatttgtggggag

SEQ ID NO: 4460725 - DNA, 14 bp, Homo sapiens
ggacagtccctgct

SEQ ID NO: 4460726 - DNA, 16 bp, Homo sapiens
ggacagtccctgctgg

SEQ ID NO: 4460727 - DNA, 22 bp, Homo sapiens
ggacagttccagaagtgtgact

SEQ ID NO: 4460728 - DNA, 21 bp, Homo sapiens
ggacagtttatcatgaagcct

SEQ ID NO: 4460729 - DNA, 23 bp, Homo sapiens
ggacataaatcacagaaaattta

SEQ ID NO: 4460730 - DNA, 15 bp, Homo sapiens
ggaccaccctgagcc

SEQ ID NO: 4460731 - DNA, 16 bp, Homo sapiens
ggaccaccctgagccg

SEQ ID NO: 4460732 - DNA, 12 bp, Homo sapiens
ggaccagaggag

SEQ ID NO: 4460733 - DNA, 16 bp, Homo sapiens
ggaccagcccttcatg

SEQ ID NO: 4460734 - DNA, 14 bp, Homo sapiens
ggaccaggacagga

SEQ ID NO: 4460735 - DNA, 19 bp, Homo sapiens
ggaccaggtttgcaggagc

SEQ ID NO: 4460736 - DNA, 19 bp, Homo sapiens
ggaccagtcaacctgggca

SEQ ID NO: 4460737 - DNA, 14 bp, Homo sapiens
ggacccaccccaac

SEQ ID NO: 4460738 - DNA, 15 bp, Homo sapiens
ggacccaccccaact

SEQ ID NO: 4460739 - DNA, 21 bp, Homo sapiens
ggacccaccccaactctcccc

SEQ ID NO: 4460740 - DNA, 20 bp, Homo sapiens
ggacccacctgtggggcctg

SEQ ID NO: 4460741 - DNA, 21 bp, Homo sapiens
ggacccagaggaaggggccag

SEQ ID NO: 4460742 - DNA, 13 bp, Homo sapiens
ggacccaggcgct

SEQ ID NO: 4460743 - DNA, 17 bp, Homo sapiens
ggacccagggcctgact

SEQ ID NO: 4460744 - DNA, 21 bp, Homo sapiens
ggacccagggcctgacttgag

SEQ ID NO: 4460745 - DNA, 22 bp, Homo sapiens
ggacccccgaggggagggcagg

SEQ ID NO: 4460746 - DNA, 20 bp, Homo sapiens
ggaccccgtttcatttttac

SEQ ID NO: 4460747 - DNA, 12 bp, Homo sapiens
ggaccctcagca

SEQ ID NO: 4460748 - DNA, 14 bp, Homo sapiens
ggaccctcagcagc

SEQ ID NO: 4460749 - DNA, 17 bp, Homo sapiens
ggaccctgacctccgcc

SEQ ID NO: 4460750 - DNA, 16 bp, Homo sapiens
ggaccctgtgacatgg

SEQ ID NO: 4460751 - DNA, 17 bp, Homo sapiens
ggacccttctgggtcca

SEQ ID NO: 4460752 - DNA, 22 bp, Homo sapiens
ggacccttctgggtccagggag

SEQ ID NO: 4460753 - DNA, 12 bp, Homo sapiens
ggaccctttcct

SEQ ID NO: 4460754 - DNA, 17 bp, Homo sapiens
ggaccctttccttcctt

SEQ ID NO: 4460755 - DNA, 22 bp, Homo sapiens
ggaccctttccttccttccctg

SEQ ID NO: 4460756 - DNA, 20 bp, Homo sapiens
ggaccgaggctacagctcca

SEQ ID NO: 4460757 - DNA, 20 bp, Homo sapiens
ggaccgggcccctctctagg

SEQ ID NO: 4460758 - DNA, 14 bp, Homo sapiens
ggaccggtgctgca

SEQ ID NO: 4460759 - DNA, 11 bp, Homo sapiens
ggacctcagca

SEQ ID NO: 4460760 - DNA, 14 bp, Homo sapiens
ggacctcagcaagc

SEQ ID NO: 4460761 - DNA, 11 bp, Homo sapiens
ggacctcctta

SEQ ID NO: 4460762 - DNA, 21 bp, Homo sapiens
ggacctgagcctggtcctggc

SEQ ID NO: 4460763 - DNA, 14 bp, Homo sapiens
ggacctgccaggca

SEQ ID NO: 4460764 - DNA, 12 bp, Homo sapiens
ggacctgctgct

SEQ ID NO: 4460765 - DNA, 13 bp, Homo sapiens
ggacctgctgctc

SEQ ID NO: 4460766 - DNA, 15 bp, Homo sapiens
ggacctgctgctcag

SEQ ID NO: 4460767 - DNA, 23 bp, Homo sapiens
ggacctgtatttaagcaaatact

SEQ ID NO: 4460768 - DNA, 20 bp, Homo sapiens
ggacgcctgggggtgccagg

SEQ ID NO: 4460769 - DNA, 16 bp, Homo sapiens
ggacgctgcagacccc

SEQ ID NO: 4460770 - DNA, 23 bp, Homo sapiens
ggacggggggccccagtcagcct

SEQ ID NO: 4460771 - DNA, 14 bp, Homo sapiens
ggacgttccagccg

SEQ ID NO: 4460772 - DNA, 21 bp, Homo sapiens
ggacgttccagccggcatggc

SEQ ID NO: 4460773 - DNA, 15 bp, Homo sapiens
ggacgttgctgagcc

SEQ ID NO: 4460774 - DNA, 16 bp, Homo sapiens
ggactaaatgatctct

SEQ ID NO: 4460775 - DNA, 19 bp, Homo sapiens
ggactatgaaaagctagaa

SEQ ID NO: 4460776 - DNA, 21 bp, Homo sapiens
ggactatgatgagaggccagc

SEQ ID NO: 4460777 - DNA, 14 bp, Homo sapiens
ggactcagccctga

SEQ ID NO: 4460778 - DNA, 16 bp, Homo sapiens
ggactcagccctgagg

SEQ ID NO: 4460779 - DNA, 11 bp, Homo sapiens
ggactcaggga

SEQ ID NO: 4460780 - DNA, 14 bp, Homo sapiens
ggactccagctcgt

SEQ ID NO: 4460781 - DNA, 15 bp, Homo sapiens
ggactccaggcccaa

SEQ ID NO: 4460782 - DNA, 22 bp, Homo sapiens
ggactccctcctcacctctgga

SEQ ID NO: 4460783 - DNA, 20 bp, Homo sapiens
ggactccggaggactgagcc

SEQ ID NO: 4460784 - DNA, 22 bp, Homo sapiens
ggactccggaggactgagcccc

SEQ ID NO: 4460785 - DNA, 17 bp, Homo sapiens
ggactccggctgtgctg

SEQ ID NO: 4460786 - DNA, 21 bp, Homo sapiens
ggactctcccaggcctgcctg

SEQ ID NO: 4460787 - DNA, 23 bp, Homo sapiens
ggactctcctcctcccctcctct

SEQ ID NO: 4460788 - DNA, 17 bp, Homo sapiens
ggactctctgtggtccc

SEQ ID NO: 4460789 - DNA, 13 bp, Homo sapiens
ggactctgcccca

SEQ ID NO: 4460790 - DNA, 16 bp, Homo sapiens
ggactctgccccaatc

SEQ ID NO: 4460791 - DNA, 16 bp, Homo sapiens
ggactctgcccctgga

SEQ ID NO: 4460792 - DNA, 23 bp, Homo sapiens
ggactctgcgggaggctggggcc

SEQ ID NO: 4460793 - DNA, 22 bp, Homo sapiens
ggactctttccgactgcccaga

SEQ ID NO: 4460794 - DNA, 21 bp, Homo sapiens
ggactgaaagaagaaaacagt

SEQ ID NO: 4460795 - DNA, 19 bp, Homo sapiens
ggactgaattgtccccagt

SEQ ID NO: 4460796 - DNA, 23 bp, Homo sapiens
ggactgagactggcacttagccc

SEQ ID NO: 4460797 - DNA, 20 bp, Homo sapiens
ggactgagccaaggaggcct

SEQ ID NO: 4460798 - DNA, 11 bp, Homo sapiens
ggactgagccc

SEQ ID NO: 4460799 - DNA, 13 bp, Homo sapiens
ggactgagccccc

SEQ ID NO: 4460800 - DNA, 14 bp, Homo sapiens
ggactgaggcctga

SEQ ID NO: 4460801 - DNA, 18 bp, Homo sapiens
ggactgagtgggaagccc

SEQ ID NO: 4460802 - DNA, 10 bp, Homo sapiens
ggactgcatg

SEQ ID NO: 4460803 - DNA, 11 bp, Homo sapiens
ggactgccaaa

SEQ ID NO: 4460804 - DNA, 12 bp, Homo sapiens
ggactgccaaat

SEQ ID NO: 4460805 - DNA, 16 bp, Homo sapiens
ggactgccaggctgtt

SEQ ID NO: 4460806 - DNA, 14 bp, Homo sapiens
ggactgcccccaga

SEQ ID NO: 4460807 - DNA, 15 bp, Homo sapiens
ggactgcccccagaa

SEQ ID NO: 4460808 - DNA, 23 bp, Homo sapiens
ggactgcccccagaaagcctcct

SEQ ID NO: 4460809 - DNA, 16 bp, Homo sapiens
ggactgcgctggacga

SEQ ID NO: 4460810 - DNA, 19 bp, Homo sapiens
ggactgctaaataaaattt

SEQ ID NO: 4460811 - DNA, 14 bp, Homo sapiens
ggactgctgctctc

SEQ ID NO: 4460812 - DNA, 19 bp, Homo sapiens
ggactgctgctctcccaag

SEQ ID NO: 4460813 - DNA, 16 bp, Homo sapiens
ggactggcccctgggt

SEQ ID NO: 4460814 - DNA, 17 bp, Homo sapiens
ggactggcccctgggtc

SEQ ID NO: 4460815 - DNA, 19 bp, Homo sapiens
ggactggctagagtcctca

SEQ ID NO: 4460816 - DNA, 22 bp, Homo sapiens
ggactggctagagtcctcactc

SEQ ID NO: 4460817 - DNA, 23 bp, Homo sapiens
ggactgggccacttctgggtggg

SEQ ID NO: 4460818 - DNA, 14 bp, Homo sapiens
ggactggtttgaga

SEQ ID NO: 4460819 - DNA, 22 bp, Homo sapiens
ggactgtacacactttatttac

SEQ ID NO: 4460820 - DNA, 21 bp, Homo sapiens
ggactgtgcctggctccctga

SEQ ID NO: 4460821 - DNA, 13 bp, Homo sapiens
ggactgtgctggt

SEQ ID NO: 4460822 - DNA, 18 bp, Homo sapiens
ggactgttccaggccctc

SEQ ID NO: 4460823 - DNA, 17 bp, Homo sapiens
ggactgtttcagtgtga

SEQ ID NO: 4460824 - DNA, 23 bp, Homo sapiens
ggacttaagcatctggctctaat

SEQ ID NO: 4460825 - DNA, 16 bp, Homo sapiens
ggacttattcattcct

SEQ ID NO: 4460826 - DNA, 18 bp, Homo sapiens
ggacttcaactgcccagc

SEQ ID NO: 4460827 - DNA, 21 bp, Homo sapiens
ggacttcaactgcccagcaac

SEQ ID NO: 4460828 - DNA, 16 bp, Homo sapiens
ggactttatttatttc

SEQ ID NO: 4460829 - DNA, 12 bp, Homo sapiens
ggactttgtaca

SEQ ID NO: 4460830 - DNA, 18 bp, Homo sapiens
ggagaaaaaaattgctct

SEQ ID NO: 4460831 - DNA, 18 bp, Homo sapiens
ggagaaaacgccagtgtg

SEQ ID NO: 4460832 - DNA, 13 bp, Homo sapiens
ggagaaactggaa

SEQ ID NO: 4460833 - DNA, 15 bp, Homo sapiens
ggagaaagaaagtac

SEQ ID NO: 4460834 - DNA, 14 bp, Homo sapiens
ggagaaagccacgc

SEQ ID NO: 4460835 - DNA, 20 bp, Homo sapiens
ggagaaatctggctgtcctt

SEQ ID NO: 4460836 - DNA, 23 bp, Homo sapiens
ggagaaatgcaataactctggga

SEQ ID NO: 4460837 - DNA, 17 bp, Homo sapiens
ggagaagaacaagaaat

SEQ ID NO: 4460838 - DNA, 14 bp, Homo sapiens
ggagaagacaacag

SEQ ID NO: 4460839 - DNA, 19 bp, Homo sapiens
ggagaagagttgaggaact

SEQ ID NO: 4460840 - DNA, 16 bp, Homo sapiens
ggagaagcagtgagcc

SEQ ID NO: 4460841 - DNA, 21 bp, Homo sapiens
ggagaagttcttgattcagcc

SEQ ID NO: 4460842 - DNA, 12 bp, Homo sapiens
ggagaatatgat

SEQ ID NO: 4460843 - DNA, 15 bp, Homo sapiens
ggagaatcacttgaa

SEQ ID NO: 4460844 - DNA, 19 bp, Homo sapiens
ggagaatcacttgaacccg

SEQ ID NO: 4460845 - DNA, 14 bp, Homo sapiens
ggagaatgaacccg

SEQ ID NO: 4460846 - DNA, 22 bp, Homo sapiens
ggagaatgtcagtatgtggaag

SEQ ID NO: 4460847 - DNA, 16 bp, Homo sapiens
ggagacaaggtgctaa

SEQ ID NO: 4460848 - DNA, 13 bp, Homo sapiens
ggagacagaccac

SEQ ID NO: 4460849 - DNA, 18 bp, Homo sapiens
ggagacagggctgctccc

SEQ ID NO: 4460850 - DNA, 19 bp, Homo sapiens
ggagacaggttagctgctc

SEQ ID NO: 4460851 - DNA, 17 bp, Homo sapiens
ggagacattagaaaaaa

SEQ ID NO: 4460852 - DNA, 17 bp, Homo sapiens
ggagacattgctctatg

SEQ ID NO: 4460853 - DNA, 17 bp, Homo sapiens
ggagaccctgccacagc

SEQ ID NO: 4460854 - DNA, 17 bp, Homo sapiens
ggagactcctggtctgt

SEQ ID NO: 4460855 - DNA, 13 bp, Homo sapiens
ggagactgggctg

SEQ ID NO: 4460856 - DNA, 22 bp, Homo sapiens
ggagactttgctgttactgctt

SEQ ID NO: 4460857 - DNA, 15 bp, Homo sapiens
ggagagaaaatatat

SEQ ID NO: 4460858 - DNA, 16 bp, Homo sapiens
ggagagaaaatatatg

SEQ ID NO: 4460859 - DNA, 15 bp, Homo sapiens
ggagagacaggcagc

SEQ ID NO: 4460860 - DNA, 17 bp, Homo sapiens
ggagagactcccatgaa

SEQ ID NO: 4460861 - DNA, 21 bp, Homo sapiens
ggagagactcccatgaagcct

SEQ ID NO: 4460862 - DNA, 13 bp, Homo sapiens
ggagagagccctt

SEQ ID NO: 4460863 - DNA, 17 bp, Homo sapiens
ggagagagcccttccca

SEQ ID NO: 4460864 - DNA, 20 bp, Homo sapiens
ggagagagcccttcccaggg

SEQ ID NO: 4460865 - DNA, 22 bp, Homo sapiens
ggagagccaccaagagggacgc

SEQ ID NO: 4460866 - DNA, 12 bp, Homo sapiens
ggagagccagcc

SEQ ID NO: 4460867 - DNA, 21 bp, Homo sapiens
ggagagccagccctccctgtc

SEQ ID NO: 4460868 - DNA, 11 bp, Homo sapiens
ggagagcctgc

SEQ ID NO: 4460869 - DNA, 13 bp, Homo sapiens
ggagagcctgctg

SEQ ID NO: 4460870 - DNA, 20 bp, Homo sapiens
ggagagctagaacctggaga

SEQ ID NO: 4460871 - DNA, 21 bp, Homo sapiens
ggagagctagaacctggaggg

SEQ ID NO: 4460872 - DNA, 17 bp, Homo sapiens
ggagagctggtgcccgg

SEQ ID NO: 4460873 - DNA, 12 bp, Homo sapiens
ggagaggcaaag

SEQ ID NO: 4460874 - DNA, 13 bp, Homo sapiens
ggagaggcggcct

SEQ ID NO: 4460875 - DNA, 14 bp, Homo sapiens
ggagagggtctgga

SEQ ID NO: 4460876 - DNA, 20 bp, Homo sapiens
ggagagggtctggagaagca

SEQ ID NO: 4460877 - DNA, 23 bp, Homo sapiens
ggagagggtctggagaagcagtg

SEQ ID NO: 4460878 - DNA, 19 bp, Homo sapiens
ggagagtgcacatgcccct

SEQ ID NO: 4460879 - DNA, 20 bp, Homo sapiens
ggagagtggacctgtgctgt

SEQ ID NO: 4460880 - DNA, 21 bp, Homo sapiens
ggagagttctttgctgcccct

SEQ ID NO: 4460881 - DNA, 22 bp, Homo sapiens
ggagagttctttgctgcccctg

SEQ ID NO: 4460882 - DNA, 23 bp, Homo sapiens
ggagatagtgccaggtggctcag

SEQ ID NO: 4460883 - DNA, 20 bp, Homo sapiens
ggagatgcagctactggaat

SEQ ID NO: 4460884 - DNA, 22 bp, Homo sapiens
ggagatgcatcgggaaagaaga

SEQ ID NO: 4460885 - DNA, 17 bp, Homo sapiens
ggagatgcttctctcct

SEQ ID NO: 4460886 - DNA, 21 bp, Homo sapiens
ggagatgcttctctccttgcc

SEQ ID NO: 4460887 - DNA, 15 bp, Homo sapiens
ggagatggagggctt

SEQ ID NO: 4460888 - DNA, 18 bp, Homo sapiens
ggagatgggtccaggggt

SEQ ID NO: 4460889 - DNA, 22 bp, Homo sapiens
ggagattaaaaccagagagaaa

SEQ ID NO: 4460890 - DNA, 21 bp, Homo sapiens
ggagcaattacggggtgacct

SEQ ID NO: 4460891 - DNA, 17 bp, Homo sapiens
ggagcaccaggcacgaa

SEQ ID NO: 4460892 - DNA, 14 bp, Homo sapiens
ggagcacccagagc

SEQ ID NO: 4460893 - DNA, 21 bp, Homo sapiens
ggagcaccgtgatggagagga

SEQ ID NO: 4460894 - DNA, 14 bp, Homo sapiens
ggagcacgtggaga

SEQ ID NO: 4460895 - DNA, 23 bp, Homo sapiens
ggagcactgcatgtcagagcact

SEQ ID NO: 4460896 - DNA, 12 bp, Homo sapiens
ggagcagagggg

SEQ ID NO: 4460897 - DNA, 12 bp, Homo sapiens
ggagcagccctg

SEQ ID NO: 4460898 - DNA, 16 bp, Homo sapiens
ggagcatcaagccact

SEQ ID NO: 4460899 - DNA, 15 bp, Homo sapiens
ggagcatggctgtga

SEQ ID NO: 4460900 - DNA, 17 bp, Homo sapiens
ggagcatggctgtgagg

SEQ ID NO: 4460901 - DNA, 24 bp, Homo sapiens
ggagcatttaatggcagctagtgc

SEQ ID NO: 4460902 - DNA, 19 bp, Homo sapiens
ggagcatttggagagaagg

SEQ ID NO: 4460903 - DNA, 15 bp, Homo sapiens
ggagccaccagttct

SEQ ID NO: 4460904 - DNA, 16 bp, Homo sapiens
ggagccactcctctga

SEQ ID NO: 4460905 - DNA, 21 bp, Homo sapiens
ggagccactcctctgactcag

SEQ ID NO: 4460906 - DNA, 16 bp, Homo sapiens
ggagccagactgtcca

SEQ ID NO: 4460907 - DNA, 18 bp, Homo sapiens
ggagccagactgtccagg

SEQ ID NO: 4460908 - DNA, 21 bp, Homo sapiens
ggagccagactgtccagggaa

SEQ ID NO: 4460909 - DNA, 13 bp, Homo sapiens
ggagcccagcctg

SEQ ID NO: 4460910 - DNA, 17 bp, Homo sapiens
ggagcccagcctgggag

SEQ ID NO: 4460911 - DNA, 19 bp, Homo sapiens
ggagcccagcctgggagcc

SEQ ID NO: 4460912 - DNA, 20 bp, Homo sapiens
ggagcccagcctgggagccc

SEQ ID NO: 4460913 - DNA, 12 bp, Homo sapiens
ggagccccaggg

SEQ ID NO: 4460914 - DNA, 17 bp, Homo sapiens
ggagccccattcctggg

SEQ ID NO: 4460915 - DNA, 19 bp, Homo sapiens
ggagcccccagcagaggca

SEQ ID NO: 4460916 - DNA, 20 bp, Homo sapiens
ggagcccgatattctccctg

SEQ ID NO: 4460917 - DNA, 18 bp, Homo sapiens
ggagccgggtctgcctct

SEQ ID NO: 4460918 - DNA, 18 bp, Homo sapiens
ggagcctagctcctgcca

SEQ ID NO: 4460919 - DNA, 18 bp, Homo sapiens
ggagcctgtggccagcag

SEQ ID NO: 4460920 - DNA, 21 bp, Homo sapiens
ggagccttcccaagttgtgct

SEQ ID NO: 4460921 - DNA, 22 bp, Homo sapiens
ggagccttcccaagttgtgctt

SEQ ID NO: 4460922 - DNA, 14 bp, Homo sapiens
ggagccttctgcca

SEQ ID NO: 4460923 - DNA, 22 bp, Homo sapiens
ggagccttctgccaccagcccc

SEQ ID NO: 4460924 - DNA, 22 bp, Homo sapiens
ggagcgagcatgtcgtggacac

SEQ ID NO: 4460925 - DNA, 16 bp, Homo sapiens
ggagcgggaggcggtg

SEQ ID NO: 4460926 - DNA, 15 bp, Homo sapiens
ggagctatcaggaac

SEQ ID NO: 4460927 - DNA, 13 bp, Homo sapiens
ggagctcctccct

SEQ ID NO: 4460928 - DNA, 14 bp, Homo sapiens
ggagctcctccctc

SEQ ID NO: 4460929 - DNA, 16 bp, Homo sapiens
ggagctcctccctcca

SEQ ID NO: 4460930 - DNA, 21 bp, Homo sapiens
ggagctcctccctccagctgc

SEQ ID NO: 4460931 - DNA, 18 bp, Homo sapiens
ggagctcctctcctggag

SEQ ID NO: 4460932 - DNA, 17 bp, Homo sapiens
ggagctcttcaggcctc

SEQ ID NO: 4460933 - DNA, 18 bp, Homo sapiens
ggagctcttcaggcctcc

SEQ ID NO: 4460934 - DNA, 16 bp, Homo sapiens
ggagctcttgggtcag

SEQ ID NO: 4460935 - DNA, 17 bp, Homo sapiens
ggagctgaaccacagaa

SEQ ID NO: 4460936 - DNA, 20 bp, Homo sapiens
ggagctgactggtttctcct

SEQ ID NO: 4460937 - DNA, 22 bp, Homo sapiens
ggagctgatcgcttctccccca

SEQ ID NO: 4460938 - DNA, 23 bp, Homo sapiens
ggagctgctggcttgcagtgcgc

SEQ ID NO: 4460939 - DNA, 13 bp, Homo sapiens
ggagctggcctgc

SEQ ID NO: 4460940 - DNA, 23 bp, Homo sapiens
ggagctggcctgcggtggaggga

SEQ ID NO: 4460941 - DNA, 14 bp, Homo sapiens
ggagctgggaggaa

SEQ ID NO: 4460942 - DNA, 11 bp, Homo sapiens
ggagctgggcc

SEQ ID NO: 4460943 - DNA, 17 bp, Homo sapiens
ggagctgggcccctgca

SEQ ID NO: 4460944 - DNA, 14 bp, Homo sapiens
ggagctgggccctg

SEQ ID NO: 4460945 - DNA, 18 bp, Homo sapiens
ggagctgggccctgcctg

SEQ ID NO: 4460946 - DNA, 19 bp, Homo sapiens
ggagctgggccctgcctgc

SEQ ID NO: 4460947 - DNA, 20 bp, Homo sapiens
ggagctgggccctgcctgca

SEQ ID NO: 4460948 - DNA, 16 bp, Homo sapiens
ggagctggtgagatca

SEQ ID NO: 4460949 - DNA, 20 bp, Homo sapiens
ggagcttcatggcagaaggc

SEQ ID NO: 4460950 - DNA, 17 bp, Homo sapiens
ggagcttgggcagtgcc

SEQ ID NO: 4460951 - DNA, 21 bp, Homo sapiens
ggagcttgggcagtgccccag

SEQ ID NO: 4460952 - DNA, 19 bp, Homo sapiens
ggaggaagggctgggccac

SEQ ID NO: 4460953 - DNA, 16 bp, Homo sapiens
ggaggaatttactttc

SEQ ID NO: 4460954 - DNA, 17 bp, Homo sapiens
ggaggacaaaaggaatg

SEQ ID NO: 4460955 - DNA, 13 bp, Homo sapiens
ggaggacaggcag

SEQ ID NO: 4460956 - DNA, 23 bp, Homo sapiens
ggaggaccgaggctacagctcca

SEQ ID NO: 4460957 - DNA, 19 bp, Homo sapiens
ggaggactagaacctggag

SEQ ID NO: 4460958 - DNA, 15 bp, Homo sapiens
ggaggactgagcccc

SEQ ID NO: 4460959 - DNA, 17 bp, Homo sapiens
ggaggactgagccccca

SEQ ID NO: 4460960 - DNA, 15 bp, Homo sapiens
ggaggagggcaggca

SEQ ID NO: 4460961 - DNA, 17 bp, Homo sapiens
ggaggatggtgtcctga

SEQ ID NO: 4460962 - DNA, 17 bp, Homo sapiens
ggaggcaagcgtgttct

SEQ ID NO: 4460963 - DNA, 18 bp, Homo sapiens
ggaggcagcgccccacca

SEQ ID NO: 4460964 - DNA, 15 bp, Homo sapiens
ggaggcagggcagcc

SEQ ID NO: 4460965 - DNA, 21 bp, Homo sapiens
ggaggcagggccttgcccaga

SEQ ID NO: 4460966 - DNA, 14 bp, Homo sapiens
ggaggcccaaatga

SEQ ID NO: 4460967 - DNA, 14 bp, Homo sapiens
ggaggcccaacctc

SEQ ID NO: 4460968 - DNA, 20 bp, Homo sapiens
ggaggcccagccgcaggaag

SEQ ID NO: 4460969 - DNA, 22 bp, Homo sapiens
ggaggcccaggctgggaactca

SEQ ID NO: 4460970 - DNA, 14 bp, Homo sapiens
ggaggcctgggggc

SEQ ID NO: 4460971 - DNA, 20 bp, Homo sapiens
ggaggcggatgttgaagtga

SEQ ID NO: 4460972 - DNA, 16 bp, Homo sapiens
ggaggcgtgcccccct

SEQ ID NO: 4460973 - DNA, 20 bp, Homo sapiens
ggaggctacccgctgtggcc

SEQ ID NO: 4460974 - DNA, 16 bp, Homo sapiens
ggaggctcccggggcc

SEQ ID NO: 4460975 - DNA, 21 bp, Homo sapiens
ggaggctcccggggcctggac

SEQ ID NO: 4460976 - DNA, 16 bp, Homo sapiens
ggaggctgagacagga

SEQ ID NO: 4460977 - DNA, 18 bp, Homo sapiens
ggaggctgaggcagaaga

SEQ ID NO: 4460978 - DNA, 14 bp, Homo sapiens
ggaggctgcagagc

SEQ ID NO: 4460979 - DNA, 20 bp, Homo sapiens
ggaggctgcagagctgaccc

SEQ ID NO: 4460980 - DNA, 10 bp, Homo sapiens
ggaggctgcc

SEQ ID NO: 4460981 - DNA, 12 bp, Homo sapiens
ggaggctgcccc

SEQ ID NO: 4460982 - DNA, 15 bp, Homo sapiens
ggaggctgcctccca

SEQ ID NO: 4460983 - DNA, 12 bp, Homo sapiens
ggaggctggggc

SEQ ID NO: 4460984 - DNA, 14 bp, Homo sapiens
ggaggctggggccc

SEQ ID NO: 4460985 - DNA, 19 bp, Homo sapiens
ggagggaaggacagtccct

SEQ ID NO: 4460986 - DNA, 17 bp, Homo sapiens
ggagggagactcagcct

SEQ ID NO: 4460987 - DNA, 13 bp, Homo sapiens
ggagggagaggga

SEQ ID NO: 4460988 - DNA, 21 bp, Homo sapiens
ggagggagtgctgtgttttag

SEQ ID NO: 4460989 - DNA, 13 bp, Homo sapiens
ggagggcagcagg

SEQ ID NO: 4460990 - DNA, 14 bp, Homo sapiens
ggagggcaggcatc

SEQ ID NO: 4460991 - DNA, 19 bp, Homo sapiens
ggagggccacatgggaggc

SEQ ID NO: 4460992 - DNA, 16 bp, Homo sapiens
ggagggccctacctga

SEQ ID NO: 4460993 - DNA, 23 bp, Homo sapiens
ggagggctagaacctggcaggtt

SEQ ID NO: 4460994 - DNA, 19 bp, Homo sapiens
ggagggcttggcccagcgc

SEQ ID NO: 4460995 - DNA, 18 bp, Homo sapiens
ggaggggaaaaaaatgtt

SEQ ID NO: 4460996 - DNA, 16 bp, Homo sapiens
ggaggggacctctcca

SEQ ID NO: 4460997 - DNA, 18 bp, Homo sapiens
ggaggggaggcagatgga

SEQ ID NO: 4460998 - DNA, 14 bp, Homo sapiens
ggaggggagggtaa

SEQ ID NO: 4460999 - DNA, 17 bp, Homo sapiens
ggaggggcgcaccccac

SEQ ID NO: 4461000 - DNA, 12 bp, Homo sapiens
ggaggggcttgg

SEQ ID NO: 4461001 - DNA, 14 bp, Homo sapiens
ggagggggagaggg

SEQ ID NO: 4461002 - DNA, 13 bp, Homo sapiens
ggagggggctggg

SEQ ID NO: 4461003 - DNA, 14 bp, Homo sapiens
ggagggggctgggg

SEQ ID NO: 4461004 - DNA, 16 bp, Homo sapiens
ggagggggcttgaagc

SEQ ID NO: 4461005 - DNA, 15 bp, Homo sapiens
ggaggggtggcccag

SEQ ID NO: 4461006 - DNA, 13 bp, Homo sapiens
ggagggtaaataa

SEQ ID NO: 4461007 - DNA, 21 bp, Homo sapiens
ggagggtcccaagctgggccc

SEQ ID NO: 4461008 - DNA, 20 bp, Homo sapiens
ggagggttctaagtgggaga

SEQ ID NO: 4461009 - DNA, 20 bp, Homo sapiens
ggaggtcaagatcagcctgg

SEQ ID NO: 4461010 - DNA, 23 bp, Homo sapiens
ggaggtcacctgccgccctgtgg

SEQ ID NO: 4461011 - DNA, 14 bp, Homo sapiens
ggaggtgctggggg

SEQ ID NO: 4461012 - DNA, 21 bp, Homo sapiens
ggaggtgctgtccccactgcc

SEQ ID NO: 4461013 - DNA, 20 bp, Homo sapiens
ggaggtggaggttgcagtga

SEQ ID NO: 4461014 - DNA, 14 bp, Homo sapiens
ggaggtggggaagg

SEQ ID NO: 4461015 - DNA, 20 bp, Homo sapiens
ggaggttgcagtgagctgag

SEQ ID NO: 4461016 - DNA, 19 bp, Homo sapiens
ggagtaaacggcccaggcc

SEQ ID NO: 4461017 - DNA, 21 bp, Homo sapiens
ggagtaaacggcccaggccag

SEQ ID NO: 4461018 - DNA, 17 bp, Homo sapiens
ggagtaacagggcagaa

SEQ ID NO: 4461019 - DNA, 14 bp, Homo sapiens
ggagtcaactggct

SEQ ID NO: 4461020 - DNA, 13 bp, Homo sapiens
ggagtcacacagt

SEQ ID NO: 4461021 - DNA, 21 bp, Homo sapiens
ggagtcacagatgaggccccc

SEQ ID NO: 4461022 - DNA, 19 bp, Homo sapiens
ggagtcagggacctgctgc

SEQ ID NO: 4461023 - DNA, 12 bp, Homo sapiens
ggagtccagacc

SEQ ID NO: 4461024 - DNA, 21 bp, Homo sapiens
ggagtccagaccccccagccc

SEQ ID NO: 4461025 - DNA, 14 bp, Homo sapiens
ggagtccagcccct

SEQ ID NO: 4461026 - DNA, 23 bp, Homo sapiens
ggagtccagcccctcctccctca

SEQ ID NO: 4461027 - DNA, 23 bp, Homo sapiens
ggagtccaggcccccagcccctc

SEQ ID NO: 4461028 - DNA, 16 bp, Homo sapiens
ggagtctcgctctgtc

SEQ ID NO: 4461029 - DNA, 22 bp, Homo sapiens
ggagtctcgctctgtcgcccag

SEQ ID NO: 4461030 - DNA, 23 bp, Homo sapiens
ggagtctcgctctgtcgcccagg

SEQ ID NO: 4461031 - DNA, 12 bp, Homo sapiens
ggagtgaatgtg

SEQ ID NO: 4461032 - DNA, 14 bp, Homo sapiens
ggagtgaatgtggc

SEQ ID NO: 4461033 - DNA, 19 bp, Homo sapiens
ggagtgaatgtggcagttt

SEQ ID NO: 4461034 - DNA, 15 bp, Homo sapiens
ggagtgcagccttct

SEQ ID NO: 4461035 - DNA, 20 bp, Homo sapiens
ggagtgtcctcttccctctc

SEQ ID NO: 4461036 - DNA, 22 bp, Homo sapiens
ggagtgtggctgaggaggcctc

SEQ ID NO: 4461037 - DNA, 20 bp, Homo sapiens
ggagtgttcccgtgcctggg

SEQ ID NO: 4461038 - DNA, 20 bp, Homo sapiens
ggagttccttatccctctct

SEQ ID NO: 4461039 - DNA, 22 bp, Homo sapiens
ggagtttgggctggagctcctc

SEQ ID NO: 4461040 - DNA, 16 bp, Homo sapiens
ggagttttactgcctg

SEQ ID NO: 4461041 - DNA, 20 bp, Homo sapiens
ggagtttttgtttggagagc

SEQ ID NO: 4461042 - DNA, 17 bp, Homo sapiens
ggataaattttttgacc

SEQ ID NO: 4461043 - DNA, 20 bp, Homo sapiens
ggataactttacagaaatgg

SEQ ID NO: 4461044 - DNA, 20 bp, Homo sapiens
ggataatgctgttgcctcat

SEQ ID NO: 4461045 - DNA, 12 bp, Homo sapiens
ggatacttgaaa

SEQ ID NO: 4461046 - DNA, 13 bp, Homo sapiens
ggatagatgtgtg

SEQ ID NO: 4461047 - DNA, 15 bp, Homo sapiens
ggatagatgtgtgga

SEQ ID NO: 4461048 - DNA, 18 bp, Homo sapiens
ggatagtatttttatcca

SEQ ID NO: 4461049 - DNA, 16 bp, Homo sapiens
ggatatagttttactt

SEQ ID NO: 4461050 - DNA, 11 bp, Homo sapiens
ggatatatttg

SEQ ID NO: 4461051 - DNA, 12 bp, Homo sapiens
ggatatatttga

SEQ ID NO: 4461052 - DNA, 16 bp, Homo sapiens
ggatatatttgaaata

SEQ ID NO: 4461053 - DNA, 14 bp, Homo sapiens
ggatatcagggcac

SEQ ID NO: 4461054 - DNA, 16 bp, Homo sapiens
ggatatgattggttca

SEQ ID NO: 4461055 - DNA, 17 bp, Homo sapiens
ggatatgggtcctctgg

SEQ ID NO: 4461056 - DNA, 16 bp, Homo sapiens
ggatatgtaaaacatt

SEQ ID NO: 4461057 - DNA, 20 bp, Homo sapiens
ggatatgttatactgaacca

SEQ ID NO: 4461058 - DNA, 9 bp, Homo sapiens
ggatattat

SEQ ID NO: 4461059 - DNA, 19 bp, Homo sapiens
ggatattatagaaaattat

SEQ ID NO: 4461060 - DNA, 17 bp, Homo sapiens
ggatattctcctcggac

SEQ ID NO: 4461061 - DNA, 23 bp, Homo sapiens
ggatattgccttatttgtctgta

SEQ ID NO: 4461062 - DNA, 17 bp, Homo sapiens
ggatatttactgctctt

SEQ ID NO: 4461063 - DNA, 17 bp, Homo sapiens
ggatcacctgaggtcag

SEQ ID NO: 4461064 - DNA, 12 bp, Homo sapiens
ggatcagaatag

SEQ ID NO: 4461065 - DNA, 14 bp, Homo sapiens
ggatcagccccgcc

SEQ ID NO: 4461066 - DNA, 21 bp, Homo sapiens
ggatcagttaactattgcatt

SEQ ID NO: 4461067 - DNA, 20 bp, Homo sapiens
ggatcagttgccccccatca

SEQ ID NO: 4461068 - DNA, 19 bp, Homo sapiens
ggatcatcaacaagatttc

SEQ ID NO: 4461069 - DNA, 15 bp, Homo sapiens
ggatccacacctggt

SEQ ID NO: 4461070 - DNA, 21 bp, Homo sapiens
ggatccatcttgagccacagt

SEQ ID NO: 4461071 - DNA, 17 bp, Homo sapiens
ggatcctccacagagag

SEQ ID NO: 4461072 - DNA, 17 bp, Homo sapiens
ggatcctccctcatggc

SEQ ID NO: 4461073 - DNA, 17 bp, Homo sapiens
ggatcctgaatctgtgc

SEQ ID NO: 4461074 - DNA, 20 bp, Homo sapiens
ggatcctgactaagcctttg

SEQ ID NO: 4461075 - DNA, 12 bp, Homo sapiens
ggatcctgcact

SEQ ID NO: 4461076 - DNA, 21 bp, Homo sapiens
ggatcctgctgctttgggctg

SEQ ID NO: 4461077 - DNA, 22 bp, Homo sapiens
ggatcctgctgctttgggctgg

SEQ ID NO: 4461078 - DNA, 18 bp, Homo sapiens
ggatcctgtaggctaaaa

SEQ ID NO: 4461079 - DNA, 20 bp, Homo sapiens
ggatcgctgcacatggcctg

SEQ ID NO: 4461080 - DNA, 17 bp, Homo sapiens
ggatcggactctgcccc

SEQ ID NO: 4461081 - DNA, 17 bp, Homo sapiens
ggatctcattggaccct

SEQ ID NO: 4461082 - DNA, 13 bp, Homo sapiens
ggatctgctccaa

SEQ ID NO: 4461083 - DNA, 13 bp, Homo sapiens
ggatctgtctgtg

SEQ ID NO: 4461084 - DNA, 18 bp, Homo sapiens
ggatcttcccacaggagg

SEQ ID NO: 4461085 - DNA, 14 bp, Homo sapiens
ggatctttgactga

SEQ ID NO: 4461086 - DNA, 19 bp, Homo sapiens
ggatgacaccctggcctga

SEQ ID NO: 4461087 - DNA, 14 bp, Homo sapiens
ggatgaccatactc

SEQ ID NO: 4461088 - DNA, 17 bp, Homo sapiens
ggatgaccatactcaga

SEQ ID NO: 4461089 - DNA, 14 bp, Homo sapiens
ggatgactttttta

SEQ ID NO: 4461090 - DNA, 23 bp, Homo sapiens
ggatgagcatggagctgtcacct

SEQ ID NO: 4461091 - DNA, 14 bp, Homo sapiens
ggatgaggacagag

SEQ ID NO: 4461092 - DNA, 20 bp, Homo sapiens
ggatgaggggcttcctgggt

SEQ ID NO: 4461093 - DNA, 18 bp, Homo sapiens
ggatgcaacaaatgtggc

SEQ ID NO: 4461094 - DNA, 15 bp, Homo sapiens
ggatgccatccaagt

SEQ ID NO: 4461095 - DNA, 19 bp, Homo sapiens
ggatgcccattcctgcctg

SEQ ID NO: 4461096 - DNA, 12 bp, Homo sapiens
ggatgctcttta

SEQ ID NO: 4461097 - DNA, 14 bp, Homo sapiens
ggatgctgaaggag

SEQ ID NO: 4461098 - DNA, 17 bp, Homo sapiens
ggatgctgctgcccctg

SEQ ID NO: 4461099 - DNA, 17 bp, Homo sapiens
ggatggaatgatgggtc

SEQ ID NO: 4461100 - DNA, 23 bp, Homo sapiens
ggatggaccaacctgctctgtcc

SEQ ID NO: 4461101 - DNA, 17 bp, Homo sapiens
ggatggcctttccttcc

SEQ ID NO: 4461102 - DNA, 20 bp, Homo sapiens
ggatggcctttccttccctc

SEQ ID NO: 4461103 - DNA, 15 bp, Homo sapiens
ggatgggaccaggga

SEQ ID NO: 4461104 - DNA, 18 bp, Homo sapiens
ggatgggcagcccaacag

SEQ ID NO: 4461105 - DNA, 15 bp, Homo sapiens
ggatggggctcccag

SEQ ID NO: 4461106 - DNA, 17 bp, Homo sapiens
ggatgggggatgggcca

SEQ ID NO: 4461107 - DNA, 21 bp, Homo sapiens
ggatgggggatgggccagggt

SEQ ID NO: 4461108 - DNA, 16 bp, Homo sapiens
ggatggtgactcctga

SEQ ID NO: 4461109 - DNA, 17 bp, Homo sapiens
ggatgtaaacagtgcct

SEQ ID NO: 4461110 - DNA, 18 bp, Homo sapiens
ggatgtaaacagtgcctg

SEQ ID NO: 4461111 - DNA, 18 bp, Homo sapiens
ggatgtactgttgaaaaa

SEQ ID NO: 4461112 - DNA, 18 bp, Homo sapiens
ggatgtgattgtggaatg

SEQ ID NO: 4461113 - DNA, 16 bp, Homo sapiens
ggatgtgctggagggg

SEQ ID NO: 4461114 - DNA, 23 bp, Homo sapiens
ggatgttagacttgctccctctc

SEQ ID NO: 4461115 - DNA, 13 bp, Homo sapiens
ggattaaaccttt

SEQ ID NO: 4461116 - DNA, 13 bp, Homo sapiens
ggattcacttcta

SEQ ID NO: 4461117 - DNA, 17 bp, Homo sapiens
ggattcacttctattta

SEQ ID NO: 4461118 - DNA, 20 bp, Homo sapiens
ggattctgaggccctgccca

SEQ ID NO: 4461119 - DNA, 17 bp, Homo sapiens
ggattctttccccagag

SEQ ID NO: 4461120 - DNA, 15 bp, Homo sapiens
ggattgcccctggct

SEQ ID NO: 4461121 - DNA, 17 bp, Homo sapiens
ggattgcctttaatatt

SEQ ID NO: 4461122 - DNA, 15 bp, Homo sapiens
ggattgtaaaatggt

SEQ ID NO: 4461123 - DNA, 23 bp, Homo sapiens
ggattgtgtatctgtgcttctaa

SEQ ID NO: 4461124 - DNA, 16 bp, Homo sapiens
ggattgttaatttcag

SEQ ID NO: 4461125 - DNA, 14 bp, Homo sapiens
ggatttatttaaaa

SEQ ID NO: 4461126 - DNA, 19 bp, Homo sapiens
ggatttatttaaaatagca

SEQ ID NO: 4461127 - DNA, 20 bp, Homo sapiens
ggatttggccacactggggc

SEQ ID NO: 4461128 - DNA, 17 bp, Homo sapiens
ggattttaatttcagga

SEQ ID NO: 4461129 - DNA, 13 bp, Homo sapiens
ggattttaccaaa

SEQ ID NO: 4461130 - DNA, 16 bp, Homo sapiens
ggattttaccaaagca

SEQ ID NO: 4461131 - DNA, 14 bp, Homo sapiens
ggatttttgtcttg

SEQ ID NO: 4461132 - DNA, 11 bp, Homo sapiens
ggcaaaagctt

SEQ ID NO: 4461133 - DNA, 18 bp, Homo sapiens
ggcaaaagtaatcatgtt

SEQ ID NO: 4461134 - DNA, 14 bp, Homo sapiens
ggcaaacctttccc

SEQ ID NO: 4461135 - DNA, 15 bp, Homo sapiens
ggcaaagaaaggaga

SEQ ID NO: 4461136 - DNA, 22 bp, Homo sapiens
ggcaaaggaggggaaacaatga

SEQ ID NO: 4461137 - DNA, 16 bp, Homo sapiens
ggcaaagtttaaatgt

SEQ ID NO: 4461138 - DNA, 18 bp, Homo sapiens
ggcaaagtttaaatgtat

SEQ ID NO: 4461139 - DNA, 24 bp, Homo sapiens
ggcaaagtttaaatgtattttaca

SEQ ID NO: 4461140 - DNA, 18 bp, Homo sapiens
ggcaaagttttacagaga

SEQ ID NO: 4461141 - DNA, 13 bp, Homo sapiens
ggcaaatattgaa

SEQ ID NO: 4461142 - DNA, 18 bp, Homo sapiens
ggcaaattcttttgaatt

SEQ ID NO: 4461143 - DNA, 17 bp, Homo sapiens
ggcaaccaactgcccca

SEQ ID NO: 4461144 - DNA, 19 bp, Homo sapiens
ggcaacgtagcctgggctc

SEQ ID NO: 4461145 - DNA, 17 bp, Homo sapiens
ggcaacttgtgataggt

SEQ ID NO: 4461146 - DNA, 16 bp, Homo sapiens
ggcaagaacagtgggc

SEQ ID NO: 4461147 - DNA, 14 bp, Homo sapiens
ggcaagagactggg

SEQ ID NO: 4461148 - DNA, 13 bp, Homo sapiens
ggcaagcatgaat

SEQ ID NO: 4461149 - DNA, 16 bp, Homo sapiens
ggcaagcatgtaactt

SEQ ID NO: 4461150 - DNA, 13 bp, Homo sapiens
ggcaagccctgcc

SEQ ID NO: 4461151 - DNA, 18 bp, Homo sapiens
ggcaagccctgcccacag

SEQ ID NO: 4461152 - DNA, 15 bp, Homo sapiens
ggcaagcctctagtg

SEQ ID NO: 4461153 - DNA, 12 bp, Homo sapiens
ggcaaggaaaaa

SEQ ID NO: 4461154 - DNA, 18 bp, Homo sapiens
ggcaaggactttgtacat

SEQ ID NO: 4461155 - DNA, 16 bp, Homo sapiens
ggcaaggagtttatta

SEQ ID NO: 4461156 - DNA, 23 bp, Homo sapiens
ggcaaggagtttattacaatgta

SEQ ID NO: 4461157 - DNA, 17 bp, Homo sapiens
ggcaataaataaatgtt

SEQ ID NO: 4461158 - DNA, 18 bp, Homo sapiens
ggcaataaataaatgttt

SEQ ID NO: 4461159 - DNA, 14 bp, Homo sapiens
ggcaatattaacct

SEQ ID NO: 4461160 - DNA, 17 bp, Homo sapiens
ggcaatcgttctgctgg

SEQ ID NO: 4461161 - DNA, 12 bp, Homo sapiens
ggcaattggaac

SEQ ID NO: 4461162 - DNA, 13 bp, Homo sapiens
ggcaattggaaca

SEQ ID NO: 4461163 - DNA, 16 bp, Homo sapiens
ggcaatttagaaaaag

SEQ ID NO: 4461164 - DNA, 18 bp, Homo sapiens
ggcaatttcctggccctc

SEQ ID NO: 4461165 - DNA, 16 bp, Homo sapiens
ggcaattttagtgtat

SEQ ID NO: 4461166 - DNA, 14 bp, Homo sapiens
ggcacaaagatgga

SEQ ID NO: 4461167 - DNA, 14 bp, Homo sapiens
ggcacacacagccc

SEQ ID NO: 4461168 - DNA, 14 bp, Homo sapiens
ggcacacagcagcc

SEQ ID NO: 4461169 - DNA, 19 bp, Homo sapiens
ggcacacagcagcccccca

SEQ ID NO: 4461170 - DNA, 22 bp, Homo sapiens
ggcacacagcagccccccagca

SEQ ID NO: 4461171 - DNA, 14 bp, Homo sapiens
ggcacacagctact

SEQ ID NO: 4461172 - DNA, 14 bp, Homo sapiens
ggcacacccctggg

SEQ ID NO: 4461173 - DNA, 12 bp, Homo sapiens
ggcacagcctgg

SEQ ID NO: 4461174 - DNA, 20 bp, Homo sapiens
ggcacatgaacagcttgcca

SEQ ID NO: 4461175 - DNA, 17 bp, Homo sapiens
ggcaccagatgcaacct

SEQ ID NO: 4461176 - DNA, 18 bp, Homo sapiens
ggcaccagatgcaacctc

SEQ ID NO: 4461177 - DNA, 15 bp, Homo sapiens
ggcaccaggggccaa

SEQ ID NO: 4461178 - DNA, 13 bp, Homo sapiens
ggcacccccatgc

SEQ ID NO: 4461179 - DNA, 21 bp, Homo sapiens
ggcacccctccgtgtggagca

SEQ ID NO: 4461180 - DNA, 19 bp, Homo sapiens
ggcaccctcagggagcctc

SEQ ID NO: 4461181 - DNA, 20 bp, Homo sapiens
ggcacctcggggacaccaga

SEQ ID NO: 4461182 - DNA, 11 bp, Homo sapiens
ggcacctgcag

SEQ ID NO: 4461183 - DNA, 20 bp, Homo sapiens
ggcacctgcagcggctgccc

SEQ ID NO: 4461184 - DNA, 18 bp, Homo sapiens
ggcacgaacccacctgct

SEQ ID NO: 4461185 - DNA, 19 bp, Homo sapiens
ggcacgaacccacctgctg

SEQ ID NO: 4461186 - DNA, 13 bp, Homo sapiens
ggcacgaaggccc

SEQ ID NO: 4461187 - DNA, 15 bp, Homo sapiens
ggcacgtaatttttt

SEQ ID NO: 4461188 - DNA, 19 bp, Homo sapiens
ggcacgttgacccaacctt

SEQ ID NO: 4461189 - DNA, 21 bp, Homo sapiens
ggcactccgcgccgatgccac

SEQ ID NO: 4461190 - DNA, 22 bp, Homo sapiens
ggcactctctgccattctgtgc

SEQ ID NO: 4461191 - DNA, 23 bp, Homo sapiens
ggcactctctgccattctgtgca

SEQ ID NO: 4461192 - DNA, 16 bp, Homo sapiens
ggcactggcgaggaga

SEQ ID NO: 4461193 - DNA, 20 bp, Homo sapiens
ggcactgggaggcagggctc

SEQ ID NO: 4461194 - DNA, 19 bp, Homo sapiens
ggcactgtgatacagtttt

SEQ ID NO: 4461195 - DNA, 20 bp, Homo sapiens
ggcactgtgatacagttttg

SEQ ID NO: 4461196 - DNA, 16 bp, Homo sapiens
ggcacttgatatttat

SEQ ID NO: 4461197 - DNA, 13 bp, Homo sapiens
ggcacttggagga

SEQ ID NO: 4461198 - DNA, 19 bp, Homo sapiens
ggcacttggaggacctggc

SEQ ID NO: 4461199 - DNA, 22 bp, Homo sapiens
ggcagaagaattgaacccagga

SEQ ID NO: 4461200 - DNA, 11 bp, Homo sapiens
ggcagaaggga

SEQ ID NO: 4461201 - DNA, 16 bp, Homo sapiens
ggcagacgccggggac

SEQ ID NO: 4461202 - DNA, 20 bp, Homo sapiens
ggcagagctggagcccccag

SEQ ID NO: 4461203 - DNA, 14 bp, Homo sapiens
ggcagagggctgga

SEQ ID NO: 4461204 - DNA, 21 bp, Homo sapiens
ggcagagggctggaggcccag

SEQ ID NO: 4461205 - DNA, 15 bp, Homo sapiens
ggcagagggggtctg

SEQ ID NO: 4461206 - DNA, 19 bp, Homo sapiens
ggcagagttacagttctgt

SEQ ID NO: 4461207 - DNA, 17 bp, Homo sapiens
ggcagatctgtgcccca

SEQ ID NO: 4461208 - DNA, 18 bp, Homo sapiens
ggcagatctgtgccccat

SEQ ID NO: 4461209 - DNA, 17 bp, Homo sapiens
ggcagatgtcttccctg

SEQ ID NO: 4461210 - DNA, 18 bp, Homo sapiens
ggcagatgtcttccctgg

SEQ ID NO: 4461211 - DNA, 22 bp, Homo sapiens
ggcagatgtcttccctgggctg

SEQ ID NO: 4461212 - DNA, 16 bp, Homo sapiens
ggcagcaatttaaatg

SEQ ID NO: 4461213 - DNA, 14 bp, Homo sapiens
ggcagcaccctccc

SEQ ID NO: 4461214 - DNA, 20 bp, Homo sapiens
ggcagcaccctcccccgcag

SEQ ID NO: 4461215 - DNA, 16 bp, Homo sapiens
ggcagccacaccactg

SEQ ID NO: 4461216 - DNA, 14 bp, Homo sapiens
ggcagccacccaag

SEQ ID NO: 4461217 - DNA, 16 bp, Homo sapiens
ggcagccacccaagcc

SEQ ID NO: 4461218 - DNA, 19 bp, Homo sapiens
ggcagccaggctgccaagg

SEQ ID NO: 4461219 - DNA, 13 bp, Homo sapiens
ggcagcccagcag

SEQ ID NO: 4461220 - DNA, 18 bp, Homo sapiens
ggcagccccgttttgggg

SEQ ID NO: 4461221 - DNA, 15 bp, Homo sapiens
ggcagcgccccacca

SEQ ID NO: 4461222 - DNA, 14 bp, Homo sapiens
ggcagctagtgcct

SEQ ID NO: 4461223 - DNA, 22 bp, Homo sapiens
ggcagctgagagccctgctgtg

SEQ ID NO: 4461224 - DNA, 17 bp, Homo sapiens
ggcagctgatccaggca

SEQ ID NO: 4461225 - DNA, 15 bp, Homo sapiens
ggcagctgcctctgc

SEQ ID NO: 4461226 - DNA, 13 bp, Homo sapiens
ggcagctgggccc

SEQ ID NO: 4461227 - DNA, 21 bp, Homo sapiens
ggcaggacttctcaccagcag

SEQ ID NO: 4461228 - DNA, 21 bp, Homo sapiens
ggcaggaggaaaaggcttggt

SEQ ID NO: 4461229 - DNA, 17 bp, Homo sapiens
ggcaggaggagctgcct

SEQ ID NO: 4461230 - DNA, 14 bp, Homo sapiens
ggcaggatggcctt

SEQ ID NO: 4461231 - DNA, 21 bp, Homo sapiens
ggcaggatggcctttccttcc

SEQ ID NO: 4461232 - DNA, 14 bp, Homo sapiens
ggcaggcaggtgtt

SEQ ID NO: 4461233 - DNA, 19 bp, Homo sapiens
ggcaggccagatggcccct

SEQ ID NO: 4461234 - DNA, 12 bp, Homo sapiens
ggcaggcccact

SEQ ID NO: 4461235 - DNA, 13 bp, Homo sapiens
ggcaggcccactc

SEQ ID NO: 4461236 - DNA, 15 bp, Homo sapiens
ggcaggctcactgcc

SEQ ID NO: 4461237 - DNA, 15 bp, Homo sapiens
ggcaggctgggccat

SEQ ID NO: 4461238 - DNA, 15 bp, Homo sapiens
ggcagggccaggcct

SEQ ID NO: 4461239 - DNA, 16 bp, Homo sapiens
ggcagggccccaggca

SEQ ID NO: 4461240 - DNA, 21 bp, Homo sapiens
ggcagggcccccaataaacca

SEQ ID NO: 4461241 - DNA, 19 bp, Homo sapiens
ggcagggccttgcccagag

SEQ ID NO: 4461242 - DNA, 18 bp, Homo sapiens
ggcagggcgagctgcagg

SEQ ID NO: 4461243 - DNA, 18 bp, Homo sapiens
ggcagggggccctgcccc

SEQ ID NO: 4461244 - DNA, 21 bp, Homo sapiens
ggcagggggccctgccccacc

SEQ ID NO: 4461245 - DNA, 16 bp, Homo sapiens
ggcagggtgggatgga

SEQ ID NO: 4461246 - DNA, 21 bp, Homo sapiens
ggcagggtgggatggaggaga

SEQ ID NO: 4461247 - DNA, 23 bp, Homo sapiens
ggcagggtgggatggaggagaag

SEQ ID NO: 4461248 - DNA, 13 bp, Homo sapiens
ggcaggtacaggt

SEQ ID NO: 4461249 - DNA, 23 bp, Homo sapiens
ggcaggtggaggtgtcaggctgc

SEQ ID NO: 4461250 - DNA, 20 bp, Homo sapiens
ggcaggttagaacctagaag

SEQ ID NO: 4461251 - DNA, 23 bp, Homo sapiens
ggcagtagctgtggtgaggtggg

SEQ ID NO: 4461252 - DNA, 22 bp, Homo sapiens
ggcagtatcctgtttgaggaaa

SEQ ID NO: 4461253 - DNA, 22 bp, Homo sapiens
ggcagtccaggcctctctctgc

SEQ ID NO: 4461254 - DNA, 16 bp, Homo sapiens
ggcagtccgtgggacg

SEQ ID NO: 4461255 - DNA, 19 bp, Homo sapiens
ggcagtctccccttcctgg

SEQ ID NO: 4461256 - DNA, 21 bp, Homo sapiens
ggcagtctccccttcctggca

SEQ ID NO: 4461257 - DNA, 14 bp, Homo sapiens
ggcagtctgctctg

SEQ ID NO: 4461258 - DNA, 16 bp, Homo sapiens
ggcagtctgctctgct

SEQ ID NO: 4461259 - DNA, 20 bp, Homo sapiens
ggcagtctgctctgctgctc

SEQ ID NO: 4461260 - DNA, 20 bp, Homo sapiens
ggcagtgagtgccatgcttt

SEQ ID NO: 4461261 - DNA, 16 bp, Homo sapiens
ggcagtgccagggcag

SEQ ID NO: 4461262 - DNA, 12 bp, Homo sapiens
ggcagtgcccca

SEQ ID NO: 4461263 - DNA, 14 bp, Homo sapiens
ggcagtgccccagg

SEQ ID NO: 4461264 - DNA, 18 bp, Homo sapiens
ggcagtgccccagggagt

SEQ ID NO: 4461265 - DNA, 18 bp, Homo sapiens
ggcatagtccccagagct

SEQ ID NO: 4461266 - DNA, 22 bp, Homo sapiens
ggcatagtccccagagctcccc

SEQ ID NO: 4461267 - DNA, 14 bp, Homo sapiens
ggcatcacagaccc

SEQ ID NO: 4461268 - DNA, 18 bp, Homo sapiens
ggcatcacagaccccagc

SEQ ID NO: 4461269 - DNA, 16 bp, Homo sapiens
ggcatccagagtccct

SEQ ID NO: 4461270 - DNA, 22 bp, Homo sapiens
ggcatcggggagccgggagcct

SEQ ID NO: 4461271 - DNA, 23 bp, Homo sapiens
ggcatctctccccatatataaat

SEQ ID NO: 4461272 - DNA, 20 bp, Homo sapiens
ggcatctcttccccagagag

SEQ ID NO: 4461273 - DNA, 19 bp, Homo sapiens
ggcatctgagtccagctcc

SEQ ID NO: 4461274 - DNA, 19 bp, Homo sapiens
ggcatctgcccctccccca

SEQ ID NO: 4461275 - DNA, 16 bp, Homo sapiens
ggcatcttggaaaagg

SEQ ID NO: 4461276 - DNA, 21 bp, Homo sapiens
ggcatctttgccttgggctgc

SEQ ID NO: 4461277 - DNA, 19 bp, Homo sapiens
ggcatcttttctagagaca

SEQ ID NO: 4461278 - DNA, 11 bp, Homo sapiens
ggcatcttttg

SEQ ID NO: 4461279 - DNA, 17 bp, Homo sapiens
ggcatggcagggccagg

SEQ ID NO: 4461280 - DNA, 20 bp, Homo sapiens
ggcatggcagggccaggcct

SEQ ID NO: 4461281 - DNA, 24 bp, Homo sapiens
ggcatgtcaacagcgttcctagag

SEQ ID NO: 4461282 - DNA, 19 bp, Homo sapiens
ggcattattaggtcttaaa

SEQ ID NO: 4461283 - DNA, 22 bp, Homo sapiens
ggcatttggtgagagtcaaagc

SEQ ID NO: 4461284 - DNA, 13 bp, Homo sapiens
ggcattttcctcc

SEQ ID NO: 4461285 - DNA, 18 bp, Homo sapiens
ggcattttcctcctctgc

SEQ ID NO: 4461286 - DNA, 16 bp, Homo sapiens
ggccaaaatcaagagt

SEQ ID NO: 4461287 - DNA, 15 bp, Homo sapiens
ggccaaacccttgct

SEQ ID NO: 4461288 - DNA, 18 bp, Homo sapiens
ggccaacctcaggctcct

SEQ ID NO: 4461289 - DNA, 15 bp, Homo sapiens
ggccaagcaggctgg

SEQ ID NO: 4461290 - DNA, 10 bp, Homo sapiens
ggccaaggac

SEQ ID NO: 4461291 - DNA, 14 bp, Homo sapiens
ggccaaggacccag

SEQ ID NO: 4461292 - DNA, 16 bp, Homo sapiens
ggccaaggtcctgctc

SEQ ID NO: 4461293 - DNA, 16 bp, Homo sapiens
ggccaagtccgcagaa

SEQ ID NO: 4461294 - DNA, 14 bp, Homo sapiens
ggccaataaaatgt

SEQ ID NO: 4461295 - DNA, 17 bp, Homo sapiens
ggccaattttggatgag

SEQ ID NO: 4461296 - DNA, 16 bp, Homo sapiens
ggccacacaggcaggg

SEQ ID NO: 4461297 - DNA, 20 bp, Homo sapiens
ggccacacaggcagggcctg

SEQ ID NO: 4461298 - DNA, 22 bp, Homo sapiens
ggccacacaggcagggcctggc

SEQ ID NO: 4461299 - DNA, 18 bp, Homo sapiens
ggccacacccctctgctg

SEQ ID NO: 4461300 - DNA, 19 bp, Homo sapiens
ggccacacccctctgctgc

SEQ ID NO: 4461301 - DNA, 20 bp, Homo sapiens
ggccacacccctctgctgca

SEQ ID NO: 4461302 - DNA, 21 bp, Homo sapiens
ggccacacccctctgctgcaa

SEQ ID NO: 4461303 - DNA, 15 bp, Homo sapiens
ggccacagctgctgg

SEQ ID NO: 4461304 - DNA, 15 bp, Homo sapiens
ggccaccagccatcc

SEQ ID NO: 4461305 - DNA, 21 bp, Homo sapiens
ggccaccccaaaccccagccc

SEQ ID NO: 4461306 - DNA, 14 bp, Homo sapiens
ggccacctttgtgc

SEQ ID NO: 4461307 - DNA, 17 bp, Homo sapiens
ggccacggagcgggagg

SEQ ID NO: 4461308 - DNA, 13 bp, Homo sapiens
ggccacgtccagg

SEQ ID NO: 4461309 - DNA, 15 bp, Homo sapiens
ggccacgtccaggtc

SEQ ID NO: 4461310 - DNA, 18 bp, Homo sapiens
ggccacgtgccaggcccg

SEQ ID NO: 4461311 - DNA, 18 bp, Homo sapiens
ggccactcaacagagagg

SEQ ID NO: 4461312 - DNA, 18 bp, Homo sapiens
ggccactggatcctgctg

SEQ ID NO: 4461313 - DNA, 12 bp, Homo sapiens
ggccactgggga

SEQ ID NO: 4461314 - DNA, 14 bp, Homo sapiens
ggccactggggact

SEQ ID NO: 4461315 - DNA, 20 bp, Homo sapiens
ggccactggggactttattt

SEQ ID NO: 4461316 - DNA, 23 bp, Homo sapiens
ggccactggggtgccttcactgg

SEQ ID NO: 4461317 - DNA, 21 bp, Homo sapiens
ggccacttctgggtggggcag

SEQ ID NO: 4461318 - DNA, 19 bp, Homo sapiens
ggccacttggtagtgtccc

SEQ ID NO: 4461319 - DNA, 14 bp, Homo sapiens
ggccagacgctgcc

SEQ ID NO: 4461320 - DNA, 12 bp, Homo sapiens
ggccagcaccct

SEQ ID NO: 4461321 - DNA, 16 bp, Homo sapiens
ggccagcaccctctcc

SEQ ID NO: 4461322 - DNA, 17 bp, Homo sapiens
ggccagcaccctctcct

SEQ ID NO: 4461323 - DNA, 19 bp, Homo sapiens
ggccagcaccctctcctgg

SEQ ID NO: 4461324 - DNA, 14 bp, Homo sapiens
ggccagcccagcca

SEQ ID NO: 4461325 - DNA, 13 bp, Homo sapiens
ggccagccccacc

SEQ ID NO: 4461326 - DNA, 14 bp, Homo sapiens
ggccagccccaccc

SEQ ID NO: 4461327 - DNA, 11 bp, Homo sapiens
ggccagccccg

SEQ ID NO: 4461328 - DNA, 20 bp, Homo sapiens
ggccagccccggccctgggc

SEQ ID NO: 4461329 - DNA, 19 bp, Homo sapiens
ggccagcctccgagaggga

SEQ ID NO: 4461330 - DNA, 22 bp, Homo sapiens
ggccagcctccgagagggagag

SEQ ID NO: 4461331 - DNA, 18 bp, Homo sapiens
ggccagcggggctgctca

SEQ ID NO: 4461332 - DNA, 11 bp, Homo sapiens
ggccagctgcg

SEQ ID NO: 4461333 - DNA, 15 bp, Homo sapiens
ggccaggaggctgcc

SEQ ID NO: 4461334 - DNA, 15 bp, Homo sapiens
ggccaggcagatctg

SEQ ID NO: 4461335 - DNA, 14 bp, Homo sapiens
ggccaggcctctgc

SEQ ID NO: 4461336 - DNA, 22 bp, Homo sapiens
ggccaggcctctgctggctcag

SEQ ID NO: 4461337 - DNA, 16 bp, Homo sapiens
ggccagggaggaagga

SEQ ID NO: 4461338 - DNA, 20 bp, Homo sapiens
ggccagggccacgctccagc

SEQ ID NO: 4461339 - DNA, 21 bp, Homo sapiens
ggccagggccacgctccagct

SEQ ID NO: 4461340 - DNA, 17 bp, Homo sapiens
ggccaggggtgctcctg

SEQ ID NO: 4461341 - DNA, 20 bp, Homo sapiens
ggccaggggtgctcctgtgc

SEQ ID NO: 4461342 - DNA, 18 bp, Homo sapiens
ggccagtacctttccatt

SEQ ID NO: 4461343 - DNA, 23 bp, Homo sapiens
ggccagtcaacggggggctcctg

SEQ ID NO: 4461344 - DNA, 13 bp, Homo sapiens
ggccagtccccat

SEQ ID NO: 4461345 - DNA, 18 bp, Homo sapiens
ggccagtcctgcctggcc

SEQ ID NO: 4461346 - DNA, 22 bp, Homo sapiens
ggccagtcctgcctggccaggc

SEQ ID NO: 4461347 - DNA, 19 bp, Homo sapiens
ggccagtgtttaaaacttc

SEQ ID NO: 4461348 - DNA, 15 bp, Homo sapiens
ggccatatatgctgt

SEQ ID NO: 4461349 - DNA, 17 bp, Homo sapiens
ggccatccctgggcccc

SEQ ID NO: 4461350 - DNA, 20 bp, Homo sapiens
ggccatccctgggcccctcc

SEQ ID NO: 4461351 - DNA, 21 bp, Homo sapiens
ggccatccctgggcccctcca

SEQ ID NO: 4461352 - DNA, 15 bp, Homo sapiens
ggccatctccctccc

SEQ ID NO: 4461353 - DNA, 17 bp, Homo sapiens
ggccatctccctcccca

SEQ ID NO: 4461354 - DNA, 13 bp, Homo sapiens
ggccatgtccaaa

SEQ ID NO: 4461355 - DNA, 15 bp, Homo sapiens
ggccatgtccaaaga

SEQ ID NO: 4461356 - DNA, 13 bp, Homo sapiens
ggcccaaaacata

SEQ ID NO: 4461357 - DNA, 13 bp, Homo sapiens
ggcccaaatagaa

SEQ ID NO: 4461358 - DNA, 15 bp, Homo sapiens
ggcccaaatgatgga

SEQ ID NO: 4461359 - DNA, 20 bp, Homo sapiens
ggcccaactggttcaggctc

SEQ ID NO: 4461360 - DNA, 18 bp, Homo sapiens
ggcccacagctcccaccc

SEQ ID NO: 4461361 - DNA, 15 bp, Homo sapiens
ggcccaccagggtcc

SEQ ID NO: 4461362 - DNA, 13 bp, Homo sapiens
ggcccactgctcg

SEQ ID NO: 4461363 - DNA, 14 bp, Homo sapiens
ggcccagcccagag

SEQ ID NO: 4461364 - DNA, 15 bp, Homo sapiens
ggcccagcccagagc

SEQ ID NO: 4461365 - DNA, 16 bp, Homo sapiens
ggcccagcccccacag

SEQ ID NO: 4461366 - DNA, 11 bp, Homo sapiens
ggcccagcccg

SEQ ID NO: 4461367 - DNA, 14 bp, Homo sapiens
ggcccagcccggct

SEQ ID NO: 4461368 - DNA, 15 bp, Homo sapiens
ggcccagcccggctc

SEQ ID NO: 4461369 - DNA, 19 bp, Homo sapiens
ggcccagcccggctcccac

SEQ ID NO: 4461370 - DNA, 14 bp, Homo sapiens
ggcccagccctgct

SEQ ID NO: 4461371 - DNA, 18 bp, Homo sapiens
ggcccagctgctcccctg

SEQ ID NO: 4461372 - DNA, 11 bp, Homo sapiens
ggcccaggcca

SEQ ID NO: 4461373 - DNA, 12 bp, Homo sapiens
ggcccaggccag

SEQ ID NO: 4461374 - DNA, 14 bp, Homo sapiens
ggcccaggccaggt

SEQ ID NO: 4461375 - DNA, 17 bp, Homo sapiens
ggcccaggccaggtgcc

SEQ ID NO: 4461376 - DNA, 14 bp, Homo sapiens
ggcccaggctggga

SEQ ID NO: 4461377 - DNA, 16 bp, Homo sapiens
ggcccagggcatctgg

SEQ ID NO: 4461378 - DNA, 18 bp, Homo sapiens
ggcccaggtcagccactg

SEQ ID NO: 4461379 - DNA, 22 bp, Homo sapiens
ggcccagtatgagccctagaag

SEQ ID NO: 4461380 - DNA, 16 bp, Homo sapiens
ggcccagtgccactgc

SEQ ID NO: 4461381 - DNA, 13 bp, Homo sapiens
ggccccagagaga

SEQ ID NO: 4461382 - DNA, 12 bp, Homo sapiens
ggccccagccca

SEQ ID NO: 4461383 - DNA, 13 bp, Homo sapiens
ggccccagcccac

SEQ ID NO: 4461384 - DNA, 15 bp, Homo sapiens
ggccccagcccaccc

SEQ ID NO: 4461385 - DNA, 17 bp, Homo sapiens
ggccccagcctccaggc

SEQ ID NO: 4461386 - DNA, 22 bp, Homo sapiens
ggccccagcctgggccatctct

SEQ ID NO: 4461387 - DNA, 11 bp, Homo sapiens
ggccccagggg

SEQ ID NO: 4461388 - DNA, 15 bp, Homo sapiens
ggccccagtcagcct

SEQ ID NO: 4461389 - DNA, 21 bp, Homo sapiens
ggccccagtcagcctctctcc

SEQ ID NO: 4461390 - DNA, 23 bp, Homo sapiens
ggccccagtcagcctctctccca

SEQ ID NO: 4461391 - DNA, 23 bp, Homo sapiens
ggccccatcttgatctttgagcc

SEQ ID NO: 4461392 - DNA, 20 bp, Homo sapiens
ggcccccaacccctcctccc

SEQ ID NO: 4461393 - DNA, 23 bp, Homo sapiens
ggcccccaacccctcctccctca

SEQ ID NO: 4461394 - DNA, 16 bp, Homo sapiens
ggcccccaacctcagg

SEQ ID NO: 4461395 - DNA, 23 bp, Homo sapiens
ggcccccaacctcagggctccca

SEQ ID NO: 4461396 - DNA, 20 bp, Homo sapiens
ggcccccaagttttttaatt

SEQ ID NO: 4461397 - DNA, 14 bp, Homo sapiens
ggcccccaataaac

SEQ ID NO: 4461398 - DNA, 16 bp, Homo sapiens
ggcccccaataaacca

SEQ ID NO: 4461399 - DNA, 21 bp, Homo sapiens
ggcccccaataaaccagtgtg

SEQ ID NO: 4461400 - DNA, 14 bp, Homo sapiens
ggcccccaataaag

SEQ ID NO: 4461401 - DNA, 16 bp, Homo sapiens
ggcccccacagcgctc

SEQ ID NO: 4461402 - DNA, 16 bp, Homo sapiens
ggcccccagcccctcc

SEQ ID NO: 4461403 - DNA, 23 bp, Homo sapiens
ggcccccagcccctcctccctca

SEQ ID NO: 4461404 - DNA, 21 bp, Homo sapiens
ggccccccgcacagccacccg

SEQ ID NO: 4461405 - DNA, 21 bp, Homo sapiens
ggcccccggccaaggacccag

SEQ ID NO: 4461406 - DNA, 18 bp, Homo sapiens
ggccccctggtctctggt

SEQ ID NO: 4461407 - DNA, 18 bp, Homo sapiens
ggccccgaggacccagac

SEQ ID NO: 4461408 - DNA, 19 bp, Homo sapiens
ggccccgaggacccagacc

SEQ ID NO: 4461409 - DNA, 17 bp, Homo sapiens
ggccccgccagggctgg

SEQ ID NO: 4461410 - DNA, 20 bp, Homo sapiens
ggccccgccagggctgggga

SEQ ID NO: 4461411 - DNA, 21 bp, Homo sapiens
ggccccgcttgtccagcgcct

SEQ ID NO: 4461412 - DNA, 22 bp, Homo sapiens
ggccccgtctctcttggaccca

SEQ ID NO: 4461413 - DNA, 16 bp, Homo sapiens
ggcccctcacccacca

SEQ ID NO: 4461414 - DNA, 21 bp, Homo sapiens
ggcccctctctagggacccct

SEQ ID NO: 4461415 - DNA, 14 bp, Homo sapiens
ggcccctggaggct

SEQ ID NO: 4461416 - DNA, 22 bp, Homo sapiens
ggcccctggaggctgcctccca

SEQ ID NO: 4461417 - DNA, 20 bp, Homo sapiens
ggcccctgggatgggaccag

SEQ ID NO: 4461418 - DNA, 23 bp, Homo sapiens
ggcccctgggtcagtctggtggg

SEQ ID NO: 4461419 - DNA, 14 bp, Homo sapiens
ggcccgcctgccca

SEQ ID NO: 4461420 - DNA, 14 bp, Homo sapiens
ggcccggcagggcg

SEQ ID NO: 4461421 - DNA, 20 bp, Homo sapiens
ggcccggccacacccagcgg

SEQ ID NO: 4461422 - DNA, 23 bp, Homo sapiens
ggcccggcgcggtggctcacgcc

SEQ ID NO: 4461423 - DNA, 15 bp, Homo sapiens
ggcccggctgagccc

SEQ ID NO: 4461424 - DNA, 22 bp, Homo sapiens
ggcccggggctggcggctactc

SEQ ID NO: 4461425 - DNA, 12 bp, Homo sapiens
ggcccggtccac

SEQ ID NO: 4461426 - DNA, 23 bp, Homo sapiens
ggcccgtcagcatcactgatggg

SEQ ID NO: 4461427 - DNA, 17 bp, Homo sapiens
ggccctacttccaggat

SEQ ID NO: 4461428 - DNA, 14 bp, Homo sapiens
ggccctccagagcc

SEQ ID NO: 4461429 - DNA, 23 bp, Homo sapiens
ggccctccagagccccacagccc

SEQ ID NO: 4461430 - DNA, 19 bp, Homo sapiens
ggccctccctgactccctg

SEQ ID NO: 4461431 - DNA, 21 bp, Homo sapiens
ggccctccctgactccctgtg

SEQ ID NO: 4461432 - DNA, 22 bp, Homo sapiens
ggccctccctgtctccagggcc

SEQ ID NO: 4461433 - DNA, 21 bp, Homo sapiens
ggccctcgctgccagctctgt

SEQ ID NO: 4461434 - DNA, 23 bp, Homo sapiens
ggccctcgctgccagctctgtat

SEQ ID NO: 4461435 - DNA, 17 bp, Homo sapiens
ggccctcgggcccagcc

SEQ ID NO: 4461436 - DNA, 17 bp, Homo sapiens
ggccctctcccttaccc

SEQ ID NO: 4461437 - DNA, 14 bp, Homo sapiens
ggccctctctctgg

SEQ ID NO: 4461438 - DNA, 16 bp, Homo sapiens
ggccctctctctgggc

SEQ ID NO: 4461439 - DNA, 14 bp, Homo sapiens
ggccctctttccct

SEQ ID NO: 4461440 - DNA, 16 bp, Homo sapiens
ggccctctttccctgc

SEQ ID NO: 4461441 - DNA, 19 bp, Homo sapiens
ggccctctttccctgcgag

SEQ ID NO: 4461442 - DNA, 20 bp, Homo sapiens
ggccctctttccctgcgaga

SEQ ID NO: 4461443 - DNA, 17 bp, Homo sapiens
ggccctgactcctctgg

SEQ ID NO: 4461444 - DNA, 22 bp, Homo sapiens
ggccctgactcctctggctttc

SEQ ID NO: 4461445 - DNA, 19 bp, Homo sapiens
ggccctgcaaaaggactct

SEQ ID NO: 4461446 - DNA, 20 bp, Homo sapiens
ggccctgcacagacctggag

SEQ ID NO: 4461447 - DNA, 17 bp, Homo sapiens
ggccctgccccacccca

SEQ ID NO: 4461448 - DNA, 13 bp, Homo sapiens
ggccctgccccca

SEQ ID NO: 4461449 - DNA, 14 bp, Homo sapiens
ggccctgcccccac

SEQ ID NO: 4461450 - DNA, 13 bp, Homo sapiens
ggccctggaggga

SEQ ID NO: 4461451 - DNA, 20 bp, Homo sapiens
ggccctggagggaaggacag

SEQ ID NO: 4461452 - DNA, 12 bp, Homo sapiens
ggccctggccag

SEQ ID NO: 4461453 - DNA, 14 bp, Homo sapiens
ggccctggccagga

SEQ ID NO: 4461454 - DNA, 17 bp, Homo sapiens
ggccctggcctgctggg

SEQ ID NO: 4461455 - DNA, 16 bp, Homo sapiens
ggccctgggctcggag

SEQ ID NO: 4461456 - DNA, 18 bp, Homo sapiens
ggccctgggctcggaggc

SEQ ID NO: 4461457 - DNA, 21 bp, Homo sapiens
ggccctgggctcggaggctgc

SEQ ID NO: 4461458 - DNA, 13 bp, Homo sapiens
ggccctgggctgg

SEQ ID NO: 4461459 - DNA, 22 bp, Homo sapiens
ggccctggggatcttcccacag

SEQ ID NO: 4461460 - DNA, 12 bp, Homo sapiens
ggccctgggtaa

SEQ ID NO: 4461461 - DNA, 15 bp, Homo sapiens
ggccctgtcccaggc

SEQ ID NO: 4461462 - DNA, 19 bp, Homo sapiens
ggccctgtcccaggccggc

SEQ ID NO: 4461463 - DNA, 19 bp, Homo sapiens
ggccctgtcgcccctcctt

SEQ ID NO: 4461464 - DNA, 17 bp, Homo sapiens
ggccctgtgccttggtg

SEQ ID NO: 4461465 - DNA, 16 bp, Homo sapiens
ggcccttagagacccc

SEQ ID NO: 4461466 - DNA, 19 bp, Homo sapiens
ggcccttcccacaggacat

SEQ ID NO: 4461467 - DNA, 12 bp, Homo sapiens
ggccgagagcct

SEQ ID NO: 4461468 - DNA, 15 bp, Homo sapiens
ggccgagctcctggg

SEQ ID NO: 4461469 - DNA, 16 bp, Homo sapiens
ggccgagctcctgggg

SEQ ID NO: 4461470 - DNA, 13 bp, Homo sapiens
ggccgcagaggat

SEQ ID NO: 4461471 - DNA, 12 bp, Homo sapiens
ggccgcctcacc

SEQ ID NO: 4461472 - DNA, 18 bp, Homo sapiens
ggccgcgccacccgggca

SEQ ID NO: 4461473 - DNA, 14 bp, Homo sapiens
ggccgctgagcgcc

SEQ ID NO: 4461474 - DNA, 16 bp, Homo sapiens
ggccgctgttcaccca

SEQ ID NO: 4461475 - DNA, 14 bp, Homo sapiens
ggccggcccagatg

SEQ ID NO: 4461476 - DNA, 22 bp, Homo sapiens
ggccgggactgctgctctccca

SEQ ID NO: 4461477 - DNA, 19 bp, Homo sapiens
ggccggttttcctcagctc

SEQ ID NO: 4461478 - DNA, 23 bp, Homo sapiens
ggccggttttcctcagctctagg

SEQ ID NO: 4461479 - DNA, 22 bp, Homo sapiens
ggccgtctcccttggcccagag

SEQ ID NO: 4461480 - DNA, 23 bp, Homo sapiens
ggccgtctcccttggcccagaga

SEQ ID NO: 4461481 - DNA, 13 bp, Homo sapiens
ggccgtctcctcc

SEQ ID NO: 4461482 - DNA, 15 bp, Homo sapiens
ggccgtctcctccct

SEQ ID NO: 4461483 - DNA, 14 bp, Homo sapiens
ggccgtgccttgtt

SEQ ID NO: 4461484 - DNA, 13 bp, Homo sapiens
ggccgtgtctctg

SEQ ID NO: 4461485 - DNA, 14 bp, Homo sapiens
ggcctaagtgcctc

SEQ ID NO: 4461486 - DNA, 21 bp, Homo sapiens
ggcctagcgatctctcctggc

SEQ ID NO: 4461487 - DNA, 22 bp, Homo sapiens
ggcctagcgatctctcctggcc

SEQ ID NO: 4461488 - DNA, 14 bp, Homo sapiens
ggcctatgtggtct

SEQ ID NO: 4461489 - DNA, 14 bp, Homo sapiens
ggcctatttaacaa

SEQ ID NO: 4461490 - DNA, 18 bp, Homo sapiens
ggcctcaactcctcccat

SEQ ID NO: 4461491 - DNA, 12 bp, Homo sapiens
ggcctcacccac

SEQ ID NO: 4461492 - DNA, 17 bp, Homo sapiens
ggcctcacccacccctg

SEQ ID NO: 4461493 - DNA, 10 bp, Homo sapiens
ggcctcagaa

SEQ ID NO: 4461494 - DNA, 13 bp, Homo sapiens
ggcctcagccctc

SEQ ID NO: 4461495 - DNA, 15 bp, Homo sapiens
ggcctcagccctcag

SEQ ID NO: 4461496 - DNA, 14 bp, Homo sapiens
ggcctcagccctgc

SEQ ID NO: 4461497 - DNA, 13 bp, Homo sapiens
ggcctcagcctgc

SEQ ID NO: 4461498 - DNA, 23 bp, Homo sapiens
ggcctcagcctgctttcctgcag

SEQ ID NO: 4461499 - DNA, 13 bp, Homo sapiens
ggcctcagctgcc

SEQ ID NO: 4461500 - DNA, 16 bp, Homo sapiens
ggcctcagctgcctca

SEQ ID NO: 4461501 - DNA, 15 bp, Homo sapiens
ggcctccactccttc

SEQ ID NO: 4461502 - DNA, 21 bp, Homo sapiens
ggcctccactccttccatctc

SEQ ID NO: 4461503 - DNA, 12 bp, Homo sapiens
ggcctcccaaag

SEQ ID NO: 4461504 - DNA, 23 bp, Homo sapiens
ggcctcccaaagtgctgagattg

SEQ ID NO: 4461505 - DNA, 23 bp, Homo sapiens
ggcctcccgccactcgccttctt

SEQ ID NO: 4461506 - DNA, 13 bp, Homo sapiens
ggcctccctgctg

SEQ ID NO: 4461507 - DNA, 15 bp, Homo sapiens
ggcctccgaggctcc

SEQ ID NO: 4461508 - DNA, 16 bp, Homo sapiens
ggcctccgaggctccc

SEQ ID NO: 4461509 - DNA, 19 bp, Homo sapiens
ggcctccgcctgggtcatg

SEQ ID NO: 4461510 - DNA, 20 bp, Homo sapiens
ggcctccggcgtcagcctcc

SEQ ID NO: 4461511 - DNA, 23 bp, Homo sapiens
ggcctccggcgtcagcctccagc

SEQ ID NO: 4461512 - DNA, 13 bp, Homo sapiens
ggcctcctcctca

SEQ ID NO: 4461513 - DNA, 17 bp, Homo sapiens
ggcctcctcctcaccct

SEQ ID NO: 4461514 - DNA, 19 bp, Homo sapiens
ggcctcctcggagagcagc

SEQ ID NO: 4461515 - DNA, 14 bp, Homo sapiens
ggcctcgtgccatg

SEQ ID NO: 4461516 - DNA, 17 bp, Homo sapiens
ggcctctaaccccaggc

SEQ ID NO: 4461517 - DNA, 18 bp, Homo sapiens
ggcctctaaccccaggcc

SEQ ID NO: 4461518 - DNA, 19 bp, Homo sapiens
ggcctctaaccccaggccc

SEQ ID NO: 4461519 - DNA, 16 bp, Homo sapiens
ggcctctccccaggaa

SEQ ID NO: 4461520 - DNA, 19 bp, Homo sapiens
ggcctctccctgcctgtgg

SEQ ID NO: 4461521 - DNA, 20 bp, Homo sapiens
ggcctctccctgcctgtggc

SEQ ID NO: 4461522 - DNA, 21 bp, Homo sapiens
ggcctctccctgcctgtggcc

SEQ ID NO: 4461523 - DNA, 18 bp, Homo sapiens
ggcctctccttggaaggt

SEQ ID NO: 4461524 - DNA, 17 bp, Homo sapiens
ggcctctcggtgctcca

SEQ ID NO: 4461525 - DNA, 18 bp, Homo sapiens
ggcctctcggtgctccat

SEQ ID NO: 4461526 - DNA, 14 bp, Homo sapiens
ggcctctctcctgc

SEQ ID NO: 4461527 - DNA, 15 bp, Homo sapiens
ggcctctctcctgcc

SEQ ID NO: 4461528 - DNA, 13 bp, Homo sapiens
ggcctctctctgc

SEQ ID NO: 4461529 - DNA, 19 bp, Homo sapiens
ggcctctctctgctccatc

SEQ ID NO: 4461530 - DNA, 17 bp, Homo sapiens
ggcctctgctggctcag

SEQ ID NO: 4461531 - DNA, 19 bp, Homo sapiens
ggcctctgctggctcagga

SEQ ID NO: 4461532 - DNA, 12 bp, Homo sapiens
ggcctctgtgcc

SEQ ID NO: 4461533 - DNA, 19 bp, Homo sapiens
ggcctcttctcaacttttt

SEQ ID NO: 4461534 - DNA, 13 bp, Homo sapiens
ggcctcttggcag

SEQ ID NO: 4461535 - DNA, 21 bp, Homo sapiens
ggcctgaagaagcacttctgc

SEQ ID NO: 4461536 - DNA, 23 bp, Homo sapiens
ggcctgaagaagcacttctgctg

SEQ ID NO: 4461537 - DNA, 14 bp, Homo sapiens
ggcctgacagctct

SEQ ID NO: 4461538 - DNA, 20 bp, Homo sapiens
ggcctgaccaaacagccaac

SEQ ID NO: 4461539 - DNA, 16 bp, Homo sapiens
ggcctgactctcagca

SEQ ID NO: 4461540 - DNA, 17 bp, Homo sapiens
ggcctgacttgagccac

SEQ ID NO: 4461541 - DNA, 19 bp, Homo sapiens
ggcctgacttgagccactc

SEQ ID NO: 4461542 - DNA, 20 bp, Homo sapiens
ggcctgagatttcatctgct

SEQ ID NO: 4461543 - DNA, 18 bp, Homo sapiens
ggcctgagcatccagacc

SEQ ID NO: 4461544 - DNA, 22 bp, Homo sapiens
ggcctgagcccctttgcctgtc

SEQ ID NO: 4461545 - DNA, 20 bp, Homo sapiens
ggcctgcaaaccttcctggg

SEQ ID NO: 4461546 - DNA, 19 bp, Homo sapiens
ggcctgcacggtgggcctt

SEQ ID NO: 4461547 - DNA, 15 bp, Homo sapiens
ggcctgcccagttgc

SEQ ID NO: 4461548 - DNA, 13 bp, Homo sapiens
ggcctgcccctgt

SEQ ID NO: 4461549 - DNA, 20 bp, Homo sapiens
ggcctgcctccagggctgga

SEQ ID NO: 4461550 - DNA, 15 bp, Homo sapiens
ggcctgcctcccact

SEQ ID NO: 4461551 - DNA, 17 bp, Homo sapiens
ggcctgcgggcccctgg

SEQ ID NO: 4461552 - DNA, 21 bp, Homo sapiens
ggcctgcggtggagggatcag

SEQ ID NO: 4461553 - DNA, 16 bp, Homo sapiens
ggcctgctagtcactg

SEQ ID NO: 4461554 - DNA, 18 bp, Homo sapiens
ggcctgctgccagtgcag

SEQ ID NO: 4461555 - DNA, 17 bp, Homo sapiens
ggcctgctgggctctcc

SEQ ID NO: 4461556 - DNA, 15 bp, Homo sapiens
ggcctggacaggcgg

SEQ ID NO: 4461557 - DNA, 20 bp, Homo sapiens
ggcctggatgccccctgtgg

SEQ ID NO: 4461558 - DNA, 16 bp, Homo sapiens
ggcctggccaggagct

SEQ ID NO: 4461559 - DNA, 17 bp, Homo sapiens
ggcctggccaggagctc

SEQ ID NO: 4461560 - DNA, 11 bp, Homo sapiens
ggcctggccct

SEQ ID NO: 4461561 - DNA, 13 bp, Homo sapiens
ggcctggccctgc

SEQ ID NO: 4461562 - DNA, 22 bp, Homo sapiens
ggcctggcctcatctcagaccc

SEQ ID NO: 4461563 - DNA, 13 bp, Homo sapiens
ggcctggctggag

SEQ ID NO: 4461564 - DNA, 13 bp, Homo sapiens
ggcctgggcagga

SEQ ID NO: 4461565 - DNA, 14 bp, Homo sapiens
ggcctgggcaggag

SEQ ID NO: 4461566 - DNA, 15 bp, Homo sapiens
ggcctgggcaggagg

SEQ ID NO: 4461567 - DNA, 10 bp, Homo sapiens
ggcctggggg

SEQ ID NO: 4461568 - DNA, 18 bp, Homo sapiens
ggcctgggggcagggaga

SEQ ID NO: 4461569 - DNA, 11 bp, Homo sapiens
ggcctggtccc

SEQ ID NO: 4461570 - DNA, 14 bp, Homo sapiens
ggcctggtccctgt

SEQ ID NO: 4461571 - DNA, 20 bp, Homo sapiens
ggcctgtcccttgcctctgc

SEQ ID NO: 4461572 - DNA, 17 bp, Homo sapiens
ggcctgtctcatcccca

SEQ ID NO: 4461573 - DNA, 14 bp, Homo sapiens
ggccttaagaactg

SEQ ID NO: 4461574 - DNA, 15 bp, Homo sapiens
ggccttaatttcctt

SEQ ID NO: 4461575 - DNA, 20 bp, Homo sapiens
ggccttaatttcctttttga

SEQ ID NO: 4461576 - DNA, 14 bp, Homo sapiens
ggccttcataatgg

SEQ ID NO: 4461577 - DNA, 20 bp, Homo sapiens
ggccttcccctggcactggc

SEQ ID NO: 4461578 - DNA, 21 bp, Homo sapiens
ggcctttaagaaccttaatga

SEQ ID NO: 4461579 - DNA, 13 bp, Homo sapiens
ggcctttgccagc

SEQ ID NO: 4461580 - DNA, 18 bp, Homo sapiens
ggcctttgccagcagagc

SEQ ID NO: 4461581 - DNA, 21 bp, Homo sapiens
ggcctttggacccagggcctg

SEQ ID NO: 4461582 - DNA, 16 bp, Homo sapiens
ggccttttatgtaatt

SEQ ID NO: 4461583 - DNA, 22 bp, Homo sapiens
ggcgaagcgttgtcctcagccc

SEQ ID NO: 4461584 - DNA, 20 bp, Homo sapiens
ggcgaagggtggtttgcaga

SEQ ID NO: 4461585 - DNA, 12 bp, Homo sapiens
ggcgaataaatg

SEQ ID NO: 4461586 - DNA, 15 bp, Homo sapiens
ggcgaataaatgttc

SEQ ID NO: 4461587 - DNA, 17 bp, Homo sapiens
ggcgaataaatgttcaa

SEQ ID NO: 4461588 - DNA, 17 bp, Homo sapiens
ggcgaatctcaaaatta

SEQ ID NO: 4461589 - DNA, 21 bp, Homo sapiens
ggcgagccatttgtcccaagt

SEQ ID NO: 4461590 - DNA, 14 bp, Homo sapiens
ggcgagctgcagga

SEQ ID NO: 4461591 - DNA, 23 bp, Homo sapiens
ggcgagtctggggacctggcact

SEQ ID NO: 4461592 - DNA, 13 bp, Homo sapiens
ggcgcaccccaca

SEQ ID NO: 4461593 - DNA, 19 bp, Homo sapiens
ggcgccaagtctggcacca

SEQ ID NO: 4461594 - DNA, 22 bp, Homo sapiens
ggcgcccacccggcccggctga

SEQ ID NO: 4461595 - DNA, 18 bp, Homo sapiens
ggcgccgggcaccaactc

SEQ ID NO: 4461596 - DNA, 16 bp, Homo sapiens
ggcgcggctgggagga

SEQ ID NO: 4461597 - DNA, 19 bp, Homo sapiens
ggcgcggtggctcacgcct

SEQ ID NO: 4461598 - DNA, 13 bp, Homo sapiens
ggcgctcagcagc

SEQ ID NO: 4461599 - DNA, 17 bp, Homo sapiens
ggcgctcggtctccacc

SEQ ID NO: 4461600 - DNA, 23 bp, Homo sapiens
ggcgctcggtctccaccccaggg

SEQ ID NO: 4461601 - DNA, 20 bp, Homo sapiens
ggcgctgggtattggaaatg

SEQ ID NO: 4461602 - DNA, 17 bp, Homo sapiens
ggcggacgttccagccg

SEQ ID NO: 4461603 - DNA, 18 bp, Homo sapiens
ggcggagccccggctctt

SEQ ID NO: 4461604 - DNA, 14 bp, Homo sapiens
ggcggcctcccagg

SEQ ID NO: 4461605 - DNA, 20 bp, Homo sapiens
ggcggctactcagcagccct

SEQ ID NO: 4461606 - DNA, 18 bp, Homo sapiens
ggcgggacagtgctgcag

SEQ ID NO: 4461607 - DNA, 17 bp, Homo sapiens
ggcgggcagagggctgg

SEQ ID NO: 4461608 - DNA, 18 bp, Homo sapiens
ggcgggcagagggctgga

SEQ ID NO: 4461609 - DNA, 13 bp, Homo sapiens
ggcgggctcagag

SEQ ID NO: 4461610 - DNA, 18 bp, Homo sapiens
ggcgggctcagagctttg

SEQ ID NO: 4461611 - DNA, 13 bp, Homo sapiens
ggcgtcagcctcc

SEQ ID NO: 4461612 - DNA, 17 bp, Homo sapiens
ggcgtcagcctccagcc

SEQ ID NO: 4461613 - DNA, 22 bp, Homo sapiens
ggcgtcagcctccagcctctgt

SEQ ID NO: 4461614 - DNA, 18 bp, Homo sapiens
ggcgtgcccccctcctcc

SEQ ID NO: 4461615 - DNA, 16 bp, Homo sapiens
ggcgtgctcagaccca

SEQ ID NO: 4461616 - DNA, 14 bp, Homo sapiens
ggcgtgtgaagaac

SEQ ID NO: 4461617 - DNA, 11 bp, Homo sapiens
ggctaaatgaa

SEQ ID NO: 4461618 - DNA, 12 bp, Homo sapiens
ggctaaatgaag

SEQ ID NO: 4461619 - DNA, 21 bp, Homo sapiens
ggctaaccatcgaaaagaaca

SEQ ID NO: 4461620 - DNA, 13 bp, Homo sapiens
ggctaatttaaca

SEQ ID NO: 4461621 - DNA, 19 bp, Homo sapiens
ggctacagctccacacgcc

SEQ ID NO: 4461622 - DNA, 21 bp, Homo sapiens
ggctacagctccacacgcccc

SEQ ID NO: 4461623 - DNA, 14 bp, Homo sapiens
ggctacagtgagcc

SEQ ID NO: 4461624 - DNA, 19 bp, Homo sapiens
ggctaccccccctcctgct

SEQ ID NO: 4461625 - DNA, 20 bp, Homo sapiens
ggctactcagcagccctcct

SEQ ID NO: 4461626 - DNA, 21 bp, Homo sapiens
ggctactcagcagccctcctc

SEQ ID NO: 4461627 - DNA, 17 bp, Homo sapiens
ggctactgttcttgaca

SEQ ID NO: 4461628 - DNA, 16 bp, Homo sapiens
ggctagaacctggagg

SEQ ID NO: 4461629 - DNA, 15 bp, Homo sapiens
ggctagacaggaacc

SEQ ID NO: 4461630 - DNA, 16 bp, Homo sapiens
ggctagaggccagccc

SEQ ID NO: 4461631 - DNA, 13 bp, Homo sapiens
ggctagagtcctc

SEQ ID NO: 4461632 - DNA, 20 bp, Homo sapiens
ggctagcttctgcttttctg

SEQ ID NO: 4461633 - DNA, 16 bp, Homo sapiens
ggctagggtggggaga

SEQ ID NO: 4461634 - DNA, 20 bp, Homo sapiens
ggctagtatcaaaagaaaga

SEQ ID NO: 4461635 - DNA, 18 bp, Homo sapiens
ggctatgaaaatgagccc

SEQ ID NO: 4461636 - DNA, 21 bp, Homo sapiens
ggctatggggatagatgtgtg

SEQ ID NO: 4461637 - DNA, 19 bp, Homo sapiens
ggctatgtagacataaaga

SEQ ID NO: 4461638 - DNA, 17 bp, Homo sapiens
ggctatttttgaagcaa

SEQ ID NO: 4461639 - DNA, 21 bp, Homo sapiens
ggctcaagcaatcctcctgcc

SEQ ID NO: 4461640 - DNA, 15 bp, Homo sapiens
ggctcaagtttttat

SEQ ID NO: 4461641 - DNA, 17 bp, Homo sapiens
ggctcacactgagaatg

SEQ ID NO: 4461642 - DNA, 22 bp, Homo sapiens
ggctcacccccttctccatcca

SEQ ID NO: 4461643 - DNA, 22 bp, Homo sapiens
ggctcacgcctgtaatcccagc

SEQ ID NO: 4461644 - DNA, 14 bp, Homo sapiens
ggctcactgccagg

SEQ ID NO: 4461645 - DNA, 13 bp, Homo sapiens
ggctcagaaggaa

SEQ ID NO: 4461646 - DNA, 11 bp, Homo sapiens
ggctcagagct

SEQ ID NO: 4461647 - DNA, 14 bp, Homo sapiens
ggctcaggaggagg

SEQ ID NO: 4461648 - DNA, 20 bp, Homo sapiens
ggctcaggaggaggggtgag

SEQ ID NO: 4461649 - DNA, 18 bp, Homo sapiens
ggctcagggcctcaggca

SEQ ID NO: 4461650 - DNA, 23 bp, Homo sapiens
ggctcagtgccacctatgcctgt

SEQ ID NO: 4461651 - DNA, 21 bp, Homo sapiens
ggctcatgcctgtaatctcag

SEQ ID NO: 4461652 - DNA, 15 bp, Homo sapiens
ggctccagagggcac

SEQ ID NO: 4461653 - DNA, 18 bp, Homo sapiens
ggctccagcaccttcttt

SEQ ID NO: 4461654 - DNA, 18 bp, Homo sapiens
ggctccagctctggcaca

SEQ ID NO: 4461655 - DNA, 16 bp, Homo sapiens
ggctccaggagcctca

SEQ ID NO: 4461656 - DNA, 17 bp, Homo sapiens
ggctccatgctgggtct

SEQ ID NO: 4461657 - DNA, 21 bp, Homo sapiens
ggctccatgctgggtctgagg

SEQ ID NO: 4461658 - DNA, 17 bp, Homo sapiens
ggctcccaatcagcttt

SEQ ID NO: 4461659 - DNA, 18 bp, Homo sapiens
ggctcccaatcagctttt

SEQ ID NO: 4461660 - DNA, 21 bp, Homo sapiens
ggctcccacataagcactagt

SEQ ID NO: 4461661 - DNA, 14 bp, Homo sapiens
ggctcccagccagg

SEQ ID NO: 4461662 - DNA, 15 bp, Homo sapiens
ggctcccagccaggc

SEQ ID NO: 4461663 - DNA, 17 bp, Homo sapiens
ggctcccagccaggccc

SEQ ID NO: 4461664 - DNA, 20 bp, Homo sapiens
ggctcccaggggtctccctg

SEQ ID NO: 4461665 - DNA, 23 bp, Homo sapiens
ggctcccaggggtctccctggct

SEQ ID NO: 4461666 - DNA, 20 bp, Homo sapiens
ggctccccctccccaggctg

SEQ ID NO: 4461667 - DNA, 20 bp, Homo sapiens
ggctcccctgcccagcctgc

SEQ ID NO: 4461668 - DNA, 15 bp, Homo sapiens
ggctcccggggcctg

SEQ ID NO: 4461669 - DNA, 17 bp, Homo sapiens
ggctcccggggcctgga

SEQ ID NO: 4461670 - DNA, 18 bp, Homo sapiens
ggctcccggggcctggac

SEQ ID NO: 4461671 - DNA, 19 bp, Homo sapiens
ggctcccggggcctggaca

SEQ ID NO: 4461672 - DNA, 21 bp, Homo sapiens
ggctccctaaactttggcctt

SEQ ID NO: 4461673 - DNA, 18 bp, Homo sapiens
ggctccctgactgggagt

SEQ ID NO: 4461674 - DNA, 20 bp, Homo sapiens
ggctccctgatgggggacag

SEQ ID NO: 4461675 - DNA, 23 bp, Homo sapiens
ggctccgggcaccaggggccaac

SEQ ID NO: 4461676 - DNA, 16 bp, Homo sapiens
ggctcctccttgccca

SEQ ID NO: 4461677 - DNA, 18 bp, Homo sapiens
ggctcctgcccaggccac

SEQ ID NO: 4461678 - DNA, 20 bp, Homo sapiens
ggctcgccgtgtctcagcct

SEQ ID NO: 4461679 - DNA, 22 bp, Homo sapiens
ggctcgccgtgtctcagcctct

SEQ ID NO: 4461680 - DNA, 17 bp, Homo sapiens
ggctcggacccacccca

SEQ ID NO: 4461681 - DNA, 19 bp, Homo sapiens
ggctcggacccaccccaac

SEQ ID NO: 4461682 - DNA, 19 bp, Homo sapiens
ggctcgtggactgagtggg

SEQ ID NO: 4461683 - DNA, 17 bp, Homo sapiens
ggctctaattcacagtg

SEQ ID NO: 4461684 - DNA, 14 bp, Homo sapiens
ggctctaccttcct

SEQ ID NO: 4461685 - DNA, 16 bp, Homo sapiens
ggctctaccttcctgt

SEQ ID NO: 4461686 - DNA, 17 bp, Homo sapiens
ggctctaccttcctgtc

SEQ ID NO: 4461687 - DNA, 19 bp, Homo sapiens
ggctctaccttcctgtccc

SEQ ID NO: 4461688 - DNA, 21 bp, Homo sapiens
ggctctaccttcctgtccctg

SEQ ID NO: 4461689 - DNA, 23 bp, Homo sapiens
ggctctaccttcctgtccctgag

SEQ ID NO: 4461690 - DNA, 22 bp, Homo sapiens
ggctctcatggtacttcctctg

SEQ ID NO: 4461691 - DNA, 14 bp, Homo sapiens
ggctctccacctca

SEQ ID NO: 4461692 - DNA, 23 bp, Homo sapiens
ggctctcccctctcgccccatcc

SEQ ID NO: 4461693 - DNA, 14 bp, Homo sapiens
ggctctgccccctc

SEQ ID NO: 4461694 - DNA, 14 bp, Homo sapiens
ggctctgccccgca

SEQ ID NO: 4461695 - DNA, 21 bp, Homo sapiens
ggctctggacagcagaagcct

SEQ ID NO: 4461696 - DNA, 18 bp, Homo sapiens
ggctctgtgctgaccctc

SEQ ID NO: 4461697 - DNA, 19 bp, Homo sapiens
ggctctgtgggtgatgggg

SEQ ID NO: 4461698 - DNA, 11 bp, Homo sapiens
ggctctgtttg

SEQ ID NO: 4461699 - DNA, 12 bp, Homo sapiens
ggctcttctcat

SEQ ID NO: 4461700 - DNA, 13 bp, Homo sapiens
ggctcttctcatt

SEQ ID NO: 4461701 - DNA, 22 bp, Homo sapiens
ggctcttctcatttcacccctc

SEQ ID NO: 4461702 - DNA, 20 bp, Homo sapiens
ggctgaagaggaccagagga

SEQ ID NO: 4461703 - DNA, 22 bp, Homo sapiens
ggctgaagaggaccagaggagc

SEQ ID NO: 4461704 - DNA, 23 bp, Homo sapiens
ggctgaagaggaccagaggagca

SEQ ID NO: 4461705 - DNA, 14 bp, Homo sapiens
ggctgaataaagcc

SEQ ID NO: 4461706 - DNA, 14 bp, Homo sapiens
ggctgacacccagg

SEQ ID NO: 4461707 - DNA, 17 bp, Homo sapiens
ggctgacacccaggccc

SEQ ID NO: 4461708 - DNA, 18 bp, Homo sapiens
ggctgacccagtccctgg

SEQ ID NO: 4461709 - DNA, 19 bp, Homo sapiens
ggctgactagaagggccag

SEQ ID NO: 4461710 - DNA, 22 bp, Homo sapiens
ggctgactagaagggccagtcc

SEQ ID NO: 4461711 - DNA, 21 bp, Homo sapiens
ggctgagacgccggcttcctc

SEQ ID NO: 4461712 - DNA, 15 bp, Homo sapiens
ggctgagatatgaac

SEQ ID NO: 4461713 - DNA, 17 bp, Homo sapiens
ggctgagccctcctgag

SEQ ID NO: 4461714 - DNA, 13 bp, Homo sapiens
ggctgagccctgc

SEQ ID NO: 4461715 - DNA, 15 bp, Homo sapiens
ggctgagctctctgt

SEQ ID NO: 4461716 - DNA, 15 bp, Homo sapiens
ggctgaggaggcctc

SEQ ID NO: 4461717 - DNA, 19 bp, Homo sapiens
ggctgaggaggcctccatc

SEQ ID NO: 4461718 - DNA, 13 bp, Homo sapiens
ggctgaggcagaa

SEQ ID NO: 4461719 - DNA, 14 bp, Homo sapiens
ggctgaggcagaag

SEQ ID NO: 4461720 - DNA, 23 bp, Homo sapiens
ggctgaggcaggagaatggtgtg

SEQ ID NO: 4461721 - DNA, 16 bp, Homo sapiens
ggctgaggcaggagga

SEQ ID NO: 4461722 - DNA, 15 bp, Homo sapiens
ggctgagggagcctg

SEQ ID NO: 4461723 - DNA, 16 bp, Homo sapiens
ggctgaggttcctctg

SEQ ID NO: 4461724 - DNA, 17 bp, Homo sapiens
ggctgaggttcctctgc

SEQ ID NO: 4461725 - DNA, 20 bp, Homo sapiens
ggctgaggttcctctgcctg

SEQ ID NO: 4461726 - DNA, 23 bp, Homo sapiens
ggctgaggttcctctgcctgccc

SEQ ID NO: 4461727 - DNA, 23 bp, Homo sapiens
ggctgagtcatgatctccctgcc

SEQ ID NO: 4461728 - DNA, 19 bp, Homo sapiens
ggctgcacccctgggccag

SEQ ID NO: 4461729 - DNA, 13 bp, Homo sapiens
ggctgcacctcct

SEQ ID NO: 4461730 - DNA, 17 bp, Homo sapiens
ggctgcagtcagccctg

SEQ ID NO: 4461731 - DNA, 16 bp, Homo sapiens
ggctgcagtggctccc

SEQ ID NO: 4461732 - DNA, 19 bp, Homo sapiens
ggctgcagtggctcccctg

SEQ ID NO: 4461733 - DNA, 15 bp, Homo sapiens
ggctgccacacccag

SEQ ID NO: 4461734 - DNA, 14 bp, Homo sapiens
ggctgccagtgcct

SEQ ID NO: 4461735 - DNA, 19 bp, Homo sapiens
ggctgcccccggccccctg

SEQ ID NO: 4461736 - DNA, 21 bp, Homo sapiens
ggctgcccccggccccctggt

SEQ ID NO: 4461737 - DNA, 17 bp, Homo sapiens
ggctgccccggcctcct

SEQ ID NO: 4461738 - DNA, 19 bp, Homo sapiens
ggctgcctgtgggcttccc

SEQ ID NO: 4461739 - DNA, 12 bp, Homo sapiens
ggctgcggcccc

SEQ ID NO: 4461740 - DNA, 22 bp, Homo sapiens
ggctgctcccacctggctctgt

SEQ ID NO: 4461741 - DNA, 19 bp, Homo sapiens
ggctgctcctccagggcca

SEQ ID NO: 4461742 - DNA, 11 bp, Homo sapiens
ggctgctgccc

SEQ ID NO: 4461743 - DNA, 14 bp, Homo sapiens
ggctgctggcgcct

SEQ ID NO: 4461744 - DNA, 19 bp, Homo sapiens
ggctgctggcgcctctgca

SEQ ID NO: 4461745 - DNA, 16 bp, Homo sapiens
ggctggaaggcagcag

SEQ ID NO: 4461746 - DNA, 18 bp, Homo sapiens
ggctggactgaggcctga

SEQ ID NO: 4461747 - DNA, 23 bp, Homo sapiens
ggctggagaatttagaatcagaa

SEQ ID NO: 4461748 - DNA, 16 bp, Homo sapiens
ggctggagctcctccc

SEQ ID NO: 4461749 - DNA, 13 bp, Homo sapiens
ggctggaggcagg

SEQ ID NO: 4461750 - DNA, 13 bp, Homo sapiens
ggctggaggccca

SEQ ID NO: 4461751 - DNA, 14 bp, Homo sapiens
ggctggaggcccag

SEQ ID NO: 4461752 - DNA, 19 bp, Homo sapiens
ggctggaggcccaggctgg

SEQ ID NO: 4461753 - DNA, 17 bp, Homo sapiens
ggctggagtaatcagat

SEQ ID NO: 4461754 - DNA, 20 bp, Homo sapiens
ggctggagtgcagtggcgcg

SEQ ID NO: 4461755 - DNA, 20 bp, Homo sapiens
ggctggagtgcggtggcgca

SEQ ID NO: 4461756 - DNA, 15 bp, Homo sapiens
ggctggcacagcccc

SEQ ID NO: 4461757 - DNA, 12 bp, Homo sapiens
ggctggcccagc

SEQ ID NO: 4461758 - DNA, 13 bp, Homo sapiens
ggctggcccagcc

SEQ ID NO: 4461759 - DNA, 14 bp, Homo sapiens
ggctggcccagccc

SEQ ID NO: 4461760 - DNA, 19 bp, Homo sapiens
ggctggcccagccctgctg

SEQ ID NO: 4461761 - DNA, 20 bp, Homo sapiens
ggctggcccagccctgctgg

SEQ ID NO: 4461762 - DNA, 19 bp, Homo sapiens
ggctggcgcttggatctgg

SEQ ID NO: 4461763 - DNA, 17 bp, Homo sapiens
ggctggctaactggaag

SEQ ID NO: 4461764 - DNA, 17 bp, Homo sapiens
ggctggctcctagggga

SEQ ID NO: 4461765 - DNA, 15 bp, Homo sapiens
ggctggctggcctca

SEQ ID NO: 4461766 - DNA, 19 bp, Homo sapiens
ggctgggcaaggaaaaaga

SEQ ID NO: 4461767 - DNA, 23 bp, Homo sapiens
ggctgggcaaggaaaaagaaaat

SEQ ID NO: 4461768 - DNA, 14 bp, Homo sapiens
ggctgggccaccag

SEQ ID NO: 4461769 - DNA, 18 bp, Homo sapiens
ggctgggccaccagggat

SEQ ID NO: 4461770 - DNA, 21 bp, Homo sapiens
ggctgggccatgtccaaagag

SEQ ID NO: 4461771 - DNA, 13 bp, Homo sapiens
ggctgggcccctg

SEQ ID NO: 4461772 - DNA, 17 bp, Homo sapiens
ggctgggcccctgggat

SEQ ID NO: 4461773 - DNA, 19 bp, Homo sapiens
ggctgggcctcgtgcgccc

SEQ ID NO: 4461774 - DNA, 21 bp, Homo sapiens
ggctggggaggtgctggggga

SEQ ID NO: 4461775 - DNA, 19 bp, Homo sapiens
ggctggggccacctttgtg

SEQ ID NO: 4461776 - DNA, 21 bp, Homo sapiens
ggctggggccccatcttgatc

SEQ ID NO: 4461777 - DNA, 16 bp, Homo sapiens
ggctgggggcaggagg

SEQ ID NO: 4461778 - DNA, 14 bp, Homo sapiens
ggctggggtcacag

SEQ ID NO: 4461779 - DNA, 16 bp, Homo sapiens
ggctggggtcacagag

SEQ ID NO: 4461780 - DNA, 17 bp, Homo sapiens
ggctggggttgccagag

SEQ ID NO: 4461781 - DNA, 20 bp, Homo sapiens
ggctggggttgccagaggcc

SEQ ID NO: 4461782 - DNA, 15 bp, Homo sapiens
ggctggtctgatgga

SEQ ID NO: 4461783 - DNA, 22 bp, Homo sapiens
ggctggtgtgtcatactgtgca

SEQ ID NO: 4461784 - DNA, 22 bp, Homo sapiens
ggctggttcggatttggggtgg

SEQ ID NO: 4461785 - DNA, 15 bp, Homo sapiens
ggctggttgtgggca

SEQ ID NO: 4461786 - DNA, 20 bp, Homo sapiens
ggctgtaactgagagaaaga

SEQ ID NO: 4461787 - DNA, 18 bp, Homo sapiens
ggctgtcagtatgacatt

SEQ ID NO: 4461788 - DNA, 18 bp, Homo sapiens
ggctgtcctaccatcagc

SEQ ID NO: 4461789 - DNA, 23 bp, Homo sapiens
ggctgtcctaccatcagctctgc

SEQ ID NO: 4461790 - DNA, 16 bp, Homo sapiens
ggctgtgctgggagaa

SEQ ID NO: 4461791 - DNA, 23 bp, Homo sapiens
ggctgtggcatccagagtccctg

SEQ ID NO: 4461792 - DNA, 21 bp, Homo sapiens
ggctgtggccgtctcctccct

SEQ ID NO: 4461793 - DNA, 20 bp, Homo sapiens
ggctgtgttatgaaaatata

SEQ ID NO: 4461794 - DNA, 16 bp, Homo sapiens
ggctgttaggacagca

SEQ ID NO: 4461795 - DNA, 13 bp, Homo sapiens
ggctgttccagac

SEQ ID NO: 4461796 - DNA, 13 bp, Homo sapiens
ggctgttccatgt

SEQ ID NO: 4461797 - DNA, 19 bp, Homo sapiens
ggctgttcctcccctgtag

SEQ ID NO: 4461798 - DNA, 21 bp, Homo sapiens
ggctgttcctcccctgtaggg

SEQ ID NO: 4461799 - DNA, 14 bp, Homo sapiens
ggctgttctcagcg

SEQ ID NO: 4461800 - DNA, 17 bp, Homo sapiens
ggctgttctcagcgttt

SEQ ID NO: 4461801 - DNA, 14 bp, Homo sapiens
ggctgttctgtagc

SEQ ID NO: 4461802 - DNA, 18 bp, Homo sapiens
ggctgttttccctctgct

SEQ ID NO: 4461803 - DNA, 20 bp, Homo sapiens
ggctgttttccctctgctgc

SEQ ID NO: 4461804 - DNA, 15 bp, Homo sapiens
ggcttaaggagagga

SEQ ID NO: 4461805 - DNA, 15 bp, Homo sapiens
ggcttaattgttctg

SEQ ID NO: 4461806 - DNA, 13 bp, Homo sapiens
ggcttacaggagc

SEQ ID NO: 4461807 - DNA, 18 bp, Homo sapiens
ggcttcaggttgcattgg

SEQ ID NO: 4461808 - DNA, 15 bp, Homo sapiens
ggcttccctggcctc

SEQ ID NO: 4461809 - DNA, 21 bp, Homo sapiens
ggcttcctctagaagccaagg

SEQ ID NO: 4461810 - DNA, 18 bp, Homo sapiens
ggcttcggagtgaatgtg

SEQ ID NO: 4461811 - DNA, 12 bp, Homo sapiens
ggcttctcctgt

SEQ ID NO: 4461812 - DNA, 19 bp, Homo sapiens
ggcttctgcggggctgaga

SEQ ID NO: 4461813 - DNA, 12 bp, Homo sapiens
ggcttctgtggg

SEQ ID NO: 4461814 - DNA, 15 bp, Homo sapiens
ggcttctgtttctag

SEQ ID NO: 4461815 - DNA, 20 bp, Homo sapiens
ggcttcttcagatcagtgct

SEQ ID NO: 4461816 - DNA, 18 bp, Homo sapiens
ggcttcttttctttgtat

SEQ ID NO: 4461817 - DNA, 13 bp, Homo sapiens
ggcttgaagccaa

SEQ ID NO: 4461818 - DNA, 16 bp, Homo sapiens
ggcttgaagccaaaga

SEQ ID NO: 4461819 - DNA, 15 bp, Homo sapiens
ggcttgaaggccagc

SEQ ID NO: 4461820 - DNA, 19 bp, Homo sapiens
ggcttgagtgagaagagct

SEQ ID NO: 4461821 - DNA, 17 bp, Homo sapiens
ggcttggatttcgtgtg

SEQ ID NO: 4461822 - DNA, 12 bp, Homo sapiens
ggcttgggcctg

SEQ ID NO: 4461823 - DNA, 16 bp, Homo sapiens
ggcttggggtgtgggg

SEQ ID NO: 4461824 - DNA, 14 bp, Homo sapiens
ggcttggtgtctgc

SEQ ID NO: 4461825 - DNA, 17 bp, Homo sapiens
ggcttgtttttcttcag

SEQ ID NO: 4461826 - DNA, 18 bp, Homo sapiens
ggcttgtttttcttcagc

SEQ ID NO: 4461827 - DNA, 21 bp, Homo sapiens
ggctttctaccacacacagcc

SEQ ID NO: 4461828 - DNA, 21 bp, Homo sapiens
ggctttgaaacctcagggctg

SEQ ID NO: 4461829 - DNA, 13 bp, Homo sapiens
ggctttgcctctt

SEQ ID NO: 4461830 - DNA, 17 bp, Homo sapiens
ggctttggcactctctg

SEQ ID NO: 4461831 - DNA, 12 bp, Homo sapiens
ggctttggccca

SEQ ID NO: 4461832 - DNA, 19 bp, Homo sapiens
ggcttttcgcttgcttctg

SEQ ID NO: 4461833 - DNA, 12 bp, Homo sapiens
ggctttttgaaa

SEQ ID NO: 4461834 - DNA, 17 bp, Homo sapiens
ggctttttttttctctt

SEQ ID NO: 4461835 - DNA, 19 bp, Homo sapiens
gggaaaaagaccaggtcta

SEQ ID NO: 4461836 - DNA, 10 bp, Homo sapiens
gggaaaacag

SEQ ID NO: 4461837 - DNA, 16 bp, Homo sapiens
gggaaacaatgaaaac

SEQ ID NO: 4461838 - DNA, 15 bp, Homo sapiens
gggaaactgggaaac

SEQ ID NO: 4461839 - DNA, 21 bp, Homo sapiens
gggaaatagcggccctggagg

SEQ ID NO: 4461840 - DNA, 23 bp, Homo sapiens
gggaaattgtaaatcctgtgttt

SEQ ID NO: 4461841 - DNA, 14 bp, Homo sapiens
gggaacagacagga

SEQ ID NO: 4461842 - DNA, 18 bp, Homo sapiens
gggaacagacaggagaaa

SEQ ID NO: 4461843 - DNA, 13 bp, Homo sapiens
gggaactcctgga

SEQ ID NO: 4461844 - DNA, 20 bp, Homo sapiens
gggaactgcagacctgtcct

SEQ ID NO: 4461845 - DNA, 15 bp, Homo sapiens
gggaagagaagacaa

SEQ ID NO: 4461846 - DNA, 23 bp, Homo sapiens
gggaagagaagagggcccagccc

SEQ ID NO: 4461847 - DNA, 21 bp, Homo sapiens
gggaagagtgactctccaggg

SEQ ID NO: 4461848 - DNA, 14 bp, Homo sapiens
gggaagcctgggtg

SEQ ID NO: 4461849 - DNA, 22 bp, Homo sapiens
gggaagctcacacatcctgtca

SEQ ID NO: 4461850 - DNA, 13 bp, Homo sapiens
gggaagctggctt

SEQ ID NO: 4461851 - DNA, 14 bp, Homo sapiens
gggaagctggcttt

SEQ ID NO: 4461852 - DNA, 20 bp, Homo sapiens
gggaagcttctgtctccagc

SEQ ID NO: 4461853 - DNA, 15 bp, Homo sapiens
gggaaggccctgagg

SEQ ID NO: 4461854 - DNA, 16 bp, Homo sapiens
gggaaggccctgaggc

SEQ ID NO: 4461855 - DNA, 18 bp, Homo sapiens
gggaaggccctgaggcgg

SEQ ID NO: 4461856 - DNA, 15 bp, Homo sapiens
gggaaggcctgactt

SEQ ID NO: 4461857 - DNA, 19 bp, Homo sapiens
gggaaggtcaccagcacca

SEQ ID NO: 4461858 - DNA, 15 bp, Homo sapiens
gggaagtagtccttg

SEQ ID NO: 4461859 - DNA, 21 bp, Homo sapiens
gggaatggaagagaaaagaca

SEQ ID NO: 4461860 - DNA, 12 bp, Homo sapiens
gggaatgggaga

SEQ ID NO: 4461861 - DNA, 18 bp, Homo sapiens
gggaattccctccccctc

SEQ ID NO: 4461862 - DNA, 14 bp, Homo sapiens
gggacaaagaaatc

SEQ ID NO: 4461863 - DNA, 17 bp, Homo sapiens
gggacaccagagctgcc

SEQ ID NO: 4461864 - DNA, 14 bp, Homo sapiens
gggacacctaggct

SEQ ID NO: 4461865 - DNA, 22 bp, Homo sapiens
gggacacctaggctagggtggg

SEQ ID NO: 4461866 - DNA, 14 bp, Homo sapiens
gggacagctgtgcc

SEQ ID NO: 4461867 - DNA, 23 bp, Homo sapiens
gggacaggtgacagtggctgctc

SEQ ID NO: 4461868 - DNA, 19 bp, Homo sapiens
gggaccaggtttgcaggag

SEQ ID NO: 4461869 - DNA, 22 bp, Homo sapiens
gggaccatcactgagagtcagg

SEQ ID NO: 4461870 - DNA, 22 bp, Homo sapiens
gggacccccaacattctgccct

SEQ ID NO: 4461871 - DNA, 19 bp, Homo sapiens
gggacccctcgccccagcc

SEQ ID NO: 4461872 - DNA, 20 bp, Homo sapiens
gggaccctgcccagagctga

SEQ ID NO: 4461873 - DNA, 13 bp, Homo sapiens
gggaccctggggc

SEQ ID NO: 4461874 - DNA, 22 bp, Homo sapiens
gggaccctgtccggcccagtgc

SEQ ID NO: 4461875 - DNA, 20 bp, Homo sapiens
gggaccggtgctgcaggagt

SEQ ID NO: 4461876 - DNA, 19 bp, Homo sapiens
gggacctgccaggcagggg

SEQ ID NO: 4461877 - DNA, 13 bp, Homo sapiens
gggaccttttggg

SEQ ID NO: 4461878 - DNA, 22 bp, Homo sapiens
gggacgtttttcttcttgggcc

SEQ ID NO: 4461879 - DNA, 20 bp, Homo sapiens
gggactacaggctcatgcca

SEQ ID NO: 4461880 - DNA, 18 bp, Homo sapiens
gggactcagcgtcccctg

SEQ ID NO: 4461881 - DNA, 18 bp, Homo sapiens
gggactccggctgtgctg

SEQ ID NO: 4461882 - DNA, 19 bp, Homo sapiens
gggactccggctgtgctgg

SEQ ID NO: 4461883 - DNA, 13 bp, Homo sapiens
gggactctcctcc

SEQ ID NO: 4461884 - DNA, 16 bp, Homo sapiens
gggactgctaaataaa

SEQ ID NO: 4461885 - DNA, 14 bp, Homo sapiens
gggactgtgcctgg

SEQ ID NO: 4461886 - DNA, 15 bp, Homo sapiens
gggactgtgcctggc

SEQ ID NO: 4461887 - DNA, 21 bp, Homo sapiens
gggactgtgcctggctccctg

SEQ ID NO: 4461888 - DNA, 10 bp, Homo sapiens
gggagaaaac

SEQ ID NO: 4461889 - DNA, 17 bp, Homo sapiens
gggagaagtagctagta

SEQ ID NO: 4461890 - DNA, 23 bp, Homo sapiens
gggagacagcttctctgcagtaa

SEQ ID NO: 4461891 - DNA, 16 bp, Homo sapiens
gggagactgggctgag

SEQ ID NO: 4461892 - DNA, 20 bp, Homo sapiens
gggagactgggctgagggag

SEQ ID NO: 4461893 - DNA, 13 bp, Homo sapiens
gggagagcctgct

SEQ ID NO: 4461894 - DNA, 16 bp, Homo sapiens
gggagagcctgctggc

SEQ ID NO: 4461895 - DNA, 18 bp, Homo sapiens
gggagagggatttccctg

SEQ ID NO: 4461896 - DNA, 21 bp, Homo sapiens
gggagatgcttctctccttgc

SEQ ID NO: 4461897 - DNA, 15 bp, Homo sapiens
gggagatgggtggga

SEQ ID NO: 4461898 - DNA, 17 bp, Homo sapiens
gggagattaaaaccaga

SEQ ID NO: 4461899 - DNA, 19 bp, Homo sapiens
gggagccacttctccccag

SEQ ID NO: 4461900 - DNA, 15 bp, Homo sapiens
gggagccagactgtc

SEQ ID NO: 4461901 - DNA, 18 bp, Homo sapiens
gggagccagactgtccag

SEQ ID NO: 4461902 - DNA, 21 bp, Homo sapiens
gggagcctagctcctgccaca

SEQ ID NO: 4461903 - DNA, 23 bp, Homo sapiens
gggagcctccccatctgtccagc

SEQ ID NO: 4461904 - DNA, 13 bp, Homo sapiens
gggagcctccccc

SEQ ID NO: 4461905 - DNA, 20 bp, Homo sapiens
gggagctcctctcctggagg

SEQ ID NO: 4461906 - DNA, 12 bp, Homo sapiens
gggagctgccaa

SEQ ID NO: 4461907 - DNA, 12 bp, Homo sapiens
gggagctgggcc

SEQ ID NO: 4461908 - DNA, 18 bp, Homo sapiens
gggagctgggccctgcct

SEQ ID NO: 4461909 - DNA, 16 bp, Homo sapiens
gggaggaaaagaaaag

SEQ ID NO: 4461910 - DNA, 12 bp, Homo sapiens
gggaggacaggc

SEQ ID NO: 4461911 - DNA, 16 bp, Homo sapiens
gggaggacaggcaggc

SEQ ID NO: 4461912 - DNA, 14 bp, Homo sapiens
gggaggagggagag

SEQ ID NO: 4461913 - DNA, 17 bp, Homo sapiens
gggaggagggagaggga

SEQ ID NO: 4461914 - DNA, 18 bp, Homo sapiens
gggaggagggagagggag

SEQ ID NO: 4461915 - DNA, 20 bp, Homo sapiens
gggaggcagaggttgcagtg

SEQ ID NO: 4461916 - DNA, 14 bp, Homo sapiens
gggaggcagccaca

SEQ ID NO: 4461917 - DNA, 14 bp, Homo sapiens
gggaggcaggtgga

SEQ ID NO: 4461918 - DNA, 20 bp, Homo sapiens
gggaggctcccggggcctgg

SEQ ID NO: 4461919 - DNA, 23 bp, Homo sapiens
gggaggctcccggggcctggaca

SEQ ID NO: 4461920 - DNA, 14 bp, Homo sapiens
gggaggctggggcc

SEQ ID NO: 4461921 - DNA, 16 bp, Homo sapiens
gggagggatcagcccc

SEQ ID NO: 4461922 - DNA, 11 bp, Homo sapiens
gggagggcagg

SEQ ID NO: 4461923 - DNA, 14 bp, Homo sapiens
gggagggctgcgac

SEQ ID NO: 4461924 - DNA, 16 bp, Homo sapiens
gggaggtcgaggtagg

SEQ ID NO: 4461925 - DNA, 18 bp, Homo sapiens
gggagtaaacggcccagg

SEQ ID NO: 4461926 - DNA, 17 bp, Homo sapiens
gggagtaattctgtcat

SEQ ID NO: 4461927 - DNA, 14 bp, Homo sapiens
gggagtagccaagc

SEQ ID NO: 4461928 - DNA, 19 bp, Homo sapiens
gggagtcagggacctgctg

SEQ ID NO: 4461929 - DNA, 20 bp, Homo sapiens
gggagtcagggacctgctgc

SEQ ID NO: 4461930 - DNA, 17 bp, Homo sapiens
gggagtgcagacaccta

SEQ ID NO: 4461931 - DNA, 19 bp, Homo sapiens
gggagtggggcctttgcca

SEQ ID NO: 4461932 - DNA, 20 bp, Homo sapiens
gggagtttaatacaggaaat

SEQ ID NO: 4461933 - DNA, 16 bp, Homo sapiens
gggagtttagggtggg

SEQ ID NO: 4461934 - DNA, 12 bp, Homo sapiens
gggatacagctg

SEQ ID NO: 4461935 - DNA, 13 bp, Homo sapiens
gggatacagctga

SEQ ID NO: 4461936 - DNA, 13 bp, Homo sapiens
gggatagatgtgt

SEQ ID NO: 4461937 - DNA, 14 bp, Homo sapiens
gggatatggctgcc

SEQ ID NO: 4461938 - DNA, 15 bp, Homo sapiens
gggatcagccccgcc

SEQ ID NO: 4461939 - DNA, 18 bp, Homo sapiens
gggatcatcatgcagctc

SEQ ID NO: 4461940 - DNA, 18 bp, Homo sapiens
gggatccacgctgggcct

SEQ ID NO: 4461941 - DNA, 19 bp, Homo sapiens
gggatcctccacagagagg

SEQ ID NO: 4461942 - DNA, 14 bp, Homo sapiens
gggatcctgcctgc

SEQ ID NO: 4461943 - DNA, 18 bp, Homo sapiens
gggatcgatgtgctcagc

SEQ ID NO: 4461944 - DNA, 23 bp, Homo sapiens
gggatcttcccacaggagggcca

SEQ ID NO: 4461945 - DNA, 16 bp, Homo sapiens
gggatgctgggctggg

SEQ ID NO: 4461946 - DNA, 17 bp, Homo sapiens
gggatgctgggctgggc

SEQ ID NO: 4461947 - DNA, 16 bp, Homo sapiens
gggatgggcagcccaa

SEQ ID NO: 4461948 - DNA, 14 bp, Homo sapiens
gggatgggccaggg

SEQ ID NO: 4461949 - DNA, 20 bp, Homo sapiens
gggatgggggatgggccagg

SEQ ID NO: 4461950 - DNA, 14 bp, Homo sapiens
gggattaagaaacc

SEQ ID NO: 4461951 - DNA, 13 bp, Homo sapiens
gggatttctggga

SEQ ID NO: 4461952 - DNA, 18 bp, Homo sapiens
gggcaaccaactgcccca

SEQ ID NO: 4461953 - DNA, 14 bp, Homo sapiens
gggcaaggaaaaag

SEQ ID NO: 4461954 - DNA, 18 bp, Homo sapiens
gggcaatttagaaaaaga

SEQ ID NO: 4461955 - DNA, 15 bp, Homo sapiens
gggcacaaagatgga

SEQ ID NO: 4461956 - DNA, 23 bp, Homo sapiens
gggcacaagctcaggtcctgctg

SEQ ID NO: 4461957 - DNA, 13 bp, Homo sapiens
gggcacagtccag

SEQ ID NO: 4461958 - DNA, 14 bp, Homo sapiens
gggcacagtccaga

SEQ ID NO: 4461959 - DNA, 20 bp, Homo sapiens
gggcacggcgggatcctcca

SEQ ID NO: 4461960 - DNA, 16 bp, Homo sapiens
gggcactgccagccca

SEQ ID NO: 4461961 - DNA, 19 bp, Homo sapiens
gggcactgccagcccaccc

SEQ ID NO: 4461962 - DNA, 22 bp, Homo sapiens
gggcactgccagcccaccccct

SEQ ID NO: 4461963 - DNA, 17 bp, Homo sapiens
gggcacttgatatttat

SEQ ID NO: 4461964 - DNA, 19 bp, Homo sapiens
gggcagaggaagcccagcc

SEQ ID NO: 4461965 - DNA, 14 bp, Homo sapiens
gggcagagggcaga

SEQ ID NO: 4461966 - DNA, 13 bp, Homo sapiens
gggcagagggctg

SEQ ID NO: 4461967 - DNA, 17 bp, Homo sapiens
gggcagcaccctccccc

SEQ ID NO: 4461968 - DNA, 18 bp, Homo sapiens
gggcagcaccctcccccg

SEQ ID NO: 4461969 - DNA, 22 bp, Homo sapiens
gggcagccacccaagcctgctg

SEQ ID NO: 4461970 - DNA, 13 bp, Homo sapiens
gggcagccagcag

SEQ ID NO: 4461971 - DNA, 16 bp, Homo sapiens
gggcagccaggagtgc

SEQ ID NO: 4461972 - DNA, 18 bp, Homo sapiens
gggcaggaaggagagcct

SEQ ID NO: 4461973 - DNA, 12 bp, Homo sapiens
gggcaggctggg

SEQ ID NO: 4461974 - DNA, 17 bp, Homo sapiens
gggcagggcgagctgca

SEQ ID NO: 4461975 - DNA, 21 bp, Homo sapiens
gggcagggcgagctgcaggaa

SEQ ID NO: 4461976 - DNA, 16 bp, Homo sapiens
gggcaggtcctgccca

SEQ ID NO: 4461977 - DNA, 18 bp, Homo sapiens
gggcagtctgagagaggc

SEQ ID NO: 4461978 - DNA, 20 bp, Homo sapiens
gggcagtctgagagaggcca

SEQ ID NO: 4461979 - DNA, 16 bp, Homo sapiens
gggcagtctgctctgc

SEQ ID NO: 4461980 - DNA, 18 bp, Homo sapiens
gggcagtctgctctgctg

SEQ ID NO: 4461981 - DNA, 15 bp, Homo sapiens
gggcagtgccccagg

SEQ ID NO: 4461982 - DNA, 17 bp, Homo sapiens
gggcatctcttccccag

SEQ ID NO: 4461983 - DNA, 22 bp, Homo sapiens
gggcatctgagtccagctcccc

SEQ ID NO: 4461984 - DNA, 20 bp, Homo sapiens
gggcatctgcccctccccca

SEQ ID NO: 4461985 - DNA, 18 bp, Homo sapiens
gggcattgagaatggagg

SEQ ID NO: 4461986 - DNA, 15 bp, Homo sapiens
gggcatttggtgaga

SEQ ID NO: 4461987 - DNA, 13 bp, Homo sapiens
gggcattttcctc

SEQ ID NO: 4461988 - DNA, 18 bp, Homo sapiens
gggcattttcctcctctg

SEQ ID NO: 4461989 - DNA, 15 bp, Homo sapiens
gggccaaacgctgag

SEQ ID NO: 4461990 - DNA, 17 bp, Homo sapiens
gggccaaacgctgagcc

SEQ ID NO: 4461991 - DNA, 18 bp, Homo sapiens
gggccaattttggatgag

SEQ ID NO: 4461992 - DNA, 18 bp, Homo sapiens
gggccacacccaggaagg

SEQ ID NO: 4461993 - DNA, 17 bp, Homo sapiens
gggccacgccggccaca

SEQ ID NO: 4461994 - DNA, 16 bp, Homo sapiens
gggccacgctccagct

SEQ ID NO: 4461995 - DNA, 22 bp, Homo sapiens
gggccacttctgggtggggcag

SEQ ID NO: 4461996 - DNA, 16 bp, Homo sapiens
gggccagaggctggga

SEQ ID NO: 4461997 - DNA, 22 bp, Homo sapiens
gggccagcggggctgctcaccc

SEQ ID NO: 4461998 - DNA, 15 bp, Homo sapiens
gggccaggaggctgc

SEQ ID NO: 4461999 - DNA, 16 bp, Homo sapiens
gggccaggcctctgct

SEQ ID NO: 4462000 - DNA, 17 bp, Homo sapiens
gggccaggcctctgctg

SEQ ID NO: 4462001 - DNA, 11 bp, Homo sapiens
gggccagggag

SEQ ID NO: 4462002 - DNA, 19 bp, Homo sapiens
gggccagtcctgcctggcc

SEQ ID NO: 4462003 - DNA, 21 bp, Homo sapiens
gggccatgtccaaagaggctg

SEQ ID NO: 4462004 - DNA, 23 bp, Homo sapiens
gggccatgtccaaagaggctgcc

SEQ ID NO: 4462005 - DNA, 14 bp, Homo sapiens
gggcccaaccctgt

SEQ ID NO: 4462006 - DNA, 18 bp, Homo sapiens
gggcccaaggcggcccct

SEQ ID NO: 4462007 - DNA, 13 bp, Homo sapiens
gggcccagcccag

SEQ ID NO: 4462008 - DNA, 16 bp, Homo sapiens
gggcccagcccagagc

SEQ ID NO: 4462009 - DNA, 12 bp, Homo sapiens
gggcccagcccc

SEQ ID NO: 4462010 - DNA, 18 bp, Homo sapiens
gggcccagcccccacagt

SEQ ID NO: 4462011 - DNA, 22 bp, Homo sapiens
gggcccagcccccacagtgctg

SEQ ID NO: 4462012 - DNA, 17 bp, Homo sapiens
gggcccagcctcctctg

SEQ ID NO: 4462013 - DNA, 18 bp, Homo sapiens
gggccccagcccaccctc

SEQ ID NO: 4462014 - DNA, 17 bp, Homo sapiens
gggccccatcttgatct

SEQ ID NO: 4462015 - DNA, 20 bp, Homo sapiens
gggcccccaatgacacccat

SEQ ID NO: 4462016 - DNA, 14 bp, Homo sapiens
gggccccccaactg

SEQ ID NO: 4462017 - DNA, 17 bp, Homo sapiens
gggccccgccagggctg

SEQ ID NO: 4462018 - DNA, 18 bp, Homo sapiens
gggccccgccagggctgg

SEQ ID NO: 4462019 - DNA, 13 bp, Homo sapiens
gggcccctccacg

SEQ ID NO: 4462020 - DNA, 20 bp, Homo sapiens
gggcccctccctacctcaac

SEQ ID NO: 4462021 - DNA, 15 bp, Homo sapiens
gggcccctctctagg

SEQ ID NO: 4462022 - DNA, 14 bp, Homo sapiens
gggcccctgggatg

SEQ ID NO: 4462023 - DNA, 14 bp, Homo sapiens
gggcccctgggctt

SEQ ID NO: 4462024 - DNA, 23 bp, Homo sapiens
gggcccctgggcttggcctgctg

SEQ ID NO: 4462025 - DNA, 16 bp, Homo sapiens
gggcccggtccacagg

SEQ ID NO: 4462026 - DNA, 20 bp, Homo sapiens
gggcccggtccacaggtcca

SEQ ID NO: 4462027 - DNA, 17 bp, Homo sapiens
gggccctctctctgggc

SEQ ID NO: 4462028 - DNA, 16 bp, Homo sapiens
gggccctctctgctct

SEQ ID NO: 4462029 - DNA, 13 bp, Homo sapiens
gggccctctttcc

SEQ ID NO: 4462030 - DNA, 17 bp, Homo sapiens
gggccctctttccctgc

SEQ ID NO: 4462031 - DNA, 18 bp, Homo sapiens
gggccctctttccctgcg

SEQ ID NO: 4462032 - DNA, 12 bp, Homo sapiens
gggccctgcctg

SEQ ID NO: 4462033 - DNA, 21 bp, Homo sapiens
gggccgggcaggtcctgccca

SEQ ID NO: 4462034 - DNA, 20 bp, Homo sapiens
gggccgggcgcggtggctca

SEQ ID NO: 4462035 - DNA, 19 bp, Homo sapiens
gggccggttctaaggctca

SEQ ID NO: 4462036 - DNA, 23 bp, Homo sapiens
gggcctagcgatctctcctggcc

SEQ ID NO: 4462037 - DNA, 23 bp, Homo sapiens
gggcctcccataattgctttgcc

SEQ ID NO: 4462038 - DNA, 19 bp, Homo sapiens
gggcctccctggcactgaa

SEQ ID NO: 4462039 - DNA, 23 bp, Homo sapiens
gggcctcggaccccactccggcc

SEQ ID NO: 4462040 - DNA, 18 bp, Homo sapiens
gggcctgacttgagccac

SEQ ID NO: 4462041 - DNA, 20 bp, Homo sapiens
gggcctgacttgagccactc

SEQ ID NO: 4462042 - DNA, 18 bp, Homo sapiens
gggcctggacaggcgggc

SEQ ID NO: 4462043 - DNA, 17 bp, Homo sapiens
gggcctgggcaggaggg

SEQ ID NO: 4462044 - DNA, 16 bp, Homo sapiens
gggcctttgccagcag

SEQ ID NO: 4462045 - DNA, 17 bp, Homo sapiens
gggcctttgccagcaga

SEQ ID NO: 4462046 - DNA, 21 bp, Homo sapiens
gggcctttgccagcagagcca

SEQ ID NO: 4462047 - DNA, 16 bp, Homo sapiens
gggcgcaccccacagc

SEQ ID NO: 4462048 - DNA, 19 bp, Homo sapiens
gggcgcaccccacagctgg

SEQ ID NO: 4462049 - DNA, 20 bp, Homo sapiens
gggcgcccacccggcccggc

SEQ ID NO: 4462050 - DNA, 16 bp, Homo sapiens
gggcgcggtggctcac

SEQ ID NO: 4462051 - DNA, 14 bp, Homo sapiens
gggcggctcctggt

SEQ ID NO: 4462052 - DNA, 16 bp, Homo sapiens
gggcggctcctggtgc

SEQ ID NO: 4462053 - DNA, 17 bp, Homo sapiens
gggcgggcagagggctg

SEQ ID NO: 4462054 - DNA, 12 bp, Homo sapiens
gggcgggctcag

SEQ ID NO: 4462055 - DNA, 15 bp, Homo sapiens
gggcgggctcagagc

SEQ ID NO: 4462056 - DNA, 17 bp, Homo sapiens
gggcgggctcagagctt

SEQ ID NO: 4462057 - DNA, 22 bp, Homo sapiens
gggcgggctcagagctttgtca

SEQ ID NO: 4462058 - DNA, 16 bp, Homo sapiens
gggcgtgactcaccca

SEQ ID NO: 4462059 - DNA, 15 bp, Homo sapiens
gggcgtgaggaactc

SEQ ID NO: 4462060 - DNA, 18 bp, Homo sapiens
gggcgttctcccaaagat

SEQ ID NO: 4462061 - DNA, 14 bp, Homo sapiens
gggcgttgggagcc

SEQ ID NO: 4462062 - DNA, 18 bp, Homo sapiens
gggcgttgggagcctagc

SEQ ID NO: 4462063 - DNA, 18 bp, Homo sapiens
gggctaaaaaggtcctgt

SEQ ID NO: 4462064 - DNA, 23 bp, Homo sapiens
gggctaagagctagcgctgccgc

SEQ ID NO: 4462065 - DNA, 20 bp, Homo sapiens
gggctaattctgggaaggga

SEQ ID NO: 4462066 - DNA, 13 bp, Homo sapiens
gggctaatttaac

SEQ ID NO: 4462067 - DNA, 19 bp, Homo sapiens
gggctaccctgagctgagg

SEQ ID NO: 4462068 - DNA, 22 bp, Homo sapiens
gggctaccctgagctgaggcag

SEQ ID NO: 4462069 - DNA, 17 bp, Homo sapiens
gggctagaacctggaga

SEQ ID NO: 4462070 - DNA, 19 bp, Homo sapiens
gggctcaagcaatcctcct

SEQ ID NO: 4462071 - DNA, 21 bp, Homo sapiens
gggctcaagcaatcctcctgc

SEQ ID NO: 4462072 - DNA, 21 bp, Homo sapiens
gggctcagagctttgtcactt

SEQ ID NO: 4462073 - DNA, 18 bp, Homo sapiens
gggctcagagtggggtag

SEQ ID NO: 4462074 - DNA, 16 bp, Homo sapiens
gggctcagggcctcag

SEQ ID NO: 4462075 - DNA, 18 bp, Homo sapiens
gggctccagcaccttctt

SEQ ID NO: 4462076 - DNA, 23 bp, Homo sapiens
gggctcccagctcctttctcctg

SEQ ID NO: 4462077 - DNA, 22 bp, Homo sapiens
gggctccctaaactttggcctt

SEQ ID NO: 4462078 - DNA, 13 bp, Homo sapiens
gggctcctgccca

SEQ ID NO: 4462079 - DNA, 15 bp, Homo sapiens
gggctcctgcccagg

SEQ ID NO: 4462080 - DNA, 16 bp, Homo sapiens
gggctcctgcccaggc

SEQ ID NO: 4462081 - DNA, 19 bp, Homo sapiens
gggctcctgcccaggccac

SEQ ID NO: 4462082 - DNA, 22 bp, Homo sapiens
gggctcctgcccaggccacaga

SEQ ID NO: 4462083 - DNA, 22 bp, Homo sapiens
gggctctcatggtacttcctct

SEQ ID NO: 4462084 - DNA, 19 bp, Homo sapiens
gggctctctgctgtacata

SEQ ID NO: 4462085 - DNA, 12 bp, Homo sapiens
gggctcttctca

SEQ ID NO: 4462086 - DNA, 15 bp, Homo sapiens
gggctgaatgtatgt

SEQ ID NO: 4462087 - DNA, 20 bp, Homo sapiens
gggctgactagaagggccag

SEQ ID NO: 4462088 - DNA, 17 bp, Homo sapiens
gggctgagaggatgaac

SEQ ID NO: 4462089 - DNA, 16 bp, Homo sapiens
gggctgagctgcctgt

SEQ ID NO: 4462090 - DNA, 13 bp, Homo sapiens
gggctgagggagc

SEQ ID NO: 4462091 - DNA, 14 bp, Homo sapiens
gggctgagggagcc

SEQ ID NO: 4462092 - DNA, 21 bp, Homo sapiens
gggctgatggattccaaacca

SEQ ID NO: 4462093 - DNA, 22 bp, Homo sapiens
gggctgcagggccactggaagg

SEQ ID NO: 4462094 - DNA, 17 bp, Homo sapiens
gggctgccttctggcct

SEQ ID NO: 4462095 - DNA, 22 bp, Homo sapiens
gggctgctcccacctggctctg

SEQ ID NO: 4462096 - DNA, 16 bp, Homo sapiens
gggctgctcctccagg

SEQ ID NO: 4462097 - DNA, 12 bp, Homo sapiens
gggctgctgtga

SEQ ID NO: 4462098 - DNA, 21 bp, Homo sapiens
gggctggaatctggagagcta

SEQ ID NO: 4462099 - DNA, 16 bp, Homo sapiens
gggctggaggcccagg

SEQ ID NO: 4462100 - DNA, 14 bp, Homo sapiens
gggctggcccagcc

SEQ ID NO: 4462101 - DNA, 17 bp, Homo sapiens
gggctggcccagccctg

SEQ ID NO: 4462102 - DNA, 21 bp, Homo sapiens
gggctggccgggactgctgct

SEQ ID NO: 4462103 - DNA, 17 bp, Homo sapiens
gggctggcgcttggatc

SEQ ID NO: 4462104 - DNA, 22 bp, Homo sapiens
gggctggcgcttggatctgggg

SEQ ID NO: 4462105 - DNA, 22 bp, Homo sapiens
gggctggctccccctccccagg

SEQ ID NO: 4462106 - DNA, 21 bp, Homo sapiens
gggctgggcaaggaaaaagaa

SEQ ID NO: 4462107 - DNA, 15 bp, Homo sapiens
gggctgggccaccag

SEQ ID NO: 4462108 - DNA, 11 bp, Homo sapiens
gggctgggccc

SEQ ID NO: 4462109 - DNA, 18 bp, Homo sapiens
gggctgggcccctccagg

SEQ ID NO: 4462110 - DNA, 23 bp, Homo sapiens
gggctgggccctctttccctgcg

SEQ ID NO: 4462111 - DNA, 13 bp, Homo sapiens
gggctggggccac

SEQ ID NO: 4462112 - DNA, 15 bp, Homo sapiens
gggctggggccacct

SEQ ID NO: 4462113 - DNA, 22 bp, Homo sapiens
gggctggggttgccagaggccc

SEQ ID NO: 4462114 - DNA, 14 bp, Homo sapiens
gggctgggtgctgg

SEQ ID NO: 4462115 - DNA, 16 bp, Homo sapiens
gggctgtcccagcccc

SEQ ID NO: 4462116 - DNA, 22 bp, Homo sapiens
gggctgtgcacccagaagaaga

SEQ ID NO: 4462117 - DNA, 21 bp, Homo sapiens
gggctgtgtcctaaggcccat

SEQ ID NO: 4462118 - DNA, 20 bp, Homo sapiens
gggcttaaagcagaagcccc

SEQ ID NO: 4462119 - DNA, 21 bp, Homo sapiens
gggcttatatgtacttttatt

SEQ ID NO: 4462120 - DNA, 17 bp, Homo sapiens
gggcttcacagccacac

SEQ ID NO: 4462121 - DNA, 15 bp, Homo sapiens
gggcttccctggcct

SEQ ID NO: 4462122 - DNA, 12 bp, Homo sapiens
gggcttcctgcc

SEQ ID NO: 4462123 - DNA, 14 bp, Homo sapiens
gggcttcctgccct

SEQ ID NO: 4462124 - DNA, 19 bp, Homo sapiens
gggcttcctgcccttccct

SEQ ID NO: 4462125 - DNA, 23 bp, Homo sapiens
gggcttcctgcccttccctctgg

SEQ ID NO: 4462126 - DNA, 16 bp, Homo sapiens
gggcttgagtgagaag

SEQ ID NO: 4462127 - DNA, 16 bp, Homo sapiens
gggcttggatttcgtg

SEQ ID NO: 4462128 - DNA, 13 bp, Homo sapiens
gggcttggcctgc

SEQ ID NO: 4462129 - DNA, 14 bp, Homo sapiens
gggcttgggcctgc

SEQ ID NO: 4462130 - DNA, 19 bp, Homo sapiens
gggcttgtttttcttcagc

SEQ ID NO: 4462131 - DNA, 15 bp, Homo sapiens
gggctttctggggcc

SEQ ID NO: 4462132 - DNA, 15 bp, Homo sapiens
ggggaaaattatttt

SEQ ID NO: 4462133 - DNA, 21 bp, Homo sapiens
ggggaaatcaaggatgctcag

SEQ ID NO: 4462134 - DNA, 18 bp, Homo sapiens
ggggaatgctcccagctg

SEQ ID NO: 4462135 - DNA, 15 bp, Homo sapiens
ggggaattccctccc

SEQ ID NO: 4462136 - DNA, 22 bp, Homo sapiens
ggggacagaggcctgcccgggc

SEQ ID NO: 4462137 - DNA, 15 bp, Homo sapiens
ggggacagggctggc

SEQ ID NO: 4462138 - DNA, 22 bp, Homo sapiens
ggggacctggtttgaatggaga

SEQ ID NO: 4462139 - DNA, 14 bp, Homo sapiens
ggggacgctgagga

SEQ ID NO: 4462140 - DNA, 23 bp, Homo sapiens
ggggacggggggccccagtcagc

SEQ ID NO: 4462141 - DNA, 14 bp, Homo sapiens
ggggacgttgctga

SEQ ID NO: 4462142 - DNA, 23 bp, Homo sapiens
ggggacgttgctgagccagctgc

SEQ ID NO: 4462143 - DNA, 16 bp, Homo sapiens
ggggactcagccctga

SEQ ID NO: 4462144 - DNA, 15 bp, Homo sapiens
ggggagaaaattaaa

SEQ ID NO: 4462145 - DNA, 17 bp, Homo sapiens
ggggagactgggctgag

SEQ ID NO: 4462146 - DNA, 18 bp, Homo sapiens
ggggagagacaggcagcc

SEQ ID NO: 4462147 - DNA, 23 bp, Homo sapiens
ggggagagacaggcagcccagca

SEQ ID NO: 4462148 - DNA, 18 bp, Homo sapiens
ggggagagcctgctggca

SEQ ID NO: 4462149 - DNA, 16 bp, Homo sapiens
ggggagccctgggttc

SEQ ID NO: 4462150 - DNA, 17 bp, Homo sapiens
ggggaggttgtggggcc

SEQ ID NO: 4462151 - DNA, 17 bp, Homo sapiens
ggggataccataaaaag

SEQ ID NO: 4462152 - DNA, 21 bp, Homo sapiens
ggggatagaggggctgcaggg

SEQ ID NO: 4462153 - DNA, 13 bp, Homo sapiens
ggggatgggccag

SEQ ID NO: 4462154 - DNA, 18 bp, Homo sapiens
ggggattgcccctggctt

SEQ ID NO: 4462155 - DNA, 15 bp, Homo sapiens
ggggcagagcctccc

SEQ ID NO: 4462156 - DNA, 16 bp, Homo sapiens
ggggcagagggcagag

SEQ ID NO: 4462157 - DNA, 22 bp, Homo sapiens
ggggcattgagaatggaggctc

SEQ ID NO: 4462158 - DNA, 21 bp, Homo sapiens
ggggcattgctgactgtgtat

SEQ ID NO: 4462159 - DNA, 16 bp, Homo sapiens
ggggccaaaaggaaaa

SEQ ID NO: 4462160 - DNA, 21 bp, Homo sapiens
ggggccaacctcaggctccta

SEQ ID NO: 4462161 - DNA, 19 bp, Homo sapiens
ggggccacttttgactagg

SEQ ID NO: 4462162 - DNA, 12 bp, Homo sapiens
ggggccagaggc

SEQ ID NO: 4462163 - DNA, 15 bp, Homo sapiens
ggggccagaggctgg

SEQ ID NO: 4462164 - DNA, 14 bp, Homo sapiens
ggggcccagcccct

SEQ ID NO: 4462165 - DNA, 14 bp, Homo sapiens
ggggccccgccagg

SEQ ID NO: 4462166 - DNA, 18 bp, Homo sapiens
ggggccccgccagggctg

SEQ ID NO: 4462167 - DNA, 19 bp, Homo sapiens
ggggccccgccagggctgg

SEQ ID NO: 4462168 - DNA, 16 bp, Homo sapiens
ggggccctgccccacc

SEQ ID NO: 4462169 - DNA, 17 bp, Homo sapiens
ggggccgggcaggtcct

SEQ ID NO: 4462170 - DNA, 23 bp, Homo sapiens
ggggccgggcaggtcctgcccat

SEQ ID NO: 4462171 - DNA, 14 bp, Homo sapiens
ggggcctcaggctc

SEQ ID NO: 4462172 - DNA, 13 bp, Homo sapiens
ggggcctggacag

SEQ ID NO: 4462173 - DNA, 21 bp, Homo sapiens
ggggcctggacaggcgggctc

SEQ ID NO: 4462174 - DNA, 12 bp, Homo sapiens
ggggcctgggca

SEQ ID NO: 4462175 - DNA, 20 bp, Homo sapiens
ggggcgcaccccacagctgg

SEQ ID NO: 4462176 - DNA, 23 bp, Homo sapiens
ggggcgcaccccacagctggggc

SEQ ID NO: 4462177 - DNA, 15 bp, Homo sapiens
ggggcgcggctggga

SEQ ID NO: 4462178 - DNA, 17 bp, Homo sapiens
ggggcgggctcagagct

SEQ ID NO: 4462179 - DNA, 11 bp, Homo sapiens
ggggctaaggc

SEQ ID NO: 4462180 - DNA, 17 bp, Homo sapiens
ggggctcctgcccaggc

SEQ ID NO: 4462181 - DNA, 14 bp, Homo sapiens
ggggctcttctcat

SEQ ID NO: 4462182 - DNA, 18 bp, Homo sapiens
ggggctgagtctccaggg

SEQ ID NO: 4462183 - DNA, 15 bp, Homo sapiens
ggggctgcacctcct

SEQ ID NO: 4462184 - DNA, 19 bp, Homo sapiens
ggggctgcacctcctaccc

SEQ ID NO: 4462185 - DNA, 14 bp, Homo sapiens
ggggctgctcccac

SEQ ID NO: 4462186 - DNA, 17 bp, Homo sapiens
ggggctgtacagtattg

SEQ ID NO: 4462187 - DNA, 18 bp, Homo sapiens
gggggacagggctggccc

SEQ ID NO: 4462188 - DNA, 23 bp, Homo sapiens
gggggacagggctggcccagccc

SEQ ID NO: 4462189 - DNA, 10 bp, Homo sapiens
gggggagccc

SEQ ID NO: 4462190 - DNA, 16 bp, Homo sapiens
gggggagtagccaagc

SEQ ID NO: 4462191 - DNA, 17 bp, Homo sapiens
gggggagtgagacaggc

SEQ ID NO: 4462192 - DNA, 22 bp, Homo sapiens
gggggcacttggaggacctggc

SEQ ID NO: 4462193 - DNA, 13 bp, Homo sapiens
gggggcagagggc

SEQ ID NO: 4462194 - DNA, 14 bp, Homo sapiens
gggggccaaggtcc

SEQ ID NO: 4462195 - DNA, 17 bp, Homo sapiens
gggggccccagtcagcc

SEQ ID NO: 4462196 - DNA, 19 bp, Homo sapiens
gggggccccagtcagcctc

SEQ ID NO: 4462197 - DNA, 21 bp, Homo sapiens
gggggccccagtcagcctctc

SEQ ID NO: 4462198 - DNA, 14 bp, Homo sapiens
gggggccgggcagg

SEQ ID NO: 4462199 - DNA, 13 bp, Homo sapiens
gggggctcctgcc

SEQ ID NO: 4462200 - DNA, 16 bp, Homo sapiens
gggggctcctgcccag

SEQ ID NO: 4462201 - DNA, 14 bp, Homo sapiens
gggggctgctccca

SEQ ID NO: 4462202 - DNA, 15 bp, Homo sapiens
ggggggccaaaagga

SEQ ID NO: 4462203 - DNA, 12 bp, Homo sapiens
ggggggctcctg

SEQ ID NO: 4462204 - DNA, 13 bp, Homo sapiens
gggggtggaggct

SEQ ID NO: 4462205 - DNA, 12 bp, Homo sapiens
gggggtggccat

SEQ ID NO: 4462206 - DNA, 21 bp, Homo sapiens
gggggtgtcttccctgcctgt

SEQ ID NO: 4462207 - DNA, 20 bp, Homo sapiens
ggggtacatttctctgagca

SEQ ID NO: 4462208 - DNA, 15 bp, Homo sapiens
ggggtagttggcaga

SEQ ID NO: 4462209 - DNA, 14 bp, Homo sapiens
ggggtcaaaggaag

SEQ ID NO: 4462210 - DNA, 23 bp, Homo sapiens
ggggtctgtgtgtttatgtgtgt

SEQ ID NO: 4462211 - DNA, 22 bp, Homo sapiens
ggggtctttgtgagagtgagct

SEQ ID NO: 4462212 - DNA, 20 bp, Homo sapiens
ggggtgagagacctgctcag

SEQ ID NO: 4462213 - DNA, 13 bp, Homo sapiens
ggggtgccgcctg

SEQ ID NO: 4462214 - DNA, 20 bp, Homo sapiens
ggggtgccttcactgggcca

SEQ ID NO: 4462215 - DNA, 15 bp, Homo sapiens
ggggtggcccagagc

SEQ ID NO: 4462216 - DNA, 14 bp, Homo sapiens
ggggtggggagatg

SEQ ID NO: 4462217 - DNA, 16 bp, Homo sapiens
ggggttcagcccctcc

SEQ ID NO: 4462218 - DNA, 17 bp, Homo sapiens
ggggttcagcccctcct

SEQ ID NO: 4462219 - DNA, 22 bp, Homo sapiens
ggggttcagcccctcctctgcc

SEQ ID NO: 4462220 - DNA, 14 bp, Homo sapiens
ggggttcaggcccg

SEQ ID NO: 4462221 - DNA, 17 bp, Homo sapiens
gggtaagaaaagctggt

SEQ ID NO: 4462222 - DNA, 13 bp, Homo sapiens
gggtaaggtgcct

SEQ ID NO: 4462223 - DNA, 14 bp, Homo sapiens
gggtaaggtgcctt

SEQ ID NO: 4462224 - DNA, 17 bp, Homo sapiens
gggtaatccctgctttt

SEQ ID NO: 4462225 - DNA, 16 bp, Homo sapiens
gggtacagatccccag

SEQ ID NO: 4462226 - DNA, 21 bp, Homo sapiens
gggtacagatccccagcccct

SEQ ID NO: 4462227 - DNA, 11 bp, Homo sapiens
gggtagaaaaa

SEQ ID NO: 4462228 - DNA, 21 bp, Homo sapiens
gggtagcccgcctgccagtcc

SEQ ID NO: 4462229 - DNA, 18 bp, Homo sapiens
gggtataatgtgtctgtg

SEQ ID NO: 4462230 - DNA, 11 bp, Homo sapiens
gggtcacagag

SEQ ID NO: 4462231 - DNA, 13 bp, Homo sapiens
gggtcacagaggc

SEQ ID NO: 4462232 - DNA, 17 bp, Homo sapiens
gggtcactggcctctcc

SEQ ID NO: 4462233 - DNA, 20 bp, Homo sapiens
gggtcagaaccctgccatgg

SEQ ID NO: 4462234 - DNA, 20 bp, Homo sapiens
gggtcagaggacctgtattt

SEQ ID NO: 4462235 - DNA, 18 bp, Homo sapiens
gggtcattcatggcctgg

SEQ ID NO: 4462236 - DNA, 21 bp, Homo sapiens
gggtccatagagatgagccca

SEQ ID NO: 4462237 - DNA, 22 bp, Homo sapiens
gggtcccaagctgggccccagc

SEQ ID NO: 4462238 - DNA, 23 bp, Homo sapiens
gggtcccaagctgggccccagcc

SEQ ID NO: 4462239 - DNA, 13 bp, Homo sapiens
gggtccctccacc

SEQ ID NO: 4462240 - DNA, 19 bp, Homo sapiens
gggtccctctaacccagtg

SEQ ID NO: 4462241 - DNA, 19 bp, Homo sapiens
gggtccggcctctccctgc

SEQ ID NO: 4462242 - DNA, 20 bp, Homo sapiens
gggtccggcctctccctgcc

SEQ ID NO: 4462243 - DNA, 18 bp, Homo sapiens
gggtcctagcccttccct

SEQ ID NO: 4462244 - DNA, 22 bp, Homo sapiens
gggtccttttgacactgctcta

SEQ ID NO: 4462245 - DNA, 18 bp, Homo sapiens
gggtctccctctcctgcc

SEQ ID NO: 4462246 - DNA, 14 bp, Homo sapiens
gggtctccctggct

SEQ ID NO: 4462247 - DNA, 16 bp, Homo sapiens
gggtctccctggctcc

SEQ ID NO: 4462248 - DNA, 18 bp, Homo sapiens
gggtctccctggctccct

SEQ ID NO: 4462249 - DNA, 22 bp, Homo sapiens
gggtctccctggctccctcctc

SEQ ID NO: 4462250 - DNA, 22 bp, Homo sapiens
gggtctcggatgacaccctggc

SEQ ID NO: 4462251 - DNA, 21 bp, Homo sapiens
gggtctctctcggcccctgtc

SEQ ID NO: 4462252 - DNA, 22 bp, Homo sapiens
gggtctctgaagggaccccccc

SEQ ID NO: 4462253 - DNA, 16 bp, Homo sapiens
gggtctgaggcccctg

SEQ ID NO: 4462254 - DNA, 20 bp, Homo sapiens
gggtctgaggcccctgcctc

SEQ ID NO: 4462255 - DNA, 21 bp, Homo sapiens
gggtctgaggcccctgcctcc

SEQ ID NO: 4462256 - DNA, 23 bp, Homo sapiens
gggtcttccctacctcaggcagg

SEQ ID NO: 4462257 - DNA, 18 bp, Homo sapiens
gggtcttgctctgtcccc

SEQ ID NO: 4462258 - DNA, 20 bp, Homo sapiens
gggtgagagacctgctcagg

SEQ ID NO: 4462259 - DNA, 13 bp, Homo sapiens
gggtgagagagga

SEQ ID NO: 4462260 - DNA, 20 bp, Homo sapiens
gggtgagctctcaggccgag

SEQ ID NO: 4462261 - DNA, 21 bp, Homo sapiens
gggtgagctctcaggccgaga

SEQ ID NO: 4462262 - DNA, 15 bp, Homo sapiens
gggtgcagcttcacc

SEQ ID NO: 4462263 - DNA, 20 bp, Homo sapiens
gggtgcatttgagagaagcc

SEQ ID NO: 4462264 - DNA, 21 bp, Homo sapiens
gggtgcatttgagagaagcca

SEQ ID NO: 4462265 - DNA, 13 bp, Homo sapiens
gggtgccttcact

SEQ ID NO: 4462266 - DNA, 20 bp, Homo sapiens
gggtgccttcactgggccag

SEQ ID NO: 4462267 - DNA, 23 bp, Homo sapiens
gggtgccttcactgggccagtca

SEQ ID NO: 4462268 - DNA, 18 bp, Homo sapiens
gggtgctgggaggaggga

SEQ ID NO: 4462269 - DNA, 18 bp, Homo sapiens
gggtggaaatcctgccct

SEQ ID NO: 4462270 - DNA, 16 bp, Homo sapiens
gggtggaggcttcctg

SEQ ID NO: 4462271 - DNA, 18 bp, Homo sapiens
gggtggatgtgctggagg

SEQ ID NO: 4462272 - DNA, 22 bp, Homo sapiens
gggtggcaggcacacagcagcc

SEQ ID NO: 4462273 - DNA, 23 bp, Homo sapiens
gggtggcaggcacacagcagccc

SEQ ID NO: 4462274 - DNA, 21 bp, Homo sapiens
gggtggccacacaggcagggc

SEQ ID NO: 4462275 - DNA, 24 bp, Homo sapiens
gggtggccacacaggcagggcctg

SEQ ID NO: 4462276 - DNA, 14 bp, Homo sapiens
gggtggcccagagc

SEQ ID NO: 4462277 - DNA, 15 bp, Homo sapiens
gggtggcccagagcc

SEQ ID NO: 4462278 - DNA, 18 bp, Homo sapiens
gggtggcccagagccata

SEQ ID NO: 4462279 - DNA, 12 bp, Homo sapiens
gggtgggaagtg

SEQ ID NO: 4462280 - DNA, 12 bp, Homo sapiens
gggtgggaggga

SEQ ID NO: 4462281 - DNA, 19 bp, Homo sapiens
gggtgggagggaggaggga

SEQ ID NO: 4462282 - DNA, 19 bp, Homo sapiens
gggtgggcctggccctgct

SEQ ID NO: 4462283 - DNA, 13 bp, Homo sapiens
gggtggggagaga

SEQ ID NO: 4462284 - DNA, 18 bp, Homo sapiens
gggtggggagagacgggc

SEQ ID NO: 4462285 - DNA, 14 bp, Homo sapiens
gggtggggctgctc

SEQ ID NO: 4462286 - DNA, 21 bp, Homo sapiens
gggtgggggacgatcaggagg

SEQ ID NO: 4462287 - DNA, 21 bp, Homo sapiens
gggtgggtcagaaccctgcca

SEQ ID NO: 4462288 - DNA, 16 bp, Homo sapiens
gggtgggtgagagaga

SEQ ID NO: 4462289 - DNA, 16 bp, Homo sapiens
gggtggtggggggcag

SEQ ID NO: 4462290 - DNA, 16 bp, Homo sapiens
gggtgtcaagtgcctg

SEQ ID NO: 4462291 - DNA, 17 bp, Homo sapiens
gggtgtcctgcaccggg

SEQ ID NO: 4462292 - DNA, 21 bp, Homo sapiens
gggtgtcctgcaccggggcct

SEQ ID NO: 4462293 - DNA, 13 bp, Homo sapiens
gggtgtctgcacc

SEQ ID NO: 4462294 - DNA, 16 bp, Homo sapiens
gggtgtcttccctgcc

SEQ ID NO: 4462295 - DNA, 19 bp, Homo sapiens
gggtgtcttccctgcctgt

SEQ ID NO: 4462296 - DNA, 21 bp, Homo sapiens
gggtgtcttccctgcctgtgg

SEQ ID NO: 4462297 - DNA, 19 bp, Homo sapiens
gggtgttctttcctgccct

SEQ ID NO: 4462298 - DNA, 19 bp, Homo sapiens
gggtgttgtagtagctgaa

SEQ ID NO: 4462299 - DNA, 18 bp, Homo sapiens
gggtgttgtatggggagg

SEQ ID NO: 4462300 - DNA, 16 bp, Homo sapiens
gggttcagcccctcct

SEQ ID NO: 4462301 - DNA, 22 bp, Homo sapiens
gggttcagcccctcctctgcca

SEQ ID NO: 4462302 - DNA, 15 bp, Homo sapiens
gggttcatgatgcag

SEQ ID NO: 4462303 - DNA, 21 bp, Homo sapiens
gggttccctcctagctctccc

SEQ ID NO: 4462304 - DNA, 22 bp, Homo sapiens
gggttccctcctagctctccca

SEQ ID NO: 4462305 - DNA, 19 bp, Homo sapiens
gggttcctctgtacagcaa

SEQ ID NO: 4462306 - DNA, 13 bp, Homo sapiens
gggttgagagcca

SEQ ID NO: 4462307 - DNA, 20 bp, Homo sapiens
gggttgccagaggccctgga

SEQ ID NO: 4462308 - DNA, 22 bp, Homo sapiens
gggttgccagaggccctggagg

SEQ ID NO: 4462309 - DNA, 17 bp, Homo sapiens
gggttggctgttccaga

SEQ ID NO: 4462310 - DNA, 23 bp, Homo sapiens
gggttggtcaggagaatgaaaca

SEQ ID NO: 4462311 - DNA, 20 bp, Homo sapiens
gggtttcaccatgttggcca

SEQ ID NO: 4462312 - DNA, 16 bp, Homo sapiens
gggtttcacctgcagg

SEQ ID NO: 4462313 - DNA, 15 bp, Homo sapiens
gggtttggacagacc

SEQ ID NO: 4462314 - DNA, 23 bp, Homo sapiens
gggttttattttatttctgaatc

SEQ ID NO: 4462315 - DNA, 13 bp, Homo sapiens
gggttttcatcta

SEQ ID NO: 4462316 - DNA, 13 bp, Homo sapiens
gggtttttgctgt

SEQ ID NO: 4462317 - DNA, 14 bp, Homo sapiens
gggtttttgctgtt

SEQ ID NO: 4462318 - DNA, 17 bp, Homo sapiens
ggtaaaatgtatttttc

SEQ ID NO: 4462319 - DNA, 19 bp, Homo sapiens
ggtaaactagctttgctct

SEQ ID NO: 4462320 - DNA, 20 bp, Homo sapiens
ggtaaatttttaggcaaaga

SEQ ID NO: 4462321 - DNA, 12 bp, Homo sapiens
ggtaaccagccc

SEQ ID NO: 4462322 - DNA, 18 bp, Homo sapiens
ggtaactgctttctgttc

SEQ ID NO: 4462323 - DNA, 22 bp, Homo sapiens
ggtaagaagggtgggagtgggg

SEQ ID NO: 4462324 - DNA, 18 bp, Homo sapiens
ggtaagattgttattaaa

SEQ ID NO: 4462325 - DNA, 18 bp, Homo sapiens
ggtaagttttttgaaatt

SEQ ID NO: 4462326 - DNA, 18 bp, Homo sapiens
ggtaatattgataagcta

SEQ ID NO: 4462327 - DNA, 20 bp, Homo sapiens
ggtaatttaaattggtcatg

SEQ ID NO: 4462328 - DNA, 14 bp, Homo sapiens
ggtacaaaaataaa

SEQ ID NO: 4462329 - DNA, 14 bp, Homo sapiens
ggtacaactgtatt

SEQ ID NO: 4462330 - DNA, 21 bp, Homo sapiens
ggtacacatgtgttatctacc

SEQ ID NO: 4462331 - DNA, 16 bp, Homo sapiens
ggtacactgtttccat

SEQ ID NO: 4462332 - DNA, 15 bp, Homo sapiens
ggtacagacatggag

SEQ ID NO: 4462333 - DNA, 12 bp, Homo sapiens
ggtacagatccc

SEQ ID NO: 4462334 - DNA, 18 bp, Homo sapiens
ggtacagatccccagccc

SEQ ID NO: 4462335 - DNA, 14 bp, Homo sapiens
ggtacatttctctg

SEQ ID NO: 4462336 - DNA, 12 bp, Homo sapiens
ggtaccagctgc

SEQ ID NO: 4462337 - DNA, 16 bp, Homo sapiens
ggtacctcaagcccca

SEQ ID NO: 4462338 - DNA, 17 bp, Homo sapiens
ggtacctcaagccccat

SEQ ID NO: 4462339 - DNA, 22 bp, Homo sapiens
ggtacctcaagccccatttcct

SEQ ID NO: 4462340 - DNA, 13 bp, Homo sapiens
ggtactaccccag

SEQ ID NO: 4462341 - DNA, 22 bp, Homo sapiens
ggtacttcagtattaaattaga

SEQ ID NO: 4462342 - DNA, 21 bp, Homo sapiens
ggtagaagccttatgaaaatt

SEQ ID NO: 4462343 - DNA, 23 bp, Homo sapiens
ggtagaatgttttcaaatgttct

SEQ ID NO: 4462344 - DNA, 16 bp, Homo sapiens
ggtagagacccccagg

SEQ ID NO: 4462345 - DNA, 20 bp, Homo sapiens
ggtagcacagattttgaatc

SEQ ID NO: 4462346 - DNA, 16 bp, Homo sapiens
ggtagcagcaggctca

SEQ ID NO: 4462347 - DNA, 17 bp, Homo sapiens
ggtagccatcaagcact

SEQ ID NO: 4462348 - DNA, 18 bp, Homo sapiens
ggtagccatcaagcactt

SEQ ID NO: 4462349 - DNA, 11 bp, Homo sapiens
ggtagcctatt

SEQ ID NO: 4462350 - DNA, 14 bp, Homo sapiens
ggtagctccagcga

SEQ ID NO: 4462351 - DNA, 18 bp, Homo sapiens
ggtagctgggaaagcata

SEQ ID NO: 4462352 - DNA, 17 bp, Homo sapiens
ggtaggagggtgggaag

SEQ ID NO: 4462353 - DNA, 15 bp, Homo sapiens
ggtagtctcactgct

SEQ ID NO: 4462354 - DNA, 17 bp, Homo sapiens
ggtagttctgtgcctcc

SEQ ID NO: 4462355 - DNA, 18 bp, Homo sapiens
ggtagttgcaattgaatt

SEQ ID NO: 4462356 - DNA, 20 bp, Homo sapiens
ggtataagttgctgtaaaat

SEQ ID NO: 4462357 - DNA, 17 bp, Homo sapiens
ggtataatgtgtctgtg

SEQ ID NO: 4462358 - DNA, 14 bp, Homo sapiens
ggtatcaaaattac

SEQ ID NO: 4462359 - DNA, 21 bp, Homo sapiens
ggtatgctggccagcaccctc

SEQ ID NO: 4462360 - DNA, 23 bp, Homo sapiens
ggtattagcaaagcaaaaggctg

SEQ ID NO: 4462361 - DNA, 16 bp, Homo sapiens
ggtattttttcctttt

SEQ ID NO: 4462362 - DNA, 21 bp, Homo sapiens
ggtcaacacaggtagcacaga

SEQ ID NO: 4462363 - DNA, 20 bp, Homo sapiens
ggtcaacagagaaggcagga

SEQ ID NO: 4462364 - DNA, 14 bp, Homo sapiens
ggtcaatgctattt

SEQ ID NO: 4462365 - DNA, 13 bp, Homo sapiens
ggtcacagaggca

SEQ ID NO: 4462366 - DNA, 18 bp, Homo sapiens
ggtcaccgagactcagcc

SEQ ID NO: 4462367 - DNA, 19 bp, Homo sapiens
ggtcaccgagactcagcct

SEQ ID NO: 4462368 - DNA, 20 bp, Homo sapiens
ggtcaccgagactcagcctc

SEQ ID NO: 4462369 - DNA, 20 bp, Homo sapiens
ggtcacgtttggtgcttctc

SEQ ID NO: 4462370 - DNA, 17 bp, Homo sapiens
ggtcactccaccatccc

SEQ ID NO: 4462371 - DNA, 14 bp, Homo sapiens
ggtcactggcctct

SEQ ID NO: 4462372 - DNA, 19 bp, Homo sapiens
ggtcagaacaggttttttt

SEQ ID NO: 4462373 - DNA, 20 bp, Homo sapiens
ggtcagagagacctcatcct

SEQ ID NO: 4462374 - DNA, 18 bp, Homo sapiens
ggtcagaggacctgtatt

SEQ ID NO: 4462375 - DNA, 14 bp, Homo sapiens
ggtcagagtgccac

SEQ ID NO: 4462376 - DNA, 14 bp, Homo sapiens
ggtcagcaggtgtc

SEQ ID NO: 4462377 - DNA, 19 bp, Homo sapiens
ggtcaggacggctcctcag

SEQ ID NO: 4462378 - DNA, 20 bp, Homo sapiens
ggtcaggacggctcctcaga

SEQ ID NO: 4462379 - DNA, 16 bp, Homo sapiens
ggtcaggtgggaaagc

SEQ ID NO: 4462380 - DNA, 20 bp, Homo sapiens
ggtcagtagtcacaaactga

SEQ ID NO: 4462381 - DNA, 12 bp, Homo sapiens
ggtcagtgcctt

SEQ ID NO: 4462382 - DNA, 13 bp, Homo sapiens
ggtcagtggccag

SEQ ID NO: 4462383 - DNA, 17 bp, Homo sapiens
ggtcagtggccaggtgc

SEQ ID NO: 4462384 - DNA, 14 bp, Homo sapiens
ggtcataagtgggg

SEQ ID NO: 4462385 - DNA, 13 bp, Homo sapiens
ggtcatgggcctg

SEQ ID NO: 4462386 - DNA, 21 bp, Homo sapiens
ggtcattttttttgcttctgg

SEQ ID NO: 4462387 - DNA, 23 bp, Homo sapiens
ggtccaatgccacctagactctc

SEQ ID NO: 4462388 - DNA, 17 bp, Homo sapiens
ggtccacacctgggcat

SEQ ID NO: 4462389 - DNA, 19 bp, Homo sapiens
ggtccacaggtccaaggac

SEQ ID NO: 4462390 - DNA, 21 bp, Homo sapiens
ggtccagggaagctggccgag

SEQ ID NO: 4462391 - DNA, 22 bp, Homo sapiens
ggtccaggggcccctccagctt

SEQ ID NO: 4462392 - DNA, 23 bp, Homo sapiens
ggtccaggggcccctccagcttg

SEQ ID NO: 4462393 - DNA, 18 bp, Homo sapiens
ggtccagtggatgccaca

SEQ ID NO: 4462394 - DNA, 20 bp, Homo sapiens
ggtcccagcccctcctccct

SEQ ID NO: 4462395 - DNA, 21 bp, Homo sapiens
ggtcccagcccctcctccctc

SEQ ID NO: 4462396 - DNA, 23 bp, Homo sapiens
ggtcccagcccctcctccctcag

SEQ ID NO: 4462397 - DNA, 24 bp, Homo sapiens
ggtcccagcccctcctccctcaga

SEQ ID NO: 4462398 - DNA, 21 bp, Homo sapiens
ggtcccccagagcatctgccc

SEQ ID NO: 4462399 - DNA, 15 bp, Homo sapiens
ggtcccccaggaggc

SEQ ID NO: 4462400 - DNA, 20 bp, Homo sapiens
ggtcccgcactctgccccca

SEQ ID NO: 4462401 - DNA, 14 bp, Homo sapiens
ggtccctccacccc

SEQ ID NO: 4462402 - DNA, 22 bp, Homo sapiens
ggtccctgataacaacctggag

SEQ ID NO: 4462403 - DNA, 21 bp, Homo sapiens
ggtcccttgagacctcagcca

SEQ ID NO: 4462404 - DNA, 20 bp, Homo sapiens
ggtccgcaccctgtcctgca

SEQ ID NO: 4462405 - DNA, 18 bp, Homo sapiens
ggtccggacactcctaga

SEQ ID NO: 4462406 - DNA, 15 bp, Homo sapiens
ggtccggcctctccc

SEQ ID NO: 4462407 - DNA, 19 bp, Homo sapiens
ggtccggcctctccctgcc

SEQ ID NO: 4462408 - DNA, 17 bp, Homo sapiens
ggtccggtgtccttttc

SEQ ID NO: 4462409 - DNA, 14 bp, Homo sapiens
ggtccgtagctccc

SEQ ID NO: 4462410 - DNA, 15 bp, Homo sapiens
ggtccgtagctcccc

SEQ ID NO: 4462411 - DNA, 21 bp, Homo sapiens
ggtccgtagctcccctggctg

SEQ ID NO: 4462412 - DNA, 23 bp, Homo sapiens
ggtccgtagctcccctggctggc

SEQ ID NO: 4462413 - DNA, 18 bp, Homo sapiens
ggtcctaaaagcaaaata

SEQ ID NO: 4462414 - DNA, 19 bp, Homo sapiens
ggtcctagcccagtgcttc

SEQ ID NO: 4462415 - DNA, 21 bp, Homo sapiens
ggtcctagcccagtgcttctc

SEQ ID NO: 4462416 - DNA, 14 bp, Homo sapiens
ggtcctagcccttc

SEQ ID NO: 4462417 - DNA, 18 bp, Homo sapiens
ggtcctagcccttccctg

SEQ ID NO: 4462418 - DNA, 21 bp, Homo sapiens
ggtcctctcttccacagtggc

SEQ ID NO: 4462419 - DNA, 22 bp, Homo sapiens
ggtcctcttttcctggcagctg

SEQ ID NO: 4462420 - DNA, 22 bp, Homo sapiens
ggtcctgactccgtcaagctgg

SEQ ID NO: 4462421 - DNA, 12 bp, Homo sapiens
ggtcctggaaca

SEQ ID NO: 4462422 - DNA, 14 bp, Homo sapiens
ggtcctggcagggc

SEQ ID NO: 4462423 - DNA, 16 bp, Homo sapiens
ggtcctggcagggcgc

SEQ ID NO: 4462424 - DNA, 18 bp, Homo sapiens
ggtcctggcagggcgcca

SEQ ID NO: 4462425 - DNA, 19 bp, Homo sapiens
ggtcctggtgctgccgagg

SEQ ID NO: 4462426 - DNA, 22 bp, Homo sapiens
ggtcctggtgctgccgagggct

SEQ ID NO: 4462427 - DNA, 20 bp, Homo sapiens
ggtccttgcctgaactccag

SEQ ID NO: 4462428 - DNA, 22 bp, Homo sapiens
ggtccttgcctgaactccagag

SEQ ID NO: 4462429 - DNA, 23 bp, Homo sapiens
ggtcctttctggaagtttctggt

SEQ ID NO: 4462430 - DNA, 15 bp, Homo sapiens
ggtcctttggggtga

SEQ ID NO: 4462431 - DNA, 18 bp, Homo sapiens
ggtcgccccgtgtttgcg

SEQ ID NO: 4462432 - DNA, 22 bp, Homo sapiens
ggtcgccccgtgtttgcgcttg

SEQ ID NO: 4462433 - DNA, 15 bp, Homo sapiens
ggtcggatctcacag

SEQ ID NO: 4462434 - DNA, 20 bp, Homo sapiens
ggtcggccgccatagcccca

SEQ ID NO: 4462435 - DNA, 23 bp, Homo sapiens
ggtcggccgccatagccccagta

SEQ ID NO: 4462436 - DNA, 15 bp, Homo sapiens
ggtcgggcagccagc

SEQ ID NO: 4462437 - DNA, 14 bp, Homo sapiens
ggtcgttttccaaa

SEQ ID NO: 4462438 - DNA, 14 bp, Homo sapiens
ggtctaggacacag

SEQ ID NO: 4462439 - DNA, 18 bp, Homo sapiens
ggtctataagatgaaaca

SEQ ID NO: 4462440 - DNA, 15 bp, Homo sapiens
ggtctatgttcccca

SEQ ID NO: 4462441 - DNA, 14 bp, Homo sapiens
ggtctattgtcgct

SEQ ID NO: 4462442 - DNA, 23 bp, Homo sapiens
ggtctattgtcgctatgtgactt

SEQ ID NO: 4462443 - DNA, 14 bp, Homo sapiens
ggtctccaccccag

SEQ ID NO: 4462444 - DNA, 15 bp, Homo sapiens
ggtctccaccccagg

SEQ ID NO: 4462445 - DNA, 14 bp, Homo sapiens
ggtctccacctgca

SEQ ID NO: 4462446 - DNA, 20 bp, Homo sapiens
ggtctccccaattctcccct

SEQ ID NO: 4462447 - DNA, 18 bp, Homo sapiens
ggtctccctctcctgcct

SEQ ID NO: 4462448 - DNA, 13 bp, Homo sapiens
ggtctccctggct

SEQ ID NO: 4462449 - DNA, 17 bp, Homo sapiens
ggtctccctggctccct

SEQ ID NO: 4462450 - DNA, 21 bp, Homo sapiens
ggtctcccttctctacactct

SEQ ID NO: 4462451 - DNA, 21 bp, Homo sapiens
ggtctcctcagggtggggggt

SEQ ID NO: 4462452 - DNA, 20 bp, Homo sapiens
ggtctcggatgacaccctgg

SEQ ID NO: 4462453 - DNA, 21 bp, Homo sapiens
ggtctcgttttgttgccaaag

SEQ ID NO: 4462454 - DNA, 18 bp, Homo sapiens
ggtctctctcggcccctg

SEQ ID NO: 4462455 - DNA, 22 bp, Homo sapiens
ggtctctctcggcccctgtctg

SEQ ID NO: 4462456 - DNA, 15 bp, Homo sapiens
ggtctctgaagggac

SEQ ID NO: 4462457 - DNA, 20 bp, Homo sapiens
ggtctcttctgaataaagca

SEQ ID NO: 4462458 - DNA, 13 bp, Homo sapiens
ggtctgagccctg

SEQ ID NO: 4462459 - DNA, 16 bp, Homo sapiens
ggtctgagccctggtg

SEQ ID NO: 4462460 - DNA, 17 bp, Homo sapiens
ggtctgaggcccctgcc

SEQ ID NO: 4462461 - DNA, 22 bp, Homo sapiens
ggtctgaggggcaactgagtct

SEQ ID NO: 4462462 - DNA, 15 bp, Homo sapiens
ggtctgcagaccatc

SEQ ID NO: 4462463 - DNA, 23 bp, Homo sapiens
ggtctgcctcttctgggagggca

SEQ ID NO: 4462464 - DNA, 22 bp, Homo sapiens
ggtctggagaagcagtgagccg

SEQ ID NO: 4462465 - DNA, 15 bp, Homo sapiens
ggtctggccagggct

SEQ ID NO: 4462466 - DNA, 16 bp, Homo sapiens
ggtctgggatatggct

SEQ ID NO: 4462467 - DNA, 13 bp, Homo sapiens
ggtctgggcagca

SEQ ID NO: 4462468 - DNA, 15 bp, Homo sapiens
ggtctggttgggcag

SEQ ID NO: 4462469 - DNA, 24 bp, Homo sapiens
ggtctggttgttgcaccatctgct

SEQ ID NO: 4462470 - DNA, 15 bp, Homo sapiens
ggtctgtctgctttg

SEQ ID NO: 4462471 - DNA, 22 bp, Homo sapiens
ggtctgtgccaaagaagaatcc

SEQ ID NO: 4462472 - DNA, 11 bp, Homo sapiens
ggtctgtgtgt

SEQ ID NO: 4462473 - DNA, 11 bp, Homo sapiens
ggtcttcagct

SEQ ID NO: 4462474 - DNA, 14 bp, Homo sapiens
ggtcttcagcttta

SEQ ID NO: 4462475 - DNA, 20 bp, Homo sapiens
ggtcttccctacctcaggca

SEQ ID NO: 4462476 - DNA, 20 bp, Homo sapiens
ggtcttgctctgtcccccag

SEQ ID NO: 4462477 - DNA, 16 bp, Homo sapiens
ggtcttttataggaaa

SEQ ID NO: 4462478 - DNA, 13 bp, Homo sapiens
ggtcttttcaaat

SEQ ID NO: 4462479 - DNA, 14 bp, Homo sapiens
ggtgaaacccccat

SEQ ID NO: 4462480 - DNA, 21 bp, Homo sapiens
ggtgaagctcacttctgggct

SEQ ID NO: 4462481 - DNA, 16 bp, Homo sapiens
ggtgaaggctctcacc

SEQ ID NO: 4462482 - DNA, 15 bp, Homo sapiens
ggtgacacctccccc

SEQ ID NO: 4462483 - DNA, 16 bp, Homo sapiens
ggtgacacctccccct

SEQ ID NO: 4462484 - DNA, 16 bp, Homo sapiens
ggtgacacgcttctga

SEQ ID NO: 4462485 - DNA, 20 bp, Homo sapiens
ggtgacacgcttctgagcag

SEQ ID NO: 4462486 - DNA, 18 bp, Homo sapiens
ggtgacatcggaaaaata

SEQ ID NO: 4462487 - DNA, 17 bp, Homo sapiens
ggtgaccagtttcttaa

SEQ ID NO: 4462488 - DNA, 14 bp, Homo sapiens
ggtgacctcctgca

SEQ ID NO: 4462489 - DNA, 19 bp, Homo sapiens
ggtgactcacttcaatgtg

SEQ ID NO: 4462490 - DNA, 20 bp, Homo sapiens
ggtgactcacttcaatgtgt

SEQ ID NO: 4462491 - DNA, 23 bp, Homo sapiens
ggtgactgtcccaccgggagcct

SEQ ID NO: 4462492 - DNA, 15 bp, Homo sapiens
ggtgacttctgctgc

SEQ ID NO: 4462493 - DNA, 16 bp, Homo sapiens
ggtgacttctgctgct

SEQ ID NO: 4462494 - DNA, 17 bp, Homo sapiens
ggtgacttctgctgctg

SEQ ID NO: 4462495 - DNA, 15 bp, Homo sapiens
ggtgagaaatttaaa

SEQ ID NO: 4462496 - DNA, 14 bp, Homo sapiens
ggtgagacagttgc

SEQ ID NO: 4462497 - DNA, 17 bp, Homo sapiens
ggtgagagacctgctca

SEQ ID NO: 4462498 - DNA, 19 bp, Homo sapiens
ggtgagagacctgctcagg

SEQ ID NO: 4462499 - DNA, 14 bp, Homo sapiens
ggtgagagagacag

SEQ ID NO: 4462500 - DNA, 17 bp, Homo sapiens
ggtgagcatggcagctg

SEQ ID NO: 4462501 - DNA, 16 bp, Homo sapiens
ggtgagctctcaggcc

SEQ ID NO: 4462502 - DNA, 23 bp, Homo sapiens
ggtgagctctcaggccgagagcc

SEQ ID NO: 4462503 - DNA, 15 bp, Homo sapiens
ggtgaggcaataaaa

SEQ ID NO: 4462504 - DNA, 14 bp, Homo sapiens
ggtgataagggaaa

SEQ ID NO: 4462505 - DNA, 12 bp, Homo sapiens
ggtgatgactta

SEQ ID NO: 4462506 - DNA, 16 bp, Homo sapiens
ggtgatggccagcccc

SEQ ID NO: 4462507 - DNA, 19 bp, Homo sapiens
ggtgatggccagcccctgg

SEQ ID NO: 4462508 - DNA, 23 bp, Homo sapiens
ggtgatttcagactgcagagggg

SEQ ID NO: 4462509 - DNA, 22 bp, Homo sapiens
ggtgcaacccaaggactgaggg

SEQ ID NO: 4462510 - DNA, 23 bp, Homo sapiens
ggtgcaacccaaggactgaggga

SEQ ID NO: 4462511 - DNA, 16 bp, Homo sapiens
ggtgcactttgtaaat

SEQ ID NO: 4462512 - DNA, 19 bp, Homo sapiens
ggtgcagcgtgtgtgccac

SEQ ID NO: 4462513 - DNA, 21 bp, Homo sapiens
ggtgcaggtctccacctgcac

SEQ ID NO: 4462514 - DNA, 19 bp, Homo sapiens
ggtgcatttgagagaagcc

SEQ ID NO: 4462515 - DNA, 21 bp, Homo sapiens
ggtgcatttgagagaagccac

SEQ ID NO: 4462516 - DNA, 23 bp, Homo sapiens
ggtgccaatttcaagttccaagt

SEQ ID NO: 4462517 - DNA, 14 bp, Homo sapiens
ggtgccagctgccc

SEQ ID NO: 4462518 - DNA, 16 bp, Homo sapiens
ggtgccagctgccctt

SEQ ID NO: 4462519 - DNA, 18 bp, Homo sapiens
ggtgccagctgcccttgc

SEQ ID NO: 4462520 - DNA, 22 bp, Homo sapiens
ggtgccagctgcccttgcaggg

SEQ ID NO: 4462521 - DNA, 14 bp, Homo sapiens
ggtgcccaggaaag

SEQ ID NO: 4462522 - DNA, 16 bp, Homo sapiens
ggtgcccatcctgcca

SEQ ID NO: 4462523 - DNA, 14 bp, Homo sapiens
ggtgcccctgctca

SEQ ID NO: 4462524 - DNA, 18 bp, Homo sapiens
ggtgcctgagaggcaggc

SEQ ID NO: 4462525 - DNA, 19 bp, Homo sapiens
ggtgcctgagaggcaggca

SEQ ID NO: 4462526 - DNA, 19 bp, Homo sapiens
ggtgcctgcacacagagtg

SEQ ID NO: 4462527 - DNA, 18 bp, Homo sapiens
ggtgcctgggtggggctg

SEQ ID NO: 4462528 - DNA, 19 bp, Homo sapiens
ggtgcctgtgaggcagggg

SEQ ID NO: 4462529 - DNA, 16 bp, Homo sapiens
ggtgccttcactgggc

SEQ ID NO: 4462530 - DNA, 19 bp, Homo sapiens
ggtgccttcactgggccag

SEQ ID NO: 4462531 - DNA, 21 bp, Homo sapiens
ggtgccttcactgggccagtc

SEQ ID NO: 4462532 - DNA, 17 bp, Homo sapiens
ggtgcctttatttccac

SEQ ID NO: 4462533 - DNA, 12 bp, Homo sapiens
ggtgcctttcct

SEQ ID NO: 4462534 - DNA, 18 bp, Homo sapiens
ggtgcctttcctgttcag

SEQ ID NO: 4462535 - DNA, 19 bp, Homo sapiens
ggtgcctttcctgttcagc

SEQ ID NO: 4462536 - DNA, 22 bp, Homo sapiens
ggtgcgcgccaccgtgcctggc

SEQ ID NO: 4462537 - DNA, 18 bp, Homo sapiens
ggtgcgggatacagctga

SEQ ID NO: 4462538 - DNA, 18 bp, Homo sapiens
ggtgctaaaaatgaaaat

SEQ ID NO: 4462539 - DNA, 21 bp, Homo sapiens
ggtgctacaaaaacacagcaa

SEQ ID NO: 4462540 - DNA, 23 bp, Homo sapiens
ggtgctacacccttttccagctg

SEQ ID NO: 4462541 - DNA, 20 bp, Homo sapiens
ggtgctcaccatgcttccag

SEQ ID NO: 4462542 - DNA, 17 bp, Homo sapiens
ggtgctccatctccgcc

SEQ ID NO: 4462543 - DNA, 14 bp, Homo sapiens
ggtgctcctgcatc

SEQ ID NO: 4462544 - DNA, 22 bp, Homo sapiens
ggtgctgccatgacagaggctg

SEQ ID NO: 4462545 - DNA, 15 bp, Homo sapiens
ggtgctgcccaggcc

SEQ ID NO: 4462546 - DNA, 13 bp, Homo sapiens
ggtgctgccgagg

SEQ ID NO: 4462547 - DNA, 16 bp, Homo sapiens
ggtgctgccgagggct

SEQ ID NO: 4462548 - DNA, 19 bp, Homo sapiens
ggtgctgccgagggctggc

SEQ ID NO: 4462549 - DNA, 22 bp, Homo sapiens
ggtgctgccgagggctggccgg

SEQ ID NO: 4462550 - DNA, 17 bp, Homo sapiens
ggtgctgcctctacctg

SEQ ID NO: 4462551 - DNA, 20 bp, Homo sapiens
ggtgctgggaggagggagag

SEQ ID NO: 4462552 - DNA, 13 bp, Homo sapiens
ggtgctggtcccg

SEQ ID NO: 4462553 - DNA, 20 bp, Homo sapiens
ggtgcttcctcctcaggccc

SEQ ID NO: 4462554 - DNA, 19 bp, Homo sapiens
ggtggaaattttatatgta

SEQ ID NO: 4462555 - DNA, 23 bp, Homo sapiens
ggtggaaattttatatgtaaatg

SEQ ID NO: 4462556 - DNA, 19 bp, Homo sapiens
ggtggaagcagaggccctg

SEQ ID NO: 4462557 - DNA, 13 bp, Homo sapiens
ggtggaagccctc

SEQ ID NO: 4462558 - DNA, 19 bp, Homo sapiens
ggtggaagccctccttcca

SEQ ID NO: 4462559 - DNA, 22 bp, Homo sapiens
ggtggaagtgtgtgccaagagc

SEQ ID NO: 4462560 - DNA, 16 bp, Homo sapiens
ggtggaagttgcagtg

SEQ ID NO: 4462561 - DNA, 15 bp, Homo sapiens
ggtggacgctgcaga

SEQ ID NO: 4462562 - DNA, 16 bp, Homo sapiens
ggtggaggaccgaggc

SEQ ID NO: 4462563 - DNA, 22 bp, Homo sapiens
ggtggaggaccgaggctacagc

SEQ ID NO: 4462564 - DNA, 23 bp, Homo sapiens
ggtggaggctgccccattgagat

SEQ ID NO: 4462565 - DNA, 22 bp, Homo sapiens
ggtggatcacgaggtcaggaga

SEQ ID NO: 4462566 - DNA, 20 bp, Homo sapiens
ggtggatcctgtaggctaaa

SEQ ID NO: 4462567 - DNA, 14 bp, Homo sapiens
ggtggatgtgctgg

SEQ ID NO: 4462568 - DNA, 18 bp, Homo sapiens
ggtggatgtgctggaggg

SEQ ID NO: 4462569 - DNA, 21 bp, Homo sapiens
ggtggatttggagaccgaaga

SEQ ID NO: 4462570 - DNA, 20 bp, Homo sapiens
ggtggcaggcacacagcagc

SEQ ID NO: 4462571 - DNA, 23 bp, Homo sapiens
ggtggcaggcacacagcagcccc

SEQ ID NO: 4462572 - DNA, 19 bp, Homo sapiens
ggtggcaggcgcctataat

SEQ ID NO: 4462573 - DNA, 19 bp, Homo sapiens
ggtggccacacaggcaggg

SEQ ID NO: 4462574 - DNA, 22 bp, Homo sapiens
ggtggccacacaggcagggcct

SEQ ID NO: 4462575 - DNA, 19 bp, Homo sapiens
ggtggccatccctgggccc

SEQ ID NO: 4462576 - DNA, 14 bp, Homo sapiens
ggtggcccagagcc

SEQ ID NO: 4462577 - DNA, 15 bp, Homo sapiens
ggtggctagtcagag

SEQ ID NO: 4462578 - DNA, 16 bp, Homo sapiens
ggtggctagtcagaga

SEQ ID NO: 4462579 - DNA, 23 bp, Homo sapiens
ggtggctctgggaatgggagagg

SEQ ID NO: 4462580 - DNA, 18 bp, Homo sapiens
ggtggctgacccagtccc

SEQ ID NO: 4462581 - DNA, 18 bp, Homo sapiens
ggtggctgccccggcctc

SEQ ID NO: 4462582 - DNA, 18 bp, Homo sapiens
ggtgggacatggaaaaga

SEQ ID NO: 4462583 - DNA, 14 bp, Homo sapiens
ggtgggagggagga

SEQ ID NO: 4462584 - DNA, 22 bp, Homo sapiens
ggtgggatccacgctgggccta

SEQ ID NO: 4462585 - DNA, 17 bp, Homo sapiens
ggtgggatggaggagaa

SEQ ID NO: 4462586 - DNA, 13 bp, Homo sapiens
ggtgggctctgtg

SEQ ID NO: 4462587 - DNA, 16 bp, Homo sapiens
ggtgggctctgtgcag

SEQ ID NO: 4462588 - DNA, 14 bp, Homo sapiens
ggtgggctggactt

SEQ ID NO: 4462589 - DNA, 23 bp, Homo sapiens
ggtgggcttcctgcccttccctc

SEQ ID NO: 4462590 - DNA, 14 bp, Homo sapiens
ggtggggatcctgc

SEQ ID NO: 4462591 - DNA, 13 bp, Homo sapiens
ggtggggctgctc

SEQ ID NO: 4462592 - DNA, 14 bp, Homo sapiens
ggtgggtccatggg

SEQ ID NO: 4462593 - DNA, 20 bp, Homo sapiens
ggtgggtcccggctctgtgg

SEQ ID NO: 4462594 - DNA, 22 bp, Homo sapiens
ggtgggtctatgttccccagga

SEQ ID NO: 4462595 - DNA, 20 bp, Homo sapiens
ggtggtgggatccacgctgg

SEQ ID NO: 4462596 - DNA, 19 bp, Homo sapiens
ggtggttaccaggcactgg

SEQ ID NO: 4462597 - DNA, 23 bp, Homo sapiens
ggtgtaaatattagtgcagttaa

SEQ ID NO: 4462598 - DNA, 23 bp, Homo sapiens
ggtgtcaaacattcgtgagctgg

SEQ ID NO: 4462599 - DNA, 17 bp, Homo sapiens
ggtgtcaggctgctggc

SEQ ID NO: 4462600 - DNA, 15 bp, Homo sapiens
ggtgtccccaacgtc

SEQ ID NO: 4462601 - DNA, 20 bp, Homo sapiens
ggtgtccccaacgtcccctc

SEQ ID NO: 4462602 - DNA, 16 bp, Homo sapiens
ggtgtccccttcccct

SEQ ID NO: 4462603 - DNA, 17 bp, Homo sapiens
ggtgtccccttcccctg

SEQ ID NO: 4462604 - DNA, 20 bp, Homo sapiens
ggtgtccccttcccctgctg

SEQ ID NO: 4462605 - DNA, 12 bp, Homo sapiens
ggtgtcctgagc

SEQ ID NO: 4462606 - DNA, 16 bp, Homo sapiens
ggtgtcctgaggcctc

SEQ ID NO: 4462607 - DNA, 12 bp, Homo sapiens
ggtgtctcccaa

SEQ ID NO: 4462608 - DNA, 18 bp, Homo sapiens
ggtgtctcccaacatggg

SEQ ID NO: 4462609 - DNA, 15 bp, Homo sapiens
ggtgtctgcacctta

SEQ ID NO: 4462610 - DNA, 15 bp, Homo sapiens
ggtgtgaacccggga

SEQ ID NO: 4462611 - DNA, 20 bp, Homo sapiens
ggtgtgaactcaccctggga

SEQ ID NO: 4462612 - DNA, 14 bp, Homo sapiens
ggtgttaatttttg

SEQ ID NO: 4462613 - DNA, 20 bp, Homo sapiens
ggtgttacacagcccaagag

SEQ ID NO: 4462614 - DNA, 22 bp, Homo sapiens
ggtgttccacctggaaactgct

SEQ ID NO: 4462615 - DNA, 21 bp, Homo sapiens
ggtgttgactggactgcttgg

SEQ ID NO: 4462616 - DNA, 13 bp, Homo sapiens
ggtgttgggtcag

SEQ ID NO: 4462617 - DNA, 14 bp, Homo sapiens
ggtgtttgttagta

SEQ ID NO: 4462618 - DNA, 18 bp, Homo sapiens
ggttaaagctaaactgaa

SEQ ID NO: 4462619 - DNA, 15 bp, Homo sapiens
ggttaaatcatttgg

SEQ ID NO: 4462620 - DNA, 16 bp, Homo sapiens
ggttaatatgtctttt

SEQ ID NO: 4462621 - DNA, 22 bp, Homo sapiens
ggttaggtgactaaaagggctt

SEQ ID NO: 4462622 - DNA, 12 bp, Homo sapiens
ggttataatttt

SEQ ID NO: 4462623 - DNA, 16 bp, Homo sapiens
ggttatttttctcttg

SEQ ID NO: 4462624 - DNA, 18 bp, Homo sapiens
ggttcagcccctcctctg

SEQ ID NO: 4462625 - DNA, 22 bp, Homo sapiens
ggttccctttccttccatccct

SEQ ID NO: 4462626 - DNA, 23 bp, Homo sapiens
ggttccgcttggagcagaggggc

SEQ ID NO: 4462627 - DNA, 19 bp, Homo sapiens
ggttcctcaaattttttga

SEQ ID NO: 4462628 - DNA, 20 bp, Homo sapiens
ggttcggatttggggtggat

SEQ ID NO: 4462629 - DNA, 12 bp, Homo sapiens
ggttctaaatat

SEQ ID NO: 4462630 - DNA, 14 bp, Homo sapiens
ggttctaaatgcaa

SEQ ID NO: 4462631 - DNA, 12 bp, Homo sapiens
ggttctctacag

SEQ ID NO: 4462632 - DNA, 23 bp, Homo sapiens
ggttctctacaggcctcttcctg

SEQ ID NO: 4462633 - DNA, 13 bp, Homo sapiens
ggttctctgcctt

SEQ ID NO: 4462634 - DNA, 12 bp, Homo sapiens
ggttctctttga

SEQ ID NO: 4462635 - DNA, 15 bp, Homo sapiens
ggttctgtttcagag

SEQ ID NO: 4462636 - DNA, 21 bp, Homo sapiens
ggttcttgcaaatgggagctg

SEQ ID NO: 4462637 - DNA, 17 bp, Homo sapiens
ggttcttgctttctctc

SEQ ID NO: 4462638 - DNA, 19 bp, Homo sapiens
ggttctttgaccagcacat

SEQ ID NO: 4462639 - DNA, 16 bp, Homo sapiens
ggttgaccccagagga

SEQ ID NO: 4462640 - DNA, 17 bp, Homo sapiens
ggttgactgatgttcat

SEQ ID NO: 4462641 - DNA, 17 bp, Homo sapiens
ggttgagagccagtggc

SEQ ID NO: 4462642 - DNA, 11 bp, Homo sapiens
ggttgaggaaa

SEQ ID NO: 4462643 - DNA, 13 bp, Homo sapiens
ggttgcacagcaa

SEQ ID NO: 4462644 - DNA, 15 bp, Homo sapiens
ggttgcactttgtag

SEQ ID NO: 4462645 - DNA, 18 bp, Homo sapiens
ggttgccagaggccctgg

SEQ ID NO: 4462646 - DNA, 21 bp, Homo sapiens
ggttgccagaggccctggagg

SEQ ID NO: 4462647 - DNA, 19 bp, Homo sapiens
ggttgggagaatgtcagta

SEQ ID NO: 4462648 - DNA, 23 bp, Homo sapiens
ggttgttgatattgtttgctgtt

SEQ ID NO: 4462649 - DNA, 21 bp, Homo sapiens
ggttgttgcaccatctgcttg

SEQ ID NO: 4462650 - DNA, 21 bp, Homo sapiens
ggtttaaaactagttagattc

SEQ ID NO: 4462651 - DNA, 16 bp, Homo sapiens
ggtttaaaagaaaaaa

SEQ ID NO: 4462652 - DNA, 16 bp, Homo sapiens
ggtttaattcagcaga

SEQ ID NO: 4462653 - DNA, 14 bp, Homo sapiens
ggtttacccagtgg

SEQ ID NO: 4462654 - DNA, 16 bp, Homo sapiens
ggtttagaaagcttgc

SEQ ID NO: 4462655 - DNA, 19 bp, Homo sapiens
ggtttcaccatgttggcca

SEQ ID NO: 4462656 - DNA, 13 bp, Homo sapiens
ggtttcatttgaa

SEQ ID NO: 4462657 - DNA, 17 bp, Homo sapiens
ggtttccaaccagggga

SEQ ID NO: 4462658 - DNA, 16 bp, Homo sapiens
ggtttctcattaaagt

SEQ ID NO: 4462659 - DNA, 20 bp, Homo sapiens
ggtttctgatctgtactttg

SEQ ID NO: 4462660 - DNA, 22 bp, Homo sapiens
ggtttgtttagaagaagtgtgt

SEQ ID NO: 4462661 - DNA, 19 bp, Homo sapiens
ggttttattgtttaaaatc

SEQ ID NO: 4462662 - DNA, 14 bp, Homo sapiens
ggttttcttcccat

SEQ ID NO: 4462663 - DNA, 14 bp, Homo sapiens
ggttttgaaatgtt

SEQ ID NO: 4462664 - DNA, 21 bp, Homo sapiens
ggttttggcaaacgctaaaga

SEQ ID NO: 4462665 - DNA, 17 bp, Homo sapiens
ggttttgtattctctga

SEQ ID NO: 4462666 - DNA, 21 bp, Homo sapiens
ggtttttaatctttgtgacag

SEQ ID NO: 4462667 - DNA, 19 bp, Homo sapiens
ggtttttacttaactgttt

SEQ ID NO: 4462668 - DNA, 13 bp, Homo sapiens
ggtttttttcctt

SEQ ID NO: 4462669 - DNA, 11 bp, Homo sapiens
gtaaaaaatgg

SEQ ID NO: 4462670 - DNA, 13 bp, Homo sapiens
gtaaaaaatttat

SEQ ID NO: 4462671 - DNA, 16 bp, Homo sapiens
gtaaaaataatgaatg

SEQ ID NO: 4462672 - DNA, 17 bp, Homo sapiens
gtaaaaatgagtcattt

SEQ ID NO: 4462673 - DNA, 14 bp, Homo sapiens
gtaaaaatgctgct

SEQ ID NO: 4462674 - DNA, 15 bp, Homo sapiens
gtaaaaatgctgctc

SEQ ID NO: 4462675 - DNA, 11 bp, Homo sapiens
gtaaaacattt

SEQ ID NO: 4462676 - DNA, 15 bp, Homo sapiens
gtaaaaccacagcag

SEQ ID NO: 4462677 - DNA, 20 bp, Homo sapiens
gtaaaacgcaccaatcagca

SEQ ID NO: 4462678 - DNA, 15 bp, Homo sapiens
gtaaaactttatttt

SEQ ID NO: 4462679 - DNA, 18 bp, Homo sapiens
gtaaaactttattttata

SEQ ID NO: 4462680 - DNA, 12 bp, Homo sapiens
gtaaaagcaaaa

SEQ ID NO: 4462681 - DNA, 15 bp, Homo sapiens
gtaaaagtgtacaga

SEQ ID NO: 4462682 - DNA, 18 bp, Homo sapiens
gtaaaatattttgaatca

SEQ ID NO: 4462683 - DNA, 15 bp, Homo sapiens
gtaaaatgaattgaa

SEQ ID NO: 4462684 - DNA, 16 bp, Homo sapiens
gtaaaatgaattgaaa

SEQ ID NO: 4462685 - DNA, 17 bp, Homo sapiens
gtaaaatgaattgaaaa

SEQ ID NO: 4462686 - DNA, 20 bp, Homo sapiens
gtaaaatgcttttcactttc

SEQ ID NO: 4462687 - DNA, 14 bp, Homo sapiens
gtaaaatgtattat

SEQ ID NO: 4462688 - DNA, 11 bp, Homo sapiens
gtaaaatgttt

SEQ ID NO: 4462689 - DNA, 9 bp, Homo sapiens
gtaaaatta

SEQ ID NO: 4462690 - DNA, 10 bp, Homo sapiens
gtaaaattaa

SEQ ID NO: 4462691 - DNA, 19 bp, Homo sapiens
gtaaaattaatgtaataaa

SEQ ID NO: 4462692 - DNA, 21 bp, Homo sapiens
gtaaaattaatgtaataaagt

SEQ ID NO: 4462693 - DNA, 23 bp, Homo sapiens
gtaaaattaatgtaataaagtga

SEQ ID NO: 4462694 - DNA, 15 bp, Homo sapiens
gtaaaatttgtgtaa

SEQ ID NO: 4462695 - DNA, 19 bp, Homo sapiens
gtaaaatttgtgtaaattt

SEQ ID NO: 4462696 - DNA, 22 bp, Homo sapiens
gtaaaatttgtgtaaatttgta

SEQ ID NO: 4462697 - DNA, 14 bp, Homo sapiens
gtaaacagtgcctg

SEQ ID NO: 4462698 - DNA, 22 bp, Homo sapiens
gtaaacagtgcctgctgaatga

SEQ ID NO: 4462699 - DNA, 15 bp, Homo sapiens
gtaaacataaaaact

SEQ ID NO: 4462700 - DNA, 22 bp, Homo sapiens
gtaaacattcctccagcctccc

SEQ ID NO: 4462701 - DNA, 20 bp, Homo sapiens
gtaaaccctatctgtgattc

SEQ ID NO: 4462702 - DNA, 17 bp, Homo sapiens
gtaaacggcccaggcca

SEQ ID NO: 4462703 - DNA, 21 bp, Homo sapiens
gtaaacggcccaggccaggtg

SEQ ID NO: 4462704 - DNA, 15 bp, Homo sapiens
gtaaactattcttaa

SEQ ID NO: 4462705 - DNA, 17 bp, Homo sapiens
gtaaactggaattaaaa

SEQ ID NO: 4462706 - DNA, 24 bp, Homo sapiens
gtaaactgtgcaccaagcaggaaa

SEQ ID NO: 4462707 - DNA, 19 bp, Homo sapiens
gtaaagaattttcatcccg

SEQ ID NO: 4462708 - DNA, 14 bp, Homo sapiens
gtaaagacaaataa

SEQ ID NO: 4462709 - DNA, 15 bp, Homo sapiens
gtaaagactggcttt

SEQ ID NO: 4462710 - DNA, 19 bp, Homo sapiens
gtaaagactggttttctgc

SEQ ID NO: 4462711 - DNA, 22 bp, Homo sapiens
gtaaagagtacactcagccact

SEQ ID NO: 4462712 - DNA, 16 bp, Homo sapiens
gtaaagctagaaatga

SEQ ID NO: 4462713 - DNA, 15 bp, Homo sapiens
gtaaagtatgtatta

SEQ ID NO: 4462714 - DNA, 20 bp, Homo sapiens
gtaaagtggttctctgcctt

SEQ ID NO: 4462715 - DNA, 16 bp, Homo sapiens
gtaaagttatgtattt

SEQ ID NO: 4462716 - DNA, 18 bp, Homo sapiens
gtaaagttggttggataa

SEQ ID NO: 4462717 - DNA, 13 bp, Homo sapiens
gtaaataaaaaga

SEQ ID NO: 4462718 - DNA, 21 bp, Homo sapiens
gtaaataaccccattctttgc

SEQ ID NO: 4462719 - DNA, 18 bp, Homo sapiens
gtaaatactgtgaaatac

SEQ ID NO: 4462720 - DNA, 14 bp, Homo sapiens
gtaaataggaattg

SEQ ID NO: 4462721 - DNA, 20 bp, Homo sapiens
gtaaataggatttttagaat

SEQ ID NO: 4462722 - DNA, 19 bp, Homo sapiens
gtaaatattgctaaaagca

SEQ ID NO: 4462723 - DNA, 21 bp, Homo sapiens
gtaaatcacgctttttgaaaa

SEQ ID NO: 4462724 - DNA, 15 bp, Homo sapiens
gtaaatcctgtgttt

SEQ ID NO: 4462725 - DNA, 14 bp, Homo sapiens
gtaaatcttttaca

SEQ ID NO: 4462726 - DNA, 12 bp, Homo sapiens
gtaaatcttttt

SEQ ID NO: 4462727 - DNA, 15 bp, Homo sapiens
gtaaatgcatattaa

SEQ ID NO: 4462728 - DNA, 19 bp, Homo sapiens
gtaaatgcatattaaataa

SEQ ID NO: 4462729 - DNA, 22 bp, Homo sapiens
gtaaatgcctcttaaattatat

SEQ ID NO: 4462730 - DNA, 17 bp, Homo sapiens
gtaaatgcttaaatttc

SEQ ID NO: 4462731 - DNA, 22 bp, Homo sapiens
gtaaatgtggattttgtagatg

SEQ ID NO: 4462732 - DNA, 21 bp, Homo sapiens
gtaaatgtgttagcactgata

SEQ ID NO: 4462733 - DNA, 22 bp, Homo sapiens
gtaaatgttatcttatactgta

SEQ ID NO: 4462734 - DNA, 23 bp, Homo sapiens
gtaaattatatttgtgctatagt

SEQ ID NO: 4462735 - DNA, 12 bp, Homo sapiens
gtaaattatttt

SEQ ID NO: 4462736 - DNA, 14 bp, Homo sapiens
gtaaattattttaa

SEQ ID NO: 4462737 - DNA, 17 bp, Homo sapiens
gtaaattattttaaatt

SEQ ID NO: 4462738 - DNA, 17 bp, Homo sapiens
gtaaatttatgtgatgg

SEQ ID NO: 4462739 - DNA, 19 bp, Homo sapiens
gtaaatttttaggcaaaga

SEQ ID NO: 4462740 - DNA, 20 bp, Homo sapiens
gtaacaatacatgagaaaga

SEQ ID NO: 4462741 - DNA, 11 bp, Homo sapiens
gtaacagacac

SEQ ID NO: 4462742 - DNA, 16 bp, Homo sapiens
gtaacagggcagaaat

SEQ ID NO: 4462743 - DNA, 15 bp, Homo sapiens
gtaacagtgtaaagt

SEQ ID NO: 4462744 - DNA, 19 bp, Homo sapiens
gtaacataactgcttcttg

SEQ ID NO: 4462745 - DNA, 14 bp, Homo sapiens
gtaacatctgccat

SEQ ID NO: 4462746 - DNA, 13 bp, Homo sapiens
gtaaccagccaga

SEQ ID NO: 4462747 - DNA, 22 bp, Homo sapiens
gtaacctcggagacgggaccct

SEQ ID NO: 4462748 - DNA, 18 bp, Homo sapiens
gtaacctcttcagaggcc

SEQ ID NO: 4462749 - DNA, 18 bp, Homo sapiens
gtaacgtgctcactgtgt

SEQ ID NO: 4462750 - DNA, 21 bp, Homo sapiens
gtaacgtgctcactgtgtata

SEQ ID NO: 4462751 - DNA, 19 bp, Homo sapiens
gtaactaactgcatacact

SEQ ID NO: 4462752 - DNA, 19 bp, Homo sapiens
gtaactatcaatatttaag

SEQ ID NO: 4462753 - DNA, 17 bp, Homo sapiens
gtaactccaccaaccca

SEQ ID NO: 4462754 - DNA, 17 bp, Homo sapiens
gtaactgctttctgttc

SEQ ID NO: 4462755 - DNA, 22 bp, Homo sapiens
gtaactgctttctgttccaaat

SEQ ID NO: 4462756 - DNA, 21 bp, Homo sapiens
gtaacttgcttaaatttctta

SEQ ID NO: 4462757 - DNA, 11 bp, Homo sapiens
gtaactttatg

SEQ ID NO: 4462758 - DNA, 14 bp, Homo sapiens
gtaactttctctta

SEQ ID NO: 4462759 - DNA, 21 bp, Homo sapiens
gtaactttgcgggatatttag

SEQ ID NO: 4462760 - DNA, 19 bp, Homo sapiens
gtaacttttgtaaatacac

SEQ ID NO: 4462761 - DNA, 20 bp, Homo sapiens
gtaagaaagtgaagcaaatc

SEQ ID NO: 4462762 - DNA, 23 bp, Homo sapiens
gtaagaacaactacctgagctaa

SEQ ID NO: 4462763 - DNA, 16 bp, Homo sapiens
gtaagaactgtacatt

SEQ ID NO: 4462764 - DNA, 17 bp, Homo sapiens
gtaagaactgtacattg

SEQ ID NO: 4462765 - DNA, 14 bp, Homo sapiens
gtaagaagggtggg

SEQ ID NO: 4462766 - DNA, 13 bp, Homo sapiens
gtaagactgctgg

SEQ ID NO: 4462767 - DNA, 16 bp, Homo sapiens
gtaagaggcttcaaaa

SEQ ID NO: 4462768 - DNA, 13 bp, Homo sapiens
gtaagatatttgc

SEQ ID NO: 4462769 - DNA, 17 bp, Homo sapiens
gtaagatctctttctaa

SEQ ID NO: 4462770 - DNA, 13 bp, Homo sapiens
gtaagattgttat

SEQ ID NO: 4462771 - DNA, 13 bp, Homo sapiens
gtaagccaaagaa

SEQ ID NO: 4462772 - DNA, 14 bp, Homo sapiens
gtaagccagagcct

SEQ ID NO: 4462773 - DNA, 18 bp, Homo sapiens
gtaaggatccggaaagaa

SEQ ID NO: 4462774 - DNA, 22 bp, Homo sapiens
gtaagggaatttaatacttttc

SEQ ID NO: 4462775 - DNA, 23 bp, Homo sapiens
gtaagggtctttggtgtttttaa

SEQ ID NO: 4462776 - DNA, 17 bp, Homo sapiens
gtaaggtgcttggagtt

SEQ ID NO: 4462777 - DNA, 18 bp, Homo sapiens
gtaaggtgtgtactcagg

SEQ ID NO: 4462778 - DNA, 14 bp, Homo sapiens
gtaagtatttccat

SEQ ID NO: 4462779 - DNA, 18 bp, Homo sapiens
gtaagtctgatttttaag

SEQ ID NO: 4462780 - DNA, 14 bp, Homo sapiens
gtaagtgccttcca

SEQ ID NO: 4462781 - DNA, 19 bp, Homo sapiens
gtaataatgtacagaggaa

SEQ ID NO: 4462782 - DNA, 22 bp, Homo sapiens
gtaatacaaactaatttagtaa

SEQ ID NO: 4462783 - DNA, 16 bp, Homo sapiens
gtaataggaccagagc

SEQ ID NO: 4462784 - DNA, 17 bp, Homo sapiens
gtaataggcattttaag

SEQ ID NO: 4462785 - DNA, 14 bp, Homo sapiens
gtaatagtttatct

SEQ ID NO: 4462786 - DNA, 14 bp, Homo sapiens
gtaatataatgtat

SEQ ID NO: 4462787 - DNA, 17 bp, Homo sapiens
gtaatataatgtatttt

SEQ ID NO: 4462788 - DNA, 21 bp, Homo sapiens
gtaatatcaaagcattttata

SEQ ID NO: 4462789 - DNA, 13 bp, Homo sapiens
gtaatatctttca

SEQ ID NO: 4462790 - DNA, 16 bp, Homo sapiens
gtaatattctgttttg

SEQ ID NO: 4462791 - DNA, 17 bp, Homo sapiens
gtaatatttacaatgta

SEQ ID NO: 4462792 - DNA, 23 bp, Homo sapiens
gtaatatttacaatgtattaagc

SEQ ID NO: 4462793 - DNA, 18 bp, Homo sapiens
gtaatattttactttgag

SEQ ID NO: 4462794 - DNA, 15 bp, Homo sapiens
gtaatcatgttttaa

SEQ ID NO: 4462795 - DNA, 12 bp, Homo sapiens
gtaatcatttta

SEQ ID NO: 4462796 - DNA, 14 bp, Homo sapiens
gtaatcccagcact

SEQ ID NO: 4462797 - DNA, 12 bp, Homo sapiens
gtaatcccagct

SEQ ID NO: 4462798 - DNA, 13 bp, Homo sapiens
gtaatcccagcta

SEQ ID NO: 4462799 - DNA, 17 bp, Homo sapiens
gtaatcccagctactca

SEQ ID NO: 4462800 - DNA, 13 bp, Homo sapiens
gtaatccctgctt

SEQ ID NO: 4462801 - DNA, 14 bp, Homo sapiens
gtaatctacaccaa

SEQ ID NO: 4462802 - DNA, 17 bp, Homo sapiens
gtaatctacaccaatga

SEQ ID NO: 4462803 - DNA, 16 bp, Homo sapiens
gtaatgcactttggga

SEQ ID NO: 4462804 - DNA, 16 bp, Homo sapiens
gtaatgtaaataaact

SEQ ID NO: 4462805 - DNA, 21 bp, Homo sapiens
gtaatgtagggttatatttgg

SEQ ID NO: 4462806 - DNA, 12 bp, Homo sapiens
gtaatgtcacca

SEQ ID NO: 4462807 - DNA, 14 bp, Homo sapiens
gtaatgtgaataaa

SEQ ID NO: 4462808 - DNA, 16 bp, Homo sapiens
gtaatgtgaataaatt

SEQ ID NO: 4462809 - DNA, 21 bp, Homo sapiens
gtaattaaaagcaaatcattt

SEQ ID NO: 4462810 - DNA, 13 bp, Homo sapiens
gtaattaaactgt

SEQ ID NO: 4462811 - DNA, 17 bp, Homo sapiens
gtaattaactgtaaact

SEQ ID NO: 4462812 - DNA, 15 bp, Homo sapiens
gtaattaaggtacat

SEQ ID NO: 4462813 - DNA, 17 bp, Homo sapiens
gtaattaaggtacatca

SEQ ID NO: 4462814 - DNA, 23 bp, Homo sapiens
gtaattagtaacatgtgttaagt

SEQ ID NO: 4462815 - DNA, 20 bp, Homo sapiens
gtaattagtgccacttaatg

SEQ ID NO: 4462816 - DNA, 13 bp, Homo sapiens
gtaattatcagtt

SEQ ID NO: 4462817 - DNA, 22 bp, Homo sapiens
gtaattcaagcctctaaacaga

SEQ ID NO: 4462818 - DNA, 15 bp, Homo sapiens
gtaattgacatgtgc

SEQ ID NO: 4462819 - DNA, 16 bp, Homo sapiens
gtaattgtaattccaa

SEQ ID NO: 4462820 - DNA, 21 bp, Homo sapiens
gtaatttaaaataattatata

SEQ ID NO: 4462821 - DNA, 20 bp, Homo sapiens
gtaatttaaaattgtgatgt

SEQ ID NO: 4462822 - DNA, 23 bp, Homo sapiens
gtaatttaaaattgtgatgtgtc

SEQ ID NO: 4462823 - DNA, 20 bp, Homo sapiens
gtaatttatagtttatacag

SEQ ID NO: 4462824 - DNA, 23 bp, Homo sapiens
gtaatttatagtttatacagttt

SEQ ID NO: 4462825 - DNA, 13 bp, Homo sapiens
gtaatttcagttc

SEQ ID NO: 4462826 - DNA, 19 bp, Homo sapiens
gtaatttctttaaatgtgt

SEQ ID NO: 4462827 - DNA, 23 bp, Homo sapiens
gtaatttgagagaaatatgaaga

SEQ ID NO: 4462828 - DNA, 13 bp, Homo sapiens
gtaatttgtaaag

SEQ ID NO: 4462829 - DNA, 14 bp, Homo sapiens
gtaatttgtaaagt

SEQ ID NO: 4462830 - DNA, 15 bp, Homo sapiens
gtaatttgtgtaata

SEQ ID NO: 4462831 - DNA, 16 bp, Homo sapiens
gtaatttgtgtaataa

SEQ ID NO: 4462832 - DNA, 22 bp, Homo sapiens
gtaatttgtgtaataaagtgtt

SEQ ID NO: 4462833 - DNA, 19 bp, Homo sapiens
gtaattttattttaaaatt

SEQ ID NO: 4462834 - DNA, 20 bp, Homo sapiens
gtaattttattttaaaattt

SEQ ID NO: 4462835 - DNA, 14 bp, Homo sapiens
gtaattttggattt

SEQ ID NO: 4462836 - DNA, 17 bp, Homo sapiens
gtaattttggattttgc

SEQ ID NO: 4462837 - DNA, 12 bp, Homo sapiens
gtacaaaaataa

SEQ ID NO: 4462838 - DNA, 18 bp, Homo sapiens
gtacaaaaataaatttat

SEQ ID NO: 4462839 - DNA, 13 bp, Homo sapiens
gtacaaacatgaa

SEQ ID NO: 4462840 - DNA, 14 bp, Homo sapiens
gtacaaacatgaaa

SEQ ID NO: 4462841 - DNA, 20 bp, Homo sapiens
gtacaaacatgaaaaacaaa

SEQ ID NO: 4462842 - DNA, 14 bp, Homo sapiens
gtacaaccctgacc

SEQ ID NO: 4462843 - DNA, 15 bp, Homo sapiens
gtacaactgtattta

SEQ ID NO: 4462844 - DNA, 18 bp, Homo sapiens
gtacaactgtatttatta

SEQ ID NO: 4462845 - DNA, 17 bp, Homo sapiens
gtacaactttttaaata

SEQ ID NO: 4462846 - DNA, 15 bp, Homo sapiens
gtacaagctcaggag

SEQ ID NO: 4462847 - DNA, 13 bp, Homo sapiens
gtacaatacaatg

SEQ ID NO: 4462848 - DNA, 16 bp, Homo sapiens
gtacaatacaatgtac

SEQ ID NO: 4462849 - DNA, 18 bp, Homo sapiens
gtacaatacaatgtacaa

SEQ ID NO: 4462850 - DNA, 13 bp, Homo sapiens
gtacaatgtgttt

SEQ ID NO: 4462851 - DNA, 17 bp, Homo sapiens
gtacaatgtgtttttct

SEQ ID NO: 4462852 - DNA, 13 bp, Homo sapiens
gtacaattttaaa

SEQ ID NO: 4462853 - DNA, 23 bp, Homo sapiens
gtacaattttaaagttcttattt

SEQ ID NO: 4462854 - DNA, 18 bp, Homo sapiens
gtacacaataagcaaaaa

SEQ ID NO: 4462855 - DNA, 20 bp, Homo sapiens
gtacacaataagcaaaaaca

SEQ ID NO: 4462856 - DNA, 24 bp, Homo sapiens
gtacacacccgcctgacaccgtgg

SEQ ID NO: 4462857 - DNA, 18 bp, Homo sapiens
gtacacatgtgttatcta

SEQ ID NO: 4462858 - DNA, 11 bp, Homo sapiens
gtacacatttc

SEQ ID NO: 4462859 - DNA, 14 bp, Homo sapiens
gtacacctccccct

SEQ ID NO: 4462860 - DNA, 22 bp, Homo sapiens
gtacactcagccactgtcacag

SEQ ID NO: 4462861 - DNA, 14 bp, Homo sapiens
gtacactttttaca

SEQ ID NO: 4462862 - DNA, 13 bp, Homo sapiens
gtacagaaagctg

SEQ ID NO: 4462863 - DNA, 14 bp, Homo sapiens
gtacagaaagctgc

SEQ ID NO: 4462864 - DNA, 18 bp, Homo sapiens
gtacagaatttgaattat

SEQ ID NO: 4462865 - DNA, 18 bp, Homo sapiens
gtacagaggaagctgttg

SEQ ID NO: 4462866 - DNA, 20 bp, Homo sapiens
gtacaggtagtgggctcaca

SEQ ID NO: 4462867 - DNA, 13 bp, Homo sapiens
gtacagtcttgta

SEQ ID NO: 4462868 - DNA, 23 bp, Homo sapiens
gtacagttgctgttgtgtgatca

SEQ ID NO: 4462869 - DNA, 14 bp, Homo sapiens
gtacataactgaaa

SEQ ID NO: 4462870 - DNA, 17 bp, Homo sapiens
gtacataattgcatgaa

SEQ ID NO: 4462871 - DNA, 16 bp, Homo sapiens
gtacatcttctttgga

SEQ ID NO: 4462872 - DNA, 11 bp, Homo sapiens
gtacatgagaa

SEQ ID NO: 4462873 - DNA, 15 bp, Homo sapiens
gtacatgataagaca

SEQ ID NO: 4462874 - DNA, 13 bp, Homo sapiens
gtacatgtgaggc

SEQ ID NO: 4462875 - DNA, 13 bp, Homo sapiens
gtacattacagat

SEQ ID NO: 4462876 - DNA, 14 bp, Homo sapiens
gtacattgtgagct

SEQ ID NO: 4462877 - DNA, 14 bp, Homo sapiens
gtacatttaaattt

SEQ ID NO: 4462878 - DNA, 13 bp, Homo sapiens
gtacatttaataa

SEQ ID NO: 4462879 - DNA, 18 bp, Homo sapiens
gtacatttaataatatca

SEQ ID NO: 4462880 - DNA, 14 bp, Homo sapiens
gtacatttgcaatt

SEQ ID NO: 4462881 - DNA, 20 bp, Homo sapiens
gtacatttttcaactttgaa

SEQ ID NO: 4462882 - DNA, 21 bp, Homo sapiens
gtacatttttcaactttgaat

SEQ ID NO: 4462883 - DNA, 19 bp, Homo sapiens
gtaccaaaattttaaaaaa

SEQ ID NO: 4462884 - DNA, 19 bp, Homo sapiens
gtaccagctgcgcttgctt

SEQ ID NO: 4462885 - DNA, 22 bp, Homo sapiens
gtaccagtgaatttttgcaata

SEQ ID NO: 4462886 - DNA, 10 bp, Homo sapiens
gtaccagtta

SEQ ID NO: 4462887 - DNA, 11 bp, Homo sapiens
gtaccagttaa

SEQ ID NO: 4462888 - DNA, 16 bp, Homo sapiens
gtaccagttaattttt

SEQ ID NO: 4462889 - DNA, 23 bp, Homo sapiens
gtaccagttaatttttccaacta

SEQ ID NO: 4462890 - DNA, 14 bp, Homo sapiens
gtaccatagaaaaa

SEQ ID NO: 4462891 - DNA, 16 bp, Homo sapiens
gtaccatttgtgtctc

SEQ ID NO: 4462892 - DNA, 13 bp, Homo sapiens
gtaccattttaaa

SEQ ID NO: 4462893 - DNA, 19 bp, Homo sapiens
gtacccagcaaatgggcat

SEQ ID NO: 4462894 - DNA, 17 bp, Homo sapiens
gtacctagctggctctg

SEQ ID NO: 4462895 - DNA, 16 bp, Homo sapiens
gtacctcaagccccat

SEQ ID NO: 4462896 - DNA, 19 bp, Homo sapiens
gtacctcaagccccatttc

SEQ ID NO: 4462897 - DNA, 14 bp, Homo sapiens
gtacctttatgtta

SEQ ID NO: 4462898 - DNA, 22 bp, Homo sapiens
gtaccttttttgttttttcaaa

SEQ ID NO: 4462899 - DNA, 23 bp, Homo sapiens
gtacgaatcttatttttcctgtc

SEQ ID NO: 4462900 - DNA, 22 bp, Homo sapiens
gtacgatcaagttgttgactgt

SEQ ID NO: 4462901 - DNA, 23 bp, Homo sapiens
gtacgatcaagttgttgactgtg

SEQ ID NO: 4462902 - DNA, 24 bp, Homo sapiens
gtacgatcaagttgttgactgtga

SEQ ID NO: 4462903 - DNA, 15 bp, Homo sapiens
gtacgatgacagtgt

SEQ ID NO: 4462904 - DNA, 24 bp, Homo sapiens
gtacgtcccgctgctgtgctctgg

SEQ ID NO: 4462905 - DNA, 15 bp, Homo sapiens
gtacgttatatattg

SEQ ID NO: 4462906 - DNA, 15 bp, Homo sapiens
gtactaatagaactt

SEQ ID NO: 4462907 - DNA, 15 bp, Homo sapiens
gtactcaaatgtagc

SEQ ID NO: 4462908 - DNA, 23 bp, Homo sapiens
gtactccagccagggcaagagag

SEQ ID NO: 4462909 - DNA, 17 bp, Homo sapiens
gtactccagcctgggca

SEQ ID NO: 4462910 - DNA, 14 bp, Homo sapiens
gtactcctcagacg

SEQ ID NO: 4462911 - DNA, 14 bp, Homo sapiens
gtactgaatttttt

SEQ ID NO: 4462912 - DNA, 20 bp, Homo sapiens
gtactgaatttttttgtaat

SEQ ID NO: 4462913 - DNA, 14 bp, Homo sapiens
gtactgatttcagt

SEQ ID NO: 4462914 - DNA, 15 bp, Homo sapiens
gtactgatttcagta

SEQ ID NO: 4462915 - DNA, 22 bp, Homo sapiens
gtactgccccccatgaggaagg

SEQ ID NO: 4462916 - DNA, 14 bp, Homo sapiens
gtactggagcctgc

SEQ ID NO: 4462917 - DNA, 16 bp, Homo sapiens
gtactggagcctgcat

SEQ ID NO: 4462918 - DNA, 15 bp, Homo sapiens
gtactggtaagattg

SEQ ID NO: 4462919 - DNA, 16 bp, Homo sapiens
gtactggttactttca

SEQ ID NO: 4462920 - DNA, 16 bp, Homo sapiens
gtactgtgggcaattt

SEQ ID NO: 4462921 - DNA, 20 bp, Homo sapiens
gtactgtgggcaatttagaa

SEQ ID NO: 4462922 - DNA, 14 bp, Homo sapiens
gtactgttgaaaaa

SEQ ID NO: 4462923 - DNA, 18 bp, Homo sapiens
gtactgttgctttaatat

SEQ ID NO: 4462924 - DNA, 13 bp, Homo sapiens
gtacttaaatgag

SEQ ID NO: 4462925 - DNA, 19 bp, Homo sapiens
gtacttaaatgagttactt

SEQ ID NO: 4462926 - DNA, 15 bp, Homo sapiens
gtacttaatttactt

SEQ ID NO: 4462927 - DNA, 23 bp, Homo sapiens
gtacttaatttacttaagtgttc

SEQ ID NO: 4462928 - DNA, 20 bp, Homo sapiens
gtacttagagtttctgtttg

SEQ ID NO: 4462929 - DNA, 18 bp, Homo sapiens
gtacttcctctgtgaact

SEQ ID NO: 4462930 - DNA, 21 bp, Homo sapiens
gtacttcctgagtggccaggg

SEQ ID NO: 4462931 - DNA, 22 bp, Homo sapiens
gtacttcttcatccatagacac

SEQ ID NO: 4462932 - DNA, 23 bp, Homo sapiens
gtacttcttcatccatagacaca

SEQ ID NO: 4462933 - DNA, 18 bp, Homo sapiens
gtacttcttgaatataaa

SEQ ID NO: 4462934 - DNA, 23 bp, Homo sapiens
gtacttgccctgaccatgcattt

SEQ ID NO: 4462935 - DNA, 20 bp, Homo sapiens
gtacttgcttgtattgtaaa

SEQ ID NO: 4462936 - DNA, 15 bp, Homo sapiens
gtactttatcatgaa

SEQ ID NO: 4462937 - DNA, 17 bp, Homo sapiens
gtacttttcattctctt

SEQ ID NO: 4462938 - DNA, 21 bp, Homo sapiens
gtacttttttaaatattttct

SEQ ID NO: 4462939 - DNA, 14 bp, Homo sapiens
gtagaaaatgagga

SEQ ID NO: 4462940 - DNA, 20 bp, Homo sapiens
gtagaaagacatctgcctgt

SEQ ID NO: 4462941 - DNA, 22 bp, Homo sapiens
gtagaaagacatctgcctgtaa

SEQ ID NO: 4462942 - DNA, 14 bp, Homo sapiens
gtagaaatgatgat

SEQ ID NO: 4462943 - DNA, 21 bp, Homo sapiens
gtagaagccttatgaaaatta

SEQ ID NO: 4462944 - DNA, 21 bp, Homo sapiens
gtagaatctcttcatgcttga

SEQ ID NO: 4462945 - DNA, 18 bp, Homo sapiens
gtagacaatcattgtttt

SEQ ID NO: 4462946 - DNA, 15 bp, Homo sapiens
gtagacatctgtcct

SEQ ID NO: 4462947 - DNA, 15 bp, Homo sapiens
gtagactgtgccaga

SEQ ID NO: 4462948 - DNA, 12 bp, Homo sapiens
gtagacttttat

SEQ ID NO: 4462949 - DNA, 13 bp, Homo sapiens
gtagagtccttgg

SEQ ID NO: 4462950 - DNA, 18 bp, Homo sapiens
gtagagtgacctcggaca

SEQ ID NO: 4462951 - DNA, 23 bp, Homo sapiens
gtagatagtatgcactatataca

SEQ ID NO: 4462952 - DNA, 14 bp, Homo sapiens
gtagatatttgaaa

SEQ ID NO: 4462953 - DNA, 19 bp, Homo sapiens
gtagatgggggaactgtga

SEQ ID NO: 4462954 - DNA, 18 bp, Homo sapiens
gtagattcaggtaataca

SEQ ID NO: 4462955 - DNA, 14 bp, Homo sapiens
gtagatttgaaaat

SEQ ID NO: 4462956 - DNA, 15 bp, Homo sapiens
gtagatttgaaaatt

SEQ ID NO: 4462957 - DNA, 23 bp, Homo sapiens
gtagcaatggccagagcctctgg

SEQ ID NO: 4462958 - DNA, 16 bp, Homo sapiens
gtagcaatgtgccttg

SEQ ID NO: 4462959 - DNA, 18 bp, Homo sapiens
gtagcacagattttgaat

SEQ ID NO: 4462960 - DNA, 19 bp, Homo sapiens
gtagcacagattttgaatc

SEQ ID NO: 4462961 - DNA, 22 bp, Homo sapiens
gtagcacttacgtaaaacattt

SEQ ID NO: 4462962 - DNA, 17 bp, Homo sapiens
gtagcagagttaaatct

SEQ ID NO: 4462963 - DNA, 17 bp, Homo sapiens
gtagcagcaggctcagg

SEQ ID NO: 4462964 - DNA, 12 bp, Homo sapiens
gtagcaggggaa

SEQ ID NO: 4462965 - DNA, 18 bp, Homo sapiens
gtagcaggtaccactgat

SEQ ID NO: 4462966 - DNA, 21 bp, Homo sapiens
gtagcattctttggagttaaa

SEQ ID NO: 4462967 - DNA, 21 bp, Homo sapiens
gtagccacagctgctgttctc

SEQ ID NO: 4462968 - DNA, 14 bp, Homo sapiens
gtagccagctgtgc

SEQ ID NO: 4462969 - DNA, 21 bp, Homo sapiens
gtagccatcaagcacttccca

SEQ ID NO: 4462970 - DNA, 16 bp, Homo sapiens
gtagccccctcatctg

SEQ ID NO: 4462971 - DNA, 16 bp, Homo sapiens
gtagcccgcctgccag

SEQ ID NO: 4462972 - DNA, 19 bp, Homo sapiens
gtagccgagagcctgctcc

SEQ ID NO: 4462973 - DNA, 18 bp, Homo sapiens
gtagcctaaatctccagt

SEQ ID NO: 4462974 - DNA, 20 bp, Homo sapiens
gtagcctatttttttagatt

SEQ ID NO: 4462975 - DNA, 13 bp, Homo sapiens
gtagctcaaaaat

SEQ ID NO: 4462976 - DNA, 16 bp, Homo sapiens
gtagctcccctggctg

SEQ ID NO: 4462977 - DNA, 17 bp, Homo sapiens
gtagctgggactacagg

SEQ ID NO: 4462978 - DNA, 19 bp, Homo sapiens
gtagcttatctgcccctcc

SEQ ID NO: 4462979 - DNA, 22 bp, Homo sapiens
gtaggaactcttaagcaatggt

SEQ ID NO: 4462980 - DNA, 15 bp, Homo sapiens
gtaggatcacctgag

SEQ ID NO: 4462981 - DNA, 14 bp, Homo sapiens
gtaggatgacaggc

SEQ ID NO: 4462982 - DNA, 16 bp, Homo sapiens
gtaggcacttttattt

SEQ ID NO: 4462983 - DNA, 22 bp, Homo sapiens
gtaggcatcagtatgtcactct

SEQ ID NO: 4462984 - DNA, 20 bp, Homo sapiens
gtaggtaaaatgtatttttc

SEQ ID NO: 4462985 - DNA, 13 bp, Homo sapiens
gtagtaacactaa

SEQ ID NO: 4462986 - DNA, 22 bp, Homo sapiens
gtagtaacactgtgatttatct

SEQ ID NO: 4462987 - DNA, 19 bp, Homo sapiens
gtagtaatttattgtctgt

SEQ ID NO: 4462988 - DNA, 16 bp, Homo sapiens
gtagtaccaaaataaa

SEQ ID NO: 4462989 - DNA, 22 bp, Homo sapiens
gtagtacttcttctgtaatatt

SEQ ID NO: 4462990 - DNA, 17 bp, Homo sapiens
gtagtagttctgtgttg

SEQ ID NO: 4462991 - DNA, 21 bp, Homo sapiens
gtagtatggcctgacagctct

SEQ ID NO: 4462992 - DNA, 22 bp, Homo sapiens
gtagtatggcctgacagctctg

SEQ ID NO: 4462993 - DNA, 15 bp, Homo sapiens
gtagtattttttgta

SEQ ID NO: 4462994 - DNA, 14 bp, Homo sapiens
gtagtcaaaaacaa

SEQ ID NO: 4462995 - DNA, 23 bp, Homo sapiens
gtagtcccagctacttgggaggc

SEQ ID NO: 4462996 - DNA, 12 bp, Homo sapiens
gtagtcttgatg

SEQ ID NO: 4462997 - DNA, 18 bp, Homo sapiens
gtagtgcatttttaaact

SEQ ID NO: 4462998 - DNA, 16 bp, Homo sapiens
gtagtgtccccagcct

SEQ ID NO: 4462999 - DNA, 16 bp, Homo sapiens
gtagttctgtgcctcc

SEQ ID NO: 4463000 - DNA, 17 bp, Homo sapiens
gtagttgggtagaaaaa

SEQ ID NO: 4463001 - DNA, 18 bp, Homo sapiens
gtataaaataaagcaaat

SEQ ID NO: 4463002 - DNA, 16 bp, Homo sapiens
gtataaagcatgtggt

SEQ ID NO: 4463003 - DNA, 14 bp, Homo sapiens
gtataaatatcagt

SEQ ID NO: 4463004 - DNA, 17 bp, Homo sapiens
gtataaatatcagtatt

SEQ ID NO: 4463005 - DNA, 21 bp, Homo sapiens
gtataacattaagaaaatatt

SEQ ID NO: 4463006 - DNA, 16 bp, Homo sapiens
gtataagctgtctgaa

SEQ ID NO: 4463007 - DNA, 16 bp, Homo sapiens
gtataagttgctgtaa

SEQ ID NO: 4463008 - DNA, 14 bp, Homo sapiens
gtataatctcctct

SEQ ID NO: 4463009 - DNA, 16 bp, Homo sapiens
gtataatgctttctga

SEQ ID NO: 4463010 - DNA, 16 bp, Homo sapiens
gtataatgtgtctgtg

SEQ ID NO: 4463011 - DNA, 15 bp, Homo sapiens
gtataatgtttatta

SEQ ID NO: 4463012 - DNA, 16 bp, Homo sapiens
gtataccaatgtgttt

SEQ ID NO: 4463013 - DNA, 19 bp, Homo sapiens
gtataccaatgtgttttct

SEQ ID NO: 4463014 - DNA, 21 bp, Homo sapiens
gtataccaatgtgttttctgt

SEQ ID NO: 4463015 - DNA, 14 bp, Homo sapiens
gtatacgtataaat

SEQ ID NO: 4463016 - DNA, 18 bp, Homo sapiens
gtatacgtataaatatca

SEQ ID NO: 4463017 - DNA, 20 bp, Homo sapiens
gtatacgtataaatatcagt

SEQ ID NO: 4463018 - DNA, 15 bp, Homo sapiens
gtatactatagtacc

SEQ ID NO: 4463019 - DNA, 13 bp, Homo sapiens
gtatactcttgaa

SEQ ID NO: 4463020 - DNA, 13 bp, Homo sapiens
gtatactttaaat

SEQ ID NO: 4463021 - DNA, 22 bp, Homo sapiens
gtatactttaaataatttaact

SEQ ID NO: 4463022 - DNA, 22 bp, Homo sapiens
gtatagaaatgctggtttttca

SEQ ID NO: 4463023 - DNA, 23 bp, Homo sapiens
gtatagaaatgctggtttttcag

SEQ ID NO: 4463024 - DNA, 20 bp, Homo sapiens
gtatagatataatgaacaaa

SEQ ID NO: 4463025 - DNA, 15 bp, Homo sapiens
gtatagatggccaaa

SEQ ID NO: 4463026 - DNA, 15 bp, Homo sapiens
gtataggaatttgta

SEQ ID NO: 4463027 - DNA, 18 bp, Homo sapiens
gtatagtgttcacaaact

SEQ ID NO: 4463028 - DNA, 23 bp, Homo sapiens
gtatagtgttcacaaactgtgaa

SEQ ID NO: 4463029 - DNA, 20 bp, Homo sapiens
gtatataaacatatttttat

SEQ ID NO: 4463030 - DNA, 12 bp, Homo sapiens
gtatataagctt

SEQ ID NO: 4463031 - DNA, 13 bp, Homo sapiens
gtatataagcttt

SEQ ID NO: 4463032 - DNA, 17 bp, Homo sapiens
gtatataatcatgctca

SEQ ID NO: 4463033 - DNA, 23 bp, Homo sapiens
gtatataatttactttgtagact

SEQ ID NO: 4463034 - DNA, 12 bp, Homo sapiens
gtatatactttt

SEQ ID NO: 4463035 - DNA, 22 bp, Homo sapiens
gtatatatcttataactgtttt

SEQ ID NO: 4463036 - DNA, 18 bp, Homo sapiens
gtatatcgttatcactgt

SEQ ID NO: 4463037 - DNA, 18 bp, Homo sapiens
gtatatctcttggaaaat

SEQ ID NO: 4463038 - DNA, 16 bp, Homo sapiens
gtatatggtatttatt

SEQ ID NO: 4463039 - DNA, 19 bp, Homo sapiens
gtatatgtgagaaatcaga

SEQ ID NO: 4463040 - DNA, 14 bp, Homo sapiens
gtatattacaatga

SEQ ID NO: 4463041 - DNA, 12 bp, Homo sapiens
gtatattacacc

SEQ ID NO: 4463042 - DNA, 23 bp, Homo sapiens
gtatattcaggacttgaaagaaa

SEQ ID NO: 4463043 - DNA, 12 bp, Homo sapiens
gtatattgctaa

SEQ ID NO: 4463044 - DNA, 21 bp, Homo sapiens
gtatattgggtgtagatttct

SEQ ID NO: 4463045 - DNA, 17 bp, Homo sapiens
gtatattttatttcaat

SEQ ID NO: 4463046 - DNA, 19 bp, Homo sapiens
gtatattttctgtatttaa

SEQ ID NO: 4463047 - DNA, 21 bp, Homo sapiens
gtatattttctgtatttaatt

SEQ ID NO: 4463048 - DNA, 16 bp, Homo sapiens
gtatattttgtagtta

SEQ ID NO: 4463049 - DNA, 15 bp, Homo sapiens
gtatcaaaattacat

SEQ ID NO: 4463050 - DNA, 20 bp, Homo sapiens
gtatcaataaaattctgtaa

SEQ ID NO: 4463051 - DNA, 23 bp, Homo sapiens
gtatcaatttctaatgtttacta

SEQ ID NO: 4463052 - DNA, 13 bp, Homo sapiens
gtatcacagtgtt

SEQ ID NO: 4463053 - DNA, 14 bp, Homo sapiens
gtatcacagtgttt

SEQ ID NO: 4463054 - DNA, 22 bp, Homo sapiens
gtatcaggacccagaggaaggg

SEQ ID NO: 4463055 - DNA, 24 bp, Homo sapiens
gtatcatctggataggagcctgct

SEQ ID NO: 4463056 - DNA, 13 bp, Homo sapiens
gtatcatctttgc

SEQ ID NO: 4463057 - DNA, 14 bp, Homo sapiens
gtatcccactagcc

SEQ ID NO: 4463058 - DNA, 21 bp, Homo sapiens
gtatcctccctggcagacaca

SEQ ID NO: 4463059 - DNA, 15 bp, Homo sapiens
gtatcgtaaccagcc

SEQ ID NO: 4463060 - DNA, 17 bp, Homo sapiens
gtatcgtaaccagccag

SEQ ID NO: 4463061 - DNA, 21 bp, Homo sapiens
gtatctaagaataataaaatc

SEQ ID NO: 4463062 - DNA, 18 bp, Homo sapiens
gtatctacagtaatgaaa

SEQ ID NO: 4463063 - DNA, 17 bp, Homo sapiens
gtatctaggcatttcat

SEQ ID NO: 4463064 - DNA, 17 bp, Homo sapiens
gtatctatttgtacaat

SEQ ID NO: 4463065 - DNA, 19 bp, Homo sapiens
gtatctgggtaagaagaaa

SEQ ID NO: 4463066 - DNA, 23 bp, Homo sapiens
gtatcttacctagtgtttactcc

SEQ ID NO: 4463067 - DNA, 18 bp, Homo sapiens
gtatcttttatcctggga

SEQ ID NO: 4463068 - DNA, 23 bp, Homo sapiens
gtatgaataatgaaaataaaaca

SEQ ID NO: 4463069 - DNA, 16 bp, Homo sapiens
gtatgatgaggccaac

SEQ ID NO: 4463070 - DNA, 19 bp, Homo sapiens
gtatgcagtgtagatttta

SEQ ID NO: 4463071 - DNA, 13 bp, Homo sapiens
gtatgctggccag

SEQ ID NO: 4463072 - DNA, 22 bp, Homo sapiens
gtatgcttttataggcctgtgt

SEQ ID NO: 4463073 - DNA, 11 bp, Homo sapiens
gtatggagtta

SEQ ID NO: 4463074 - DNA, 20 bp, Homo sapiens
gtatggattgggggggccaa

SEQ ID NO: 4463075 - DNA, 14 bp, Homo sapiens
gtatggtcaggatg

SEQ ID NO: 4463076 - DNA, 15 bp, Homo sapiens
gtatggttgacacta

SEQ ID NO: 4463077 - DNA, 11 bp, Homo sapiens
gtatgtaaaaa

SEQ ID NO: 4463078 - DNA, 16 bp, Homo sapiens
gtatgtaaataggttt

SEQ ID NO: 4463079 - DNA, 11 bp, Homo sapiens
gtatgtacaat

SEQ ID NO: 4463080 - DNA, 16 bp, Homo sapiens
gtatgtacaatacaat

SEQ ID NO: 4463081 - DNA, 18 bp, Homo sapiens
gtatgtacaatacaatgt

SEQ ID NO: 4463082 - DNA, 21 bp, Homo sapiens
gtatgtacaatacaatgtaca

SEQ ID NO: 4463083 - DNA, 23 bp, Homo sapiens
gtatgtacaatacaatgtacaat

SEQ ID NO: 4463084 - DNA, 11 bp, Homo sapiens
gtatgtcactc

SEQ ID NO: 4463085 - DNA, 16 bp, Homo sapiens
gtatgtcactcagaaa

SEQ ID NO: 4463086 - DNA, 17 bp, Homo sapiens
gtatgtccttcagctga

SEQ ID NO: 4463087 - DNA, 20 bp, Homo sapiens
gtatgtgggggtctgtgtgt

SEQ ID NO: 4463088 - DNA, 13 bp, Homo sapiens
gtatgtgggtgac

SEQ ID NO: 4463089 - DNA, 14 bp, Homo sapiens
gtatgttatacaac

SEQ ID NO: 4463090 - DNA, 20 bp, Homo sapiens
gtatgtttgctgattattta

SEQ ID NO: 4463091 - DNA, 15 bp, Homo sapiens
gtatgtttgtacttg

SEQ ID NO: 4463092 - DNA, 22 bp, Homo sapiens
gtatgttttaattgcatttaaa

SEQ ID NO: 4463093 - DNA, 17 bp, Homo sapiens
gtattaaacctttccat

SEQ ID NO: 4463094 - DNA, 14 bp, Homo sapiens
gtattaacatgcaa

SEQ ID NO: 4463095 - DNA, 21 bp, Homo sapiens
gtattaagcccacagtatatt

SEQ ID NO: 4463096 - DNA, 19 bp, Homo sapiens
gtattaagggcattttaaa

SEQ ID NO: 4463097 - DNA, 12 bp, Homo sapiens
gtattaataaaa

SEQ ID NO: 4463098 - DNA, 13 bp, Homo sapiens
gtattaataaaaa

SEQ ID NO: 4463099 - DNA, 15 bp, Homo sapiens
gtattaataaaaaga

SEQ ID NO: 4463100 - DNA, 17 bp, Homo sapiens
gtattatctgttgcctt

SEQ ID NO: 4463101 - DNA, 20 bp, Homo sapiens
gtattatcttgttcaggaaa

SEQ ID NO: 4463102 - DNA, 15 bp, Homo sapiens
gtattattacaaata

SEQ ID NO: 4463103 - DNA, 16 bp, Homo sapiens
gtattatttacattta

SEQ ID NO: 4463104 - DNA, 19 bp, Homo sapiens
gtattcaaaaattatctat

SEQ ID NO: 4463105 - DNA, 18 bp, Homo sapiens
gtattcaccctgggcagt

SEQ ID NO: 4463106 - DNA, 17 bp, Homo sapiens
gtattcaggcactgaga

SEQ ID NO: 4463107 - DNA, 19 bp, Homo sapiens
gtattccaccttaaattaa

SEQ ID NO: 4463108 - DNA, 21 bp, Homo sapiens
gtattcccaaaaattactttg

SEQ ID NO: 4463109 - DNA, 17 bp, Homo sapiens
gtattcctgcctttgat

SEQ ID NO: 4463110 - DNA, 11 bp, Homo sapiens
gtattctctga

SEQ ID NO: 4463111 - DNA, 12 bp, Homo sapiens
gtattctctgag

SEQ ID NO: 4463112 - DNA, 12 bp, Homo sapiens
gtattcttcatg

SEQ ID NO: 4463113 - DNA, 16 bp, Homo sapiens
gtattcttcatgaaat

SEQ ID NO: 4463114 - DNA, 22 bp, Homo sapiens
gtattcttctcttccttttatc

SEQ ID NO: 4463115 - DNA, 16 bp, Homo sapiens
gtattcttgagggaca

SEQ ID NO: 4463116 - DNA, 20 bp, Homo sapiens
gtattgctgtccttgaatgc

SEQ ID NO: 4463117 - DNA, 21 bp, Homo sapiens
gtattgctgtgtctcctctca

SEQ ID NO: 4463118 - DNA, 10 bp, Homo sapiens
gtattggaaa

SEQ ID NO: 4463119 - DNA, 23 bp, Homo sapiens
gtattgggcaggaggaaaaggct

SEQ ID NO: 4463120 - DNA, 11 bp, Homo sapiens
gtattgtaaat

SEQ ID NO: 4463121 - DNA, 19 bp, Homo sapiens
gtattgtaaattatatttg

SEQ ID NO: 4463122 - DNA, 19 bp, Homo sapiens
gtattgtctattatttaga

SEQ ID NO: 4463123 - DNA, 17 bp, Homo sapiens
gtattgttagatgtttg

SEQ ID NO: 4463124 - DNA, 15 bp, Homo sapiens
gtatttaaaaacatt

SEQ ID NO: 4463125 - DNA, 20 bp, Homo sapiens
gtatttaactacatctgcct

SEQ ID NO: 4463126 - DNA, 15 bp, Homo sapiens
gtatttaccaaaaat

SEQ ID NO: 4463127 - DNA, 14 bp, Homo sapiens
gtatttagaagcca

SEQ ID NO: 4463128 - DNA, 19 bp, Homo sapiens
gtatttagactgtggccat

SEQ ID NO: 4463129 - DNA, 13 bp, Homo sapiens
gtatttataaaaa

SEQ ID NO: 4463130 - DNA, 20 bp, Homo sapiens
gtatttataaaaatataaat

SEQ ID NO: 4463131 - DNA, 20 bp, Homo sapiens
gtatttatttaaaactctgg

SEQ ID NO: 4463132 - DNA, 19 bp, Homo sapiens
gtatttattttttcttttc

SEQ ID NO: 4463133 - DNA, 19 bp, Homo sapiens
gtatttctggtgtatattt

SEQ ID NO: 4463134 - DNA, 23 bp, Homo sapiens
gtatttcttaagaattcaaattt

SEQ ID NO: 4463135 - DNA, 19 bp, Homo sapiens
gtatttctttgtagaataa

SEQ ID NO: 4463136 - DNA, 16 bp, Homo sapiens
gtatttgatgtacatt

SEQ ID NO: 4463137 - DNA, 18 bp, Homo sapiens
gtatttgattcaaaatat

SEQ ID NO: 4463138 - DNA, 19 bp, Homo sapiens
gtatttgattcaaaatatt

SEQ ID NO: 4463139 - DNA, 12 bp, Homo sapiens
gtatttgctaat

SEQ ID NO: 4463140 - DNA, 19 bp, Homo sapiens
gtatttggaaataaagtca

SEQ ID NO: 4463141 - DNA, 21 bp, Homo sapiens
gtatttggaaataaagtcaga

SEQ ID NO: 4463142 - DNA, 17 bp, Homo sapiens
gtatttgtattctctgc

SEQ ID NO: 4463143 - DNA, 18 bp, Homo sapiens
gtatttgttaatttagaa

SEQ ID NO: 4463144 - DNA, 15 bp, Homo sapiens
gtatttgttatatat

SEQ ID NO: 4463145 - DNA, 13 bp, Homo sapiens
gtattttaatcac

SEQ ID NO: 4463146 - DNA, 12 bp, Homo sapiens
gtattttcatag

SEQ ID NO: 4463147 - DNA, 13 bp, Homo sapiens
gtattttcatagt

SEQ ID NO: 4463148 - DNA, 13 bp, Homo sapiens
gtattttccagcc

SEQ ID NO: 4463149 - DNA, 21 bp, Homo sapiens
gtattttccagccttatgtgt

SEQ ID NO: 4463150 - DNA, 19 bp, Homo sapiens
gtattttgaaccaaaacat

SEQ ID NO: 4463151 - DNA, 20 bp, Homo sapiens
gtattttggaggtgcttgat

SEQ ID NO: 4463152 - DNA, 20 bp, Homo sapiens
gtatttttcatctttaagaa

SEQ ID NO: 4463153 - DNA, 19 bp, Homo sapiens
gtatttttgatgtatatat

SEQ ID NO: 4463154 - DNA, 21 bp, Homo sapiens
gtatttttgggctattgcata

SEQ ID NO: 4463155 - DNA, 21 bp, Homo sapiens
gtattttttcaagttgtaaat

SEQ ID NO: 4463156 - DNA, 14 bp, Homo sapiens
gtattttttccttt

SEQ ID NO: 4463157 - DNA, 16 bp, Homo sapiens
gtatttttttaaatca

SEQ ID NO: 4463158 - DNA, 22 bp, Homo sapiens
gtatttttttttctaagagaag

SEQ ID NO: 4463159 - DNA, 13 bp, Homo sapiens
gtcaaaaattttg

SEQ ID NO: 4463160 - DNA, 15 bp, Homo sapiens
gtcaaaaggtgcctg

SEQ ID NO: 4463161 - DNA, 21 bp, Homo sapiens
gtcaaaataaagattctcaca

SEQ ID NO: 4463162 - DNA, 14 bp, Homo sapiens
gtcaaaatatgtaa

SEQ ID NO: 4463163 - DNA, 13 bp, Homo sapiens
gtcaaagaagctt

SEQ ID NO: 4463164 - DNA, 18 bp, Homo sapiens
gtcaacagagaaggcagg

SEQ ID NO: 4463165 - DNA, 17 bp, Homo sapiens
gtcaacatttctcatgt

SEQ ID NO: 4463166 - DNA, 14 bp, Homo sapiens
gtcaacctgggcaa

SEQ ID NO: 4463167 - DNA, 18 bp, Homo sapiens
gtcaacggggggctcctg

SEQ ID NO: 4463168 - DNA, 20 bp, Homo sapiens
gtcaacggggggctcctgcc

SEQ ID NO: 4463169 - DNA, 22 bp, Homo sapiens
gtcaacggggggctcctgccca

SEQ ID NO: 4463170 - DNA, 17 bp, Homo sapiens
gtcaactctttgttatt

SEQ ID NO: 4463171 - DNA, 14 bp, Homo sapiens
gtcaactggctggc

SEQ ID NO: 4463172 - DNA, 15 bp, Homo sapiens
gtcaactggctggcc

SEQ ID NO: 4463173 - DNA, 21 bp, Homo sapiens
gtcaactttcctcaaatcaaa

SEQ ID NO: 4463174 - DNA, 12 bp, Homo sapiens
gtcaagacattt

SEQ ID NO: 4463175 - DNA, 13 bp, Homo sapiens
gtcaagacatttg

SEQ ID NO: 4463176 - DNA, 15 bp, Homo sapiens
gtcaagacatttgct

SEQ ID NO: 4463177 - DNA, 17 bp, Homo sapiens
gtcaagagtagttatat

SEQ ID NO: 4463178 - DNA, 14 bp, Homo sapiens
gtcaagctggtgct

SEQ ID NO: 4463179 - DNA, 13 bp, Homo sapiens
gtcaagcttctct

SEQ ID NO: 4463180 - DNA, 15 bp, Homo sapiens
gtcaagcttctctgt

SEQ ID NO: 4463181 - DNA, 13 bp, Homo sapiens
gtcaagtcaacca

SEQ ID NO: 4463182 - DNA, 17 bp, Homo sapiens
gtcaagtgcgtccacga

SEQ ID NO: 4463183 - DNA, 14 bp, Homo sapiens
gtcaagtgggatct

SEQ ID NO: 4463184 - DNA, 18 bp, Homo sapiens
gtcaagttgtgcttgttt

SEQ ID NO: 4463185 - DNA, 21 bp, Homo sapiens
gtcaataacactgtattttaa

SEQ ID NO: 4463186 - DNA, 22 bp, Homo sapiens
gtcaatcccctcattcaggaaa

SEQ ID NO: 4463187 - DNA, 22 bp, Homo sapiens
gtcaatgctatttttgttttta

SEQ ID NO: 4463188 - DNA, 12 bp, Homo sapiens
gtcaatgtactt

SEQ ID NO: 4463189 - DNA, 16 bp, Homo sapiens
gtcacaataaagttta

SEQ ID NO: 4463190 - DNA, 18 bp, Homo sapiens
gtcacacccatggcctca

SEQ ID NO: 4463191 - DNA, 21 bp, Homo sapiens
gtcacacccatggcctcagcc

SEQ ID NO: 4463192 - DNA, 22 bp, Homo sapiens
gtcacagacgtgaaagccagaa

SEQ ID NO: 4463193 - DNA, 15 bp, Homo sapiens
gtcacagaggcatag

SEQ ID NO: 4463194 - DNA, 20 bp, Homo sapiens
gtcacagagtgagactccat

SEQ ID NO: 4463195 - DNA, 14 bp, Homo sapiens
gtcacagatgaggc

SEQ ID NO: 4463196 - DNA, 21 bp, Homo sapiens
gtcacagcctcctctgtctgc

SEQ ID NO: 4463197 - DNA, 12 bp, Homo sapiens
gtcacagctgta

SEQ ID NO: 4463198 - DNA, 20 bp, Homo sapiens
gtcacagtaaaaataaaata

SEQ ID NO: 4463199 - DNA, 21 bp, Homo sapiens
gtcacagtaaagagtacactc

SEQ ID NO: 4463200 - DNA, 18 bp, Homo sapiens
gtcacagtcttgtgaact

SEQ ID NO: 4463201 - DNA, 14 bp, Homo sapiens
gtcacatcacaata

SEQ ID NO: 4463202 - DNA, 22 bp, Homo sapiens
gtcaccaccttcccagctctcc

SEQ ID NO: 4463203 - DNA, 16 bp, Homo sapiens
gtcaccacgactggcc

SEQ ID NO: 4463204 - DNA, 17 bp, Homo sapiens
gtcaccacgactggcca

SEQ ID NO: 4463205 - DNA, 19 bp, Homo sapiens
gtcaccagctatctgtcat

SEQ ID NO: 4463206 - DNA, 19 bp, Homo sapiens
gtcacccctttctgtccca

SEQ ID NO: 4463207 - DNA, 14 bp, Homo sapiens
gtcaccctggcctg

SEQ ID NO: 4463208 - DNA, 15 bp, Homo sapiens
gtcacctcagcactg

SEQ ID NO: 4463209 - DNA, 17 bp, Homo sapiens
gtcacctctcagctgct

SEQ ID NO: 4463210 - DNA, 22 bp, Homo sapiens
gtcacctcttccgactctttct

SEQ ID NO: 4463211 - DNA, 13 bp, Homo sapiens
gtcacctgtgctt

SEQ ID NO: 4463212 - DNA, 22 bp, Homo sapiens
gtcacgaggtccagacccactc

SEQ ID NO: 4463213 - DNA, 14 bp, Homo sapiens
gtcacgccagactt

SEQ ID NO: 4463214 - DNA, 19 bp, Homo sapiens
gtcacgtttggtgcttctc

SEQ ID NO: 4463215 - DNA, 16 bp, Homo sapiens
gtcactccaccatccc

SEQ ID NO: 4463216 - DNA, 19 bp, Homo sapiens
gtcactccaccatccccac

SEQ ID NO: 4463217 - DNA, 21 bp, Homo sapiens
gtcactccaccatccccaccc

SEQ ID NO: 4463218 - DNA, 22 bp, Homo sapiens
gtcactgcatttgcctgcttct

SEQ ID NO: 4463219 - DNA, 18 bp, Homo sapiens
gtcactggaggttgaagc

SEQ ID NO: 4463220 - DNA, 20 bp, Homo sapiens
gtcactggaggttgaagcca

SEQ ID NO: 4463221 - DNA, 22 bp, Homo sapiens
gtcactgtctcaactactcagc

SEQ ID NO: 4463222 - DNA, 18 bp, Homo sapiens
gtcacttaggtagtacca

SEQ ID NO: 4463223 - DNA, 13 bp, Homo sapiens
gtcacttgccaca

SEQ ID NO: 4463224 - DNA, 14 bp, Homo sapiens
gtcacttgccacat

SEQ ID NO: 4463225 - DNA, 14 bp, Homo sapiens
gtcactttttctga

SEQ ID NO: 4463226 - DNA, 20 bp, Homo sapiens
gtcagaacattcgaatctct

SEQ ID NO: 4463227 - DNA, 22 bp, Homo sapiens
gtcagaacattcgaatctctgc

SEQ ID NO: 4463228 - DNA, 16 bp, Homo sapiens
gtcagaaccctgccat

SEQ ID NO: 4463229 - DNA, 15 bp, Homo sapiens
gtcagaagtctagtt

SEQ ID NO: 4463230 - DNA, 12 bp, Homo sapiens
gtcagaataaaa

SEQ ID NO: 4463231 - DNA, 16 bp, Homo sapiens
gtcagacgcctgagga

SEQ ID NO: 4463232 - DNA, 17 bp, Homo sapiens
gtcagacgcctgaggaa

SEQ ID NO: 4463233 - DNA, 18 bp, Homo sapiens
gtcagacgcctgaggaac

SEQ ID NO: 4463234 - DNA, 19 bp, Homo sapiens
gtcagacttccaaatcctg

SEQ ID NO: 4463235 - DNA, 23 bp, Homo sapiens
gtcagacttccaaatcctggaag

SEQ ID NO: 4463236 - DNA, 12 bp, Homo sapiens
gtcagagccact

SEQ ID NO: 4463237 - DNA, 13 bp, Homo sapiens
gtcagagtccagt

SEQ ID NO: 4463238 - DNA, 16 bp, Homo sapiens
gtcagagtccagtgct

SEQ ID NO: 4463239 - DNA, 15 bp, Homo sapiens
gtcagagtgccactg

SEQ ID NO: 4463240 - DNA, 13 bp, Homo sapiens
gtcagattaaatt

SEQ ID NO: 4463241 - DNA, 16 bp, Homo sapiens
gtcagattcctttccc

SEQ ID NO: 4463242 - DNA, 22 bp, Homo sapiens
gtcagcatcactgatgggaata

SEQ ID NO: 4463243 - DNA, 14 bp, Homo sapiens
gtcagcatttgatc

SEQ ID NO: 4463244 - DNA, 11 bp, Homo sapiens
gtcagccagcc

SEQ ID NO: 4463245 - DNA, 18 bp, Homo sapiens
gtcagccatcgtcctggg

SEQ ID NO: 4463246 - DNA, 12 bp, Homo sapiens
gtcagcctccag

SEQ ID NO: 4463247 - DNA, 15 bp, Homo sapiens
gtcagcctccagcct

SEQ ID NO: 4463248 - DNA, 16 bp, Homo sapiens
gtcagcctctctccca

SEQ ID NO: 4463249 - DNA, 13 bp, Homo sapiens
gtcagcggtgcag

SEQ ID NO: 4463250 - DNA, 23 bp, Homo sapiens
gtcaggacggctcctcagagcgc

SEQ ID NO: 4463251 - DNA, 23 bp, Homo sapiens
gtcaggagttcaagaccagcctg

SEQ ID NO: 4463252 - DNA, 22 bp, Homo sapiens
gtcaggcccgtcagcatcactg

SEQ ID NO: 4463253 - DNA, 18 bp, Homo sapiens
gtcaggcctggcctcatc

SEQ ID NO: 4463254 - DNA, 16 bp, Homo sapiens
gtcaggcggagctgct

SEQ ID NO: 4463255 - DNA, 20 bp, Homo sapiens
gtcaggctgctggcgcctct

SEQ ID NO: 4463256 - DNA, 17 bp, Homo sapiens
gtcaggtggttaccagg

SEQ ID NO: 4463257 - DNA, 16 bp, Homo sapiens
gtcagtaccttcaaac

SEQ ID NO: 4463258 - DNA, 17 bp, Homo sapiens
gtcagtatgtggaagtg

SEQ ID NO: 4463259 - DNA, 21 bp, Homo sapiens
gtcagtatgtggaagtgtggg

SEQ ID NO: 4463260 - DNA, 19 bp, Homo sapiens
gtcagtccctacttaggaa

SEQ ID NO: 4463261 - DNA, 17 bp, Homo sapiens
gtcagtggccaggtgcc

SEQ ID NO: 4463262 - DNA, 22 bp, Homo sapiens
gtcagtgggaacgtgactgccc

SEQ ID NO: 4463263 - DNA, 13 bp, Homo sapiens
gtcagttgtaata

SEQ ID NO: 4463264 - DNA, 13 bp, Homo sapiens
gtcagttgtatca

SEQ ID NO: 4463265 - DNA, 13 bp, Homo sapiens
gtcagtttctaca

SEQ ID NO: 4463266 - DNA, 21 bp, Homo sapiens
gtcataaagtgagaaaactgt

SEQ ID NO: 4463267 - DNA, 16 bp, Homo sapiens
gtcataaatactgtca

SEQ ID NO: 4463268 - DNA, 14 bp, Homo sapiens
gtcataagtgggga

SEQ ID NO: 4463269 - DNA, 17 bp, Homo sapiens
gtcataagtggggagag

SEQ ID NO: 4463270 - DNA, 20 bp, Homo sapiens
gtcatagcaagcttttgctc

SEQ ID NO: 4463271 - DNA, 21 bp, Homo sapiens
gtcatagcaagcttttgctca

SEQ ID NO: 4463272 - DNA, 15 bp, Homo sapiens
gtcatcagatatgct

SEQ ID NO: 4463273 - DNA, 19 bp, Homo sapiens
gtcatcagtcatcaggtgt

SEQ ID NO: 4463274 - DNA, 19 bp, Homo sapiens
gtcatcggaggctgggccc

SEQ ID NO: 4463275 - DNA, 22 bp, Homo sapiens
gtcatcggaggctgggcccctg

SEQ ID NO: 4463276 - DNA, 23 bp, Homo sapiens
gtcatctagcgcaattgaaggat

SEQ ID NO: 4463277 - DNA, 18 bp, Homo sapiens
gtcatctcattccactgt

SEQ ID NO: 4463278 - DNA, 15 bp, Homo sapiens
gtcatctctctgggg

SEQ ID NO: 4463279 - DNA, 22 bp, Homo sapiens
gtcatctctctggggccctggg

SEQ ID NO: 4463280 - DNA, 13 bp, Homo sapiens
gtcatctctgttc

SEQ ID NO: 4463281 - DNA, 12 bp, Homo sapiens
gtcatcttgcta

SEQ ID NO: 4463282 - DNA, 18 bp, Homo sapiens
gtcatcttgctaccagta

SEQ ID NO: 4463283 - DNA, 20 bp, Homo sapiens
gtcatgacaagatgggacag

SEQ ID NO: 4463284 - DNA, 16 bp, Homo sapiens
gtcatgatctccctgc

SEQ ID NO: 4463285 - DNA, 14 bp, Homo sapiens
gtcatgatgaatca

SEQ ID NO: 4463286 - DNA, 13 bp, Homo sapiens
gtcatgggcctgt

SEQ ID NO: 4463287 - DNA, 14 bp, Homo sapiens
gtcatggtactacc

SEQ ID NO: 4463288 - DNA, 16 bp, Homo sapiens
gtcattagactcctcc

SEQ ID NO: 4463289 - DNA, 15 bp, Homo sapiens
gtcattatattctaa

SEQ ID NO: 4463290 - DNA, 18 bp, Homo sapiens
gtcattatattctaatta

SEQ ID NO: 4463291 - DNA, 23 bp, Homo sapiens
gtcattatttttgttagcaaaga

SEQ ID NO: 4463292 - DNA, 21 bp, Homo sapiens
gtcattcaggtgacctcctgc

SEQ ID NO: 4463293 - DNA, 21 bp, Homo sapiens
gtcattcccattccttttcgt

SEQ ID NO: 4463294 - DNA, 21 bp, Homo sapiens
gtcattcctaaaacacccttc

SEQ ID NO: 4463295 - DNA, 17 bp, Homo sapiens
gtcattcttttgccaca

SEQ ID NO: 4463296 - DNA, 22 bp, Homo sapiens
gtcattcttttgccacatccct

SEQ ID NO: 4463297 - DNA, 14 bp, Homo sapiens
gtcattgacttcat

SEQ ID NO: 4463298 - DNA, 16 bp, Homo sapiens
gtcattgacttcattt

SEQ ID NO: 4463299 - DNA, 18 bp, Homo sapiens
gtcattgcacctatctca

SEQ ID NO: 4463300 - DNA, 22 bp, Homo sapiens
gtcattgcacctatctcagcca

SEQ ID NO: 4463301 - DNA, 13 bp, Homo sapiens
gtcatttaaatgt

SEQ ID NO: 4463302 - DNA, 14 bp, Homo sapiens
gtcatttaaatgtg

SEQ ID NO: 4463303 - DNA, 18 bp, Homo sapiens
gtcatttaggatccatgc

SEQ ID NO: 4463304 - DNA, 20 bp, Homo sapiens
gtcatttcattccattgcct

SEQ ID NO: 4463305 - DNA, 16 bp, Homo sapiens
gtcattttattttgta

SEQ ID NO: 4463306 - DNA, 16 bp, Homo sapiens
gtcatttttaatgtat

SEQ ID NO: 4463307 - DNA, 23 bp, Homo sapiens
gtcatttttaatgtatctatttg

SEQ ID NO: 4463308 - DNA, 18 bp, Homo sapiens
gtccaaaagattgctgaa

SEQ ID NO: 4463309 - DNA, 22 bp, Homo sapiens
gtccaaaatatttgtgatttac

SEQ ID NO: 4463310 - DNA, 14 bp, Homo sapiens
gtccaaaggaggct

SEQ ID NO: 4463311 - DNA, 16 bp, Homo sapiens
gtccaaaggaggctgg

SEQ ID NO: 4463312 - DNA, 20 bp, Homo sapiens
gtccaaaggaggctggcagg

SEQ ID NO: 4463313 - DNA, 22 bp, Homo sapiens
gtccaaatgtcctccagaagcc

SEQ ID NO: 4463314 - DNA, 20 bp, Homo sapiens
gtccaacctaacccctttcc

SEQ ID NO: 4463315 - DNA, 21 bp, Homo sapiens
gtccaacctaacccctttcct

SEQ ID NO: 4463316 - DNA, 24 bp, Homo sapiens
gtccaagcataccaacacgagcag

SEQ ID NO: 4463317 - DNA, 17 bp, Homo sapiens
gtccaaggacaccctcc

SEQ ID NO: 4463318 - DNA, 18 bp, Homo sapiens
gtccaaggccagtcccca

SEQ ID NO: 4463319 - DNA, 14 bp, Homo sapiens
gtccaatatgaaaa

SEQ ID NO: 4463320 - DNA, 17 bp, Homo sapiens
gtccaatcctatgtttt

SEQ ID NO: 4463321 - DNA, 20 bp, Homo sapiens
gtccaatgccacctagactc

SEQ ID NO: 4463322 - DNA, 22 bp, Homo sapiens
gtccaatgccacctagactctc

SEQ ID NO: 4463323 - DNA, 18 bp, Homo sapiens
gtccacaggtccaaggac

SEQ ID NO: 4463324 - DNA, 16 bp, Homo sapiens
gtccaccatgctctct

SEQ ID NO: 4463325 - DNA, 20 bp, Homo sapiens
gtccaccatgctctctcacc

SEQ ID NO: 4463326 - DNA, 17 bp, Homo sapiens
gtccaccctgagctcgg

SEQ ID NO: 4463327 - DNA, 22 bp, Homo sapiens
gtccaccctgagctcggggaca

SEQ ID NO: 4463328 - DNA, 15 bp, Homo sapiens
gtccacgactgtctc

SEQ ID NO: 4463329 - DNA, 15 bp, Homo sapiens
gtccacgcccaccag

SEQ ID NO: 4463330 - DNA, 23 bp, Homo sapiens
gtccacgcccaccagccttgctc

SEQ ID NO: 4463331 - DNA, 12 bp, Homo sapiens
gtccagaaatgg

SEQ ID NO: 4463332 - DNA, 11 bp, Homo sapiens
gtccagacagc

SEQ ID NO: 4463333 - DNA, 14 bp, Homo sapiens
gtccagacccaagt

SEQ ID NO: 4463334 - DNA, 20 bp, Homo sapiens
gtccagaccccccagcccct

SEQ ID NO: 4463335 - DNA, 16 bp, Homo sapiens
gtccagagaccacacc

SEQ ID NO: 4463336 - DNA, 19 bp, Homo sapiens
gtccagagacccctcaatc

SEQ ID NO: 4463337 - DNA, 13 bp, Homo sapiens
gtccagcagtctg

SEQ ID NO: 4463338 - DNA, 20 bp, Homo sapiens
gtccagccgccattgccacc

SEQ ID NO: 4463339 - DNA, 22 bp, Homo sapiens
gtccagccgccattgccaccag

SEQ ID NO: 4463340 - DNA, 11 bp, Homo sapiens
gtccagcctgg

SEQ ID NO: 4463341 - DNA, 19 bp, Homo sapiens
gtccagctgggaagccctt

SEQ ID NO: 4463342 - DNA, 17 bp, Homo sapiens
gtccagctggggccaga

SEQ ID NO: 4463343 - DNA, 19 bp, Homo sapiens
gtccagctggggccagagg

SEQ ID NO: 4463344 - DNA, 20 bp, Homo sapiens
gtccagctggggccagaggc

SEQ ID NO: 4463345 - DNA, 23 bp, Homo sapiens
gtccaggcccccaacccctcctc

SEQ ID NO: 4463346 - DNA, 15 bp, Homo sapiens
gtccaggcccccagc

SEQ ID NO: 4463347 - DNA, 17 bp, Homo sapiens
gtccaggcccccagccc

SEQ ID NO: 4463348 - DNA, 14 bp, Homo sapiens
gtccaggcctctct

SEQ ID NO: 4463349 - DNA, 17 bp, Homo sapiens
gtccaggcctctctctg

SEQ ID NO: 4463350 - DNA, 22 bp, Homo sapiens
gtccagggaaacagcctctctc

SEQ ID NO: 4463351 - DNA, 23 bp, Homo sapiens
gtccagggaaacagcctctctct

SEQ ID NO: 4463352 - DNA, 14 bp, Homo sapiens
gtccaggggcccct

SEQ ID NO: 4463353 - DNA, 21 bp, Homo sapiens
gtccaggggcccctccagctt

SEQ ID NO: 4463354 - DNA, 22 bp, Homo sapiens
gtccaggggtctgtctgctttg

SEQ ID NO: 4463355 - DNA, 17 bp, Homo sapiens
gtccagggtttctctgc

SEQ ID NO: 4463356 - DNA, 14 bp, Homo sapiens
gtccaggtcccagc

SEQ ID NO: 4463357 - DNA, 15 bp, Homo sapiens
gtccagtgctctgcc

SEQ ID NO: 4463358 - DNA, 16 bp, Homo sapiens
gtccagtgctctgcct

SEQ ID NO: 4463359 - DNA, 16 bp, Homo sapiens
gtccagttttcttgct

SEQ ID NO: 4463360 - DNA, 19 bp, Homo sapiens
gtccatagagatgagccca

SEQ ID NO: 4463361 - DNA, 17 bp, Homo sapiens
gtccatatcacacacat

SEQ ID NO: 4463362 - DNA, 18 bp, Homo sapiens
gtccatatcacacacatt

SEQ ID NO: 4463363 - DNA, 15 bp, Homo sapiens
gtccatatgcatcta

SEQ ID NO: 4463364 - DNA, 17 bp, Homo sapiens
gtccatccccttccccc

SEQ ID NO: 4463365 - DNA, 19 bp, Homo sapiens
gtccatccccttcccccat

SEQ ID NO: 4463366 - DNA, 15 bp, Homo sapiens
gtccatccgactgcc

SEQ ID NO: 4463367 - DNA, 15 bp, Homo sapiens
gtccatctgacaaaa

SEQ ID NO: 4463368 - DNA, 15 bp, Homo sapiens
gtccatgctccaggg

SEQ ID NO: 4463369 - DNA, 13 bp, Homo sapiens
gtccatgggcaga

SEQ ID NO: 4463370 - DNA, 23 bp, Homo sapiens
gtccatgggcagagcccaaggga

SEQ ID NO: 4463371 - DNA, 13 bp, Homo sapiens
gtccatttcctaa

SEQ ID NO: 4463372 - DNA, 13 bp, Homo sapiens
gtcccaagctggg

SEQ ID NO: 4463373 - DNA, 21 bp, Homo sapiens
gtcccaagctgggccccagcc

SEQ ID NO: 4463374 - DNA, 15 bp, Homo sapiens
gtcccaattaaaata

SEQ ID NO: 4463375 - DNA, 16 bp, Homo sapiens
gtcccaattaaaatac

SEQ ID NO: 4463376 - DNA, 15 bp, Homo sapiens
gtcccaattctgccc

SEQ ID NO: 4463377 - DNA, 16 bp, Homo sapiens
gtcccacatcagggcg

SEQ ID NO: 4463378 - DNA, 12 bp, Homo sapiens
gtcccacccacc

SEQ ID NO: 4463379 - DNA, 12 bp, Homo sapiens
gtcccactgtgc

SEQ ID NO: 4463380 - DNA, 21 bp, Homo sapiens
gtcccagactaaaggatccag

SEQ ID NO: 4463381 - DNA, 21 bp, Homo sapiens
gtcccagattggctcacactg

SEQ ID NO: 4463382 - DNA, 17 bp, Homo sapiens
gtcccagcccctcctcc

SEQ ID NO: 4463383 - DNA, 21 bp, Homo sapiens
gtcccagcccctcctccctca

SEQ ID NO: 4463384 - DNA, 17 bp, Homo sapiens
gtcccaggccggcccag

SEQ ID NO: 4463385 - DNA, 21 bp, Homo sapiens
gtcccaggggcagccacacca

SEQ ID NO: 4463386 - DNA, 17 bp, Homo sapiens
gtcccagtgaactcggc

SEQ ID NO: 4463387 - DNA, 21 bp, Homo sapiens
gtcccatgctggctgaagagg

SEQ ID NO: 4463388 - DNA, 14 bp, Homo sapiens
gtcccattcagtgg

SEQ ID NO: 4463389 - DNA, 16 bp, Homo sapiens
gtcccattctagatcc

SEQ ID NO: 4463390 - DNA, 20 bp, Homo sapiens
gtcccattctagatcctgca

SEQ ID NO: 4463391 - DNA, 16 bp, Homo sapiens
gtcccatttttctctt

SEQ ID NO: 4463392 - DNA, 17 bp, Homo sapiens
gtccccaaacaggacag

SEQ ID NO: 4463393 - DNA, 16 bp, Homo sapiens
gtccccaacgtcccct

SEQ ID NO: 4463394 - DNA, 20 bp, Homo sapiens
gtccccaacgtcccctccgc

SEQ ID NO: 4463395 - DNA, 15 bp, Homo sapiens
gtccccacccatgcg

SEQ ID NO: 4463396 - DNA, 16 bp, Homo sapiens
gtccccacccctgccc

SEQ ID NO: 4463397 - DNA, 16 bp, Homo sapiens
gtccccagagctcccc

SEQ ID NO: 4463398 - DNA, 18 bp, Homo sapiens
gtccccagtttgcagaaa

SEQ ID NO: 4463399 - DNA, 17 bp, Homo sapiens
gtcccccagagcatctg

SEQ ID NO: 4463400 - DNA, 19 bp, Homo sapiens
gtcccccagagcatctgcc

SEQ ID NO: 4463401 - DNA, 24 bp, Homo sapiens
gtcccccagagcatctgccccagg

SEQ ID NO: 4463402 - DNA, 13 bp, Homo sapiens
gtcccccaggctg

SEQ ID NO: 4463403 - DNA, 14 bp, Homo sapiens
gtcccccaggctgg

SEQ ID NO: 4463404 - DNA, 18 bp, Homo sapiens
gtcccccaggctggagtg

SEQ ID NO: 4463405 - DNA, 20 bp, Homo sapiens
gtcccccaggctggagtgca

SEQ ID NO: 4463406 - DNA, 21 bp, Homo sapiens
gtccccccccaacctttccct

SEQ ID NO: 4463407 - DNA, 16 bp, Homo sapiens
gtccccctcctcagcc

SEQ ID NO: 4463408 - DNA, 21 bp, Homo sapiens
gtccccctcctcagccagcct

SEQ ID NO: 4463409 - DNA, 13 bp, Homo sapiens
gtccccctctgtc

SEQ ID NO: 4463410 - DNA, 19 bp, Homo sapiens
gtcccctcactctgtcagc

SEQ ID NO: 4463411 - DNA, 20 bp, Homo sapiens
gtcccctcactctgtcagcc

SEQ ID NO: 4463412 - DNA, 13 bp, Homo sapiens
gtcccctccccca

SEQ ID NO: 4463413 - DNA, 12 bp, Homo sapiens
gtcccctccgcc

SEQ ID NO: 4463414 - DNA, 16 bp, Homo sapiens
gtccccttcccctgct

SEQ ID NO: 4463415 - DNA, 16 bp, Homo sapiens
gtcccgcactctgccc

SEQ ID NO: 4463416 - DNA, 17 bp, Homo sapiens
gtcccgctgctgtgctc

SEQ ID NO: 4463417 - DNA, 17 bp, Homo sapiens
gtcccggctctgtgggt

SEQ ID NO: 4463418 - DNA, 22 bp, Homo sapiens
gtcccgggacacctaggctagg

SEQ ID NO: 4463419 - DNA, 15 bp, Homo sapiens
gtcccggggccagca

SEQ ID NO: 4463420 - DNA, 17 bp, Homo sapiens
gtcccggggccagcact

SEQ ID NO: 4463421 - DNA, 21 bp, Homo sapiens
gtcccggttcagacccctgcc

SEQ ID NO: 4463422 - DNA, 23 bp, Homo sapiens
gtcccggttcagacccctgcctg

SEQ ID NO: 4463423 - DNA, 15 bp, Homo sapiens
gtccctccctgcctg

SEQ ID NO: 4463424 - DNA, 16 bp, Homo sapiens
gtccctgaagagaagg

SEQ ID NO: 4463425 - DNA, 22 bp, Homo sapiens
gtccctgagatttaacccctcc

SEQ ID NO: 4463426 - DNA, 13 bp, Homo sapiens
gtccctgcctgga

SEQ ID NO: 4463427 - DNA, 14 bp, Homo sapiens
gtccctgcctggac

SEQ ID NO: 4463428 - DNA, 22 bp, Homo sapiens
gtccctgcctggaccagcctct

SEQ ID NO: 4463429 - DNA, 23 bp, Homo sapiens
gtccctggagggcaagccctgcc

SEQ ID NO: 4463430 - DNA, 20 bp, Homo sapiens
gtccctgggggaagccctgg

SEQ ID NO: 4463431 - DNA, 21 bp, Homo sapiens
gtccctgggggaagccctgga

SEQ ID NO: 4463432 - DNA, 18 bp, Homo sapiens
gtccctgtcatttgaacc

SEQ ID NO: 4463433 - DNA, 16 bp, Homo sapiens
gtccctgtccctctag

SEQ ID NO: 4463434 - DNA, 20 bp, Homo sapiens
gtcccttccaatgctgtggg

SEQ ID NO: 4463435 - DNA, 12 bp, Homo sapiens
gtcccttcccct

SEQ ID NO: 4463436 - DNA, 13 bp, Homo sapiens
gtcccttcccctc

SEQ ID NO: 4463437 - DNA, 14 bp, Homo sapiens
gtcccttcccctcc

SEQ ID NO: 4463438 - DNA, 18 bp, Homo sapiens
gtcccttgagacctcagc

SEQ ID NO: 4463439 - DNA, 13 bp, Homo sapiens
gtcccttgcagct

SEQ ID NO: 4463440 - DNA, 20 bp, Homo sapiens
gtcccttgcctctgccctgg

SEQ ID NO: 4463441 - DNA, 16 bp, Homo sapiens
gtccctttcccctaga

SEQ ID NO: 4463442 - DNA, 15 bp, Homo sapiens
gtcccttttccctta

SEQ ID NO: 4463443 - DNA, 20 bp, Homo sapiens
gtccgctgaagatggagggg

SEQ ID NO: 4463444 - DNA, 20 bp, Homo sapiens
gtccggcctctccctgcctg

SEQ ID NO: 4463445 - DNA, 17 bp, Homo sapiens
gtccgtagctcccctgg

SEQ ID NO: 4463446 - DNA, 18 bp, Homo sapiens
gtcctaaagggacaataa

SEQ ID NO: 4463447 - DNA, 19 bp, Homo sapiens
gtcctaactttctgaatta

SEQ ID NO: 4463448 - DNA, 15 bp, Homo sapiens
gtcctaaggaacctt

SEQ ID NO: 4463449 - DNA, 17 bp, Homo sapiens
gtcctaccatcagctct

SEQ ID NO: 4463450 - DNA, 18 bp, Homo sapiens
gtcctaccatcagctctg

SEQ ID NO: 4463451 - DNA, 19 bp, Homo sapiens
gtcctaccatcagctctgc

SEQ ID NO: 4463452 - DNA, 21 bp, Homo sapiens
gtcctaccatcagctctgcct

SEQ ID NO: 4463453 - DNA, 22 bp, Homo sapiens
gtcctaccatcagctctgcctt

SEQ ID NO: 4463454 - DNA, 20 bp, Homo sapiens
gtcctacgtccaaggtggca

SEQ ID NO: 4463455 - DNA, 15 bp, Homo sapiens
gtcctagcccttccc

SEQ ID NO: 4463456 - DNA, 18 bp, Homo sapiens
gtcctagcccttccctga

SEQ ID NO: 4463457 - DNA, 16 bp, Homo sapiens
gtcctagctcttacac

SEQ ID NO: 4463458 - DNA, 15 bp, Homo sapiens
gtcctatgcaataaa

SEQ ID NO: 4463459 - DNA, 20 bp, Homo sapiens
gtcctatgcaataaaattat

SEQ ID NO: 4463460 - DNA, 22 bp, Homo sapiens
gtcctattgtgactcttctaaa

SEQ ID NO: 4463461 - DNA, 14 bp, Homo sapiens
gtcctcactcccag

SEQ ID NO: 4463462 - DNA, 16 bp, Homo sapiens
gtcctcactcccagtc

SEQ ID NO: 4463463 - DNA, 12 bp, Homo sapiens
gtcctcagcccc

SEQ ID NO: 4463464 - DNA, 19 bp, Homo sapiens
gtcctccagaagcctctgg

SEQ ID NO: 4463465 - DNA, 16 bp, Homo sapiens
gtcctccccctgccag

SEQ ID NO: 4463466 - DNA, 19 bp, Homo sapiens
gtcctccccctgccagtgc

SEQ ID NO: 4463467 - DNA, 22 bp, Homo sapiens
gtcctccccctgccagtgcctt

SEQ ID NO: 4463468 - DNA, 14 bp, Homo sapiens
gtcctccctcaccc

SEQ ID NO: 4463469 - DNA, 15 bp, Homo sapiens
gtcctccctgacttt

SEQ ID NO: 4463470 - DNA, 15 bp, Homo sapiens
gtcctcctcacctca

SEQ ID NO: 4463471 - DNA, 17 bp, Homo sapiens
gtcctcctcacctcatg

SEQ ID NO: 4463472 - DNA, 21 bp, Homo sapiens
gtcctcctcacctcatgccca

SEQ ID NO: 4463473 - DNA, 14 bp, Homo sapiens
gtcctcctctgtga

SEQ ID NO: 4463474 - DNA, 22 bp, Homo sapiens
gtcctcctggtgggtccagggg

SEQ ID NO: 4463475 - DNA, 20 bp, Homo sapiens
gtcctctcagttctctccct

SEQ ID NO: 4463476 - DNA, 18 bp, Homo sapiens
gtcctctccctgccaagt

SEQ ID NO: 4463477 - DNA, 13 bp, Homo sapiens
gtcctctcgagcc

SEQ ID NO: 4463478 - DNA, 13 bp, Homo sapiens
gtcctctcttcca

SEQ ID NO: 4463479 - DNA, 22 bp, Homo sapiens
gtcctcttctgctcttttcctg

SEQ ID NO: 4463480 - DNA, 23 bp, Homo sapiens
gtcctcttctgctcttttcctgg

SEQ ID NO: 4463481 - DNA, 13 bp, Homo sapiens
gtcctcttttcct

SEQ ID NO: 4463482 - DNA, 18 bp, Homo sapiens
gtcctcttttcctggcag

SEQ ID NO: 4463483 - DNA, 17 bp, Homo sapiens
gtcctgatcagagccgt

SEQ ID NO: 4463484 - DNA, 21 bp, Homo sapiens
gtcctgcacaccctgggccac

SEQ ID NO: 4463485 - DNA, 11 bp, Homo sapiens
gtcctgccagc

SEQ ID NO: 4463486 - DNA, 14 bp, Homo sapiens
gtcctgcccatgtg

SEQ ID NO: 4463487 - DNA, 17 bp, Homo sapiens
gtcctgcccatgtgtcc

SEQ ID NO: 4463488 - DNA, 14 bp, Homo sapiens
gtcctgcctggcca

SEQ ID NO: 4463489 - DNA, 13 bp, Homo sapiens
gtcctggcagggc

SEQ ID NO: 4463490 - DNA, 14 bp, Homo sapiens
gtcctgggcctgcc

SEQ ID NO: 4463491 - DNA, 16 bp, Homo sapiens
gtcctgtctctgcctg

SEQ ID NO: 4463492 - DNA, 15 bp, Homo sapiens
gtcctgttccctacc

SEQ ID NO: 4463493 - DNA, 17 bp, Homo sapiens
gtcctgtttctgtcaag

SEQ ID NO: 4463494 - DNA, 18 bp, Homo sapiens
gtccttaggcctctgaga

SEQ ID NO: 4463495 - DNA, 15 bp, Homo sapiens
gtccttatgttaagc

SEQ ID NO: 4463496 - DNA, 14 bp, Homo sapiens
gtccttatttattt

SEQ ID NO: 4463497 - DNA, 22 bp, Homo sapiens
gtccttcagtgagcccctcccc

SEQ ID NO: 4463498 - DNA, 19 bp, Homo sapiens
gtccttccctgttctccct

SEQ ID NO: 4463499 - DNA, 19 bp, Homo sapiens
gtccttgcctgaactccag

SEQ ID NO: 4463500 - DNA, 15 bp, Homo sapiens
gtccttgggtccatt

SEQ ID NO: 4463501 - DNA, 14 bp, Homo sapiens
gtcctttctcagag

SEQ ID NO: 4463502 - DNA, 18 bp, Homo sapiens
gtccttttcactacacca

SEQ ID NO: 4463503 - DNA, 20 bp, Homo sapiens
gtccttttgacactgctcta

SEQ ID NO: 4463504 - DNA, 22 bp, Homo sapiens
gtcgagaaagaggcaccaggaa

SEQ ID NO: 4463505 - DNA, 18 bp, Homo sapiens
gtcgagattgcactgctg

SEQ ID NO: 4463506 - DNA, 17 bp, Homo sapiens
gtcgaggctgcagtcag

SEQ ID NO: 4463507 - DNA, 13 bp, Homo sapiens
gtcgccaggctag

SEQ ID NO: 4463508 - DNA, 15 bp, Homo sapiens
gtcgccccaggccct

SEQ ID NO: 4463509 - DNA, 17 bp, Homo sapiens
gtcgccccgtgtttgcg

SEQ ID NO: 4463510 - DNA, 14 bp, Homo sapiens
gtcgcctgcctgca

SEQ ID NO: 4463511 - DNA, 18 bp, Homo sapiens
gtcgcctgcctgcagcag

SEQ ID NO: 4463512 - DNA, 22 bp, Homo sapiens
gtcgctcagtctgttcactgca

SEQ ID NO: 4463513 - DNA, 16 bp, Homo sapiens
gtcggactgcccccag

SEQ ID NO: 4463514 - DNA, 17 bp, Homo sapiens
gtcggactgcccccaga

SEQ ID NO: 4463515 - DNA, 17 bp, Homo sapiens
gtcggaggtgctgtccc

SEQ ID NO: 4463516 - DNA, 13 bp, Homo sapiens
gtcggatctcaca

SEQ ID NO: 4463517 - DNA, 22 bp, Homo sapiens
gtcggccccaccagtgcctctc

SEQ ID NO: 4463518 - DNA, 14 bp, Homo sapiens
gtcggccccatctc

SEQ ID NO: 4463519 - DNA, 15 bp, Homo sapiens
gtcggctaagtggga

SEQ ID NO: 4463520 - DNA, 18 bp, Homo sapiens
gtcgggagttcgagacca

SEQ ID NO: 4463521 - DNA, 14 bp, Homo sapiens
gtcgggcagccagc

SEQ ID NO: 4463522 - DNA, 22 bp, Homo sapiens
gtcgggcatggtggctcatgcc

SEQ ID NO: 4463523 - DNA, 15 bp, Homo sapiens
gtcgggcttccctgg

SEQ ID NO: 4463524 - DNA, 17 bp, Homo sapiens
gtcgtgatgtggaggaa

SEQ ID NO: 4463525 - DNA, 23 bp, Homo sapiens
gtcgtggacacacacagactatt

SEQ ID NO: 4463526 - DNA, 21 bp, Homo sapiens
gtcgttgttgtggaagcatgt

SEQ ID NO: 4463527 - DNA, 11 bp, Homo sapiens
gtcgttttcca

SEQ ID NO: 4463528 - DNA, 15 bp, Homo sapiens
gtcgttttccaaaga

SEQ ID NO: 4463529 - DNA, 20 bp, Homo sapiens
gtctaatgattcaaatgttt

SEQ ID NO: 4463530 - DNA, 17 bp, Homo sapiens
gtctacccagagaagcc

SEQ ID NO: 4463531 - DNA, 21 bp, Homo sapiens
gtctacgggggcacttggagg

SEQ ID NO: 4463532 - DNA, 22 bp, Homo sapiens
gtctactggacaatcttatgtt

SEQ ID NO: 4463533 - DNA, 21 bp, Homo sapiens
gtctaggagctgggaggaaaa

SEQ ID NO: 4463534 - DNA, 17 bp, Homo sapiens
gtctaggattgggcctc

SEQ ID NO: 4463535 - DNA, 23 bp, Homo sapiens
gtctaggcaggacctgtggccaa

SEQ ID NO: 4463536 - DNA, 14 bp, Homo sapiens
gtctagggagagac

SEQ ID NO: 4463537 - DNA, 17 bp, Homo sapiens
gtctatctaatgacatg

SEQ ID NO: 4463538 - DNA, 20 bp, Homo sapiens
gtctatctggtattaaatgc

SEQ ID NO: 4463539 - DNA, 23 bp, Homo sapiens
gtctatgtagctgaaaataaaat

SEQ ID NO: 4463540 - DNA, 18 bp, Homo sapiens
gtctattttatatctgtt

SEQ ID NO: 4463541 - DNA, 18 bp, Homo sapiens
gtctattttgtctatagg

SEQ ID NO: 4463542 - DNA, 15 bp, Homo sapiens
gtctcaatgaaatag

SEQ ID NO: 4463543 - DNA, 22 bp, Homo sapiens
gtctcactgtgggaaggccagc

SEQ ID NO: 4463544 - DNA, 23 bp, Homo sapiens
gtctcagacactaaatgcagaca

SEQ ID NO: 4463545 - DNA, 16 bp, Homo sapiens
gtctcagcctctgcca

SEQ ID NO: 4463546 - DNA, 22 bp, Homo sapiens
gtctcagcctctgccagcgcca

SEQ ID NO: 4463547 - DNA, 20 bp, Homo sapiens
gtctcaggtttgttttgtga

SEQ ID NO: 4463548 - DNA, 22 bp, Homo sapiens
gtctcagtcattgctgttgtat

SEQ ID NO: 4463549 - DNA, 22 bp, Homo sapiens
gtctcagtggcttcatctgtca

SEQ ID NO: 4463550 - DNA, 14 bp, Homo sapiens
gtctcagtttcttg

SEQ ID NO: 4463551 - DNA, 19 bp, Homo sapiens
gtctcataggttgagcaat

SEQ ID NO: 4463552 - DNA, 16 bp, Homo sapiens
gtctcatccatcatca

SEQ ID NO: 4463553 - DNA, 22 bp, Homo sapiens
gtctcatcctcccattgcccag

SEQ ID NO: 4463554 - DNA, 16 bp, Homo sapiens
gtctcattttaatgta

SEQ ID NO: 4463555 - DNA, 20 bp, Homo sapiens
gtctcattttaatgtaaaga

SEQ ID NO: 4463556 - DNA, 16 bp, Homo sapiens
gtctccaaccccccag

SEQ ID NO: 4463557 - DNA, 14 bp, Homo sapiens
gtctccacttgtat

SEQ ID NO: 4463558 - DNA, 13 bp, Homo sapiens
gtctccagctgct

SEQ ID NO: 4463559 - DNA, 11 bp, Homo sapiens
gtctcccaaca

SEQ ID NO: 4463560 - DNA, 16 bp, Homo sapiens
gtctcccaacatggga

SEQ ID NO: 4463561 - DNA, 19 bp, Homo sapiens
gtctccccaattctcccct

SEQ ID NO: 4463562 - DNA, 12 bp, Homo sapiens
gtctccccttcc

SEQ ID NO: 4463563 - DNA, 16 bp, Homo sapiens
gtctccccttcctggc

SEQ ID NO: 4463564 - DNA, 16 bp, Homo sapiens
gtctccctcctctgcc

SEQ ID NO: 4463565 - DNA, 14 bp, Homo sapiens
gtctccctctcctg

SEQ ID NO: 4463566 - DNA, 15 bp, Homo sapiens
gtctccctctcctgc

SEQ ID NO: 4463567 - DNA, 18 bp, Homo sapiens
gtctccctctcctgccta

SEQ ID NO: 4463568 - DNA, 20 bp, Homo sapiens
gtctccctctcctgcctact

SEQ ID NO: 4463569 - DNA, 22 bp, Homo sapiens
gtctccctctcctgcctactca

SEQ ID NO: 4463570 - DNA, 11 bp, Homo sapiens
gtctccctggc

SEQ ID NO: 4463571 - DNA, 14 bp, Homo sapiens
gtctccctggctcc

SEQ ID NO: 4463572 - DNA, 15 bp, Homo sapiens
gtctccctggctccc

SEQ ID NO: 4463573 - DNA, 19 bp, Homo sapiens
gtctcccttggcccagaga

SEQ ID NO: 4463574 - DNA, 17 bp, Homo sapiens
gtctcctaaaactggga

SEQ ID NO: 4463575 - DNA, 22 bp, Homo sapiens
gtctcctatatatttctattat

SEQ ID NO: 4463576 - DNA, 15 bp, Homo sapiens
gtctcctcactccct

SEQ ID NO: 4463577 - DNA, 14 bp, Homo sapiens
gtctcgctctgtca

SEQ ID NO: 4463578 - DNA, 22 bp, Homo sapiens
gtctcgctctgtcgcccaggct

SEQ ID NO: 4463579 - DNA, 23 bp, Homo sapiens
gtctcgttttgttgccaaagctg

SEQ ID NO: 4463580 - DNA, 22 bp, Homo sapiens
gtctctaccaaaaaaaggaagg

SEQ ID NO: 4463581 - DNA, 17 bp, Homo sapiens
gtctctactaaaaatac

SEQ ID NO: 4463582 - DNA, 13 bp, Homo sapiens
gtctctctcccat

SEQ ID NO: 4463583 - DNA, 21 bp, Homo sapiens
gtctctcttcagactctcagc

SEQ ID NO: 4463584 - DNA, 20 bp, Homo sapiens
gtctctcttctctccagctg

SEQ ID NO: 4463585 - DNA, 16 bp, Homo sapiens
gtctctcttggaccca

SEQ ID NO: 4463586 - DNA, 10 bp, Homo sapiens
gtctctgaag

SEQ ID NO: 4463587 - DNA, 17 bp, Homo sapiens
gtctctgaatacacagt

SEQ ID NO: 4463588 - DNA, 17 bp, Homo sapiens
gtctctgtataatctat

SEQ ID NO: 4463589 - DNA, 20 bp, Homo sapiens
gtctctgtataatctattta

SEQ ID NO: 4463590 - DNA, 22 bp, Homo sapiens
gtctcttctgagctatttcatc

SEQ ID NO: 4463591 - DNA, 12 bp, Homo sapiens
gtctctttctca

SEQ ID NO: 4463592 - DNA, 21 bp, Homo sapiens
gtctgaaactggcttccccac

SEQ ID NO: 4463593 - DNA, 21 bp, Homo sapiens
gtctgaagtacaaacatgaaa

SEQ ID NO: 4463594 - DNA, 12 bp, Homo sapiens
gtctgaatattt

SEQ ID NO: 4463595 - DNA, 14 bp, Homo sapiens
gtctgagagaggcc

SEQ ID NO: 4463596 - DNA, 18 bp, Homo sapiens
gtctgagagaggccattc

SEQ ID NO: 4463597 - DNA, 20 bp, Homo sapiens
gtctgagccacagcagcatt

SEQ ID NO: 4463598 - DNA, 13 bp, Homo sapiens
gtctgagccctgg

SEQ ID NO: 4463599 - DNA, 20 bp, Homo sapiens
gtctgagtagtggccactgg

SEQ ID NO: 4463600 - DNA, 22 bp, Homo sapiens
gtctgagtagtggccactgggg

SEQ ID NO: 4463601 - DNA, 18 bp, Homo sapiens
gtctgagtctgagtcctg

SEQ ID NO: 4463602 - DNA, 13 bp, Homo sapiens
gtctgatctgtgc

SEQ ID NO: 4463603 - DNA, 15 bp, Homo sapiens
gtctgatctgtgctt

SEQ ID NO: 4463604 - DNA, 23 bp, Homo sapiens
gtctgatctgtgctttccagctc

SEQ ID NO: 4463605 - DNA, 14 bp, Homo sapiens
gtctgcaccttaga

SEQ ID NO: 4463606 - DNA, 16 bp, Homo sapiens
gtctgcatttcatatt

SEQ ID NO: 4463607 - DNA, 18 bp, Homo sapiens
gtctgcatttcatattat

SEQ ID NO: 4463608 - DNA, 11 bp, Homo sapiens
gtctgcctctt

SEQ ID NO: 4463609 - DNA, 22 bp, Homo sapiens
gtctgccttcacaaatgtcatt

SEQ ID NO: 4463610 - DNA, 22 bp, Homo sapiens
gtctgcggggggtgtcttccct

SEQ ID NO: 4463611 - DNA, 21 bp, Homo sapiens
gtctgctctgctgctctgacc

SEQ ID NO: 4463612 - DNA, 15 bp, Homo sapiens
gtctgctgatgcagc

SEQ ID NO: 4463613 - DNA, 14 bp, Homo sapiens
gtctggaagtccaa

SEQ ID NO: 4463614 - DNA, 13 bp, Homo sapiens
gtctggaccccgt

SEQ ID NO: 4463615 - DNA, 17 bp, Homo sapiens
gtctggagaagcagtga

SEQ ID NO: 4463616 - DNA, 22 bp, Homo sapiens
gtctggatctgggaccctttcc

SEQ ID NO: 4463617 - DNA, 20 bp, Homo sapiens
gtctggctcggacccacccc

SEQ ID NO: 4463618 - DNA, 21 bp, Homo sapiens
gtctggctcggacccacccca

SEQ ID NO: 4463619 - DNA, 17 bp, Homo sapiens
gtctggctttggcactc

SEQ ID NO: 4463620 - DNA, 23 bp, Homo sapiens
gtctgggaacttgcgagtccaag

SEQ ID NO: 4463621 - DNA, 18 bp, Homo sapiens
gtctgggcactggatgca

SEQ ID NO: 4463622 - DNA, 15 bp, Homo sapiens
gtctgtaaaaaatgg

SEQ ID NO: 4463623 - DNA, 20 bp, Homo sapiens
gtctgtaaaaaatggagctc

SEQ ID NO: 4463624 - DNA, 23 bp, Homo sapiens
gtctgtaaaaaatggagctcagt

SEQ ID NO: 4463625 - DNA, 19 bp, Homo sapiens
gtctgtaaatctaacatta

SEQ ID NO: 4463626 - DNA, 14 bp, Homo sapiens
gtctgtagagggcc

SEQ ID NO: 4463627 - DNA, 14 bp, Homo sapiens
gtctgtcaggggct

SEQ ID NO: 4463628 - DNA, 16 bp, Homo sapiens
gtctgtcaggggcttg

SEQ ID NO: 4463629 - DNA, 22 bp, Homo sapiens
gtctgtcaggggcttggatttc

SEQ ID NO: 4463630 - DNA, 22 bp, Homo sapiens
gtctgtcatgaacatgttcctg

SEQ ID NO: 4463631 - DNA, 21 bp, Homo sapiens
gtctgtctacatttctgcaga

SEQ ID NO: 4463632 - DNA, 16 bp, Homo sapiens
gtctgtctttcctgaa

SEQ ID NO: 4463633 - DNA, 20 bp, Homo sapiens
gtctgtctttcctgaaccat

SEQ ID NO: 4463634 - DNA, 18 bp, Homo sapiens
gtctgtgaacagagagac

SEQ ID NO: 4463635 - DNA, 15 bp, Homo sapiens
gtctgtgatctctgc

SEQ ID NO: 4463636 - DNA, 16 bp, Homo sapiens
gtctgtgatctctgct

SEQ ID NO: 4463637 - DNA, 13 bp, Homo sapiens
gtctgtgcacatg

SEQ ID NO: 4463638 - DNA, 19 bp, Homo sapiens
gtctgtgcacatgcctctg

SEQ ID NO: 4463639 - DNA, 16 bp, Homo sapiens
gtctgtggattttttc

SEQ ID NO: 4463640 - DNA, 20 bp, Homo sapiens
gtctgtgtgctgtttgaaaa

SEQ ID NO: 4463641 - DNA, 18 bp, Homo sapiens
gtctgtgtgggactgtac

SEQ ID NO: 4463642 - DNA, 20 bp, Homo sapiens
gtctgtgtgtgtgtatgtgg

SEQ ID NO: 4463643 - DNA, 11 bp, Homo sapiens
gtctgtgtgtt

SEQ ID NO: 4463644 - DNA, 17 bp, Homo sapiens
gtctgtgttttgaaaga

SEQ ID NO: 4463645 - DNA, 14 bp, Homo sapiens
gtctgttatttatt

SEQ ID NO: 4463646 - DNA, 15 bp, Homo sapiens
gtctgttcccagccc

SEQ ID NO: 4463647 - DNA, 22 bp, Homo sapiens
gtctgttcccagcccctgcaga

SEQ ID NO: 4463648 - DNA, 17 bp, Homo sapiens
gtctgtttaaagtggca

SEQ ID NO: 4463649 - DNA, 14 bp, Homo sapiens
gtcttaaaaaatgt

SEQ ID NO: 4463650 - DNA, 16 bp, Homo sapiens
gtcttaaaaaatgtga

SEQ ID NO: 4463651 - DNA, 13 bp, Homo sapiens
gtcttaagggtca

SEQ ID NO: 4463652 - DNA, 21 bp, Homo sapiens
gtcttaattaaaagaatattt

SEQ ID NO: 4463653 - DNA, 19 bp, Homo sapiens
gtcttaatttatttcttaa

SEQ ID NO: 4463654 - DNA, 18 bp, Homo sapiens
gtcttacataaaccattt

SEQ ID NO: 4463655 - DNA, 23 bp, Homo sapiens
gtcttagaagtggaccaggacag

SEQ ID NO: 4463656 - DNA, 16 bp, Homo sapiens
gtcttcagctttatcc

SEQ ID NO: 4463657 - DNA, 14 bp, Homo sapiens
gtcttccacaaaga

SEQ ID NO: 4463658 - DNA, 16 bp, Homo sapiens
gtcttccacaaagaaa

SEQ ID NO: 4463659 - DNA, 19 bp, Homo sapiens
gtcttccacaaagaaaatt

SEQ ID NO: 4463660 - DNA, 15 bp, Homo sapiens
gtcttcccagggtag

SEQ ID NO: 4463661 - DNA, 15 bp, Homo sapiens
gtcttccctgcttca

SEQ ID NO: 4463662 - DNA, 14 bp, Homo sapiens
gtcttccctgggct

SEQ ID NO: 4463663 - DNA, 16 bp, Homo sapiens
gtcttccctgggctgc

SEQ ID NO: 4463664 - DNA, 15 bp, Homo sapiens
gtcttccttctaccc

SEQ ID NO: 4463665 - DNA, 14 bp, Homo sapiens
gtcttctatttatt

SEQ ID NO: 4463666 - DNA, 15 bp, Homo sapiens
gtcttgaaaactgtg

SEQ ID NO: 4463667 - DNA, 17 bp, Homo sapiens
gtcttgaaatgaaaggg

SEQ ID NO: 4463668 - DNA, 21 bp, Homo sapiens
gtcttgaaatgaaagggaaac

SEQ ID NO: 4463669 - DNA, 18 bp, Homo sapiens
gtcttgatgaccaaagtc

SEQ ID NO: 4463670 - DNA, 16 bp, Homo sapiens
gtcttgatgttttttc

SEQ ID NO: 4463671 - DNA, 18 bp, Homo sapiens
gtcttgccaactccatct

SEQ ID NO: 4463672 - DNA, 16 bp, Homo sapiens
gtcttgctctgtcccc

SEQ ID NO: 4463673 - DNA, 19 bp, Homo sapiens
gtcttgctgttgacatatt

SEQ ID NO: 4463674 - DNA, 19 bp, Homo sapiens
gtcttgggggtcagggggg

SEQ ID NO: 4463675 - DNA, 17 bp, Homo sapiens
gtcttgtcatacaaatt

SEQ ID NO: 4463676 - DNA, 11 bp, Homo sapiens
gtcttgtgaaa

SEQ ID NO: 4463677 - DNA, 19 bp, Homo sapiens
gtctttaaaaactgtttta

SEQ ID NO: 4463678 - DNA, 12 bp, Homo sapiens
gtctttaatcat

SEQ ID NO: 4463679 - DNA, 24 bp, Homo sapiens
gtctttataaagctgttcttgaaa

SEQ ID NO: 4463680 - DNA, 15 bp, Homo sapiens
gtctttcagtacttt

SEQ ID NO: 4463681 - DNA, 18 bp, Homo sapiens
gtctttcattcggtgtga

SEQ ID NO: 4463682 - DNA, 19 bp, Homo sapiens
gtctttcattcggtgtgaa

SEQ ID NO: 4463683 - DNA, 21 bp, Homo sapiens
gtctttccaaattatttctta

SEQ ID NO: 4463684 - DNA, 20 bp, Homo sapiens
gtctttccattggatctcat

SEQ ID NO: 4463685 - DNA, 20 bp, Homo sapiens
gtctttctagccataataaa

SEQ ID NO: 4463686 - DNA, 22 bp, Homo sapiens
gtctttctagccataataaaat

SEQ ID NO: 4463687 - DNA, 19 bp, Homo sapiens
gtctttctttggtgccttt

SEQ ID NO: 4463688 - DNA, 13 bp, Homo sapiens
gtctttgccttct

SEQ ID NO: 4463689 - DNA, 16 bp, Homo sapiens
gtctttgtaatgtcac

SEQ ID NO: 4463690 - DNA, 13 bp, Homo sapiens
gtcttttaaaatg

SEQ ID NO: 4463691 - DNA, 15 bp, Homo sapiens
gtcttttgttcgcat

SEQ ID NO: 4463692 - DNA, 16 bp, Homo sapiens
gtcttttgttctctga

SEQ ID NO: 4463693 - DNA, 13 bp, Homo sapiens
gtcttttttctct

SEQ ID NO: 4463694 - DNA, 18 bp, Homo sapiens
gtgaaaacgtcttccttc

SEQ ID NO: 4463695 - DNA, 13 bp, Homo sapiens
gtgaaaagagcaa

SEQ ID NO: 4463696 - DNA, 15 bp, Homo sapiens
gtgaaaatagtgtaa

SEQ ID NO: 4463697 - DNA, 20 bp, Homo sapiens
gtgaaaatagtgtaagaact

SEQ ID NO: 4463698 - DNA, 23 bp, Homo sapiens
gtgaaaatatacttgactctaat

SEQ ID NO: 4463699 - DNA, 21 bp, Homo sapiens
gtgaaagggagctatcaggaa

SEQ ID NO: 4463700 - DNA, 14 bp, Homo sapiens
gtgaaatgtaactg

SEQ ID NO: 4463701 - DNA, 13 bp, Homo sapiens
gtgaaattatttt

SEQ ID NO: 4463702 - DNA, 20 bp, Homo sapiens
gtgaaccaaaaatagaaatt

SEQ ID NO: 4463703 - DNA, 15 bp, Homo sapiens
gtgaaccaatgcaag

SEQ ID NO: 4463704 - DNA, 22 bp, Homo sapiens
gtgaacctacctgccttggaga

SEQ ID NO: 4463705 - DNA, 19 bp, Homo sapiens
gtgaactcatcccttgttt

SEQ ID NO: 4463706 - DNA, 12 bp, Homo sapiens
gtgaactgtgtg

SEQ ID NO: 4463707 - DNA, 22 bp, Homo sapiens
gtgaactgtgtgtgaatctgct

SEQ ID NO: 4463708 - DNA, 23 bp, Homo sapiens
gtgaagaatttagatcttatatt

SEQ ID NO: 4463709 - DNA, 22 bp, Homo sapiens
gtgaaggattatggaaaaataa

SEQ ID NO: 4463710 - DNA, 22 bp, Homo sapiens
gtgaaggcttctctctgtggga

SEQ ID NO: 4463711 - DNA, 16 bp, Homo sapiens
gtgaagggaaagataa

SEQ ID NO: 4463712 - DNA, 15 bp, Homo sapiens
gtgaagtgtggctgg

SEQ ID NO: 4463713 - DNA, 18 bp, Homo sapiens
gtgaagtgtggctggtgt

SEQ ID NO: 4463714 - DNA, 22 bp, Homo sapiens
gtgaagtgtggctggtgtcccc

SEQ ID NO: 4463715 - DNA, 16 bp, Homo sapiens
gtgaagtgttaataca

SEQ ID NO: 4463716 - DNA, 17 bp, Homo sapiens
gtgaagttgaataaaca

SEQ ID NO: 4463717 - DNA, 14 bp, Homo sapiens
gtgaataccccaag

SEQ ID NO: 4463718 - DNA, 15 bp, Homo sapiens
gtgaatacctgctca

SEQ ID NO: 4463719 - DNA, 14 bp, Homo sapiens
gtgaatagcctggc

SEQ ID NO: 4463720 - DNA, 19 bp, Homo sapiens
gtgaataggttatatgcaa

SEQ ID NO: 4463721 - DNA, 15 bp, Homo sapiens
gtgaatcagacccta

SEQ ID NO: 4463722 - DNA, 14 bp, Homo sapiens
gtgaatctgctttt

SEQ ID NO: 4463723 - DNA, 13 bp, Homo sapiens
gtgaatgaacact

SEQ ID NO: 4463724 - DNA, 17 bp, Homo sapiens
gtgaatgtggcagttta

SEQ ID NO: 4463725 - DNA, 21 bp, Homo sapiens
gtgaattaggctgtaactact

SEQ ID NO: 4463726 - DNA, 17 bp, Homo sapiens
gtgaattattgacactg

SEQ ID NO: 4463727 - DNA, 14 bp, Homo sapiens
gtgaatttatgaga

SEQ ID NO: 4463728 - DNA, 11 bp, Homo sapiens
gtgaattttta

SEQ ID NO: 4463729 - DNA, 13 bp, Homo sapiens
gtgaatttttaag

SEQ ID NO: 4463730 - DNA, 13 bp, Homo sapiens
gtgaatttttgca

SEQ ID NO: 4463731 - DNA, 17 bp, Homo sapiens
gtgaatttttgcaataa

SEQ ID NO: 4463732 - DNA, 23 bp, Homo sapiens
gtgaatttttgcaataatgcagt

SEQ ID NO: 4463733 - DNA, 16 bp, Homo sapiens
gtgacaaataagatta

SEQ ID NO: 4463734 - DNA, 16 bp, Homo sapiens
gtgacaattctgtttt

SEQ ID NO: 4463735 - DNA, 14 bp, Homo sapiens
gtgacacctccccc

SEQ ID NO: 4463736 - DNA, 19 bp, Homo sapiens
gtgacaggaaagccctccc

SEQ ID NO: 4463737 - DNA, 16 bp, Homo sapiens
gtgacagtcataaata

SEQ ID NO: 4463738 - DNA, 15 bp, Homo sapiens
gtgacagtggctgct

SEQ ID NO: 4463739 - DNA, 18 bp, Homo sapiens
gtgacataattgtccagt

SEQ ID NO: 4463740 - DNA, 20 bp, Homo sapiens
gtgacatggtgcctgagagg

SEQ ID NO: 4463741 - DNA, 24 bp, Homo sapiens
gtgacatggtgcctgagaggcagg

SEQ ID NO: 4463742 - DNA, 15 bp, Homo sapiens
gtgaccaatgtcttg

SEQ ID NO: 4463743 - DNA, 13 bp, Homo sapiens
gtgacccatctgt

SEQ ID NO: 4463744 - DNA, 16 bp, Homo sapiens
gtgacccatctgtagt

SEQ ID NO: 4463745 - DNA, 19 bp, Homo sapiens
gtgacctccatactgggct

SEQ ID NO: 4463746 - DNA, 19 bp, Homo sapiens
gtgacctcggacagagccc

SEQ ID NO: 4463747 - DNA, 21 bp, Homo sapiens
gtgacctcggacagagccccc

SEQ ID NO: 4463748 - DNA, 14 bp, Homo sapiens
gtgacctcttgcct

SEQ ID NO: 4463749 - DNA, 17 bp, Homo sapiens
gtgacctcttgcctcga

SEQ ID NO: 4463750 - DNA, 19 bp, Homo sapiens
gtgactctagcaaggctca

SEQ ID NO: 4463751 - DNA, 14 bp, Homo sapiens
gtgactctccaggg

SEQ ID NO: 4463752 - DNA, 12 bp, Homo sapiens
gtgactctttcc

SEQ ID NO: 4463753 - DNA, 16 bp, Homo sapiens
gtgactgccccaactc

SEQ ID NO: 4463754 - DNA, 20 bp, Homo sapiens
gtgactgccccaactcctgg

SEQ ID NO: 4463755 - DNA, 13 bp, Homo sapiens
gtgactgtcccac

SEQ ID NO: 4463756 - DNA, 18 bp, Homo sapiens
gtgactgtgtaactttct

SEQ ID NO: 4463757 - DNA, 17 bp, Homo sapiens
gtgacttctgctgctgg

SEQ ID NO: 4463758 - DNA, 15 bp, Homo sapiens
gtgagaaatttaaac

SEQ ID NO: 4463759 - DNA, 13 bp, Homo sapiens
gtgagacaggctg

SEQ ID NO: 4463760 - DNA, 15 bp, Homo sapiens
gtgagacaggctggg

SEQ ID NO: 4463761 - DNA, 15 bp, Homo sapiens
gtgagacccccacac

SEQ ID NO: 4463762 - DNA, 16 bp, Homo sapiens
gtgagacccccacacc

SEQ ID NO: 4463763 - DNA, 20 bp, Homo sapiens
gtgagactcgagaactttca

SEQ ID NO: 4463764 - DNA, 13 bp, Homo sapiens
gtgagactgtaca

SEQ ID NO: 4463765 - DNA, 17 bp, Homo sapiens
gtgagagaaatgaagtt

SEQ ID NO: 4463766 - DNA, 16 bp, Homo sapiens
gtgagagtcaaagctg

SEQ ID NO: 4463767 - DNA, 21 bp, Homo sapiens
gtgagatcaacaacactactt

SEQ ID NO: 4463768 - DNA, 23 bp, Homo sapiens
gtgagcaccaccagggctccagg

SEQ ID NO: 4463769 - DNA, 16 bp, Homo sapiens
gtgagcatcagagggc

SEQ ID NO: 4463770 - DNA, 19 bp, Homo sapiens
gtgagcatgcacactgaga

SEQ ID NO: 4463771 - DNA, 16 bp, Homo sapiens
gtgagcatggggccag

SEQ ID NO: 4463772 - DNA, 19 bp, Homo sapiens
gtgagcatgggtgtgccct

SEQ ID NO: 4463773 - DNA, 16 bp, Homo sapiens
gtgagccaaaatcatg

SEQ ID NO: 4463774 - DNA, 23 bp, Homo sapiens
gtgagccaagatcgcaccactgc

SEQ ID NO: 4463775 - DNA, 18 bp, Homo sapiens
gtgagccaccgtgcctgg

SEQ ID NO: 4463776 - DNA, 19 bp, Homo sapiens
gtgagccaccgtgcctggc

SEQ ID NO: 4463777 - DNA, 13 bp, Homo sapiens
gtgagccctgctc

SEQ ID NO: 4463778 - DNA, 14 bp, Homo sapiens
gtgagccctgctct

SEQ ID NO: 4463779 - DNA, 23 bp, Homo sapiens
gtgagctggggactcagggaccg

SEQ ID NO: 4463780 - DNA, 11 bp, Homo sapiens
gtgaggagctg

SEQ ID NO: 4463781 - DNA, 21 bp, Homo sapiens
gtgaggagtccagcacaacct

SEQ ID NO: 4463782 - DNA, 15 bp, Homo sapiens
gtgaggatgtctggg

SEQ ID NO: 4463783 - DNA, 17 bp, Homo sapiens
gtgaggcaggggcggag

SEQ ID NO: 4463784 - DNA, 15 bp, Homo sapiens
gtgaggccagggcag

SEQ ID NO: 4463785 - DNA, 16 bp, Homo sapiens
gtgagggagacaggaa

SEQ ID NO: 4463786 - DNA, 22 bp, Homo sapiens
gtgaggggggggtgggtgagag

SEQ ID NO: 4463787 - DNA, 16 bp, Homo sapiens
gtgagtagttgttggt

SEQ ID NO: 4463788 - DNA, 14 bp, Homo sapiens
gtgagtcatttaaa

SEQ ID NO: 4463789 - DNA, 22 bp, Homo sapiens
gtgagtcatttaaatgtgtaca

SEQ ID NO: 4463790 - DNA, 15 bp, Homo sapiens
gtgagtgccatgctt

SEQ ID NO: 4463791 - DNA, 20 bp, Homo sapiens
gtgagtgtgaatataaatgt

SEQ ID NO: 4463792 - DNA, 16 bp, Homo sapiens
gtgagttgcatgtttt

SEQ ID NO: 4463793 - DNA, 19 bp, Homo sapiens
gtgagttgcatgtttttga

SEQ ID NO: 4463794 - DNA, 17 bp, Homo sapiens
gtgagtttgagctgcct

SEQ ID NO: 4463795 - DNA, 21 bp, Homo sapiens
gtgagttttactcttaaatca

SEQ ID NO: 4463796 - DNA, 21 bp, Homo sapiens
gtgataagggaaaagataaag

SEQ ID NO: 4463797 - DNA, 15 bp, Homo sapiens
gtgataattttgaat

SEQ ID NO: 4463798 - DNA, 17 bp, Homo sapiens
gtgataggtacctgagt

SEQ ID NO: 4463799 - DNA, 14 bp, Homo sapiens
gtgatatttttctt

SEQ ID NO: 4463800 - DNA, 17 bp, Homo sapiens
gtgatcaatatttttat

SEQ ID NO: 4463801 - DNA, 20 bp, Homo sapiens
gtgatccacccgcctcagcc

SEQ ID NO: 4463802 - DNA, 22 bp, Homo sapiens
gtgatccgcctacctcagcctc

SEQ ID NO: 4463803 - DNA, 15 bp, Homo sapiens
gtgatctcagatcag

SEQ ID NO: 4463804 - DNA, 21 bp, Homo sapiens
gtgatcttaatatatttgaaa

SEQ ID NO: 4463805 - DNA, 17 bp, Homo sapiens
gtgatgaacatattcat

SEQ ID NO: 4463806 - DNA, 13 bp, Homo sapiens
gtgatggagagga

SEQ ID NO: 4463807 - DNA, 17 bp, Homo sapiens
gtgatggagaggacaga

SEQ ID NO: 4463808 - DNA, 23 bp, Homo sapiens
gtgatggagtttctctagaagct

SEQ ID NO: 4463809 - DNA, 15 bp, Homo sapiens
gtgatggccagcccc

SEQ ID NO: 4463810 - DNA, 16 bp, Homo sapiens
gtgatggccagcccct

SEQ ID NO: 4463811 - DNA, 17 bp, Homo sapiens
gtgatgggaaagcattg

SEQ ID NO: 4463812 - DNA, 21 bp, Homo sapiens
gtgatgggcccgcctcggcct

SEQ ID NO: 4463813 - DNA, 16 bp, Homo sapiens
gtgatgtaaaaatgct

SEQ ID NO: 4463814 - DNA, 13 bp, Homo sapiens
gtgatgtcactca

SEQ ID NO: 4463815 - DNA, 14 bp, Homo sapiens
gtgatgtggaggaa

SEQ ID NO: 4463816 - DNA, 22 bp, Homo sapiens
gtgatgtttggattgatatcgt

SEQ ID NO: 4463817 - DNA, 17 bp, Homo sapiens
gtgattaccagggactg

SEQ ID NO: 4463818 - DNA, 23 bp, Homo sapiens
gtgattactctttgctttgtagt

SEQ ID NO: 4463819 - DNA, 18 bp, Homo sapiens
gtgattatctctttgatc

SEQ ID NO: 4463820 - DNA, 21 bp, Homo sapiens
gtgattcagaaaatgttctgt

SEQ ID NO: 4463821 - DNA, 23 bp, Homo sapiens
gtgattccactacacctggctga

SEQ ID NO: 4463822 - DNA, 20 bp, Homo sapiens
gtgattcccaactcctttct

SEQ ID NO: 4463823 - DNA, 13 bp, Homo sapiens
gtgattctgcctt

SEQ ID NO: 4463824 - DNA, 11 bp, Homo sapiens
gtgattgtgaa

SEQ ID NO: 4463825 - DNA, 14 bp, Homo sapiens
gtgattgtggaatg

SEQ ID NO: 4463826 - DNA, 21 bp, Homo sapiens
gtgatttctttaaaagaatga

SEQ ID NO: 4463827 - DNA, 19 bp, Homo sapiens
gtgattttaagacaagctg

SEQ ID NO: 4463828 - DNA, 17 bp, Homo sapiens
gtgatttttatgccacc

SEQ ID NO: 4463829 - DNA, 20 bp, Homo sapiens
gtgatttttatgccacctga

SEQ ID NO: 4463830 - DNA, 21 bp, Homo sapiens
gtgcaaacagtaacgtgtgcg

SEQ ID NO: 4463831 - DNA, 17 bp, Homo sapiens
gtgcaaattcagaactg

SEQ ID NO: 4463832 - DNA, 22 bp, Homo sapiens
gtgcaaggtggcctttgtgctg

SEQ ID NO: 4463833 - DNA, 13 bp, Homo sapiens
gtgcaatgtaaat

SEQ ID NO: 4463834 - DNA, 20 bp, Homo sapiens
gtgcaatgtaaatattttaa

SEQ ID NO: 4463835 - DNA, 22 bp, Homo sapiens
gtgcaatgtaaatattttaaag

SEQ ID NO: 4463836 - DNA, 18 bp, Homo sapiens
gtgcaattccaagaaaat

SEQ ID NO: 4463837 - DNA, 19 bp, Homo sapiens
gtgcaattccaagaaaata

SEQ ID NO: 4463838 - DNA, 13 bp, Homo sapiens
gtgcacaaggatt

SEQ ID NO: 4463839 - DNA, 15 bp, Homo sapiens
gtgcacgtggagagc

SEQ ID NO: 4463840 - DNA, 18 bp, Homo sapiens
gtgcacgtggagagctgg

SEQ ID NO: 4463841 - DNA, 20 bp, Homo sapiens
gtgcactgctccctggggtt

SEQ ID NO: 4463842 - DNA, 15 bp, Homo sapiens
gtgcagaaaatattt

SEQ ID NO: 4463843 - DNA, 17 bp, Homo sapiens
gtgcagccttcccctcc

SEQ ID NO: 4463844 - DNA, 20 bp, Homo sapiens
gtgcagccttcccctccctg

SEQ ID NO: 4463845 - DNA, 17 bp, Homo sapiens
gtgcagcgtgtgtgcca

SEQ ID NO: 4463846 - DNA, 19 bp, Homo sapiens
gtgcagcttcacccaccag

SEQ ID NO: 4463847 - DNA, 17 bp, Homo sapiens
gtgcaggctgcagtggc

SEQ ID NO: 4463848 - DNA, 21 bp, Homo sapiens
gtgcagggaagtgcagagctt

SEQ ID NO: 4463849 - DNA, 18 bp, Homo sapiens
gtgcagggatattgcctt

SEQ ID NO: 4463850 - DNA, 13 bp, Homo sapiens
gtgcaggtctcca

SEQ ID NO: 4463851 - DNA, 18 bp, Homo sapiens
gtgcaggtctccacctgc

SEQ ID NO: 4463852 - DNA, 15 bp, Homo sapiens
gtgcaggtggggaga

SEQ ID NO: 4463853 - DNA, 23 bp, Homo sapiens
gtgcagtctttgagataatttgt

SEQ ID NO: 4463854 - DNA, 19 bp, Homo sapiens
gtgcagtttcttttcacat

SEQ ID NO: 4463855 - DNA, 13 bp, Homo sapiens
gtgcataatgctt

SEQ ID NO: 4463856 - DNA, 20 bp, Homo sapiens
gtgcatagttgtagacaaag

SEQ ID NO: 4463857 - DNA, 14 bp, Homo sapiens
gtgcatcccccctg

SEQ ID NO: 4463858 - DNA, 19 bp, Homo sapiens
gtgcatccttgtaatacct

SEQ ID NO: 4463859 - DNA, 20 bp, Homo sapiens
gtgcatccttgtaatacctg

SEQ ID NO: 4463860 - DNA, 15 bp, Homo sapiens
gtgcatctcagatgc

SEQ ID NO: 4463861 - DNA, 22 bp, Homo sapiens
gtgcatctcctcccgcccttcc

SEQ ID NO: 4463862 - DNA, 13 bp, Homo sapiens
gtgcatgctctct

SEQ ID NO: 4463863 - DNA, 15 bp, Homo sapiens
gtgcatgctctctgc

SEQ ID NO: 4463864 - DNA, 16 bp, Homo sapiens
gtgcatgctctctgca

SEQ ID NO: 4463865 - DNA, 18 bp, Homo sapiens
gtgcatgctctctgcagc

SEQ ID NO: 4463866 - DNA, 24 bp, Homo sapiens
gtgcatggaagtaattaaggtaca

SEQ ID NO: 4463867 - DNA, 12 bp, Homo sapiens
gtgcatgggctc

SEQ ID NO: 4463868 - DNA, 23 bp, Homo sapiens
gtgcatttgtgctagaaattttc

SEQ ID NO: 4463869 - DNA, 21 bp, Homo sapiens
gtgcattttctaagtgggaca

SEQ ID NO: 4463870 - DNA, 22 bp, Homo sapiens
gtgcatttttaaacttgaaata

SEQ ID NO: 4463871 - DNA, 13 bp, Homo sapiens
gtgccaagagcta

SEQ ID NO: 4463872 - DNA, 21 bp, Homo sapiens
gtgccaatttcaagttccaag

SEQ ID NO: 4463873 - DNA, 16 bp, Homo sapiens
gtgccacagaggcccc

SEQ ID NO: 4463874 - DNA, 22 bp, Homo sapiens
gtgccacagaggccccacctga

SEQ ID NO: 4463875 - DNA, 19 bp, Homo sapiens
gtgccactgcgggagctct

SEQ ID NO: 4463876 - DNA, 18 bp, Homo sapiens
gtgccacttaatgtatgt

SEQ ID NO: 4463877 - DNA, 14 bp, Homo sapiens
gtgccagaagctac

SEQ ID NO: 4463878 - DNA, 18 bp, Homo sapiens
gtgccagatataactgtc

SEQ ID NO: 4463879 - DNA, 21 bp, Homo sapiens
gtgccagatataactgtcttg

SEQ ID NO: 4463880 - DNA, 14 bp, Homo sapiens
gtgccagcattcca

SEQ ID NO: 4463881 - DNA, 20 bp, Homo sapiens
gtgccagctgcccttgcagg

SEQ ID NO: 4463882 - DNA, 19 bp, Homo sapiens
gtgccaggcccggggctgg

SEQ ID NO: 4463883 - DNA, 11 bp, Homo sapiens
gtgccatggaa

SEQ ID NO: 4463884 - DNA, 20 bp, Homo sapiens
gtgccatggatttccactgc

SEQ ID NO: 4463885 - DNA, 15 bp, Homo sapiens
gtgccattgtcttta

SEQ ID NO: 4463886 - DNA, 21 bp, Homo sapiens
gtgccatttctgaactgttac

SEQ ID NO: 4463887 - DNA, 16 bp, Homo sapiens
gtgcccagaataagtt

SEQ ID NO: 4463888 - DNA, 14 bp, Homo sapiens
gtgcccagcctgga

SEQ ID NO: 4463889 - DNA, 13 bp, Homo sapiens
gtgccccagggag

SEQ ID NO: 4463890 - DNA, 21 bp, Homo sapiens
gtgccccagggagtccagggt

SEQ ID NO: 4463891 - DNA, 13 bp, Homo sapiens
gtgcccccctcct

SEQ ID NO: 4463892 - DNA, 17 bp, Homo sapiens
gtgcccccgcctgccac

SEQ ID NO: 4463893 - DNA, 16 bp, Homo sapiens
gtgcccccgggaatgg

SEQ ID NO: 4463894 - DNA, 17 bp, Homo sapiens
gtgcccccgggaatgga

SEQ ID NO: 4463895 - DNA, 16 bp, Homo sapiens
gtgccccgactgtggg

SEQ ID NO: 4463896 - DNA, 15 bp, Homo sapiens
gtgcccgcatgtgtg

SEQ ID NO: 4463897 - DNA, 12 bp, Homo sapiens
gtgcccttgggg

SEQ ID NO: 4463898 - DNA, 19 bp, Homo sapiens
gtgccgaggcttgggctcc

SEQ ID NO: 4463899 - DNA, 17 bp, Homo sapiens
gtgccgctgccacccgc

SEQ ID NO: 4463900 - DNA, 23 bp, Homo sapiens
gtgccggcggcagccccacttca

SEQ ID NO: 4463901 - DNA, 15 bp, Homo sapiens
gtgccgttactctcc

SEQ ID NO: 4463902 - DNA, 18 bp, Homo sapiens
gtgccgttactctccaac

SEQ ID NO: 4463903 - DNA, 22 bp, Homo sapiens
gtgccgttactctccaacctgg

SEQ ID NO: 4463904 - DNA, 16 bp, Homo sapiens
gtgcctaatggagaag

SEQ ID NO: 4463905 - DNA, 22 bp, Homo sapiens
gtgcctagtaaatgttaactgt

SEQ ID NO: 4463906 - DNA, 12 bp, Homo sapiens
gtgcctcccccc

SEQ ID NO: 4463907 - DNA, 16 bp, Homo sapiens
gtgcctccccccagac

SEQ ID NO: 4463908 - DNA, 14 bp, Homo sapiens
gtgcctctccctgc

SEQ ID NO: 4463909 - DNA, 20 bp, Homo sapiens
gtgcctcttctttttcttct

SEQ ID NO: 4463910 - DNA, 17 bp, Homo sapiens
gtgcctgagaccagggt

SEQ ID NO: 4463911 - DNA, 23 bp, Homo sapiens
gtgcctgagaccagggtggccac

SEQ ID NO: 4463912 - DNA, 14 bp, Homo sapiens
gtgcctgagaggca

SEQ ID NO: 4463913 - DNA, 15 bp, Homo sapiens
gtgcctgcacacaga

SEQ ID NO: 4463914 - DNA, 14 bp, Homo sapiens
gtgcctgccactct

SEQ ID NO: 4463915 - DNA, 21 bp, Homo sapiens
gtgcctgccactctctgggac

SEQ ID NO: 4463916 - DNA, 17 bp, Homo sapiens
gtgcctggccccagcct

SEQ ID NO: 4463917 - DNA, 12 bp, Homo sapiens
gtgcctgggaga

SEQ ID NO: 4463918 - DNA, 21 bp, Homo sapiens
gtgcctgggtggatgggccac

SEQ ID NO: 4463919 - DNA, 20 bp, Homo sapiens
gtgcctgggtggggctgctc

SEQ ID NO: 4463920 - DNA, 22 bp, Homo sapiens
gtgcctgggtggggctgctcct

SEQ ID NO: 4463921 - DNA, 23 bp, Homo sapiens
gtgcctgggtggggctgctcctc

SEQ ID NO: 4463922 - DNA, 17 bp, Homo sapiens
gtgccttacctcctgcc

SEQ ID NO: 4463923 - DNA, 20 bp, Homo sapiens
gtgccttacctcctgcccag

SEQ ID NO: 4463924 - DNA, 21 bp, Homo sapiens
gtgccttccatgtcggcctct

SEQ ID NO: 4463925 - DNA, 22 bp, Homo sapiens
gtgccttccatgtcggcctcta

SEQ ID NO: 4463926 - DNA, 15 bp, Homo sapiens
gtgccttctgggctt

SEQ ID NO: 4463927 - DNA, 14 bp, Homo sapiens
gtgccttctgtggg

SEQ ID NO: 4463928 - DNA, 19 bp, Homo sapiens
gtgccttcttattctcact

SEQ ID NO: 4463929 - DNA, 23 bp, Homo sapiens
gtgccttcttattctcactccac

SEQ ID NO: 4463930 - DNA, 19 bp, Homo sapiens
gtgccttggggaatttcct

SEQ ID NO: 4463931 - DNA, 21 bp, Homo sapiens
gtgccttggggaatttcctct

SEQ ID NO: 4463932 - DNA, 12 bp, Homo sapiens
gtgcctttcaaa

SEQ ID NO: 4463933 - DNA, 18 bp, Homo sapiens
gtgcctttcctgttcagc

SEQ ID NO: 4463934 - DNA, 21 bp, Homo sapiens
gtgcctttcctgttcagcatt

SEQ ID NO: 4463935 - DNA, 14 bp, Homo sapiens
gtgcctttctttgc

SEQ ID NO: 4463936 - DNA, 16 bp, Homo sapiens
gtgcctttctttgcct

SEQ ID NO: 4463937 - DNA, 12 bp, Homo sapiens
gtgcgcccgtgg

SEQ ID NO: 4463938 - DNA, 23 bp, Homo sapiens
gtgcgctgctctgcaggctgggg

SEQ ID NO: 4463939 - DNA, 17 bp, Homo sapiens
gtgcgggatacagctga

SEQ ID NO: 4463940 - DNA, 16 bp, Homo sapiens
gtgcgtgcgtgtgtgt

SEQ ID NO: 4463941 - DNA, 21 bp, Homo sapiens
gtgcgtggcttccctgtccca

SEQ ID NO: 4463942 - DNA, 14 bp, Homo sapiens
gtgctaatatactt

SEQ ID NO: 4463943 - DNA, 21 bp, Homo sapiens
gtgctacatgacgacaaagct

SEQ ID NO: 4463944 - DNA, 12 bp, Homo sapiens
gtgctacctgca

SEQ ID NO: 4463945 - DNA, 13 bp, Homo sapiens
gtgctatgaattt

SEQ ID NO: 4463946 - DNA, 14 bp, Homo sapiens
gtgctattaatatt

SEQ ID NO: 4463947 - DNA, 17 bp, Homo sapiens
gtgctatttaacatttt

SEQ ID NO: 4463948 - DNA, 20 bp, Homo sapiens
gtgctatttaacattttaca

SEQ ID NO: 4463949 - DNA, 13 bp, Homo sapiens
gtgctccatctcc

SEQ ID NO: 4463950 - DNA, 15 bp, Homo sapiens
gtgctccatctccgc

SEQ ID NO: 4463951 - DNA, 20 bp, Homo sapiens
gtgctcccaaaacattttaa

SEQ ID NO: 4463952 - DNA, 14 bp, Homo sapiens
gtgctcctgtgctc

SEQ ID NO: 4463953 - DNA, 17 bp, Homo sapiens
gtgctcggacacagttt

SEQ ID NO: 4463954 - DNA, 16 bp, Homo sapiens
gtgctctctttctgtc

SEQ ID NO: 4463955 - DNA, 20 bp, Homo sapiens
gtgctctgctaaccatttat

SEQ ID NO: 4463956 - DNA, 22 bp, Homo sapiens
gtgctctggggatttctgggat

SEQ ID NO: 4463957 - DNA, 16 bp, Homo sapiens
gtgctcttttctcctc

SEQ ID NO: 4463958 - DNA, 20 bp, Homo sapiens
gtgctcttttctcctcactg

SEQ ID NO: 4463959 - DNA, 20 bp, Homo sapiens
gtgctgacaatactgctgcc

SEQ ID NO: 4463960 - DNA, 18 bp, Homo sapiens
gtgctgagattgcagatg

SEQ ID NO: 4463961 - DNA, 16 bp, Homo sapiens
gtgctgataagaatga

SEQ ID NO: 4463962 - DNA, 21 bp, Homo sapiens
gtgctgatcctaagaattttt

SEQ ID NO: 4463963 - DNA, 22 bp, Homo sapiens
gtgctgcccagcagcccctgag

SEQ ID NO: 4463964 - DNA, 14 bp, Homo sapiens
gtgctgcccaggcc

SEQ ID NO: 4463965 - DNA, 12 bp, Homo sapiens
gtgctgccctgt

SEQ ID NO: 4463966 - DNA, 18 bp, Homo sapiens
gtgctgccgagggctggc

SEQ ID NO: 4463967 - DNA, 11 bp, Homo sapiens
gtgctgcctct

SEQ ID NO: 4463968 - DNA, 21 bp, Homo sapiens
gtgctgcctggccctccccac

SEQ ID NO: 4463969 - DNA, 22 bp, Homo sapiens
gtgctgcctggccctccccaca

SEQ ID NO: 4463970 - DNA, 16 bp, Homo sapiens
gtgctgcgcctgcagg

SEQ ID NO: 4463971 - DNA, 19 bp, Homo sapiens
gtgctgcgcctgcaggcag

SEQ ID NO: 4463972 - DNA, 16 bp, Homo sapiens
gtgctgctgtgtgctt

SEQ ID NO: 4463973 - DNA, 11 bp, Homo sapiens
gtgctggactg

SEQ ID NO: 4463974 - DNA, 23 bp, Homo sapiens
gtgctggaggggtggcccagagc

SEQ ID NO: 4463975 - DNA, 15 bp, Homo sapiens
gtgctggcccaccca

SEQ ID NO: 4463976 - DNA, 20 bp, Homo sapiens
gtgctgggattacaggtgta

SEQ ID NO: 4463977 - DNA, 15 bp, Homo sapiens
gtgctggggcacggc

SEQ ID NO: 4463978 - DNA, 22 bp, Homo sapiens
gtgctggtcagagagacctcat

SEQ ID NO: 4463979 - DNA, 18 bp, Homo sapiens
gtgctgtccatgcttctc

SEQ ID NO: 4463980 - DNA, 20 bp, Homo sapiens
gtgctgtctgatctgtgctt

SEQ ID NO: 4463981 - DNA, 21 bp, Homo sapiens
gtgctgtcttttgttctctga

SEQ ID NO: 4463982 - DNA, 14 bp, Homo sapiens
gtgctgtggagaga

SEQ ID NO: 4463983 - DNA, 15 bp, Homo sapiens
gtgctgtgggcagca

SEQ ID NO: 4463984 - DNA, 18 bp, Homo sapiens
gtgctgtgggcagcaccc

SEQ ID NO: 4463985 - DNA, 19 bp, Homo sapiens
gtgctgtttattaatctta

SEQ ID NO: 4463986 - DNA, 17 bp, Homo sapiens
gtgctgtttgaaaataa

SEQ ID NO: 4463987 - DNA, 22 bp, Homo sapiens
gtgcttagcaaaaaataatgac

SEQ ID NO: 4463988 - DNA, 14 bp, Homo sapiens
gtgcttcgggccct

SEQ ID NO: 4463989 - DNA, 16 bp, Homo sapiens
gtgcttctccccagaa

SEQ ID NO: 4463990 - DNA, 17 bp, Homo sapiens
gtgcttctccccagaat

SEQ ID NO: 4463991 - DNA, 21 bp, Homo sapiens
gtgcttctccccagaattcac

SEQ ID NO: 4463992 - DNA, 14 bp, Homo sapiens
gtgcttgagccagg

SEQ ID NO: 4463993 - DNA, 12 bp, Homo sapiens
gtgcttgggctc

SEQ ID NO: 4463994 - DNA, 15 bp, Homo sapiens
gtgcttgggctccac

SEQ ID NO: 4463995 - DNA, 16 bp, Homo sapiens
gtgcttgggctccacg

SEQ ID NO: 4463996 - DNA, 17 bp, Homo sapiens
gtgcttgggctccacgg

SEQ ID NO: 4463997 - DNA, 21 bp, Homo sapiens
gtgctttattgaattagaaaa

SEQ ID NO: 4463998 - DNA, 16 bp, Homo sapiens
gtgctttccagctcac

SEQ ID NO: 4463999 - DNA, 21 bp, Homo sapiens
gtgctttccttcatctcccac

SEQ ID NO: 4464000 - DNA, 12 bp, Homo sapiens
gtgctttctatt

SEQ ID NO: 4464001 - DNA, 13 bp, Homo sapiens
gtgctttctattg

SEQ ID NO: 4464002 - DNA, 22 bp, Homo sapiens
gtgctttctattgtacagaagc

SEQ ID NO: 4464003 - DNA, 21 bp, Homo sapiens
gtgctttggttaatacatctt

SEQ ID NO: 4464004 - DNA, 19 bp, Homo sapiens
gtgcttttatagaggctag

SEQ ID NO: 4464005 - DNA, 23 bp, Homo sapiens
gtgctttttaagaatatttttag

SEQ ID NO: 4464006 - DNA, 15 bp, Homo sapiens
gtgctttttcactgc

SEQ ID NO: 4464007 - DNA, 16 bp, Homo sapiens
gtgctttttttgtgtg

SEQ ID NO: 4464008 - DNA, 12 bp, Homo sapiens
gtggaaaaacac

SEQ ID NO: 4464009 - DNA, 23 bp, Homo sapiens
gtggaaaaatgcccatttttgct

SEQ ID NO: 4464010 - DNA, 11 bp, Homo sapiens
gtggaaatcct

SEQ ID NO: 4464011 - DNA, 19 bp, Homo sapiens
gtggaacataaaaaggaca

SEQ ID NO: 4464012 - DNA, 22 bp, Homo sapiens
gtggaacgtttttcctgttctt

SEQ ID NO: 4464013 - DNA, 20 bp, Homo sapiens
gtggaagaagggagaagaaa

SEQ ID NO: 4464014 - DNA, 13 bp, Homo sapiens
gtggaagcagagg

SEQ ID NO: 4464015 - DNA, 21 bp, Homo sapiens
gtggaagcagaggccctgccc

SEQ ID NO: 4464016 - DNA, 23 bp, Homo sapiens
gtggaagcagaggccctgccccc

SEQ ID NO: 4464017 - DNA, 17 bp, Homo sapiens
gtggaagccctccttcc

SEQ ID NO: 4464018 - DNA, 14 bp, Homo sapiens
gtggaagtgtgggt

SEQ ID NO: 4464019 - DNA, 19 bp, Homo sapiens
gtggaagtgtgggtctgtg

SEQ ID NO: 4464020 - DNA, 20 bp, Homo sapiens
gtggaagtgtgggtctgtgt

SEQ ID NO: 4464021 - DNA, 20 bp, Homo sapiens
gtggaattttgagaaaaata

SEQ ID NO: 4464022 - DNA, 18 bp, Homo sapiens
gtggacaggatgaggaca

SEQ ID NO: 4464023 - DNA, 13 bp, Homo sapiens
gtggacgctgcag

SEQ ID NO: 4464024 - DNA, 16 bp, Homo sapiens
gtggacgctgcagacc

SEQ ID NO: 4464025 - DNA, 21 bp, Homo sapiens
gtggacgctgcagaccccagg

SEQ ID NO: 4464026 - DNA, 18 bp, Homo sapiens
gtggactcagaaagccaa

SEQ ID NO: 4464027 - DNA, 17 bp, Homo sapiens
gtggactgagtgggaag

SEQ ID NO: 4464028 - DNA, 17 bp, Homo sapiens
gtggactggcccctggg

SEQ ID NO: 4464029 - DNA, 21 bp, Homo sapiens
gtggactggtgtcataaactt

SEQ ID NO: 4464030 - DNA, 17 bp, Homo sapiens
gtggagaagccacaggc

SEQ ID NO: 4464031 - DNA, 22 bp, Homo sapiens
gtggagaccctgccacagccag

SEQ ID NO: 4464032 - DNA, 16 bp, Homo sapiens
gtggagagctggtgcc

SEQ ID NO: 4464033 - DNA, 17 bp, Homo sapiens
gtggagagctggtgccc

SEQ ID NO: 4464034 - DNA, 20 bp, Homo sapiens
gtggagatagtgccaggtgg

SEQ ID NO: 4464035 - DNA, 18 bp, Homo sapiens
gtggagccccacactggg

SEQ ID NO: 4464036 - DNA, 17 bp, Homo sapiens
gtggaggaagagccacc

SEQ ID NO: 4464037 - DNA, 19 bp, Homo sapiens
gtggaggaagggctgggcc

SEQ ID NO: 4464038 - DNA, 17 bp, Homo sapiens
gtggaggaggaaggcaa

SEQ ID NO: 4464039 - DNA, 12 bp, Homo sapiens
gtggaggggctt

SEQ ID NO: 4464040 - DNA, 15 bp, Homo sapiens
gtggaggggcttggg

SEQ ID NO: 4464041 - DNA, 12 bp, Homo sapiens
gtggaggggtgt

SEQ ID NO: 4464042 - DNA, 16 bp, Homo sapiens
gtggaggggtgtggca

SEQ ID NO: 4464043 - DNA, 17 bp, Homo sapiens
gtggaggtgtcaggctg

SEQ ID NO: 4464044 - DNA, 19 bp, Homo sapiens
gtggaggttgcagtgagct

SEQ ID NO: 4464045 - DNA, 13 bp, Homo sapiens
gtggagtctgagt

SEQ ID NO: 4464046 - DNA, 15 bp, Homo sapiens
gtggagtttctctgt

SEQ ID NO: 4464047 - DNA, 23 bp, Homo sapiens
gtggatcacaaagtggaacgaaa

SEQ ID NO: 4464048 - DNA, 22 bp, Homo sapiens
gtggatcacgaggtcaggagat

SEQ ID NO: 4464049 - DNA, 19 bp, Homo sapiens
gtggatccaaactgatcca

SEQ ID NO: 4464050 - DNA, 14 bp, Homo sapiens
gtggatctggggac

SEQ ID NO: 4464051 - DNA, 13 bp, Homo sapiens
gtggatcttcaga

SEQ ID NO: 4464052 - DNA, 22 bp, Homo sapiens
gtggatcttcagaactgccctt

SEQ ID NO: 4464053 - DNA, 20 bp, Homo sapiens
gtggatgaaaaaaagggaaa

SEQ ID NO: 4464054 - DNA, 20 bp, Homo sapiens
gtggatgccgatttctgtaa

SEQ ID NO: 4464055 - DNA, 14 bp, Homo sapiens
gtggatgtgctgga

SEQ ID NO: 4464056 - DNA, 16 bp, Homo sapiens
gtggatgtgctggagg

SEQ ID NO: 4464057 - DNA, 13 bp, Homo sapiens
gtggattctttaa

SEQ ID NO: 4464058 - DNA, 21 bp, Homo sapiens
gtggattttggttttgttccc

SEQ ID NO: 4464059 - DNA, 21 bp, Homo sapiens
gtggcacgggaccactccagg

SEQ ID NO: 4464060 - DNA, 14 bp, Homo sapiens
gtggcactggggca

SEQ ID NO: 4464061 - DNA, 19 bp, Homo sapiens
gtggcagcaacggcacagc

SEQ ID NO: 4464062 - DNA, 23 bp, Homo sapiens
gtggcaggcacacagcagccccc

SEQ ID NO: 4464063 - DNA, 23 bp, Homo sapiens
gtggcagggggccccgccagggc

SEQ ID NO: 4464064 - DNA, 21 bp, Homo sapiens
gtggcagtggttttggcaaac

SEQ ID NO: 4464065 - DNA, 22 bp, Homo sapiens
gtggccaagaagcagtggcctt

SEQ ID NO: 4464066 - DNA, 13 bp, Homo sapiens
gtggccaagccta

SEQ ID NO: 4464067 - DNA, 14 bp, Homo sapiens
gtggccaagttctt

SEQ ID NO: 4464068 - DNA, 16 bp, Homo sapiens
gtggccacacaggcag

SEQ ID NO: 4464069 - DNA, 17 bp, Homo sapiens
gtggccacacaggcagg

SEQ ID NO: 4464070 - DNA, 18 bp, Homo sapiens
gtggccacacaggcaggg

SEQ ID NO: 4464071 - DNA, 20 bp, Homo sapiens
gtggccacacaggcagggcc

SEQ ID NO: 4464072 - DNA, 11 bp, Homo sapiens
gtggccacagc

SEQ ID NO: 4464073 - DNA, 13 bp, Homo sapiens
gtggccactcagc

SEQ ID NO: 4464074 - DNA, 14 bp, Homo sapiens
gtggccactcagct

SEQ ID NO: 4464075 - DNA, 13 bp, Homo sapiens
gtggccaggggtg

SEQ ID NO: 4464076 - DNA, 17 bp, Homo sapiens
gtggccatatatgctgt

SEQ ID NO: 4464077 - DNA, 14 bp, Homo sapiens
gtggccatccctgg

SEQ ID NO: 4464078 - DNA, 16 bp, Homo sapiens
gtggccatccctgggc

SEQ ID NO: 4464079 - DNA, 18 bp, Homo sapiens
gtggccatccctgggccc

SEQ ID NO: 4464080 - DNA, 20 bp, Homo sapiens
gtggccatccctgggcccct

SEQ ID NO: 4464081 - DNA, 17 bp, Homo sapiens
gtggccatccctgtgag

SEQ ID NO: 4464082 - DNA, 13 bp, Homo sapiens
gtggcccagcacg

SEQ ID NO: 4464083 - DNA, 19 bp, Homo sapiens
gtggccctctcccttaccc

SEQ ID NO: 4464084 - DNA, 17 bp, Homo sapiens
gtggccctggcctgctg

SEQ ID NO: 4464085 - DNA, 18 bp, Homo sapiens
gtggccctggcctgctgg

SEQ ID NO: 4464086 - DNA, 17 bp, Homo sapiens
gtggccggcctcctcct

SEQ ID NO: 4464087 - DNA, 19 bp, Homo sapiens
gtggccggcctcctcctca

SEQ ID NO: 4464088 - DNA, 21 bp, Homo sapiens
gtggccggcctcctcctcacc

SEQ ID NO: 4464089 - DNA, 14 bp, Homo sapiens
gtggccgggcacag

SEQ ID NO: 4464090 - DNA, 19 bp, Homo sapiens
gtggccggtgccagctgcc

SEQ ID NO: 4464091 - DNA, 21 bp, Homo sapiens
gtggccggtgccagctgccct

SEQ ID NO: 4464092 - DNA, 13 bp, Homo sapiens
gtggccgtctcct

SEQ ID NO: 4464093 - DNA, 22 bp, Homo sapiens
gtggcctaacctgccgagagtc

SEQ ID NO: 4464094 - DNA, 19 bp, Homo sapiens
gtggcctacaaatcagtaa

SEQ ID NO: 4464095 - DNA, 21 bp, Homo sapiens
gtggcctatttcagctgcttt

SEQ ID NO: 4464096 - DNA, 12 bp, Homo sapiens
gtggcctcagaa

SEQ ID NO: 4464097 - DNA, 13 bp, Homo sapiens
gtggcctcagaat

SEQ ID NO: 4464098 - DNA, 14 bp, Homo sapiens
gtggcctcagccct

SEQ ID NO: 4464099 - DNA, 15 bp, Homo sapiens
gtggcctcagccctc

SEQ ID NO: 4464100 - DNA, 14 bp, Homo sapiens
gtggcctccctgct

SEQ ID NO: 4464101 - DNA, 22 bp, Homo sapiens
gtggcctccctgctgtgccatg

SEQ ID NO: 4464102 - DNA, 22 bp, Homo sapiens
gtggcctgctaaggctcctcct

SEQ ID NO: 4464103 - DNA, 18 bp, Homo sapiens
gtggcctggccaggagct

SEQ ID NO: 4464104 - DNA, 14 bp, Homo sapiens
gtggcctggtccct

SEQ ID NO: 4464105 - DNA, 15 bp, Homo sapiens
gtggcctggtccctg

SEQ ID NO: 4464106 - DNA, 14 bp, Homo sapiens
gtggcctttgtgct

SEQ ID NO: 4464107 - DNA, 14 bp, Homo sapiens
gtggcggtgcctgg

SEQ ID NO: 4464108 - DNA, 17 bp, Homo sapiens
gtggcggtgcctgggtg

SEQ ID NO: 4464109 - DNA, 17 bp, Homo sapiens
gtggctcagtgccacct

SEQ ID NO: 4464110 - DNA, 22 bp, Homo sapiens
gtggctcccctgcccagcctgc

SEQ ID NO: 4464111 - DNA, 18 bp, Homo sapiens
gtggctcctatctgtgtt

SEQ ID NO: 4464112 - DNA, 20 bp, Homo sapiens
gtggctcctatctgtgtttt

SEQ ID NO: 4464113 - DNA, 18 bp, Homo sapiens
gtggctcgggaggcgaag

SEQ ID NO: 4464114 - DNA, 23 bp, Homo sapiens
gtggctctgggaatgggagaggg

SEQ ID NO: 4464115 - DNA, 17 bp, Homo sapiens
gtggctgaggaggcctc

SEQ ID NO: 4464116 - DNA, 18 bp, Homo sapiens
gtggctgccacacccagg

SEQ ID NO: 4464117 - DNA, 12 bp, Homo sapiens
gtggctgctctg

SEQ ID NO: 4464118 - DNA, 21 bp, Homo sapiens
gtggctggctctaccttcctg

SEQ ID NO: 4464119 - DNA, 22 bp, Homo sapiens
gtggctggctctaccttcctgt

SEQ ID NO: 4464120 - DNA, 18 bp, Homo sapiens
gtggctggtgtccccttc

SEQ ID NO: 4464121 - DNA, 23 bp, Homo sapiens
gtggctggtgtccccttcccctg

SEQ ID NO: 4464122 - DNA, 15 bp, Homo sapiens
gtggctgtgtgtctg

SEQ ID NO: 4464123 - DNA, 16 bp, Homo sapiens
gtggctttccaggcac

SEQ ID NO: 4464124 - DNA, 22 bp, Homo sapiens
gtggctttccaggcaccctcag

SEQ ID NO: 4464125 - DNA, 23 bp, Homo sapiens
gtggctttccaggcaccctcagg

SEQ ID NO: 4464126 - DNA, 14 bp, Homo sapiens
gtggctttgctgtt

SEQ ID NO: 4464127 - DNA, 23 bp, Homo sapiens
gtgggaacgactgggcactgcca

SEQ ID NO: 4464128 - DNA, 14 bp, Homo sapiens
gtgggaagaaagaa

SEQ ID NO: 4464129 - DNA, 20 bp, Homo sapiens
gtgggaagcccatcctgacc

SEQ ID NO: 4464130 - DNA, 14 bp, Homo sapiens
gtgggaaggccagc

SEQ ID NO: 4464131 - DNA, 14 bp, Homo sapiens
gtgggaagggagag

SEQ ID NO: 4464132 - DNA, 19 bp, Homo sapiens
gtgggaccctgtccggccc

SEQ ID NO: 4464133 - DNA, 15 bp, Homo sapiens
gtgggactgtacaca

SEQ ID NO: 4464134 - DNA, 22 bp, Homo sapiens
gtgggactgtggtgacttctgc

SEQ ID NO: 4464135 - DNA, 21 bp, Homo sapiens
gtgggagctgaaccacagaaa

SEQ ID NO: 4464136 - DNA, 15 bp, Homo sapiens
gtgggagggaggagg

SEQ ID NO: 4464137 - DNA, 19 bp, Homo sapiens
gtgggagggaggagggagt

SEQ ID NO: 4464138 - DNA, 19 bp, Homo sapiens
gtgggagtaacagggcaga

SEQ ID NO: 4464139 - DNA, 14 bp, Homo sapiens
gtgggagtgtgtaa

SEQ ID NO: 4464140 - DNA, 16 bp, Homo sapiens
gtgggcaacacatgca

SEQ ID NO: 4464141 - DNA, 15 bp, Homo sapiens
gtgggcagcaccctc

SEQ ID NO: 4464142 - DNA, 16 bp, Homo sapiens
gtgggcagcaccctcc

SEQ ID NO: 4464143 - DNA, 17 bp, Homo sapiens
gtgggcagcaccctccc

SEQ ID NO: 4464144 - DNA, 20 bp, Homo sapiens
gtgggcgttgggagcctagc

SEQ ID NO: 4464145 - DNA, 13 bp, Homo sapiens
gtgggctccctga

SEQ ID NO: 4464146 - DNA, 17 bp, Homo sapiens
gtgggctggacttctac

SEQ ID NO: 4464147 - DNA, 19 bp, Homo sapiens
gtgggctggacttctacct

SEQ ID NO: 4464148 - DNA, 21 bp, Homo sapiens
gtgggcttcctgcccttccct

SEQ ID NO: 4464149 - DNA, 21 bp, Homo sapiens
gtgggcttcggagtgaatgtg

SEQ ID NO: 4464150 - DNA, 16 bp, Homo sapiens
gtggggatatcagggc

SEQ ID NO: 4464151 - DNA, 15 bp, Homo sapiens
gtggggcagagcctc

SEQ ID NO: 4464152 - DNA, 14 bp, Homo sapiens
gtggggcattgaga

SEQ ID NO: 4464153 - DNA, 14 bp, Homo sapiens
gtggggcccactgc

SEQ ID NO: 4464154 - DNA, 17 bp, Homo sapiens
gtggggcccactgctcg

SEQ ID NO: 4464155 - DNA, 24 bp, Homo sapiens
gtggggcccagacaccagcctagc

SEQ ID NO: 4464156 - DNA, 13 bp, Homo sapiens
gtggggcctttgc

SEQ ID NO: 4464157 - DNA, 13 bp, Homo sapiens
gtggggctcctgg

SEQ ID NO: 4464158 - DNA, 17 bp, Homo sapiens
gtggggctgctcctcca

SEQ ID NO: 4464159 - DNA, 18 bp, Homo sapiens
gtggggctgctcctccag

SEQ ID NO: 4464160 - DNA, 14 bp, Homo sapiens
gtgggggagggagg

SEQ ID NO: 4464161 - DNA, 17 bp, Homo sapiens
gtgggggcagagggcag

SEQ ID NO: 4464162 - DNA, 16 bp, Homo sapiens
gtggggggacagacag

SEQ ID NO: 4464163 - DNA, 23 bp, Homo sapiens
gtggggggggggcgcggctggga

SEQ ID NO: 4464164 - DNA, 13 bp, Homo sapiens
gtggggggtcctt

SEQ ID NO: 4464165 - DNA, 15 bp, Homo sapiens
gtgggggtctgtgtg

SEQ ID NO: 4464166 - DNA, 22 bp, Homo sapiens
gtggggtacatttctctgagca

SEQ ID NO: 4464167 - DNA, 22 bp, Homo sapiens
gtggggtctccctctcctgcct

SEQ ID NO: 4464168 - DNA, 9 bp, Homo sapiens
gtgggtcag

SEQ ID NO: 4464169 - DNA, 20 bp, Homo sapiens
gtgggtccaggggcccctcc

SEQ ID NO: 4464170 - DNA, 11 bp, Homo sapiens
gtgggtctctg

SEQ ID NO: 4464171 - DNA, 14 bp, Homo sapiens
gtgggtctctgaag

SEQ ID NO: 4464172 - DNA, 17 bp, Homo sapiens
gtgggtctctgtgtgtg

SEQ ID NO: 4464173 - DNA, 13 bp, Homo sapiens
gtgggtctgggat

SEQ ID NO: 4464174 - DNA, 13 bp, Homo sapiens
gtgggtctgtgtg

SEQ ID NO: 4464175 - DNA, 14 bp, Homo sapiens
gtgggtgagagaga

SEQ ID NO: 4464176 - DNA, 20 bp, Homo sapiens
gtgggtgagctctcaggccg

SEQ ID NO: 4464177 - DNA, 21 bp, Homo sapiens
gtgggtgttctttcctgccct

SEQ ID NO: 4464178 - DNA, 16 bp, Homo sapiens
gtgggttattctggag

SEQ ID NO: 4464179 - DNA, 12 bp, Homo sapiens
gtggtaatctac

SEQ ID NO: 4464180 - DNA, 15 bp, Homo sapiens
gtggtaatctacacc

SEQ ID NO: 4464181 - DNA, 17 bp, Homo sapiens
gtggtactttgcagctg

SEQ ID NO: 4464182 - DNA, 13 bp, Homo sapiens
gtggtagctccag

SEQ ID NO: 4464183 - DNA, 22 bp, Homo sapiens
gtggtatggagctgtgccgagg

SEQ ID NO: 4464184 - DNA, 18 bp, Homo sapiens
gtggtattaattttgata

SEQ ID NO: 4464185 - DNA, 14 bp, Homo sapiens
gtggtctgtgtcac

SEQ ID NO: 4464186 - DNA, 16 bp, Homo sapiens
gtggtgaagtgtggct

SEQ ID NO: 4464187 - DNA, 17 bp, Homo sapiens
gtggtgaagtgtggctg

SEQ ID NO: 4464188 - DNA, 21 bp, Homo sapiens
gtggtgaagtgtggctggtgt

SEQ ID NO: 4464189 - DNA, 23 bp, Homo sapiens
gtggtgaagtgtggctggtgtcc

SEQ ID NO: 4464190 - DNA, 20 bp, Homo sapiens
gtggtgcagccttcccctcc

SEQ ID NO: 4464191 - DNA, 12 bp, Homo sapiens
gtggtgcctgca

SEQ ID NO: 4464192 - DNA, 18 bp, Homo sapiens
gtggtggcctggtccctg

SEQ ID NO: 4464193 - DNA, 22 bp, Homo sapiens
gtggtgggatccacgctgggcc

SEQ ID NO: 4464194 - DNA, 23 bp, Homo sapiens
gtggtgggatccacgctgggcct

SEQ ID NO: 4464195 - DNA, 12 bp, Homo sapiens
gtggtggtgcta

SEQ ID NO: 4464196 - DNA, 23 bp, Homo sapiens
gtggtgtgtccccctctgtccag

SEQ ID NO: 4464197 - DNA, 15 bp, Homo sapiens
gtggttctctgcctt

SEQ ID NO: 4464198 - DNA, 18 bp, Homo sapiens
gtggttgggtgtgggcag

SEQ ID NO: 4464199 - DNA, 14 bp, Homo sapiens
gtggtttcatgtta

SEQ ID NO: 4464200 - DNA, 22 bp, Homo sapiens
gtggttttattacaaatgcaaa

SEQ ID NO: 4464201 - DNA, 13 bp, Homo sapiens
gtgtaaaattaat

SEQ ID NO: 4464202 - DNA, 21 bp, Homo sapiens
gtgtaaattaattacatacat

SEQ ID NO: 4464203 - DNA, 20 bp, Homo sapiens
gtgtaacttgcttaaatttc

SEQ ID NO: 4464204 - DNA, 20 bp, Homo sapiens
gtgtaactttcataccactt

SEQ ID NO: 4464205 - DNA, 15 bp, Homo sapiens
gtgtaagaactgtac

SEQ ID NO: 4464206 - DNA, 17 bp, Homo sapiens
gtgtaagaactgtacat

SEQ ID NO: 4464207 - DNA, 13 bp, Homo sapiens
gtgtaataaagtg

SEQ ID NO: 4464208 - DNA, 14 bp, Homo sapiens
gtgtaatcatttta

SEQ ID NO: 4464209 - DNA, 22 bp, Homo sapiens
gtgtaatcattttaaattccac

SEQ ID NO: 4464210 - DNA, 17 bp, Homo sapiens
gtgtacagttggcatgg

SEQ ID NO: 4464211 - DNA, 13 bp, Homo sapiens
gtgtactggagcc

SEQ ID NO: 4464212 - DNA, 11 bp, Homo sapiens
gtgtactgtgt

SEQ ID NO: 4464213 - DNA, 11 bp, Homo sapiens
gtgtagaaaaa

SEQ ID NO: 4464214 - DNA, 18 bp, Homo sapiens
gtgtagattttatagtgt

SEQ ID NO: 4464215 - DNA, 20 bp, Homo sapiens
gtgtagattttatagtgtgt

SEQ ID NO: 4464216 - DNA, 16 bp, Homo sapiens
gtgtagcaactacagt

SEQ ID NO: 4464217 - DNA, 18 bp, Homo sapiens
gtgtagctaacagttgcc

SEQ ID NO: 4464218 - DNA, 23 bp, Homo sapiens
gtgtatagctgtgtgtgtgttca

SEQ ID NO: 4464219 - DNA, 14 bp, Homo sapiens
gtgtatagtgttca

SEQ ID NO: 4464220 - DNA, 13 bp, Homo sapiens
gtgtatatatctt

SEQ ID NO: 4464221 - DNA, 21 bp, Homo sapiens
gtgtatatatgtgtgccctgg

SEQ ID NO: 4464222 - DNA, 21 bp, Homo sapiens
gtgtatatattataaaaatta

SEQ ID NO: 4464223 - DNA, 19 bp, Homo sapiens
gtgtatatctcttggaaaa

SEQ ID NO: 4464224 - DNA, 15 bp, Homo sapiens
gtgtatatgtattta

SEQ ID NO: 4464225 - DNA, 14 bp, Homo sapiens
gtgtatcagtgttt

SEQ ID NO: 4464226 - DNA, 18 bp, Homo sapiens
gtgtatcgtaaccagcca

SEQ ID NO: 4464227 - DNA, 21 bp, Homo sapiens
gtgtatgtgggggtctgtgtg

SEQ ID NO: 4464228 - DNA, 20 bp, Homo sapiens
gtgtattccaagacatgtct

SEQ ID NO: 4464229 - DNA, 17 bp, Homo sapiens
gtgtatttaattgtaaa

SEQ ID NO: 4464230 - DNA, 17 bp, Homo sapiens
gtgtatttacgctttga

SEQ ID NO: 4464231 - DNA, 19 bp, Homo sapiens
gtgtatttattttacagct

SEQ ID NO: 4464232 - DNA, 19 bp, Homo sapiens
gtgtatttgctaattttta

SEQ ID NO: 4464233 - DNA, 21 bp, Homo sapiens
gtgtatttggaaataaagtca

SEQ ID NO: 4464234 - DNA, 19 bp, Homo sapiens
gtgtcaactctttgttatt

SEQ ID NO: 4464235 - DNA, 14 bp, Homo sapiens
gtgtcacctgtgct

SEQ ID NO: 4464236 - DNA, 14 bp, Homo sapiens
gtgtcagagcccag

SEQ ID NO: 4464237 - DNA, 17 bp, Homo sapiens
gtgtcagagcccagccc

SEQ ID NO: 4464238 - DNA, 14 bp, Homo sapiens
gtgtcagctctgtt

SEQ ID NO: 4464239 - DNA, 15 bp, Homo sapiens
gtgtcaggctgctgg

SEQ ID NO: 4464240 - DNA, 13 bp, Homo sapiens
gtgtcataaactt

SEQ ID NO: 4464241 - DNA, 15 bp, Homo sapiens
gtgtcatttagtaag

SEQ ID NO: 4464242 - DNA, 22 bp, Homo sapiens
gtgtcattttcttgatgtcact

SEQ ID NO: 4464243 - DNA, 13 bp, Homo sapiens
gtgtcattttgat

SEQ ID NO: 4464244 - DNA, 14 bp, Homo sapiens
gtgtccccaacgtc

SEQ ID NO: 4464245 - DNA, 22 bp, Homo sapiens
gtgtccccaacgtcccctccgc

SEQ ID NO: 4464246 - DNA, 14 bp, Homo sapiens
gtgtccccctctgt

SEQ ID NO: 4464247 - DNA, 18 bp, Homo sapiens
gtgtccccctctgtccag

SEQ ID NO: 4464248 - DNA, 20 bp, Homo sapiens
gtgtcccctcactctgtcag

SEQ ID NO: 4464249 - DNA, 14 bp, Homo sapiens
gtgtccctaatgtg

SEQ ID NO: 4464250 - DNA, 15 bp, Homo sapiens
gtgtcctctccctgc

SEQ ID NO: 4464251 - DNA, 17 bp, Homo sapiens
gtgtcctctccctgcca

SEQ ID NO: 4464252 - DNA, 18 bp, Homo sapiens
gtgtcctcttccctctct

SEQ ID NO: 4464253 - DNA, 10 bp, Homo sapiens
gtgtcctgag

SEQ ID NO: 4464254 - DNA, 16 bp, Homo sapiens
gtgtcctgcccatgcc

SEQ ID NO: 4464255 - DNA, 17 bp, Homo sapiens
gtgtccttgcacctgca

SEQ ID NO: 4464256 - DNA, 19 bp, Homo sapiens
gtgtctaggcaggacctgt

SEQ ID NO: 4464257 - DNA, 18 bp, Homo sapiens
gtgtctcagcctctgcca

SEQ ID NO: 4464258 - DNA, 20 bp, Homo sapiens
gtgtctcagcctctgccagc

SEQ ID NO: 4464259 - DNA, 17 bp, Homo sapiens
gtgtctccaacccccca

SEQ ID NO: 4464260 - DNA, 19 bp, Homo sapiens
gtgtctccaaccccccagc

SEQ ID NO: 4464261 - DNA, 22 bp, Homo sapiens
gtgtctccccgtgtcctctccc

SEQ ID NO: 4464262 - DNA, 20 bp, Homo sapiens
gtgtctgtgccctccaaaga

SEQ ID NO: 4464263 - DNA, 11 bp, Homo sapiens
gtgtctgtgtt

SEQ ID NO: 4464264 - DNA, 22 bp, Homo sapiens
gtgtcttaattaaaagaatatt

SEQ ID NO: 4464265 - DNA, 21 bp, Homo sapiens
gtgtcttccctgcctgtggca

SEQ ID NO: 4464266 - DNA, 21 bp, Homo sapiens
gtgtctttctaagaaatcaag

SEQ ID NO: 4464267 - DNA, 23 bp, Homo sapiens
gtgtgaacctacctgccttggag

SEQ ID NO: 4464268 - DNA, 22 bp, Homo sapiens
gtgtgaactcaccctgggagcc

SEQ ID NO: 4464269 - DNA, 23 bp, Homo sapiens
gtgtgaactcaccctgggagcca

SEQ ID NO: 4464270 - DNA, 14 bp, Homo sapiens
gtgtgaatgaacac

SEQ ID NO: 4464271 - DNA, 22 bp, Homo sapiens
gtgtgacaattctgtttttaat

SEQ ID NO: 4464272 - DNA, 16 bp, Homo sapiens
gtgtgaccctgggcag

SEQ ID NO: 4464273 - DNA, 13 bp, Homo sapiens
gtgtgacctgagg

SEQ ID NO: 4464274 - DNA, 17 bp, Homo sapiens
gtgtgactctagcaagg

SEQ ID NO: 4464275 - DNA, 20 bp, Homo sapiens
gtgtgactctagcaaggctc

SEQ ID NO: 4464276 - DNA, 14 bp, Homo sapiens
gtgtgagcagtgga

SEQ ID NO: 4464277 - DNA, 18 bp, Homo sapiens
gtgtgaggagctgctggc

SEQ ID NO: 4464278 - DNA, 15 bp, Homo sapiens
gtgtgaggccagggc

SEQ ID NO: 4464279 - DNA, 17 bp, Homo sapiens
gtgtgaggccagggcag

SEQ ID NO: 4464280 - DNA, 14 bp, Homo sapiens
gtgtgatcgtctga

SEQ ID NO: 4464281 - DNA, 22 bp, Homo sapiens
gtgtgatcttaatatatttgaa

SEQ ID NO: 4464282 - DNA, 13 bp, Homo sapiens
gtgtgcatatttg

SEQ ID NO: 4464283 - DNA, 12 bp, Homo sapiens
gtgtgccctgga

SEQ ID NO: 4464284 - DNA, 12 bp, Homo sapiens
gtgtgccttcca

SEQ ID NO: 4464285 - DNA, 23 bp, Homo sapiens
gtgtgccttccagatcctctctg

SEQ ID NO: 4464286 - DNA, 15 bp, Homo sapiens
gtgtgctaaaaatga

SEQ ID NO: 4464287 - DNA, 17 bp, Homo sapiens
gtgtggaatgtcgcaga

SEQ ID NO: 4464288 - DNA, 22 bp, Homo sapiens
gtgtggagggagtgagccagca

SEQ ID NO: 4464289 - DNA, 23 bp, Homo sapiens
gtgtggccggcctcctcctcacc

SEQ ID NO: 4464290 - DNA, 16 bp, Homo sapiens
gtgtggcctcagccct

SEQ ID NO: 4464291 - DNA, 17 bp, Homo sapiens
gtgtgggactgtacaca

SEQ ID NO: 4464292 - DNA, 18 bp, Homo sapiens
gtgtggggggacagacag

SEQ ID NO: 4464293 - DNA, 21 bp, Homo sapiens
gtgtggtactttgcagctgct

SEQ ID NO: 4464294 - DNA, 15 bp, Homo sapiens
gtgtgtaaaattaat

SEQ ID NO: 4464295 - DNA, 15 bp, Homo sapiens
gtgtgtacctgtggc

SEQ ID NO: 4464296 - DNA, 16 bp, Homo sapiens
gtgtgtagatagtatg

SEQ ID NO: 4464297 - DNA, 14 bp, Homo sapiens
gtgtgtattcttaa

SEQ ID NO: 4464298 - DNA, 14 bp, Homo sapiens
gtgtgtgtatgtgg

SEQ ID NO: 4464299 - DNA, 21 bp, Homo sapiens
gtgtgttataaaataatgtac

SEQ ID NO: 4464300 - DNA, 14 bp, Homo sapiens
gtgtgtttatgtgt

SEQ ID NO: 4464301 - DNA, 15 bp, Homo sapiens
gtgtgtttatgtgtg

SEQ ID NO: 4464302 - DNA, 16 bp, Homo sapiens
gtgtgtttatgtgtgt

SEQ ID NO: 4464303 - DNA, 14 bp, Homo sapiens
gtgttaagattgca

SEQ ID NO: 4464304 - DNA, 15 bp, Homo sapiens
gtgttaatacatcac

SEQ ID NO: 4464305 - DNA, 12 bp, Homo sapiens
gtgttaattttt

SEQ ID NO: 4464306 - DNA, 20 bp, Homo sapiens
gtgttactaaaaaaaagatg

SEQ ID NO: 4464307 - DNA, 16 bp, Homo sapiens
gtgttagggaagggcc

SEQ ID NO: 4464308 - DNA, 13 bp, Homo sapiens
gtgttataaaata

SEQ ID NO: 4464309 - DNA, 17 bp, Homo sapiens
gtgttatcttttgaatt

SEQ ID NO: 4464310 - DNA, 21 bp, Homo sapiens
gtgttatttccccagccacag

SEQ ID NO: 4464311 - DNA, 15 bp, Homo sapiens
gtgttcaatctgtga

SEQ ID NO: 4464312 - DNA, 18 bp, Homo sapiens
gtgttcacaaactgtgaa

SEQ ID NO: 4464313 - DNA, 15 bp, Homo sapiens
gtgttcattttaagt

SEQ ID NO: 4464314 - DNA, 18 bp, Homo sapiens
gtgttcccaatctgaaat

SEQ ID NO: 4464315 - DNA, 21 bp, Homo sapiens
gtgttcccatttcagctgatc

SEQ ID NO: 4464316 - DNA, 15 bp, Homo sapiens
gtgttcccgtgcctg

SEQ ID NO: 4464317 - DNA, 17 bp, Homo sapiens
gtgttcccgtgcctggg

SEQ ID NO: 4464318 - DNA, 15 bp, Homo sapiens
gtgttccctttgtct

SEQ ID NO: 4464319 - DNA, 18 bp, Homo sapiens
gtgttcctgaagctgctg

SEQ ID NO: 4464320 - DNA, 20 bp, Homo sapiens
gtgttcctgaagctgctgtg

SEQ ID NO: 4464321 - DNA, 22 bp, Homo sapiens
gtgttcctgaagctgctgtgtc

SEQ ID NO: 4464322 - DNA, 19 bp, Homo sapiens
gtgttcgtttccatcatgt

SEQ ID NO: 4464323 - DNA, 23 bp, Homo sapiens
gtgttctgctccataccttttct

SEQ ID NO: 4464324 - DNA, 18 bp, Homo sapiens
gtgttctgggctggggcc

SEQ ID NO: 4464325 - DNA, 19 bp, Homo sapiens
gtgttcttcgtaactttat

SEQ ID NO: 4464326 - DNA, 20 bp, Homo sapiens
gtgttctttcctgccctgtc

SEQ ID NO: 4464327 - DNA, 13 bp, Homo sapiens
gtgttgaaaacca

SEQ ID NO: 4464328 - DNA, 19 bp, Homo sapiens
gtgttgaccactccagaga

SEQ ID NO: 4464329 - DNA, 18 bp, Homo sapiens
gtgttgactttataaatt

SEQ ID NO: 4464330 - DNA, 17 bp, Homo sapiens
gtgttgcactgaacagg

SEQ ID NO: 4464331 - DNA, 21 bp, Homo sapiens
gtgttggctttgcagctgctg

SEQ ID NO: 4464332 - DNA, 14 bp, Homo sapiens
gtgttgtatgcctt

SEQ ID NO: 4464333 - DNA, 12 bp, Homo sapiens
gtgtttaaaact

SEQ ID NO: 4464334 - DNA, 21 bp, Homo sapiens
gtgtttaaagttcaacatgtt

SEQ ID NO: 4464335 - DNA, 16 bp, Homo sapiens
gtgtttaagtcatttt

SEQ ID NO: 4464336 - DNA, 16 bp, Homo sapiens
gtgtttatgtgctatt

SEQ ID NO: 4464337 - DNA, 16 bp, Homo sapiens
gtgtttatgtgtgtgt

SEQ ID NO: 4464338 - DNA, 19 bp, Homo sapiens
gtgtttctagcactggcct

SEQ ID NO: 4464339 - DNA, 13 bp, Homo sapiens
gtgtttctgactc

SEQ ID NO: 4464340 - DNA, 9 bp, Homo sapiens
gtgtttgct

SEQ ID NO: 4464341 - DNA, 22 bp, Homo sapiens
gtgtttgcttaaaatatgtgaa

SEQ ID NO: 4464342 - DNA, 16 bp, Homo sapiens
gtgtttgtgtgtttca

SEQ ID NO: 4464343 - DNA, 14 bp, Homo sapiens
gtgttttaattgta

SEQ ID NO: 4464344 - DNA, 19 bp, Homo sapiens
gtgttttcatcatttcagc

SEQ ID NO: 4464345 - DNA, 13 bp, Homo sapiens
gtgttttctgtag

SEQ ID NO: 4464346 - DNA, 19 bp, Homo sapiens
gtgttttctgtagactcta

SEQ ID NO: 4464347 - DNA, 15 bp, Homo sapiens
gtgttttgaaagaat

SEQ ID NO: 4464348 - DNA, 16 bp, Homo sapiens
gtgttttgaattgtgt

SEQ ID NO: 4464349 - DNA, 22 bp, Homo sapiens
gtgttttgccctatatacctca

SEQ ID NO: 4464350 - DNA, 19 bp, Homo sapiens
gtgttttgtcagacttcca

SEQ ID NO: 4464351 - DNA, 13 bp, Homo sapiens
gtgttttgttttg

SEQ ID NO: 4464352 - DNA, 17 bp, Homo sapiens
gtgtttttagctgtgac

SEQ ID NO: 4464353 - DNA, 18 bp, Homo sapiens
gtgtttttctccagtgct

SEQ ID NO: 4464354 - DNA, 15 bp, Homo sapiens
gtgttttttaagata

SEQ ID NO: 4464355 - DNA, 13 bp, Homo sapiens
gttaaaaaaaaaa

SEQ ID NO: 4464356 - DNA, 14 bp, Homo sapiens
gttaaaagatgaaa

SEQ ID NO: 4464357 - DNA, 20 bp, Homo sapiens
gttaaaagatgaaaatattt

SEQ ID NO: 4464358 - DNA, 14 bp, Homo sapiens
gttaaaatgtgatt

SEQ ID NO: 4464359 - DNA, 15 bp, Homo sapiens
gttaaagaaaggaaa

SEQ ID NO: 4464360 - DNA, 12 bp, Homo sapiens
gttaaagatgca

SEQ ID NO: 4464361 - DNA, 20 bp, Homo sapiens
gttaaagtcagtgggaacgt

SEQ ID NO: 4464362 - DNA, 14 bp, Homo sapiens
gttaaataaataga

SEQ ID NO: 4464363 - DNA, 20 bp, Homo sapiens
gttaaatacaggaaacagtt

SEQ ID NO: 4464364 - DNA, 18 bp, Homo sapiens
gttaaatgtaatataatg

SEQ ID NO: 4464365 - DNA, 19 bp, Homo sapiens
gttaaattcagtaatgcag

SEQ ID NO: 4464366 - DNA, 18 bp, Homo sapiens
gttaaattccatatgctc

SEQ ID NO: 4464367 - DNA, 23 bp, Homo sapiens
gttaacaatgcctattgtaatat

SEQ ID NO: 4464368 - DNA, 14 bp, Homo sapiens
gttaacagagctaa

SEQ ID NO: 4464369 - DNA, 19 bp, Homo sapiens
gttaactgtgaaataccac

SEQ ID NO: 4464370 - DNA, 15 bp, Homo sapiens
gttaacttggtcaga

SEQ ID NO: 4464371 - DNA, 16 bp, Homo sapiens
gttaagaaagcactta

SEQ ID NO: 4464372 - DNA, 22 bp, Homo sapiens
gttaagacatgatttccttgaa

SEQ ID NO: 4464373 - DNA, 16 bp, Homo sapiens
gttaagcattaccact

SEQ ID NO: 4464374 - DNA, 20 bp, Homo sapiens
gttaagcattaccactcagg

SEQ ID NO: 4464375 - DNA, 21 bp, Homo sapiens
gttaagtcccattcagtggca

SEQ ID NO: 4464376 - DNA, 23 bp, Homo sapiens
gttaagtcctccctgacttttct

SEQ ID NO: 4464377 - DNA, 21 bp, Homo sapiens
gttaagtctatctggtattaa

SEQ ID NO: 4464378 - DNA, 19 bp, Homo sapiens
gttaatacatcacatctta

SEQ ID NO: 4464379 - DNA, 14 bp, Homo sapiens
gttaatcttaatgt

SEQ ID NO: 4464380 - DNA, 17 bp, Homo sapiens
gttaatcttaatgtata

SEQ ID NO: 4464381 - DNA, 19 bp, Homo sapiens
gttaatgactctttctgaa

SEQ ID NO: 4464382 - DNA, 18 bp, Homo sapiens
gttaatgcattgttgtaa

SEQ ID NO: 4464383 - DNA, 21 bp, Homo sapiens
gttaatgcattgttgtaaagt

SEQ ID NO: 4464384 - DNA, 16 bp, Homo sapiens
gttaatgtatataaaa

SEQ ID NO: 4464385 - DNA, 18 bp, Homo sapiens
gttaatgtatataaaaat

SEQ ID NO: 4464386 - DNA, 21 bp, Homo sapiens
gttaatgtggactggaacatg

SEQ ID NO: 4464387 - DNA, 19 bp, Homo sapiens
gttaatttataatgtattt

SEQ ID NO: 4464388 - DNA, 20 bp, Homo sapiens
gttaatttataatgtatttg

SEQ ID NO: 4464389 - DNA, 23 bp, Homo sapiens
gttaatttctccctatgtttatt

SEQ ID NO: 4464390 - DNA, 18 bp, Homo sapiens
gttaattttttggtacaa

SEQ ID NO: 4464391 - DNA, 16 bp, Homo sapiens
gttacacaaaaatcta

SEQ ID NO: 4464392 - DNA, 16 bp, Homo sapiens
gttacacagcccaaga

SEQ ID NO: 4464393 - DNA, 16 bp, Homo sapiens
gttacacatttttcag

SEQ ID NO: 4464394 - DNA, 14 bp, Homo sapiens
gttacactgttaga

SEQ ID NO: 4464395 - DNA, 23 bp, Homo sapiens
gttacagagaatttctaaagtaa

SEQ ID NO: 4464396 - DNA, 22 bp, Homo sapiens
gttacagggaagtggtctcccc

SEQ ID NO: 4464397 - DNA, 14 bp, Homo sapiens
gttacagttctgtg

SEQ ID NO: 4464398 - DNA, 19 bp, Homo sapiens
gttacataaggatgacttt

SEQ ID NO: 4464399 - DNA, 13 bp, Homo sapiens
gttaccattcaca

SEQ ID NO: 4464400 - DNA, 22 bp, Homo sapiens
gttaccattttaacgctgccta

SEQ ID NO: 4464401 - DNA, 23 bp, Homo sapiens
gttaccattttaacgctgcctaa

SEQ ID NO: 4464402 - DNA, 13 bp, Homo sapiens
gttacctactttg

SEQ ID NO: 4464403 - DNA, 18 bp, Homo sapiens
gttaccttatagttactg

SEQ ID NO: 4464404 - DNA, 20 bp, Homo sapiens
gttaccttatagttactgtg

SEQ ID NO: 4464405 - DNA, 16 bp, Homo sapiens
gttactaatatgccta

SEQ ID NO: 4464406 - DNA, 19 bp, Homo sapiens
gttactcacacctgtaatc

SEQ ID NO: 4464407 - DNA, 12 bp, Homo sapiens
gttactcagccc

SEQ ID NO: 4464408 - DNA, 23 bp, Homo sapiens
gttactgcttctctttgtgcagt

SEQ ID NO: 4464409 - DNA, 18 bp, Homo sapiens
gttactggataaattgtt

SEQ ID NO: 4464410 - DNA, 16 bp, Homo sapiens
gttacttagaatgcca

SEQ ID NO: 4464411 - DNA, 16 bp, Homo sapiens
gttagaaaatgactta

SEQ ID NO: 4464412 - DNA, 21 bp, Homo sapiens
gttagaaaatgacttatttct

SEQ ID NO: 4464413 - DNA, 16 bp, Homo sapiens
gttagaactgattaca

SEQ ID NO: 4464414 - DNA, 23 bp, Homo sapiens
gttagaccgctctcttttctgta

SEQ ID NO: 4464415 - DNA, 13 bp, Homo sapiens
gttagacttgctc

SEQ ID NO: 4464416 - DNA, 18 bp, Homo sapiens
gttagacttgtgtgcatg

SEQ ID NO: 4464417 - DNA, 23 bp, Homo sapiens
gttagatattgctactataatca

SEQ ID NO: 4464418 - DNA, 11 bp, Homo sapiens
gttagatgttt

SEQ ID NO: 4464419 - DNA, 20 bp, Homo sapiens
gttagcaaactatttcagtg

SEQ ID NO: 4464420 - DNA, 20 bp, Homo sapiens
gttagcactgatagtccttt

SEQ ID NO: 4464421 - DNA, 20 bp, Homo sapiens
gttagcatgtgtgactttca

SEQ ID NO: 4464422 - DNA, 14 bp, Homo sapiens
gttagctgtcacat

SEQ ID NO: 4464423 - DNA, 22 bp, Homo sapiens
gttagctgtcacatacaacttt

SEQ ID NO: 4464424 - DNA, 20 bp, Homo sapiens
gttaggaggacaaaaggaat

SEQ ID NO: 4464425 - DNA, 13 bp, Homo sapiens
gttaggaggtcct

SEQ ID NO: 4464426 - DNA, 17 bp, Homo sapiens
gttaggtgactaaaagg

SEQ ID NO: 4464427 - DNA, 24 bp, Homo sapiens
gttagttcaatctggattcatatt

SEQ ID NO: 4464428 - DNA, 11 bp, Homo sapiens
gttataaaatt

SEQ ID NO: 4464429 - DNA, 12 bp, Homo sapiens
gttataaataaa

SEQ ID NO: 4464430 - DNA, 16 bp, Homo sapiens
gttataacagatgtga

SEQ ID NO: 4464431 - DNA, 18 bp, Homo sapiens
gttatacaaccttcattt

SEQ ID NO: 4464432 - DNA, 20 bp, Homo sapiens
gttatacaaccttcatttaa

SEQ ID NO: 4464433 - DNA, 22 bp, Homo sapiens
gttatacagttataaaattaaa

SEQ ID NO: 4464434 - DNA, 14 bp, Homo sapiens
gttatatagtggat

SEQ ID NO: 4464435 - DNA, 17 bp, Homo sapiens
gttatatataataaata

SEQ ID NO: 4464436 - DNA, 16 bp, Homo sapiens
gttatatattgtatta

SEQ ID NO: 4464437 - DNA, 12 bp, Homo sapiens
gttatattgctt

SEQ ID NO: 4464438 - DNA, 23 bp, Homo sapiens
gttatatttcagatgtaatgttt

SEQ ID NO: 4464439 - DNA, 21 bp, Homo sapiens
gttatcacctaagcacttcta

SEQ ID NO: 4464440 - DNA, 14 bp, Homo sapiens
gttatccaactatt

SEQ ID NO: 4464441 - DNA, 19 bp, Homo sapiens
gttatctcaggtgagctgg

SEQ ID NO: 4464442 - DNA, 20 bp, Homo sapiens
gttatcttatactgtacaat

SEQ ID NO: 4464443 - DNA, 20 bp, Homo sapiens
gttatcttttgaattcttga

SEQ ID NO: 4464444 - DNA, 20 bp, Homo sapiens
gttatgaacatccaagtctt

SEQ ID NO: 4464445 - DNA, 13 bp, Homo sapiens
gttatgctgtcat

SEQ ID NO: 4464446 - DNA, 16 bp, Homo sapiens
gttatggtagaaaaat

SEQ ID NO: 4464447 - DNA, 23 bp, Homo sapiens
gttatgtcttgtatttaaaaaca

SEQ ID NO: 4464448 - DNA, 14 bp, Homo sapiens
gttatgttcagaaa

SEQ ID NO: 4464449 - DNA, 17 bp, Homo sapiens
gttatgttgataaacca

SEQ ID NO: 4464450 - DNA, 13 bp, Homo sapiens
gttattaaatgat

SEQ ID NO: 4464451 - DNA, 15 bp, Homo sapiens
gttattaatttgtaa

SEQ ID NO: 4464452 - DNA, 14 bp, Homo sapiens
gttattataacata

SEQ ID NO: 4464453 - DNA, 17 bp, Homo sapiens
gttattgcaataaagta

SEQ ID NO: 4464454 - DNA, 18 bp, Homo sapiens
gttattgcaataaagtat

SEQ ID NO: 4464455 - DNA, 14 bp, Homo sapiens
gttattgcagttta

SEQ ID NO: 4464456 - DNA, 13 bp, Homo sapiens
gttattgtgtata

SEQ ID NO: 4464457 - DNA, 14 bp, Homo sapiens
gttatttattatta

SEQ ID NO: 4464458 - DNA, 18 bp, Homo sapiens
gttatttccccagccaca

SEQ ID NO: 4464459 - DNA, 17 bp, Homo sapiens
gttatttctatgaaaat

SEQ ID NO: 4464460 - DNA, 14 bp, Homo sapiens
gttatttcttccct

SEQ ID NO: 4464461 - DNA, 22 bp, Homo sapiens
gttattttatatctgagcaagg

SEQ ID NO: 4464462 - DNA, 13 bp, Homo sapiens
gttattttccagg

SEQ ID NO: 4464463 - DNA, 14 bp, Homo sapiens
gttattttctacag

SEQ ID NO: 4464464 - DNA, 17 bp, Homo sapiens
gttattttctacagtgg

SEQ ID NO: 4464465 - DNA, 20 bp, Homo sapiens
gttattttctacagtggttt

SEQ ID NO: 4464466 - DNA, 15 bp, Homo sapiens
gttattttcttctaa

SEQ ID NO: 4464467 - DNA, 21 bp, Homo sapiens
gttcaaaacttattggaatgt

SEQ ID NO: 4464468 - DNA, 12 bp, Homo sapiens
gttcaaagccag

SEQ ID NO: 4464469 - DNA, 22 bp, Homo sapiens
gttcaacaaagaaacaaagatg

SEQ ID NO: 4464470 - DNA, 20 bp, Homo sapiens
gttcaacctggtggcaccag

SEQ ID NO: 4464471 - DNA, 16 bp, Homo sapiens
gttcaagcctgtggga

SEQ ID NO: 4464472 - DNA, 21 bp, Homo sapiens
gttcaatctgtgaagccttta

SEQ ID NO: 4464473 - DNA, 20 bp, Homo sapiens
gttcacaaactgtgaaaata

SEQ ID NO: 4464474 - DNA, 17 bp, Homo sapiens
gttcacttctaaaccaa

SEQ ID NO: 4464475 - DNA, 21 bp, Homo sapiens
gttcacttctttgcagagcct

SEQ ID NO: 4464476 - DNA, 13 bp, Homo sapiens
gttcagaaaagaa

SEQ ID NO: 4464477 - DNA, 22 bp, Homo sapiens
gttcagaatttagtgtatccat

SEQ ID NO: 4464478 - DNA, 15 bp, Homo sapiens
gttcagacccctgcc

SEQ ID NO: 4464479 - DNA, 22 bp, Homo sapiens
gttcagatgtttcatcaatgca

SEQ ID NO: 4464480 - DNA, 20 bp, Homo sapiens
gttcagcacttgtctcattt

SEQ ID NO: 4464481 - DNA, 18 bp, Homo sapiens
gttcagcccctcctctgc

SEQ ID NO: 4464482 - DNA, 15 bp, Homo sapiens
gttcaggggactcag

SEQ ID NO: 4464483 - DNA, 18 bp, Homo sapiens
gttcaggggactcagccc

SEQ ID NO: 4464484 - DNA, 19 bp, Homo sapiens
gttcataacagtgccattg

SEQ ID NO: 4464485 - DNA, 22 bp, Homo sapiens
gttcataacagtgccattgtct

SEQ ID NO: 4464486 - DNA, 16 bp, Homo sapiens
gttcatcaatgaatga

SEQ ID NO: 4464487 - DNA, 20 bp, Homo sapiens
gttcatcaccatttcctcct

SEQ ID NO: 4464488 - DNA, 17 bp, Homo sapiens
gttcatcacctgctaga

SEQ ID NO: 4464489 - DNA, 17 bp, Homo sapiens
gttcatccaaggctgtt

SEQ ID NO: 4464490 - DNA, 19 bp, Homo sapiens
gttcatcttgtacaaactt

SEQ ID NO: 4464491 - DNA, 14 bp, Homo sapiens
gttcatgatagaaa

SEQ ID NO: 4464492 - DNA, 17 bp, Homo sapiens
gttcatgatgcagtctc

SEQ ID NO: 4464493 - DNA, 10 bp, Homo sapiens
gttcatgttg

SEQ ID NO: 4464494 - DNA, 13 bp, Homo sapiens
gttcattcccaga

SEQ ID NO: 4464495 - DNA, 13 bp, Homo sapiens
gttcattttaagt

SEQ ID NO: 4464496 - DNA, 13 bp, Homo sapiens
gttcattttgaaa

SEQ ID NO: 4464497 - DNA, 16 bp, Homo sapiens
gttcattttgaaaata

SEQ ID NO: 4464498 - DNA, 19 bp, Homo sapiens
gttcattttgaaaatatgt

SEQ ID NO: 4464499 - DNA, 14 bp, Homo sapiens
gttccagaaagtaa

SEQ ID NO: 4464500 - DNA, 17 bp, Homo sapiens
gttccagaagtgtgact

SEQ ID NO: 4464501 - DNA, 19 bp, Homo sapiens
gttccagatacttcagctt

SEQ ID NO: 4464502 - DNA, 18 bp, Homo sapiens
gttccagccaaagcatgc

SEQ ID NO: 4464503 - DNA, 18 bp, Homo sapiens
gttccaggccctccagtg

SEQ ID NO: 4464504 - DNA, 19 bp, Homo sapiens
gttccaggccctccagtgg

SEQ ID NO: 4464505 - DNA, 15 bp, Homo sapiens
gttccagtcctaact

SEQ ID NO: 4464506 - DNA, 14 bp, Homo sapiens
gttccattatgaaa

SEQ ID NO: 4464507 - DNA, 22 bp, Homo sapiens
gttccattatgaaaatcttatt

SEQ ID NO: 4464508 - DNA, 14 bp, Homo sapiens
gttcccaagcaaag

SEQ ID NO: 4464509 - DNA, 14 bp, Homo sapiens
gttcccagcccctc

SEQ ID NO: 4464510 - DNA, 19 bp, Homo sapiens
gttcccagcccctcctccc

SEQ ID NO: 4464511 - DNA, 21 bp, Homo sapiens
gttcccagcccctcctccctc

SEQ ID NO: 4464512 - DNA, 22 bp, Homo sapiens
gttcccagcccctcctccctca

SEQ ID NO: 4464513 - DNA, 18 bp, Homo sapiens
gttcccagcccctgcaga

SEQ ID NO: 4464514 - DNA, 15 bp, Homo sapiens
gttccccaaatacaa

SEQ ID NO: 4464515 - DNA, 21 bp, Homo sapiens
gttcccctagtaagtgccttc

SEQ ID NO: 4464516 - DNA, 22 bp, Homo sapiens
gttccccttccactgagggcag

SEQ ID NO: 4464517 - DNA, 17 bp, Homo sapiens
gttcccgggagctgggc

SEQ ID NO: 4464518 - DNA, 13 bp, Homo sapiens
gttccctcccaga

SEQ ID NO: 4464519 - DNA, 18 bp, Homo sapiens
gttccctgaaaacccaga

SEQ ID NO: 4464520 - DNA, 19 bp, Homo sapiens
gttccctgaaaacccagag

SEQ ID NO: 4464521 - DNA, 15 bp, Homo sapiens
gttcccttgaccatt

SEQ ID NO: 4464522 - DNA, 23 bp, Homo sapiens
gttccgtgggaccctcagcagct

SEQ ID NO: 4464523 - DNA, 14 bp, Homo sapiens
gttcctagagaaga

SEQ ID NO: 4464524 - DNA, 23 bp, Homo sapiens
gttcctagcactgccccacatgc

SEQ ID NO: 4464525 - DNA, 20 bp, Homo sapiens
gttcctcaaattttttgact

SEQ ID NO: 4464526 - DNA, 15 bp, Homo sapiens
gttcctcgccctggg

SEQ ID NO: 4464527 - DNA, 12 bp, Homo sapiens
gttcctctgcct

SEQ ID NO: 4464528 - DNA, 13 bp, Homo sapiens
gttcctctgcctg

SEQ ID NO: 4464529 - DNA, 23 bp, Homo sapiens
gttcctctgctcaccgcccatca

SEQ ID NO: 4464530 - DNA, 15 bp, Homo sapiens
gttcctgaagctgct

SEQ ID NO: 4464531 - DNA, 17 bp, Homo sapiens
gttcctgaagctgctgt

SEQ ID NO: 4464532 - DNA, 17 bp, Homo sapiens
gttcctggccttctgaa

SEQ ID NO: 4464533 - DNA, 21 bp, Homo sapiens
gttcctgtgtgaccctgggca

SEQ ID NO: 4464534 - DNA, 22 bp, Homo sapiens
gttcctgtgtgaccctgggcag

SEQ ID NO: 4464535 - DNA, 15 bp, Homo sapiens
gttccttactgcaga

SEQ ID NO: 4464536 - DNA, 23 bp, Homo sapiens
gttccttcatttccaccaggccg

SEQ ID NO: 4464537 - DNA, 13 bp, Homo sapiens
gttcctttctttt

SEQ ID NO: 4464538 - DNA, 14 bp, Homo sapiens
gttcctttttgcag

SEQ ID NO: 4464539 - DNA, 22 bp, Homo sapiens
gttcgacgagacggtcgagcag

SEQ ID NO: 4464540 - DNA, 16 bp, Homo sapiens
gttcgatacctggagc

SEQ ID NO: 4464541 - DNA, 13 bp, Homo sapiens
gttcgcagagctt

SEQ ID NO: 4464542 - DNA, 16 bp, Homo sapiens
gttctaaaaggtgtga

SEQ ID NO: 4464543 - DNA, 13 bp, Homo sapiens
gttctaaggctca

SEQ ID NO: 4464544 - DNA, 19 bp, Homo sapiens
gttctaagtctttccattg

SEQ ID NO: 4464545 - DNA, 23 bp, Homo sapiens
gttctaattaagaaaactattaa

SEQ ID NO: 4464546 - DNA, 19 bp, Homo sapiens
gttctagacgcccctccca

SEQ ID NO: 4464547 - DNA, 17 bp, Homo sapiens
gttctataaatgaatgt

SEQ ID NO: 4464548 - DNA, 21 bp, Homo sapiens
gttctataagaataaggcttt

SEQ ID NO: 4464549 - DNA, 12 bp, Homo sapiens
gttctatccaaa

SEQ ID NO: 4464550 - DNA, 14 bp, Homo sapiens
gttctatccaaaca

SEQ ID NO: 4464551 - DNA, 21 bp, Homo sapiens
gttctatggagactttgctgt

SEQ ID NO: 4464552 - DNA, 22 bp, Homo sapiens
gttctattaatcacctctctgt

SEQ ID NO: 4464553 - DNA, 16 bp, Homo sapiens
gttctatttcttgaag

SEQ ID NO: 4464554 - DNA, 16 bp, Homo sapiens
gttctcaacatactgt

SEQ ID NO: 4464555 - DNA, 18 bp, Homo sapiens
gttctcaacatactgtaa

SEQ ID NO: 4464556 - DNA, 22 bp, Homo sapiens
gttctcaactggggggcaattt

SEQ ID NO: 4464557 - DNA, 23 bp, Homo sapiens
gttctcagaatcccttaacagtt

SEQ ID NO: 4464558 - DNA, 16 bp, Homo sapiens
gttctcaggacagcat

SEQ ID NO: 4464559 - DNA, 13 bp, Homo sapiens
gttctccactggg

SEQ ID NO: 4464560 - DNA, 14 bp, Homo sapiens
gttctcccaaagat

SEQ ID NO: 4464561 - DNA, 19 bp, Homo sapiens
gttctccctttctctctcc

SEQ ID NO: 4464562 - DNA, 23 bp, Homo sapiens
gttctccgggtgtggcctcagcc

SEQ ID NO: 4464563 - DNA, 20 bp, Homo sapiens
gttctcctgaatattttttg

SEQ ID NO: 4464564 - DNA, 12 bp, Homo sapiens
gttctctgcctt

SEQ ID NO: 4464565 - DNA, 20 bp, Homo sapiens
gttctgagctgtaatttcgc

SEQ ID NO: 4464566 - DNA, 14 bp, Homo sapiens
gttctgcaaataga

SEQ ID NO: 4464567 - DNA, 19 bp, Homo sapiens
gttctgcaaatagaaaaca

SEQ ID NO: 4464568 - DNA, 14 bp, Homo sapiens
gttctgcctcctgg

SEQ ID NO: 4464569 - DNA, 11 bp, Homo sapiens
gttctgcctct

SEQ ID NO: 4464570 - DNA, 12 bp, Homo sapiens
gttctgcctgga

SEQ ID NO: 4464571 - DNA, 18 bp, Homo sapiens
gttctgctcatcattctc

SEQ ID NO: 4464572 - DNA, 23 bp, Homo sapiens
gttctgctcatcattctctgtct

SEQ ID NO: 4464573 - DNA, 21 bp, Homo sapiens
gttctgctccataccttttct

SEQ ID NO: 4464574 - DNA, 16 bp, Homo sapiens
gttctgctggccaaga

SEQ ID NO: 4464575 - DNA, 18 bp, Homo sapiens
gttctgctggccaagaag

SEQ ID NO: 4464576 - DNA, 19 bp, Homo sapiens
gttctgctgtctgggactc

SEQ ID NO: 4464577 - DNA, 15 bp, Homo sapiens
gttctgcttttaagt

SEQ ID NO: 4464578 - DNA, 21 bp, Homo sapiens
gttctggcactattataagtg

SEQ ID NO: 4464579 - DNA, 11 bp, Homo sapiens
gttctgggctg

SEQ ID NO: 4464580 - DNA, 12 bp, Homo sapiens
gttctgggctgg

SEQ ID NO: 4464581 - DNA, 13 bp, Homo sapiens
gttctgggctggg

SEQ ID NO: 4464582 - DNA, 15 bp, Homo sapiens
gttctgggctggggc

SEQ ID NO: 4464583 - DNA, 18 bp, Homo sapiens
gttctgggtgataatttt

SEQ ID NO: 4464584 - DNA, 18 bp, Homo sapiens
gttctgggtgttgaccac

SEQ ID NO: 4464585 - DNA, 15 bp, Homo sapiens
gttctggtatgcatt

SEQ ID NO: 4464586 - DNA, 22 bp, Homo sapiens
gttctggtatgcattctttata

SEQ ID NO: 4464587 - DNA, 16 bp, Homo sapiens
gttctgtaataaaact

SEQ ID NO: 4464588 - DNA, 22 bp, Homo sapiens
gttctgtgacccatctgtagta

SEQ ID NO: 4464589 - DNA, 14 bp, Homo sapiens
gttctgtggttcct

SEQ ID NO: 4464590 - DNA, 21 bp, Homo sapiens
gttctgtggtttcatgttagt

SEQ ID NO: 4464591 - DNA, 13 bp, Homo sapiens
gttctgtgtattt

SEQ ID NO: 4464592 - DNA, 21 bp, Homo sapiens
gttcttaaaaaatttatactt

SEQ ID NO: 4464593 - DNA, 16 bp, Homo sapiens
gttcttaacacttcct

SEQ ID NO: 4464594 - DNA, 13 bp, Homo sapiens
gttcttattttag

SEQ ID NO: 4464595 - DNA, 15 bp, Homo sapiens
gttcttattttagta

SEQ ID NO: 4464596 - DNA, 22 bp, Homo sapiens
gttcttccttttttaaaataaa

SEQ ID NO: 4464597 - DNA, 22 bp, Homo sapiens
gttcttcttgttctgagattca

SEQ ID NO: 4464598 - DNA, 14 bp, Homo sapiens
gttcttgctttctc

SEQ ID NO: 4464599 - DNA, 22 bp, Homo sapiens
gttcttgctttctctctcatgc

SEQ ID NO: 4464600 - DNA, 24 bp, Homo sapiens
gttcttgctttctctctcatgcct

SEQ ID NO: 4464601 - DNA, 15 bp, Homo sapiens
gttcttggaaaaaat

SEQ ID NO: 4464602 - DNA, 14 bp, Homo sapiens
gttcttggtgactg

SEQ ID NO: 4464603 - DNA, 22 bp, Homo sapiens
gttcttggtgtttgactgtaat

SEQ ID NO: 4464604 - DNA, 11 bp, Homo sapiens
gttctttcaac

SEQ ID NO: 4464605 - DNA, 20 bp, Homo sapiens
gttctttcctccccctgcaa

SEQ ID NO: 4464606 - DNA, 11 bp, Homo sapiens
gttctttgttt

SEQ ID NO: 4464607 - DNA, 15 bp, Homo sapiens
gttctttgttttttt

SEQ ID NO: 4464608 - DNA, 17 bp, Homo sapiens
gttctttttaagttaat

SEQ ID NO: 4464609 - DNA, 13 bp, Homo sapiens
gttctttttctga

SEQ ID NO: 4464610 - DNA, 19 bp, Homo sapiens
gttgaaaaagtttgttttt

SEQ ID NO: 4464611 - DNA, 17 bp, Homo sapiens
gttgaaaaatagcatat

SEQ ID NO: 4464612 - DNA, 17 bp, Homo sapiens
gttgaaaaccaaaatga

SEQ ID NO: 4464613 - DNA, 23 bp, Homo sapiens
gttgaaaagactccaaagaaatg

SEQ ID NO: 4464614 - DNA, 16 bp, Homo sapiens
gttgaaaagcacacac

SEQ ID NO: 4464615 - DNA, 14 bp, Homo sapiens
gttgaaaggttttt

SEQ ID NO: 4464616 - DNA, 18 bp, Homo sapiens
gttgaaccattatacttt

SEQ ID NO: 4464617 - DNA, 19 bp, Homo sapiens
gttgaactaatatatgaaa

SEQ ID NO: 4464618 - DNA, 18 bp, Homo sapiens
gttgaagacagcttccca

SEQ ID NO: 4464619 - DNA, 23 bp, Homo sapiens
gttgaagcaaatcgaatgaaatt

SEQ ID NO: 4464620 - DNA, 19 bp, Homo sapiens
gttgacatatttaatgttt

SEQ ID NO: 4464621 - DNA, 21 bp, Homo sapiens
gttgacctttatttattaaac

SEQ ID NO: 4464622 - DNA, 24 bp, Homo sapiens
gttgacttatagtacatgataaat

SEQ ID NO: 4464623 - DNA, 18 bp, Homo sapiens
gttgactttataaatttc

SEQ ID NO: 4464624 - DNA, 20 bp, Homo sapiens
gttgagaatcactgctccag

SEQ ID NO: 4464625 - DNA, 14 bp, Homo sapiens
gttgagctcaggtt

SEQ ID NO: 4464626 - DNA, 16 bp, Homo sapiens
gttgaggaactgtaca

SEQ ID NO: 4464627 - DNA, 17 bp, Homo sapiens
gttgagggaacagacag

SEQ ID NO: 4464628 - DNA, 21 bp, Homo sapiens
gttgagggtgtcacgagccca

SEQ ID NO: 4464629 - DNA, 15 bp, Homo sapiens
gttgataaaaatact

SEQ ID NO: 4464630 - DNA, 23 bp, Homo sapiens
gttgataaaccaaaaacatttga

SEQ ID NO: 4464631 - DNA, 23 bp, Homo sapiens
gttgatattcaaggctttaaaag

SEQ ID NO: 4464632 - DNA, 16 bp, Homo sapiens
gttgatattgtttgct

SEQ ID NO: 4464633 - DNA, 21 bp, Homo sapiens
gttgatggtagggtataatgt

SEQ ID NO: 4464634 - DNA, 18 bp, Homo sapiens
gttgattaagaaaggaag

SEQ ID NO: 4464635 - DNA, 17 bp, Homo sapiens
gttgcaaagagacattt

SEQ ID NO: 4464636 - DNA, 13 bp, Homo sapiens
gttgcacccagcc

SEQ ID NO: 4464637 - DNA, 15 bp, Homo sapiens
gttgcacccagccct

SEQ ID NO: 4464638 - DNA, 14 bp, Homo sapiens
gttgcactgtttgc

SEQ ID NO: 4464639 - DNA, 17 bp, Homo sapiens
gttgcaggttcatggat

SEQ ID NO: 4464640 - DNA, 20 bp, Homo sapiens
gttgcatgtagtaacactaa

SEQ ID NO: 4464641 - DNA, 17 bp, Homo sapiens
gttgcatgtttttgaaa

SEQ ID NO: 4464642 - DNA, 12 bp, Homo sapiens
gttgccagaggc

SEQ ID NO: 4464643 - DNA, 16 bp, Homo sapiens
gttgccagaggccctg

SEQ ID NO: 4464644 - DNA, 15 bp, Homo sapiens
gttgccccccatcac

SEQ ID NO: 4464645 - DNA, 15 bp, Homo sapiens
gttgcctaattggaa

SEQ ID NO: 4464646 - DNA, 12 bp, Homo sapiens
gttgcctccccc

SEQ ID NO: 4464647 - DNA, 16 bp, Homo sapiens
gttgccttatttctca

SEQ ID NO: 4464648 - DNA, 19 bp, Homo sapiens
gttgctctgacctcctctg

SEQ ID NO: 4464649 - DNA, 17 bp, Homo sapiens
gttgctgagccagctgc

SEQ ID NO: 4464650 - DNA, 18 bp, Homo sapiens
gttgctggatcaggaagc

SEQ ID NO: 4464651 - DNA, 13 bp, Homo sapiens
gttggaaaaaatt

SEQ ID NO: 4464652 - DNA, 15 bp, Homo sapiens
gttggaaaaaatttg

SEQ ID NO: 4464653 - DNA, 21 bp, Homo sapiens
gttggaactatacccgggacc

SEQ ID NO: 4464654 - DNA, 22 bp, Homo sapiens
gttggaactatacccgggacca

SEQ ID NO: 4464655 - DNA, 15 bp, Homo sapiens
gttggaagaggaaca

SEQ ID NO: 4464656 - DNA, 15 bp, Homo sapiens
gttggaatggatttt

SEQ ID NO: 4464657 - DNA, 19 bp, Homo sapiens
gttggagagctagaacctg

SEQ ID NO: 4464658 - DNA, 21 bp, Homo sapiens
gttggagtttgggctggagct

SEQ ID NO: 4464659 - DNA, 23 bp, Homo sapiens
gttggagtttgggctggagctcc

SEQ ID NO: 4464660 - DNA, 15 bp, Homo sapiens
gttggattccatgct

SEQ ID NO: 4464661 - DNA, 16 bp, Homo sapiens
gttggattccatgcta

SEQ ID NO: 4464662 - DNA, 14 bp, Homo sapiens
gttggatttttgtc

SEQ ID NO: 4464663 - DNA, 12 bp, Homo sapiens
gttggcaggccc

SEQ ID NO: 4464664 - DNA, 19 bp, Homo sapiens
gttggcatagctctggggt

SEQ ID NO: 4464665 - DNA, 17 bp, Homo sapiens
gttggctgttccagact

SEQ ID NO: 4464666 - DNA, 13 bp, Homo sapiens
gttggcttctgtt

SEQ ID NO: 4464667 - DNA, 23 bp, Homo sapiens
gttggcttctgtttctagttgag

SEQ ID NO: 4464668 - DNA, 18 bp, Homo sapiens
gttggctttgcagctgct

SEQ ID NO: 4464669 - DNA, 21 bp, Homo sapiens
gttggctttgcagctgctgtc

SEQ ID NO: 4464670 - DNA, 15 bp, Homo sapiens
gttgggagcctagct

SEQ ID NO: 4464671 - DNA, 19 bp, Homo sapiens
gttgggcagccagaccagc

SEQ ID NO: 4464672 - DNA, 18 bp, Homo sapiens
gttggggaagggcctgcc

SEQ ID NO: 4464673 - DNA, 14 bp, Homo sapiens
gttggggcttcaca

SEQ ID NO: 4464674 - DNA, 14 bp, Homo sapiens
gttgggggaatgca

SEQ ID NO: 4464675 - DNA, 14 bp, Homo sapiens
gttgggtagaaaaa

SEQ ID NO: 4464676 - DNA, 21 bp, Homo sapiens
gttgggtcagtggccaggtgc

SEQ ID NO: 4464677 - DNA, 18 bp, Homo sapiens
gttggtattaataaaaag

SEQ ID NO: 4464678 - DNA, 14 bp, Homo sapiens
gttggtctgtagca

SEQ ID NO: 4464679 - DNA, 18 bp, Homo sapiens
gttggttttgacttcaga

SEQ ID NO: 4464680 - DNA, 16 bp, Homo sapiens
gttgtaaacaggaagc

SEQ ID NO: 4464681 - DNA, 21 bp, Homo sapiens
gttgtaaagtatgtattattt

SEQ ID NO: 4464682 - DNA, 21 bp, Homo sapiens
gttgtaaagtatttgatgtac

SEQ ID NO: 4464683 - DNA, 13 bp, Homo sapiens
gttgtaactaggc

SEQ ID NO: 4464684 - DNA, 18 bp, Homo sapiens
gttgtaactaggctcaga

SEQ ID NO: 4464685 - DNA, 19 bp, Homo sapiens
gttgtaactaggctcagag

SEQ ID NO: 4464686 - DNA, 17 bp, Homo sapiens
gttgtaatatttcttca

SEQ ID NO: 4464687 - DNA, 12 bp, Homo sapiens
gttgtacatgat

SEQ ID NO: 4464688 - DNA, 18 bp, Homo sapiens
gttgtaccgcaatgtgac

SEQ ID NO: 4464689 - DNA, 16 bp, Homo sapiens
gttgtactttatatct

SEQ ID NO: 4464690 - DNA, 23 bp, Homo sapiens
gttgtactttatatcttgtttac

SEQ ID NO: 4464691 - DNA, 14 bp, Homo sapiens
gttgtatgccttta

SEQ ID NO: 4464692 - DNA, 16 bp, Homo sapiens
gttgtatttcaaatat

SEQ ID NO: 4464693 - DNA, 23 bp, Homo sapiens
gttgtatttcaaatatctaagca

SEQ ID NO: 4464694 - DNA, 17 bp, Homo sapiens
gttgtcctcagccccgc

SEQ ID NO: 4464695 - DNA, 15 bp, Homo sapiens
gttgtcctgttaatt

SEQ ID NO: 4464696 - DNA, 17 bp, Homo sapiens
gttgtcgtaaagatttg

SEQ ID NO: 4464697 - DNA, 16 bp, Homo sapiens
gttgtctggcaaggac

SEQ ID NO: 4464698 - DNA, 18 bp, Homo sapiens
gttgtgactctaggcttc

SEQ ID NO: 4464699 - DNA, 23 bp, Homo sapiens
gttgtgactctaggcttcaggtt

SEQ ID NO: 4464700 - DNA, 12 bp, Homo sapiens
gttgtgtgtggg

SEQ ID NO: 4464701 - DNA, 13 bp, Homo sapiens
gttgtgtgtggga

SEQ ID NO: 4464702 - DNA, 16 bp, Homo sapiens
gttgtgttttttaaga

SEQ ID NO: 4464703 - DNA, 13 bp, Homo sapiens
gttgttaatttag

SEQ ID NO: 4464704 - DNA, 13 bp, Homo sapiens
gttgttctgcctg

SEQ ID NO: 4464705 - DNA, 20 bp, Homo sapiens
gttgttgatattgtttgctg

SEQ ID NO: 4464706 - DNA, 21 bp, Homo sapiens
gttgttgatattgtttgctgt

SEQ ID NO: 4464707 - DNA, 19 bp, Homo sapiens
gttgttgcaccatctgctt

SEQ ID NO: 4464708 - DNA, 15 bp, Homo sapiens
gttgttgtggaagca

SEQ ID NO: 4464709 - DNA, 18 bp, Homo sapiens
gttgttgtgtgtatatgt

SEQ ID NO: 4464710 - DNA, 21 bp, Homo sapiens
gttgttgtgtgtatatgtatt

SEQ ID NO: 4464711 - DNA, 22 bp, Homo sapiens
gttgttgtgtgtatatgtattt

SEQ ID NO: 4464712 - DNA, 14 bp, Homo sapiens
gttgtttgcttctt

SEQ ID NO: 4464713 - DNA, 14 bp, Homo sapiens
gtttaaaaaaaaaa

SEQ ID NO: 4464714 - DNA, 17 bp, Homo sapiens
gtttaaaaaataacttc

SEQ ID NO: 4464715 - DNA, 21 bp, Homo sapiens
gtttaaaataaaatgaaaatt

SEQ ID NO: 4464716 - DNA, 10 bp, Homo sapiens
gtttaaaatc

SEQ ID NO: 4464717 - DNA, 23 bp, Homo sapiens
gtttaaacccaagtgctgcacaa

SEQ ID NO: 4464718 - DNA, 18 bp, Homo sapiens
gtttaaagaaagtgtatt

SEQ ID NO: 4464719 - DNA, 20 bp, Homo sapiens
gtttaaattgatagcagata

SEQ ID NO: 4464720 - DNA, 23 bp, Homo sapiens
gtttaagcttaacatttcatgta

SEQ ID NO: 4464721 - DNA, 17 bp, Homo sapiens
gtttaagggtggaaaaa

SEQ ID NO: 4464722 - DNA, 18 bp, Homo sapiens
gtttaatttttatttctt

SEQ ID NO: 4464723 - DNA, 20 bp, Homo sapiens
gtttacaaaaatttctgtaa

SEQ ID NO: 4464724 - DNA, 13 bp, Homo sapiens
gtttacaggggtt

SEQ ID NO: 4464725 - DNA, 13 bp, Homo sapiens
gtttacagtgaag

SEQ ID NO: 4464726 - DNA, 17 bp, Homo sapiens
gtttacagtgaagaaag

SEQ ID NO: 4464727 - DNA, 17 bp, Homo sapiens
gtttacataagagaaag

SEQ ID NO: 4464728 - DNA, 18 bp, Homo sapiens
gtttacataagagaaaga

SEQ ID NO: 4464729 - DNA, 23 bp, Homo sapiens
gtttactatatagaatttcctgt

SEQ ID NO: 4464730 - DNA, 13 bp, Homo sapiens
gtttactcccttc

SEQ ID NO: 4464731 - DNA, 17 bp, Homo sapiens
gtttactcccttctgta

SEQ ID NO: 4464732 - DNA, 18 bp, Homo sapiens
gtttacttatcttatgcc

SEQ ID NO: 4464733 - DNA, 16 bp, Homo sapiens
gtttagaagaagtgtg

SEQ ID NO: 4464734 - DNA, 15 bp, Homo sapiens
gtttagaagcgctca

SEQ ID NO: 4464735 - DNA, 17 bp, Homo sapiens
gtttagaatcagaataa

SEQ ID NO: 4464736 - DNA, 19 bp, Homo sapiens
gtttagatagggctgggca

SEQ ID NO: 4464737 - DNA, 20 bp, Homo sapiens
gtttagatttatggttgtta

SEQ ID NO: 4464738 - DNA, 16 bp, Homo sapiens
gtttagttttacacta

SEQ ID NO: 4464739 - DNA, 19 bp, Homo sapiens
gtttagttttacattttaa

SEQ ID NO: 4464740 - DNA, 22 bp, Homo sapiens
gtttataaatagcatttggaaa

SEQ ID NO: 4464741 - DNA, 16 bp, Homo sapiens
gtttataaatgttctg

SEQ ID NO: 4464742 - DNA, 19 bp, Homo sapiens
gtttataaatgttctggta

SEQ ID NO: 4464743 - DNA, 19 bp, Homo sapiens
gtttatacagttttaaaga

SEQ ID NO: 4464744 - DNA, 17 bp, Homo sapiens
gtttatatattgaaagt

SEQ ID NO: 4464745 - DNA, 16 bp, Homo sapiens
gtttatatcactgtct

SEQ ID NO: 4464746 - DNA, 21 bp, Homo sapiens
gtttatatggaagaaagtaag

SEQ ID NO: 4464747 - DNA, 21 bp, Homo sapiens
gtttatgaattataaatgtgt

SEQ ID NO: 4464748 - DNA, 15 bp, Homo sapiens
gtttatgatatttct

SEQ ID NO: 4464749 - DNA, 17 bp, Homo sapiens
gtttatgatatttcttg

SEQ ID NO: 4464750 - DNA, 22 bp, Homo sapiens
gtttatggaaatattaagaaca

SEQ ID NO: 4464751 - DNA, 13 bp, Homo sapiens
gtttatggcctca

SEQ ID NO: 4464752 - DNA, 14 bp, Homo sapiens
gtttattaatctta

SEQ ID NO: 4464753 - DNA, 13 bp, Homo sapiens
gtttattattgta

SEQ ID NO: 4464754 - DNA, 23 bp, Homo sapiens
gtttattgtagtaaactattctt

SEQ ID NO: 4464755 - DNA, 14 bp, Homo sapiens
gtttattgtttgat

SEQ ID NO: 4464756 - DNA, 20 bp, Homo sapiens
gtttattgtttgatgttttt

SEQ ID NO: 4464757 - DNA, 11 bp, Homo sapiens
gtttatttcct

SEQ ID NO: 4464758 - DNA, 19 bp, Homo sapiens
gtttattttcaagaataat

SEQ ID NO: 4464759 - DNA, 20 bp, Homo sapiens
gtttattttcattctgccaa

SEQ ID NO: 4464760 - DNA, 15 bp, Homo sapiens
gtttcaaaatagaca

SEQ ID NO: 4464761 - DNA, 16 bp, Homo sapiens
gtttcaaactgtaaaa

SEQ ID NO: 4464762 - DNA, 14 bp, Homo sapiens
gtttcaactttctt

SEQ ID NO: 4464763 - DNA, 23 bp, Homo sapiens
gtttcacagcctataaccagaca

SEQ ID NO: 4464764 - DNA, 17 bp, Homo sapiens
gtttcagagcataaaac

SEQ ID NO: 4464765 - DNA, 19 bp, Homo sapiens
gtttcatgtatgtatataa

SEQ ID NO: 4464766 - DNA, 17 bp, Homo sapiens
gtttcatgttagttacc

SEQ ID NO: 4464767 - DNA, 15 bp, Homo sapiens
gtttcattacttgaa

SEQ ID NO: 4464768 - DNA, 22 bp, Homo sapiens
gtttcccaaaacaatctattta

SEQ ID NO: 4464769 - DNA, 16 bp, Homo sapiens
gtttcccaagagctac

SEQ ID NO: 4464770 - DNA, 23 bp, Homo sapiens
gtttccccaataaagccttttaa

SEQ ID NO: 4464771 - DNA, 21 bp, Homo sapiens
gtttcctaaatccaaccattt

SEQ ID NO: 4464772 - DNA, 22 bp, Homo sapiens
gtttcctcatctatggttctaa

SEQ ID NO: 4464773 - DNA, 17 bp, Homo sapiens
gtttcctcgagaggcac

SEQ ID NO: 4464774 - DNA, 17 bp, Homo sapiens
gtttcctgacattgtct

SEQ ID NO: 4464775 - DNA, 15 bp, Homo sapiens
gtttccttttttccc

SEQ ID NO: 4464776 - DNA, 22 bp, Homo sapiens
gtttcggccttcataatggcct

SEQ ID NO: 4464777 - DNA, 23 bp, Homo sapiens
gtttctaccggagagagaatgta

SEQ ID NO: 4464778 - DNA, 18 bp, Homo sapiens
gtttctagcactggcctg

SEQ ID NO: 4464779 - DNA, 21 bp, Homo sapiens
gtttctatggattcacttcta

SEQ ID NO: 4464780 - DNA, 22 bp, Homo sapiens
gtttctatggattcacttctat

SEQ ID NO: 4464781 - DNA, 13 bp, Homo sapiens
gtttctctgcaga

SEQ ID NO: 4464782 - DNA, 18 bp, Homo sapiens
gtttctggtgccatttct

SEQ ID NO: 4464783 - DNA, 21 bp, Homo sapiens
gtttctgtcaagctggtgcta

SEQ ID NO: 4464784 - DNA, 12 bp, Homo sapiens
gtttctgttcca

SEQ ID NO: 4464785 - DNA, 21 bp, Homo sapiens
gtttcttaaataagaaacttt

SEQ ID NO: 4464786 - DNA, 12 bp, Homo sapiens
gtttcttcattt

SEQ ID NO: 4464787 - DNA, 19 bp, Homo sapiens
gtttcttgccttttgttaa

SEQ ID NO: 4464788 - DNA, 17 bp, Homo sapiens
gtttcttgtgtagattt

SEQ ID NO: 4464789 - DNA, 16 bp, Homo sapiens
gtttgaaagttgtaca

SEQ ID NO: 4464790 - DNA, 18 bp, Homo sapiens
gtttgaaagttgtacatg

SEQ ID NO: 4464791 - DNA, 19 bp, Homo sapiens
gtttgaaagttgtacatga

SEQ ID NO: 4464792 - DNA, 23 bp, Homo sapiens
gtttgaaagttgtacatgataag

SEQ ID NO: 4464793 - DNA, 22 bp, Homo sapiens
gtttgaaatgaggtctgtttaa

SEQ ID NO: 4464794 - DNA, 14 bp, Homo sapiens
gtttgaaattctga

SEQ ID NO: 4464795 - DNA, 15 bp, Homo sapiens
gtttgaaattctgaa

SEQ ID NO: 4464796 - DNA, 22 bp, Homo sapiens
gtttgaagagccattttggtaa

SEQ ID NO: 4464797 - DNA, 20 bp, Homo sapiens
gtttgaagcacaactccctt

SEQ ID NO: 4464798 - DNA, 14 bp, Homo sapiens
gtttgaatatttgt

SEQ ID NO: 4464799 - DNA, 10 bp, Homo sapiens
gtttgacaaa

SEQ ID NO: 4464800 - DNA, 23 bp, Homo sapiens
gtttgacctcgactggtttttct

SEQ ID NO: 4464801 - DNA, 13 bp, Homo sapiens
gtttgactgtaat

SEQ ID NO: 4464802 - DNA, 13 bp, Homo sapiens
gtttgactttttg

SEQ ID NO: 4464803 - DNA, 15 bp, Homo sapiens
gtttgagaccaggct

SEQ ID NO: 4464804 - DNA, 16 bp, Homo sapiens
gtttgagaccaggctg

SEQ ID NO: 4464805 - DNA, 13 bp, Homo sapiens
gtttgagctcaga

SEQ ID NO: 4464806 - DNA, 14 bp, Homo sapiens
gtttgagctgcctt

SEQ ID NO: 4464807 - DNA, 15 bp, Homo sapiens
gtttgagctgccttc

SEQ ID NO: 4464808 - DNA, 17 bp, Homo sapiens
gtttgaggaagtggctg

SEQ ID NO: 4464809 - DNA, 18 bp, Homo sapiens
gtttgagtttttcctccc

SEQ ID NO: 4464810 - DNA, 21 bp, Homo sapiens
gtttgattggatattctcctc

SEQ ID NO: 4464811 - DNA, 20 bp, Homo sapiens
gtttgcacaagttccctgga

SEQ ID NO: 4464812 - DNA, 19 bp, Homo sapiens
gtttgcagaaaagcacctg

SEQ ID NO: 4464813 - DNA, 22 bp, Homo sapiens
gtttgcagaaaagcacctgccg

SEQ ID NO: 4464814 - DNA, 17 bp, Homo sapiens
gtttgccaagctaatct

SEQ ID NO: 4464815 - DNA, 15 bp, Homo sapiens
gtttgctgattattt

SEQ ID NO: 4464816 - DNA, 16 bp, Homo sapiens
gtttgctgttgggttt

SEQ ID NO: 4464817 - DNA, 18 bp, Homo sapiens
gtttgcttaaaatatgtg

SEQ ID NO: 4464818 - DNA, 17 bp, Homo sapiens
gtttgctttgctttgta

SEQ ID NO: 4464819 - DNA, 22 bp, Homo sapiens
gtttggacagacccacccccag

SEQ ID NO: 4464820 - DNA, 19 bp, Homo sapiens
gtttggcaaaactcaggca

SEQ ID NO: 4464821 - DNA, 19 bp, Homo sapiens
gtttgggctggagctcctc

SEQ ID NO: 4464822 - DNA, 19 bp, Homo sapiens
gtttggggcagaaaggact

SEQ ID NO: 4464823 - DNA, 13 bp, Homo sapiens
gtttggtgctttt

SEQ ID NO: 4464824 - DNA, 13 bp, Homo sapiens
gtttgtaaatgcc

SEQ ID NO: 4464825 - DNA, 21 bp, Homo sapiens
gtttgtaaggatgattttaat

SEQ ID NO: 4464826 - DNA, 12 bp, Homo sapiens
gtttgtggcctc

SEQ ID NO: 4464827 - DNA, 13 bp, Homo sapiens
gtttgtggctggg

SEQ ID NO: 4464828 - DNA, 20 bp, Homo sapiens
gtttgtggctgggggcagga

SEQ ID NO: 4464829 - DNA, 18 bp, Homo sapiens
gtttgtgtttatgaaaca

SEQ ID NO: 4464830 - DNA, 15 bp, Homo sapiens
gtttgttaaagcctg

SEQ ID NO: 4464831 - DNA, 18 bp, Homo sapiens
gtttgttaaagcctgttc

SEQ ID NO: 4464832 - DNA, 16 bp, Homo sapiens
gtttgtttacataaga

SEQ ID NO: 4464833 - DNA, 12 bp, Homo sapiens
gtttgtttcttt

SEQ ID NO: 4464834 - DNA, 20 bp, Homo sapiens
gtttgttttagaaccagccg

SEQ ID NO: 4464835 - DNA, 17 bp, Homo sapiens
gtttgttttcaaaatac

SEQ ID NO: 4464836 - DNA, 23 bp, Homo sapiens
gtttgtttttgtttggtataaat

SEQ ID NO: 4464837 - DNA, 22 bp, Homo sapiens
gttttaaaatgtgaggcaataa

SEQ ID NO: 4464838 - DNA, 15 bp, Homo sapiens
gttttaaagaaattt

SEQ ID NO: 4464839 - DNA, 19 bp, Homo sapiens
gttttaaagaaattttagt

SEQ ID NO: 4464840 - DNA, 22 bp, Homo sapiens
gttttaaatgtacagacatatt

SEQ ID NO: 4464841 - DNA, 19 bp, Homo sapiens
gttttaaggaaaaaagatt

SEQ ID NO: 4464842 - DNA, 16 bp, Homo sapiens
gttttacaatagttct

SEQ ID NO: 4464843 - DNA, 20 bp, Homo sapiens
gttttacaatagttctgtgg

SEQ ID NO: 4464844 - DNA, 16 bp, Homo sapiens
gttttacacagagaaa

SEQ ID NO: 4464845 - DNA, 20 bp, Homo sapiens
gttttacagctgcctttcgt

SEQ ID NO: 4464846 - DNA, 14 bp, Homo sapiens
gttttacaggaaac

SEQ ID NO: 4464847 - DNA, 21 bp, Homo sapiens
gttttacaggaaacaaacctt

SEQ ID NO: 4464848 - DNA, 21 bp, Homo sapiens
gttttacattgttgagctatt

SEQ ID NO: 4464849 - DNA, 21 bp, Homo sapiens
gttttactcttaaatcatttg

SEQ ID NO: 4464850 - DNA, 13 bp, Homo sapiens
gttttactgcctg

SEQ ID NO: 4464851 - DNA, 14 bp, Homo sapiens
gttttactgcctgt

SEQ ID NO: 4464852 - DNA, 17 bp, Homo sapiens
gttttactgtcagatta

SEQ ID NO: 4464853 - DNA, 19 bp, Homo sapiens
gttttactgtcagattaaa

SEQ ID NO: 4464854 - DNA, 20 bp, Homo sapiens
gttttactgtcagattaaat

SEQ ID NO: 4464855 - DNA, 18 bp, Homo sapiens
gttttacttttaaactgt

SEQ ID NO: 4464856 - DNA, 15 bp, Homo sapiens
gttttagaaattggt

SEQ ID NO: 4464857 - DNA, 21 bp, Homo sapiens
gttttaggaaaagtgaatctt

SEQ ID NO: 4464858 - DNA, 21 bp, Homo sapiens
gttttataatttaataaaaag

SEQ ID NO: 4464859 - DNA, 23 bp, Homo sapiens
gttttatatattatgtgaagaat

SEQ ID NO: 4464860 - DNA, 20 bp, Homo sapiens
gttttatggttacttcttct

SEQ ID NO: 4464861 - DNA, 15 bp, Homo sapiens
gttttattctgactt

SEQ ID NO: 4464862 - DNA, 20 bp, Homo sapiens
gttttattctgacttcctct

SEQ ID NO: 4464863 - DNA, 13 bp, Homo sapiens
gttttatttacat

SEQ ID NO: 4464864 - DNA, 13 bp, Homo sapiens
gttttatttatat

SEQ ID NO: 4464865 - DNA, 24 bp, Homo sapiens
gttttatttatatcttgttattaa

SEQ ID NO: 4464866 - DNA, 16 bp, Homo sapiens
gttttattttaaatta

SEQ ID NO: 4464867 - DNA, 16 bp, Homo sapiens
gttttcaaaatacttc

SEQ ID NO: 4464868 - DNA, 21 bp, Homo sapiens
gttttcagaacctcttcccca

SEQ ID NO: 4464869 - DNA, 12 bp, Homo sapiens
gttttcagactg

SEQ ID NO: 4464870 - DNA, 24 bp, Homo sapiens
gttttcaggagtgggttgatttca

SEQ ID NO: 4464871 - DNA, 16 bp, Homo sapiens
gttttcattatctcaa

SEQ ID NO: 4464872 - DNA, 12 bp, Homo sapiens
gttttcatttgc

SEQ ID NO: 4464873 - DNA, 22 bp, Homo sapiens
gttttcattttaactggcatgt

SEQ ID NO: 4464874 - DNA, 11 bp, Homo sapiens
gttttccaaac

SEQ ID NO: 4464875 - DNA, 14 bp, Homo sapiens
gttttccactgtgc

SEQ ID NO: 4464876 - DNA, 17 bp, Homo sapiens
gttttccaggtgtagct

SEQ ID NO: 4464877 - DNA, 23 bp, Homo sapiens
gttttctgagaaagactattcaa

SEQ ID NO: 4464878 - DNA, 14 bp, Homo sapiens
gttttctgtagact

SEQ ID NO: 4464879 - DNA, 15 bp, Homo sapiens
gttttcttcctttga

SEQ ID NO: 4464880 - DNA, 19 bp, Homo sapiens
gttttgaaagtttaacaaa

SEQ ID NO: 4464881 - DNA, 15 bp, Homo sapiens
gttttgaaggcaaaa

SEQ ID NO: 4464882 - DNA, 21 bp, Homo sapiens
gttttgaaggcaaaattgcaa

SEQ ID NO: 4464883 - DNA, 21 bp, Homo sapiens
gttttgactactagagctcca

SEQ ID NO: 4464884 - DNA, 21 bp, Homo sapiens
gttttgatgtttgtggcctca

SEQ ID NO: 4464885 - DNA, 23 bp, Homo sapiens
gttttgatgtttgtggcctcaga

SEQ ID NO: 4464886 - DNA, 18 bp, Homo sapiens
gttttggactctctgtgg

SEQ ID NO: 4464887 - DNA, 13 bp, Homo sapiens
gttttgtaaaaga

SEQ ID NO: 4464888 - DNA, 15 bp, Homo sapiens
gttttgtattctctg

SEQ ID NO: 4464889 - DNA, 15 bp, Homo sapiens
gttttgtattgcttc

SEQ ID NO: 4464890 - DNA, 17 bp, Homo sapiens
gttttgtcaaactgtag

SEQ ID NO: 4464891 - DNA, 15 bp, Homo sapiens
gttttgttaatatac

SEQ ID NO: 4464892 - DNA, 15 bp, Homo sapiens
gttttgttcccctcc

SEQ ID NO: 4464893 - DNA, 21 bp, Homo sapiens
gttttgttcccctcctccact

SEQ ID NO: 4464894 - DNA, 19 bp, Homo sapiens
gttttgttttcgtttttca

SEQ ID NO: 4464895 - DNA, 14 bp, Homo sapiens
gttttgttttggac

SEQ ID NO: 4464896 - DNA, 22 bp, Homo sapiens
gtttttaaaaaaaaaaaatcat

SEQ ID NO: 4464897 - DNA, 14 bp, Homo sapiens
gtttttaaattttg

SEQ ID NO: 4464898 - DNA, 19 bp, Homo sapiens
gtttttaaattttgtaatg

SEQ ID NO: 4464899 - DNA, 17 bp, Homo sapiens
gtttttaaattttgtat

SEQ ID NO: 4464900 - DNA, 18 bp, Homo sapiens
gtttttaacaatctaaca

SEQ ID NO: 4464901 - DNA, 20 bp, Homo sapiens
gtttttaatctttgtgacag

SEQ ID NO: 4464902 - DNA, 19 bp, Homo sapiens
gtttttaattaaaaacttt

SEQ ID NO: 4464903 - DNA, 15 bp, Homo sapiens
gtttttataataaaa

SEQ ID NO: 4464904 - DNA, 16 bp, Homo sapiens
gtttttatggggctga

SEQ ID NO: 4464905 - DNA, 13 bp, Homo sapiens
gtttttatttctt

SEQ ID NO: 4464906 - DNA, 14 bp, Homo sapiens
gtttttcacttcta

SEQ ID NO: 4464907 - DNA, 15 bp, Homo sapiens
gtttttcatactgta

SEQ ID NO: 4464908 - DNA, 16 bp, Homo sapiens
gtttttcatactgtac

SEQ ID NO: 4464909 - DNA, 18 bp, Homo sapiens
gtttttcatactgtacac

SEQ ID NO: 4464910 - DNA, 21 bp, Homo sapiens
gtttttcatactgtacacatt

SEQ ID NO: 4464911 - DNA, 17 bp, Homo sapiens
gtttttcatcttttgaa

SEQ ID NO: 4464912 - DNA, 16 bp, Homo sapiens
gtttttccctccccag

SEQ ID NO: 4464913 - DNA, 16 bp, Homo sapiens
gtttttctccagtgct

SEQ ID NO: 4464914 - DNA, 23 bp, Homo sapiens
gtttttctctataaagggtcagg

SEQ ID NO: 4464915 - DNA, 17 bp, Homo sapiens
gtttttggaaaaacctt

SEQ ID NO: 4464916 - DNA, 16 bp, Homo sapiens
gtttttggatggctta

SEQ ID NO: 4464917 - DNA, 24 bp, Homo sapiens
gtttttggatggtgttacatatta

SEQ ID NO: 4464918 - DNA, 13 bp, Homo sapiens
gtttttgggatgt

SEQ ID NO: 4464919 - DNA, 12 bp, Homo sapiens
gtttttgtgctg

SEQ ID NO: 4464920 - DNA, 16 bp, Homo sapiens
gtttttgtttttgcat

SEQ ID NO: 4464921 - DNA, 18 bp, Homo sapiens
gttttttaagatagtgta

SEQ ID NO: 4464922 - DNA, 13 bp, Homo sapiens
gttttttactttg

SEQ ID NO: 4464923 - DNA, 20 bp, Homo sapiens
gttttttcctcagtgcattt

SEQ ID NO: 4464924 - DNA, 19 bp, Homo sapiens
gttttttggggatgtggag

SEQ ID NO: 4464925 - DNA, 13 bp, Homo sapiens
gttttttgtagaa

SEQ ID NO: 4464926 - DNA, 14 bp, Homo sapiens
gtttttttctaaaa

SEQ ID NO: 4464927 - DNA, 19 bp, Homo sapiens
gtttttttcttctgtattt

SEQ ID NO: 4464928 - DNA, 17 bp, Homo sapiens
gtttttttgttattaaa

SEQ ID NO: 4464929 - DNA, 18 bp, Homo sapiens
taaaaaaaaaaaaaagct

SEQ ID NO: 4464930 - DNA, 22 bp, Homo sapiens
taaaaaaaaaaaaaagctttat

SEQ ID NO: 4464931 - DNA, 17 bp, Homo sapiens
taaaaaaaaaaaatcat

SEQ ID NO: 4464932 - DNA, 19 bp, Homo sapiens
taaaaaaaaaaagattgta

SEQ ID NO: 4464933 - DNA, 19 bp, Homo sapiens
taaaaaaaaaactgcttta

SEQ ID NO: 4464934 - DNA, 16 bp, Homo sapiens
taaaaaaaaaagtcac

SEQ ID NO: 4464935 - DNA, 19 bp, Homo sapiens
taaaaaaaaagatctgttt

SEQ ID NO: 4464936 - DNA, 21 bp, Homo sapiens
taaaaaaaaatagatgtcttt

SEQ ID NO: 4464937 - DNA, 23 bp, Homo sapiens
taaaaaaaaatagatgtctttta

SEQ ID NO: 4464938 - DNA, 18 bp, Homo sapiens
taaaaaaaatccttgtga

SEQ ID NO: 4464939 - DNA, 15 bp, Homo sapiens
taaaaaaataagaag

SEQ ID NO: 4464940 - DNA, 22 bp, Homo sapiens
taaaaaaataagaagaatgctt

SEQ ID NO: 4464941 - DNA, 20 bp, Homo sapiens
taaaaaaataataataatgt

SEQ ID NO: 4464942 - DNA, 18 bp, Homo sapiens
taaaaaacactaaacatt

SEQ ID NO: 4464943 - DNA, 19 bp, Homo sapiens
taaaaaacactaaacattc

SEQ ID NO: 4464944 - DNA, 16 bp, Homo sapiens
taaaaaactgtataag

SEQ ID NO: 4464945 - DNA, 18 bp, Homo sapiens
taaaaaagcatacttcta

SEQ ID NO: 4464946 - DNA, 18 bp, Homo sapiens
taaaaaagcttaaaactt

SEQ ID NO: 4464947 - DNA, 20 bp, Homo sapiens
taaaaaagcttaaaactttg

SEQ ID NO: 4464948 - DNA, 18 bp, Homo sapiens
taaaaaagtctctattta

SEQ ID NO: 4464949 - DNA, 17 bp, Homo sapiens
taaaaaatcctgcccaa

SEQ ID NO: 4464950 - DNA, 14 bp, Homo sapiens
taaaaaatctgaag

SEQ ID NO: 4464951 - DNA, 14 bp, Homo sapiens
taaaaaatgtgaaa

SEQ ID NO: 4464952 - DNA, 20 bp, Homo sapiens
taaaaaatgtgtgtattctt

SEQ ID NO: 4464953 - DNA, 11 bp, Homo sapiens
taaaaaattaa

SEQ ID NO: 4464954 - DNA, 15 bp, Homo sapiens
taaaaaattatggaa

SEQ ID NO: 4464955 - DNA, 16 bp, Homo sapiens
taaaaaattatggaat

SEQ ID NO: 4464956 - DNA, 24 bp, Homo sapiens
taaaaaattatggaatatcatctg

SEQ ID NO: 4464957 - DNA, 22 bp, Homo sapiens
taaaaacaaaaacatcccaaga

SEQ ID NO: 4464958 - DNA, 23 bp, Homo sapiens
taaaaacaaaaacatcccaagat

SEQ ID NO: 4464959 - DNA, 17 bp, Homo sapiens
taaaaacaaatgagttt

SEQ ID NO: 4464960 - DNA, 17 bp, Homo sapiens
taaaaacaagtcatttt

SEQ ID NO: 4464961 - DNA, 21 bp, Homo sapiens
taaaaacacaccttaaaacat

SEQ ID NO: 4464962 - DNA, 21 bp, Homo sapiens
taaaaacattgcctttgaatg

SEQ ID NO: 4464963 - DNA, 12 bp, Homo sapiens
taaaaacatttt

SEQ ID NO: 4464964 - DNA, 15 bp, Homo sapiens
taaaaacattttgaa

SEQ ID NO: 4464965 - DNA, 15 bp, Homo sapiens
taaaaactttaaaga

SEQ ID NO: 4464966 - DNA, 15 bp, Homo sapiens
taaaaagaaaatatt

SEQ ID NO: 4464967 - DNA, 13 bp, Homo sapiens
taaaaagaaaggc

SEQ ID NO: 4464968 - DNA, 15 bp, Homo sapiens
taaaaagaagtgctg

SEQ ID NO: 4464969 - DNA, 20 bp, Homo sapiens
taaaaagacattttttaaaa

SEQ ID NO: 4464970 - DNA, 16 bp, Homo sapiens
taaaaagagtaatttc

SEQ ID NO: 4464971 - DNA, 22 bp, Homo sapiens
taaaaagagtaatttcatttaa

SEQ ID NO: 4464972 - DNA, 14 bp, Homo sapiens
taaaaagatcactt

SEQ ID NO: 4464973 - DNA, 20 bp, Homo sapiens
taaaaagcttccatgattct

SEQ ID NO: 4464974 - DNA, 18 bp, Homo sapiens
taaaaaggacatcagcaa

SEQ ID NO: 4464975 - DNA, 19 bp, Homo sapiens
taaaaaggacatcagcaaa

SEQ ID NO: 4464976 - DNA, 20 bp, Homo sapiens
taaaaaggagaatttttcct

SEQ ID NO: 4464977 - DNA, 14 bp, Homo sapiens
taaaaagtattttt

SEQ ID NO: 4464978 - DNA, 18 bp, Homo sapiens
taaaaagtattttttcaa

SEQ ID NO: 4464979 - DNA, 12 bp, Homo sapiens
taaaaagtgttt

SEQ ID NO: 4464980 - DNA, 15 bp, Homo sapiens
taaaaataagtcaac

SEQ ID NO: 4464981 - DNA, 19 bp, Homo sapiens
taaaaataagtcaacagta

SEQ ID NO: 4464982 - DNA, 17 bp, Homo sapiens
taaaaataccttctatg

SEQ ID NO: 4464983 - DNA, 20 bp, Homo sapiens
taaaaataccttctatgtat

SEQ ID NO: 4464984 - DNA, 12 bp, Homo sapiens
taaaaatataaa

SEQ ID NO: 4464985 - DNA, 15 bp, Homo sapiens
taaaaatataaattg

SEQ ID NO: 4464986 - DNA, 13 bp, Homo sapiens
taaaaatcaactt

SEQ ID NO: 4464987 - DNA, 19 bp, Homo sapiens
taaaaatgagatttcttat

SEQ ID NO: 4464988 - DNA, 15 bp, Homo sapiens
taaaaatggtttaaa

SEQ ID NO: 4464989 - DNA, 19 bp, Homo sapiens
taaaaatggtttaaatggt

SEQ ID NO: 4464990 - DNA, 22 bp, Homo sapiens
taaaaatgtcttgctgttgaca

SEQ ID NO: 4464991 - DNA, 12 bp, Homo sapiens
taaaaatgtggt

SEQ ID NO: 4464992 - DNA, 17 bp, Homo sapiens
taaaaatgttcttacac

SEQ ID NO: 4464993 - DNA, 16 bp, Homo sapiens
taaaaattatcaaaaa

SEQ ID NO: 4464994 - DNA, 19 bp, Homo sapiens
taaaaattatcaaaaagct

SEQ ID NO: 4464995 - DNA, 21 bp, Homo sapiens
taaaaattctagattaccatg

SEQ ID NO: 4464996 - DNA, 11 bp, Homo sapiens
taaaacaaaag

SEQ ID NO: 4464997 - DNA, 12 bp, Homo sapiens
taaaacaaaaga

SEQ ID NO: 4464998 - DNA, 13 bp, Homo sapiens
taaaacaaaagag

SEQ ID NO: 4464999 - DNA, 15 bp, Homo sapiens
taaaacaaataaata

SEQ ID NO: 4465000 - DNA, 16 bp, Homo sapiens
taaaacaaataaatat

SEQ ID NO: 4465001 - DNA, 22 bp, Homo sapiens
taaaacaacagctcgatccaaa

SEQ ID NO: 4465002 - DNA, 19 bp, Homo sapiens
taaaacacaacaagaaact

SEQ ID NO: 4465003 - DNA, 14 bp, Homo sapiens
taaaacacacaggt

SEQ ID NO: 4465004 - DNA, 13 bp, Homo sapiens
taaaacagacact

SEQ ID NO: 4465005 - DNA, 23 bp, Homo sapiens
taaaacaggcaaagttttacaga

SEQ ID NO: 4465006 - DNA, 13 bp, Homo sapiens
taaaacagtcatc

SEQ ID NO: 4465007 - DNA, 22 bp, Homo sapiens
taaaacatcactatcaatttta

SEQ ID NO: 4465008 - DNA, 18 bp, Homo sapiens
taaaacatgactcctaca

SEQ ID NO: 4465009 - DNA, 17 bp, Homo sapiens
taaaacatttgtttccc

SEQ ID NO: 4465010 - DNA, 19 bp, Homo sapiens
taaaacccatttaaatttt

SEQ ID NO: 4465011 - DNA, 15 bp, Homo sapiens
taaaactagcaactc

SEQ ID NO: 4465012 - DNA, 16 bp, Homo sapiens
taaaactagcaactct

SEQ ID NO: 4465013 - DNA, 15 bp, Homo sapiens
taaaactataacatt

SEQ ID NO: 4465014 - DNA, 13 bp, Homo sapiens
taaaactatttgt

SEQ ID NO: 4465015 - DNA, 17 bp, Homo sapiens
taaaactcactgtgatc

SEQ ID NO: 4465016 - DNA, 18 bp, Homo sapiens
taaaactcatcacataaa

SEQ ID NO: 4465017 - DNA, 20 bp, Homo sapiens
taaaactgaacttgaagcta

SEQ ID NO: 4465018 - DNA, 23 bp, Homo sapiens
taaaactgggattaagaaacctt

SEQ ID NO: 4465019 - DNA, 14 bp, Homo sapiens
taaaagaaactttc

SEQ ID NO: 4465020 - DNA, 17 bp, Homo sapiens
taaaagaaactttcttt

SEQ ID NO: 4465021 - DNA, 16 bp, Homo sapiens
taaaagaatattttaa

SEQ ID NO: 4465022 - DNA, 22 bp, Homo sapiens
taaaagagaccacccatatcat

SEQ ID NO: 4465023 - DNA, 16 bp, Homo sapiens
taaaagatcttgcaga

SEQ ID NO: 4465024 - DNA, 13 bp, Homo sapiens
taaaagatgaaag

SEQ ID NO: 4465025 - DNA, 16 bp, Homo sapiens
taaaagcaaaaaagaa

SEQ ID NO: 4465026 - DNA, 20 bp, Homo sapiens
taaaagcaaaaaagaaaacc

SEQ ID NO: 4465027 - DNA, 21 bp, Homo sapiens
taaaagcaaaataaaaactat

SEQ ID NO: 4465028 - DNA, 13 bp, Homo sapiens
taaaagcaaatca

SEQ ID NO: 4465029 - DNA, 19 bp, Homo sapiens
taaaagcaattatattgtc

SEQ ID NO: 4465030 - DNA, 18 bp, Homo sapiens
taaaagcaccactgttct

SEQ ID NO: 4465031 - DNA, 15 bp, Homo sapiens
taaaagctttcatgt

SEQ ID NO: 4465032 - DNA, 23 bp, Homo sapiens
taaaaggatagtatttttatcca

SEQ ID NO: 4465033 - DNA, 19 bp, Homo sapiens
taaaaggctaagaatagtg

SEQ ID NO: 4465034 - DNA, 13 bp, Homo sapiens
taaaaggcttcca

SEQ ID NO: 4465035 - DNA, 14 bp, Homo sapiens
taaaagtaaaatgt

SEQ ID NO: 4465036 - DNA, 18 bp, Homo sapiens
taaaagtaaaatgtcttt

SEQ ID NO: 4465037 - DNA, 17 bp, Homo sapiens
taaaagtcattattcct

SEQ ID NO: 4465038 - DNA, 18 bp, Homo sapiens
taaaagtgtgtaaatgct

SEQ ID NO: 4465039 - DNA, 21 bp, Homo sapiens
taaaagttcataacagtgcca

SEQ ID NO: 4465040 - DNA, 11 bp, Homo sapiens
taaaagttttg

SEQ ID NO: 4465041 - DNA, 19 bp, Homo sapiens
taaaagttttgaaggaaac

SEQ ID NO: 4465042 - DNA, 21 bp, Homo sapiens
taaaagttttgaaggaaacct

SEQ ID NO: 4465043 - DNA, 21 bp, Homo sapiens
taaaagttttttattatgcat

SEQ ID NO: 4465044 - DNA, 19 bp, Homo sapiens
taaaataaaatgaaaattg

SEQ ID NO: 4465045 - DNA, 17 bp, Homo sapiens
taaaataaaatgcctca

SEQ ID NO: 4465046 - DNA, 17 bp, Homo sapiens
taaaataatgtactgaa

SEQ ID NO: 4465047 - DNA, 19 bp, Homo sapiens
taaaataatgtactgaatt

SEQ ID NO: 4465048 - DNA, 19 bp, Homo sapiens
taaaataattatataactg

SEQ ID NO: 4465049 - DNA, 14 bp, Homo sapiens
taaaataattcata

SEQ ID NO: 4465050 - DNA, 17 bp, Homo sapiens
taaaataattcatatct

SEQ ID NO: 4465051 - DNA, 16 bp, Homo sapiens
taaaataattctgagt

SEQ ID NO: 4465052 - DNA, 12 bp, Homo sapiens
taaaatacttat

SEQ ID NO: 4465053 - DNA, 16 bp, Homo sapiens
taaaatagcaaaagaa

SEQ ID NO: 4465054 - DNA, 21 bp, Homo sapiens
taaaatagcaaaagaagaagt

SEQ ID NO: 4465055 - DNA, 13 bp, Homo sapiens
taaaatagcaata

SEQ ID NO: 4465056 - DNA, 16 bp, Homo sapiens
taaaatatatgaggct

SEQ ID NO: 4465057 - DNA, 23 bp, Homo sapiens
taaaatatcaatattttctgcaa

SEQ ID NO: 4465058 - DNA, 12 bp, Homo sapiens
taaaatatctat

SEQ ID NO: 4465059 - DNA, 18 bp, Homo sapiens
taaaatatctatttgaat

SEQ ID NO: 4465060 - DNA, 21 bp, Homo sapiens
taaaatatctatttgaataaa

SEQ ID NO: 4465061 - DNA, 22 bp, Homo sapiens
taaaatatctatttgaataaat

SEQ ID NO: 4465062 - DNA, 15 bp, Homo sapiens
taaaatatgtgaagt

SEQ ID NO: 4465063 - DNA, 17 bp, Homo sapiens
taaaatatgtgaagttt

SEQ ID NO: 4465064 - DNA, 19 bp, Homo sapiens
taaaatatgtgaagttttc

SEQ ID NO: 4465065 - DNA, 15 bp, Homo sapiens
taaaatattattgaa

SEQ ID NO: 4465066 - DNA, 16 bp, Homo sapiens
taaaatattattgaac

SEQ ID NO: 4465067 - DNA, 17 bp, Homo sapiens
taaaatattcgaaattc

SEQ ID NO: 4465068 - DNA, 14 bp, Homo sapiens
taaaatattttgaa

SEQ ID NO: 4465069 - DNA, 11 bp, Homo sapiens
taaaatcacta

SEQ ID NO: 4465070 - DNA, 17 bp, Homo sapiens
taaaatcactaacatta

SEQ ID NO: 4465071 - DNA, 18 bp, Homo sapiens
taaaatcactaacattat

SEQ ID NO: 4465072 - DNA, 13 bp, Homo sapiens
taaaatcatttct

SEQ ID NO: 4465073 - DNA, 22 bp, Homo sapiens
taaaatctataacataaagaat

SEQ ID NO: 4465074 - DNA, 13 bp, Homo sapiens
taaaatctgtcac

SEQ ID NO: 4465075 - DNA, 14 bp, Homo sapiens
taaaatctgtcacg

SEQ ID NO: 4465076 - DNA, 15 bp, Homo sapiens
taaaatgaaatgcta

SEQ ID NO: 4465077 - DNA, 18 bp, Homo sapiens
taaaatgcaatatttgta

SEQ ID NO: 4465078 - DNA, 17 bp, Homo sapiens
taaaatgctcaatttca

SEQ ID NO: 4465079 - DNA, 21 bp, Homo sapiens
taaaatgcttcactgtacgta

SEQ ID NO: 4465080 - DNA, 13 bp, Homo sapiens
taaaatgctttaa

SEQ ID NO: 4465081 - DNA, 22 bp, Homo sapiens
taaaatggatgccttgaataat

SEQ ID NO: 4465082 - DNA, 17 bp, Homo sapiens
taaaatggcgaacatgt

SEQ ID NO: 4465083 - DNA, 22 bp, Homo sapiens
taaaatgtatctaagaataata

SEQ ID NO: 4465084 - DNA, 16 bp, Homo sapiens
taaaatgtatctgcat

SEQ ID NO: 4465085 - DNA, 21 bp, Homo sapiens
taaaatgtcagtgtttgggaa

SEQ ID NO: 4465086 - DNA, 15 bp, Homo sapiens
taaaatgtctttcca

SEQ ID NO: 4465087 - DNA, 16 bp, Homo sapiens
taaaatgtgaaaaact

SEQ ID NO: 4465088 - DNA, 19 bp, Homo sapiens
taaaatgtgaggcaataag

SEQ ID NO: 4465089 - DNA, 14 bp, Homo sapiens
taaaatgtttctct

SEQ ID NO: 4465090 - DNA, 13 bp, Homo sapiens
taaaattaaattt

SEQ ID NO: 4465091 - DNA, 14 bp, Homo sapiens
taaaattatactgt

SEQ ID NO: 4465092 - DNA, 15 bp, Homo sapiens
taaaattatactgtg

SEQ ID NO: 4465093 - DNA, 22 bp, Homo sapiens
taaaattcagtttttttccagt

SEQ ID NO: 4465094 - DNA, 19 bp, Homo sapiens
taaaattctgtaatttgaa

SEQ ID NO: 4465095 - DNA, 23 bp, Homo sapiens
taaaattgaatagtttatttctg

SEQ ID NO: 4465096 - DNA, 12 bp, Homo sapiens
taaaattgatat

SEQ ID NO: 4465097 - DNA, 20 bp, Homo sapiens
taaaattgcagtttcatgta

SEQ ID NO: 4465098 - DNA, 22 bp, Homo sapiens
taaaatttattctacttttaaa

SEQ ID NO: 4465099 - DNA, 23 bp, Homo sapiens
taaaatttattctacttttaaat

SEQ ID NO: 4465100 - DNA, 15 bp, Homo sapiens
taaaatttcataatt

SEQ ID NO: 4465101 - DNA, 22 bp, Homo sapiens
taaaatttcataattctgaaac

SEQ ID NO: 4465102 - DNA, 14 bp, Homo sapiens
taaaatttgtagaa

SEQ ID NO: 4465103 - DNA, 20 bp, Homo sapiens
taaaatttgtgtaaatttgt

SEQ ID NO: 4465104 - DNA, 13 bp, Homo sapiens
taaaatttgttct

SEQ ID NO: 4465105 - DNA, 20 bp, Homo sapiens
taaaatttgttcttgtattt

SEQ ID NO: 4465106 - DNA, 16 bp, Homo sapiens
taaaattttagatgta

SEQ ID NO: 4465107 - DNA, 13 bp, Homo sapiens
taaacaagtattt

SEQ ID NO: 4465108 - DNA, 23 bp, Homo sapiens
taaacaagtatttgttaatttag

SEQ ID NO: 4465109 - DNA, 22 bp, Homo sapiens
taaacaatgatgccctgctcca

SEQ ID NO: 4465110 - DNA, 17 bp, Homo sapiens
taaacacaggctgtcct

SEQ ID NO: 4465111 - DNA, 13 bp, Homo sapiens
taaacacatagat

SEQ ID NO: 4465112 - DNA, 19 bp, Homo sapiens
taaacagaaaactcccaat

SEQ ID NO: 4465113 - DNA, 14 bp, Homo sapiens
taaacagaactcca

SEQ ID NO: 4465114 - DNA, 17 bp, Homo sapiens
taaacagacaaaaacaa

SEQ ID NO: 4465115 - DNA, 21 bp, Homo sapiens
taaacagacaggaatttagaa

SEQ ID NO: 4465116 - DNA, 20 bp, Homo sapiens
taaacagcaccaccatttaa

SEQ ID NO: 4465117 - DNA, 22 bp, Homo sapiens
taaacagtgaacttgtctggct

SEQ ID NO: 4465118 - DNA, 20 bp, Homo sapiens
taaacatatttttatacttt

SEQ ID NO: 4465119 - DNA, 23 bp, Homo sapiens
taaacattcctccagcctcccct

SEQ ID NO: 4465120 - DNA, 11 bp, Homo sapiens
taaacattttc

SEQ ID NO: 4465121 - DNA, 14 bp, Homo sapiens
taaacattttcata

SEQ ID NO: 4465122 - DNA, 17 bp, Homo sapiens
taaaccaactctaatat

SEQ ID NO: 4465123 - DNA, 22 bp, Homo sapiens
taaaccaagattatgtgacttg

SEQ ID NO: 4465124 - DNA, 19 bp, Homo sapiens
taaaccaaggctagaacca

SEQ ID NO: 4465125 - DNA, 13 bp, Homo sapiens
taaaccactgaaa

SEQ ID NO: 4465126 - DNA, 20 bp, Homo sapiens
taaaccactgaaaaaatata

SEQ ID NO: 4465127 - DNA, 14 bp, Homo sapiens
taaaccactgtgcg

SEQ ID NO: 4465128 - DNA, 21 bp, Homo sapiens
taaaccagaacccagtgtttc

SEQ ID NO: 4465129 - DNA, 22 bp, Homo sapiens
taaaccatggccaattcagttt

SEQ ID NO: 4465130 - DNA, 14 bp, Homo sapiens
taaacccatacaat

SEQ ID NO: 4465131 - DNA, 15 bp, Homo sapiens
taaacccatacaatg

SEQ ID NO: 4465132 - DNA, 19 bp, Homo sapiens
taaacccatacaatgtatg

SEQ ID NO: 4465133 - DNA, 18 bp, Homo sapiens
taaaccctatctgtgatt

SEQ ID NO: 4465134 - DNA, 14 bp, Homo sapiens
taaacctgttcttc

SEQ ID NO: 4465135 - DNA, 15 bp, Homo sapiens
taaacggcccaggcc

SEQ ID NO: 4465136 - DNA, 20 bp, Homo sapiens
taaacggcccaggccaggtg

SEQ ID NO: 4465137 - DNA, 16 bp, Homo sapiens
taaacggtttttatta

SEQ ID NO: 4465138 - DNA, 13 bp, Homo sapiens
taaactaaagtat

SEQ ID NO: 4465139 - DNA, 23 bp, Homo sapiens
taaactaaagtatggtacatcta

SEQ ID NO: 4465140 - DNA, 14 bp, Homo sapiens
taaactactctttg

SEQ ID NO: 4465141 - DNA, 16 bp, Homo sapiens
taaactactctttgat

SEQ ID NO: 4465142 - DNA, 18 bp, Homo sapiens
taaactagtttttcctat

SEQ ID NO: 4465143 - DNA, 15 bp, Homo sapiens
taaactataagcaag

SEQ ID NO: 4465144 - DNA, 17 bp, Homo sapiens
taaactataagcaagaa

SEQ ID NO: 4465145 - DNA, 13 bp, Homo sapiens
taaactatttata

SEQ ID NO: 4465146 - DNA, 23 bp, Homo sapiens
taaactatttatatcacacaata

SEQ ID NO: 4465147 - DNA, 18 bp, Homo sapiens
taaactatttttttctta

SEQ ID NO: 4465148 - DNA, 14 bp, Homo sapiens
taaactctctagct

SEQ ID NO: 4465149 - DNA, 15 bp, Homo sapiens
taaactctcttctct

SEQ ID NO: 4465150 - DNA, 13 bp, Homo sapiens
taaactctgcatc

SEQ ID NO: 4465151 - DNA, 19 bp, Homo sapiens
taaactgtactagtctgtg

SEQ ID NO: 4465152 - DNA, 20 bp, Homo sapiens
taaactgtactagtctgtgt

SEQ ID NO: 4465153 - DNA, 13 bp, Homo sapiens
taaactgtatttt

SEQ ID NO: 4465154 - DNA, 12 bp, Homo sapiens
taaactgtgttt

SEQ ID NO: 4465155 - DNA, 13 bp, Homo sapiens
taaactgtgttta

SEQ ID NO: 4465156 - DNA, 20 bp, Homo sapiens
taaactgttgggaaagctct

SEQ ID NO: 4465157 - DNA, 16 bp, Homo sapiens
taaacttataacccac

SEQ ID NO: 4465158 - DNA, 17 bp, Homo sapiens
taaacttccaaagaaag

SEQ ID NO: 4465159 - DNA, 21 bp, Homo sapiens
taaacttccaaagaaagttct

SEQ ID NO: 4465160 - DNA, 18 bp, Homo sapiens
taaacttccccatcttct

SEQ ID NO: 4465161 - DNA, 17 bp, Homo sapiens
taaacttgaaatatata

SEQ ID NO: 4465162 - DNA, 22 bp, Homo sapiens
taaacttggtgcttattgatat

SEQ ID NO: 4465163 - DNA, 12 bp, Homo sapiens
taaactttcaat

SEQ ID NO: 4465164 - DNA, 13 bp, Homo sapiens
taaactttctcca

SEQ ID NO: 4465165 - DNA, 12 bp, Homo sapiens
taaactttctct

SEQ ID NO: 4465166 - DNA, 15 bp, Homo sapiens
taaactttggccttt

SEQ ID NO: 4465167 - DNA, 16 bp, Homo sapiens
taaactttttaaaata

SEQ ID NO: 4465168 - DNA, 18 bp, Homo sapiens
taaactttttttctgtac

SEQ ID NO: 4465169 - DNA, 20 bp, Homo sapiens
taaagaaaaatatcttggcc

SEQ ID NO: 4465170 - DNA, 21 bp, Homo sapiens
taaagaaaagtttaccatctg

SEQ ID NO: 4465171 - DNA, 18 bp, Homo sapiens
taaagaaagaatgcattc

SEQ ID NO: 4465172 - DNA, 13 bp, Homo sapiens
taaagaaaggaaa

SEQ ID NO: 4465173 - DNA, 22 bp, Homo sapiens
taaagaaaggaaaagaaaacaa

SEQ ID NO: 4465174 - DNA, 23 bp, Homo sapiens
taaagaaaggaaaagaaaacaaa

SEQ ID NO: 4465175 - DNA, 13 bp, Homo sapiens
taaagaaagtgta

SEQ ID NO: 4465176 - DNA, 16 bp, Homo sapiens
taaagaaagtgtattt

SEQ ID NO: 4465177 - DNA, 14 bp, Homo sapiens
taaagaaattcaag

SEQ ID NO: 4465178 - DNA, 22 bp, Homo sapiens
taaagaaattcaagaagtattt

SEQ ID NO: 4465179 - DNA, 17 bp, Homo sapiens
taaagaagataaacaca

SEQ ID NO: 4465180 - DNA, 20 bp, Homo sapiens
taaagaagataaacacaaaa

SEQ ID NO: 4465181 - DNA, 17 bp, Homo sapiens
taaagaatacttgaact

SEQ ID NO: 4465182 - DNA, 20 bp, Homo sapiens
taaagaatacttgaacttgt

SEQ ID NO: 4465183 - DNA, 14 bp, Homo sapiens
taaagaatatatat

SEQ ID NO: 4465184 - DNA, 20 bp, Homo sapiens
taaagaatgccatttctcac

SEQ ID NO: 4465185 - DNA, 18 bp, Homo sapiens
taaagaattaatgactta

SEQ ID NO: 4465186 - DNA, 15 bp, Homo sapiens
taaagaattttcatc

SEQ ID NO: 4465187 - DNA, 19 bp, Homo sapiens
taaagaattttcatcccgt

SEQ ID NO: 4465188 - DNA, 21 bp, Homo sapiens
taaagacaaccatatttagca

SEQ ID NO: 4465189 - DNA, 21 bp, Homo sapiens
taaagacccagggggagaatg

SEQ ID NO: 4465190 - DNA, 17 bp, Homo sapiens
taaagactacaataaaa

SEQ ID NO: 4465191 - DNA, 15 bp, Homo sapiens
taaagactggctttt

SEQ ID NO: 4465192 - DNA, 20 bp, Homo sapiens
taaagactggcttttattaa

SEQ ID NO: 4465193 - DNA, 21 bp, Homo sapiens
taaagactgtggaaatgccaa

SEQ ID NO: 4465194 - DNA, 20 bp, Homo sapiens
taaagacttttatgtgagat

SEQ ID NO: 4465195 - DNA, 11 bp, Homo sapiens
taaagagaaac

SEQ ID NO: 4465196 - DNA, 14 bp, Homo sapiens
taaagagaaacttt

SEQ ID NO: 4465197 - DNA, 19 bp, Homo sapiens
taaagagaaactttgtgct

SEQ ID NO: 4465198 - DNA, 16 bp, Homo sapiens
taaagagatagcttct

SEQ ID NO: 4465199 - DNA, 16 bp, Homo sapiens
taaagagcccttgcct

SEQ ID NO: 4465200 - DNA, 20 bp, Homo sapiens
taaagaggaaaagtgcaatg

SEQ ID NO: 4465201 - DNA, 22 bp, Homo sapiens
taaagagtgtgttataaaataa

SEQ ID NO: 4465202 - DNA, 12 bp, Homo sapiens
taaagagttatt

SEQ ID NO: 4465203 - DNA, 15 bp, Homo sapiens
taaagagttattcaa

SEQ ID NO: 4465204 - DNA, 21 bp, Homo sapiens
taaagataacccttattccat

SEQ ID NO: 4465205 - DNA, 23 bp, Homo sapiens
taaagatacagaactctttcaaa

SEQ ID NO: 4465206 - DNA, 13 bp, Homo sapiens
taaagatacatga

SEQ ID NO: 4465207 - DNA, 20 bp, Homo sapiens
taaagatatggagaattgct

SEQ ID NO: 4465208 - DNA, 13 bp, Homo sapiens
taaagatcacaca

SEQ ID NO: 4465209 - DNA, 14 bp, Homo sapiens
taaagatcacacat

SEQ ID NO: 4465210 - DNA, 23 bp, Homo sapiens
taaagatcacacatcaagactat

SEQ ID NO: 4465211 - DNA, 13 bp, Homo sapiens
taaagatcacaga

SEQ ID NO: 4465212 - DNA, 21 bp, Homo sapiens
taaagatgcaaggaccaggac

SEQ ID NO: 4465213 - DNA, 22 bp, Homo sapiens
taaagatgcaaggaccaggact

SEQ ID NO: 4465214 - DNA, 15 bp, Homo sapiens
taaagattagggaaa

SEQ ID NO: 4465215 - DNA, 23 bp, Homo sapiens
taaagatttatacagttgaaaac

SEQ ID NO: 4465216 - DNA, 13 bp, Homo sapiens
taaagatttgggt

SEQ ID NO: 4465217 - DNA, 12 bp, Homo sapiens
taaagatttttt

SEQ ID NO: 4465218 - DNA, 15 bp, Homo sapiens
taaagcgtttgcaca

SEQ ID NO: 4465219 - DNA, 15 bp, Homo sapiens
taaagctcaaatgaa

SEQ ID NO: 4465220 - DNA, 20 bp, Homo sapiens
taaagctcaaatgaaatgta

SEQ ID NO: 4465221 - DNA, 17 bp, Homo sapiens
taaagctgttcttgaaa

SEQ ID NO: 4465222 - DNA, 22 bp, Homo sapiens
taaagcttgatttgatctttgt

SEQ ID NO: 4465223 - DNA, 12 bp, Homo sapiens
taaagctttatc

SEQ ID NO: 4465224 - DNA, 15 bp, Homo sapiens
taaagctttatcttt

SEQ ID NO: 4465225 - DNA, 16 bp, Homo sapiens
taaagctttatctttg

SEQ ID NO: 4465226 - DNA, 21 bp, Homo sapiens
taaagctttatctttgtgtaa

SEQ ID NO: 4465227 - DNA, 16 bp, Homo sapiens
taaaggaaaacaaaaa

SEQ ID NO: 4465228 - DNA, 12 bp, Homo sapiens
taaaggactgta

SEQ ID NO: 4465229 - DNA, 17 bp, Homo sapiens
taaaggcagctgcctct

SEQ ID NO: 4465230 - DNA, 17 bp, Homo sapiens
taaaggcagttttctaa

SEQ ID NO: 4465231 - DNA, 19 bp, Homo sapiens
taaagggcccaatgaatta

SEQ ID NO: 4465232 - DNA, 20 bp, Homo sapiens
taaagggcccaatgaattat

SEQ ID NO: 4465233 - DNA, 14 bp, Homo sapiens
taaaggtctgcact

SEQ ID NO: 4465234 - DNA, 21 bp, Homo sapiens
taaaggtgacatcggaaaaat

SEQ ID NO: 4465235 - DNA, 17 bp, Homo sapiens
taaaggtgtcttcctcc

SEQ ID NO: 4465236 - DNA, 13 bp, Homo sapiens
taaagtaaattat

SEQ ID NO: 4465237 - DNA, 13 bp, Homo sapiens
taaagtataatgt

SEQ ID NO: 4465238 - DNA, 15 bp, Homo sapiens
taaagtataatgttt

SEQ ID NO: 4465239 - DNA, 19 bp, Homo sapiens
taaagtatagagagaagtt

SEQ ID NO: 4465240 - DNA, 21 bp, Homo sapiens
taaagtatgcattattaaatt

SEQ ID NO: 4465241 - DNA, 19 bp, Homo sapiens
taaagtatgtattatttac

SEQ ID NO: 4465242 - DNA, 21 bp, Homo sapiens
taaagtatgtattatttacat

SEQ ID NO: 4465243 - DNA, 15 bp, Homo sapiens
taaagtattccacct

SEQ ID NO: 4465244 - DNA, 20 bp, Homo sapiens
taaagtattccaccttaaat

SEQ ID NO: 4465245 - DNA, 18 bp, Homo sapiens
taaagtattcttctcttc

SEQ ID NO: 4465246 - DNA, 23 bp, Homo sapiens
taaagtatttgatgtacattaca

SEQ ID NO: 4465247 - DNA, 19 bp, Homo sapiens
taaagtattttaattttaa

SEQ ID NO: 4465248 - DNA, 21 bp, Homo sapiens
taaagtcacatccctgtaaat

SEQ ID NO: 4465249 - DNA, 13 bp, Homo sapiens
taaagtgtgtgat

SEQ ID NO: 4465250 - DNA, 13 bp, Homo sapiens
taaagtgttttca

SEQ ID NO: 4465251 - DNA, 15 bp, Homo sapiens
taaagtgttttcaga

SEQ ID NO: 4465252 - DNA, 16 bp, Homo sapiens
taaagtgttttcagag

SEQ ID NO: 4465253 - DNA, 13 bp, Homo sapiens
taaagttaaagtc

SEQ ID NO: 4465254 - DNA, 20 bp, Homo sapiens
taaagttagtatcttttgat

SEQ ID NO: 4465255 - DNA, 14 bp, Homo sapiens
taaagttctgtgta

SEQ ID NO: 4465256 - DNA, 20 bp, Homo sapiens
taaagttcttattttagtat

SEQ ID NO: 4465257 - DNA, 21 bp, Homo sapiens
taaagttcttattttagtata

SEQ ID NO: 4465258 - DNA, 16 bp, Homo sapiens
taaagttggttggata

SEQ ID NO: 4465259 - DNA, 22 bp, Homo sapiens
taaagttgttcgccgcgtggaa

SEQ ID NO: 4465260 - DNA, 12 bp, Homo sapiens
taaagtttatta

SEQ ID NO: 4465261 - DNA, 14 bp, Homo sapiens
taaagtttccatta

SEQ ID NO: 4465262 - DNA, 19 bp, Homo sapiens
taaagtttttaaagtgtgt

SEQ ID NO: 4465263 - DNA, 14 bp, Homo sapiens
taaataaaaatgga

SEQ ID NO: 4465264 - DNA, 15 bp, Homo sapiens
taaataaaaatgtct

SEQ ID NO: 4465265 - DNA, 18 bp, Homo sapiens
taaataaaaatttataag

SEQ ID NO: 4465266 - DNA, 13 bp, Homo sapiens
taaataaaagcac

SEQ ID NO: 4465267 - DNA, 12 bp, Homo sapiens
taaataaaattg

SEQ ID NO: 4465268 - DNA, 23 bp, Homo sapiens
taaataaacacatagattcacct

SEQ ID NO: 4465269 - DNA, 12 bp, Homo sapiens
taaataaactat

SEQ ID NO: 4465270 - DNA, 16 bp, Homo sapiens
taaataaactatttat

SEQ ID NO: 4465271 - DNA, 12 bp, Homo sapiens
taaataaatttc

SEQ ID NO: 4465272 - DNA, 14 bp, Homo sapiens
taaataaatttgac

SEQ ID NO: 4465273 - DNA, 17 bp, Homo sapiens
taaataacacagatatt

SEQ ID NO: 4465274 - DNA, 18 bp, Homo sapiens
taaataaccccattcttt

SEQ ID NO: 4465275 - DNA, 11 bp, Homo sapiens
taaataagaaa

SEQ ID NO: 4465276 - DNA, 13 bp, Homo sapiens
taaataagaaact

SEQ ID NO: 4465277 - DNA, 16 bp, Homo sapiens
taaataagaaactttt

SEQ ID NO: 4465278 - DNA, 18 bp, Homo sapiens
taaatacaggaaacagtt

SEQ ID NO: 4465279 - DNA, 17 bp, Homo sapiens
taaatacagtcttccat

SEQ ID NO: 4465280 - DNA, 13 bp, Homo sapiens
taaatactgtgaa

SEQ ID NO: 4465281 - DNA, 17 bp, Homo sapiens
taaatactgtgaaatac

SEQ ID NO: 4465282 - DNA, 21 bp, Homo sapiens
taaatagaaagagttctatgg

SEQ ID NO: 4465283 - DNA, 13 bp, Homo sapiens
taaataggaaagt

SEQ ID NO: 4465284 - DNA, 22 bp, Homo sapiens
taaataggttcttcttgttctg

SEQ ID NO: 4465285 - DNA, 12 bp, Homo sapiens
taaatagtattt

SEQ ID NO: 4465286 - DNA, 13 bp, Homo sapiens
taaatataacact

SEQ ID NO: 4465287 - DNA, 17 bp, Homo sapiens
taaatataccactcttt

SEQ ID NO: 4465288 - DNA, 15 bp, Homo sapiens
taaatatatataaag

SEQ ID NO: 4465289 - DNA, 23 bp, Homo sapiens
taaatatatatggtcatatacat

SEQ ID NO: 4465290 - DNA, 21 bp, Homo sapiens
taaatatatattttgtacttt

SEQ ID NO: 4465291 - DNA, 19 bp, Homo sapiens
taaatatatgtatgtaaaa

SEQ ID NO: 4465292 - DNA, 15 bp, Homo sapiens
taaatatattttctt

SEQ ID NO: 4465293 - DNA, 21 bp, Homo sapiens
taaatatctgaacatttacta

SEQ ID NO: 4465294 - DNA, 17 bp, Homo sapiens
taaatatcttctgattt

SEQ ID NO: 4465295 - DNA, 18 bp, Homo sapiens
taaatatcttctgatttg

SEQ ID NO: 4465296 - DNA, 23 bp, Homo sapiens
taaatatgaaccctttgtttctt

SEQ ID NO: 4465297 - DNA, 13 bp, Homo sapiens
taaatatgacagt

SEQ ID NO: 4465298 - DNA, 17 bp, Homo sapiens
taaatattagtgcagtt

SEQ ID NO: 4465299 - DNA, 15 bp, Homo sapiens
taaatattgctaaaa

SEQ ID NO: 4465300 - DNA, 18 bp, Homo sapiens
taaatattttaaagaatt

SEQ ID NO: 4465301 - DNA, 12 bp, Homo sapiens
taaatcaaggaa

SEQ ID NO: 4465302 - DNA, 13 bp, Homo sapiens
taaatcaataaag

SEQ ID NO: 4465303 - DNA, 16 bp, Homo sapiens
taaatcacagaaaatt

SEQ ID NO: 4465304 - DNA, 16 bp, Homo sapiens
taaatcacgctttttg

SEQ ID NO: 4465305 - DNA, 19 bp, Homo sapiens
taaatcacgctttttgaaa

SEQ ID NO: 4465306 - DNA, 12 bp, Homo sapiens
taaatcagacca

SEQ ID NO: 4465307 - DNA, 21 bp, Homo sapiens
taaatcatttggttaaatcat

SEQ ID NO: 4465308 - DNA, 12 bp, Homo sapiens
taaatcctgtgt

SEQ ID NO: 4465309 - DNA, 16 bp, Homo sapiens
taaatctagacattct

SEQ ID NO: 4465310 - DNA, 15 bp, Homo sapiens
taaatctcttctttg

SEQ ID NO: 4465311 - DNA, 13 bp, Homo sapiens
taaatctgattaa

SEQ ID NO: 4465312 - DNA, 20 bp, Homo sapiens
taaatctgctggagtttcat

SEQ ID NO: 4465313 - DNA, 14 bp, Homo sapiens
taaatctgtgatga

SEQ ID NO: 4465314 - DNA, 13 bp, Homo sapiens
taaatctttcaaa

SEQ ID NO: 4465315 - DNA, 23 bp, Homo sapiens
taaatcttttataggatttattt

SEQ ID NO: 4465316 - DNA, 21 bp, Homo sapiens
taaatctttttgcttctactt

SEQ ID NO: 4465317 - DNA, 14 bp, Homo sapiens
taaatgaatatttt

SEQ ID NO: 4465318 - DNA, 17 bp, Homo sapiens
taaatgacagtaatatt

SEQ ID NO: 4465319 - DNA, 14 bp, Homo sapiens
taaatgactgaagt

SEQ ID NO: 4465320 - DNA, 20 bp, Homo sapiens
taaatgagggtttctgatct

SEQ ID NO: 4465321 - DNA, 20 bp, Homo sapiens
taaatgatttaaatttaagt

SEQ ID NO: 4465322 - DNA, 17 bp, Homo sapiens
taaatgatttcattcaa

SEQ ID NO: 4465323 - DNA, 14 bp, Homo sapiens
taaatgcaataaga

SEQ ID NO: 4465324 - DNA, 15 bp, Homo sapiens
taaatgcaataagat

SEQ ID NO: 4465325 - DNA, 22 bp, Homo sapiens
taaatgcagacaacaccttcct

SEQ ID NO: 4465326 - DNA, 15 bp, Homo sapiens
taaatgcctcttaaa

SEQ ID NO: 4465327 - DNA, 21 bp, Homo sapiens
taaatgcctcttaaattatat

SEQ ID NO: 4465328 - DNA, 19 bp, Homo sapiens
taaatgcttaaatttcaga

SEQ ID NO: 4465329 - DNA, 20 bp, Homo sapiens
taaatgcttaaatttcagaa

SEQ ID NO: 4465330 - DNA, 22 bp, Homo sapiens
taaatgcttaaatttcagaatt

SEQ ID NO: 4465331 - DNA, 17 bp, Homo sapiens
taaatgctttatgcaaa

SEQ ID NO: 4465332 - DNA, 20 bp, Homo sapiens
taaatggtttggtgcttttt

SEQ ID NO: 4465333 - DNA, 13 bp, Homo sapiens
taaatgtaaaaat

SEQ ID NO: 4465334 - DNA, 21 bp, Homo sapiens
taaatgtaaaaatgaaggaat

SEQ ID NO: 4465335 - DNA, 16 bp, Homo sapiens
taaatgtaaagatatt

SEQ ID NO: 4465336 - DNA, 17 bp, Homo sapiens
taaatgtaaagatattt

SEQ ID NO: 4465337 - DNA, 23 bp, Homo sapiens
taaatgtagcttcagtcattaaa

SEQ ID NO: 4465338 - DNA, 12 bp, Homo sapiens
taaatgtatact

SEQ ID NO: 4465339 - DNA, 13 bp, Homo sapiens
taaatgtatttta

SEQ ID NO: 4465340 - DNA, 16 bp, Homo sapiens
taaatgtgccttcatt

SEQ ID NO: 4465341 - DNA, 17 bp, Homo sapiens
taaatgtggattttgta

SEQ ID NO: 4465342 - DNA, 11 bp, Homo sapiens
taaatgtgtgt

SEQ ID NO: 4465343 - DNA, 13 bp, Homo sapiens
taaatgtgtgtat

SEQ ID NO: 4465344 - DNA, 16 bp, Homo sapiens
taaatgttacttctga

SEQ ID NO: 4465345 - DNA, 20 bp, Homo sapiens
taaatgttatgactatgtaa

SEQ ID NO: 4465346 - DNA, 22 bp, Homo sapiens
taaatgttatgactatgtaaac

SEQ ID NO: 4465347 - DNA, 13 bp, Homo sapiens
taaatgttattat

SEQ ID NO: 4465348 - DNA, 12 bp, Homo sapiens
taaatgttcaaa

SEQ ID NO: 4465349 - DNA, 14 bp, Homo sapiens
taaatgttttagtg

SEQ ID NO: 4465350 - DNA, 15 bp, Homo sapiens
taaattaaacaattt

SEQ ID NO: 4465351 - DNA, 22 bp, Homo sapiens
taaattaaacaatttattttat

SEQ ID NO: 4465352 - DNA, 13 bp, Homo sapiens
taaattaaatata

SEQ ID NO: 4465353 - DNA, 19 bp, Homo sapiens
taaattaagatcctaaact

SEQ ID NO: 4465354 - DNA, 17 bp, Homo sapiens
taaattaatatctttct

SEQ ID NO: 4465355 - DNA, 14 bp, Homo sapiens
taaattacaatttt

SEQ ID NO: 4465356 - DNA, 13 bp, Homo sapiens
taaattacagctt

SEQ ID NO: 4465357 - DNA, 18 bp, Homo sapiens
taaattacagcttttatg

SEQ ID NO: 4465358 - DNA, 13 bp, Homo sapiens
taaattagaaaat

SEQ ID NO: 4465359 - DNA, 21 bp, Homo sapiens
taaattaggaataaataaaaa

SEQ ID NO: 4465360 - DNA, 20 bp, Homo sapiens
taaattataaggactgcatg

SEQ ID NO: 4465361 - DNA, 14 bp, Homo sapiens
taaattatatattt

SEQ ID NO: 4465362 - DNA, 17 bp, Homo sapiens
taaattatggcatttct

SEQ ID NO: 4465363 - DNA, 19 bp, Homo sapiens
taaattatggcatttctat

SEQ ID NO: 4465364 - DNA, 14 bp, Homo sapiens
taaattattaagca

SEQ ID NO: 4465365 - DNA, 23 bp, Homo sapiens
taaattattaagcagactggaaa

SEQ ID NO: 4465366 - DNA, 17 bp, Homo sapiens
taaattattatcttctt

SEQ ID NO: 4465367 - DNA, 22 bp, Homo sapiens
taaattattatcttcttaacag

SEQ ID NO: 4465368 - DNA, 11 bp, Homo sapiens
taaattatttt

SEQ ID NO: 4465369 - DNA, 13 bp, Homo sapiens
taaattattttat

SEQ ID NO: 4465370 - DNA, 15 bp, Homo sapiens
taaattattttcaaa

SEQ ID NO: 4465371 - DNA, 19 bp, Homo sapiens
taaattcaataaaaacctt

SEQ ID NO: 4465372 - DNA, 18 bp, Homo sapiens
taaattcacaaactttta

SEQ ID NO: 4465373 - DNA, 16 bp, Homo sapiens
taaattcactttcatt

SEQ ID NO: 4465374 - DNA, 21 bp, Homo sapiens
taaattcatttctagactcaa

SEQ ID NO: 4465375 - DNA, 18 bp, Homo sapiens
taaattcccaacttctct

SEQ ID NO: 4465376 - DNA, 19 bp, Homo sapiens
taaattcccgttttgtcac

SEQ ID NO: 4465377 - DNA, 19 bp, Homo sapiens
taaattcctcaacagtgtt

SEQ ID NO: 4465378 - DNA, 22 bp, Homo sapiens
taaattcctcaacagtgttttc

SEQ ID NO: 4465379 - DNA, 22 bp, Homo sapiens
taaattcttaaaactttctaaa

SEQ ID NO: 4465380 - DNA, 15 bp, Homo sapiens
taaattcttttttaa

SEQ ID NO: 4465381 - DNA, 22 bp, Homo sapiens
taaattgatttttataaatact

SEQ ID NO: 4465382 - DNA, 13 bp, Homo sapiens
taaattgcaagaa

SEQ ID NO: 4465383 - DNA, 21 bp, Homo sapiens
taaattgcaccagaaatgttt

SEQ ID NO: 4465384 - DNA, 17 bp, Homo sapiens
taaattgctaatgttgc

SEQ ID NO: 4465385 - DNA, 22 bp, Homo sapiens
taaattgctttctatatcttct

SEQ ID NO: 4465386 - DNA, 16 bp, Homo sapiens
taaattggtcatggta

SEQ ID NO: 4465387 - DNA, 13 bp, Homo sapiens
taaattgtacatt

SEQ ID NO: 4465388 - DNA, 19 bp, Homo sapiens
taaattgtacattttgtaa

SEQ ID NO: 4465389 - DNA, 22 bp, Homo sapiens
taaattgtacattttgtaaaat

SEQ ID NO: 4465390 - DNA, 16 bp, Homo sapiens
taaattgtctttaaaa

SEQ ID NO: 4465391 - DNA, 22 bp, Homo sapiens
taaattgtctttaaaaactgtt

SEQ ID NO: 4465392 - DNA, 23 bp, Homo sapiens
taaatttaagtaagttttataag

SEQ ID NO: 4465393 - DNA, 20 bp, Homo sapiens
taaatttcccagttaaagat

SEQ ID NO: 4465394 - DNA, 22 bp, Homo sapiens
taaatttcccagttaaagatta

SEQ ID NO: 4465395 - DNA, 13 bp, Homo sapiens
taaatttctgtct

SEQ ID NO: 4465396 - DNA, 14 bp, Homo sapiens
taaatttcttttat

SEQ ID NO: 4465397 - DNA, 16 bp, Homo sapiens
taaatttcttttatta

SEQ ID NO: 4465398 - DNA, 17 bp, Homo sapiens
taaatttcttttattaa

SEQ ID NO: 4465399 - DNA, 20 bp, Homo sapiens
taaatttcttttattaatac

SEQ ID NO: 4465400 - DNA, 12 bp, Homo sapiens
taaattttaaag

SEQ ID NO: 4465401 - DNA, 17 bp, Homo sapiens
taaattttaattcaaga

SEQ ID NO: 4465402 - DNA, 18 bp, Homo sapiens
taaattttaattcaagaa

SEQ ID NO: 4465403 - DNA, 22 bp, Homo sapiens
taaattttatgtcatagaaata

SEQ ID NO: 4465404 - DNA, 14 bp, Homo sapiens
taaattttcttcag

SEQ ID NO: 4465405 - DNA, 16 bp, Homo sapiens
taaattttcttcagtt

SEQ ID NO: 4465406 - DNA, 18 bp, Homo sapiens
taaattttcttcagttgg

SEQ ID NO: 4465407 - DNA, 14 bp, Homo sapiens
taaattttgtaatg

SEQ ID NO: 4465408 - DNA, 20 bp, Homo sapiens
taaatttttaggcaaagata

SEQ ID NO: 4465409 - DNA, 21 bp, Homo sapiens
taaattttttgacctatttta

SEQ ID NO: 4465410 - DNA, 14 bp, Homo sapiens
taaatttttttcct

SEQ ID NO: 4465411 - DNA, 19 bp, Homo sapiens
taaattttttttgtttcat

SEQ ID NO: 4465412 - DNA, 14 bp, Homo sapiens
taacaaaaaaggtt

SEQ ID NO: 4465413 - DNA, 15 bp, Homo sapiens
taacaaaatgtatgt

SEQ ID NO: 4465414 - DNA, 16 bp, Homo sapiens
taacaaaatgtatgtc

SEQ ID NO: 4465415 - DNA, 13 bp, Homo sapiens
taacaaattattt

SEQ ID NO: 4465416 - DNA, 14 bp, Homo sapiens
taacaaattatttt

SEQ ID NO: 4465417 - DNA, 16 bp, Homo sapiens
taacaactatttttgt

SEQ ID NO: 4465418 - DNA, 12 bp, Homo sapiens
taacaataataa

SEQ ID NO: 4465419 - DNA, 14 bp, Homo sapiens
taacaataataaaa

SEQ ID NO: 4465420 - DNA, 16 bp, Homo sapiens
taacaataatatttca

SEQ ID NO: 4465421 - DNA, 19 bp, Homo sapiens
taacaataatatttcaagt

SEQ ID NO: 4465422 - DNA, 23 bp, Homo sapiens
taacaataatatttcaagtgcct

SEQ ID NO: 4465423 - DNA, 24 bp, Homo sapiens
taacaataatatttcaagtgccta

SEQ ID NO: 4465424 - DNA, 15 bp, Homo sapiens
taacaatctaacaat

SEQ ID NO: 4465425 - DNA, 21 bp, Homo sapiens
taacaatctaacaataatatt

SEQ ID NO: 4465426 - DNA, 13 bp, Homo sapiens
taacaatgccttg

SEQ ID NO: 4465427 - DNA, 17 bp, Homo sapiens
taacaatgccttgttgt

SEQ ID NO: 4465428 - DNA, 19 bp, Homo sapiens
taacaatgccttgttgtat

SEQ ID NO: 4465429 - DNA, 14 bp, Homo sapiens
taacaattaattgt

SEQ ID NO: 4465430 - DNA, 17 bp, Homo sapiens
taacaattaattgtctt

SEQ ID NO: 4465431 - DNA, 18 bp, Homo sapiens
taacacaggataaagtta

SEQ ID NO: 4465432 - DNA, 13 bp, Homo sapiens
taacactaatata

SEQ ID NO: 4465433 - DNA, 22 bp, Homo sapiens
taacactaatatatttaaaaat

SEQ ID NO: 4465434 - DNA, 22 bp, Homo sapiens
taacactacacttctccttatc

SEQ ID NO: 4465435 - DNA, 22 bp, Homo sapiens
taacactctaggatgtatattt

SEQ ID NO: 4465436 - DNA, 16 bp, Homo sapiens
taacactgtgatttat

SEQ ID NO: 4465437 - DNA, 23 bp, Homo sapiens
taacactttagttatattcactg

SEQ ID NO: 4465438 - DNA, 22 bp, Homo sapiens
taacagaaattgtatattgtaa

SEQ ID NO: 4465439 - DNA, 13 bp, Homo sapiens
taacagagaaata

SEQ ID NO: 4465440 - DNA, 14 bp, Homo sapiens
taacagatgtgaaa

SEQ ID NO: 4465441 - DNA, 22 bp, Homo sapiens
taacagatgtgaaaatatactt

SEQ ID NO: 4465442 - DNA, 17 bp, Homo sapiens
taacagccctcctctgc

SEQ ID NO: 4465443 - DNA, 17 bp, Homo sapiens
taacagctacaaacttt

SEQ ID NO: 4465444 - DNA, 15 bp, Homo sapiens
taacaggccaaagag

SEQ ID NO: 4465445 - DNA, 20 bp, Homo sapiens
taacagggagaagtagctag

SEQ ID NO: 4465446 - DNA, 14 bp, Homo sapiens
taacagtgccattg

SEQ ID NO: 4465447 - DNA, 20 bp, Homo sapiens
taacagtgtctttctagcca

SEQ ID NO: 4465448 - DNA, 22 bp, Homo sapiens
taacataactgcttcttggagc

SEQ ID NO: 4465449 - DNA, 22 bp, Homo sapiens
taacataggtttttaaagacta

SEQ ID NO: 4465450 - DNA, 19 bp, Homo sapiens
taacatagtaagttcagca

SEQ ID NO: 4465451 - DNA, 19 bp, Homo sapiens
taacatgacttccttattt

SEQ ID NO: 4465452 - DNA, 14 bp, Homo sapiens
taacatgcaataac

SEQ ID NO: 4465453 - DNA, 16 bp, Homo sapiens
taacatgcaataacaa

SEQ ID NO: 4465454 - DNA, 18 bp, Homo sapiens
taacatggtttaaaagaa

SEQ ID NO: 4465455 - DNA, 11 bp, Homo sapiens
taacattatat

SEQ ID NO: 4465456 - DNA, 21 bp, Homo sapiens
taacattatataacaaaaaag

SEQ ID NO: 4465457 - DNA, 21 bp, Homo sapiens
taacattcaggaattcttgga

SEQ ID NO: 4465458 - DNA, 13 bp, Homo sapiens
taacattcctaaa

SEQ ID NO: 4465459 - DNA, 16 bp, Homo sapiens
taacattcctaaaatg

SEQ ID NO: 4465460 - DNA, 17 bp, Homo sapiens
taacattcctaaaatgc

SEQ ID NO: 4465461 - DNA, 17 bp, Homo sapiens
taacattgtttttgtat

SEQ ID NO: 4465462 - DNA, 15 bp, Homo sapiens
taacatttaaattcc

SEQ ID NO: 4465463 - DNA, 16 bp, Homo sapiens
taacatttaaattcca

SEQ ID NO: 4465464 - DNA, 16 bp, Homo sapiens
taacattttacagtaa

SEQ ID NO: 4465465 - DNA, 15 bp, Homo sapiens
taacatttttcaata

SEQ ID NO: 4465466 - DNA, 21 bp, Homo sapiens
taaccaagagataactgtaaa

SEQ ID NO: 4465467 - DNA, 12 bp, Homo sapiens
taaccaagttcc

SEQ ID NO: 4465468 - DNA, 14 bp, Homo sapiens
taaccacaactttc

SEQ ID NO: 4465469 - DNA, 21 bp, Homo sapiens
taaccacaactttcactataa

SEQ ID NO: 4465470 - DNA, 22 bp, Homo sapiens
taaccacttcgcacacacccat

SEQ ID NO: 4465471 - DNA, 16 bp, Homo sapiens
taaccagaattataca

SEQ ID NO: 4465472 - DNA, 14 bp, Homo sapiens
taaccagccctgca

SEQ ID NO: 4465473 - DNA, 19 bp, Homo sapiens
taaccaggccatttttggt

SEQ ID NO: 4465474 - DNA, 18 bp, Homo sapiens
taacccacctctcctgcc

SEQ ID NO: 4465475 - DNA, 17 bp, Homo sapiens
taacccagttaacttac

SEQ ID NO: 4465476 - DNA, 19 bp, Homo sapiens
taacccatctctgaactgg

SEQ ID NO: 4465477 - DNA, 22 bp, Homo sapiens
taaccccagggcactgccagcc

SEQ ID NO: 4465478 - DNA, 18 bp, Homo sapiens
taacccccagcccacaga

SEQ ID NO: 4465479 - DNA, 18 bp, Homo sapiens
taaccccgggcgggtggc

SEQ ID NO: 4465480 - DNA, 20 bp, Homo sapiens
taaccctttggtttttttct

SEQ ID NO: 4465481 - DNA, 20 bp, Homo sapiens
taaccgtgaagctcttccta

SEQ ID NO: 4465482 - DNA, 22 bp, Homo sapiens
taacctaatcaccatgtaagca

SEQ ID NO: 4465483 - DNA, 21 bp, Homo sapiens
taacctaattaatatattaaa

SEQ ID NO: 4465484 - DNA, 19 bp, Homo sapiens
taacctagttaaagaaagg

SEQ ID NO: 4465485 - DNA, 22 bp, Homo sapiens
taacctagttaaagaaaggaaa

SEQ ID NO: 4465486 - DNA, 15 bp, Homo sapiens
taacctatgataatt

SEQ ID NO: 4465487 - DNA, 22 bp, Homo sapiens
taacctcccttaagcagcaaca

SEQ ID NO: 4465488 - DNA, 20 bp, Homo sapiens
taacctgaccgtgggcgggg

SEQ ID NO: 4465489 - DNA, 19 bp, Homo sapiens
taacctgcaagttgctctg

SEQ ID NO: 4465490 - DNA, 11 bp, Homo sapiens
taacctggagg

SEQ ID NO: 4465491 - DNA, 15 bp, Homo sapiens
taacctgttatttct

SEQ ID NO: 4465492 - DNA, 19 bp, Homo sapiens
taaccttaaccttaaaatt

SEQ ID NO: 4465493 - DNA, 20 bp, Homo sapiens
taaccttaaccttaaaattg

SEQ ID NO: 4465494 - DNA, 19 bp, Homo sapiens
taaccttactaattatact

SEQ ID NO: 4465495 - DNA, 17 bp, Homo sapiens
taaccttatcctgcatt

SEQ ID NO: 4465496 - DNA, 18 bp, Homo sapiens
taaccttatcctgcattg

SEQ ID NO: 4465497 - DNA, 18 bp, Homo sapiens
taaccttgtttattagca

SEQ ID NO: 4465498 - DNA, 13 bp, Homo sapiens
taacctttgctat

SEQ ID NO: 4465499 - DNA, 18 bp, Homo sapiens
taacgacccactctgctt

SEQ ID NO: 4465500 - DNA, 21 bp, Homo sapiens
taacgactacaaaataaaact

SEQ ID NO: 4465501 - DNA, 14 bp, Homo sapiens
taacgcaaccaagt

SEQ ID NO: 4465502 - DNA, 13 bp, Homo sapiens
taacggtgctaaa

SEQ ID NO: 4465503 - DNA, 17 bp, Homo sapiens
taacggttaagaaagca

SEQ ID NO: 4465504 - DNA, 18 bp, Homo sapiens
taacgtccactagcttac

SEQ ID NO: 4465505 - DNA, 20 bp, Homo sapiens
taacgtccactagcttactg

SEQ ID NO: 4465506 - DNA, 15 bp, Homo sapiens
taacgtgctcactgt

SEQ ID NO: 4465507 - DNA, 14 bp, Homo sapiens
taactaaaatgtat

SEQ ID NO: 4465508 - DNA, 17 bp, Homo sapiens
taactaaaatgtatcta

SEQ ID NO: 4465509 - DNA, 14 bp, Homo sapiens
taactaaattttaa

SEQ ID NO: 4465510 - DNA, 20 bp, Homo sapiens
taactacccttaattactta

SEQ ID NO: 4465511 - DNA, 16 bp, Homo sapiens
taactactttataact

SEQ ID NO: 4465512 - DNA, 17 bp, Homo sapiens
taactactttataacta

SEQ ID NO: 4465513 - DNA, 23 bp, Homo sapiens
taactataagatacaataaaaca

SEQ ID NO: 4465514 - DNA, 18 bp, Homo sapiens
taactatcaatatttaag

SEQ ID NO: 4465515 - DNA, 16 bp, Homo sapiens
taactattgcatttat

SEQ ID NO: 4465516 - DNA, 17 bp, Homo sapiens
taactatttttttcaaa

SEQ ID NO: 4465517 - DNA, 22 bp, Homo sapiens
taactcaaggataccttcttat

SEQ ID NO: 4465518 - DNA, 19 bp, Homo sapiens
taactcctgccattcttct

SEQ ID NO: 4465519 - DNA, 17 bp, Homo sapiens
taactcctgtccctttt

SEQ ID NO: 4465520 - DNA, 16 bp, Homo sapiens
taactctgtataatag

SEQ ID NO: 4465521 - DNA, 14 bp, Homo sapiens
taactgaaaatgaa

SEQ ID NO: 4465522 - DNA, 20 bp, Homo sapiens
taactgaaaattatttaaac

SEQ ID NO: 4465523 - DNA, 14 bp, Homo sapiens
taactgaaggagaa

SEQ ID NO: 4465524 - DNA, 16 bp, Homo sapiens
taactgacaagccatc

SEQ ID NO: 4465525 - DNA, 20 bp, Homo sapiens
taactgacaagccatcttga

SEQ ID NO: 4465526 - DNA, 23 bp, Homo sapiens
taactgactggatggtccagtgt

SEQ ID NO: 4465527 - DNA, 16 bp, Homo sapiens
taactgatgagtaaac

SEQ ID NO: 4465528 - DNA, 19 bp, Homo sapiens
taactgatgagtaaactga

SEQ ID NO: 4465529 - DNA, 12 bp, Homo sapiens
taactgatttct

SEQ ID NO: 4465530 - DNA, 16 bp, Homo sapiens
taactgatttctatgg

SEQ ID NO: 4465531 - DNA, 22 bp, Homo sapiens
taactggaagcatgtaggagaa

SEQ ID NO: 4465532 - DNA, 17 bp, Homo sapiens
taactggcatgtcattt

SEQ ID NO: 4465533 - DNA, 17 bp, Homo sapiens
taactggtgcactttgt

SEQ ID NO: 4465534 - DNA, 22 bp, Homo sapiens
taactggtgcactttgtaaatt

SEQ ID NO: 4465535 - DNA, 12 bp, Homo sapiens
taactgtaaact

SEQ ID NO: 4465536 - DNA, 14 bp, Homo sapiens
taactgtaaacttg

SEQ ID NO: 4465537 - DNA, 15 bp, Homo sapiens
taactgtaaagatgt

SEQ ID NO: 4465538 - DNA, 23 bp, Homo sapiens
taactgtaaagatgtttatttca

SEQ ID NO: 4465539 - DNA, 16 bp, Homo sapiens
taactgtatatttgta

SEQ ID NO: 4465540 - DNA, 17 bp, Homo sapiens
taactgtatatttgtat

SEQ ID NO: 4465541 - DNA, 16 bp, Homo sapiens
taactgtatttcagta

SEQ ID NO: 4465542 - DNA, 22 bp, Homo sapiens
taactgtatttgaaataagaat

SEQ ID NO: 4465543 - DNA, 16 bp, Homo sapiens
taactgtcttgtttca

SEQ ID NO: 4465544 - DNA, 16 bp, Homo sapiens
taactgtgaaatacca

SEQ ID NO: 4465545 - DNA, 14 bp, Homo sapiens
taactgttacagta

SEQ ID NO: 4465546 - DNA, 17 bp, Homo sapiens
taactgttacagtaatg

SEQ ID NO: 4465547 - DNA, 15 bp, Homo sapiens
taactgtttatatgt

SEQ ID NO: 4465548 - DNA, 14 bp, Homo sapiens
taactgttttagaa

SEQ ID NO: 4465549 - DNA, 14 bp, Homo sapiens
taactgttttaggt

SEQ ID NO: 4465550 - DNA, 22 bp, Homo sapiens
taacttaaaagaacatgtatat

SEQ ID NO: 4465551 - DNA, 14 bp, Homo sapiens
taacttaaatagta

SEQ ID NO: 4465552 - DNA, 14 bp, Homo sapiens
taacttagttttta

SEQ ID NO: 4465553 - DNA, 15 bp, Homo sapiens
taacttatattaata

SEQ ID NO: 4465554 - DNA, 15 bp, Homo sapiens
taacttattcaaaga

SEQ ID NO: 4465555 - DNA, 18 bp, Homo sapiens
taacttcaaatatagaga

SEQ ID NO: 4465556 - DNA, 23 bp, Homo sapiens
taacttcacccgagttcctctgg

SEQ ID NO: 4465557 - DNA, 23 bp, Homo sapiens
taacttcatattaatataagttt

SEQ ID NO: 4465558 - DNA, 12 bp, Homo sapiens
taacttcattgt

SEQ ID NO: 4465559 - DNA, 18 bp, Homo sapiens
taacttccatgttctggg

SEQ ID NO: 4465560 - DNA, 18 bp, Homo sapiens
taacttcttatggaattg

SEQ ID NO: 4465561 - DNA, 23 bp, Homo sapiens
taacttcttatggaattgatttg

SEQ ID NO: 4465562 - DNA, 19 bp, Homo sapiens
taacttcttgcttctttct

SEQ ID NO: 4465563 - DNA, 20 bp, Homo sapiens
taacttcttgcttctttcta

SEQ ID NO: 4465564 - DNA, 13 bp, Homo sapiens
taacttggggagg

SEQ ID NO: 4465565 - DNA, 14 bp, Homo sapiens
taacttggggaggc

SEQ ID NO: 4465566 - DNA, 17 bp, Homo sapiens
taacttggtcagagcca

SEQ ID NO: 4465567 - DNA, 21 bp, Homo sapiens
taacttggtcagagccactct

SEQ ID NO: 4465568 - DNA, 21 bp, Homo sapiens
taacttgtgtattagatatca

SEQ ID NO: 4465569 - DNA, 18 bp, Homo sapiens
taactttaaggatttgaa

SEQ ID NO: 4465570 - DNA, 14 bp, Homo sapiens
taactttacagaaa

SEQ ID NO: 4465571 - DNA, 17 bp, Homo sapiens
taactttggttttcttg

SEQ ID NO: 4465572 - DNA, 14 bp, Homo sapiens
taacttttatatta

SEQ ID NO: 4465573 - DNA, 16 bp, Homo sapiens
taacttttgtgaatta

SEQ ID NO: 4465574 - DNA, 22 bp, Homo sapiens
taacttttgtgaattaggctgt

SEQ ID NO: 4465575 - DNA, 23 bp, Homo sapiens
taactttttgtttttatttcttt

SEQ ID NO: 4465576 - DNA, 19 bp, Homo sapiens
taacttttttgagtcattg

SEQ ID NO: 4465577 - DNA, 14 bp, Homo sapiens
taagaaaaaaaatg

SEQ ID NO: 4465578 - DNA, 17 bp, Homo sapiens
taagaaaaaaaatgtac

SEQ ID NO: 4465579 - DNA, 15 bp, Homo sapiens
taagaaaaaaagcaa

SEQ ID NO: 4465580 - DNA, 16 bp, Homo sapiens
taagaaaaacaataaa

SEQ ID NO: 4465581 - DNA, 15 bp, Homo sapiens
taagaaaacaagtat

SEQ ID NO: 4465582 - DNA, 23 bp, Homo sapiens
taagaaaatgttacggcatcaca

SEQ ID NO: 4465583 - DNA, 12 bp, Homo sapiens
taagaaaattta

SEQ ID NO: 4465584 - DNA, 20 bp, Homo sapiens
taagaaacttttttatttaa

SEQ ID NO: 4465585 - DNA, 20 bp, Homo sapiens
taagaaagcacttaaacaga

SEQ ID NO: 4465586 - DNA, 20 bp, Homo sapiens
taagaaagccaccttgttac

SEQ ID NO: 4465587 - DNA, 21 bp, Homo sapiens
taagaaagccaccttgttaca

SEQ ID NO: 4465588 - DNA, 22 bp, Homo sapiens
taagaaagccaccttgttacaa

SEQ ID NO: 4465589 - DNA, 23 bp, Homo sapiens
taagaaaggaagcattgtaaaat

SEQ ID NO: 4465590 - DNA, 18 bp, Homo sapiens
taagaaagtgaagcaaat

SEQ ID NO: 4465591 - DNA, 13 bp, Homo sapiens
taagaaatagaat

SEQ ID NO: 4465592 - DNA, 18 bp, Homo sapiens
taagaaatatctgtgaaa

SEQ ID NO: 4465593 - DNA, 19 bp, Homo sapiens
taagaaatatctgtgaaat

SEQ ID NO: 4465594 - DNA, 18 bp, Homo sapiens
taagaaatggtggaactg

SEQ ID NO: 4465595 - DNA, 17 bp, Homo sapiens
taagaaattttgccttt

SEQ ID NO: 4465596 - DNA, 15 bp, Homo sapiens
taagaacattttata

SEQ ID NO: 4465597 - DNA, 22 bp, Homo sapiens
taagaacattttataaaacata

SEQ ID NO: 4465598 - DNA, 23 bp, Homo sapiens
taagaacccatggaaaaatgcca

SEQ ID NO: 4465599 - DNA, 13 bp, Homo sapiens
taagaacccctct

SEQ ID NO: 4465600 - DNA, 16 bp, Homo sapiens
taagaaccttaatgac

SEQ ID NO: 4465601 - DNA, 16 bp, Homo sapiens
taagaactaaaatgtt

SEQ ID NO: 4465602 - DNA, 21 bp, Homo sapiens
taagaactacaaacaaaattt

SEQ ID NO: 4465603 - DNA, 13 bp, Homo sapiens
taagaactgtaca

SEQ ID NO: 4465604 - DNA, 21 bp, Homo sapiens
taagaactgtacattgtgagc

SEQ ID NO: 4465605 - DNA, 21 bp, Homo sapiens
taagaagaatgcttaatcaga

SEQ ID NO: 4465606 - DNA, 22 bp, Homo sapiens
taagaagacattttgttacata

SEQ ID NO: 4465607 - DNA, 13 bp, Homo sapiens
taagaagcaataa

SEQ ID NO: 4465608 - DNA, 18 bp, Homo sapiens
taagaagcaatctttgaa

SEQ ID NO: 4465609 - DNA, 17 bp, Homo sapiens
taagaaggcaaaaatgt

SEQ ID NO: 4465610 - DNA, 18 bp, Homo sapiens
taagaaggcaaaaatgta

SEQ ID NO: 4465611 - DNA, 20 bp, Homo sapiens
taagaaggcaatattaacct

SEQ ID NO: 4465612 - DNA, 18 bp, Homo sapiens
taagaatcttagataact

SEQ ID NO: 4465613 - DNA, 16 bp, Homo sapiens
taagaatgcttaaaaa

SEQ ID NO: 4465614 - DNA, 19 bp, Homo sapiens
taagaatttttttttaaat

SEQ ID NO: 4465615 - DNA, 22 bp, Homo sapiens
taagacaagagatctacacatg

SEQ ID NO: 4465616 - DNA, 23 bp, Homo sapiens
taagacaagagatctacacatgt

SEQ ID NO: 4465617 - DNA, 15 bp, Homo sapiens
taagacaatagtatt

SEQ ID NO: 4465618 - DNA, 22 bp, Homo sapiens
taagacacactccccacttcac

SEQ ID NO: 4465619 - DNA, 14 bp, Homo sapiens
taagacagcatgtg

SEQ ID NO: 4465620 - DNA, 20 bp, Homo sapiens
taagacatactccttccatc

SEQ ID NO: 4465621 - DNA, 21 bp, Homo sapiens
taagacattttgtttttactg

SEQ ID NO: 4465622 - DNA, 23 bp, Homo sapiens
taagacattttgtttttactgta

SEQ ID NO: 4465623 - DNA, 20 bp, Homo sapiens
taagacatttttcattcatg

SEQ ID NO: 4465624 - DNA, 22 bp, Homo sapiens
taagacccttattgctgtcctg

SEQ ID NO: 4465625 - DNA, 15 bp, Homo sapiens
taagactaactcaag

SEQ ID NO: 4465626 - DNA, 12 bp, Homo sapiens
taagactactaa

SEQ ID NO: 4465627 - DNA, 19 bp, Homo sapiens
taagactctgtgtggctgt

SEQ ID NO: 4465628 - DNA, 20 bp, Homo sapiens
taagactctgtgtggctgtg

SEQ ID NO: 4465629 - DNA, 15 bp, Homo sapiens
taagagaaaagagag

SEQ ID NO: 4465630 - DNA, 18 bp, Homo sapiens
taagagaagtagaaatca

SEQ ID NO: 4465631 - DNA, 16 bp, Homo sapiens
taagagagatgagaaa

SEQ ID NO: 4465632 - DNA, 18 bp, Homo sapiens
taagagagatgagaaagc

SEQ ID NO: 4465633 - DNA, 22 bp, Homo sapiens
taagagattggatcaagtatta

SEQ ID NO: 4465634 - DNA, 16 bp, Homo sapiens
taagagctagcgctgc

SEQ ID NO: 4465635 - DNA, 20 bp, Homo sapiens
taagagctagcgctgccgca

SEQ ID NO: 4465636 - DNA, 23 bp, Homo sapiens
taagagctattttagaaagctaa

SEQ ID NO: 4465637 - DNA, 23 bp, Homo sapiens
taagaggtattggattttcacag

SEQ ID NO: 4465638 - DNA, 15 bp, Homo sapiens
taagatacaataaaa

SEQ ID NO: 4465639 - DNA, 14 bp, Homo sapiens
taagatacactgca

SEQ ID NO: 4465640 - DNA, 15 bp, Homo sapiens
taagatagtgtaact

SEQ ID NO: 4465641 - DNA, 15 bp, Homo sapiens
taagatatatacatg

SEQ ID NO: 4465642 - DNA, 16 bp, Homo sapiens
taagatcctaaactct

SEQ ID NO: 4465643 - DNA, 17 bp, Homo sapiens
taagatctatagcctct

SEQ ID NO: 4465644 - DNA, 14 bp, Homo sapiens
taagatgaaacatc

SEQ ID NO: 4465645 - DNA, 19 bp, Homo sapiens
taagatgaaacatcatttc

SEQ ID NO: 4465646 - DNA, 21 bp, Homo sapiens
taagatgaaacatcatttcaa

SEQ ID NO: 4465647 - DNA, 22 bp, Homo sapiens
taagatgcatgtctgccaaaat

SEQ ID NO: 4465648 - DNA, 18 bp, Homo sapiens
taagatgtacatttaata

SEQ ID NO: 4465649 - DNA, 15 bp, Homo sapiens
taagatgtgttctta

SEQ ID NO: 4465650 - DNA, 19 bp, Homo sapiens
taagattgcactgttctga

SEQ ID NO: 4465651 - DNA, 19 bp, Homo sapiens
taagattgcgcctgagata

SEQ ID NO: 4465652 - DNA, 13 bp, Homo sapiens
taagatttaccca

SEQ ID NO: 4465653 - DNA, 14 bp, Homo sapiens
taagatttctctaa

SEQ ID NO: 4465654 - DNA, 17 bp, Homo sapiens
taagatttctctaatat

SEQ ID NO: 4465655 - DNA, 16 bp, Homo sapiens
taagatttttcaaaat

SEQ ID NO: 4465656 - DNA, 21 bp, Homo sapiens
taagcaaagcacccatttcaa

SEQ ID NO: 4465657 - DNA, 16 bp, Homo sapiens
taagcaaatacttagc

SEQ ID NO: 4465658 - DNA, 22 bp, Homo sapiens
taagcaaatacttagcaaaaag

SEQ ID NO: 4465659 - DNA, 18 bp, Homo sapiens
taagcaacttgcttctaa

SEQ ID NO: 4465660 - DNA, 22 bp, Homo sapiens
taagcaagtatatttatttcta

SEQ ID NO: 4465661 - DNA, 21 bp, Homo sapiens
taagcaagtgaactcatccct

SEQ ID NO: 4465662 - DNA, 21 bp, Homo sapiens
taagcaagttaagtgtcctcc

SEQ ID NO: 4465663 - DNA, 20 bp, Homo sapiens
taagcagactggaaaagtga

SEQ ID NO: 4465664 - DNA, 16 bp, Homo sapiens
taagcagattgcttta

SEQ ID NO: 4465665 - DNA, 18 bp, Homo sapiens
taagcagtaatctgtcag

SEQ ID NO: 4465666 - DNA, 22 bp, Homo sapiens
taagcagttatggtgatgactt

SEQ ID NO: 4465667 - DNA, 17 bp, Homo sapiens
taagcatactttgtaaa

SEQ ID NO: 4465668 - DNA, 15 bp, Homo sapiens
taagcattgcctggc

SEQ ID NO: 4465669 - DNA, 22 bp, Homo sapiens
taagcatttgtacatcttcttt

SEQ ID NO: 4465670 - DNA, 11 bp, Homo sapiens
taagccaaaga

SEQ ID NO: 4465671 - DNA, 21 bp, Homo sapiens
taagccaaagaaatgaacatt

SEQ ID NO: 4465672 - DNA, 19 bp, Homo sapiens
taagccacttaaaatgttc

SEQ ID NO: 4465673 - DNA, 19 bp, Homo sapiens
taagccatagaccctgagg

SEQ ID NO: 4465674 - DNA, 15 bp, Homo sapiens
taagcccttaataat

SEQ ID NO: 4465675 - DNA, 19 bp, Homo sapiens
taagcctcatcatcagagc

SEQ ID NO: 4465676 - DNA, 23 bp, Homo sapiens
taagcctttgccgtgagcatgca

SEQ ID NO: 4465677 - DNA, 19 bp, Homo sapiens
taagctatccgtgttgcag

SEQ ID NO: 4465678 - DNA, 13 bp, Homo sapiens
taagctgtgtctg

SEQ ID NO: 4465679 - DNA, 17 bp, Homo sapiens
taagcttttcattttaa

SEQ ID NO: 4465680 - DNA, 15 bp, Homo sapiens
taagctttttggaat

SEQ ID NO: 4465681 - DNA, 15 bp, Homo sapiens
taaggaaacttctga

SEQ ID NO: 4465682 - DNA, 21 bp, Homo sapiens
taaggaaagcaataaatgaat

SEQ ID NO: 4465683 - DNA, 14 bp, Homo sapiens
taaggaatagcttt

SEQ ID NO: 4465684 - DNA, 18 bp, Homo sapiens
taaggaatagctttgtat

SEQ ID NO: 4465685 - DNA, 12 bp, Homo sapiens
taaggactgcat

SEQ ID NO: 4465686 - DNA, 14 bp, Homo sapiens
taaggactgcatgg

SEQ ID NO: 4465687 - DNA, 17 bp, Homo sapiens
taaggagaaagaaagta

SEQ ID NO: 4465688 - DNA, 22 bp, Homo sapiens
taaggagaaagaaagtacccag

SEQ ID NO: 4465689 - DNA, 23 bp, Homo sapiens
taaggagaaagaaagtacccagc

SEQ ID NO: 4465690 - DNA, 15 bp, Homo sapiens
taaggagcatgattt

SEQ ID NO: 4465691 - DNA, 15 bp, Homo sapiens
taaggataaatcata

SEQ ID NO: 4465692 - DNA, 19 bp, Homo sapiens
taaggatatgattaatatt

SEQ ID NO: 4465693 - DNA, 20 bp, Homo sapiens
taaggatggggttatgaacc

SEQ ID NO: 4465694 - DNA, 19 bp, Homo sapiens
taaggcagctgatccaggc

SEQ ID NO: 4465695 - DNA, 22 bp, Homo sapiens
taaggccttttatgtaatttct

SEQ ID NO: 4465696 - DNA, 13 bp, Homo sapiens
taaggcttttatt

SEQ ID NO: 4465697 - DNA, 11 bp, Homo sapiens
taagggaaaaa

SEQ ID NO: 4465698 - DNA, 12 bp, Homo sapiens
taagggaaaaat

SEQ ID NO: 4465699 - DNA, 19 bp, Homo sapiens
taagggaatttaatacttt

SEQ ID NO: 4465700 - DNA, 19 bp, Homo sapiens
taagggacttaacttgttt

SEQ ID NO: 4465701 - DNA, 17 bp, Homo sapiens
taagggtggaaaaatgc

SEQ ID NO: 4465702 - DNA, 18 bp, Homo sapiens
taagggtggaaaaatgcc

SEQ ID NO: 4465703 - DNA, 19 bp, Homo sapiens
taagggtggaaaaatgccc

SEQ ID NO: 4465704 - DNA, 12 bp, Homo sapiens
taaggtacatca

SEQ ID NO: 4465705 - DNA, 21 bp, Homo sapiens
taaggtctttcagtacttttt

SEQ ID NO: 4465706 - DNA, 18 bp, Homo sapiens
taaggtgggagaattgct

SEQ ID NO: 4465707 - DNA, 21 bp, Homo sapiens
taaggttagaaacattttgat

SEQ ID NO: 4465708 - DNA, 13 bp, Homo sapiens
taagtaaaaccac

SEQ ID NO: 4465709 - DNA, 19 bp, Homo sapiens
taagtaaaaccacagcagt

SEQ ID NO: 4465710 - DNA, 13 bp, Homo sapiens
taagtaaaagtct

SEQ ID NO: 4465711 - DNA, 21 bp, Homo sapiens
taagtaaaagtctacctgtgt

SEQ ID NO: 4465712 - DNA, 21 bp, Homo sapiens
taagtaacgtgctcactgtgt

SEQ ID NO: 4465713 - DNA, 14 bp, Homo sapiens
taagtaatttagaa

SEQ ID NO: 4465714 - DNA, 23 bp, Homo sapiens
taagtaatttagaagatattatt

SEQ ID NO: 4465715 - DNA, 18 bp, Homo sapiens
taagtacacaataagcaa

SEQ ID NO: 4465716 - DNA, 13 bp, Homo sapiens
taagtagcattca

SEQ ID NO: 4465717 - DNA, 14 bp, Homo sapiens
taagtcaacagtaa

SEQ ID NO: 4465718 - DNA, 16 bp, Homo sapiens
taagtcaacagtaaac

SEQ ID NO: 4465719 - DNA, 17 bp, Homo sapiens
taagtcaacagtaaacc

SEQ ID NO: 4465720 - DNA, 15 bp, Homo sapiens
taagtcaacctgcct

SEQ ID NO: 4465721 - DNA, 22 bp, Homo sapiens
taagtcattgaaatttactgtg

SEQ ID NO: 4465722 - DNA, 13 bp, Homo sapiens
taagtcatttttt

SEQ ID NO: 4465723 - DNA, 21 bp, Homo sapiens
taagtcattttttacttgaat

SEQ ID NO: 4465724 - DNA, 16 bp, Homo sapiens
taagtctacattaaac

SEQ ID NO: 4465725 - DNA, 22 bp, Homo sapiens
taagtctatactaatgcttaca

SEQ ID NO: 4465726 - DNA, 14 bp, Homo sapiens
taagtgaagggaaa

SEQ ID NO: 4465727 - DNA, 22 bp, Homo sapiens
taagtgacaaataagattaata

SEQ ID NO: 4465728 - DNA, 23 bp, Homo sapiens
taagtgacaaataagattaataa

SEQ ID NO: 4465729 - DNA, 17 bp, Homo sapiens
taagtgatgtcatttga

SEQ ID NO: 4465730 - DNA, 14 bp, Homo sapiens
taagtgccttccat

SEQ ID NO: 4465731 - DNA, 16 bp, Homo sapiens
taagtgccttccatgt

SEQ ID NO: 4465732 - DNA, 23 bp, Homo sapiens
taagtgcttcacaggttttatgt

SEQ ID NO: 4465733 - DNA, 13 bp, Homo sapiens
taagtggctgcct

SEQ ID NO: 4465734 - DNA, 12 bp, Homo sapiens
taagtgttcatt

SEQ ID NO: 4465735 - DNA, 14 bp, Homo sapiens
taagtgttcatttt

SEQ ID NO: 4465736 - DNA, 14 bp, Homo sapiens
taagtgttggaaaa

SEQ ID NO: 4465737 - DNA, 17 bp, Homo sapiens
taagtgttggaaaaaat

SEQ ID NO: 4465738 - DNA, 23 bp, Homo sapiens
taagttatgcctctgacagtcca

SEQ ID NO: 4465739 - DNA, 15 bp, Homo sapiens
taagttattgcagtt

SEQ ID NO: 4465740 - DNA, 20 bp, Homo sapiens
taagttattgcagtttatca

SEQ ID NO: 4465741 - DNA, 15 bp, Homo sapiens
taagttattttacct

SEQ ID NO: 4465742 - DNA, 19 bp, Homo sapiens
taagttcaaattcttctga

SEQ ID NO: 4465743 - DNA, 13 bp, Homo sapiens
taagttgaccttt

SEQ ID NO: 4465744 - DNA, 14 bp, Homo sapiens
taagttgaccttta

SEQ ID NO: 4465745 - DNA, 18 bp, Homo sapiens
taagttgacctttattta

SEQ ID NO: 4465746 - DNA, 14 bp, Homo sapiens
taagttgagcgtgc

SEQ ID NO: 4465747 - DNA, 16 bp, Homo sapiens
taagttgctgtaaaat

SEQ ID NO: 4465748 - DNA, 18 bp, Homo sapiens
taagttgctgtaaaattt

SEQ ID NO: 4465749 - DNA, 22 bp, Homo sapiens
taagttgctgtaaaatttgtgt

SEQ ID NO: 4465750 - DNA, 20 bp, Homo sapiens
taagttggcttctgtttcta

SEQ ID NO: 4465751 - DNA, 22 bp, Homo sapiens
taagttggcttctgtttctagt

SEQ ID NO: 4465752 - DNA, 22 bp, Homo sapiens
taagttgtataggctaaatgtt

SEQ ID NO: 4465753 - DNA, 19 bp, Homo sapiens
taagttgtcaaagaagctt

SEQ ID NO: 4465754 - DNA, 17 bp, Homo sapiens
taagttgtctgtctgaa

SEQ ID NO: 4465755 - DNA, 15 bp, Homo sapiens
taataaaaagacaac

SEQ ID NO: 4465756 - DNA, 14 bp, Homo sapiens
taataaaaatttat

SEQ ID NO: 4465757 - DNA, 18 bp, Homo sapiens
taataaaaatttattatt

SEQ ID NO: 4465758 - DNA, 22 bp, Homo sapiens
taataaagtattccaccttaaa

SEQ ID NO: 4465759 - DNA, 14 bp, Homo sapiens
taataaagtgaact

SEQ ID NO: 4465760 - DNA, 18 bp, Homo sapiens
taataaagtgaactttgt

SEQ ID NO: 4465761 - DNA, 14 bp, Homo sapiens
taataaattttcta

SEQ ID NO: 4465762 - DNA, 17 bp, Homo sapiens
taataaattttctaaaa

SEQ ID NO: 4465763 - DNA, 19 bp, Homo sapiens
taataactttctctgtgaa

SEQ ID NO: 4465764 - DNA, 20 bp, Homo sapiens
taataactttctctgtgaaa

SEQ ID NO: 4465765 - DNA, 16 bp, Homo sapiens
taataagaacagatca

SEQ ID NO: 4465766 - DNA, 17 bp, Homo sapiens
taataagatttttcaaa

SEQ ID NO: 4465767 - DNA, 21 bp, Homo sapiens
taataagtgacaaataagatt

SEQ ID NO: 4465768 - DNA, 13 bp, Homo sapiens
taataataatgcc

SEQ ID NO: 4465769 - DNA, 14 bp, Homo sapiens
taataataatgttt

SEQ ID NO: 4465770 - DNA, 22 bp, Homo sapiens
taataatgagctattaaaactc

SEQ ID NO: 4465771 - DNA, 16 bp, Homo sapiens
taataatgccaatgaa

SEQ ID NO: 4465772 - DNA, 17 bp, Homo sapiens
taataatgccaatgaac

SEQ ID NO: 4465773 - DNA, 23 bp, Homo sapiens
taataatgccaatgaacatctca

SEQ ID NO: 4465774 - DNA, 22 bp, Homo sapiens
taataatttagacttcaagcat

SEQ ID NO: 4465775 - DNA, 15 bp, Homo sapiens
taataatttttgctg

SEQ ID NO: 4465776 - DNA, 16 bp, Homo sapiens
taataatttttgctga

SEQ ID NO: 4465777 - DNA, 22 bp, Homo sapiens
taatacagcaacaatttatgaa

SEQ ID NO: 4465778 - DNA, 16 bp, Homo sapiens
taatacatcacatctt

SEQ ID NO: 4465779 - DNA, 17 bp, Homo sapiens
taatacatcacatctta

SEQ ID NO: 4465780 - DNA, 18 bp, Homo sapiens
taatacatcacatcttat

SEQ ID NO: 4465781 - DNA, 18 bp, Homo sapiens
taatacctgattgatcac

SEQ ID NO: 4465782 - DNA, 17 bp, Homo sapiens
taatacgtgccagatat

SEQ ID NO: 4465783 - DNA, 13 bp, Homo sapiens
taatactctattt

SEQ ID NO: 4465784 - DNA, 14 bp, Homo sapiens
taatactttctatg

SEQ ID NO: 4465785 - DNA, 13 bp, Homo sapiens
taatactttgtat

SEQ ID NO: 4465786 - DNA, 15 bp, Homo sapiens
taatagaaatgcata

SEQ ID NO: 4465787 - DNA, 14 bp, Homo sapiens
taatagaacttgtt

SEQ ID NO: 4465788 - DNA, 15 bp, Homo sapiens
taatagaacttgtta

SEQ ID NO: 4465789 - DNA, 16 bp, Homo sapiens
taatagaataaaggca

SEQ ID NO: 4465790 - DNA, 20 bp, Homo sapiens
taatagaataaaggcagttt

SEQ ID NO: 4465791 - DNA, 23 bp, Homo sapiens
taatagattttttcagacttgtc

SEQ ID NO: 4465792 - DNA, 23 bp, Homo sapiens
taatagcactaaccaatgccttt

SEQ ID NO: 4465793 - DNA, 23 bp, Homo sapiens
taatagccaaagatttcatatct

SEQ ID NO: 4465794 - DNA, 16 bp, Homo sapiens
taataggcattttaag

SEQ ID NO: 4465795 - DNA, 16 bp, Homo sapiens
taatagggaatatatc

SEQ ID NO: 4465796 - DNA, 14 bp, Homo sapiens
taatagtactattg

SEQ ID NO: 4465797 - DNA, 13 bp, Homo sapiens
taatataaatgtt

SEQ ID NO: 4465798 - DNA, 14 bp, Homo sapiens
taatataaattcac

SEQ ID NO: 4465799 - DNA, 21 bp, Homo sapiens
taatataagtttctttagaaa

SEQ ID NO: 4465800 - DNA, 20 bp, Homo sapiens
taatatacaagcaagcaaaa

SEQ ID NO: 4465801 - DNA, 15 bp, Homo sapiens
taatatataatttaa

SEQ ID NO: 4465802 - DNA, 16 bp, Homo sapiens
taatatataatttaat

SEQ ID NO: 4465803 - DNA, 20 bp, Homo sapiens
taatatataatttaatgtaa

SEQ ID NO: 4465804 - DNA, 21 bp, Homo sapiens
taatatataatttaatgtaaa

SEQ ID NO: 4465805 - DNA, 13 bp, Homo sapiens
taatatatgaaat

SEQ ID NO: 4465806 - DNA, 12 bp, Homo sapiens
taatatattgaa

SEQ ID NO: 4465807 - DNA, 14 bp, Homo sapiens
taatatatttcttc

SEQ ID NO: 4465808 - DNA, 17 bp, Homo sapiens
taatatattttctgttt

SEQ ID NO: 4465809 - DNA, 17 bp, Homo sapiens
taatatcaaaagaaaat

SEQ ID NO: 4465810 - DNA, 21 bp, Homo sapiens
taatatcactcattaattaac

SEQ ID NO: 4465811 - DNA, 12 bp, Homo sapiens
taatatcctaaa

SEQ ID NO: 4465812 - DNA, 15 bp, Homo sapiens
taatatcctaaacat

SEQ ID NO: 4465813 - DNA, 19 bp, Homo sapiens
taatatctttcagttatta

SEQ ID NO: 4465814 - DNA, 14 bp, Homo sapiens
taatatgagcttca

SEQ ID NO: 4465815 - DNA, 15 bp, Homo sapiens
taatatgagcttcaa

SEQ ID NO: 4465816 - DNA, 15 bp, Homo sapiens
taatatggaaatctt

SEQ ID NO: 4465817 - DNA, 22 bp, Homo sapiens
taatatggaaccttccctccaa

SEQ ID NO: 4465818 - DNA, 22 bp, Homo sapiens
taatatggccacagtagtcttg

SEQ ID NO: 4465819 - DNA, 14 bp, Homo sapiens
taatatgtttagtt

SEQ ID NO: 4465820 - DNA, 23 bp, Homo sapiens
taatatgtttagttttacatttt

SEQ ID NO: 4465821 - DNA, 23 bp, Homo sapiens
taatattaatattcccattttat

SEQ ID NO: 4465822 - DNA, 19 bp, Homo sapiens
taatattcagccagcttaa

SEQ ID NO: 4465823 - DNA, 19 bp, Homo sapiens
taatattcccattttatta

SEQ ID NO: 4465824 - DNA, 23 bp, Homo sapiens
taatattctgttttgttaatata

SEQ ID NO: 4465825 - DNA, 17 bp, Homo sapiens
taatattgaaaattgaa

SEQ ID NO: 4465826 - DNA, 16 bp, Homo sapiens
taatattgcttcttgt

SEQ ID NO: 4465827 - DNA, 19 bp, Homo sapiens
taatattggtgctatttaa

SEQ ID NO: 4465828 - DNA, 20 bp, Homo sapiens
taatattgtttttctttcta

SEQ ID NO: 4465829 - DNA, 19 bp, Homo sapiens
taatatttacaatgtatta

SEQ ID NO: 4465830 - DNA, 18 bp, Homo sapiens
taatatttcttcaaatat

SEQ ID NO: 4465831 - DNA, 18 bp, Homo sapiens
taatattttgtaatattc

SEQ ID NO: 4465832 - DNA, 14 bp, Homo sapiens
taatcaaatgattt

SEQ ID NO: 4465833 - DNA, 21 bp, Homo sapiens
taatcaaatgatttcatattg

SEQ ID NO: 4465834 - DNA, 22 bp, Homo sapiens
taatcaaatgatttcatattga

SEQ ID NO: 4465835 - DNA, 16 bp, Homo sapiens
taatcaagagaaactt

SEQ ID NO: 4465836 - DNA, 18 bp, Homo sapiens
taatcaagagaaacttca

SEQ ID NO: 4465837 - DNA, 20 bp, Homo sapiens
taatcaccatgtaagcactc

SEQ ID NO: 4465838 - DNA, 19 bp, Homo sapiens
taatcacttaacattccta

SEQ ID NO: 4465839 - DNA, 20 bp, Homo sapiens
taatcagaaagaaaaaattt

SEQ ID NO: 4465840 - DNA, 19 bp, Homo sapiens
taatcagcatatgtgtaaa

SEQ ID NO: 4465841 - DNA, 14 bp, Homo sapiens
taatcagtcatttc

SEQ ID NO: 4465842 - DNA, 23 bp, Homo sapiens
taatcagttcattagaaatattt

SEQ ID NO: 4465843 - DNA, 22 bp, Homo sapiens
taatcatacaaactctcaccat

SEQ ID NO: 4465844 - DNA, 15 bp, Homo sapiens
taatcatgctcatgt

SEQ ID NO: 4465845 - DNA, 18 bp, Homo sapiens
taatcatgctcatgtata

SEQ ID NO: 4465846 - DNA, 21 bp, Homo sapiens
taatcatgctcatgtatattt

SEQ ID NO: 4465847 - DNA, 17 bp, Homo sapiens
taatcatgttttaatgt

SEQ ID NO: 4465848 - DNA, 20 bp, Homo sapiens
taatcattatttgagactgt

SEQ ID NO: 4465849 - DNA, 13 bp, Homo sapiens
taatcatttgttt

SEQ ID NO: 4465850 - DNA, 12 bp, Homo sapiens
taatcattttaa

SEQ ID NO: 4465851 - DNA, 21 bp, Homo sapiens
taatcattttagaattaaaat

SEQ ID NO: 4465852 - DNA, 12 bp, Homo sapiens
taatcattttca

SEQ ID NO: 4465853 - DNA, 14 bp, Homo sapiens
taatcattttcatt

SEQ ID NO: 4465854 - DNA, 20 bp, Homo sapiens
taatccaatccactaacact

SEQ ID NO: 4465855 - DNA, 22 bp, Homo sapiens
taatccaatccactaacacttt

SEQ ID NO: 4465856 - DNA, 22 bp, Homo sapiens
taatccattccttgaggacaga

SEQ ID NO: 4465857 - DNA, 12 bp, Homo sapiens
taatcccagcta

SEQ ID NO: 4465858 - DNA, 20 bp, Homo sapiens
taatcccagctactcaggag

SEQ ID NO: 4465859 - DNA, 15 bp, Homo sapiens
taatcccagctactg

SEQ ID NO: 4465860 - DNA, 10 bp, Homo sapiens
taatctacac

SEQ ID NO: 4465861 - DNA, 18 bp, Homo sapiens
taatctacaccaatgaaa

SEQ ID NO: 4465862 - DNA, 12 bp, Homo sapiens
taatctatatta

SEQ ID NO: 4465863 - DNA, 14 bp, Homo sapiens
taatctatattaaa

SEQ ID NO: 4465864 - DNA, 15 bp, Homo sapiens
taatctatattaaat

SEQ ID NO: 4465865 - DNA, 22 bp, Homo sapiens
taatctcctctgctcattaaac

SEQ ID NO: 4465866 - DNA, 23 bp, Homo sapiens
taatctctctgccgaaagtcaaa

SEQ ID NO: 4465867 - DNA, 14 bp, Homo sapiens
taatctctgtgtgt

SEQ ID NO: 4465868 - DNA, 21 bp, Homo sapiens
taatctctgtgtgttttcttt

SEQ ID NO: 4465869 - DNA, 15 bp, Homo sapiens
taatctcttcttata

SEQ ID NO: 4465870 - DNA, 16 bp, Homo sapiens
taatcttaatgtatat

SEQ ID NO: 4465871 - DNA, 16 bp, Homo sapiens
taatcttgaattgtaa

SEQ ID NO: 4465872 - DNA, 22 bp, Homo sapiens
taatcttgaattgtaactgttc

SEQ ID NO: 4465873 - DNA, 14 bp, Homo sapiens
taatctttcaaacc

SEQ ID NO: 4465874 - DNA, 21 bp, Homo sapiens
taatgaaaataaaacacacct

SEQ ID NO: 4465875 - DNA, 23 bp, Homo sapiens
taatgaaacaaagagttcaagaa

SEQ ID NO: 4465876 - DNA, 15 bp, Homo sapiens
taatgaaatgtttac

SEQ ID NO: 4465877 - DNA, 16 bp, Homo sapiens
taatgaagaaagtgga

SEQ ID NO: 4465878 - DNA, 16 bp, Homo sapiens
taatgaagtaaagcca

SEQ ID NO: 4465879 - DNA, 22 bp, Homo sapiens
taatgaagtattacatgattta

SEQ ID NO: 4465880 - DNA, 21 bp, Homo sapiens
taatgaatttttatgatattc

SEQ ID NO: 4465881 - DNA, 13 bp, Homo sapiens
taatgaccatgtt

SEQ ID NO: 4465882 - DNA, 17 bp, Homo sapiens
taatgaccatgttatat

SEQ ID NO: 4465883 - DNA, 22 bp, Homo sapiens
taatgactctttctgaaggaag

SEQ ID NO: 4465884 - DNA, 16 bp, Homo sapiens
taatgacttagaaact

SEQ ID NO: 4465885 - DNA, 23 bp, Homo sapiens
taatgagcagatgagagtttctg

SEQ ID NO: 4465886 - DNA, 18 bp, Homo sapiens
taatgagctattaaaact

SEQ ID NO: 4465887 - DNA, 16 bp, Homo sapiens
taatgataactaaaat

SEQ ID NO: 4465888 - DNA, 12 bp, Homo sapiens
taatgatactga

SEQ ID NO: 4465889 - DNA, 15 bp, Homo sapiens
taatgatactgatta

SEQ ID NO: 4465890 - DNA, 18 bp, Homo sapiens
taatgatactgattatga

SEQ ID NO: 4465891 - DNA, 21 bp, Homo sapiens
taatgatactgattatgaaat

SEQ ID NO: 4465892 - DNA, 13 bp, Homo sapiens
taatgatatactg

SEQ ID NO: 4465893 - DNA, 19 bp, Homo sapiens
taatgatcgaaaaaataat

SEQ ID NO: 4465894 - DNA, 19 bp, Homo sapiens
taatgattaagggacattt

SEQ ID NO: 4465895 - DNA, 20 bp, Homo sapiens
taatgattaagggacatttc

SEQ ID NO: 4465896 - DNA, 21 bp, Homo sapiens
taatgattcaaatgttttaaa

SEQ ID NO: 4465897 - DNA, 13 bp, Homo sapiens
taatgcactttct

SEQ ID NO: 4465898 - DNA, 16 bp, Homo sapiens
taatgcagtatggtac

SEQ ID NO: 4465899 - DNA, 20 bp, Homo sapiens
taatgcagtatggtacattt

SEQ ID NO: 4465900 - DNA, 18 bp, Homo sapiens
taatgcagtttttaaaaa

SEQ ID NO: 4465901 - DNA, 18 bp, Homo sapiens
taatgcattcttctctgt

SEQ ID NO: 4465902 - DNA, 11 bp, Homo sapiens
taatgcattgt

SEQ ID NO: 4465903 - DNA, 23 bp, Homo sapiens
taatgccaatgaacatctcatgt

SEQ ID NO: 4465904 - DNA, 20 bp, Homo sapiens
taatgccacacattgtgctt

SEQ ID NO: 4465905 - DNA, 19 bp, Homo sapiens
taatgccactaaattgaca

SEQ ID NO: 4465906 - DNA, 15 bp, Homo sapiens
taatgccttactctt

SEQ ID NO: 4465907 - DNA, 13 bp, Homo sapiens
taatgctttctga

SEQ ID NO: 4465908 - DNA, 13 bp, Homo sapiens
taatgctttggaa

SEQ ID NO: 4465909 - DNA, 16 bp, Homo sapiens
taatgctttggaaaaa

SEQ ID NO: 4465910 - DNA, 17 bp, Homo sapiens
taatgctttggaaaaat

SEQ ID NO: 4465911 - DNA, 20 bp, Homo sapiens
taatgcttttctaattaata

SEQ ID NO: 4465912 - DNA, 23 bp, Homo sapiens
taatggaagtgtatttattttac

SEQ ID NO: 4465913 - DNA, 13 bp, Homo sapiens
taatggagaagac

SEQ ID NO: 4465914 - DNA, 21 bp, Homo sapiens
taatggatcatagaattgcag

SEQ ID NO: 4465915 - DNA, 22 bp, Homo sapiens
taatggattataatcagaatgg

SEQ ID NO: 4465916 - DNA, 15 bp, Homo sapiens
taatggattgttaat

SEQ ID NO: 4465917 - DNA, 20 bp, Homo sapiens
taatggattgttaatttcag

SEQ ID NO: 4465918 - DNA, 12 bp, Homo sapiens
taatggcagcag

SEQ ID NO: 4465919 - DNA, 14 bp, Homo sapiens
taatggcagcagaa

SEQ ID NO: 4465920 - DNA, 17 bp, Homo sapiens
taatggcagctagtgcc

SEQ ID NO: 4465921 - DNA, 17 bp, Homo sapiens
taatggtgtccagtctt

SEQ ID NO: 4465922 - DNA, 19 bp, Homo sapiens
taatggtttttatttctcg

SEQ ID NO: 4465923 - DNA, 18 bp, Homo sapiens
taatgtaaagatttgctt

SEQ ID NO: 4465924 - DNA, 15 bp, Homo sapiens
taatgtaaataaaac

SEQ ID NO: 4465925 - DNA, 16 bp, Homo sapiens
taatgtaataaagtga

SEQ ID NO: 4465926 - DNA, 17 bp, Homo sapiens
taatgtaataaagtgaa

SEQ ID NO: 4465927 - DNA, 18 bp, Homo sapiens
taatgtactgatttcagt

SEQ ID NO: 4465928 - DNA, 21 bp, Homo sapiens
taatgtaggatgacaggctct

SEQ ID NO: 4465929 - DNA, 17 bp, Homo sapiens
taatgtagggttatatt

SEQ ID NO: 4465930 - DNA, 14 bp, Homo sapiens
taatgtatataaaa

SEQ ID NO: 4465931 - DNA, 17 bp, Homo sapiens
taatgtatgttaccaaa

SEQ ID NO: 4465932 - DNA, 15 bp, Homo sapiens
taatgtattttcttt

SEQ ID NO: 4465933 - DNA, 21 bp, Homo sapiens
taatgtgaaaatggtccagga

SEQ ID NO: 4465934 - DNA, 23 bp, Homo sapiens
taatgtgaaatgtaactgtccgt

SEQ ID NO: 4465935 - DNA, 20 bp, Homo sapiens
taatgtgacagtgttcagta

SEQ ID NO: 4465936 - DNA, 19 bp, Homo sapiens
taatgtgagtagttactaa

SEQ ID NO: 4465937 - DNA, 20 bp, Homo sapiens
taatgtgatcatatgaggac

SEQ ID NO: 4465938 - DNA, 22 bp, Homo sapiens
taatgtgatcatatgaggacct

SEQ ID NO: 4465939 - DNA, 23 bp, Homo sapiens
taatgtgcagggatattgcctta

SEQ ID NO: 4465940 - DNA, 22 bp, Homo sapiens
taatgtgcccaaagctctgaat

SEQ ID NO: 4465941 - DNA, 23 bp, Homo sapiens
taatgtgtctcaggctcaagttt

SEQ ID NO: 4465942 - DNA, 18 bp, Homo sapiens
taatgttcattttgaaaa

SEQ ID NO: 4465943 - DNA, 22 bp, Homo sapiens
taatgtttattaaatgcttcat

SEQ ID NO: 4465944 - DNA, 12 bp, Homo sapiens
taatgtttctga

SEQ ID NO: 4465945 - DNA, 13 bp, Homo sapiens
taatgtttctgat

SEQ ID NO: 4465946 - DNA, 17 bp, Homo sapiens
taatgttttaaatgtac

SEQ ID NO: 4465947 - DNA, 19 bp, Homo sapiens
taatgttttctttgcaaag

SEQ ID NO: 4465948 - DNA, 15 bp, Homo sapiens
taatgtttttaaaaa

SEQ ID NO: 4465949 - DNA, 13 bp, Homo sapiens
taattaaaaactt

SEQ ID NO: 4465950 - DNA, 14 bp, Homo sapiens
taattaaaaacttt

SEQ ID NO: 4465951 - DNA, 20 bp, Homo sapiens
taattaaaagaatattttaa

SEQ ID NO: 4465952 - DNA, 19 bp, Homo sapiens
taattaaaagcaaatcatt

SEQ ID NO: 4465953 - DNA, 17 bp, Homo sapiens
taattaaactagtttaa

SEQ ID NO: 4465954 - DNA, 17 bp, Homo sapiens
taattaaagactcaaga

SEQ ID NO: 4465955 - DNA, 17 bp, Homo sapiens
taattaaggtacatcat

SEQ ID NO: 4465956 - DNA, 18 bp, Homo sapiens
taattaaggtacatcatt

SEQ ID NO: 4465957 - DNA, 17 bp, Homo sapiens
taattaccaacctgtta

SEQ ID NO: 4465958 - DNA, 21 bp, Homo sapiens
taattactggaattcttctgc

SEQ ID NO: 4465959 - DNA, 17 bp, Homo sapiens
taattagatccattaat

SEQ ID NO: 4465960 - DNA, 23 bp, Homo sapiens
taattagatccattaatttaaat

SEQ ID NO: 4465961 - DNA, 16 bp, Homo sapiens
taattagcttgttaca

SEQ ID NO: 4465962 - DNA, 19 bp, Homo sapiens
taattaggaattactttat

SEQ ID NO: 4465963 - DNA, 21 bp, Homo sapiens
taattaggaattactttatta

SEQ ID NO: 4465964 - DNA, 23 bp, Homo sapiens
taattaggaattactttattata

SEQ ID NO: 4465965 - DNA, 22 bp, Homo sapiens
taattaggcagcctgctataaa

SEQ ID NO: 4465966 - DNA, 19 bp, Homo sapiens
taattagtgccacttaatg

SEQ ID NO: 4465967 - DNA, 14 bp, Homo sapiens
taattatataactg

SEQ ID NO: 4465968 - DNA, 20 bp, Homo sapiens
taattatataactgtatttg

SEQ ID NO: 4465969 - DNA, 20 bp, Homo sapiens
taattatcagttggtttgga

SEQ ID NO: 4465970 - DNA, 16 bp, Homo sapiens
taattatttctaacac

SEQ ID NO: 4465971 - DNA, 19 bp, Homo sapiens
taattcaagcctctaaaca

SEQ ID NO: 4465972 - DNA, 18 bp, Homo sapiens
taattcaaggaatttctt

SEQ ID NO: 4465973 - DNA, 18 bp, Homo sapiens
taattcatatctaaatag

SEQ ID NO: 4465974 - DNA, 16 bp, Homo sapiens
taattcccaacatttc

SEQ ID NO: 4465975 - DNA, 18 bp, Homo sapiens
taattctcattaaaagaa

SEQ ID NO: 4465976 - DNA, 12 bp, Homo sapiens
taattctgaaac

SEQ ID NO: 4465977 - DNA, 15 bp, Homo sapiens
taattcttaaaacta

SEQ ID NO: 4465978 - DNA, 13 bp, Homo sapiens
taattctttcaac

SEQ ID NO: 4465979 - DNA, 21 bp, Homo sapiens
taattgatcagatgctgaatt

SEQ ID NO: 4465980 - DNA, 15 bp, Homo sapiens
taattgcacttttta

SEQ ID NO: 4465981 - DNA, 14 bp, Homo sapiens
taattgcatgaaaa

SEQ ID NO: 4465982 - DNA, 20 bp, Homo sapiens
taattgcatttaaaaatata

SEQ ID NO: 4465983 - DNA, 17 bp, Homo sapiens
taattgctttgccaaaa

SEQ ID NO: 4465984 - DNA, 12 bp, Homo sapiens
taattgtaaact

SEQ ID NO: 4465985 - DNA, 20 bp, Homo sapiens
taattgtactgtgtttttaa

SEQ ID NO: 4465986 - DNA, 12 bp, Homo sapiens
taattgtcatta

SEQ ID NO: 4465987 - DNA, 21 bp, Homo sapiens
taattgtgaaaaagttaaaca

SEQ ID NO: 4465988 - DNA, 21 bp, Homo sapiens
taattgtgcaaaggataaatt

SEQ ID NO: 4465989 - DNA, 20 bp, Homo sapiens
taattgtgtggattctttaa

SEQ ID NO: 4465990 - DNA, 18 bp, Homo sapiens
taattgtgtttatttttt

SEQ ID NO: 4465991 - DNA, 19 bp, Homo sapiens
taatttaaaattgtgatgt

SEQ ID NO: 4465992 - DNA, 12 bp, Homo sapiens
taatttaacacc

SEQ ID NO: 4465993 - DNA, 21 bp, Homo sapiens
taatttaatgtaaataaaaca

SEQ ID NO: 4465994 - DNA, 14 bp, Homo sapiens
taatttacttaagt

SEQ ID NO: 4465995 - DNA, 22 bp, Homo sapiens
taatttacttaagtgttcattt

SEQ ID NO: 4465996 - DNA, 22 bp, Homo sapiens
taatttactttggaatgttgaa

SEQ ID NO: 4465997 - DNA, 15 bp, Homo sapiens
taatttagaagatat

SEQ ID NO: 4465998 - DNA, 21 bp, Homo sapiens
taatttagaagatattatttg

SEQ ID NO: 4465999 - DNA, 21 bp, Homo sapiens
taatttagacttcaagcatgg

SEQ ID NO: 4466000 - DNA, 22 bp, Homo sapiens
taatttagagataggaaactga

SEQ ID NO: 4466001 - DNA, 24 bp, Homo sapiens
taatttagtaaataaacaagtcaa

SEQ ID NO: 4466002 - DNA, 16 bp, Homo sapiens
taatttagtaaatgtt

SEQ ID NO: 4466003 - DNA, 16 bp, Homo sapiens
taatttagtggattaa

SEQ ID NO: 4466004 - DNA, 19 bp, Homo sapiens
taatttagttgtttctaga

SEQ ID NO: 4466005 - DNA, 13 bp, Homo sapiens
taatttataaaaa

SEQ ID NO: 4466006 - DNA, 16 bp, Homo sapiens
taatttataatgtatt

SEQ ID NO: 4466007 - DNA, 20 bp, Homo sapiens
taatttatactttaaagtat

SEQ ID NO: 4466008 - DNA, 18 bp, Homo sapiens
taatttatagtttataca

SEQ ID NO: 4466009 - DNA, 23 bp, Homo sapiens
taatttatatagatgtcagcaat

SEQ ID NO: 4466010 - DNA, 13 bp, Homo sapiens
taatttatgtgct

SEQ ID NO: 4466011 - DNA, 19 bp, Homo sapiens
taatttattgtctgtctac

SEQ ID NO: 4466012 - DNA, 20 bp, Homo sapiens
taatttatttaatatttaat

SEQ ID NO: 4466013 - DNA, 13 bp, Homo sapiens
taatttatttcaa

SEQ ID NO: 4466014 - DNA, 19 bp, Homo sapiens
taatttatttccactaaaa

SEQ ID NO: 4466015 - DNA, 16 bp, Homo sapiens
taatttcaaaatgctt

SEQ ID NO: 4466016 - DNA, 15 bp, Homo sapiens
taatttcaaatctgt

SEQ ID NO: 4466017 - DNA, 12 bp, Homo sapiens
taatttcaggaa

SEQ ID NO: 4466018 - DNA, 13 bp, Homo sapiens
taatttcaggaaa

SEQ ID NO: 4466019 - DNA, 14 bp, Homo sapiens
taatttcaggaaaa

SEQ ID NO: 4466020 - DNA, 15 bp, Homo sapiens
taatttcagtgtaaa

SEQ ID NO: 4466021 - DNA, 12 bp, Homo sapiens
taatttcatttt

SEQ ID NO: 4466022 - DNA, 20 bp, Homo sapiens
taatttcattttagtatttt

SEQ ID NO: 4466023 - DNA, 13 bp, Homo sapiens
taatttccttttt

SEQ ID NO: 4466024 - DNA, 17 bp, Homo sapiens
taatttcctttttgaca

SEQ ID NO: 4466025 - DNA, 19 bp, Homo sapiens
taatttcctttttgacact

SEQ ID NO: 4466026 - DNA, 20 bp, Homo sapiens
taatttcctttttgacactg

SEQ ID NO: 4466027 - DNA, 22 bp, Homo sapiens
taatttcctttttgacactgaa

SEQ ID NO: 4466028 - DNA, 13 bp, Homo sapiens
taatttcgcctta

SEQ ID NO: 4466029 - DNA, 18 bp, Homo sapiens
taatttcgccttaaactc

SEQ ID NO: 4466030 - DNA, 13 bp, Homo sapiens
taatttctcctcc

SEQ ID NO: 4466031 - DNA, 18 bp, Homo sapiens
taatttctgccatttcat

SEQ ID NO: 4466032 - DNA, 19 bp, Homo sapiens
taatttctgccatttcatg

SEQ ID NO: 4466033 - DNA, 13 bp, Homo sapiens
taatttgaagatt

SEQ ID NO: 4466034 - DNA, 14 bp, Homo sapiens
taatttgaagattg

SEQ ID NO: 4466035 - DNA, 12 bp, Homo sapiens
taatttgcatta

SEQ ID NO: 4466036 - DNA, 16 bp, Homo sapiens
taatttgcattaaatt

SEQ ID NO: 4466037 - DNA, 17 bp, Homo sapiens
taatttggggaaaatga

SEQ ID NO: 4466038 - DNA, 12 bp, Homo sapiens
taatttgtaaag

SEQ ID NO: 4466039 - DNA, 16 bp, Homo sapiens
taatttgtaaagttgg

SEQ ID NO: 4466040 - DNA, 17 bp, Homo sapiens
taatttgtcttagttga

SEQ ID NO: 4466041 - DNA, 21 bp, Homo sapiens
taatttgttggggctttacat

SEQ ID NO: 4466042 - DNA, 17 bp, Homo sapiens
taatttgttttggatat

SEQ ID NO: 4466043 - DNA, 13 bp, Homo sapiens
taattttaaattc

SEQ ID NO: 4466044 - DNA, 15 bp, Homo sapiens
taattttaactgatt

SEQ ID NO: 4466045 - DNA, 20 bp, Homo sapiens
taattttacgacctgtctgt

SEQ ID NO: 4466046 - DNA, 17 bp, Homo sapiens
taattttactcactcac

SEQ ID NO: 4466047 - DNA, 13 bp, Homo sapiens
taattttcccaat

SEQ ID NO: 4466048 - DNA, 13 bp, Homo sapiens
taattttgcaaat

SEQ ID NO: 4466049 - DNA, 20 bp, Homo sapiens
taatttttgatactaagcat

SEQ ID NO: 4466050 - DNA, 15 bp, Homo sapiens
taatttttgctttta

SEQ ID NO: 4466051 - DNA, 18 bp, Homo sapiens
taatttttgcttttagaa

SEQ ID NO: 4466052 - DNA, 17 bp, Homo sapiens
taatttttgtattattt

SEQ ID NO: 4466053 - DNA, 21 bp, Homo sapiens
taatttttgtattatttttgt

SEQ ID NO: 4466054 - DNA, 18 bp, Homo sapiens
taattttttggtacaaaa

SEQ ID NO: 4466055 - DNA, 14 bp, Homo sapiens
taatttttttcaca

SEQ ID NO: 4466056 - DNA, 13 bp, Homo sapiens
taattttttttaa

SEQ ID NO: 4466057 - DNA, 20 bp, Homo sapiens
taattttttttaaaatagaa

SEQ ID NO: 4466058 - DNA, 23 bp, Homo sapiens
tacaaaaaatgcagaacttaatc

SEQ ID NO: 4466059 - DNA, 14 bp, Homo sapiens
tacaaaaacacagc

SEQ ID NO: 4466060 - DNA, 15 bp, Homo sapiens
tacaaaaacacagca

SEQ ID NO: 4466061 - DNA, 17 bp, Homo sapiens
tacaaaaacacagcaag

SEQ ID NO: 4466062 - DNA, 15 bp, Homo sapiens
tacaaaaataaattt

SEQ ID NO: 4466063 - DNA, 14 bp, Homo sapiens
tacaaaatacacat

SEQ ID NO: 4466064 - DNA, 13 bp, Homo sapiens
tacaaaatattta

SEQ ID NO: 4466065 - DNA, 20 bp, Homo sapiens
tacaaaatatttaagtgaag

SEQ ID NO: 4466066 - DNA, 18 bp, Homo sapiens
tacaaacaaaatttctat

SEQ ID NO: 4466067 - DNA, 15 bp, Homo sapiens
tacaaacaatctctt

SEQ ID NO: 4466068 - DNA, 16 bp, Homo sapiens
tacaaacagtatttct

SEQ ID NO: 4466069 - DNA, 13 bp, Homo sapiens
tacaaacttttaa

SEQ ID NO: 4466070 - DNA, 16 bp, Homo sapiens
tacaaacttttaagat

SEQ ID NO: 4466071 - DNA, 18 bp, Homo sapiens
tacaaacttttaagattt

SEQ ID NO: 4466072 - DNA, 22 bp, Homo sapiens
tacaaagaaaaattaattagga

SEQ ID NO: 4466073 - DNA, 19 bp, Homo sapiens
tacaaagagatgcttggag

SEQ ID NO: 4466074 - DNA, 13 bp, Homo sapiens
tacaaagatgact

SEQ ID NO: 4466075 - DNA, 18 bp, Homo sapiens
tacaaagcactagagaat

SEQ ID NO: 4466076 - DNA, 23 bp, Homo sapiens
tacaaagcactagagaatgcaca

SEQ ID NO: 4466077 - DNA, 23 bp, Homo sapiens
tacaaaggcatgttttaaaatct

SEQ ID NO: 4466078 - DNA, 15 bp, Homo sapiens
tacaaagtggaaact

SEQ ID NO: 4466079 - DNA, 20 bp, Homo sapiens
tacaaatcagaagtcatctt

SEQ ID NO: 4466080 - DNA, 21 bp, Homo sapiens
tacaaatcagaagtcatcttg

SEQ ID NO: 4466081 - DNA, 21 bp, Homo sapiens
tacaaatcctctgttttctct

SEQ ID NO: 4466082 - DNA, 18 bp, Homo sapiens
tacaaatgtggctgtaaa

SEQ ID NO: 4466083 - DNA, 16 bp, Homo sapiens
tacaaatttggcctta

SEQ ID NO: 4466084 - DNA, 22 bp, Homo sapiens
tacaaatttggccttaagaact

SEQ ID NO: 4466085 - DNA, 20 bp, Homo sapiens
tacaaattttttaatttcca

SEQ ID NO: 4466086 - DNA, 21 bp, Homo sapiens
tacaacagaaaccagaaaagc

SEQ ID NO: 4466087 - DNA, 17 bp, Homo sapiens
tacaacattcaacttta

SEQ ID NO: 4466088 - DNA, 12 bp, Homo sapiens
tacaaccttcat

SEQ ID NO: 4466089 - DNA, 20 bp, Homo sapiens
tacaactaaataacacagat

SEQ ID NO: 4466090 - DNA, 20 bp, Homo sapiens
tacaactaacgcaaccaagt

SEQ ID NO: 4466091 - DNA, 17 bp, Homo sapiens
tacaactcattccagat

SEQ ID NO: 4466092 - DNA, 14 bp, Homo sapiens
tacaactgtattta

SEQ ID NO: 4466093 - DNA, 17 bp, Homo sapiens
tacaactgtatttatta

SEQ ID NO: 4466094 - DNA, 18 bp, Homo sapiens
tacaacttgtatttccaa

SEQ ID NO: 4466095 - DNA, 24 bp, Homo sapiens
tacaagatgaaggagaggcaacat

SEQ ID NO: 4466096 - DNA, 17 bp, Homo sapiens
tacaagcagttaatcac

SEQ ID NO: 4466097 - DNA, 23 bp, Homo sapiens
tacaagccaaaagtccctccctg

SEQ ID NO: 4466098 - DNA, 22 bp, Homo sapiens
tacaaggtaggctgcaaaatta

SEQ ID NO: 4466099 - DNA, 20 bp, Homo sapiens
tacaagtataacagttttga

SEQ ID NO: 4466100 - DNA, 18 bp, Homo sapiens
tacaataaaacaaataaa

SEQ ID NO: 4466101 - DNA, 13 bp, Homo sapiens
tacaataaaagta

SEQ ID NO: 4466102 - DNA, 17 bp, Homo sapiens
tacaatagtatacattt

SEQ ID NO: 4466103 - DNA, 19 bp, Homo sapiens
tacaatagtatacatttta

SEQ ID NO: 4466104 - DNA, 17 bp, Homo sapiens
tacaatgcacttttatg

SEQ ID NO: 4466105 - DNA, 19 bp, Homo sapiens
tacaatgcacttttatgaa

SEQ ID NO: 4466106 - DNA, 23 bp, Homo sapiens
tacaatgcacttttatgaagttt

SEQ ID NO: 4466107 - DNA, 17 bp, Homo sapiens
tacaatgtacaattatg

SEQ ID NO: 4466108 - DNA, 13 bp, Homo sapiens
tacaatgtatctt

SEQ ID NO: 4466109 - DNA, 17 bp, Homo sapiens
tacaatgtatctttatt

SEQ ID NO: 4466110 - DNA, 12 bp, Homo sapiens
tacaatgtatgt

SEQ ID NO: 4466111 - DNA, 19 bp, Homo sapiens
tacaatgtgtttttctcca

SEQ ID NO: 4466112 - DNA, 20 bp, Homo sapiens
tacaatgtgtttttctccag

SEQ ID NO: 4466113 - DNA, 17 bp, Homo sapiens
tacaattatgtctcttg

SEQ ID NO: 4466114 - DNA, 18 bp, Homo sapiens
tacaattatgtctcttga

SEQ ID NO: 4466115 - DNA, 21 bp, Homo sapiens
tacaattcattgtgttacctg

SEQ ID NO: 4466116 - DNA, 18 bp, Homo sapiens
tacaatttgtttttgcat

SEQ ID NO: 4466117 - DNA, 17 bp, Homo sapiens
tacaattttaaagttct

SEQ ID NO: 4466118 - DNA, 15 bp, Homo sapiens
tacacaataagcaaa

SEQ ID NO: 4466119 - DNA, 15 bp, Homo sapiens
tacacaatacagtat

SEQ ID NO: 4466120 - DNA, 16 bp, Homo sapiens
tacacacggtgccttt

SEQ ID NO: 4466121 - DNA, 16 bp, Homo sapiens
tacacactcagccaca

SEQ ID NO: 4466122 - DNA, 18 bp, Homo sapiens
tacacagtgagactgtac

SEQ ID NO: 4466123 - DNA, 20 bp, Homo sapiens
tacacagtgagactgtacat

SEQ ID NO: 4466124 - DNA, 19 bp, Homo sapiens
tacacagtgggaagatttt

SEQ ID NO: 4466125 - DNA, 17 bp, Homo sapiens
tacacagttaaataaat

SEQ ID NO: 4466126 - DNA, 13 bp, Homo sapiens
tacacatcttaaa

SEQ ID NO: 4466127 - DNA, 11 bp, Homo sapiens
tacacatgtgt

SEQ ID NO: 4466128 - DNA, 13 bp, Homo sapiens
tacacatgtgtta

SEQ ID NO: 4466129 - DNA, 19 bp, Homo sapiens
tacacatgtgttatctacc

SEQ ID NO: 4466130 - DNA, 23 bp, Homo sapiens
tacacatgtgttatctacctcaa

SEQ ID NO: 4466131 - DNA, 13 bp, Homo sapiens
tacacatttcact

SEQ ID NO: 4466132 - DNA, 17 bp, Homo sapiens
tacaccaatgaaaacat

SEQ ID NO: 4466133 - DNA, 14 bp, Homo sapiens
tacaccagaagaca

SEQ ID NO: 4466134 - DNA, 19 bp, Homo sapiens
tacaccatgtttgagctca

SEQ ID NO: 4466135 - DNA, 21 bp, Homo sapiens
tacacccaaggattctgttct

SEQ ID NO: 4466136 - DNA, 12 bp, Homo sapiens
tacacctccccc

SEQ ID NO: 4466137 - DNA, 18 bp, Homo sapiens
tacacctccccctgcgcc

SEQ ID NO: 4466138 - DNA, 19 bp, Homo sapiens
tacacctccccctgcgccc

SEQ ID NO: 4466139 - DNA, 13 bp, Homo sapiens
tacacctccctcc

SEQ ID NO: 4466140 - DNA, 13 bp, Homo sapiens
tacacctggctga

SEQ ID NO: 4466141 - DNA, 23 bp, Homo sapiens
tacacctggctgaggttcctctg

SEQ ID NO: 4466142 - DNA, 21 bp, Homo sapiens
tacacgtatttgaatggcctt

SEQ ID NO: 4466143 - DNA, 15 bp, Homo sapiens
tacacgtttatctta

SEQ ID NO: 4466144 - DNA, 12 bp, Homo sapiens
tacactacgcac

SEQ ID NO: 4466145 - DNA, 18 bp, Homo sapiens
tacactaggaaacgtgtt

SEQ ID NO: 4466146 - DNA, 14 bp, Homo sapiens
tacactagttgttt

SEQ ID NO: 4466147 - DNA, 14 bp, Homo sapiens
tacactccagtgag

SEQ ID NO: 4466148 - DNA, 17 bp, Homo sapiens
tacactctcctgggccc

SEQ ID NO: 4466149 - DNA, 13 bp, Homo sapiens
tacactctgctgt

SEQ ID NO: 4466150 - DNA, 13 bp, Homo sapiens
tacactgcacttt

SEQ ID NO: 4466151 - DNA, 17 bp, Homo sapiens
tacactgttagaacact

SEQ ID NO: 4466152 - DNA, 21 bp, Homo sapiens
tacactgttagaacactattt

SEQ ID NO: 4466153 - DNA, 13 bp, Homo sapiens
tacactttgttgc

SEQ ID NO: 4466154 - DNA, 15 bp, Homo sapiens
tacactttgttgcaa

SEQ ID NO: 4466155 - DNA, 18 bp, Homo sapiens
tacactttgttgcaagat

SEQ ID NO: 4466156 - DNA, 15 bp, Homo sapiens
tacactttttacagc

SEQ ID NO: 4466157 - DNA, 13 bp, Homo sapiens
tacagaaagctgc

SEQ ID NO: 4466158 - DNA, 17 bp, Homo sapiens
tacagaaccaaatcgtg

SEQ ID NO: 4466159 - DNA, 17 bp, Homo sapiens
tacagaatattaaatat

SEQ ID NO: 4466160 - DNA, 18 bp, Homo sapiens
tacagaatcttgttttga

SEQ ID NO: 4466161 - DNA, 20 bp, Homo sapiens
tacagaattggatacagtac

SEQ ID NO: 4466162 - DNA, 16 bp, Homo sapiens
tacagaatttgaatta

SEQ ID NO: 4466163 - DNA, 17 bp, Homo sapiens
tacagaatttgaattat

SEQ ID NO: 4466164 - DNA, 13 bp, Homo sapiens
tacagacatattt

SEQ ID NO: 4466165 - DNA, 18 bp, Homo sapiens
tacagacatatttaactg

SEQ ID NO: 4466166 - DNA, 19 bp, Homo sapiens
tacagacatatttaactgg

SEQ ID NO: 4466167 - DNA, 19 bp, Homo sapiens
tacagactccatctcttct

SEQ ID NO: 4466168 - DNA, 20 bp, Homo sapiens
tacagactccatctcttctg

SEQ ID NO: 4466169 - DNA, 17 bp, Homo sapiens
tacagagacagaaagca

SEQ ID NO: 4466170 - DNA, 21 bp, Homo sapiens
tacagagaggatacatttaat

SEQ ID NO: 4466171 - DNA, 18 bp, Homo sapiens
tacagaggaagctgttgg

SEQ ID NO: 4466172 - DNA, 15 bp, Homo sapiens
tacagataacttctt

SEQ ID NO: 4466173 - DNA, 22 bp, Homo sapiens
tacagatccccagcccctcctc

SEQ ID NO: 4466174 - DNA, 23 bp, Homo sapiens
tacagcactactgggtgtcattt

SEQ ID NO: 4466175 - DNA, 20 bp, Homo sapiens
tacagcagcaatattttgta

SEQ ID NO: 4466176 - DNA, 13 bp, Homo sapiens
tacagcctggacc

SEQ ID NO: 4466177 - DNA, 14 bp, Homo sapiens
tacagctactttaa

SEQ ID NO: 4466178 - DNA, 17 bp, Homo sapiens
tacagctatatttgatt

SEQ ID NO: 4466179 - DNA, 13 bp, Homo sapiens
tacagctcagtaa

SEQ ID NO: 4466180 - DNA, 21 bp, Homo sapiens
tacagctcattaaactttttt

SEQ ID NO: 4466181 - DNA, 13 bp, Homo sapiens
tacagctccacac

SEQ ID NO: 4466182 - DNA, 20 bp, Homo sapiens
tacagctcctttgaaaactc

SEQ ID NO: 4466183 - DNA, 11 bp, Homo sapiens
tacagctgagt

SEQ ID NO: 4466184 - DNA, 23 bp, Homo sapiens
tacagctgcctttcgtgatctta

SEQ ID NO: 4466185 - DNA, 15 bp, Homo sapiens
tacaggaatgaagaa

SEQ ID NO: 4466186 - DNA, 16 bp, Homo sapiens
tacaggaatgaagaac

SEQ ID NO: 4466187 - DNA, 14 bp, Homo sapiens
tacaggcagtctct

SEQ ID NO: 4466188 - DNA, 16 bp, Homo sapiens
tacagggaggctcccg

SEQ ID NO: 4466189 - DNA, 22 bp, Homo sapiens
tacagggccaaacgctgagcca

SEQ ID NO: 4466190 - DNA, 20 bp, Homo sapiens
tacaggggaggggcgcaccc

SEQ ID NO: 4466191 - DNA, 22 bp, Homo sapiens
tacagggtagcaggtaccactg

SEQ ID NO: 4466192 - DNA, 13 bp, Homo sapiens
tacagggtgactc

SEQ ID NO: 4466193 - DNA, 14 bp, Homo sapiens
tacagggtgactca

SEQ ID NO: 4466194 - DNA, 21 bp, Homo sapiens
tacagtaaatgttacttctga

SEQ ID NO: 4466195 - DNA, 14 bp, Homo sapiens
tacagtaatgaaat

SEQ ID NO: 4466196 - DNA, 17 bp, Homo sapiens
tacagtatataagcttt

SEQ ID NO: 4466197 - DNA, 15 bp, Homo sapiens
tacagtctaaagctg

SEQ ID NO: 4466198 - DNA, 13 bp, Homo sapiens
tacagtctgtcat

SEQ ID NO: 4466199 - DNA, 14 bp, Homo sapiens
tacagtctgtcatg

SEQ ID NO: 4466200 - DNA, 14 bp, Homo sapiens
tacagtcttccaca

SEQ ID NO: 4466201 - DNA, 13 bp, Homo sapiens
tacagtcttgtat

SEQ ID NO: 4466202 - DNA, 16 bp, Homo sapiens
tacagtgattcatgta

SEQ ID NO: 4466203 - DNA, 21 bp, Homo sapiens
tacagtggttttatactgaag

SEQ ID NO: 4466204 - DNA, 15 bp, Homo sapiens
tacagtgtacagtct

SEQ ID NO: 4466205 - DNA, 18 bp, Homo sapiens
tacagtgttaaaagaaaa

SEQ ID NO: 4466206 - DNA, 16 bp, Homo sapiens
tacagttacagttgat

SEQ ID NO: 4466207 - DNA, 14 bp, Homo sapiens
tacagttataaaat

SEQ ID NO: 4466208 - DNA, 13 bp, Homo sapiens
tacagttctgctc

SEQ ID NO: 4466209 - DNA, 19 bp, Homo sapiens
tacagttgaaaacttgtaa

SEQ ID NO: 4466210 - DNA, 13 bp, Homo sapiens
tacagtttgactt

SEQ ID NO: 4466211 - DNA, 17 bp, Homo sapiens
tacagtttgactttttg

SEQ ID NO: 4466212 - DNA, 14 bp, Homo sapiens
tacagttttaaaga

SEQ ID NO: 4466213 - DNA, 15 bp, Homo sapiens
tacagttttaactgt

SEQ ID NO: 4466214 - DNA, 13 bp, Homo sapiens
tacagttttcatt

SEQ ID NO: 4466215 - DNA, 15 bp, Homo sapiens
tacagttttgagtaa

SEQ ID NO: 4466216 - DNA, 15 bp, Homo sapiens
tacataactcctgtc

SEQ ID NO: 4466217 - DNA, 20 bp, Homo sapiens
tacataactcctgtcccttt

SEQ ID NO: 4466218 - DNA, 15 bp, Homo sapiens
tacataactgaaaat

SEQ ID NO: 4466219 - DNA, 22 bp, Homo sapiens
tacataagagaaagaggccaga

SEQ ID NO: 4466220 - DNA, 16 bp, Homo sapiens
tacataaggatgactt

SEQ ID NO: 4466221 - DNA, 18 bp, Homo sapiens
tacataattgcatgaaaa

SEQ ID NO: 4466222 - DNA, 13 bp, Homo sapiens
tacatacactgta

SEQ ID NO: 4466223 - DNA, 21 bp, Homo sapiens
tacatacagaggtaactatca

SEQ ID NO: 4466224 - DNA, 15 bp, Homo sapiens
tacatactaatgaag

SEQ ID NO: 4466225 - DNA, 15 bp, Homo sapiens
tacatactgcatctt

SEQ ID NO: 4466226 - DNA, 23 bp, Homo sapiens
tacatactttatcaatgtgtctt

SEQ ID NO: 4466227 - DNA, 23 bp, Homo sapiens
tacatactttcatcctgactctg

SEQ ID NO: 4466228 - DNA, 18 bp, Homo sapiens
tacatagagatctatttt

SEQ ID NO: 4466229 - DNA, 13 bp, Homo sapiens
tacatagtctttg

SEQ ID NO: 4466230 - DNA, 14 bp, Homo sapiens
tacatagtctttgt

SEQ ID NO: 4466231 - DNA, 19 bp, Homo sapiens
tacatagtctttgtttaca

SEQ ID NO: 4466232 - DNA, 20 bp, Homo sapiens
tacatagtctttgtttacat

SEQ ID NO: 4466233 - DNA, 23 bp, Homo sapiens
tacatagttttcttcctttgaaa

SEQ ID NO: 4466234 - DNA, 23 bp, Homo sapiens
tacatatataaaactaaggcttt

SEQ ID NO: 4466235 - DNA, 14 bp, Homo sapiens
tacatatcaaatag

SEQ ID NO: 4466236 - DNA, 15 bp, Homo sapiens
tacatattgtatata

SEQ ID NO: 4466237 - DNA, 13 bp, Homo sapiens
tacatcaattaat

SEQ ID NO: 4466238 - DNA, 21 bp, Homo sapiens
tacatcacatcttatttattt

SEQ ID NO: 4466239 - DNA, 22 bp, Homo sapiens
tacatcagtatagtgttttatt

SEQ ID NO: 4466240 - DNA, 13 bp, Homo sapiens
tacatcagtttgt

SEQ ID NO: 4466241 - DNA, 16 bp, Homo sapiens
tacatcagtttgttcc

SEQ ID NO: 4466242 - DNA, 15 bp, Homo sapiens
tacatcattattgta

SEQ ID NO: 4466243 - DNA, 16 bp, Homo sapiens
tacatcattattgtag

SEQ ID NO: 4466244 - DNA, 19 bp, Homo sapiens
tacatcattattgtagttt

SEQ ID NO: 4466245 - DNA, 20 bp, Homo sapiens
tacatcattattgtagtttg

SEQ ID NO: 4466246 - DNA, 22 bp, Homo sapiens
tacatccgtaggacaagtttta

SEQ ID NO: 4466247 - DNA, 12 bp, Homo sapiens
tacatctgcctt

SEQ ID NO: 4466248 - DNA, 18 bp, Homo sapiens
tacatgagaacaaacaga

SEQ ID NO: 4466249 - DNA, 22 bp, Homo sapiens
tacatgaggtactgagagtgaa

SEQ ID NO: 4466250 - DNA, 16 bp, Homo sapiens
tacatgagttcaaata

SEQ ID NO: 4466251 - DNA, 15 bp, Homo sapiens
tacatgataagacat

SEQ ID NO: 4466252 - DNA, 16 bp, Homo sapiens
tacatgataagacatt

SEQ ID NO: 4466253 - DNA, 21 bp, Homo sapiens
tacatgataagacattttgtt

SEQ ID NO: 4466254 - DNA, 15 bp, Homo sapiens
tacatgatacatttt

SEQ ID NO: 4466255 - DNA, 16 bp, Homo sapiens
tacatgatacattttt

SEQ ID NO: 4466256 - DNA, 17 bp, Homo sapiens
tacatgatacattttta

SEQ ID NO: 4466257 - DNA, 17 bp, Homo sapiens
tacatgatttaaagact

SEQ ID NO: 4466258 - DNA, 17 bp, Homo sapiens
tacatgcaacagaagtg

SEQ ID NO: 4466259 - DNA, 15 bp, Homo sapiens
tacatgcacagtcat

SEQ ID NO: 4466260 - DNA, 22 bp, Homo sapiens
tacatgcattgagctctctcat

SEQ ID NO: 4466261 - DNA, 19 bp, Homo sapiens
tacatgctaagagaagtag

SEQ ID NO: 4466262 - DNA, 15 bp, Homo sapiens
tacatggtgtttgtg

SEQ ID NO: 4466263 - DNA, 14 bp, Homo sapiens
tacatgtaatttga

SEQ ID NO: 4466264 - DNA, 17 bp, Homo sapiens
tacatgtttataaatct

SEQ ID NO: 4466265 - DNA, 20 bp, Homo sapiens
tacatgttttttcatttgta

SEQ ID NO: 4466266 - DNA, 21 bp, Homo sapiens
tacatgttttttcatttgtaa

SEQ ID NO: 4466267 - DNA, 21 bp, Homo sapiens
tacattaaactcaaatgtaat

SEQ ID NO: 4466268 - DNA, 19 bp, Homo sapiens
tacattaacggtgctaaaa

SEQ ID NO: 4466269 - DNA, 15 bp, Homo sapiens
tacattaaggagcag

SEQ ID NO: 4466270 - DNA, 22 bp, Homo sapiens
tacattaattattattgctgtt

SEQ ID NO: 4466271 - DNA, 13 bp, Homo sapiens
tacattacagatt

SEQ ID NO: 4466272 - DNA, 18 bp, Homo sapiens
tacattagtatcccacta

SEQ ID NO: 4466273 - DNA, 19 bp, Homo sapiens
tacattattaaacgatttc

SEQ ID NO: 4466274 - DNA, 14 bp, Homo sapiens
tacattattgctta

SEQ ID NO: 4466275 - DNA, 19 bp, Homo sapiens
tacattcttccatcatcac

SEQ ID NO: 4466276 - DNA, 19 bp, Homo sapiens
tacattcttggttgttaat

SEQ ID NO: 4466277 - DNA, 22 bp, Homo sapiens
tacattgccgtggcatcttaaa

SEQ ID NO: 4466278 - DNA, 16 bp, Homo sapiens
tacattggttttgaaa

SEQ ID NO: 4466279 - DNA, 17 bp, Homo sapiens
tacattggttttgaaat

SEQ ID NO: 4466280 - DNA, 20 bp, Homo sapiens
tacattggttttgaaatgtt

SEQ ID NO: 4466281 - DNA, 13 bp, Homo sapiens
tacattgttgagc

SEQ ID NO: 4466282 - DNA, 23 bp, Homo sapiens
tacattgttgagctattgctgtt

SEQ ID NO: 4466283 - DNA, 11 bp, Homo sapiens
tacatttaata

SEQ ID NO: 4466284 - DNA, 17 bp, Homo sapiens
tacatttaataaaactg

SEQ ID NO: 4466285 - DNA, 17 bp, Homo sapiens
tacatttaataatatca

SEQ ID NO: 4466286 - DNA, 19 bp, Homo sapiens
tacatttaataatatcaaa

SEQ ID NO: 4466287 - DNA, 15 bp, Homo sapiens
tacatttcatacaac

SEQ ID NO: 4466288 - DNA, 15 bp, Homo sapiens
tacatttcttttaaa

SEQ ID NO: 4466289 - DNA, 21 bp, Homo sapiens
tacatttgggagtttttatga

SEQ ID NO: 4466290 - DNA, 22 bp, Homo sapiens
tacatttgtggtcacatgcttt

SEQ ID NO: 4466291 - DNA, 23 bp, Homo sapiens
tacattttattaagctttttgga

SEQ ID NO: 4466292 - DNA, 14 bp, Homo sapiens
tacattttattctg

SEQ ID NO: 4466293 - DNA, 14 bp, Homo sapiens
tacattttgtaaaa

SEQ ID NO: 4466294 - DNA, 15 bp, Homo sapiens
tacattttgtaaaat

SEQ ID NO: 4466295 - DNA, 19 bp, Homo sapiens
tacatttttatttttggtt

SEQ ID NO: 4466296 - DNA, 16 bp, Homo sapiens
tacatttttcaacttt

SEQ ID NO: 4466297 - DNA, 19 bp, Homo sapiens
tacatttttcaactttgaa

SEQ ID NO: 4466298 - DNA, 13 bp, Homo sapiens
tacatttttcagc

SEQ ID NO: 4466299 - DNA, 16 bp, Homo sapiens
taccaaaaaaaggaag

SEQ ID NO: 4466300 - DNA, 15 bp, Homo sapiens
taccaaaaaccatgt

SEQ ID NO: 4466301 - DNA, 22 bp, Homo sapiens
taccaaaaaccatgttgcgttc

SEQ ID NO: 4466302 - DNA, 15 bp, Homo sapiens
taccaaaaataaata

SEQ ID NO: 4466303 - DNA, 22 bp, Homo sapiens
taccaaaggaatttgcatccag

SEQ ID NO: 4466304 - DNA, 14 bp, Homo sapiens
taccaaatctcagt

SEQ ID NO: 4466305 - DNA, 13 bp, Homo sapiens
taccaaatgaaat

SEQ ID NO: 4466306 - DNA, 18 bp, Homo sapiens
taccaaatgaaatgccaa

SEQ ID NO: 4466307 - DNA, 19 bp, Homo sapiens
taccaaatgaaatgccaaa

SEQ ID NO: 4466308 - DNA, 16 bp, Homo sapiens
taccaacacgagcagg

SEQ ID NO: 4466309 - DNA, 12 bp, Homo sapiens
taccaacctgtt

SEQ ID NO: 4466310 - DNA, 18 bp, Homo sapiens
taccaagacccccgtctc

SEQ ID NO: 4466311 - DNA, 21 bp, Homo sapiens
taccaaggtacaactgtattt

SEQ ID NO: 4466312 - DNA, 22 bp, Homo sapiens
taccaaggtacaactgtattta

SEQ ID NO: 4466313 - DNA, 21 bp, Homo sapiens
taccaagtatgaagtataaat

SEQ ID NO: 4466314 - DNA, 18 bp, Homo sapiens
taccaagtgcttcctaca

SEQ ID NO: 4466315 - DNA, 17 bp, Homo sapiens
taccaatgaaaaaatgt

SEQ ID NO: 4466316 - DNA, 20 bp, Homo sapiens
taccaatgtgttttctgtag

SEQ ID NO: 4466317 - DNA, 21 bp, Homo sapiens
taccacacacagcctgtccct

SEQ ID NO: 4466318 - DNA, 20 bp, Homo sapiens
taccaccatgcactgtaaat

SEQ ID NO: 4466319 - DNA, 17 bp, Homo sapiens
taccacgccttgacctt

SEQ ID NO: 4466320 - DNA, 15 bp, Homo sapiens
taccagcagcaactg

SEQ ID NO: 4466321 - DNA, 16 bp, Homo sapiens
taccagcagcaactga

SEQ ID NO: 4466322 - DNA, 12 bp, Homo sapiens
taccagccagcc

SEQ ID NO: 4466323 - DNA, 13 bp, Homo sapiens
taccagcgaggag

SEQ ID NO: 4466324 - DNA, 14 bp, Homo sapiens
taccagctgcgctt

SEQ ID NO: 4466325 - DNA, 19 bp, Homo sapiens
taccagggactgaggggag

SEQ ID NO: 4466326 - DNA, 20 bp, Homo sapiens
taccagtatttagaagccaa

SEQ ID NO: 4466327 - DNA, 17 bp, Homo sapiens
taccagtgttgggtttt

SEQ ID NO: 4466328 - DNA, 17 bp, Homo sapiens
taccatagaaaaatgta

SEQ ID NO: 4466329 - DNA, 16 bp, Homo sapiens
taccatagagtaatga

SEQ ID NO: 4466330 - DNA, 15 bp, Homo sapiens
taccatcagctctgc

SEQ ID NO: 4466331 - DNA, 18 bp, Homo sapiens
taccatcagctctgcctt

SEQ ID NO: 4466332 - DNA, 17 bp, Homo sapiens
taccatgagatgagatg

SEQ ID NO: 4466333 - DNA, 20 bp, Homo sapiens
taccatgagatgagatgacc

SEQ ID NO: 4466334 - DNA, 16 bp, Homo sapiens
taccatgccatttaaa

SEQ ID NO: 4466335 - DNA, 18 bp, Homo sapiens
taccatggttctgcctcc

SEQ ID NO: 4466336 - DNA, 16 bp, Homo sapiens
taccatgtgtgctaat

SEQ ID NO: 4466337 - DNA, 22 bp, Homo sapiens
taccattacttgtataaataca

SEQ ID NO: 4466338 - DNA, 18 bp, Homo sapiens
taccattatttttaggat

SEQ ID NO: 4466339 - DNA, 21 bp, Homo sapiens
taccattcacaataaaagctt

SEQ ID NO: 4466340 - DNA, 21 bp, Homo sapiens
taccatttgctactgtacata

SEQ ID NO: 4466341 - DNA, 18 bp, Homo sapiens
taccattttaaagttagt

SEQ ID NO: 4466342 - DNA, 15 bp, Homo sapiens
tacccaaactgcttt

SEQ ID NO: 4466343 - DNA, 22 bp, Homo sapiens
tacccagaatgtcagattcctt

SEQ ID NO: 4466344 - DNA, 16 bp, Homo sapiens
tacccagagaagcccc

SEQ ID NO: 4466345 - DNA, 10 bp, Homo sapiens
tacccagcaa

SEQ ID NO: 4466346 - DNA, 15 bp, Homo sapiens
tacccaggtgggtcc

SEQ ID NO: 4466347 - DNA, 15 bp, Homo sapiens
tacccagttgcctcc

SEQ ID NO: 4466348 - DNA, 19 bp, Homo sapiens
tacccagttgcctccaggg

SEQ ID NO: 4466349 - DNA, 18 bp, Homo sapiens
taccccaatttcggattt

SEQ ID NO: 4466350 - DNA, 13 bp, Homo sapiens
taccccagttcct

SEQ ID NO: 4466351 - DNA, 12 bp, Homo sapiens
tacccccaacct

SEQ ID NO: 4466352 - DNA, 16 bp, Homo sapiens
tacccccaacctcatt

SEQ ID NO: 4466353 - DNA, 14 bp, Homo sapiens
tacccctgctccca

SEQ ID NO: 4466354 - DNA, 20 bp, Homo sapiens
tacccctgctcccattcctc

SEQ ID NO: 4466355 - DNA, 14 bp, Homo sapiens
taccctcccaccag

SEQ ID NO: 4466356 - DNA, 18 bp, Homo sapiens
taccctgagctgaggcag

SEQ ID NO: 4466357 - DNA, 20 bp, Homo sapiens
taccgtaggctttgtattca

SEQ ID NO: 4466358 - DNA, 17 bp, Homo sapiens
taccgtctacatttcac

SEQ ID NO: 4466359 - DNA, 21 bp, Homo sapiens
tacctaaaggactattatgtg

SEQ ID NO: 4466360 - DNA, 17 bp, Homo sapiens
tacctaagattacaaat

SEQ ID NO: 4466361 - DNA, 20 bp, Homo sapiens
tacctaagattacaaatcag

SEQ ID NO: 4466362 - DNA, 14 bp, Homo sapiens
tacctacatatttg

SEQ ID NO: 4466363 - DNA, 20 bp, Homo sapiens
tacctagtgcaaaaactgta

SEQ ID NO: 4466364 - DNA, 21 bp, Homo sapiens
tacctagtgcaaaaactgtaa

SEQ ID NO: 4466365 - DNA, 22 bp, Homo sapiens
tacctagtgcaaaaactgtaaa

SEQ ID NO: 4466366 - DNA, 19 bp, Homo sapiens
tacctcaacaagaagaatt

SEQ ID NO: 4466367 - DNA, 13 bp, Homo sapiens
tacctcaaggtaa

SEQ ID NO: 4466368 - DNA, 18 bp, Homo sapiens
tacctcaatttttgtttt

SEQ ID NO: 4466369 - DNA, 15 bp, Homo sapiens
tacctcaccctgcta

SEQ ID NO: 4466370 - DNA, 14 bp, Homo sapiens
tacctcactgtcca

SEQ ID NO: 4466371 - DNA, 11 bp, Homo sapiens
tacctcagaaa

SEQ ID NO: 4466372 - DNA, 14 bp, Homo sapiens
tacctcaggcagga

SEQ ID NO: 4466373 - DNA, 16 bp, Homo sapiens
tacctcagtgctcctg

SEQ ID NO: 4466374 - DNA, 18 bp, Homo sapiens
tacctcagtgctcctgga

SEQ ID NO: 4466375 - DNA, 20 bp, Homo sapiens
tacctcagtggatcttcaga

SEQ ID NO: 4466376 - DNA, 13 bp, Homo sapiens
tacctctgagaag

SEQ ID NO: 4466377 - DNA, 16 bp, Homo sapiens
tacctcttcacctgac

SEQ ID NO: 4466378 - DNA, 21 bp, Homo sapiens
tacctgattgatcacacagtg

SEQ ID NO: 4466379 - DNA, 14 bp, Homo sapiens
tacctgattgtatt

SEQ ID NO: 4466380 - DNA, 12 bp, Homo sapiens
tacctgattttt

SEQ ID NO: 4466381 - DNA, 16 bp, Homo sapiens
tacctgccactcacac

SEQ ID NO: 4466382 - DNA, 19 bp, Homo sapiens
tacctgccactcacacagc

SEQ ID NO: 4466383 - DNA, 20 bp, Homo sapiens
tacctgccactcacacagcc

SEQ ID NO: 4466384 - DNA, 21 bp, Homo sapiens
tacctgccactcacacagcca

SEQ ID NO: 4466385 - DNA, 22 bp, Homo sapiens
tacctgccactcacacagccag

SEQ ID NO: 4466386 - DNA, 16 bp, Homo sapiens
tacctgccttttaagt

SEQ ID NO: 4466387 - DNA, 19 bp, Homo sapiens
tacctgccttttaagtttg

SEQ ID NO: 4466388 - DNA, 21 bp, Homo sapiens
tacctgctcacgtcaaatgca

SEQ ID NO: 4466389 - DNA, 23 bp, Homo sapiens
tacctgctctccaagtctcagtg

SEQ ID NO: 4466390 - DNA, 11 bp, Homo sapiens
tacctgctgct

SEQ ID NO: 4466391 - DNA, 15 bp, Homo sapiens
tacctggaatcaaat

SEQ ID NO: 4466392 - DNA, 21 bp, Homo sapiens
tacctggaatcaaataaaaat

SEQ ID NO: 4466393 - DNA, 12 bp, Homo sapiens
tacctgtggata

SEQ ID NO: 4466394 - DNA, 16 bp, Homo sapiens
taccttatagttactg

SEQ ID NO: 4466395 - DNA, 16 bp, Homo sapiens
taccttcaaactttag

SEQ ID NO: 4466396 - DNA, 21 bp, Homo sapiens
taccttccatacacagaggag

SEQ ID NO: 4466397 - DNA, 18 bp, Homo sapiens
taccttcctgtccctgag

SEQ ID NO: 4466398 - DNA, 15 bp, Homo sapiens
taccttctatgtatt

SEQ ID NO: 4466399 - DNA, 16 bp, Homo sapiens
taccttctatgtatta

SEQ ID NO: 4466400 - DNA, 17 bp, Homo sapiens
taccttgaaatgctgtt

SEQ ID NO: 4466401 - DNA, 18 bp, Homo sapiens
taccttgacacatagttt

SEQ ID NO: 4466402 - DNA, 17 bp, Homo sapiens
taccttttaaaattgaa

SEQ ID NO: 4466403 - DNA, 18 bp, Homo sapiens
taccttttctcacaaaaa

SEQ ID NO: 4466404 - DNA, 21 bp, Homo sapiens
taccttttctcttttctttct

SEQ ID NO: 4466405 - DNA, 14 bp, Homo sapiens
tacctttttatatt

SEQ ID NO: 4466406 - DNA, 22 bp, Homo sapiens
taccttttttgttttttcaaaa

SEQ ID NO: 4466407 - DNA, 14 bp, Homo sapiens
tacgaatacttttg

SEQ ID NO: 4466408 - DNA, 14 bp, Homo sapiens
tacgatgtaaattt

SEQ ID NO: 4466409 - DNA, 15 bp, Homo sapiens
tacgatgtaaatttt

SEQ ID NO: 4466410 - DNA, 15 bp, Homo sapiens
tacgcactggacagc

SEQ ID NO: 4466411 - DNA, 22 bp, Homo sapiens
tacgcagcgtgctttaaaaaat

SEQ ID NO: 4466412 - DNA, 23 bp, Homo sapiens
tacgccaatgttatgccagctcc

SEQ ID NO: 4466413 - DNA, 14 bp, Homo sapiens
tacgctttgattca

SEQ ID NO: 4466414 - DNA, 17 bp, Homo sapiens
tacgcttttaatgaaaa

SEQ ID NO: 4466415 - DNA, 22 bp, Homo sapiens
tacggatttgtccaaataaatt

SEQ ID NO: 4466416 - DNA, 17 bp, Homo sapiens
tacggattttcagttac

SEQ ID NO: 4466417 - DNA, 21 bp, Homo sapiens
tacggcatcacacttatattt

SEQ ID NO: 4466418 - DNA, 21 bp, Homo sapiens
tacgtagcctaaggctcctgt

SEQ ID NO: 4466419 - DNA, 14 bp, Homo sapiens
tacgtagctctctt

SEQ ID NO: 4466420 - DNA, 17 bp, Homo sapiens
tacgtataatgctttct

SEQ ID NO: 4466421 - DNA, 16 bp, Homo sapiens
tacgtcccgctgctgt

SEQ ID NO: 4466422 - DNA, 18 bp, Homo sapiens
tacgtcccgctgctgtgc

SEQ ID NO: 4466423 - DNA, 22 bp, Homo sapiens
tacgtttccccaataaagcctt

SEQ ID NO: 4466424 - DNA, 18 bp, Homo sapiens
tactaaaaaaaagatgaa

SEQ ID NO: 4466425 - DNA, 14 bp, Homo sapiens
tactaaaaatacaa

SEQ ID NO: 4466426 - DNA, 18 bp, Homo sapiens
tactaaaaatacaaaaaa

SEQ ID NO: 4466427 - DNA, 18 bp, Homo sapiens
tactaaaattatgttact

SEQ ID NO: 4466428 - DNA, 18 bp, Homo sapiens
tactaaaccaactctaat

SEQ ID NO: 4466429 - DNA, 20 bp, Homo sapiens
tactaagcattgaatggcta

SEQ ID NO: 4466430 - DNA, 17 bp, Homo sapiens
tactaaggaaaataata

SEQ ID NO: 4466431 - DNA, 19 bp, Homo sapiens
tactaatgatttagtgttg

SEQ ID NO: 4466432 - DNA, 13 bp, Homo sapiens
tactaattccaca

SEQ ID NO: 4466433 - DNA, 17 bp, Homo sapiens
tactacagtcaagatag

SEQ ID NO: 4466434 - DNA, 18 bp, Homo sapiens
tactacattgagtagaca

SEQ ID NO: 4466435 - DNA, 16 bp, Homo sapiens
tactacttaatgctta

SEQ ID NO: 4466436 - DNA, 21 bp, Homo sapiens
tactagggatccctcatctgt

SEQ ID NO: 4466437 - DNA, 18 bp, Homo sapiens
tactagtactattgctat

SEQ ID NO: 4466438 - DNA, 19 bp, Homo sapiens
tactagtgtttaagtcatt

SEQ ID NO: 4466439 - DNA, 18 bp, Homo sapiens
tactataatcaaatgatt

SEQ ID NO: 4466440 - DNA, 16 bp, Homo sapiens
tactatcctgtaaata

SEQ ID NO: 4466441 - DNA, 21 bp, Homo sapiens
tactatgatcagaagaacatg

SEQ ID NO: 4466442 - DNA, 17 bp, Homo sapiens
tactatgcagtatctct

SEQ ID NO: 4466443 - DNA, 19 bp, Homo sapiens
tactatgcagtatctctta

SEQ ID NO: 4466444 - DNA, 17 bp, Homo sapiens
tactatgtctgaacata

SEQ ID NO: 4466445 - DNA, 20 bp, Homo sapiens
tactattatggaattactct

SEQ ID NO: 4466446 - DNA, 15 bp, Homo sapiens
tactattgttacatt

SEQ ID NO: 4466447 - DNA, 12 bp, Homo sapiens
tactatttcaca

SEQ ID NO: 4466448 - DNA, 19 bp, Homo sapiens
tactcagcagcagagagcc

SEQ ID NO: 4466449 - DNA, 21 bp, Homo sapiens
tactcagcagcagagagccct

SEQ ID NO: 4466450 - DNA, 22 bp, Homo sapiens
tactcagcagcagagagccctg

SEQ ID NO: 4466451 - DNA, 14 bp, Homo sapiens
tactcagccctggg

SEQ ID NO: 4466452 - DNA, 23 bp, Homo sapiens
tactcagccctgggccccaccac

SEQ ID NO: 4466453 - DNA, 21 bp, Homo sapiens
tactcaggaggctgagacagg

SEQ ID NO: 4466454 - DNA, 16 bp, Homo sapiens
tactcatttttcatga

SEQ ID NO: 4466455 - DNA, 21 bp, Homo sapiens
tactccagccagggcaagaga

SEQ ID NO: 4466456 - DNA, 15 bp, Homo sapiens
tactcccttctgtag

SEQ ID NO: 4466457 - DNA, 14 bp, Homo sapiens
tactcctagaagaa

SEQ ID NO: 4466458 - DNA, 14 bp, Homo sapiens
tactcctatttttg

SEQ ID NO: 4466459 - DNA, 13 bp, Homo sapiens
tactcctctgcag

SEQ ID NO: 4466460 - DNA, 23 bp, Homo sapiens
tactcctgggcacccttaatctt

SEQ ID NO: 4466461 - DNA, 16 bp, Homo sapiens
tactcctgtgctctgg

SEQ ID NO: 4466462 - DNA, 19 bp, Homo sapiens
tactcctgtgctctggagg

SEQ ID NO: 4466463 - DNA, 16 bp, Homo sapiens
tactctacttacagtt

SEQ ID NO: 4466464 - DNA, 14 bp, Homo sapiens
tactctagatgaag

SEQ ID NO: 4466465 - DNA, 16 bp, Homo sapiens
tactctccaacctgga

SEQ ID NO: 4466466 - DNA, 13 bp, Homo sapiens
tactctccatatc

SEQ ID NO: 4466467 - DNA, 20 bp, Homo sapiens
tactctccccacgagggctg

SEQ ID NO: 4466468 - DNA, 22 bp, Homo sapiens
tactctccccacgagggctggc

SEQ ID NO: 4466469 - DNA, 20 bp, Homo sapiens
tactcttctaaaacttgagt

SEQ ID NO: 4466470 - DNA, 14 bp, Homo sapiens
tactcttcttgaaa

SEQ ID NO: 4466471 - DNA, 22 bp, Homo sapiens
tactctttctctcccctcctct

SEQ ID NO: 4466472 - DNA, 13 bp, Homo sapiens
tactctttctgta

SEQ ID NO: 4466473 - DNA, 14 bp, Homo sapiens
tactctttctgtat

SEQ ID NO: 4466474 - DNA, 16 bp, Homo sapiens
tactctttctgtatat

SEQ ID NO: 4466475 - DNA, 12 bp, Homo sapiens
tactctttgaaa

SEQ ID NO: 4466476 - DNA, 22 bp, Homo sapiens
tactgaactacatgcataaact

SEQ ID NO: 4466477 - DNA, 12 bp, Homo sapiens
tactgaaggaaa

SEQ ID NO: 4466478 - DNA, 18 bp, Homo sapiens
tactgaaggaaaaacaca

SEQ ID NO: 4466479 - DNA, 21 bp, Homo sapiens
tactgaatgaagcagtatttt

SEQ ID NO: 4466480 - DNA, 17 bp, Homo sapiens
tactgaatgatctattc

SEQ ID NO: 4466481 - DNA, 22 bp, Homo sapiens
tactgaattggcttccagattt

SEQ ID NO: 4466482 - DNA, 13 bp, Homo sapiens
tactgaattgtat

SEQ ID NO: 4466483 - DNA, 21 bp, Homo sapiens
tactgacaactgtttaattga

SEQ ID NO: 4466484 - DNA, 18 bp, Homo sapiens
tactgacagggagcagcc

SEQ ID NO: 4466485 - DNA, 23 bp, Homo sapiens
tactgacagggagcagcccccgg

SEQ ID NO: 4466486 - DNA, 15 bp, Homo sapiens
tactgagaatataca

SEQ ID NO: 4466487 - DNA, 17 bp, Homo sapiens
tactgagagtgaacaaa

SEQ ID NO: 4466488 - DNA, 19 bp, Homo sapiens
tactgagagtgaacaaatt

SEQ ID NO: 4466489 - DNA, 11 bp, Homo sapiens
tactgagctgt

SEQ ID NO: 4466490 - DNA, 16 bp, Homo sapiens
tactgagtaaacccta

SEQ ID NO: 4466491 - DNA, 13 bp, Homo sapiens
tactgattatgaa

SEQ ID NO: 4466492 - DNA, 16 bp, Homo sapiens
tactgattatgaaatg

SEQ ID NO: 4466493 - DNA, 14 bp, Homo sapiens
tactgatttcagta

SEQ ID NO: 4466494 - DNA, 21 bp, Homo sapiens
tactgatttgggctgaatgta

SEQ ID NO: 4466495 - DNA, 17 bp, Homo sapiens
tactgcactccagcctg

SEQ ID NO: 4466496 - DNA, 17 bp, Homo sapiens
tactgcatactttttaa

SEQ ID NO: 4466497 - DNA, 18 bp, Homo sapiens
tactgcatactttttaaa

SEQ ID NO: 4466498 - DNA, 22 bp, Homo sapiens
tactgcatactttttaaatgta

SEQ ID NO: 4466499 - DNA, 13 bp, Homo sapiens
tactgcattctga

SEQ ID NO: 4466500 - DNA, 20 bp, Homo sapiens
tactgccattcacttcataa

SEQ ID NO: 4466501 - DNA, 22 bp, Homo sapiens
tactgccttaataaaaaatgaa

SEQ ID NO: 4466502 - DNA, 19 bp, Homo sapiens
tactgcctttagaaaatat

SEQ ID NO: 4466503 - DNA, 19 bp, Homo sapiens
tactgcgtccaccctgagc

SEQ ID NO: 4466504 - DNA, 20 bp, Homo sapiens
tactgcgtccaccctgagct

SEQ ID NO: 4466505 - DNA, 15 bp, Homo sapiens
tactgctcagcttct

SEQ ID NO: 4466506 - DNA, 16 bp, Homo sapiens
tactgctctagaaagt

SEQ ID NO: 4466507 - DNA, 15 bp, Homo sapiens
tactgctgattcttg

SEQ ID NO: 4466508 - DNA, 14 bp, Homo sapiens
tactgcttctcttt

SEQ ID NO: 4466509 - DNA, 17 bp, Homo sapiens
tactgcttctctttgtg

SEQ ID NO: 4466510 - DNA, 18 bp, Homo sapiens
tactgcttctctttgtgc

SEQ ID NO: 4466511 - DNA, 18 bp, Homo sapiens
tactggaattcttctgca

SEQ ID NO: 4466512 - DNA, 23 bp, Homo sapiens
tactggaattcttctgcaacatt

SEQ ID NO: 4466513 - DNA, 15 bp, Homo sapiens
tactggatctcttaa

SEQ ID NO: 4466514 - DNA, 15 bp, Homo sapiens
tactgggtgtcattt

SEQ ID NO: 4466515 - DNA, 20 bp, Homo sapiens
tactgggtgtcatttcattc

SEQ ID NO: 4466516 - DNA, 22 bp, Homo sapiens
tactgggtgtcatttcattcca

SEQ ID NO: 4466517 - DNA, 23 bp, Homo sapiens
tactgggtgtcatttcattccat

SEQ ID NO: 4466518 - DNA, 18 bp, Homo sapiens
tactggtccaaaagattg

SEQ ID NO: 4466519 - DNA, 16 bp, Homo sapiens
tactgtaacattcagg

SEQ ID NO: 4466520 - DNA, 18 bp, Homo sapiens
tactgtaagaataattta

SEQ ID NO: 4466521 - DNA, 12 bp, Homo sapiens
tactgtacacat

SEQ ID NO: 4466522 - DNA, 19 bp, Homo sapiens
tactgtacataaacaatga

SEQ ID NO: 4466523 - DNA, 21 bp, Homo sapiens
tactgtacataaacaatgatg

SEQ ID NO: 4466524 - DNA, 16 bp, Homo sapiens
tactgtatattttgta

SEQ ID NO: 4466525 - DNA, 21 bp, Homo sapiens
tactgtatcaataaaattctg

SEQ ID NO: 4466526 - DNA, 14 bp, Homo sapiens
tactgtatcctgaa

SEQ ID NO: 4466527 - DNA, 13 bp, Homo sapiens
tactgtatgtttt

SEQ ID NO: 4466528 - DNA, 16 bp, Homo sapiens
tactgtatttttcaga

SEQ ID NO: 4466529 - DNA, 17 bp, Homo sapiens
tactgtcagattaaatt

SEQ ID NO: 4466530 - DNA, 18 bp, Homo sapiens
tactgtcagattaaatta

SEQ ID NO: 4466531 - DNA, 23 bp, Homo sapiens
tactgtcagctcccctcggagaa

SEQ ID NO: 4466532 - DNA, 21 bp, Homo sapiens
tactgtgcaggcctgtccctg

SEQ ID NO: 4466533 - DNA, 19 bp, Homo sapiens
tactgtgggcaatttagaa

SEQ ID NO: 4466534 - DNA, 17 bp, Homo sapiens
tactgtgtgtgagtgtg

SEQ ID NO: 4466535 - DNA, 14 bp, Homo sapiens
tactgtgtgtgtga

SEQ ID NO: 4466536 - DNA, 17 bp, Homo sapiens
tactgtgtgtgtgaatg

SEQ ID NO: 4466537 - DNA, 18 bp, Homo sapiens
tactgtgtgtgtgaatga

SEQ ID NO: 4466538 - DNA, 21 bp, Homo sapiens
tactgtgtgtgtgaatgaaca

SEQ ID NO: 4466539 - DNA, 13 bp, Homo sapiens
tactgtgttttta

SEQ ID NO: 4466540 - DNA, 21 bp, Homo sapiens
tactgtgtttttaaattttgt

SEQ ID NO: 4466541 - DNA, 23 bp, Homo sapiens
tactgttcggaaggggttcctca

SEQ ID NO: 4466542 - DNA, 19 bp, Homo sapiens
tactgtttattaaagtaca

SEQ ID NO: 4466543 - DNA, 22 bp, Homo sapiens
tactgttttgaataaattttca

SEQ ID NO: 4466544 - DNA, 21 bp, Homo sapiens
tacttaaaaaaaaaaaaaagc

SEQ ID NO: 4466545 - DNA, 22 bp, Homo sapiens
tacttaaaaaatcctgcccaaa

SEQ ID NO: 4466546 - DNA, 19 bp, Homo sapiens
tacttaacacgtgaatatt

SEQ ID NO: 4466547 - DNA, 22 bp, Homo sapiens
tacttaagtgttcattttaagt

SEQ ID NO: 4466548 - DNA, 22 bp, Homo sapiens
tacttaatgaccatgttatatt

SEQ ID NO: 4466549 - DNA, 17 bp, Homo sapiens
tacttagcaaaaagtgg

SEQ ID NO: 4466550 - DNA, 15 bp, Homo sapiens
tacttaggaaatact

SEQ ID NO: 4466551 - DNA, 13 bp, Homo sapiens
tacttataaagag

SEQ ID NO: 4466552 - DNA, 14 bp, Homo sapiens
tacttatctctaaa

SEQ ID NO: 4466553 - DNA, 20 bp, Homo sapiens
tacttcctcccagcattgct

SEQ ID NO: 4466554 - DNA, 19 bp, Homo sapiens
tacttcctctgtgaactgt

SEQ ID NO: 4466555 - DNA, 20 bp, Homo sapiens
tacttcctctgtgaactgtg

SEQ ID NO: 4466556 - DNA, 12 bp, Homo sapiens
tacttctaagag

SEQ ID NO: 4466557 - DNA, 20 bp, Homo sapiens
tacttctcattttttaaaaa

SEQ ID NO: 4466558 - DNA, 22 bp, Homo sapiens
tacttctctataaaaaatatgt

SEQ ID NO: 4466559 - DNA, 14 bp, Homo sapiens
tacttctttttcat

SEQ ID NO: 4466560 - DNA, 15 bp, Homo sapiens
tacttctttttcatt

SEQ ID NO: 4466561 - DNA, 13 bp, Homo sapiens
tacttgaacaaaa

SEQ ID NO: 4466562 - DNA, 14 bp, Homo sapiens
tacttgaacaaaag

SEQ ID NO: 4466563 - DNA, 21 bp, Homo sapiens
tacttgaacaaaagggtcaga

SEQ ID NO: 4466564 - DNA, 17 bp, Homo sapiens
tacttgaacttgcctct

SEQ ID NO: 4466565 - DNA, 14 bp, Homo sapiens
tacttgaatagtat

SEQ ID NO: 4466566 - DNA, 19 bp, Homo sapiens
tacttgaatcagatggtgt

SEQ ID NO: 4466567 - DNA, 12 bp, Homo sapiens
tacttgaatgaa

SEQ ID NO: 4466568 - DNA, 12 bp, Homo sapiens
tacttgaatgta

SEQ ID NO: 4466569 - DNA, 12 bp, Homo sapiens
tacttgactcta

SEQ ID NO: 4466570 - DNA, 14 bp, Homo sapiens
tacttgactctaat

SEQ ID NO: 4466571 - DNA, 16 bp, Homo sapiens
tacttgccctgaccat

SEQ ID NO: 4466572 - DNA, 22 bp, Homo sapiens
tacttgccctgaccatgcattt

SEQ ID NO: 4466573 - DNA, 17 bp, Homo sapiens
tacttgcttcagtggac

SEQ ID NO: 4466574 - DNA, 19 bp, Homo sapiens
tacttgcttgtattgtaaa

SEQ ID NO: 4466575 - DNA, 16 bp, Homo sapiens
tacttggcattgagta

SEQ ID NO: 4466576 - DNA, 16 bp, Homo sapiens
tacttggtttgtgaat

SEQ ID NO: 4466577 - DNA, 13 bp, Homo sapiens
tacttgtttgaat

SEQ ID NO: 4466578 - DNA, 16 bp, Homo sapiens
tactttaaataattta

SEQ ID NO: 4466579 - DNA, 23 bp, Homo sapiens
tactttacaaaccattacctgta

SEQ ID NO: 4466580 - DNA, 16 bp, Homo sapiens
tactttacctctctgt

SEQ ID NO: 4466581 - DNA, 17 bp, Homo sapiens
tactttacctctctgtc

SEQ ID NO: 4466582 - DNA, 18 bp, Homo sapiens
tactttacctctctgtca

SEQ ID NO: 4466583 - DNA, 22 bp, Homo sapiens
tactttacctctctgtcatgtg

SEQ ID NO: 4466584 - DNA, 15 bp, Homo sapiens
tactttacttttgct

SEQ ID NO: 4466585 - DNA, 16 bp, Homo sapiens
tactttacttttgctg

SEQ ID NO: 4466586 - DNA, 19 bp, Homo sapiens
tactttagccatcataact

SEQ ID NO: 4466587 - DNA, 20 bp, Homo sapiens
tactttataactaacatgtc

SEQ ID NO: 4466588 - DNA, 12 bp, Homo sapiens
tactttatatct

SEQ ID NO: 4466589 - DNA, 14 bp, Homo sapiens
tactttatatctgt

SEQ ID NO: 4466590 - DNA, 18 bp, Homo sapiens
tactttatatcttgttta

SEQ ID NO: 4466591 - DNA, 20 bp, Homo sapiens
tactttatatcttgtttaca

SEQ ID NO: 4466592 - DNA, 22 bp, Homo sapiens
tactttatcatgaatgctttta

SEQ ID NO: 4466593 - DNA, 15 bp, Homo sapiens
tactttattataaaa

SEQ ID NO: 4466594 - DNA, 14 bp, Homo sapiens
tactttatttctga

SEQ ID NO: 4466595 - DNA, 18 bp, Homo sapiens
tactttcaaaatgaattt

SEQ ID NO: 4466596 - DNA, 20 bp, Homo sapiens
tactttcatcctgactctgc

SEQ ID NO: 4466597 - DNA, 17 bp, Homo sapiens
tactttcatcttaaact

SEQ ID NO: 4466598 - DNA, 20 bp, Homo sapiens
tactttcatcttaaactaat

SEQ ID NO: 4466599 - DNA, 20 bp, Homo sapiens
tactttcgtaatagctcaga

SEQ ID NO: 4466600 - DNA, 23 bp, Homo sapiens
tactttcttcaccaagtgcaata

SEQ ID NO: 4466601 - DNA, 15 bp, Homo sapiens
tactttgacagtgtt

SEQ ID NO: 4466602 - DNA, 20 bp, Homo sapiens
tactttgacagtgtttttag

SEQ ID NO: 4466603 - DNA, 18 bp, Homo sapiens
tactttgcaatccaaata

SEQ ID NO: 4466604 - DNA, 18 bp, Homo sapiens
tactttgcattgtctgtc

SEQ ID NO: 4466605 - DNA, 23 bp, Homo sapiens
tactttggcaatttcctggccct

SEQ ID NO: 4466606 - DNA, 20 bp, Homo sapiens
tactttggtagctgggaaag

SEQ ID NO: 4466607 - DNA, 18 bp, Homo sapiens
tactttggtttctgagca

SEQ ID NO: 4466608 - DNA, 21 bp, Homo sapiens
tactttgtagactgtttcaca

SEQ ID NO: 4466609 - DNA, 16 bp, Homo sapiens
tactttgtgtttagct

SEQ ID NO: 4466610 - DNA, 19 bp, Homo sapiens
tactttgttaggattttca

SEQ ID NO: 4466611 - DNA, 13 bp, Homo sapiens
tacttttaaataa

SEQ ID NO: 4466612 - DNA, 19 bp, Homo sapiens
tacttttattattttaatt

SEQ ID NO: 4466613 - DNA, 14 bp, Homo sapiens
tacttttctgttta

SEQ ID NO: 4466614 - DNA, 17 bp, Homo sapiens
tacttttctgtttagtt

SEQ ID NO: 4466615 - DNA, 22 bp, Homo sapiens
tacttttgagtatggctatcta

SEQ ID NO: 4466616 - DNA, 15 bp, Homo sapiens
tacttttgccctttg

SEQ ID NO: 4466617 - DNA, 17 bp, Homo sapiens
tactttttaaaaataac

SEQ ID NO: 4466618 - DNA, 19 bp, Homo sapiens
tactttttaaaaataactg

SEQ ID NO: 4466619 - DNA, 19 bp, Homo sapiens
tactttttagtaatttctt

SEQ ID NO: 4466620 - DNA, 13 bp, Homo sapiens
tactttttcatga

SEQ ID NO: 4466621 - DNA, 13 bp, Homo sapiens
tactttttgttat

SEQ ID NO: 4466622 - DNA, 13 bp, Homo sapiens
tacttttttaaat

SEQ ID NO: 4466623 - DNA, 21 bp, Homo sapiens
tacttttttaaatattttcta

SEQ ID NO: 4466624 - DNA, 22 bp, Homo sapiens
tacttttttaaatattttctat

SEQ ID NO: 4466625 - DNA, 21 bp, Homo sapiens
tagaaaaacatctgaagagct

SEQ ID NO: 4466626 - DNA, 21 bp, Homo sapiens
tagaaaaacatttaaactttt

SEQ ID NO: 4466627 - DNA, 19 bp, Homo sapiens
tagaaaaagaacatgcagt

SEQ ID NO: 4466628 - DNA, 20 bp, Homo sapiens
tagaaaaagaacatgcagtt

SEQ ID NO: 4466629 - DNA, 23 bp, Homo sapiens
tagaaaaagaacatgcagtttga

SEQ ID NO: 4466630 - DNA, 13 bp, Homo sapiens
tagaaaaagggtc

SEQ ID NO: 4466631 - DNA, 23 bp, Homo sapiens
tagaaaaagtcaatgtacttgtt

SEQ ID NO: 4466632 - DNA, 12 bp, Homo sapiens
tagaaaaatgta

SEQ ID NO: 4466633 - DNA, 18 bp, Homo sapiens
tagaaaaatgtataaaaa

SEQ ID NO: 4466634 - DNA, 16 bp, Homo sapiens
tagaaaaattattaga

SEQ ID NO: 4466635 - DNA, 19 bp, Homo sapiens
tagaaaaattattagaaca

SEQ ID NO: 4466636 - DNA, 17 bp, Homo sapiens
tagaaaaatttcacgat

SEQ ID NO: 4466637 - DNA, 22 bp, Homo sapiens
tagaaaacaggaaaaaaacttt

SEQ ID NO: 4466638 - DNA, 16 bp, Homo sapiens
tagaaaacataatctt

SEQ ID NO: 4466639 - DNA, 12 bp, Homo sapiens
tagaaaagttat

SEQ ID NO: 4466640 - DNA, 14 bp, Homo sapiens
tagaaaagttatta

SEQ ID NO: 4466641 - DNA, 21 bp, Homo sapiens
tagaaaatgacttatttctgc

SEQ ID NO: 4466642 - DNA, 18 bp, Homo sapiens
tagaaaattagtgaccat

SEQ ID NO: 4466643 - DNA, 13 bp, Homo sapiens
tagaaaattattt

SEQ ID NO: 4466644 - DNA, 14 bp, Homo sapiens
tagaaaattatttg

SEQ ID NO: 4466645 - DNA, 23 bp, Homo sapiens
tagaaaatttgttattttgcaac

SEQ ID NO: 4466646 - DNA, 21 bp, Homo sapiens
tagaaaattttatgtatttta

SEQ ID NO: 4466647 - DNA, 16 bp, Homo sapiens
tagaaacaaaatacaa

SEQ ID NO: 4466648 - DNA, 17 bp, Homo sapiens
tagaaacaaaatacaat

SEQ ID NO: 4466649 - DNA, 17 bp, Homo sapiens
tagaaacatgtaatcct

SEQ ID NO: 4466650 - DNA, 16 bp, Homo sapiens
tagaaacctgaatgaa

SEQ ID NO: 4466651 - DNA, 12 bp, Homo sapiens
tagaaagaaagt

SEQ ID NO: 4466652 - DNA, 15 bp, Homo sapiens
tagaaagaagccata

SEQ ID NO: 4466653 - DNA, 23 bp, Homo sapiens
tagaaagacatctgcctgtaatt

SEQ ID NO: 4466654 - DNA, 15 bp, Homo sapiens
tagaaagaccaggcc

SEQ ID NO: 4466655 - DNA, 17 bp, Homo sapiens
tagaaagaccaggccaa

SEQ ID NO: 4466656 - DNA, 16 bp, Homo sapiens
tagaaagagaaacagt

SEQ ID NO: 4466657 - DNA, 12 bp, Homo sapiens
tagaaagctaaa

SEQ ID NO: 4466658 - DNA, 14 bp, Homo sapiens
tagaaagctaaagt

SEQ ID NO: 4466659 - DNA, 18 bp, Homo sapiens
tagaaagctaaatgaatc

SEQ ID NO: 4466660 - DNA, 19 bp, Homo sapiens
tagaaataaaggatgtgat

SEQ ID NO: 4466661 - DNA, 16 bp, Homo sapiens
tagaaatatatcctgt

SEQ ID NO: 4466662 - DNA, 16 bp, Homo sapiens
tagaaatattaaagat

SEQ ID NO: 4466663 - DNA, 16 bp, Homo sapiens
tagaaatattttaaaa

SEQ ID NO: 4466664 - DNA, 11 bp, Homo sapiens
tagaaatcata

SEQ ID NO: 4466665 - DNA, 19 bp, Homo sapiens
tagaaatgatgatgtggaa

SEQ ID NO: 4466666 - DNA, 11 bp, Homo sapiens
tagaaatgttt

SEQ ID NO: 4466667 - DNA, 16 bp, Homo sapiens
tagaaatgtttattga

SEQ ID NO: 4466668 - DNA, 21 bp, Homo sapiens
tagaaattggtacataggctt

SEQ ID NO: 4466669 - DNA, 17 bp, Homo sapiens
tagaaattttgtaagaa

SEQ ID NO: 4466670 - DNA, 15 bp, Homo sapiens
tagaacaagatgcac

SEQ ID NO: 4466671 - DNA, 23 bp, Homo sapiens
tagaacaagatgcactcgctgtg

SEQ ID NO: 4466672 - DNA, 13 bp, Homo sapiens
tagaacactattt

SEQ ID NO: 4466673 - DNA, 19 bp, Homo sapiens
tagaacactattttcagaa

SEQ ID NO: 4466674 - DNA, 20 bp, Homo sapiens
tagaacactattttcagaat

SEQ ID NO: 4466675 - DNA, 21 bp, Homo sapiens
tagaacactattttcagaatc

SEQ ID NO: 4466676 - DNA, 23 bp, Homo sapiens
tagaacactattttcagaatctg

SEQ ID NO: 4466677 - DNA, 18 bp, Homo sapiens
tagaacagtggaaactat

SEQ ID NO: 4466678 - DNA, 14 bp, Homo sapiens
tagaacattcactt

SEQ ID NO: 4466679 - DNA, 17 bp, Homo sapiens
tagaacattcacttttg

SEQ ID NO: 4466680 - DNA, 16 bp, Homo sapiens
tagaacattgatctgt

SEQ ID NO: 4466681 - DNA, 18 bp, Homo sapiens
tagaacattgatctgttt

SEQ ID NO: 4466682 - DNA, 19 bp, Homo sapiens
tagaacattgatctgtttt

SEQ ID NO: 4466683 - DNA, 23 bp, Homo sapiens
tagaacattgatctgttttacag

SEQ ID NO: 4466684 - DNA, 23 bp, Homo sapiens
tagaaccaagaagggctagaacc

SEQ ID NO: 4466685 - DNA, 16 bp, Homo sapiens
tagaaccactatgaag

SEQ ID NO: 4466686 - DNA, 23 bp, Homo sapiens
tagaaccatgttggttgcacttt

SEQ ID NO: 4466687 - DNA, 14 bp, Homo sapiens
tagaacctagaagg

SEQ ID NO: 4466688 - DNA, 16 bp, Homo sapiens
tagaacctagaagggc

SEQ ID NO: 4466689 - DNA, 23 bp, Homo sapiens
tagaacctagaagggctagaacc

SEQ ID NO: 4466690 - DNA, 23 bp, Homo sapiens
tagaacgtgcatccttgtaatac

SEQ ID NO: 4466691 - DNA, 15 bp, Homo sapiens
tagaactatcatttt

SEQ ID NO: 4466692 - DNA, 14 bp, Homo sapiens
tagaagaagtgtgt

SEQ ID NO: 4466693 - DNA, 17 bp, Homo sapiens
tagaagagtctattgtc

SEQ ID NO: 4466694 - DNA, 19 bp, Homo sapiens
tagaagccaagggaaaggg

SEQ ID NO: 4466695 - DNA, 17 bp, Homo sapiens
tagaagccgtgggaaga

SEQ ID NO: 4466696 - DNA, 19 bp, Homo sapiens
tagaaggaagtgtgtttgc

SEQ ID NO: 4466697 - DNA, 22 bp, Homo sapiens
tagaagggctagaacctggaga

SEQ ID NO: 4466698 - DNA, 13 bp, Homo sapiens
tagaagtcttaat

SEQ ID NO: 4466699 - DNA, 22 bp, Homo sapiens
tagaagtcttaattgtgtttat

SEQ ID NO: 4466700 - DNA, 23 bp, Homo sapiens
tagaagtcttaattgtgtttatt

SEQ ID NO: 4466701 - DNA, 20 bp, Homo sapiens
tagaagtggaccaggacagg

SEQ ID NO: 4466702 - DNA, 19 bp, Homo sapiens
tagaataaaggcagttttc

SEQ ID NO: 4466703 - DNA, 14 bp, Homo sapiens
tagaataaatggtt

SEQ ID NO: 4466704 - DNA, 15 bp, Homo sapiens
tagaataaatggttt

SEQ ID NO: 4466705 - DNA, 14 bp, Homo sapiens
tagaatattcagac

SEQ ID NO: 4466706 - DNA, 15 bp, Homo sapiens
tagaatattcagaca

SEQ ID NO: 4466707 - DNA, 17 bp, Homo sapiens
tagaatattcagacaaa

SEQ ID NO: 4466708 - DNA, 12 bp, Homo sapiens
tagaatcagaat

SEQ ID NO: 4466709 - DNA, 13 bp, Homo sapiens
tagaatcagaata

SEQ ID NO: 4466710 - DNA, 15 bp, Homo sapiens
tagaatcagaataaa

SEQ ID NO: 4466711 - DNA, 17 bp, Homo sapiens
tagaatgaatttatctt

SEQ ID NO: 4466712 - DNA, 22 bp, Homo sapiens
tagaatgaatttatctttacca

SEQ ID NO: 4466713 - DNA, 20 bp, Homo sapiens
tagaatggaggaagaacaac

SEQ ID NO: 4466714 - DNA, 20 bp, Homo sapiens
tagaatgtctgaagtacaaa

SEQ ID NO: 4466715 - DNA, 23 bp, Homo sapiens
tagaatgtctgaagtacaaacat

SEQ ID NO: 4466716 - DNA, 21 bp, Homo sapiens
tagaattaaaaaagcatactt

SEQ ID NO: 4466717 - DNA, 14 bp, Homo sapiens
tagaattaaaattt

SEQ ID NO: 4466718 - DNA, 15 bp, Homo sapiens
tagaattaacacatg

SEQ ID NO: 4466719 - DNA, 19 bp, Homo sapiens
tagaattatctaatttata

SEQ ID NO: 4466720 - DNA, 22 bp, Homo sapiens
tagaattatctaatttataaaa

SEQ ID NO: 4466721 - DNA, 20 bp, Homo sapiens
tagaattgagtgtttaaagt

SEQ ID NO: 4466722 - DNA, 16 bp, Homo sapiens
tagaattgcagtcatt

SEQ ID NO: 4466723 - DNA, 14 bp, Homo sapiens
tagaattgcattga

SEQ ID NO: 4466724 - DNA, 14 bp, Homo sapiens
tagaatttcctgta

SEQ ID NO: 4466725 - DNA, 19 bp, Homo sapiens
tagaatttcctgtaatata

SEQ ID NO: 4466726 - DNA, 15 bp, Homo sapiens
tagaatttgtttcat

SEQ ID NO: 4466727 - DNA, 18 bp, Homo sapiens
tagaatttgtttcatcta

SEQ ID NO: 4466728 - DNA, 20 bp, Homo sapiens
tagaatttgtttcatctatt

SEQ ID NO: 4466729 - DNA, 13 bp, Homo sapiens
tagacaaaaagta

SEQ ID NO: 4466730 - DNA, 16 bp, Homo sapiens
tagacaaaaagtatat

SEQ ID NO: 4466731 - DNA, 13 bp, Homo sapiens
tagacaaaatcaa

SEQ ID NO: 4466732 - DNA, 14 bp, Homo sapiens
tagacaaaggcctt

SEQ ID NO: 4466733 - DNA, 15 bp, Homo sapiens
tagacaaaggcctta

SEQ ID NO: 4466734 - DNA, 12 bp, Homo sapiens
tagacaaagtac

SEQ ID NO: 4466735 - DNA, 22 bp, Homo sapiens
tagacaattcctccagagacac

SEQ ID NO: 4466736 - DNA, 15 bp, Homo sapiens
tagacaattgaggta

SEQ ID NO: 4466737 - DNA, 22 bp, Homo sapiens
tagacacaatttcatttccagc

SEQ ID NO: 4466738 - DNA, 20 bp, Homo sapiens
tagacacatgaaggtaaata

SEQ ID NO: 4466739 - DNA, 17 bp, Homo sapiens
tagacacatttaaggat

SEQ ID NO: 4466740 - DNA, 21 bp, Homo sapiens
tagacactccccgaagtcttt

SEQ ID NO: 4466741 - DNA, 19 bp, Homo sapiens
tagaccctgaggccctggg

SEQ ID NO: 4466742 - DNA, 15 bp, Homo sapiens
tagacgcccctccca

SEQ ID NO: 4466743 - DNA, 23 bp, Homo sapiens
tagactaaggccattattgtact

SEQ ID NO: 4466744 - DNA, 14 bp, Homo sapiens
tagactatttcttt

SEQ ID NO: 4466745 - DNA, 17 bp, Homo sapiens
tagactctgtctacctg

SEQ ID NO: 4466746 - DNA, 22 bp, Homo sapiens
tagactctgtctacctggtctg

SEQ ID NO: 4466747 - DNA, 13 bp, Homo sapiens
tagacttccccat

SEQ ID NO: 4466748 - DNA, 17 bp, Homo sapiens
tagacttccccatcccg

SEQ ID NO: 4466749 - DNA, 12 bp, Homo sapiens
tagactttatgt

SEQ ID NO: 4466750 - DNA, 22 bp, Homo sapiens
tagagaacagtattgggcagga

SEQ ID NO: 4466751 - DNA, 19 bp, Homo sapiens
tagagaacgcagccctaga

SEQ ID NO: 4466752 - DNA, 15 bp, Homo sapiens
tagagaagacaggct

SEQ ID NO: 4466753 - DNA, 16 bp, Homo sapiens
tagagaatgttccaga

SEQ ID NO: 4466754 - DNA, 17 bp, Homo sapiens
tagagaatgttccagac

SEQ ID NO: 4466755 - DNA, 13 bp, Homo sapiens
tagagacagatgc

SEQ ID NO: 4466756 - DNA, 19 bp, Homo sapiens
tagagacaggacagaatgt

SEQ ID NO: 4466757 - DNA, 15 bp, Homo sapiens
tagagacccccaggc

SEQ ID NO: 4466758 - DNA, 17 bp, Homo sapiens
tagagatatttttgtac

SEQ ID NO: 4466759 - DNA, 16 bp, Homo sapiens
tagagatgattcagag

SEQ ID NO: 4466760 - DNA, 17 bp, Homo sapiens
tagagattacctcctga

SEQ ID NO: 4466761 - DNA, 21 bp, Homo sapiens
tagagattacctcctgagaaa

SEQ ID NO: 4466762 - DNA, 13 bp, Homo sapiens
tagagcagacagg

SEQ ID NO: 4466763 - DNA, 15 bp, Homo sapiens
tagagcagacaggcc

SEQ ID NO: 4466764 - DNA, 12 bp, Homo sapiens
tagagccaggca

SEQ ID NO: 4466765 - DNA, 19 bp, Homo sapiens
tagagccaggcacacactg

SEQ ID NO: 4466766 - DNA, 12 bp, Homo sapiens
tagagcctgcct

SEQ ID NO: 4466767 - DNA, 19 bp, Homo sapiens
tagagcgtttggttaaagt

SEQ ID NO: 4466768 - DNA, 20 bp, Homo sapiens
tagagctgtattaagccact

SEQ ID NO: 4466769 - DNA, 13 bp, Homo sapiens
tagaggaaaagaa

SEQ ID NO: 4466770 - DNA, 20 bp, Homo sapiens
tagaggaaattcaaatccct

SEQ ID NO: 4466771 - DNA, 13 bp, Homo sapiens
tagaggaagaaat

SEQ ID NO: 4466772 - DNA, 22 bp, Homo sapiens
tagaggaagaaatgtcagatgc

SEQ ID NO: 4466773 - DNA, 19 bp, Homo sapiens
tagaggagaaactggaact

SEQ ID NO: 4466774 - DNA, 21 bp, Homo sapiens
tagaggctccagctctggcac

SEQ ID NO: 4466775 - DNA, 18 bp, Homo sapiens
tagaggcttctccgccag

SEQ ID NO: 4466776 - DNA, 14 bp, Homo sapiens
tagagggccctggt

SEQ ID NO: 4466777 - DNA, 17 bp, Homo sapiens
tagaggtgagaaattta

SEQ ID NO: 4466778 - DNA, 14 bp, Homo sapiens
tagagtcctcactc

SEQ ID NO: 4466779 - DNA, 13 bp, Homo sapiens
tagagtttctgtt

SEQ ID NO: 4466780 - DNA, 20 bp, Homo sapiens
tagagtttctgtttgattct

SEQ ID NO: 4466781 - DNA, 21 bp, Homo sapiens
tagagtttctgtttgattctt

SEQ ID NO: 4466782 - DNA, 15 bp, Homo sapiens
tagagttttattcct

SEQ ID NO: 4466783 - DNA, 17 bp, Homo sapiens
tagataaccttgtttat

SEQ ID NO: 4466784 - DNA, 20 bp, Homo sapiens
tagataacttcttgaaaaag

SEQ ID NO: 4466785 - DNA, 21 bp, Homo sapiens
tagataatttattatacacct

SEQ ID NO: 4466786 - DNA, 12 bp, Homo sapiens
tagatacaataa

SEQ ID NO: 4466787 - DNA, 16 bp, Homo sapiens
tagatacaataaattg

SEQ ID NO: 4466788 - DNA, 17 bp, Homo sapiens
tagatacaataaattgc

SEQ ID NO: 4466789 - DNA, 22 bp, Homo sapiens
tagataccctacgctgtccaga

SEQ ID NO: 4466790 - DNA, 13 bp, Homo sapiens
tagatagggctgg

SEQ ID NO: 4466791 - DNA, 17 bp, Homo sapiens
tagatagttagaacctg

SEQ ID NO: 4466792 - DNA, 23 bp, Homo sapiens
tagatataatgaacaaaattatt

SEQ ID NO: 4466793 - DNA, 15 bp, Homo sapiens
tagatattgctacta

SEQ ID NO: 4466794 - DNA, 19 bp, Homo sapiens
tagatatttgaaatagatt

SEQ ID NO: 4466795 - DNA, 21 bp, Homo sapiens
tagatcctaagatgtgttctt

SEQ ID NO: 4466796 - DNA, 14 bp, Homo sapiens
tagatcttaagcag

SEQ ID NO: 4466797 - DNA, 18 bp, Homo sapiens
tagatcttatattggttt

SEQ ID NO: 4466798 - DNA, 19 bp, Homo sapiens
tagatgacaaatattctga

SEQ ID NO: 4466799 - DNA, 22 bp, Homo sapiens
tagatgagtgggaggcgtgccc

SEQ ID NO: 4466800 - DNA, 12 bp, Homo sapiens
tagatgataaag

SEQ ID NO: 4466801 - DNA, 14 bp, Homo sapiens
tagatgcttagtgt

SEQ ID NO: 4466802 - DNA, 21 bp, Homo sapiens
tagatggcaacattggacaga

SEQ ID NO: 4466803 - DNA, 18 bp, Homo sapiens
tagatgggggaactgtga

SEQ ID NO: 4466804 - DNA, 16 bp, Homo sapiens
tagatgggttcttagc

SEQ ID NO: 4466805 - DNA, 17 bp, Homo sapiens
tagatgtagtatttttt

SEQ ID NO: 4466806 - DNA, 15 bp, Homo sapiens
tagatgtcagcaatt

SEQ ID NO: 4466807 - DNA, 12 bp, Homo sapiens
tagatgtctttt

SEQ ID NO: 4466808 - DNA, 11 bp, Homo sapiens
tagatgtgtgg

SEQ ID NO: 4466809 - DNA, 18 bp, Homo sapiens
tagatgttccagtaatct

SEQ ID NO: 4466810 - DNA, 16 bp, Homo sapiens
tagattacatctgcct

SEQ ID NO: 4466811 - DNA, 17 bp, Homo sapiens
tagattacatctgcctt

SEQ ID NO: 4466812 - DNA, 14 bp, Homo sapiens
tagattattataaa

SEQ ID NO: 4466813 - DNA, 12 bp, Homo sapiens
tagattcacctg

SEQ ID NO: 4466814 - DNA, 13 bp, Homo sapiens
tagattcacctgt

SEQ ID NO: 4466815 - DNA, 15 bp, Homo sapiens
tagattcacctgtaa

SEQ ID NO: 4466816 - DNA, 16 bp, Homo sapiens
tagattcacctgtaaa

SEQ ID NO: 4466817 - DNA, 17 bp, Homo sapiens
tagattcaggtaataca

SEQ ID NO: 4466818 - DNA, 19 bp, Homo sapiens
tagattcaggtaatacaaa

SEQ ID NO: 4466819 - DNA, 12 bp, Homo sapiens
tagattgcagaa

SEQ ID NO: 4466820 - DNA, 11 bp, Homo sapiens
tagatttatgg

SEQ ID NO: 4466821 - DNA, 20 bp, Homo sapiens
tagatttcagctatgcagaa

SEQ ID NO: 4466822 - DNA, 12 bp, Homo sapiens
tagatttgaaaa

SEQ ID NO: 4466823 - DNA, 17 bp, Homo sapiens
tagatttgaaaaacttt

SEQ ID NO: 4466824 - DNA, 13 bp, Homo sapiens
tagattttatagt

SEQ ID NO: 4466825 - DNA, 15 bp, Homo sapiens
tagattttatagtgt

SEQ ID NO: 4466826 - DNA, 19 bp, Homo sapiens
tagattttatagtgtgttg

SEQ ID NO: 4466827 - DNA, 14 bp, Homo sapiens
tagattttattatg

SEQ ID NO: 4466828 - DNA, 13 bp, Homo sapiens
tagattttgttat

SEQ ID NO: 4466829 - DNA, 18 bp, Homo sapiens
tagcaaaaagtggggcag

SEQ ID NO: 4466830 - DNA, 14 bp, Homo sapiens
tagcaaagaattga

SEQ ID NO: 4466831 - DNA, 11 bp, Homo sapiens
tagcaaagatt

SEQ ID NO: 4466832 - DNA, 23 bp, Homo sapiens
tagcaaagcaaaaggctgagaag

SEQ ID NO: 4466833 - DNA, 16 bp, Homo sapiens
tagcaaatcagtatat

SEQ ID NO: 4466834 - DNA, 18 bp, Homo sapiens
tagcaaatcagtatattt

SEQ ID NO: 4466835 - DNA, 20 bp, Homo sapiens
tagcaaatgtttactgtatc

SEQ ID NO: 4466836 - DNA, 19 bp, Homo sapiens
tagcaaatttgtttaatct

SEQ ID NO: 4466837 - DNA, 18 bp, Homo sapiens
tagcaacaacaattggta

SEQ ID NO: 4466838 - DNA, 22 bp, Homo sapiens
tagcaactacagtctaaagctg

SEQ ID NO: 4466839 - DNA, 15 bp, Homo sapiens
tagcaagcttttgct

SEQ ID NO: 4466840 - DNA, 13 bp, Homo sapiens
tagcaaggctcat

SEQ ID NO: 4466841 - DNA, 15 bp, Homo sapiens
tagcaataactgaaa

SEQ ID NO: 4466842 - DNA, 19 bp, Homo sapiens
tagcaataactgaaaatga

SEQ ID NO: 4466843 - DNA, 16 bp, Homo sapiens
tagcaatacagggagg

SEQ ID NO: 4466844 - DNA, 14 bp, Homo sapiens
tagcaatctcttca

SEQ ID NO: 4466845 - DNA, 13 bp, Homo sapiens
tagcacagaggcc

SEQ ID NO: 4466846 - DNA, 14 bp, Homo sapiens
tagcacagaggcct

SEQ ID NO: 4466847 - DNA, 15 bp, Homo sapiens
tagcacagaggcctg

SEQ ID NO: 4466848 - DNA, 19 bp, Homo sapiens
tagcaccaatacaaattga

SEQ ID NO: 4466849 - DNA, 22 bp, Homo sapiens
tagcaccttcagggctgagttc

SEQ ID NO: 4466850 - DNA, 14 bp, Homo sapiens
tagcactaggcacc

SEQ ID NO: 4466851 - DNA, 16 bp, Homo sapiens
tagcactgagctcaca

SEQ ID NO: 4466852 - DNA, 17 bp, Homo sapiens
tagcactgatagtcctt

SEQ ID NO: 4466853 - DNA, 20 bp, Homo sapiens
tagcactgccccacatgcat

SEQ ID NO: 4466854 - DNA, 13 bp, Homo sapiens
tagcactggcctg

SEQ ID NO: 4466855 - DNA, 21 bp, Homo sapiens
tagcactggtttgtttctcaa

SEQ ID NO: 4466856 - DNA, 16 bp, Homo sapiens
tagcacttacgtaaaa

SEQ ID NO: 4466857 - DNA, 16 bp, Homo sapiens
tagcacttgacctttt

SEQ ID NO: 4466858 - DNA, 15 bp, Homo sapiens
tagcactttcattgc

SEQ ID NO: 4466859 - DNA, 17 bp, Homo sapiens
tagcactttcattgcca

SEQ ID NO: 4466860 - DNA, 23 bp, Homo sapiens
tagcactttcattgccagtgtct

SEQ ID NO: 4466861 - DNA, 13 bp, Homo sapiens
tagcagagttaaa

SEQ ID NO: 4466862 - DNA, 16 bp, Homo sapiens
tagcagagttaaatct

SEQ ID NO: 4466863 - DNA, 14 bp, Homo sapiens
tagcagatggagta

SEQ ID NO: 4466864 - DNA, 12 bp, Homo sapiens
tagcagcaggct

SEQ ID NO: 4466865 - DNA, 17 bp, Homo sapiens
tagcagccctggatggt

SEQ ID NO: 4466866 - DNA, 15 bp, Homo sapiens
tagcaggaaatgtag

SEQ ID NO: 4466867 - DNA, 22 bp, Homo sapiens
tagcaggccaaggtctgagcca

SEQ ID NO: 4466868 - DNA, 15 bp, Homo sapiens
tagcaggctgttcca

SEQ ID NO: 4466869 - DNA, 16 bp, Homo sapiens
tagcaggctgttccat

SEQ ID NO: 4466870 - DNA, 16 bp, Homo sapiens
tagcaggggcaccttc

SEQ ID NO: 4466871 - DNA, 18 bp, Homo sapiens
tagcaggggcaccttccg

SEQ ID NO: 4466872 - DNA, 15 bp, Homo sapiens
tagcagttataacag

SEQ ID NO: 4466873 - DNA, 21 bp, Homo sapiens
tagcagttataacagatgtga

SEQ ID NO: 4466874 - DNA, 13 bp, Homo sapiens
tagcatataaatg

SEQ ID NO: 4466875 - DNA, 14 bp, Homo sapiens
tagcatataaatgt

SEQ ID NO: 4466876 - DNA, 20 bp, Homo sapiens
tagcatataaatgtttatat

SEQ ID NO: 4466877 - DNA, 21 bp, Homo sapiens
tagcatataaatgtttatatt

SEQ ID NO: 4466878 - DNA, 22 bp, Homo sapiens
tagcatataaatgtttatattg

SEQ ID NO: 4466879 - DNA, 12 bp, Homo sapiens
tagcatgtaatg

SEQ ID NO: 4466880 - DNA, 24 bp, Homo sapiens
tagcattgtaaaattatttcatga

SEQ ID NO: 4466881 - DNA, 12 bp, Homo sapiens
tagcatttattt

SEQ ID NO: 4466882 - DNA, 16 bp, Homo sapiens
tagccaaaaatagcta

SEQ ID NO: 4466883 - DNA, 13 bp, Homo sapiens
tagccaaagattt

SEQ ID NO: 4466884 - DNA, 22 bp, Homo sapiens
tagccacagctgctgttctcag

SEQ ID NO: 4466885 - DNA, 16 bp, Homo sapiens
tagccacatttggaat

SEQ ID NO: 4466886 - DNA, 21 bp, Homo sapiens
tagccacatttggaatacttt

SEQ ID NO: 4466887 - DNA, 22 bp, Homo sapiens
tagccactagtaagtaattatg

SEQ ID NO: 4466888 - DNA, 19 bp, Homo sapiens
tagccagcgtttattgtag

SEQ ID NO: 4466889 - DNA, 13 bp, Homo sapiens
tagccagctgtca

SEQ ID NO: 4466890 - DNA, 14 bp, Homo sapiens
tagccataataaaa

SEQ ID NO: 4466891 - DNA, 16 bp, Homo sapiens
tagccatcaagcactt

SEQ ID NO: 4466892 - DNA, 18 bp, Homo sapiens
tagccccctcatctgcag

SEQ ID NO: 4466893 - DNA, 20 bp, Homo sapiens
tagccccctcatctgcagga

SEQ ID NO: 4466894 - DNA, 22 bp, Homo sapiens
tagccccctggtaatagctgta

SEQ ID NO: 4466895 - DNA, 12 bp, Homo sapiens
tagcccgcctgc

SEQ ID NO: 4466896 - DNA, 15 bp, Homo sapiens
tagcccgcctgccag

SEQ ID NO: 4466897 - DNA, 16 bp, Homo sapiens
tagccctcacattaga

SEQ ID NO: 4466898 - DNA, 17 bp, Homo sapiens
tagccgagagcctgctc

SEQ ID NO: 4466899 - DNA, 21 bp, Homo sapiens
tagcctaaggctcctgttttg

SEQ ID NO: 4466900 - DNA, 12 bp, Homo sapiens
tagcctctccca

SEQ ID NO: 4466901 - DNA, 16 bp, Homo sapiens
tagcctctcctttgta

SEQ ID NO: 4466902 - DNA, 17 bp, Homo sapiens
tagcctctcctttgtag

SEQ ID NO: 4466903 - DNA, 13 bp, Homo sapiens
tagcctgatgaga

SEQ ID NO: 4466904 - DNA, 18 bp, Homo sapiens
tagccttgctcaggtgca

SEQ ID NO: 4466905 - DNA, 18 bp, Homo sapiens
tagcctttacctgtgaag

SEQ ID NO: 4466906 - DNA, 17 bp, Homo sapiens
tagcgatctctcctggc

SEQ ID NO: 4466907 - DNA, 19 bp, Homo sapiens
tagcgctatagttactgtc

SEQ ID NO: 4466908 - DNA, 22 bp, Homo sapiens
tagcgctgccgcaccccagagt

SEQ ID NO: 4466909 - DNA, 13 bp, Homo sapiens
tagcggccctgga

SEQ ID NO: 4466910 - DNA, 16 bp, Homo sapiens
tagcggccctggagga

SEQ ID NO: 4466911 - DNA, 17 bp, Homo sapiens
tagcgtcaagacatttg

SEQ ID NO: 4466912 - DNA, 16 bp, Homo sapiens
tagcgttttttaaatg

SEQ ID NO: 4466913 - DNA, 15 bp, Homo sapiens
tagctaactgtaaat

SEQ ID NO: 4466914 - DNA, 24 bp, Homo sapiens
tagctaataatgagctattaaaac

SEQ ID NO: 4466915 - DNA, 13 bp, Homo sapiens
tagctacactgag

SEQ ID NO: 4466916 - DNA, 15 bp, Homo sapiens
tagctacactgagca

SEQ ID NO: 4466917 - DNA, 23 bp, Homo sapiens
tagctacctacatgctgaaaaat

SEQ ID NO: 4466918 - DNA, 14 bp, Homo sapiens
tagctagaagtggg

SEQ ID NO: 4466919 - DNA, 21 bp, Homo sapiens
tagctatgctgtatctgtgct

SEQ ID NO: 4466920 - DNA, 17 bp, Homo sapiens
tagctcccctggctggc

SEQ ID NO: 4466921 - DNA, 21 bp, Homo sapiens
tagctcccctggctggctcct

SEQ ID NO: 4466922 - DNA, 21 bp, Homo sapiens
tagctccgggggtacagccct

SEQ ID NO: 4466923 - DNA, 14 bp, Homo sapiens
tagctcggcaccaa

SEQ ID NO: 4466924 - DNA, 17 bp, Homo sapiens
tagctctgcctccctct

SEQ ID NO: 4466925 - DNA, 23 bp, Homo sapiens
tagctctggggtgggcagttttt

SEQ ID NO: 4466926 - DNA, 23 bp, Homo sapiens
tagctcttttttgtttgtttctt

SEQ ID NO: 4466927 - DNA, 15 bp, Homo sapiens
tagctgcaaaaataa

SEQ ID NO: 4466928 - DNA, 11 bp, Homo sapiens
tagctgcagaa

SEQ ID NO: 4466929 - DNA, 12 bp, Homo sapiens
tagctgcagaac

SEQ ID NO: 4466930 - DNA, 20 bp, Homo sapiens
tagctggttggagagctaga

SEQ ID NO: 4466931 - DNA, 17 bp, Homo sapiens
tagctgtacttcttgaa

SEQ ID NO: 4466932 - DNA, 21 bp, Homo sapiens
tagctgtcacatacaactttt

SEQ ID NO: 4466933 - DNA, 22 bp, Homo sapiens
tagctgtcacatacaacttttt

SEQ ID NO: 4466934 - DNA, 22 bp, Homo sapiens
tagctgtgtgaatacctgctca

SEQ ID NO: 4466935 - DNA, 19 bp, Homo sapiens
tagctgttctaattaagaa

SEQ ID NO: 4466936 - DNA, 20 bp, Homo sapiens
tagctgttctaattaagaaa

SEQ ID NO: 4466937 - DNA, 11 bp, Homo sapiens
tagcttcagga

SEQ ID NO: 4466938 - DNA, 18 bp, Homo sapiens
tagcttcaggaacctcga

SEQ ID NO: 4466939 - DNA, 16 bp, Homo sapiens
tagcttcagtcattaa

SEQ ID NO: 4466940 - DNA, 15 bp, Homo sapiens
tagcttctgcttttc

SEQ ID NO: 4466941 - DNA, 22 bp, Homo sapiens
tagctttaacttaaatagtatt

SEQ ID NO: 4466942 - DNA, 14 bp, Homo sapiens
tagctttcctggtc

SEQ ID NO: 4466943 - DNA, 12 bp, Homo sapiens
taggaaaatgct

SEQ ID NO: 4466944 - DNA, 15 bp, Homo sapiens
taggaaataaaatta

SEQ ID NO: 4466945 - DNA, 15 bp, Homo sapiens
taggaactgctgggc

SEQ ID NO: 4466946 - DNA, 18 bp, Homo sapiens
taggaactgctgggcttg

SEQ ID NO: 4466947 - DNA, 19 bp, Homo sapiens
taggaagatcgttccacct

SEQ ID NO: 4466948 - DNA, 12 bp, Homo sapiens
taggaaggaaac

SEQ ID NO: 4466949 - DNA, 13 bp, Homo sapiens
taggaaggaaact

SEQ ID NO: 4466950 - DNA, 14 bp, Homo sapiens
taggaaggctgtga

SEQ ID NO: 4466951 - DNA, 17 bp, Homo sapiens
taggaagttgacttata

SEQ ID NO: 4466952 - DNA, 16 bp, Homo sapiens
taggaatagaggaaga

SEQ ID NO: 4466953 - DNA, 18 bp, Homo sapiens
taggaatagaggaagaaa

SEQ ID NO: 4466954 - DNA, 14 bp, Homo sapiens
taggaatcccagag

SEQ ID NO: 4466955 - DNA, 21 bp, Homo sapiens
taggaatcccagaggtgggat

SEQ ID NO: 4466956 - DNA, 17 bp, Homo sapiens
taggaatgtacatgaag

SEQ ID NO: 4466957 - DNA, 20 bp, Homo sapiens
taggaattgacccacaagaa

SEQ ID NO: 4466958 - DNA, 23 bp, Homo sapiens
taggaattgacccacaagaaatg

SEQ ID NO: 4466959 - DNA, 19 bp, Homo sapiens
taggacacagttcctggga

SEQ ID NO: 4466960 - DNA, 23 bp, Homo sapiens
taggactagaagattagaaacta

SEQ ID NO: 4466961 - DNA, 18 bp, Homo sapiens
taggactgacatttctat

SEQ ID NO: 4466962 - DNA, 13 bp, Homo sapiens
taggactgtagaa

SEQ ID NO: 4466963 - DNA, 14 bp, Homo sapiens
taggactgtagaaa

SEQ ID NO: 4466964 - DNA, 21 bp, Homo sapiens
taggacttaaaattagtcttt

SEQ ID NO: 4466965 - DNA, 18 bp, Homo sapiens
taggacttaaccttgaaa

SEQ ID NO: 4466966 - DNA, 17 bp, Homo sapiens
taggagatgaaactggt

SEQ ID NO: 4466967 - DNA, 15 bp, Homo sapiens
taggagcctgctggt

SEQ ID NO: 4466968 - DNA, 23 bp, Homo sapiens
taggagcctgctggtcacagcct

SEQ ID NO: 4466969 - DNA, 14 bp, Homo sapiens
taggagctgggagg

SEQ ID NO: 4466970 - DNA, 18 bp, Homo sapiens
taggaggacaaaaggaat

SEQ ID NO: 4466971 - DNA, 16 bp, Homo sapiens
taggagggaaaccttt

SEQ ID NO: 4466972 - DNA, 19 bp, Homo sapiens
taggatagatcttaagcag

SEQ ID NO: 4466973 - DNA, 16 bp, Homo sapiens
taggatgaacaatgta

SEQ ID NO: 4466974 - DNA, 15 bp, Homo sapiens
taggatgtgatgatg

SEQ ID NO: 4466975 - DNA, 14 bp, Homo sapiens
taggattttcacac

SEQ ID NO: 4466976 - DNA, 14 bp, Homo sapiens
taggatttttagaa

SEQ ID NO: 4466977 - DNA, 22 bp, Homo sapiens
taggcagcctgctataaagtta

SEQ ID NO: 4466978 - DNA, 15 bp, Homo sapiens
taggccactcctcca

SEQ ID NO: 4466979 - DNA, 20 bp, Homo sapiens
taggcctcaactcctcccat

SEQ ID NO: 4466980 - DNA, 17 bp, Homo sapiens
taggcctgtcccttgcc

SEQ ID NO: 4466981 - DNA, 21 bp, Homo sapiens
taggctaaaaggcttccaggc

SEQ ID NO: 4466982 - DNA, 15 bp, Homo sapiens
taggctagagacaga

SEQ ID NO: 4466983 - DNA, 18 bp, Homo sapiens
taggctagagacagatgc

SEQ ID NO: 4466984 - DNA, 21 bp, Homo sapiens
taggctagagacagatgctgg

SEQ ID NO: 4466985 - DNA, 21 bp, Homo sapiens
taggctcttatgtgtgccttt

SEQ ID NO: 4466986 - DNA, 15 bp, Homo sapiens
taggctgcaaaatta

SEQ ID NO: 4466987 - DNA, 16 bp, Homo sapiens
taggctgttctgtagc

SEQ ID NO: 4466988 - DNA, 13 bp, Homo sapiens
taggctgttttct

SEQ ID NO: 4466989 - DNA, 16 bp, Homo sapiens
taggcttctattacct

SEQ ID NO: 4466990 - DNA, 21 bp, Homo sapiens
tagggacccctcgccccagcc

SEQ ID NO: 4466991 - DNA, 14 bp, Homo sapiens
tagggactatcagg

SEQ ID NO: 4466992 - DNA, 21 bp, Homo sapiens
tagggactgccaggctgtttc

SEQ ID NO: 4466993 - DNA, 22 bp, Homo sapiens
tagggagttcatctggagggtt

SEQ ID NO: 4466994 - DNA, 20 bp, Homo sapiens
tagggcacatgaaaaatttt

SEQ ID NO: 4466995 - DNA, 20 bp, Homo sapiens
tagggcagattttcatgcaa

SEQ ID NO: 4466996 - DNA, 20 bp, Homo sapiens
tagggctaaatgtttaaaga

SEQ ID NO: 4466997 - DNA, 22 bp, Homo sapiens
taggggcttataataaaggact

SEQ ID NO: 4466998 - DNA, 18 bp, Homo sapiens
tagggtaaggtgccttct

SEQ ID NO: 4466999 - DNA, 13 bp, Homo sapiens
tagggtataatgt

SEQ ID NO: 4467000 - DNA, 16 bp, Homo sapiens
tagggtggagagccac

SEQ ID NO: 4467001 - DNA, 12 bp, Homo sapiens
tagggtggccct

SEQ ID NO: 4467002 - DNA, 20 bp, Homo sapiens
tagggttctaaatgcaataa

SEQ ID NO: 4467003 - DNA, 17 bp, Homo sapiens
tagggtttggacagacc

SEQ ID NO: 4467004 - DNA, 22 bp, Homo sapiens
taggtaaatttttaggcaaaga

SEQ ID NO: 4467005 - DNA, 21 bp, Homo sapiens
taggtaccatttgtgtctctt

SEQ ID NO: 4467006 - DNA, 14 bp, Homo sapiens
taggtagaaaaagg

SEQ ID NO: 4467007 - DNA, 16 bp, Homo sapiens
taggtagaaaaagggt

SEQ ID NO: 4467008 - DNA, 15 bp, Homo sapiens
taggtcaagtaataa

SEQ ID NO: 4467009 - DNA, 20 bp, Homo sapiens
taggtcattcttttgccaca

SEQ ID NO: 4467010 - DNA, 16 bp, Homo sapiens
taggtctcctcagggt

SEQ ID NO: 4467011 - DNA, 19 bp, Homo sapiens
taggtctcggactaagcct

SEQ ID NO: 4467012 - DNA, 14 bp, Homo sapiens
taggtctttctctc

SEQ ID NO: 4467013 - DNA, 20 bp, Homo sapiens
taggtgactaaaagggcttc

SEQ ID NO: 4467014 - DNA, 20 bp, Homo sapiens
taggtgctacaaaaacacag

SEQ ID NO: 4467015 - DNA, 23 bp, Homo sapiens
taggtgctacaaaaacacagcaa

SEQ ID NO: 4467016 - DNA, 19 bp, Homo sapiens
taggtgctatttgtcatct

SEQ ID NO: 4467017 - DNA, 18 bp, Homo sapiens
taggtgtgtgtgtccaga

SEQ ID NO: 4467018 - DNA, 22 bp, Homo sapiens
taggtgttaggcatgtcccacc

SEQ ID NO: 4467019 - DNA, 17 bp, Homo sapiens
taggttaaagctaaact

SEQ ID NO: 4467020 - DNA, 20 bp, Homo sapiens
taggttgttaccaagtatga

SEQ ID NO: 4467021 - DNA, 18 bp, Homo sapiens
taggtttctaaaaagtca

SEQ ID NO: 4467022 - DNA, 14 bp, Homo sapiens
tagtaaataaacaa

SEQ ID NO: 4467023 - DNA, 18 bp, Homo sapiens
tagtaaatcacgcttttt

SEQ ID NO: 4467024 - DNA, 21 bp, Homo sapiens
tagtaaatcacgctttttgaa

SEQ ID NO: 4467025 - DNA, 14 bp, Homo sapiens
tagtaacactaata

SEQ ID NO: 4467026 - DNA, 15 bp, Homo sapiens
tagtaacactaatat

SEQ ID NO: 4467027 - DNA, 16 bp, Homo sapiens
tagtaacctttaaaaa

SEQ ID NO: 4467028 - DNA, 22 bp, Homo sapiens
tagtaacctttaaaaatgtata

SEQ ID NO: 4467029 - DNA, 15 bp, Homo sapiens
tagtaactataagat

SEQ ID NO: 4467030 - DNA, 17 bp, Homo sapiens
tagtaactataagatac

SEQ ID NO: 4467031 - DNA, 16 bp, Homo sapiens
tagtaagtaattatgc

SEQ ID NO: 4467032 - DNA, 17 bp, Homo sapiens
tagtaagtaattatgca

SEQ ID NO: 4467033 - DNA, 21 bp, Homo sapiens
tagtaagtaattatgcactaa

SEQ ID NO: 4467034 - DNA, 15 bp, Homo sapiens
tagtaagttaatgta

SEQ ID NO: 4467035 - DNA, 14 bp, Homo sapiens
tagtaatctgcatt

SEQ ID NO: 4467036 - DNA, 24 bp, Homo sapiens
tagtaatttattgtctgtctacat

SEQ ID NO: 4467037 - DNA, 22 bp, Homo sapiens
tagtactagagatattttgtaa

SEQ ID NO: 4467038 - DNA, 17 bp, Homo sapiens
tagtacttcttctgtaa

SEQ ID NO: 4467039 - DNA, 20 bp, Homo sapiens
tagtagaaagacatctgcct

SEQ ID NO: 4467040 - DNA, 21 bp, Homo sapiens
tagtagaaagacatctgcctg

SEQ ID NO: 4467041 - DNA, 16 bp, Homo sapiens
tagtagcaatgtgcct

SEQ ID NO: 4467042 - DNA, 23 bp, Homo sapiens
tagtagcgttttttaaatgtata

SEQ ID NO: 4467043 - DNA, 23 bp, Homo sapiens
tagtagtcaaaaacaaagctgat

SEQ ID NO: 4467044 - DNA, 23 bp, Homo sapiens
tagtagttagaaattaaatctgt

SEQ ID NO: 4467045 - DNA, 16 bp, Homo sapiens
tagtataaatgtacat

SEQ ID NO: 4467046 - DNA, 15 bp, Homo sapiens
tagtatacattgtct

SEQ ID NO: 4467047 - DNA, 16 bp, Homo sapiens
tagtatacgtataaat

SEQ ID NO: 4467048 - DNA, 20 bp, Homo sapiens
tagtatggcctgacagctct

SEQ ID NO: 4467049 - DNA, 12 bp, Homo sapiens
tagtattaacta

SEQ ID NO: 4467050 - DNA, 20 bp, Homo sapiens
tagtatttatgggtggattt

SEQ ID NO: 4467051 - DNA, 14 bp, Homo sapiens
tagtatttctcctt

SEQ ID NO: 4467052 - DNA, 17 bp, Homo sapiens
tagtatttgattcaaaa

SEQ ID NO: 4467053 - DNA, 19 bp, Homo sapiens
tagtattttttgtataatt

SEQ ID NO: 4467054 - DNA, 19 bp, Homo sapiens
tagtcaatttctacttctg

SEQ ID NO: 4467055 - DNA, 14 bp, Homo sapiens
tagtcccagctact

SEQ ID NO: 4467056 - DNA, 23 bp, Homo sapiens
tagtcccagctacttgggaggct

SEQ ID NO: 4467057 - DNA, 14 bp, Homo sapiens
tagtccgctgaaga

SEQ ID NO: 4467058 - DNA, 14 bp, Homo sapiens
tagtccttggcata

SEQ ID NO: 4467059 - DNA, 18 bp, Homo sapiens
tagtccttttgggaagaa

SEQ ID NO: 4467060 - DNA, 17 bp, Homo sapiens
tagtctgaaactggctt

SEQ ID NO: 4467061 - DNA, 19 bp, Homo sapiens
tagtcttgaaatgaaaggg

SEQ ID NO: 4467062 - DNA, 23 bp, Homo sapiens
tagtcttggaagctgtttggaaa

SEQ ID NO: 4467063 - DNA, 19 bp, Homo sapiens
tagtcttttgtaatatcaa

SEQ ID NO: 4467064 - DNA, 20 bp, Homo sapiens
tagtgacaccagtaattatg

SEQ ID NO: 4467065 - DNA, 15 bp, Homo sapiens
tagtgattaaatata

SEQ ID NO: 4467066 - DNA, 19 bp, Homo sapiens
tagtgattaaatatatcta

SEQ ID NO: 4467067 - DNA, 22 bp, Homo sapiens
tagtgatttttatgccacctga

SEQ ID NO: 4467068 - DNA, 15 bp, Homo sapiens
tagtgcacaaaatga

SEQ ID NO: 4467069 - DNA, 18 bp, Homo sapiens
tagtgcatttttaaactt

SEQ ID NO: 4467070 - DNA, 13 bp, Homo sapiens
tagtgccacccac

SEQ ID NO: 4467071 - DNA, 22 bp, Homo sapiens
tagtgccacttaatgtatgtta

SEQ ID NO: 4467072 - DNA, 21 bp, Homo sapiens
tagtgctggtcagagagacct

SEQ ID NO: 4467073 - DNA, 23 bp, Homo sapiens
tagtggaaaaacacatggggaaa

SEQ ID NO: 4467074 - DNA, 13 bp, Homo sapiens
tagtggaacattt

SEQ ID NO: 4467075 - DNA, 20 bp, Homo sapiens
tagtggggtctccctctcct

SEQ ID NO: 4467076 - DNA, 22 bp, Homo sapiens
tagtggggtctccctctcctgc

SEQ ID NO: 4467077 - DNA, 20 bp, Homo sapiens
tagtggtttatcagcaaaaa

SEQ ID NO: 4467078 - DNA, 14 bp, Homo sapiens
tagtgtaagaactg

SEQ ID NO: 4467079 - DNA, 15 bp, Homo sapiens
tagtgtaccaagtgc

SEQ ID NO: 4467080 - DNA, 19 bp, Homo sapiens
tagtgtatgattactggcc

SEQ ID NO: 4467081 - DNA, 20 bp, Homo sapiens
tagtgtattaatctctgtgt

SEQ ID NO: 4467082 - DNA, 17 bp, Homo sapiens
tagtgtcctatgcaata

SEQ ID NO: 4467083 - DNA, 17 bp, Homo sapiens
tagtgtgctcggacaca

SEQ ID NO: 4467084 - DNA, 19 bp, Homo sapiens
tagtgtgctcggacacagt

SEQ ID NO: 4467085 - DNA, 14 bp, Homo sapiens
tagtgttaactgtt

SEQ ID NO: 4467086 - DNA, 20 bp, Homo sapiens
tagtgttaatgactctttct

SEQ ID NO: 4467087 - DNA, 17 bp, Homo sapiens
tagtgttcacaaactgt

SEQ ID NO: 4467088 - DNA, 21 bp, Homo sapiens
tagtgttcacaaactgtgaaa

SEQ ID NO: 4467089 - DNA, 18 bp, Homo sapiens
tagtgtttggacagctga

SEQ ID NO: 4467090 - DNA, 12 bp, Homo sapiens
tagttaaaactc

SEQ ID NO: 4467091 - DNA, 23 bp, Homo sapiens
tagttaaaactcatcacataaag

SEQ ID NO: 4467092 - DNA, 20 bp, Homo sapiens
tagttaacatagtaagttca

SEQ ID NO: 4467093 - DNA, 14 bp, Homo sapiens
tagttaagacatga

SEQ ID NO: 4467094 - DNA, 21 bp, Homo sapiens
tagttaagacatgatttcctt

SEQ ID NO: 4467095 - DNA, 23 bp, Homo sapiens
tagttaagacatgatttccttga

SEQ ID NO: 4467096 - DNA, 12 bp, Homo sapiens
tagttaccttat

SEQ ID NO: 4467097 - DNA, 14 bp, Homo sapiens
tagttaccttatag

SEQ ID NO: 4467098 - DNA, 17 bp, Homo sapiens
tagttaccttatagtta

SEQ ID NO: 4467099 - DNA, 22 bp, Homo sapiens
tagttaccttatagttactgtg

SEQ ID NO: 4467100 - DNA, 19 bp, Homo sapiens
tagttactgtgtaattagt

SEQ ID NO: 4467101 - DNA, 19 bp, Homo sapiens
tagttatacttatttgtat

SEQ ID NO: 4467102 - DNA, 16 bp, Homo sapiens
tagttattaaatgttt

SEQ ID NO: 4467103 - DNA, 23 bp, Homo sapiens
tagttcaatctggattcatattt

SEQ ID NO: 4467104 - DNA, 15 bp, Homo sapiens
tagttcaatttcatg

SEQ ID NO: 4467105 - DNA, 21 bp, Homo sapiens
tagttcaatttcatgtttctt

SEQ ID NO: 4467106 - DNA, 14 bp, Homo sapiens
tagttcagcaaaac

SEQ ID NO: 4467107 - DNA, 21 bp, Homo sapiens
tagttccttactgtttacagt

SEQ ID NO: 4467108 - DNA, 14 bp, Homo sapiens
tagttctataagaa

SEQ ID NO: 4467109 - DNA, 15 bp, Homo sapiens
tagttctcagcttgc

SEQ ID NO: 4467110 - DNA, 13 bp, Homo sapiens
tagttctgccagg

SEQ ID NO: 4467111 - DNA, 20 bp, Homo sapiens
tagttctgtaataaaactgt

SEQ ID NO: 4467112 - DNA, 16 bp, Homo sapiens
tagttctgtatataaa

SEQ ID NO: 4467113 - DNA, 21 bp, Homo sapiens
tagttgaataaaaatagaaac

SEQ ID NO: 4467114 - DNA, 16 bp, Homo sapiens
tagttgcaattgaatt

SEQ ID NO: 4467115 - DNA, 19 bp, Homo sapiens
tagttgcatagcagtatat

SEQ ID NO: 4467116 - DNA, 14 bp, Homo sapiens
tagttgccaacagt

SEQ ID NO: 4467117 - DNA, 21 bp, Homo sapiens
tagttgccaacagttgtatgt

SEQ ID NO: 4467118 - DNA, 13 bp, Homo sapiens
tagttgctcttct

SEQ ID NO: 4467119 - DNA, 14 bp, Homo sapiens
tagttgctttgtta

SEQ ID NO: 4467120 - DNA, 17 bp, Homo sapiens
tagttgcttttgaagga

SEQ ID NO: 4467121 - DNA, 18 bp, Homo sapiens
tagttgcttttgaaggaa

SEQ ID NO: 4467122 - DNA, 21 bp, Homo sapiens
tagttgcttttgaaggaatac

SEQ ID NO: 4467123 - DNA, 21 bp, Homo sapiens
tagttgtcacagtcttgtgaa

SEQ ID NO: 4467124 - DNA, 22 bp, Homo sapiens
tagttgtcacagtcttgtgaac

SEQ ID NO: 4467125 - DNA, 17 bp, Homo sapiens
tagttgtctctcttcag

SEQ ID NO: 4467126 - DNA, 21 bp, Homo sapiens
tagttgtgggcaacacatgca

SEQ ID NO: 4467127 - DNA, 12 bp, Homo sapiens
tagttgtgtctg

SEQ ID NO: 4467128 - DNA, 15 bp, Homo sapiens
tagtttacacactgt

SEQ ID NO: 4467129 - DNA, 18 bp, Homo sapiens
tagtttatacagttttaa

SEQ ID NO: 4467130 - DNA, 19 bp, Homo sapiens
tagtttcatataaagtatc

SEQ ID NO: 4467131 - DNA, 18 bp, Homo sapiens
tagtttgaaagttgtaca

SEQ ID NO: 4467132 - DNA, 19 bp, Homo sapiens
tagtttgaaagttgtacat

SEQ ID NO: 4467133 - DNA, 21 bp, Homo sapiens
tagtttgaaagttgtacatga

SEQ ID NO: 4467134 - DNA, 15 bp, Homo sapiens
tagtttgaatgtttt

SEQ ID NO: 4467135 - DNA, 17 bp, Homo sapiens
tagtttgatcagacagc

SEQ ID NO: 4467136 - DNA, 15 bp, Homo sapiens
tagtttgcatttaag

SEQ ID NO: 4467137 - DNA, 17 bp, Homo sapiens
tagtttgcatttaagaa

SEQ ID NO: 4467138 - DNA, 19 bp, Homo sapiens
tagtttgcctgcagtttct

SEQ ID NO: 4467139 - DNA, 15 bp, Homo sapiens
tagtttgctttgctt

SEQ ID NO: 4467140 - DNA, 19 bp, Homo sapiens
tagtttgctttgctttgta

SEQ ID NO: 4467141 - DNA, 18 bp, Homo sapiens
tagttttataggcagctg

SEQ ID NO: 4467142 - DNA, 11 bp, Homo sapiens
tagttttatgc

SEQ ID NO: 4467143 - DNA, 15 bp, Homo sapiens
tagttttcagccttg

SEQ ID NO: 4467144 - DNA, 14 bp, Homo sapiens
tagttttcatttta

SEQ ID NO: 4467145 - DNA, 17 bp, Homo sapiens
tagttttccctgcactg

SEQ ID NO: 4467146 - DNA, 18 bp, Homo sapiens
tagttttgtgaaggtgat

SEQ ID NO: 4467147 - DNA, 23 bp, Homo sapiens
tagtttttaaaatttatttgcaa

SEQ ID NO: 4467148 - DNA, 21 bp, Homo sapiens
tataaaaaagaaaacttgtgt

SEQ ID NO: 4467149 - DNA, 22 bp, Homo sapiens
tataaaaaatcatgccagtatt

SEQ ID NO: 4467150 - DNA, 20 bp, Homo sapiens
tataaaaaattaacttagtt

SEQ ID NO: 4467151 - DNA, 16 bp, Homo sapiens
tataaaaattatcaaa

SEQ ID NO: 4467152 - DNA, 23 bp, Homo sapiens
tataaaataaaaagtcacaatga

SEQ ID NO: 4467153 - DNA, 16 bp, Homo sapiens
tataaaataatgtact

SEQ ID NO: 4467154 - DNA, 21 bp, Homo sapiens
tataaaatgcccatttcgaag

SEQ ID NO: 4467155 - DNA, 18 bp, Homo sapiens
tataaacatatttttata

SEQ ID NO: 4467156 - DNA, 21 bp, Homo sapiens
tataaacatatttttatactt

SEQ ID NO: 4467157 - DNA, 22 bp, Homo sapiens
tataaacatgcttgcattatat

SEQ ID NO: 4467158 - DNA, 21 bp, Homo sapiens
tataaactaccaaattagtga

SEQ ID NO: 4467159 - DNA, 16 bp, Homo sapiens
tataaactataaactt

SEQ ID NO: 4467160 - DNA, 12 bp, Homo sapiens
tataaactttta

SEQ ID NO: 4467161 - DNA, 12 bp, Homo sapiens
tataaagcagta

SEQ ID NO: 4467162 - DNA, 15 bp, Homo sapiens
tataaagctgttctt

SEQ ID NO: 4467163 - DNA, 19 bp, Homo sapiens
tataaagtatagagagaag

SEQ ID NO: 4467164 - DNA, 21 bp, Homo sapiens
tataaataaaatcatgtagtt

SEQ ID NO: 4467165 - DNA, 13 bp, Homo sapiens
tataaatagcatt

SEQ ID NO: 4467166 - DNA, 15 bp, Homo sapiens
tataaatgatatcaa

SEQ ID NO: 4467167 - DNA, 17 bp, Homo sapiens
tataaatgcaataagaa

SEQ ID NO: 4467168 - DNA, 14 bp, Homo sapiens
tataaatgtaaaaa

SEQ ID NO: 4467169 - DNA, 13 bp, Homo sapiens
tataaatgtacat

SEQ ID NO: 4467170 - DNA, 13 bp, Homo sapiens
tataaatgtgtgt

SEQ ID NO: 4467171 - DNA, 16 bp, Homo sapiens
tataaatgtgtgtatg

SEQ ID NO: 4467172 - DNA, 22 bp, Homo sapiens
tataaatgttctggtatgcatt

SEQ ID NO: 4467173 - DNA, 17 bp, Homo sapiens
tataaatgtttatattg

SEQ ID NO: 4467174 - DNA, 18 bp, Homo sapiens
tataaatgtttatattgt

SEQ ID NO: 4467175 - DNA, 12 bp, Homo sapiens
tataaattaaat

SEQ ID NO: 4467176 - DNA, 13 bp, Homo sapiens
tataaattaaata

SEQ ID NO: 4467177 - DNA, 20 bp, Homo sapiens
tataaattaaatatatgtat

SEQ ID NO: 4467178 - DNA, 22 bp, Homo sapiens
tataaattaaatatatgtatgt

SEQ ID NO: 4467179 - DNA, 19 bp, Homo sapiens
tataaattgtacattttgt

SEQ ID NO: 4467180 - DNA, 14 bp, Homo sapiens
tataaattgtcttt

SEQ ID NO: 4467181 - DNA, 23 bp, Homo sapiens
tataaattgtctttaaaaactgt

SEQ ID NO: 4467182 - DNA, 19 bp, Homo sapiens
tataaatttaagaaaacaa

SEQ ID NO: 4467183 - DNA, 17 bp, Homo sapiens
tataaattttttttgtt

SEQ ID NO: 4467184 - DNA, 15 bp, Homo sapiens
tataacagatgtgaa

SEQ ID NO: 4467185 - DNA, 19 bp, Homo sapiens
tataacagatgtgaaaata

SEQ ID NO: 4467186 - DNA, 17 bp, Homo sapiens
tataacattatataaca

SEQ ID NO: 4467187 - DNA, 16 bp, Homo sapiens
tataaccagacacata

SEQ ID NO: 4467188 - DNA, 14 bp, Homo sapiens
tataacgtgttcaa

SEQ ID NO: 4467189 - DNA, 23 bp, Homo sapiens
tataactctgcactactcctctg

SEQ ID NO: 4467190 - DNA, 23 bp, Homo sapiens
tataactgtatttgaaataagaa

SEQ ID NO: 4467191 - DNA, 16 bp, Homo sapiens
tataacttcaaatttt

SEQ ID NO: 4467192 - DNA, 13 bp, Homo sapiens
tataactttagaa

SEQ ID NO: 4467193 - DNA, 16 bp, Homo sapiens
tataactttagaaata

SEQ ID NO: 4467194 - DNA, 19 bp, Homo sapiens
tataagaaaagtaatgaag

SEQ ID NO: 4467195 - DNA, 14 bp, Homo sapiens
tataagaagcaatc

SEQ ID NO: 4467196 - DNA, 22 bp, Homo sapiens
tataagaagcaatctttgaaat

SEQ ID NO: 4467197 - DNA, 17 bp, Homo sapiens
tataagacactttgcca

SEQ ID NO: 4467198 - DNA, 19 bp, Homo sapiens
tataagcaaattgcttttt

SEQ ID NO: 4467199 - DNA, 14 bp, Homo sapiens
tataagcgtattta

SEQ ID NO: 4467200 - DNA, 20 bp, Homo sapiens
tataagcgtatttagactgt

SEQ ID NO: 4467201 - DNA, 10 bp, Homo sapiens
tataaggact

SEQ ID NO: 4467202 - DNA, 12 bp, Homo sapiens
tataaggactgc

SEQ ID NO: 4467203 - DNA, 14 bp, Homo sapiens
tataaggactgcat

SEQ ID NO: 4467204 - DNA, 21 bp, Homo sapiens
tataaggactgcatggtaatt

SEQ ID NO: 4467205 - DNA, 23 bp, Homo sapiens
tataaggactttttgatggaatt

SEQ ID NO: 4467206 - DNA, 21 bp, Homo sapiens
tataaggtgctctctttctgt

SEQ ID NO: 4467207 - DNA, 22 bp, Homo sapiens
tataaggtgctctctttctgtc

SEQ ID NO: 4467208 - DNA, 23 bp, Homo sapiens
tataagtaaagtgattaaagtgc

SEQ ID NO: 4467209 - DNA, 16 bp, Homo sapiens
tataagtgcttcacag

SEQ ID NO: 4467210 - DNA, 12 bp, Homo sapiens
tataagttgacc

SEQ ID NO: 4467211 - DNA, 14 bp, Homo sapiens
tataagttgacctt

SEQ ID NO: 4467212 - DNA, 12 bp, Homo sapiens
tataagtttctt

SEQ ID NO: 4467213 - DNA, 18 bp, Homo sapiens
tataagtttctttagaaa

SEQ ID NO: 4467214 - DNA, 14 bp, Homo sapiens
tataataaaatttc

SEQ ID NO: 4467215 - DNA, 14 bp, Homo sapiens
tataatactgtttt

SEQ ID NO: 4467216 - DNA, 14 bp, Homo sapiens
tataatactttgta

SEQ ID NO: 4467217 - DNA, 14 bp, Homo sapiens
tataatataaatat

SEQ ID NO: 4467218 - DNA, 14 bp, Homo sapiens
tataatatggaacc

SEQ ID NO: 4467219 - DNA, 21 bp, Homo sapiens
tataatattcagccagcttaa

SEQ ID NO: 4467220 - DNA, 17 bp, Homo sapiens
tataatcatcaagtaat

SEQ ID NO: 4467221 - DNA, 22 bp, Homo sapiens
tataatcatcaagtaatacaaa

SEQ ID NO: 4467222 - DNA, 17 bp, Homo sapiens
tataatcatgctcatgt

SEQ ID NO: 4467223 - DNA, 13 bp, Homo sapiens
tataatctattta

SEQ ID NO: 4467224 - DNA, 14 bp, Homo sapiens
tataatctatttac

SEQ ID NO: 4467225 - DNA, 15 bp, Homo sapiens
tataatctatttaca

SEQ ID NO: 4467226 - DNA, 18 bp, Homo sapiens
tataatctcctctgctca

SEQ ID NO: 4467227 - DNA, 17 bp, Homo sapiens
tataatcttataattgt

SEQ ID NO: 4467228 - DNA, 16 bp, Homo sapiens
tataatgaacaaaatt

SEQ ID NO: 4467229 - DNA, 17 bp, Homo sapiens
tataatgaacaaaatta

SEQ ID NO: 4467230 - DNA, 23 bp, Homo sapiens
tataatgacttatatgctgaatt

SEQ ID NO: 4467231 - DNA, 20 bp, Homo sapiens
tataatgacttttaaaattt

SEQ ID NO: 4467232 - DNA, 12 bp, Homo sapiens
tataatgtattt

SEQ ID NO: 4467233 - DNA, 19 bp, Homo sapiens
tataatgtatttgaaaatt

SEQ ID NO: 4467234 - DNA, 13 bp, Homo sapiens
tataatgtatttt

SEQ ID NO: 4467235 - DNA, 20 bp, Homo sapiens
tataatgtcagcttatccta

SEQ ID NO: 4467236 - DNA, 19 bp, Homo sapiens
tataatgtgaaatgtaact

SEQ ID NO: 4467237 - DNA, 16 bp, Homo sapiens
tataatgtgcccaaag

SEQ ID NO: 4467238 - DNA, 14 bp, Homo sapiens
tataatgtgtctgt

SEQ ID NO: 4467239 - DNA, 14 bp, Homo sapiens
tataattaatgctt

SEQ ID NO: 4467240 - DNA, 17 bp, Homo sapiens
tataattggatttccta

SEQ ID NO: 4467241 - DNA, 20 bp, Homo sapiens
tataattggatttcctaata

SEQ ID NO: 4467242 - DNA, 16 bp, Homo sapiens
tataatttaatgtaaa

SEQ ID NO: 4467243 - DNA, 17 bp, Homo sapiens
tataatttacctaagat

SEQ ID NO: 4467244 - DNA, 21 bp, Homo sapiens
tatacaaaagagcatggatgc

SEQ ID NO: 4467245 - DNA, 18 bp, Homo sapiens
tatacaaccttcatttaa

SEQ ID NO: 4467246 - DNA, 19 bp, Homo sapiens
tatacaaccttcatttaaa

SEQ ID NO: 4467247 - DNA, 20 bp, Homo sapiens
tatacaaccttcatttaaaa

SEQ ID NO: 4467248 - DNA, 13 bp, Homo sapiens
tatacaagtactg

SEQ ID NO: 4467249 - DNA, 19 bp, Homo sapiens
tatacaagtactggtaaga

SEQ ID NO: 4467250 - DNA, 23 bp, Homo sapiens
tatacaagtactggtaagattgt

SEQ ID NO: 4467251 - DNA, 21 bp, Homo sapiens
tatacaatggaataaattatg

SEQ ID NO: 4467252 - DNA, 18 bp, Homo sapiens
tatacagttataaaatta

SEQ ID NO: 4467253 - DNA, 22 bp, Homo sapiens
tatacagttataaaattaaaag

SEQ ID NO: 4467254 - DNA, 23 bp, Homo sapiens
tatacagttataaaattaaaagt

SEQ ID NO: 4467255 - DNA, 19 bp, Homo sapiens
tatacagttgaaaacttgt

SEQ ID NO: 4467256 - DNA, 15 bp, Homo sapiens
tatacagtttgactt

SEQ ID NO: 4467257 - DNA, 14 bp, Homo sapiens
tatacatacatgta

SEQ ID NO: 4467258 - DNA, 15 bp, Homo sapiens
tatacatacatgtat

SEQ ID NO: 4467259 - DNA, 16 bp, Homo sapiens
tatacatagtctttgt

SEQ ID NO: 4467260 - DNA, 14 bp, Homo sapiens
tatacatatgagaa

SEQ ID NO: 4467261 - DNA, 23 bp, Homo sapiens
tatacatcagtatagtgttttat

SEQ ID NO: 4467262 - DNA, 22 bp, Homo sapiens
tatacatggaatcgaagtgttt

SEQ ID NO: 4467263 - DNA, 14 bp, Homo sapiens
tatacatgttggaa

SEQ ID NO: 4467264 - DNA, 17 bp, Homo sapiens
tataccagcaatatatc

SEQ ID NO: 4467265 - DNA, 21 bp, Homo sapiens
tataccatgtgtgctaatata

SEQ ID NO: 4467266 - DNA, 12 bp, Homo sapiens
tatacctgattt

SEQ ID NO: 4467267 - DNA, 13 bp, Homo sapiens
tatacctgccttt

SEQ ID NO: 4467268 - DNA, 12 bp, Homo sapiens
tataccttattt

SEQ ID NO: 4467269 - DNA, 21 bp, Homo sapiens
tataccttatttatttttgtg

SEQ ID NO: 4467270 - DNA, 22 bp, Homo sapiens
tataccttatttatttttgtgt

SEQ ID NO: 4467271 - DNA, 19 bp, Homo sapiens
tatacgtataaatatcagt

SEQ ID NO: 4467272 - DNA, 20 bp, Homo sapiens
tatacgtataaatatcagta

SEQ ID NO: 4467273 - DNA, 18 bp, Homo sapiens
tatactaaaccaactcta

SEQ ID NO: 4467274 - DNA, 23 bp, Homo sapiens
tatactcctgtcacctagaacgt

SEQ ID NO: 4467275 - DNA, 19 bp, Homo sapiens
tatactctttctgtatata

SEQ ID NO: 4467276 - DNA, 20 bp, Homo sapiens
tatactgaaggaaaaacaca

SEQ ID NO: 4467277 - DNA, 22 bp, Homo sapiens
tatactgaaggaaaaacacaag

SEQ ID NO: 4467278 - DNA, 23 bp, Homo sapiens
tatactgatcttcattaccaata

SEQ ID NO: 4467279 - DNA, 16 bp, Homo sapiens
tatactgcatactttt

SEQ ID NO: 4467280 - DNA, 17 bp, Homo sapiens
tatactgtacaataaaa

SEQ ID NO: 4467281 - DNA, 14 bp, Homo sapiens
tatacttaaaaaat

SEQ ID NO: 4467282 - DNA, 13 bp, Homo sapiens
tatacttgaacaa

SEQ ID NO: 4467283 - DNA, 17 bp, Homo sapiens
tatacttgaacaaaagg

SEQ ID NO: 4467284 - DNA, 13 bp, Homo sapiens
tatacttgactct

SEQ ID NO: 4467285 - DNA, 14 bp, Homo sapiens
tatacttgactcta

SEQ ID NO: 4467286 - DNA, 19 bp, Homo sapiens
tatactttactttttccat

SEQ ID NO: 4467287 - DNA, 17 bp, Homo sapiens
tatactttttttgttat

SEQ ID NO: 4467288 - DNA, 22 bp, Homo sapiens
tatagaaaaataaaaatctctt

SEQ ID NO: 4467289 - DNA, 14 bp, Homo sapiens
tatagaatttcctg

SEQ ID NO: 4467290 - DNA, 18 bp, Homo sapiens
tatagacaaaagaataag

SEQ ID NO: 4467291 - DNA, 17 bp, Homo sapiens
tatagatgtcagcaatt

SEQ ID NO: 4467292 - DNA, 14 bp, Homo sapiens
tatagattgtctta

SEQ ID NO: 4467293 - DNA, 16 bp, Homo sapiens
tatagattgtcttaat

SEQ ID NO: 4467294 - DNA, 19 bp, Homo sapiens
tatagcactgagctcacat

SEQ ID NO: 4467295 - DNA, 11 bp, Homo sapiens
tatagcagaag

SEQ ID NO: 4467296 - DNA, 18 bp, Homo sapiens
tatagccaaaaatagcta

SEQ ID NO: 4467297 - DNA, 22 bp, Homo sapiens
tatagccctgccctcccaagtc

SEQ ID NO: 4467298 - DNA, 16 bp, Homo sapiens
tatagctacaggaagc

SEQ ID NO: 4467299 - DNA, 21 bp, Homo sapiens
tatagctgcaagtgtatctcc

SEQ ID NO: 4467300 - DNA, 17 bp, Homo sapiens
tatagctgcttccagtg

SEQ ID NO: 4467301 - DNA, 16 bp, Homo sapiens
tatagcttttatctgc

SEQ ID NO: 4467302 - DNA, 12 bp, Homo sapiens
tataggaattga

SEQ ID NO: 4467303 - DNA, 13 bp, Homo sapiens
tataggaattgac

SEQ ID NO: 4467304 - DNA, 15 bp, Homo sapiens
tataggaatttgtat

SEQ ID NO: 4467305 - DNA, 23 bp, Homo sapiens
tataggtcctgtgttaaacacta

SEQ ID NO: 4467306 - DNA, 14 bp, Homo sapiens
tatagtgaaaaatg

SEQ ID NO: 4467307 - DNA, 22 bp, Homo sapiens
tatagtgaagtgttaatacatc

SEQ ID NO: 4467308 - DNA, 16 bp, Homo sapiens
tatagtgcacaaaatg

SEQ ID NO: 4467309 - DNA, 18 bp, Homo sapiens
tatagtggaaaaacacat

SEQ ID NO: 4467310 - DNA, 18 bp, Homo sapiens
tatagtggatgatataca

SEQ ID NO: 4467311 - DNA, 22 bp, Homo sapiens
tatagtggatgatatacacagt

SEQ ID NO: 4467312 - DNA, 19 bp, Homo sapiens
tatagtgttcacaaactgt

SEQ ID NO: 4467313 - DNA, 17 bp, Homo sapiens
tatagttactgtcctgt

SEQ ID NO: 4467314 - DNA, 13 bp, Homo sapiens
tatagttactgtg

SEQ ID NO: 4467315 - DNA, 16 bp, Homo sapiens
tatagttttactttta

SEQ ID NO: 4467316 - DNA, 22 bp, Homo sapiens
tatagttttacttttaaactgt

SEQ ID NO: 4467317 - DNA, 23 bp, Homo sapiens
tatagttttacttttaaactgtg

SEQ ID NO: 4467318 - DNA, 22 bp, Homo sapiens
tatataaaactaaggcttttat

SEQ ID NO: 4467319 - DNA, 19 bp, Homo sapiens
tatataaaacttaaaaaca

SEQ ID NO: 4467320 - DNA, 14 bp, Homo sapiens
tatataaaataact

SEQ ID NO: 4467321 - DNA, 11 bp, Homo sapiens
tatataaacat

SEQ ID NO: 4467322 - DNA, 15 bp, Homo sapiens
tatataaagaatata

SEQ ID NO: 4467323 - DNA, 22 bp, Homo sapiens
tatataaattattactttaaat

SEQ ID NO: 4467324 - DNA, 14 bp, Homo sapiens
tatataacaaataa

SEQ ID NO: 4467325 - DNA, 18 bp, Homo sapiens
tatataagactgctgcag

SEQ ID NO: 4467326 - DNA, 12 bp, Homo sapiens
tatataatatct

SEQ ID NO: 4467327 - DNA, 13 bp, Homo sapiens
tatataatatcta

SEQ ID NO: 4467328 - DNA, 16 bp, Homo sapiens
tatataatcatcaagt

SEQ ID NO: 4467329 - DNA, 16 bp, Homo sapiens
tatataatcatgctca

SEQ ID NO: 4467330 - DNA, 23 bp, Homo sapiens
tatatacatcacgttaaagtagg

SEQ ID NO: 4467331 - DNA, 22 bp, Homo sapiens
tatatagaatttcctgtaatat

SEQ ID NO: 4467332 - DNA, 18 bp, Homo sapiens
tatatagctggcaagaat

SEQ ID NO: 4467333 - DNA, 14 bp, Homo sapiens
tatatagcttgaaa

SEQ ID NO: 4467334 - DNA, 10 bp, Homo sapiens
tatatataaa

SEQ ID NO: 4467335 - DNA, 13 bp, Homo sapiens
tatatataaagta

SEQ ID NO: 4467336 - DNA, 17 bp, Homo sapiens
tatatataataaatact

SEQ ID NO: 4467337 - DNA, 20 bp, Homo sapiens
tatatataatcatcaagtaa

SEQ ID NO: 4467338 - DNA, 14 bp, Homo sapiens
tatatatataaagt

SEQ ID NO: 4467339 - DNA, 14 bp, Homo sapiens
tatatatatataaa

SEQ ID NO: 4467340 - DNA, 13 bp, Homo sapiens
tatatatctatta

SEQ ID NO: 4467341 - DNA, 16 bp, Homo sapiens
tatatatctattattc

SEQ ID NO: 4467342 - DNA, 17 bp, Homo sapiens
tatatatgtgtgccctg

SEQ ID NO: 4467343 - DNA, 16 bp, Homo sapiens
tatatattatgtgaag

SEQ ID NO: 4467344 - DNA, 19 bp, Homo sapiens
tatatcacatgttttctct

SEQ ID NO: 4467345 - DNA, 18 bp, Homo sapiens
tatatcagcagacactcc

SEQ ID NO: 4467346 - DNA, 18 bp, Homo sapiens
tatatcagctactgtagt

SEQ ID NO: 4467347 - DNA, 14 bp, Homo sapiens
tatatcataactat

SEQ ID NO: 4467348 - DNA, 17 bp, Homo sapiens
tatatcatacagttttc

SEQ ID NO: 4467349 - DNA, 15 bp, Homo sapiens
tatatcattatcttt

SEQ ID NO: 4467350 - DNA, 17 bp, Homo sapiens
tatatcctgtgtacctc

SEQ ID NO: 4467351 - DNA, 15 bp, Homo sapiens
tatatctaacttcga

SEQ ID NO: 4467352 - DNA, 21 bp, Homo sapiens
tatatctaccccagactagat

SEQ ID NO: 4467353 - DNA, 17 bp, Homo sapiens
tatatctatctatttga

SEQ ID NO: 4467354 - DNA, 15 bp, Homo sapiens
tatatctcttggaaa

SEQ ID NO: 4467355 - DNA, 23 bp, Homo sapiens
tatatctcttggaaaataagaca

SEQ ID NO: 4467356 - DNA, 16 bp, Homo sapiens
tatatctgagcaagga

SEQ ID NO: 4467357 - DNA, 13 bp, Homo sapiens
tatatctgctgtc

SEQ ID NO: 4467358 - DNA, 17 bp, Homo sapiens
tatatctgctgtccaga

SEQ ID NO: 4467359 - DNA, 14 bp, Homo sapiens
tatatctggaatga

SEQ ID NO: 4467360 - DNA, 13 bp, Homo sapiens
tatatctggcctc

SEQ ID NO: 4467361 - DNA, 19 bp, Homo sapiens
tatatctgtaatgatactg

SEQ ID NO: 4467362 - DNA, 13 bp, Homo sapiens
tatatcttacaaa

SEQ ID NO: 4467363 - DNA, 15 bp, Homo sapiens
tatatcttataactg

SEQ ID NO: 4467364 - DNA, 16 bp, Homo sapiens
tatatcttataactgt

SEQ ID NO: 4467365 - DNA, 12 bp, Homo sapiens
tatatcttgttt

SEQ ID NO: 4467366 - DNA, 15 bp, Homo sapiens
tatatgaacatagac

SEQ ID NO: 4467367 - DNA, 18 bp, Homo sapiens
tatatgaagaaaatcact

SEQ ID NO: 4467368 - DNA, 19 bp, Homo sapiens
tatatgaagaaaatcactt

SEQ ID NO: 4467369 - DNA, 16 bp, Homo sapiens
tatatgagaagaatag

SEQ ID NO: 4467370 - DNA, 14 bp, Homo sapiens
tatatgatatgcat

SEQ ID NO: 4467371 - DNA, 15 bp, Homo sapiens
tatatgatatgcatg

SEQ ID NO: 4467372 - DNA, 18 bp, Homo sapiens
tatatgctgaattgaaca

SEQ ID NO: 4467373 - DNA, 19 bp, Homo sapiens
tatatgctgtatttctttg

SEQ ID NO: 4467374 - DNA, 23 bp, Homo sapiens
tatatgctgtatttctttgtaga

SEQ ID NO: 4467375 - DNA, 14 bp, Homo sapiens
tatatgcttactga

SEQ ID NO: 4467376 - DNA, 17 bp, Homo sapiens
tatatgcttactgatat

SEQ ID NO: 4467377 - DNA, 21 bp, Homo sapiens
tatatgcttactgatatattt

SEQ ID NO: 4467378 - DNA, 21 bp, Homo sapiens
tatatggaggattctttcccc

SEQ ID NO: 4467379 - DNA, 14 bp, Homo sapiens
tatatggcaaatag

SEQ ID NO: 4467380 - DNA, 15 bp, Homo sapiens
tatatggtccactgg

SEQ ID NO: 4467381 - DNA, 14 bp, Homo sapiens
tatatgtaaattac

SEQ ID NO: 4467382 - DNA, 19 bp, Homo sapiens
tatatgtagtgcattttta

SEQ ID NO: 4467383 - DNA, 11 bp, Homo sapiens
tatatgtatgt

SEQ ID NO: 4467384 - DNA, 13 bp, Homo sapiens
tatatgtgagaaa

SEQ ID NO: 4467385 - DNA, 14 bp, Homo sapiens
tatatgtgtataca

SEQ ID NO: 4467386 - DNA, 17 bp, Homo sapiens
tatatgtgtgccctgga

SEQ ID NO: 4467387 - DNA, 14 bp, Homo sapiens
tatattaaaacaat

SEQ ID NO: 4467388 - DNA, 15 bp, Homo sapiens
tatattaaaacaata

SEQ ID NO: 4467389 - DNA, 20 bp, Homo sapiens
tatattaaaacaataatgca

SEQ ID NO: 4467390 - DNA, 22 bp, Homo sapiens
tatattaaaacaataatgcaat

SEQ ID NO: 4467391 - DNA, 21 bp, Homo sapiens
tatattaaaattccaaattca

SEQ ID NO: 4467392 - DNA, 22 bp, Homo sapiens
tatattaaaattccaaattcat

SEQ ID NO: 4467393 - DNA, 12 bp, Homo sapiens
tatattaaacat

SEQ ID NO: 4467394 - DNA, 14 bp, Homo sapiens
tatattaatattta

SEQ ID NO: 4467395 - DNA, 15 bp, Homo sapiens
tatattagtaattta

SEQ ID NO: 4467396 - DNA, 14 bp, Homo sapiens
tatattagttgctt

SEQ ID NO: 4467397 - DNA, 14 bp, Homo sapiens
tatattataaatat

SEQ ID NO: 4467398 - DNA, 21 bp, Homo sapiens
tatattataaatatatataaa

SEQ ID NO: 4467399 - DNA, 22 bp, Homo sapiens
tatattataaatatatataaag

SEQ ID NO: 4467400 - DNA, 15 bp, Homo sapiens
tatattatatacata

SEQ ID NO: 4467401 - DNA, 22 bp, Homo sapiens
tatattatcaaggggactaaag

SEQ ID NO: 4467402 - DNA, 14 bp, Homo sapiens
tatattatgtgaag

SEQ ID NO: 4467403 - DNA, 14 bp, Homo sapiens
tatattatgtttaa

SEQ ID NO: 4467404 - DNA, 22 bp, Homo sapiens
tatattcactggttttacacag

SEQ ID NO: 4467405 - DNA, 19 bp, Homo sapiens
tatattcattctttttgaa

SEQ ID NO: 4467406 - DNA, 23 bp, Homo sapiens
tatattgaaagttgcttttattg

SEQ ID NO: 4467407 - DNA, 22 bp, Homo sapiens
tatattgaacttttgtactgaa

SEQ ID NO: 4467408 - DNA, 13 bp, Homo sapiens
tatattgataaat

SEQ ID NO: 4467409 - DNA, 15 bp, Homo sapiens
tatattgataaattt

SEQ ID NO: 4467410 - DNA, 22 bp, Homo sapiens
tatattgcttcctgtgtaacat

SEQ ID NO: 4467411 - DNA, 22 bp, Homo sapiens
tatattggtttgcacaagttcc

SEQ ID NO: 4467412 - DNA, 16 bp, Homo sapiens
tatattgtaaagaagg

SEQ ID NO: 4467413 - DNA, 14 bp, Homo sapiens
tatattgtaattta

SEQ ID NO: 4467414 - DNA, 17 bp, Homo sapiens
tatattgtttttatata

SEQ ID NO: 4467415 - DNA, 20 bp, Homo sapiens
tatatttaaaaaattatgga

SEQ ID NO: 4467416 - DNA, 17 bp, Homo sapiens
tatatttaaaaataagt

SEQ ID NO: 4467417 - DNA, 12 bp, Homo sapiens
tatatttatttc

SEQ ID NO: 4467418 - DNA, 19 bp, Homo sapiens
tatatttcagatgtaatgt

SEQ ID NO: 4467419 - DNA, 16 bp, Homo sapiens
tatatttcctttatgt

SEQ ID NO: 4467420 - DNA, 14 bp, Homo sapiens
tatatttcttcttc

SEQ ID NO: 4467421 - DNA, 14 bp, Homo sapiens
tatatttgaaatag

SEQ ID NO: 4467422 - DNA, 22 bp, Homo sapiens
tatatttgaaatagtatacatt

SEQ ID NO: 4467423 - DNA, 20 bp, Homo sapiens
tatatttgtaaatttatgtg

SEQ ID NO: 4467424 - DNA, 15 bp, Homo sapiens
tatatttgtttcaaa

SEQ ID NO: 4467425 - DNA, 13 bp, Homo sapiens
tatattttatata

SEQ ID NO: 4467426 - DNA, 18 bp, Homo sapiens
tatattttatataaagta

SEQ ID NO: 4467427 - DNA, 13 bp, Homo sapiens
tatattttatgaa

SEQ ID NO: 4467428 - DNA, 23 bp, Homo sapiens
tatattttatgaacattgtactg

SEQ ID NO: 4467429 - DNA, 18 bp, Homo sapiens
tatattttgtactttgtg

SEQ ID NO: 4467430 - DNA, 21 bp, Homo sapiens
tatattttttgttaaatgatt

SEQ ID NO: 4467431 - DNA, 15 bp, Homo sapiens
tatcaaaaaaccttt

SEQ ID NO: 4467432 - DNA, 18 bp, Homo sapiens
tatcaaaaaacctttaca

SEQ ID NO: 4467433 - DNA, 22 bp, Homo sapiens
tatcaaaagaaaattgatattt

SEQ ID NO: 4467434 - DNA, 13 bp, Homo sapiens
tatcaaaagactt

SEQ ID NO: 4467435 - DNA, 19 bp, Homo sapiens
tatcaaagaagagtcaaca

SEQ ID NO: 4467436 - DNA, 21 bp, Homo sapiens
tatcaaagaagagtcaacatt

SEQ ID NO: 4467437 - DNA, 19 bp, Homo sapiens
tatcaaagagaagatgcct

SEQ ID NO: 4467438 - DNA, 21 bp, Homo sapiens
tatcaaagagaagatgcctgt

SEQ ID NO: 4467439 - DNA, 22 bp, Homo sapiens
tatcaaagcattttataaatga

SEQ ID NO: 4467440 - DNA, 13 bp, Homo sapiens
tatcaaatgaaac

SEQ ID NO: 4467441 - DNA, 19 bp, Homo sapiens
tatcaataaaattctgtaa

SEQ ID NO: 4467442 - DNA, 20 bp, Homo sapiens
tatcaataaaattctgtaat

SEQ ID NO: 4467443 - DNA, 19 bp, Homo sapiens
tatcaatattttctgcaat

SEQ ID NO: 4467444 - DNA, 16 bp, Homo sapiens
tatcaatgtgtctttc

SEQ ID NO: 4467445 - DNA, 18 bp, Homo sapiens
tatcaatgtgtctttcta

SEQ ID NO: 4467446 - DNA, 15 bp, Homo sapiens
tatcaatttctaatg

SEQ ID NO: 4467447 - DNA, 20 bp, Homo sapiens
tatcacaaatcttaacttga

SEQ ID NO: 4467448 - DNA, 15 bp, Homo sapiens
tatcacacaatatag

SEQ ID NO: 4467449 - DNA, 19 bp, Homo sapiens
tatcacacacattgctgtg

SEQ ID NO: 4467450 - DNA, 17 bp, Homo sapiens
tatcacacttctgtgag

SEQ ID NO: 4467451 - DNA, 19 bp, Homo sapiens
tatcacataagagagatga

SEQ ID NO: 4467452 - DNA, 18 bp, Homo sapiens
tatcacctaagcacttct

SEQ ID NO: 4467453 - DNA, 20 bp, Homo sapiens
tatcactaaataaacacgat

SEQ ID NO: 4467454 - DNA, 14 bp, Homo sapiens
tatcagcacgtgtg

SEQ ID NO: 4467455 - DNA, 19 bp, Homo sapiens
tatcagcagacactccagt

SEQ ID NO: 4467456 - DNA, 19 bp, Homo sapiens
tatcagctttgataattgt

SEQ ID NO: 4467457 - DNA, 14 bp, Homo sapiens
tatcagcttttctg

SEQ ID NO: 4467458 - DNA, 22 bp, Homo sapiens
tatcagggaaactaagattctt

SEQ ID NO: 4467459 - DNA, 20 bp, Homo sapiens
tatcagtattctgacatgta

SEQ ID NO: 4467460 - DNA, 21 bp, Homo sapiens
tatcagtattctgacatgtaa

SEQ ID NO: 4467461 - DNA, 17 bp, Homo sapiens
tatcagtgtcctttcca

SEQ ID NO: 4467462 - DNA, 15 bp, Homo sapiens
tatcagtgtttatgt

SEQ ID NO: 4467463 - DNA, 19 bp, Homo sapiens
tatcagttactcagccctg

SEQ ID NO: 4467464 - DNA, 20 bp, Homo sapiens
tatcagttactcagccctgg

SEQ ID NO: 4467465 - DNA, 21 bp, Homo sapiens
tatcagttactcagccctggg

SEQ ID NO: 4467466 - DNA, 13 bp, Homo sapiens
tatcagtttgcta

SEQ ID NO: 4467467 - DNA, 21 bp, Homo sapiens
tatcatactcttctaaaactt

SEQ ID NO: 4467468 - DNA, 15 bp, Homo sapiens
tatcatagttaacat

SEQ ID NO: 4467469 - DNA, 16 bp, Homo sapiens
tatcatagttaacata

SEQ ID NO: 4467470 - DNA, 20 bp, Homo sapiens
tatcatcacgtatgttatac

SEQ ID NO: 4467471 - DNA, 14 bp, Homo sapiens
tatcatccacacat

SEQ ID NO: 4467472 - DNA, 20 bp, Homo sapiens
tatcatcctttcagttttta

SEQ ID NO: 4467473 - DNA, 13 bp, Homo sapiens
tatcatctgtcat

SEQ ID NO: 4467474 - DNA, 17 bp, Homo sapiens
tatcatctgtcattata

SEQ ID NO: 4467475 - DNA, 14 bp, Homo sapiens
tatcatgaagcctg

SEQ ID NO: 4467476 - DNA, 11 bp, Homo sapiens
tatcatgaatg

SEQ ID NO: 4467477 - DNA, 16 bp, Homo sapiens
tatcatgaattttaaa

SEQ ID NO: 4467478 - DNA, 14 bp, Homo sapiens
tatcatgcaaaata

SEQ ID NO: 4467479 - DNA, 23 bp, Homo sapiens
tatcatgcacacaattagatttc

SEQ ID NO: 4467480 - DNA, 13 bp, Homo sapiens
tatcatggaagaa

SEQ ID NO: 4467481 - DNA, 17 bp, Homo sapiens
tatcatggggagtaata

SEQ ID NO: 4467482 - DNA, 13 bp, Homo sapiens
tatcatgttaacc

SEQ ID NO: 4467483 - DNA, 18 bp, Homo sapiens
tatcattaaacaaataaa

SEQ ID NO: 4467484 - DNA, 18 bp, Homo sapiens
tatcattatctttgctgt

SEQ ID NO: 4467485 - DNA, 20 bp, Homo sapiens
tatcattatctttgctgtta

SEQ ID NO: 4467486 - DNA, 19 bp, Homo sapiens
tatcattcatcttcttctt

SEQ ID NO: 4467487 - DNA, 16 bp, Homo sapiens
tatcatttttacacta

SEQ ID NO: 4467488 - DNA, 18 bp, Homo sapiens
tatcatttttacactatt

SEQ ID NO: 4467489 - DNA, 13 bp, Homo sapiens
tatccaaaagctt

SEQ ID NO: 4467490 - DNA, 20 bp, Homo sapiens
tatccacaatagctgacggc

SEQ ID NO: 4467491 - DNA, 18 bp, Homo sapiens
tatccacagaaaatgtaa

SEQ ID NO: 4467492 - DNA, 21 bp, Homo sapiens
tatccacagaacctttgtcaa

SEQ ID NO: 4467493 - DNA, 19 bp, Homo sapiens
tatccacccagcccattct

SEQ ID NO: 4467494 - DNA, 17 bp, Homo sapiens
tatccaggcaccaggac

SEQ ID NO: 4467495 - DNA, 19 bp, Homo sapiens
tatccaggttccctcccag

SEQ ID NO: 4467496 - DNA, 17 bp, Homo sapiens
tatccataaaaaaaaat

SEQ ID NO: 4467497 - DNA, 24 bp, Homo sapiens
tatccataatgcattcttctctgt

SEQ ID NO: 4467498 - DNA, 17 bp, Homo sapiens
tatccatattgagtcaa

SEQ ID NO: 4467499 - DNA, 22 bp, Homo sapiens
tatccatattgagtcaaatggt

SEQ ID NO: 4467500 - DNA, 16 bp, Homo sapiens
tatccatttatctttt

SEQ ID NO: 4467501 - DNA, 20 bp, Homo sapiens
tatccccatctccctgcctg

SEQ ID NO: 4467502 - DNA, 22 bp, Homo sapiens
tatccccatctccctgcctggc

SEQ ID NO: 4467503 - DNA, 18 bp, Homo sapiens
tatcccttggacatttta

SEQ ID NO: 4467504 - DNA, 20 bp, Homo sapiens
tatcctccctggcagacaca

SEQ ID NO: 4467505 - DNA, 19 bp, Homo sapiens
tatcctctccccctcctcc

SEQ ID NO: 4467506 - DNA, 13 bp, Homo sapiens
tatcctgctgaaa

SEQ ID NO: 4467507 - DNA, 20 bp, Homo sapiens
tatcctgggagcactgcgtt

SEQ ID NO: 4467508 - DNA, 14 bp, Homo sapiens
tatcctgtattctt

SEQ ID NO: 4467509 - DNA, 12 bp, Homo sapiens
tatcctgtgtac

SEQ ID NO: 4467510 - DNA, 18 bp, Homo sapiens
tatcctgtgtacctcact

SEQ ID NO: 4467511 - DNA, 20 bp, Homo sapiens
tatccttataggcctgtccc

SEQ ID NO: 4467512 - DNA, 22 bp, Homo sapiens
tatccttataggcctgtccctt

SEQ ID NO: 4467513 - DNA, 19 bp, Homo sapiens
tatccttgggccataatta

SEQ ID NO: 4467514 - DNA, 19 bp, Homo sapiens
tatcctttatacagttgta

SEQ ID NO: 4467515 - DNA, 18 bp, Homo sapiens
tatcctttggtcctggtg

SEQ ID NO: 4467516 - DNA, 14 bp, Homo sapiens
tatccttttatctc

SEQ ID NO: 4467517 - DNA, 13 bp, Homo sapiens
tatcgaaatttgt

SEQ ID NO: 4467518 - DNA, 18 bp, Homo sapiens
tatcgttatcactgtgca

SEQ ID NO: 4467519 - DNA, 18 bp, Homo sapiens
tatctaaagttatatttc

SEQ ID NO: 4467520 - DNA, 15 bp, Homo sapiens
tatctaactttgtaa

SEQ ID NO: 4467521 - DNA, 13 bp, Homo sapiens
tatctaagaataa

SEQ ID NO: 4467522 - DNA, 13 bp, Homo sapiens
tatctacaaaaat

SEQ ID NO: 4467523 - DNA, 13 bp, Homo sapiens
tatctacaaagaa

SEQ ID NO: 4467524 - DNA, 16 bp, Homo sapiens
tatctacagtaatgaa

SEQ ID NO: 4467525 - DNA, 17 bp, Homo sapiens
tatctacagtaatgaaa

SEQ ID NO: 4467526 - DNA, 22 bp, Homo sapiens
tatctaccccagactagatgta

SEQ ID NO: 4467527 - DNA, 22 bp, Homo sapiens
tatctacctcaaggtaacaaga

SEQ ID NO: 4467528 - DNA, 20 bp, Homo sapiens
tatctagcatttatttctct

SEQ ID NO: 4467529 - DNA, 17 bp, Homo sapiens
tatctaggcatttcatt

SEQ ID NO: 4467530 - DNA, 19 bp, Homo sapiens
tatctataatttacctaag

SEQ ID NO: 4467531 - DNA, 14 bp, Homo sapiens
tatctatataaaat

SEQ ID NO: 4467532 - DNA, 15 bp, Homo sapiens
tatctatataaaata

SEQ ID NO: 4467533 - DNA, 18 bp, Homo sapiens
tatctatataaaataact

SEQ ID NO: 4467534 - DNA, 16 bp, Homo sapiens
tatctatctatttgag

SEQ ID NO: 4467535 - DNA, 17 bp, Homo sapiens
tatctatctatttgagg

SEQ ID NO: 4467536 - DNA, 13 bp, Homo sapiens
tatctattagcag

SEQ ID NO: 4467537 - DNA, 18 bp, Homo sapiens
tatctatttgaataaatt

SEQ ID NO: 4467538 - DNA, 21 bp, Homo sapiens
tatctatttgaataaattatg

SEQ ID NO: 4467539 - DNA, 12 bp, Homo sapiens
tatctatttgag

SEQ ID NO: 4467540 - DNA, 17 bp, Homo sapiens
tatctatttgtacaatt

SEQ ID NO: 4467541 - DNA, 15 bp, Homo sapiens
tatctcactttgtaa

SEQ ID NO: 4467542 - DNA, 19 bp, Homo sapiens
tatctcaggaagtccagcc

SEQ ID NO: 4467543 - DNA, 22 bp, Homo sapiens
tatctcagtctaaggtctcatg

SEQ ID NO: 4467544 - DNA, 15 bp, Homo sapiens
tatctccatggccct

SEQ ID NO: 4467545 - DNA, 16 bp, Homo sapiens
tatctccttcccctac

SEQ ID NO: 4467546 - DNA, 21 bp, Homo sapiens
tatctctctgtcttttttctc

SEQ ID NO: 4467547 - DNA, 14 bp, Homo sapiens
tatctcttggaaaa

SEQ ID NO: 4467548 - DNA, 18 bp, Homo sapiens
tatctctttgatctactt

SEQ ID NO: 4467549 - DNA, 14 bp, Homo sapiens
tatctgaacattta

SEQ ID NO: 4467550 - DNA, 23 bp, Homo sapiens
tatctgcggctttaaactgacag

SEQ ID NO: 4467551 - DNA, 11 bp, Homo sapiens
tatctgctgtc

SEQ ID NO: 4467552 - DNA, 13 bp, Homo sapiens
tatctgctgtcca

SEQ ID NO: 4467553 - DNA, 19 bp, Homo sapiens
tatctggaacaacttgtag

SEQ ID NO: 4467554 - DNA, 22 bp, Homo sapiens
tatctggaacaacttgtagcag

SEQ ID NO: 4467555 - DNA, 15 bp, Homo sapiens
tatctggcctctgct

SEQ ID NO: 4467556 - DNA, 15 bp, Homo sapiens
tatctggtgcctcct

SEQ ID NO: 4467557 - DNA, 16 bp, Homo sapiens
tatctgtaatgatact

SEQ ID NO: 4467558 - DNA, 21 bp, Homo sapiens
tatctgtagacggctcagtat

SEQ ID NO: 4467559 - DNA, 21 bp, Homo sapiens
tatctgtcatctctctggggc

SEQ ID NO: 4467560 - DNA, 19 bp, Homo sapiens
tatctgtgcttctaatatt

SEQ ID NO: 4467561 - DNA, 15 bp, Homo sapiens
tatctgtttgttact

SEQ ID NO: 4467562 - DNA, 17 bp, Homo sapiens
tatcttaagcatgtcaa

SEQ ID NO: 4467563 - DNA, 14 bp, Homo sapiens
tatcttacaaaata

SEQ ID NO: 4467564 - DNA, 22 bp, Homo sapiens
tatcttacaaaatacacattct

SEQ ID NO: 4467565 - DNA, 19 bp, Homo sapiens
tatcttacgtttaagctta

SEQ ID NO: 4467566 - DNA, 17 bp, Homo sapiens
tatcttactatttcaca

SEQ ID NO: 4467567 - DNA, 14 bp, Homo sapiens
tatcttataactgt

SEQ ID NO: 4467568 - DNA, 18 bp, Homo sapiens
tatcttataactgtttta

SEQ ID NO: 4467569 - DNA, 20 bp, Homo sapiens
tatcttcaccctcatccttt

SEQ ID NO: 4467570 - DNA, 23 bp, Homo sapiens
tatcttcatgtaaattgactgta

SEQ ID NO: 4467571 - DNA, 21 bp, Homo sapiens
tatcttcgttagtaatctgta

SEQ ID NO: 4467572 - DNA, 23 bp, Homo sapiens
tatcttcgttagtaatctgtata

SEQ ID NO: 4467573 - DNA, 14 bp, Homo sapiens
tatcttctgatttg

SEQ ID NO: 4467574 - DNA, 15 bp, Homo sapiens
tatcttcttaacagt

SEQ ID NO: 4467575 - DNA, 18 bp, Homo sapiens
tatcttctttattattcc

SEQ ID NO: 4467576 - DNA, 15 bp, Homo sapiens
tatcttgttattaat

SEQ ID NO: 4467577 - DNA, 17 bp, Homo sapiens
tatcttgttattaatgt

SEQ ID NO: 4467578 - DNA, 21 bp, Homo sapiens
tatcttgttattaatgtttct

SEQ ID NO: 4467579 - DNA, 17 bp, Homo sapiens
tatcttgttcaggaaaa

SEQ ID NO: 4467580 - DNA, 16 bp, Homo sapiens
tatcttgtttacaata

SEQ ID NO: 4467581 - DNA, 15 bp, Homo sapiens
tatctttattaaaac

SEQ ID NO: 4467582 - DNA, 12 bp, Homo sapiens
tatctttcagtt

SEQ ID NO: 4467583 - DNA, 19 bp, Homo sapiens
tatctttgattctccttca

SEQ ID NO: 4467584 - DNA, 18 bp, Homo sapiens
tatctttgtattcttcat

SEQ ID NO: 4467585 - DNA, 22 bp, Homo sapiens
tatctttgtattcttcatgaaa

SEQ ID NO: 4467586 - DNA, 18 bp, Homo sapiens
tatctttgtgtaatctaa

SEQ ID NO: 4467587 - DNA, 21 bp, Homo sapiens
tatcttttgtatatctaagac

SEQ ID NO: 4467588 - DNA, 17 bp, Homo sapiens
tatcttttgtttccttt

SEQ ID NO: 4467589 - DNA, 18 bp, Homo sapiens
tatctttttacctttcat

SEQ ID NO: 4467590 - DNA, 17 bp, Homo sapiens
tatcttttttaaactgt

SEQ ID NO: 4467591 - DNA, 15 bp, Homo sapiens
tatcttttttcctta

SEQ ID NO: 4467592 - DNA, 14 bp, Homo sapiens
tatgaaaaagaaga

SEQ ID NO: 4467593 - DNA, 19 bp, Homo sapiens
tatgaaaaattggggagga

SEQ ID NO: 4467594 - DNA, 21 bp, Homo sapiens
tatgaaaatatagacattctc

SEQ ID NO: 4467595 - DNA, 12 bp, Homo sapiens
tatgaaaatggg

SEQ ID NO: 4467596 - DNA, 19 bp, Homo sapiens
tatgaaaattatactgaga

SEQ ID NO: 4467597 - DNA, 22 bp, Homo sapiens
tatgaaagtagattcatgaaaa

SEQ ID NO: 4467598 - DNA, 15 bp, Homo sapiens
tatgaaatatatgtg

SEQ ID NO: 4467599 - DNA, 23 bp, Homo sapiens
tatgaacattgtactgttgcttt

SEQ ID NO: 4467600 - DNA, 22 bp, Homo sapiens
tatgaacccttcctgagcttta

SEQ ID NO: 4467601 - DNA, 20 bp, Homo sapiens
tatgaaccctttgtttcttg

SEQ ID NO: 4467602 - DNA, 21 bp, Homo sapiens
tatgaaccctttgtttcttgt

SEQ ID NO: 4467603 - DNA, 14 bp, Homo sapiens
tatgaagaactgag

SEQ ID NO: 4467604 - DNA, 16 bp, Homo sapiens
tatgaagaactgagga

SEQ ID NO: 4467605 - DNA, 17 bp, Homo sapiens
tatgaagaactgaggag

SEQ ID NO: 4467606 - DNA, 17 bp, Homo sapiens
tatgaagtataaatctg

SEQ ID NO: 4467607 - DNA, 20 bp, Homo sapiens
tatgaagtttttaaaaataa

SEQ ID NO: 4467608 - DNA, 22 bp, Homo sapiens
tatgaagtttttaaaaataaag

SEQ ID NO: 4467609 - DNA, 21 bp, Homo sapiens
tatgaatatatggcatttgca

SEQ ID NO: 4467610 - DNA, 12 bp, Homo sapiens
tatgaatcaaat

SEQ ID NO: 4467611 - DNA, 22 bp, Homo sapiens
tatgacactgttaatagtacta

SEQ ID NO: 4467612 - DNA, 20 bp, Homo sapiens
tatgacagctgtccctgtca

SEQ ID NO: 4467613 - DNA, 20 bp, Homo sapiens
tatgacagtgaattttgcac

SEQ ID NO: 4467614 - DNA, 23 bp, Homo sapiens
tatgacataagcaatcattttat

SEQ ID NO: 4467615 - DNA, 18 bp, Homo sapiens
tatgaccagaagccttgg

SEQ ID NO: 4467616 - DNA, 14 bp, Homo sapiens
tatgaccctgttta

SEQ ID NO: 4467617 - DNA, 16 bp, Homo sapiens
tatgactaattcacaa

SEQ ID NO: 4467618 - DNA, 21 bp, Homo sapiens
tatgactaatttggggaaaat

SEQ ID NO: 4467619 - DNA, 21 bp, Homo sapiens
tatgagaatataccttattta

SEQ ID NO: 4467620 - DNA, 14 bp, Homo sapiens
tatgagatactttg

SEQ ID NO: 4467621 - DNA, 14 bp, Homo sapiens
tatgagcttcaata

SEQ ID NO: 4467622 - DNA, 23 bp, Homo sapiens
tatgagcttcaatataagaagca

SEQ ID NO: 4467623 - DNA, 24 bp, Homo sapiens
tatgaggaaactgagtcactcaca

SEQ ID NO: 4467624 - DNA, 15 bp, Homo sapiens
tatgagggtgtttcc

SEQ ID NO: 4467625 - DNA, 16 bp, Homo sapiens
tatgagttcttgtttt

SEQ ID NO: 4467626 - DNA, 18 bp, Homo sapiens
tatgagttgttttcagac

SEQ ID NO: 4467627 - DNA, 22 bp, Homo sapiens
tatgagttgttttcagactcag

SEQ ID NO: 4467628 - DNA, 12 bp, Homo sapiens
tatgatatgcat

SEQ ID NO: 4467629 - DNA, 13 bp, Homo sapiens
tatgatatgcatg

SEQ ID NO: 4467630 - DNA, 22 bp, Homo sapiens
tatgatatgcatgtagcatata

SEQ ID NO: 4467631 - DNA, 22 bp, Homo sapiens
tatgatattttctgtgcctgaa

SEQ ID NO: 4467632 - DNA, 18 bp, Homo sapiens
tatgatccctaatgtgtt

SEQ ID NO: 4467633 - DNA, 15 bp, Homo sapiens
tatgatggagcaact

SEQ ID NO: 4467634 - DNA, 18 bp, Homo sapiens
tatgatggagcaactgaa

SEQ ID NO: 4467635 - DNA, 15 bp, Homo sapiens
tatgattactggcct

SEQ ID NO: 4467636 - DNA, 21 bp, Homo sapiens
tatgattattaacgatgtcca

SEQ ID NO: 4467637 - DNA, 18 bp, Homo sapiens
tatgattggttcagtttt

SEQ ID NO: 4467638 - DNA, 19 bp, Homo sapiens
tatgattttcataacttat

SEQ ID NO: 4467639 - DNA, 17 bp, Homo sapiens
tatgatttttttttcat

SEQ ID NO: 4467640 - DNA, 14 bp, Homo sapiens
tatgcaaaactttt

SEQ ID NO: 4467641 - DNA, 17 bp, Homo sapiens
tatgcaaacctcatctt

SEQ ID NO: 4467642 - DNA, 12 bp, Homo sapiens
tatgcaaagcac

SEQ ID NO: 4467643 - DNA, 15 bp, Homo sapiens
tatgcaagcagcttt

SEQ ID NO: 4467644 - DNA, 20 bp, Homo sapiens
tatgcactgaagagctcttg

SEQ ID NO: 4467645 - DNA, 22 bp, Homo sapiens
tatgcacttataattttcctaa

SEQ ID NO: 4467646 - DNA, 23 bp, Homo sapiens
tatgcactttttccttactgtgc

SEQ ID NO: 4467647 - DNA, 21 bp, Homo sapiens
tatgcagaaatagacaaaaag

SEQ ID NO: 4467648 - DNA, 16 bp, Homo sapiens
tatgcagcaaatatat

SEQ ID NO: 4467649 - DNA, 17 bp, Homo sapiens
tatgcaggcagcacagc

SEQ ID NO: 4467650 - DNA, 19 bp, Homo sapiens
tatgcagtattgagcactg

SEQ ID NO: 4467651 - DNA, 15 bp, Homo sapiens
tatgcatagatatat

SEQ ID NO: 4467652 - DNA, 14 bp, Homo sapiens
tatgcatatttgtt

SEQ ID NO: 4467653 - DNA, 15 bp, Homo sapiens
tatgcatatttgttt

SEQ ID NO: 4467654 - DNA, 20 bp, Homo sapiens
tatgcatgtagcatataaat

SEQ ID NO: 4467655 - DNA, 22 bp, Homo sapiens
tatgcattcacatttagaaaag

SEQ ID NO: 4467656 - DNA, 23 bp, Homo sapiens
tatgcattcacatttagaaaagt

SEQ ID NO: 4467657 - DNA, 21 bp, Homo sapiens
tatgcatttaaatacagtctt

SEQ ID NO: 4467658 - DNA, 20 bp, Homo sapiens
tatgccaatcttaaagacaa

SEQ ID NO: 4467659 - DNA, 21 bp, Homo sapiens
tatgccaccaacttacaaaaa

SEQ ID NO: 4467660 - DNA, 14 bp, Homo sapiens
tatgcctgtggtga

SEQ ID NO: 4467661 - DNA, 15 bp, Homo sapiens
tatgcctgtggtgaa

SEQ ID NO: 4467662 - DNA, 19 bp, Homo sapiens
tatgcctgtggtgaagtgt

SEQ ID NO: 4467663 - DNA, 18 bp, Homo sapiens
tatgctattgacaataaa

SEQ ID NO: 4467664 - DNA, 20 bp, Homo sapiens
tatgctattgacaataaaat

SEQ ID NO: 4467665 - DNA, 19 bp, Homo sapiens
tatgctggccagcaccctc

SEQ ID NO: 4467666 - DNA, 14 bp, Homo sapiens
tatgctgtatttct

SEQ ID NO: 4467667 - DNA, 19 bp, Homo sapiens
tatgctgtatttctttgta

SEQ ID NO: 4467668 - DNA, 13 bp, Homo sapiens
tatgctttccttc

SEQ ID NO: 4467669 - DNA, 15 bp, Homo sapiens
tatggaaaaataaaa

SEQ ID NO: 4467670 - DNA, 20 bp, Homo sapiens
tatggaaaaataaaactgtc

SEQ ID NO: 4467671 - DNA, 15 bp, Homo sapiens
tatggaaatctttta

SEQ ID NO: 4467672 - DNA, 20 bp, Homo sapiens
tatggaacataaagttgtat

SEQ ID NO: 4467673 - DNA, 22 bp, Homo sapiens
tatggaagggtttgtggctggg

SEQ ID NO: 4467674 - DNA, 16 bp, Homo sapiens
tatggaatatcatctg

SEQ ID NO: 4467675 - DNA, 20 bp, Homo sapiens
tatggaatatcatctgtcat

SEQ ID NO: 4467676 - DNA, 11 bp, Homo sapiens
tatggaattga

SEQ ID NO: 4467677 - DNA, 17 bp, Homo sapiens
tatggactgttttgata

SEQ ID NO: 4467678 - DNA, 19 bp, Homo sapiens
tatggagaaacaaaatcct

SEQ ID NO: 4467679 - DNA, 15 bp, Homo sapiens
tatggagactttgct

SEQ ID NO: 4467680 - DNA, 18 bp, Homo sapiens
tatggaggattctttccc

SEQ ID NO: 4467681 - DNA, 22 bp, Homo sapiens
tatggaggattctttccccaga

SEQ ID NO: 4467682 - DNA, 19 bp, Homo sapiens
tatggaggctttgcataga

SEQ ID NO: 4467683 - DNA, 17 bp, Homo sapiens
tatggagtcttgtgaaa

SEQ ID NO: 4467684 - DNA, 16 bp, Homo sapiens
tatggagttaaataaa

SEQ ID NO: 4467685 - DNA, 15 bp, Homo sapiens
tatggatatatttga

SEQ ID NO: 4467686 - DNA, 21 bp, Homo sapiens
tatggatatatttgaaatagt

SEQ ID NO: 4467687 - DNA, 22 bp, Homo sapiens
tatggatatatttgaaatagta

SEQ ID NO: 4467688 - DNA, 16 bp, Homo sapiens
tatggatgattaaatt

SEQ ID NO: 4467689 - DNA, 14 bp, Homo sapiens
tatggattcacttc

SEQ ID NO: 4467690 - DNA, 15 bp, Homo sapiens
tatggatttccagtt

SEQ ID NO: 4467691 - DNA, 14 bp, Homo sapiens
tatggcatttctat

SEQ ID NO: 4467692 - DNA, 19 bp, Homo sapiens
tatggcatttgcagatttt

SEQ ID NO: 4467693 - DNA, 16 bp, Homo sapiens
tatggccagtctgccc

SEQ ID NO: 4467694 - DNA, 22 bp, Homo sapiens
tatggcccagtgtcaagttgtg

SEQ ID NO: 4467695 - DNA, 16 bp, Homo sapiens
tatggcctgacagctc

SEQ ID NO: 4467696 - DNA, 17 bp, Homo sapiens
tatggcctgacagctct

SEQ ID NO: 4467697 - DNA, 18 bp, Homo sapiens
tatggcctgacagctctg

SEQ ID NO: 4467698 - DNA, 19 bp, Homo sapiens
tatggctatctatacctgc

SEQ ID NO: 4467699 - DNA, 22 bp, Homo sapiens
tatggctatctatacctgcctt

SEQ ID NO: 4467700 - DNA, 23 bp, Homo sapiens
tatggctttcaaagctaaaatat

SEQ ID NO: 4467701 - DNA, 15 bp, Homo sapiens
tatgggagccccagg

SEQ ID NO: 4467702 - DNA, 16 bp, Homo sapiens
tatgggagccccaggg

SEQ ID NO: 4467703 - DNA, 20 bp, Homo sapiens
tatgggatattcccaagccg

SEQ ID NO: 4467704 - DNA, 15 bp, Homo sapiens
tatgggggcatctct

SEQ ID NO: 4467705 - DNA, 23 bp, Homo sapiens
tatgggggcatctcttccccaga

SEQ ID NO: 4467706 - DNA, 14 bp, Homo sapiens
tatgggtcctctgg

SEQ ID NO: 4467707 - DNA, 19 bp, Homo sapiens
tatgggtgggattttgcaa

SEQ ID NO: 4467708 - DNA, 11 bp, Homo sapiens
tatggtaaaaa

SEQ ID NO: 4467709 - DNA, 19 bp, Homo sapiens
tatggtaactgctttctgt

SEQ ID NO: 4467710 - DNA, 15 bp, Homo sapiens
tatggtacatctacc

SEQ ID NO: 4467711 - DNA, 21 bp, Homo sapiens
tatggtacatttttcaacttt

SEQ ID NO: 4467712 - DNA, 14 bp, Homo sapiens
tatggtagaaaaat

SEQ ID NO: 4467713 - DNA, 19 bp, Homo sapiens
tatggtagaaaaatttcac

SEQ ID NO: 4467714 - DNA, 22 bp, Homo sapiens
tatggtagaaaaatttcacgat

SEQ ID NO: 4467715 - DNA, 22 bp, Homo sapiens
tatggtatgctggccagcaccc

SEQ ID NO: 4467716 - DNA, 19 bp, Homo sapiens
tatggtcctaaaagcaaaa

SEQ ID NO: 4467717 - DNA, 20 bp, Homo sapiens
tatgtaaataggtttctaaa

SEQ ID NO: 4467718 - DNA, 12 bp, Homo sapiens
tatgtaaatgtg

SEQ ID NO: 4467719 - DNA, 16 bp, Homo sapiens
tatgtaagaacacatt

SEQ ID NO: 4467720 - DNA, 17 bp, Homo sapiens
tatgtaataatgtacag

SEQ ID NO: 4467721 - DNA, 16 bp, Homo sapiens
tatgtaatgaagtaaa

SEQ ID NO: 4467722 - DNA, 12 bp, Homo sapiens
tatgtaatttct

SEQ ID NO: 4467723 - DNA, 14 bp, Homo sapiens
tatgtacaaccctg

SEQ ID NO: 4467724 - DNA, 17 bp, Homo sapiens
tatgtacaaccctgacc

SEQ ID NO: 4467725 - DNA, 17 bp, Homo sapiens
tatgtacaatacaatgt

SEQ ID NO: 4467726 - DNA, 14 bp, Homo sapiens
tatgtagataacaa

SEQ ID NO: 4467727 - DNA, 14 bp, Homo sapiens
tatgtatgtaaaaa

SEQ ID NO: 4467728 - DNA, 23 bp, Homo sapiens
tatgtatttaagatgtacattta

SEQ ID NO: 4467729 - DNA, 13 bp, Homo sapiens
tatgtcatagaaa

SEQ ID NO: 4467730 - DNA, 15 bp, Homo sapiens
tatgtcatagaaata

SEQ ID NO: 4467731 - DNA, 17 bp, Homo sapiens
tatgtcatttttaatgt

SEQ ID NO: 4467732 - DNA, 18 bp, Homo sapiens
tatgtcatttttaatgta

SEQ ID NO: 4467733 - DNA, 22 bp, Homo sapiens
tatgtcctgtgagatgtgtatc

SEQ ID NO: 4467734 - DNA, 18 bp, Homo sapiens
tatgtctcttgagcatca

SEQ ID NO: 4467735 - DNA, 14 bp, Homo sapiens
tatgtctgaacata

SEQ ID NO: 4467736 - DNA, 14 bp, Homo sapiens
tatgtctgccttcg

SEQ ID NO: 4467737 - DNA, 18 bp, Homo sapiens
tatgtgaaatgctttctg

SEQ ID NO: 4467738 - DNA, 19 bp, Homo sapiens
tatgtgacaattttgtaca

SEQ ID NO: 4467739 - DNA, 14 bp, Homo sapiens
tatgtgacattaac

SEQ ID NO: 4467740 - DNA, 20 bp, Homo sapiens
tatgtgagatttccttatca

SEQ ID NO: 4467741 - DNA, 23 bp, Homo sapiens
tatgtgctattaatatttgttta

SEQ ID NO: 4467742 - DNA, 17 bp, Homo sapiens
tatgtgggcagattttc

SEQ ID NO: 4467743 - DNA, 19 bp, Homo sapiens
tatgtgggggtctgtgtgt

SEQ ID NO: 4467744 - DNA, 16 bp, Homo sapiens
tatgtgtgaggagctg

SEQ ID NO: 4467745 - DNA, 16 bp, Homo sapiens
tatgtgtgccctggac

SEQ ID NO: 4467746 - DNA, 17 bp, Homo sapiens
tatgtgtgccctggact

SEQ ID NO: 4467747 - DNA, 18 bp, Homo sapiens
tatgtgtgtttctgtcct

SEQ ID NO: 4467748 - DNA, 16 bp, Homo sapiens
tatgtgttacattatt

SEQ ID NO: 4467749 - DNA, 17 bp, Homo sapiens
tatgtgttatgaacatc

SEQ ID NO: 4467750 - DNA, 16 bp, Homo sapiens
tatgtgttgaaaacca

SEQ ID NO: 4467751 - DNA, 17 bp, Homo sapiens
tatgtgttgaaaaccaa

SEQ ID NO: 4467752 - DNA, 19 bp, Homo sapiens
tatgtgttgaaaaccaaaa

SEQ ID NO: 4467753 - DNA, 23 bp, Homo sapiens
tatgtgttgaaaaccaaaatgac

SEQ ID NO: 4467754 - DNA, 20 bp, Homo sapiens
tatgtgtttctcctcagaag

SEQ ID NO: 4467755 - DNA, 20 bp, Homo sapiens
tatgtgttttttgcaacata

SEQ ID NO: 4467756 - DNA, 19 bp, Homo sapiens
tatgttaagggaagaattc

SEQ ID NO: 4467757 - DNA, 22 bp, Homo sapiens
tatgttatacaaccttcattta

SEQ ID NO: 4467758 - DNA, 16 bp, Homo sapiens
tatgttcagaaaatgc

SEQ ID NO: 4467759 - DNA, 12 bp, Homo sapiens
tatgttcttggc

SEQ ID NO: 4467760 - DNA, 12 bp, Homo sapiens
tatgttgaatac

SEQ ID NO: 4467761 - DNA, 13 bp, Homo sapiens
tatgttgataaac

SEQ ID NO: 4467762 - DNA, 15 bp, Homo sapiens
tatgttgctttgaaa

SEQ ID NO: 4467763 - DNA, 20 bp, Homo sapiens
tatgttggttgatataacac

SEQ ID NO: 4467764 - DNA, 22 bp, Homo sapiens
tatgtttaagatatatttccaa

SEQ ID NO: 4467765 - DNA, 14 bp, Homo sapiens
tatgtttatttcat

SEQ ID NO: 4467766 - DNA, 23 bp, Homo sapiens
tatgtttctacacattgctacct

SEQ ID NO: 4467767 - DNA, 13 bp, Homo sapiens
tatgtttgctgat

SEQ ID NO: 4467768 - DNA, 13 bp, Homo sapiens
tatgttttaacaa

SEQ ID NO: 4467769 - DNA, 14 bp, Homo sapiens
tatgtttttctgta

SEQ ID NO: 4467770 - DNA, 18 bp, Homo sapiens
tattaaaaaacttcatgt

SEQ ID NO: 4467771 - DNA, 15 bp, Homo sapiens
tattaaaaaagtcta

SEQ ID NO: 4467772 - DNA, 12 bp, Homo sapiens
tattaaaactca

SEQ ID NO: 4467773 - DNA, 16 bp, Homo sapiens
tattaaaactcagcct

SEQ ID NO: 4467774 - DNA, 14 bp, Homo sapiens
tattaaaattctga

SEQ ID NO: 4467775 - DNA, 12 bp, Homo sapiens
tattaaacaaag

SEQ ID NO: 4467776 - DNA, 13 bp, Homo sapiens
tattaaacaaagt

SEQ ID NO: 4467777 - DNA, 17 bp, Homo sapiens
tattaaacaaagtttca

SEQ ID NO: 4467778 - DNA, 20 bp, Homo sapiens
tattaaagatttatttagct

SEQ ID NO: 4467779 - DNA, 21 bp, Homo sapiens
tattaaagatttatttagcta

SEQ ID NO: 4467780 - DNA, 23 bp, Homo sapiens
tattaaaggtgaaaattgtataa

SEQ ID NO: 4467781 - DNA, 20 bp, Homo sapiens
tattaaaggttaaattgctt

SEQ ID NO: 4467782 - DNA, 19 bp, Homo sapiens
tattaaataataaagtatg

SEQ ID NO: 4467783 - DNA, 12 bp, Homo sapiens
tattaaatgcca

SEQ ID NO: 4467784 - DNA, 17 bp, Homo sapiens
tattaaatgtttcaaaa

SEQ ID NO: 4467785 - DNA, 15 bp, Homo sapiens
tattaacgatgtcca

SEQ ID NO: 4467786 - DNA, 23 bp, Homo sapiens
tattaactctgcatagacaaagg

SEQ ID NO: 4467787 - DNA, 13 bp, Homo sapiens
tattaagaaagga

SEQ ID NO: 4467788 - DNA, 20 bp, Homo sapiens
tattaagaaaggaagcattg

SEQ ID NO: 4467789 - DNA, 24 bp, Homo sapiens
tattaagaaaggaagcattgtaaa

SEQ ID NO: 4467790 - DNA, 16 bp, Homo sapiens
tattaagaacatttta

SEQ ID NO: 4467791 - DNA, 20 bp, Homo sapiens
tattaagaacattttataaa

SEQ ID NO: 4467792 - DNA, 20 bp, Homo sapiens
tattaagaagcaataactat

SEQ ID NO: 4467793 - DNA, 18 bp, Homo sapiens
tattaagacaatagcact

SEQ ID NO: 4467794 - DNA, 21 bp, Homo sapiens
tattaagcccacagtatattt

SEQ ID NO: 4467795 - DNA, 13 bp, Homo sapiens
tattaagcttttt

SEQ ID NO: 4467796 - DNA, 19 bp, Homo sapiens
tattaagctttttggaatc

SEQ ID NO: 4467797 - DNA, 13 bp, Homo sapiens
tattaataaaaag

SEQ ID NO: 4467798 - DNA, 16 bp, Homo sapiens
tattaataaaaagaca

SEQ ID NO: 4467799 - DNA, 21 bp, Homo sapiens
tattaatataataatgatgat

SEQ ID NO: 4467800 - DNA, 18 bp, Homo sapiens
tattaatatatatctgct

SEQ ID NO: 4467801 - DNA, 12 bp, Homo sapiens
tattaatattta

SEQ ID NO: 4467802 - DNA, 24 bp, Homo sapiens
tattaatatttaggagtctatttt

SEQ ID NO: 4467803 - DNA, 21 bp, Homo sapiens
tattaatcttggatagctaat

SEQ ID NO: 4467804 - DNA, 22 bp, Homo sapiens
tattaatcttggatagctaata

SEQ ID NO: 4467805 - DNA, 13 bp, Homo sapiens
tattaatgaaaat

SEQ ID NO: 4467806 - DNA, 17 bp, Homo sapiens
tattaatgcactttcta

SEQ ID NO: 4467807 - DNA, 20 bp, Homo sapiens
tattacaaatattgtcatct

SEQ ID NO: 4467808 - DNA, 21 bp, Homo sapiens
tattacaaatattgtcatctt

SEQ ID NO: 4467809 - DNA, 22 bp, Homo sapiens
tattacaaatattgtcatcttt

SEQ ID NO: 4467810 - DNA, 12 bp, Homo sapiens
tattacaaatgc

SEQ ID NO: 4467811 - DNA, 15 bp, Homo sapiens
tattacaacatttat

SEQ ID NO: 4467812 - DNA, 14 bp, Homo sapiens
tattacaatgatca

SEQ ID NO: 4467813 - DNA, 16 bp, Homo sapiens
tattacaatgtatctt

SEQ ID NO: 4467814 - DNA, 17 bp, Homo sapiens
tattacatatatcatta

SEQ ID NO: 4467815 - DNA, 15 bp, Homo sapiens
tattacattttcagt

SEQ ID NO: 4467816 - DNA, 15 bp, Homo sapiens
tattaccccttttcg

SEQ ID NO: 4467817 - DNA, 15 bp, Homo sapiens
tattacctattaggt

SEQ ID NO: 4467818 - DNA, 12 bp, Homo sapiens
tattactagtgt

SEQ ID NO: 4467819 - DNA, 23 bp, Homo sapiens
tattactagtgtttaagtcattt

SEQ ID NO: 4467820 - DNA, 16 bp, Homo sapiens
tattactgatgtgtgc

SEQ ID NO: 4467821 - DNA, 15 bp, Homo sapiens
tattactttaaatta

SEQ ID NO: 4467822 - DNA, 16 bp, Homo sapiens
tattacttttctgttt

SEQ ID NO: 4467823 - DNA, 18 bp, Homo sapiens
tattagagtgtctttcca

SEQ ID NO: 4467824 - DNA, 16 bp, Homo sapiens
tattaggtggaaattt

SEQ ID NO: 4467825 - DNA, 13 bp, Homo sapiens
tattagtaattta

SEQ ID NO: 4467826 - DNA, 14 bp, Homo sapiens
tattagttgctttg

SEQ ID NO: 4467827 - DNA, 15 bp, Homo sapiens
tattataaactataa

SEQ ID NO: 4467828 - DNA, 20 bp, Homo sapiens
tattataaactataaactta

SEQ ID NO: 4467829 - DNA, 19 bp, Homo sapiens
tattataactctgtataat

SEQ ID NO: 4467830 - DNA, 19 bp, Homo sapiens
tattataagtcttacataa

SEQ ID NO: 4467831 - DNA, 14 bp, Homo sapiens
tattataagtgctt

SEQ ID NO: 4467832 - DNA, 12 bp, Homo sapiens
tattataagttg

SEQ ID NO: 4467833 - DNA, 18 bp, Homo sapiens
tattataagttgaccttt

SEQ ID NO: 4467834 - DNA, 21 bp, Homo sapiens
tattataagttgacctttatt

SEQ ID NO: 4467835 - DNA, 21 bp, Homo sapiens
tattatagcaactttaagaag

SEQ ID NO: 4467836 - DNA, 15 bp, Homo sapiens
tattatatatttaca

SEQ ID NO: 4467837 - DNA, 17 bp, Homo sapiens
tattatatatttacaga

SEQ ID NO: 4467838 - DNA, 23 bp, Homo sapiens
tattatatatttacagaagaaaa

SEQ ID NO: 4467839 - DNA, 17 bp, Homo sapiens
tattatatcagcttttc

SEQ ID NO: 4467840 - DNA, 14 bp, Homo sapiens
tattatatgttcta

SEQ ID NO: 4467841 - DNA, 14 bp, Homo sapiens
tattatctgggctt

SEQ ID NO: 4467842 - DNA, 18 bp, Homo sapiens
tattatcttcttaacagt

SEQ ID NO: 4467843 - DNA, 21 bp, Homo sapiens
tattatcttgttcaggaaaag

SEQ ID NO: 4467844 - DNA, 16 bp, Homo sapiens
tattatggaaaactgt

SEQ ID NO: 4467845 - DNA, 19 bp, Homo sapiens
tattatgtcctgtgagatg

SEQ ID NO: 4467846 - DNA, 21 bp, Homo sapiens
tattatgtctcttctgagcta

SEQ ID NO: 4467847 - DNA, 16 bp, Homo sapiens
tattatgtgaagaatt

SEQ ID NO: 4467848 - DNA, 14 bp, Homo sapiens
tattatgttgttca

SEQ ID NO: 4467849 - DNA, 15 bp, Homo sapiens
tattattaatttatt

SEQ ID NO: 4467850 - DNA, 19 bp, Homo sapiens
tattattaatttattgggg

SEQ ID NO: 4467851 - DNA, 22 bp, Homo sapiens
tattattataatcttataattg

SEQ ID NO: 4467852 - DNA, 16 bp, Homo sapiens
tattattcccattcta

SEQ ID NO: 4467853 - DNA, 23 bp, Homo sapiens
tattattcccgacgacacatata

SEQ ID NO: 4467854 - DNA, 22 bp, Homo sapiens
tattatttgggggaactggaca

SEQ ID NO: 4467855 - DNA, 17 bp, Homo sapiens
tattattttaaatttct

SEQ ID NO: 4467856 - DNA, 20 bp, Homo sapiens
tattattttagtgtgtaaaa

SEQ ID NO: 4467857 - DNA, 21 bp, Homo sapiens
tattattttagtgtgtaaaat

SEQ ID NO: 4467858 - DNA, 23 bp, Homo sapiens
tattattttagtgtgtaaaatta

SEQ ID NO: 4467859 - DNA, 18 bp, Homo sapiens
tattatttttttaaacaa

SEQ ID NO: 4467860 - DNA, 16 bp, Homo sapiens
tattcaaagagaaaac

SEQ ID NO: 4467861 - DNA, 22 bp, Homo sapiens
tattcaaagatgataatttagt

SEQ ID NO: 4467862 - DNA, 22 bp, Homo sapiens
tattcaaatttgatgatgttaa

SEQ ID NO: 4467863 - DNA, 19 bp, Homo sapiens
tattcaactaatacatggt

SEQ ID NO: 4467864 - DNA, 18 bp, Homo sapiens
tattcaactattcttcat

SEQ ID NO: 4467865 - DNA, 12 bp, Homo sapiens
tattcagaatat

SEQ ID NO: 4467866 - DNA, 15 bp, Homo sapiens
tattcagacaaaatg

SEQ ID NO: 4467867 - DNA, 16 bp, Homo sapiens
tattcagacaaaatgg

SEQ ID NO: 4467868 - DNA, 21 bp, Homo sapiens
tattcagacaaaatggataca

SEQ ID NO: 4467869 - DNA, 16 bp, Homo sapiens
tattcaggcactgaga

SEQ ID NO: 4467870 - DNA, 21 bp, Homo sapiens
tattcagtggtgaaatcttgt

SEQ ID NO: 4467871 - DNA, 23 bp, Homo sapiens
tattcatagcagcttattcacaa

SEQ ID NO: 4467872 - DNA, 16 bp, Homo sapiens
tattcatagtttaatt

SEQ ID NO: 4467873 - DNA, 19 bp, Homo sapiens
tattcatatacaaacatgt

SEQ ID NO: 4467874 - DNA, 17 bp, Homo sapiens
tattcatattggaaaaa

SEQ ID NO: 4467875 - DNA, 17 bp, Homo sapiens
tattcattatttgtcaa

SEQ ID NO: 4467876 - DNA, 19 bp, Homo sapiens
tattcattatttgtcaaat

SEQ ID NO: 4467877 - DNA, 13 bp, Homo sapiens
tattcattcactc

SEQ ID NO: 4467878 - DNA, 16 bp, Homo sapiens
tattcattcctcacaa

SEQ ID NO: 4467879 - DNA, 17 bp, Homo sapiens
tattccaaaccaaattt

SEQ ID NO: 4467880 - DNA, 18 bp, Homo sapiens
tattccaccttaaattaa

SEQ ID NO: 4467881 - DNA, 21 bp, Homo sapiens
tattccagaatgctgtacatc

SEQ ID NO: 4467882 - DNA, 23 bp, Homo sapiens
tattccagaatgctgtacatcta

SEQ ID NO: 4467883 - DNA, 13 bp, Homo sapiens
tattcccaagccg

SEQ ID NO: 4467884 - DNA, 19 bp, Homo sapiens
tattcccgacgacacatat

SEQ ID NO: 4467885 - DNA, 15 bp, Homo sapiens
tattccctgcacaca

SEQ ID NO: 4467886 - DNA, 18 bp, Homo sapiens
tattccctgcacacacat

SEQ ID NO: 4467887 - DNA, 21 bp, Homo sapiens
tattcctaatggctatttttg

SEQ ID NO: 4467888 - DNA, 13 bp, Homo sapiens
tattcctgccttt

SEQ ID NO: 4467889 - DNA, 15 bp, Homo sapiens
tattcctgcctttga

SEQ ID NO: 4467890 - DNA, 13 bp, Homo sapiens
tattcctttcctt

SEQ ID NO: 4467891 - DNA, 21 bp, Homo sapiens
tattcctttccttttttgaga

SEQ ID NO: 4467892 - DNA, 15 bp, Homo sapiens
tattcctttttctat

SEQ ID NO: 4467893 - DNA, 16 bp, Homo sapiens
tattcgaatgaaaaga

SEQ ID NO: 4467894 - DNA, 19 bp, Homo sapiens
tattctaagaaatatctgt

SEQ ID NO: 4467895 - DNA, 15 bp, Homo sapiens
tattctaattaaaat

SEQ ID NO: 4467896 - DNA, 16 bp, Homo sapiens
tattctagcctgcatt

SEQ ID NO: 4467897 - DNA, 21 bp, Homo sapiens
tattctagcctgcattgagct

SEQ ID NO: 4467898 - DNA, 14 bp, Homo sapiens
tattctcactccac

SEQ ID NO: 4467899 - DNA, 17 bp, Homo sapiens
tattctctttttaacaa

SEQ ID NO: 4467900 - DNA, 20 bp, Homo sapiens
tattctgacatgtaagaaaa

SEQ ID NO: 4467901 - DNA, 16 bp, Homo sapiens
tattctgacttcctct

SEQ ID NO: 4467902 - DNA, 18 bp, Homo sapiens
tattctgtcagtgttaaa

SEQ ID NO: 4467903 - DNA, 14 bp, Homo sapiens
tattctgttttgtt

SEQ ID NO: 4467904 - DNA, 21 bp, Homo sapiens
tattctgttttgttaatatac

SEQ ID NO: 4467905 - DNA, 19 bp, Homo sapiens
tattcttaaaatgcaatat

SEQ ID NO: 4467906 - DNA, 21 bp, Homo sapiens
tattcttaaaatgcaatattt

SEQ ID NO: 4467907 - DNA, 14 bp, Homo sapiens
tattcttcatgaaa

SEQ ID NO: 4467908 - DNA, 21 bp, Homo sapiens
tattcttcatgaaatgtgttt

SEQ ID NO: 4467909 - DNA, 20 bp, Homo sapiens
tattcttggaccatgccaga

SEQ ID NO: 4467910 - DNA, 15 bp, Homo sapiens
tattcttgtttgaat

SEQ ID NO: 4467911 - DNA, 19 bp, Homo sapiens
tattgaaaattgaaaagta

SEQ ID NO: 4467912 - DNA, 17 bp, Homo sapiens
tattgaaagttgctttt

SEQ ID NO: 4467913 - DNA, 15 bp, Homo sapiens
tattgaaatgctgta

SEQ ID NO: 4467914 - DNA, 15 bp, Homo sapiens
tattgaataaagaga

SEQ ID NO: 4467915 - DNA, 18 bp, Homo sapiens
tattgaatactgtctgta

SEQ ID NO: 4467916 - DNA, 15 bp, Homo sapiens
tattgaattagaaaa

SEQ ID NO: 4467917 - DNA, 22 bp, Homo sapiens
tattgaatttttcctatgctat

SEQ ID NO: 4467918 - DNA, 13 bp, Homo sapiens
tattgacaataaa

SEQ ID NO: 4467919 - DNA, 21 bp, Homo sapiens
tattgacaataaaatattatt

SEQ ID NO: 4467920 - DNA, 24 bp, Homo sapiens
tattgacactgaacttaataactg

SEQ ID NO: 4467921 - DNA, 20 bp, Homo sapiens
tattgacaggtcttttcaaa

SEQ ID NO: 4467922 - DNA, 21 bp, Homo sapiens
tattgacaggtcttttcaaat

SEQ ID NO: 4467923 - DNA, 22 bp, Homo sapiens
tattgactaacaggccaaagag

SEQ ID NO: 4467924 - DNA, 19 bp, Homo sapiens
tattgagcagaattcattc

SEQ ID NO: 4467925 - DNA, 14 bp, Homo sapiens
tattgagtcaaatg

SEQ ID NO: 4467926 - DNA, 21 bp, Homo sapiens
tattgagtcttaactgtattt

SEQ ID NO: 4467927 - DNA, 23 bp, Homo sapiens
tattgagtcttaactgtatttca

SEQ ID NO: 4467928 - DNA, 14 bp, Homo sapiens
tattgagtttgtag

SEQ ID NO: 4467929 - DNA, 14 bp, Homo sapiens
tattgataaatttt

SEQ ID NO: 4467930 - DNA, 11 bp, Homo sapiens
tattgatattc

SEQ ID NO: 4467931 - DNA, 18 bp, Homo sapiens
tattgatcccttctcctg

SEQ ID NO: 4467932 - DNA, 23 bp, Homo sapiens
tattgatcccttctcctgccctt

SEQ ID NO: 4467933 - DNA, 22 bp, Homo sapiens
tattgatgcagtgtgtctttat

SEQ ID NO: 4467934 - DNA, 22 bp, Homo sapiens
tattgatgtacagtctgtcatg

SEQ ID NO: 4467935 - DNA, 20 bp, Homo sapiens
tattgatttgaaaagaattt

SEQ ID NO: 4467936 - DNA, 22 bp, Homo sapiens
tattgatttgaaaagaatttgt

SEQ ID NO: 4467937 - DNA, 24 bp, Homo sapiens
tattgcaaatgagggaagaacatt

SEQ ID NO: 4467938 - DNA, 11 bp, Homo sapiens
tattgcagttt

SEQ ID NO: 4467939 - DNA, 19 bp, Homo sapiens
tattgcagtttatcattca

SEQ ID NO: 4467940 - DNA, 11 bp, Homo sapiens
tattgcataag

SEQ ID NO: 4467941 - DNA, 17 bp, Homo sapiens
tattgcatgcaatttga

SEQ ID NO: 4467942 - DNA, 13 bp, Homo sapiens
tattgccttattt

SEQ ID NO: 4467943 - DNA, 19 bp, Homo sapiens
tattgccttctcaccagct

SEQ ID NO: 4467944 - DNA, 20 bp, Homo sapiens
tattgccttctcaccagctg

SEQ ID NO: 4467945 - DNA, 23 bp, Homo sapiens
tattgctcgcccagacaccatgt

SEQ ID NO: 4467946 - DNA, 15 bp, Homo sapiens
tattgctgaagaatc

SEQ ID NO: 4467947 - DNA, 16 bp, Homo sapiens
tattgctgattttaat

SEQ ID NO: 4467948 - DNA, 12 bp, Homo sapiens
tattgctgtgtc

SEQ ID NO: 4467949 - DNA, 14 bp, Homo sapiens
tattgcttcaattt

SEQ ID NO: 4467950 - DNA, 14 bp, Homo sapiens
tattgcttcttgtg

SEQ ID NO: 4467951 - DNA, 19 bp, Homo sapiens
tattgcttgttggattttt

SEQ ID NO: 4467952 - DNA, 23 bp, Homo sapiens
tattggcttgataaacataatta

SEQ ID NO: 4467953 - DNA, 15 bp, Homo sapiens
tattggggaattaaa

SEQ ID NO: 4467954 - DNA, 19 bp, Homo sapiens
tattggggaattaaatagt

SEQ ID NO: 4467955 - DNA, 19 bp, Homo sapiens
tattggggaccaaatcaaa

SEQ ID NO: 4467956 - DNA, 20 bp, Homo sapiens
tattgggtgtagatttctga

SEQ ID NO: 4467957 - DNA, 22 bp, Homo sapiens
tattggtccagcttgctcttca

SEQ ID NO: 4467958 - DNA, 15 bp, Homo sapiens
tattgtaaaacaggt

SEQ ID NO: 4467959 - DNA, 13 bp, Homo sapiens
tattgtaaatgtg

SEQ ID NO: 4467960 - DNA, 18 bp, Homo sapiens
tattgtaatgagtgaatt

SEQ ID NO: 4467961 - DNA, 12 bp, Homo sapiens
tattgtacagaa

SEQ ID NO: 4467962 - DNA, 17 bp, Homo sapiens
tattgtatattacaatg

SEQ ID NO: 4467963 - DNA, 19 bp, Homo sapiens
tattgtatattacaatgat

SEQ ID NO: 4467964 - DNA, 19 bp, Homo sapiens
tattgtcgctatgtgactt

SEQ ID NO: 4467965 - DNA, 17 bp, Homo sapiens
tattgtctattatttag

SEQ ID NO: 4467966 - DNA, 14 bp, Homo sapiens
tattgtctgtaaat

SEQ ID NO: 4467967 - DNA, 22 bp, Homo sapiens
tattgtctgtaaatctaacatt

SEQ ID NO: 4467968 - DNA, 13 bp, Homo sapiens
tattgtctgtctc

SEQ ID NO: 4467969 - DNA, 19 bp, Homo sapiens
tattgtgacttcactgtat

SEQ ID NO: 4467970 - DNA, 22 bp, Homo sapiens
tattgtgccaactgccaggctg

SEQ ID NO: 4467971 - DNA, 22 bp, Homo sapiens
tattgtgttttgctttggaaac

SEQ ID NO: 4467972 - DNA, 14 bp, Homo sapiens
tattgttactctta

SEQ ID NO: 4467973 - DNA, 15 bp, Homo sapiens
tattgttataaataa

SEQ ID NO: 4467974 - DNA, 17 bp, Homo sapiens
tattgttcagcatgcaa

SEQ ID NO: 4467975 - DNA, 14 bp, Homo sapiens
tattgttgaaaaag

SEQ ID NO: 4467976 - DNA, 17 bp, Homo sapiens
tattgttgaaaaagttt

SEQ ID NO: 4467977 - DNA, 12 bp, Homo sapiens
tattgtttcaat

SEQ ID NO: 4467978 - DNA, 15 bp, Homo sapiens
tattgtttctacaat

SEQ ID NO: 4467979 - DNA, 14 bp, Homo sapiens
tattgtttgctgtt

SEQ ID NO: 4467980 - DNA, 17 bp, Homo sapiens
tattgttttacaatagt

SEQ ID NO: 4467981 - DNA, 15 bp, Homo sapiens
tattgtttttatttc

SEQ ID NO: 4467982 - DNA, 14 bp, Homo sapiens
tatttaaaaaacta

SEQ ID NO: 4467983 - DNA, 14 bp, Homo sapiens
tatttaaaaaatta

SEQ ID NO: 4467984 - DNA, 21 bp, Homo sapiens
tatttaaaaaattatggaata

SEQ ID NO: 4467985 - DNA, 14 bp, Homo sapiens
tatttaaaaacatt

SEQ ID NO: 4467986 - DNA, 15 bp, Homo sapiens
tatttaaaaacattt

SEQ ID NO: 4467987 - DNA, 21 bp, Homo sapiens
tatttaaaatagcaaaagaag

SEQ ID NO: 4467988 - DNA, 19 bp, Homo sapiens
tatttaaaccgctaaaaga

SEQ ID NO: 4467989 - DNA, 14 bp, Homo sapiens
tatttaaattacaa

SEQ ID NO: 4467990 - DNA, 13 bp, Homo sapiens
tatttaaattctt

SEQ ID NO: 4467991 - DNA, 18 bp, Homo sapiens
tatttaacaagatgtttc

SEQ ID NO: 4467992 - DNA, 13 bp, Homo sapiens
tatttaacagaaa

SEQ ID NO: 4467993 - DNA, 18 bp, Homo sapiens
tatttaactacatctgcc

SEQ ID NO: 4467994 - DNA, 15 bp, Homo sapiens
tatttaactggtgca

SEQ ID NO: 4467995 - DNA, 12 bp, Homo sapiens
tatttaagcaaa

SEQ ID NO: 4467996 - DNA, 17 bp, Homo sapiens
tatttaagcaaatactt

SEQ ID NO: 4467997 - DNA, 17 bp, Homo sapiens
tatttaagctttaaatg

SEQ ID NO: 4467998 - DNA, 18 bp, Homo sapiens
tatttaagctttaaatga

SEQ ID NO: 4467999 - DNA, 23 bp, Homo sapiens
tatttaagctttaaatgacagta

SEQ ID NO: 4468000 - DNA, 23 bp, Homo sapiens
tatttaatacagctgaagtcaaa

SEQ ID NO: 4468001 - DNA, 18 bp, Homo sapiens
tatttaatagcaaagaat

SEQ ID NO: 4468002 - DNA, 19 bp, Homo sapiens
tatttaatagcaaagaatt

SEQ ID NO: 4468003 - DNA, 20 bp, Homo sapiens
tatttaatagcaaagaattg

SEQ ID NO: 4468004 - DNA, 13 bp, Homo sapiens
tatttaatatcaa

SEQ ID NO: 4468005 - DNA, 18 bp, Homo sapiens
tatttaatatcaaaagaa

SEQ ID NO: 4468006 - DNA, 18 bp, Homo sapiens
tatttaatgatgattatg

SEQ ID NO: 4468007 - DNA, 20 bp, Homo sapiens
tatttaatggaagtgtattt

SEQ ID NO: 4468008 - DNA, 15 bp, Homo sapiens
tatttaattgtaaac

SEQ ID NO: 4468009 - DNA, 13 bp, Homo sapiens
tatttaatttgaa

SEQ ID NO: 4468010 - DNA, 23 bp, Homo sapiens
tatttaatttgaaggtagaatgt

SEQ ID NO: 4468011 - DNA, 14 bp, Homo sapiens
tatttacaatgtat

SEQ ID NO: 4468012 - DNA, 17 bp, Homo sapiens
tatttacaatgtattaa

SEQ ID NO: 4468013 - DNA, 23 bp, Homo sapiens
tatttacagaagaaaagcatgca

SEQ ID NO: 4468014 - DNA, 14 bp, Homo sapiens
tatttaccaaaaat

SEQ ID NO: 4468015 - DNA, 15 bp, Homo sapiens
tatttacccttttcc

SEQ ID NO: 4468016 - DNA, 18 bp, Homo sapiens
tatttacctagtgcaaaa

SEQ ID NO: 4468017 - DNA, 14 bp, Homo sapiens
tatttacgctttga

SEQ ID NO: 4468018 - DNA, 22 bp, Homo sapiens
tatttacgctttgattcatagt

SEQ ID NO: 4468019 - DNA, 13 bp, Homo sapiens
tatttagaaatga

SEQ ID NO: 4468020 - DNA, 17 bp, Homo sapiens
tatttagaactttgtat

SEQ ID NO: 4468021 - DNA, 15 bp, Homo sapiens
tatttagacaagaga

SEQ ID NO: 4468022 - DNA, 19 bp, Homo sapiens
tatttagactgtggccata

SEQ ID NO: 4468023 - DNA, 21 bp, Homo sapiens
tatttagatgataaagagaca

SEQ ID NO: 4468024 - DNA, 23 bp, Homo sapiens
tatttagatgataaagagacagt

SEQ ID NO: 4468025 - DNA, 17 bp, Homo sapiens
tatttagctgttttgga

SEQ ID NO: 4468026 - DNA, 14 bp, Homo sapiens
tatttagtttttaa

SEQ ID NO: 4468027 - DNA, 13 bp, Homo sapiens
tatttatatactt

SEQ ID NO: 4468028 - DNA, 14 bp, Homo sapiens
tatttatgtgtgag

SEQ ID NO: 4468029 - DNA, 14 bp, Homo sapiens
tatttattaaactt

SEQ ID NO: 4468030 - DNA, 16 bp, Homo sapiens
tatttattaaacttca

SEQ ID NO: 4468031 - DNA, 18 bp, Homo sapiens
tatttattaaacttcagc

SEQ ID NO: 4468032 - DNA, 13 bp, Homo sapiens
tatttattaaatt

SEQ ID NO: 4468033 - DNA, 14 bp, Homo sapiens
tatttattaaattt

SEQ ID NO: 4468034 - DNA, 13 bp, Homo sapiens
tatttattacata

SEQ ID NO: 4468035 - DNA, 16 bp, Homo sapiens
tatttattacataatt

SEQ ID NO: 4468036 - DNA, 12 bp, Homo sapiens
tatttattcatt

SEQ ID NO: 4468037 - DNA, 22 bp, Homo sapiens
tatttattcattatttgtcaaa

SEQ ID NO: 4468038 - DNA, 12 bp, Homo sapiens
tatttattgaaa

SEQ ID NO: 4468039 - DNA, 16 bp, Homo sapiens
tatttattgaaatgat

SEQ ID NO: 4468040 - DNA, 14 bp, Homo sapiens
tatttatttattta

SEQ ID NO: 4468041 - DNA, 15 bp, Homo sapiens
tatttattttagcaa

SEQ ID NO: 4468042 - DNA, 17 bp, Homo sapiens
tatttattttagcaaat

SEQ ID NO: 4468043 - DNA, 21 bp, Homo sapiens
tatttatttttacctgctttt

SEQ ID NO: 4468044 - DNA, 18 bp, Homo sapiens
tatttcaaattggagctt

SEQ ID NO: 4468045 - DNA, 14 bp, Homo sapiens
tatttcaagtgcct

SEQ ID NO: 4468046 - DNA, 15 bp, Homo sapiens
tatttcacaacagcc

SEQ ID NO: 4468047 - DNA, 21 bp, Homo sapiens
tatttcacttaaactttgtca

SEQ ID NO: 4468048 - DNA, 17 bp, Homo sapiens
tatttcagattttgata

SEQ ID NO: 4468049 - DNA, 19 bp, Homo sapiens
tatttcagattttgataac

SEQ ID NO: 4468050 - DNA, 23 bp, Homo sapiens
tatttcagattttgataactgtt

SEQ ID NO: 4468051 - DNA, 18 bp, Homo sapiens
tatttcagctgctttgac

SEQ ID NO: 4468052 - DNA, 21 bp, Homo sapiens
tatttcaggcattggatattt

SEQ ID NO: 4468053 - DNA, 17 bp, Homo sapiens
tatttcagtattttcca

SEQ ID NO: 4468054 - DNA, 18 bp, Homo sapiens
tatttcagtattttccag

SEQ ID NO: 4468055 - DNA, 21 bp, Homo sapiens
tatttcagtgataatgttcat

SEQ ID NO: 4468056 - DNA, 15 bp, Homo sapiens
tatttcagtgatttt

SEQ ID NO: 4468057 - DNA, 19 bp, Homo sapiens
tatttccaaacctggttca

SEQ ID NO: 4468058 - DNA, 18 bp, Homo sapiens
tatttccaagaacctata

SEQ ID NO: 4468059 - DNA, 15 bp, Homo sapiens
tatttccactaaaaa

SEQ ID NO: 4468060 - DNA, 18 bp, Homo sapiens
tatttccctctcattttg

SEQ ID NO: 4468061 - DNA, 13 bp, Homo sapiens
tatttcctccctc

SEQ ID NO: 4468062 - DNA, 14 bp, Homo sapiens
tatttcctcttgaa

SEQ ID NO: 4468063 - DNA, 14 bp, Homo sapiens
tatttcctttatgt

SEQ ID NO: 4468064 - DNA, 16 bp, Homo sapiens
tatttcctttatgtga

SEQ ID NO: 4468065 - DNA, 17 bp, Homo sapiens
tatttcctttatgtgaa

SEQ ID NO: 4468066 - DNA, 17 bp, Homo sapiens
tatttcgaccctggggc

SEQ ID NO: 4468067 - DNA, 20 bp, Homo sapiens
tatttctaatccttttcctt

SEQ ID NO: 4468068 - DNA, 14 bp, Homo sapiens
tatttctattatta

SEQ ID NO: 4468069 - DNA, 21 bp, Homo sapiens
tatttctccatcccctccctg

SEQ ID NO: 4468070 - DNA, 19 bp, Homo sapiens
tatttctctggcaaacttt

SEQ ID NO: 4468071 - DNA, 20 bp, Homo sapiens
tatttctctggcaaactttt

SEQ ID NO: 4468072 - DNA, 14 bp, Homo sapiens
tatttctgaaggta

SEQ ID NO: 4468073 - DNA, 21 bp, Homo sapiens
tatttctgaaggtagcattct

SEQ ID NO: 4468074 - DNA, 17 bp, Homo sapiens
tatttctgatttcataa

SEQ ID NO: 4468075 - DNA, 19 bp, Homo sapiens
tatttctgatttcataatt

SEQ ID NO: 4468076 - DNA, 17 bp, Homo sapiens
tatttctgcatatgttg

SEQ ID NO: 4468077 - DNA, 15 bp, Homo sapiens
tatttctgtatataa

SEQ ID NO: 4468078 - DNA, 11 bp, Homo sapiens
tatttctgtga

SEQ ID NO: 4468079 - DNA, 13 bp, Homo sapiens
tatttctgtgaaa

SEQ ID NO: 4468080 - DNA, 15 bp, Homo sapiens
tatttctgtgaaaga

SEQ ID NO: 4468081 - DNA, 18 bp, Homo sapiens
tatttctgtgaaagaagt

SEQ ID NO: 4468082 - DNA, 10 bp, Homo sapiens
tatttcttaa

SEQ ID NO: 4468083 - DNA, 17 bp, Homo sapiens
tatttcttaagaattca

SEQ ID NO: 4468084 - DNA, 23 bp, Homo sapiens
tatttcttaattattataaaaat

SEQ ID NO: 4468085 - DNA, 16 bp, Homo sapiens
tatttctttgtagaat

SEQ ID NO: 4468086 - DNA, 17 bp, Homo sapiens
tatttctttgtagaata

SEQ ID NO: 4468087 - DNA, 15 bp, Homo sapiens
tatttctttttatag

SEQ ID NO: 4468088 - DNA, 16 bp, Homo sapiens
tatttgaaaaaaactt

SEQ ID NO: 4468089 - DNA, 23 bp, Homo sapiens
tatttgaaaaaaacttcattctc

SEQ ID NO: 4468090 - DNA, 19 bp, Homo sapiens
tatttgaaaattacatgtt

SEQ ID NO: 4468091 - DNA, 20 bp, Homo sapiens
tatttgaaaattacatgttt

SEQ ID NO: 4468092 - DNA, 15 bp, Homo sapiens
tatttgaacaagtgg

SEQ ID NO: 4468093 - DNA, 14 bp, Homo sapiens
tatttgaataaatt

SEQ ID NO: 4468094 - DNA, 17 bp, Homo sapiens
tatttgactttttcaca

SEQ ID NO: 4468095 - DNA, 15 bp, Homo sapiens
tatttgattatgtat

SEQ ID NO: 4468096 - DNA, 20 bp, Homo sapiens
tatttgattatgtatggata

SEQ ID NO: 4468097 - DNA, 17 bp, Homo sapiens
tatttgattcaaaatat

SEQ ID NO: 4468098 - DNA, 21 bp, Homo sapiens
tatttgattcaaaatatttaa

SEQ ID NO: 4468099 - DNA, 20 bp, Homo sapiens
tatttgcaaatatactttac

SEQ ID NO: 4468100 - DNA, 22 bp, Homo sapiens
tatttgcaggtctttaaatcat

SEQ ID NO: 4468101 - DNA, 22 bp, Homo sapiens
tatttgcataacaattcctcta

SEQ ID NO: 4468102 - DNA, 15 bp, Homo sapiens
tatttgctaatgtat

SEQ ID NO: 4468103 - DNA, 19 bp, Homo sapiens
tatttgctaatgtataatg

SEQ ID NO: 4468104 - DNA, 20 bp, Homo sapiens
tatttgggggaactggacac

SEQ ID NO: 4468105 - DNA, 16 bp, Homo sapiens
tatttgtaaatttatg

SEQ ID NO: 4468106 - DNA, 14 bp, Homo sapiens
tatttgtaatagat

SEQ ID NO: 4468107 - DNA, 12 bp, Homo sapiens
tatttgtaatta

SEQ ID NO: 4468108 - DNA, 14 bp, Homo sapiens
tatttgtaattaaa

SEQ ID NO: 4468109 - DNA, 15 bp, Homo sapiens
tatttgtataaaaat

SEQ ID NO: 4468110 - DNA, 18 bp, Homo sapiens
tatttgtataaaagtgtg

SEQ ID NO: 4468111 - DNA, 20 bp, Homo sapiens
tatttgtatgatattttaaa

SEQ ID NO: 4468112 - DNA, 10 bp, Homo sapiens
tatttgtcaa

SEQ ID NO: 4468113 - DNA, 20 bp, Homo sapiens
tatttgtcatgctgggattt

SEQ ID NO: 4468114 - DNA, 15 bp, Homo sapiens
tatttgtctcttaca

SEQ ID NO: 4468115 - DNA, 17 bp, Homo sapiens
tatttgttatatataat

SEQ ID NO: 4468116 - DNA, 19 bp, Homo sapiens
tatttgtttagttcagcaa

SEQ ID NO: 4468117 - DNA, 21 bp, Homo sapiens
tatttgtttatggtaaaaaat

SEQ ID NO: 4468118 - DNA, 21 bp, Homo sapiens
tatttgtttttattgtaaaac

SEQ ID NO: 4468119 - DNA, 17 bp, Homo sapiens
tattttaaaatttgttc

SEQ ID NO: 4468120 - DNA, 13 bp, Homo sapiens
tattttaaagaat

SEQ ID NO: 4468121 - DNA, 12 bp, Homo sapiens
tattttaaatat

SEQ ID NO: 4468122 - DNA, 11 bp, Homo sapiens
tattttaaatt

SEQ ID NO: 4468123 - DNA, 18 bp, Homo sapiens
tattttaaattataagga

SEQ ID NO: 4468124 - DNA, 22 bp, Homo sapiens
tattttaaattataaggactgc

SEQ ID NO: 4468125 - DNA, 21 bp, Homo sapiens
tattttaattttaaagagtgt

SEQ ID NO: 4468126 - DNA, 22 bp, Homo sapiens
tattttacatgaagctgtataa

SEQ ID NO: 4468127 - DNA, 16 bp, Homo sapiens
tattttagaaagctaa

SEQ ID NO: 4468128 - DNA, 16 bp, Homo sapiens
tattttagaataaatt

SEQ ID NO: 4468129 - DNA, 19 bp, Homo sapiens
tattttagcaaatcagtat

SEQ ID NO: 4468130 - DNA, 17 bp, Homo sapiens
tattttagggttctaaa

SEQ ID NO: 4468131 - DNA, 22 bp, Homo sapiens
tattttagggttctaaatgcaa

SEQ ID NO: 4468132 - DNA, 20 bp, Homo sapiens
tattttaggtgctgttatgt

SEQ ID NO: 4468133 - DNA, 22 bp, Homo sapiens
tattttaggtgtaaaataatta

SEQ ID NO: 4468134 - DNA, 14 bp, Homo sapiens
tattttataatcag

SEQ ID NO: 4468135 - DNA, 20 bp, Homo sapiens
tattttatatcatacagttt

SEQ ID NO: 4468136 - DNA, 20 bp, Homo sapiens
tattttatgaacattgtact

SEQ ID NO: 4468137 - DNA, 19 bp, Homo sapiens
tattttattctatgtatgt

SEQ ID NO: 4468138 - DNA, 17 bp, Homo sapiens
tattttattttattgaa

SEQ ID NO: 4468139 - DNA, 13 bp, Homo sapiens
tattttcaccatt

SEQ ID NO: 4468140 - DNA, 14 bp, Homo sapiens
tattttcagaatct

SEQ ID NO: 4468141 - DNA, 21 bp, Homo sapiens
tattttcagaatctgaatgta

SEQ ID NO: 4468142 - DNA, 23 bp, Homo sapiens
tattttcagggttttaaacacta

SEQ ID NO: 4468143 - DNA, 17 bp, Homo sapiens
tattttcatagtgacct

SEQ ID NO: 4468144 - DNA, 23 bp, Homo sapiens
tattttcccaatagcactttcat

SEQ ID NO: 4468145 - DNA, 16 bp, Homo sapiens
tattttcgtgtgagat

SEQ ID NO: 4468146 - DNA, 15 bp, Homo sapiens
tattttctacagtgg

SEQ ID NO: 4468147 - DNA, 13 bp, Homo sapiens
tattttctgtatt

SEQ ID NO: 4468148 - DNA, 14 bp, Homo sapiens
tattttctgttcta

SEQ ID NO: 4468149 - DNA, 13 bp, Homo sapiens
tattttcttttta

SEQ ID NO: 4468150 - DNA, 14 bp, Homo sapiens
tattttctttttat

SEQ ID NO: 4468151 - DNA, 13 bp, Homo sapiens
tattttgaatcaa

SEQ ID NO: 4468152 - DNA, 23 bp, Homo sapiens
tattttgaatcaataatatattt

SEQ ID NO: 4468153 - DNA, 12 bp, Homo sapiens
tattttgacaga

SEQ ID NO: 4468154 - DNA, 18 bp, Homo sapiens
tattttgacagaagctat

SEQ ID NO: 4468155 - DNA, 23 bp, Homo sapiens
tattttgacagaagctatttcat

SEQ ID NO: 4468156 - DNA, 18 bp, Homo sapiens
tattttgacataaagttg

SEQ ID NO: 4468157 - DNA, 16 bp, Homo sapiens
tattttgagaaactgc

SEQ ID NO: 4468158 - DNA, 21 bp, Homo sapiens
tattttgagtcctaggactta

SEQ ID NO: 4468159 - DNA, 14 bp, Homo sapiens
tattttgataataa

SEQ ID NO: 4468160 - DNA, 16 bp, Homo sapiens
tattttgatataattg

SEQ ID NO: 4468161 - DNA, 13 bp, Homo sapiens
tattttgatgcag

SEQ ID NO: 4468162 - DNA, 17 bp, Homo sapiens
tattttgatgcagcatt

SEQ ID NO: 4468163 - DNA, 19 bp, Homo sapiens
tattttgatgcagcatttg

SEQ ID NO: 4468164 - DNA, 20 bp, Homo sapiens
tattttgcactctgtaattg

SEQ ID NO: 4468165 - DNA, 13 bp, Homo sapiens
tattttgccattt

SEQ ID NO: 4468166 - DNA, 14 bp, Homo sapiens
tattttgtaaaatg

SEQ ID NO: 4468167 - DNA, 17 bp, Homo sapiens
tattttgtaaaatgtat

SEQ ID NO: 4468168 - DNA, 16 bp, Homo sapiens
tattttgtaatattct

SEQ ID NO: 4468169 - DNA, 20 bp, Homo sapiens
tattttgtactttgtggaga

SEQ ID NO: 4468170 - DNA, 18 bp, Homo sapiens
tattttgtagttaatata

SEQ ID NO: 4468171 - DNA, 15 bp, Homo sapiens
tattttgtatgaaat

SEQ ID NO: 4468172 - DNA, 15 bp, Homo sapiens
tatttttatacttta

SEQ ID NO: 4468173 - DNA, 22 bp, Homo sapiens
tatttttatataatatctaaag

SEQ ID NO: 4468174 - DNA, 23 bp, Homo sapiens
tatttttatataatatctaaagt

SEQ ID NO: 4468175 - DNA, 20 bp, Homo sapiens
tatttttatatcatgcaaaa

SEQ ID NO: 4468176 - DNA, 21 bp, Homo sapiens
tatttttatatttcctttatg

SEQ ID NO: 4468177 - DNA, 18 bp, Homo sapiens
tatttttgacatggaaat

SEQ ID NO: 4468178 - DNA, 18 bp, Homo sapiens
tatttttgctgcttctga

SEQ ID NO: 4468179 - DNA, 19 bp, Homo sapiens
tatttttggcagtctgaat

SEQ ID NO: 4468180 - DNA, 15 bp, Homo sapiens
tatttttgtgtaggt

SEQ ID NO: 4468181 - DNA, 19 bp, Homo sapiens
tattttttcttttctttac

SEQ ID NO: 4468182 - DNA, 14 bp, Homo sapiens
tattttttgtataa

SEQ ID NO: 4468183 - DNA, 16 bp, Homo sapiens
tattttttgtataatt

SEQ ID NO: 4468184 - DNA, 18 bp, Homo sapiens
tatttttttaaacaaaat

SEQ ID NO: 4468185 - DNA, 20 bp, Homo sapiens
tatttttttaaatcaaggaa

SEQ ID NO: 4468186 - DNA, 19 bp, Homo sapiens
tatttttttagattgagaa

SEQ ID NO: 4468187 - DNA, 20 bp, Homo sapiens
tatttttttcctaagacatt

SEQ ID NO: 4468188 - DNA, 19 bp, Homo sapiens
tatttttttttctaagaga

SEQ ID NO: 4468189 - DNA, 18 bp, Homo sapiens
tcaaaaaaaaaaagaaaa

SEQ ID NO: 4468190 - DNA, 16 bp, Homo sapiens
tcaaaaaaaagaaaaa

SEQ ID NO: 4468191 - DNA, 18 bp, Homo sapiens
tcaaaaaacctttacagt

SEQ ID NO: 4468192 - DNA, 14 bp, Homo sapiens
tcaaaaagaaatca

SEQ ID NO: 4468193 - DNA, 22 bp, Homo sapiens
tcaaaaataaaaaatctgaaga

SEQ ID NO: 4468194 - DNA, 23 bp, Homo sapiens
tcaaaaataaaaaatctgaagag

SEQ ID NO: 4468195 - DNA, 18 bp, Homo sapiens
tcaaaaattttgaatgta

SEQ ID NO: 4468196 - DNA, 20 bp, Homo sapiens
tcaaaacaatattactttgt

SEQ ID NO: 4468197 - DNA, 23 bp, Homo sapiens
tcaaaacctgattggccactgga

SEQ ID NO: 4468198 - DNA, 13 bp, Homo sapiens
tcaaaactgcact

SEQ ID NO: 4468199 - DNA, 21 bp, Homo sapiens
tcaaaacttggacccttggaa

SEQ ID NO: 4468200 - DNA, 17 bp, Homo sapiens
tcaaaagaatctattag

SEQ ID NO: 4468201 - DNA, 22 bp, Homo sapiens
tcaaaagctatttaaagcatct

SEQ ID NO: 4468202 - DNA, 21 bp, Homo sapiens
tcaaaatacttctttttcatt

SEQ ID NO: 4468203 - DNA, 19 bp, Homo sapiens
tcaaaatagaaaagttatt

SEQ ID NO: 4468204 - DNA, 22 bp, Homo sapiens
tcaaaatagggactatctatct

SEQ ID NO: 4468205 - DNA, 20 bp, Homo sapiens
tcaaaatattgagcagaatt

SEQ ID NO: 4468206 - DNA, 13 bp, Homo sapiens
tcaaaatatttaa

SEQ ID NO: 4468207 - DNA, 14 bp, Homo sapiens
tcaaaatatttaaa

SEQ ID NO: 4468208 - DNA, 19 bp, Homo sapiens
tcaaaatatttaaaaatgt

SEQ ID NO: 4468209 - DNA, 23 bp, Homo sapiens
tcaaaatgctctaatgagcattt

SEQ ID NO: 4468210 - DNA, 17 bp, Homo sapiens
tcaaaatgctttttatt

SEQ ID NO: 4468211 - DNA, 16 bp, Homo sapiens
tcaaaatggtgtgcta

SEQ ID NO: 4468212 - DNA, 21 bp, Homo sapiens
tcaaaatttaacagttacctg

SEQ ID NO: 4468213 - DNA, 21 bp, Homo sapiens
tcaaacaccaacataaaaatg

SEQ ID NO: 4468214 - DNA, 22 bp, Homo sapiens
tcaaacagtctcaggaaatcaa

SEQ ID NO: 4468215 - DNA, 15 bp, Homo sapiens
tcaaacattttctgg

SEQ ID NO: 4468216 - DNA, 22 bp, Homo sapiens
tcaaaccaagggtacagatccc

SEQ ID NO: 4468217 - DNA, 15 bp, Homo sapiens
tcaaactcattgcag

SEQ ID NO: 4468218 - DNA, 22 bp, Homo sapiens
tcaaactccaaggttcccttgt

SEQ ID NO: 4468219 - DNA, 19 bp, Homo sapiens
tcaaactccctagtctcca

SEQ ID NO: 4468220 - DNA, 19 bp, Homo sapiens
tcaaactgaggaatttcac

SEQ ID NO: 4468221 - DNA, 22 bp, Homo sapiens
tcaaacttggatacttggattt

SEQ ID NO: 4468222 - DNA, 18 bp, Homo sapiens
tcaaactttacagaaaga

SEQ ID NO: 4468223 - DNA, 12 bp, Homo sapiens
tcaaagaaagtg

SEQ ID NO: 4468224 - DNA, 14 bp, Homo sapiens
tcaaagaaagtgta

SEQ ID NO: 4468225 - DNA, 11 bp, Homo sapiens
tcaaagaagct

SEQ ID NO: 4468226 - DNA, 15 bp, Homo sapiens
tcaaagaagcttcca

SEQ ID NO: 4468227 - DNA, 15 bp, Homo sapiens
tcaaagaagtcggaa

SEQ ID NO: 4468228 - DNA, 16 bp, Homo sapiens
tcaaagaagtcggaat

SEQ ID NO: 4468229 - DNA, 23 bp, Homo sapiens
tcaaagaagtcggaatgtcatag

SEQ ID NO: 4468230 - DNA, 15 bp, Homo sapiens
tcaaagagaagatgc

SEQ ID NO: 4468231 - DNA, 21 bp, Homo sapiens
tcaaagaggtgaacattaaaa

SEQ ID NO: 4468232 - DNA, 13 bp, Homo sapiens
tcaaagcaagcat

SEQ ID NO: 4468233 - DNA, 19 bp, Homo sapiens
tcaaagcaattgaaatgca

SEQ ID NO: 4468234 - DNA, 15 bp, Homo sapiens
tcaaagcataaaatg

SEQ ID NO: 4468235 - DNA, 22 bp, Homo sapiens
tcaaagcatggacatttagaag

SEQ ID NO: 4468236 - DNA, 23 bp, Homo sapiens
tcaaagccagcgtcctcctctgt

SEQ ID NO: 4468237 - DNA, 23 bp, Homo sapiens
tcaaagtaaggctggtaagagaa

SEQ ID NO: 4468238 - DNA, 18 bp, Homo sapiens
tcaaagtctcaatgaaat

SEQ ID NO: 4468239 - DNA, 19 bp, Homo sapiens
tcaaagtggtaaatactgt

SEQ ID NO: 4468240 - DNA, 22 bp, Homo sapiens
tcaaagtggtaaatactgtgaa

SEQ ID NO: 4468241 - DNA, 20 bp, Homo sapiens
tcaaagtgtaaacaccatag

SEQ ID NO: 4468242 - DNA, 22 bp, Homo sapiens
tcaaagtgtaacagatatcagt

SEQ ID NO: 4468243 - DNA, 17 bp, Homo sapiens
tcaaagttcatagagtt

SEQ ID NO: 4468244 - DNA, 12 bp, Homo sapiens
tcaaagtttata

SEQ ID NO: 4468245 - DNA, 15 bp, Homo sapiens
tcaaagtttatatgc

SEQ ID NO: 4468246 - DNA, 15 bp, Homo sapiens
tcaaataaacactgt

SEQ ID NO: 4468247 - DNA, 16 bp, Homo sapiens
tcaaataaacactgtg

SEQ ID NO: 4468248 - DNA, 14 bp, Homo sapiens
tcaaatacatgcac

SEQ ID NO: 4468249 - DNA, 20 bp, Homo sapiens
tcaaataggctattaaaaaa

SEQ ID NO: 4468250 - DNA, 17 bp, Homo sapiens
tcaaatatgcaaagcac

SEQ ID NO: 4468251 - DNA, 14 bp, Homo sapiens
tcaaatcctctttt

SEQ ID NO: 4468252 - DNA, 14 bp, Homo sapiens
tcaaatgaaatgta

SEQ ID NO: 4468253 - DNA, 23 bp, Homo sapiens
tcaaatgaaatgtatgcattcac

SEQ ID NO: 4468254 - DNA, 22 bp, Homo sapiens
tcaaatgaataatgcctttgta

SEQ ID NO: 4468255 - DNA, 18 bp, Homo sapiens
tcaaatgaatgattaaat

SEQ ID NO: 4468256 - DNA, 17 bp, Homo sapiens
tcaaatgatcctcccac

SEQ ID NO: 4468257 - DNA, 20 bp, Homo sapiens
tcaaatgatttcatattgat

SEQ ID NO: 4468258 - DNA, 16 bp, Homo sapiens
tcaaatgcagtatatt

SEQ ID NO: 4468259 - DNA, 19 bp, Homo sapiens
tcaaatgcagtatatttct

SEQ ID NO: 4468260 - DNA, 13 bp, Homo sapiens
tcaaatggactgt

SEQ ID NO: 4468261 - DNA, 15 bp, Homo sapiens
tcaaatggactgtta

SEQ ID NO: 4468262 - DNA, 19 bp, Homo sapiens
tcaaatgtaaactctcttc

SEQ ID NO: 4468263 - DNA, 17 bp, Homo sapiens
tcaaatgtgcattttgt

SEQ ID NO: 4468264 - DNA, 17 bp, Homo sapiens
tcaaattactaatgatt

SEQ ID NO: 4468265 - DNA, 19 bp, Homo sapiens
tcaaattactaatgattta

SEQ ID NO: 4468266 - DNA, 13 bp, Homo sapiens
tcaaattcagctc

SEQ ID NO: 4468267 - DNA, 15 bp, Homo sapiens
tcaaattcttctgaa

SEQ ID NO: 4468268 - DNA, 16 bp, Homo sapiens
tcaaattcttctgaac

SEQ ID NO: 4468269 - DNA, 18 bp, Homo sapiens
tcaaatttatttccaatg

SEQ ID NO: 4468270 - DNA, 13 bp, Homo sapiens
tcaaattttgtac

SEQ ID NO: 4468271 - DNA, 21 bp, Homo sapiens
tcaaattttttaaaagagaca

SEQ ID NO: 4468272 - DNA, 16 bp, Homo sapiens
tcaaattttttgactt

SEQ ID NO: 4468273 - DNA, 15 bp, Homo sapiens
tcaacaaaaattgtc

SEQ ID NO: 4468274 - DNA, 20 bp, Homo sapiens
tcaacaaagaaacaaagatg

SEQ ID NO: 4468275 - DNA, 22 bp, Homo sapiens
tcaacaagatttccttgtgcaa

SEQ ID NO: 4468276 - DNA, 17 bp, Homo sapiens
tcaacaataaaattttt

SEQ ID NO: 4468277 - DNA, 18 bp, Homo sapiens
tcaacaattggtgtcatt

SEQ ID NO: 4468278 - DNA, 19 bp, Homo sapiens
tcaacaattggtgtcattt

SEQ ID NO: 4468279 - DNA, 20 bp, Homo sapiens
tcaacaattggtgtcatttt

SEQ ID NO: 4468280 - DNA, 23 bp, Homo sapiens
tcaacaattggtgtcattttctt

SEQ ID NO: 4468281 - DNA, 18 bp, Homo sapiens
tcaacaccttaatatgct

SEQ ID NO: 4468282 - DNA, 16 bp, Homo sapiens
tcaacagagactgaat

SEQ ID NO: 4468283 - DNA, 16 bp, Homo sapiens
tcaacagagaggacca

SEQ ID NO: 4468284 - DNA, 13 bp, Homo sapiens
tcaacagtaaacc

SEQ ID NO: 4468285 - DNA, 22 bp, Homo sapiens
tcaacagtaaaccactgaaaaa

SEQ ID NO: 4468286 - DNA, 16 bp, Homo sapiens
tcaacataaagagcaa

SEQ ID NO: 4468287 - DNA, 23 bp, Homo sapiens
tcaacatacattggttttgaaat

SEQ ID NO: 4468288 - DNA, 13 bp, Homo sapiens
tcaacatactgta

SEQ ID NO: 4468289 - DNA, 15 bp, Homo sapiens
tcaacatactgtaat

SEQ ID NO: 4468290 - DNA, 16 bp, Homo sapiens
tcaacatagtgagaca

SEQ ID NO: 4468291 - DNA, 14 bp, Homo sapiens
tcaacatttctcaa

SEQ ID NO: 4468292 - DNA, 12 bp, Homo sapiens
tcaacccccctc

SEQ ID NO: 4468293 - DNA, 13 bp, Homo sapiens
tcaacctgcctga

SEQ ID NO: 4468294 - DNA, 19 bp, Homo sapiens
tcaacctggtggcaccaga

SEQ ID NO: 4468295 - DNA, 12 bp, Homo sapiens
tcaacctgtaaa

SEQ ID NO: 4468296 - DNA, 15 bp, Homo sapiens
tcaacctgtaaatta

SEQ ID NO: 4468297 - DNA, 20 bp, Homo sapiens
tcaaccttccaacttcctgt

SEQ ID NO: 4468298 - DNA, 23 bp, Homo sapiens
tcaacgcttaaaggtgtcttcct

SEQ ID NO: 4468299 - DNA, 17 bp, Homo sapiens
tcaacggggggctcctg

SEQ ID NO: 4468300 - DNA, 19 bp, Homo sapiens
tcaacggggggctcctgcc

SEQ ID NO: 4468301 - DNA, 17 bp, Homo sapiens
tcaactaatacatggtt

SEQ ID NO: 4468302 - DNA, 12 bp, Homo sapiens
tcaactattctt

SEQ ID NO: 4468303 - DNA, 21 bp, Homo sapiens
tcaactccaaggcacactgtt

SEQ ID NO: 4468304 - DNA, 20 bp, Homo sapiens
tcaactcccaacttcttcct

SEQ ID NO: 4468305 - DNA, 19 bp, Homo sapiens
tcaactcccttctcggggt

SEQ ID NO: 4468306 - DNA, 18 bp, Homo sapiens
tcaactctacccctgctc

SEQ ID NO: 4468307 - DNA, 20 bp, Homo sapiens
tcaactctccaatgttctat

SEQ ID NO: 4468308 - DNA, 16 bp, Homo sapiens
tcaactctttgttatt

SEQ ID NO: 4468309 - DNA, 14 bp, Homo sapiens
tcaactgcccagca

SEQ ID NO: 4468310 - DNA, 14 bp, Homo sapiens
tcaactgcctactc

SEQ ID NO: 4468311 - DNA, 15 bp, Homo sapiens
tcaacttaataagat

SEQ ID NO: 4468312 - DNA, 19 bp, Homo sapiens
tcaacttgcaatttgcaag

SEQ ID NO: 4468313 - DNA, 20 bp, Homo sapiens
tcaacttgggctactgaact

SEQ ID NO: 4468314 - DNA, 21 bp, Homo sapiens
tcaactttagtatttttacta

SEQ ID NO: 4468315 - DNA, 17 bp, Homo sapiens
tcaactttttattgcct

SEQ ID NO: 4468316 - DNA, 22 bp, Homo sapiens
tcaactttttattgccttctca

SEQ ID NO: 4468317 - DNA, 23 bp, Homo sapiens
tcaactttttattgccttctcac

SEQ ID NO: 4468318 - DNA, 23 bp, Homo sapiens
tcaacttttttcccttgggctgg

SEQ ID NO: 4468319 - DNA, 20 bp, Homo sapiens
tcaagaagtatttttttaat

SEQ ID NO: 4468320 - DNA, 23 bp, Homo sapiens
tcaagaagtatttttttaatttc

SEQ ID NO: 4468321 - DNA, 13 bp, Homo sapiens
tcaagacatttct

SEQ ID NO: 4468322 - DNA, 13 bp, Homo sapiens
tcaagacatttgc

SEQ ID NO: 4468323 - DNA, 17 bp, Homo sapiens
tcaagacatttgctgaa

SEQ ID NO: 4468324 - DNA, 18 bp, Homo sapiens
tcaagaccagcctggtca

SEQ ID NO: 4468325 - DNA, 15 bp, Homo sapiens
tcaagactatctaca

SEQ ID NO: 4468326 - DNA, 12 bp, Homo sapiens
tcaagagaaact

SEQ ID NO: 4468327 - DNA, 13 bp, Homo sapiens
tcaagagaaactt

SEQ ID NO: 4468328 - DNA, 16 bp, Homo sapiens
tcaagagaaacttcaa

SEQ ID NO: 4468329 - DNA, 16 bp, Homo sapiens
tcaagagatctttctt

SEQ ID NO: 4468330 - DNA, 16 bp, Homo sapiens
tcaagagctgccctcc

SEQ ID NO: 4468331 - DNA, 12 bp, Homo sapiens
tcaagaggaatc

SEQ ID NO: 4468332 - DNA, 19 bp, Homo sapiens
tcaagagtttattattgta

SEQ ID NO: 4468333 - DNA, 18 bp, Homo sapiens
tcaagatatatgtgtata

SEQ ID NO: 4468334 - DNA, 22 bp, Homo sapiens
tcaagatgatgatgatctttaa

SEQ ID NO: 4468335 - DNA, 15 bp, Homo sapiens
tcaagatttttttcc

SEQ ID NO: 4468336 - DNA, 19 bp, Homo sapiens
tcaagcaatccacctgcct

SEQ ID NO: 4468337 - DNA, 22 bp, Homo sapiens
tcaagcaatcctcctgcctcag

SEQ ID NO: 4468338 - DNA, 12 bp, Homo sapiens
tcaagcatgaag

SEQ ID NO: 4468339 - DNA, 13 bp, Homo sapiens
tcaagcctctaaa

SEQ ID NO: 4468340 - DNA, 15 bp, Homo sapiens
tcaagcctctaaaca

SEQ ID NO: 4468341 - DNA, 19 bp, Homo sapiens
tcaagcctgtgcaaaaaaa

SEQ ID NO: 4468342 - DNA, 13 bp, Homo sapiens
tcaagcctgtggg

SEQ ID NO: 4468343 - DNA, 14 bp, Homo sapiens
tcaagcctgtggga

SEQ ID NO: 4468344 - DNA, 21 bp, Homo sapiens
tcaagctgttatttcttccct

SEQ ID NO: 4468345 - DNA, 21 bp, Homo sapiens
tcaagcttttgcttgatccag

SEQ ID NO: 4468346 - DNA, 20 bp, Homo sapiens
tcaaggaaaagttctttcaa

SEQ ID NO: 4468347 - DNA, 20 bp, Homo sapiens
tcaaggaaaggctcatttaa

SEQ ID NO: 4468348 - DNA, 16 bp, Homo sapiens
tcaaggaatttcttaa

SEQ ID NO: 4468349 - DNA, 23 bp, Homo sapiens
tcaaggaatttcttaacttcttg

SEQ ID NO: 4468350 - DNA, 15 bp, Homo sapiens
tcaaggacaggagcc

SEQ ID NO: 4468351 - DNA, 21 bp, Homo sapiens
tcaaggactgtttcagtgtga

SEQ ID NO: 4468352 - DNA, 22 bp, Homo sapiens
tcaaggactgtttcagtgtgag

SEQ ID NO: 4468353 - DNA, 16 bp, Homo sapiens
tcaaggagaatatgat

SEQ ID NO: 4468354 - DNA, 13 bp, Homo sapiens
tcaaggagaggca

SEQ ID NO: 4468355 - DNA, 18 bp, Homo sapiens
tcaaggagaggcaaagaa

SEQ ID NO: 4468356 - DNA, 22 bp, Homo sapiens
tcaaggatggttttgggactag

SEQ ID NO: 4468357 - DNA, 17 bp, Homo sapiens
tcaaggcatgccaagta

SEQ ID NO: 4468358 - DNA, 16 bp, Homo sapiens
tcaaggggactaaagt

SEQ ID NO: 4468359 - DNA, 15 bp, Homo sapiens
tcaagtaatacaaac

SEQ ID NO: 4468360 - DNA, 14 bp, Homo sapiens
tcaagtaatattgg

SEQ ID NO: 4468361 - DNA, 15 bp, Homo sapiens
tcaagtaattgtgaa

SEQ ID NO: 4468362 - DNA, 19 bp, Homo sapiens
tcaagtacacaaagtaact

SEQ ID NO: 4468363 - DNA, 22 bp, Homo sapiens
tcaagtaccaccaagggatctg

SEQ ID NO: 4468364 - DNA, 23 bp, Homo sapiens
tcaagtatccaattcagggtccc

SEQ ID NO: 4468365 - DNA, 20 bp, Homo sapiens
tcaagtgcatgctctctgca

SEQ ID NO: 4468366 - DNA, 21 bp, Homo sapiens
tcaagtgcatgctctctgcag

SEQ ID NO: 4468367 - DNA, 22 bp, Homo sapiens
tcaagtgcatgctctctgcagc

SEQ ID NO: 4468368 - DNA, 13 bp, Homo sapiens
tcaagtgccaaac

SEQ ID NO: 4468369 - DNA, 11 bp, Homo sapiens
tcaagtgccta

SEQ ID NO: 4468370 - DNA, 19 bp, Homo sapiens
tcaagtgcttaaaaatact

SEQ ID NO: 4468371 - DNA, 18 bp, Homo sapiens
tcaagtgggatctgtcac

SEQ ID NO: 4468372 - DNA, 15 bp, Homo sapiens
tcaagttatttcctt

SEQ ID NO: 4468373 - DNA, 16 bp, Homo sapiens
tcaagttgtaaataat

SEQ ID NO: 4468374 - DNA, 14 bp, Homo sapiens
tcaagttgtgcttg

SEQ ID NO: 4468375 - DNA, 17 bp, Homo sapiens
tcaagttgtgcttgttt

SEQ ID NO: 4468376 - DNA, 20 bp, Homo sapiens
tcaagttgttgactgtgatt

SEQ ID NO: 4468377 - DNA, 13 bp, Homo sapiens
tcaagtttttcat

SEQ ID NO: 4468378 - DNA, 23 bp, Homo sapiens
tcaagtttttcatactgtacaca

SEQ ID NO: 4468379 - DNA, 15 bp, Homo sapiens
tcaataaaattctgt

SEQ ID NO: 4468380 - DNA, 19 bp, Homo sapiens
tcaataaaattctgtaatt

SEQ ID NO: 4468381 - DNA, 14 bp, Homo sapiens
tcaataaacagtca

SEQ ID NO: 4468382 - DNA, 16 bp, Homo sapiens
tcaataaacagtcact

SEQ ID NO: 4468383 - DNA, 19 bp, Homo sapiens
tcaataatatattttctgt

SEQ ID NO: 4468384 - DNA, 20 bp, Homo sapiens
tcaatagatttaggagcaga

SEQ ID NO: 4468385 - DNA, 21 bp, Homo sapiens
tcaatagatttaggagcagaa

SEQ ID NO: 4468386 - DNA, 16 bp, Homo sapiens
tcaatagtattaacta

SEQ ID NO: 4468387 - DNA, 16 bp, Homo sapiens
tcaatagttgaattag

SEQ ID NO: 4468388 - DNA, 16 bp, Homo sapiens
tcaatataagaagcaa

SEQ ID NO: 4468389 - DNA, 16 bp, Homo sapiens
tcaatatattgaactt

SEQ ID NO: 4468390 - DNA, 22 bp, Homo sapiens
tcaatatattgaacttttgtac

SEQ ID NO: 4468391 - DNA, 20 bp, Homo sapiens
tcaatatgcaagcagctttt

SEQ ID NO: 4468392 - DNA, 12 bp, Homo sapiens
tcaatatttaag

SEQ ID NO: 4468393 - DNA, 17 bp, Homo sapiens
tcaatattttcttttcc

SEQ ID NO: 4468394 - DNA, 16 bp, Homo sapiens
tcaatcatttctatta

SEQ ID NO: 4468395 - DNA, 20 bp, Homo sapiens
tcaatcccctcattcaggaa

SEQ ID NO: 4468396 - DNA, 21 bp, Homo sapiens
tcaatcctaatttctcctccc

SEQ ID NO: 4468397 - DNA, 22 bp, Homo sapiens
tcaatcctaatttctcctccct

SEQ ID NO: 4468398 - DNA, 17 bp, Homo sapiens
tcaatctggcttctgca

SEQ ID NO: 4468399 - DNA, 16 bp, Homo sapiens
tcaatctgtaaactgt

SEQ ID NO: 4468400 - DNA, 17 bp, Homo sapiens
tcaatctgtaaactgtg

SEQ ID NO: 4468401 - DNA, 15 bp, Homo sapiens
tcaatgcagttctca

SEQ ID NO: 4468402 - DNA, 18 bp, Homo sapiens
tcaatgccttgattagac

SEQ ID NO: 4468403 - DNA, 12 bp, Homo sapiens
tcaatgctattt

SEQ ID NO: 4468404 - DNA, 15 bp, Homo sapiens
tcaatgctatttttg

SEQ ID NO: 4468405 - DNA, 18 bp, Homo sapiens
tcaatgggaagactcagg

SEQ ID NO: 4468406 - DNA, 14 bp, Homo sapiens
tcaatggttcaagt

SEQ ID NO: 4468407 - DNA, 19 bp, Homo sapiens
tcaatgtacttgtttgaat

SEQ ID NO: 4468408 - DNA, 22 bp, Homo sapiens
tcaatgtacttgtttgaatatt

SEQ ID NO: 4468409 - DNA, 22 bp, Homo sapiens
tcaatgtggaaaaaatatttta

SEQ ID NO: 4468410 - DNA, 14 bp, Homo sapiens
tcaatgtgtataaa

SEQ ID NO: 4468411 - DNA, 16 bp, Homo sapiens
tcaatgtgtataaatt

SEQ ID NO: 4468412 - DNA, 12 bp, Homo sapiens
tcaatgtgtgca

SEQ ID NO: 4468413 - DNA, 20 bp, Homo sapiens
tcaattagcgtttaaggtga

SEQ ID NO: 4468414 - DNA, 17 bp, Homo sapiens
tcaattcaaagctgtgt

SEQ ID NO: 4468415 - DNA, 16 bp, Homo sapiens
tcaattcataaaaaca

SEQ ID NO: 4468416 - DNA, 20 bp, Homo sapiens
tcaattgacattcctttgaa

SEQ ID NO: 4468417 - DNA, 12 bp, Homo sapiens
tcaatttaaaaa

SEQ ID NO: 4468418 - DNA, 21 bp, Homo sapiens
tcaatttaagtgttggaaaaa

SEQ ID NO: 4468419 - DNA, 12 bp, Homo sapiens
tcaatttcagca

SEQ ID NO: 4468420 - DNA, 16 bp, Homo sapiens
tcaatttcatgtttct

SEQ ID NO: 4468421 - DNA, 12 bp, Homo sapiens
tcaatttctaat

SEQ ID NO: 4468422 - DNA, 12 bp, Homo sapiens
tcaatttggagc

SEQ ID NO: 4468423 - DNA, 23 bp, Homo sapiens
tcaatttggagcattaactaaat

SEQ ID NO: 4468424 - DNA, 21 bp, Homo sapiens
tcaatttttgtttttgagtac

SEQ ID NO: 4468425 - DNA, 18 bp, Homo sapiens
tcacaaaaaaagtaattg

SEQ ID NO: 4468426 - DNA, 23 bp, Homo sapiens
tcacaaaaaaatgttcattgtag

SEQ ID NO: 4468427 - DNA, 13 bp, Homo sapiens
tcacaaaaaggca

SEQ ID NO: 4468428 - DNA, 20 bp, Homo sapiens
tcacaaaatatattttgttt

SEQ ID NO: 4468429 - DNA, 22 bp, Homo sapiens
tcacaaaatgcacttctattta

SEQ ID NO: 4468430 - DNA, 19 bp, Homo sapiens
tcacaaactgatctaaaat

SEQ ID NO: 4468431 - DNA, 19 bp, Homo sapiens
tcacaaactgtgaaaatag

SEQ ID NO: 4468432 - DNA, 15 bp, Homo sapiens
tcacaaacttttata

SEQ ID NO: 4468433 - DNA, 17 bp, Homo sapiens
tcacaaacttttatact

SEQ ID NO: 4468434 - DNA, 21 bp, Homo sapiens
tcacaaacttttatactcttt

SEQ ID NO: 4468435 - DNA, 18 bp, Homo sapiens
tcacaaaggctgacattc

SEQ ID NO: 4468436 - DNA, 17 bp, Homo sapiens
tcacaaagtggaacgaa

SEQ ID NO: 4468437 - DNA, 15 bp, Homo sapiens
tcacaaatgtcattg

SEQ ID NO: 4468438 - DNA, 19 bp, Homo sapiens
tcacaaatgtcattgtcta

SEQ ID NO: 4468439 - DNA, 20 bp, Homo sapiens
tcacaaatgtcattgtctac

SEQ ID NO: 4468440 - DNA, 23 bp, Homo sapiens
tcacaaattccgattagaccttt

SEQ ID NO: 4468441 - DNA, 14 bp, Homo sapiens
tcacaacagcctga

SEQ ID NO: 4468442 - DNA, 13 bp, Homo sapiens
tcacaagacccaa

SEQ ID NO: 4468443 - DNA, 16 bp, Homo sapiens
tcacaagcctcctgta

SEQ ID NO: 4468444 - DNA, 14 bp, Homo sapiens
tcacaataaaagct

SEQ ID NO: 4468445 - DNA, 21 bp, Homo sapiens
tcacaatagccgatatcagaa

SEQ ID NO: 4468446 - DNA, 22 bp, Homo sapiens
tcacaatagccgatatcagaat

SEQ ID NO: 4468447 - DNA, 14 bp, Homo sapiens
tcacaatattcagt

SEQ ID NO: 4468448 - DNA, 18 bp, Homo sapiens
tcacaatattcagtggtg

SEQ ID NO: 4468449 - DNA, 18 bp, Homo sapiens
tcacaatgagtttgggca

SEQ ID NO: 4468450 - DNA, 14 bp, Homo sapiens
tcacaatgttctgg

SEQ ID NO: 4468451 - DNA, 13 bp, Homo sapiens
tcacaatttttaa

SEQ ID NO: 4468452 - DNA, 16 bp, Homo sapiens
tcacacaatatagttt

SEQ ID NO: 4468453 - DNA, 21 bp, Homo sapiens
tcacacaatatagttttttct

SEQ ID NO: 4468454 - DNA, 24 bp, Homo sapiens
tcacacacacaaaaaatgcacaaa

SEQ ID NO: 4468455 - DNA, 23 bp, Homo sapiens
tcacacagccaggtgccttggag

SEQ ID NO: 4468456 - DNA, 14 bp, Homo sapiens
tcacacagcccagt

SEQ ID NO: 4468457 - DNA, 12 bp, Homo sapiens
tcacaccagcca

SEQ ID NO: 4468458 - DNA, 15 bp, Homo sapiens
tcacacctcactctt

SEQ ID NO: 4468459 - DNA, 20 bp, Homo sapiens
tcacacctgaactgaacacc

SEQ ID NO: 4468460 - DNA, 21 bp, Homo sapiens
tcacacggcttgtgggcactg

SEQ ID NO: 4468461 - DNA, 19 bp, Homo sapiens
tcacacgtttaatcccagc

SEQ ID NO: 4468462 - DNA, 22 bp, Homo sapiens
tcacacgtttaatcccagcact

SEQ ID NO: 4468463 - DNA, 18 bp, Homo sapiens
tcacactcaaggacagga

SEQ ID NO: 4468464 - DNA, 16 bp, Homo sapiens
tcacactctaactgta

SEQ ID NO: 4468465 - DNA, 19 bp, Homo sapiens
tcacactgagaatgtaaga

SEQ ID NO: 4468466 - DNA, 18 bp, Homo sapiens
tcacactgcaagagcctt

SEQ ID NO: 4468467 - DNA, 20 bp, Homo sapiens
tcacactgcaagagccttgg

SEQ ID NO: 4468468 - DNA, 23 bp, Homo sapiens
tcacactgggtggtggcctggtc

SEQ ID NO: 4468469 - DNA, 11 bp, Homo sapiens
tcacagaagaa

SEQ ID NO: 4468470 - DNA, 17 bp, Homo sapiens
tcacagaccccagctgg

SEQ ID NO: 4468471 - DNA, 21 bp, Homo sapiens
tcacagacttctggcctagga

SEQ ID NO: 4468472 - DNA, 14 bp, Homo sapiens
tcacagagcagcaa

SEQ ID NO: 4468473 - DNA, 15 bp, Homo sapiens
tcacagaggaagaac

SEQ ID NO: 4468474 - DNA, 11 bp, Homo sapiens
tcacagaggca

SEQ ID NO: 4468475 - DNA, 17 bp, Homo sapiens
tcacagaggcttcttca

SEQ ID NO: 4468476 - DNA, 19 bp, Homo sapiens
tcacagagtgagactccat

SEQ ID NO: 4468477 - DNA, 16 bp, Homo sapiens
tcacagatgaggcccc

SEQ ID NO: 4468478 - DNA, 16 bp, Homo sapiens
tcacagattgcttcat

SEQ ID NO: 4468479 - DNA, 16 bp, Homo sapiens
tcacagccacacctgg

SEQ ID NO: 4468480 - DNA, 17 bp, Homo sapiens
tcacagccagactggca

SEQ ID NO: 4468481 - DNA, 19 bp, Homo sapiens
tcacagcccaaaatttgat

SEQ ID NO: 4468482 - DNA, 17 bp, Homo sapiens
tcacagcctcctctgtc

SEQ ID NO: 4468483 - DNA, 14 bp, Homo sapiens
tcacaggaagtaga

SEQ ID NO: 4468484 - DNA, 22 bp, Homo sapiens
tcacaggcatattccctgcaca

SEQ ID NO: 4468485 - DNA, 14 bp, Homo sapiens
tcacagggttgggc

SEQ ID NO: 4468486 - DNA, 23 bp, Homo sapiens
tcacagggttgggcccagatctg

SEQ ID NO: 4468487 - DNA, 24 bp, Homo sapiens
tcacagggttgggcccagatctgg

SEQ ID NO: 4468488 - DNA, 15 bp, Homo sapiens
tcacagtaaaaataa

SEQ ID NO: 4468489 - DNA, 21 bp, Homo sapiens
tcacagtaaaaataaaatact

SEQ ID NO: 4468490 - DNA, 19 bp, Homo sapiens
tcacagtaaagagtacact

SEQ ID NO: 4468491 - DNA, 19 bp, Homo sapiens
tcacagtatcagtattttc

SEQ ID NO: 4468492 - DNA, 22 bp, Homo sapiens
tcacagtatcagtattttcaca

SEQ ID NO: 4468493 - DNA, 22 bp, Homo sapiens
tcacagtcccactgtgcaggtg

SEQ ID NO: 4468494 - DNA, 15 bp, Homo sapiens
tcacagtcttgtgaa

SEQ ID NO: 4468495 - DNA, 16 bp, Homo sapiens
tcacagtcttgtgaac

SEQ ID NO: 4468496 - DNA, 16 bp, Homo sapiens
tcacagtgaacactca

SEQ ID NO: 4468497 - DNA, 17 bp, Homo sapiens
tcacagtgctcttttct

SEQ ID NO: 4468498 - DNA, 16 bp, Homo sapiens
tcacagtgcttttaag

SEQ ID NO: 4468499 - DNA, 19 bp, Homo sapiens
tcacagtgtttttattgct

SEQ ID NO: 4468500 - DNA, 13 bp, Homo sapiens
tcacagttcctcg

SEQ ID NO: 4468501 - DNA, 18 bp, Homo sapiens
tcacagttcctcgccctg

SEQ ID NO: 4468502 - DNA, 19 bp, Homo sapiens
tcacagttcctcgccctgg

SEQ ID NO: 4468503 - DNA, 12 bp, Homo sapiens
tcacagttctgt

SEQ ID NO: 4468504 - DNA, 14 bp, Homo sapiens
tcacagttctgtaa

SEQ ID NO: 4468505 - DNA, 14 bp, Homo sapiens
tcacatctaaagct

SEQ ID NO: 4468506 - DNA, 17 bp, Homo sapiens
tcacatctaaagcttta

SEQ ID NO: 4468507 - DNA, 14 bp, Homo sapiens
tcacatcttattta

SEQ ID NO: 4468508 - DNA, 23 bp, Homo sapiens
tcacatcttatttattttagcaa

SEQ ID NO: 4468509 - DNA, 14 bp, Homo sapiens
tcacattcttggct

SEQ ID NO: 4468510 - DNA, 20 bp, Homo sapiens
tcacattgagagtaagcacg

SEQ ID NO: 4468511 - DNA, 20 bp, Homo sapiens
tcacattggagtcactgcca

SEQ ID NO: 4468512 - DNA, 14 bp, Homo sapiens
tcacattttccttt

SEQ ID NO: 4468513 - DNA, 16 bp, Homo sapiens
tcacattttccttttc

SEQ ID NO: 4468514 - DNA, 17 bp, Homo sapiens
tcaccaaaatttctaca

SEQ ID NO: 4468515 - DNA, 16 bp, Homo sapiens
tcaccaagctcacagt

SEQ ID NO: 4468516 - DNA, 14 bp, Homo sapiens
tcaccaattaaaaa

SEQ ID NO: 4468517 - DNA, 24 bp, Homo sapiens
tcaccaccaataaatcagaccatg

SEQ ID NO: 4468518 - DNA, 12 bp, Homo sapiens
tcaccaccccct

SEQ ID NO: 4468519 - DNA, 18 bp, Homo sapiens
tcaccaccccctgtccca

SEQ ID NO: 4468520 - DNA, 22 bp, Homo sapiens
tcaccaccccctgtcccattct

SEQ ID NO: 4468521 - DNA, 18 bp, Homo sapiens
tcaccaccttcccagctc

SEQ ID NO: 4468522 - DNA, 18 bp, Homo sapiens
tcaccacgactggccagg

SEQ ID NO: 4468523 - DNA, 14 bp, Homo sapiens
tcaccactcatttt

SEQ ID NO: 4468524 - DNA, 14 bp, Homo sapiens
tcaccagagacttt

SEQ ID NO: 4468525 - DNA, 19 bp, Homo sapiens
tcaccagcaccaacaccac

SEQ ID NO: 4468526 - DNA, 20 bp, Homo sapiens
tcaccagccctgcagcccac

SEQ ID NO: 4468527 - DNA, 15 bp, Homo sapiens
tcaccagctgcaaag

SEQ ID NO: 4468528 - DNA, 16 bp, Homo sapiens
tcaccagctgcaaagt

SEQ ID NO: 4468529 - DNA, 18 bp, Homo sapiens
tcaccagctgcaaagtgt

SEQ ID NO: 4468530 - DNA, 19 bp, Homo sapiens
tcaccagctgcaaagtgtt

SEQ ID NO: 4468531 - DNA, 21 bp, Homo sapiens
tcaccaggctggagtgcagtg

SEQ ID NO: 4468532 - DNA, 13 bp, Homo sapiens
tcaccagtgttcc

SEQ ID NO: 4468533 - DNA, 15 bp, Homo sapiens
tcaccagtgttcctg

SEQ ID NO: 4468534 - DNA, 16 bp, Homo sapiens
tcaccagtgttcctga

SEQ ID NO: 4468535 - DNA, 17 bp, Homo sapiens
tcaccagtgttcctgaa

SEQ ID NO: 4468536 - DNA, 16 bp, Homo sapiens
tcaccatgtaagcact

SEQ ID NO: 4468537 - DNA, 17 bp, Homo sapiens
tcaccatttgattatgt

SEQ ID NO: 4468538 - DNA, 15 bp, Homo sapiens
tcacccacagggcta

SEQ ID NO: 4468539 - DNA, 15 bp, Homo sapiens
tcacccaccaggcca

SEQ ID NO: 4468540 - DNA, 20 bp, Homo sapiens
tcacccaccaggccagctca

SEQ ID NO: 4468541 - DNA, 21 bp, Homo sapiens
tcacccagacagcctgtttct

SEQ ID NO: 4468542 - DNA, 21 bp, Homo sapiens
tcaccccagtggccactcagc

SEQ ID NO: 4468543 - DNA, 12 bp, Homo sapiens
tcacccccaact

SEQ ID NO: 4468544 - DNA, 12 bp, Homo sapiens
tcacccccatcc

SEQ ID NO: 4468545 - DNA, 15 bp, Homo sapiens
tcaccccctcccacc

SEQ ID NO: 4468546 - DNA, 20 bp, Homo sapiens
tcaccccctcccacccccag

SEQ ID NO: 4468547 - DNA, 22 bp, Homo sapiens
tcaccccctcccacccccagcc

SEQ ID NO: 4468548 - DNA, 15 bp, Homo sapiens
tcaccccctccttca

SEQ ID NO: 4468549 - DNA, 14 bp, Homo sapiens
tcacccctcccttt

SEQ ID NO: 4468550 - DNA, 18 bp, Homo sapiens
tcacccctccctttctcc

SEQ ID NO: 4468551 - DNA, 14 bp, Homo sapiens
tcacccctctgccc

SEQ ID NO: 4468552 - DNA, 15 bp, Homo sapiens
tcacccctctgcccc

SEQ ID NO: 4468553 - DNA, 19 bp, Homo sapiens
tcacccctctgcccctgca

SEQ ID NO: 4468554 - DNA, 21 bp, Homo sapiens
tcacccctctgcccctgcagc

SEQ ID NO: 4468555 - DNA, 21 bp, Homo sapiens
tcacccctggttctcatcttt

SEQ ID NO: 4468556 - DNA, 23 bp, Homo sapiens
tcaccctcctgacccccatgtaa

SEQ ID NO: 4468557 - DNA, 14 bp, Homo sapiens
tcaccctgggcagt

SEQ ID NO: 4468558 - DNA, 17 bp, Homo sapiens
tcacccttcccggcccc

SEQ ID NO: 4468559 - DNA, 23 bp, Homo sapiens
tcaccgagactcagcctctgctg

SEQ ID NO: 4468560 - DNA, 13 bp, Homo sapiens
tcaccgagcagag

SEQ ID NO: 4468561 - DNA, 20 bp, Homo sapiens
tcaccgctggcccttagaga

SEQ ID NO: 4468562 - DNA, 16 bp, Homo sapiens
tcaccgggatgaacct

SEQ ID NO: 4468563 - DNA, 17 bp, Homo sapiens
tcaccggtcagtgcctt

SEQ ID NO: 4468564 - DNA, 19 bp, Homo sapiens
tcaccgtatctcaggaagt

SEQ ID NO: 4468565 - DNA, 13 bp, Homo sapiens
tcaccgtgggctc

SEQ ID NO: 4468566 - DNA, 17 bp, Homo sapiens
tcaccgtgggctccctg

SEQ ID NO: 4468567 - DNA, 20 bp, Homo sapiens
tcacctagaacgtgcatcct

SEQ ID NO: 4468568 - DNA, 13 bp, Homo sapiens
tcacctcatgccc

SEQ ID NO: 4468569 - DNA, 23 bp, Homo sapiens
tcacctcatgcccaccccctgcc

SEQ ID NO: 4468570 - DNA, 18 bp, Homo sapiens
tcacctctcagctgctgg

SEQ ID NO: 4468571 - DNA, 19 bp, Homo sapiens
tcacctctcagctgctgga

SEQ ID NO: 4468572 - DNA, 15 bp, Homo sapiens
tcacctctgcctcaa

SEQ ID NO: 4468573 - DNA, 13 bp, Homo sapiens
tcacctcttctac

SEQ ID NO: 4468574 - DNA, 14 bp, Homo sapiens
tcacctgaacccca

SEQ ID NO: 4468575 - DNA, 18 bp, Homo sapiens
tcacctgaaccccagagg

SEQ ID NO: 4468576 - DNA, 22 bp, Homo sapiens
tcacctgaaccccagaggcaga

SEQ ID NO: 4468577 - DNA, 15 bp, Homo sapiens
tcacctgaggtcagg

SEQ ID NO: 4468578 - DNA, 13 bp, Homo sapiens
tcacctgcactaa

SEQ ID NO: 4468579 - DNA, 18 bp, Homo sapiens
tcacctgctcccagtcct

SEQ ID NO: 4468580 - DNA, 23 bp, Homo sapiens
tcacctgctcccagtcctgcctg

SEQ ID NO: 4468581 - DNA, 19 bp, Homo sapiens
tcacctgggaccttactcc

SEQ ID NO: 4468582 - DNA, 17 bp, Homo sapiens
tcacctgtaaaacttta

SEQ ID NO: 4468583 - DNA, 19 bp, Homo sapiens
tcacctgtaaacctgagtc

SEQ ID NO: 4468584 - DNA, 20 bp, Homo sapiens
tcacctgtgcttcgggccct

SEQ ID NO: 4468585 - DNA, 13 bp, Homo sapiens
tcacgattcattt

SEQ ID NO: 4468586 - DNA, 20 bp, Homo sapiens
tcacgattcttaccctttct

SEQ ID NO: 4468587 - DNA, 20 bp, Homo sapiens
tcacgccattgtactccagc

SEQ ID NO: 4468588 - DNA, 23 bp, Homo sapiens
tcacgccattgtactccagcctg

SEQ ID NO: 4468589 - DNA, 23 bp, Homo sapiens
tcacgcctgtaatcccagcactt

SEQ ID NO: 4468590 - DNA, 21 bp, Homo sapiens
tcacgcctgtaatcccagcag

SEQ ID NO: 4468591 - DNA, 16 bp, Homo sapiens
tcacgctttttgaaaa

SEQ ID NO: 4468592 - DNA, 22 bp, Homo sapiens
tcacgggagatttcttgttgct

SEQ ID NO: 4468593 - DNA, 19 bp, Homo sapiens
tcacggggttggctgttcc

SEQ ID NO: 4468594 - DNA, 20 bp, Homo sapiens
tcacgttaccatttacatgt

SEQ ID NO: 4468595 - DNA, 20 bp, Homo sapiens
tcacgttaccttgacacata

SEQ ID NO: 4468596 - DNA, 18 bp, Homo sapiens
tcacgttagaggaaaaat

SEQ ID NO: 4468597 - DNA, 17 bp, Homo sapiens
tcacgtttggtgcttct

SEQ ID NO: 4468598 - DNA, 21 bp, Homo sapiens
tcacgtttggtgcttctcaga

SEQ ID NO: 4468599 - DNA, 21 bp, Homo sapiens
tcactaaagggcttcatttta

SEQ ID NO: 4468600 - DNA, 17 bp, Homo sapiens
tcactaacagggagaag

SEQ ID NO: 4468601 - DNA, 16 bp, Homo sapiens
tcactaacattatatt

SEQ ID NO: 4468602 - DNA, 15 bp, Homo sapiens
tcactaatttttgta

SEQ ID NO: 4468603 - DNA, 16 bp, Homo sapiens
tcactaatttttgtat

SEQ ID NO: 4468604 - DNA, 20 bp, Homo sapiens
tcactaccctattctctctt

SEQ ID NO: 4468605 - DNA, 15 bp, Homo sapiens
tcactactgcattta

SEQ ID NO: 4468606 - DNA, 19 bp, Homo sapiens
tcactataatgtgaaatgt

SEQ ID NO: 4468607 - DNA, 15 bp, Homo sapiens
tcactatatatattt

SEQ ID NO: 4468608 - DNA, 21 bp, Homo sapiens
tcactatggtatgctggccag

SEQ ID NO: 4468609 - DNA, 16 bp, Homo sapiens
tcactcaccactacca

SEQ ID NO: 4468610 - DNA, 17 bp, Homo sapiens
tcactcactcactcatt

SEQ ID NO: 4468611 - DNA, 14 bp, Homo sapiens
tcactcactctgat

SEQ ID NO: 4468612 - DNA, 12 bp, Homo sapiens
tcactcataaag

SEQ ID NO: 4468613 - DNA, 20 bp, Homo sapiens
tcactcatgcaaactgcttt

SEQ ID NO: 4468614 - DNA, 22 bp, Homo sapiens
tcactcatgcaaactgctttat

SEQ ID NO: 4468615 - DNA, 23 bp, Homo sapiens
tcactcatgcaaactgctttatt

SEQ ID NO: 4468616 - DNA, 18 bp, Homo sapiens
tcactcattaatgaatca

SEQ ID NO: 4468617 - DNA, 16 bp, Homo sapiens
tcactccaccacccaa

SEQ ID NO: 4468618 - DNA, 19 bp, Homo sapiens
tcactccaccatccccacc

SEQ ID NO: 4468619 - DNA, 21 bp, Homo sapiens
tcactccaccatccccacccc

SEQ ID NO: 4468620 - DNA, 21 bp, Homo sapiens
tcactcccctctcctcccctt

SEQ ID NO: 4468621 - DNA, 19 bp, Homo sapiens
tcactcctgagacccctgg

SEQ ID NO: 4468622 - DNA, 16 bp, Homo sapiens
tcactctgacagtatt

SEQ ID NO: 4468623 - DNA, 20 bp, Homo sapiens
tcactctgacagtattaaca

SEQ ID NO: 4468624 - DNA, 18 bp, Homo sapiens
tcactctgtccctgtcct

SEQ ID NO: 4468625 - DNA, 22 bp, Homo sapiens
tcactcttctgtcttgtcccca

SEQ ID NO: 4468626 - DNA, 19 bp, Homo sapiens
tcactcttgtactgcctgc

SEQ ID NO: 4468627 - DNA, 11 bp, Homo sapiens
tcactctttat

SEQ ID NO: 4468628 - DNA, 14 bp, Homo sapiens
tcactctttatagt

SEQ ID NO: 4468629 - DNA, 18 bp, Homo sapiens
tcactgagagtcaggagt

SEQ ID NO: 4468630 - DNA, 22 bp, Homo sapiens
tcactgagcatcactagtgaca

SEQ ID NO: 4468631 - DNA, 21 bp, Homo sapiens
tcactgagttttgtttcactt

SEQ ID NO: 4468632 - DNA, 12 bp, Homo sapiens
tcactgatggga

SEQ ID NO: 4468633 - DNA, 17 bp, Homo sapiens
tcactgatgtacaatta

SEQ ID NO: 4468634 - DNA, 18 bp, Homo sapiens
tcactgcaacctccgcct

SEQ ID NO: 4468635 - DNA, 18 bp, Homo sapiens
tcactgcagtcacctctt

SEQ ID NO: 4468636 - DNA, 19 bp, Homo sapiens
tcactgcctaaaattttag

SEQ ID NO: 4468637 - DNA, 23 bp, Homo sapiens
tcactggaaattgaggtccatgg

SEQ ID NO: 4468638 - DNA, 17 bp, Homo sapiens
tcactggagcaccaggc

SEQ ID NO: 4468639 - DNA, 12 bp, Homo sapiens
tcactggcctct

SEQ ID NO: 4468640 - DNA, 22 bp, Homo sapiens
tcactggcgacacgtagcagct

SEQ ID NO: 4468641 - DNA, 13 bp, Homo sapiens
tcactggggcaga

SEQ ID NO: 4468642 - DNA, 14 bp, Homo sapiens
tcactggggcagac

SEQ ID NO: 4468643 - DNA, 20 bp, Homo sapiens
tcactggggcatgagatttt

SEQ ID NO: 4468644 - DNA, 19 bp, Homo sapiens
tcactgtctttaattctgt

SEQ ID NO: 4468645 - DNA, 21 bp, Homo sapiens
tcactgtgggaaggccagctg

SEQ ID NO: 4468646 - DNA, 15 bp, Homo sapiens
tcactgtttataaat

SEQ ID NO: 4468647 - DNA, 17 bp, Homo sapiens
tcactgtttataaatgt

SEQ ID NO: 4468648 - DNA, 19 bp, Homo sapiens
tcacttaaaggcacaaata

SEQ ID NO: 4468649 - DNA, 20 bp, Homo sapiens
tcacttaacattcctaaaat

SEQ ID NO: 4468650 - DNA, 22 bp, Homo sapiens
tcacttaacattcctaaaatgc

SEQ ID NO: 4468651 - DNA, 17 bp, Homo sapiens
tcacttaatgtttctta

SEQ ID NO: 4468652 - DNA, 13 bp, Homo sapiens
tcacttatcagtt

SEQ ID NO: 4468653 - DNA, 17 bp, Homo sapiens
tcacttcctacaagagc

SEQ ID NO: 4468654 - DNA, 21 bp, Homo sapiens
tcacttctacctacatatttg

SEQ ID NO: 4468655 - DNA, 20 bp, Homo sapiens
tcacttgaggaggagctggc

SEQ ID NO: 4468656 - DNA, 15 bp, Homo sapiens
tcacttgctctttga

SEQ ID NO: 4468657 - DNA, 15 bp, Homo sapiens
tcactttactttcaa

SEQ ID NO: 4468658 - DNA, 16 bp, Homo sapiens
tcactttactttcaag

SEQ ID NO: 4468659 - DNA, 21 bp, Homo sapiens
tcactttcccttgtgtcaaga

SEQ ID NO: 4468660 - DNA, 13 bp, Homo sapiens
tcactttcttcaa

SEQ ID NO: 4468661 - DNA, 14 bp, Homo sapiens
tcactttcttcaaa

SEQ ID NO: 4468662 - DNA, 17 bp, Homo sapiens
tcactttgacacccagg

SEQ ID NO: 4468663 - DNA, 19 bp, Homo sapiens
tcactttgacacttttcat

SEQ ID NO: 4468664 - DNA, 15 bp, Homo sapiens
tcactttgacatttg

SEQ ID NO: 4468665 - DNA, 13 bp, Homo sapiens
tcactttgtgtat

SEQ ID NO: 4468666 - DNA, 13 bp, Homo sapiens
tcactttttctga

SEQ ID NO: 4468667 - DNA, 19 bp, Homo sapiens
tcactttttttctttttct

SEQ ID NO: 4468668 - DNA, 22 bp, Homo sapiens
tcagaaaacagggtccaggaat

SEQ ID NO: 4468669 - DNA, 13 bp, Homo sapiens
tcagaaaaccaaa

SEQ ID NO: 4468670 - DNA, 15 bp, Homo sapiens
tcagaaaaccaaagg

SEQ ID NO: 4468671 - DNA, 23 bp, Homo sapiens
tcagaaaatgttctgtttgctgt

SEQ ID NO: 4468672 - DNA, 15 bp, Homo sapiens
tcagaacctcttccc

SEQ ID NO: 4468673 - DNA, 20 bp, Homo sapiens
tcagaacctcttccccagaa

SEQ ID NO: 4468674 - DNA, 14 bp, Homo sapiens
tcagaactaaattt

SEQ ID NO: 4468675 - DNA, 20 bp, Homo sapiens
tcagaactaaatttttcata

SEQ ID NO: 4468676 - DNA, 22 bp, Homo sapiens
tcagaactaaatttttcataga

SEQ ID NO: 4468677 - DNA, 13 bp, Homo sapiens
tcagaactgccct

SEQ ID NO: 4468678 - DNA, 17 bp, Homo sapiens
tcagaacttcaggtgtg

SEQ ID NO: 4468679 - DNA, 13 bp, Homo sapiens
tcagaagaaaaag

SEQ ID NO: 4468680 - DNA, 17 bp, Homo sapiens
tcagaagaaaaagaagc

SEQ ID NO: 4468681 - DNA, 18 bp, Homo sapiens
tcagaagaaaaagaagca

SEQ ID NO: 4468682 - DNA, 18 bp, Homo sapiens
tcagaagaaaggccaagg

SEQ ID NO: 4468683 - DNA, 18 bp, Homo sapiens
tcagaagaacatgatttt

SEQ ID NO: 4468684 - DNA, 17 bp, Homo sapiens
tcagaagagttgtgcac

SEQ ID NO: 4468685 - DNA, 17 bp, Homo sapiens
tcagaagcaagccagac

SEQ ID NO: 4468686 - DNA, 15 bp, Homo sapiens
tcagaagcctccaag

SEQ ID NO: 4468687 - DNA, 23 bp, Homo sapiens
tcagaagcctccaagcctgcctc

SEQ ID NO: 4468688 - DNA, 19 bp, Homo sapiens
tcagaaggccccagagaga

SEQ ID NO: 4468689 - DNA, 15 bp, Homo sapiens
tcagaagtcatcttg

SEQ ID NO: 4468690 - DNA, 18 bp, Homo sapiens
tcagaagtcatcttgcta

SEQ ID NO: 4468691 - DNA, 22 bp, Homo sapiens
tcagaagtcatcttgctaccag

SEQ ID NO: 4468692 - DNA, 14 bp, Homo sapiens
tcagaataaagttg

SEQ ID NO: 4468693 - DNA, 17 bp, Homo sapiens
tcagaataaagttgtat

SEQ ID NO: 4468694 - DNA, 15 bp, Homo sapiens
tcagaatcagaagat

SEQ ID NO: 4468695 - DNA, 18 bp, Homo sapiens
tcagaatcccttaacagt

SEQ ID NO: 4468696 - DNA, 18 bp, Homo sapiens
tcagaatctgaatgtaat

SEQ ID NO: 4468697 - DNA, 18 bp, Homo sapiens
tcagaattaagcagaaca

SEQ ID NO: 4468698 - DNA, 18 bp, Homo sapiens
tcagaattcggtgtgctg

SEQ ID NO: 4468699 - DNA, 20 bp, Homo sapiens
tcagaattggcataatttgt

SEQ ID NO: 4468700 - DNA, 11 bp, Homo sapiens
tcagacccagc

SEQ ID NO: 4468701 - DNA, 18 bp, Homo sapiens
tcagacccaggagtccag

SEQ ID NO: 4468702 - DNA, 20 bp, Homo sapiens
tcagacccaggagtccagac

SEQ ID NO: 4468703 - DNA, 21 bp, Homo sapiens
tcagacccaggagtccagacc

SEQ ID NO: 4468704 - DNA, 19 bp, Homo sapiens
tcagacccaggagtccagc

SEQ ID NO: 4468705 - DNA, 23 bp, Homo sapiens
tcagacccctttgagagacgcca

SEQ ID NO: 4468706 - DNA, 14 bp, Homo sapiens
tcagaccctacccc

SEQ ID NO: 4468707 - DNA, 18 bp, Homo sapiens
tcagaccctaccccacca

SEQ ID NO: 4468708 - DNA, 16 bp, Homo sapiens
tcagacgcctgaggaa

SEQ ID NO: 4468709 - DNA, 17 bp, Homo sapiens
tcagacgcctgaggaac

SEQ ID NO: 4468710 - DNA, 16 bp, Homo sapiens
tcagactctcagccca

SEQ ID NO: 4468711 - DNA, 16 bp, Homo sapiens
tcagactgacactact

SEQ ID NO: 4468712 - DNA, 17 bp, Homo sapiens
tcagactgacactacta

SEQ ID NO: 4468713 - DNA, 14 bp, Homo sapiens
tcagactgcaatat

SEQ ID NO: 4468714 - DNA, 19 bp, Homo sapiens
tcagacttccaaatcctgg

SEQ ID NO: 4468715 - DNA, 14 bp, Homo sapiens
tcagacttgtcaag

SEQ ID NO: 4468716 - DNA, 20 bp, Homo sapiens
tcagagaaggaaaagactga

SEQ ID NO: 4468717 - DNA, 21 bp, Homo sapiens
tcagagaaggaaaagactgaa

SEQ ID NO: 4468718 - DNA, 20 bp, Homo sapiens
tcagagagacctcatcctgc

SEQ ID NO: 4468719 - DNA, 23 bp, Homo sapiens
tcagagataaagcttaggtcaaa

SEQ ID NO: 4468720 - DNA, 17 bp, Homo sapiens
tcagagatctcccttct

SEQ ID NO: 4468721 - DNA, 15 bp, Homo sapiens
tcagagcactcccta

SEQ ID NO: 4468722 - DNA, 16 bp, Homo sapiens
tcagagccagcctggc

SEQ ID NO: 4468723 - DNA, 19 bp, Homo sapiens
tcagagcccagcccaggag

SEQ ID NO: 4468724 - DNA, 20 bp, Homo sapiens
tcagagccgtggtcctttgg

SEQ ID NO: 4468725 - DNA, 17 bp, Homo sapiens
tcagagcctttcctcaa

SEQ ID NO: 4468726 - DNA, 16 bp, Homo sapiens
tcagagcgcacaggga

SEQ ID NO: 4468727 - DNA, 16 bp, Homo sapiens
tcagagctttgtcact

SEQ ID NO: 4468728 - DNA, 17 bp, Homo sapiens
tcagagctttgtcactt

SEQ ID NO: 4468729 - DNA, 19 bp, Homo sapiens
tcagagctttgtcacttgc

SEQ ID NO: 4468730 - DNA, 21 bp, Homo sapiens
tcagagctttgtcacttgcca

SEQ ID NO: 4468731 - DNA, 14 bp, Homo sapiens
tcagaggtatctta

SEQ ID NO: 4468732 - DNA, 18 bp, Homo sapiens
tcagaggtgctaaattgt

SEQ ID NO: 4468733 - DNA, 12 bp, Homo sapiens
tcagagtccagt

SEQ ID NO: 4468734 - DNA, 20 bp, Homo sapiens
tcagagtccagtgctctgcc

SEQ ID NO: 4468735 - DNA, 21 bp, Homo sapiens
tcagagtccagtgctctgcct

SEQ ID NO: 4468736 - DNA, 17 bp, Homo sapiens
tcagagtctctgataca

SEQ ID NO: 4468737 - DNA, 14 bp, Homo sapiens
tcagatataaaaga

SEQ ID NO: 4468738 - DNA, 23 bp, Homo sapiens
tcagatatcttggacaaatcaca

SEQ ID NO: 4468739 - DNA, 16 bp, Homo sapiens
tcagatatgcttacta

SEQ ID NO: 4468740 - DNA, 20 bp, Homo sapiens
tcagatcattatcagcctgt

SEQ ID NO: 4468741 - DNA, 19 bp, Homo sapiens
tcagatcttaatataaatt

SEQ ID NO: 4468742 - DNA, 23 bp, Homo sapiens
tcagatgaggtcaacacaggtag

SEQ ID NO: 4468743 - DNA, 17 bp, Homo sapiens
tcagatgcgtgcccagc

SEQ ID NO: 4468744 - DNA, 15 bp, Homo sapiens
tcagatgctgaattg

SEQ ID NO: 4468745 - DNA, 19 bp, Homo sapiens
tcagatgcttgcggcaaaa

SEQ ID NO: 4468746 - DNA, 22 bp, Homo sapiens
tcagatgcttgcggcaaaagga

SEQ ID NO: 4468747 - DNA, 19 bp, Homo sapiens
tcagatggaaaattcattt

SEQ ID NO: 4468748 - DNA, 20 bp, Homo sapiens
tcagatgttaaaataaatgg

SEQ ID NO: 4468749 - DNA, 14 bp, Homo sapiens
tcagattaaattac

SEQ ID NO: 4468750 - DNA, 16 bp, Homo sapiens
tcagattaaattacag

SEQ ID NO: 4468751 - DNA, 20 bp, Homo sapiens
tcagattaaattacagcttt

SEQ ID NO: 4468752 - DNA, 23 bp, Homo sapiens
tcagattgtggaatgttggataa

SEQ ID NO: 4468753 - DNA, 23 bp, Homo sapiens
tcagatttaacctgttatttcta

SEQ ID NO: 4468754 - DNA, 15 bp, Homo sapiens
tcagcaaactctttt

SEQ ID NO: 4468755 - DNA, 13 bp, Homo sapiens
tcagcaaagaaaa

SEQ ID NO: 4468756 - DNA, 18 bp, Homo sapiens
tcagcaaagtggttccct

SEQ ID NO: 4468757 - DNA, 20 bp, Homo sapiens
tcagcaaagtggttccctct

SEQ ID NO: 4468758 - DNA, 23 bp, Homo sapiens
tcagcaacccttcctgctgctgc

SEQ ID NO: 4468759 - DNA, 17 bp, Homo sapiens
tcagcaagctgcccagc

SEQ ID NO: 4468760 - DNA, 22 bp, Homo sapiens
tcagcacattcgggaccaatat

SEQ ID NO: 4468761 - DNA, 12 bp, Homo sapiens
tcagcaccaccc

SEQ ID NO: 4468762 - DNA, 23 bp, Homo sapiens
tcagcaccaccctagtcccttcc

SEQ ID NO: 4468763 - DNA, 15 bp, Homo sapiens
tcagcacttgtctca

SEQ ID NO: 4468764 - DNA, 17 bp, Homo sapiens
tcagcacttgtctcatt

SEQ ID NO: 4468765 - DNA, 21 bp, Homo sapiens
tcagcacttgtctcattttaa

SEQ ID NO: 4468766 - DNA, 13 bp, Homo sapiens
tcagcagacactc

SEQ ID NO: 4468767 - DNA, 17 bp, Homo sapiens
tcagcagacactccagt

SEQ ID NO: 4468768 - DNA, 15 bp, Homo sapiens
tcagcagcaaaacca

SEQ ID NO: 4468769 - DNA, 19 bp, Homo sapiens
tcagcagcagagagccctg

SEQ ID NO: 4468770 - DNA, 12 bp, Homo sapiens
tcagcaggaggc

SEQ ID NO: 4468771 - DNA, 20 bp, Homo sapiens
tcagcaggaggcaagcgtgt

SEQ ID NO: 4468772 - DNA, 13 bp, Homo sapiens
tcagcaggtgtct

SEQ ID NO: 4468773 - DNA, 22 bp, Homo sapiens
tcagcaggttggcttttttccc

SEQ ID NO: 4468774 - DNA, 16 bp, Homo sapiens
tcagcatcacccacct

SEQ ID NO: 4468775 - DNA, 21 bp, Homo sapiens
tcagcattcttagcctgtggc

SEQ ID NO: 4468776 - DNA, 17 bp, Homo sapiens
tcagcatttgatctgtt

SEQ ID NO: 4468777 - DNA, 15 bp, Homo sapiens
tcagccaaagtccta

SEQ ID NO: 4468778 - DNA, 17 bp, Homo sapiens
tcagccaagtgcagagt

SEQ ID NO: 4468779 - DNA, 17 bp, Homo sapiens
tcagccacaaagccccc

SEQ ID NO: 4468780 - DNA, 18 bp, Homo sapiens
tcagccacaaagcccccc

SEQ ID NO: 4468781 - DNA, 21 bp, Homo sapiens
tcagccacatgccccaggctc

SEQ ID NO: 4468782 - DNA, 10 bp, Homo sapiens
tcagccagcc

SEQ ID NO: 4468783 - DNA, 23 bp, Homo sapiens
tcagccagccgccctgggctgtc

SEQ ID NO: 4468784 - DNA, 15 bp, Homo sapiens
tcagccagcttaaac

SEQ ID NO: 4468785 - DNA, 16 bp, Homo sapiens
tcagccatcgtcctgg

SEQ ID NO: 4468786 - DNA, 17 bp, Homo sapiens
tcagccatcgtcctggg

SEQ ID NO: 4468787 - DNA, 18 bp, Homo sapiens
tcagccatcgtcctggga

SEQ ID NO: 4468788 - DNA, 21 bp, Homo sapiens
tcagccatgaggagttgctgt

SEQ ID NO: 4468789 - DNA, 12 bp, Homo sapiens
tcagcccagaag

SEQ ID NO: 4468790 - DNA, 14 bp, Homo sapiens
tcagccccagccca

SEQ ID NO: 4468791 - DNA, 18 bp, Homo sapiens
tcagccccagcccagaca

SEQ ID NO: 4468792 - DNA, 21 bp, Homo sapiens
tcagccccaggccagctgcgg

SEQ ID NO: 4468793 - DNA, 14 bp, Homo sapiens
tcagccccgcctgt

SEQ ID NO: 4468794 - DNA, 18 bp, Homo sapiens
tcagccccgcctgtcaca

SEQ ID NO: 4468795 - DNA, 20 bp, Homo sapiens
tcagccccgcctgtcacaat

SEQ ID NO: 4468796 - DNA, 14 bp, Homo sapiens
tcagcccctcctct

SEQ ID NO: 4468797 - DNA, 21 bp, Homo sapiens
tcagcccctcctctgccacct

SEQ ID NO: 4468798 - DNA, 13 bp, Homo sapiens
tcagccctgaaaa

SEQ ID NO: 4468799 - DNA, 23 bp, Homo sapiens
tcagccctgaggtgaaagggagc

SEQ ID NO: 4468800 - DNA, 12 bp, Homo sapiens
tcagccctgctc

SEQ ID NO: 4468801 - DNA, 13 bp, Homo sapiens
tcagccctgctcc

SEQ ID NO: 4468802 - DNA, 16 bp, Homo sapiens
tcagccctgctccctg

SEQ ID NO: 4468803 - DNA, 19 bp, Homo sapiens
tcagccctgggccccacca

SEQ ID NO: 4468804 - DNA, 21 bp, Homo sapiens
tcagcctaagaaacactcatg

SEQ ID NO: 4468805 - DNA, 19 bp, Homo sapiens
tcagcctccagcctctgtt

SEQ ID NO: 4468806 - DNA, 23 bp, Homo sapiens
tcagcctccatcctaccccctgt

SEQ ID NO: 4468807 - DNA, 20 bp, Homo sapiens
tcagcctcccaagtagctgg

SEQ ID NO: 4468808 - DNA, 15 bp, Homo sapiens
tcagcctcccatagc

SEQ ID NO: 4468809 - DNA, 17 bp, Homo sapiens
tcagcctcccatagctg

SEQ ID NO: 4468810 - DNA, 20 bp, Homo sapiens
tcagcctcccatagctggga

SEQ ID NO: 4468811 - DNA, 14 bp, Homo sapiens
tcagcctctgctgg

SEQ ID NO: 4468812 - DNA, 15 bp, Homo sapiens
tcagcctctgctgga

SEQ ID NO: 4468813 - DNA, 17 bp, Homo sapiens
tcagcctctgctggaga

SEQ ID NO: 4468814 - DNA, 18 bp, Homo sapiens
tcagcctctgctggagaa

SEQ ID NO: 4468815 - DNA, 14 bp, Homo sapiens
tcagccttcctcct

SEQ ID NO: 4468816 - DNA, 22 bp, Homo sapiens
tcagccttggataatgctgttg

SEQ ID NO: 4468817 - DNA, 12 bp, Homo sapiens
tcagcggtgcag

SEQ ID NO: 4468818 - DNA, 18 bp, Homo sapiens
tcagctcccctcggagaa

SEQ ID NO: 4468819 - DNA, 19 bp, Homo sapiens
tcagctctgatctgaggct

SEQ ID NO: 4468820 - DNA, 13 bp, Homo sapiens
tcagctctgcctt

SEQ ID NO: 4468821 - DNA, 20 bp, Homo sapiens
tcagctctgccttgcactgt

SEQ ID NO: 4468822 - DNA, 17 bp, Homo sapiens
tcagctctggggcagag

SEQ ID NO: 4468823 - DNA, 20 bp, Homo sapiens
tcagctctggggcagaggaa

SEQ ID NO: 4468824 - DNA, 22 bp, Homo sapiens
tcagctctgtttacgaagcaat

SEQ ID NO: 4468825 - DNA, 14 bp, Homo sapiens
tcagctgcctcact

SEQ ID NO: 4468826 - DNA, 24 bp, Homo sapiens
tcagctgcctcacttcctacaaga

SEQ ID NO: 4468827 - DNA, 13 bp, Homo sapiens
tcagctgctggat

SEQ ID NO: 4468828 - DNA, 13 bp, Homo sapiens
tcagcttctccca

SEQ ID NO: 4468829 - DNA, 15 bp, Homo sapiens
tcagcttctcccaag

SEQ ID NO: 4468830 - DNA, 16 bp, Homo sapiens
tcagcttctcccaagc

SEQ ID NO: 4468831 - DNA, 21 bp, Homo sapiens
tcagcttcttcacaggcactc

SEQ ID NO: 4468832 - DNA, 15 bp, Homo sapiens
tcagctttgataatt

SEQ ID NO: 4468833 - DNA, 17 bp, Homo sapiens
tcagcttttgttctaga

SEQ ID NO: 4468834 - DNA, 19 bp, Homo sapiens
tcagcttttgttctagact

SEQ ID NO: 4468835 - DNA, 21 bp, Homo sapiens
tcaggaaaactgacagaggag

SEQ ID NO: 4468836 - DNA, 15 bp, Homo sapiens
tcaggaaaaggttga

SEQ ID NO: 4468837 - DNA, 20 bp, Homo sapiens
tcaggaaagaatagaaagaa

SEQ ID NO: 4468838 - DNA, 13 bp, Homo sapiens
tcaggaaagagag

SEQ ID NO: 4468839 - DNA, 18 bp, Homo sapiens
tcaggaaccgaggcaggg

SEQ ID NO: 4468840 - DNA, 20 bp, Homo sapiens
tcaggaacctcgagtactgt

SEQ ID NO: 4468841 - DNA, 22 bp, Homo sapiens
tcaggaacctcgagtactgtgg

SEQ ID NO: 4468842 - DNA, 22 bp, Homo sapiens
tcaggaatatctgttcccagcc

SEQ ID NO: 4468843 - DNA, 17 bp, Homo sapiens
tcaggaattccctggaa

SEQ ID NO: 4468844 - DNA, 16 bp, Homo sapiens
tcaggaatttaagaat

SEQ ID NO: 4468845 - DNA, 15 bp, Homo sapiens
tcaggacagaacagt

SEQ ID NO: 4468846 - DNA, 20 bp, Homo sapiens
tcaggaccaaagctttcatg

SEQ ID NO: 4468847 - DNA, 14 bp, Homo sapiens
tcaggacggctcct

SEQ ID NO: 4468848 - DNA, 15 bp, Homo sapiens
tcaggacggctcctc

SEQ ID NO: 4468849 - DNA, 16 bp, Homo sapiens
tcaggacggctcctca

SEQ ID NO: 4468850 - DNA, 20 bp, Homo sapiens
tcaggacggctcctcagagc

SEQ ID NO: 4468851 - DNA, 16 bp, Homo sapiens
tcaggactctgcggga

SEQ ID NO: 4468852 - DNA, 15 bp, Homo sapiens
tcaggagagcaaggt

SEQ ID NO: 4468853 - DNA, 15 bp, Homo sapiens
tcaggagcttcaatg

SEQ ID NO: 4468854 - DNA, 19 bp, Homo sapiens
tcaggaggcgaataaatgt

SEQ ID NO: 4468855 - DNA, 13 bp, Homo sapiens
tcaggaggctgag

SEQ ID NO: 4468856 - DNA, 18 bp, Homo sapiens
tcaggaggctgagacagg

SEQ ID NO: 4468857 - DNA, 20 bp, Homo sapiens
tcaggaggctgaggcagaag

SEQ ID NO: 4468858 - DNA, 21 bp, Homo sapiens
tcaggagggtcaccctggcct

SEQ ID NO: 4468859 - DNA, 22 bp, Homo sapiens
tcaggagtttgagaccaggctg

SEQ ID NO: 4468860 - DNA, 14 bp, Homo sapiens
tcaggcacacagct

SEQ ID NO: 4468861 - DNA, 18 bp, Homo sapiens
tcaggccagcccagccag

SEQ ID NO: 4468862 - DNA, 16 bp, Homo sapiens
tcaggcccagctgctc

SEQ ID NO: 4468863 - DNA, 18 bp, Homo sapiens
tcaggcccagctgctccc

SEQ ID NO: 4468864 - DNA, 18 bp, Homo sapiens
tcaggcccaggagtccag

SEQ ID NO: 4468865 - DNA, 18 bp, Homo sapiens
tcaggcccgtcagcatca

SEQ ID NO: 4468866 - DNA, 22 bp, Homo sapiens
tcaggcccgtcagcatcactga

SEQ ID NO: 4468867 - DNA, 15 bp, Homo sapiens
tcaggccgaaggagg

SEQ ID NO: 4468868 - DNA, 17 bp, Homo sapiens
tcaggcctggcctcatc

SEQ ID NO: 4468869 - DNA, 18 bp, Homo sapiens
tcaggctatatgcagtcc

SEQ ID NO: 4468870 - DNA, 19 bp, Homo sapiens
tcaggctgctggcgcctct

SEQ ID NO: 4468871 - DNA, 21 bp, Homo sapiens
tcaggctgctggcgcctctgc

SEQ ID NO: 4468872 - DNA, 15 bp, Homo sapiens
tcaggctgcttggga

SEQ ID NO: 4468873 - DNA, 23 bp, Homo sapiens
tcagggacagagacacctgcacc

SEQ ID NO: 4468874 - DNA, 16 bp, Homo sapiens
tcagggagcaagaggt

SEQ ID NO: 4468875 - DNA, 23 bp, Homo sapiens
tcagggagcagggaaggcctgac

SEQ ID NO: 4468876 - DNA, 13 bp, Homo sapiens
tcagggagtgcag

SEQ ID NO: 4468877 - DNA, 21 bp, Homo sapiens
tcagggcattctgttggccta

SEQ ID NO: 4468878 - DNA, 17 bp, Homo sapiens
tcagggctgtcccagcc

SEQ ID NO: 4468879 - DNA, 18 bp, Homo sapiens
tcagggctgtcccagccc

SEQ ID NO: 4468880 - DNA, 20 bp, Homo sapiens
tcagggctgtcccagccccg

SEQ ID NO: 4468881 - DNA, 14 bp, Homo sapiens
tcaggggaagagaa

SEQ ID NO: 4468882 - DNA, 18 bp, Homo sapiens
tcaggggcctctctcctg

SEQ ID NO: 4468883 - DNA, 17 bp, Homo sapiens
tcaggggctccatgctg

SEQ ID NO: 4468884 - DNA, 17 bp, Homo sapiens
tcaggtaacactacaga

SEQ ID NO: 4468885 - DNA, 19 bp, Homo sapiens
tcaggtagttgcaattgaa

SEQ ID NO: 4468886 - DNA, 18 bp, Homo sapiens
tcaggtgacctcctgcag

SEQ ID NO: 4468887 - DNA, 19 bp, Homo sapiens
tcaggtgatttgtatgctc

SEQ ID NO: 4468888 - DNA, 21 bp, Homo sapiens
tcaggttccagaacagccctc

SEQ ID NO: 4468889 - DNA, 13 bp, Homo sapiens
tcaggttgcattg

SEQ ID NO: 4468890 - DNA, 14 bp, Homo sapiens
tcaggtttgttttg

SEQ ID NO: 4468891 - DNA, 15 bp, Homo sapiens
tcaggtttgttttgt

SEQ ID NO: 4468892 - DNA, 22 bp, Homo sapiens
tcaggtttttcctttttttgta

SEQ ID NO: 4468893 - DNA, 20 bp, Homo sapiens
tcagtaaaattatactgtgt

SEQ ID NO: 4468894 - DNA, 15 bp, Homo sapiens
tcagtaacataactg

SEQ ID NO: 4468895 - DNA, 14 bp, Homo sapiens
tcagtaagcagcct

SEQ ID NO: 4468896 - DNA, 15 bp, Homo sapiens
tcagtaagctgtgtg

SEQ ID NO: 4468897 - DNA, 17 bp, Homo sapiens
tcagtaagtatctggag

SEQ ID NO: 4468898 - DNA, 19 bp, Homo sapiens
tcagtaatttagaaatcat

SEQ ID NO: 4468899 - DNA, 16 bp, Homo sapiens
tcagtacgatcaagtt

SEQ ID NO: 4468900 - DNA, 19 bp, Homo sapiens
tcagtacgatcaagttgtt

SEQ ID NO: 4468901 - DNA, 24 bp, Homo sapiens
tcagtacgatcaagttgttgactg

SEQ ID NO: 4468902 - DNA, 14 bp, Homo sapiens
tcagtagaaagcta

SEQ ID NO: 4468903 - DNA, 17 bp, Homo sapiens
tcagtagaaagctaaag

SEQ ID NO: 4468904 - DNA, 18 bp, Homo sapiens
tcagtagtcacaaactga

SEQ ID NO: 4468905 - DNA, 14 bp, Homo sapiens
tcagtatattttct

SEQ ID NO: 4468906 - DNA, 15 bp, Homo sapiens
tcagtatattttctg

SEQ ID NO: 4468907 - DNA, 20 bp, Homo sapiens
tcagtatattttctgtattt

SEQ ID NO: 4468908 - DNA, 21 bp, Homo sapiens
tcagtatattttctgtattta

SEQ ID NO: 4468909 - DNA, 17 bp, Homo sapiens
tcagtatccatgctctt

SEQ ID NO: 4468910 - DNA, 20 bp, Homo sapiens
tcagtatccatgctcttgac

SEQ ID NO: 4468911 - DNA, 18 bp, Homo sapiens
tcagtattctgacatgta

SEQ ID NO: 4468912 - DNA, 15 bp, Homo sapiens
tcagtattttccagc

SEQ ID NO: 4468913 - DNA, 22 bp, Homo sapiens
tcagtattttccagccttatgt

SEQ ID NO: 4468914 - DNA, 23 bp, Homo sapiens
tcagtattttccagccttatgtg

SEQ ID NO: 4468915 - DNA, 13 bp, Homo sapiens
tcagtcaaaactt

SEQ ID NO: 4468916 - DNA, 20 bp, Homo sapiens
tcagtcaatggaagaaatgg

SEQ ID NO: 4468917 - DNA, 18 bp, Homo sapiens
tcagtccccacagataac

SEQ ID NO: 4468918 - DNA, 22 bp, Homo sapiens
tcagtcctgtagttttatttta

SEQ ID NO: 4468919 - DNA, 17 bp, Homo sapiens
tcagtctaaggtctcat

SEQ ID NO: 4468920 - DNA, 15 bp, Homo sapiens
tcagtctctgagcag

SEQ ID NO: 4468921 - DNA, 19 bp, Homo sapiens
tcagtctggtgggaggacg

SEQ ID NO: 4468922 - DNA, 14 bp, Homo sapiens
tcagtctgttcact

SEQ ID NO: 4468923 - DNA, 21 bp, Homo sapiens
tcagtctgttcactgcattca

SEQ ID NO: 4468924 - DNA, 15 bp, Homo sapiens
tcagtgacataaaaa

SEQ ID NO: 4468925 - DNA, 15 bp, Homo sapiens
tcagtgagcccctcc

SEQ ID NO: 4468926 - DNA, 19 bp, Homo sapiens
tcagtgagcccctccccag

SEQ ID NO: 4468927 - DNA, 13 bp, Homo sapiens
tcagtgagcctcc

SEQ ID NO: 4468928 - DNA, 16 bp, Homo sapiens
tcagtgagcctcctgt

SEQ ID NO: 4468929 - DNA, 20 bp, Homo sapiens
tcagtgagcctcctgtgcct

SEQ ID NO: 4468930 - DNA, 13 bp, Homo sapiens
tcagtgaggactc

SEQ ID NO: 4468931 - DNA, 17 bp, Homo sapiens
tcagtgataatgttcat

SEQ ID NO: 4468932 - DNA, 16 bp, Homo sapiens
tcagtgcatttgtgct

SEQ ID NO: 4468933 - DNA, 13 bp, Homo sapiens
tcagtgcccacca

SEQ ID NO: 4468934 - DNA, 13 bp, Homo sapiens
tcagtgctccctc

SEQ ID NO: 4468935 - DNA, 19 bp, Homo sapiens
tcagtgctccctcacatgt

SEQ ID NO: 4468936 - DNA, 18 bp, Homo sapiens
tcagtgctcctggaaact

SEQ ID NO: 4468937 - DNA, 13 bp, Homo sapiens
tcagtggccaggt

SEQ ID NO: 4468938 - DNA, 15 bp, Homo sapiens
tcagtggcttctcca

SEQ ID NO: 4468939 - DNA, 16 bp, Homo sapiens
tcagtggcttctccag

SEQ ID NO: 4468940 - DNA, 22 bp, Homo sapiens
tcagtgggaacgtgactgcccc

SEQ ID NO: 4468941 - DNA, 16 bp, Homo sapiens
tcagtgggagaaaaca

SEQ ID NO: 4468942 - DNA, 16 bp, Homo sapiens
tcagtggtgaaatctt

SEQ ID NO: 4468943 - DNA, 18 bp, Homo sapiens
tcagtgtacacgtctgga

SEQ ID NO: 4468944 - DNA, 18 bp, Homo sapiens
tcagtgtaccatttgcct

SEQ ID NO: 4468945 - DNA, 19 bp, Homo sapiens
tcagtgtaccatttgcctc

SEQ ID NO: 4468946 - DNA, 18 bp, Homo sapiens
tcagtgtcgggaattttc

SEQ ID NO: 4468947 - DNA, 19 bp, Homo sapiens
tcagtgtctccccgtgtcc

SEQ ID NO: 4468948 - DNA, 17 bp, Homo sapiens
tcagtgtgagtcagaat

SEQ ID NO: 4468949 - DNA, 14 bp, Homo sapiens
tcagttactcagcc

SEQ ID NO: 4468950 - DNA, 15 bp, Homo sapiens
tcagttactcagccc

SEQ ID NO: 4468951 - DNA, 19 bp, Homo sapiens
tcagttactcagccctggg

SEQ ID NO: 4468952 - DNA, 20 bp, Homo sapiens
tcagttatacagttataaaa

SEQ ID NO: 4468953 - DNA, 13 bp, Homo sapiens
tcagttattaaat

SEQ ID NO: 4468954 - DNA, 22 bp, Homo sapiens
tcagttcaacctggtggcacca

SEQ ID NO: 4468955 - DNA, 13 bp, Homo sapiens
tcagttgcccccc

SEQ ID NO: 4468956 - DNA, 15 bp, Homo sapiens
tcagttgttatttat

SEQ ID NO: 4468957 - DNA, 17 bp, Homo sapiens
tcagtttcacagaaaat

SEQ ID NO: 4468958 - DNA, 18 bp, Homo sapiens
tcagtttcacagaaaata

SEQ ID NO: 4468959 - DNA, 14 bp, Homo sapiens
tcagtttctatcaa

SEQ ID NO: 4468960 - DNA, 22 bp, Homo sapiens
tcagttttgcttattgtgtgtt

SEQ ID NO: 4468961 - DNA, 19 bp, Homo sapiens
tcagtttttattaatctac

SEQ ID NO: 4468962 - DNA, 22 bp, Homo sapiens
tcagtttttattaatctactgt

SEQ ID NO: 4468963 - DNA, 16 bp, Homo sapiens
tcagtttttcacttct

SEQ ID NO: 4468964 - DNA, 19 bp, Homo sapiens
tcataaacagatgaataaa

SEQ ID NO: 4468965 - DNA, 22 bp, Homo sapiens
tcataaatactgtcaaacaata

SEQ ID NO: 4468966 - DNA, 23 bp, Homo sapiens
tcataaatactgtcaaacaataa

SEQ ID NO: 4468967 - DNA, 14 bp, Homo sapiens
tcataaatttgaat

SEQ ID NO: 4468968 - DNA, 20 bp, Homo sapiens
tcataacggttaagaaagca

SEQ ID NO: 4468969 - DNA, 17 bp, Homo sapiens
tcataaggagttggtgt

SEQ ID NO: 4468970 - DNA, 23 bp, Homo sapiens
tcataatttaaaaatctccatta

SEQ ID NO: 4468971 - DNA, 16 bp, Homo sapiens
tcataatttgtttcca

SEQ ID NO: 4468972 - DNA, 15 bp, Homo sapiens
tcatacaaactctca

SEQ ID NO: 4468973 - DNA, 18 bp, Homo sapiens
tcatacaaactctcacca

SEQ ID NO: 4468974 - DNA, 21 bp, Homo sapiens
tcatacaagtcatggtcacag

SEQ ID NO: 4468975 - DNA, 12 bp, Homo sapiens
tcatacagaagg

SEQ ID NO: 4468976 - DNA, 12 bp, Homo sapiens
tcatactgtaca

SEQ ID NO: 4468977 - DNA, 17 bp, Homo sapiens
tcatactgtacacattt

SEQ ID NO: 4468978 - DNA, 21 bp, Homo sapiens
tcatactgtacacatttctta

SEQ ID NO: 4468979 - DNA, 22 bp, Homo sapiens
tcatactgttttgaataaattt

SEQ ID NO: 4468980 - DNA, 14 bp, Homo sapiens
tcatacttaaaaat

SEQ ID NO: 4468981 - DNA, 22 bp, Homo sapiens
tcatacttaacatttcattgta

SEQ ID NO: 4468982 - DNA, 17 bp, Homo sapiens
tcatagattattataaa

SEQ ID NO: 4468983 - DNA, 18 bp, Homo sapiens
tcatagattattataaac

SEQ ID NO: 4468984 - DNA, 19 bp, Homo sapiens
tcatagattattataaact

SEQ ID NO: 4468985 - DNA, 20 bp, Homo sapiens
tcatagatttgaaaaacttt

SEQ ID NO: 4468986 - DNA, 11 bp, Homo sapiens
tcatagcagct

SEQ ID NO: 4468987 - DNA, 12 bp, Homo sapiens
tcatagcagctt

SEQ ID NO: 4468988 - DNA, 14 bp, Homo sapiens
tcataggttaaaaa

SEQ ID NO: 4468989 - DNA, 15 bp, Homo sapiens
tcataggttaaaaaa

SEQ ID NO: 4468990 - DNA, 20 bp, Homo sapiens
tcataggttaaaaaaaaaag

SEQ ID NO: 4468991 - DNA, 18 bp, Homo sapiens
tcatagtaacttcttatg

SEQ ID NO: 4468992 - DNA, 17 bp, Homo sapiens
tcatagtcttgaaatga

SEQ ID NO: 4468993 - DNA, 18 bp, Homo sapiens
tcatagtcttgaaatgaa

SEQ ID NO: 4468994 - DNA, 22 bp, Homo sapiens
tcatagtcttgaaatgaaaggg

SEQ ID NO: 4468995 - DNA, 13 bp, Homo sapiens
tcatagttaacat

SEQ ID NO: 4468996 - DNA, 13 bp, Homo sapiens
tcatagttcagaa

SEQ ID NO: 4468997 - DNA, 18 bp, Homo sapiens
tcatagttcagaatttag

SEQ ID NO: 4468998 - DNA, 13 bp, Homo sapiens
tcatataaagtat

SEQ ID NO: 4468999 - DNA, 23 bp, Homo sapiens
tcatataattaaagactcaagag

SEQ ID NO: 4469000 - DNA, 16 bp, Homo sapiens
tcatataccagcaata

SEQ ID NO: 4469001 - DNA, 12 bp, Homo sapiens
tcatatatactg

SEQ ID NO: 4469002 - DNA, 14 bp, Homo sapiens
tcatatatactgta

SEQ ID NO: 4469003 - DNA, 16 bp, Homo sapiens
tcatatatgactttat

SEQ ID NO: 4469004 - DNA, 17 bp, Homo sapiens
tcatatattaaaacaat

SEQ ID NO: 4469005 - DNA, 18 bp, Homo sapiens
tcatatcactaaataaac

SEQ ID NO: 4469006 - DNA, 15 bp, Homo sapiens
tcatatcatactgtt

SEQ ID NO: 4469007 - DNA, 13 bp, Homo sapiens
tcatatcatccac

SEQ ID NO: 4469008 - DNA, 14 bp, Homo sapiens
tcatatcatccaca

SEQ ID NO: 4469009 - DNA, 13 bp, Homo sapiens
tcatatcatttct

SEQ ID NO: 4469010 - DNA, 14 bp, Homo sapiens
tcatatcatttctt

SEQ ID NO: 4469011 - DNA, 21 bp, Homo sapiens
tcatatgaaaggtgccatgga

SEQ ID NO: 4469012 - DNA, 21 bp, Homo sapiens
tcatatgaggacctttatatc

SEQ ID NO: 4469013 - DNA, 21 bp, Homo sapiens
tcatatgatacaccattatgt

SEQ ID NO: 4469014 - DNA, 24 bp, Homo sapiens
tcatatggaatgtattttcaaatg

SEQ ID NO: 4469015 - DNA, 16 bp, Homo sapiens
tcatattattttagtg

SEQ ID NO: 4469016 - DNA, 15 bp, Homo sapiens
tcatatttattgatt

SEQ ID NO: 4469017 - DNA, 20 bp, Homo sapiens
tcatatttgaggagtgttaa

SEQ ID NO: 4469018 - DNA, 13 bp, Homo sapiens
tcatcaacaagat

SEQ ID NO: 4469019 - DNA, 21 bp, Homo sapiens
tcatcaatagtgtcctatgca

SEQ ID NO: 4469020 - DNA, 17 bp, Homo sapiens
tcatcaatgaatgaatg

SEQ ID NO: 4469021 - DNA, 14 bp, Homo sapiens
tcatcacactgggt

SEQ ID NO: 4469022 - DNA, 21 bp, Homo sapiens
tcatcacctgctagaacctct

SEQ ID NO: 4469023 - DNA, 17 bp, Homo sapiens
tcatcactgtaaagaca

SEQ ID NO: 4469024 - DNA, 21 bp, Homo sapiens
tcatcactttgacctaaatta

SEQ ID NO: 4469025 - DNA, 19 bp, Homo sapiens
tcatcagaaaggaaaaaca

SEQ ID NO: 4469026 - DNA, 19 bp, Homo sapiens
tcatcagtaaagtaccttt

SEQ ID NO: 4469027 - DNA, 17 bp, Homo sapiens
tcatcataggtaaggtt

SEQ ID NO: 4469028 - DNA, 14 bp, Homo sapiens
tcatcatcagagcc

SEQ ID NO: 4469029 - DNA, 18 bp, Homo sapiens
tcatcatgagttctgctg

SEQ ID NO: 4469030 - DNA, 13 bp, Homo sapiens
tcatcatgcagct

SEQ ID NO: 4469031 - DNA, 13 bp, Homo sapiens
tcatcatgtctat

SEQ ID NO: 4469032 - DNA, 18 bp, Homo sapiens
tcatcatgtctattgtcc

SEQ ID NO: 4469033 - DNA, 14 bp, Homo sapiens
tcatcattctctgt

SEQ ID NO: 4469034 - DNA, 22 bp, Homo sapiens
tcatcattctctgtctcatcca

SEQ ID NO: 4469035 - DNA, 15 bp, Homo sapiens
tcatcatttcagcca

SEQ ID NO: 4469036 - DNA, 16 bp, Homo sapiens
tcatcatttcagccaa

SEQ ID NO: 4469037 - DNA, 12 bp, Homo sapiens
tcatccatcatc

SEQ ID NO: 4469038 - DNA, 21 bp, Homo sapiens
tcatccccaggggtcccagcc

SEQ ID NO: 4469039 - DNA, 21 bp, Homo sapiens
tcatcccgagcacctccacat

SEQ ID NO: 4469040 - DNA, 23 bp, Homo sapiens
tcatcccgagcacctccacatcc

SEQ ID NO: 4469041 - DNA, 13 bp, Homo sapiens
tcatccctccttg

SEQ ID NO: 4469042 - DNA, 19 bp, Homo sapiens
tcatccctggacttctggg

SEQ ID NO: 4469043 - DNA, 14 bp, Homo sapiens
tcatccgttgtgac

SEQ ID NO: 4469044 - DNA, 14 bp, Homo sapiens
tcatcctcaaagaa

SEQ ID NO: 4469045 - DNA, 21 bp, Homo sapiens
tcatcctcaaagaaagtgtat

SEQ ID NO: 4469046 - DNA, 23 bp, Homo sapiens
tcatcctcacagtgaacactcag

SEQ ID NO: 4469047 - DNA, 20 bp, Homo sapiens
tcatcctcccattgcccagt

SEQ ID NO: 4469048 - DNA, 20 bp, Homo sapiens
tcatcctgactctgccccct

SEQ ID NO: 4469049 - DNA, 20 bp, Homo sapiens
tcatcgaagggattgtgtat

SEQ ID NO: 4469050 - DNA, 14 bp, Homo sapiens
tcatcgaatctact

SEQ ID NO: 4469051 - DNA, 20 bp, Homo sapiens
tcatcgacttagcctgagtc

SEQ ID NO: 4469052 - DNA, 16 bp, Homo sapiens
tcatcggaggctgggc

SEQ ID NO: 4469053 - DNA, 17 bp, Homo sapiens
tcatctaataaatcagt

SEQ ID NO: 4469054 - DNA, 21 bp, Homo sapiens
tcatctatgagggtgtttcct

SEQ ID NO: 4469055 - DNA, 16 bp, Homo sapiens
tcatctattttatttt

SEQ ID NO: 4469056 - DNA, 22 bp, Homo sapiens
tcatctattttattttattgaa

SEQ ID NO: 4469057 - DNA, 23 bp, Homo sapiens
tcatctattttattttattgaat

SEQ ID NO: 4469058 - DNA, 12 bp, Homo sapiens
tcatctattttg

SEQ ID NO: 4469059 - DNA, 17 bp, Homo sapiens
tcatctattttgatgca

SEQ ID NO: 4469060 - DNA, 19 bp, Homo sapiens
tcatctattttgatgcagc

SEQ ID NO: 4469061 - DNA, 22 bp, Homo sapiens
tcatctcagtgaagaatacttc

SEQ ID NO: 4469062 - DNA, 20 bp, Homo sapiens
tcatctcatttaagggaaaa

SEQ ID NO: 4469063 - DNA, 13 bp, Homo sapiens
tcatctctctggg

SEQ ID NO: 4469064 - DNA, 23 bp, Homo sapiens
tcatctctgttcttttcccgcct

SEQ ID NO: 4469065 - DNA, 17 bp, Homo sapiens
tcatctgctctccttcc

SEQ ID NO: 4469066 - DNA, 18 bp, Homo sapiens
tcatctgctctccttcct

SEQ ID NO: 4469067 - DNA, 19 bp, Homo sapiens
tcatctggcaacatcttta

SEQ ID NO: 4469068 - DNA, 20 bp, Homo sapiens
tcatctggcttttcgcttgc

SEQ ID NO: 4469069 - DNA, 16 bp, Homo sapiens
tcatctggggacctgg

SEQ ID NO: 4469070 - DNA, 15 bp, Homo sapiens
tcatctgtcattata

SEQ ID NO: 4469071 - DNA, 16 bp, Homo sapiens
tcatctgtcattatat

SEQ ID NO: 4469072 - DNA, 19 bp, Homo sapiens
tcatctgtcattatattct

SEQ ID NO: 4469073 - DNA, 23 bp, Homo sapiens
tcatctgtcattatattctaatt

SEQ ID NO: 4469074 - DNA, 18 bp, Homo sapiens
tcatctgtccctccggga

SEQ ID NO: 4469075 - DNA, 12 bp, Homo sapiens
tcatcttaaact

SEQ ID NO: 4469076 - DNA, 13 bp, Homo sapiens
tcatcttaaacta

SEQ ID NO: 4469077 - DNA, 15 bp, Homo sapiens
tcatcttagttctgt

SEQ ID NO: 4469078 - DNA, 17 bp, Homo sapiens
tcatcttgtacaaactt

SEQ ID NO: 4469079 - DNA, 14 bp, Homo sapiens
tcatcttgtgaaat

SEQ ID NO: 4469080 - DNA, 13 bp, Homo sapiens
tcatctttaagaa

SEQ ID NO: 4469081 - DNA, 16 bp, Homo sapiens
tcatctttgccaagta

SEQ ID NO: 4469082 - DNA, 14 bp, Homo sapiens
tcatcttttcaagg

SEQ ID NO: 4469083 - DNA, 16 bp, Homo sapiens
tcatgaaatgtgtttt

SEQ ID NO: 4469084 - DNA, 14 bp, Homo sapiens
tcatgaaggagggg

SEQ ID NO: 4469085 - DNA, 15 bp, Homo sapiens
tcatgaatattttca

SEQ ID NO: 4469086 - DNA, 21 bp, Homo sapiens
tcatgaatgcttttagtgtgt

SEQ ID NO: 4469087 - DNA, 18 bp, Homo sapiens
tcatgaattttaaagtat

SEQ ID NO: 4469088 - DNA, 18 bp, Homo sapiens
tcatgacaagatgggaca

SEQ ID NO: 4469089 - DNA, 19 bp, Homo sapiens
tcatgacaagatgggacag

SEQ ID NO: 4469090 - DNA, 14 bp, Homo sapiens
tcatgacagcctcc

SEQ ID NO: 4469091 - DNA, 23 bp, Homo sapiens
tcatgagtctacctgagcattca

SEQ ID NO: 4469092 - DNA, 16 bp, Homo sapiens
tcatgatagaaagaat

SEQ ID NO: 4469093 - DNA, 22 bp, Homo sapiens
tcatgatagaaagaataaaatg

SEQ ID NO: 4469094 - DNA, 17 bp, Homo sapiens
tcatgatctccctgccg

SEQ ID NO: 4469095 - DNA, 13 bp, Homo sapiens
tcatgatgcagtc

SEQ ID NO: 4469096 - DNA, 20 bp, Homo sapiens
tcatgatgcagtctcctctt

SEQ ID NO: 4469097 - DNA, 22 bp, Homo sapiens
tcatgatgcagtctcctcttta

SEQ ID NO: 4469098 - DNA, 16 bp, Homo sapiens
tcatgattagcaagtt

SEQ ID NO: 4469099 - DNA, 18 bp, Homo sapiens
tcatgcaaaagttctcat

SEQ ID NO: 4469100 - DNA, 19 bp, Homo sapiens
tcatgcagctcaactttct

SEQ ID NO: 4469101 - DNA, 14 bp, Homo sapiens
tcatgcagctgtgg

SEQ ID NO: 4469102 - DNA, 16 bp, Homo sapiens
tcatgcccaccccctg

SEQ ID NO: 4469103 - DNA, 21 bp, Homo sapiens
tcatgccccctttcagatgtc

SEQ ID NO: 4469104 - DNA, 16 bp, Homo sapiens
tcatgcggtgggtgct

SEQ ID NO: 4469105 - DNA, 19 bp, Homo sapiens
tcatgcggtgggtgctgcc

SEQ ID NO: 4469106 - DNA, 14 bp, Homo sapiens
tcatgctgggattt

SEQ ID NO: 4469107 - DNA, 18 bp, Homo sapiens
tcatgctgggatttccaa

SEQ ID NO: 4469108 - DNA, 17 bp, Homo sapiens
tcatgcttaataaacat

SEQ ID NO: 4469109 - DNA, 15 bp, Homo sapiens
tcatgcttactattt

SEQ ID NO: 4469110 - DNA, 15 bp, Homo sapiens
tcatggaagaaaagg

SEQ ID NO: 4469111 - DNA, 16 bp, Homo sapiens
tcatggctacctcaga

SEQ ID NO: 4469112 - DNA, 18 bp, Homo sapiens
tcatggctgtgtccactg

SEQ ID NO: 4469113 - DNA, 14 bp, Homo sapiens
tcatggcttaggat

SEQ ID NO: 4469114 - DNA, 13 bp, Homo sapiens
tcatgggaagaac

SEQ ID NO: 4469115 - DNA, 14 bp, Homo sapiens
tcatgggctgtgtg

SEQ ID NO: 4469116 - DNA, 15 bp, Homo sapiens
tcatgggtcctagcc

SEQ ID NO: 4469117 - DNA, 22 bp, Homo sapiens
tcatgggtcctagcccttccct

SEQ ID NO: 4469118 - DNA, 18 bp, Homo sapiens
tcatggtacttcctctgt

SEQ ID NO: 4469119 - DNA, 21 bp, Homo sapiens
tcatggtagatttttttcata

SEQ ID NO: 4469120 - DNA, 23 bp, Homo sapiens
tcatggtgggttcaggggactca

SEQ ID NO: 4469121 - DNA, 18 bp, Homo sapiens
tcatggtttgcatttaaa

SEQ ID NO: 4469122 - DNA, 13 bp, Homo sapiens
tcatgtaaattga

SEQ ID NO: 4469123 - DNA, 18 bp, Homo sapiens
tcatgtacaagatgaagg

SEQ ID NO: 4469124 - DNA, 13 bp, Homo sapiens
tcatgtacttttt

SEQ ID NO: 4469125 - DNA, 15 bp, Homo sapiens
tcatgtagtaagatt

SEQ ID NO: 4469126 - DNA, 23 bp, Homo sapiens
tcatgtcttcattttttaatgtg

SEQ ID NO: 4469127 - DNA, 23 bp, Homo sapiens
tcatgtggcagggagcagtacac

SEQ ID NO: 4469128 - DNA, 20 bp, Homo sapiens
tcatgtggcccaactctcct

SEQ ID NO: 4469129 - DNA, 13 bp, Homo sapiens
tcatgtgtgctca

SEQ ID NO: 4469130 - DNA, 12 bp, Homo sapiens
tcatgtgtgtcc

SEQ ID NO: 4469131 - DNA, 23 bp, Homo sapiens
tcatgtgtgtccacgactgtctc

SEQ ID NO: 4469132 - DNA, 15 bp, Homo sapiens
tcatgtgttcccttt

SEQ ID NO: 4469133 - DNA, 21 bp, Homo sapiens
tcatgttgttgtgtgtatatg

SEQ ID NO: 4469134 - DNA, 17 bp, Homo sapiens
tcatgtttacagaggac

SEQ ID NO: 4469135 - DNA, 13 bp, Homo sapiens
tcattaaactcta

SEQ ID NO: 4469136 - DNA, 19 bp, Homo sapiens
tcattaaactctaaagatt

SEQ ID NO: 4469137 - DNA, 15 bp, Homo sapiens
tcattaaactgattc

SEQ ID NO: 4469138 - DNA, 17 bp, Homo sapiens
tcattaaactgattcca

SEQ ID NO: 4469139 - DNA, 17 bp, Homo sapiens
tcattaaacttttttaa

SEQ ID NO: 4469140 - DNA, 13 bp, Homo sapiens
tcattaaataaat

SEQ ID NO: 4469141 - DNA, 18 bp, Homo sapiens
tcattaacccatctctga

SEQ ID NO: 4469142 - DNA, 23 bp, Homo sapiens
tcattaatagctgccttcaagga

SEQ ID NO: 4469143 - DNA, 17 bp, Homo sapiens
tcattaccttaaagcat

SEQ ID NO: 4469144 - DNA, 22 bp, Homo sapiens
tcattaccttttaccagctttt

SEQ ID NO: 4469145 - DNA, 15 bp, Homo sapiens
tcattagaaatattt

SEQ ID NO: 4469146 - DNA, 15 bp, Homo sapiens
tcattatattctaat

SEQ ID NO: 4469147 - DNA, 13 bp, Homo sapiens
tcattatctcaaa

SEQ ID NO: 4469148 - DNA, 19 bp, Homo sapiens
tcattatctcaaaactgca

SEQ ID NO: 4469149 - DNA, 20 bp, Homo sapiens
tcattatctcaaaactgcac

SEQ ID NO: 4469150 - DNA, 18 bp, Homo sapiens
tcattatgctttgaactt

SEQ ID NO: 4469151 - DNA, 17 bp, Homo sapiens
tcattatgttaatattt

SEQ ID NO: 4469152 - DNA, 19 bp, Homo sapiens
tcattattatctagctaag

SEQ ID NO: 4469153 - DNA, 14 bp, Homo sapiens
tcattattctctgc

SEQ ID NO: 4469154 - DNA, 14 bp, Homo sapiens
tcattatttattaa

SEQ ID NO: 4469155 - DNA, 14 bp, Homo sapiens
tcattatttgagac

SEQ ID NO: 4469156 - DNA, 20 bp, Homo sapiens
tcattatttttgttagcaaa

SEQ ID NO: 4469157 - DNA, 22 bp, Homo sapiens
tcattcaggtgacctcctgcag

SEQ ID NO: 4469158 - DNA, 22 bp, Homo sapiens
tcattccacactccttgtcaac

SEQ ID NO: 4469159 - DNA, 22 bp, Homo sapiens
tcattcccattccttttcgttt

SEQ ID NO: 4469160 - DNA, 12 bp, Homo sapiens
tcattccccagg

SEQ ID NO: 4469161 - DNA, 23 bp, Homo sapiens
tcattcctccagtgcatactgta

SEQ ID NO: 4469162 - DNA, 15 bp, Homo sapiens
tcattccttcactca

SEQ ID NO: 4469163 - DNA, 22 bp, Homo sapiens
tcattcggtgtgaacttttctc

SEQ ID NO: 4469164 - DNA, 18 bp, Homo sapiens
tcattctactaatgtgat

SEQ ID NO: 4469165 - DNA, 23 bp, Homo sapiens
tcattctcataattcctacagca

SEQ ID NO: 4469166 - DNA, 15 bp, Homo sapiens
tcattctctgtctca

SEQ ID NO: 4469167 - DNA, 16 bp, Homo sapiens
tcattctctgtctcat

SEQ ID NO: 4469168 - DNA, 18 bp, Homo sapiens
tcattctctgtctcatcc

SEQ ID NO: 4469169 - DNA, 14 bp, Homo sapiens
tcattctgaattaa

SEQ ID NO: 4469170 - DNA, 12 bp, Homo sapiens
tcattctgccaa

SEQ ID NO: 4469171 - DNA, 13 bp, Homo sapiens
tcattctgccaaa

SEQ ID NO: 4469172 - DNA, 15 bp, Homo sapiens
tcattctgccaaagt

SEQ ID NO: 4469173 - DNA, 18 bp, Homo sapiens
tcattctgctacttcact

SEQ ID NO: 4469174 - DNA, 20 bp, Homo sapiens
tcattcttttgccacatccc

SEQ ID NO: 4469175 - DNA, 21 bp, Homo sapiens
tcattgaaatgtaatttcagt

SEQ ID NO: 4469176 - DNA, 21 bp, Homo sapiens
tcattgcacctatctcagcca

SEQ ID NO: 4469177 - DNA, 22 bp, Homo sapiens
tcattgcagcagataacttttt

SEQ ID NO: 4469178 - DNA, 17 bp, Homo sapiens
tcattgccagtgtcttt

SEQ ID NO: 4469179 - DNA, 23 bp, Homo sapiens
tcattgccagtgtctttctttgg

SEQ ID NO: 4469180 - DNA, 14 bp, Homo sapiens
tcattgcttctgac

SEQ ID NO: 4469181 - DNA, 23 bp, Homo sapiens
tcattgggtttttcctctgttaa

SEQ ID NO: 4469182 - DNA, 23 bp, Homo sapiens
tcattggtggtagccatcaagca

SEQ ID NO: 4469183 - DNA, 13 bp, Homo sapiens
tcattgtaatcac

SEQ ID NO: 4469184 - DNA, 16 bp, Homo sapiens
tcattgtagattttgt

SEQ ID NO: 4469185 - DNA, 14 bp, Homo sapiens
tcatttaaatatct

SEQ ID NO: 4469186 - DNA, 23 bp, Homo sapiens
tcatttagcatgttgttgaaagg

SEQ ID NO: 4469187 - DNA, 16 bp, Homo sapiens
tcatttagtaaggatt

SEQ ID NO: 4469188 - DNA, 17 bp, Homo sapiens
tcatttataatactgtt

SEQ ID NO: 4469189 - DNA, 16 bp, Homo sapiens
tcatttatctataatt

SEQ ID NO: 4469190 - DNA, 18 bp, Homo sapiens
tcatttatctataattta

SEQ ID NO: 4469191 - DNA, 15 bp, Homo sapiens
tcatttcaaggcagt

SEQ ID NO: 4469192 - DNA, 21 bp, Homo sapiens
tcatttcacccctccctttct

SEQ ID NO: 4469193 - DNA, 13 bp, Homo sapiens
tcatttcagaagt

SEQ ID NO: 4469194 - DNA, 15 bp, Homo sapiens
tcatttcagtttcta

SEQ ID NO: 4469195 - DNA, 16 bp, Homo sapiens
tcatttcatctcattt

SEQ ID NO: 4469196 - DNA, 17 bp, Homo sapiens
tcatttcatctcattta

SEQ ID NO: 4469197 - DNA, 20 bp, Homo sapiens
tcatttcatctcatttaagg

SEQ ID NO: 4469198 - DNA, 13 bp, Homo sapiens
tcatttcattcca

SEQ ID NO: 4469199 - DNA, 15 bp, Homo sapiens
tcatttcattccatt

SEQ ID NO: 4469200 - DNA, 17 bp, Homo sapiens
tcatttccctatcttct

SEQ ID NO: 4469201 - DNA, 17 bp, Homo sapiens
tcatttctatttctcct

SEQ ID NO: 4469202 - DNA, 18 bp, Homo sapiens
tcatttctcataattttg

SEQ ID NO: 4469203 - DNA, 22 bp, Homo sapiens
tcatttctcataattttgcaaa

SEQ ID NO: 4469204 - DNA, 14 bp, Homo sapiens
tcatttctttgagt

SEQ ID NO: 4469205 - DNA, 22 bp, Homo sapiens
tcatttgcacacaaaaataaag

SEQ ID NO: 4469206 - DNA, 16 bp, Homo sapiens
tcatttggcttgctgt

SEQ ID NO: 4469207 - DNA, 16 bp, Homo sapiens
tcatttgggctagact

SEQ ID NO: 4469208 - DNA, 13 bp, Homo sapiens
tcatttggttaaa

SEQ ID NO: 4469209 - DNA, 15 bp, Homo sapiens
tcatttgtaaaaatg

SEQ ID NO: 4469210 - DNA, 17 bp, Homo sapiens
tcatttgtatgtcaaag

SEQ ID NO: 4469211 - DNA, 17 bp, Homo sapiens
tcatttgtttaaacaat

SEQ ID NO: 4469212 - DNA, 21 bp, Homo sapiens
tcatttgtttaaacaatcttt

SEQ ID NO: 4469213 - DNA, 13 bp, Homo sapiens
tcattttaaaaag

SEQ ID NO: 4469214 - DNA, 21 bp, Homo sapiens
tcattttaactggcatgtcat

SEQ ID NO: 4469215 - DNA, 13 bp, Homo sapiens
tcattttaatata

SEQ ID NO: 4469216 - DNA, 17 bp, Homo sapiens
tcattttaatatataat

SEQ ID NO: 4469217 - DNA, 21 bp, Homo sapiens
tcattttaatatataatttaa

SEQ ID NO: 4469218 - DNA, 12 bp, Homo sapiens
tcattttaatgt

SEQ ID NO: 4469219 - DNA, 15 bp, Homo sapiens
tcattttaatgtaaa

SEQ ID NO: 4469220 - DNA, 14 bp, Homo sapiens
tcattttactggta

SEQ ID NO: 4469221 - DNA, 22 bp, Homo sapiens
tcattttatggcacctatttct

SEQ ID NO: 4469222 - DNA, 15 bp, Homo sapiens
tcattttatgttaag

SEQ ID NO: 4469223 - DNA, 16 bp, Homo sapiens
tcattttattttgtaa

SEQ ID NO: 4469224 - DNA, 23 bp, Homo sapiens
tcattttctagatacaataaatt

SEQ ID NO: 4469225 - DNA, 12 bp, Homo sapiens
tcattttcttga

SEQ ID NO: 4469226 - DNA, 12 bp, Homo sapiens
tcattttgaaaa

SEQ ID NO: 4469227 - DNA, 14 bp, Homo sapiens
tcattttggggggt

SEQ ID NO: 4469228 - DNA, 14 bp, Homo sapiens
tcattttggtactt

SEQ ID NO: 4469229 - DNA, 11 bp, Homo sapiens
tcatttttaat

SEQ ID NO: 4469230 - DNA, 14 bp, Homo sapiens
tcatttttaatgta

SEQ ID NO: 4469231 - DNA, 13 bp, Homo sapiens
tcatttttacact

SEQ ID NO: 4469232 - DNA, 13 bp, Homo sapiens
tcatttttatagc

SEQ ID NO: 4469233 - DNA, 16 bp, Homo sapiens
tcatttttatagcaac

SEQ ID NO: 4469234 - DNA, 22 bp, Homo sapiens
tcatttttgaaactgcatttgt

SEQ ID NO: 4469235 - DNA, 15 bp, Homo sapiens
tcatttttgtatttt

SEQ ID NO: 4469236 - DNA, 15 bp, Homo sapiens
tcattttttacttga

SEQ ID NO: 4469237 - DNA, 16 bp, Homo sapiens
tcatttttttccaggc

SEQ ID NO: 4469238 - DNA, 13 bp, Homo sapiens
tcattttttttaa

SEQ ID NO: 4469239 - DNA, 22 bp, Homo sapiens
tccaaaaaaaaaaaaaatacaa

SEQ ID NO: 4469240 - DNA, 18 bp, Homo sapiens
tccaaaaatctgcctggg

SEQ ID NO: 4469241 - DNA, 17 bp, Homo sapiens
tccaaaaatgtgtaaga

SEQ ID NO: 4469242 - DNA, 14 bp, Homo sapiens
tccaaaacatttct

SEQ ID NO: 4469243 - DNA, 22 bp, Homo sapiens
tccaaaacatttctggacagta

SEQ ID NO: 4469244 - DNA, 16 bp, Homo sapiens
tccaaaagctttttat

SEQ ID NO: 4469245 - DNA, 20 bp, Homo sapiens
tccaaaataatctatattaa

SEQ ID NO: 4469246 - DNA, 12 bp, Homo sapiens
tccaaaatgctt

SEQ ID NO: 4469247 - DNA, 14 bp, Homo sapiens
tccaaacaggctca

SEQ ID NO: 4469248 - DNA, 15 bp, Homo sapiens
tccaaacatgtattt

SEQ ID NO: 4469249 - DNA, 14 bp, Homo sapiens
tccaaaccaaattt

SEQ ID NO: 4469250 - DNA, 17 bp, Homo sapiens
tccaaaccaaattttaa

SEQ ID NO: 4469251 - DNA, 13 bp, Homo sapiens
tccaaagaggctg

SEQ ID NO: 4469252 - DNA, 23 bp, Homo sapiens
tccaaaggaagtctaggagctgg

SEQ ID NO: 4469253 - DNA, 15 bp, Homo sapiens
tccaaatcctggaag

SEQ ID NO: 4469254 - DNA, 16 bp, Homo sapiens
tccaaatcctggaagg

SEQ ID NO: 4469255 - DNA, 17 bp, Homo sapiens
tccaaatgtcctccaga

SEQ ID NO: 4469256 - DNA, 19 bp, Homo sapiens
tccaaatgtcctccagaag

SEQ ID NO: 4469257 - DNA, 12 bp, Homo sapiens
tccaaattcagt

SEQ ID NO: 4469258 - DNA, 18 bp, Homo sapiens
tccaaattcagtttcata

SEQ ID NO: 4469259 - DNA, 22 bp, Homo sapiens
tccaaattgtgcttctccccag

SEQ ID NO: 4469260 - DNA, 18 bp, Homo sapiens
tccaaccattcaaaaatt

SEQ ID NO: 4469261 - DNA, 14 bp, Homo sapiens
tccaaccccccagc

SEQ ID NO: 4469262 - DNA, 21 bp, Homo sapiens
tccaaccccccagcactgagg

SEQ ID NO: 4469263 - DNA, 22 bp, Homo sapiens
tccaacccgtctggcccaccag

SEQ ID NO: 4469264 - DNA, 21 bp, Homo sapiens
tccaacctaacccctttcctg

SEQ ID NO: 4469265 - DNA, 23 bp, Homo sapiens
tccaacctaacccctttcctgcg

SEQ ID NO: 4469266 - DNA, 14 bp, Homo sapiens
tccaacctggacaa

SEQ ID NO: 4469267 - DNA, 21 bp, Homo sapiens
tccaacctggggggcagtggt

SEQ ID NO: 4469268 - DNA, 19 bp, Homo sapiens
tccaactaatgccttactc

SEQ ID NO: 4469269 - DNA, 20 bp, Homo sapiens
tccaactactaatagaataa

SEQ ID NO: 4469270 - DNA, 16 bp, Homo sapiens
tccaactattaagata

SEQ ID NO: 4469271 - DNA, 19 bp, Homo sapiens
tccaactcctttcagccac

SEQ ID NO: 4469272 - DNA, 17 bp, Homo sapiens
tccaacttcctgtggcc

SEQ ID NO: 4469273 - DNA, 20 bp, Homo sapiens
tccaacttcctgtggcctga

SEQ ID NO: 4469274 - DNA, 11 bp, Homo sapiens
tccaagaaaat

SEQ ID NO: 4469275 - DNA, 16 bp, Homo sapiens
tccaagacagcagcag

SEQ ID NO: 4469276 - DNA, 23 bp, Homo sapiens
tccaagacagcagcagcctgcac

SEQ ID NO: 4469277 - DNA, 22 bp, Homo sapiens
tccaagacatgtctgttctaca

SEQ ID NO: 4469278 - DNA, 19 bp, Homo sapiens
tccaagatgctggcaccaa

SEQ ID NO: 4469279 - DNA, 14 bp, Homo sapiens
tccaagcacagagc

SEQ ID NO: 4469280 - DNA, 21 bp, Homo sapiens
tccaagcatttcatgaaaaag

SEQ ID NO: 4469281 - DNA, 23 bp, Homo sapiens
tccaagcgaggtcaacagagaag

SEQ ID NO: 4469282 - DNA, 20 bp, Homo sapiens
tccaaggaggggctgtaaaa

SEQ ID NO: 4469283 - DNA, 16 bp, Homo sapiens
tccaaggtgatgttgt

SEQ ID NO: 4469284 - DNA, 19 bp, Homo sapiens
tccaagtagtccaccttca

SEQ ID NO: 4469285 - DNA, 23 bp, Homo sapiens
tccaagtatatcagctactgtag

SEQ ID NO: 4469286 - DNA, 21 bp, Homo sapiens
tccaataaaaacattttgaag

SEQ ID NO: 4469287 - DNA, 13 bp, Homo sapiens
tccaatatttctg

SEQ ID NO: 4469288 - DNA, 11 bp, Homo sapiens
tccaatgtgtt

SEQ ID NO: 4469289 - DNA, 14 bp, Homo sapiens
tccaatgttttatt

SEQ ID NO: 4469290 - DNA, 21 bp, Homo sapiens
tccaatgttttattggggaat

SEQ ID NO: 4469291 - DNA, 19 bp, Homo sapiens
tccaattctgaaatacttt

SEQ ID NO: 4469292 - DNA, 12 bp, Homo sapiens
tccaatttcccc

SEQ ID NO: 4469293 - DNA, 23 bp, Homo sapiens
tccaattttaatttagtaaatgt

SEQ ID NO: 4469294 - DNA, 12 bp, Homo sapiens
tccacaaaataa

SEQ ID NO: 4469295 - DNA, 17 bp, Homo sapiens
tccacaaacacattata

SEQ ID NO: 4469296 - DNA, 14 bp, Homo sapiens
tccacaaagaaaat

SEQ ID NO: 4469297 - DNA, 19 bp, Homo sapiens
tccacaaagaaaattccta

SEQ ID NO: 4469298 - DNA, 20 bp, Homo sapiens
tccacaaattattaatgaaa

SEQ ID NO: 4469299 - DNA, 17 bp, Homo sapiens
tccacaagattcccaga

SEQ ID NO: 4469300 - DNA, 20 bp, Homo sapiens
tccacaagattcccagagac

SEQ ID NO: 4469301 - DNA, 23 bp, Homo sapiens
tccacaagattcccagagacagg

SEQ ID NO: 4469302 - DNA, 12 bp, Homo sapiens
tccacaagggga

SEQ ID NO: 4469303 - DNA, 14 bp, Homo sapiens
tccacaccttttat

SEQ ID NO: 4469304 - DNA, 15 bp, Homo sapiens
tccacactgaccaag

SEQ ID NO: 4469305 - DNA, 19 bp, Homo sapiens
tccacagatttttttgtaa

SEQ ID NO: 4469306 - DNA, 17 bp, Homo sapiens
tccacagcagtgtcaca

SEQ ID NO: 4469307 - DNA, 14 bp, Homo sapiens
tccacagccttgca

SEQ ID NO: 4469308 - DNA, 19 bp, Homo sapiens
tccacagggagcaaacact

SEQ ID NO: 4469309 - DNA, 17 bp, Homo sapiens
tccacagtggcgggccc

SEQ ID NO: 4469310 - DNA, 14 bp, Homo sapiens
tccacataaatttt

SEQ ID NO: 4469311 - DNA, 20 bp, Homo sapiens
tccacataaattttaattca

SEQ ID NO: 4469312 - DNA, 13 bp, Homo sapiens
tccacatctgcct

SEQ ID NO: 4469313 - DNA, 14 bp, Homo sapiens
tccacatgttactg

SEQ ID NO: 4469314 - DNA, 15 bp, Homo sapiens
tccacattcttcagt

SEQ ID NO: 4469315 - DNA, 13 bp, Homo sapiens
tccaccacccaaa

SEQ ID NO: 4469316 - DNA, 17 bp, Homo sapiens
tccaccacccaaaagtc

SEQ ID NO: 4469317 - DNA, 17 bp, Homo sapiens
tccaccaggccgtgcct

SEQ ID NO: 4469318 - DNA, 20 bp, Homo sapiens
tccaccaggccgtgccttgt

SEQ ID NO: 4469319 - DNA, 13 bp, Homo sapiens
tccacccagccca

SEQ ID NO: 4469320 - DNA, 12 bp, Homo sapiens
tccaccctctga

SEQ ID NO: 4469321 - DNA, 13 bp, Homo sapiens
tccaccctgccaa

SEQ ID NO: 4469322 - DNA, 14 bp, Homo sapiens
tccaccctgccaag

SEQ ID NO: 4469323 - DNA, 20 bp, Homo sapiens
tccaccctgccaagactcct

SEQ ID NO: 4469324 - DNA, 23 bp, Homo sapiens
tccaccctgccaagactcctcag

SEQ ID NO: 4469325 - DNA, 16 bp, Homo sapiens
tccacccttggcctgt

SEQ ID NO: 4469326 - DNA, 20 bp, Homo sapiens
tccacccttggcctgtctca

SEQ ID NO: 4469327 - DNA, 14 bp, Homo sapiens
tccaccgctgccta

SEQ ID NO: 4469328 - DNA, 19 bp, Homo sapiens
tccaccgctgcctaagtgg

SEQ ID NO: 4469329 - DNA, 14 bp, Homo sapiens
tccacctacatgag

SEQ ID NO: 4469330 - DNA, 18 bp, Homo sapiens
tccacctcaagaccccca

SEQ ID NO: 4469331 - DNA, 11 bp, Homo sapiens
tccacctcagc

SEQ ID NO: 4469332 - DNA, 12 bp, Homo sapiens
tccacctcagcc

SEQ ID NO: 4469333 - DNA, 14 bp, Homo sapiens
tccacctcagcctt

SEQ ID NO: 4469334 - DNA, 16 bp, Homo sapiens
tccacctcagccttgg

SEQ ID NO: 4469335 - DNA, 17 bp, Homo sapiens
tccacctcagccttgga

SEQ ID NO: 4469336 - DNA, 17 bp, Homo sapiens
tccaccttaaattaaac

SEQ ID NO: 4469337 - DNA, 14 bp, Homo sapiens
tccacctttcccaa

SEQ ID NO: 4469338 - DNA, 14 bp, Homo sapiens
tccacgactgtctc

SEQ ID NO: 4469339 - DNA, 17 bp, Homo sapiens
tccacgactgtctccat

SEQ ID NO: 4469340 - DNA, 19 bp, Homo sapiens
tccacgactgtctccatgg

SEQ ID NO: 4469341 - DNA, 14 bp, Homo sapiens
tccacgcccaccag

SEQ ID NO: 4469342 - DNA, 19 bp, Homo sapiens
tccacgcccaccagccttg

SEQ ID NO: 4469343 - DNA, 14 bp, Homo sapiens
tccacgcctcctgg

SEQ ID NO: 4469344 - DNA, 15 bp, Homo sapiens
tccacgcctcctggc

SEQ ID NO: 4469345 - DNA, 18 bp, Homo sapiens
tccacgcctcctggccag

SEQ ID NO: 4469346 - DNA, 15 bp, Homo sapiens
tccacgctgggccta

SEQ ID NO: 4469347 - DNA, 19 bp, Homo sapiens
tccacgttctgctcatcat

SEQ ID NO: 4469348 - DNA, 20 bp, Homo sapiens
tccacgttctgctcatcatt

SEQ ID NO: 4469349 - DNA, 14 bp, Homo sapiens
tccactaaaaatat

SEQ ID NO: 4469350 - DNA, 16 bp, Homo sapiens
tccactccttccagaa

SEQ ID NO: 4469351 - DNA, 23 bp, Homo sapiens
tccactccttccatctcttcctt

SEQ ID NO: 4469352 - DNA, 17 bp, Homo sapiens
tccactcgacccagaat

SEQ ID NO: 4469353 - DNA, 18 bp, Homo sapiens
tccactcgacccagaatg

SEQ ID NO: 4469354 - DNA, 17 bp, Homo sapiens
tccactctaccctccca

SEQ ID NO: 4469355 - DNA, 13 bp, Homo sapiens
tccactctccccc

SEQ ID NO: 4469356 - DNA, 18 bp, Homo sapiens
tccactgagcaagcaagg

SEQ ID NO: 4469357 - DNA, 12 bp, Homo sapiens
tccactgtgcta

SEQ ID NO: 4469358 - DNA, 17 bp, Homo sapiens
tccactgtggcactggc

SEQ ID NO: 4469359 - DNA, 15 bp, Homo sapiens
tccagaagagcccat

SEQ ID NO: 4469360 - DNA, 18 bp, Homo sapiens
tccagaatgctgtacatc

SEQ ID NO: 4469361 - DNA, 21 bp, Homo sapiens
tccagaatgctgtacatctat

SEQ ID NO: 4469362 - DNA, 16 bp, Homo sapiens
tccagacagcctgtat

SEQ ID NO: 4469363 - DNA, 22 bp, Homo sapiens
tccagacagtcgctcagtctgt

SEQ ID NO: 4469364 - DNA, 13 bp, Homo sapiens
tccagacccaagt

SEQ ID NO: 4469365 - DNA, 14 bp, Homo sapiens
tccagaccccccag

SEQ ID NO: 4469366 - DNA, 15 bp, Homo sapiens
tccagaccccccagc

SEQ ID NO: 4469367 - DNA, 20 bp, Homo sapiens
tccagaccccccagcccctc

SEQ ID NO: 4469368 - DNA, 22 bp, Homo sapiens
tccagaccccccagcccctcct

SEQ ID NO: 4469369 - DNA, 15 bp, Homo sapiens
tccagaccccctgag

SEQ ID NO: 4469370 - DNA, 19 bp, Homo sapiens
tccagacctggctccactc

SEQ ID NO: 4469371 - DNA, 19 bp, Homo sapiens
tccagactcaggttccaga

SEQ ID NO: 4469372 - DNA, 12 bp, Homo sapiens
tccagacttcaa

SEQ ID NO: 4469373 - DNA, 12 bp, Homo sapiens
tccagactttct

SEQ ID NO: 4469374 - DNA, 15 bp, Homo sapiens
tccagagacaacagg

SEQ ID NO: 4469375 - DNA, 13 bp, Homo sapiens
tccagagacactg

SEQ ID NO: 4469376 - DNA, 20 bp, Homo sapiens
tccagagacactgagccagt

SEQ ID NO: 4469377 - DNA, 14 bp, Homo sapiens
tccagagaccacac

SEQ ID NO: 4469378 - DNA, 18 bp, Homo sapiens
tccagagaccacaccact

SEQ ID NO: 4469379 - DNA, 21 bp, Homo sapiens
tccagagattcattttctaga

SEQ ID NO: 4469380 - DNA, 23 bp, Homo sapiens
tccagagattcattttctagata

SEQ ID NO: 4469381 - DNA, 22 bp, Homo sapiens
tccagagcccaaggtcagggag

SEQ ID NO: 4469382 - DNA, 15 bp, Homo sapiens
tccagagctcatttc

SEQ ID NO: 4469383 - DNA, 20 bp, Homo sapiens
tccagagggacagtcagttt

SEQ ID NO: 4469384 - DNA, 17 bp, Homo sapiens
tccagagggcactctgc

SEQ ID NO: 4469385 - DNA, 21 bp, Homo sapiens
tccagataattggtggatcaa

SEQ ID NO: 4469386 - DNA, 20 bp, Homo sapiens
tccagatcctctctggggct

SEQ ID NO: 4469387 - DNA, 13 bp, Homo sapiens
tccagatgtgtgc

SEQ ID NO: 4469388 - DNA, 22 bp, Homo sapiens
tccagattcagggagaatgttg

SEQ ID NO: 4469389 - DNA, 18 bp, Homo sapiens
tccagcaaatcaagctga

SEQ ID NO: 4469390 - DNA, 13 bp, Homo sapiens
tccagcaccttct

SEQ ID NO: 4469391 - DNA, 18 bp, Homo sapiens
tccagcaccttctttctg

SEQ ID NO: 4469392 - DNA, 20 bp, Homo sapiens
tccagcaccttctttctgga

SEQ ID NO: 4469393 - DNA, 21 bp, Homo sapiens
tccagcagcagcacttagacc

SEQ ID NO: 4469394 - DNA, 14 bp, Homo sapiens
tccagccaaagcat

SEQ ID NO: 4469395 - DNA, 13 bp, Homo sapiens
tccagccagcgcc

SEQ ID NO: 4469396 - DNA, 19 bp, Homo sapiens
tccagccagcgcctccctc

SEQ ID NO: 4469397 - DNA, 20 bp, Homo sapiens
tccagccagcgcctccctcc

SEQ ID NO: 4469398 - DNA, 20 bp, Homo sapiens
tccagccagggcaagagagc

SEQ ID NO: 4469399 - DNA, 17 bp, Homo sapiens
tccagccagggtgacag

SEQ ID NO: 4469400 - DNA, 19 bp, Homo sapiens
tccagcccctcctccctca

SEQ ID NO: 4469401 - DNA, 21 bp, Homo sapiens
tccagcccctcctccctcaga

SEQ ID NO: 4469402 - DNA, 22 bp, Homo sapiens
tccagcccctcctccctcagac

SEQ ID NO: 4469403 - DNA, 23 bp, Homo sapiens
tccagcccctcctccctcagacc

SEQ ID NO: 4469404 - DNA, 22 bp, Homo sapiens
tccagcctcagagatctccctt

SEQ ID NO: 4469405 - DNA, 12 bp, Homo sapiens
tccagcctcccc

SEQ ID NO: 4469406 - DNA, 14 bp, Homo sapiens
tccagcctctgccg

SEQ ID NO: 4469407 - DNA, 16 bp, Homo sapiens
tccagcctctgttccc

SEQ ID NO: 4469408 - DNA, 21 bp, Homo sapiens
tccagcctctgttcccctagt

SEQ ID NO: 4469409 - DNA, 24 bp, Homo sapiens
tccagcctgagtgacagagcgaga

SEQ ID NO: 4469410 - DNA, 21 bp, Homo sapiens
tccagcctgggcaacaagagc

SEQ ID NO: 4469411 - DNA, 22 bp, Homo sapiens
tccagcctgggcagccaggctg

SEQ ID NO: 4469412 - DNA, 17 bp, Homo sapiens
tccagcctgggtcacag

SEQ ID NO: 4469413 - DNA, 22 bp, Homo sapiens
tccagcctgggtcacagagtga

SEQ ID NO: 4469414 - DNA, 20 bp, Homo sapiens
tccagccttatgtgttacat

SEQ ID NO: 4469415 - DNA, 21 bp, Homo sapiens
tccagccttctctcaaggaga

SEQ ID NO: 4469416 - DNA, 15 bp, Homo sapiens
tccagcgatggtgct

SEQ ID NO: 4469417 - DNA, 19 bp, Homo sapiens
tccagcgatggtgctgccc

SEQ ID NO: 4469418 - DNA, 21 bp, Homo sapiens
tccagcgatggtgctgcccag

SEQ ID NO: 4469419 - DNA, 21 bp, Homo sapiens
tccagctcaccccccacactc

SEQ ID NO: 4469420 - DNA, 14 bp, Homo sapiens
tccagctcgtgtgt

SEQ ID NO: 4469421 - DNA, 16 bp, Homo sapiens
tccagctctgcccccg

SEQ ID NO: 4469422 - DNA, 15 bp, Homo sapiens
tccagctctggcaca

SEQ ID NO: 4469423 - DNA, 22 bp, Homo sapiens
tccagctgccccggcccctccc

SEQ ID NO: 4469424 - DNA, 18 bp, Homo sapiens
tccagctgctgagatcct

SEQ ID NO: 4469425 - DNA, 18 bp, Homo sapiens
tccagctgggaagccctt

SEQ ID NO: 4469426 - DNA, 19 bp, Homo sapiens
tccagctgggaagcccttt

SEQ ID NO: 4469427 - DNA, 19 bp, Homo sapiens
tccagctggggccagaggc

SEQ ID NO: 4469428 - DNA, 16 bp, Homo sapiens
tccagcttgctcttca

SEQ ID NO: 4469429 - DNA, 15 bp, Homo sapiens
tccaggaaagagcag

SEQ ID NO: 4469430 - DNA, 16 bp, Homo sapiens
tccaggaatggtgctt

SEQ ID NO: 4469431 - DNA, 22 bp, Homo sapiens
tccaggagattggatttgctgt

SEQ ID NO: 4469432 - DNA, 13 bp, Homo sapiens
tccaggagcctca

SEQ ID NO: 4469433 - DNA, 16 bp, Homo sapiens
tccaggagcctcatcc

SEQ ID NO: 4469434 - DNA, 22 bp, Homo sapiens
tccaggagcctcatccagcctc

SEQ ID NO: 4469435 - DNA, 24 bp, Homo sapiens
tccaggagcctcatccagcctcag

SEQ ID NO: 4469436 - DNA, 16 bp, Homo sapiens
tccaggattttaattt

SEQ ID NO: 4469437 - DNA, 21 bp, Homo sapiens
tccaggattttaatttcagga

SEQ ID NO: 4469438 - DNA, 23 bp, Homo sapiens
tccaggattttaatttcaggaaa

SEQ ID NO: 4469439 - DNA, 21 bp, Homo sapiens
tccaggcaatcgttctgctgg

SEQ ID NO: 4469440 - DNA, 23 bp, Homo sapiens
tccaggcaatcgttctgctggcc

SEQ ID NO: 4469441 - DNA, 13 bp, Homo sapiens
tccaggcaccagg

SEQ ID NO: 4469442 - DNA, 22 bp, Homo sapiens
tccaggcaccctcagggagcct

SEQ ID NO: 4469443 - DNA, 16 bp, Homo sapiens
tccaggcactgagata

SEQ ID NO: 4469444 - DNA, 18 bp, Homo sapiens
tccaggcccaaggctccc

SEQ ID NO: 4469445 - DNA, 23 bp, Homo sapiens
tccaggcccccaacccctcctcc

SEQ ID NO: 4469446 - DNA, 14 bp, Homo sapiens
tccaggcccccagc

SEQ ID NO: 4469447 - DNA, 16 bp, Homo sapiens
tccaggccctccagtg

SEQ ID NO: 4469448 - DNA, 20 bp, Homo sapiens
tccaggcctctctctgctcc

SEQ ID NO: 4469449 - DNA, 15 bp, Homo sapiens
tccaggctgagagcc

SEQ ID NO: 4469450 - DNA, 13 bp, Homo sapiens
tccaggctggttc

SEQ ID NO: 4469451 - DNA, 19 bp, Homo sapiens
tccaggctgttctcagcgt

SEQ ID NO: 4469452 - DNA, 20 bp, Homo sapiens
tccaggctttgtacagagtg

SEQ ID NO: 4469453 - DNA, 18 bp, Homo sapiens
tccagggaaacagcctct

SEQ ID NO: 4469454 - DNA, 22 bp, Homo sapiens
tccagggaaacagcctctctct

SEQ ID NO: 4469455 - DNA, 23 bp, Homo sapiens
tccagggaattcttacagccaag

SEQ ID NO: 4469456 - DNA, 15 bp, Homo sapiens
tccagggaggggtcc

SEQ ID NO: 4469457 - DNA, 20 bp, Homo sapiens
tccagggaggggtccctgca

SEQ ID NO: 4469458 - DNA, 18 bp, Homo sapiens
tccagggatgattcaagc

SEQ ID NO: 4469459 - DNA, 23 bp, Homo sapiens
tccagggatgattcaagccattc

SEQ ID NO: 4469460 - DNA, 13 bp, Homo sapiens
tccagggccccca

SEQ ID NO: 4469461 - DNA, 15 bp, Homo sapiens
tccagggcccccacc

SEQ ID NO: 4469462 - DNA, 21 bp, Homo sapiens
tccagggcctctccttggaag

SEQ ID NO: 4469463 - DNA, 18 bp, Homo sapiens
tccagggctcttccagat

SEQ ID NO: 4469464 - DNA, 14 bp, Homo sapiens
tccagggctggact

SEQ ID NO: 4469465 - DNA, 12 bp, Homo sapiens
tccaggggcacc

SEQ ID NO: 4469466 - DNA, 20 bp, Homo sapiens
tccaggggccaattttggat

SEQ ID NO: 4469467 - DNA, 18 bp, Homo sapiens
tccaggggcccctccagc

SEQ ID NO: 4469468 - DNA, 19 bp, Homo sapiens
tccaggggcccctccagct

SEQ ID NO: 4469469 - DNA, 14 bp, Homo sapiens
tccaggggtttaca

SEQ ID NO: 4469470 - DNA, 16 bp, Homo sapiens
tccagggtcctctctt

SEQ ID NO: 4469471 - DNA, 18 bp, Homo sapiens
tccagggtcctctcttcc

SEQ ID NO: 4469472 - DNA, 21 bp, Homo sapiens
tccagggtcctctcttccaca

SEQ ID NO: 4469473 - DNA, 16 bp, Homo sapiens
tccagggtttctctgc

SEQ ID NO: 4469474 - DNA, 18 bp, Homo sapiens
tccaggtcccagcccctc

SEQ ID NO: 4469475 - DNA, 13 bp, Homo sapiens
tccaggtctgcct

SEQ ID NO: 4469476 - DNA, 19 bp, Homo sapiens
tccagtaatctaatatggc

SEQ ID NO: 4469477 - DNA, 20 bp, Homo sapiens
tccagtacgtcccgctgctg

SEQ ID NO: 4469478 - DNA, 21 bp, Homo sapiens
tccagtacgtcccgctgctgt

SEQ ID NO: 4469479 - DNA, 15 bp, Homo sapiens
tccagtcatggtact

SEQ ID NO: 4469480 - DNA, 19 bp, Homo sapiens
tccagtcatggtactaccc

SEQ ID NO: 4469481 - DNA, 14 bp, Homo sapiens
tccagtcattatgt

SEQ ID NO: 4469482 - DNA, 21 bp, Homo sapiens
tccagtcattatgttaatatt

SEQ ID NO: 4469483 - DNA, 15 bp, Homo sapiens
tccagtcttcctgac

SEQ ID NO: 4469484 - DNA, 22 bp, Homo sapiens
tccagtcttcctgacactttaa

SEQ ID NO: 4469485 - DNA, 23 bp, Homo sapiens
tccagtcttcctgacactttaat

SEQ ID NO: 4469486 - DNA, 14 bp, Homo sapiens
tccagtgacttgca

SEQ ID NO: 4469487 - DNA, 23 bp, Homo sapiens
tccagtgacttgcaatccaggct

SEQ ID NO: 4469488 - DNA, 14 bp, Homo sapiens
tccagtgagacagc

SEQ ID NO: 4469489 - DNA, 14 bp, Homo sapiens
tccagtgctctgcc

SEQ ID NO: 4469490 - DNA, 17 bp, Homo sapiens
tccagtgctctgcctca

SEQ ID NO: 4469491 - DNA, 13 bp, Homo sapiens
tccagtgctggat

SEQ ID NO: 4469492 - DNA, 23 bp, Homo sapiens
tccagtggctcgctccctgtagc

SEQ ID NO: 4469493 - DNA, 22 bp, Homo sapiens
tccagtgggctgatgctgggac

SEQ ID NO: 4469494 - DNA, 15 bp, Homo sapiens
tccagttctccgtaa

SEQ ID NO: 4469495 - DNA, 17 bp, Homo sapiens
tccagtttctttcccca

SEQ ID NO: 4469496 - DNA, 14 bp, Homo sapiens
tccatacacagagg

SEQ ID NO: 4469497 - DNA, 18 bp, Homo sapiens
tccatagagatgagccca

SEQ ID NO: 4469498 - DNA, 20 bp, Homo sapiens
tccatagagatgagcccacc

SEQ ID NO: 4469499 - DNA, 18 bp, Homo sapiens
tccataggaaggctgtga

SEQ ID NO: 4469500 - DNA, 13 bp, Homo sapiens
tccatatcacaca

SEQ ID NO: 4469501 - DNA, 14 bp, Homo sapiens
tccatatgctccag

SEQ ID NO: 4469502 - DNA, 16 bp, Homo sapiens
tccatatgctccagga

SEQ ID NO: 4469503 - DNA, 16 bp, Homo sapiens
tccatcatcactgtaa

SEQ ID NO: 4469504 - DNA, 18 bp, Homo sapiens
tccatcccctccctgcct

SEQ ID NO: 4469505 - DNA, 21 bp, Homo sapiens
tccatccccttcccccatccc

SEQ ID NO: 4469506 - DNA, 23 bp, Homo sapiens
tccatccccttcccccatcccta

SEQ ID NO: 4469507 - DNA, 22 bp, Homo sapiens
tccatccctaccccctaagagc

SEQ ID NO: 4469508 - DNA, 15 bp, Homo sapiens
tccatccgactgccc

SEQ ID NO: 4469509 - DNA, 22 bp, Homo sapiens
tccatctccgcctccacactga

SEQ ID NO: 4469510 - DNA, 15 bp, Homo sapiens
tccatctcttccttc

SEQ ID NO: 4469511 - DNA, 17 bp, Homo sapiens
tccatctcttccttcag

SEQ ID NO: 4469512 - DNA, 24 bp, Homo sapiens
tccatctgggcttatatgtacttt

SEQ ID NO: 4469513 - DNA, 14 bp, Homo sapiens
tccatcttgctttt

SEQ ID NO: 4469514 - DNA, 18 bp, Homo sapiens
tccatcttggtagttctg

SEQ ID NO: 4469515 - DNA, 23 bp, Homo sapiens
tccatcttggtagttctgtgcct

SEQ ID NO: 4469516 - DNA, 13 bp, Homo sapiens
tccatctttacaa

SEQ ID NO: 4469517 - DNA, 21 bp, Homo sapiens
tccatgaagatgtagaggaga

SEQ ID NO: 4469518 - DNA, 22 bp, Homo sapiens
tccatgaagatgtagaggagaa

SEQ ID NO: 4469519 - DNA, 15 bp, Homo sapiens
tccatgacatcaaga

SEQ ID NO: 4469520 - DNA, 16 bp, Homo sapiens
tccatgaccagaaaca

SEQ ID NO: 4469521 - DNA, 20 bp, Homo sapiens
tccatgacctagttttccat

SEQ ID NO: 4469522 - DNA, 12 bp, Homo sapiens
tccatgattcta

SEQ ID NO: 4469523 - DNA, 14 bp, Homo sapiens
tccatgcaactgga

SEQ ID NO: 4469524 - DNA, 19 bp, Homo sapiens
tccatgcgtgtttctgact

SEQ ID NO: 4469525 - DNA, 15 bp, Homo sapiens
tccatgctgggtctg

SEQ ID NO: 4469526 - DNA, 20 bp, Homo sapiens
tccatgctgggtctgaggcc

SEQ ID NO: 4469527 - DNA, 17 bp, Homo sapiens
tccatggccctgtccca

SEQ ID NO: 4469528 - DNA, 18 bp, Homo sapiens
tccatggccctgtcccag

SEQ ID NO: 4469529 - DNA, 19 bp, Homo sapiens
tccatgtgaccgaacactg

SEQ ID NO: 4469530 - DNA, 14 bp, Homo sapiens
tccatgtgcctttc

SEQ ID NO: 4469531 - DNA, 16 bp, Homo sapiens
tccatgtgcctttctt

SEQ ID NO: 4469532 - DNA, 19 bp, Homo sapiens
tccatgtgcctttctttgc

SEQ ID NO: 4469533 - DNA, 23 bp, Homo sapiens
tccatgtgtgtgccaagccctgg

SEQ ID NO: 4469534 - DNA, 16 bp, Homo sapiens
tccatgttctattttt

SEQ ID NO: 4469535 - DNA, 19 bp, Homo sapiens
tccatgttctgggtgatgg

SEQ ID NO: 4469536 - DNA, 21 bp, Homo sapiens
tccatgttctgggtgatggaa

SEQ ID NO: 4469537 - DNA, 13 bp, Homo sapiens
tccattaattaat

SEQ ID NO: 4469538 - DNA, 15 bp, Homo sapiens
tccattaatttaaat

SEQ ID NO: 4469539 - DNA, 21 bp, Homo sapiens
tccattaatttaaatgattta

SEQ ID NO: 4469540 - DNA, 18 bp, Homo sapiens
tccattccttcacatagt

SEQ ID NO: 4469541 - DNA, 23 bp, Homo sapiens
tccattctccaggggtttacagt

SEQ ID NO: 4469542 - DNA, 14 bp, Homo sapiens
tccattctcccagg

SEQ ID NO: 4469543 - DNA, 16 bp, Homo sapiens
tccattctcccaggta

SEQ ID NO: 4469544 - DNA, 16 bp, Homo sapiens
tccattctcctcagtg

SEQ ID NO: 4469545 - DNA, 18 bp, Homo sapiens
tccattgcctagctcttt

SEQ ID NO: 4469546 - DNA, 22 bp, Homo sapiens
tccattgtagtggcctgtgctt

SEQ ID NO: 4469547 - DNA, 14 bp, Homo sapiens
tccatttcccctct

SEQ ID NO: 4469548 - DNA, 12 bp, Homo sapiens
tccatttgcaag

SEQ ID NO: 4469549 - DNA, 15 bp, Homo sapiens
tccatttgcaaggga

SEQ ID NO: 4469550 - DNA, 20 bp, Homo sapiens
tccattttacgttttagaaa

SEQ ID NO: 4469551 - DNA, 19 bp, Homo sapiens
tccattttcctacaggcag

SEQ ID NO: 4469552 - DNA, 15 bp, Homo sapiens
tccatttttacaagt

SEQ ID NO: 4469553 - DNA, 19 bp, Homo sapiens
tcccaaaacaatctattta

SEQ ID NO: 4469554 - DNA, 22 bp, Homo sapiens
tcccaaacgccctttcctcctc

SEQ ID NO: 4469555 - DNA, 13 bp, Homo sapiens
tcccaaagtgctg

SEQ ID NO: 4469556 - DNA, 16 bp, Homo sapiens
tcccaaagtgctggga

SEQ ID NO: 4469557 - DNA, 13 bp, Homo sapiens
tcccaaagtgttg

SEQ ID NO: 4469558 - DNA, 17 bp, Homo sapiens
tcccaaatcctatttaa

SEQ ID NO: 4469559 - DNA, 18 bp, Homo sapiens
tcccaaatcctatttaaa

SEQ ID NO: 4469560 - DNA, 20 bp, Homo sapiens
tcccaaatcctatttaaaga

SEQ ID NO: 4469561 - DNA, 20 bp, Homo sapiens
tcccaaatttgattgatttg

SEQ ID NO: 4469562 - DNA, 16 bp, Homo sapiens
tcccaacactgccagc

SEQ ID NO: 4469563 - DNA, 20 bp, Homo sapiens
tcccaacctctttttcctcc

SEQ ID NO: 4469564 - DNA, 21 bp, Homo sapiens
tcccaacgtactcctcagacg

SEQ ID NO: 4469565 - DNA, 15 bp, Homo sapiens
tcccaacttcttcct

SEQ ID NO: 4469566 - DNA, 17 bp, Homo sapiens
tcccaacttcttcctgt

SEQ ID NO: 4469567 - DNA, 13 bp, Homo sapiens
tcccaagagctac

SEQ ID NO: 4469568 - DNA, 12 bp, Homo sapiens
tcccaagcaaag

SEQ ID NO: 4469569 - DNA, 13 bp, Homo sapiens
tcccaagctgggc

SEQ ID NO: 4469570 - DNA, 18 bp, Homo sapiens
tcccaagctgggccccag

SEQ ID NO: 4469571 - DNA, 16 bp, Homo sapiens
tcccaaggagaacaaa

SEQ ID NO: 4469572 - DNA, 17 bp, Homo sapiens
tcccaaggagaacaaat

SEQ ID NO: 4469573 - DNA, 19 bp, Homo sapiens
tcccaaggagaacaaatat

SEQ ID NO: 4469574 - DNA, 19 bp, Homo sapiens
tcccaaggcaagcatgaat

SEQ ID NO: 4469575 - DNA, 20 bp, Homo sapiens
tcccaaggcaagcatgaata

SEQ ID NO: 4469576 - DNA, 16 bp, Homo sapiens
tcccaagtggtgccta

SEQ ID NO: 4469577 - DNA, 18 bp, Homo sapiens
tcccaagtggtgcctaaa

SEQ ID NO: 4469578 - DNA, 14 bp, Homo sapiens
tcccaatacaaaga

SEQ ID NO: 4469579 - DNA, 23 bp, Homo sapiens
tcccaatagcactttcattgcca

SEQ ID NO: 4469580 - DNA, 13 bp, Homo sapiens
tcccaatcagctt

SEQ ID NO: 4469581 - DNA, 14 bp, Homo sapiens
tcccaatcagcttt

SEQ ID NO: 4469582 - DNA, 23 bp, Homo sapiens
tcccaatcagcttttgttctaga

SEQ ID NO: 4469583 - DNA, 13 bp, Homo sapiens
tcccaattttctg

SEQ ID NO: 4469584 - DNA, 21 bp, Homo sapiens
tcccacaccgcgtcccagctc

SEQ ID NO: 4469585 - DNA, 18 bp, Homo sapiens
tcccacagcagccccagg

SEQ ID NO: 4469586 - DNA, 20 bp, Homo sapiens
tcccacagcagccccaggag

SEQ ID NO: 4469587 - DNA, 17 bp, Homo sapiens
tcccacaggagggccag

SEQ ID NO: 4469588 - DNA, 19 bp, Homo sapiens
tcccacatgaggccatctc

SEQ ID NO: 4469589 - DNA, 15 bp, Homo sapiens
tcccaccaccctgag

SEQ ID NO: 4469590 - DNA, 19 bp, Homo sapiens
tcccaccagaacgcacccc

SEQ ID NO: 4469591 - DNA, 22 bp, Homo sapiens
tcccaccagaacgcaccccact

SEQ ID NO: 4469592 - DNA, 23 bp, Homo sapiens
tcccacccacccgccgcctccca

SEQ ID NO: 4469593 - DNA, 13 bp, Homo sapiens
tcccaccccaccc

SEQ ID NO: 4469594 - DNA, 16 bp, Homo sapiens
tcccaccccaccccct

SEQ ID NO: 4469595 - DNA, 20 bp, Homo sapiens
tcccaccccacccccttcag

SEQ ID NO: 4469596 - DNA, 14 bp, Homo sapiens
tcccacccccagcc

SEQ ID NO: 4469597 - DNA, 15 bp, Homo sapiens
tcccacccccagccc

SEQ ID NO: 4469598 - DNA, 23 bp, Homo sapiens
tcccacccccagccccgactcca

SEQ ID NO: 4469599 - DNA, 20 bp, Homo sapiens
tcccaccccctcctccccca

SEQ ID NO: 4469600 - DNA, 22 bp, Homo sapiens
tcccaccccctcctcccccagt

SEQ ID NO: 4469601 - DNA, 19 bp, Homo sapiens
tcccacccggccacagctg

SEQ ID NO: 4469602 - DNA, 20 bp, Homo sapiens
tcccacccggccacagctgc

SEQ ID NO: 4469603 - DNA, 21 bp, Homo sapiens
tcccacccggccacagctgct

SEQ ID NO: 4469604 - DNA, 23 bp, Homo sapiens
tcccacccggccacagctgctgg

SEQ ID NO: 4469605 - DNA, 15 bp, Homo sapiens
tcccaccctccctag

SEQ ID NO: 4469606 - DNA, 18 bp, Homo sapiens
tcccacctctctccccaa

SEQ ID NO: 4469607 - DNA, 20 bp, Homo sapiens
tcccacctggctctgtggcg

SEQ ID NO: 4469608 - DNA, 14 bp, Homo sapiens
tcccaccttcccac

SEQ ID NO: 4469609 - DNA, 15 bp, Homo sapiens
tcccaccttcccacc

SEQ ID NO: 4469610 - DNA, 22 bp, Homo sapiens
tcccacgactgttgtacaagct

SEQ ID NO: 4469611 - DNA, 23 bp, Homo sapiens
tcccacgactgttgtacaagctc

SEQ ID NO: 4469612 - DNA, 20 bp, Homo sapiens
tcccacgccaggccagcagg

SEQ ID NO: 4469613 - DNA, 18 bp, Homo sapiens
tcccacgtctaactggaa

SEQ ID NO: 4469614 - DNA, 22 bp, Homo sapiens
tcccacgttctgttaatttagt

SEQ ID NO: 4469615 - DNA, 15 bp, Homo sapiens
tcccactcaccccgg

SEQ ID NO: 4469616 - DNA, 15 bp, Homo sapiens
tcccactgcactcca

SEQ ID NO: 4469617 - DNA, 17 bp, Homo sapiens
tcccactgcactccagc

SEQ ID NO: 4469618 - DNA, 13 bp, Homo sapiens
tcccactgttctg

SEQ ID NO: 4469619 - DNA, 17 bp, Homo sapiens
tcccagacaggccctcc

SEQ ID NO: 4469620 - DNA, 22 bp, Homo sapiens
tcccagacaggccctccctgtc

SEQ ID NO: 4469621 - DNA, 13 bp, Homo sapiens
tcccagaccagcc

SEQ ID NO: 4469622 - DNA, 20 bp, Homo sapiens
tcccagaggagccaccagtt

SEQ ID NO: 4469623 - DNA, 21 bp, Homo sapiens
tcccagagtcagaggagaaga

SEQ ID NO: 4469624 - DNA, 23 bp, Homo sapiens
tcccagattggctcacactgaga

SEQ ID NO: 4469625 - DNA, 20 bp, Homo sapiens
tcccagcacctattgaatta

SEQ ID NO: 4469626 - DNA, 22 bp, Homo sapiens
tcccagcactttgagaggctga

SEQ ID NO: 4469627 - DNA, 16 bp, Homo sapiens
tcccagcactttggga

SEQ ID NO: 4469628 - DNA, 19 bp, Homo sapiens
tcccagcactttgggaggc

SEQ ID NO: 4469629 - DNA, 18 bp, Homo sapiens
tcccagcatccctggagc

SEQ ID NO: 4469630 - DNA, 21 bp, Homo sapiens
tcccagcatccctggagcagg

SEQ ID NO: 4469631 - DNA, 14 bp, Homo sapiens
tcccagccaggccc

SEQ ID NO: 4469632 - DNA, 16 bp, Homo sapiens
tcccagcccctcctcc

SEQ ID NO: 4469633 - DNA, 21 bp, Homo sapiens
tcccagcccctcctccctcag

SEQ ID NO: 4469634 - DNA, 23 bp, Homo sapiens
tcccagcccctcctccctcagac

SEQ ID NO: 4469635 - DNA, 23 bp, Homo sapiens
tcccagcccctcctccctcaggc

SEQ ID NO: 4469636 - DNA, 14 bp, Homo sapiens
tcccagctactcag

SEQ ID NO: 4469637 - DNA, 16 bp, Homo sapiens
tcccagctactcagga

SEQ ID NO: 4469638 - DNA, 22 bp, Homo sapiens
tcccagctactcaggaggctga

SEQ ID NO: 4469639 - DNA, 23 bp, Homo sapiens
tcccagctactcaggaggctgag

SEQ ID NO: 4469640 - DNA, 16 bp, Homo sapiens
tcccagctacttggga

SEQ ID NO: 4469641 - DNA, 23 bp, Homo sapiens
tcccagctaggaagagcaggact

SEQ ID NO: 4469642 - DNA, 15 bp, Homo sapiens
tcccagctcctttct

SEQ ID NO: 4469643 - DNA, 20 bp, Homo sapiens
tcccagctcctttctcctgt

SEQ ID NO: 4469644 - DNA, 22 bp, Homo sapiens
tcccagctcctttctcctgtga

SEQ ID NO: 4469645 - DNA, 23 bp, Homo sapiens
tcccagctcctttctcctgtgaa

SEQ ID NO: 4469646 - DNA, 13 bp, Homo sapiens
tcccagctgtgct

SEQ ID NO: 4469647 - DNA, 21 bp, Homo sapiens
tcccaggagatgggtccaggg

SEQ ID NO: 4469648 - DNA, 16 bp, Homo sapiens
tcccaggccccagggg

SEQ ID NO: 4469649 - DNA, 17 bp, Homo sapiens
tcccaggccccagggga

SEQ ID NO: 4469650 - DNA, 21 bp, Homo sapiens
tcccaggccccaggggagaaa

SEQ ID NO: 4469651 - DNA, 17 bp, Homo sapiens
tcccaggcctgcctgca

SEQ ID NO: 4469652 - DNA, 17 bp, Homo sapiens
tcccagggaccttggaa

SEQ ID NO: 4469653 - DNA, 16 bp, Homo sapiens
tcccagggcacccagg

SEQ ID NO: 4469654 - DNA, 17 bp, Homo sapiens
tcccagggcacccaggc

SEQ ID NO: 4469655 - DNA, 17 bp, Homo sapiens
tcccaggtaatttaaat

SEQ ID NO: 4469656 - DNA, 18 bp, Homo sapiens
tcccaggtaatttaaatt

SEQ ID NO: 4469657 - DNA, 18 bp, Homo sapiens
tcccaggtaccagctgcg

SEQ ID NO: 4469658 - DNA, 21 bp, Homo sapiens
tcccaggtaccagctgcgctt

SEQ ID NO: 4469659 - DNA, 15 bp, Homo sapiens
tcccagtatgtttta

SEQ ID NO: 4469660 - DNA, 14 bp, Homo sapiens
tcccagtcctgcct

SEQ ID NO: 4469661 - DNA, 16 bp, Homo sapiens
tcccagtcctgcctga

SEQ ID NO: 4469662 - DNA, 21 bp, Homo sapiens
tcccataattgctttgccaaa

SEQ ID NO: 4469663 - DNA, 13 bp, Homo sapiens
tcccatagctggg

SEQ ID NO: 4469664 - DNA, 15 bp, Homo sapiens
tcccatctcttcctt

SEQ ID NO: 4469665 - DNA, 16 bp, Homo sapiens
tcccatctcttccttg

SEQ ID NO: 4469666 - DNA, 19 bp, Homo sapiens
tcccatctgcaccccttct

SEQ ID NO: 4469667 - DNA, 14 bp, Homo sapiens
tcccatctggctca

SEQ ID NO: 4469668 - DNA, 15 bp, Homo sapiens
tcccatctggtcatt

SEQ ID NO: 4469669 - DNA, 12 bp, Homo sapiens
tcccatgaagcc

SEQ ID NO: 4469670 - DNA, 13 bp, Homo sapiens
tcccatgaagcct

SEQ ID NO: 4469671 - DNA, 16 bp, Homo sapiens
tcccatgaagcctttt

SEQ ID NO: 4469672 - DNA, 21 bp, Homo sapiens
tcccatggagccccagccccc

SEQ ID NO: 4469673 - DNA, 14 bp, Homo sapiens
tcccattaaaaatg

SEQ ID NO: 4469674 - DNA, 14 bp, Homo sapiens
tcccattcctccct

SEQ ID NO: 4469675 - DNA, 12 bp, Homo sapiens
tcccattctaga

SEQ ID NO: 4469676 - DNA, 14 bp, Homo sapiens
tcccattctatgtg

SEQ ID NO: 4469677 - DNA, 14 bp, Homo sapiens
tcccattgcccagt

SEQ ID NO: 4469678 - DNA, 15 bp, Homo sapiens
tcccattgccctggt

SEQ ID NO: 4469679 - DNA, 18 bp, Homo sapiens
tcccatttagtgtgaata

SEQ ID NO: 4469680 - DNA, 16 bp, Homo sapiens
tccccaaacaggacag

SEQ ID NO: 4469681 - DNA, 18 bp, Homo sapiens
tccccaaaccataaaacc

SEQ ID NO: 4469682 - DNA, 21 bp, Homo sapiens
tccccaacacctgcctctgac

SEQ ID NO: 4469683 - DNA, 23 bp, Homo sapiens
tccccaacgtcccctccgccgtg

SEQ ID NO: 4469684 - DNA, 13 bp, Homo sapiens
tccccaactccct

SEQ ID NO: 4469685 - DNA, 23 bp, Homo sapiens
tccccaactgctccagcctctgc

SEQ ID NO: 4469686 - DNA, 17 bp, Homo sapiens
tccccaataaagccttt

SEQ ID NO: 4469687 - DNA, 17 bp, Homo sapiens
tccccaatccatgcttc

SEQ ID NO: 4469688 - DNA, 18 bp, Homo sapiens
tccccaatccatgcttca

SEQ ID NO: 4469689 - DNA, 22 bp, Homo sapiens
tccccaattacagggtgactca

SEQ ID NO: 4469690 - DNA, 17 bp, Homo sapiens
tccccacagcgtccctg

SEQ ID NO: 4469691 - DNA, 15 bp, Homo sapiens
tccccacccatgcgc

SEQ ID NO: 4469692 - DNA, 16 bp, Homo sapiens
tccccacccctgcccc

SEQ ID NO: 4469693 - DNA, 17 bp, Homo sapiens
tccccaccctcctcttg

SEQ ID NO: 4469694 - DNA, 18 bp, Homo sapiens
tccccaccctcctcttgg

SEQ ID NO: 4469695 - DNA, 16 bp, Homo sapiens
tccccacgagggctgg

SEQ ID NO: 4469696 - DNA, 18 bp, Homo sapiens
tccccactcctctcccac

SEQ ID NO: 4469697 - DNA, 20 bp, Homo sapiens
tccccactcctctcccacag

SEQ ID NO: 4469698 - DNA, 13 bp, Homo sapiens
tccccacttcact

SEQ ID NO: 4469699 - DNA, 20 bp, Homo sapiens
tccccagacccagaggtcca

SEQ ID NO: 4469700 - DNA, 12 bp, Homo sapiens
tccccagactct

SEQ ID NO: 4469701 - DNA, 15 bp, Homo sapiens
tccccagccagccct

SEQ ID NO: 4469702 - DNA, 17 bp, Homo sapiens
tccccagccccctccca

SEQ ID NO: 4469703 - DNA, 22 bp, Homo sapiens
tccccagcccctcctccctcag

SEQ ID NO: 4469704 - DNA, 23 bp, Homo sapiens
tccccagcccctcctccctcaga

SEQ ID NO: 4469705 - DNA, 13 bp, Homo sapiens
tccccaggctgga

SEQ ID NO: 4469706 - DNA, 17 bp, Homo sapiens
tccccaggggtcccagc

SEQ ID NO: 4469707 - DNA, 22 bp, Homo sapiens
tccccaggggtcccagccaccc

SEQ ID NO: 4469708 - DNA, 17 bp, Homo sapiens
tccccagggtgtctcta

SEQ ID NO: 4469709 - DNA, 22 bp, Homo sapiens
tccccagtgcctgccactctct

SEQ ID NO: 4469710 - DNA, 18 bp, Homo sapiens
tccccagttccacagcag

SEQ ID NO: 4469711 - DNA, 19 bp, Homo sapiens
attaaacaatttattttat

SEQ ID NO: 4469712 - DNA, 11 bp, Homo sapiens
attaaaccttt

SEQ ID NO: 4469713 - DNA, 17 bp, Homo sapiens
attaaacctttccattt

SEQ ID NO: 4469714 - DNA, 15 bp, Homo sapiens
ctgcctctgctccct

SEQ ID NO: 4469715 - DNA, 17 bp, Homo sapiens
ctgcctctgctccctct

SEQ ID NO: 4469716 - DNA, 22 bp, Homo sapiens
ctgcctcttctcttgacagtct

SEQ ID NO: 4469717 - DNA, 16 bp, Homo sapiens
ctgcctcttctgggag

SEQ ID NO: 4469718 - DNA, 18 bp, Homo sapiens
ctgcctgaacagccctct

SEQ ID NO: 4469719 - DNA, 19 bp, Homo sapiens
ctgcctgaacagccctctc

SEQ ID NO: 4469720 - DNA, 14 bp, Homo sapiens
ctgcctgagggcag

SEQ ID NO: 4469721 - DNA, 15 bp, Homo sapiens
ctgcctgcagcaggc

SEQ ID NO: 4469722 - DNA, 17 bp, Homo sapiens
ctgcctgcagcaggcag

SEQ ID NO: 4469723 - DNA, 18 bp, Homo sapiens
ctgcctgcagccagggct

SEQ ID NO: 4469724 - DNA, 15 bp, Homo sapiens
ctgcctgccccgccc

SEQ ID NO: 4469725 - DNA, 19 bp, Homo sapiens
ctgcctgccccgcccccag

SEQ ID NO: 4469726 - DNA, 21 bp, Homo sapiens
ctgcctgccccgcccccagtc

SEQ ID NO: 4469727 - DNA, 18 bp, Homo sapiens
ctgcctgcgcccaccccg

SEQ ID NO: 4469728 - DNA, 14 bp, Homo sapiens
ctgcctgcggccca

SEQ ID NO: 4469729 - DNA, 12 bp, Homo sapiens
ctgcctggactt

SEQ ID NO: 4469730 - DNA, 23 bp, Homo sapiens
ctgcctggcccccaacctcaggg

SEQ ID NO: 4469731 - DNA, 19 bp, Homo sapiens
ctgcctggttttatttata

SEQ ID NO: 4469732 - DNA, 15 bp, Homo sapiens
ctgcctgtaattaaa

SEQ ID NO: 4469733 - DNA, 20 bp, Homo sapiens
ctgcctgtagcaatggccag

SEQ ID NO: 4469734 - DNA, 13 bp, Homo sapiens
ctgcctgtcccca

SEQ ID NO: 4469735 - DNA, 23 bp, Homo sapiens
ctgcctgtccccaaacaggacag

SEQ ID NO: 4469736 - DNA, 14 bp, Homo sapiens
ctgcctgtctgctt

SEQ ID NO: 4469737 - DNA, 16 bp, Homo sapiens
ctgcctgtctgcttgc

SEQ ID NO: 4469738 - DNA, 12 bp, Homo sapiens
ctgcctgtggca

SEQ ID NO: 4469739 - DNA, 15 bp, Homo sapiens
ctgcctgtggcccct

SEQ ID NO: 4469740 - DNA, 13 bp, Homo sapiens
ctgcctgtgggct

SEQ ID NO: 4469741 - DNA, 21 bp, Homo sapiens
ctgcctgttggcaggcccact

SEQ ID NO: 4469742 - DNA, 22 bp, Homo sapiens
ctgccttaaaaccaaagagggc

SEQ ID NO: 4469743 - DNA, 17 bp, Homo sapiens
ctgccttaaacacacat

SEQ ID NO: 4469744 - DNA, 20 bp, Homo sapiens
ctgccttacccgccatacat

SEQ ID NO: 4469745 - DNA, 19 bp, Homo sapiens
ctgccttagagccaggcac

SEQ ID NO: 4469746 - DNA, 14 bp, Homo sapiens
ctgccttagcttca

SEQ ID NO: 4469747 - DNA, 17 bp, Homo sapiens
ctgccttagcttcagga

SEQ ID NO: 4469748 - DNA, 21 bp, Homo sapiens
ctgccttcaaggactgtttca

SEQ ID NO: 4469749 - DNA, 15 bp, Homo sapiens
ctgccttcagggaga

SEQ ID NO: 4469750 - DNA, 18 bp, Homo sapiens
ctgccttcctcctgggcc

SEQ ID NO: 4469751 - DNA, 17 bp, Homo sapiens
ctgccttctaccctctg

SEQ ID NO: 4469752 - DNA, 17 bp, Homo sapiens
ctgccttctttccatca

SEQ ID NO: 4469753 - DNA, 20 bp, Homo sapiens
ctgccttgccctcctgggcc

SEQ ID NO: 4469754 - DNA, 21 bp, Homo sapiens
ctgccttttaagtttgaaact

SEQ ID NO: 4469755 - DNA, 22 bp, Homo sapiens
ctgcgaagaccctcttgcccat

SEQ ID NO: 4469756 - DNA, 22 bp, Homo sapiens
ctgcgaccttgcaacctcacct

SEQ ID NO: 4469757 - DNA, 16 bp, Homo sapiens
ctgcgacgcttgctct

SEQ ID NO: 4469758 - DNA, 23 bp, Homo sapiens
ctgcgaggacatcaaagtggtaa

SEQ ID NO: 4469759 - DNA, 19 bp, Homo sapiens
ctgcgcagcctccagggcc

SEQ ID NO: 4469760 - DNA, 17 bp, Homo sapiens
ctgcgcccaccccgctc

SEQ ID NO: 4469761 - DNA, 20 bp, Homo sapiens
ctgcgcccaccccgctctgc

SEQ ID NO: 4469762 - DNA, 22 bp, Homo sapiens
ctgcgccccgcacgactgcggg

SEQ ID NO: 4469763 - DNA, 14 bp, Homo sapiens
ctgcgcctgcaggc

SEQ ID NO: 4469764 - DNA, 18 bp, Homo sapiens
ctgcgcctgctgcctgct

SEQ ID NO: 4469765 - DNA, 20 bp, Homo sapiens
ctgcgctggacgatagcttg

SEQ ID NO: 4469766 - DNA, 14 bp, Homo sapiens
ctgcgggagccaga

SEQ ID NO: 4469767 - DNA, 13 bp, Homo sapiens
ctgcgggaggctg

SEQ ID NO: 4469768 - DNA, 15 bp, Homo sapiens
ctgcgggaggctggg

SEQ ID NO: 4469769 - DNA, 22 bp, Homo sapiens
ctgcggggctgagacgccggct

SEQ ID NO: 4469770 - DNA, 14 bp, Homo sapiens
ctgcgtccaccctg

SEQ ID NO: 4469771 - DNA, 20 bp, Homo sapiens
ctgcgtcccagcctgcaccc

SEQ ID NO: 4469772 - DNA, 15 bp, Homo sapiens
ctgcgtcctcctcac

SEQ ID NO: 4469773 - DNA, 24 bp, Homo sapiens
ctgcgtcctcctcacctcatgccc

SEQ ID NO: 4469774 - DNA, 21 bp, Homo sapiens
ctgcgttcccagaccatggga

SEQ ID NO: 4469775 - DNA, 12 bp, Homo sapiens
ctgctaaataaa

SEQ ID NO: 4469776 - DNA, 19 bp, Homo sapiens
ctgctaaatctcctatttt

SEQ ID NO: 4469777 - DNA, 19 bp, Homo sapiens
ctgctaaggctcctccttg

SEQ ID NO: 4469778 - DNA, 20 bp, Homo sapiens
ctgctacctctgagaagaca

SEQ ID NO: 4469779 - DNA, 18 bp, Homo sapiens
ctgctagaacctctcgta

SEQ ID NO: 4469780 - DNA, 21 bp, Homo sapiens
ctgctagagcagacaggcctg

SEQ ID NO: 4469781 - DNA, 19 bp, Homo sapiens
ctgctagcacagaggcctg

SEQ ID NO: 4469782 - DNA, 20 bp, Homo sapiens
ctgctagcacagaggcctga

SEQ ID NO: 4469783 - DNA, 18 bp, Homo sapiens
ctgctagtcactggaaat

SEQ ID NO: 4469784 - DNA, 16 bp, Homo sapiens
ctgctatgtgtggtac

SEQ ID NO: 4469785 - DNA, 16 bp, Homo sapiens
ctgctcacccacctct

SEQ ID NO: 4469786 - DNA, 20 bp, Homo sapiens
ctgctcaccgcccatcaggg

SEQ ID NO: 4469787 - DNA, 23 bp, Homo sapiens
ctgctcaccgcccatcagggttc

SEQ ID NO: 4469788 - DNA, 15 bp, Homo sapiens
ctgctcactgggccc

SEQ ID NO: 4469789 - DNA, 18 bp, Homo sapiens
ctgctcatcacccttccg

SEQ ID NO: 4469790 - DNA, 18 bp, Homo sapiens
ctgctcatcattctctgt

SEQ ID NO: 4469791 - DNA, 11 bp, Homo sapiens
ctgctccacca

SEQ ID NO: 4469792 - DNA, 17 bp, Homo sapiens
ctgctccaccagcagca

SEQ ID NO: 4469793 - DNA, 12 bp, Homo sapiens
ctgctccaccct

SEQ ID NO: 4469794 - DNA, 17 bp, Homo sapiens
ctgctccacccttggcc

SEQ ID NO: 4469795 - DNA, 19 bp, Homo sapiens
ctgctccacccttggcctg

SEQ ID NO: 4469796 - DNA, 16 bp, Homo sapiens
ctgctccagcctctgc

SEQ ID NO: 4469797 - DNA, 17 bp, Homo sapiens
ctgctccagcctctgcc

SEQ ID NO: 4469798 - DNA, 20 bp, Homo sapiens
ctgctccataccttttctct

SEQ ID NO: 4469799 - DNA, 21 bp, Homo sapiens
ctgctccataccttttctctt

SEQ ID NO: 4469800 - DNA, 10 bp, Homo sapiens
ctgctcccac

SEQ ID NO: 4469801 - DNA, 20 bp, Homo sapiens
ctgctcccacctggctctgt

SEQ ID NO: 4469802 - DNA, 20 bp, Homo sapiens
ctgctcccagtcctgcctga

SEQ ID NO: 4469803 - DNA, 17 bp, Homo sapiens
ctgctcccattcctccc

SEQ ID NO: 4469804 - DNA, 20 bp, Homo sapiens
ctgctccccaacacctgcct

SEQ ID NO: 4469805 - DNA, 22 bp, Homo sapiens
ctgctcccccaccccctcccca

SEQ ID NO: 4469806 - DNA, 21 bp, Homo sapiens
ctgctcccggcccgcctgccc

SEQ ID NO: 4469807 - DNA, 16 bp, Homo sapiens
ctgctccctgcaagct

SEQ ID NO: 4469808 - DNA, 16 bp, Homo sapiens
ctgctccctgcctcct

SEQ ID NO: 4469809 - DNA, 11 bp, Homo sapiens
ctgctcctcca

SEQ ID NO: 4469810 - DNA, 17 bp, Homo sapiens
ctgctcctccagggcca

SEQ ID NO: 4469811 - DNA, 22 bp, Homo sapiens
ctgctcctccagggccacgtgc

SEQ ID NO: 4469812 - DNA, 24 bp, Homo sapiens
ctgctcctccagggccacgtgcca

SEQ ID NO: 4469813 - DNA, 12 bp, Homo sapiens
ctgctccttggc

SEQ ID NO: 4469814 - DNA, 19 bp, Homo sapiens
ctgctccttggcaccccca

SEQ ID NO: 4469815 - DNA, 16 bp, Homo sapiens
ctgctcgtggactgtg

SEQ ID NO: 4469816 - DNA, 14 bp, Homo sapiens
ctgctctcccaagg

SEQ ID NO: 4469817 - DNA, 19 bp, Homo sapiens
ctgctctccgcgcctaccc

SEQ ID NO: 4469818 - DNA, 15 bp, Homo sapiens
ctgctctccttcact

SEQ ID NO: 4469819 - DNA, 21 bp, Homo sapiens
ctgctctccttcactctgaca

SEQ ID NO: 4469820 - DNA, 17 bp, Homo sapiens
ctgctctccttcctgga

SEQ ID NO: 4469821 - DNA, 19 bp, Homo sapiens
ctgctctccttcctggagc

SEQ ID NO: 4469822 - DNA, 20 bp, Homo sapiens
ctgctctgcaggctggggag

SEQ ID NO: 4469823 - DNA, 17 bp, Homo sapiens
ctgctctgctgctctga

SEQ ID NO: 4469824 - DNA, 23 bp, Homo sapiens
ctgctctggaataaagttgcaga

SEQ ID NO: 4469825 - DNA, 19 bp, Homo sapiens
ctgctctgggaaggggctt

SEQ ID NO: 4469826 - DNA, 17 bp, Homo sapiens
ctgctctggttgtttct

SEQ ID NO: 4469827 - DNA, 21 bp, Homo sapiens
ctgctctggttgtttctgttc

SEQ ID NO: 4469828 - DNA, 22 bp, Homo sapiens
ctgctctggttgtttctgttcc

SEQ ID NO: 4469829 - DNA, 16 bp, Homo sapiens
ctgctctttattgcag

SEQ ID NO: 4469830 - DNA, 21 bp, Homo sapiens
ctgctgaagccagttgcttct

SEQ ID NO: 4469831 - DNA, 22 bp, Homo sapiens
ctgctgaatgatttccaaagag

SEQ ID NO: 4469832 - DNA, 24 bp, Homo sapiens
ctgctgaccttggaggaatgacaa

SEQ ID NO: 4469833 - DNA, 16 bp, Homo sapiens
ctgctgagagacccaa

SEQ ID NO: 4469834 - DNA, 21 bp, Homo sapiens
ctgctgagagacccaaggagg

SEQ ID NO: 4469835 - DNA, 19 bp, Homo sapiens
ctgctgagatcctggactg

SEQ ID NO: 4469836 - DNA, 17 bp, Homo sapiens
ctgctgagtcctttcca

SEQ ID NO: 4469837 - DNA, 15 bp, Homo sapiens
ctgctgagttggcct

SEQ ID NO: 4469838 - DNA, 20 bp, Homo sapiens
ctgctgcagattagttcttt

SEQ ID NO: 4469839 - DNA, 23 bp, Homo sapiens
ctgctgcagattagttctttttg

SEQ ID NO: 4469840 - DNA, 14 bp, Homo sapiens
ctgctgcatcgctg

SEQ ID NO: 4469841 - DNA, 17 bp, Homo sapiens
ctgctgcccatgtttca

SEQ ID NO: 4469842 - DNA, 22 bp, Homo sapiens
ctgctgcccccaccccggggac

SEQ ID NO: 4469843 - DNA, 22 bp, Homo sapiens
ctgctgcccctgcacagcaggc

SEQ ID NO: 4469844 - DNA, 14 bp, Homo sapiens
ctgctgccgccgcc

SEQ ID NO: 4469845 - DNA, 13 bp, Homo sapiens
ctgctgctaaggc

SEQ ID NO: 4469846 - DNA, 14 bp, Homo sapiens
ctgctgctactgct

SEQ ID NO: 4469847 - DNA, 11 bp, Homo sapiens
ctgctgctctc

SEQ ID NO: 4469848 - DNA, 16 bp, Homo sapiens
ctgctgctctcccaag

SEQ ID NO: 4469849 - DNA, 14 bp, Homo sapiens
ctgctgctctgacc

SEQ ID NO: 4469850 - DNA, 15 bp, Homo sapiens
ctgctgctgggactt

SEQ ID NO: 4469851 - DNA, 17 bp, Homo sapiens
ctgctgctgggacttga

SEQ ID NO: 4469852 - DNA, 16 bp, Homo sapiens
ctgctgcttctccaaa

SEQ ID NO: 4469853 - DNA, 20 bp, Homo sapiens
ctgctgctttgggctgggat

SEQ ID NO: 4469854 - DNA, 22 bp, Homo sapiens
ctgctggagaataaatttggga

SEQ ID NO: 4469855 - DNA, 12 bp, Homo sapiens
ctgctggatgac

SEQ ID NO: 4469856 - DNA, 13 bp, Homo sapiens
ctgctggatgact

SEQ ID NO: 4469857 - DNA, 14 bp, Homo sapiens
ctgctggcacccac

SEQ ID NO: 4469858 - DNA, 21 bp, Homo sapiens
ctgctggccccgcccctgccc

SEQ ID NO: 4469859 - DNA, 15 bp, Homo sapiens
ctgctggccgcctca

SEQ ID NO: 4469860 - DNA, 14 bp, Homo sapiens
ctgctggcgcctct

SEQ ID NO: 4469861 - DNA, 16 bp, Homo sapiens
ctgctggcgcctctgc

SEQ ID NO: 4469862 - DNA, 13 bp, Homo sapiens
ctgctggctcagg

SEQ ID NO: 4469863 - DNA, 13 bp, Homo sapiens
ctgctgggacttg

SEQ ID NO: 4469864 - DNA, 19 bp, Homo sapiens
ctgctgggctctccacctc

SEQ ID NO: 4469865 - DNA, 18 bp, Homo sapiens
ctgctggggaagaacagc

SEQ ID NO: 4469866 - DNA, 21 bp, Homo sapiens
ctgctggggaagaacagcccc

SEQ ID NO: 4469867 - DNA, 17 bp, Homo sapiens
ctgctggtcacagcctc

SEQ ID NO: 4469868 - DNA, 18 bp, Homo sapiens
ctgctggtcacagcctcc

SEQ ID NO: 4469869 - DNA, 14 bp, Homo sapiens
ctgctgtccagaca

SEQ ID NO: 4469870 - DNA, 18 bp, Homo sapiens
ctgctgtcgctctcagtt

SEQ ID NO: 4469871 - DNA, 16 bp, Homo sapiens
ctgctgtctgggactc

SEQ ID NO: 4469872 - DNA, 16 bp, Homo sapiens
ctgctgtgattccact

SEQ ID NO: 4469873 - DNA, 17 bp, Homo sapiens
ctgctgtgccatgctgg

SEQ ID NO: 4469874 - DNA, 19 bp, Homo sapiens
ctgctgtgccatgctgggc

SEQ ID NO: 4469875 - DNA, 14 bp, Homo sapiens
ctgctgtgctgctc

SEQ ID NO: 4469876 - DNA, 12 bp, Homo sapiens
ctgctgtgtcct

SEQ ID NO: 4469877 - DNA, 15 bp, Homo sapiens
ctgctgttctcagga

SEQ ID NO: 4469878 - DNA, 21 bp, Homo sapiens
ctgcttacctactttcttcag

SEQ ID NO: 4469879 - DNA, 14 bp, Homo sapiens
ctgcttatgaaaag

SEQ ID NO: 4469880 - DNA, 13 bp, Homo sapiens
ctgcttcattgac

SEQ ID NO: 4469881 - DNA, 23 bp, Homo sapiens
ctgcttctccaaaaatctgcctg

SEQ ID NO: 4469882 - DNA, 19 bp, Homo sapiens
ctgcttcttgctggtgaaa

SEQ ID NO: 4469883 - DNA, 15 bp, Homo sapiens
ctgcttcttggagct

SEQ ID NO: 4469884 - DNA, 20 bp, Homo sapiens
ctgcttgagttcccagatgg

SEQ ID NO: 4469885 - DNA, 17 bp, Homo sapiens
ctgcttgcccgctccca

SEQ ID NO: 4469886 - DNA, 18 bp, Homo sapiens
ctgcttgcccgctcccac

SEQ ID NO: 4469887 - DNA, 23 bp, Homo sapiens
ctgcttggacggattccttggca

SEQ ID NO: 4469888 - DNA, 17 bp, Homo sapiens
ctgcttgtgatctcaca

SEQ ID NO: 4469889 - DNA, 13 bp, Homo sapiens
ctgctttaatcag

SEQ ID NO: 4469890 - DNA, 14 bp, Homo sapiens
ctgctttctccttt

SEQ ID NO: 4469891 - DNA, 13 bp, Homo sapiens
ctgctttctgttc

SEQ ID NO: 4469892 - DNA, 15 bp, Homo sapiens
ctgctttctgttcca

SEQ ID NO: 4469893 - DNA, 14 bp, Homo sapiens
ctgctttgcatctt

SEQ ID NO: 4469894 - DNA, 17 bp, Homo sapiens
ctgctttgcatctttgt

SEQ ID NO: 4469895 - DNA, 14 bp, Homo sapiens
ctgctttgggctgg

SEQ ID NO: 4469896 - DNA, 16 bp, Homo sapiens
ctgctttgggctggga

SEQ ID NO: 4469897 - DNA, 17 bp, Homo sapiens
ctgcttttaactctaga

SEQ ID NO: 4469898 - DNA, 19 bp, Homo sapiens
ctgcttttaactctagaat

SEQ ID NO: 4469899 - DNA, 22 bp, Homo sapiens
ctgcttttatgtagtttaggct

SEQ ID NO: 4469900 - DNA, 17 bp, Homo sapiens
ctgcttttcagaatgga

SEQ ID NO: 4469901 - DNA, 19 bp, Homo sapiens
ctgcttttccctttgtgag

SEQ ID NO: 4469902 - DNA, 14 bp, Homo sapiens
ctgcttttcctctg

SEQ ID NO: 4469903 - DNA, 19 bp, Homo sapiens
ctgcttttcctctgccttc

SEQ ID NO: 4469904 - DNA, 14 bp, Homo sapiens
ctgcttttctgccc

SEQ ID NO: 4469905 - DNA, 15 bp, Homo sapiens
ctgcttttctgccct

SEQ ID NO: 4469906 - DNA, 21 bp, Homo sapiens
ctgcttttctgccctggctgc

SEQ ID NO: 4469907 - DNA, 22 bp, Homo sapiens
ctgcttttctgccctggctgct

SEQ ID NO: 4469908 - DNA, 24 bp, Homo sapiens
ctgcttttctgccctggctgctgc

SEQ ID NO: 4469909 - DNA, 13 bp, Homo sapiens
ctgcttttgcaga

SEQ ID NO: 4469910 - DNA, 16 bp, Homo sapiens
ctgctttttggaaagt

SEQ ID NO: 4469911 - DNA, 20 bp, Homo sapiens
ctgctttttggaaagtcaga

SEQ ID NO: 4469912 - DNA, 15 bp, Homo sapiens
ctggaaaaaaataca

SEQ ID NO: 4469913 - DNA, 14 bp, Homo sapiens
ctggaaaacctcct

SEQ ID NO: 4469914 - DNA, 13 bp, Homo sapiens
ctggaaaggggag

SEQ ID NO: 4469915 - DNA, 20 bp, Homo sapiens
ctggaaaggggagagcctgc

SEQ ID NO: 4469916 - DNA, 23 bp, Homo sapiens
ctggaaaggggagagcctgctgg

SEQ ID NO: 4469917 - DNA, 13 bp, Homo sapiens
ctggaaagggggt

SEQ ID NO: 4469918 - DNA, 17 bp, Homo sapiens
ctggaaataatatcatt

SEQ ID NO: 4469919 - DNA, 23 bp, Homo sapiens
ctggaaatatcagttactcagcc

SEQ ID NO: 4469920 - DNA, 20 bp, Homo sapiens
ctggaaatgtagcacttacg

SEQ ID NO: 4469921 - DNA, 17 bp, Homo sapiens
ctggaacaaattatttt

SEQ ID NO: 4469922 - DNA, 17 bp, Homo sapiens
ctggaacaacttgtagc

SEQ ID NO: 4469923 - DNA, 12 bp, Homo sapiens
ctggaacacagg

SEQ ID NO: 4469924 - DNA, 14 bp, Homo sapiens
ctggaaccttctag

SEQ ID NO: 4469925 - DNA, 14 bp, Homo sapiens
ctggaagaaagcaa

SEQ ID NO: 4469926 - DNA, 16 bp, Homo sapiens
ctggaagccagctttc

SEQ ID NO: 4469927 - DNA, 17 bp, Homo sapiens
ctggaagccagctttcc

SEQ ID NO: 4469928 - DNA, 12 bp, Homo sapiens
ctggaagctgtg

SEQ ID NO: 4469929 - DNA, 22 bp, Homo sapiens
ctggaagctgtgtccttgcacc

SEQ ID NO: 4469930 - DNA, 22 bp, Homo sapiens
ctggaaggaacatggagctgtc

SEQ ID NO: 4469931 - DNA, 14 bp, Homo sapiens
ctggaaggacacag

SEQ ID NO: 4469932 - DNA, 17 bp, Homo sapiens
ctggaaggacacagtga

SEQ ID NO: 4469933 - DNA, 18 bp, Homo sapiens
ctggaaggacacagtgat

SEQ ID NO: 4469934 - DNA, 15 bp, Homo sapiens
ctggaaggcagcagg

SEQ ID NO: 4469935 - DNA, 15 bp, Homo sapiens
ctggaagtttctggt

SEQ ID NO: 4469936 - DNA, 20 bp, Homo sapiens
ctggaatataaaacagtcat

SEQ ID NO: 4469937 - DNA, 16 bp, Homo sapiens
ctggaatggtgttttg

SEQ ID NO: 4469938 - DNA, 16 bp, Homo sapiens
ctggaatgtgccacag

SEQ ID NO: 4469939 - DNA, 17 bp, Homo sapiens
ctggaatgtgccacaga

SEQ ID NO: 4469940 - DNA, 18 bp, Homo sapiens
ctggaatgtttttccctc

SEQ ID NO: 4469941 - DNA, 14 bp, Homo sapiens
ctggaattcttctg

SEQ ID NO: 4469942 - DNA, 14 bp, Homo sapiens
ctggacaaagaatt

SEQ ID NO: 4469943 - DNA, 15 bp, Homo sapiens
ctggacaaagaattc

SEQ ID NO: 4469944 - DNA, 19 bp, Homo sapiens
ctggacacaataggtcttt

SEQ ID NO: 4469945 - DNA, 22 bp, Homo sapiens
ctggacacaataggtctttctc

SEQ ID NO: 4469946 - DNA, 19 bp, Homo sapiens
ctggacactctatatgtag

SEQ ID NO: 4469947 - DNA, 18 bp, Homo sapiens
ctggacagcagaagcctc

SEQ ID NO: 4469948 - DNA, 20 bp, Homo sapiens
ctggacagcagaagcctcca

SEQ ID NO: 4469949 - DNA, 13 bp, Homo sapiens
ctggacagccagt

SEQ ID NO: 4469950 - DNA, 15 bp, Homo sapiens
ctggacaggcgggct

SEQ ID NO: 4469951 - DNA, 17 bp, Homo sapiens
ctggacatcaccagtcc

SEQ ID NO: 4469952 - DNA, 14 bp, Homo sapiens
ctggaccagcctct

SEQ ID NO: 4469953 - DNA, 15 bp, Homo sapiens
ctggactatagctgt

SEQ ID NO: 4469954 - DNA, 14 bp, Homo sapiens
ctggactattgtgc

SEQ ID NO: 4469955 - DNA, 18 bp, Homo sapiens
ctggactccggaggactg

SEQ ID NO: 4469956 - DNA, 20 bp, Homo sapiens
ctggactccggaggactgag

SEQ ID NO: 4469957 - DNA, 21 bp, Homo sapiens
ctggactccggaggactgagc

SEQ ID NO: 4469958 - DNA, 22 bp, Homo sapiens
ctggactccggaggactgagcc

SEQ ID NO: 4469959 - DNA, 21 bp, Homo sapiens
ctggactctcagtctctgagc

SEQ ID NO: 4469960 - DNA, 16 bp, Homo sapiens
ctggactgaggcctga

SEQ ID NO: 4469961 - DNA, 18 bp, Homo sapiens
ctggactgaggcctgagc

SEQ ID NO: 4469962 - DNA, 15 bp, Homo sapiens
ctggactggctagag

SEQ ID NO: 4469963 - DNA, 21 bp, Homo sapiens
ctggactgttccaggccctcc

SEQ ID NO: 4469964 - DNA, 23 bp, Homo sapiens
ctggactgttccaggccctccag

SEQ ID NO: 4469965 - DNA, 18 bp, Homo sapiens
ctggacttaagcatctgg

SEQ ID NO: 4469966 - DNA, 19 bp, Homo sapiens
ctggacttctacctgccct

SEQ ID NO: 4469967 - DNA, 20 bp, Homo sapiens
ctggacttctacctgccctc

SEQ ID NO: 4469968 - DNA, 20 bp, Homo sapiens
ctggagaaaaaaattgctct

SEQ ID NO: 4469969 - DNA, 22 bp, Homo sapiens
ctggagaaaaaaattgctctgt

SEQ ID NO: 4469970 - DNA, 18 bp, Homo sapiens
ctggagaaagccacgccc

SEQ ID NO: 4469971 - DNA, 19 bp, Homo sapiens
ctggagaaagccacgccct

SEQ ID NO: 4469972 - DNA, 23 bp, Homo sapiens
ctggagaactagaacctggaggg

SEQ ID NO: 4469973 - DNA, 22 bp, Homo sapiens
ctggagaaggtattagcaaagc

SEQ ID NO: 4469974 - DNA, 14 bp, Homo sapiens
ctggagacttcctc

SEQ ID NO: 4469975 - DNA, 17 bp, Homo sapiens
ctggagacttcctctgg

SEQ ID NO: 4469976 - DNA, 23 bp, Homo sapiens
ctggagatgcagctactggaatg

SEQ ID NO: 4469977 - DNA, 23 bp, Homo sapiens
ctggagcagaggaggggaaagtc

SEQ ID NO: 4469978 - DNA, 14 bp, Homo sapiens
ctggagcatttctc

SEQ ID NO: 4469979 - DNA, 23 bp, Homo sapiens
ctggagcccagaggagggcagca

SEQ ID NO: 4469980 - DNA, 21 bp, Homo sapiens
ctggagcccagcgtcagaagt

SEQ ID NO: 4469981 - DNA, 13 bp, Homo sapiens
ctggagccccatc

SEQ ID NO: 4469982 - DNA, 14 bp, Homo sapiens
ctggagctcctccc

SEQ ID NO: 4469983 - DNA, 17 bp, Homo sapiens
ctggagctcctccctcc

SEQ ID NO: 4469984 - DNA, 19 bp, Homo sapiens
ctggagctcctccctccag

SEQ ID NO: 4469985 - DNA, 20 bp, Homo sapiens
ctggagctcctccctccagc

SEQ ID NO: 4469986 - DNA, 12 bp, Homo sapiens
ctggagctctgc

SEQ ID NO: 4469987 - DNA, 18 bp, Homo sapiens
ctggaggaacacttgatg

SEQ ID NO: 4469988 - DNA, 16 bp, Homo sapiens
ctggaggacagaggga

SEQ ID NO: 4469989 - DNA, 14 bp, Homo sapiens
ctggaggagcagca

SEQ ID NO: 4469990 - DNA, 16 bp, Homo sapiens
ctggaggagcagcagc

SEQ ID NO: 4469991 - DNA, 14 bp, Homo sapiens
ctggaggaggcctg

SEQ ID NO: 4469992 - DNA, 13 bp, Homo sapiens
ctggaggcagggc

SEQ ID NO: 4469993 - DNA, 14 bp, Homo sapiens
ctggaggcagggcc

SEQ ID NO: 4469994 - DNA, 16 bp, Homo sapiens
ctggaggcagggcctt

SEQ ID NO: 4469995 - DNA, 20 bp, Homo sapiens
ctggaggcagggccttgccc

SEQ ID NO: 4469996 - DNA, 13 bp, Homo sapiens
ctggaggcccagg

SEQ ID NO: 4469997 - DNA, 17 bp, Homo sapiens
ctggaggcccaggctgg

SEQ ID NO: 4469998 - DNA, 18 bp, Homo sapiens
ctggaggcccaggctggg

SEQ ID NO: 4469999 - DNA, 21 bp, Homo sapiens
ctggaggctgcctcccaacag

SEQ ID NO: 4470000 - DNA, 16 bp, Homo sapiens
ctggagggaaggacag

SEQ ID NO: 4470001 - DNA, 21 bp, Homo sapiens
ctggagggcaagccctgccca

SEQ ID NO: 4470002 - DNA, 19 bp, Homo sapiens
ctggagggctggaatctgg

SEQ ID NO: 4470003 - DNA, 20 bp, Homo sapiens
ctggagggctggaatctgga

SEQ ID NO: 4470004 - DNA, 22 bp, Homo sapiens
ctggagggctggaatctggaga

SEQ ID NO: 4470005 - DNA, 14 bp, Homo sapiens
ctggaggggtggcc

SEQ ID NO: 4470006 - DNA, 16 bp, Homo sapiens
ctggaggggtggccca

SEQ ID NO: 4470007 - DNA, 22 bp, Homo sapiens
ctggaggggtggcccagagcca

SEQ ID NO: 4470008 - DNA, 14 bp, Homo sapiens
ctggaggtcagcat

SEQ ID NO: 4470009 - DNA, 18 bp, Homo sapiens
ctggagtcccaaatgtca

SEQ ID NO: 4470010 - DNA, 15 bp, Homo sapiens
ctggagtgcagtggc

SEQ ID NO: 4470011 - DNA, 16 bp, Homo sapiens
ctggagtgcagtggca

SEQ ID NO: 4470012 - DNA, 21 bp, Homo sapiens
ctggagtggatctatttacat

SEQ ID NO: 4470013 - DNA, 13 bp, Homo sapiens
ctggataggagcc

SEQ ID NO: 4470014 - DNA, 15 bp, Homo sapiens
ctggataggagcctg

SEQ ID NO: 4470015 - DNA, 19 bp, Homo sapiens
ctggataggagcctgctgg

SEQ ID NO: 4470016 - DNA, 22 bp, Homo sapiens
ctggatccatcttgagccacag

SEQ ID NO: 4470017 - DNA, 18 bp, Homo sapiens
ctggatcgctgcacatgg

SEQ ID NO: 4470018 - DNA, 23 bp, Homo sapiens
ctggatctatccctgcggcctcc

SEQ ID NO: 4470019 - DNA, 14 bp, Homo sapiens
ctggatctgtgagg

SEQ ID NO: 4470020 - DNA, 15 bp, Homo sapiens
ctggatctgttcctt

SEQ ID NO: 4470021 - DNA, 22 bp, Homo sapiens
ctggatgagtagcgctatagtt

SEQ ID NO: 4470022 - DNA, 18 bp, Homo sapiens
ctggatgccccctgtgga

SEQ ID NO: 4470023 - DNA, 18 bp, Homo sapiens
ctggatggtccagtgtca

SEQ ID NO: 4470024 - DNA, 15 bp, Homo sapiens
ctggatggtggccag

SEQ ID NO: 4470025 - DNA, 21 bp, Homo sapiens
ctggatggtgtgccttccaga

SEQ ID NO: 4470026 - DNA, 15 bp, Homo sapiens
ctggatgtttggaaa

SEQ ID NO: 4470027 - DNA, 23 bp, Homo sapiens
ctggattggttggcaaactaaag

SEQ ID NO: 4470028 - DNA, 13 bp, Homo sapiens
ctggatttgatga

SEQ ID NO: 4470029 - DNA, 19 bp, Homo sapiens
ctggcaaacagggcctctg

SEQ ID NO: 4470030 - DNA, 13 bp, Homo sapiens
ctggcaagaatgg

SEQ ID NO: 4470031 - DNA, 19 bp, Homo sapiens
ctggcaaggactttgtaca

SEQ ID NO: 4470032 - DNA, 17 bp, Homo sapiens
ctggcacacacccctcc

SEQ ID NO: 4470033 - DNA, 13 bp, Homo sapiens
ctggcacagaggt

SEQ ID NO: 4470034 - DNA, 18 bp, Homo sapiens
ctggcacagcccctggag

SEQ ID NO: 4470035 - DNA, 19 bp, Homo sapiens
ctggcacagcccctggagc

SEQ ID NO: 4470036 - DNA, 23 bp, Homo sapiens
ctggcacagccgcgggccaggag

SEQ ID NO: 4470037 - DNA, 15 bp, Homo sapiens
ctggcacagcctggc

SEQ ID NO: 4470038 - DNA, 19 bp, Homo sapiens
ctggcacagttttctgaga

SEQ ID NO: 4470039 - DNA, 20 bp, Homo sapiens
ctggcacagttttctgagaa

SEQ ID NO: 4470040 - DNA, 20 bp, Homo sapiens
ctggcaccatgttggcctct

SEQ ID NO: 4470041 - DNA, 12 bp, Homo sapiens
ctggcagacaca

SEQ ID NO: 4470042 - DNA, 20 bp, Homo sapiens
ctggcagacacaacccaata

SEQ ID NO: 4470043 - DNA, 22 bp, Homo sapiens
ctggcagagaggtaaagggtgg

SEQ ID NO: 4470044 - DNA, 18 bp, Homo sapiens
ctggcagctgagagccct

SEQ ID NO: 4470045 - DNA, 20 bp, Homo sapiens
ctggcagctgagagccctgc

SEQ ID NO: 4470046 - DNA, 11 bp, Homo sapiens
ctggcagctgc

SEQ ID NO: 4470047 - DNA, 16 bp, Homo sapiens
ctggcagctgctgtgg

SEQ ID NO: 4470048 - DNA, 23 bp, Homo sapiens
ctggcagggcgccaagtctggca

SEQ ID NO: 4470049 - DNA, 20 bp, Homo sapiens
ctggcaggggagacaggagc

SEQ ID NO: 4470050 - DNA, 23 bp, Homo sapiens
ctggcaggggagacaggagccta

SEQ ID NO: 4470051 - DNA, 22 bp, Homo sapiens
ctggcagtcctggaagccagct

SEQ ID NO: 4470052 - DNA, 22 bp, Homo sapiens
ctggcagtttatatttaactct

SEQ ID NO: 4470053 - DNA, 19 bp, Homo sapiens
ctggcataatttttacagt

SEQ ID NO: 4470054 - DNA, 16 bp, Homo sapiens
ctggcatcgcagcttc

SEQ ID NO: 4470055 - DNA, 20 bp, Homo sapiens
ctggcatcgcagcttcctgt

SEQ ID NO: 4470056 - DNA, 18 bp, Homo sapiens
ctggcatgtcaacagcgt

SEQ ID NO: 4470057 - DNA, 13 bp, Homo sapiens
ctggcatgtcatt

SEQ ID NO: 4470058 - DNA, 15 bp, Homo sapiens
ctggcatgtcatttg

SEQ ID NO: 4470059 - DNA, 18 bp, Homo sapiens
ctggccaaacccttgctt

SEQ ID NO: 4470060 - DNA, 16 bp, Homo sapiens
ctggccaacggggtga

SEQ ID NO: 4470061 - DNA, 17 bp, Homo sapiens
ctggccacacaggatct

SEQ ID NO: 4470062 - DNA, 15 bp, Homo sapiens
ctggccaccagccat

SEQ ID NO: 4470063 - DNA, 16 bp, Homo sapiens
ctggccaccagccatc

SEQ ID NO: 4470064 - DNA, 15 bp, Homo sapiens
ctggccacccctccc

SEQ ID NO: 4470065 - DNA, 18 bp, Homo sapiens
ctggccacccctccccag

SEQ ID NO: 4470066 - DNA, 13 bp, Homo sapiens
ctggccagacgct

SEQ ID NO: 4470067 - DNA, 11 bp, Homo sapiens
ctggccagatt

SEQ ID NO: 4470068 - DNA, 12 bp, Homo sapiens
ctggccagcacc

SEQ ID NO: 4470069 - DNA, 15 bp, Homo sapiens
ctggccagcaccctc

SEQ ID NO: 4470070 - DNA, 20 bp, Homo sapiens
ctggccagcaccctctcctg

SEQ ID NO: 4470071 - DNA, 15 bp, Homo sapiens
ctggccaggagctct

SEQ ID NO: 4470072 - DNA, 20 bp, Homo sapiens
ctggccaggagctcttcagg

SEQ ID NO: 4470073 - DNA, 22 bp, Homo sapiens
ctggccaggagctcttcaggcc

SEQ ID NO: 4470074 - DNA, 11 bp, Homo sapiens
ctggccaggca

SEQ ID NO: 4470075 - DNA, 22 bp, Homo sapiens
ctggccagggccacgctccagc

SEQ ID NO: 4470076 - DNA, 15 bp, Homo sapiens
ctggccagtgtttaa

SEQ ID NO: 4470077 - DNA, 20 bp, Homo sapiens
ctggccatctccctccccag

SEQ ID NO: 4470078 - DNA, 21 bp, Homo sapiens
ctggccatctccctccccaga

SEQ ID NO: 4470079 - DNA, 21 bp, Homo sapiens
ctggccatttccaagaggctg

SEQ ID NO: 4470080 - DNA, 23 bp, Homo sapiens
ctggccatttccaagaggctgta

SEQ ID NO: 4470081 - DNA, 15 bp, Homo sapiens
ctggcccaaccagaa

SEQ ID NO: 4470082 - DNA, 14 bp, Homo sapiens
ctggcccaccaggg

SEQ ID NO: 4470083 - DNA, 10 bp, Homo sapiens
ctggcccagc

SEQ ID NO: 4470084 - DNA, 13 bp, Homo sapiens
ctggcccagccct

SEQ ID NO: 4470085 - DNA, 14 bp, Homo sapiens
ctggcccagccctg

SEQ ID NO: 4470086 - DNA, 16 bp, Homo sapiens
ctggcccagccctgct

SEQ ID NO: 4470087 - DNA, 20 bp, Homo sapiens
ctggcccagccctgctggcc

SEQ ID NO: 4470088 - DNA, 17 bp, Homo sapiens
ctggccccagcctgggc

SEQ ID NO: 4470089 - DNA, 19 bp, Homo sapiens
ctggccccatgtctctcag

SEQ ID NO: 4470090 - DNA, 21 bp, Homo sapiens
ctggccccatgtctctcagaa

SEQ ID NO: 4470091 - DNA, 15 bp, Homo sapiens
ctggcccccatcagc

SEQ ID NO: 4470092 - DNA, 20 bp, Homo sapiens
ctggcccccatcagccctgc

SEQ ID NO: 4470093 - DNA, 22 bp, Homo sapiens
ctggcccccatcagccctgcta

SEQ ID NO: 4470094 - DNA, 13 bp, Homo sapiens
ctggcccctcacc

SEQ ID NO: 4470095 - DNA, 20 bp, Homo sapiens
ctggcccctcacccaccatg

SEQ ID NO: 4470096 - DNA, 14 bp, Homo sapiens
ctggcccctgggtc

SEQ ID NO: 4470097 - DNA, 23 bp, Homo sapiens
ctggccctatgcttccggcctcc

SEQ ID NO: 4470098 - DNA, 16 bp, Homo sapiens
ctggccctccactcct

SEQ ID NO: 4470099 - DNA, 14 bp, Homo sapiens
ctggccctccccac

SEQ ID NO: 4470100 - DNA, 20 bp, Homo sapiens
ctggccgagggtcctggctc

SEQ ID NO: 4470101 - DNA, 19 bp, Homo sapiens
ctggccgcctcaccccctc

SEQ ID NO: 4470102 - DNA, 21 bp, Homo sapiens
ctggccgctgagcgcccccga

SEQ ID NO: 4470103 - DNA, 15 bp, Homo sapiens
ctggccgtccttgtc

SEQ ID NO: 4470104 - DNA, 19 bp, Homo sapiens
ctggcctatccgctgccag

SEQ ID NO: 4470105 - DNA, 22 bp, Homo sapiens
ctggcctatccgctgccagcct

SEQ ID NO: 4470106 - DNA, 21 bp, Homo sapiens
ctggcctcaaagcaagcattc

SEQ ID NO: 4470107 - DNA, 22 bp, Homo sapiens
ctggcctcacccacccctgcac

SEQ ID NO: 4470108 - DNA, 13 bp, Homo sapiens
ctggcctcataca

SEQ ID NO: 4470109 - DNA, 18 bp, Homo sapiens
ctggcctcatctcagacc

SEQ ID NO: 4470110 - DNA, 21 bp, Homo sapiens
ctggcctccaaaatattaaca

SEQ ID NO: 4470111 - DNA, 22 bp, Homo sapiens
ctggcctccgcctgggtcatgg

SEQ ID NO: 4470112 - DNA, 22 bp, Homo sapiens
ctggcctccggcgtcagcctcc

SEQ ID NO: 4470113 - DNA, 15 bp, Homo sapiens
ctggcctctgtgcca

SEQ ID NO: 4470114 - DNA, 18 bp, Homo sapiens
ctggcctgaactgaggag

SEQ ID NO: 4470115 - DNA, 22 bp, Homo sapiens
ctggcctgcggtggagggatca

SEQ ID NO: 4470116 - DNA, 19 bp, Homo sapiens
ctggcctgctgggctctcc

SEQ ID NO: 4470117 - DNA, 20 bp, Homo sapiens
ctggcctggtttcctcgaga

SEQ ID NO: 4470118 - DNA, 15 bp, Homo sapiens
ctggccttgtacttg

SEQ ID NO: 4470119 - DNA, 20 bp, Homo sapiens
ctggcctttttcatttatct

SEQ ID NO: 4470120 - DNA, 18 bp, Homo sapiens
ctggcgacacactccgtc

SEQ ID NO: 4470121 - DNA, 16 bp, Homo sapiens
ctggcgcaggtgggct

SEQ ID NO: 4470122 - DNA, 17 bp, Homo sapiens
ctggcgcccctgcctgt

SEQ ID NO: 4470123 - DNA, 20 bp, Homo sapiens
ctggcgcccctgcctgtgcc

SEQ ID NO: 4470124 - DNA, 16 bp, Homo sapiens
ctggcgctcagcagcc

SEQ ID NO: 4470125 - DNA, 21 bp, Homo sapiens
ctggcgcttggatctggggtg

SEQ ID NO: 4470126 - DNA, 18 bp, Homo sapiens
ctggcggctactcagcag

SEQ ID NO: 4470127 - DNA, 22 bp, Homo sapiens
ctggcggctactcagcagccct

SEQ ID NO: 4470128 - DNA, 23 bp, Homo sapiens
ctggcggctactcagcagccctc

SEQ ID NO: 4470129 - DNA, 20 bp, Homo sapiens
ctggcgggcctttttcctgc

SEQ ID NO: 4470130 - DNA, 16 bp, Homo sapiens
ctggcgtgctcagacc

SEQ ID NO: 4470131 - DNA, 18 bp, Homo sapiens
ctggcgtgctcagaccca

SEQ ID NO: 4470132 - DNA, 22 bp, Homo sapiens
ctggcgtgctcagacccaacag

SEQ ID NO: 4470133 - DNA, 19 bp, Homo sapiens
ctggcgttcacctccctgc

SEQ ID NO: 4470134 - DNA, 19 bp, Homo sapiens
ctggcgttctcaagaatct

SEQ ID NO: 4470135 - DNA, 21 bp, Homo sapiens
ctggctaacagtctagtgcaa

SEQ ID NO: 4470136 - DNA, 17 bp, Homo sapiens
ctggctaactggaagca

SEQ ID NO: 4470137 - DNA, 20 bp, Homo sapiens
ctggctaattttctgtattt

SEQ ID NO: 4470138 - DNA, 22 bp, Homo sapiens
ctggctagaggccagccccacc

SEQ ID NO: 4470139 - DNA, 23 bp, Homo sapiens
ctggctagaggccagccccaccc

SEQ ID NO: 4470140 - DNA, 16 bp, Homo sapiens
ctggctccactcttga

SEQ ID NO: 4470141 - DNA, 14 bp, Homo sapiens
ctggctccagtctc

SEQ ID NO: 4470142 - DNA, 15 bp, Homo sapiens
ctggctccagtctca

SEQ ID NO: 4470143 - DNA, 13 bp, Homo sapiens
ctggctcccacct

SEQ ID NO: 4470144 - DNA, 14 bp, Homo sapiens
ctggctcccacctg

SEQ ID NO: 4470145 - DNA, 18 bp, Homo sapiens
ctggctccccctccccag

SEQ ID NO: 4470146 - DNA, 17 bp, Homo sapiens
ctggctccctcctccag

SEQ ID NO: 4470147 - DNA, 14 bp, Homo sapiens
ctggctcctgaggg

SEQ ID NO: 4470148 - DNA, 18 bp, Homo sapiens
ctggctcggacccacccc

SEQ ID NO: 4470149 - DNA, 20 bp, Homo sapiens
ctggctctaattcacagtgc

SEQ ID NO: 4470150 - DNA, 18 bp, Homo sapiens
ctggctctaccttcctgt

SEQ ID NO: 4470151 - DNA, 21 bp, Homo sapiens
ctggctctgccccctccccca

SEQ ID NO: 4470152 - DNA, 23 bp, Homo sapiens
ctggctctgtggcgagccatttg

SEQ ID NO: 4470153 - DNA, 15 bp, Homo sapiens
ctggctcttctgccc

SEQ ID NO: 4470154 - DNA, 22 bp, Homo sapiens
ctggctgaagaggaccagagga

SEQ ID NO: 4470155 - DNA, 23 bp, Homo sapiens
ctggctgaagaggaccagaggag

SEQ ID NO: 4470156 - DNA, 24 bp, Homo sapiens
ctggctgaagaggaccagaggagc

SEQ ID NO: 4470157 - DNA, 17 bp, Homo sapiens
ctggctgaggttcctct

SEQ ID NO: 4470158 - DNA, 22 bp, Homo sapiens
ctggctgaggttcctctgcctg

SEQ ID NO: 4470159 - DNA, 23 bp, Homo sapiens
ctggctgaggttcctctgcctgc

SEQ ID NO: 4470160 - DNA, 14 bp, Homo sapiens
ctggctgctgcccc

SEQ ID NO: 4470161 - DNA, 20 bp, Homo sapiens
ctggctggaggagcagcagc

SEQ ID NO: 4470162 - DNA, 15 bp, Homo sapiens
ctggctggctcctag

SEQ ID NO: 4470163 - DNA, 16 bp, Homo sapiens
ctggctggctcctagg

SEQ ID NO: 4470164 - DNA, 12 bp, Homo sapiens
ctggctgtttga

SEQ ID NO: 4470165 - DNA, 12 bp, Homo sapiens
ctggcttattta

SEQ ID NO: 4470166 - DNA, 19 bp, Homo sapiens
ctggcttgtaactccacca

SEQ ID NO: 4470167 - DNA, 20 bp, Homo sapiens
ctggcttgtaactccaccaa

SEQ ID NO: 4470168 - DNA, 15 bp, Homo sapiens
ctggctttcccagga

SEQ ID NO: 4470169 - DNA, 19 bp, Homo sapiens
ctggctttcccaggagatg

SEQ ID NO: 4470170 - DNA, 20 bp, Homo sapiens
ctggctttgaaacctcaggg

SEQ ID NO: 4470171 - DNA, 22 bp, Homo sapiens
ctggctttgcctcttctttgtg

SEQ ID NO: 4470172 - DNA, 14 bp, Homo sapiens
ctggctttggcact

SEQ ID NO: 4470173 - DNA, 14 bp, Homo sapiens
ctggcttttattaa

SEQ ID NO: 4470174 - DNA, 22 bp, Homo sapiens
ctggcttttattaatgcacttt

SEQ ID NO: 4470175 - DNA, 15 bp, Homo sapiens
ctggcttttcgcttg

SEQ ID NO: 4470176 - DNA, 23 bp, Homo sapiens
ctggcttttcgcttgcttctgca

SEQ ID NO: 4470177 - DNA, 16 bp, Homo sapiens
ctgggaaatattccct

SEQ ID NO: 4470178 - DNA, 18 bp, Homo sapiens
ctgggaaatattccctag

SEQ ID NO: 4470179 - DNA, 19 bp, Homo sapiens
ctgggaaatgagaaggcag

SEQ ID NO: 4470180 - DNA, 23 bp, Homo sapiens
ctgggaaatgagaaggcagccac

SEQ ID NO: 4470181 - DNA, 23 bp, Homo sapiens
ctgggaacatcacattcctctgc

SEQ ID NO: 4470182 - DNA, 17 bp, Homo sapiens
ctgggaactcatctggt

SEQ ID NO: 4470183 - DNA, 19 bp, Homo sapiens
ctgggaactgcagacctgt

SEQ ID NO: 4470184 - DNA, 13 bp, Homo sapiens
ctgggaagccctt

SEQ ID NO: 4470185 - DNA, 19 bp, Homo sapiens
ctgggaagctgagggcaaa

SEQ ID NO: 4470186 - DNA, 20 bp, Homo sapiens
ctgggaagggagagttcttt

SEQ ID NO: 4470187 - DNA, 18 bp, Homo sapiens
ctgggacccttaggatgg

SEQ ID NO: 4470188 - DNA, 16 bp, Homo sapiens
ctgggactacaggcgc

SEQ ID NO: 4470189 - DNA, 18 bp, Homo sapiens
ctgggactctcctcctcc

SEQ ID NO: 4470190 - DNA, 13 bp, Homo sapiens
ctgggagacaaag

SEQ ID NO: 4470191 - DNA, 18 bp, Homo sapiens
ctgggagaccctgaactc

SEQ ID NO: 4470192 - DNA, 12 bp, Homo sapiens
ctgggagagaag

SEQ ID NO: 4470193 - DNA, 14 bp, Homo sapiens
ctgggagccagtcc

SEQ ID NO: 4470194 - DNA, 13 bp, Homo sapiens
ctgggaggaaaag

SEQ ID NO: 4470195 - DNA, 22 bp, Homo sapiens
ctgggaggaaaagaaaagaggg

SEQ ID NO: 4470196 - DNA, 18 bp, Homo sapiens
ctgggaggacaggcaggc

SEQ ID NO: 4470197 - DNA, 17 bp, Homo sapiens
ctgggaggagggagagg

SEQ ID NO: 4470198 - DNA, 19 bp, Homo sapiens
ctgggaggagggagaggga

SEQ ID NO: 4470199 - DNA, 16 bp, Homo sapiens
ctgggaggcagggctc

SEQ ID NO: 4470200 - DNA, 19 bp, Homo sapiens
ctgggaggcagggctctcc

SEQ ID NO: 4470201 - DNA, 11 bp, Homo sapiens
ctgggagggca

SEQ ID NO: 4470202 - DNA, 22 bp, Homo sapiens
ctgggagtcacacagtgttgga

SEQ ID NO: 4470203 - DNA, 13 bp, Homo sapiens
ctgggataactga

SEQ ID NO: 4470204 - DNA, 18 bp, Homo sapiens
ctgggataactgatttct

SEQ ID NO: 4470205 - DNA, 22 bp, Homo sapiens
ctgggatatatggaggattctt

SEQ ID NO: 4470206 - DNA, 20 bp, Homo sapiens
ctgggatatggctgcccagg

SEQ ID NO: 4470207 - DNA, 23 bp, Homo sapiens
ctgggatcctgactaagcctttg

SEQ ID NO: 4470208 - DNA, 15 bp, Homo sapiens
ctgggatgggaccag

SEQ ID NO: 4470209 - DNA, 16 bp, Homo sapiens
ctgggatgggaccagg

SEQ ID NO: 4470210 - DNA, 17 bp, Homo sapiens
ctgggatgggaccaggg

SEQ ID NO: 4470211 - DNA, 20 bp, Homo sapiens
ctgggatgggaccagggatg

SEQ ID NO: 4470212 - DNA, 23 bp, Homo sapiens
ctgggattccttagactcttttc

SEQ ID NO: 4470213 - DNA, 15 bp, Homo sapiens
ctgggcaaggaaaaa

SEQ ID NO: 4470214 - DNA, 18 bp, Homo sapiens
ctgggcaaggaaaaagaa

SEQ ID NO: 4470215 - DNA, 15 bp, Homo sapiens
ctgggcagagggagg

SEQ ID NO: 4470216 - DNA, 17 bp, Homo sapiens
ctgggcagccaggctgc

SEQ ID NO: 4470217 - DNA, 17 bp, Homo sapiens
ctgggcatcttctggct

SEQ ID NO: 4470218 - DNA, 15 bp, Homo sapiens
ctgggccaccaggga

SEQ ID NO: 4470219 - DNA, 16 bp, Homo sapiens
ctgggccaccagggat

SEQ ID NO: 4470220 - DNA, 17 bp, Homo sapiens
ctgggccaccagggatc

SEQ ID NO: 4470221 - DNA, 16 bp, Homo sapiens
ctgggccactggggac

SEQ ID NO: 4470222 - DNA, 23 bp, Homo sapiens
ctgggccagccgcccacccccac

SEQ ID NO: 4470223 - DNA, 11 bp, Homo sapiens
ctgggccagtc

SEQ ID NO: 4470224 - DNA, 21 bp, Homo sapiens
ctgggccataatgttgcttct

SEQ ID NO: 4470225 - DNA, 13 bp, Homo sapiens
ctgggcccagggg

SEQ ID NO: 4470226 - DNA, 15 bp, Homo sapiens
ctgggcccaggggct

SEQ ID NO: 4470227 - DNA, 14 bp, Homo sapiens
ctgggccccaccac

SEQ ID NO: 4470228 - DNA, 16 bp, Homo sapiens
ctgggccccaccacct

SEQ ID NO: 4470229 - DNA, 12 bp, Homo sapiens
ctgggccccagc

SEQ ID NO: 4470230 - DNA, 14 bp, Homo sapiens
ctgggccccagccc

SEQ ID NO: 4470231 - DNA, 19 bp, Homo sapiens
ctgggccccagcccaccct

SEQ ID NO: 4470232 - DNA, 15 bp, Homo sapiens
ctgggcccctccacg

SEQ ID NO: 4470233 - DNA, 22 bp, Homo sapiens
ctgggcccctccacgcctcctg

SEQ ID NO: 4470234 - DNA, 15 bp, Homo sapiens
ctgggcccctccagg

SEQ ID NO: 4470235 - DNA, 19 bp, Homo sapiens
ctgggcccctccctacctc

SEQ ID NO: 4470236 - DNA, 20 bp, Homo sapiens
ctgggcccctccctacctca

SEQ ID NO: 4470237 - DNA, 12 bp, Homo sapiens
ctgggcccctgc

SEQ ID NO: 4470238 - DNA, 20 bp, Homo sapiens
ctgggcccctgcacaggcac

SEQ ID NO: 4470239 - DNA, 14 bp, Homo sapiens
ctgggcccctggga

SEQ ID NO: 4470240 - DNA, 15 bp, Homo sapiens
ctgggcccgagcctg

SEQ ID NO: 4470241 - DNA, 18 bp, Homo sapiens
ctgggccctctctgctct

SEQ ID NO: 4470242 - DNA, 16 bp, Homo sapiens
ctgggccctgcctgca

SEQ ID NO: 4470243 - DNA, 20 bp, Homo sapiens
ctgggccctgcctgcagcca

SEQ ID NO: 4470244 - DNA, 23 bp, Homo sapiens
ctgggccctgcctgcagccaggg

SEQ ID NO: 4470245 - DNA, 11 bp, Homo sapiens
ctgggccctgg

SEQ ID NO: 4470246 - DNA, 13 bp, Homo sapiens
ctgggccctgggc

SEQ ID NO: 4470247 - DNA, 15 bp, Homo sapiens
ctgggccctgggctg

SEQ ID NO: 4470248 - DNA, 19 bp, Homo sapiens
ctgggccctgtcgcccctc

SEQ ID NO: 4470249 - DNA, 21 bp, Homo sapiens
ctgggcctcagttcaacctgg

SEQ ID NO: 4470250 - DNA, 18 bp, Homo sapiens
ctgggctaccccccctcc

SEQ ID NO: 4470251 - DNA, 22 bp, Homo sapiens
ctgggctaggtagaaaaagggt

SEQ ID NO: 4470252 - DNA, 22 bp, Homo sapiens
ctgggctattgctgctgcccct

SEQ ID NO: 4470253 - DNA, 23 bp, Homo sapiens
ctgggctattgctgctgcccctt

SEQ ID NO: 4470254 - DNA, 17 bp, Homo sapiens
ctgggctcggaggctgc

SEQ ID NO: 4470255 - DNA, 14 bp, Homo sapiens
ctgggctctccacc

SEQ ID NO: 4470256 - DNA, 17 bp, Homo sapiens
ctgggctctccacctca

SEQ ID NO: 4470257 - DNA, 18 bp, Homo sapiens
ctgggctctccacctcag

SEQ ID NO: 4470258 - DNA, 19 bp, Homo sapiens
ctgggctctccacctcagc

SEQ ID NO: 4470259 - DNA, 20 bp, Homo sapiens
ctgggctgccaccagccccc

SEQ ID NO: 4470260 - DNA, 15 bp, Homo sapiens
ctgggctggcacagc

SEQ ID NO: 4470261 - DNA, 19 bp, Homo sapiens
ctgggctggcacagcccct

SEQ ID NO: 4470262 - DNA, 22 bp, Homo sapiens
ctgggctggcacagcccctgga

SEQ ID NO: 4470263 - DNA, 16 bp, Homo sapiens
ctgggctgggccctct

SEQ ID NO: 4470264 - DNA, 16 bp, Homo sapiens
ctgggctggggccacc

SEQ ID NO: 4470265 - DNA, 18 bp, Homo sapiens
ctgggctggggccacctt

SEQ ID NO: 4470266 - DNA, 23 bp, Homo sapiens
ctgggctggggccacctttgtgc

SEQ ID NO: 4470267 - DNA, 17 bp, Homo sapiens
ctgggctgtctgtcacc

SEQ ID NO: 4470268 - DNA, 13 bp, Homo sapiens
ctgggcttggcct

SEQ ID NO: 4470269 - DNA, 14 bp, Homo sapiens
ctgggcttggcctg

SEQ ID NO: 4470270 - DNA, 16 bp, Homo sapiens
ctgggcttggcctgct

SEQ ID NO: 4470271 - DNA, 23 bp, Homo sapiens
ctgggcttggggtgtggggtggg

SEQ ID NO: 4470272 - DNA, 20 bp, Homo sapiens
ctggggaaacaacatttata

SEQ ID NO: 4470273 - DNA, 19 bp, Homo sapiens
ctggggaagaacagccccg

SEQ ID NO: 4470274 - DNA, 20 bp, Homo sapiens
ctggggaagaacagccccgg

SEQ ID NO: 4470275 - DNA, 21 bp, Homo sapiens
ctggggaagaacagccccggg

SEQ ID NO: 4470276 - DNA, 17 bp, Homo sapiens
ctggggaatgctcccag

SEQ ID NO: 4470277 - DNA, 18 bp, Homo sapiens
ctggggaatgctcccagc

SEQ ID NO: 4470278 - DNA, 22 bp, Homo sapiens
ctggggacacagcatcagctca

SEQ ID NO: 4470279 - DNA, 19 bp, Homo sapiens
ctggggacgccaaggaggt

SEQ ID NO: 4470280 - DNA, 22 bp, Homo sapiens
ctggggacgttgctgagccagc

SEQ ID NO: 4470281 - DNA, 17 bp, Homo sapiens
ctggggactcagggacc

SEQ ID NO: 4470282 - DNA, 20 bp, Homo sapiens
ctggggacttcaactgccca

SEQ ID NO: 4470283 - DNA, 18 bp, Homo sapiens
ctggggacttgtgtctgc

SEQ ID NO: 4470284 - DNA, 15 bp, Homo sapiens
ctggggagcccactg

SEQ ID NO: 4470285 - DNA, 21 bp, Homo sapiens
ctggggagcccactgaggggc

SEQ ID NO: 4470286 - DNA, 23 bp, Homo sapiens
ctggggagcccactgaggggcca

SEQ ID NO: 4470287 - DNA, 16 bp, Homo sapiens
ctggggagctcctggg

SEQ ID NO: 4470288 - DNA, 16 bp, Homo sapiens
ctggggagctgttgat

SEQ ID NO: 4470289 - DNA, 23 bp, Homo sapiens
ctggggagtaaacggcccaggcc

SEQ ID NO: 4470290 - DNA, 19 bp, Homo sapiens
ctggggagtggttaggcag

SEQ ID NO: 4470291 - DNA, 20 bp, Homo sapiens
ctggggatcttcccacagga

SEQ ID NO: 4470292 - DNA, 16 bp, Homo sapiens
ctggggatttctggga

SEQ ID NO: 4470293 - DNA, 17 bp, Homo sapiens
ctggggatttctgggat

SEQ ID NO: 4470294 - DNA, 12 bp, Homo sapiens
ctggggcacggc

SEQ ID NO: 4470295 - DNA, 14 bp, Homo sapiens
ctggggcacggcgg

SEQ ID NO: 4470296 - DNA, 14 bp, Homo sapiens
ctggggcagaggaa

SEQ ID NO: 4470297 - DNA, 22 bp, Homo sapiens
ctggggcagcaccctataaatc

SEQ ID NO: 4470298 - DNA, 14 bp, Homo sapiens
ctggggcaggctgc

SEQ ID NO: 4470299 - DNA, 18 bp, Homo sapiens
ctggggcaggctgcttca

SEQ ID NO: 4470300 - DNA, 17 bp, Homo sapiens
ctggggcaggctgggcc

SEQ ID NO: 4470301 - DNA, 23 bp, Homo sapiens
ctggggccacctttgtgcagctt

SEQ ID NO: 4470302 - DNA, 15 bp, Homo sapiens
ctggggccagaggct

SEQ ID NO: 4470303 - DNA, 13 bp, Homo sapiens
ctggggcccagcc

SEQ ID NO: 4470304 - DNA, 16 bp, Homo sapiens
ctggggcccagcccct

SEQ ID NO: 4470305 - DNA, 16 bp, Homo sapiens
ctggggccctgggcct

SEQ ID NO: 4470306 - DNA, 23 bp, Homo sapiens
ctggggcctagcgatctctcctg

SEQ ID NO: 4470307 - DNA, 14 bp, Homo sapiens
ctggggctgtgtta

SEQ ID NO: 4470308 - DNA, 16 bp, Homo sapiens
ctggggctgtgttttg

SEQ ID NO: 4470309 - DNA, 12 bp, Homo sapiens
ctgggggcagga

SEQ ID NO: 4470310 - DNA, 19 bp, Homo sapiens
ctgggggcaggagggccct

SEQ ID NO: 4470311 - DNA, 22 bp, Homo sapiens
ctggggggcaattttgcactga

SEQ ID NO: 4470312 - DNA, 16 bp, Homo sapiens
ctggggggcagtggtg

SEQ ID NO: 4470313 - DNA, 19 bp, Homo sapiens
ctgggggtgccaggaccag

SEQ ID NO: 4470314 - DNA, 16 bp, Homo sapiens
ctggggtgccgcctgc

SEQ ID NO: 4470315 - DNA, 18 bp, Homo sapiens
ctggggtgccgcctgccc

SEQ ID NO: 4470316 - DNA, 22 bp, Homo sapiens
ctggggtgccttcactgggcca

SEQ ID NO: 4470317 - DNA, 23 bp, Homo sapiens
ctggggtgccttcactgggccag

SEQ ID NO: 4470318 - DNA, 13 bp, Homo sapiens
ctggggttcagcc

SEQ ID NO: 4470319 - DNA, 20 bp, Homo sapiens
ctggggttcagcccctcctc

SEQ ID NO: 4470320 - DNA, 21 bp, Homo sapiens
ctggggttcagcccctcctct

SEQ ID NO: 4470321 - DNA, 22 bp, Homo sapiens
ctggggttcagcccctcctctg

SEQ ID NO: 4470322 - DNA, 23 bp, Homo sapiens
ctggggttcagcccctcctctgc

SEQ ID NO: 4470323 - DNA, 16 bp, Homo sapiens
ctggggttctctacag

SEQ ID NO: 4470324 - DNA, 19 bp, Homo sapiens
ctggggttgccagaggccc

SEQ ID NO: 4470325 - DNA, 20 bp, Homo sapiens
ctggggttgccagaggccct

SEQ ID NO: 4470326 - DNA, 22 bp, Homo sapiens
ctggggttgccagaggccctgg

SEQ ID NO: 4470327 - DNA, 23 bp, Homo sapiens
ctggggttgccagaggccctgga

SEQ ID NO: 4470328 - DNA, 15 bp, Homo sapiens
ctgggtaagaagaaa

SEQ ID NO: 4470329 - DNA, 16 bp, Homo sapiens
ctgggtaagaagaaag

SEQ ID NO: 4470330 - DNA, 17 bp, Homo sapiens
ctgggtactgaaagcct

SEQ ID NO: 4470331 - DNA, 19 bp, Homo sapiens
ctgggtattggaaatggat

SEQ ID NO: 4470332 - DNA, 16 bp, Homo sapiens
ctgggtcacagagtga

SEQ ID NO: 4470333 - DNA, 13 bp, Homo sapiens
ctgggtcagtctg

SEQ ID NO: 4470334 - DNA, 14 bp, Homo sapiens
ctgggtcatgggcc

SEQ ID NO: 4470335 - DNA, 17 bp, Homo sapiens
ctgggtcatgggcctgt

SEQ ID NO: 4470336 - DNA, 18 bp, Homo sapiens
ctgggtcatgggcctgtg

SEQ ID NO: 4470337 - DNA, 15 bp, Homo sapiens
ctgggtccatatcac

SEQ ID NO: 4470338 - DNA, 13 bp, Homo sapiens
ctgggtcctgcca

SEQ ID NO: 4470339 - DNA, 15 bp, Homo sapiens
ctgggtcctgccagc

SEQ ID NO: 4470340 - DNA, 18 bp, Homo sapiens
ctgggtcctgttccctac

SEQ ID NO: 4470341 - DNA, 16 bp, Homo sapiens
ctgggtctgaggcccc

SEQ ID NO: 4470342 - DNA, 18 bp, Homo sapiens
ctgggtctgaggcccctg

SEQ ID NO: 4470343 - DNA, 14 bp, Homo sapiens
ctgggtgagaccca

SEQ ID NO: 4470344 - DNA, 13 bp, Homo sapiens
ctgggtgatggaa

SEQ ID NO: 4470345 - DNA, 20 bp, Homo sapiens
ctgggtgatggaaactgcca

SEQ ID NO: 4470346 - DNA, 16 bp, Homo sapiens
ctgggtggatgggcca

SEQ ID NO: 4470347 - DNA, 17 bp, Homo sapiens
ctgggtggggctgctcc

SEQ ID NO: 4470348 - DNA, 20 bp, Homo sapiens
ctgggtggggctgctcctcc

SEQ ID NO: 4470349 - DNA, 17 bp, Homo sapiens
ctgggtggtggcctggt

SEQ ID NO: 4470350 - DNA, 13 bp, Homo sapiens
ctgggtgtcattt

SEQ ID NO: 4470351 - DNA, 20 bp, Homo sapiens
ctgggtgtcatttcattcca

SEQ ID NO: 4470352 - DNA, 15 bp, Homo sapiens
ctgggtgttgaccac

SEQ ID NO: 4470353 - DNA, 19 bp, Homo sapiens
ctgggtgttgaccactcca

SEQ ID NO: 4470354 - DNA, 18 bp, Homo sapiens
ctgggttaattcatttgg

SEQ ID NO: 4470355 - DNA, 17 bp, Homo sapiens
ctgggttgcctttattt

SEQ ID NO: 4470356 - DNA, 20 bp, Homo sapiens
ctgggtttctaagcagttat

SEQ ID NO: 4470357 - DNA, 20 bp, Homo sapiens
ctgggttttgtattctctga

SEQ ID NO: 4470358 - DNA, 22 bp, Homo sapiens
ctgggttttgtattctctgagc

SEQ ID NO: 4470359 - DNA, 18 bp, Homo sapiens
ctgggttttgttggcttt

SEQ ID NO: 4470360 - DNA, 20 bp, Homo sapiens
ctggtaaacattcctccagc

SEQ ID NO: 4470361 - DNA, 22 bp, Homo sapiens
ctggtaagattgttattaaatg

SEQ ID NO: 4470362 - DNA, 14 bp, Homo sapiens
ctggtaagcagagg

SEQ ID NO: 4470363 - DNA, 18 bp, Homo sapiens
ctggtaagcagaggcttt

SEQ ID NO: 4470364 - DNA, 19 bp, Homo sapiens
ctggtacccgcccttccga

SEQ ID NO: 4470365 - DNA, 16 bp, Homo sapiens
ctggtagagaccccca

SEQ ID NO: 4470366 - DNA, 20 bp, Homo sapiens
ctggtagagacccccaggcc

SEQ ID NO: 4470367 - DNA, 22 bp, Homo sapiens
ctggtagagacccccaggcctg

SEQ ID NO: 4470368 - DNA, 17 bp, Homo sapiens
ctggtattgttctcaca

SEQ ID NO: 4470369 - DNA, 15 bp, Homo sapiens
ctggtcacagcctcc

SEQ ID NO: 4470370 - DNA, 16 bp, Homo sapiens
ctggtcacagcctcct

SEQ ID NO: 4470371 - DNA, 17 bp, Homo sapiens
ctggtcacagcctcctc

SEQ ID NO: 4470372 - DNA, 18 bp, Homo sapiens
ctggtcaccgagactcag

SEQ ID NO: 4470373 - DNA, 21 bp, Homo sapiens
ctggtcaccgagactcagcct

SEQ ID NO: 4470374 - DNA, 15 bp, Homo sapiens
ctggtccaaaagatt

SEQ ID NO: 4470375 - DNA, 22 bp, Homo sapiens
ctggtccaaaagattgctgaaa

SEQ ID NO: 4470376 - DNA, 15 bp, Homo sapiens
ctggtccagggaagc

SEQ ID NO: 4470377 - DNA, 23 bp, Homo sapiens
ctggtccctgttttcccacgagg

SEQ ID NO: 4470378 - DNA, 21 bp, Homo sapiens
ctggtcccttgcagctagttt

SEQ ID NO: 4470379 - DNA, 13 bp, Homo sapiens
ctggtccttattt

SEQ ID NO: 4470380 - DNA, 20 bp, Homo sapiens
ctggtctcagcagcgaccac

SEQ ID NO: 4470381 - DNA, 21 bp, Homo sapiens
ctggtctcagcagcgaccacc

SEQ ID NO: 4470382 - DNA, 12 bp, Homo sapiens
ctggtctgaggg

SEQ ID NO: 4470383 - DNA, 17 bp, Homo sapiens
ctggtctgtgaagagcc

SEQ ID NO: 4470384 - DNA, 22 bp, Homo sapiens
ctggtctgtgaagagccggtgg

SEQ ID NO: 4470385 - DNA, 12 bp, Homo sapiens
ctggtcttcctt

SEQ ID NO: 4470386 - DNA, 18 bp, Homo sapiens
ctggtgaactgagctggg

SEQ ID NO: 4470387 - DNA, 15 bp, Homo sapiens
ctggtgaagctcact

SEQ ID NO: 4470388 - DNA, 17 bp, Homo sapiens
ctggtgcaaattcagaa

SEQ ID NO: 4470389 - DNA, 19 bp, Homo sapiens
ctggtgcactttgtaaatt

SEQ ID NO: 4470390 - DNA, 23 bp, Homo sapiens
ctggtgcaggtctccacctgcac

SEQ ID NO: 4470391 - DNA, 15 bp, Homo sapiens
ctggtgccaatttca

SEQ ID NO: 4470392 - DNA, 18 bp, Homo sapiens
ctggtgccaatttcaagt

SEQ ID NO: 4470393 - DNA, 17 bp, Homo sapiens
ctggtgctcctgcatct

SEQ ID NO: 4470394 - DNA, 19 bp, Homo sapiens
ctggtgctgccgagggctg

SEQ ID NO: 4470395 - DNA, 21 bp, Homo sapiens
ctggtgctgccgagggctggc

SEQ ID NO: 4470396 - DNA, 16 bp, Homo sapiens
ctggtgctttccttca

SEQ ID NO: 4470397 - DNA, 19 bp, Homo sapiens
ctggtggaggaagggctgg

SEQ ID NO: 4470398 - DNA, 14 bp, Homo sapiens
ctggtggcacagga

SEQ ID NO: 4470399 - DNA, 15 bp, Homo sapiens
ctggtggcacaggag

SEQ ID NO: 4470400 - DNA, 18 bp, Homo sapiens
ctggtggcaccagatgca

SEQ ID NO: 4470401 - DNA, 22 bp, Homo sapiens
ctggtggcaccagatgcaacct

SEQ ID NO: 4470402 - DNA, 18 bp, Homo sapiens
ctggtggtgcagccttcc

SEQ ID NO: 4470403 - DNA, 14 bp, Homo sapiens
ctggtggtggctcg

SEQ ID NO: 4470404 - DNA, 17 bp, Homo sapiens
ctggtggtttttgctct

SEQ ID NO: 4470405 - DNA, 19 bp, Homo sapiens
ctggtgtatattttaatgt

SEQ ID NO: 4470406 - DNA, 12 bp, Homo sapiens
ctggtgtcccct

SEQ ID NO: 4470407 - DNA, 20 bp, Homo sapiens
ctggtgtccccttcccctgc

SEQ ID NO: 4470408 - DNA, 18 bp, Homo sapiens
ctggtgtgacctgagggc

SEQ ID NO: 4470409 - DNA, 23 bp, Homo sapiens
ctggtgtgttcaagaccagcctg

SEQ ID NO: 4470410 - DNA, 23 bp, Homo sapiens
ctggtgtttctagcactggcctg

SEQ ID NO: 4470411 - DNA, 19 bp, Homo sapiens
ctggttaaaaaacaaatgt

SEQ ID NO: 4470412 - DNA, 18 bp, Homo sapiens
ctggttactttcaaaatg

SEQ ID NO: 4470413 - DNA, 18 bp, Homo sapiens
ctggttcaaagtaaagca

SEQ ID NO: 4470414 - DNA, 13 bp, Homo sapiens
ctggttcaggctc

SEQ ID NO: 4470415 - DNA, 12 bp, Homo sapiens
ctggttcattgt

SEQ ID NO: 4470416 - DNA, 12 bp, Homo sapiens
ctggttctcatc

SEQ ID NO: 4470417 - DNA, 14 bp, Homo sapiens
ctggttctcatctt

SEQ ID NO: 4470418 - DNA, 23 bp, Homo sapiens
ctggttcttgcaaatgggagctg

SEQ ID NO: 4470419 - DNA, 17 bp, Homo sapiens
ctggttggagagctaga

SEQ ID NO: 4470420 - DNA, 15 bp, Homo sapiens
ctggttgtgggcact

SEQ ID NO: 4470421 - DNA, 19 bp, Homo sapiens
ctggttgtttctgttccaa

SEQ ID NO: 4470422 - DNA, 15 bp, Homo sapiens
ctggtttttcagttt

SEQ ID NO: 4470423 - DNA, 13 bp, Homo sapiens
ctgtaaaaaatgg

SEQ ID NO: 4470424 - DNA, 17 bp, Homo sapiens
ctgtaaaaaatggagct

SEQ ID NO: 4470425 - DNA, 18 bp, Homo sapiens
ctgtaaaaaatggagctc

SEQ ID NO: 4470426 - DNA, 22 bp, Homo sapiens
ctgtaaaacacaccaatcagcg

SEQ ID NO: 4470427 - DNA, 15 bp, Homo sapiens
ctgtaaaacaggtta

SEQ ID NO: 4470428 - DNA, 13 bp, Homo sapiens
ctgtaaaacttta

SEQ ID NO: 4470429 - DNA, 20 bp, Homo sapiens
ctgtaaaactttattttata

SEQ ID NO: 4470430 - DNA, 22 bp, Homo sapiens
ctgtaaaagtgtacagactctt

SEQ ID NO: 4470431 - DNA, 20 bp, Homo sapiens
ctgtaaaatccatttaatca

SEQ ID NO: 4470432 - DNA, 17 bp, Homo sapiens
ctgtaaaatttgtgtaa

SEQ ID NO: 4470433 - DNA, 19 bp, Homo sapiens
ctgtaaaatttgtgtaaat

SEQ ID NO: 4470434 - DNA, 12 bp, Homo sapiens
ctgtaaactgtg

SEQ ID NO: 4470435 - DNA, 20 bp, Homo sapiens
ctgtaaactgtgtattccaa

SEQ ID NO: 4470436 - DNA, 20 bp, Homo sapiens
ctgtaaacttggaatcaagg

SEQ ID NO: 4470437 - DNA, 21 bp, Homo sapiens
ctgtaaagatgtttatttcag

SEQ ID NO: 4470438 - DNA, 16 bp, Homo sapiens
ctgtaaattattttaa

SEQ ID NO: 4470439 - DNA, 18 bp, Homo sapiens
ctgtaaattattttaaat

SEQ ID NO: 4470440 - DNA, 20 bp, Homo sapiens
ctgtaaattattttaaatta

SEQ ID NO: 4470441 - DNA, 15 bp, Homo sapiens
ctgtaacattcagga

SEQ ID NO: 4470442 - DNA, 19 bp, Homo sapiens
ctgtaactactttataact

SEQ ID NO: 4470443 - DNA, 14 bp, Homo sapiens
ctgtaactgagaga

SEQ ID NO: 4470444 - DNA, 15 bp, Homo sapiens
ctgtaactgtcagtg

SEQ ID NO: 4470445 - DNA, 20 bp, Homo sapiens
ctgtaagaataatttatagt

SEQ ID NO: 4470446 - DNA, 21 bp, Homo sapiens
ctgtaagaataatttatagta

SEQ ID NO: 4470447 - DNA, 15 bp, Homo sapiens
ctgtaagccaaagaa

SEQ ID NO: 4470448 - DNA, 19 bp, Homo sapiens
ctgtaagccaaagaaatga

SEQ ID NO: 4470449 - DNA, 22 bp, Homo sapiens
ctgtaagccaaagaaatgaaca

SEQ ID NO: 4470450 - DNA, 17 bp, Homo sapiens
ctgtaagcctatatata

SEQ ID NO: 4470451 - DNA, 17 bp, Homo sapiens
ctgtaaggtgcttgctc

SEQ ID NO: 4470452 - DNA, 21 bp, Homo sapiens
ctgtaatacgtagctctctta

SEQ ID NO: 4470453 - DNA, 14 bp, Homo sapiens
ctgtaatatttaca

SEQ ID NO: 4470454 - DNA, 15 bp, Homo sapiens
ctgtaatatttacaa

SEQ ID NO: 4470455 - DNA, 17 bp, Homo sapiens
ctgtaatcaaaaggagg

SEQ ID NO: 4470456 - DNA, 23 bp, Homo sapiens
ctgtaatcacagctacttgggag

SEQ ID NO: 4470457 - DNA, 15 bp, Homo sapiens
ctgtaatcccagcac

SEQ ID NO: 4470458 - DNA, 17 bp, Homo sapiens
ctgtaatcccagcactt

SEQ ID NO: 4470459 - DNA, 14 bp, Homo sapiens
ctgtaatcccagct

SEQ ID NO: 4470460 - DNA, 14 bp, Homo sapiens
ctgtaatgtaaata

SEQ ID NO: 4470461 - DNA, 16 bp, Homo sapiens
ctgtaatgtaaataaa

SEQ ID NO: 4470462 - DNA, 21 bp, Homo sapiens
ctgtaatgtaggcacttttat

SEQ ID NO: 4470463 - DNA, 13 bp, Homo sapiens
ctgtaattgtaat

SEQ ID NO: 4470464 - DNA, 20 bp, Homo sapiens
ctgtaatttcgccttaaact

SEQ ID NO: 4470465 - DNA, 12 bp, Homo sapiens
ctgtaatttgaa

SEQ ID NO: 4470466 - DNA, 11 bp, Homo sapiens
ctgtacaataa

SEQ ID NO: 4470467 - DNA, 20 bp, Homo sapiens
ctgtacacactttatttact

SEQ ID NO: 4470468 - DNA, 11 bp, Homo sapiens
ctgtacacatt

SEQ ID NO: 4470469 - DNA, 21 bp, Homo sapiens
ctgtacacatttcttaaaaca

SEQ ID NO: 4470470 - DNA, 12 bp, Homo sapiens
ctgtacagtatt

SEQ ID NO: 4470471 - DNA, 17 bp, Homo sapiens
ctgtacataaacaatga

SEQ ID NO: 4470472 - DNA, 15 bp, Homo sapiens
ctgtacataattgca

SEQ ID NO: 4470473 - DNA, 19 bp, Homo sapiens
ctgtacataattgcatgaa

SEQ ID NO: 4470474 - DNA, 21 bp, Homo sapiens
ctgtacataattgcatgaaaa

SEQ ID NO: 4470475 - DNA, 22 bp, Homo sapiens
ctgtacataattgcatgaaaat

SEQ ID NO: 4470476 - DNA, 14 bp, Homo sapiens
ctgtacatctattt

SEQ ID NO: 4470477 - DNA, 20 bp, Homo sapiens
ctgtacattgtgagctctgg

SEQ ID NO: 4470478 - DNA, 17 bp, Homo sapiens
ctgtaccagttaatttt

SEQ ID NO: 4470479 - DNA, 14 bp, Homo sapiens
ctgtacctcagtgg

SEQ ID NO: 4470480 - DNA, 16 bp, Homo sapiens
ctgtactttgtgttta

SEQ ID NO: 4470481 - DNA, 15 bp, Homo sapiens
ctgtagacatctgtc

SEQ ID NO: 4470482 - DNA, 19 bp, Homo sapiens
ctgtagagtcctatttcag

SEQ ID NO: 4470483 - DNA, 13 bp, Homo sapiens
ctgtagcaagctg

SEQ ID NO: 4470484 - DNA, 14 bp, Homo sapiens
ctgtagccacagct

SEQ ID NO: 4470485 - DNA, 19 bp, Homo sapiens
ctgtagcttatctgcccct

SEQ ID NO: 4470486 - DNA, 15 bp, Homo sapiens
ctgtagctttcctgg

SEQ ID NO: 4470487 - DNA, 23 bp, Homo sapiens
ctgtaggctaaaaggcttccagg

SEQ ID NO: 4470488 - DNA, 24 bp, Homo sapiens
ctgtagggtaattagtaacatgtg

SEQ ID NO: 4470489 - DNA, 19 bp, Homo sapiens
ctgtagtaaaatgttttca

SEQ ID NO: 4470490 - DNA, 15 bp, Homo sapiens
ctgtagtctcagcta

SEQ ID NO: 4470491 - DNA, 21 bp, Homo sapiens
ctgtagtgtattaatctctgt

SEQ ID NO: 4470492 - DNA, 19 bp, Homo sapiens
ctgtagttcaatttcatgt

SEQ ID NO: 4470493 - DNA, 18 bp, Homo sapiens
ctgtagttttattttatg

SEQ ID NO: 4470494 - DNA, 20 bp, Homo sapiens
ctgtagttttattttatgtt

SEQ ID NO: 4470495 - DNA, 22 bp, Homo sapiens
ctgtagttttattttatgttta

SEQ ID NO: 4470496 - DNA, 24 bp, Homo sapiens
ctgtagttttattttatgtttaga

SEQ ID NO: 4470497 - DNA, 20 bp, Homo sapiens
ctgtagttttccctgcactg

SEQ ID NO: 4470498 - DNA, 22 bp, Homo sapiens
ctgtagttttccctgcactgtg

SEQ ID NO: 4470499 - DNA, 14 bp, Homo sapiens
ctgtataaacagaa

SEQ ID NO: 4470500 - DNA, 14 bp, Homo sapiens
ctgtataaagcatg

SEQ ID NO: 4470501 - DNA, 18 bp, Homo sapiens
ctgtataacattaagaaa

SEQ ID NO: 4470502 - DNA, 18 bp, Homo sapiens
ctgtataatagagataag

SEQ ID NO: 4470503 - DNA, 22 bp, Homo sapiens
ctgtatacagtgcagagccttc

SEQ ID NO: 4470504 - DNA, 14 bp, Homo sapiens
ctgtatactcttga

SEQ ID NO: 4470505 - DNA, 16 bp, Homo sapiens
ctgtatactcttgaat

SEQ ID NO: 4470506 - DNA, 15 bp, Homo sapiens
ctgtatataaaataa

SEQ ID NO: 4470507 - DNA, 13 bp, Homo sapiens
ctgtatataaaca

SEQ ID NO: 4470508 - DNA, 13 bp, Homo sapiens
ctgtatatacttt

SEQ ID NO: 4470509 - DNA, 14 bp, Homo sapiens
ctgtatatactttt

SEQ ID NO: 4470510 - DNA, 14 bp, Homo sapiens
ctgtatatgtaaat

SEQ ID NO: 4470511 - DNA, 15 bp, Homo sapiens
ctgtatatttctttt

SEQ ID NO: 4470512 - DNA, 15 bp, Homo sapiens
ctgtatatttgtatg

SEQ ID NO: 4470513 - DNA, 19 bp, Homo sapiens
ctgtatatttgtatgatat

SEQ ID NO: 4470514 - DNA, 23 bp, Homo sapiens
ctgtatattttgtagttaatata

SEQ ID NO: 4470515 - DNA, 22 bp, Homo sapiens
ctgtatcaataaaattctgtaa

SEQ ID NO: 4470516 - DNA, 16 bp, Homo sapiens
ctgtatcaggacccag

SEQ ID NO: 4470517 - DNA, 22 bp, Homo sapiens
ctgtatcaggacccagaggaag

SEQ ID NO: 4470518 - DNA, 23 bp, Homo sapiens
ctgtatccaggttccctcccaga

SEQ ID NO: 4470519 - DNA, 12 bp, Homo sapiens
ctgtatcctgaa

SEQ ID NO: 4470520 - DNA, 22 bp, Homo sapiens
ctgtatcttgggggacagggct

SEQ ID NO: 4470521 - DNA, 18 bp, Homo sapiens
ctgtatgtttttactgaa

SEQ ID NO: 4470522 - DNA, 21 bp, Homo sapiens
ctgtatgtttttactgaatga

SEQ ID NO: 4470523 - DNA, 17 bp, Homo sapiens
ctgtattcttgtttgaa

SEQ ID NO: 4470524 - DNA, 18 bp, Homo sapiens
ctgtatttatgtgtgagg

SEQ ID NO: 4470525 - DNA, 23 bp, Homo sapiens
ctgtatttatgtgtgaggagctg

SEQ ID NO: 4470526 - DNA, 13 bp, Homo sapiens
ctgtatttcagta

SEQ ID NO: 4470527 - DNA, 21 bp, Homo sapiens
ctgtatttcagtattttccag

SEQ ID NO: 4470528 - DNA, 21 bp, Homo sapiens
ctgtattttatttagacaaga

SEQ ID NO: 4470529 - DNA, 22 bp, Homo sapiens
ctgtattttatttagacaagag

SEQ ID NO: 4470530 - DNA, 22 bp, Homo sapiens
ctgtattttgatataattgtac

SEQ ID NO: 4470531 - DNA, 20 bp, Homo sapiens
ctgtattttgtattgtttca

SEQ ID NO: 4470532 - DNA, 22 bp, Homo sapiens
ctgtcaacttcccatctggctc

SEQ ID NO: 4470533 - DNA, 13 bp, Homo sapiens
ctgtcacaccagc

SEQ ID NO: 4470534 - DNA, 15 bp, Homo sapiens
ctgtcacaccagcca

SEQ ID NO: 4470535 - DNA, 16 bp, Homo sapiens
ctgtcacaccagccat

SEQ ID NO: 4470536 - DNA, 19 bp, Homo sapiens
ctgtcacagtaaaaataaa

SEQ ID NO: 4470537 - DNA, 23 bp, Homo sapiens
ctgtcaccaagctcacagttcct

SEQ ID NO: 4470538 - DNA, 16 bp, Homo sapiens
ctgtcacctctcagct

SEQ ID NO: 4470539 - DNA, 15 bp, Homo sapiens
ctgtcacctcttccg

SEQ ID NO: 4470540 - DNA, 18 bp, Homo sapiens
ctgtcacggggttccctc

SEQ ID NO: 4470541 - DNA, 20 bp, Homo sapiens
ctgtcacggggttccctcct

SEQ ID NO: 4470542 - DNA, 21 bp, Homo sapiens
ctgtcactttttttctttttc

SEQ ID NO: 4470543 - DNA, 15 bp, Homo sapiens
ctgtcagatgtcaca

SEQ ID NO: 4470544 - DNA, 20 bp, Homo sapiens
ctgtcagccagccgccctgg

SEQ ID NO: 4470545 - DNA, 21 bp, Homo sapiens
ctgtcagccagccgccctggg

SEQ ID NO: 4470546 - DNA, 21 bp, Homo sapiens
ctgtcagctcccctcggagaa

SEQ ID NO: 4470547 - DNA, 18 bp, Homo sapiens
ctgtcagtggggcagcct

SEQ ID NO: 4470548 - DNA, 16 bp, Homo sapiens
ctgtcagtgtttgtat

SEQ ID NO: 4470549 - DNA, 14 bp, Homo sapiens
ctgtcatctctctg

SEQ ID NO: 4470550 - DNA, 18 bp, Homo sapiens
ctgtcatctctctggggc

SEQ ID NO: 4470551 - DNA, 14 bp, Homo sapiens
ctgtcatctttctt

SEQ ID NO: 4470552 - DNA, 20 bp, Homo sapiens
ctgtcatgaacatgttcctg

SEQ ID NO: 4470553 - DNA, 20 bp, Homo sapiens
ctgtcatggtcctttctgga

SEQ ID NO: 4470554 - DNA, 22 bp, Homo sapiens
ctgtcattatattctaattaaa

SEQ ID NO: 4470555 - DNA, 19 bp, Homo sapiens
ctgtccaaaagcgccctca

SEQ ID NO: 4470556 - DNA, 19 bp, Homo sapiens
ctgtccaaaggaggctggc

SEQ ID NO: 4470557 - DNA, 22 bp, Homo sapiens
ctgtccaaaggaggctggcagg

SEQ ID NO: 4470558 - DNA, 16 bp, Homo sapiens
ctgtccaacatggtga

SEQ ID NO: 4470559 - DNA, 15 bp, Homo sapiens
ctgtccagacagcct

SEQ ID NO: 4470560 - DNA, 16 bp, Homo sapiens
ctgtccagacagcctg

SEQ ID NO: 4470561 - DNA, 17 bp, Homo sapiens
ctgtccagacagcctgt

SEQ ID NO: 4470562 - DNA, 13 bp, Homo sapiens
ctgtccagctggg

SEQ ID NO: 4470563 - DNA, 20 bp, Homo sapiens
ctgtccagggaaacagcctc

SEQ ID NO: 4470564 - DNA, 21 bp, Homo sapiens
ctgtccagggaaacagcctct

SEQ ID NO: 4470565 - DNA, 12 bp, Homo sapiens
ctgtcccagcta

SEQ ID NO: 4470566 - DNA, 14 bp, Homo sapiens
ctgtcccagctacc

SEQ ID NO: 4470567 - DNA, 12 bp, Homo sapiens
ctgtcccaggcc

SEQ ID NO: 4470568 - DNA, 17 bp, Homo sapiens
ctgtcccagttgtggca

SEQ ID NO: 4470569 - DNA, 16 bp, Homo sapiens
ctgtcccattctagat

SEQ ID NO: 4470570 - DNA, 21 bp, Homo sapiens
ctgtcccattctagatcctgc

SEQ ID NO: 4470571 - DNA, 13 bp, Homo sapiens
ctgtcccccaggc

SEQ ID NO: 4470572 - DNA, 16 bp, Homo sapiens
ctgtccccttctctca

SEQ ID NO: 4470573 - DNA, 21 bp, Homo sapiens
ctgtccccttctctcatctct

SEQ ID NO: 4470574 - DNA, 17 bp, Homo sapiens
ctgtccctccgggacct

SEQ ID NO: 4470575 - DNA, 12 bp, Homo sapiens
ctgtccctgtca

SEQ ID NO: 4470576 - DNA, 14 bp, Homo sapiens
ctgtcccttgcctc

SEQ ID NO: 4470577 - DNA, 17 bp, Homo sapiens
ctgtcccttttccctta

SEQ ID NO: 4470578 - DNA, 15 bp, Homo sapiens
ctgtccggcccagtg

SEQ ID NO: 4470579 - DNA, 22 bp, Homo sapiens
ctgtccggcccagtgccactgc

SEQ ID NO: 4470580 - DNA, 18 bp, Homo sapiens
ctgtccgtttactccaag

SEQ ID NO: 4470581 - DNA, 15 bp, Homo sapiens
ctgtcctattatatt

SEQ ID NO: 4470582 - DNA, 21 bp, Homo sapiens
ctgtcctattatattcattct

SEQ ID NO: 4470583 - DNA, 12 bp, Homo sapiens
ctgtcctcctcg

SEQ ID NO: 4470584 - DNA, 23 bp, Homo sapiens
ctgtcctcctcggatcaccgaga

SEQ ID NO: 4470585 - DNA, 19 bp, Homo sapiens
ctgtcctcctggtgggtcc

SEQ ID NO: 4470586 - DNA, 11 bp, Homo sapiens
ctgtccttaac

SEQ ID NO: 4470587 - DNA, 20 bp, Homo sapiens
ctgtccttaacccacctctc

SEQ ID NO: 4470588 - DNA, 12 bp, Homo sapiens
ctgtccttccct

SEQ ID NO: 4470589 - DNA, 14 bp, Homo sapiens
ctgtccttccctgt

SEQ ID NO: 4470590 - DNA, 17 bp, Homo sapiens
ctgtcgcccaggctgga

SEQ ID NO: 4470591 - DNA, 16 bp, Homo sapiens
ctgtcgccccaggccc

SEQ ID NO: 4470592 - DNA, 11 bp, Homo sapiens
ctgtctacatt

SEQ ID NO: 4470593 - DNA, 15 bp, Homo sapiens
ctgtctagctgtttc

SEQ ID NO: 4470594 - DNA, 23 bp, Homo sapiens
ctgtctaggttaaagctaaactg

SEQ ID NO: 4470595 - DNA, 16 bp, Homo sapiens
ctgtctagtctctcct

SEQ ID NO: 4470596 - DNA, 23 bp, Homo sapiens
ctgtctcaaaaaaaaaaagaaaa

SEQ ID NO: 4470597 - DNA, 19 bp, Homo sapiens
ctgtctcaaagcataaaat

SEQ ID NO: 4470598 - DNA, 12 bp, Homo sapiens
ctgtctcacctg

SEQ ID NO: 4470599 - DNA, 17 bp, Homo sapiens
ctgtctcacctggactt

SEQ ID NO: 4470600 - DNA, 17 bp, Homo sapiens
ctgtctcactcttctgt

SEQ ID NO: 4470601 - DNA, 17 bp, Homo sapiens
ctgtctcatccatcatc

SEQ ID NO: 4470602 - DNA, 17 bp, Homo sapiens
ctgtctcatccccaggg

SEQ ID NO: 4470603 - DNA, 20 bp, Homo sapiens
ctgtctccatggccctgcaa

SEQ ID NO: 4470604 - DNA, 13 bp, Homo sapiens
ctgtctcccacgt

SEQ ID NO: 4470605 - DNA, 21 bp, Homo sapiens
ctgtctccctcctctgcccgg

SEQ ID NO: 4470606 - DNA, 24 bp, Homo sapiens
ctgtctcgggggggttttcatcta

SEQ ID NO: 4470607 - DNA, 22 bp, Homo sapiens
ctgtctctaaaaagaagccaca

SEQ ID NO: 4470608 - DNA, 23 bp, Homo sapiens
ctgtctctaaaaagaagccacag

SEQ ID NO: 4470609 - DNA, 23 bp, Homo sapiens
ctgtctctaccaaaaaaaggaag

SEQ ID NO: 4470610 - DNA, 12 bp, Homo sapiens
ctgtctctgcct

SEQ ID NO: 4470611 - DNA, 13 bp, Homo sapiens
ctgtctctgcctg

SEQ ID NO: 4470612 - DNA, 17 bp, Homo sapiens
ctgtctctgcctgcggc

SEQ ID NO: 4470613 - DNA, 20 bp, Homo sapiens
ctgtctgagtagtggccact

SEQ ID NO: 4470614 - DNA, 17 bp, Homo sapiens
ctgtctgatctgtgctt

SEQ ID NO: 4470615 - DNA, 12 bp, Homo sapiens
ctgtctgcttgc

SEQ ID NO: 4470616 - DNA, 22 bp, Homo sapiens
ctgtctgcttgcatctgcacat

SEQ ID NO: 4470617 - DNA, 23 bp, Homo sapiens
ctgtctgcttgcatctgcacata

SEQ ID NO: 4470618 - DNA, 12 bp, Homo sapiens
ctgtctggaaga

SEQ ID NO: 4470619 - DNA, 21 bp, Homo sapiens
ctgtctggaagacgtggctct

SEQ ID NO: 4470620 - DNA, 22 bp, Homo sapiens
ctgtctggctcggacccacccc

SEQ ID NO: 4470621 - DNA, 23 bp, Homo sapiens
ctgtctggctcggacccacccca

SEQ ID NO: 4470622 - DNA, 15 bp, Homo sapiens
ctgtctgggactcct

SEQ ID NO: 4470623 - DNA, 16 bp, Homo sapiens
ctgtctgtagagggcc

SEQ ID NO: 4470624 - DNA, 13 bp, Homo sapiens
ctgtctgtcacca

SEQ ID NO: 4470625 - DNA, 17 bp, Homo sapiens
ctgtctgtgcacatgcc

SEQ ID NO: 4470626 - DNA, 17 bp, Homo sapiens
ctgtctgttcccagccc

SEQ ID NO: 4470627 - DNA, 14 bp, Homo sapiens
ctgtctgttctttt

SEQ ID NO: 4470628 - DNA, 11 bp, Homo sapiens
ctgtcttccca

SEQ ID NO: 4470629 - DNA, 12 bp, Homo sapiens
ctgtcttcttca

SEQ ID NO: 4470630 - DNA, 19 bp, Homo sapiens
ctgtcttgactttttaaaa

SEQ ID NO: 4470631 - DNA, 18 bp, Homo sapiens
ctgtcttgttaatgcttt

SEQ ID NO: 4470632 - DNA, 22 bp, Homo sapiens
ctgtgaaaatagtgtaagaact

SEQ ID NO: 4470633 - DNA, 23 bp, Homo sapiens
ctgtgaaaatagtgtaagaactg

SEQ ID NO: 4470634 - DNA, 20 bp, Homo sapiens
ctgtgaaataccacaagcct

SEQ ID NO: 4470635 - DNA, 23 bp, Homo sapiens
ctgtgaaatatcatcacgtatgt

SEQ ID NO: 4470636 - DNA, 21 bp, Homo sapiens
ctgtgaaccaacccccatctc

SEQ ID NO: 4470637 - DNA, 17 bp, Homo sapiens
ctgtgaacttgactggg

SEQ ID NO: 4470638 - DNA, 19 bp, Homo sapiens
ctgtgaacttgactgggtg

SEQ ID NO: 4470639 - DNA, 23 bp, Homo sapiens
ctgtgaagagccggtggtgcccg

SEQ ID NO: 4470640 - DNA, 14 bp, Homo sapiens
ctgtgaagcctctc

SEQ ID NO: 4470641 - DNA, 17 bp, Homo sapiens
ctgtgaagcctttatct

SEQ ID NO: 4470642 - DNA, 15 bp, Homo sapiens
ctgtgaatacttgaa

SEQ ID NO: 4470643 - DNA, 17 bp, Homo sapiens
ctgtgaatggaggcaga

SEQ ID NO: 4470644 - DNA, 21 bp, Homo sapiens
ctgtgaatggaggcagagacc

SEQ ID NO: 4470645 - DNA, 23 bp, Homo sapiens
ctgtgaatggaggcagagacctc

SEQ ID NO: 4470646 - DNA, 19 bp, Homo sapiens
ctgtgaatttgtgtaagga

SEQ ID NO: 4470647 - DNA, 17 bp, Homo sapiens
ctgtgacatggtgcctg

SEQ ID NO: 4470648 - DNA, 24 bp, Homo sapiens
ctgtgacatggtgcctgagaggca

SEQ ID NO: 4470649 - DNA, 15 bp, Homo sapiens
ctgtgacccagaggg

SEQ ID NO: 4470650 - DNA, 15 bp, Homo sapiens
ctgtgacccatctgt

SEQ ID NO: 4470651 - DNA, 18 bp, Homo sapiens
ctgtgacccatctgtagt

SEQ ID NO: 4470652 - DNA, 17 bp, Homo sapiens
ctgtgactagatacaga

SEQ ID NO: 4470653 - DNA, 15 bp, Homo sapiens
ctgtgagacccccac

SEQ ID NO: 4470654 - DNA, 17 bp, Homo sapiens
ctgtgagacccccacac

SEQ ID NO: 4470655 - DNA, 23 bp, Homo sapiens
ctgtgagacccccacacctcagt

SEQ ID NO: 4470656 - DNA, 13 bp, Homo sapiens
ctgtgagatgtgt

SEQ ID NO: 4470657 - DNA, 21 bp, Homo sapiens
ctgtgagcatggggccaggaa

SEQ ID NO: 4470658 - DNA, 22 bp, Homo sapiens
ctgtgagtggttcaagcacact

SEQ ID NO: 4470659 - DNA, 16 bp, Homo sapiens
ctgtgatatgtctgct

SEQ ID NO: 4470660 - DNA, 23 bp, Homo sapiens
ctgtgatcaatatttttatatca

SEQ ID NO: 4470661 - DNA, 14 bp, Homo sapiens
ctgtgatctctgct

SEQ ID NO: 4470662 - DNA, 15 bp, Homo sapiens
ctgtgatctctgctg

SEQ ID NO: 4470663 - DNA, 17 bp, Homo sapiens
ctgtgatctctgctggg

SEQ ID NO: 4470664 - DNA, 17 bp, Homo sapiens
ctgtgatgatcctcata

SEQ ID NO: 4470665 - DNA, 15 bp, Homo sapiens
ctgtgattactcttt

SEQ ID NO: 4470666 - DNA, 15 bp, Homo sapiens
ctgtgcaaaaaaatt

SEQ ID NO: 4470667 - DNA, 15 bp, Homo sapiens
ctgtgcaatttctgt

SEQ ID NO: 4470668 - DNA, 19 bp, Homo sapiens
ctgtgcaatttctgtacat

SEQ ID NO: 4470669 - DNA, 18 bp, Homo sapiens
ctgtgcacatctgtgtct

SEQ ID NO: 4470670 - DNA, 15 bp, Homo sapiens
ctgtgcacatgcctc

SEQ ID NO: 4470671 - DNA, 19 bp, Homo sapiens
ctgtgcacccagaagaaga

SEQ ID NO: 4470672 - DNA, 16 bp, Homo sapiens
ctgtgcaggttcccac

SEQ ID NO: 4470673 - DNA, 22 bp, Homo sapiens
ctgtgcatccgcctgaaagtgt

SEQ ID NO: 4470674 - DNA, 17 bp, Homo sapiens
ctgtgccagaggccaga

SEQ ID NO: 4470675 - DNA, 20 bp, Homo sapiens
ctgtgccatgctgggccact

SEQ ID NO: 4470676 - DNA, 18 bp, Homo sapiens
ctgtgcccggcctgtgta

SEQ ID NO: 4470677 - DNA, 17 bp, Homo sapiens
ctgtgccgggaggcagc

SEQ ID NO: 4470678 - DNA, 21 bp, Homo sapiens
ctgtgccgggaggcagccaca

SEQ ID NO: 4470679 - DNA, 13 bp, Homo sapiens
ctgtgctatgaat

SEQ ID NO: 4470680 - DNA, 15 bp, Homo sapiens
ctgtgctcaccctct

SEQ ID NO: 4470681 - DNA, 12 bp, Homo sapiens
ctgtgctgctca

SEQ ID NO: 4470682 - DNA, 13 bp, Homo sapiens
ctgtgctggggca

SEQ ID NO: 4470683 - DNA, 17 bp, Homo sapiens
ctgtgctggggcacggc

SEQ ID NO: 4470684 - DNA, 19 bp, Homo sapiens
ctgtgctgtcctttaacat

SEQ ID NO: 4470685 - DNA, 14 bp, Homo sapiens
ctgtgctgtggaga

SEQ ID NO: 4470686 - DNA, 16 bp, Homo sapiens
ctgtgctttccagctc

SEQ ID NO: 4470687 - DNA, 17 bp, Homo sapiens
ctgtgctttccagctca

SEQ ID NO: 4470688 - DNA, 20 bp, Homo sapiens
ctgtgctttccagctcaccc

SEQ ID NO: 4470689 - DNA, 21 bp, Homo sapiens
ctgtgctttccagctcacccc

SEQ ID NO: 4470690 - DNA, 12 bp, Homo sapiens
ctgtgctttcta

SEQ ID NO: 4470691 - DNA, 15 bp, Homo sapiens
ctgtgctttctattg

SEQ ID NO: 4470692 - DNA, 20 bp, Homo sapiens
ctgtgctttctattgtacag

SEQ ID NO: 4470693 - DNA, 18 bp, Homo sapiens
ctgtggaacataaaaagg

SEQ ID NO: 4470694 - DNA, 12 bp, Homo sapiens
ctgtggaagcaa

SEQ ID NO: 4470695 - DNA, 18 bp, Homo sapiens
ctgtggaaggcagagaaa

SEQ ID NO: 4470696 - DNA, 15 bp, Homo sapiens
ctgtggaataaagat

SEQ ID NO: 4470697 - DNA, 20 bp, Homo sapiens
ctgtggaataaagatggtcc

SEQ ID NO: 4470698 - DNA, 23 bp, Homo sapiens
ctgtggacaggatgaggacagag

SEQ ID NO: 4470699 - DNA, 16 bp, Homo sapiens
ctgtggaggggcttgg

SEQ ID NO: 4470700 - DNA, 22 bp, Homo sapiens
ctgtggaggggcttgggcctgc

SEQ ID NO: 4470701 - DNA, 14 bp, Homo sapiens
ctgtggatgctgct

SEQ ID NO: 4470702 - DNA, 18 bp, Homo sapiens
ctgtggatgctgctgccc

SEQ ID NO: 4470703 - DNA, 19 bp, Homo sapiens
ctgtggatgctgctgcccc

SEQ ID NO: 4470704 - DNA, 21 bp, Homo sapiens
ctgtggatgctgctgcccctg

SEQ ID NO: 4470705 - DNA, 15 bp, Homo sapiens
ctgtggcactggcca

SEQ ID NO: 4470706 - DNA, 22 bp, Homo sapiens
ctgtggcagagttacagttctg

SEQ ID NO: 4470707 - DNA, 17 bp, Homo sapiens
ctgtggcaggaggagct

SEQ ID NO: 4470708 - DNA, 22 bp, Homo sapiens
ctgtggcaggaggagctgcctc

SEQ ID NO: 4470709 - DNA, 17 bp, Homo sapiens
ctgtggcatctttgcct

SEQ ID NO: 4470710 - DNA, 17 bp, Homo sapiens
ctgtggccatatatgct

SEQ ID NO: 4470711 - DNA, 19 bp, Homo sapiens
ctgtggcccctcccctgca

SEQ ID NO: 4470712 - DNA, 19 bp, Homo sapiens
ctgtggccggtgccagctg

SEQ ID NO: 4470713 - DNA, 15 bp, Homo sapiens
ctgtggccgtctcct

SEQ ID NO: 4470714 - DNA, 17 bp, Homo sapiens
ctgtggccgtctcctcc

SEQ ID NO: 4470715 - DNA, 19 bp, Homo sapiens
ctgtggccgtctcctccct

SEQ ID NO: 4470716 - DNA, 20 bp, Homo sapiens
ctgtggccgtctcctccctc

SEQ ID NO: 4470717 - DNA, 18 bp, Homo sapiens
ctgtggcggtgcctgggt

SEQ ID NO: 4470718 - DNA, 22 bp, Homo sapiens
ctgtggctgtgtgtctgcttgt

SEQ ID NO: 4470719 - DNA, 19 bp, Homo sapiens
ctgtggctttttgttcaga

SEQ ID NO: 4470720 - DNA, 16 bp, Homo sapiens
ctgtgggagagcgaag

SEQ ID NO: 4470721 - DNA, 15 bp, Homo sapiens
ctgtgggcaatttag

SEQ ID NO: 4470722 - DNA, 12 bp, Homo sapiens
ctgtgggcagca

SEQ ID NO: 4470723 - DNA, 16 bp, Homo sapiens
ctgtgggcagcaccct

SEQ ID NO: 4470724 - DNA, 23 bp, Homo sapiens
ctgtgggcagcaccctcccccgc

SEQ ID NO: 4470725 - DNA, 16 bp, Homo sapiens
ctgtgggcggctcctg

SEQ ID NO: 4470726 - DNA, 19 bp, Homo sapiens
ctgtgggcggctcctggtg

SEQ ID NO: 4470727 - DNA, 21 bp, Homo sapiens
ctgtgggcggctcctggtgct

SEQ ID NO: 4470728 - DNA, 17 bp, Homo sapiens
ctgtggggactgaacct

SEQ ID NO: 4470729 - DNA, 21 bp, Homo sapiens
ctgtggggggtaatccctgct

SEQ ID NO: 4470730 - DNA, 14 bp, Homo sapiens
ctgtgggggtggcc

SEQ ID NO: 4470731 - DNA, 14 bp, Homo sapiens
ctgtgggtctctga

SEQ ID NO: 4470732 - DNA, 20 bp, Homo sapiens
ctgtgggtctctgaagggac

SEQ ID NO: 4470733 - DNA, 22 bp, Homo sapiens
ctgtgggtctgggagtcacaca

SEQ ID NO: 4470734 - DNA, 18 bp, Homo sapiens
ctgtgggtgttctttcct

SEQ ID NO: 4470735 - DNA, 19 bp, Homo sapiens
ctgtgggtgttctttcctg

SEQ ID NO: 4470736 - DNA, 13 bp, Homo sapiens
ctgtggtcccttc

SEQ ID NO: 4470737 - DNA, 20 bp, Homo sapiens
ctgtggtcgtcaactttcct

SEQ ID NO: 4470738 - DNA, 22 bp, Homo sapiens
ctgtggtgacttctgctgctgg

SEQ ID NO: 4470739 - DNA, 15 bp, Homo sapiens
ctgtggtttcatgtt

SEQ ID NO: 4470740 - DNA, 16 bp, Homo sapiens
ctgtggtttcatgtta

SEQ ID NO: 4470741 - DNA, 17 bp, Homo sapiens
ctgtggtttcatgttag

SEQ ID NO: 4470742 - DNA, 18 bp, Homo sapiens
ctgtggtttcatgttagt

SEQ ID NO: 4470743 - DNA, 23 bp, Homo sapiens
ctgtggtttggttggggcttcac

SEQ ID NO: 4470744 - DNA, 16 bp, Homo sapiens
ctgtggttttattaca

SEQ ID NO: 4470745 - DNA, 15 bp, Homo sapiens
ctgtgtaacatctgc

SEQ ID NO: 4470746 - DNA, 16 bp, Homo sapiens
ctgtgtaacatctgcc

SEQ ID NO: 4470747 - DNA, 20 bp, Homo sapiens
ctgtgtacaactttttaaat

SEQ ID NO: 4470748 - DNA, 17 bp, Homo sapiens
ctgtgtacataactgaa

SEQ ID NO: 4470749 - DNA, 17 bp, Homo sapiens
ctgtgtacctcactgtc

SEQ ID NO: 4470750 - DNA, 14 bp, Homo sapiens
ctgtgtactgtgtc

SEQ ID NO: 4470751 - DNA, 19 bp, Homo sapiens
ctgtgtataggaatttgta

SEQ ID NO: 4470752 - DNA, 13 bp, Homo sapiens
ctgtgtatatctc

SEQ ID NO: 4470753 - DNA, 17 bp, Homo sapiens
ctgtgtattaaaccttt

SEQ ID NO: 4470754 - DNA, 14 bp, Homo sapiens
ctgtgtattaacat

SEQ ID NO: 4470755 - DNA, 19 bp, Homo sapiens
ctgtgtattccaagacatg

SEQ ID NO: 4470756 - DNA, 21 bp, Homo sapiens
ctgtgtatttaattgtaaact

SEQ ID NO: 4470757 - DNA, 22 bp, Homo sapiens
ctgtgtatttaattgtaaactg

SEQ ID NO: 4470758 - DNA, 23 bp, Homo sapiens
ctgtgtatttaattgtaaactgt

SEQ ID NO: 4470759 - DNA, 16 bp, Homo sapiens
ctgtgtcagagcccag

SEQ ID NO: 4470760 - DNA, 17 bp, Homo sapiens
ctgtgtcagagcccagc

SEQ ID NO: 4470761 - DNA, 18 bp, Homo sapiens
ctgtgtcatttcttcact

SEQ ID NO: 4470762 - DNA, 18 bp, Homo sapiens
ctgtgtcccatgtcccgt

SEQ ID NO: 4470763 - DNA, 22 bp, Homo sapiens
ctgtgtcccatgtcccgtgtct

SEQ ID NO: 4470764 - DNA, 16 bp, Homo sapiens
ctgtgtcctaaggccc

SEQ ID NO: 4470765 - DNA, 14 bp, Homo sapiens
ctgtgtccttgcac

SEQ ID NO: 4470766 - DNA, 15 bp, Homo sapiens
ctgtgtctcctctca

SEQ ID NO: 4470767 - DNA, 22 bp, Homo sapiens
ctgtgtctgcccaatgaataat

SEQ ID NO: 4470768 - DNA, 20 bp, Homo sapiens
ctgtgtgaaactttcattcc

SEQ ID NO: 4470769 - DNA, 14 bp, Homo sapiens
ctgtgtgattaaaa

SEQ ID NO: 4470770 - DNA, 21 bp, Homo sapiens
ctgtgtgcaactaactgactc

SEQ ID NO: 4470771 - DNA, 23 bp, Homo sapiens
ctgtgtgtgtgaatgaacactct

SEQ ID NO: 4470772 - DNA, 17 bp, Homo sapiens
ctgtgtgtttatgtgtg

SEQ ID NO: 4470773 - DNA, 16 bp, Homo sapiens
ctgtgttatgaaaata

SEQ ID NO: 4470774 - DNA, 13 bp, Homo sapiens
ctgtgttctgggc

SEQ ID NO: 4470775 - DNA, 15 bp, Homo sapiens
ctgtgttctgggctg

SEQ ID NO: 4470776 - DNA, 14 bp, Homo sapiens
ctgtgttgcttcaa

SEQ ID NO: 4470777 - DNA, 18 bp, Homo sapiens
ctgtgtttcacttaatgt

SEQ ID NO: 4470778 - DNA, 21 bp, Homo sapiens
ctgtgtttcacttaatgtttc

SEQ ID NO: 4470779 - DNA, 22 bp, Homo sapiens
ctgtgtttcattacttgaatgt

SEQ ID NO: 4470780 - DNA, 17 bp, Homo sapiens
ctgtgtttttttctaaa

SEQ ID NO: 4470781 - DNA, 15 bp, Homo sapiens
ctgttaatttatagg

SEQ ID NO: 4470782 - DNA, 20 bp, Homo sapiens
ctgttacacactaacatcaa

SEQ ID NO: 4470783 - DNA, 15 bp, Homo sapiens
ctgttacagtaatgt

SEQ ID NO: 4470784 - DNA, 18 bp, Homo sapiens
ctgttaccaaatctcagt

SEQ ID NO: 4470785 - DNA, 16 bp, Homo sapiens
ctgttacgtttgaagt

SEQ ID NO: 4470786 - DNA, 13 bp, Homo sapiens
ctgttactgcttc

SEQ ID NO: 4470787 - DNA, 17 bp, Homo sapiens
ctgttactgcttctctt

SEQ ID NO: 4470788 - DNA, 20 bp, Homo sapiens
ctgttactgcttctctttgt

SEQ ID NO: 4470789 - DNA, 15 bp, Homo sapiens
ctgttactttggcaa

SEQ ID NO: 4470790 - DNA, 17 bp, Homo sapiens
ctgttagaacactattt

SEQ ID NO: 4470791 - DNA, 18 bp, Homo sapiens
ctgttatcaaactgctgt

SEQ ID NO: 4470792 - DNA, 12 bp, Homo sapiens
ctgttcacccac

SEQ ID NO: 4470793 - DNA, 18 bp, Homo sapiens
ctgttcacccacagggct

SEQ ID NO: 4470794 - DNA, 17 bp, Homo sapiens
ctgttcagcattcttag

SEQ ID NO: 4470795 - DNA, 11 bp, Homo sapiens
ctgttccaaat

SEQ ID NO: 4470796 - DNA, 18 bp, Homo sapiens
ctgttccaaattcagttt

SEQ ID NO: 4470797 - DNA, 13 bp, Homo sapiens
ctgttccagactc

SEQ ID NO: 4470798 - DNA, 15 bp, Homo sapiens
ctgttccaggccctc

SEQ ID NO: 4470799 - DNA, 20 bp, Homo sapiens
ctgttccaggccctccagtg

SEQ ID NO: 4470800 - DNA, 15 bp, Homo sapiens
ctgttccatgcaact

SEQ ID NO: 4470801 - DNA, 21 bp, Homo sapiens
ctgttccatgttctatttttg

SEQ ID NO: 4470802 - DNA, 12 bp, Homo sapiens
ctgttcccagcc

SEQ ID NO: 4470803 - DNA, 16 bp, Homo sapiens
ctgttcccagcccctg

SEQ ID NO: 4470804 - DNA, 18 bp, Homo sapiens
ctgttcccagcccctgca

SEQ ID NO: 4470805 - DNA, 15 bp, Homo sapiens
ctgttccccctgtgc

SEQ ID NO: 4470806 - DNA, 13 bp, Homo sapiens
ctgttcccttgca

SEQ ID NO: 4470807 - DNA, 16 bp, Homo sapiens
ctgttcctgttcagta

SEQ ID NO: 4470808 - DNA, 14 bp, Homo sapiens
ctgttccttttata

SEQ ID NO: 4470809 - DNA, 13 bp, Homo sapiens
ctgttcggaaggg

SEQ ID NO: 4470810 - DNA, 14 bp, Homo sapiens
ctgttctagttttt

SEQ ID NO: 4470811 - DNA, 19 bp, Homo sapiens
ctgttctagttttttactt

SEQ ID NO: 4470812 - DNA, 14 bp, Homo sapiens
ctgttctcagcgtt

SEQ ID NO: 4470813 - DNA, 17 bp, Homo sapiens
ctgttctccctttctct

SEQ ID NO: 4470814 - DNA, 20 bp, Homo sapiens
ctgttctccctttctctctc

SEQ ID NO: 4470815 - DNA, 19 bp, Homo sapiens
ctgttctgtggttcctctg

SEQ ID NO: 4470816 - DNA, 16 bp, Homo sapiens
ctgttcttgacaatca

SEQ ID NO: 4470817 - DNA, 22 bp, Homo sapiens
ctgttctttaaatgtctgaaat

SEQ ID NO: 4470818 - DNA, 21 bp, Homo sapiens
ctgttgacatatttaatgttt

SEQ ID NO: 4470819 - DNA, 22 bp, Homo sapiens
ctgttgacatatttaatgtttt

SEQ ID NO: 4470820 - DNA, 14 bp, Homo sapiens
ctgttgatctttca

SEQ ID NO: 4470821 - DNA, 16 bp, Homo sapiens
ctgttgatctttcact

SEQ ID NO: 4470822 - DNA, 21 bp, Homo sapiens
ctgttgattaatttctgccat

SEQ ID NO: 4470823 - DNA, 22 bp, Homo sapiens
ctgttgcatttttttattagta

SEQ ID NO: 4470824 - DNA, 17 bp, Homo sapiens
ctgttgccgagcccagc

SEQ ID NO: 4470825 - DNA, 18 bp, Homo sapiens
ctgttgcctaattggaaa

SEQ ID NO: 4470826 - DNA, 18 bp, Homo sapiens
ctgttgccttatttctca

SEQ ID NO: 4470827 - DNA, 14 bp, Homo sapiens
ctgttggataatta

SEQ ID NO: 4470828 - DNA, 16 bp, Homo sapiens
ctgttggattccatgc

SEQ ID NO: 4470829 - DNA, 18 bp, Homo sapiens
ctgttggattccatgcta

SEQ ID NO: 4470830 - DNA, 17 bp, Homo sapiens
ctgttggcaggcccact

SEQ ID NO: 4470831 - DNA, 23 bp, Homo sapiens
ctgttggcctaagtgcctcttct

SEQ ID NO: 4470832 - DNA, 14 bp, Homo sapiens
ctgttgtacaagct

SEQ ID NO: 4470833 - DNA, 22 bp, Homo sapiens
ctgtttaaagtcacatccctgt

SEQ ID NO: 4470834 - DNA, 20 bp, Homo sapiens
ctgtttactcccttctgtag

SEQ ID NO: 4470835 - DNA, 22 bp, Homo sapiens
ctgtttactcccttctgtagtt

SEQ ID NO: 4470836 - DNA, 17 bp, Homo sapiens
ctgtttagtagcagtga

SEQ ID NO: 4470837 - DNA, 20 bp, Homo sapiens
ctgtttagtagcagtgattg

SEQ ID NO: 4470838 - DNA, 20 bp, Homo sapiens
ctgtttatatgtgttgaaaa

SEQ ID NO: 4470839 - DNA, 18 bp, Homo sapiens
ctgtttatggcctcagct

SEQ ID NO: 4470840 - DNA, 18 bp, Homo sapiens
ctgtttattaatcttagt

SEQ ID NO: 4470841 - DNA, 14 bp, Homo sapiens
ctgtttcctgacag

SEQ ID NO: 4470842 - DNA, 23 bp, Homo sapiens
ctgtttcctgacagatgcctggt

SEQ ID NO: 4470843 - DNA, 16 bp, Homo sapiens
ctgtttctatcctgtt

SEQ ID NO: 4470844 - DNA, 17 bp, Homo sapiens
ctgtttctctgctgtca

SEQ ID NO: 4470845 - DNA, 20 bp, Homo sapiens
ctgtttctggaagactgctc

SEQ ID NO: 4470846 - DNA, 20 bp, Homo sapiens
ctgtttgaagaaaaaggaca

SEQ ID NO: 4470847 - DNA, 15 bp, Homo sapiens
ctgtttgacacctct

SEQ ID NO: 4470848 - DNA, 23 bp, Homo sapiens
ctgtttgacacctcttttttcgt

SEQ ID NO: 4470849 - DNA, 21 bp, Homo sapiens
ctgtttgaggaaagcaagaat

SEQ ID NO: 4470850 - DNA, 18 bp, Homo sapiens
ctgtttgatataccaaat

SEQ ID NO: 4470851 - DNA, 21 bp, Homo sapiens
ctgtttgatataccaaattaa

SEQ ID NO: 4470852 - DNA, 19 bp, Homo sapiens
ctgtttgcttgtagttgaa

SEQ ID NO: 4470853 - DNA, 23 bp, Homo sapiens
ctgtttggaaataaatcttccta

SEQ ID NO: 4470854 - DNA, 20 bp, Homo sapiens
ctgtttgtttgacaaagaaa

SEQ ID NO: 4470855 - DNA, 23 bp, Homo sapiens
ctgttttaaaatgtgaggcaata

SEQ ID NO: 4470856 - DNA, 18 bp, Homo sapiens
ctgttttacagctgcctt

SEQ ID NO: 4470857 - DNA, 15 bp, Homo sapiens
ctgttttacaggaaa

SEQ ID NO: 4470858 - DNA, 23 bp, Homo sapiens
ctgttttatatattatgtgaaga

SEQ ID NO: 4470859 - DNA, 21 bp, Homo sapiens
ctgttttccctctgctgcttt

SEQ ID NO: 4470860 - DNA, 15 bp, Homo sapiens
ctgttttctgtaaat

SEQ ID NO: 4470861 - DNA, 18 bp, Homo sapiens
ctgttttcttctcagtct

SEQ ID NO: 4470862 - DNA, 16 bp, Homo sapiens
ctgttttgcctcccca

SEQ ID NO: 4470863 - DNA, 20 bp, Homo sapiens
ctgttttgtggtttggaata

SEQ ID NO: 4470864 - DNA, 15 bp, Homo sapiens
ctgttttgttaatat

SEQ ID NO: 4470865 - DNA, 16 bp, Homo sapiens
ctgtttttagtgctga

SEQ ID NO: 4470866 - DNA, 12 bp, Homo sapiens
ctgtttttcaca

SEQ ID NO: 4470867 - DNA, 15 bp, Homo sapiens
ctgtttttcacattt

SEQ ID NO: 4470868 - DNA, 13 bp, Homo sapiens
ctgtttttccggt

SEQ ID NO: 4470869 - DNA, 20 bp, Homo sapiens
ctgtttttggctgttttccc

SEQ ID NO: 4470870 - DNA, 20 bp, Homo sapiens
cttaaaaaaaaaaaaaagct

SEQ ID NO: 4470871 - DNA, 21 bp, Homo sapiens
cttaaaaaaaaaaaaaagctt

SEQ ID NO: 4470872 - DNA, 22 bp, Homo sapiens
cttaaaaaaaaaaaaaagcttt

SEQ ID NO: 4470873 - DNA, 23 bp, Homo sapiens
cttaaaaaaaaaaaaaagcttta

SEQ ID NO: 4470874 - DNA, 21 bp, Homo sapiens
cttaaaaaaacacggaagcac

SEQ ID NO: 4470875 - DNA, 12 bp, Homo sapiens
cttaaaaatggt

SEQ ID NO: 4470876 - DNA, 21 bp, Homo sapiens
cttaaaaattaaattggaaag

SEQ ID NO: 4470877 - DNA, 21 bp, Homo sapiens
cttaaaaccaaagagggcttc

SEQ ID NO: 4470878 - DNA, 13 bp, Homo sapiens
cttaaaactataa

SEQ ID NO: 4470879 - DNA, 18 bp, Homo sapiens
cttaaaagcatcataata

SEQ ID NO: 4470880 - DNA, 14 bp, Homo sapiens
cttaaaatatgtga

SEQ ID NO: 4470881 - DNA, 19 bp, Homo sapiens
cttaaaatatgtgaagttt

SEQ ID NO: 4470882 - DNA, 13 bp, Homo sapiens
cttaaaatgcaat

SEQ ID NO: 4470883 - DNA, 21 bp, Homo sapiens
cttaaaattgatattatatta

SEQ ID NO: 4470884 - DNA, 13 bp, Homo sapiens
cttaaacaaaaat

SEQ ID NO: 4470885 - DNA, 18 bp, Homo sapiens
cttaaacacaggctgtcc

SEQ ID NO: 4470886 - DNA, 16 bp, Homo sapiens
cttaaacccatacaat

SEQ ID NO: 4470887 - DNA, 17 bp, Homo sapiens
cttaaacccatacaatg

SEQ ID NO: 4470888 - DNA, 20 bp, Homo sapiens
cttaaacccatacaatgtat

SEQ ID NO: 4470889 - DNA, 15 bp, Homo sapiens
cttaaacctggaatc

SEQ ID NO: 4470890 - DNA, 16 bp, Homo sapiens
cttaaacttgacccag

SEQ ID NO: 4470891 - DNA, 14 bp, Homo sapiens
cttaaacttgtgaa

SEQ ID NO: 4470892 - DNA, 14 bp, Homo sapiens
cttaaactttgtca

SEQ ID NO: 4470893 - DNA, 20 bp, Homo sapiens
cttaaactttgtcacttctg

SEQ ID NO: 4470894 - DNA, 14 bp, Homo sapiens
cttaaagacaaatt

SEQ ID NO: 4470895 - DNA, 13 bp, Homo sapiens
cttaaagcatttc

SEQ ID NO: 4470896 - DNA, 15 bp, Homo sapiens
cttaaagcttgattt

SEQ ID NO: 4470897 - DNA, 21 bp, Homo sapiens
cttaaagcttgatttgatctt

SEQ ID NO: 4470898 - DNA, 21 bp, Homo sapiens
cttaaataataaacagtggaa

SEQ ID NO: 4470899 - DNA, 22 bp, Homo sapiens
cttaaataggaaagtttcttca

SEQ ID NO: 4470900 - DNA, 16 bp, Homo sapiens
cttaaatcatttggtt

SEQ ID NO: 4470901 - DNA, 23 bp, Homo sapiens
cttaaatggtgtaattttgtcct

SEQ ID NO: 4470902 - DNA, 12 bp, Homo sapiens
cttaaattaaac

SEQ ID NO: 4470903 - DNA, 14 bp, Homo sapiens
cttaaattaaacaa

SEQ ID NO: 4470904 - DNA, 15 bp, Homo sapiens
cttaaattaaacaat

SEQ ID NO: 4470905 - DNA, 18 bp, Homo sapiens
cttaaattatatatttat

SEQ ID NO: 4470906 - DNA, 12 bp, Homo sapiens
cttaaattcatt

SEQ ID NO: 4470907 - DNA, 20 bp, Homo sapiens
cttaaattcatttctagact

SEQ ID NO: 4470908 - DNA, 14 bp, Homo sapiens
cttaaattcctcaa

SEQ ID NO: 4470909 - DNA, 14 bp, Homo sapiens
cttaaatttcagaa

SEQ ID NO: 4470910 - DNA, 16 bp, Homo sapiens
cttaaatttcagaatt

SEQ ID NO: 4470911 - DNA, 13 bp, Homo sapiens
cttaaatttctta

SEQ ID NO: 4470912 - DNA, 20 bp, Homo sapiens
cttaaatttcttatgtgaca

SEQ ID NO: 4470913 - DNA, 22 bp, Homo sapiens
cttaaatttcttatgtgacatt

SEQ ID NO: 4470914 - DNA, 16 bp, Homo sapiens
cttaaattttcttcct

SEQ ID NO: 4470915 - DNA, 17 bp, Homo sapiens
cttaaattttcttcctt

SEQ ID NO: 4470916 - DNA, 14 bp, Homo sapiens
cttaacccacctct

SEQ ID NO: 4470917 - DNA, 22 bp, Homo sapiens
cttaacccacctctcctgccct

SEQ ID NO: 4470918 - DNA, 12 bp, Homo sapiens
cttaacctcagg

SEQ ID NO: 4470919 - DNA, 11 bp, Homo sapiens
cttaacctttg

SEQ ID NO: 4470920 - DNA, 19 bp, Homo sapiens
cttaactacttatctctaa

SEQ ID NO: 4470921 - DNA, 15 bp, Homo sapiens
cttaactgtatttca

SEQ ID NO: 4470922 - DNA, 22 bp, Homo sapiens
cttaacttccatgttctgggtg

SEQ ID NO: 4470923 - DNA, 23 bp, Homo sapiens
cttaacttccatgttctgggtga

SEQ ID NO: 4470924 - DNA, 14 bp, Homo sapiens
cttaacttcttgct

SEQ ID NO: 4470925 - DNA, 21 bp, Homo sapiens
cttaacttcttgcttctttct

SEQ ID NO: 4470926 - DNA, 12 bp, Homo sapiens
cttaacttgttt

SEQ ID NO: 4470927 - DNA, 20 bp, Homo sapiens
cttaagaattcaaatttgta

SEQ ID NO: 4470928 - DNA, 22 bp, Homo sapiens
cttaagaattcaaatttgtaat

SEQ ID NO: 4470929 - DNA, 19 bp, Homo sapiens
cttaagacagcatgtgtta

SEQ ID NO: 4470930 - DNA, 14 bp, Homo sapiens
cttaagatattgaa

SEQ ID NO: 4470931 - DNA, 20 bp, Homo sapiens
cttaagattaattttctctt

SEQ ID NO: 4470932 - DNA, 13 bp, Homo sapiens
cttaagcacaatt

SEQ ID NO: 4470933 - DNA, 16 bp, Homo sapiens
cttaagcaggtttgtt

SEQ ID NO: 4470934 - DNA, 20 bp, Homo sapiens
cttaagcagtaatctgtcag

SEQ ID NO: 4470935 - DNA, 18 bp, Homo sapiens
cttaagcatctggctcta

SEQ ID NO: 4470936 - DNA, 15 bp, Homo sapiens
cttaaggctcttttg

SEQ ID NO: 4470937 - DNA, 19 bp, Homo sapiens
cttaagggtcactggcctc

SEQ ID NO: 4470938 - DNA, 17 bp, Homo sapiens
cttaagggttgcttgct

SEQ ID NO: 4470939 - DNA, 16 bp, Homo sapiens
cttaagtgtaaatgaa

SEQ ID NO: 4470940 - DNA, 16 bp, Homo sapiens
cttaagtgttcatttt

SEQ ID NO: 4470941 - DNA, 12 bp, Homo sapiens
cttaataataat

SEQ ID NO: 4470942 - DNA, 13 bp, Homo sapiens
cttaataataatg

SEQ ID NO: 4470943 - DNA, 18 bp, Homo sapiens
cttaatactaccttgaaa

SEQ ID NO: 4470944 - DNA, 22 bp, Homo sapiens
cttaatagctgtagttttccct

SEQ ID NO: 4470945 - DNA, 13 bp, Homo sapiens
cttaatataaatt

SEQ ID NO: 4470946 - DNA, 14 bp, Homo sapiens
cttaatataaattc

SEQ ID NO: 4470947 - DNA, 17 bp, Homo sapiens
cttaatatattcccaag

SEQ ID NO: 4470948 - DNA, 12 bp, Homo sapiens
cttaatatttct

SEQ ID NO: 4470949 - DNA, 15 bp, Homo sapiens
cttaatatttcttca

SEQ ID NO: 4470950 - DNA, 21 bp, Homo sapiens
cttaatcaagatttttttcct

SEQ ID NO: 4470951 - DNA, 14 bp, Homo sapiens
cttaatctttgaaa

SEQ ID NO: 4470952 - DNA, 16 bp, Homo sapiens
cttaatgacaacactt

SEQ ID NO: 4470953 - DNA, 18 bp, Homo sapiens
cttaatgccactaaattg

SEQ ID NO: 4470954 - DNA, 16 bp, Homo sapiens
cttaattattgatgtt

SEQ ID NO: 4470955 - DNA, 14 bp, Homo sapiens
cttaattgcaagtc

SEQ ID NO: 4470956 - DNA, 18 bp, Homo sapiens
cttaattgcaagtctgcc

SEQ ID NO: 4470957 - DNA, 13 bp, Homo sapiens
cttaattgtgttt

SEQ ID NO: 4470958 - DNA, 23 bp, Homo sapiens
cttaattgttctgctttttctgt

SEQ ID NO: 4470959 - DNA, 15 bp, Homo sapiens
cttaatttaattgct

SEQ ID NO: 4470960 - DNA, 21 bp, Homo sapiens
cttaatttaattgctttgaag

SEQ ID NO: 4470961 - DNA, 20 bp, Homo sapiens
cttaatttacttaagtgttc

SEQ ID NO: 4470962 - DNA, 19 bp, Homo sapiens
cttaatttcaaatctgtaa

SEQ ID NO: 4470963 - DNA, 23 bp, Homo sapiens
cttaatttcctttttgacactga

SEQ ID NO: 4470964 - DNA, 15 bp, Homo sapiens
cttaatttgaaatct

SEQ ID NO: 4470965 - DNA, 16 bp, Homo sapiens
cttacaaaatacacat

SEQ ID NO: 4470966 - DNA, 17 bp, Homo sapiens
cttacaagcttaaagct

SEQ ID NO: 4470967 - DNA, 13 bp, Homo sapiens
cttacagcaggca

SEQ ID NO: 4470968 - DNA, 20 bp, Homo sapiens
cttacataaaccatttttgt

SEQ ID NO: 4470969 - DNA, 19 bp, Homo sapiens
cttaccaggcaccaaaaga

SEQ ID NO: 4470970 - DNA, 20 bp, Homo sapiens
cttaccccttagcctccctg

SEQ ID NO: 4470971 - DNA, 16 bp, Homo sapiens
cttacctactttcttc

SEQ ID NO: 4470972 - DNA, 13 bp, Homo sapiens
cttacctcctgcc

SEQ ID NO: 4470973 - DNA, 23 bp, Homo sapiens
cttacgtttaagcttaacatttc

SEQ ID NO: 4470974 - DNA, 14 bp, Homo sapiens
cttactaaatcttc

SEQ ID NO: 4470975 - DNA, 12 bp, Homo sapiens
cttactaggaag

SEQ ID NO: 4470976 - DNA, 15 bp, Homo sapiens
cttactcacctctct

SEQ ID NO: 4470977 - DNA, 18 bp, Homo sapiens
cttactcacctctctcta

SEQ ID NO: 4470978 - DNA, 15 bp, Homo sapiens
cttactgatatattt

SEQ ID NO: 4470979 - DNA, 22 bp, Homo sapiens
cttacttgccaagaaaatgaag

SEQ ID NO: 4470980 - DNA, 20 bp, Homo sapiens
cttactttacctctctgtca

SEQ ID NO: 4470981 - DNA, 20 bp, Homo sapiens
cttagaaacactgcaaattt

SEQ ID NO: 4470982 - DNA, 20 bp, Homo sapiens
cttagaacagtggaaactat

SEQ ID NO: 4470983 - DNA, 17 bp, Homo sapiens
cttagaagaatattgta

SEQ ID NO: 4470984 - DNA, 17 bp, Homo sapiens
cttagaagtggaccagg

SEQ ID NO: 4470985 - DNA, 22 bp, Homo sapiens
cttagaagtggaccaggacagg

SEQ ID NO: 4470986 - DNA, 13 bp, Homo sapiens
cttagaatgccat

SEQ ID NO: 4470987 - DNA, 22 bp, Homo sapiens
cttagacctcctaaatgcccca

SEQ ID NO: 4470988 - DNA, 17 bp, Homo sapiens
cttagacctgccagcca

SEQ ID NO: 4470989 - DNA, 18 bp, Homo sapiens
cttagactctagtattta

SEQ ID NO: 4470990 - DNA, 19 bp, Homo sapiens
cttagagccaagtgtcttt

SEQ ID NO: 4470991 - DNA, 14 bp, Homo sapiens
cttagagccaggca

SEQ ID NO: 4470992 - DNA, 15 bp, Homo sapiens
cttagagccaggcac

SEQ ID NO: 4470993 - DNA, 17 bp, Homo sapiens
cttagagccaggcacac

SEQ ID NO: 4470994 - DNA, 17 bp, Homo sapiens
cttagagtttctgtttg

SEQ ID NO: 4470995 - DNA, 12 bp, Homo sapiens
cttagataactt

SEQ ID NO: 4470996 - DNA, 18 bp, Homo sapiens
cttagatgttctaagtct

SEQ ID NO: 4470997 - DNA, 14 bp, Homo sapiens
cttagattcttaat

SEQ ID NO: 4470998 - DNA, 13 bp, Homo sapiens
cttagatttcata

SEQ ID NO: 4470999 - DNA, 21 bp, Homo sapiens
cttagatttcatagttcagaa

SEQ ID NO: 4471000 - DNA, 16 bp, Homo sapiens
cttagcaccttcaggg

SEQ ID NO: 4471001 - DNA, 16 bp, Homo sapiens
cttagcagccctggat

SEQ ID NO: 4471002 - DNA, 17 bp, Homo sapiens
cttagcagccctggatg

SEQ ID NO: 4471003 - DNA, 18 bp, Homo sapiens
cttagcagccctggatgg

SEQ ID NO: 4471004 - DNA, 22 bp, Homo sapiens
cttagccatttttcaaagcaat

SEQ ID NO: 4471005 - DNA, 18 bp, Homo sapiens
cttagcccaagaggtctg

SEQ ID NO: 4471006 - DNA, 11 bp, Homo sapiens
cttagcctccc

SEQ ID NO: 4471007 - DNA, 14 bp, Homo sapiens
cttagcctctccca

SEQ ID NO: 4471008 - DNA, 15 bp, Homo sapiens
cttagcctctcccac

SEQ ID NO: 4471009 - DNA, 16 bp, Homo sapiens
cttagcgtcaagacat

SEQ ID NO: 4471010 - DNA, 19 bp, Homo sapiens
cttagcgtcaagacatttg

SEQ ID NO: 4471011 - DNA, 23 bp, Homo sapiens
cttagcgtcaagacatttgctga

SEQ ID NO: 4471012 - DNA, 17 bp, Homo sapiens
cttagcgttctggactc

SEQ ID NO: 4471013 - DNA, 19 bp, Homo sapiens
cttagcgttctggactctg

SEQ ID NO: 4471014 - DNA, 24 bp, Homo sapiens
cttagcgttctggactctgcccca

SEQ ID NO: 4471015 - DNA, 17 bp, Homo sapiens
cttagctatccttggct

SEQ ID NO: 4471016 - DNA, 11 bp, Homo sapiens
cttagcttcag

SEQ ID NO: 4471017 - DNA, 14 bp, Homo sapiens
cttagcttcaggaa

SEQ ID NO: 4471018 - DNA, 15 bp, Homo sapiens
cttagcttcaggaac

SEQ ID NO: 4471019 - DNA, 18 bp, Homo sapiens
cttagcttcaggaacctc

SEQ ID NO: 4471020 - DNA, 16 bp, Homo sapiens
cttagctttagaaaca

SEQ ID NO: 4471021 - DNA, 20 bp, Homo sapiens
cttagcttttgatgtctcca

SEQ ID NO: 4471022 - DNA, 23 bp, Homo sapiens
cttaggctttgtatgacagtgaa

SEQ ID NO: 4471023 - DNA, 12 bp, Homo sapiens
cttagggaaaga

SEQ ID NO: 4471024 - DNA, 14 bp, Homo sapiens
cttagggaaagatg

SEQ ID NO: 4471025 - DNA, 21 bp, Homo sapiens
cttagggacagtcaaaaccaa

SEQ ID NO: 4471026 - DNA, 18 bp, Homo sapiens
cttagtaagtaatatcaa

SEQ ID NO: 4471027 - DNA, 12 bp, Homo sapiens
cttagtaagtat

SEQ ID NO: 4471028 - DNA, 18 bp, Homo sapiens
cttagtatagtagaaaga

SEQ ID NO: 4471029 - DNA, 13 bp, Homo sapiens
cttagtcccaagc

SEQ ID NO: 4471030 - DNA, 17 bp, Homo sapiens
cttagtggttccccacc

SEQ ID NO: 4471031 - DNA, 14 bp, Homo sapiens
cttagtgttcaaaa

SEQ ID NO: 4471032 - DNA, 21 bp, Homo sapiens
cttagtgttcaaaacaaaatg

SEQ ID NO: 4471033 - DNA, 16 bp, Homo sapiens
cttagttatcagcttt

SEQ ID NO: 4471034 - DNA, 19 bp, Homo sapiens
cttagttctgtatataaat

SEQ ID NO: 4471035 - DNA, 17 bp, Homo sapiens
cttataacctagttaaa

SEQ ID NO: 4471036 - DNA, 21 bp, Homo sapiens
cttataacctagttaaagaaa

SEQ ID NO: 4471037 - DNA, 16 bp, Homo sapiens
cttataactgttttag

SEQ ID NO: 4471038 - DNA, 22 bp, Homo sapiens
cttataacttgtaagtctgatt

SEQ ID NO: 4471039 - DNA, 17 bp, Homo sapiens
cttataataaaggactg

SEQ ID NO: 4471040 - DNA, 20 bp, Homo sapiens
cttataataaaggactgtaa

SEQ ID NO: 4471041 - DNA, 14 bp, Homo sapiens
cttataattgttct

SEQ ID NO: 4471042 - DNA, 16 bp, Homo sapiens
cttatactgtacaata

SEQ ID NO: 4471043 - DNA, 18 bp, Homo sapiens
cttatagaagcttcagca

SEQ ID NO: 4471044 - DNA, 14 bp, Homo sapiens
cttatagttactgt

SEQ ID NO: 4471045 - DNA, 15 bp, Homo sapiens
cttatagttactgtg

SEQ ID NO: 4471046 - DNA, 19 bp, Homo sapiens
cttatagttactgtgtaat

SEQ ID NO: 4471047 - DNA, 17 bp, Homo sapiens
cttatatatgcacttaa

SEQ ID NO: 4471048 - DNA, 18 bp, Homo sapiens
cttatatgctgaattgaa

SEQ ID NO: 4471049 - DNA, 21 bp, Homo sapiens
cttatattaatagtaatttgt

SEQ ID NO: 4471050 - DNA, 14 bp, Homo sapiens
cttatattggtttg

SEQ ID NO: 4471051 - DNA, 21 bp, Homo sapiens
cttatattttatgaacattgt

SEQ ID NO: 4471052 - DNA, 21 bp, Homo sapiens
cttatccataaaaaaaaatag

SEQ ID NO: 4471053 - DNA, 15 bp, Homo sapiens
cttatccctctcttc

SEQ ID NO: 4471054 - DNA, 19 bp, Homo sapiens
cttatcctaaggctgtcca

SEQ ID NO: 4471055 - DNA, 13 bp, Homo sapiens
cttatcctgcatt

SEQ ID NO: 4471056 - DNA, 17 bp, Homo sapiens
cttatctctaaaccatc

SEQ ID NO: 4471057 - DNA, 15 bp, Homo sapiens
cttatctctctgtgc

SEQ ID NO: 4471058 - DNA, 21 bp, Homo sapiens
cttatctctctgtgctgtgga

SEQ ID NO: 4471059 - DNA, 19 bp, Homo sapiens
cttatctgcccctccccca

SEQ ID NO: 4471060 - DNA, 16 bp, Homo sapiens
cttatctttattggct

SEQ ID NO: 4471061 - DNA, 15 bp, Homo sapiens
cttatgaaaagtact

SEQ ID NO: 4471062 - DNA, 19 bp, Homo sapiens
cttatgaaaagtactaata

SEQ ID NO: 4471063 - DNA, 14 bp, Homo sapiens
cttatgaggagggg

SEQ ID NO: 4471064 - DNA, 18 bp, Homo sapiens
cttatgcggttaattttg

SEQ ID NO: 4471065 - DNA, 15 bp, Homo sapiens
cttatgctgatttat

SEQ ID NO: 4471066 - DNA, 17 bp, Homo sapiens
cttatggaattgatttg

SEQ ID NO: 4471067 - DNA, 14 bp, Homo sapiens
cttatgtcctgtca

SEQ ID NO: 4471068 - DNA, 23 bp, Homo sapiens
cttatgtgacattaacaaataaa

SEQ ID NO: 4471069 - DNA, 17 bp, Homo sapiens
cttatgtgttacattat

SEQ ID NO: 4471070 - DNA, 21 bp, Homo sapiens
cttatgtgttacattattcca

SEQ ID NO: 4471071 - DNA, 18 bp, Homo sapiens
cttattaaaaaatttgta

SEQ ID NO: 4471072 - DNA, 21 bp, Homo sapiens
cttattaatcatacaaactct

SEQ ID NO: 4471073 - DNA, 17 bp, Homo sapiens
cttattacccaggaaga

SEQ ID NO: 4471074 - DNA, 13 bp, Homo sapiens
cttattcattcct

SEQ ID NO: 4471075 - DNA, 17 bp, Homo sapiens
cttattcccccaaactt

SEQ ID NO: 4471076 - DNA, 19 bp, Homo sapiens
cttattcctaatggctatt

SEQ ID NO: 4471077 - DNA, 16 bp, Homo sapiens
cttattcctcagtgag

SEQ ID NO: 4471078 - DNA, 19 bp, Homo sapiens
cttattgatattctaagaa

SEQ ID NO: 4471079 - DNA, 16 bp, Homo sapiens
cttattgctgatttta

SEQ ID NO: 4471080 - DNA, 19 bp, Homo sapiens
cttattgctgattttaatg

SEQ ID NO: 4471081 - DNA, 10 bp, Homo sapiens
cttattgctt

SEQ ID NO: 4471082 - DNA, 16 bp, Homo sapiens
cttattgttctttcat

SEQ ID NO: 4471083 - DNA, 22 bp, Homo sapiens
cttattgtttttggatggctta

SEQ ID NO: 4471084 - DNA, 22 bp, Homo sapiens
cttatttaatcttttcttattt

SEQ ID NO: 4471085 - DNA, 19 bp, Homo sapiens
cttatttacagataacttc

SEQ ID NO: 4471086 - DNA, 20 bp, Homo sapiens
cttatttacagataacttct

SEQ ID NO: 4471087 - DNA, 16 bp, Homo sapiens
cttatttacccttttc

SEQ ID NO: 4471088 - DNA, 18 bp, Homo sapiens
cttatttatgtgaacaac

SEQ ID NO: 4471089 - DNA, 15 bp, Homo sapiens
cttatttcatttctt

SEQ ID NO: 4471090 - DNA, 11 bp, Homo sapiens
cttatttctgc

SEQ ID NO: 4471091 - DNA, 20 bp, Homo sapiens
cttatttctttcctttaaaa

SEQ ID NO: 4471092 - DNA, 16 bp, Homo sapiens
cttatttgtatatggt

SEQ ID NO: 4471093 - DNA, 13 bp, Homo sapiens
cttattttagtat

SEQ ID NO: 4471094 - DNA, 12 bp, Homo sapiens
cttatttttcct

SEQ ID NO: 4471095 - DNA, 13 bp, Homo sapiens
cttatttttcctg

SEQ ID NO: 4471096 - DNA, 17 bp, Homo sapiens
cttatttttcctgtcct

SEQ ID NO: 4471097 - DNA, 20 bp, Homo sapiens
cttatttttcctgtcctgcc

SEQ ID NO: 4471098 - DNA, 14 bp, Homo sapiens
cttatttttctgag

SEQ ID NO: 4471099 - DNA, 22 bp, Homo sapiens
cttatttttctgaggtccttat

SEQ ID NO: 4471100 - DNA, 21 bp, Homo sapiens
cttcaaaaataaaaaatctga

SEQ ID NO: 4471101 - DNA, 22 bp, Homo sapiens
cttcaaaatattgagcagaatt

SEQ ID NO: 4471102 - DNA, 13 bp, Homo sapiens
cttcaaagtctca

SEQ ID NO: 4471103 - DNA, 16 bp, Homo sapiens
cttcaaagtctcaatg

SEQ ID NO: 4471104 - DNA, 15 bp, Homo sapiens
cttcaaagtttatat

SEQ ID NO: 4471105 - DNA, 19 bp, Homo sapiens
cttcaaatatagagatatt

SEQ ID NO: 4471106 - DNA, 12 bp, Homo sapiens
cttcaacatgac

SEQ ID NO: 4471107 - DNA, 17 bp, Homo sapiens
cttcaagaatcagaaga

SEQ ID NO: 4471108 - DNA, 16 bp, Homo sapiens
cttcaaggaggcccac

SEQ ID NO: 4471109 - DNA, 18 bp, Homo sapiens
cttcaaggaggcccactg

SEQ ID NO: 4471110 - DNA, 12 bp, Homo sapiens
cttcaagtgcca

SEQ ID NO: 4471111 - DNA, 12 bp, Homo sapiens
cttcaataaacc

SEQ ID NO: 4471112 - DNA, 20 bp, Homo sapiens
cttcaataaaccacaagcat

SEQ ID NO: 4471113 - DNA, 22 bp, Homo sapiens
cttcaataaaccacaagcatct

SEQ ID NO: 4471114 - DNA, 22 bp, Homo sapiens
cttcaataaagcctgacttcac

SEQ ID NO: 4471115 - DNA, 14 bp, Homo sapiens
cttcaatataagaa

SEQ ID NO: 4471116 - DNA, 22 bp, Homo sapiens
cttcaatataagaagcaatctt

SEQ ID NO: 4471117 - DNA, 13 bp, Homo sapiens
cttcaatttcaaa

SEQ ID NO: 4471118 - DNA, 15 bp, Homo sapiens
cttcaatttcaaact

SEQ ID NO: 4471119 - DNA, 17 bp, Homo sapiens
cttcaatttcaaacttt

SEQ ID NO: 4471120 - DNA, 14 bp, Homo sapiens
cttcacagccacac

SEQ ID NO: 4471121 - DNA, 23 bp, Homo sapiens
cttcacagccacacctggactga

SEQ ID NO: 4471122 - DNA, 17 bp, Homo sapiens
cttcacatcccattggg

SEQ ID NO: 4471123 - DNA, 17 bp, Homo sapiens
cttcaccatttggcaat

SEQ ID NO: 4471124 - DNA, 19 bp, Homo sapiens
cttcacccaccaggccagc

SEQ ID NO: 4471125 - DNA, 19 bp, Homo sapiens
cttcaccccagtggccact

SEQ ID NO: 4471126 - DNA, 23 bp, Homo sapiens
cttcaccccagtggccactcagc

SEQ ID NO: 4471127 - DNA, 21 bp, Homo sapiens
cttcacccgagttcctctggg

SEQ ID NO: 4471128 - DNA, 23 bp, Homo sapiens
cttcacgattcttaccctttctt

SEQ ID NO: 4471129 - DNA, 17 bp, Homo sapiens
cttcactctgacagtat

SEQ ID NO: 4471130 - DNA, 18 bp, Homo sapiens
cttcactgtatataaaca

SEQ ID NO: 4471131 - DNA, 19 bp, Homo sapiens
cttcactgtatataaacat

SEQ ID NO: 4471132 - DNA, 17 bp, Homo sapiens
cttcactgtatatgtaa

SEQ ID NO: 4471133 - DNA, 17 bp, Homo sapiens
cttcactgtcatcttca

SEQ ID NO: 4471134 - DNA, 16 bp, Homo sapiens
cttcacttacaagaaa

SEQ ID NO: 4471135 - DNA, 14 bp, Homo sapiens
cttcacttcaagct

SEQ ID NO: 4471136 - DNA, 13 bp, Homo sapiens
cttcacttctccc

SEQ ID NO: 4471137 - DNA, 17 bp, Homo sapiens
cttcagaacagaggcat

SEQ ID NO: 4471138 - DNA, 23 bp, Homo sapiens
cttcagaacagaggcatttaaaa

SEQ ID NO: 4471139 - DNA, 18 bp, Homo sapiens
cttcagaactgcccttgc

SEQ ID NO: 4471140 - DNA, 19 bp, Homo sapiens
cttcagaactgcccttgct

SEQ ID NO: 4471141 - DNA, 20 bp, Homo sapiens
cttcagaactgcccttgctg

SEQ ID NO: 4471142 - DNA, 21 bp, Homo sapiens
cttcagaactgcccttgctgc

SEQ ID NO: 4471143 - DNA, 15 bp, Homo sapiens
cttcagatcagtgct

SEQ ID NO: 4471144 - DNA, 17 bp, Homo sapiens
cttcagatcagtgcttg

SEQ ID NO: 4471145 - DNA, 20 bp, Homo sapiens
cttcagcaaccctacagtat

SEQ ID NO: 4471146 - DNA, 18 bp, Homo sapiens
cttcagcatttacttgaa

SEQ ID NO: 4471147 - DNA, 16 bp, Homo sapiens
cttcagccctcacccc

SEQ ID NO: 4471148 - DNA, 19 bp, Homo sapiens
cttcagccctcacccctgg

SEQ ID NO: 4471149 - DNA, 15 bp, Homo sapiens
cttcagcctgaaaga

SEQ ID NO: 4471150 - DNA, 13 bp, Homo sapiens
cttcagctgactc

SEQ ID NO: 4471151 - DNA, 14 bp, Homo sapiens
cttcagctttgtgt

SEQ ID NO: 4471152 - DNA, 21 bp, Homo sapiens
cttcaggaacctcgagtactg

SEQ ID NO: 4471153 - DNA, 22 bp, Homo sapiens
cttcaggaacctcgagtactgt

SEQ ID NO: 4471154 - DNA, 18 bp, Homo sapiens
cttcaggactctgcggga

SEQ ID NO: 4471155 - DNA, 23 bp, Homo sapiens
cttcaggccccgccccatgggcc

SEQ ID NO: 4471156 - DNA, 22 bp, Homo sapiens
cttcaggtaaagggcaaataat

SEQ ID NO: 4471157 - DNA, 16 bp, Homo sapiens
cttcaggtggaaaaac

SEQ ID NO: 4471158 - DNA, 15 bp, Homo sapiens
cttcaggttgcattg

SEQ ID NO: 4471159 - DNA, 16 bp, Homo sapiens
cttcagtcattaaatt

SEQ ID NO: 4471160 - DNA, 15 bp, Homo sapiens
cttcagtgagcccct

SEQ ID NO: 4471161 - DNA, 20 bp, Homo sapiens
cttcagtgagcccctcccca

SEQ ID NO: 4471162 - DNA, 21 bp, Homo sapiens
cttcagtgagcccctccccag

SEQ ID NO: 4471163 - DNA, 15 bp, Homo sapiens
cttcagtgcccacca

SEQ ID NO: 4471164 - DNA, 13 bp, Homo sapiens
cttcagtgggaga

SEQ ID NO: 4471165 - DNA, 18 bp, Homo sapiens
cttcagtgggagaaaaca

SEQ ID NO: 4471166 - DNA, 17 bp, Homo sapiens
cttcagttatgattttt

SEQ ID NO: 4471167 - DNA, 19 bp, Homo sapiens
cttcagttggtgtgttttt

SEQ ID NO: 4471168 - DNA, 22 bp, Homo sapiens
cttcagttggtgtgtttttggg

SEQ ID NO: 4471169 - DNA, 20 bp, Homo sapiens
cttcagtttcacagaaaata

SEQ ID NO: 4471170 - DNA, 20 bp, Homo sapiens
cttcagtttccgaatctctt

SEQ ID NO: 4471171 - DNA, 15 bp, Homo sapiens
cttcataatggcctg

SEQ ID NO: 4471172 - DNA, 15 bp, Homo sapiens
cttcatacagaaggc

SEQ ID NO: 4471173 - DNA, 16 bp, Homo sapiens
cttcatacagaaggca

SEQ ID NO: 4471174 - DNA, 20 bp, Homo sapiens
cttcatatcatccacacatg

SEQ ID NO: 4471175 - DNA, 21 bp, Homo sapiens
cttcatatcatccacacatga

SEQ ID NO: 4471176 - DNA, 15 bp, Homo sapiens
cttcatattaatata

SEQ ID NO: 4471177 - DNA, 13 bp, Homo sapiens
cttcatctggcaa

SEQ ID NO: 4471178 - DNA, 14 bp, Homo sapiens
cttcatctggcaac

SEQ ID NO: 4471179 - DNA, 20 bp, Homo sapiens
cttcatctgtgggatgctga

SEQ ID NO: 4471180 - DNA, 17 bp, Homo sapiens
cttcatgaaatgtgttt

SEQ ID NO: 4471181 - DNA, 16 bp, Homo sapiens
cttcatgacagcctcc

SEQ ID NO: 4471182 - DNA, 18 bp, Homo sapiens
cttcatgcccttctgatt

SEQ ID NO: 4471183 - DNA, 17 bp, Homo sapiens
cttcatgcttgacatac

SEQ ID NO: 4471184 - DNA, 20 bp, Homo sapiens
cttcatgcttttgcttgcaa

SEQ ID NO: 4471185 - DNA, 12 bp, Homo sapiens
cttcatgtaaat

SEQ ID NO: 4471186 - DNA, 22 bp, Homo sapiens
cttcatgtaaattgactgtact

SEQ ID NO: 4471187 - DNA, 16 bp, Homo sapiens
cttcatgtaattttat

SEQ ID NO: 4471188 - DNA, 15 bp, Homo sapiens
cttcattctttgcag

SEQ ID NO: 4471189 - DNA, 17 bp, Homo sapiens
cttcattgacctctact

SEQ ID NO: 4471190 - DNA, 18 bp, Homo sapiens
cttcattgtaatctgcaa

SEQ ID NO: 4471191 - DNA, 11 bp, Homo sapiens
cttcattgttt

SEQ ID NO: 4471192 - DNA, 14 bp, Homo sapiens
cttcattgtttgga

SEQ ID NO: 4471193 - DNA, 21 bp, Homo sapiens
cttcattgtttggacctgcat

SEQ ID NO: 4471194 - DNA, 23 bp, Homo sapiens
cttcattgtttggacctgcatat

SEQ ID NO: 4471195 - DNA, 13 bp, Homo sapiens
cttcatttctctg

SEQ ID NO: 4471196 - DNA, 14 bp, Homo sapiens
cttcatttctctgc

SEQ ID NO: 4471197 - DNA, 16 bp, Homo sapiens
cttcattttatattta

SEQ ID NO: 4471198 - DNA, 18 bp, Homo sapiens
cttcattttatatttaaa

SEQ ID NO: 4471199 - DNA, 17 bp, Homo sapiens
cttcattttgtataatc

SEQ ID NO: 4471200 - DNA, 19 bp, Homo sapiens
cttccaaacaggctcagag

SEQ ID NO: 4471201 - DNA, 12 bp, Homo sapiens
cttccaaagaaa

SEQ ID NO: 4471202 - DNA, 19 bp, Homo sapiens
cttccaaagactccctcca

SEQ ID NO: 4471203 - DNA, 22 bp, Homo sapiens
cttccaaagactccctccatag

SEQ ID NO: 4471204 - DNA, 19 bp, Homo sapiens
cttccaaatcccctaagca

SEQ ID NO: 4471205 - DNA, 16 bp, Homo sapiens
cttccaattaatgctt

SEQ ID NO: 4471206 - DNA, 17 bp, Homo sapiens
cttccaattaatgcttt

SEQ ID NO: 4471207 - DNA, 12 bp, Homo sapiens
cttccacaaaat

SEQ ID NO: 4471208 - DNA, 13 bp, Homo sapiens
cttccacaaaatt

SEQ ID NO: 4471209 - DNA, 11 bp, Homo sapiens
cttccacaaac

SEQ ID NO: 4471210 - DNA, 16 bp, Homo sapiens
cttccacaaagaaaat

SEQ ID NO: 4471211 - DNA, 17 bp, Homo sapiens
cttccacaaagaaaatt

SEQ ID NO: 4471212 - DNA, 16 bp, Homo sapiens
cttccacatgttactg

SEQ ID NO: 4471213 - DNA, 12 bp, Homo sapiens
cttccacccagt

SEQ ID NO: 4471214 - DNA, 15 bp, Homo sapiens
cttccactgagggca

SEQ ID NO: 4471215 - DNA, 19 bp, Homo sapiens
cttccactgtgcacctgcg

SEQ ID NO: 4471216 - DNA, 14 bp, Homo sapiens
cttccagattttaa

SEQ ID NO: 4471217 - DNA, 13 bp, Homo sapiens
cttccaggaaact

SEQ ID NO: 4471218 - DNA, 17 bp, Homo sapiens
cttccaggaaactccac

SEQ ID NO: 4471219 - DNA, 18 bp, Homo sapiens
cttccaggaaactccaca

SEQ ID NO: 4471220 - DNA, 19 bp, Homo sapiens
cttccaggtgttactgtaa

SEQ ID NO: 4471221 - DNA, 22 bp, Homo sapiens
cttccaggtgttactgtaattc

SEQ ID NO: 4471222 - DNA, 20 bp, Homo sapiens
cttccagtctggagagctgt

SEQ ID NO: 4471223 - DNA, 21 bp, Homo sapiens
cttccagtcttcctgacactt

SEQ ID NO: 4471224 - DNA, 18 bp, Homo sapiens
cttccatacacagaggag

SEQ ID NO: 4471225 - DNA, 15 bp, Homo sapiens
cttccatagctgctg

SEQ ID NO: 4471226 - DNA, 21 bp, Homo sapiens
cttccatagctgctgccctag

SEQ ID NO: 4471227 - DNA, 16 bp, Homo sapiens
cttccatcatcactgt

SEQ ID NO: 4471228 - DNA, 17 bp, Homo sapiens
cttccatcatcactgta

SEQ ID NO: 4471229 - DNA, 12 bp, Homo sapiens
cttccatcccta

SEQ ID NO: 4471230 - DNA, 14 bp, Homo sapiens
cttccatccctacc

SEQ ID NO: 4471231 - DNA, 15 bp, Homo sapiens
cttccatctcttcct

SEQ ID NO: 4471232 - DNA, 17 bp, Homo sapiens
cttccatctcttccttc

SEQ ID NO: 4471233 - DNA, 14 bp, Homo sapiens
cttccatgattcta

SEQ ID NO: 4471234 - DNA, 14 bp, Homo sapiens
cttccatgcctgta

SEQ ID NO: 4471235 - DNA, 17 bp, Homo sapiens
cttccatgcctgtagct

SEQ ID NO: 4471236 - DNA, 18 bp, Homo sapiens
cttccatgtcggcctcta

SEQ ID NO: 4471237 - DNA, 18 bp, Homo sapiens
cttccatgtgcctttctt

SEQ ID NO: 4471238 - DNA, 21 bp, Homo sapiens
cttccattccatctagttttt

SEQ ID NO: 4471239 - DNA, 13 bp, Homo sapiens
cttccatttgcaa

SEQ ID NO: 4471240 - DNA, 14 bp, Homo sapiens
cttccatttgcaag

SEQ ID NO: 4471241 - DNA, 18 bp, Homo sapiens
cttccattttcattctgt

SEQ ID NO: 4471242 - DNA, 21 bp, Homo sapiens
cttcccaacgtactcctcaga

SEQ ID NO: 4471243 - DNA, 20 bp, Homo sapiens
cttcccacatgcctgcgcct

SEQ ID NO: 4471244 - DNA, 15 bp, Homo sapiens
cttcccagctctccc

SEQ ID NO: 4471245 - DNA, 22 bp, Homo sapiens
cttcccagctctccctctggcc

SEQ ID NO: 4471246 - DNA, 19 bp, Homo sapiens
cttcccaggagtggaggag

SEQ ID NO: 4471247 - DNA, 12 bp, Homo sapiens
cttcccagggca

SEQ ID NO: 4471248 - DNA, 19 bp, Homo sapiens
cttcccagggcacccaggc

SEQ ID NO: 4471249 - DNA, 17 bp, Homo sapiens
cttcccatttcttccca

SEQ ID NO: 4471250 - DNA, 12 bp, Homo sapiens
cttccccagaga

SEQ ID NO: 4471251 - DNA, 13 bp, Homo sapiens
cttccccagagag

SEQ ID NO: 4471252 - DNA, 14 bp, Homo sapiens
cttccccagagagg

SEQ ID NO: 4471253 - DNA, 12 bp, Homo sapiens
cttccccatccc

SEQ ID NO: 4471254 - DNA, 13 bp, Homo sapiens
cttccccatggga

SEQ ID NO: 4471255 - DNA, 18 bp, Homo sapiens
cttcccctacacctccct

SEQ ID NO: 4471256 - DNA, 14 bp, Homo sapiens
cttcccctccctgg

SEQ ID NO: 4471257 - DNA, 16 bp, Homo sapiens
cttcccctccctggct

SEQ ID NO: 4471258 - DNA, 18 bp, Homo sapiens
cttcccctccctggctcc

SEQ ID NO: 4471259 - DNA, 14 bp, Homo sapiens
cttcccctgctgac

SEQ ID NO: 4471260 - DNA, 17 bp, Homo sapiens
cttcccctggcactggc

SEQ ID NO: 4471261 - DNA, 15 bp, Homo sapiens
cttccccttagaaac

SEQ ID NO: 4471262 - DNA, 13 bp, Homo sapiens
cttccccttctgt

SEQ ID NO: 4471263 - DNA, 23 bp, Homo sapiens
cttcccggcccccggccaaggac

SEQ ID NO: 4471264 - DNA, 16 bp, Homo sapiens
cttccctacctcaggc

SEQ ID NO: 4471265 - DNA, 15 bp, Homo sapiens
cttccctccctatct

SEQ ID NO: 4471266 - DNA, 17 bp, Homo sapiens
cttccctccttttaaaa

SEQ ID NO: 4471267 - DNA, 13 bp, Homo sapiens
cttccctctctga

SEQ ID NO: 4471268 - DNA, 15 bp, Homo sapiens
cttccctctctgatg

SEQ ID NO: 4471269 - DNA, 21 bp, Homo sapiens
cttccctctctgatgtcccag

SEQ ID NO: 4471270 - DNA, 19 bp, Homo sapiens
cttccctctgggcacgcct

SEQ ID NO: 4471271 - DNA, 13 bp, Homo sapiens
cttccctgactca

SEQ ID NO: 4471272 - DNA, 14 bp, Homo sapiens
cttccctgactcat

SEQ ID NO: 4471273 - DNA, 22 bp, Homo sapiens
cttccctgagtgcgggctgagg

SEQ ID NO: 4471274 - DNA, 11 bp, Homo sapiens
cttccctgcct

SEQ ID NO: 4471275 - DNA, 13 bp, Homo sapiens
cttccctgcctgt

SEQ ID NO: 4471276 - DNA, 18 bp, Homo sapiens
cttccctgctttgcatct

SEQ ID NO: 4471277 - DNA, 22 bp, Homo sapiens
cttccctggaaaccttccaccc

SEQ ID NO: 4471278 - DNA, 15 bp, Homo sapiens
cttccctggccccgc

SEQ ID NO: 4471279 - DNA, 13 bp, Homo sapiens
cttccctggcctc

SEQ ID NO: 4471280 - DNA, 16 bp, Homo sapiens
cttccctgggctgcca

SEQ ID NO: 4471281 - DNA, 16 bp, Homo sapiens
cttccctgttctccct

SEQ ID NO: 4471282 - DNA, 17 bp, Homo sapiens
cttcccttagcctctcc

SEQ ID NO: 4471283 - DNA, 15 bp, Homo sapiens
cttccctttgtgtat

SEQ ID NO: 4471284 - DNA, 13 bp, Homo sapiens
cttccgacatccc

SEQ ID NO: 4471285 - DNA, 22 bp, Homo sapiens
cttccgctgaggggtctcggat

SEQ ID NO: 4471286 - DNA, 16 bp, Homo sapiens
cttccgtgagacacaa

SEQ ID NO: 4471287 - DNA, 18 bp, Homo sapiens
cttccgtgagacacaaga

SEQ ID NO: 4471288 - DNA, 20 bp, Homo sapiens
cttccgtggtcagagtgcca

SEQ ID NO: 4471289 - DNA, 18 bp, Homo sapiens
cttcctacaagagcagcc

SEQ ID NO: 4471290 - DNA, 19 bp, Homo sapiens
cttcctacccacacctctg

SEQ ID NO: 4471291 - DNA, 15 bp, Homo sapiens
cttcctcagctgcct

SEQ ID NO: 4471292 - DNA, 20 bp, Homo sapiens
cttcctcccaagtggtgcct

SEQ ID NO: 4471293 - DNA, 23 bp, Homo sapiens
cttcctcccaagtggtgcctaaa

SEQ ID NO: 4471294 - DNA, 16 bp, Homo sapiens
cttcctcccatttccc

SEQ ID NO: 4471295 - DNA, 15 bp, Homo sapiens
cttcctcctcatcct

SEQ ID NO: 4471296 - DNA, 22 bp, Homo sapiens
cttcctcctcatcctccctgac

SEQ ID NO: 4471297 - DNA, 15 bp, Homo sapiens
cttcctcctgcagac

SEQ ID NO: 4471298 - DNA, 14 bp, Homo sapiens
cttcctcctgggcc

SEQ ID NO: 4471299 - DNA, 15 bp, Homo sapiens
cttcctcctgggccc

SEQ ID NO: 4471300 - DNA, 22 bp, Homo sapiens
cttcctctacgtttatcctggc

SEQ ID NO: 4471301 - DNA, 13 bp, Homo sapiens
cttcctctcaggc

SEQ ID NO: 4471302 - DNA, 15 bp, Homo sapiens
cttcctgacacttta

SEQ ID NO: 4471303 - DNA, 14 bp, Homo sapiens
cttcctgagcttta

SEQ ID NO: 4471304 - DNA, 13 bp, Homo sapiens
cttcctgcccttc

SEQ ID NO: 4471305 - DNA, 17 bp, Homo sapiens
cttcctgcccttccctc

SEQ ID NO: 4471306 - DNA, 20 bp, Homo sapiens
cttcctgcccttccctctgg

SEQ ID NO: 4471307 - DNA, 15 bp, Homo sapiens
cttcctgcgtcctcc

SEQ ID NO: 4471308 - DNA, 22 bp, Homo sapiens
cttcctggcacattgcccctct

SEQ ID NO: 4471309 - DNA, 23 bp, Homo sapiens
cttcctggcacattgcccctctg

SEQ ID NO: 4471310 - DNA, 17 bp, Homo sapiens
cttcctgggaggacagg

SEQ ID NO: 4471311 - DNA, 18 bp, Homo sapiens
cttcctgggaggacaggc

SEQ ID NO: 4471312 - DNA, 22 bp, Homo sapiens
cttcctgggaggacaggcaggc

SEQ ID NO: 4471313 - DNA, 21 bp, Homo sapiens
cttcctgggtcctgttcccta

SEQ ID NO: 4471314 - DNA, 20 bp, Homo sapiens
cttcctgtctagtctctcct

SEQ ID NO: 4471315 - DNA, 23 bp, Homo sapiens
cttcctgtctagtctctcctgta

SEQ ID NO: 4471316 - DNA, 14 bp, Homo sapiens
cttcctgtgccttt

SEQ ID NO: 4471317 - DNA, 15 bp, Homo sapiens
cttcctgtgcctttc

SEQ ID NO: 4471318 - DNA, 23 bp, Homo sapiens
cttcctgtttttcacattttcct

SEQ ID NO: 4471319 - DNA, 15 bp, Homo sapiens
cttccttcaggactc

SEQ ID NO: 4471320 - DNA, 15 bp, Homo sapiens
cttccttccctggct

SEQ ID NO: 4471321 - DNA, 17 bp, Homo sapiens
cttccttccctggcttg

SEQ ID NO: 4471322 - DNA, 22 bp, Homo sapiens
cttccttctaccccaaggccag

SEQ ID NO: 4471323 - DNA, 14 bp, Homo sapiens
cttcgaaaatctag

SEQ ID NO: 4471324 - DNA, 23 bp, Homo sapiens
cttcgaccacagcaagccatcat

SEQ ID NO: 4471325 - DNA, 23 bp, Homo sapiens
cttcgaggtggatcacagaggct

SEQ ID NO: 4471326 - DNA, 13 bp, Homo sapiens
cttcgctagaaaa

SEQ ID NO: 4471327 - DNA, 12 bp, Homo sapiens
cttcgctggact

SEQ ID NO: 4471328 - DNA, 15 bp, Homo sapiens
cttcggacaaaatat

SEQ ID NO: 4471329 - DNA, 16 bp, Homo sapiens
cttcggagtgaatgtg

SEQ ID NO: 4471330 - DNA, 18 bp, Homo sapiens
cttcggggaactcctgga

SEQ ID NO: 4471331 - DNA, 19 bp, Homo sapiens
cttcggggaactcctggaa

SEQ ID NO: 4471332 - DNA, 15 bp, Homo sapiens
cttcgttctttttaa

SEQ ID NO: 4471333 - DNA, 18 bp, Homo sapiens
cttcgttctttttaagtt

SEQ ID NO: 4471334 - DNA, 13 bp, Homo sapiens
cttcgttttggtt

SEQ ID NO: 4471335 - DNA, 18 bp, Homo sapiens
cttctaaaatagcaataa

SEQ ID NO: 4471336 - DNA, 13 bp, Homo sapiens
cttctaaaccaaa

SEQ ID NO: 4471337 - DNA, 18 bp, Homo sapiens
cttctaaatgcccagttc

SEQ ID NO: 4471338 - DNA, 14 bp, Homo sapiens
cttctaagaagaca

SEQ ID NO: 4471339 - DNA, 17 bp, Homo sapiens
cttctaagaagacattt

SEQ ID NO: 4471340 - DNA, 21 bp, Homo sapiens
cttctaagtaaaaccacagca

SEQ ID NO: 4471341 - DNA, 22 bp, Homo sapiens
cttctaagtaaaaccacagcag

SEQ ID NO: 4471342 - DNA, 14 bp, Homo sapiens
cttctacactctcc

SEQ ID NO: 4471343 - DNA, 18 bp, Homo sapiens
cttctacactctcctggg

SEQ ID NO: 4471344 - DNA, 22 bp, Homo sapiens
cttctacccagatggaaaaata

SEQ ID NO: 4471345 - DNA, 13 bp, Homo sapiens
cttctaccctctg

SEQ ID NO: 4471346 - DNA, 17 bp, Homo sapiens
cttctacctgccactca

SEQ ID NO: 4471347 - DNA, 23 bp, Homo sapiens
cttctacctgccactcacacagc

SEQ ID NO: 4471348 - DNA, 15 bp, Homo sapiens
cttctacctgccctc

SEQ ID NO: 4471349 - DNA, 17 bp, Homo sapiens
cttctactcctgcctca

SEQ ID NO: 4471350 - DNA, 19 bp, Homo sapiens
cttctagaatgtctgaagt

SEQ ID NO: 4471351 - DNA, 16 bp, Homo sapiens
cttctagatctcagcc

SEQ ID NO: 4471352 - DNA, 19 bp, Homo sapiens
cttctagatggaccccagc

SEQ ID NO: 4471353 - DNA, 17 bp, Homo sapiens
cttctagttctgccagg

SEQ ID NO: 4471354 - DNA, 20 bp, Homo sapiens
cttctattctagcctgcatt

SEQ ID NO: 4471355 - DNA, 14 bp, Homo sapiens
cttctattggtctc

SEQ ID NO: 4471356 - DNA, 19 bp, Homo sapiens
cttctcaacttttttccct

SEQ ID NO: 4471357 - DNA, 22 bp, Homo sapiens
cttctcaccagctgcaaagtgt

SEQ ID NO: 4471358 - DNA, 16 bp, Homo sapiens
cttctcacgctttgtt

SEQ ID NO: 4471359 - DNA, 13 bp, Homo sapiens
cttctcacggcga

SEQ ID NO: 4471360 - DNA, 14 bp, Homo sapiens
cttctcagaagcac

SEQ ID NO: 4471361 - DNA, 16 bp, Homo sapiens
cttctcagaagcacag

SEQ ID NO: 4471362 - DNA, 19 bp, Homo sapiens
cttctcagatttctgagga

SEQ ID NO: 4471363 - DNA, 22 bp, Homo sapiens
cttctcagatttctgaggaaat

SEQ ID NO: 4471364 - DNA, 17 bp, Homo sapiens
cttctcatttcacccct

SEQ ID NO: 4471365 - DNA, 18 bp, Homo sapiens
cttctcatttcacccctc

SEQ ID NO: 4471366 - DNA, 21 bp, Homo sapiens
cttctcatttcacccctccct

SEQ ID NO: 4471367 - DNA, 22 bp, Homo sapiens
cttctcatttcacccctccctt

SEQ ID NO: 4471368 - DNA, 19 bp, Homo sapiens
cttctccaaaaatctgcct

SEQ ID NO: 4471369 - DNA, 20 bp, Homo sapiens
cttctccaaaaatctgcctg

SEQ ID NO: 4471370 - DNA, 15 bp, Homo sapiens
cttctccaacactga

SEQ ID NO: 4471371 - DNA, 16 bp, Homo sapiens
cttctccaattctgaa

SEQ ID NO: 4471372 - DNA, 18 bp, Homo sapiens
cttctcccatctcttcct

SEQ ID NO: 4471373 - DNA, 20 bp, Homo sapiens
cttctcccatctcttccttg

SEQ ID NO: 4471374 - DNA, 12 bp, Homo sapiens
cttctccgccag

SEQ ID NO: 4471375 - DNA, 14 bp, Homo sapiens
cttctccgccagcc

SEQ ID NO: 4471376 - DNA, 17 bp, Homo sapiens
cttctccgccagcctcc

SEQ ID NO: 4471377 - DNA, 19 bp, Homo sapiens
cttctcctcctctgtcttt

SEQ ID NO: 4471378 - DNA, 18 bp, Homo sapiens
cttctcctgttttatata

SEQ ID NO: 4471379 - DNA, 19 bp, Homo sapiens
cttctcctgttttatatat

SEQ ID NO: 4471380 - DNA, 15 bp, Homo sapiens
cttctcgtgtttgct

SEQ ID NO: 4471381 - DNA, 19 bp, Homo sapiens
cttctcgtgtttgcttaaa

SEQ ID NO: 4471382 - DNA, 14 bp, Homo sapiens
cttctctccagctg

SEQ ID NO: 4471383 - DNA, 12 bp, Homo sapiens
cttctctcccca

SEQ ID NO: 4471384 - DNA, 15 bp, Homo sapiens
cttctctccttgccc

SEQ ID NO: 4471385 - DNA, 13 bp, Homo sapiens
cttctctctgtgg

SEQ ID NO: 4471386 - DNA, 13 bp, Homo sapiens
cttctctgcagta

SEQ ID NO: 4471387 - DNA, 11 bp, Homo sapiens
cttctctgctc

SEQ ID NO: 4471388 - DNA, 13 bp, Homo sapiens
cttctctgctcca

SEQ ID NO: 4471389 - DNA, 14 bp, Homo sapiens
cttctctgctccac

SEQ ID NO: 4471390 - DNA, 16 bp, Homo sapiens
cttctctgctccacca

SEQ ID NO: 4471391 - DNA, 16 bp, Homo sapiens
cttctcttgttaggta

SEQ ID NO: 4471392 - DNA, 20 bp, Homo sapiens
cttctgaaaacccaaggcca

SEQ ID NO: 4471393 - DNA, 19 bp, Homo sapiens
cttctgaactccatacagc

SEQ ID NO: 4471394 - DNA, 15 bp, Homo sapiens
cttctgactgccccc

SEQ ID NO: 4471395 - DNA, 15 bp, Homo sapiens
cttctgattcccctc

SEQ ID NO: 4471396 - DNA, 16 bp, Homo sapiens
cttctgcagcaactcc

SEQ ID NO: 4471397 - DNA, 18 bp, Homo sapiens
cttctgcagcaactccca

SEQ ID NO: 4471398 - DNA, 19 bp, Homo sapiens
cttctgcagcaactcccac

SEQ ID NO: 4471399 - DNA, 23 bp, Homo sapiens
cttctgcagcaactcccacgact

SEQ ID NO: 4471400 - DNA, 18 bp, Homo sapiens
cttctgcattactattaa

SEQ ID NO: 4471401 - DNA, 16 bp, Homo sapiens
cttctgccaccagccc

SEQ ID NO: 4471402 - DNA, 16 bp, Homo sapiens
cttctgccttctcatg

SEQ ID NO: 4471403 - DNA, 13 bp, Homo sapiens
cttctgctccacc

SEQ ID NO: 4471404 - DNA, 15 bp, Homo sapiens
cttctgctccaccct

SEQ ID NO: 4471405 - DNA, 16 bp, Homo sapiens
cttctgctgtacagat

SEQ ID NO: 4471406 - DNA, 14 bp, Homo sapiens
cttctgcttttctg

SEQ ID NO: 4471407 - DNA, 17 bp, Homo sapiens
cttctgcttttctgccc

SEQ ID NO: 4471408 - DNA, 19 bp, Homo sapiens
cttctgcttttctgccctg

SEQ ID NO: 4471409 - DNA, 21 bp, Homo sapiens
cttctgcttttctgccctggc

SEQ ID NO: 4471410 - DNA, 16 bp, Homo sapiens
cttctggcctaggacc

SEQ ID NO: 4471411 - DNA, 20 bp, Homo sapiens
cttctggcctaggacccctc

SEQ ID NO: 4471412 - DNA, 15 bp, Homo sapiens
cttctggctacctgt

SEQ ID NO: 4471413 - DNA, 16 bp, Homo sapiens
cttctggctacctgtt

SEQ ID NO: 4471414 - DNA, 22 bp, Homo sapiens
cttctgggagggcagcagggct

SEQ ID NO: 4471415 - DNA, 16 bp, Homo sapiens
cttctgggcctgacca

SEQ ID NO: 4471416 - DNA, 21 bp, Homo sapiens
cttctgggcttcatctggcaa

SEQ ID NO: 4471417 - DNA, 20 bp, Homo sapiens
cttctggggcaggctgggcc

SEQ ID NO: 4471418 - DNA, 19 bp, Homo sapiens
cttctggtgctactccatg

SEQ ID NO: 4471419 - DNA, 21 bp, Homo sapiens
cttctggtgctactccatgca

SEQ ID NO: 4471420 - DNA, 21 bp, Homo sapiens
cttctggtgttgactggactg

SEQ ID NO: 4471421 - DNA, 14 bp, Homo sapiens
cttctgtaatattt

SEQ ID NO: 4471422 - DNA, 15 bp, Homo sapiens
cttctgtaattgtgt

SEQ ID NO: 4471423 - DNA, 20 bp, Homo sapiens
cttctgtaattgtgtggatt

SEQ ID NO: 4471424 - DNA, 18 bp, Homo sapiens
cttctgtactaaagtatt

SEQ ID NO: 4471425 - DNA, 20 bp, Homo sapiens
cttctgtatttttttttcta

SEQ ID NO: 4471426 - DNA, 18 bp, Homo sapiens
cttctgtcttcacaacag

SEQ ID NO: 4471427 - DNA, 22 bp, Homo sapiens
cttctgtgagacccccacacct

SEQ ID NO: 4471428 - DNA, 19 bp, Homo sapiens
cttctgtggggactccggc

SEQ ID NO: 4471429 - DNA, 16 bp, Homo sapiens
cttctgtggggcccct

SEQ ID NO: 4471430 - DNA, 12 bp, Homo sapiens
cttctgtttcta

SEQ ID NO: 4471431 - DNA, 16 bp, Homo sapiens
cttctgtttctagttg

SEQ ID NO: 4471432 - DNA, 19 bp, Homo sapiens
cttcttatggaattgattt

SEQ ID NO: 4471433 - DNA, 20 bp, Homo sapiens
cttcttattctcactccacc

SEQ ID NO: 4471434 - DNA, 22 bp, Homo sapiens
cttcttattctcactccaccac

SEQ ID NO: 4471435 - DNA, 14 bp, Homo sapiens
cttcttcagctgac

SEQ ID NO: 4471436 - DNA, 21 bp, Homo sapiens
cttcttcggggaactcctgga

SEQ ID NO: 4471437 - DNA, 20 bp, Homo sapiens
cttcttctaagaagacattt

SEQ ID NO: 4471438 - DNA, 12 bp, Homo sapiens
cttcttctgtaa

SEQ ID NO: 4471439 - DNA, 15 bp, Homo sapiens
cttcttctgtaatat

SEQ ID NO: 4471440 - DNA, 17 bp, Homo sapiens
cttcttctgtaatattt

SEQ ID NO: 4471441 - DNA, 22 bp, Homo sapiens
cttcttctgtaatatttacaat

SEQ ID NO: 4471442 - DNA, 13 bp, Homo sapiens
cttcttgaatata

SEQ ID NO: 4471443 - DNA, 20 bp, Homo sapiens
cttcttgccatcactggtcc

SEQ ID NO: 4471444 - DNA, 22 bp, Homo sapiens
cttcttggagctttggaatatt

SEQ ID NO: 4471445 - DNA, 18 bp, Homo sapiens
cttcttgggcccggtcca

SEQ ID NO: 4471446 - DNA, 22 bp, Homo sapiens
cttcttgttctgagattcaata

SEQ ID NO: 4471447 - DNA, 23 bp, Homo sapiens
cttctttcattctaatccttgct

SEQ ID NO: 4471448 - DNA, 13 bp, Homo sapiens
cttctttccatca

SEQ ID NO: 4471449 - DNA, 23 bp, Homo sapiens
cttctttccatcaactcccaact

SEQ ID NO: 4471450 - DNA, 15 bp, Homo sapiens
cttctttctggactg

SEQ ID NO: 4471451 - DNA, 21 bp, Homo sapiens
cttctttgctgcattcctttt

SEQ ID NO: 4471452 - DNA, 20 bp, Homo sapiens
cttctttggaaataaaagat

SEQ ID NO: 4471453 - DNA, 16 bp, Homo sapiens
cttcttttctttgtat

SEQ ID NO: 4471454 - DNA, 14 bp, Homo sapiens
cttcttttttaagt

SEQ ID NO: 4471455 - DNA, 14 bp, Homo sapiens
cttgaaaaaaaaca

SEQ ID NO: 4471456 - DNA, 15 bp, Homo sapiens
cttgaaaaagatggc

SEQ ID NO: 4471457 - DNA, 13 bp, Homo sapiens
cttgaaaactgtg

SEQ ID NO: 4471458 - DNA, 22 bp, Homo sapiens
cttgaaaactgtgcaacttttt

SEQ ID NO: 4471459 - DNA, 22 bp, Homo sapiens
cttgaaacagattcaggccagc

SEQ ID NO: 4471460 - DNA, 15 bp, Homo sapiens
cttgaaaccagtatt

SEQ ID NO: 4471461 - DNA, 20 bp, Homo sapiens
cttgaaagcagttaaactga

SEQ ID NO: 4471462 - DNA, 22 bp, Homo sapiens
cttgaaagcagttaaactgatt

SEQ ID NO: 4471463 - DNA, 15 bp, Homo sapiens
cttgaaatattcaga

SEQ ID NO: 4471464 - DNA, 16 bp, Homo sapiens
cttgaaatattcagaa

SEQ ID NO: 4471465 - DNA, 19 bp, Homo sapiens
cttgaaatattcagaaatt

SEQ ID NO: 4471466 - DNA, 21 bp, Homo sapiens
cttgaaatggaaagtcatgca

SEQ ID NO: 4471467 - DNA, 13 bp, Homo sapiens
cttgaaatttaca

SEQ ID NO: 4471468 - DNA, 13 bp, Homo sapiens
cttgaaatttaga

SEQ ID NO: 4471469 - DNA, 16 bp, Homo sapiens
cttgaaattttaacct

SEQ ID NO: 4471470 - DNA, 11 bp, Homo sapiens
cttgaacaaaa

SEQ ID NO: 4471471 - DNA, 14 bp, Homo sapiens
cttgaacaaaaggg

SEQ ID NO: 4471472 - DNA, 22 bp, Homo sapiens
cttgaacaaaagggtcagagga

SEQ ID NO: 4471473 - DNA, 15 bp, Homo sapiens
cttgaacaaagacat

SEQ ID NO: 4471474 - DNA, 20 bp, Homo sapiens
cttgaacaaagacatttata

SEQ ID NO: 4471475 - DNA, 16 bp, Homo sapiens
cttgaacacagtattt

SEQ ID NO: 4471476 - DNA, 20 bp, Homo sapiens
cttgaacacagtattttccc

SEQ ID NO: 4471477 - DNA, 19 bp, Homo sapiens
cttgaacccgggggacaga

SEQ ID NO: 4471478 - DNA, 19 bp, Homo sapiens
cttgaactctgttccccca

SEQ ID NO: 4471479 - DNA, 23 bp, Homo sapiens
cttgaagaaacagagtggcctcc

SEQ ID NO: 4471480 - DNA, 13 bp, Homo sapiens
cttgaagccaaag

SEQ ID NO: 4471481 - DNA, 16 bp, Homo sapiens
cttgaagccaaagaaa

SEQ ID NO: 4471482 - DNA, 19 bp, Homo sapiens
cttgaagccaaagaaaaat

SEQ ID NO: 4471483 - DNA, 18 bp, Homo sapiens
cttgaagcctaaatttgt

SEQ ID NO: 4471484 - DNA, 17 bp, Homo sapiens
cttgaaggtacacccca

SEQ ID NO: 4471485 - DNA, 15 bp, Homo sapiens
cttgaatagtattgt

SEQ ID NO: 4471486 - DNA, 13 bp, Homo sapiens
cttgaatataaaa

SEQ ID NO: 4471487 - DNA, 19 bp, Homo sapiens
cttgaatgtggcttgagaa

SEQ ID NO: 4471488 - DNA, 20 bp, Homo sapiens
cttgaattgtaactgttctt

SEQ ID NO: 4471489 - DNA, 16 bp, Homo sapiens
cttgaatttcatgctt

SEQ ID NO: 4471490 - DNA, 21 bp, Homo sapiens
cttgacacaggaaatgggaaa

SEQ ID NO: 4471491 - DNA, 19 bp, Homo sapiens
cttgacatacctaccagta

SEQ ID NO: 4471492 - DNA, 13 bp, Homo sapiens
cttgaccaggctg

SEQ ID NO: 4471493 - DNA, 21 bp, Homo sapiens
cttgaccaggctgcctccctt

SEQ ID NO: 4471494 - DNA, 22 bp, Homo sapiens
cttgaccatcgtccttcctctc

SEQ ID NO: 4471495 - DNA, 20 bp, Homo sapiens
cttgacctgcattgtaaata

SEQ ID NO: 4471496 - DNA, 12 bp, Homo sapiens
cttgactctaat

SEQ ID NO: 4471497 - DNA, 13 bp, Homo sapiens
cttgactttgctc

SEQ ID NO: 4471498 - DNA, 19 bp, Homo sapiens
cttgactttgctcctcaca

SEQ ID NO: 4471499 - DNA, 20 bp, Homo sapiens
cttgagaaccagtctcctca

SEQ ID NO: 4471500 - DNA, 18 bp, Homo sapiens
cttgagaaccttttcaaa

SEQ ID NO: 4471501 - DNA, 18 bp, Homo sapiens
cttgagaatctttgcatg

SEQ ID NO: 4471502 - DNA, 14 bp, Homo sapiens
cttgagacctcagc

SEQ ID NO: 4471503 - DNA, 15 bp, Homo sapiens
cttgagacctcagcc

SEQ ID NO: 4471504 - DNA, 20 bp, Homo sapiens
cttgagagtagatggtttga

SEQ ID NO: 4471505 - DNA, 12 bp, Homo sapiens
cttgagatgaaa

SEQ ID NO: 4471506 - DNA, 16 bp, Homo sapiens
cttgagcatcaatctt

SEQ ID NO: 4471507 - DNA, 21 bp, Homo sapiens
cttgagccacagtcactggat

SEQ ID NO: 4471508 - DNA, 23 bp, Homo sapiens
cttgagcccaggagttcaagacc

SEQ ID NO: 4471509 - DNA, 16 bp, Homo sapiens
cttgagctcaggagtt

SEQ ID NO: 4471510 - DNA, 20 bp, Homo sapiens
cttgaggttctcttttgact

SEQ ID NO: 4471511 - DNA, 21 bp, Homo sapiens
cttgagtgagaagagcttgca

SEQ ID NO: 4471512 - DNA, 22 bp, Homo sapiens
cttgagtgagaagagcttgcac

SEQ ID NO: 4471513 - DNA, 23 bp, Homo sapiens
cttgatcaacatcttttcttgcc

SEQ ID NO: 4471514 - DNA, 14 bp, Homo sapiens
cttgatcatgtctt

SEQ ID NO: 4471515 - DNA, 17 bp, Homo sapiens
cttgatccagaagagcc

SEQ ID NO: 4471516 - DNA, 15 bp, Homo sapiens
cttgatcggaaagct

SEQ ID NO: 4471517 - DNA, 11 bp, Homo sapiens
cttgatctatc

SEQ ID NO: 4471518 - DNA, 18 bp, Homo sapiens
cgccattgtactccagcc

SEQ ID NO: 4471519 - DNA, 22 bp, Homo sapiens
cgcccacaagccttactcacct

SEQ ID NO: 4471520 - DNA, 23 bp, Homo sapiens
cgcccaccagccttgctctcttc

SEQ ID NO: 4471521 - DNA, 17 bp, Homo sapiens
cgcccacccgccttgtg

SEQ ID NO: 4471522 - DNA, 19 bp, Homo sapiens
cgcccacccgccttgtgag

SEQ ID NO: 4471523 - DNA, 18 bp, Homo sapiens
cgcccacccggcccggct

SEQ ID NO: 4471524 - DNA, 21 bp, Homo sapiens
cgcccagacaccatgtgcaat

SEQ ID NO: 4471525 - DNA, 20 bp, Homo sapiens
cgcccaggctggagtgcagt

SEQ ID NO: 4471526 - DNA, 16 bp, Homo sapiens
cgccccagagtggccc

SEQ ID NO: 4471527 - DNA, 19 bp, Homo sapiens
cgcccccgagccctgactc

SEQ ID NO: 4471528 - DNA, 23 bp, Homo sapiens
cgcccccgagccctgactcctgg

SEQ ID NO: 4471529 - DNA, 19 bp, Homo sapiens
cgccccgcacgactgcggg

SEQ ID NO: 4471530 - DNA, 21 bp, Homo sapiens
cgccccttccctctctccctg

SEQ ID NO: 4471531 - DNA, 22 bp, Homo sapiens
cgccccttccctctctccctgc

SEQ ID NO: 4471532 - DNA, 23 bp, Homo sapiens
cgccccttccctctctccctgcc

SEQ ID NO: 4471533 - DNA, 15 bp, Homo sapiens
cgcccgagctgttta

SEQ ID NO: 4471534 - DNA, 13 bp, Homo sapiens
cgcccgaggcaga

SEQ ID NO: 4471535 - DNA, 16 bp, Homo sapiens
cgccctatttctatgt

SEQ ID NO: 4471536 - DNA, 13 bp, Homo sapiens
cgccctcaggggc

SEQ ID NO: 4471537 - DNA, 13 bp, Homo sapiens
cgccctccctgct

SEQ ID NO: 4471538 - DNA, 15 bp, Homo sapiens
cgccctgggctgtct

SEQ ID NO: 4471539 - DNA, 18 bp, Homo sapiens
cgccctgggctgtctgtc

SEQ ID NO: 4471540 - DNA, 19 bp, Homo sapiens
cgccctgggctgtctgtca

SEQ ID NO: 4471541 - DNA, 22 bp, Homo sapiens
cgccctgggctgtctgtcacca

SEQ ID NO: 4471542 - DNA, 18 bp, Homo sapiens
cgcccttccatgtgcctt

SEQ ID NO: 4471543 - DNA, 14 bp, Homo sapiens
cgccctttcctcct

SEQ ID NO: 4471544 - DNA, 16 bp, Homo sapiens
cgccctttcctcctca

SEQ ID NO: 4471545 - DNA, 13 bp, Homo sapiens
cgccgccgccgct

SEQ ID NO: 4471546 - DNA, 15 bp, Homo sapiens
cgccgccgctgccct

SEQ ID NO: 4471547 - DNA, 19 bp, Homo sapiens
cggagcccagcctgggagc

SEQ ID NO: 4471548 - DNA, 21 bp, Homo sapiens
cggagcccagcctgggagccc

SEQ ID NO: 4471549 - DNA, 22 bp, Homo sapiens
cggagcccagcctgggagccca

SEQ ID NO: 4471550 - DNA, 17 bp, Homo sapiens
cggaggactgagccccc

SEQ ID NO: 4471551 - DNA, 16 bp, Homo sapiens
cggaggctgcccccgg

SEQ ID NO: 4471552 - DNA, 16 bp, Homo sapiens
cggaggtgctgtcccc

SEQ ID NO: 4471553 - DNA, 23 bp, Homo sapiens
cggaggtgctgtccccactgccc

SEQ ID NO: 4471554 - DNA, 20 bp, Homo sapiens
cggagtctcgctctgtcgcc

SEQ ID NO: 4471555 - DNA, 13 bp, Homo sapiens
cggagtgaatgtg

SEQ ID NO: 4471556 - DNA, 15 bp, Homo sapiens
cggagtgaatgtggc

SEQ ID NO: 4471557 - DNA, 19 bp, Homo sapiens
cggagtggggggacagaga

SEQ ID NO: 4471558 - DNA, 16 bp, Homo sapiens
cggatctgctgggctc

SEQ ID NO: 4471559 - DNA, 15 bp, Homo sapiens
cggatgacaccctgg

SEQ ID NO: 4471560 - DNA, 17 bp, Homo sapiens
cggatgacaccctggcc

SEQ ID NO: 4471561 - DNA, 19 bp, Homo sapiens
cggatgacaccctggcctg

SEQ ID NO: 4471562 - DNA, 19 bp, Homo sapiens
cggatgcccattcctgcct

SEQ ID NO: 4471563 - DNA, 17 bp, Homo sapiens
cggattttttccaaaat

SEQ ID NO: 4471564 - DNA, 13 bp, Homo sapiens
cggcaaaaggaaa

SEQ ID NO: 4471565 - DNA, 17 bp, Homo sapiens
cggcaacgtagcctggg

SEQ ID NO: 4471566 - DNA, 18 bp, Homo sapiens
cggcaacgtagcctgggc

SEQ ID NO: 4471567 - DNA, 14 bp, Homo sapiens
cggcaagccacagg

SEQ ID NO: 4471568 - DNA, 19 bp, Homo sapiens
cggcagggcccccaataaa

SEQ ID NO: 4471569 - DNA, 20 bp, Homo sapiens
cggcagggcgggcagagggc

SEQ ID NO: 4471570 - DNA, 18 bp, Homo sapiens
cggcatagtccccagagc

SEQ ID NO: 4471571 - DNA, 14 bp, Homo sapiens
cggcatggctggga

SEQ ID NO: 4471572 - DNA, 17 bp, Homo sapiens
cggccaaggacccaggc

SEQ ID NO: 4471573 - DNA, 20 bp, Homo sapiens
cggccaaggacccaggcgct

SEQ ID NO: 4471574 - DNA, 17 bp, Homo sapiens
cggccacacccagcggc

SEQ ID NO: 4471575 - DNA, 19 bp, Homo sapiens
cggccacacccagcggccc

SEQ ID NO: 4471576 - DNA, 14 bp, Homo sapiens
cggccacagctgct

SEQ ID NO: 4471577 - DNA, 15 bp, Homo sapiens
cggccacagctgctg

SEQ ID NO: 4471578 - DNA, 16 bp, Homo sapiens
cggccaggcctgcggg

SEQ ID NO: 4471579 - DNA, 17 bp, Homo sapiens
cggccaggcctgcgggc

SEQ ID NO: 4471580 - DNA, 21 bp, Homo sapiens
cggcccagaagtttccctcaa

SEQ ID NO: 4471581 - DNA, 17 bp, Homo sapiens
cggcccagcccggctcc

SEQ ID NO: 4471582 - DNA, 15 bp, Homo sapiens
cggcccaggccaggt

SEQ ID NO: 4471583 - DNA, 13 bp, Homo sapiens
cggcccagtgcca

SEQ ID NO: 4471584 - DNA, 15 bp, Homo sapiens
cggcccagtgccact

SEQ ID NO: 4471585 - DNA, 15 bp, Homo sapiens
cggccccaccagtgc

SEQ ID NO: 4471586 - DNA, 16 bp, Homo sapiens
cggccccaccagtgcc

SEQ ID NO: 4471587 - DNA, 18 bp, Homo sapiens
cggccccaccagtgcctc

SEQ ID NO: 4471588 - DNA, 20 bp, Homo sapiens
cggccccaccagtgcctctc

SEQ ID NO: 4471589 - DNA, 21 bp, Homo sapiens
cggccccaccagtgcctctcc

SEQ ID NO: 4471590 - DNA, 20 bp, Homo sapiens
cggccccccgcacagccacc

SEQ ID NO: 4471591 - DNA, 13 bp, Homo sapiens
cggcccccggcca

SEQ ID NO: 4471592 - DNA, 16 bp, Homo sapiens
cggcccccggccaagg

SEQ ID NO: 4471593 - DNA, 15 bp, Homo sapiens
cggccccctggtctc

SEQ ID NO: 4471594 - DNA, 22 bp, Homo sapiens
cggccccgtctctcttggaccc

SEQ ID NO: 4471595 - DNA, 14 bp, Homo sapiens
cggcccctccccct

SEQ ID NO: 4471596 - DNA, 17 bp, Homo sapiens
cggcccggctgagccct

SEQ ID NO: 4471597 - DNA, 19 bp, Homo sapiens
cggcccggctgagccctgc

SEQ ID NO: 4471598 - DNA, 13 bp, Homo sapiens
cggccctgggctc

SEQ ID NO: 4471599 - DNA, 22 bp, Homo sapiens
cggccctgggctcggaggctgc

SEQ ID NO: 4471600 - DNA, 16 bp, Homo sapiens
cggccgcattccctga

SEQ ID NO: 4471601 - DNA, 21 bp, Homo sapiens
cggccgccatagccccagtag

SEQ ID NO: 4471602 - DNA, 14 bp, Homo sapiens
cggccgcgccaccc

SEQ ID NO: 4471603 - DNA, 14 bp, Homo sapiens
cggccgtggaagga

SEQ ID NO: 4471604 - DNA, 19 bp, Homo sapiens
cggcctcccaaagtgctgg

SEQ ID NO: 4471605 - DNA, 18 bp, Homo sapiens
cggcctccgaggctcccc

SEQ ID NO: 4471606 - DNA, 21 bp, Homo sapiens
cggcctccgaggctccccgcc

SEQ ID NO: 4471607 - DNA, 14 bp, Homo sapiens
cggcctcctcctca

SEQ ID NO: 4471608 - DNA, 17 bp, Homo sapiens
cggcctcctcctcaccc

SEQ ID NO: 4471609 - DNA, 17 bp, Homo sapiens
cggcctcctcggagagc

SEQ ID NO: 4471610 - DNA, 18 bp, Homo sapiens
cggcctcctcggagagca

SEQ ID NO: 4471611 - DNA, 15 bp, Homo sapiens
cggcctctaacccca

SEQ ID NO: 4471612 - DNA, 17 bp, Homo sapiens
cggcctctaaccccagg

SEQ ID NO: 4471613 - DNA, 18 bp, Homo sapiens
cggcctctaaccccaggc

SEQ ID NO: 4471614 - DNA, 21 bp, Homo sapiens
cggcctctccctgcctgtggc

SEQ ID NO: 4471615 - DNA, 12 bp, Homo sapiens
cggcctgtgggt

SEQ ID NO: 4471616 - DNA, 15 bp, Homo sapiens
cggcgtcagcctcca

SEQ ID NO: 4471617 - DNA, 16 bp, Homo sapiens
cggcgtcagcctccag

SEQ ID NO: 4471618 - DNA, 19 bp, Homo sapiens
cggctactcagcagccctc

SEQ ID NO: 4471619 - DNA, 12 bp, Homo sapiens
cggctccaactc

SEQ ID NO: 4471620 - DNA, 22 bp, Homo sapiens
cggctccccctccagccagaga

SEQ ID NO: 4471621 - DNA, 18 bp, Homo sapiens
cggctcccctctgcttct

SEQ ID NO: 4471622 - DNA, 13 bp, Homo sapiens
cggctcctcagag

SEQ ID NO: 4471623 - DNA, 15 bp, Homo sapiens
cggctcctcagagcg

SEQ ID NO: 4471624 - DNA, 16 bp, Homo sapiens
cggctcctcagagcgc

SEQ ID NO: 4471625 - DNA, 23 bp, Homo sapiens
cggctcctcgagatcccaacact

SEQ ID NO: 4471626 - DNA, 13 bp, Homo sapiens
cggctcctggtgc

SEQ ID NO: 4471627 - DNA, 22 bp, Homo sapiens
cggctctgtgggtgatggggag

SEQ ID NO: 4471628 - DNA, 22 bp, Homo sapiens
cggctcttatagaagcttcagc

SEQ ID NO: 4471629 - DNA, 23 bp, Homo sapiens
cggctcttatagaagcttcagca

SEQ ID NO: 4471630 - DNA, 19 bp, Homo sapiens
cggctgctccttcaggcga

SEQ ID NO: 4471631 - DNA, 22 bp, Homo sapiens
cggctgggaggagggcaggcat

SEQ ID NO: 4471632 - DNA, 23 bp, Homo sapiens
cggctgggaggagggcaggcatc

SEQ ID NO: 4471633 - DNA, 15 bp, Homo sapiens
cggctggggactgct

SEQ ID NO: 4471634 - DNA, 23 bp, Homo sapiens
cggctgtttcctgacagatgcct

SEQ ID NO: 4471635 - DNA, 13 bp, Homo sapiens
cggcttcctcctt

SEQ ID NO: 4471636 - DNA, 17 bp, Homo sapiens
cgggaaagaagaaactc

SEQ ID NO: 4471637 - DNA, 20 bp, Homo sapiens
cgggaaaggatggagtgttt

SEQ ID NO: 4471638 - DNA, 16 bp, Homo sapiens
cgggaatgagctgtgt

SEQ ID NO: 4471639 - DNA, 19 bp, Homo sapiens
cgggacatggttgggggaa

SEQ ID NO: 4471640 - DNA, 14 bp, Homo sapiens
cgggaccctgccca

SEQ ID NO: 4471641 - DNA, 21 bp, Homo sapiens
cgggaccctgcccagagctga

SEQ ID NO: 4471642 - DNA, 22 bp, Homo sapiens
cgggaccctgcccagagctgag

SEQ ID NO: 4471643 - DNA, 16 bp, Homo sapiens
cgggactcaggcggga

SEQ ID NO: 4471644 - DNA, 22 bp, Homo sapiens
cgggactcaggcgggacagtgc

SEQ ID NO: 4471645 - DNA, 22 bp, Homo sapiens
cgggagacagcttctctgcagt

SEQ ID NO: 4471646 - DNA, 14 bp, Homo sapiens
cgggagcacccaga

SEQ ID NO: 4471647 - DNA, 14 bp, Homo sapiens
cgggagcctccccc

SEQ ID NO: 4471648 - DNA, 18 bp, Homo sapiens
cgggagcctccccctcag

SEQ ID NO: 4471649 - DNA, 19 bp, Homo sapiens
cgggagcctccccctcaga

SEQ ID NO: 4471650 - DNA, 15 bp, Homo sapiens
cgggagctgggccct

SEQ ID NO: 4471651 - DNA, 17 bp, Homo sapiens
cgggagctgggccctgc

SEQ ID NO: 4471652 - DNA, 23 bp, Homo sapiens
cgggagctgggccctgcctgcag

SEQ ID NO: 4471653 - DNA, 12 bp, Homo sapiens
cgggaggcagcc

SEQ ID NO: 4471654 - DNA, 13 bp, Homo sapiens
cgggaggctgggg

SEQ ID NO: 4471655 - DNA, 14 bp, Homo sapiens
cgggaggctggggc

SEQ ID NO: 4471656 - DNA, 16 bp, Homo sapiens
cgggaggctggggccc

SEQ ID NO: 4471657 - DNA, 14 bp, Homo sapiens
cgggatacagctga

SEQ ID NO: 4471658 - DNA, 15 bp, Homo sapiens
cgggatacagctgag

SEQ ID NO: 4471659 - DNA, 16 bp, Homo sapiens
cgggatacagctgagt

SEQ ID NO: 4471660 - DNA, 23 bp, Homo sapiens
cgggatcctccacagagaggagg

SEQ ID NO: 4471661 - DNA, 21 bp, Homo sapiens
cgggattgaagggtcctgccg

SEQ ID NO: 4471662 - DNA, 19 bp, Homo sapiens
cgggcagagggctggaggc

SEQ ID NO: 4471663 - DNA, 22 bp, Homo sapiens
cgggcagagggctggaggccca

SEQ ID NO: 4471664 - DNA, 11 bp, Homo sapiens
cgggcagcccc

SEQ ID NO: 4471665 - DNA, 21 bp, Homo sapiens
cgggcaggtcctgcccatgtg

SEQ ID NO: 4471666 - DNA, 23 bp, Homo sapiens
cgggcaggtcctgcccatgtgtc

SEQ ID NO: 4471667 - DNA, 19 bp, Homo sapiens
cgggcagtctgctctgctg

SEQ ID NO: 4471668 - DNA, 12 bp, Homo sapiens
cgggcccagccc

SEQ ID NO: 4471669 - DNA, 18 bp, Homo sapiens
cgggcccagcccccacag

SEQ ID NO: 4471670 - DNA, 23 bp, Homo sapiens
cgggcccagcccccacagtgctg

SEQ ID NO: 4471671 - DNA, 22 bp, Homo sapiens
cgggccccatcctcatccctga

SEQ ID NO: 4471672 - DNA, 23 bp, Homo sapiens
cgggccgtctcccttggcccaga

SEQ ID NO: 4471673 - DNA, 14 bp, Homo sapiens
cgggcgcggtggct

SEQ ID NO: 4471674 - DNA, 10 bp, Homo sapiens
cgggctcaga

SEQ ID NO: 4471675 - DNA, 11 bp, Homo sapiens
cgggctcagag

SEQ ID NO: 4471676 - DNA, 13 bp, Homo sapiens
cgggctcagagct

SEQ ID NO: 4471677 - DNA, 14 bp, Homo sapiens
cgggctcgggtctg

SEQ ID NO: 4471678 - DNA, 14 bp, Homo sapiens
cgggctctctgctg

SEQ ID NO: 4471679 - DNA, 15 bp, Homo sapiens
cgggctctgacagcc

SEQ ID NO: 4471680 - DNA, 15 bp, Homo sapiens
cgggctgaggccaga

SEQ ID NO: 4471681 - DNA, 15 bp, Homo sapiens
cgggctggcgggcct

SEQ ID NO: 4471682 - DNA, 18 bp, Homo sapiens
cgggctggcgggcctttt

SEQ ID NO: 4471683 - DNA, 17 bp, Homo sapiens
cgggcttccctggcctc

SEQ ID NO: 4471684 - DNA, 15 bp, Homo sapiens
cggggaactcctgga

SEQ ID NO: 4471685 - DNA, 16 bp, Homo sapiens
cggggacagaggcctg

SEQ ID NO: 4471686 - DNA, 22 bp, Homo sapiens
cggggacaggtgacagtggctg

SEQ ID NO: 4471687 - DNA, 16 bp, Homo sapiens
cggggccccctggtca

SEQ ID NO: 4471688 - DNA, 16 bp, Homo sapiens
cggggctcttctcatt

SEQ ID NO: 4471689 - DNA, 18 bp, Homo sapiens
cgggggcagtctgagaga

SEQ ID NO: 4471690 - DNA, 22 bp, Homo sapiens
cgggggcatctgagtccagctc

SEQ ID NO: 4471691 - DNA, 14 bp, Homo sapiens
cggggggctcctgc

SEQ ID NO: 4471692 - DNA, 17 bp, Homo sapiens
cggggggtgtcttccct

SEQ ID NO: 4471693 - DNA, 12 bp, Homo sapiens
cggggtgcagaa

SEQ ID NO: 4471694 - DNA, 13 bp, Homo sapiens
cggggttccctcc

SEQ ID NO: 4471695 - DNA, 21 bp, Homo sapiens
cggggttggctgttccagact

SEQ ID NO: 4471696 - DNA, 19 bp, Homo sapiens
cgggtcaacatttccaaaa

SEQ ID NO: 4471697 - DNA, 22 bp, Homo sapiens
cgggtcatctgtacctctgcct

SEQ ID NO: 4471698 - DNA, 22 bp, Homo sapiens
cgggtccatagagatgagccca

SEQ ID NO: 4471699 - DNA, 12 bp, Homo sapiens
cgggtccggcct

SEQ ID NO: 4471700 - DNA, 19 bp, Homo sapiens
cgggtgatggccagcccct

SEQ ID NO: 4471701 - DNA, 22 bp, Homo sapiens
cgggtgcatttgagagaagcca

SEQ ID NO: 4471702 - DNA, 23 bp, Homo sapiens
cgggtgcatttgagagaagccac

SEQ ID NO: 4471703 - DNA, 20 bp, Homo sapiens
cgggtgcccgtaatcccagc

SEQ ID NO: 4471704 - DNA, 15 bp, Homo sapiens
cgggtgtggcctcag

SEQ ID NO: 4471705 - DNA, 16 bp, Homo sapiens
cgggtgtggcctcagc

SEQ ID NO: 4471706 - DNA, 19 bp, Homo sapiens
cgggttctagacgcccctc

SEQ ID NO: 4471707 - DNA, 19 bp, Homo sapiens
cggtcagtgccttttggaa

SEQ ID NO: 4471708 - DNA, 14 bp, Homo sapiens
cggtcccccagagc

SEQ ID NO: 4471709 - DNA, 22 bp, Homo sapiens
cggtcccttgagacctcagcca

SEQ ID NO: 4471710 - DNA, 19 bp, Homo sapiens
cggtcgggcagccagcaga

SEQ ID NO: 4471711 - DNA, 19 bp, Homo sapiens
cggtgcctgggtggggctg

SEQ ID NO: 4471712 - DNA, 14 bp, Homo sapiens
cggtgctgcaggag

SEQ ID NO: 4471713 - DNA, 16 bp, Homo sapiens
cggtgctgcaggagtg

SEQ ID NO: 4471714 - DNA, 16 bp, Homo sapiens
cggtgctgtgagggag

SEQ ID NO: 4471715 - DNA, 19 bp, Homo sapiens
cggtgctgtgagggagggg

SEQ ID NO: 4471716 - DNA, 14 bp, Homo sapiens
cggtggctgccccg

SEQ ID NO: 4471717 - DNA, 16 bp, Homo sapiens
cggtggctgccccggc

SEQ ID NO: 4471718 - DNA, 13 bp, Homo sapiens
cggtgggccttgc

SEQ ID NO: 4471719 - DNA, 18 bp, Homo sapiens
cggtgggccttgctgggg

SEQ ID NO: 4471720 - DNA, 20 bp, Homo sapiens
cggtggtgcccgtgcccgca

SEQ ID NO: 4471721 - DNA, 15 bp, Homo sapiens
cggtgtgcaccaggg

SEQ ID NO: 4471722 - DNA, 16 bp, Homo sapiens
cggtgtgcaccagggt

SEQ ID NO: 4471723 - DNA, 14 bp, Homo sapiens
cggttaaattccat

SEQ ID NO: 4471724 - DNA, 17 bp, Homo sapiens
cggttaagaaagcactt

SEQ ID NO: 4471725 - DNA, 16 bp, Homo sapiens
cggttcagacccctgc

SEQ ID NO: 4471726 - DNA, 21 bp, Homo sapiens
cggttgttctttcctcacatt

SEQ ID NO: 4471727 - DNA, 16 bp, Homo sapiens
cggttgttgatattgt

SEQ ID NO: 4471728 - DNA, 13 bp, Homo sapiens
cggtttttattaa

SEQ ID NO: 4471729 - DNA, 23 bp, Homo sapiens
cgtaaaggtttatttttctgtta

SEQ ID NO: 4471730 - DNA, 15 bp, Homo sapiens
cgtaacagtgtaaag

SEQ ID NO: 4471731 - DNA, 14 bp, Homo sapiens
cgtaaccagccaga

SEQ ID NO: 4471732 - DNA, 23 bp, Homo sapiens
cgtaagcacattcgggccatttc

SEQ ID NO: 4471733 - DNA, 13 bp, Homo sapiens
cgtaagcagtata

SEQ ID NO: 4471734 - DNA, 23 bp, Homo sapiens
cgtaagcagtatattagtattat

SEQ ID NO: 4471735 - DNA, 15 bp, Homo sapiens
cgtaaggatgtgtga

SEQ ID NO: 4471736 - DNA, 13 bp, Homo sapiens
cgtaatcccagct

SEQ ID NO: 4471737 - DNA, 23 bp, Homo sapiens
cgtaccaccatgcactgtaaata

SEQ ID NO: 4471738 - DNA, 15 bp, Homo sapiens
cgtagcctgggctca

SEQ ID NO: 4471739 - DNA, 23 bp, Homo sapiens
cgtagcctgggctcactgtgctg

SEQ ID NO: 4471740 - DNA, 15 bp, Homo sapiens
cgtagctcccctggc

SEQ ID NO: 4471741 - DNA, 18 bp, Homo sapiens
cgtagctcccctggctgg

SEQ ID NO: 4471742 - DNA, 15 bp, Homo sapiens
cgtaggacaagtttt

SEQ ID NO: 4471743 - DNA, 13 bp, Homo sapiens
cgtataatgcttt

SEQ ID NO: 4471744 - DNA, 14 bp, Homo sapiens
cgtataatgctttc

SEQ ID NO: 4471745 - DNA, 15 bp, Homo sapiens
cgtataggcatgtaa

SEQ ID NO: 4471746 - DNA, 16 bp, Homo sapiens
cgtataggcatgtaaa

SEQ ID NO: 4471747 - DNA, 13 bp, Homo sapiens
cgtatcacagtgt

SEQ ID NO: 4471748 - DNA, 14 bp, Homo sapiens
cgtatcacagtgtt

SEQ ID NO: 4471749 - DNA, 19 bp, Homo sapiens
cgtatgcatttttttagtt

SEQ ID NO: 4471750 - DNA, 15 bp, Homo sapiens
cgtatgttatacaac

SEQ ID NO: 4471751 - DNA, 21 bp, Homo sapiens
cgtatttaatagcaaagaatt

SEQ ID NO: 4471752 - DNA, 22 bp, Homo sapiens
cgtatttagactgtggccatat

SEQ ID NO: 4471753 - DNA, 12 bp, Homo sapiens
cgtcaagacatt

SEQ ID NO: 4471754 - DNA, 15 bp, Homo sapiens
cgtcaagacatttgc

SEQ ID NO: 4471755 - DNA, 16 bp, Homo sapiens
cgtcaccccagccctc

SEQ ID NO: 4471756 - DNA, 12 bp, Homo sapiens
cgtcagcctcca

SEQ ID NO: 4471757 - DNA, 15 bp, Homo sapiens
cgtcagcctccagcc

SEQ ID NO: 4471758 - DNA, 20 bp, Homo sapiens
cgtcagcctccagcctctgt

SEQ ID NO: 4471759 - DNA, 22 bp, Homo sapiens
cgtcaggccctgactcctctgg

SEQ ID NO: 4471760 - DNA, 21 bp, Homo sapiens
cgtccagccgccattgccacc

SEQ ID NO: 4471761 - DNA, 19 bp, Homo sapiens
cgtcccagcatccctggag

SEQ ID NO: 4471762 - DNA, 19 bp, Homo sapiens
cgtcccagcctgcacccct

SEQ ID NO: 4471763 - DNA, 14 bp, Homo sapiens
cgtcccagctcccc

SEQ ID NO: 4471764 - DNA, 16 bp, Homo sapiens
cgtcccagctcccctc

SEQ ID NO: 4471765 - DNA, 21 bp, Homo sapiens
cgtcccagctcccctcttttg

SEQ ID NO: 4471766 - DNA, 14 bp, Homo sapiens
cgtcccctccgccg

SEQ ID NO: 4471767 - DNA, 21 bp, Homo sapiens
cgtcccctccgccgtgccggc

SEQ ID NO: 4471768 - DNA, 13 bp, Homo sapiens
cgtcccctgctac

SEQ ID NO: 4471769 - DNA, 17 bp, Homo sapiens
cgtcccgcgttcaagac

SEQ ID NO: 4471770 - DNA, 22 bp, Homo sapiens
cgtcccgctgctgtgctctggg

SEQ ID NO: 4471771 - DNA, 13 bp, Homo sapiens
cgtcctccccctg

SEQ ID NO: 4471772 - DNA, 16 bp, Homo sapiens
cgtcctccccctgcca

SEQ ID NO: 4471773 - DNA, 21 bp, Homo sapiens
cgtcctcctcacctcatgccc

SEQ ID NO: 4471774 - DNA, 13 bp, Homo sapiens
cgtcctcctctgt

SEQ ID NO: 4471775 - DNA, 14 bp, Homo sapiens
cgtcctcctctgtg

SEQ ID NO: 4471776 - DNA, 19 bp, Homo sapiens
cgtcgggcttccctggcct

SEQ ID NO: 4471777 - DNA, 18 bp, Homo sapiens
cgtcgttttacaagaaaa

SEQ ID NO: 4471778 - DNA, 21 bp, Homo sapiens
cgtctaatgggggcagtctcc

SEQ ID NO: 4471779 - DNA, 22 bp, Homo sapiens
cgtctaatgggggcagtctccc

SEQ ID NO: 4471780 - DNA, 19 bp, Homo sapiens
cgtctacatttcacattat

SEQ ID NO: 4471781 - DNA, 14 bp, Homo sapiens
cgtctccagctgct

SEQ ID NO: 4471782 - DNA, 21 bp, Homo sapiens
cgtctcccttggcccagagac

SEQ ID NO: 4471783 - DNA, 14 bp, Homo sapiens
cgtctctctcccat

SEQ ID NO: 4471784 - DNA, 23 bp, Homo sapiens
cgtctctctcccatggagcccca

SEQ ID NO: 4471785 - DNA, 18 bp, Homo sapiens
cgtctgccttggcatcct

SEQ ID NO: 4471786 - DNA, 17 bp, Homo sapiens
cgtctggggttcagccc

SEQ ID NO: 4471787 - DNA, 18 bp, Homo sapiens
cgtctggggttcagcccc

SEQ ID NO: 4471788 - DNA, 23 bp, Homo sapiens
cgtctggggttcagcccctcctc

SEQ ID NO: 4471789 - DNA, 18 bp, Homo sapiens
cgtctgtcaggggcttgg

SEQ ID NO: 4471790 - DNA, 16 bp, Homo sapiens
cgtgaatgtctcagcg

SEQ ID NO: 4471791 - DNA, 14 bp, Homo sapiens
cgtgactcacccaa

SEQ ID NO: 4471792 - DNA, 15 bp, Homo sapiens
cgtgactcacccaag

SEQ ID NO: 4471793 - DNA, 16 bp, Homo sapiens
cgtgactcacccaagc

SEQ ID NO: 4471794 - DNA, 17 bp, Homo sapiens
cgtgactcacccaagca

SEQ ID NO: 4471795 - DNA, 20 bp, Homo sapiens
cgtgactgccccaactcctg

SEQ ID NO: 4471796 - DNA, 23 bp, Homo sapiens
cgtgactgccccaactcctggaa

SEQ ID NO: 4471797 - DNA, 12 bp, Homo sapiens
cgtgagacacaa

SEQ ID NO: 4471798 - DNA, 16 bp, Homo sapiens
cgtgagcaccaccagg

SEQ ID NO: 4471799 - DNA, 23 bp, Homo sapiens
cgtgagcatgcacactgagaatg

SEQ ID NO: 4471800 - DNA, 14 bp, Homo sapiens
cgtgagccactgcg

SEQ ID NO: 4471801 - DNA, 20 bp, Homo sapiens
cgtgagccactgcgcccggc

SEQ ID NO: 4471802 - DNA, 23 bp, Homo sapiens
cgtgagctggggactcagggacc

SEQ ID NO: 4471803 - DNA, 19 bp, Homo sapiens
cgtgagtggacgtgtcagg

SEQ ID NO: 4471804 - DNA, 23 bp, Homo sapiens
cgtgagtggacgtgtcaggtggt

SEQ ID NO: 4471805 - DNA, 16 bp, Homo sapiens
cgtgatcttattgctt

SEQ ID NO: 4471806 - DNA, 17 bp, Homo sapiens
cgtgatggagaggacag

SEQ ID NO: 4471807 - DNA, 18 bp, Homo sapiens
cgtgatggagaggacaga

SEQ ID NO: 4471808 - DNA, 20 bp, Homo sapiens
cgtgatggagaggacagagc

SEQ ID NO: 4471809 - DNA, 15 bp, Homo sapiens
cgtgatgggcccgcc

SEQ ID NO: 4471810 - DNA, 16 bp, Homo sapiens
cgtgatgtggaggaag

SEQ ID NO: 4471811 - DNA, 21 bp, Homo sapiens
cgtgatgtggaggaagagcca

SEQ ID NO: 4471812 - DNA, 17 bp, Homo sapiens
cgtgcacgtggagagct

SEQ ID NO: 4471813 - DNA, 20 bp, Homo sapiens
cgtgcacgtggagagctggt

SEQ ID NO: 4471814 - DNA, 20 bp, Homo sapiens
cgtgcagcagggaaggccca

SEQ ID NO: 4471815 - DNA, 17 bp, Homo sapiens
cgtgcatccttgtaata

SEQ ID NO: 4471816 - DNA, 14 bp, Homo sapiens
cgtgcatggctcct

SEQ ID NO: 4471817 - DNA, 16 bp, Homo sapiens
cgtgccagctctagtt

SEQ ID NO: 4471818 - DNA, 15 bp, Homo sapiens
cgtgcccagctcttc

SEQ ID NO: 4471819 - DNA, 17 bp, Homo sapiens
cgtgcccccctcctcca

SEQ ID NO: 4471820 - DNA, 19 bp, Homo sapiens
cgtgcccccctcctccagt

SEQ ID NO: 4471821 - DNA, 15 bp, Homo sapiens
cgtgcctgagaccag

SEQ ID NO: 4471822 - DNA, 17 bp, Homo sapiens
cgtgcctgagaccaggg

SEQ ID NO: 4471823 - DNA, 19 bp, Homo sapiens
cgtgcctgagaccagggtg

SEQ ID NO: 4471824 - DNA, 23 bp, Homo sapiens
cgtgcctgagaccagggtggcca

SEQ ID NO: 4471825 - DNA, 15 bp, Homo sapiens
cgtgcctggccagat

SEQ ID NO: 4471826 - DNA, 12 bp, Homo sapiens
cgtgcctgggag

SEQ ID NO: 4471827 - DNA, 13 bp, Homo sapiens
cgtgcctgggaga

SEQ ID NO: 4471828 - DNA, 19 bp, Homo sapiens
cgtgcgcactgcatgggaa

SEQ ID NO: 4471829 - DNA, 19 bp, Homo sapiens
cgtgcgtgtgtgtgtgttt

SEQ ID NO: 4471830 - DNA, 13 bp, Homo sapiens
cgtgctacctgca

SEQ ID NO: 4471831 - DNA, 15 bp, Homo sapiens
cgtgctactgcactc

SEQ ID NO: 4471832 - DNA, 17 bp, Homo sapiens
cgtgctactgcactcca

SEQ ID NO: 4471833 - DNA, 13 bp, Homo sapiens
cgtgctcactgtg

SEQ ID NO: 4471834 - DNA, 15 bp, Homo sapiens
cgtgctcactgtgta

SEQ ID NO: 4471835 - DNA, 12 bp, Homo sapiens
cgtggaaacaca

SEQ ID NO: 4471836 - DNA, 16 bp, Homo sapiens
cgtggaaggagggatg

SEQ ID NO: 4471837 - DNA, 15 bp, Homo sapiens
cgtggacagcgctgt

SEQ ID NO: 4471838 - DNA, 19 bp, Homo sapiens
cgtggactgtgctggtgca

SEQ ID NO: 4471839 - DNA, 20 bp, Homo sapiens
cgtggagagctggtgcccgg

SEQ ID NO: 4471840 - DNA, 16 bp, Homo sapiens
cgtggccatccctgtg

SEQ ID NO: 4471841 - DNA, 19 bp, Homo sapiens
cgtggcgggaatgagctgt

SEQ ID NO: 4471842 - DNA, 20 bp, Homo sapiens
cgtggcgggaatgagctgtg

SEQ ID NO: 4471843 - DNA, 17 bp, Homo sapiens
cgtgggctccctgactg

SEQ ID NO: 4471844 - DNA, 17 bp, Homo sapiens
cgtgggcttaaagcaga

SEQ ID NO: 4471845 - DNA, 11 bp, Homo sapiens
cgtgggtcaga

SEQ ID NO: 4471846 - DNA, 12 bp, Homo sapiens
cgtgggtcagaa

SEQ ID NO: 4471847 - DNA, 17 bp, Homo sapiens
cgtggtcagagtgccac

SEQ ID NO: 4471848 - DNA, 10 bp, Homo sapiens
cgtggtttgc

SEQ ID NO: 4471849 - DNA, 21 bp, Homo sapiens
cgtggtttgcctgaggctgta

SEQ ID NO: 4471850 - DNA, 21 bp, Homo sapiens
cgtgtaacacgtgaaggcaat

SEQ ID NO: 4471851 - DNA, 23 bp, Homo sapiens
cgtgtcaggtggttaccaggcac

SEQ ID NO: 4471852 - DNA, 12 bp, Homo sapiens
cgtgtcctctcc

SEQ ID NO: 4471853 - DNA, 14 bp, Homo sapiens
cgtgtctcagcctc

SEQ ID NO: 4471854 - DNA, 15 bp, Homo sapiens
cgtgtctcagcctct

SEQ ID NO: 4471855 - DNA, 18 bp, Homo sapiens
cgtgtgacctccatactg

SEQ ID NO: 4471856 - DNA, 23 bp, Homo sapiens
cgtgtgagtgagggagacaggaa

SEQ ID NO: 4471857 - DNA, 21 bp, Homo sapiens
cgtgtgggtcccgcactctgc

SEQ ID NO: 4471858 - DNA, 17 bp, Homo sapiens
cgtgtgtccatgtgttc

SEQ ID NO: 4471859 - DNA, 23 bp, Homo sapiens
cgtgtgtgtggccggcctcctcc

SEQ ID NO: 4471860 - DNA, 18 bp, Homo sapiens
cgtgttccgcttctctct

SEQ ID NO: 4471861 - DNA, 12 bp, Homo sapiens
cgtgttctcagc

SEQ ID NO: 4471862 - DNA, 13 bp, Homo sapiens
cgtgttctcagca

SEQ ID NO: 4471863 - DNA, 15 bp, Homo sapiens
cgtgttgtatctaca

SEQ ID NO: 4471864 - DNA, 14 bp, Homo sapiens
cgtgtttctgactc

SEQ ID NO: 4471865 - DNA, 17 bp, Homo sapiens
cgtgtttgcttaaaata

SEQ ID NO: 4471866 - DNA, 23 bp, Homo sapiens
cgttaagcacaagacacagaata

SEQ ID NO: 4471867 - DNA, 18 bp, Homo sapiens
cgttaggaggacaaaagg

SEQ ID NO: 4471868 - DNA, 21 bp, Homo sapiens
cgttaggaggacaaaaggaat

SEQ ID NO: 4471869 - DNA, 16 bp, Homo sapiens
cgttagtaatctgtat

SEQ ID NO: 4471870 - DNA, 14 bp, Homo sapiens
cgttatatattgta

SEQ ID NO: 4471871 - DNA, 23 bp, Homo sapiens
cgttcaagacttgagcggagccc

SEQ ID NO: 4471872 - DNA, 11 bp, Homo sapiens
cgttccagccg

SEQ ID NO: 4471873 - DNA, 12 bp, Homo sapiens
cgttcctggcct

SEQ ID NO: 4471874 - DNA, 21 bp, Homo sapiens
cgttcgcagagcttttcagat

SEQ ID NO: 4471875 - DNA, 14 bp, Homo sapiens
cgttctattgtgtg

SEQ ID NO: 4471876 - DNA, 12 bp, Homo sapiens
cgttctcaagaa

SEQ ID NO: 4471877 - DNA, 15 bp, Homo sapiens
cgttctcaagaatct

SEQ ID NO: 4471878 - DNA, 14 bp, Homo sapiens
cgttctgctcatca

SEQ ID NO: 4471879 - DNA, 12 bp, Homo sapiens
cgttctgctggc

SEQ ID NO: 4471880 - DNA, 16 bp, Homo sapiens
cgttctggactctgcc

SEQ ID NO: 4471881 - DNA, 18 bp, Homo sapiens
cgttctggactctgcccc

SEQ ID NO: 4471882 - DNA, 23 bp, Homo sapiens
cgttgcaaccactgcaatatctt

SEQ ID NO: 4471883 - DNA, 13 bp, Homo sapiens
cgttgctgagcca

SEQ ID NO: 4471884 - DNA, 18 bp, Homo sapiens
cgttgctgagccagctgc

SEQ ID NO: 4471885 - DNA, 21 bp, Homo sapiens
cgttggagtttgggctggagc

SEQ ID NO: 4471886 - DNA, 16 bp, Homo sapiens
cgttgtcacacccatg

SEQ ID NO: 4471887 - DNA, 20 bp, Homo sapiens
cgttgtcacacccatggcct

SEQ ID NO: 4471888 - DNA, 11 bp, Homo sapiens
cgttgtgaggg

SEQ ID NO: 4471889 - DNA, 16 bp, Homo sapiens
cgttgtgtatattaca

SEQ ID NO: 4471890 - DNA, 19 bp, Homo sapiens
cgtttaaagttctgtgtat

SEQ ID NO: 4471891 - DNA, 17 bp, Homo sapiens
cgtttaagccaaaacaa

SEQ ID NO: 4471892 - DNA, 22 bp, Homo sapiens
cgtttaagccaaaacaatgttt

SEQ ID NO: 4471893 - DNA, 19 bp, Homo sapiens
cgtttaatcccagcacttt

SEQ ID NO: 4471894 - DNA, 15 bp, Homo sapiens
cgtttccatcatgtc

SEQ ID NO: 4471895 - DNA, 15 bp, Homo sapiens
cgtttccttacacat

SEQ ID NO: 4471896 - DNA, 14 bp, Homo sapiens
cgtttcctttgttg

SEQ ID NO: 4471897 - DNA, 17 bp, Homo sapiens
cgtttgaccttttatgt

SEQ ID NO: 4471898 - DNA, 15 bp, Homo sapiens
cgtttggttaaagta

SEQ ID NO: 4471899 - DNA, 19 bp, Homo sapiens
cgtttgtttgtttgtttaa

SEQ ID NO: 4471900 - DNA, 14 bp, Homo sapiens
cgttttccaaagag

SEQ ID NO: 4471901 - DNA, 19 bp, Homo sapiens
cgtttttcttcttgggccc

SEQ ID NO: 4471902 - DNA, 15 bp, Homo sapiens
cgtttttgtgctgtg

SEQ ID NO: 4471903 - DNA, 18 bp, Homo sapiens
cgtttttgtgctgtgggc

SEQ ID NO: 4471904 - DNA, 15 bp, Homo sapiens
ctaaaaaaaagatga

SEQ ID NO: 4471905 - DNA, 20 bp, Homo sapiens
ctaaaaaagctgaatcagac

SEQ ID NO: 4471906 - DNA, 16 bp, Homo sapiens
ctaaaaagttgaacca

SEQ ID NO: 4471907 - DNA, 22 bp, Homo sapiens
ctaaaaagttgaaccattatac

SEQ ID NO: 4471908 - DNA, 13 bp, Homo sapiens
ctaaaaatacaaa

SEQ ID NO: 4471909 - DNA, 14 bp, Homo sapiens
ctaaaaatattaaa

SEQ ID NO: 4471910 - DNA, 14 bp, Homo sapiens
ctaaaaatattgtt

SEQ ID NO: 4471911 - DNA, 12 bp, Homo sapiens
ctaaaaatgaag

SEQ ID NO: 4471912 - DNA, 12 bp, Homo sapiens
ctaaaagacatg

SEQ ID NO: 4471913 - DNA, 15 bp, Homo sapiens
ctaaaagcatgtata

SEQ ID NO: 4471914 - DNA, 16 bp, Homo sapiens
ctaaaaggcttccagg

SEQ ID NO: 4471915 - DNA, 17 bp, Homo sapiens
ctaaaaggcttccaggc

SEQ ID NO: 4471916 - DNA, 23 bp, Homo sapiens
ctaaaaggcttccaggctgagag

SEQ ID NO: 4471917 - DNA, 23 bp, Homo sapiens
ctaaaagtctccaaaacatttct

SEQ ID NO: 4471918 - DNA, 22 bp, Homo sapiens
ctaaaagttcataacagtgcca

SEQ ID NO: 4471919 - DNA, 15 bp, Homo sapiens
ctaaaatatataata

SEQ ID NO: 4471920 - DNA, 17 bp, Homo sapiens
ctaaaatcccaccagaa

SEQ ID NO: 4471921 - DNA, 19 bp, Homo sapiens
ctaaaatggcgaacatgtg

SEQ ID NO: 4471922 - DNA, 20 bp, Homo sapiens
ctaaaatggcgaacatgtgt

SEQ ID NO: 4471923 - DNA, 17 bp, Homo sapiens
ctaaaatgttttatgac

SEQ ID NO: 4471924 - DNA, 19 bp, Homo sapiens
ctaaaattatgttactgta

SEQ ID NO: 4471925 - DNA, 14 bp, Homo sapiens
ctaaaatttacaca

SEQ ID NO: 4471926 - DNA, 13 bp, Homo sapiens
ctaaaatttcata

SEQ ID NO: 4471927 - DNA, 20 bp, Homo sapiens
ctaaaatttcataattctga

SEQ ID NO: 4471928 - DNA, 13 bp, Homo sapiens
ctaaacatcattc

SEQ ID NO: 4471929 - DNA, 23 bp, Homo sapiens
ctaaacatcattcatttttgttg

SEQ ID NO: 4471930 - DNA, 19 bp, Homo sapiens
ctaaaccatctatgtgaat

SEQ ID NO: 4471931 - DNA, 19 bp, Homo sapiens
ctaaacccaatccaaatgg

SEQ ID NO: 4471932 - DNA, 18 bp, Homo sapiens
ctaaaccccatacctgga

SEQ ID NO: 4471933 - DNA, 13 bp, Homo sapiens
ctaaacctcagtt

SEQ ID NO: 4471934 - DNA, 17 bp, Homo sapiens
ctaaacctcagttatta

SEQ ID NO: 4471935 - DNA, 20 bp, Homo sapiens
ctaaacgagtcaatcccctc

SEQ ID NO: 4471936 - DNA, 16 bp, Homo sapiens
ctaaacggattccaaa

SEQ ID NO: 4471937 - DNA, 21 bp, Homo sapiens
ctaaactttttttctgtacca

SEQ ID NO: 4471938 - DNA, 23 bp, Homo sapiens
ctaaagaaaaatatcttggccta

SEQ ID NO: 4471939 - DNA, 18 bp, Homo sapiens
ctaaagagcccttgcctc

SEQ ID NO: 4471940 - DNA, 20 bp, Homo sapiens
ctaaagagcccttgcctccc

SEQ ID NO: 4471941 - DNA, 19 bp, Homo sapiens
ctaaagagttattcaaatg

SEQ ID NO: 4471942 - DNA, 21 bp, Homo sapiens
ctaaagagttattcaaatgaa

SEQ ID NO: 4471943 - DNA, 21 bp, Homo sapiens
ctaaagcactggtttcaagaa

SEQ ID NO: 4471944 - DNA, 14 bp, Homo sapiens
ctaaagctttatct

SEQ ID NO: 4471945 - DNA, 22 bp, Homo sapiens
ctaaagctttatctttgtgtaa

SEQ ID NO: 4471946 - DNA, 21 bp, Homo sapiens
ctaaaggactattatgtggaa

SEQ ID NO: 4471947 - DNA, 15 bp, Homo sapiens
ctaaaggatccagag

SEQ ID NO: 4471948 - DNA, 18 bp, Homo sapiens
ctaaaggatccagagagc

SEQ ID NO: 4471949 - DNA, 23 bp, Homo sapiens
ctaaaggatccagagagcagctc

SEQ ID NO: 4471950 - DNA, 23 bp, Homo sapiens
ctaaaggctaaacatatggcttt

SEQ ID NO: 4471951 - DNA, 14 bp, Homo sapiens
ctaaagggagaaat

SEQ ID NO: 4471952 - DNA, 18 bp, Homo sapiens
ctaaagggagaaatgcca

SEQ ID NO: 4471953 - DNA, 17 bp, Homo sapiens
ctaaagtaaaattgaag

SEQ ID NO: 4471954 - DNA, 24 bp, Homo sapiens
ctaaagtaaaattgaagcaactac

SEQ ID NO: 4471955 - DNA, 21 bp, Homo sapiens
ctaaagtacagcctggaccac

SEQ ID NO: 4471956 - DNA, 19 bp, Homo sapiens
ctaaagtagggaagtttta

SEQ ID NO: 4471957 - DNA, 15 bp, Homo sapiens
ctaaagtcctggccc

SEQ ID NO: 4471958 - DNA, 10 bp, Homo sapiens
ctaaagttat

SEQ ID NO: 4471959 - DNA, 13 bp, Homo sapiens
ctaaagttatatt

SEQ ID NO: 4471960 - DNA, 20 bp, Homo sapiens
ctaaataaaatttgttgcat

SEQ ID NO: 4471961 - DNA, 17 bp, Homo sapiens
ctaaatatatattatgc

SEQ ID NO: 4471962 - DNA, 13 bp, Homo sapiens
ctaaatgcaataa

SEQ ID NO: 4471963 - DNA, 15 bp, Homo sapiens
ctaaatgcccagttc

SEQ ID NO: 4471964 - DNA, 17 bp, Homo sapiens
ctaaatgcccagttcac

SEQ ID NO: 4471965 - DNA, 19 bp, Homo sapiens
ctaaatgctgttcttacac

SEQ ID NO: 4471966 - DNA, 21 bp, Homo sapiens
ctaaatgtgcaatagaaggtg

SEQ ID NO: 4471967 - DNA, 17 bp, Homo sapiens
ctaaatgtttaaagaaa

SEQ ID NO: 4471968 - DNA, 15 bp, Homo sapiens
ctaaattcagggaga

SEQ ID NO: 4471969 - DNA, 16 bp, Homo sapiens
ctaaatttctgccaag

SEQ ID NO: 4471970 - DNA, 20 bp, Homo sapiens
ctaaatttgtgctttttaag

SEQ ID NO: 4471971 - DNA, 16 bp, Homo sapiens
ctaaattttaaagcca

SEQ ID NO: 4471972 - DNA, 18 bp, Homo sapiens
ctaacaataatatttcaa

SEQ ID NO: 4471973 - DNA, 23 bp, Homo sapiens
ctaacaataatatttcaagtgcc

SEQ ID NO: 4471974 - DNA, 15 bp, Homo sapiens
ctaacaatgacattt

SEQ ID NO: 4471975 - DNA, 18 bp, Homo sapiens
ctaacaatgccttgttgt

SEQ ID NO: 4471976 - DNA, 17 bp, Homo sapiens
ctaacagcacagggaag

SEQ ID NO: 4471977 - DNA, 12 bp, Homo sapiens
ctaacagccctc

SEQ ID NO: 4471978 - DNA, 17 bp, Homo sapiens
ctaacagctacaaactt

SEQ ID NO: 4471979 - DNA, 12 bp, Homo sapiens
ctaacagggaga

SEQ ID NO: 4471980 - DNA, 17 bp, Homo sapiens
ctaacagttgccacatc

SEQ ID NO: 4471981 - DNA, 20 bp, Homo sapiens
ctaacagttgccacatcaca

SEQ ID NO: 4471982 - DNA, 18 bp, Homo sapiens
ctaacatatgatactgat

SEQ ID NO: 4471983 - DNA, 17 bp, Homo sapiens
ctaacattatattgcaa

SEQ ID NO: 4471984 - DNA, 22 bp, Homo sapiens
ctaacattatattgcaatgaag

SEQ ID NO: 4471985 - DNA, 17 bp, Homo sapiens
ctaacattattactttt

SEQ ID NO: 4471986 - DNA, 20 bp, Homo sapiens
ctaaccacttcgcacacacc

SEQ ID NO: 4471987 - DNA, 17 bp, Homo sapiens
ctaaccatccccaactc

SEQ ID NO: 4471988 - DNA, 18 bp, Homo sapiens
ctaaccatccccaactcc

SEQ ID NO: 4471989 - DNA, 14 bp, Homo sapiens
ctaaccatttatat

SEQ ID NO: 4471990 - DNA, 13 bp, Homo sapiens
ctaaccccaggcc

SEQ ID NO: 4471991 - DNA, 15 bp, Homo sapiens
ctaaccccaggcccc

SEQ ID NO: 4471992 - DNA, 21 bp, Homo sapiens
ctaacccccagcccacagagc

SEQ ID NO: 4471993 - DNA, 18 bp, Homo sapiens
ctaacccttaaaaatgca

SEQ ID NO: 4471994 - DNA, 15 bp, Homo sapiens
ctaacctcatcttct

SEQ ID NO: 4471995 - DNA, 12 bp, Homo sapiens
ctaacctgccga

SEQ ID NO: 4471996 - DNA, 21 bp, Homo sapiens
ctaacctgccgagagtccatc

SEQ ID NO: 4471997 - DNA, 17 bp, Homo sapiens
ctaacctgggttccctt

SEQ ID NO: 4471998 - DNA, 18 bp, Homo sapiens
ctaacgtccactagctta

SEQ ID NO: 4471999 - DNA, 18 bp, Homo sapiens
ctaactcaagataatcct

SEQ ID NO: 4472000 - DNA, 22 bp, Homo sapiens
ctaactcctgccattcttctgg

SEQ ID NO: 4472001 - DNA, 16 bp, Homo sapiens
ctaactgactctgtta

SEQ ID NO: 4472002 - DNA, 18 bp, Homo sapiens
ctaactgatgagtaaact

SEQ ID NO: 4472003 - DNA, 13 bp, Homo sapiens
ctaactgctgtta

SEQ ID NO: 4472004 - DNA, 23 bp, Homo sapiens
ctaactggaaacaaaacagaagg

SEQ ID NO: 4472005 - DNA, 14 bp, Homo sapiens
ctaactgtaaatca

SEQ ID NO: 4472006 - DNA, 15 bp, Homo sapiens
ctaactgtaaatcat

SEQ ID NO: 4472007 - DNA, 17 bp, Homo sapiens
ctaactgtaaatcatgt

SEQ ID NO: 4472008 - DNA, 12 bp, Homo sapiens
ctaactgtatat

SEQ ID NO: 4472009 - DNA, 14 bp, Homo sapiens
ctaactgtgatttg

SEQ ID NO: 4472010 - DNA, 16 bp, Homo sapiens
ctaacttcgaatatat

SEQ ID NO: 4472011 - DNA, 22 bp, Homo sapiens
ctaagaaatcaagtaatgaatc

SEQ ID NO: 4472012 - DNA, 12 bp, Homo sapiens
ctaagaagacat

SEQ ID NO: 4472013 - DNA, 14 bp, Homo sapiens
ctaagaagacattt

SEQ ID NO: 4472014 - DNA, 15 bp, Homo sapiens
ctaagaagacatttt

SEQ ID NO: 4472015 - DNA, 16 bp, Homo sapiens
ctaagaagacattttg

SEQ ID NO: 4472016 - DNA, 19 bp, Homo sapiens
ctaagaagacattttgtta

SEQ ID NO: 4472017 - DNA, 15 bp, Homo sapiens
ctaagaataataaaa

SEQ ID NO: 4472018 - DNA, 18 bp, Homo sapiens
ctaagaataataaaatca

SEQ ID NO: 4472019 - DNA, 21 bp, Homo sapiens
ctaagaatgtacagttgagct

SEQ ID NO: 4472020 - DNA, 17 bp, Homo sapiens
ctaagacatttttcatt

SEQ ID NO: 4472021 - DNA, 14 bp, Homo sapiens
ctaagactctgtgt

SEQ ID NO: 4472022 - DNA, 23 bp, Homo sapiens
ctaagactctgtgtggctgtgca

SEQ ID NO: 4472023 - DNA, 16 bp, Homo sapiens
ctaagagaagttattt

SEQ ID NO: 4472024 - DNA, 21 bp, Homo sapiens
ctaagagaagttgtaaagtat

SEQ ID NO: 4472025 - DNA, 19 bp, Homo sapiens
ctaagagacagttctctgt

SEQ ID NO: 4472026 - DNA, 20 bp, Homo sapiens
ctaagagctagcgctgccgc

SEQ ID NO: 4472027 - DNA, 19 bp, Homo sapiens
ctaagatacactgcacttt

SEQ ID NO: 4472028 - DNA, 20 bp, Homo sapiens
ctaagatgaagctgagcttt

SEQ ID NO: 4472029 - DNA, 15 bp, Homo sapiens
ctaagcaaaatgtga

SEQ ID NO: 4472030 - DNA, 18 bp, Homo sapiens
ctaagcaaaatgtgatat

SEQ ID NO: 4472031 - DNA, 13 bp, Homo sapiens
ctaagcacttcta

SEQ ID NO: 4472032 - DNA, 16 bp, Homo sapiens
ctaagcacttctagaa

SEQ ID NO: 4472033 - DNA, 21 bp, Homo sapiens
ctaagcataaaagatgaaaga

SEQ ID NO: 4472034 - DNA, 24 bp, Homo sapiens
ctaagcatgtgtcccaggagcagg

SEQ ID NO: 4472035 - DNA, 14 bp, Homo sapiens
ctaagcctacctgc

SEQ ID NO: 4472036 - DNA, 16 bp, Homo sapiens
ctaagcctacctgctc

SEQ ID NO: 4472037 - DNA, 15 bp, Homo sapiens
ctaagctgctctaaa

SEQ ID NO: 4472038 - DNA, 14 bp, Homo sapiens
ctaaggaaccaaca

SEQ ID NO: 4472039 - DNA, 20 bp, Homo sapiens
ctaaggaggggaaaaaaatg

SEQ ID NO: 4472040 - DNA, 17 bp, Homo sapiens
ctaaggatacctgcttt

SEQ ID NO: 4472041 - DNA, 11 bp, Homo sapiens
ctaaggcagct

SEQ ID NO: 4472042 - DNA, 13 bp, Homo sapiens
ctaaggcagctga

SEQ ID NO: 4472043 - DNA, 15 bp, Homo sapiens
ctaaggctcctcctt

SEQ ID NO: 4472044 - DNA, 23 bp, Homo sapiens
ctaaggggcttgtgttctgctcc

SEQ ID NO: 4472045 - DNA, 14 bp, Homo sapiens
ctaaggtctcatgc

SEQ ID NO: 4472046 - DNA, 21 bp, Homo sapiens
ctaaggttgtctacgggggca

SEQ ID NO: 4472047 - DNA, 17 bp, Homo sapiens
ctaagtaatttagaaga

SEQ ID NO: 4472048 - DNA, 19 bp, Homo sapiens
ctaagtaatttagaagata

SEQ ID NO: 4472049 - DNA, 20 bp, Homo sapiens
ctaagtacacaataagcaaa

SEQ ID NO: 4472050 - DNA, 17 bp, Homo sapiens
ctaagtgctaagtgctt

SEQ ID NO: 4472051 - DNA, 19 bp, Homo sapiens
ctaagtggctgccttcttt

SEQ ID NO: 4472052 - DNA, 20 bp, Homo sapiens
ctaagtggctgccttctttc

SEQ ID NO: 4472053 - DNA, 12 bp, Homo sapiens
ctaataaaataa

SEQ ID NO: 4472054 - DNA, 15 bp, Homo sapiens
ctaataaagagactg

SEQ ID NO: 4472055 - DNA, 13 bp, Homo sapiens
ctaataaataatc

SEQ ID NO: 4472056 - DNA, 19 bp, Homo sapiens
ctaataatgagctattaaa

SEQ ID NO: 4472057 - DNA, 17 bp, Homo sapiens
ctaatatacagggtagc

SEQ ID NO: 4472058 - DNA, 23 bp, Homo sapiens
ctaatatactttttttgttatag

SEQ ID NO: 4472059 - DNA, 14 bp, Homo sapiens
ctaatatatttaaa

SEQ ID NO: 4472060 - DNA, 17 bp, Homo sapiens
ctaatatatttaaaaat

SEQ ID NO: 4472061 - DNA, 18 bp, Homo sapiens
ctaatatgattatacaaa

SEQ ID NO: 4472062 - DNA, 20 bp, Homo sapiens
ctaatatggccacagtagtc

SEQ ID NO: 4472063 - DNA, 22 bp, Homo sapiens
ctaatattagttggctttcata

SEQ ID NO: 4472064 - DNA, 18 bp, Homo sapiens
ctaatcaccatgtaagca

SEQ ID NO: 4472065 - DNA, 19 bp, Homo sapiens
ctaatcaccatgtaagcac

SEQ ID NO: 4472066 - DNA, 23 bp, Homo sapiens
ctaatcagattgcttaaaagcat

SEQ ID NO: 4472067 - DNA, 19 bp, Homo sapiens
ctaatcatacaccagaaga

SEQ ID NO: 4472068 - DNA, 12 bp, Homo sapiens
ctaatccttttc

SEQ ID NO: 4472069 - DNA, 22 bp, Homo sapiens
ctaatccttttccttatttgcc

SEQ ID NO: 4472070 - DNA, 18 bp, Homo sapiens
ctaatctaacaatggaag

SEQ ID NO: 4472071 - DNA, 11 bp, Homo sapiens
ctaatctgcct

SEQ ID NO: 4472072 - DNA, 18 bp, Homo sapiens
ctaatgaaagtgatgaca

SEQ ID NO: 4472073 - DNA, 21 bp, Homo sapiens
ctaatgaaggttttcatttgc

SEQ ID NO: 4472074 - DNA, 17 bp, Homo sapiens
ctaatgaggagagaaaa

SEQ ID NO: 4472075 - DNA, 14 bp, Homo sapiens
ctaatggagaagac

SEQ ID NO: 4472076 - DNA, 14 bp, Homo sapiens
ctaatgtcacaaca

SEQ ID NO: 4472077 - DNA, 17 bp, Homo sapiens
ctaattaaccttactaa

SEQ ID NO: 4472078 - DNA, 18 bp, Homo sapiens
ctaattaaccttactaat

SEQ ID NO: 4472079 - DNA, 20 bp, Homo sapiens
ctaattcaaggaatttctta

SEQ ID NO: 4472080 - DNA, 16 bp, Homo sapiens
ctaattcacagtgctc

SEQ ID NO: 4472081 - DNA, 16 bp, Homo sapiens
ctaattcagtgtcaca

SEQ ID NO: 4472082 - DNA, 17 bp, Homo sapiens
ctaattccacacctttt

SEQ ID NO: 4472083 - DNA, 20 bp, Homo sapiens
ctaattcccaacatttctta

SEQ ID NO: 4472084 - DNA, 19 bp, Homo sapiens
ctaattctgggaagggaga

SEQ ID NO: 4472085 - DNA, 19 bp, Homo sapiens
ctaattctgtgattaaaat

SEQ ID NO: 4472086 - DNA, 15 bp, Homo sapiens
ctaattggaaagtgc

SEQ ID NO: 4472087 - DNA, 17 bp, Homo sapiens
ctaattggaaagtgcca

SEQ ID NO: 4472088 - DNA, 13 bp, Homo sapiens
ctaatttaacacc

SEQ ID NO: 4472089 - DNA, 17 bp, Homo sapiens
ctaatttataaaaaggt

SEQ ID NO: 4472090 - DNA, 19 bp, Homo sapiens
ctaatttatactttaaagt

SEQ ID NO: 4472091 - DNA, 17 bp, Homo sapiens
ctaatttattctaaatt

SEQ ID NO: 4472092 - DNA, 15 bp, Homo sapiens
ctaatttcattttag

SEQ ID NO: 4472093 - DNA, 14 bp, Homo sapiens
ctaatttctcctcc

SEQ ID NO: 4472094 - DNA, 13 bp, Homo sapiens
ctaatttgcatta

SEQ ID NO: 4472095 - DNA, 14 bp, Homo sapiens
ctaatttgcattaa

SEQ ID NO: 4472096 - DNA, 22 bp, Homo sapiens
ctaatttgtaggaaaaagcaag

SEQ ID NO: 4472097 - DNA, 22 bp, Homo sapiens
ctaatttttattaattttagtt

SEQ ID NO: 4472098 - DNA, 13 bp, Homo sapiens
ctaatttttgtat

SEQ ID NO: 4472099 - DNA, 16 bp, Homo sapiens
ctaattttttgttgtt

SEQ ID NO: 4472100 - DNA, 16 bp, Homo sapiens
ctaatttttttgtatt

SEQ ID NO: 4472101 - DNA, 20 bp, Homo sapiens
ctaatttttttgtattttag

SEQ ID NO: 4472102 - DNA, 18 bp, Homo sapiens
ctacaaaaacacagcaag

SEQ ID NO: 4472103 - DNA, 20 bp, Homo sapiens
ctacaaaaacacagcaaggg

SEQ ID NO: 4472104 - DNA, 15 bp, Homo sapiens
ctacaaacaaaattt

SEQ ID NO: 4472105 - DNA, 21 bp, Homo sapiens
ctacaaacaaaatttctatta

SEQ ID NO: 4472106 - DNA, 13 bp, Homo sapiens
ctacaaagaaaaa

SEQ ID NO: 4472107 - DNA, 10 bp, Homo sapiens
ctacaaatca

SEQ ID NO: 4472108 - DNA, 15 bp, Homo sapiens
ctacaaatcagtaat

SEQ ID NO: 4472109 - DNA, 17 bp, Homo sapiens
ctacaagagcagcctgt

SEQ ID NO: 4472110 - DNA, 18 bp, Homo sapiens
ctacaagagcagcctgtg

SEQ ID NO: 4472111 - DNA, 22 bp, Homo sapiens
ctacaagagcagcctgtggcat

SEQ ID NO: 4472112 - DNA, 23 bp, Homo sapiens
ctacaagagcagcctgtggcatc

SEQ ID NO: 4472113 - DNA, 18 bp, Homo sapiens
ctacaatattctctctta

SEQ ID NO: 4472114 - DNA, 20 bp, Homo sapiens
ctacacaatacagtattata

SEQ ID NO: 4472115 - DNA, 13 bp, Homo sapiens
ctacaccaatgaa

SEQ ID NO: 4472116 - DNA, 16 bp, Homo sapiens
ctacacccttttccag

SEQ ID NO: 4472117 - DNA, 14 bp, Homo sapiens
ctacacctccctcc

SEQ ID NO: 4472118 - DNA, 12 bp, Homo sapiens
ctacacctggct

SEQ ID NO: 4472119 - DNA, 13 bp, Homo sapiens
ctacacctggctg

SEQ ID NO: 4472120 - DNA, 22 bp, Homo sapiens
ctacacgcatgatggagctgat

SEQ ID NO: 4472121 - DNA, 15 bp, Homo sapiens
ctacactcacctgca

SEQ ID NO: 4472122 - DNA, 17 bp, Homo sapiens
ctacactccagtgagac

SEQ ID NO: 4472123 - DNA, 15 bp, Homo sapiens
ctacactctcctggg

SEQ ID NO: 4472124 - DNA, 17 bp, Homo sapiens
ctacactctcctgggcc

SEQ ID NO: 4472125 - DNA, 23 bp, Homo sapiens
ctacactcttgtaataaaatgtc

SEQ ID NO: 4472126 - DNA, 21 bp, Homo sapiens
ctacagaaaccaggtaagccc

SEQ ID NO: 4472127 - DNA, 15 bp, Homo sapiens
ctacagaacaaccca

SEQ ID NO: 4472128 - DNA, 19 bp, Homo sapiens
ctacagaacaacccaccat

SEQ ID NO: 4472129 - DNA, 21 bp, Homo sapiens
ctacagaatattaaatattat

SEQ ID NO: 4472130 - DNA, 17 bp, Homo sapiens
ctacagactccatctct

SEQ ID NO: 4472131 - DNA, 18 bp, Homo sapiens
ctacagactccatctctt

SEQ ID NO: 4472132 - DNA, 20 bp, Homo sapiens
ctacagagcttccctgactc

SEQ ID NO: 4472133 - DNA, 14 bp, Homo sapiens
ctacagatgagtca

SEQ ID NO: 4472134 - DNA, 19 bp, Homo sapiens
ctacagcactactgggtgt

SEQ ID NO: 4472135 - DNA, 22 bp, Homo sapiens
ctacagcactactgggtgtcat

SEQ ID NO: 4472136 - DNA, 18 bp, Homo sapiens
ctacagctatatttgatt

SEQ ID NO: 4472137 - DNA, 11 bp, Homo sapiens
ctacagctcca

SEQ ID NO: 4472138 - DNA, 18 bp, Homo sapiens
ctacagtcaagatagaaa

SEQ ID NO: 4472139 - DNA, 14 bp, Homo sapiens
ctacagtcaggaaa

SEQ ID NO: 4472140 - DNA, 21 bp, Homo sapiens
ctacagtcaggaaaggaatca

SEQ ID NO: 4472141 - DNA, 23 bp, Homo sapiens
ctacagtgatgattgaattctaa

SEQ ID NO: 4472142 - DNA, 17 bp, Homo sapiens
ctacagtgtacagtctt

SEQ ID NO: 4472143 - DNA, 18 bp, Homo sapiens
ctacagttttaactgtgg

SEQ ID NO: 4472144 - DNA, 18 bp, Homo sapiens
ctacatactatggaattt

SEQ ID NO: 4472145 - DNA, 22 bp, Homo sapiens
ctacatatttgtatgtttttct

SEQ ID NO: 4472146 - DNA, 23 bp, Homo sapiens
ctacatatttgtatgtttttctg

SEQ ID NO: 4472147 - DNA, 19 bp, Homo sapiens
ctacatgacgacaaagctg

SEQ ID NO: 4472148 - DNA, 22 bp, Homo sapiens
ctacatgacgggttgtgagact

SEQ ID NO: 4472149 - DNA, 17 bp, Homo sapiens
ctacatgagaacaaaca

SEQ ID NO: 4472150 - DNA, 23 bp, Homo sapiens
ctacatgcagcccatgcccacct

SEQ ID NO: 4472151 - DNA, 14 bp, Homo sapiens
ctacatgctgaaaa

SEQ ID NO: 4472152 - DNA, 16 bp, Homo sapiens
ctacatgctgaaaaat

SEQ ID NO: 4472153 - DNA, 20 bp, Homo sapiens
ctacatgtctagagaacact

SEQ ID NO: 4472154 - DNA, 12 bp, Homo sapiens
ctacattaaaca

SEQ ID NO: 4472155 - DNA, 18 bp, Homo sapiens
ctacattccaaagaaaca

SEQ ID NO: 4472156 - DNA, 19 bp, Homo sapiens
ctacattcttggttgttaa

SEQ ID NO: 4472157 - DNA, 18 bp, Homo sapiens
ctacatttctactatgat

SEQ ID NO: 4472158 - DNA, 18 bp, Homo sapiens
ctaccaaaaaaaggaagg

SEQ ID NO: 4472159 - DNA, 15 bp, Homo sapiens
ctaccacacacagcc

SEQ ID NO: 4472160 - DNA, 12 bp, Homo sapiens
ctaccactctaa

SEQ ID NO: 4472161 - DNA, 18 bp, Homo sapiens
ctaccactctaatcaaga

SEQ ID NO: 4472162 - DNA, 22 bp, Homo sapiens
ctaccactgtggccccaagagg

SEQ ID NO: 4472163 - DNA, 13 bp, Homo sapiens
ctaccagccagcc

SEQ ID NO: 4472164 - DNA, 16 bp, Homo sapiens
ctaccagccagcctca

SEQ ID NO: 4472165 - DNA, 20 bp, Homo sapiens
ctaccagccagcctcagaag

SEQ ID NO: 4472166 - DNA, 20 bp, Homo sapiens
ctaccagtatttagaagcca

SEQ ID NO: 4472167 - DNA, 15 bp, Homo sapiens
ctaccatcagctctg

SEQ ID NO: 4472168 - DNA, 23 bp, Homo sapiens
ctaccatggttctgcctcctggc

SEQ ID NO: 4472169 - DNA, 14 bp, Homo sapiens
ctaccccagttcct

SEQ ID NO: 4472170 - DNA, 15 bp, Homo sapiens
ctaccccagttccta

SEQ ID NO: 4472171 - DNA, 17 bp, Homo sapiens
ctaccccctaagagcca

SEQ ID NO: 4472172 - DNA, 14 bp, Homo sapiens
ctaccccctgtgcc

SEQ ID NO: 4472173 - DNA, 15 bp, Homo sapiens
ctacccgctgtggcc

SEQ ID NO: 4472174 - DNA, 16 bp, Homo sapiens
ctacccgctgtggccg

SEQ ID NO: 4472175 - DNA, 16 bp, Homo sapiens
ctaccctaaccaagtt

SEQ ID NO: 4472176 - DNA, 15 bp, Homo sapiens
ctaccctcccaccag

SEQ ID NO: 4472177 - DNA, 14 bp, Homo sapiens
ctaccctcccaccc

SEQ ID NO: 4472178 - DNA, 16 bp, Homo sapiens
ctaccctcccaccccc

SEQ ID NO: 4472179 - DNA, 17 bp, Homo sapiens
ctaccctcctgcactgt

SEQ ID NO: 4472180 - DNA, 13 bp, Homo sapiens
ctaccctgagatc

SEQ ID NO: 4472181 - DNA, 17 bp, Homo sapiens
ctaccctgagctgaggc

SEQ ID NO: 4472182 - DNA, 22 bp, Homo sapiens
ctaccggacactcgtcacccca

SEQ ID NO: 4472183 - DNA, 16 bp, Homo sapiens
ctaccgtcttttcctg

SEQ ID NO: 4472184 - DNA, 14 bp, Homo sapiens
ctacctcaggcagg

SEQ ID NO: 4472185 - DNA, 13 bp, Homo sapiens
ctacctcagtgct

SEQ ID NO: 4472186 - DNA, 16 bp, Homo sapiens
ctacctcagtgctcct

SEQ ID NO: 4472187 - DNA, 15 bp, Homo sapiens
ctacctgccactcac

SEQ ID NO: 4472188 - DNA, 12 bp, Homo sapiens
ctacctgccctc

SEQ ID NO: 4472189 - DNA, 16 bp, Homo sapiens
ctacctgcttggtctt

SEQ ID NO: 4472190 - DNA, 22 bp, Homo sapiens
ctacctgtgtttttttctaaaa

SEQ ID NO: 4472191 - DNA, 15 bp, Homo sapiens
ctacctgtttgaagg

SEQ ID NO: 4472192 - DNA, 13 bp, Homo sapiens
ctaccttcctgtc

SEQ ID NO: 4472193 - DNA, 14 bp, Homo sapiens
ctaccttcctgtcc

SEQ ID NO: 4472194 - DNA, 19 bp, Homo sapiens
ctaccttcctgtccctgag

SEQ ID NO: 4472195 - DNA, 14 bp, Homo sapiens
ctaccttgaaaata

SEQ ID NO: 4472196 - DNA, 17 bp, Homo sapiens
ctaccttttaaaattga

SEQ ID NO: 4472197 - DNA, 14 bp, Homo sapiens
ctacctttttatat

SEQ ID NO: 4472198 - DNA, 15 bp, Homo sapiens
ctacctttttatatt

SEQ ID NO: 4472199 - DNA, 20 bp, Homo sapiens
ctacgagggaggaacacctg

SEQ ID NO: 4472200 - DNA, 21 bp, Homo sapiens
ctacgagggaggaacacctga

SEQ ID NO: 4472201 - DNA, 23 bp, Homo sapiens
ctacgtatttttctgacttttac

SEQ ID NO: 4472202 - DNA, 14 bp, Homo sapiens
ctactaaaaataca

SEQ ID NO: 4472203 - DNA, 15 bp, Homo sapiens
ctactaaaaatacaa

SEQ ID NO: 4472204 - DNA, 20 bp, Homo sapiens
ctactaaaattcaaaaacaa

SEQ ID NO: 4472205 - DNA, 21 bp, Homo sapiens
ctactaaggggcttgtgttct

SEQ ID NO: 4472206 - DNA, 17 bp, Homo sapiens
ctactaatagaataaag

SEQ ID NO: 4472207 - DNA, 18 bp, Homo sapiens
ctactaatagaataaagg

SEQ ID NO: 4472208 - DNA, 14 bp, Homo sapiens
ctactatgatcaga

SEQ ID NO: 4472209 - DNA, 14 bp, Homo sapiens
ctactattggccct

SEQ ID NO: 4472210 - DNA, 15 bp, Homo sapiens
ctactattttggaaa

SEQ ID NO: 4472211 - DNA, 17 bp, Homo sapiens
ctactcagcagccctcc

SEQ ID NO: 4472212 - DNA, 22 bp, Homo sapiens
ctactcagcagccctcctcacc

SEQ ID NO: 4472213 - DNA, 15 bp, Homo sapiens
ctactcaggaggctg

SEQ ID NO: 4472214 - DNA, 20 bp, Homo sapiens
ctactcaggaggctgagaca

SEQ ID NO: 4472215 - DNA, 16 bp, Homo sapiens
ctactcctagaagaac

SEQ ID NO: 4472216 - DNA, 14 bp, Homo sapiens
ctactcctctgcag

SEQ ID NO: 4472217 - DNA, 11 bp, Homo sapiens
ctactcctgcc

SEQ ID NO: 4472218 - DNA, 13 bp, Homo sapiens
ctactcctgtgct

SEQ ID NO: 4472219 - DNA, 17 bp, Homo sapiens
ctactcgatagcctgag

SEQ ID NO: 4472220 - DNA, 14 bp, Homo sapiens
ctactctaccatgg

SEQ ID NO: 4472221 - DNA, 22 bp, Homo sapiens
ctactctaccatggttctgcct

SEQ ID NO: 4472222 - DNA, 22 bp, Homo sapiens
ctactctcaggtttttgaggaa

SEQ ID NO: 4472223 - DNA, 20 bp, Homo sapiens
ctactctccccacgagggct

SEQ ID NO: 4472224 - DNA, 21 bp, Homo sapiens
ctactctccccacgagggctg

SEQ ID NO: 4472225 - DNA, 22 bp, Homo sapiens
ctactctccccacgagggctgg

SEQ ID NO: 4472226 - DNA, 23 bp, Homo sapiens
ctactctccccacgagggctggc

SEQ ID NO: 4472227 - DNA, 23 bp, Homo sapiens
ctactctggaatgtttttccctc

SEQ ID NO: 4472228 - DNA, 12 bp, Homo sapiens
ctactctttgat

SEQ ID NO: 4472229 - DNA, 19 bp, Homo sapiens
ctactgaaccctgcctctt

SEQ ID NO: 4472230 - DNA, 16 bp, Homo sapiens
ctactgaattggcttc

SEQ ID NO: 4472231 - DNA, 15 bp, Homo sapiens
ctactgacagggagc

SEQ ID NO: 4472232 - DNA, 17 bp, Homo sapiens
ctactgcactccagcct

SEQ ID NO: 4472233 - DNA, 18 bp, Homo sapiens
ctactgcactccagcctg

SEQ ID NO: 4472234 - DNA, 14 bp, Homo sapiens
ctactgccatcctg

SEQ ID NO: 4472235 - DNA, 18 bp, Homo sapiens
ctactgccatcctggccc

SEQ ID NO: 4472236 - DNA, 13 bp, Homo sapiens
ctactgctcagct

SEQ ID NO: 4472237 - DNA, 16 bp, Homo sapiens
ctactggattcttatt

SEQ ID NO: 4472238 - DNA, 16 bp, Homo sapiens
ctactggggaggctga

SEQ ID NO: 4472239 - DNA, 17 bp, Homo sapiens
ctactggggaggctgag

SEQ ID NO: 4472240 - DNA, 23 bp, Homo sapiens
ctactgggtgtcatttcattcca

SEQ ID NO: 4472241 - DNA, 11 bp, Homo sapiens
ctactgtgtaa

SEQ ID NO: 4472242 - DNA, 15 bp, Homo sapiens
ctactgtttgatttg

SEQ ID NO: 4472243 - DNA, 20 bp, Homo sapiens
ctacttacccaggtgggtcc

SEQ ID NO: 4472244 - DNA, 20 bp, Homo sapiens
ctacttctggaagtcatctc

SEQ ID NO: 4472245 - DNA, 17 bp, Homo sapiens
ctacttctgtaattgtg

SEQ ID NO: 4472246 - DNA, 20 bp, Homo sapiens
ctacttgaaggtacacccca

SEQ ID NO: 4472247 - DNA, 15 bp, Homo sapiens
ctacttgcctcattt

SEQ ID NO: 4472248 - DNA, 22 bp, Homo sapiens
ctacttggcaaggtcatagaca

SEQ ID NO: 4472249 - DNA, 19 bp, Homo sapiens
ctacttgggaggctgagat

SEQ ID NO: 4472250 - DNA, 18 bp, Homo sapiens
ctacttgtaaaatgcttt

SEQ ID NO: 4472251 - DNA, 21 bp, Homo sapiens
ctacttgtaaaatgcttttca

SEQ ID NO: 4472252 - DNA, 16 bp, Homo sapiens
ctacttgttcatttgg

SEQ ID NO: 4472253 - DNA, 21 bp, Homo sapiens
ctactttaacctatgataatt

SEQ ID NO: 4472254 - DNA, 18 bp, Homo sapiens
ctactttcatcttaaact

SEQ ID NO: 4472255 - DNA, 19 bp, Homo sapiens
ctactttcatcttaaacta

SEQ ID NO: 4472256 - DNA, 21 bp, Homo sapiens
ctactttcatcttaaactaat

SEQ ID NO: 4472257 - DNA, 23 bp, Homo sapiens
ctactttcatcttaaactaatac

SEQ ID NO: 4472258 - DNA, 14 bp, Homo sapiens
ctactttctctctc

SEQ ID NO: 4472259 - DNA, 18 bp, Homo sapiens
ctactttgactttttgca

SEQ ID NO: 4472260 - DNA, 16 bp, Homo sapiens
ctagaaacttccaaat

SEQ ID NO: 4472261 - DNA, 13 bp, Homo sapiens
ctagaaattttca

SEQ ID NO: 4472262 - DNA, 18 bp, Homo sapiens
ctagaacctggaagggct

SEQ ID NO: 4472263 - DNA, 18 bp, Homo sapiens
ctagaacctggagggctg

SEQ ID NO: 4472264 - DNA, 19 bp, Homo sapiens
ctagaacgtgcatccttgt

SEQ ID NO: 4472265 - DNA, 23 bp, Homo sapiens
ctagaacgtgcatccttgtaata

SEQ ID NO: 4472266 - DNA, 17 bp, Homo sapiens
ctagaactatcattttt

SEQ ID NO: 4472267 - DNA, 18 bp, Homo sapiens
ctagaagaaccaaatacc

SEQ ID NO: 4472268 - DNA, 19 bp, Homo sapiens
ctagaagaaccaaatacct

SEQ ID NO: 4472269 - DNA, 19 bp, Homo sapiens
ctagaagagtctattgtct

SEQ ID NO: 4472270 - DNA, 20 bp, Homo sapiens
ctagaagagtctattgtctc

SEQ ID NO: 4472271 - DNA, 18 bp, Homo sapiens
ctagaagatgtgtaaaca

SEQ ID NO: 4472272 - DNA, 21 bp, Homo sapiens
ctagaagccaagggaaagggg

SEQ ID NO: 4472273 - DNA, 14 bp, Homo sapiens
ctagaatcatactt

SEQ ID NO: 4472274 - DNA, 16 bp, Homo sapiens
ctagaattgagtgttt

SEQ ID NO: 4472275 - DNA, 21 bp, Homo sapiens
ctagaatttatcacacttctg

SEQ ID NO: 4472276 - DNA, 15 bp, Homo sapiens
ctagacacaatttca

SEQ ID NO: 4472277 - DNA, 23 bp, Homo sapiens
ctagacacatgaaggtaaataaa

SEQ ID NO: 4472278 - DNA, 16 bp, Homo sapiens
ctagacgcaccgcctg

SEQ ID NO: 4472279 - DNA, 15 bp, Homo sapiens
ctagacgcccctccc

SEQ ID NO: 4472280 - DNA, 19 bp, Homo sapiens
ctagactagcaatctcttc

SEQ ID NO: 4472281 - DNA, 17 bp, Homo sapiens
ctagactcaaaacctgg

SEQ ID NO: 4472282 - DNA, 21 bp, Homo sapiens
ctagactcaaaacctggagat

SEQ ID NO: 4472283 - DNA, 15 bp, Homo sapiens
ctagactgttacttt

SEQ ID NO: 4472284 - DNA, 14 bp, Homo sapiens
ctagacttccccat

SEQ ID NO: 4472285 - DNA, 15 bp, Homo sapiens
ctagacttccccatc

SEQ ID NO: 4472286 - DNA, 10 bp, Homo sapiens
ctagagaaac

SEQ ID NO: 4472287 - DNA, 22 bp, Homo sapiens
ctagagaacagtattgggcagg

SEQ ID NO: 4472288 - DNA, 21 bp, Homo sapiens
ctagagaatgcacagatatac

SEQ ID NO: 4472289 - DNA, 14 bp, Homo sapiens
ctagagacagatgc

SEQ ID NO: 4472290 - DNA, 21 bp, Homo sapiens
ctagagacagatgctggtgga

SEQ ID NO: 4472291 - DNA, 15 bp, Homo sapiens
ctagagatattttgt

SEQ ID NO: 4472292 - DNA, 21 bp, Homo sapiens
ctagagcaacttttcttggaa

SEQ ID NO: 4472293 - DNA, 14 bp, Homo sapiens
ctagagcagacagg

SEQ ID NO: 4472294 - DNA, 18 bp, Homo sapiens
ctagaggccagccccacc

SEQ ID NO: 4472295 - DNA, 23 bp, Homo sapiens
ctagaggctccagctctggcaca

SEQ ID NO: 4472296 - DNA, 17 bp, Homo sapiens
ctagaggtgagaaattt

SEQ ID NO: 4472297 - DNA, 19 bp, Homo sapiens
ctagaggtgagaaatttaa

SEQ ID NO: 4472298 - DNA, 17 bp, Homo sapiens
ctagagttatcttcttt

SEQ ID NO: 4472299 - DNA, 16 bp, Homo sapiens
ctagagttttatcaac

SEQ ID NO: 4472300 - DNA, 16 bp, Homo sapiens
ctagatacaataaatt

SEQ ID NO: 4472301 - DNA, 14 bp, Homo sapiens
ctagatatgaatat

SEQ ID NO: 4472302 - DNA, 10 bp, Homo sapiens
ctagatccag

SEQ ID NO: 4472303 - DNA, 20 bp, Homo sapiens
ctagatcctgcaccccagca

SEQ ID NO: 4472304 - DNA, 17 bp, Homo sapiens
ctagatgaagttttaca

SEQ ID NO: 4472305 - DNA, 21 bp, Homo sapiens
ctagatgattttttgaaagtt

SEQ ID NO: 4472306 - DNA, 22 bp, Homo sapiens
ctagatgcacgtggggcccact

SEQ ID NO: 4472307 - DNA, 17 bp, Homo sapiens
ctagatggaccccagca

SEQ ID NO: 4472308 - DNA, 15 bp, Homo sapiens
ctagattacatctgc

SEQ ID NO: 4472309 - DNA, 18 bp, Homo sapiens
ctagattacatctgcctt

SEQ ID NO: 4472310 - DNA, 11 bp, Homo sapiens
ctagcaactct

SEQ ID NO: 4472311 - DNA, 20 bp, Homo sapiens
ctagcaatacagggaggctc

SEQ ID NO: 4472312 - DNA, 13 bp, Homo sapiens
ctagcacagaggc

SEQ ID NO: 4472313 - DNA, 17 bp, Homo sapiens
ctagcacagaggcctga

SEQ ID NO: 4472314 - DNA, 15 bp, Homo sapiens
ctagcactgccccac

SEQ ID NO: 4472315 - DNA, 18 bp, Homo sapiens
ctagcactgccccacatg

SEQ ID NO: 4472316 - DNA, 20 bp, Homo sapiens
ctagcactgccccacatgca

SEQ ID NO: 4472317 - DNA, 15 bp, Homo sapiens
ctagcactggcctgc

SEQ ID NO: 4472318 - DNA, 15 bp, Homo sapiens
ctagcaggctgttcc

SEQ ID NO: 4472319 - DNA, 23 bp, Homo sapiens
ctagcattgtaaaattatttcat

SEQ ID NO: 4472320 - DNA, 15 bp, Homo sapiens
ctagcatttatttct

SEQ ID NO: 4472321 - DNA, 19 bp, Homo sapiens
ctagcatttatttctctgg

SEQ ID NO: 4472322 - DNA, 20 bp, Homo sapiens
ctagccaaaccaggaccctg

SEQ ID NO: 4472323 - DNA, 19 bp, Homo sapiens
ctagccagcacaaaaggca

SEQ ID NO: 4472324 - DNA, 16 bp, Homo sapiens
ctagcccaaaggtaag

SEQ ID NO: 4472325 - DNA, 12 bp, Homo sapiens
ctagcccttccc

SEQ ID NO: 4472326 - DNA, 15 bp, Homo sapiens
ctagcccttccctga

SEQ ID NO: 4472327 - DNA, 16 bp, Homo sapiens
ctagcccttccctgag

SEQ ID NO: 4472328 - DNA, 15 bp, Homo sapiens
ctagcctgcactttg

SEQ ID NO: 4472329 - DNA, 16 bp, Homo sapiens
ctagcgatctctcctg

SEQ ID NO: 4472330 - DNA, 17 bp, Homo sapiens
ctagcgatctctcctgg

SEQ ID NO: 4472331 - DNA, 19 bp, Homo sapiens
ctagcgatctctcctggcc

SEQ ID NO: 4472332 - DNA, 14 bp, Homo sapiens
ctagcggagcccag

SEQ ID NO: 4472333 - DNA, 17 bp, Homo sapiens
ctagcggagcccagcct

SEQ ID NO: 4472334 - DNA, 16 bp, Homo sapiens
ctagcggctgctcctt

SEQ ID NO: 4472335 - DNA, 22 bp, Homo sapiens
ctagctaagcggaacatgtgct

SEQ ID NO: 4472336 - DNA, 18 bp, Homo sapiens
ctagctatgctgtatctg

SEQ ID NO: 4472337 - DNA, 21 bp, Homo sapiens
ctagctatgctgtatctgtgc

SEQ ID NO: 4472338 - DNA, 23 bp, Homo sapiens
ctagctccgggggtacagccctt

SEQ ID NO: 4472339 - DNA, 21 bp, Homo sapiens
ctagctcctgccacatggagc

SEQ ID NO: 4472340 - DNA, 15 bp, Homo sapiens
ctagctctcccagtg

SEQ ID NO: 4472341 - DNA, 21 bp, Homo sapiens
ctagctgcacagggcagctgg

SEQ ID NO: 4472342 - DNA, 14 bp, Homo sapiens
ctagctggctctgt

SEQ ID NO: 4472343 - DNA, 21 bp, Homo sapiens
ctagctgttctaattaagaaa

SEQ ID NO: 4472344 - DNA, 15 bp, Homo sapiens
ctagctttagaccct

SEQ ID NO: 4472345 - DNA, 14 bp, Homo sapiens
ctagctttttaatt

SEQ ID NO: 4472346 - DNA, 15 bp, Homo sapiens
ctaggacacagttcc

SEQ ID NO: 4472347 - DNA, 20 bp, Homo sapiens
ctaggacccgtctccagctg

SEQ ID NO: 4472348 - DNA, 22 bp, Homo sapiens
ctaggacttaaaattagtcttt

SEQ ID NO: 4472349 - DNA, 13 bp, Homo sapiens
ctaggagaagagt

SEQ ID NO: 4472350 - DNA, 16 bp, Homo sapiens
ctaggagctgggagga

SEQ ID NO: 4472351 - DNA, 19 bp, Homo sapiens
ctaggagtcaactggctgg

SEQ ID NO: 4472352 - DNA, 16 bp, Homo sapiens
ctaggatggttctgtg

SEQ ID NO: 4472353 - DNA, 18 bp, Homo sapiens
ctaggattgggcctccca

SEQ ID NO: 4472354 - DNA, 19 bp, Homo sapiens
ctaggccactcctccaaag

SEQ ID NO: 4472355 - DNA, 20 bp, Homo sapiens
ctaggcctcaactcctccca

SEQ ID NO: 4472356 - DNA, 21 bp, Homo sapiens
ctaggcctcaactcctcccat

SEQ ID NO: 4472357 - DNA, 15 bp, Homo sapiens
ctaggctagggtggg

SEQ ID NO: 4472358 - DNA, 12 bp, Homo sapiens
ctaggctcagag

SEQ ID NO: 4472359 - DNA, 13 bp, Homo sapiens
ctaggctcagaga

SEQ ID NO: 4472360 - DNA, 22 bp, Homo sapiens
ctaggctcagagatgtgcaccc

SEQ ID NO: 4472361 - DNA, 24 bp, Homo sapiens
ctagggacccctcgccccagcctc

SEQ ID NO: 4472362 - DNA, 16 bp, Homo sapiens
ctagggattcaggctg

SEQ ID NO: 4472363 - DNA, 18 bp, Homo sapiens
ctagggccaagcccagca

SEQ ID NO: 4472364 - DNA, 15 bp, Homo sapiens
ctaggggtttctgtt

SEQ ID NO: 4472365 - DNA, 16 bp, Homo sapiens
ctagggtcttgggggt

SEQ ID NO: 4472366 - DNA, 13 bp, Homo sapiens
ctagggtggccct

SEQ ID NO: 4472367 - DNA, 14 bp, Homo sapiens
ctaggtacgatgac

SEQ ID NO: 4472368 - DNA, 11 bp, Homo sapiens
ctaggtatcat

SEQ ID NO: 4472369 - DNA, 20 bp, Homo sapiens
ctaggtatcattcaactctc

SEQ ID NO: 4472370 - DNA, 16 bp, Homo sapiens
ctaggtctcctcaggg

SEQ ID NO: 4472371 - DNA, 14 bp, Homo sapiens
ctaggtgtccccaa

SEQ ID NO: 4472372 - DNA, 23 bp, Homo sapiens
ctagtaacaatacatgagaaaga

SEQ ID NO: 4472373 - DNA, 15 bp, Homo sapiens
ctagtaagtgccttc

SEQ ID NO: 4472374 - DNA, 17 bp, Homo sapiens
ctagtaagtgccttcca

SEQ ID NO: 4472375 - DNA, 12 bp, Homo sapiens
ctagtactatta

SEQ ID NO: 4472376 - DNA, 16 bp, Homo sapiens
ctagtagcaatgtgcc

SEQ ID NO: 4472377 - DNA, 15 bp, Homo sapiens
ctagtaggaatgtac

SEQ ID NO: 4472378 - DNA, 22 bp, Homo sapiens
ctagtaggcagcaaaagaccaa

SEQ ID NO: 4472379 - DNA, 23 bp, Homo sapiens
ctagtatcaaaagaaagaaaatc

SEQ ID NO: 4472380 - DNA, 18 bp, Homo sapiens
ctagtcacaaagactcct

SEQ ID NO: 4472381 - DNA, 18 bp, Homo sapiens
ctagtcagagagagtgtt

SEQ ID NO: 4472382 - DNA, 14 bp, Homo sapiens
ctagtcccttcccc

SEQ ID NO: 4472383 - DNA, 15 bp, Homo sapiens
ctagtcccttcccct

SEQ ID NO: 4472384 - DNA, 20 bp, Homo sapiens
ctagtcccttcccctccctg

SEQ ID NO: 4472385 - DNA, 23 bp, Homo sapiens
ctagtcccttcccctccctggct

SEQ ID NO: 4472386 - DNA, 20 bp, Homo sapiens
ctagtcctcacttctagatc

SEQ ID NO: 4472387 - DNA, 19 bp, Homo sapiens
ctagtgcaaaaactgtaaa

SEQ ID NO: 4472388 - DNA, 17 bp, Homo sapiens
ctagtgccaaataattg

SEQ ID NO: 4472389 - DNA, 19 bp, Homo sapiens
ctagtgccaaataattgat

SEQ ID NO: 4472390 - DNA, 19 bp, Homo sapiens
ctagtggggtctccctctc

SEQ ID NO: 4472391 - DNA, 20 bp, Homo sapiens
ctagtggggtctccctctcc

SEQ ID NO: 4472392 - DNA, 17 bp, Homo sapiens
ctagtgtttaaaaggct

SEQ ID NO: 4472393 - DNA, 12 bp, Homo sapiens
ctagtgtttact

SEQ ID NO: 4472394 - DNA, 13 bp, Homo sapiens
ctagttaataatt

SEQ ID NO: 4472395 - DNA, 19 bp, Homo sapiens
ctagttagcatccaggctg

SEQ ID NO: 4472396 - DNA, 23 bp, Homo sapiens
ctagttagcatccaggctggcca

SEQ ID NO: 4472397 - DNA, 22 bp, Homo sapiens
ctagttctcagcttgcagctgg

SEQ ID NO: 4472398 - DNA, 14 bp, Homo sapiens
ctagttctgccagg

SEQ ID NO: 4472399 - DNA, 15 bp, Homo sapiens
ctagttctgccagga

SEQ ID NO: 4472400 - DNA, 15 bp, Homo sapiens
ctagttctttcctcc

SEQ ID NO: 4472401 - DNA, 23 bp, Homo sapiens
ctagttctttcctccccctgcaa

SEQ ID NO: 4472402 - DNA, 15 bp, Homo sapiens
ctagttgaggagttt

SEQ ID NO: 4472403 - DNA, 17 bp, Homo sapiens
ctagttggggagctaag

SEQ ID NO: 4472404 - DNA, 12 bp, Homo sapiens
ctagtttattct

SEQ ID NO: 4472405 - DNA, 16 bp, Homo sapiens
ctagtttgtttagtta

SEQ ID NO: 4472406 - DNA, 19 bp, Homo sapiens
ctagttttcagccttggga

SEQ ID NO: 4472407 - DNA, 11 bp, Homo sapiens
ctagtttttta

SEQ ID NO: 4472408 - DNA, 12 bp, Homo sapiens
ctataaaagctt

SEQ ID NO: 4472409 - DNA, 19 bp, Homo sapiens
ctataaaagctttctgcca

SEQ ID NO: 4472410 - DNA, 20 bp, Homo sapiens
ctataaaatgcccatttcga

SEQ ID NO: 4472411 - DNA, 21 bp, Homo sapiens
ctataaacttaagggcaagga

SEQ ID NO: 4472412 - DNA, 22 bp, Homo sapiens
ctataaatcaacaccttaatat

SEQ ID NO: 4472413 - DNA, 23 bp, Homo sapiens
ctataacagtgtctttctagcca

SEQ ID NO: 4472414 - DNA, 17 bp, Homo sapiens
ctataacattatataac

SEQ ID NO: 4472415 - DNA, 16 bp, Homo sapiens
ctataaccagacacat

SEQ ID NO: 4472416 - DNA, 22 bp, Homo sapiens
ctataagatgaaacatcatttc

SEQ ID NO: 4472417 - DNA, 19 bp, Homo sapiens
ctataagcttaaataggaa

SEQ ID NO: 4472418 - DNA, 22 bp, Homo sapiens
ctataagcttaaataggaaagt

SEQ ID NO: 4472419 - DNA, 21 bp, Homo sapiens
ctataaggtgctctctttctg

SEQ ID NO: 4472420 - DNA, 22 bp, Homo sapiens
ctataaggtgctctctttctgt

SEQ ID NO: 4472421 - DNA, 13 bp, Homo sapiens
ctataatcaaatg

SEQ ID NO: 4472422 - DNA, 15 bp, Homo sapiens
ctataatcaaatgat

SEQ ID NO: 4472423 - DNA, 21 bp, Homo sapiens
ctataatcaaatgatttcata

SEQ ID NO: 4472424 - DNA, 17 bp, Homo sapiens
ctataatcccagctact

SEQ ID NO: 4472425 - DNA, 14 bp, Homo sapiens
ctataatctgtttt

SEQ ID NO: 4472426 - DNA, 11 bp, Homo sapiens
ctataatgtga

SEQ ID NO: 4472427 - DNA, 14 bp, Homo sapiens
ctataatgtgaaat

SEQ ID NO: 4472428 - DNA, 21 bp, Homo sapiens
ctataatgtgaaatgtaactg

SEQ ID NO: 4472429 - DNA, 22 bp, Homo sapiens
ctataatttacctaagattaca

SEQ ID NO: 4472430 - DNA, 21 bp, Homo sapiens
ctatacaaattttcagaaggt

SEQ ID NO: 4472431 - DNA, 22 bp, Homo sapiens
ctatacatgttggaaatgtgtt

SEQ ID NO: 4472432 - DNA, 15 bp, Homo sapiens
ctatacccacccaga

SEQ ID NO: 4472433 - DNA, 16 bp, Homo sapiens
ctatacccacccagaa

SEQ ID NO: 4472434 - DNA, 19 bp, Homo sapiens
ctatacctgccttttaagt

SEQ ID NO: 4472435 - DNA, 21 bp, Homo sapiens
ctatactgcatactttttaaa

SEQ ID NO: 4472436 - DNA, 16 bp, Homo sapiens
ctatacttgaacaaaa

SEQ ID NO: 4472437 - DNA, 17 bp, Homo sapiens
ctatagctaagtacaca

SEQ ID NO: 4472438 - DNA, 15 bp, Homo sapiens
ctataggtgctacaa

SEQ ID NO: 4472439 - DNA, 18 bp, Homo sapiens
ctatagtatttgattcaa

SEQ ID NO: 4472440 - DNA, 13 bp, Homo sapiens
ctatagttactgt

SEQ ID NO: 4472441 - DNA, 12 bp, Homo sapiens
ctatataaaata

SEQ ID NO: 4472442 - DNA, 22 bp, Homo sapiens
ctatatacatcacgttaaagta

SEQ ID NO: 4472443 - DNA, 11 bp, Homo sapiens
ctatatacctc

SEQ ID NO: 4472444 - DNA, 15 bp, Homo sapiens
ctatatacctcacta

SEQ ID NO: 4472445 - DNA, 14 bp, Homo sapiens
ctatatagaatttc

SEQ ID NO: 4472446 - DNA, 20 bp, Homo sapiens
ctatatagaatttcctgtaa

SEQ ID NO: 4472447 - DNA, 15 bp, Homo sapiens
ctatatataaaacgg

SEQ ID NO: 4472448 - DNA, 19 bp, Homo sapiens
ctatatataaaacggtgct

SEQ ID NO: 4472449 - DNA, 16 bp, Homo sapiens
ctatatatttctatta

SEQ ID NO: 4472450 - DNA, 18 bp, Homo sapiens
ctatatgagaagaatagc

SEQ ID NO: 4472451 - DNA, 16 bp, Homo sapiens
ctatatgcagtccttt

SEQ ID NO: 4472452 - DNA, 17 bp, Homo sapiens
ctatatgtagtgcattt

SEQ ID NO: 4472453 - DNA, 22 bp, Homo sapiens
ctatatgtagtgcatttttaaa

SEQ ID NO: 4472454 - DNA, 14 bp, Homo sapiens
ctatattaaatgag

SEQ ID NO: 4472455 - DNA, 22 bp, Homo sapiens
ctatattccaggtttaagtaga

SEQ ID NO: 4472456 - DNA, 16 bp, Homo sapiens
ctatattcctttttct

SEQ ID NO: 4472457 - DNA, 17 bp, Homo sapiens
ctatatttgattatgta

SEQ ID NO: 4472458 - DNA, 13 bp, Homo sapiens
ctatcaattttaa

SEQ ID NO: 4472459 - DNA, 14 bp, Homo sapiens
ctatcaattttaag

SEQ ID NO: 4472460 - DNA, 13 bp, Homo sapiens
ctatcaggtaata

SEQ ID NO: 4472461 - DNA, 18 bp, Homo sapiens
ctatcagttgatttttct

SEQ ID NO: 4472462 - DNA, 21 bp, Homo sapiens
ctatccccatctccctgcctg

SEQ ID NO: 4472463 - DNA, 23 bp, Homo sapiens
ctatccccatctccctgcctggc

SEQ ID NO: 4472464 - DNA, 17 bp, Homo sapiens
ctatccgctgccagcct

SEQ ID NO: 4472465 - DNA, 13 bp, Homo sapiens
ctatcctctgtaa

SEQ ID NO: 4472466 - DNA, 22 bp, Homo sapiens
ctatccttggctttcagagcca

SEQ ID NO: 4472467 - DNA, 13 bp, Homo sapiens
ctatcctttcaaa

SEQ ID NO: 4472468 - DNA, 16 bp, Homo sapiens
ctatccttttgcctgc

SEQ ID NO: 4472469 - DNA, 13 bp, Homo sapiens
ctatctaatgaca

SEQ ID NO: 4472470 - DNA, 16 bp, Homo sapiens
ctatctacaaagaaaa

SEQ ID NO: 4472471 - DNA, 19 bp, Homo sapiens
ctatctatacctgcctttt

SEQ ID NO: 4472472 - DNA, 13 bp, Homo sapiens
ctatctatttgag

SEQ ID NO: 4472473 - DNA, 22 bp, Homo sapiens
ctatctcatgccagtgccttat

SEQ ID NO: 4472474 - DNA, 17 bp, Homo sapiens
ctatctggtattaaatg

SEQ ID NO: 4472475 - DNA, 16 bp, Homo sapiens
ctatctggtgatttct

SEQ ID NO: 4472476 - DNA, 17 bp, Homo sapiens
ctatctgtattcccaaa

SEQ ID NO: 4472477 - DNA, 14 bp, Homo sapiens
ctatctgtgttttg

SEQ ID NO: 4472478 - DNA, 18 bp, Homo sapiens
ctatcttttgtttccttt

SEQ ID NO: 4472479 - DNA, 13 bp, Homo sapiens
ctatgaaaatgag

SEQ ID NO: 4472480 - DNA, 15 bp, Homo sapiens
ctatgaaaatgagcc

SEQ ID NO: 4472481 - DNA, 16 bp, Homo sapiens
ctatgaaaatgagccc

SEQ ID NO: 4472482 - DNA, 17 bp, Homo sapiens
ctatgaaaatgagccct

SEQ ID NO: 4472483 - DNA, 19 bp, Homo sapiens
ctatgaaaatgagccctgg

SEQ ID NO: 4472484 - DNA, 22 bp, Homo sapiens
ctatgaaaatgagccctggctc

SEQ ID NO: 4472485 - DNA, 22 bp, Homo sapiens
ctatgaacagaaactacatttc

SEQ ID NO: 4472486 - DNA, 15 bp, Homo sapiens
ctatgaggagcctct

SEQ ID NO: 4472487 - DNA, 19 bp, Homo sapiens
ctatgatgagaggccagca

SEQ ID NO: 4472488 - DNA, 23 bp, Homo sapiens
ctatgatgtgaaacactttgcct

SEQ ID NO: 4472489 - DNA, 15 bp, Homo sapiens
ctatgcactgaagag

SEQ ID NO: 4472490 - DNA, 19 bp, Homo sapiens
ctatgcactgaagagctct

SEQ ID NO: 4472491 - DNA, 21 bp, Homo sapiens
ctatgcactgaagagctcttg

SEQ ID NO: 4472492 - DNA, 22 bp, Homo sapiens
ctatgcactgaagagctcttgg

SEQ ID NO: 4472493 - DNA, 21 bp, Homo sapiens
ctatgctattgacaataaaat

SEQ ID NO: 4472494 - DNA, 14 bp, Homo sapiens
ctatgctgtatctg

SEQ ID NO: 4472495 - DNA, 23 bp, Homo sapiens
ctatggagactttgctgttactg

SEQ ID NO: 4472496 - DNA, 18 bp, Homo sapiens
ctatggagtgaaattatt

SEQ ID NO: 4472497 - DNA, 13 bp, Homo sapiens
ctatggccagtct

SEQ ID NO: 4472498 - DNA, 22 bp, Homo sapiens
ctatggctttaaataaattaag

SEQ ID NO: 4472499 - DNA, 16 bp, Homo sapiens
ctatggctttcaaagc

SEQ ID NO: 4472500 - DNA, 18 bp, Homo sapiens
ctatgggaatttggcttc

SEQ ID NO: 4472501 - DNA, 19 bp, Homo sapiens
ctatgggagccccagggtc

SEQ ID NO: 4472502 - DNA, 20 bp, Homo sapiens
ctatggggatagatgtgtgg

SEQ ID NO: 4472503 - DNA, 19 bp, Homo sapiens
ctatggtatgctggccagc

SEQ ID NO: 4472504 - DNA, 13 bp, Homo sapiens
ctatggtcacaga

SEQ ID NO: 4472505 - DNA, 23 bp, Homo sapiens
ctatgtcatttgctggagctctg

SEQ ID NO: 4472506 - DNA, 13 bp, Homo sapiens
ctatgtcattttt

SEQ ID NO: 4472507 - DNA, 13 bp, Homo sapiens
ctatgtctgcctt

SEQ ID NO: 4472508 - DNA, 22 bp, Homo sapiens
ctatgtgacatttctcttcccc

SEQ ID NO: 4472509 - DNA, 22 bp, Homo sapiens
ctatgtgccttatgttgaaaaa

SEQ ID NO: 4472510 - DNA, 14 bp, Homo sapiens
ctatgtgtttttct

SEQ ID NO: 4472511 - DNA, 22 bp, Homo sapiens
ctatgtgtttttctcatatttg

SEQ ID NO: 4472512 - DNA, 13 bp, Homo sapiens
ctatgttaatatt

SEQ ID NO: 4472513 - DNA, 19 bp, Homo sapiens
ctatgttgcctaggctgga

SEQ ID NO: 4472514 - DNA, 14 bp, Homo sapiens
ctatgtttttaatg

SEQ ID NO: 4472515 - DNA, 20 bp, Homo sapiens
ctatgtttttgttcaaagcc

SEQ ID NO: 4472516 - DNA, 13 bp, Homo sapiens
ctattaaaaaagt

SEQ ID NO: 4472517 - DNA, 23 bp, Homo sapiens
ctattaaaaaagtctacaacata

SEQ ID NO: 4472518 - DNA, 13 bp, Homo sapiens
ctattaaaactca

SEQ ID NO: 4472519 - DNA, 14 bp, Homo sapiens
ctattaatcaagag

SEQ ID NO: 4472520 - DNA, 18 bp, Homo sapiens
ctattaatcaagagaaac

SEQ ID NO: 4472521 - DNA, 14 bp, Homo sapiens
ctattactgatgtg

SEQ ID NO: 4472522 - DNA, 16 bp, Homo sapiens
ctattacttgaacttt

SEQ ID NO: 4472523 - DNA, 20 bp, Homo sapiens
ctattacttttctgtttagt

SEQ ID NO: 4472524 - DNA, 17 bp, Homo sapiens
ctattagtgttaactgt

SEQ ID NO: 4472525 - DNA, 19 bp, Homo sapiens
ctattatagtgaaacatgt

SEQ ID NO: 4472526 - DNA, 19 bp, Homo sapiens
ctattatctgtcagctgca

SEQ ID NO: 4472527 - DNA, 19 bp, Homo sapiens
ctattatttagaaatgaac

SEQ ID NO: 4472528 - DNA, 20 bp, Homo sapiens
ctattccaagactcagatga

SEQ ID NO: 4472529 - DNA, 15 bp, Homo sapiens
ctattccctcagcct

SEQ ID NO: 4472530 - DNA, 17 bp, Homo sapiens
ctattccgagcccttag

SEQ ID NO: 4472531 - DNA, 15 bp, Homo sapiens
ctattcgaatgaaaa

SEQ ID NO: 4472532 - DNA, 15 bp, Homo sapiens
ctattctagcctgca

SEQ ID NO: 4472533 - DNA, 14 bp, Homo sapiens
ctattctccagctg

SEQ ID NO: 4472534 - DNA, 15 bp, Homo sapiens
ctattcttaataaaa

SEQ ID NO: 4472535 - DNA, 21 bp, Homo sapiens
ctattcttgatttatttgctt

SEQ ID NO: 4472536 - DNA, 22 bp, Homo sapiens
ctattcttggaccatgccagat

SEQ ID NO: 4472537 - DNA, 14 bp, Homo sapiens
ctattgacaataaa

SEQ ID NO: 4472538 - DNA, 18 bp, Homo sapiens
ctattgacaataaaatat

SEQ ID NO: 4472539 - DNA, 16 bp, Homo sapiens
ctattgacttttcaat

SEQ ID NO: 4472540 - DNA, 20 bp, Homo sapiens
ctattgatgtacagtctgtc

SEQ ID NO: 4472541 - DNA, 14 bp, Homo sapiens
ctattgatttgaaa

SEQ ID NO: 4472542 - DNA, 15 bp, Homo sapiens
ctattgatttgaaaa

SEQ ID NO: 4472543 - DNA, 19 bp, Homo sapiens
ctattgcatttatatgtac

SEQ ID NO: 4472544 - DNA, 18 bp, Homo sapiens
ctattgcttggacttaac

SEQ ID NO: 4472545 - DNA, 21 bp, Homo sapiens
ctattgggttaatttctccct

SEQ ID NO: 4472546 - DNA, 19 bp, Homo sapiens
ctattgtaatatagaaaaa

SEQ ID NO: 4472547 - DNA, 14 bp, Homo sapiens
ctattgtagagcca

SEQ ID NO: 4472548 - DNA, 22 bp, Homo sapiens
ctattgtgcaatgtaaatattt

SEQ ID NO: 4472549 - DNA, 20 bp, Homo sapiens
ctattgtgtggatgaccaca

SEQ ID NO: 4472550 - DNA, 14 bp, Homo sapiens
ctatttaaagacct

SEQ ID NO: 4472551 - DNA, 12 bp, Homo sapiens
ctatttatatca

SEQ ID NO: 4472552 - DNA, 17 bp, Homo sapiens
ctatttatatgtacatg

SEQ ID NO: 4472553 - DNA, 12 bp, Homo sapiens
ctatttatttat

SEQ ID NO: 4472554 - DNA, 14 bp, Homo sapiens
ctatttcagctgct

SEQ ID NO: 4472555 - DNA, 15 bp, Homo sapiens
ctatttcagctgctt

SEQ ID NO: 4472556 - DNA, 18 bp, Homo sapiens
ctatttcagctgctttga

SEQ ID NO: 4472557 - DNA, 19 bp, Homo sapiens
ctatttccaaaagcacatg

SEQ ID NO: 4472558 - DNA, 12 bp, Homo sapiens
ctatttctatgt

SEQ ID NO: 4472559 - DNA, 16 bp, Homo sapiens
ctatttgaataaatta

SEQ ID NO: 4472560 - DNA, 19 bp, Homo sapiens
ctatttgccaatgtatatt

SEQ ID NO: 4472561 - DNA, 23 bp, Homo sapiens
ctatttgtggcaattttatgttt

SEQ ID NO: 4472562 - DNA, 19 bp, Homo sapiens
ctattttaaatatccattt

SEQ ID NO: 4472563 - DNA, 11 bp, Homo sapiens
ctattttaaga

SEQ ID NO: 4472564 - DNA, 19 bp, Homo sapiens
ctattttaagacgtgaatg

SEQ ID NO: 4472565 - DNA, 14 bp, Homo sapiens
ctattttagaaagc

SEQ ID NO: 4472566 - DNA, 15 bp, Homo sapiens
ctattttagaataaa

SEQ ID NO: 4472567 - DNA, 19 bp, Homo sapiens
ctattttagggttctaaat

SEQ ID NO: 4472568 - DNA, 20 bp, Homo sapiens
ctattttagggttctaaatg

SEQ ID NO: 4472569 - DNA, 17 bp, Homo sapiens
ctattttattttattga

SEQ ID NO: 4472570 - DNA, 16 bp, Homo sapiens
ctattttcagaatctg

SEQ ID NO: 4472571 - DNA, 12 bp, Homo sapiens
ctattttcctct

SEQ ID NO: 4472572 - DNA, 14 bp, Homo sapiens
ctattttcctctgg

SEQ ID NO: 4472573 - DNA, 15 bp, Homo sapiens
ctattttcctctggc

SEQ ID NO: 4472574 - DNA, 21 bp, Homo sapiens
ctattttgatgcagcatttga

SEQ ID NO: 4472575 - DNA, 16 bp, Homo sapiens
ctatttttctctcctg

SEQ ID NO: 4472576 - DNA, 21 bp, Homo sapiens
ctatttttgactgtagccaca

SEQ ID NO: 4472577 - DNA, 13 bp, Homo sapiens
ctatttttgttgt

SEQ ID NO: 4472578 - DNA, 15 bp, Homo sapiens
ctatttttgttttta

SEQ ID NO: 4472579 - DNA, 20 bp, Homo sapiens
ctatttttttaaaatcacta

SEQ ID NO: 4472580 - DNA, 23 bp, Homo sapiens
ctatttttttcttaaagcaaact

SEQ ID NO: 4472581 - DNA, 23 bp, Homo sapiens
ctcaaaaaaaaaaaagagagaga

SEQ ID NO: 4472582 - DNA, 21 bp, Homo sapiens
ctcaaaaaaaagaaaatgtct

SEQ ID NO: 4472583 - DNA, 22 bp, Homo sapiens
ctcaaaaaaaagaaaatgtctt

SEQ ID NO: 4472584 - DNA, 17 bp, Homo sapiens
ctcaaaaagcagaagga

SEQ ID NO: 4472585 - DNA, 18 bp, Homo sapiens
ctcaaaaagcagaaggag

SEQ ID NO: 4472586 - DNA, 20 bp, Homo sapiens
ctcaaaacacttccagtctg

SEQ ID NO: 4472587 - DNA, 21 bp, Homo sapiens
ctcaaaacctgattggccact

SEQ ID NO: 4472588 - DNA, 14 bp, Homo sapiens
ctcaaaacctggag

SEQ ID NO: 4472589 - DNA, 23 bp, Homo sapiens
ctcaaaataccatgccatttaaa

SEQ ID NO: 4472590 - DNA, 13 bp, Homo sapiens
ctcaaaattagat

SEQ ID NO: 4472591 - DNA, 17 bp, Homo sapiens
ctcaaacaacactggtg

SEQ ID NO: 4472592 - DNA, 13 bp, Homo sapiens
ctcaaacttgtgg

SEQ ID NO: 4472593 - DNA, 15 bp, Homo sapiens
ctcaaacttgtggcc

SEQ ID NO: 4472594 - DNA, 13 bp, Homo sapiens
ctcaaagaaagtg

SEQ ID NO: 4472595 - DNA, 14 bp, Homo sapiens
ctcaaagaggcctt

SEQ ID NO: 4472596 - DNA, 16 bp, Homo sapiens
ctcaaagatctgaatt

SEQ ID NO: 4472597 - DNA, 17 bp, Homo sapiens
ctcaaatacatgcacag

SEQ ID NO: 4472598 - DNA, 20 bp, Homo sapiens
ctcaaatacatgcacagtca

SEQ ID NO: 4472599 - DNA, 20 bp, Homo sapiens
ctcaaataggctattaaaaa

SEQ ID NO: 4472600 - DNA, 17 bp, Homo sapiens
ctcaaatcaaaaacagg

SEQ ID NO: 4472601 - DNA, 15 bp, Homo sapiens
ctcaaatccaaaatg

SEQ ID NO: 4472602 - DNA, 17 bp, Homo sapiens
ctcaaatgatgggaagt

SEQ ID NO: 4472603 - DNA, 14 bp, Homo sapiens
ctcaaattcagctc

SEQ ID NO: 4472604 - DNA, 17 bp, Homo sapiens
ctcaaattcagctctga

SEQ ID NO: 4472605 - DNA, 23 bp, Homo sapiens
ctcaacatactgtaatcaaaagg

SEQ ID NO: 4472606 - DNA, 17 bp, Homo sapiens
ctcaacccccctcccag

SEQ ID NO: 4472607 - DNA, 21 bp, Homo sapiens
ctcaacccccctcccagacag

SEQ ID NO: 4472608 - DNA, 18 bp, Homo sapiens
ctcaacctgtaaattatt

SEQ ID NO: 4472609 - DNA, 20 bp, Homo sapiens
ctcaaccttccaacttcctg

SEQ ID NO: 4472610 - DNA, 16 bp, Homo sapiens
ctcaacgtattgtttc

SEQ ID NO: 4472611 - DNA, 15 bp, Homo sapiens
ctcaactcctcccat

SEQ ID NO: 4472612 - DNA, 16 bp, Homo sapiens
ctcaactttctgttgg

SEQ ID NO: 4472613 - DNA, 16 bp, Homo sapiens
ctcaacttttttccct

SEQ ID NO: 4472614 - DNA, 15 bp, Homo sapiens
ctcaagaatctagaa

SEQ ID NO: 4472615 - DNA, 21 bp, Homo sapiens
ctcaagacccccatttgtccc

SEQ ID NO: 4472616 - DNA, 23 bp, Homo sapiens
ctcaagacccccatttgtcccag

SEQ ID NO: 4472617 - DNA, 16 bp, Homo sapiens
ctcaagaggaatctgt

SEQ ID NO: 4472618 - DNA, 17 bp, Homo sapiens
ctcaagaggaatctgtt

SEQ ID NO: 4472619 - DNA, 18 bp, Homo sapiens
ctcaagaggaatctgttt

SEQ ID NO: 4472620 - DNA, 19 bp, Homo sapiens
ctcaagatatggaagtgga

SEQ ID NO: 4472621 - DNA, 17 bp, Homo sapiens
ctcaagcaagatgagct

SEQ ID NO: 4472622 - DNA, 19 bp, Homo sapiens
ctcaagcaatccacctgcc

SEQ ID NO: 4472623 - DNA, 21 bp, Homo sapiens
ctcaagcaatccacctgcctt

SEQ ID NO: 4472624 - DNA, 16 bp, Homo sapiens
ctcaagcaatcctcct

SEQ ID NO: 4472625 - DNA, 16 bp, Homo sapiens
ctcaagcgattctcct

SEQ ID NO: 4472626 - DNA, 22 bp, Homo sapiens
ctcaaggaaaagttctttcaac

SEQ ID NO: 4472627 - DNA, 13 bp, Homo sapiens
ctcaaggacagga

SEQ ID NO: 4472628 - DNA, 21 bp, Homo sapiens
ctcaaggacaggagcctggtc

SEQ ID NO: 4472629 - DNA, 20 bp, Homo sapiens
ctcaaggataccttcttatt

SEQ ID NO: 4472630 - DNA, 16 bp, Homo sapiens
ctcaagggttttccag

SEQ ID NO: 4472631 - DNA, 13 bp, Homo sapiens
ctcaataaacagt

SEQ ID NO: 4472632 - DNA, 15 bp, Homo sapiens
ctcaatccaccttca

SEQ ID NO: 4472633 - DNA, 22 bp, Homo sapiens
ctcaattatttgcatattttga

SEQ ID NO: 4472634 - DNA, 22 bp, Homo sapiens
ctcaatttttgtttttgagtac

SEQ ID NO: 4472635 - DNA, 23 bp, Homo sapiens
ctcacaaaaaggcaaatattgaa

SEQ ID NO: 4472636 - DNA, 21 bp, Homo sapiens
ctcacaatagccgatatcaga

SEQ ID NO: 4472637 - DNA, 14 bp, Homo sapiens
ctcacacagccagg

SEQ ID NO: 4472638 - DNA, 16 bp, Homo sapiens
ctcacacagccaggtg

SEQ ID NO: 4472639 - DNA, 22 bp, Homo sapiens
ctcacacagccaggtgccttgg

SEQ ID NO: 4472640 - DNA, 15 bp, Homo sapiens
ctcacacatcctgtc

SEQ ID NO: 4472641 - DNA, 13 bp, Homo sapiens
ctcacactgagaa

SEQ ID NO: 4472642 - DNA, 19 bp, Homo sapiens
ctcacactggtctgctgtc

SEQ ID NO: 4472643 - DNA, 16 bp, Homo sapiens
ctcacagttcctcgcc

SEQ ID NO: 4472644 - DNA, 21 bp, Homo sapiens
ctcacattgagagtaagcacg

SEQ ID NO: 4472645 - DNA, 17 bp, Homo sapiens
ctcaccactaccagcca

SEQ ID NO: 4472646 - DNA, 19 bp, Homo sapiens
ctcaccactaccagccagc

SEQ ID NO: 4472647 - DNA, 20 bp, Homo sapiens
ctcaccagccccccgcgcgc

SEQ ID NO: 4472648 - DNA, 12 bp, Homo sapiens
ctcaccagccct

SEQ ID NO: 4472649 - DNA, 15 bp, Homo sapiens
ctcacccaccatgga

SEQ ID NO: 4472650 - DNA, 17 bp, Homo sapiens
ctcacccacccctgcac

SEQ ID NO: 4472651 - DNA, 17 bp, Homo sapiens
ctcacccaggcaatctt

SEQ ID NO: 4472652 - DNA, 12 bp, Homo sapiens
ctcacccagtcc

SEQ ID NO: 4472653 - DNA, 15 bp, Homo sapiens
ctcacccagtcctgc

SEQ ID NO: 4472654 - DNA, 14 bp, Homo sapiens
ctcacccatcctag

SEQ ID NO: 4472655 - DNA, 21 bp, Homo sapiens
ctcaccccctcccacccccag

SEQ ID NO: 4472656 - DNA, 23 bp, Homo sapiens
ctcaccccctcccacccccagcc

SEQ ID NO: 4472657 - DNA, 15 bp, Homo sapiens
ctcaccccctccttc

SEQ ID NO: 4472658 - DNA, 14 bp, Homo sapiens
ctcaccccctcggg

SEQ ID NO: 4472659 - DNA, 15 bp, Homo sapiens
ctcacccccttctcc

SEQ ID NO: 4472660 - DNA, 20 bp, Homo sapiens
ctcacccccttctccatcca

SEQ ID NO: 4472661 - DNA, 16 bp, Homo sapiens
ctcaccccgtctgggg

SEQ ID NO: 4472662 - DNA, 20 bp, Homo sapiens
ctcacccctggttctcatct

SEQ ID NO: 4472663 - DNA, 21 bp, Homo sapiens
ctcacccctggttctcatctt

SEQ ID NO: 4472664 - DNA, 16 bp, Homo sapiens
ctcaccgcccatcagg

SEQ ID NO: 4472665 - DNA, 14 bp, Homo sapiens
ctcaccgctggccc

SEQ ID NO: 4472666 - DNA, 19 bp, Homo sapiens
ctcaccgctggcccttaga

SEQ ID NO: 4472667 - DNA, 21 bp, Homo sapiens
ctcacctaatggttgtacata

SEQ ID NO: 4472668 - DNA, 14 bp, Homo sapiens
ctcacctcatgccc

SEQ ID NO: 4472669 - DNA, 16 bp, Homo sapiens
ctcacctctctctaag

SEQ ID NO: 4472670 - DNA, 14 bp, Homo sapiens
ctcacctctgcctc

SEQ ID NO: 4472671 - DNA, 15 bp, Homo sapiens
ctcacctctgcctca

SEQ ID NO: 4472672 - DNA, 14 bp, Homo sapiens
ctcacctctggact

SEQ ID NO: 4472673 - DNA, 21 bp, Homo sapiens
ctcacctctggactggctaga

SEQ ID NO: 4472674 - DNA, 20 bp, Homo sapiens
ctcacctgctcccagtcctg

SEQ ID NO: 4472675 - DNA, 12 bp, Homo sapiens
ctcacctggact

SEQ ID NO: 4472676 - DNA, 16 bp, Homo sapiens
ctcacctggttgaccc

SEQ ID NO: 4472677 - DNA, 17 bp, Homo sapiens
ctcacctggttgaccca

SEQ ID NO: 4472678 - DNA, 14 bp, Homo sapiens
ctcacctttttaaa

SEQ ID NO: 4472679 - DNA, 23 bp, Homo sapiens
ctcacgcctgtaatcccagcact

SEQ ID NO: 4472680 - DNA, 13 bp, Homo sapiens
ctcacgctttgtt

SEQ ID NO: 4472681 - DNA, 21 bp, Homo sapiens
ctcacggaccactcgaggcct

SEQ ID NO: 4472682 - DNA, 23 bp, Homo sapiens
ctcacggaccactcgaggcctgc

SEQ ID NO: 4472683 - DNA, 20 bp, Homo sapiens
ctcactaccctattctctct

SEQ ID NO: 4472684 - DNA, 21 bp, Homo sapiens
ctcactagccatgctttatgt

SEQ ID NO: 4472685 - DNA, 23 bp, Homo sapiens
ctcactatggtatgctggccagc

SEQ ID NO: 4472686 - DNA, 24 bp, Homo sapiens
ctcactatggtatgctggccagca

SEQ ID NO: 4472687 - DNA, 19 bp, Homo sapiens
ctcactattcttggaccat

SEQ ID NO: 4472688 - DNA, 15 bp, Homo sapiens
ctcactcactgttta

SEQ ID NO: 4472689 - DNA, 16 bp, Homo sapiens
ctcactccaccaccca

SEQ ID NO: 4472690 - DNA, 20 bp, Homo sapiens
ctcactccaccacccaaaag

SEQ ID NO: 4472691 - DNA, 15 bp, Homo sapiens
ctcactcccagtcca

SEQ ID NO: 4472692 - DNA, 23 bp, Homo sapiens
ctcactcccttctacctgccact

SEQ ID NO: 4472693 - DNA, 18 bp, Homo sapiens
ctcactctgtcagccagc

SEQ ID NO: 4472694 - DNA, 15 bp, Homo sapiens
ctcactctgtttcct

SEQ ID NO: 4472695 - DNA, 16 bp, Homo sapiens
ctcactcttctgtctt

SEQ ID NO: 4472696 - DNA, 18 bp, Homo sapiens
ctcactgcagcctcagcg

SEQ ID NO: 4472697 - DNA, 21 bp, Homo sapiens
ctcactgcagcctcagcgtcc

SEQ ID NO: 4472698 - DNA, 12 bp, Homo sapiens
ctcactgggccc

SEQ ID NO: 4472699 - DNA, 16 bp, Homo sapiens
ctcactgtctatttaa

SEQ ID NO: 4472700 - DNA, 10 bp, Homo sapiens
ctcactgtga

SEQ ID NO: 4472701 - DNA, 12 bp, Homo sapiens
ctcactgtgatc

SEQ ID NO: 4472702 - DNA, 24 bp, Homo sapiens
ctcactgtgggaaggccagctgcc

SEQ ID NO: 4472703 - DNA, 15 bp, Homo sapiens
ctcacttagtccttt

SEQ ID NO: 4472704 - DNA, 18 bp, Homo sapiens
ctcacttcaatgtgtcat

SEQ ID NO: 4472705 - DNA, 14 bp, Homo sapiens
ctcacttctaaatt

SEQ ID NO: 4472706 - DNA, 21 bp, Homo sapiens
ctcacttctagatctcagcca

SEQ ID NO: 4472707 - DNA, 16 bp, Homo sapiens
ctcacttgaggaggag

SEQ ID NO: 4472708 - DNA, 15 bp, Homo sapiens
ctcactttactttca

SEQ ID NO: 4472709 - DNA, 20 bp, Homo sapiens
ctcactttcccttgtgtcaa

SEQ ID NO: 4472710 - DNA, 13 bp, Homo sapiens
ctcactttgtaaa

SEQ ID NO: 4472711 - DNA, 17 bp, Homo sapiens
ctcagaaagccaacatg

SEQ ID NO: 4472712 - DNA, 13 bp, Homo sapiens
ctcagaagcacag

SEQ ID NO: 4472713 - DNA, 18 bp, Homo sapiens
ctcagaaggaatggtgcg

SEQ ID NO: 4472714 - DNA, 21 bp, Homo sapiens
ctcagaaggaatggtgcgtgg

SEQ ID NO: 4472715 - DNA, 15 bp, Homo sapiens
ctcagaagtccctgt

SEQ ID NO: 4472716 - DNA, 22 bp, Homo sapiens
ctcagaattcggtgtgctgcca

SEQ ID NO: 4472717 - DNA, 21 bp, Homo sapiens
ctcagacccaacagcaaagga

SEQ ID NO: 4472718 - DNA, 18 bp, Homo sapiens
ctcagacccagcggtcca

SEQ ID NO: 4472719 - DNA, 21 bp, Homo sapiens
ctcagacccaggagtccagac

SEQ ID NO: 4472720 - DNA, 19 bp, Homo sapiens
ctcagacccaggggtccag

SEQ ID NO: 4472721 - DNA, 22 bp, Homo sapiens
ctcagacccaggggtccaggcc

SEQ ID NO: 4472722 - DNA, 15 bp, Homo sapiens
ctcagacccccactc

SEQ ID NO: 4472723 - DNA, 12 bp, Homo sapiens
ctcagacccctc

SEQ ID NO: 4472724 - DNA, 18 bp, Homo sapiens
ctcagacccctcagcccc

SEQ ID NO: 4472725 - DNA, 14 bp, Homo sapiens
ctcagaccctgctt

SEQ ID NO: 4472726 - DNA, 15 bp, Homo sapiens
ctcagacgttgcctg

SEQ ID NO: 4472727 - DNA, 15 bp, Homo sapiens
ctcagacttgccagg

SEQ ID NO: 4472728 - DNA, 20 bp, Homo sapiens
ctcagagaaggaaaagactg

SEQ ID NO: 4472729 - DNA, 15 bp, Homo sapiens
ctcagagatctccct

SEQ ID NO: 4472730 - DNA, 23 bp, Homo sapiens
ctcagagcgccaggaagccagag

SEQ ID NO: 4472731 - DNA, 13 bp, Homo sapiens
ctcagagctttgt

SEQ ID NO: 4472732 - DNA, 14 bp, Homo sapiens
ctcagagctttgtc

SEQ ID NO: 4472733 - DNA, 15 bp, Homo sapiens
ctcagagctttgtca

SEQ ID NO: 4472734 - DNA, 18 bp, Homo sapiens
ctcagagctttgtcactt

SEQ ID NO: 4472735 - DNA, 19 bp, Homo sapiens
ctcagagctttgtcacttg

SEQ ID NO: 4472736 - DNA, 14 bp, Homo sapiens
ctcagaggcctgct

SEQ ID NO: 4472737 - DNA, 16 bp, Homo sapiens
ctcagagtccactgtg

SEQ ID NO: 4472738 - DNA, 21 bp, Homo sapiens
ctcagatcagtgtaccatttg

SEQ ID NO: 4472739 - DNA, 15 bp, Homo sapiens
ctcagatctgtctga

SEQ ID NO: 4472740 - DNA, 18 bp, Homo sapiens
ctcagatctgtctgatag

SEQ ID NO: 4472741 - DNA, 17 bp, Homo sapiens
ctcagatgatctctcca

SEQ ID NO: 4472742 - DNA, 19 bp, Homo sapiens
ctcagatgatgccagctgt

SEQ ID NO: 4472743 - DNA, 18 bp, Homo sapiens
ctcagatgcagtttggag

SEQ ID NO: 4472744 - DNA, 14 bp, Homo sapiens
ctcagatgttaaaa

SEQ ID NO: 4472745 - DNA, 16 bp, Homo sapiens
ctcagatgttaaaata

SEQ ID NO: 4472746 - DNA, 12 bp, Homo sapiens
ctcagattcttc

SEQ ID NO: 4472747 - DNA, 15 bp, Homo sapiens
ctcagattcttcact

SEQ ID NO: 4472748 - DNA, 17 bp, Homo sapiens
ctcagcaagctgcccag

SEQ ID NO: 4472749 - DNA, 22 bp, Homo sapiens
ctcagcaagctgcccagccctg

SEQ ID NO: 4472750 - DNA, 17 bp, Homo sapiens
ctcagcaattcagaccc

SEQ ID NO: 4472751 - DNA, 11 bp, Homo sapiens
ctcagcactgt

SEQ ID NO: 4472752 - DNA, 19 bp, Homo sapiens
ctcagcagacatttatctt

SEQ ID NO: 4472753 - DNA, 14 bp, Homo sapiens
ctcagcagcagaga

SEQ ID NO: 4472754 - DNA, 18 bp, Homo sapiens
ctcagcagcagagagccc

SEQ ID NO: 4472755 - DNA, 20 bp, Homo sapiens
ctcagcagccctagcggctg

SEQ ID NO: 4472756 - DNA, 22 bp, Homo sapiens
ctcagcagccctagcggctgct

SEQ ID NO: 4472757 - DNA, 18 bp, Homo sapiens
ctcagcagccctcctcac

SEQ ID NO: 4472758 - DNA, 18 bp, Homo sapiens
ctcagcagcgaccacccc

SEQ ID NO: 4472759 - DNA, 23 bp, Homo sapiens
ctcagcagcgaccacccctgcct

SEQ ID NO: 4472760 - DNA, 23 bp, Homo sapiens
ctcagcaggttggcttttttccc

SEQ ID NO: 4472761 - DNA, 21 bp, Homo sapiens
ctcagcatttccttgtcccgt

SEQ ID NO: 4472762 - DNA, 19 bp, Homo sapiens
ctcagccaaatttcctgtt

SEQ ID NO: 4472763 - DNA, 24 bp, Homo sapiens
ctcagccacaaagccccccagctc

SEQ ID NO: 4472764 - DNA, 20 bp, Homo sapiens
ctcagccactgtcacaggca

SEQ ID NO: 4472765 - DNA, 14 bp, Homo sapiens
ctcagccaggccct

SEQ ID NO: 4472766 - DNA, 21 bp, Homo sapiens
ctcagccatgaggagttgctg

SEQ ID NO: 4472767 - DNA, 20 bp, Homo sapiens
ctcagcccagaagaaaattc

SEQ ID NO: 4472768 - DNA, 15 bp, Homo sapiens
ctcagccccaactct

SEQ ID NO: 4472769 - DNA, 16 bp, Homo sapiens
ctcagccccaactctt

SEQ ID NO: 4472770 - DNA, 20 bp, Homo sapiens
ctcagccccaggccagctgc

SEQ ID NO: 4472771 - DNA, 16 bp, Homo sapiens
ctcagcccgctgagtg

SEQ ID NO: 4472772 - DNA, 12 bp, Homo sapiens
ctcagccctcag

SEQ ID NO: 4472773 - DNA, 16 bp, Homo sapiens
ctcagccctcagaaca

SEQ ID NO: 4472774 - DNA, 17 bp, Homo sapiens
ctcagccctcagaacaa

SEQ ID NO: 4472775 - DNA, 14 bp, Homo sapiens
ctcagccctcagtt

SEQ ID NO: 4472776 - DNA, 11 bp, Homo sapiens
ctcagccctga

SEQ ID NO: 4472777 - DNA, 15 bp, Homo sapiens
ctcagccctgaggtg

SEQ ID NO: 4472778 - DNA, 14 bp, Homo sapiens
ctcagccctgctcc

SEQ ID NO: 4472779 - DNA, 19 bp, Homo sapiens
ctcagccctgctccctgcc

SEQ ID NO: 4472780 - DNA, 12 bp, Homo sapiens
ctcagccctggg

SEQ ID NO: 4472781 - DNA, 13 bp, Homo sapiens
ctcagccctgggc

SEQ ID NO: 4472782 - DNA, 19 bp, Homo sapiens
ctcagccctgggccccacc

SEQ ID NO: 4472783 - DNA, 20 bp, Homo sapiens
ctcagcctcccatagctggg

SEQ ID NO: 4472784 - DNA, 15 bp, Homo sapiens
ctcagcctctgccag

SEQ ID NO: 4472785 - DNA, 13 bp, Homo sapiens
ctcagcctctgct

SEQ ID NO: 4472786 - DNA, 17 bp, Homo sapiens
ctcagcctctgctggag

SEQ ID NO: 4472787 - DNA, 19 bp, Homo sapiens
ctcagcctgctttcctgca

SEQ ID NO: 4472788 - DNA, 20 bp, Homo sapiens
ctcagcctgctttcctgcag

SEQ ID NO: 4472789 - DNA, 21 bp, Homo sapiens
ctcagcctgctttcctgcagc

SEQ ID NO: 4472790 - DNA, 14 bp, Homo sapiens
ctcagcctgggaca

SEQ ID NO: 4472791 - DNA, 17 bp, Homo sapiens
ctcagctataattctgt

SEQ ID NO: 4472792 - DNA, 19 bp, Homo sapiens
ctcagctctcctgctgcag

SEQ ID NO: 4472793 - DNA, 13 bp, Homo sapiens
ctcagctctctgg

SEQ ID NO: 4472794 - DNA, 15 bp, Homo sapiens
ctcagctctctggga

SEQ ID NO: 4472795 - DNA, 21 bp, Homo sapiens
ctcagctctctgggacctcct

SEQ ID NO: 4472796 - DNA, 17 bp, Homo sapiens
ctcagctgcctcctgcg

SEQ ID NO: 4472797 - DNA, 17 bp, Homo sapiens
ctcagctgctggatgac

SEQ ID NO: 4472798 - DNA, 14 bp, Homo sapiens
ctcagcttcctacc

SEQ ID NO: 4472799 - DNA, 13 bp, Homo sapiens
ctcagcttcttct

SEQ ID NO: 4472800 - DNA, 11 bp, Homo sapiens
ctcaggaaaga

SEQ ID NO: 4472801 - DNA, 15 bp, Homo sapiens
ctcaggaaagaatag

SEQ ID NO: 4472802 - DNA, 21 bp, Homo sapiens
ctcaggaaagaatagaaagaa

SEQ ID NO: 4472803 - DNA, 17 bp, Homo sapiens
ctcaggaaccgaggcag

SEQ ID NO: 4472804 - DNA, 16 bp, Homo sapiens
ctcaggaattccctgg

SEQ ID NO: 4472805 - DNA, 17 bp, Homo sapiens
ctcaggaattccctgga

SEQ ID NO: 4472806 - DNA, 18 bp, Homo sapiens
ctcaggaattccctggaa

SEQ ID NO: 4472807 - DNA, 18 bp, Homo sapiens
ctcaggacagaacagtgt

SEQ ID NO: 4472808 - DNA, 16 bp, Homo sapiens
ctcaggacagcatccc

SEQ ID NO: 4472809 - DNA, 21 bp, Homo sapiens
ctcaggaccaaagctttcatg

SEQ ID NO: 4472810 - DNA, 19 bp, Homo sapiens
ctcaggagatggagggctt

SEQ ID NO: 4472811 - DNA, 13 bp, Homo sapiens
ctcaggaggcgaa

SEQ ID NO: 4472812 - DNA, 20 bp, Homo sapiens
ctcaggaggctgaggcagaa

SEQ ID NO: 4472813 - DNA, 17 bp, Homo sapiens
ctcaggagtctgccact

SEQ ID NO: 4472814 - DNA, 14 bp, Homo sapiens
ctcaggcacacagc

SEQ ID NO: 4472815 - DNA, 18 bp, Homo sapiens
ctcaggcacacagctact

SEQ ID NO: 4472816 - DNA, 22 bp, Homo sapiens
ctcaggcagcgtgtgggtcccg

SEQ ID NO: 4472817 - DNA, 19 bp, Homo sapiens
ctcaggccaagggaccagg

SEQ ID NO: 4472818 - DNA, 18 bp, Homo sapiens
ctcaggcccagctgctcc

SEQ ID NO: 4472819 - DNA, 17 bp, Homo sapiens
ctcaggcccaggagtcc

SEQ ID NO: 4472820 - DNA, 18 bp, Homo sapiens
ctcaggcccaggagtcca

SEQ ID NO: 4472821 - DNA, 14 bp, Homo sapiens
ctcaggccgagagc

SEQ ID NO: 4472822 - DNA, 20 bp, Homo sapiens
ctcaggcctgactctcagca

SEQ ID NO: 4472823 - DNA, 17 bp, Homo sapiens
ctcaggctcaagttttt

SEQ ID NO: 4472824 - DNA, 19 bp, Homo sapiens
ctcagggagcagggaaggc

SEQ ID NO: 4472825 - DNA, 13 bp, Homo sapiens
ctcagggcctcag

SEQ ID NO: 4472826 - DNA, 14 bp, Homo sapiens
ctcagggcctcagg

SEQ ID NO: 4472827 - DNA, 16 bp, Homo sapiens
ctcagggctcccaggg

SEQ ID NO: 4472828 - DNA, 13 bp, Homo sapiens
ctcagggctcctg

SEQ ID NO: 4472829 - DNA, 17 bp, Homo sapiens
ctcagggctgtcccagc

SEQ ID NO: 4472830 - DNA, 20 bp, Homo sapiens
ctcagggctgtcccagcccc

SEQ ID NO: 4472831 - DNA, 18 bp, Homo sapiens
ctcaggggcctctctcct

SEQ ID NO: 4472832 - DNA, 18 bp, Homo sapiens
ctcagggtggggggtgac

SEQ ID NO: 4472833 - DNA, 17 bp, Homo sapiens
ctcaggtaatcatttta

SEQ ID NO: 4472834 - DNA, 16 bp, Homo sapiens
ctcagtaaagcacttg

SEQ ID NO: 4472835 - DNA, 22 bp, Homo sapiens
ctcagtaacataactgcttctt

SEQ ID NO: 4472836 - DNA, 20 bp, Homo sapiens
ctcagtaagtatctggagga

SEQ ID NO: 4472837 - DNA, 19 bp, Homo sapiens
ctcagtaatttagaaatca

SEQ ID NO: 4472838 - DNA, 15 bp, Homo sapiens
ctcagtctaaggtct

SEQ ID NO: 4472839 - DNA, 17 bp, Homo sapiens
ctcagtctctcttctct

SEQ ID NO: 4472840 - DNA, 20 bp, Homo sapiens
ctcagtctctgagcagtgaa

SEQ ID NO: 4472841 - DNA, 14 bp, Homo sapiens
ctcagtctgttcac

SEQ ID NO: 4472842 - DNA, 13 bp, Homo sapiens
ctcagtgagcctc

SEQ ID NO: 4472843 - DNA, 21 bp, Homo sapiens
ctcagtgagcctcctgtgcct

SEQ ID NO: 4472844 - DNA, 22 bp, Homo sapiens
ctcagtgagcctcctgtgcctg

SEQ ID NO: 4472845 - DNA, 14 bp, Homo sapiens
ctcagtgcatttgt

SEQ ID NO: 4472846 - DNA, 16 bp, Homo sapiens
ctcagtgcatttgtgc

SEQ ID NO: 4472847 - DNA, 13 bp, Homo sapiens
ctcagtgccacct

SEQ ID NO: 4472848 - DNA, 22 bp, Homo sapiens
ctcagtgctcctggaaacttag

SEQ ID NO: 4472849 - DNA, 18 bp, Homo sapiens
ctcagtgcttgggctcca

SEQ ID NO: 4472850 - DNA, 21 bp, Homo sapiens
ctcagtggatcttcagaactg

SEQ ID NO: 4472851 - DNA, 23 bp, Homo sapiens
ctcagtggatcttcagaactgcc

SEQ ID NO: 4472852 - DNA, 18 bp, Homo sapiens
ctcagtggcttctccagg

SEQ ID NO: 4472853 - DNA, 19 bp, Homo sapiens
ctcagtggcttctccaggg

SEQ ID NO: 4472854 - DNA, 23 bp, Homo sapiens
ctcagttattacatgtaatttga

SEQ ID NO: 4472855 - DNA, 18 bp, Homo sapiens
ctcagttcaacctggtgg

SEQ ID NO: 4472856 - DNA, 14 bp, Homo sapiens
ctcagttcccttgg

SEQ ID NO: 4472857 - DNA, 16 bp, Homo sapiens
ctcagttcccttggcc

SEQ ID NO: 4472858 - DNA, 17 bp, Homo sapiens
ctcagttcccttggcct

SEQ ID NO: 4472859 - DNA, 20 bp, Homo sapiens
ctcagttcccttggcctcag

SEQ ID NO: 4472860 - DNA, 21 bp, Homo sapiens
ctcagttcccttggcctcaga

SEQ ID NO: 4472861 - DNA, 24 bp, Homo sapiens
ctcagttccttcatttccaccagg

SEQ ID NO: 4472862 - DNA, 16 bp, Homo sapiens
ctcagttctctccctt

SEQ ID NO: 4472863 - DNA, 17 bp, Homo sapiens
ctcagttgttctgagca

SEQ ID NO: 4472864 - DNA, 17 bp, Homo sapiens
ctcagttgtttgcttct

SEQ ID NO: 4472865 - DNA, 22 bp, Homo sapiens
ctcagttgtttgcttcttgcca

SEQ ID NO: 4472866 - DNA, 18 bp, Homo sapiens
ctcagtttaaggtacact

SEQ ID NO: 4472867 - DNA, 18 bp, Homo sapiens
ctcatacacagttaaata

SEQ ID NO: 4472868 - DNA, 21 bp, Homo sapiens
ctcatacagaaagtgacaagg

SEQ ID NO: 4472869 - DNA, 16 bp, Homo sapiens
ctcataccctccctcc

SEQ ID NO: 4472870 - DNA, 14 bp, Homo sapiens
ctcatactcctggg

SEQ ID NO: 4472871 - DNA, 17 bp, Homo sapiens
ctcatagccctcagaca

SEQ ID NO: 4472872 - DNA, 14 bp, Homo sapiens
ctcatatgttccca

SEQ ID NO: 4472873 - DNA, 13 bp, Homo sapiens
ctcatattgtgat

SEQ ID NO: 4472874 - DNA, 21 bp, Homo sapiens
ctcatattgtgattctgcctt

SEQ ID NO: 4472875 - DNA, 13 bp, Homo sapiens
ctcatcacataaa

SEQ ID NO: 4472876 - DNA, 12 bp, Homo sapiens
ctcatcagtagt

SEQ ID NO: 4472877 - DNA, 19 bp, Homo sapiens
ctcatccatcatcatgtgt

SEQ ID NO: 4472878 - DNA, 22 bp, Homo sapiens
ctcatcccaacctctttttcct

SEQ ID NO: 4472879 - DNA, 18 bp, Homo sapiens
ctcatccctgactggcca

SEQ ID NO: 4472880 - DNA, 16 bp, Homo sapiens
ctcatcctcccattgc

SEQ ID NO: 4472881 - DNA, 21 bp, Homo sapiens
ctcatctatggttctaaatat

SEQ ID NO: 4472882 - DNA, 11 bp, Homo sapiens
ctcatctcagt

SEQ ID NO: 4472883 - DNA, 18 bp, Homo sapiens
ctcatctcagtgaagaat

SEQ ID NO: 4472884 - DNA, 17 bp, Homo sapiens
ctcatctcttagctccc

SEQ ID NO: 4472885 - DNA, 19 bp, Homo sapiens
ctcatctcttagctcccct

SEQ ID NO: 4472886 - DNA, 12 bp, Homo sapiens
ctcatctgcagg

SEQ ID NO: 4472887 - DNA, 17 bp, Homo sapiens
ctcatctgtccctccgg

SEQ ID NO: 4472888 - DNA, 17 bp, Homo sapiens
ctcatcttcttcaccat

SEQ ID NO: 4472889 - DNA, 16 bp, Homo sapiens
ctcatcttgtgaaatg

SEQ ID NO: 4472890 - DNA, 17 bp, Homo sapiens
ctcatctttctccttca

SEQ ID NO: 4472891 - DNA, 13 bp, Homo sapiens
ctcatctttcttg

SEQ ID NO: 4472892 - DNA, 16 bp, Homo sapiens
ctcatgactttatagt

SEQ ID NO: 4472893 - DNA, 21 bp, Homo sapiens
ctcatgagtctacctgagcat

SEQ ID NO: 4472894 - DNA, 16 bp, Homo sapiens
ctcatgagtgtgcccc

SEQ ID NO: 4472895 - DNA, 17 bp, Homo sapiens
ctcatgcaaactgcttt

SEQ ID NO: 4472896 - DNA, 21 bp, Homo sapiens
ctcatgcaaactgctttattt

SEQ ID NO: 4472897 - DNA, 19 bp, Homo sapiens
ctcatgcaaatcaattact

SEQ ID NO: 4472898 - DNA, 12 bp, Homo sapiens
ctcatgccatca

SEQ ID NO: 4472899 - DNA, 13 bp, Homo sapiens
ctcatgcccaccc

SEQ ID NO: 4472900 - DNA, 22 bp, Homo sapiens
ctcatgccccctttcagatgtc

SEQ ID NO: 4472901 - DNA, 23 bp, Homo sapiens
ctcatgccccctttcagatgtct

SEQ ID NO: 4472902 - DNA, 17 bp, Homo sapiens
ctcatgtatcatctgga

SEQ ID NO: 4472903 - DNA, 19 bp, Homo sapiens
ctcatgtatcatctggata

SEQ ID NO: 4472904 - DNA, 19 bp, Homo sapiens
ctcatgtgcagtcagcttt

SEQ ID NO: 4472905 - DNA, 13 bp, Homo sapiens
ctcatgttgctga

SEQ ID NO: 4472906 - DNA, 17 bp, Homo sapiens
ctcatgttgctgaattt

SEQ ID NO: 4472907 - DNA, 18 bp, Homo sapiens
ctcattaaactctaaaga

SEQ ID NO: 4472908 - DNA, 15 bp, Homo sapiens
ctcattaaacttttt

SEQ ID NO: 4472909 - DNA, 13 bp, Homo sapiens
ctcattaatagct

SEQ ID NO: 4472910 - DNA, 17 bp, Homo sapiens
ctcattaggttttgctt

SEQ ID NO: 4472911 - DNA, 15 bp, Homo sapiens
ctcattccagaggaa

SEQ ID NO: 4472912 - DNA, 14 bp, Homo sapiens
ctcattccagatcc

SEQ ID NO: 4472913 - DNA, 13 bp, Homo sapiens
ctcattccccagg

SEQ ID NO: 4472914 - DNA, 21 bp, Homo sapiens
ctcattctactaatgtgatgc

SEQ ID NO: 4472915 - DNA, 19 bp, Homo sapiens
ctcattctgaaggagcccc

SEQ ID NO: 4472916 - DNA, 16 bp, Homo sapiens
ctcattgcagcagata

SEQ ID NO: 4472917 - DNA, 13 bp, Homo sapiens
ctcattgcttctg

SEQ ID NO: 4472918 - DNA, 17 bp, Homo sapiens
ctcattggacccttcca

SEQ ID NO: 4472919 - DNA, 18 bp, Homo sapiens
ctcatttaagggaaaaat

SEQ ID NO: 4472920 - DNA, 22 bp, Homo sapiens
ctcatttaagggaaaaatatat

SEQ ID NO: 4472921 - DNA, 22 bp, Homo sapiens
ctcatttcacccctccctttct

SEQ ID NO: 4472922 - DNA, 23 bp, Homo sapiens
ctcatttcacccctccctttctc

SEQ ID NO: 4472923 - DNA, 13 bp, Homo sapiens
ctcattttaatgt

SEQ ID NO: 4472924 - DNA, 12 bp, Homo sapiens
ctcattttcctg

SEQ ID NO: 4472925 - DNA, 19 bp, Homo sapiens
ctccaaaaatctgcctggg

SEQ ID NO: 4472926 - DNA, 21 bp, Homo sapiens
ctccaaaaatctgcctgggtt

SEQ ID NO: 4472927 - DNA, 14 bp, Homo sapiens
ctccaaaacatttc

SEQ ID NO: 4472928 - DNA, 21 bp, Homo sapiens
ctccaaaatattaacattctt

SEQ ID NO: 4472929 - DNA, 22 bp, Homo sapiens
ctccaaaggaagtctaggagct

SEQ ID NO: 4472930 - DNA, 15 bp, Homo sapiens
ctccaaaggccccct

SEQ ID NO: 4472931 - DNA, 19 bp, Homo sapiens
ctccaaccccccagcactg

SEQ ID NO: 4472932 - DNA, 20 bp, Homo sapiens
ctccaaccccccagcactga

SEQ ID NO: 4472933 - DNA, 22 bp, Homo sapiens
ctccaaccccccagcactgagg

SEQ ID NO: 4472934 - DNA, 21 bp, Homo sapiens
ctccaactcctttcagccaca

SEQ ID NO: 4472935 - DNA, 21 bp, Homo sapiens
ctccaagatttaacctgcaag

SEQ ID NO: 4472936 - DNA, 13 bp, Homo sapiens
ctccaagcacaga

SEQ ID NO: 4472937 - DNA, 17 bp, Homo sapiens
ctccaagcacagagcct

SEQ ID NO: 4472938 - DNA, 21 bp, Homo sapiens
ctccaaggaggggctgtaaaa

SEQ ID NO: 4472939 - DNA, 15 bp, Homo sapiens
ctccaaggtggggtc

SEQ ID NO: 4472940 - DNA, 21 bp, Homo sapiens
ctccaagtctcagtggcttca

SEQ ID NO: 4472941 - DNA, 16 bp, Homo sapiens
ctccaatgactgagca

SEQ ID NO: 4472942 - DNA, 23 bp, Homo sapiens
ctccaatggaaagcttttcagtg

SEQ ID NO: 4472943 - DNA, 13 bp, Homo sapiens
ctccacacctgaa

SEQ ID NO: 4472944 - DNA, 12 bp, Homo sapiens
ctccacaccttt

SEQ ID NO: 4472945 - DNA, 21 bp, Homo sapiens
ctccacacgccccggtccccc

SEQ ID NO: 4472946 - DNA, 20 bp, Homo sapiens
ctccacactgaccaagtgct

SEQ ID NO: 4472947 - DNA, 13 bp, Homo sapiens
ctccacagagagg

SEQ ID NO: 4472948 - DNA, 20 bp, Homo sapiens
ctccacagagaggaggggac

SEQ ID NO: 4472949 - DNA, 21 bp, Homo sapiens
ctccacatcaacattccaggg

SEQ ID NO: 4472950 - DNA, 13 bp, Homo sapiens
ctccacatctgcc

SEQ ID NO: 4472951 - DNA, 14 bp, Homo sapiens
ctccacatctgcct

SEQ ID NO: 4472952 - DNA, 16 bp, Homo sapiens
ctccacatctgcctta

SEQ ID NO: 4472953 - DNA, 22 bp, Homo sapiens
ctccacattcttcagtttttca

SEQ ID NO: 4472954 - DNA, 14 bp, Homo sapiens
ctccaccagcagca

SEQ ID NO: 4472955 - DNA, 16 bp, Homo sapiens
ctccaccagcagcatg

SEQ ID NO: 4472956 - DNA, 16 bp, Homo sapiens
ctccaccatccccacc

SEQ ID NO: 4472957 - DNA, 17 bp, Homo sapiens
ctccaccatccccaccc

SEQ ID NO: 4472958 - DNA, 17 bp, Homo sapiens
ctccaccccacagaacc

SEQ ID NO: 4472959 - DNA, 14 bp, Homo sapiens
ctccaccccagggt

SEQ ID NO: 4472960 - DNA, 15 bp, Homo sapiens
ctccacccttggcct

SEQ ID NO: 4472961 - DNA, 21 bp, Homo sapiens
ctccacccttggcctgtctca

SEQ ID NO: 4472962 - DNA, 14 bp, Homo sapiens
ctccaccgctgcct

SEQ ID NO: 4472963 - DNA, 15 bp, Homo sapiens
ctccaccgctgccta

SEQ ID NO: 4472964 - DNA, 19 bp, Homo sapiens
ctccaccgctgcctaagtg

SEQ ID NO: 4472965 - DNA, 14 bp, Homo sapiens
ctccacctcagcct

SEQ ID NO: 4472966 - DNA, 16 bp, Homo sapiens
ctccacctcagccttg

SEQ ID NO: 4472967 - DNA, 11 bp, Homo sapiens
ctccacctgca

SEQ ID NO: 4472968 - DNA, 14 bp, Homo sapiens
ctccacgcctcctg

SEQ ID NO: 4472969 - DNA, 15 bp, Homo sapiens
ctccacgcctcctgg

SEQ ID NO: 4472970 - DNA, 20 bp, Homo sapiens
ctccacgcctcctggccaga

SEQ ID NO: 4472971 - DNA, 18 bp, Homo sapiens
ctccacgttctgctcatc

SEQ ID NO: 4472972 - DNA, 16 bp, Homo sapiens
ctccactcatgtgact

SEQ ID NO: 4472973 - DNA, 18 bp, Homo sapiens
ctccactcctcatcccca

SEQ ID NO: 4472974 - DNA, 12 bp, Homo sapiens
ctccactccttc

SEQ ID NO: 4472975 - DNA, 16 bp, Homo sapiens
ctccactccttccatc

SEQ ID NO: 4472976 - DNA, 14 bp, Homo sapiens
ctccactcgaccca

SEQ ID NO: 4472977 - DNA, 18 bp, Homo sapiens
ctccactctagttctaga

SEQ ID NO: 4472978 - DNA, 19 bp, Homo sapiens
ctccactctagttctagat

SEQ ID NO: 4472979 - DNA, 24 bp, Homo sapiens
ctccactggggaatgctcccagct

SEQ ID NO: 4472980 - DNA, 13 bp, Homo sapiens
ctccacttgtata

SEQ ID NO: 4472981 - DNA, 16 bp, Homo sapiens
ctccagaagcctctgg

SEQ ID NO: 4472982 - DNA, 23 bp, Homo sapiens
ctccagactaacatgtcagtttt

SEQ ID NO: 4472983 - DNA, 18 bp, Homo sapiens
ctccagagaagtttcgag

SEQ ID NO: 4472984 - DNA, 18 bp, Homo sapiens
ctccagagggcactcaga

SEQ ID NO: 4472985 - DNA, 20 bp, Homo sapiens
ctccagagggcactcagaag

SEQ ID NO: 4472986 - DNA, 13 bp, Homo sapiens
ctccagcaccttc

SEQ ID NO: 4472987 - DNA, 20 bp, Homo sapiens
ctccagcaccttctttctgg

SEQ ID NO: 4472988 - DNA, 19 bp, Homo sapiens
ctccagcagactcctgctc

SEQ ID NO: 4472989 - DNA, 14 bp, Homo sapiens
ctccagccagcgcc

SEQ ID NO: 4472990 - DNA, 15 bp, Homo sapiens
ctccagccagcgcct

SEQ ID NO: 4472991 - DNA, 19 bp, Homo sapiens
ctccagccagcgcctccct

SEQ ID NO: 4472992 - DNA, 15 bp, Homo sapiens
ctccagcctcccctc

SEQ ID NO: 4472993 - DNA, 21 bp, Homo sapiens
ctccagcctcccctcccctgg

SEQ ID NO: 4472994 - DNA, 12 bp, Homo sapiens
ctccagcctctg

SEQ ID NO: 4472995 - DNA, 19 bp, Homo sapiens
ctccagcctctgccgctgc

SEQ ID NO: 4472996 - DNA, 13 bp, Homo sapiens
ctccagcctctgt

SEQ ID NO: 4472997 - DNA, 19 bp, Homo sapiens
ctccagcctgagtgacaga

SEQ ID NO: 4472998 - DNA, 14 bp, Homo sapiens
ctccagcctgggca

SEQ ID NO: 4472999 - DNA, 13 bp, Homo sapiens
ctccagctctggc

SEQ ID NO: 4473000 - DNA, 14 bp, Homo sapiens
ctccagctctggca

SEQ ID NO: 4473001 - DNA, 20 bp, Homo sapiens
ctccagctgactaaactttt

SEQ ID NO: 4473002 - DNA, 12 bp, Homo sapiens
ctccagcttccc

SEQ ID NO: 4473003 - DNA, 18 bp, Homo sapiens
ctccagcttgtggagccc

SEQ ID NO: 4473004 - DNA, 19 bp, Homo sapiens
ctccagcttgtggagcccc

SEQ ID NO: 4473005 - DNA, 20 bp, Homo sapiens
ctccagcttgtggagcccca

SEQ ID NO: 4473006 - DNA, 19 bp, Homo sapiens
ctccagcttttctttttct

SEQ ID NO: 4473007 - DNA, 14 bp, Homo sapiens
ctccaggagcctca

SEQ ID NO: 4473008 - DNA, 15 bp, Homo sapiens
ctccaggagcctcat

SEQ ID NO: 4473009 - DNA, 19 bp, Homo sapiens
ctccaggagcctcatccag

SEQ ID NO: 4473010 - DNA, 22 bp, Homo sapiens
ctccaggcatttagccctcaca

SEQ ID NO: 4473011 - DNA, 18 bp, Homo sapiens
ctccaggcccccaactcc

SEQ ID NO: 4473012 - DNA, 14 bp, Homo sapiens
ctccaggcctgcct

SEQ ID NO: 4473013 - DNA, 16 bp, Homo sapiens
ctccaggcctgcctcc

SEQ ID NO: 4473014 - DNA, 19 bp, Homo sapiens
ctccaggcctgcctcccac

SEQ ID NO: 4473015 - DNA, 12 bp, Homo sapiens
ctccagggctgg

SEQ ID NO: 4473016 - DNA, 13 bp, Homo sapiens
ctccagggctgga

SEQ ID NO: 4473017 - DNA, 16 bp, Homo sapiens
ctccagggctggactg

SEQ ID NO: 4473018 - DNA, 21 bp, Homo sapiens
ctccagggctggactgaggcc

SEQ ID NO: 4473019 - DNA, 20 bp, Homo sapiens
ctccaggggtcctaggcctc

SEQ ID NO: 4473020 - DNA, 17 bp, Homo sapiens
ctccagggtcaggcgga

SEQ ID NO: 4473021 - DNA, 14 bp, Homo sapiens
ctccagggtcctct

SEQ ID NO: 4473022 - DNA, 22 bp, Homo sapiens
ctccagggtcctctcttccaca

SEQ ID NO: 4473023 - DNA, 23 bp, Homo sapiens
ctccagggtcctctcttccacag

SEQ ID NO: 4473024 - DNA, 21 bp, Homo sapiens
ctccagtacgtcccgctgctg

SEQ ID NO: 4473025 - DNA, 18 bp, Homo sapiens
ctccagtataatctcctc

SEQ ID NO: 4473026 - DNA, 20 bp, Homo sapiens
ctccagtctcatcctcccat

SEQ ID NO: 4473027 - DNA, 17 bp, Homo sapiens
ctccagtgcatactgta

SEQ ID NO: 4473028 - DNA, 22 bp, Homo sapiens
ctccagtgctgtccatgcttct

SEQ ID NO: 4473029 - DNA, 18 bp, Homo sapiens
ctccagtgggctgatgct

SEQ ID NO: 4473030 - DNA, 20 bp, Homo sapiens
ctccagtgggctgatgctgg

SEQ ID NO: 4473031 - DNA, 21 bp, Homo sapiens
ctccagttagaatgcaccatg

SEQ ID NO: 4473032 - DNA, 19 bp, Homo sapiens
ctccagtttgcccaccaca

SEQ ID NO: 4473033 - DNA, 13 bp, Homo sapiens
ctccatacagcct

SEQ ID NO: 4473034 - DNA, 16 bp, Homo sapiens
ctccatacagcctcta

SEQ ID NO: 4473035 - DNA, 14 bp, Homo sapiens
ctccataccttttc

SEQ ID NO: 4473036 - DNA, 20 bp, Homo sapiens
ctccataccttttctctttt

SEQ ID NO: 4473037 - DNA, 21 bp, Homo sapiens
ctccataccttttctcttttc

SEQ ID NO: 4473038 - DNA, 16 bp, Homo sapiens
ctccatatctccttcc

SEQ ID NO: 4473039 - DNA, 17 bp, Homo sapiens
ctccatcagaaaaccaa

SEQ ID NO: 4473040 - DNA, 11 bp, Homo sapiens
ctccatcccct

SEQ ID NO: 4473041 - DNA, 15 bp, Homo sapiens
ctccatcccctccct

SEQ ID NO: 4473042 - DNA, 16 bp, Homo sapiens
ctccatcccctccctg

SEQ ID NO: 4473043 - DNA, 17 bp, Homo sapiens
ctccatcccctccctgc

SEQ ID NO: 4473044 - DNA, 21 bp, Homo sapiens
ctccatcccctccctgcctgc

SEQ ID NO: 4473045 - DNA, 20 bp, Homo sapiens
ctccatcctaccccctgtgc

SEQ ID NO: 4473046 - DNA, 14 bp, Homo sapiens
ctccatctcatgta

SEQ ID NO: 4473047 - DNA, 12 bp, Homo sapiens
ctccatctcttc

SEQ ID NO: 4473048 - DNA, 23 bp, Homo sapiens
ctccatctcttctgcaagcctca

SEQ ID NO: 4473049 - DNA, 23 bp, Homo sapiens
ctccatcttggtagttctgtgcc

SEQ ID NO: 4473050 - DNA, 17 bp, Homo sapiens
ctccatgctcctcacct

SEQ ID NO: 4473051 - DNA, 16 bp, Homo sapiens
ctccatgctccttgag

SEQ ID NO: 4473052 - DNA, 15 bp, Homo sapiens
ctccatggccctgtc

SEQ ID NO: 4473053 - DNA, 18 bp, Homo sapiens
ctccatggccctgtccca

SEQ ID NO: 4473054 - DNA, 21 bp, Homo sapiens
ctccatggccctgtcccaggc

SEQ ID NO: 4473055 - DNA, 22 bp, Homo sapiens
ctccatggggttcgagactcca

SEQ ID NO: 4473056 - DNA, 22 bp, Homo sapiens
ctccatgtgaccgaacactgca

SEQ ID NO: 4473057 - DNA, 15 bp, Homo sapiens
ctccatgtgcctctt

SEQ ID NO: 4473058 - DNA, 19 bp, Homo sapiens
ctccatgtgtgtgccaagc

SEQ ID NO: 4473059 - DNA, 24 bp, Homo sapiens
ctccattcccgtggaacgtttttc

SEQ ID NO: 4473060 - DNA, 13 bp, Homo sapiens
ctccattctattt

SEQ ID NO: 4473061 - DNA, 14 bp, Homo sapiens
ctccattctatttt

SEQ ID NO: 4473062 - DNA, 21 bp, Homo sapiens
ctccattctgcactcagaaaa

SEQ ID NO: 4473063 - DNA, 20 bp, Homo sapiens
ctccattgggcacagtccag

SEQ ID NO: 4473064 - DNA, 21 bp, Homo sapiens
ctccattgggcacagtccaga

SEQ ID NO: 4473065 - DNA, 23 bp, Homo sapiens
ctcccaaagctcagacttgccag

SEQ ID NO: 4473066 - DNA, 15 bp, Homo sapiens
ctcccaaagtgctgg

SEQ ID NO: 4473067 - DNA, 16 bp, Homo sapiens
ctcccaaagtgctggg

SEQ ID NO: 4473068 - DNA, 22 bp, Homo sapiens
ctcccaaagtgctgggattaca

SEQ ID NO: 4473069 - DNA, 14 bp, Homo sapiens
ctcccaacagagct

SEQ ID NO: 4473070 - DNA, 21 bp, Homo sapiens
ctcccaacatgggagggatca

SEQ ID NO: 4473071 - DNA, 17 bp, Homo sapiens
ctcccaagcgttcctgg

SEQ ID NO: 4473072 - DNA, 19 bp, Homo sapiens
ctcccaagcgttcctggcc

SEQ ID NO: 4473073 - DNA, 20 bp, Homo sapiens
ctcccaagcgttcctggcct

SEQ ID NO: 4473074 - DNA, 18 bp, Homo sapiens
ctcccaaggagaacaaat

SEQ ID NO: 4473075 - DNA, 18 bp, Homo sapiens
ctcccaaggtcctctcag

SEQ ID NO: 4473076 - DNA, 16 bp, Homo sapiens
ctcccaagtggtgcct

SEQ ID NO: 4473077 - DNA, 23 bp, Homo sapiens
ctcccaatcagcttttgttctag

SEQ ID NO: 4473078 - DNA, 14 bp, Homo sapiens
ctcccacaccgcgt

SEQ ID NO: 4473079 - DNA, 20 bp, Homo sapiens
ctcccacaccgcgtcccagc

SEQ ID NO: 4473080 - DNA, 20 bp, Homo sapiens
ctcccacagagtgctggact

SEQ ID NO: 4473081 - DNA, 21 bp, Homo sapiens
ctcccacagagtgctggactg

SEQ ID NO: 4473082 - DNA, 18 bp, Homo sapiens
ctcccacagcagccccag

SEQ ID NO: 4473083 - DNA, 22 bp, Homo sapiens
ctcccacagcagccccaggaga

SEQ ID NO: 4473084 - DNA, 15 bp, Homo sapiens
ctcccacagcttcct

SEQ ID NO: 4473085 - DNA, 16 bp, Homo sapiens
ctcccacagcttcctg

SEQ ID NO: 4473086 - DNA, 23 bp, Homo sapiens
ctcccaccccacccccttcagtg

SEQ ID NO: 4473087 - DNA, 15 bp, Homo sapiens
ctcccacccccagcc

SEQ ID NO: 4473088 - DNA, 22 bp, Homo sapiens
ctcccacccggccacagctgct

SEQ ID NO: 4473089 - DNA, 16 bp, Homo sapiens
ctcccaccgctgcctc

SEQ ID NO: 4473090 - DNA, 14 bp, Homo sapiens
ctcccacctcagcc

SEQ ID NO: 4473091 - DNA, 20 bp, Homo sapiens
ctcccacctgacacaccagg

SEQ ID NO: 4473092 - DNA, 21 bp, Homo sapiens
ctcccacctgtttctggaaga

SEQ ID NO: 4473093 - DNA, 17 bp, Homo sapiens
ctcccagacaggccctc

SEQ ID NO: 4473094 - DNA, 18 bp, Homo sapiens
ctcccagacaggccctcc

SEQ ID NO: 4473095 - DNA, 22 bp, Homo sapiens
ctcccagacaggccctccctgt

SEQ ID NO: 4473096 - DNA, 23 bp, Homo sapiens
ctcccagacaggccctccctgtc

SEQ ID NO: 4473097 - DNA, 15 bp, Homo sapiens
ctcccagaggagcca

SEQ ID NO: 4473098 - DNA, 19 bp, Homo sapiens
ctcccagaggagccaccag

SEQ ID NO: 4473099 - DNA, 11 bp, Homo sapiens
ctcccagccag

SEQ ID NO: 4473100 - DNA, 19 bp, Homo sapiens
ctcccagctcctttctcct

SEQ ID NO: 4473101 - DNA, 20 bp, Homo sapiens
ctcccagctcctttctcctg

SEQ ID NO: 4473102 - DNA, 14 bp, Homo sapiens
ctcccagctgtgct

SEQ ID NO: 4473103 - DNA, 15 bp, Homo sapiens
ctcccaggccccagg

SEQ ID NO: 4473104 - DNA, 18 bp, Homo sapiens
ctcccaggcctgcctgca

SEQ ID NO: 4473105 - DNA, 20 bp, Homo sapiens
ctcccaggcctgcctgcatg

SEQ ID NO: 4473106 - DNA, 20 bp, Homo sapiens
ctcccaggggtctccctggc

SEQ ID NO: 4473107 - DNA, 23 bp, Homo sapiens
ctcccaggggtctccctggctcc

SEQ ID NO: 4473108 - DNA, 17 bp, Homo sapiens
ctcccagtatgttttaa

SEQ ID NO: 4473109 - DNA, 23 bp, Homo sapiens
ctcccagtatgttttaacaaaaa

SEQ ID NO: 4473110 - DNA, 20 bp, Homo sapiens
ctcccagtcctgcctgaaca

SEQ ID NO: 4473111 - DNA, 20 bp, Homo sapiens
ctcccagtgaactcctgcca

SEQ ID NO: 4473112 - DNA, 22 bp, Homo sapiens
ctcccataattgctttgccaaa

SEQ ID NO: 4473113 - DNA, 12 bp, Homo sapiens
ctcccatgaagc

SEQ ID NO: 4473114 - DNA, 14 bp, Homo sapiens
ctcccatgaagcct

SEQ ID NO: 4473115 - DNA, 21 bp, Homo sapiens
ctcccatgaccatactgaggg

SEQ ID NO: 4473116 - DNA, 18 bp, Homo sapiens
ctcccatgagggagatgc

SEQ ID NO: 4473117 - DNA, 20 bp, Homo sapiens
ctcccatgagggagatgcca

SEQ ID NO: 4473118 - DNA, 16 bp, Homo sapiens
ctcccatggagcccca

SEQ ID NO: 4473119 - DNA, 14 bp, Homo sapiens
ctcccatggcacct

SEQ ID NO: 4473120 - DNA, 16 bp, Homo sapiens
ctcccattttggaatt

SEQ ID NO: 4473121 - DNA, 23 bp, Homo sapiens
ctccccaacacctgcctctgacc

SEQ ID NO: 4473122 - DNA, 13 bp, Homo sapiens
ctccccaactccc

SEQ ID NO: 4473123 - DNA, 15 bp, Homo sapiens
ctccccacagcgtcc

SEQ ID NO: 4473124 - DNA, 18 bp, Homo sapiens
ctccccacagcgtccctg

SEQ ID NO: 4473125 - DNA, 19 bp, Homo sapiens
ctccccacagcgtccctgg

SEQ ID NO: 4473126 - DNA, 20 bp, Homo sapiens
ctccccacagcgtccctggc

SEQ ID NO: 4473127 - DNA, 15 bp, Homo sapiens
ctccccacgagggct

SEQ ID NO: 4473128 - DNA, 16 bp, Homo sapiens
ctccccacttcacttt

SEQ ID NO: 4473129 - DNA, 20 bp, Homo sapiens
ctccccacttcactttcttc

SEQ ID NO: 4473130 - DNA, 10 bp, Homo sapiens
ctccccagaa

SEQ ID NO: 4473131 - DNA, 14 bp, Homo sapiens
ctccccagaattca

SEQ ID NO: 4473132 - DNA, 23 bp, Homo sapiens
ctccccagagctggcgctcagca

SEQ ID NO: 4473133 - DNA, 14 bp, Homo sapiens
ctccccagccccag

SEQ ID NO: 4473134 - DNA, 18 bp, Homo sapiens
ctccccagccccctccca

SEQ ID NO: 4473135 - DNA, 13 bp, Homo sapiens
ctccccagtacag

SEQ ID NO: 4473136 - DNA, 15 bp, Homo sapiens
ctccccagtgcctgc

SEQ ID NO: 4473137 - DNA, 16 bp, Homo sapiens
ctccccagtgcctgcc

SEQ ID NO: 4473138 - DNA, 19 bp, Homo sapiens
ctccccagtgcctgccact

SEQ ID NO: 4473139 - DNA, 21 bp, Homo sapiens
ctccccagtgcctgccactct

SEQ ID NO: 4473140 - DNA, 18 bp, Homo sapiens
ctccccatatataaatta

SEQ ID NO: 4473141 - DNA, 20 bp, Homo sapiens
ctccccatatataaattatt

SEQ ID NO: 4473142 - DNA, 17 bp, Homo sapiens
ctccccatttcccatct

SEQ ID NO: 4473143 - DNA, 19 bp, Homo sapiens
ctcccccaccccctcccca

SEQ ID NO: 4473144 - DNA, 20 bp, Homo sapiens
ctcccccatccccaccactg

SEQ ID NO: 4473145 - DNA, 17 bp, Homo sapiens
ctcccccgtggtgcctg

SEQ ID NO: 4473146 - DNA, 18 bp, Homo sapiens
ctcccccgtggtgcctgc

SEQ ID NO: 4473147 - DNA, 17 bp, Homo sapiens
ctcccccgtttctcctt

SEQ ID NO: 4473148 - DNA, 14 bp, Homo sapiens
ctccccctcagatg

SEQ ID NO: 4473149 - DNA, 14 bp, Homo sapiens
ctccccctccccag

SEQ ID NO: 4473150 - DNA, 15 bp, Homo sapiens
ctccccctccccagg

SEQ ID NO: 4473151 - DNA, 23 bp, Homo sapiens
ctccccctgcaacttccgctgag

SEQ ID NO: 4473152 - DNA, 16 bp, Homo sapiens
ctccccctgccagtgc

SEQ ID NO: 4473153 - DNA, 19 bp, Homo sapiens
ctccccctgccagtgcctt

SEQ ID NO: 4473154 - DNA, 11 bp, Homo sapiens
ctccccctgcg

SEQ ID NO: 4473155 - DNA, 13 bp, Homo sapiens
ctccccgcctcca

SEQ ID NO: 4473156 - DNA, 14 bp, Homo sapiens
ctccccgcctccac

SEQ ID NO: 4473157 - DNA, 20 bp, Homo sapiens
ctccccgcctccactctagt

SEQ ID NO: 4473158 - DNA, 15 bp, Homo sapiens
ctccccgctctggat

SEQ ID NO: 4473159 - DNA, 22 bp, Homo sapiens
ctccccgtgtcctctccctgcc

SEQ ID NO: 4473160 - DNA, 17 bp, Homo sapiens
ctcccctatccacccag

SEQ ID NO: 4473161 - DNA, 18 bp, Homo sapiens
ctcccctatccacccagc

SEQ ID NO: 4473162 - DNA, 19 bp, Homo sapiens
ctcccctatccacccagcc

SEQ ID NO: 4473163 - DNA, 13 bp, Homo sapiens
ctcccctcccctg

SEQ ID NO: 4473164 - DNA, 16 bp, Homo sapiens
ctcccctcccctgggg

SEQ ID NO: 4473165 - DNA, 13 bp, Homo sapiens
ctcccctcctcta

SEQ ID NO: 4473166 - DNA, 15 bp, Homo sapiens
ctcccctcctcttcc

SEQ ID NO: 4473167 - DNA, 23 bp, Homo sapiens
ctcccctcctcttcccttagcct

SEQ ID NO: 4473168 - DNA, 14 bp, Homo sapiens
ctcccctctcagca

SEQ ID NO: 4473169 - DNA, 13 bp, Homo sapiens
ctcccctcttttg

SEQ ID NO: 4473170 - DNA, 18 bp, Homo sapiens
ctcccctgcccagcctgc

SEQ ID NO: 4473171 - DNA, 18 bp, Homo sapiens
ctcccctgcccccaggac

SEQ ID NO: 4473172 - DNA, 23 bp, Homo sapiens
ctcccctgcccccaggactgggc

SEQ ID NO: 4473173 - DNA, 14 bp, Homo sapiens
ctcccctggctggc

SEQ ID NO: 4473174 - DNA, 16 bp, Homo sapiens
ctcccctggctggctc

SEQ ID NO: 4473175 - DNA, 21 bp, Homo sapiens
ctcccctggctggctcctagg

SEQ ID NO: 4473176 - DNA, 12 bp, Homo sapiens
ctccccttcctg

SEQ ID NO: 4473177 - DNA, 13 bp, Homo sapiens
ctccccttcctgg

SEQ ID NO: 4473178 - DNA, 16 bp, Homo sapiens
ctccccttcctggcac

SEQ ID NO: 4473179 - DNA, 14 bp, Homo sapiens
ctccccttcctgtt

SEQ ID NO: 4473180 - DNA, 20 bp, Homo sapiens
ctccccttttttcttctatt

SEQ ID NO: 4473181 - DNA, 20 bp, Homo sapiens
ctccccttttttttctgatt

SEQ ID NO: 4473182 - DNA, 18 bp, Homo sapiens
ctcccgaaaaatgtgtgg

SEQ ID NO: 4473183 - DNA, 22 bp, Homo sapiens
ctcccgaaaaatgtgtggttct

SEQ ID NO: 4473184 - DNA, 22 bp, Homo sapiens
ctcccgagtagctgggactaga

SEQ ID NO: 4473185 - DNA, 15 bp, Homo sapiens
ctcccgccactcgcc

SEQ ID NO: 4473186 - DNA, 13 bp, Homo sapiens
ctcccgccccgcc

SEQ ID NO: 4473187 - DNA, 21 bp, Homo sapiens
ctcccgcccttccatgtgcct

SEQ ID NO: 4473188 - DNA, 14 bp, Homo sapiens
ctcccgctcccagg

SEQ ID NO: 4473189 - DNA, 14 bp, Homo sapiens
ctcccggggactca

SEQ ID NO: 4473190 - DNA, 12 bp, Homo sapiens
ctcccggggcct

SEQ ID NO: 4473191 - DNA, 17 bp, Homo sapiens
ctcccggggcctggaca

SEQ ID NO: 4473192 - DNA, 18 bp, Homo sapiens
ctcccggggcctggacag

SEQ ID NO: 4473193 - DNA, 20 bp, Homo sapiens
ctcccggggcctggacaggc

SEQ ID NO: 4473194 - DNA, 19 bp, Homo sapiens
ctccctaatttatgtgcta

SEQ ID NO: 4473195 - DNA, 11 bp, Homo sapiens
ctccctacctc

SEQ ID NO: 4473196 - DNA, 16 bp, Homo sapiens
ctccctacctcaacct

SEQ ID NO: 4473197 - DNA, 20 bp, Homo sapiens
ctccctacctcaacctgtaa

SEQ ID NO: 4473198 - DNA, 14 bp, Homo sapiens
ctccctagtctcca

SEQ ID NO: 4473199 - DNA, 17 bp, Homo sapiens
ctccctatcaagcacta

SEQ ID NO: 4473200 - DNA, 12 bp, Homo sapiens
ctccctcaaacc

SEQ ID NO: 4473201 - DNA, 10 bp, Homo sapiens
ctccctcaga

SEQ ID NO: 4473202 - DNA, 14 bp, Homo sapiens
ctccctcagaccca

SEQ ID NO: 4473203 - DNA, 15 bp, Homo sapiens
ctccctcagacccag

SEQ ID NO: 4473204 - DNA, 22 bp, Homo sapiens
ctccctcagacccagcggtcca

SEQ ID NO: 4473205 - DNA, 17 bp, Homo sapiens
ctccctcagacccagga

SEQ ID NO: 4473206 - DNA, 19 bp, Homo sapiens
ctccctcagacccaggagt

SEQ ID NO: 4473207 - DNA, 20 bp, Homo sapiens
ctccctcagacccaggggtc

SEQ ID NO: 4473208 - DNA, 19 bp, Homo sapiens
ctccctcaggcccaggagt

SEQ ID NO: 4473209 - DNA, 14 bp, Homo sapiens
ctccctcatggctc

SEQ ID NO: 4473210 - DNA, 16 bp, Homo sapiens
ctccctccaccccagg

SEQ ID NO: 4473211 - DNA, 17 bp, Homo sapiens
ctccctccaccccagga

SEQ ID NO: 4473212 - DNA, 18 bp, Homo sapiens
ctccctccaccccaggac

SEQ ID NO: 4473213 - DNA, 16 bp, Homo sapiens
ctccctccagggtcct

SEQ ID NO: 4473214 - DNA, 18 bp, Homo sapiens
ctccctcccctgccctgg

SEQ ID NO: 4473215 - DNA, 18 bp, Homo sapiens
ctccctcctcacctctgg

SEQ ID NO: 4473216 - DNA, 14 bp, Homo sapiens
ctccctcctccagg

SEQ ID NO: 4473217 - DNA, 21 bp, Homo sapiens
ctccctctccaagacagcagc

SEQ ID NO: 4473218 - DNA, 23 bp, Homo sapiens
ctccctctccaagacagcagcag

SEQ ID NO: 4473219 - DNA, 13 bp, Homo sapiens
ctccctctcctgc

SEQ ID NO: 4473220 - DNA, 14 bp, Homo sapiens
ctccctctcctgcc

SEQ ID NO: 4473221 - DNA, 15 bp, Homo sapiens
ctccctctcctgcct

SEQ ID NO: 4473222 - DNA, 21 bp, Homo sapiens
ctccctctctcttctgctcca

SEQ ID NO: 4473223 - DNA, 22 bp, Homo sapiens
ctccctctctcttctgctccac

SEQ ID NO: 4473224 - DNA, 17 bp, Homo sapiens
ctccctctggccctgcc

SEQ ID NO: 4473225 - DNA, 18 bp, Homo sapiens
ctccctctggccctgcct

SEQ ID NO: 4473226 - DNA, 21 bp, Homo sapiens
ctccctgaaaatgtttttctg

SEQ ID NO: 4473227 - DNA, 16 bp, Homo sapiens
ctccctgaccctgctc

SEQ ID NO: 4473228 - DNA, 18 bp, Homo sapiens
ctccctgaccctgctcct

SEQ ID NO: 4473229 - DNA, 19 bp, Homo sapiens
ctccctgaccctgctccta

SEQ ID NO: 4473230 - DNA, 18 bp, Homo sapiens
ctccctgactccctgtgg

SEQ ID NO: 4473231 - DNA, 20 bp, Homo sapiens
ctccctgatgggggacagga

SEQ ID NO: 4473232 - DNA, 19 bp, Homo sapiens
ctccctgccaagtctcaga

SEQ ID NO: 4473233 - DNA, 21 bp, Homo sapiens
ctccctgccaagtctcagaag

SEQ ID NO: 4473234 - DNA, 22 bp, Homo sapiens
ctccctgccaagtctcagaaga

SEQ ID NO: 4473235 - DNA, 16 bp, Homo sapiens
ctccctgccgcctcaa

SEQ ID NO: 4473236 - DNA, 22 bp, Homo sapiens
ctccctgcctcactcctccgtg

SEQ ID NO: 4473237 - DNA, 16 bp, Homo sapiens
ctccctgcctcctgcc

SEQ ID NO: 4473238 - DNA, 14 bp, Homo sapiens
ctccctgcctgagg

SEQ ID NO: 4473239 - DNA, 13 bp, Homo sapiens
ctccctgcctgct

SEQ ID NO: 4473240 - DNA, 16 bp, Homo sapiens
ctccctgcctgctcct

SEQ ID NO: 4473241 - DNA, 13 bp, Homo sapiens
ctccctgcctggc

SEQ ID NO: 4473242 - DNA, 14 bp, Homo sapiens
ctccctgcctgtgg

SEQ ID NO: 4473243 - DNA, 19 bp, Homo sapiens
ctccctgctagcacagagg

SEQ ID NO: 4473244 - DNA, 13 bp, Homo sapiens
ctccctgctcagt

SEQ ID NO: 4473245 - DNA, 14 bp, Homo sapiens
ctccctgctcagtg

SEQ ID NO: 4473246 - DNA, 15 bp, Homo sapiens
ctccctgctcagtgc

SEQ ID NO: 4473247 - DNA, 16 bp, Homo sapiens
ctccctgctcagtgct

SEQ ID NO: 4473248 - DNA, 19 bp, Homo sapiens
ctccctgctcagtgcttgg

SEQ ID NO: 4473249 - DNA, 14 bp, Homo sapiens
ctccctgctgctcc

SEQ ID NO: 4473250 - DNA, 17 bp, Homo sapiens
ctccctgctgctcctag

SEQ ID NO: 4473251 - DNA, 11 bp, Homo sapiens
ctccctggagt

SEQ ID NO: 4473252 - DNA, 16 bp, Homo sapiens
ctccctggatcacata

SEQ ID NO: 4473253 - DNA, 14 bp, Homo sapiens
ctccctggctccca

SEQ ID NO: 4473254 - DNA, 15 bp, Homo sapiens
ctccctggctccctc

SEQ ID NO: 4473255 - DNA, 19 bp, Homo sapiens
ctccctggcttctgtgggg

SEQ ID NO: 4473256 - DNA, 16 bp, Homo sapiens
ctccctgggacacaga

SEQ ID NO: 4473257 - DNA, 17 bp, Homo sapiens
ctccctgtataagacac

SEQ ID NO: 4473258 - DNA, 16 bp, Homo sapiens
ctccctgtcctcctcg

SEQ ID NO: 4473259 - DNA, 18 bp, Homo sapiens
ctccctgtcctcctcgga

SEQ ID NO: 4473260 - DNA, 22 bp, Homo sapiens
ctccctgtctccagggccccca

SEQ ID NO: 4473261 - DNA, 22 bp, Homo sapiens
ctccctgtgttctgggctgggg

SEQ ID NO: 4473262 - DNA, 17 bp, Homo sapiens
ctcccttcctctctcct

SEQ ID NO: 4473263 - DNA, 12 bp, Homo sapiens
ctcccttccttt

SEQ ID NO: 4473264 - DNA, 21 bp, Homo sapiens
ctcccttctacctgccactca

SEQ ID NO: 4473265 - DNA, 23 bp, Homo sapiens
ctcccttgactttgctcctcaca

SEQ ID NO: 4473266 - DNA, 18 bp, Homo sapiens
ctcccttggcccagagac

SEQ ID NO: 4473267 - DNA, 21 bp, Homo sapiens
ctcccttggttgttccttttt

SEQ ID NO: 4473268 - DNA, 15 bp, Homo sapiens
ctccctttcactaaa

SEQ ID NO: 4473269 - DNA, 17 bp, Homo sapiens
ctccctttctcaggagc

SEQ ID NO: 4473270 - DNA, 14 bp, Homo sapiens
ctccctttctcccc

SEQ ID NO: 4473271 - DNA, 15 bp, Homo sapiens
ctccctttctcccct

SEQ ID NO: 4473272 - DNA, 23 bp, Homo sapiens
ctccctttctcccctgcccccag

SEQ ID NO: 4473273 - DNA, 16 bp, Homo sapiens
ctccctttctctctcc

SEQ ID NO: 4473274 - DNA, 20 bp, Homo sapiens
ctccctttctctctcctctc

SEQ ID NO: 4473275 - DNA, 18 bp, Homo sapiens
ctccgactctgcacccgc

SEQ ID NO: 4473276 - DNA, 14 bp, Homo sapiens
ctccgagagggaga

SEQ ID NO: 4473277 - DNA, 16 bp, Homo sapiens
ctccgagagggagaga

SEQ ID NO: 4473278 - DNA, 17 bp, Homo sapiens
ctccgaggacccaggaa

SEQ ID NO: 4473279 - DNA, 17 bp, Homo sapiens
ctccgaggctccccgcc

SEQ ID NO: 4473280 - DNA, 18 bp, Homo sapiens
ctccgaggctccccgcct

SEQ ID NO: 4473281 - DNA, 21 bp, Homo sapiens
ctccgaggctccccgcctcca

SEQ ID NO: 4473282 - DNA, 18 bp, Homo sapiens
ctccgagtgaactggtct

SEQ ID NO: 4473283 - DNA, 20 bp, Homo sapiens
ctccgcatcacctcaccaag

SEQ ID NO: 4473284 - DNA, 20 bp, Homo sapiens
ctccgccagcctcctctgga

SEQ ID NO: 4473285 - DNA, 15 bp, Homo sapiens
ctccgcccagcctct

SEQ ID NO: 4473286 - DNA, 17 bp, Homo sapiens
ctccgcccagcctctcc

SEQ ID NO: 4473287 - DNA, 18 bp, Homo sapiens
ctccggaggactgagccc

SEQ ID NO: 4473288 - DNA, 17 bp, Homo sapiens
ctccggcgtcagcctcc

SEQ ID NO: 4473289 - DNA, 20 bp, Homo sapiens
ctccggcgtcagcctccagc

SEQ ID NO: 4473290 - DNA, 21 bp, Homo sapiens
ctccggcgtcagcctccagcc

SEQ ID NO: 4473291 - DNA, 22 bp, Homo sapiens
ctccggcgtcagcctccagcct

SEQ ID NO: 4473292 - DNA, 13 bp, Homo sapiens
ctccggctgtgct

SEQ ID NO: 4473293 - DNA, 13 bp, Homo sapiens
ctccgggcgtgtg

SEQ ID NO: 4473294 - DNA, 15 bp, Homo sapiens
ctccgggtgtggcct

SEQ ID NO: 4473295 - DNA, 17 bp, Homo sapiens
ctccgtaacagtgtaaa

SEQ ID NO: 4473296 - DNA, 13 bp, Homo sapiens
ctccgtcaagctg

SEQ ID NO: 4473297 - DNA, 17 bp, Homo sapiens
ctccgtcaagctggttg

SEQ ID NO: 4473298 - DNA, 20 bp, Homo sapiens
ctccgtcagcttctcccaag

SEQ ID NO: 4473299 - DNA, 22 bp, Homo sapiens
ctccgtccatccgactgcccct

SEQ ID NO: 4473300 - DNA, 20 bp, Homo sapiens
ctccgtgagcaccaccaggg

SEQ ID NO: 4473301 - DNA, 13 bp, Homo sapiens
ctcctaaaactgg

SEQ ID NO: 4473302 - DNA, 16 bp, Homo sapiens
ctcctaccctcccacc

SEQ ID NO: 4473303 - DNA, 22 bp, Homo sapiens
ctcctaccctcccaccagaacg

SEQ ID NO: 4473304 - DNA, 15 bp, Homo sapiens
ctcctagaagaacca

SEQ ID NO: 4473305 - DNA, 23 bp, Homo sapiens
ctcctagaagtcttaattgtgtt

SEQ ID NO: 4473306 - DNA, 18 bp, Homo sapiens
ctcctagagaacgcagcc

SEQ ID NO: 4473307 - DNA, 16 bp, Homo sapiens
ctcctagctctcccag

SEQ ID NO: 4473308 - DNA, 21 bp, Homo sapiens
ctcctaggacccgtctccagc

SEQ ID NO: 4473309 - DNA, 18 bp, Homo sapiens
ctcctatctgtgttttga

SEQ ID NO: 4473310 - DNA, 13 bp, Homo sapiens
ctcctatttcaat

SEQ ID NO: 4473311 - DNA, 16 bp, Homo sapiens
ctcctcaaagcctcaa

SEQ ID NO: 4473312 - DNA, 15 bp, Homo sapiens
ctcctcaccccgtct

SEQ ID NO: 4473313 - DNA, 19 bp, Homo sapiens
ctcctcacctcatgcccac

SEQ ID NO: 4473314 - DNA, 14 bp, Homo sapiens
ctcctcacctctgg

SEQ ID NO: 4473315 - DNA, 16 bp, Homo sapiens
ctcctcacctctggac

SEQ ID NO: 4473316 - DNA, 22 bp, Homo sapiens
ctcctcacctctggactggcta

SEQ ID NO: 4473317 - DNA, 13 bp, Homo sapiens
ctcctcactctgt

SEQ ID NO: 4473318 - DNA, 17 bp, Homo sapiens
ctcctcactctgtccct

SEQ ID NO: 4473319 - DNA, 23 bp, Homo sapiens
ctcctcactctgtccctgtcctt

SEQ ID NO: 4473320 - DNA, 16 bp, Homo sapiens
ctcctcactgtatcca

SEQ ID NO: 4473321 - DNA, 21 bp, Homo sapiens
ctcctcagagcgccaggaagc

SEQ ID NO: 4473322 - DNA, 11 bp, Homo sapiens
ctcctcagcca

SEQ ID NO: 4473323 - DNA, 15 bp, Homo sapiens
ctcctcagccagcct

SEQ ID NO: 4473324 - DNA, 18 bp, Homo sapiens
ctcctcaggcacacagct

SEQ ID NO: 4473325 - DNA, 23 bp, Homo sapiens
ctcctcaggcacacagctactct

SEQ ID NO: 4473326 - DNA, 20 bp, Homo sapiens
ctcctcaggcccagctgctc

SEQ ID NO: 4473327 - DNA, 13 bp, Homo sapiens
ctcctcagggtgg

SEQ ID NO: 4473328 - DNA, 21 bp, Homo sapiens
ctcctcagtggcttctccagg

SEQ ID NO: 4473329 - DNA, 15 bp, Homo sapiens
ctcctccaaaggaag

SEQ ID NO: 4473330 - DNA, 23 bp, Homo sapiens
ctcctccaaaggaagtctaggag

SEQ ID NO: 4473331 - DNA, 11 bp, Homo sapiens
ctcctccaggg

SEQ ID NO: 4473332 - DNA, 23 bp, Homo sapiens
ctcctccagtacgtcccgctgct

SEQ ID NO: 4473333 - DNA, 13 bp, Homo sapiens
ctcctcccctcct

SEQ ID NO: 4473334 - DNA, 13 bp, Homo sapiens
ctcctccccttcc

SEQ ID NO: 4473335 - DNA, 16 bp, Homo sapiens
ctcctccccttcctgt

SEQ ID NO: 4473336 - DNA, 20 bp, Homo sapiens
ctcctccccttcctgtttct

SEQ ID NO: 4473337 - DNA, 10 bp, Homo sapiens
ctcctccctc

SEQ ID NO: 4473338 - DNA, 15 bp, Homo sapiens
ctcctccctcagacc

SEQ ID NO: 4473339 - DNA, 18 bp, Homo sapiens
ctcctccctcagacccag

SEQ ID NO: 4473340 - DNA, 17 bp, Homo sapiens
ctcctccctcagactca

SEQ ID NO: 4473341 - DNA, 14 bp, Homo sapiens
ctcctccctcaggc

SEQ ID NO: 4473342 - DNA, 15 bp, Homo sapiens
ctcctccctcaggcc

SEQ ID NO: 4473343 - DNA, 17 bp, Homo sapiens
ctcctccctccagctgc

SEQ ID NO: 4473344 - DNA, 21 bp, Homo sapiens
ctcctcccttccttttccctg

SEQ ID NO: 4473345 - DNA, 22 bp, Homo sapiens
ctcctcccttccttttccctgc

SEQ ID NO: 4473346 - DNA, 13 bp, Homo sapiens
ctcctcctcaccc

SEQ ID NO: 4473347 - DNA, 16 bp, Homo sapiens
ctcctcctcccctcct

SEQ ID NO: 4473348 - DNA, 20 bp, Homo sapiens
ctcctcctgggctccagagg

SEQ ID NO: 4473349 - DNA, 13 bp, Homo sapiens
ctcctccttgccc

SEQ ID NO: 4473350 - DNA, 24 bp, Homo sapiens
ctcctcgagatcccaacactgcca

SEQ ID NO: 4473351 - DNA, 17 bp, Homo sapiens
ctcctcggactgtgtgc

SEQ ID NO: 4473352 - DNA, 19 bp, Homo sapiens
ctcctcggagagcagcagc

SEQ ID NO: 4473353 - DNA, 15 bp, Homo sapiens
ctcctctcagagtga

SEQ ID NO: 4473354 - DNA, 22 bp, Homo sapiens
ctcctctcagagtgacagtcat

SEQ ID NO: 4473355 - DNA, 15 bp, Homo sapiens
ctcctctcctggagg

SEQ ID NO: 4473356 - DNA, 16 bp, Homo sapiens
ctcctctgaaacagct

SEQ ID NO: 4473357 - DNA, 17 bp, Homo sapiens
ctcctctgaaacagctg

SEQ ID NO: 4473358 - DNA, 18 bp, Homo sapiens
ctcctctgaaacagctgc

SEQ ID NO: 4473359 - DNA, 23 bp, Homo sapiens
ctcctctgaaacagctgccttag

SEQ ID NO: 4473360 - DNA, 20 bp, Homo sapiens
ctcctctgactcagggctcc

SEQ ID NO: 4473361 - DNA, 13 bp, Homo sapiens
ctcctctgcactc

SEQ ID NO: 4473362 - DNA, 16 bp, Homo sapiens
ctcctctgcagtgcct

SEQ ID NO: 4473363 - DNA, 11 bp, Homo sapiens
ctcctctgcca

SEQ ID NO: 4473364 - DNA, 12 bp, Homo sapiens
ctcctctgccac

SEQ ID NO: 4473365 - DNA, 14 bp, Homo sapiens
ctcctctgccacct

SEQ ID NO: 4473366 - DNA, 15 bp, Homo sapiens
ctcctctgccacctc

SEQ ID NO: 4473367 - DNA, 17 bp, Homo sapiens
ctcctctgccacctccc

SEQ ID NO: 4473368 - DNA, 24 bp, Homo sapiens
ctcctctgcccgggagctcaggaa

SEQ ID NO: 4473369 - DNA, 14 bp, Homo sapiens
ctcctctggctttc

SEQ ID NO: 4473370 - DNA, 23 bp, Homo sapiens
ctcctctgtgaccaatgtcttga

SEQ ID NO: 4473371 - DNA, 23 bp, Homo sapiens
ctcctcttcccttagcctctccc

SEQ ID NO: 4473372 - DNA, 14 bp, Homo sapiens
ctcctcttcctgcc

SEQ ID NO: 4473373 - DNA, 12 bp, Homo sapiens
ctcctcttggaa

SEQ ID NO: 4473374 - DNA, 13 bp, Homo sapiens
ctcctcttggaat

SEQ ID NO: 4473375 - DNA, 12 bp, Homo sapiens
ctcctctttaaa

SEQ ID NO: 4473376 - DNA, 17 bp, Homo sapiens
ctcctgaaacctcttcc

SEQ ID NO: 4473377 - DNA, 22 bp, Homo sapiens
ctcctgaaacctcttcctaggc

SEQ ID NO: 4473378 - DNA, 15 bp, Homo sapiens
ctcctgacccccatg

SEQ ID NO: 4473379 - DNA, 19 bp, Homo sapiens
ctcctgacccccatgtaaa

SEQ ID NO: 4473380 - DNA, 20 bp, Homo sapiens
ctcctgagaaaaaaggttcc

SEQ ID NO: 4473381 - DNA, 15 bp, Homo sapiens
ctcctgagacccctg

SEQ ID NO: 4473382 - DNA, 17 bp, Homo sapiens
ctcctgaggctttggat

SEQ ID NO: 4473383 - DNA, 20 bp, Homo sapiens
ctcctgaggggcatctgccc

SEQ ID NO: 4473384 - DNA, 20 bp, Homo sapiens
ctcctgcaaatttagtttgt

SEQ ID NO: 4473385 - DNA, 21 bp, Homo sapiens
ctcctgcaaatttagtttgtt

SEQ ID NO: 4473386 - DNA, 16 bp, Homo sapiens
ctcctgcagacacctg

SEQ ID NO: 4473387 - DNA, 20 bp, Homo sapiens
ctcctgcagacacctggact

SEQ ID NO: 4473388 - DNA, 21 bp, Homo sapiens
ctcctgcagacacctggactg

SEQ ID NO: 4473389 - DNA, 22 bp, Homo sapiens
ctcctgccacatggagccccct

SEQ ID NO: 4473390 - DNA, 22 bp, Homo sapiens
ctcctgccaggcacacacagcc

SEQ ID NO: 4473391 - DNA, 14 bp, Homo sapiens
ctcctgccattctt

SEQ ID NO: 4473392 - DNA, 11 bp, Homo sapiens
ctcctgcccag

SEQ ID NO: 4473393 - DNA, 17 bp, Homo sapiens
ctcctgcccaggagagc

SEQ ID NO: 4473394 - DNA, 20 bp, Homo sapiens
ctcctgcccaggagagccag

SEQ ID NO: 4473395 - DNA, 14 bp, Homo sapiens
ctcctgcccaggcc

SEQ ID NO: 4473396 - DNA, 18 bp, Homo sapiens
ctcctgcccaggccacag

SEQ ID NO: 4473397 - DNA, 23 bp, Homo sapiens
ctcctgcccaggccacagagaac

SEQ ID NO: 4473398 - DNA, 18 bp, Homo sapiens
ctcctgccccctgccagt

SEQ ID NO: 4473399 - DNA, 17 bp, Homo sapiens
ctcctgccctttcccag

SEQ ID NO: 4473400 - DNA, 19 bp, Homo sapiens
ctcctgcctatgtctcctc

SEQ ID NO: 4473401 - DNA, 11 bp, Homo sapiens
ctcctgcctca

SEQ ID NO: 4473402 - DNA, 15 bp, Homo sapiens
ctcctgcctcagcct

SEQ ID NO: 4473403 - DNA, 20 bp, Homo sapiens
ctcctgcctcagcctcccat

SEQ ID NO: 4473404 - DNA, 20 bp, Homo sapiens
ctcctgcctgccctgcctca

SEQ ID NO: 4473405 - DNA, 22 bp, Homo sapiens
ctcctgcctgccctgcctcagc

SEQ ID NO: 4473406 - DNA, 16 bp, Homo sapiens
ctcctgccttcctcct

SEQ ID NO: 4473407 - DNA, 19 bp, Homo sapiens
ctcctgccttcctcctggg

SEQ ID NO: 4473408 - DNA, 20 bp, Homo sapiens
ctcctgccttcctcctgggc

SEQ ID NO: 4473409 - DNA, 18 bp, Homo sapiens
ctcctgcgccctgtgccc

SEQ ID NO: 4473410 - DNA, 18 bp, Homo sapiens
ctcctgctgcctaataaa

SEQ ID NO: 4473411 - DNA, 15 bp, Homo sapiens
ctcctggaagctgtg

SEQ ID NO: 4473412 - DNA, 17 bp, Homo sapiens
ctcctggactccggagg

SEQ ID NO: 4473413 - DNA, 20 bp, Homo sapiens
ctcctggactccggaggact

SEQ ID NO: 4473414 - DNA, 22 bp, Homo sapiens
ctcctggactccggaggactga

SEQ ID NO: 4473415 - DNA, 18 bp, Homo sapiens
ctcctggcctatccgctg

SEQ ID NO: 4473416 - DNA, 22 bp, Homo sapiens
ctcctggcctatccgctgccag

SEQ ID NO: 4473417 - DNA, 23 bp, Homo sapiens
ctcctggcctatccgctgccagc

SEQ ID NO: 4473418 - DNA, 12 bp, Homo sapiens
ctcctggccttt

SEQ ID NO: 4473419 - DNA, 13 bp, Homo sapiens
ctcctggcctttt

SEQ ID NO: 4473420 - DNA, 13 bp, Homo sapiens
ctcctgggaccct

SEQ ID NO: 4473421 - DNA, 17 bp, Homo sapiens
ctcctgggacccttggc

SEQ ID NO: 4473422 - DNA, 11 bp, Homo sapiens
ctcctgggagg

SEQ ID NO: 4473423 - DNA, 17 bp, Homo sapiens
ctcctgggagggagact

SEQ ID NO: 4473424 - DNA, 13 bp, Homo sapiens
ctcctgggcccct

SEQ ID NO: 4473425 - DNA, 20 bp, Homo sapiens
ctcctgggcccctccctacc

SEQ ID NO: 4473426 - DNA, 23 bp, Homo sapiens
ctcctgggcccctccctacctca

SEQ ID NO: 4473427 - DNA, 14 bp, Homo sapiens
ctcctgggccctct

SEQ ID NO: 4473428 - DNA, 16 bp, Homo sapiens
ctcctgggccctgggc

SEQ ID NO: 4473429 - DNA, 19 bp, Homo sapiens
ctcctgggccctgggctgg

SEQ ID NO: 4473430 - DNA, 23 bp, Homo sapiens
ctcctgggccctgggctggcaca

SEQ ID NO: 4473431 - DNA, 19 bp, Homo sapiens
ctcctgggctcaagcaatc

SEQ ID NO: 4473432 - DNA, 14 bp, Homo sapiens
ctcctgggctccag

SEQ ID NO: 4473433 - DNA, 16 bp, Homo sapiens
ctcctgggctccagag

SEQ ID NO: 4473434 - DNA, 13 bp, Homo sapiens
ctcctggggagct

SEQ ID NO: 4473435 - DNA, 14 bp, Homo sapiens
ctcctggggagctc

SEQ ID NO: 4473436 - DNA, 17 bp, Homo sapiens
ctcctggggagctcctg

SEQ ID NO: 4473437 - DNA, 20 bp, Homo sapiens
ctcctggggagctcctggga

SEQ ID NO: 4473438 - DNA, 22 bp, Homo sapiens
ctcctggggagctcctgggacc

SEQ ID NO: 4473439 - DNA, 18 bp, Homo sapiens
ctcctgggggtggcaggc

SEQ ID NO: 4473440 - DNA, 24 bp, Homo sapiens
ctcctgggggtggcaggcacacag

SEQ ID NO: 4473441 - DNA, 22 bp, Homo sapiens
ctcctgggttttgtattctctg

SEQ ID NO: 4473442 - DNA, 21 bp, Homo sapiens
ctcctggtagaggggccggct

SEQ ID NO: 4473443 - DNA, 14 bp, Homo sapiens
ctcctggtctgtga

SEQ ID NO: 4473444 - DNA, 11 bp, Homo sapiens
ctcctggtgct

SEQ ID NO: 4473445 - DNA, 17 bp, Homo sapiens
ctcctggtgggtccagg

SEQ ID NO: 4473446 - DNA, 21 bp, Homo sapiens
ctcctgtacctcagtggatct

SEQ ID NO: 4473447 - DNA, 15 bp, Homo sapiens
ctcctgtcccttttc

SEQ ID NO: 4473448 - DNA, 16 bp, Homo sapiens
ctcctgtctccctcct

SEQ ID NO: 4473449 - DNA, 15 bp, Homo sapiens
ctcctgtcttcccag

SEQ ID NO: 4473450 - DNA, 18 bp, Homo sapiens
ctcctgtcttcccagggt

SEQ ID NO: 4473451 - DNA, 21 bp, Homo sapiens
ctcctgtcttcccagggtagc

SEQ ID NO: 4473452 - DNA, 19 bp, Homo sapiens
ctcctgtgcctggccccag

SEQ ID NO: 4473453 - DNA, 22 bp, Homo sapiens
ctcctgtgcctggccccagcct

SEQ ID NO: 4473454 - DNA, 16 bp, Homo sapiens
ctcctgtgctcaccct

SEQ ID NO: 4473455 - DNA, 17 bp, Homo sapiens
ctcctgtgctcaccctc

SEQ ID NO: 4473456 - DNA, 22 bp, Homo sapiens
ctcctgtggaaggcagagaaat

SEQ ID NO: 4473457 - DNA, 15 bp, Homo sapiens
ctcctgtgtactgtg

SEQ ID NO: 4473458 - DNA, 16 bp, Homo sapiens
ctcctgtgtactgtgt

SEQ ID NO: 4473459 - DNA, 17 bp, Homo sapiens
ctcctgtgtggaagaag

SEQ ID NO: 4473460 - DNA, 20 bp, Homo sapiens
ctcctgttttatatattatg

SEQ ID NO: 4473461 - DNA, 18 bp, Homo sapiens
ctccttaatttaattgct

SEQ ID NO: 4473462 - DNA, 21 bp, Homo sapiens
ctccttaatttaattgctttg

SEQ ID NO: 4473463 - DNA, 14 bp, Homo sapiens
ctccttccccagac

SEQ ID NO: 4473464 - DNA, 17 bp, Homo sapiens
ctccttccccagaccca

SEQ ID NO: 4473465 - DNA, 19 bp, Homo sapiens
ctccttccccagacccaga

SEQ ID NO: 4473466 - DNA, 14 bp, Homo sapiens
ctccttcctggaga

SEQ ID NO: 4473467 - DNA, 15 bp, Homo sapiens
ctccttccttcagga

SEQ ID NO: 4473468 - DNA, 17 bp, Homo sapiens
ctccttgagaggagaaa

SEQ ID NO: 4473469 - DNA, 23 bp, Homo sapiens
ctccttgagaggagaaatgcaat

SEQ ID NO: 4473470 - DNA, 16 bp, Homo sapiens
ctccttggaaggtctt

SEQ ID NO: 4473471 - DNA, 13 bp, Homo sapiens
ctccttgggccct

SEQ ID NO: 4473472 - DNA, 15 bp, Homo sapiens
ctccttggtgcctct

SEQ ID NO: 4473473 - DNA, 13 bp, Homo sapiens
ctcctttaattgt

SEQ ID NO: 4473474 - DNA, 16 bp, Homo sapiens
ctcctttcagccacat

SEQ ID NO: 4473475 - DNA, 17 bp, Homo sapiens
ctcctttctcctgtgaa

SEQ ID NO: 4473476 - DNA, 18 bp, Homo sapiens
ctcctttctcctgtgaat

SEQ ID NO: 4473477 - DNA, 15 bp, Homo sapiens
ctcctttctgcagac

SEQ ID NO: 4473478 - DNA, 21 bp, Homo sapiens
ctcctttctttttcttcttcc

SEQ ID NO: 4473479 - DNA, 16 bp, Homo sapiens
ctcctttgcaatagca

SEQ ID NO: 4473480 - DNA, 18 bp, Homo sapiens
ctccttttatctggtgcc

SEQ ID NO: 4473481 - DNA, 20 bp, Homo sapiens
ctccttttatctggtgcctc

SEQ ID NO: 4473482 - DNA, 22 bp, Homo sapiens
ctccttttatctggtgcctcct

SEQ ID NO: 4473483 - DNA, 12 bp, Homo sapiens
ctccttttatgt

SEQ ID NO: 4473484 - DNA, 15 bp, Homo sapiens
ctccttttatgtgta

SEQ ID NO: 4473485 - DNA, 14 bp, Homo sapiens
ctcgaaacacagaa

SEQ ID NO: 4473486 - DNA, 20 bp, Homo sapiens
ctcgaaacacagaaaccttt

SEQ ID NO: 4473487 - DNA, 22 bp, Homo sapiens
ctcgacaaaggccacaggcagt

SEQ ID NO: 4473488 - DNA, 19 bp, Homo sapiens
ctcgacagggcctggagcc

SEQ ID NO: 4473489 - DNA, 21 bp, Homo sapiens
ctcgacccagaatggagcctg

SEQ ID NO: 4473490 - DNA, 15 bp, Homo sapiens
ctcgacctccccacc

SEQ ID NO: 4473491 - DNA, 22 bp, Homo sapiens
ctcgactctgctgctcatggga

SEQ ID NO: 4473492 - DNA, 13 bp, Homo sapiens
ctcgagatcccaa

SEQ ID NO: 4473493 - DNA, 20 bp, Homo sapiens
ctcgagatgggtgctggtcc

SEQ ID NO: 4473494 - DNA, 14 bp, Homo sapiens
ctcgagtactgtgg

SEQ ID NO: 4473495 - DNA, 16 bp, Homo sapiens
ctcgagtactgtgggc

SEQ ID NO: 4473496 - DNA, 18 bp, Homo sapiens
ctcgagtactgtgggcaa

SEQ ID NO: 4473497 - DNA, 14 bp, Homo sapiens
ctcgagtttctggt

SEQ ID NO: 4473498 - DNA, 18 bp, Homo sapiens
ctcgatttaaactccagc

SEQ ID NO: 4473499 - DNA, 19 bp, Homo sapiens
ctcgatttaaactccagca

SEQ ID NO: 4473500 - DNA, 19 bp, Homo sapiens
ctcgcagggaatgcagcag

SEQ ID NO: 4473501 - DNA, 14 bp, Homo sapiens
ctcgcccagacacc

SEQ ID NO: 4473502 - DNA, 16 bp, Homo sapiens
ctcgcccagacaccat

SEQ ID NO: 4473503 - DNA, 17 bp, Homo sapiens
ctcgcccagcaggagag

SEQ ID NO: 4473504 - DNA, 23 bp, Homo sapiens
ctcgccccttccctctctccctg

SEQ ID NO: 4473505 - DNA, 13 bp, Homo sapiens
ctcgccctgggtc

SEQ ID NO: 4473506 - DNA, 17 bp, Homo sapiens
ctcgccggatctgaggg

SEQ ID NO: 4473507 - DNA, 21 bp, Homo sapiens
ctcgccgtgtctcagcctctg

SEQ ID NO: 4473508 - DNA, 17 bp, Homo sapiens
ctcgctctgtcgcccag

SEQ ID NO: 4473509 - DNA, 20 bp, Homo sapiens
ctcgctctgtcgcccaggct

SEQ ID NO: 4473510 - DNA, 12 bp, Homo sapiens
ctcgctgccagc

SEQ ID NO: 4473511 - DNA, 16 bp, Homo sapiens
ctcgctgccagctctg

SEQ ID NO: 4473512 - DNA, 20 bp, Homo sapiens
ctcgctgccctgtggacagg

SEQ ID NO: 4473513 - DNA, 22 bp, Homo sapiens
ctcgctgtgattttaagacaag

SEQ ID NO: 4473514 - DNA, 13 bp, Homo sapiens
ctcgcttgctgga

SEQ ID NO: 4473515 - DNA, 16 bp, Homo sapiens
ctcggaattcataata

SEQ ID NO: 4473516 - DNA, 15 bp, Homo sapiens
ctcggacagagcccc

SEQ ID NO: 4473517 - DNA, 22 bp, Homo sapiens
ctcggacagagcccccctagca

SEQ ID NO: 4473518 - DNA, 19 bp, Homo sapiens
ctcggaccccactccggcc

SEQ ID NO: 4473519 - DNA, 18 bp, Homo sapiens
ctcggactaagcctacct

SEQ ID NO: 4473520 - DNA, 20 bp, Homo sapiens
ctcggagaagagctgttcac

SEQ ID NO: 4473521 - DNA, 22 bp, Homo sapiens
ctcggagacgggaccctgccca

SEQ ID NO: 4473522 - DNA, 18 bp, Homo sapiens
ctcggagactatggcctc

SEQ ID NO: 4473523 - DNA, 19 bp, Homo sapiens
ctcggagactatggcctcg

SEQ ID NO: 4473524 - DNA, 16 bp, Homo sapiens
ctcggagagcagcagc

SEQ ID NO: 4473525 - DNA, 17 bp, Homo sapiens
ctcggagagcagcagca

SEQ ID NO: 4473526 - DNA, 15 bp, Homo sapiens
ctcggaggctgcccc

SEQ ID NO: 4473527 - DNA, 19 bp, Homo sapiens
ctcggatgacaccctggcc

SEQ ID NO: 4473528 - DNA, 21 bp, Homo sapiens
ctcggatgacaccctggcctg

SEQ ID NO: 4473529 - DNA, 22 bp, Homo sapiens
ctcggatggaccaacctgctct

SEQ ID NO: 4473530 - DNA, 19 bp, Homo sapiens
ctcggcatagtccccagag

SEQ ID NO: 4473531 - DNA, 18 bp, Homo sapiens
ctcggcctccgaggctcc

SEQ ID NO: 4473532 - DNA, 12 bp, Homo sapiens
ctcgggcccagc

SEQ ID NO: 4473533 - DNA, 14 bp, Homo sapiens
ctcgggcccagccc

SEQ ID NO: 4473534 - DNA, 15 bp, Homo sapiens
ctcgggcccagcccc

SEQ ID NO: 4473535 - DNA, 14 bp, Homo sapiens
ctcgggtgcatttg

SEQ ID NO: 4473536 - DNA, 21 bp, Homo sapiens
ctcgggtggctagtcagagag

SEQ ID NO: 4473537 - DNA, 20 bp, Homo sapiens
ctcggtctccaccccagggt

SEQ ID NO: 4473538 - DNA, 15 bp, Homo sapiens
ctcggtttgccaaaa

SEQ ID NO: 4473539 - DNA, 16 bp, Homo sapiens
ctcggtttgccaaaat

SEQ ID NO: 4473540 - DNA, 22 bp, Homo sapiens
ctcggtttgccaaaattcattt

SEQ ID NO: 4473541 - DNA, 18 bp, Homo sapiens
ctcgtcaagagcatgcac

SEQ ID NO: 4473542 - DNA, 22 bp, Homo sapiens
ctcgtcagctgggatgtgaagt

SEQ ID NO: 4473543 - DNA, 20 bp, Homo sapiens
ctcgtcctccccctgccagt

SEQ ID NO: 4473544 - DNA, 20 bp, Homo sapiens
ctcgtgcattaaaatttctt

SEQ ID NO: 4473545 - DNA, 21 bp, Homo sapiens
ctcgtggactgtgctggtgca

SEQ ID NO: 4473546 - DNA, 15 bp, Homo sapiens
ctcgtggtaggactg

SEQ ID NO: 4473547 - DNA, 16 bp, Homo sapiens
ctcgtggtaggactgt

SEQ ID NO: 4473548 - DNA, 21 bp, Homo sapiens
ctcgtggtaggactgtagaaa

SEQ ID NO: 4473549 - DNA, 16 bp, Homo sapiens
ctcgtgtgtcctcatg

SEQ ID NO: 4473550 - DNA, 18 bp, Homo sapiens
ctcgtgtttgcttaaaat

SEQ ID NO: 4473551 - DNA, 19 bp, Homo sapiens
ctctaaaaagaagccacag

SEQ ID NO: 4473552 - DNA, 18 bp, Homo sapiens
ctctaaatagcacttttt

SEQ ID NO: 4473553 - DNA, 12 bp, Homo sapiens
ctctaacccagt

SEQ ID NO: 4473554 - DNA, 14 bp, Homo sapiens
ctctaacccagtgg

SEQ ID NO: 4473555 - DNA, 17 bp, Homo sapiens
ctctaacccagtggctg

SEQ ID NO: 4473556 - DNA, 15 bp, Homo sapiens
ctctaaccccaggcc

SEQ ID NO: 4473557 - DNA, 21 bp, Homo sapiens
ctctaaccccaggccccgagg

SEQ ID NO: 4473558 - DNA, 17 bp, Homo sapiens
ctctaactgtatatttg

SEQ ID NO: 4473559 - DNA, 16 bp, Homo sapiens
ctctaaggcaggatgt

SEQ ID NO: 4473560 - DNA, 15 bp, Homo sapiens
ctctaagtttagaag

SEQ ID NO: 4473561 - DNA, 12 bp, Homo sapiens
ctctaatattgg

SEQ ID NO: 4473562 - DNA, 16 bp, Homo sapiens
ctctaatcagattgct

SEQ ID NO: 4473563 - DNA, 22 bp, Homo sapiens
ctctaatggactgaccttaaaa

SEQ ID NO: 4473564 - DNA, 17 bp, Homo sapiens
ctctaatgttgtatcat

SEQ ID NO: 4473565 - DNA, 17 bp, Homo sapiens
ctctacagagcttccct

SEQ ID NO: 4473566 - DNA, 15 bp, Homo sapiens
ctctacagccgtccc

SEQ ID NO: 4473567 - DNA, 14 bp, Homo sapiens
ctctaccccaattt

SEQ ID NO: 4473568 - DNA, 14 bp, Homo sapiens
ctctaccctcccac

SEQ ID NO: 4473569 - DNA, 15 bp, Homo sapiens
ctctaccctcccacc

SEQ ID NO: 4473570 - DNA, 12 bp, Homo sapiens
ctctacctgaca

SEQ ID NO: 4473571 - DNA, 22 bp, Homo sapiens
ctctacctgacactcccttggg

SEQ ID NO: 4473572 - DNA, 19 bp, Homo sapiens
ctctactaaaaataccaaa

SEQ ID NO: 4473573 - DNA, 17 bp, Homo sapiens
ctctactaaaattcaaa

SEQ ID NO: 4473574 - DNA, 21 bp, Homo sapiens
ctctactaacaatcagctcct

SEQ ID NO: 4473575 - DNA, 17 bp, Homo sapiens
ctctactgaatgtcatt

SEQ ID NO: 4473576 - DNA, 13 bp, Homo sapiens
ctctactgtgtaa

SEQ ID NO: 4473577 - DNA, 22 bp, Homo sapiens
ctctagaagccaagggaaaggg

SEQ ID NO: 4473578 - DNA, 13 bp, Homo sapiens
ctctagaagctcc

SEQ ID NO: 4473579 - DNA, 22 bp, Homo sapiens
ctctagagccttcagccttaat

SEQ ID NO: 4473580 - DNA, 23 bp, Homo sapiens
ctctagaggcatcacctgggacc

SEQ ID NO: 4473581 - DNA, 17 bp, Homo sapiens
ctctagatggcaacatt

SEQ ID NO: 4473582 - DNA, 13 bp, Homo sapiens
ctctagcaaggct

SEQ ID NO: 4473583 - DNA, 16 bp, Homo sapiens
ctctagcaaggctcat

SEQ ID NO: 4473584 - DNA, 23 bp, Homo sapiens
ctctaggcttcaggttgcattgg

SEQ ID NO: 4473585 - DNA, 13 bp, Homo sapiens
ctctagggacccc

SEQ ID NO: 4473586 - DNA, 20 bp, Homo sapiens
ctctagggacccctcgcccc

SEQ ID NO: 4473587 - DNA, 21 bp, Homo sapiens
ctctagggactgccaggctgt

SEQ ID NO: 4473588 - DNA, 17 bp, Homo sapiens
ctctagtgcggtttact

SEQ ID NO: 4473589 - DNA, 19 bp, Homo sapiens
ctctataaagggtcaggcc

SEQ ID NO: 4473590 - DNA, 20 bp, Homo sapiens
ctctataaagggtcaggccc

SEQ ID NO: 4473591 - DNA, 22 bp, Homo sapiens
ctctatattgttcagcatgcaa

SEQ ID NO: 4473592 - DNA, 23 bp, Homo sapiens
ctctatgaaaagcacaaggggcc

SEQ ID NO: 4473593 - DNA, 14 bp, Homo sapiens
ctctatggaaggag

SEQ ID NO: 4473594 - DNA, 22 bp, Homo sapiens
ctctattgggcacagcctaggg

SEQ ID NO: 4473595 - DNA, 14 bp, Homo sapiens
ctctatttaaattc

SEQ ID NO: 4473596 - DNA, 16 bp, Homo sapiens
ctctatttaaattctt

SEQ ID NO: 4473597 - DNA, 17 bp, Homo sapiens
ctctatttaaattcttt

SEQ ID NO: 4473598 - DNA, 15 bp, Homo sapiens
ctctcaagctagcca

SEQ ID NO: 4473599 - DNA, 14 bp, Homo sapiens
ctctcaagtaatat

SEQ ID NO: 4473600 - DNA, 13 bp, Homo sapiens
ctctcacccccat

SEQ ID NO: 4473601 - DNA, 17 bp, Homo sapiens
ctctcagaattcttcag

SEQ ID NO: 4473602 - DNA, 22 bp, Homo sapiens
ctctcagaggcctgctgccagt

SEQ ID NO: 4473603 - DNA, 13 bp, Homo sapiens
ctctcagcccaga

SEQ ID NO: 4473604 - DNA, 15 bp, Homo sapiens
ctctcaggccgagag

SEQ ID NO: 4473605 - DNA, 18 bp, Homo sapiens
ctctcaggccgagagcct

SEQ ID NO: 4473606 - DNA, 23 bp, Homo sapiens
ctctcaggtggaggcaacagggc

SEQ ID NO: 4473607 - DNA, 13 bp, Homo sapiens
ctctcagtctctg

SEQ ID NO: 4473608 - DNA, 16 bp, Homo sapiens
ctctcagtctctgagc

SEQ ID NO: 4473609 - DNA, 23 bp, Homo sapiens
ctctcatagaacattgatctgtt

SEQ ID NO: 4473610 - DNA, 11 bp, Homo sapiens
ctctcattccc

SEQ ID NO: 4473611 - DNA, 14 bp, Homo sapiens
ctctcattccccag

SEQ ID NO: 4473612 - DNA, 16 bp, Homo sapiens
ctctcattccccaggt

SEQ ID NO: 4473613 - DNA, 14 bp, Homo sapiens
ctctccaagacagc

SEQ ID NO: 4473614 - DNA, 17 bp, Homo sapiens
ctctccaagtctcagtg

SEQ ID NO: 4473615 - DNA, 12 bp, Homo sapiens
ctctccacctca

SEQ ID NO: 4473616 - DNA, 23 bp, Homo sapiens
ctctccacggtagcacttgacct

SEQ ID NO: 4473617 - DNA, 22 bp, Homo sapiens
ctctccactcatgtgactcttt

SEQ ID NO: 4473618 - DNA, 20 bp, Homo sapiens
ctctccatatcccttcctct

SEQ ID NO: 4473619 - DNA, 14 bp, Homo sapiens
ctctcccacccggc

SEQ ID NO: 4473620 - DNA, 15 bp, Homo sapiens
ctctcccacccggcc

SEQ ID NO: 4473621 - DNA, 23 bp, Homo sapiens
ctctcccacccggccacagctgc

SEQ ID NO: 4473622 - DNA, 19 bp, Homo sapiens
ctctcccagtgaactcctg

SEQ ID NO: 4473623 - DNA, 22 bp, Homo sapiens
ctctcccagtgaactcctgcca

SEQ ID NO: 4473624 - DNA, 14 bp, Homo sapiens
ctctcccatggagc

SEQ ID NO: 4473625 - DNA, 19 bp, Homo sapiens
ctctcccatggagccccag

SEQ ID NO: 4473626 - DNA, 22 bp, Homo sapiens
ctctcccatggagccccagccc

SEQ ID NO: 4473627 - DNA, 23 bp, Homo sapiens
ctctcccatggagccccagcccc

SEQ ID NO: 4473628 - DNA, 22 bp, Homo sapiens
ctctccccaatccatgcttcac

SEQ ID NO: 4473629 - DNA, 12 bp, Homo sapiens
ctctccccacac

SEQ ID NO: 4473630 - DNA, 18 bp, Homo sapiens
ctctccccagccccctcc

SEQ ID NO: 4473631 - DNA, 22 bp, Homo sapiens
ctctccccaggaagtggctcag

SEQ ID NO: 4473632 - DNA, 11 bp, Homo sapiens
ctctccccagt

SEQ ID NO: 4473633 - DNA, 14 bp, Homo sapiens
ctctccccagtgcc

SEQ ID NO: 4473634 - DNA, 15 bp, Homo sapiens
ctctccccatatata

SEQ ID NO: 4473635 - DNA, 22 bp, Homo sapiens
ctctccccatatataaattatt

SEQ ID NO: 4473636 - DNA, 11 bp, Homo sapiens
ctctccctgcc

SEQ ID NO: 4473637 - DNA, 21 bp, Homo sapiens
ctctccctgccaagtctcaga

SEQ ID NO: 4473638 - DNA, 14 bp, Homo sapiens
ctctccctgcctca

SEQ ID NO: 4473639 - DNA, 13 bp, Homo sapiens
ctctccctgcctg

SEQ ID NO: 4473640 - DNA, 13 bp, Homo sapiens
ctctccctgctgc

SEQ ID NO: 4473641 - DNA, 14 bp, Homo sapiens
ctctccctgctgct

SEQ ID NO: 4473642 - DNA, 18 bp, Homo sapiens
ctctccctggtcccctcc

SEQ ID NO: 4473643 - DNA, 21 bp, Homo sapiens
ctctccctgtacacagtgccc

SEQ ID NO: 4473644 - DNA, 23 bp, Homo sapiens
ctctccctgtgttctgggctggg

SEQ ID NO: 4473645 - DNA, 13 bp, Homo sapiens
ctctcccttaccc

SEQ ID NO: 4473646 - DNA, 17 bp, Homo sapiens
ctctccgactctgcacc

SEQ ID NO: 4473647 - DNA, 20 bp, Homo sapiens
ctctccgactctgcacccgc

SEQ ID NO: 4473648 - DNA, 18 bp, Homo sapiens
ctctcctcatctccaagg

SEQ ID NO: 4473649 - DNA, 12 bp, Homo sapiens
ctctcctcctcc

SEQ ID NO: 4473650 - DNA, 14 bp, Homo sapiens
ctctcctcctcccc

SEQ ID NO: 4473651 - DNA, 10 bp, Homo sapiens
ctctcctctc

SEQ ID NO: 4473652 - DNA, 12 bp, Homo sapiens
ctctcctctctg

SEQ ID NO: 4473653 - DNA, 14 bp, Homo sapiens
ctctcctgccctgt

SEQ ID NO: 4473654 - DNA, 17 bp, Homo sapiens
ctctcctgccctgtgat

SEQ ID NO: 4473655 - DNA, 13 bp, Homo sapiens
ctctcctggagga

SEQ ID NO: 4473656 - DNA, 21 bp, Homo sapiens
ctctcctggcctatccgctgc

SEQ ID NO: 4473657 - DNA, 23 bp, Homo sapiens
ctctcctggcctatccgctgcca

SEQ ID NO: 4473658 - DNA, 21 bp, Homo sapiens
ctctcctgtccaacctaaccc

SEQ ID NO: 4473659 - DNA, 17 bp, Homo sapiens
ctctccttcactctgac

SEQ ID NO: 4473660 - DNA, 22 bp, Homo sapiens
ctctccttcatgacagcctcca

SEQ ID NO: 4473661 - DNA, 15 bp, Homo sapiens
ctctccttgcccccc

SEQ ID NO: 4473662 - DNA, 20 bp, Homo sapiens
ctctccttggccacagactg

SEQ ID NO: 4473663 - DNA, 21 bp, Homo sapiens
ctctcctttgaaacctgctct

SEQ ID NO: 4473664 - DNA, 19 bp, Homo sapiens
ctctcgactgtcagtgggg

SEQ ID NO: 4473665 - DNA, 12 bp, Homo sapiens
ctctcgagccca

SEQ ID NO: 4473666 - DNA, 18 bp, Homo sapiens
ctctcgccccatccctgc

SEQ ID NO: 4473667 - DNA, 18 bp, Homo sapiens
ctctcgctgccctgtgga

SEQ ID NO: 4473668 - DNA, 12 bp, Homo sapiens
ctctcggcccct

SEQ ID NO: 4473669 - DNA, 14 bp, Homo sapiens
ctctcggtgctcca

SEQ ID NO: 4473670 - DNA, 22 bp, Homo sapiens
ctctctaccttttaaaattgaa

SEQ ID NO: 4473671 - DNA, 11 bp, Homo sapiens
ctctctagctt

SEQ ID NO: 4473672 - DNA, 17 bp, Homo sapiens
ctctctattccctcagc

SEQ ID NO: 4473673 - DNA, 19 bp, Homo sapiens
ctctctattccctcagcct

SEQ ID NO: 4473674 - DNA, 14 bp, Homo sapiens
ctctctcacctgct

SEQ ID NO: 4473675 - DNA, 16 bp, Homo sapiens
ctctctcatgcctcct

SEQ ID NO: 4473676 - DNA, 14 bp, Homo sapiens
ctctctcccaggac

SEQ ID NO: 4473677 - DNA, 12 bp, Homo sapiens
ctctctcccagt

SEQ ID NO: 4473678 - DNA, 20 bp, Homo sapiens
ctctctcccatggagcccca

SEQ ID NO: 4473679 - DNA, 13 bp, Homo sapiens
ctctctccctgcc

SEQ ID NO: 4473680 - DNA, 15 bp, Homo sapiens
ctctctccctgcctc

SEQ ID NO: 4473681 - DNA, 12 bp, Homo sapiens
ctctctccctgg

SEQ ID NO: 4473682 - DNA, 16 bp, Homo sapiens
ctctctcctctctgct

SEQ ID NO: 4473683 - DNA, 14 bp, Homo sapiens
ctctctcctgtcca

SEQ ID NO: 4473684 - DNA, 16 bp, Homo sapiens
ctctctccttggccac

SEQ ID NO: 4473685 - DNA, 18 bp, Homo sapiens
ctctctcggcccctgtct

SEQ ID NO: 4473686 - DNA, 14 bp, Homo sapiens
ctctctctgtccct

SEQ ID NO: 4473687 - DNA, 13 bp, Homo sapiens
ctctctcttttct

SEQ ID NO: 4473688 - DNA, 15 bp, Homo sapiens
ctctctgatgtccca

SEQ ID NO: 4473689 - DNA, 16 bp, Homo sapiens
ctctctgatgtcccag

SEQ ID NO: 4473690 - DNA, 21 bp, Homo sapiens
ctctctgcagccagcccagcc

SEQ ID NO: 4473691 - DNA, 9 bp, Homo sapiens
ctctctgct

SEQ ID NO: 4473692 - DNA, 17 bp, Homo sapiens
ctctctggaaagaggct

SEQ ID NO: 4473693 - DNA, 19 bp, Homo sapiens
ctctctggaaagaggctct

SEQ ID NO: 4473694 - DNA, 20 bp, Homo sapiens
ctctctggaaagaggctctg

SEQ ID NO: 4473695 - DNA, 12 bp, Homo sapiens
ctctctgggact

SEQ ID NO: 4473696 - DNA, 16 bp, Homo sapiens
ctctctgggactctcc

SEQ ID NO: 4473697 - DNA, 18 bp, Homo sapiens
ctctctgggactctcctc

SEQ ID NO: 4473698 - DNA, 20 bp, Homo sapiens
ctctctgggcccaggggctg

SEQ ID NO: 4473699 - DNA, 18 bp, Homo sapiens
ctctctggggccctgggc

SEQ ID NO: 4473700 - DNA, 20 bp, Homo sapiens
ctctctggggccctgggcct

SEQ ID NO: 4473701 - DNA, 17 bp, Homo sapiens
ctctctgtcttttttct

SEQ ID NO: 4473702 - DNA, 16 bp, Homo sapiens
ctctctgtgctgtgga

SEQ ID NO: 4473703 - DNA, 19 bp, Homo sapiens
ctctcttattgttctttca

SEQ ID NO: 4473704 - DNA, 18 bp, Homo sapiens
ctctcttcaataaaccac

SEQ ID NO: 4473705 - DNA, 23 bp, Homo sapiens
ctctcttcagactctcagcccag

SEQ ID NO: 4473706 - DNA, 14 bp, Homo sapiens
ctctcttccccttc

SEQ ID NO: 4473707 - DNA, 16 bp, Homo sapiens
ctctcttctctccagc

SEQ ID NO: 4473708 - DNA, 12 bp, Homo sapiens
ctctcttctgct

SEQ ID NO: 4473709 - DNA, 18 bp, Homo sapiens
ctctcttctgctccaccc

SEQ ID NO: 4473710 - DNA, 19 bp, Homo sapiens
ctctcttggggcgcccacc

SEQ ID NO: 4473711 - DNA, 14 bp, Homo sapiens
ctctctttctctgg

SEQ ID NO: 4473712 - DNA, 12 bp, Homo sapiens
ctctcttttaaa

SEQ ID NO: 4473713 - DNA, 14 bp, Homo sapiens
ctctcttttctgta

SEQ ID NO: 4473714 - DNA, 13 bp, Homo sapiens
ctctgaaaacaag

SEQ ID NO: 4473715 - DNA, 21 bp, Homo sapiens
ctctgaaaacaaggtttccat

SEQ ID NO: 4473716 - DNA, 12 bp, Homo sapiens
ctctgaaacagc

SEQ ID NO: 4473717 - DNA, 13 bp, Homo sapiens
ctctgaaacagct

SEQ ID NO: 4473718 - DNA, 23 bp, Homo sapiens
ctctgaacttccaagctccaaat

SEQ ID NO: 4473719 - DNA, 22 bp, Homo sapiens
ctctgaatagttaaaaattaaa

SEQ ID NO: 4473720 - DNA, 14 bp, Homo sapiens
ctctgacagtccac

SEQ ID NO: 4473721 - DNA, 16 bp, Homo sapiens
ctctgacagtccacag

SEQ ID NO: 4473722 - DNA, 18 bp, Homo sapiens
ctctgacagtccacaggg

SEQ ID NO: 4473723 - DNA, 18 bp, Homo sapiens
ctctgacctcctctgggc

SEQ ID NO: 4473724 - DNA, 23 bp, Homo sapiens
ctctgacctcctctgggccctgt

SEQ ID NO: 4473725 - DNA, 19 bp, Homo sapiens
ctctgaccttccagagccc

SEQ ID NO: 4473726 - DNA, 23 bp, Homo sapiens
ctctgaccttccagagcccaagg

SEQ ID NO: 4473727 - DNA, 14 bp, Homo sapiens
ctctgactcagggc

SEQ ID NO: 4473728 - DNA, 15 bp, Homo sapiens
ctctgactcagggct

SEQ ID NO: 4473729 - DNA, 17 bp, Homo sapiens
ctctgactcagggctcc

SEQ ID NO: 4473730 - DNA, 21 bp, Homo sapiens
ctctgactcagggctcctggg

SEQ ID NO: 4473731 - DNA, 15 bp, Homo sapiens
ctctgagccagatta

SEQ ID NO: 4473732 - DNA, 16 bp, Homo sapiens
ctctgagccagattac

SEQ ID NO: 4473733 - DNA, 15 bp, Homo sapiens
ctctgagctgtgcag

SEQ ID NO: 4473734 - DNA, 21 bp, Homo sapiens
ctctgatacacagtaattgtg

SEQ ID NO: 4473735 - DNA, 20 bp, Homo sapiens
ctctgatagctgtttcaaat

SEQ ID NO: 4473736 - DNA, 21 bp, Homo sapiens
ctctgatccctctacagagct

SEQ ID NO: 4473737 - DNA, 22 bp, Homo sapiens
ctctgatccctctacagagctt

SEQ ID NO: 4473738 - DNA, 18 bp, Homo sapiens
ctctgcaaaaggagagac

SEQ ID NO: 4473739 - DNA, 14 bp, Homo sapiens
ctctgcaagaagaa

SEQ ID NO: 4473740 - DNA, 21 bp, Homo sapiens
ctctgcaattttactgtgaaa

SEQ ID NO: 4473741 - DNA, 20 bp, Homo sapiens
ctctgcacaccctccagaga

SEQ ID NO: 4473742 - DNA, 17 bp, Homo sapiens
ctctgcacccagaacag

SEQ ID NO: 4473743 - DNA, 16 bp, Homo sapiens
ctctgcacccgcctcg

SEQ ID NO: 4473744 - DNA, 17 bp, Homo sapiens
ctctgcacccgcctcga

SEQ ID NO: 4473745 - DNA, 19 bp, Homo sapiens
ctctgcagacttcccagct

SEQ ID NO: 4473746 - DNA, 13 bp, Homo sapiens
ctctgcagatgtg

SEQ ID NO: 4473747 - DNA, 13 bp, Homo sapiens
ctctgcagtaaaa

SEQ ID NO: 4473748 - DNA, 18 bp, Homo sapiens
ctctgcagtaaaacacat

SEQ ID NO: 4473749 - DNA, 17 bp, Homo sapiens
ctctgcagtctcatttc

SEQ ID NO: 4473750 - DNA, 19 bp, Homo sapiens
ctctgcagtctcatttctc

SEQ ID NO: 4473751 - DNA, 13 bp, Homo sapiens
ctctgcagtgcct

SEQ ID NO: 4473752 - DNA, 14 bp, Homo sapiens
ctctgcagtgcctt

SEQ ID NO: 4473753 - DNA, 15 bp, Homo sapiens
ctctgcagtgccttg

SEQ ID NO: 4473754 - DNA, 16 bp, Homo sapiens
ctctgcagtgccttgg

SEQ ID NO: 4473755 - DNA, 14 bp, Homo sapiens
ctctgcatccagag

SEQ ID NO: 4473756 - DNA, 16 bp, Homo sapiens
ctctgcatgcggccca

SEQ ID NO: 4473757 - DNA, 17 bp, Homo sapiens
ctctgcatgcggcccag

SEQ ID NO: 4473758 - DNA, 18 bp, Homo sapiens
ctctgcatgcggcccagc

SEQ ID NO: 4473759 - DNA, 23 bp, Homo sapiens
ctctgcatgcggcccagcccggc

SEQ ID NO: 4473760 - DNA, 22 bp, Homo sapiens
ctctgcatttgtctattctcca

SEQ ID NO: 4473761 - DNA, 23 bp, Homo sapiens
ctctgcatttgtctattctccag

SEQ ID NO: 4473762 - DNA, 14 bp, Homo sapiens
ctctgccacctccc

SEQ ID NO: 4473763 - DNA, 22 bp, Homo sapiens
ctctgccagaagatcccctcag

SEQ ID NO: 4473764 - DNA, 17 bp, Homo sapiens
ctctgccattctgtgca

SEQ ID NO: 4473765 - DNA, 18 bp, Homo sapiens
ctctgccattctgtgcag

SEQ ID NO: 4473766 - DNA, 20 bp, Homo sapiens
ctctgcccagccgggcacag

SEQ ID NO: 4473767 - DNA, 23 bp, Homo sapiens
ctctgccccaatcgggtccagag

SEQ ID NO: 4473768 - DNA, 21 bp, Homo sapiens
ctctgcccccgcgggttctag

SEQ ID NO: 4473769 - DNA, 23 bp, Homo sapiens
ctctgcccccgcgggttctagac

SEQ ID NO: 4473770 - DNA, 14 bp, Homo sapiens
ctctgccccctccc

SEQ ID NO: 4473771 - DNA, 17 bp, Homo sapiens
ctctgccccctccccca

SEQ ID NO: 4473772 - DNA, 18 bp, Homo sapiens
ctctgccccctcccccat

SEQ ID NO: 4473773 - DNA, 12 bp, Homo sapiens
ctctgccccctg

SEQ ID NO: 4473774 - DNA, 17 bp, Homo sapiens
ctctgccccctgctggc

SEQ ID NO: 4473775 - DNA, 11 bp, Homo sapiens
ctctgcccctg

SEQ ID NO: 4473776 - DNA, 17 bp, Homo sapiens
ctctgcccctgcagctg

SEQ ID NO: 4473777 - DNA, 19 bp, Homo sapiens
ctctgcccctgcagctgga

SEQ ID NO: 4473778 - DNA, 16 bp, Homo sapiens
ctctgcccctggacct

SEQ ID NO: 4473779 - DNA, 20 bp, Homo sapiens
ctctgcccgggagctcagga

SEQ ID NO: 4473780 - DNA, 16 bp, Homo sapiens
ctctgccctctccctg

SEQ ID NO: 4473781 - DNA, 18 bp, Homo sapiens
ctctgccctctccctgtg

SEQ ID NO: 4473782 - DNA, 12 bp, Homo sapiens
ctctgccctgga

SEQ ID NO: 4473783 - DNA, 15 bp, Homo sapiens
ctctgccctggaaag

SEQ ID NO: 4473784 - DNA, 16 bp, Homo sapiens
ctctgccctggattgg

SEQ ID NO: 4473785 - DNA, 14 bp, Homo sapiens
ctctgccgctgcca

SEQ ID NO: 4473786 - DNA, 16 bp, Homo sapiens
ctctgccgctgccatg

SEQ ID NO: 4473787 - DNA, 19 bp, Homo sapiens
ctctgccgctgccatgctt

SEQ ID NO: 4473788 - DNA, 20 bp, Homo sapiens
ctctgccggtcgggcagcca

SEQ ID NO: 4473789 - DNA, 23 bp, Homo sapiens
ctctgccggtcgggcagccagca

SEQ ID NO: 4473790 - DNA, 14 bp, Homo sapiens
ctctgcctacagcc

SEQ ID NO: 4473791 - DNA, 17 bp, Homo sapiens
ctctgcctacagccagg

SEQ ID NO: 4473792 - DNA, 12 bp, Homo sapiens
ctctgcctcaga

SEQ ID NO: 4473793 - DNA, 16 bp, Homo sapiens
ctctgcctcccaggtt

SEQ ID NO: 4473794 - DNA, 13 bp, Homo sapiens
ctctgcctgcccc

SEQ ID NO: 4473795 - DNA, 23 bp, Homo sapiens
ctctgccttgccctcctgggccc

SEQ ID NO: 4473796 - DNA, 10 bp, Homo sapiens
ctctgccttt

SEQ ID NO: 4473797 - DNA, 17 bp, Homo sapiens
ctctgcgggaggctggg

SEQ ID NO: 4473798 - DNA, 21 bp, Homo sapiens
ctctgcgggaggctggggccc

SEQ ID NO: 4473799 - DNA, 23 bp, Homo sapiens
ctctgcgggaggctggggcccca

SEQ ID NO: 4473800 - DNA, 21 bp, Homo sapiens
ctctgctcaccgcccatcagg

SEQ ID NO: 4473801 - DNA, 14 bp, Homo sapiens
ctctgctccaccac

SEQ ID NO: 4473802 - DNA, 19 bp, Homo sapiens
ctctgctccaccacatcct

SEQ ID NO: 4473803 - DNA, 12 bp, Homo sapiens
ctctgctccctc

SEQ ID NO: 4473804 - DNA, 13 bp, Homo sapiens
ctctgctccctct

SEQ ID NO: 4473805 - DNA, 13 bp, Homo sapiens
ctctgctctgcgt

SEQ ID NO: 4473806 - DNA, 19 bp, Homo sapiens
ctctgctgcaacaagctca

SEQ ID NO: 4473807 - DNA, 15 bp, Homo sapiens
ctctgctggctcagg

SEQ ID NO: 4473808 - DNA, 16 bp, Homo sapiens
ctctgctggctcagga

SEQ ID NO: 4473809 - DNA, 14 bp, Homo sapiens
ctctgcttctcacg

SEQ ID NO: 4473810 - DNA, 15 bp, Homo sapiens
ctctggaatgttttt

SEQ ID NO: 4473811 - DNA, 21 bp, Homo sapiens
ctctggacagcagaagcctcc

SEQ ID NO: 4473812 - DNA, 22 bp, Homo sapiens
ctctggacagcagaagcctcca

SEQ ID NO: 4473813 - DNA, 13 bp, Homo sapiens
ctctggacagcca

SEQ ID NO: 4473814 - DNA, 14 bp, Homo sapiens
ctctggacagccag

SEQ ID NO: 4473815 - DNA, 23 bp, Homo sapiens
ctctggacggcaggctcactgcc

SEQ ID NO: 4473816 - DNA, 13 bp, Homo sapiens
ctctggactggct

SEQ ID NO: 4473817 - DNA, 14 bp, Homo sapiens
ctctggactggcta

SEQ ID NO: 4473818 - DNA, 15 bp, Homo sapiens
ctctggagcatttct

SEQ ID NO: 4473819 - DNA, 11 bp, Homo sapiens
ctctggcacag

SEQ ID NO: 4473820 - DNA, 15 bp, Homo sapiens
ctctggcccctcacc

SEQ ID NO: 4473821 - DNA, 22 bp, Homo sapiens
ctctggcccctcacccaccatg

SEQ ID NO: 4473822 - DNA, 20 bp, Homo sapiens
ctctggctagaggccagccc

SEQ ID NO: 4473823 - DNA, 14 bp, Homo sapiens
ctctggctctgcct

SEQ ID NO: 4473824 - DNA, 18 bp, Homo sapiens
ctctggctctgcctcagg

SEQ ID NO: 4473825 - DNA, 23 bp, Homo sapiens
ctctgggaaatgagaaggcagcc

SEQ ID NO: 4473826 - DNA, 18 bp, Homo sapiens
ctctgggatttatgctca

SEQ ID NO: 4473827 - DNA, 17 bp, Homo sapiens
ctctgggcacgcctgct

SEQ ID NO: 4473828 - DNA, 17 bp, Homo sapiens
ctctggggatttctggg

SEQ ID NO: 4473829 - DNA, 18 bp, Homo sapiens
ctctggggatttctggga

SEQ ID NO: 4473830 - DNA, 18 bp, Homo sapiens
ctctggggccctgggcct

SEQ ID NO: 4473831 - DNA, 15 bp, Homo sapiens
ctctggggtgcagct

SEQ ID NO: 4473832 - DNA, 16 bp, Homo sapiens
ctctggtgctcctgca

SEQ ID NO: 4473833 - DNA, 17 bp, Homo sapiens
ctctggtggcacaggag

SEQ ID NO: 4473834 - DNA, 23 bp, Homo sapiens
ctctggttatttttctcttgtac

SEQ ID NO: 4473835 - DNA, 22 bp, Homo sapiens
ctctggttgtttctgttccaaa

SEQ ID NO: 4473836 - DNA, 23 bp, Homo sapiens
ctctggttgtttctgttccaaat

SEQ ID NO: 4473837 - DNA, 14 bp, Homo sapiens
ctctgtaaaacaca

SEQ ID NO: 4473838 - DNA, 14 bp, Homo sapiens
ctctgtaaaacgca

SEQ ID NO: 4473839 - DNA, 22 bp, Homo sapiens
ctctgtacagcaagatgtttct

SEQ ID NO: 4473840 - DNA, 11 bp, Homo sapiens
ctctgtacttt

SEQ ID NO: 4473841 - DNA, 17 bp, Homo sapiens
ctctgtagcaaatttgt

SEQ ID NO: 4473842 - DNA, 22 bp, Homo sapiens
ctctgtagcaaatttgtttaat

SEQ ID NO: 4473843 - DNA, 22 bp, Homo sapiens
ctctgtataatctatttacata

SEQ ID NO: 4473844 - DNA, 22 bp, Homo sapiens
ctctgtatcaggacccagagga

SEQ ID NO: 4473845 - DNA, 14 bp, Homo sapiens
ctctgtattgtcta

SEQ ID NO: 4473846 - DNA, 17 bp, Homo sapiens
ctctgtcagccagccgc

SEQ ID NO: 4473847 - DNA, 19 bp, Homo sapiens
ctctgtccaggcactgaga

SEQ ID NO: 4473848 - DNA, 18 bp, Homo sapiens
ctctgtcccccaggctgg

SEQ ID NO: 4473849 - DNA, 15 bp, Homo sapiens
ctctgtccccttctc

SEQ ID NO: 4473850 - DNA, 14 bp, Homo sapiens
ctctgtccctgtaa

SEQ ID NO: 4473851 - DNA, 20 bp, Homo sapiens
ctctgtctacctggtctggt

SEQ ID NO: 4473852 - DNA, 14 bp, Homo sapiens
ctctgtctgccctt

SEQ ID NO: 4473853 - DNA, 22 bp, Homo sapiens
ctctgtctgcccttcaccccag

SEQ ID NO: 4473854 - DNA, 19 bp, Homo sapiens
ctctgtcttggtaggtttg

SEQ ID NO: 4473855 - DNA, 13 bp, Homo sapiens
ctctgtgaactgt

SEQ ID NO: 4473856 - DNA, 18 bp, Homo sapiens
ctctgtgaccaatgtctt

SEQ ID NO: 4473857 - DNA, 13 bp, Homo sapiens
ctctgtgacccta

SEQ ID NO: 4473858 - DNA, 13 bp, Homo sapiens
ctctgtgagactc

SEQ ID NO: 4473859 - DNA, 17 bp, Homo sapiens
ctctgtgagggtgctga

SEQ ID NO: 4473860 - DNA, 20 bp, Homo sapiens
ctctgtgcagtcactggagg

SEQ ID NO: 4473861 - DNA, 21 bp, Homo sapiens
ctctgtgctgaccctcctgtt

SEQ ID NO: 4473862 - DNA, 17 bp, Homo sapiens
ctctgtgggctggcagt

SEQ ID NO: 4473863 - DNA, 22 bp, Homo sapiens
ctctgtgggtgatggggagggg

SEQ ID NO: 4473864 - DNA, 16 bp, Homo sapiens
ctctgtgtatatctct

SEQ ID NO: 4473865 - DNA, 16 bp, Homo sapiens
ctctgtgtggctgtgc

SEQ ID NO: 4473866 - DNA, 20 bp, Homo sapiens
ctctgtgtggctgtgcaatt

SEQ ID NO: 4473867 - DNA, 12 bp, Homo sapiens
ctctgtgtgtgt

SEQ ID NO: 4473868 - DNA, 13 bp, Homo sapiens
ctctgttccccca

SEQ ID NO: 4473869 - DNA, 16 bp, Homo sapiens
ctctgttcccccaccc

SEQ ID NO: 4473870 - DNA, 19 bp, Homo sapiens
ctctgttgtttggttcagg

SEQ ID NO: 4473871 - DNA, 21 bp, Homo sapiens
ctctgttgtttggttcaggga

SEQ ID NO: 4473872 - DNA, 17 bp, Homo sapiens
ctcttaaacttgtgaat

SEQ ID NO: 4473873 - DNA, 14 bp, Homo sapiens
ctcttactgctaac

SEQ ID NO: 4473874 - DNA, 18 bp, Homo sapiens
ctcttagaagaatattgt

SEQ ID NO: 4473875 - DNA, 17 bp, Homo sapiens
ctcttagctcccctcca

SEQ ID NO: 4473876 - DNA, 18 bp, Homo sapiens
ctcttagctcccctccaa

SEQ ID NO: 4473877 - DNA, 19 bp, Homo sapiens
ctcttagctcccctccaac

SEQ ID NO: 4473878 - DNA, 15 bp, Homo sapiens
ctcttattgttcttt

SEQ ID NO: 4473879 - DNA, 12 bp, Homo sapiens
ctcttatttctt

SEQ ID NO: 4473880 - DNA, 16 bp, Homo sapiens
ctcttatttctttcct

SEQ ID NO: 4473881 - DNA, 19 bp, Homo sapiens
ctcttatttctttccttta

SEQ ID NO: 4473882 - DNA, 20 bp, Homo sapiens
ctcttatttctttcctttaa

SEQ ID NO: 4473883 - DNA, 21 bp, Homo sapiens
ctcttatttctttcctttaaa

SEQ ID NO: 4473884 - DNA, 12 bp, Homo sapiens
ctcttcaataaa

SEQ ID NO: 4473885 - DNA, 13 bp, Homo sapiens
ctcttcaataaac

SEQ ID NO: 4473886 - DNA, 15 bp, Homo sapiens
ctcttcaataaacca

SEQ ID NO: 4473887 - DNA, 22 bp, Homo sapiens
ctcttcaataaaccacaagcat

SEQ ID NO: 4473888 - DNA, 15 bp, Homo sapiens
ctcttcagactctca

SEQ ID NO: 4473889 - DNA, 20 bp, Homo sapiens
ctcttcagactctcagccca

SEQ ID NO: 4473890 - DNA, 13 bp, Homo sapiens
ctcttcaggcctg

SEQ ID NO: 4473891 - DNA, 14 bp, Homo sapiens
ctcttcaggcctgc

SEQ ID NO: 4473892 - DNA, 16 bp, Homo sapiens
ctcttcataataaacc

SEQ ID NO: 4473893 - DNA, 13 bp, Homo sapiens
ctcttcccatgtc

SEQ ID NO: 4473894 - DNA, 13 bp, Homo sapiens
ctcttccccagag

SEQ ID NO: 4473895 - DNA, 15 bp, Homo sapiens
ctcttccccttagaa

SEQ ID NO: 4473896 - DNA, 14 bp, Homo sapiens
ctcttccccttccc

SEQ ID NO: 4473897 - DNA, 16 bp, Homo sapiens
ctcttcccttagcctc

SEQ ID NO: 4473898 - DNA, 21 bp, Homo sapiens
ctcttcccttagcctctccca

SEQ ID NO: 4473899 - DNA, 22 bp, Homo sapiens
ctcttcccttagcctctcccac

SEQ ID NO: 4473900 - DNA, 22 bp, Homo sapiens
ctcttcctaggccacgtccagg

SEQ ID NO: 4473901 - DNA, 20 bp, Homo sapiens
ctcttctagatggaccccag

SEQ ID NO: 4473902 - DNA, 12 bp, Homo sapiens
ctcttctcattt

SEQ ID NO: 4473903 - DNA, 12 bp, Homo sapiens
ctcttctgagct

SEQ ID NO: 4473904 - DNA, 15 bp, Homo sapiens
ctcttctgagctatt

SEQ ID NO: 4473905 - DNA, 18 bp, Homo sapiens
ctcttctgagctatttca

SEQ ID NO: 4473906 - DNA, 18 bp, Homo sapiens
ctcttctgctccaccctt

SEQ ID NO: 4473907 - DNA, 21 bp, Homo sapiens
ctcttctgctccacccttggc

SEQ ID NO: 4473908 - DNA, 19 bp, Homo sapiens
ctcttctgctcttttcctg

SEQ ID NO: 4473909 - DNA, 23 bp, Homo sapiens
ctcttctggggcaggctgggcca

SEQ ID NO: 4473910 - DNA, 13 bp, Homo sapiens
ctcttctggtgtt

SEQ ID NO: 4473911 - DNA, 19 bp, Homo sapiens
ctcttctggtgttgactgg

SEQ ID NO: 4473912 - DNA, 16 bp, Homo sapiens
ctcttcttcccagcac

SEQ ID NO: 4473913 - DNA, 15 bp, Homo sapiens
ctcttcttgaaattt

SEQ ID NO: 4473914 - DNA, 22 bp, Homo sapiens
ctcttctttaaagggatggcaa

SEQ ID NO: 4473915 - DNA, 15 bp, Homo sapiens
ctcttctttctgaag

SEQ ID NO: 4473916 - DNA, 14 bp, Homo sapiens
ctcttctttgtgcc

SEQ ID NO: 4473917 - DNA, 17 bp, Homo sapiens
ctcttctttgtgccttt

SEQ ID NO: 4473918 - DNA, 19 bp, Homo sapiens
ctcttctttttcttcttgt

SEQ ID NO: 4473919 - DNA, 18 bp, Homo sapiens
ctcttgaaatattcagaa

SEQ ID NO: 4473920 - DNA, 20 bp, Homo sapiens
ctcttgaacgttatgttcag

SEQ ID NO: 4473921 - DNA, 23 bp, Homo sapiens
ctcttgaacgttatgttcagaaa

SEQ ID NO: 4473922 - DNA, 14 bp, Homo sapiens
ctcttgacagtctg

SEQ ID NO: 4473923 - DNA, 14 bp, Homo sapiens
ctcttgaccaggct

SEQ ID NO: 4473924 - DNA, 19 bp, Homo sapiens
ctcttgaccaggctgcctc

SEQ ID NO: 4473925 - DNA, 16 bp, Homo sapiens
ctcttgaccttgtaga

SEQ ID NO: 4473926 - DNA, 15 bp, Homo sapiens
ctcttgagcatcaat

SEQ ID NO: 4473927 - DNA, 20 bp, Homo sapiens
ctcttgatctctcttgtcct

SEQ ID NO: 4473928 - DNA, 17 bp, Homo sapiens
ctcttgatttcacattt

SEQ ID NO: 4473929 - DNA, 21 bp, Homo sapiens
ctcttgatttcacatttctac

SEQ ID NO: 4473930 - DNA, 13 bp, Homo sapiens
ctcttgcaggctg

SEQ ID NO: 4473931 - DNA, 14 bp, Homo sapiens
ctcttgctttctat

SEQ ID NO: 4473932 - DNA, 17 bp, Homo sapiens
ctcttggaaaataagac

SEQ ID NO: 4473933 - DNA, 18 bp, Homo sapiens
ctcttggaaaataagaca

SEQ ID NO: 4473934 - DNA, 22 bp, Homo sapiens
ctcttggaattacaagccctgg

SEQ ID NO: 4473935 - DNA, 14 bp, Homo sapiens
ctcttggacccacc

SEQ ID NO: 4473936 - DNA, 18 bp, Homo sapiens
ctcttggagaccttaccc

SEQ ID NO: 4473937 - DNA, 17 bp, Homo sapiens
ctcttggtcagcttttg

SEQ ID NO: 4473938 - DNA, 20 bp, Homo sapiens
ctcttggttcgatacctgga

SEQ ID NO: 4473939 - DNA, 20 bp, Homo sapiens
ctcttgtcctcttctgctct

SEQ ID NO: 4473940 - DNA, 17 bp, Homo sapiens
ctcttgtgtccctggaa

SEQ ID NO: 4473941 - DNA, 15 bp, Homo sapiens
ctctttaaccctccc

SEQ ID NO: 4473942 - DNA, 16 bp, Homo sapiens
ctctttaattttaact

SEQ ID NO: 4473943 - DNA, 18 bp, Homo sapiens
ctctttagtgttctgttt

SEQ ID NO: 4473944 - DNA, 13 bp, Homo sapiens
ctctttatagtgc

SEQ ID NO: 4473945 - DNA, 21 bp, Homo sapiens
ctctttattttaaaaaacact

SEQ ID NO: 4473946 - DNA, 19 bp, Homo sapiens
ctctttcacacaatgccca

SEQ ID NO: 4473947 - DNA, 22 bp, Homo sapiens
ctctttccagtggatcataaga

SEQ ID NO: 4473948 - DNA, 12 bp, Homo sapiens
ctctttctctct

SEQ ID NO: 4473949 - DNA, 13 bp, Homo sapiens
ctctttctctctc

SEQ ID NO: 4473950 - DNA, 14 bp, Homo sapiens
ctctttctctcttt

SEQ ID NO: 4473951 - DNA, 12 bp, Homo sapiens
ctctttctctgg

SEQ ID NO: 4473952 - DNA, 22 bp, Homo sapiens
ctctttctctggtggtcttcct

SEQ ID NO: 4473953 - DNA, 23 bp, Homo sapiens
ctctttctctggtggtcttcctt

SEQ ID NO: 4473954 - DNA, 18 bp, Homo sapiens
ctctttctgaaggaagag

SEQ ID NO: 4473955 - DNA, 14 bp, Homo sapiens
ctctttctgtatat

SEQ ID NO: 4473956 - DNA, 15 bp, Homo sapiens
ctctttctgtcttct

SEQ ID NO: 4473957 - DNA, 12 bp, Homo sapiens
ctctttcttcat

SEQ ID NO: 4473958 - DNA, 17 bp, Homo sapiens
ctcttttacctgctgct

SEQ ID NO: 4473959 - DNA, 23 bp, Homo sapiens
ctcttttccactccattgtcgta

SEQ ID NO: 4473960 - DNA, 18 bp, Homo sapiens
ctcttttcctggcagctg

SEQ ID NO: 4473961 - DNA, 20 bp, Homo sapiens
ctcttttctacacactcagc

SEQ ID NO: 4473962 - DNA, 17 bp, Homo sapiens
ctcttttgtgatgaaca

SEQ ID NO: 4473963 - DNA, 17 bp, Homo sapiens
ctcttttttgtttgttt

SEQ ID NO: 4473964 - DNA, 21 bp, Homo sapiens
ctcttttttgtttgtttcttt

SEQ ID NO: 4473965 - DNA, 21 bp, Homo sapiens
ctgaaaaaaacatatccaaaa

SEQ ID NO: 4473966 - DNA, 13 bp, Homo sapiens
ctgaaaaaatata

SEQ ID NO: 4473967 - DNA, 17 bp, Homo sapiens
ctgaaaacactgtgcac

SEQ ID NO: 4473968 - DNA, 19 bp, Homo sapiens
ctgaaaacatctagcccaa

SEQ ID NO: 4473969 - DNA, 14 bp, Homo sapiens
ctgaaaacccagag

SEQ ID NO: 4473970 - DNA, 15 bp, Homo sapiens
ctgaaaacccagaga

SEQ ID NO: 4473971 - DNA, 18 bp, Homo sapiens
ctgaaaacctaccagcca

SEQ ID NO: 4473972 - DNA, 16 bp, Homo sapiens
ctgaaaagaaggaaag

SEQ ID NO: 4473973 - DNA, 20 bp, Homo sapiens
ctgaaaatattgttttacaa

SEQ ID NO: 4473974 - DNA, 22 bp, Homo sapiens
ctgaaaatattgttttacaata

SEQ ID NO: 4473975 - DNA, 16 bp, Homo sapiens
ctgaaaatttaacagt

SEQ ID NO: 4473976 - DNA, 15 bp, Homo sapiens
ctgaaacaaaatgtt

SEQ ID NO: 4473977 - DNA, 16 bp, Homo sapiens
ctgaaacaaaatgttt

SEQ ID NO: 4473978 - DNA, 15 bp, Homo sapiens
ctgaaacaacaaata

SEQ ID NO: 4473979 - DNA, 12 bp, Homo sapiens
ctgaaacagctg

SEQ ID NO: 4473980 - DNA, 17 bp, Homo sapiens
ctgaaacagctgcctta

SEQ ID NO: 4473981 - DNA, 14 bp, Homo sapiens
ctgaaaccagtgtt

SEQ ID NO: 4473982 - DNA, 19 bp, Homo sapiens
ctgaaactcatagacactg

SEQ ID NO: 4473983 - DNA, 21 bp, Homo sapiens
ctgaaagactgaagaaagtgt

SEQ ID NO: 4473984 - DNA, 13 bp, Homo sapiens
ctgaaagaggaat

SEQ ID NO: 4473985 - DNA, 17 bp, Homo sapiens
ctgaaagaggaatgaag

SEQ ID NO: 4473986 - DNA, 12 bp, Homo sapiens
ctgaaagccacg

SEQ ID NO: 4473987 - DNA, 17 bp, Homo sapiens
ctgaaaggtagactttt

SEQ ID NO: 4473988 - DNA, 14 bp, Homo sapiens
ctgaaagtaaagtt

SEQ ID NO: 4473989 - DNA, 15 bp, Homo sapiens
ctgaaataatatatt

SEQ ID NO: 4473990 - DNA, 20 bp, Homo sapiens
ctgaaataatatatttcttc

SEQ ID NO: 4473991 - DNA, 21 bp, Homo sapiens
ctgaaataatatatttcttct

SEQ ID NO: 4473992 - DNA, 21 bp, Homo sapiens
ctgaaatatcccgggggtggg

SEQ ID NO: 4473993 - DNA, 22 bp, Homo sapiens
ctgaaatatcccgggggtgggg

SEQ ID NO: 4473994 - DNA, 13 bp, Homo sapiens
ctgaaatgaagat

SEQ ID NO: 4473995 - DNA, 15 bp, Homo sapiens
ctgaaatgacatttc

SEQ ID NO: 4473996 - DNA, 22 bp, Homo sapiens
ctgaaattttatatgcttactg

SEQ ID NO: 4473997 - DNA, 17 bp, Homo sapiens
ctgaacacaaccagagg

SEQ ID NO: 4473998 - DNA, 19 bp, Homo sapiens
ctgaacacttttgttgtaa

SEQ ID NO: 4473999 - DNA, 20 bp, Homo sapiens
ctgaacacttttgttgtaaa

SEQ ID NO: 4474000 - DNA, 13 bp, Homo sapiens
ctgaacaggttct

SEQ ID NO: 4474001 - DNA, 21 bp, Homo sapiens
ctgaacatttactacagtttt

SEQ ID NO: 4474002 - DNA, 13 bp, Homo sapiens
ctgaaccacagaa

SEQ ID NO: 4474003 - DNA, 13 bp, Homo sapiens
ctgaaccaggcca

SEQ ID NO: 4474004 - DNA, 12 bp, Homo sapiens
ctgaaccatgtg

SEQ ID NO: 4474005 - DNA, 14 bp, Homo sapiens
ctgaaccccagagg

SEQ ID NO: 4474006 - DNA, 23 bp, Homo sapiens
ctgaaccttaggctttgtatgac

SEQ ID NO: 4474007 - DNA, 15 bp, Homo sapiens
ctgaactaaagtgct

SEQ ID NO: 4474008 - DNA, 16 bp, Homo sapiens
ctgaactattttaaat

SEQ ID NO: 4474009 - DNA, 21 bp, Homo sapiens
ctgaactattttaaataaaat

SEQ ID NO: 4474010 - DNA, 15 bp, Homo sapiens
ctgaactcaaactga

SEQ ID NO: 4474011 - DNA, 12 bp, Homo sapiens
ctgaactccaga

SEQ ID NO: 4474012 - DNA, 13 bp, Homo sapiens
ctgaactccagag

SEQ ID NO: 4474013 - DNA, 14 bp, Homo sapiens
ctgaactgacaatg

SEQ ID NO: 4474014 - DNA, 18 bp, Homo sapiens
ctgaactgacaatgaagg

SEQ ID NO: 4474015 - DNA, 12 bp, Homo sapiens
ctgaactgagcc

SEQ ID NO: 4474016 - DNA, 18 bp, Homo sapiens
ctgaactgagccccagcg

SEQ ID NO: 4474017 - DNA, 13 bp, Homo sapiens
ctgaactgttaca

SEQ ID NO: 4474018 - DNA, 17 bp, Homo sapiens
ctgaacttgaagctaac

SEQ ID NO: 4474019 - DNA, 23 bp, Homo sapiens
ctgaacttggtctgcagaccatc

SEQ ID NO: 4474020 - DNA, 16 bp, Homo sapiens
ctgaactttctccctc

SEQ ID NO: 4474021 - DNA, 17 bp, Homo sapiens
ctgaactttctccctca

SEQ ID NO: 4474022 - DNA, 13 bp, Homo sapiens
ctgaagaaagtgt

SEQ ID NO: 4474023 - DNA, 13 bp, Homo sapiens
ctgaagagctctt

SEQ ID NO: 4474024 - DNA, 14 bp, Homo sapiens
ctgaagagctcttg

SEQ ID NO: 4474025 - DNA, 17 bp, Homo sapiens
ctgaagaggaccagagg

SEQ ID NO: 4474026 - DNA, 18 bp, Homo sapiens
ctgaagaggcttctcctg

SEQ ID NO: 4474027 - DNA, 15 bp, Homo sapiens
ctgaagatgcagctc

SEQ ID NO: 4474028 - DNA, 22 bp, Homo sapiens
ctgaagatgcagctcactaccc

SEQ ID NO: 4474029 - DNA, 23 bp, Homo sapiens
ctgaagatggagggggctggggt

SEQ ID NO: 4474030 - DNA, 16 bp, Homo sapiens
ctgaagcaaagtgccc

SEQ ID NO: 4474031 - DNA, 12 bp, Homo sapiens
ctgaagcctctg

SEQ ID NO: 4474032 - DNA, 14 bp, Homo sapiens
ctgaaggaaaaaca

SEQ ID NO: 4474033 - DNA, 20 bp, Homo sapiens
ctgaaggagatcaatggttt

SEQ ID NO: 4474034 - DNA, 12 bp, Homo sapiens
ctgaaggagccc

SEQ ID NO: 4474035 - DNA, 21 bp, Homo sapiens
ctgaaggagccccattcctgg

SEQ ID NO: 4474036 - DNA, 17 bp, Homo sapiens
ctgaaggctaaaaagca

SEQ ID NO: 4474037 - DNA, 14 bp, Homo sapiens
ctgaagggaccccc

SEQ ID NO: 4474038 - DNA, 21 bp, Homo sapiens
ctgaagggtggatgtgctgga

SEQ ID NO: 4474039 - DNA, 23 bp, Homo sapiens
ctgaagggtggatgtgctggagg

SEQ ID NO: 4474040 - DNA, 14 bp, Homo sapiens
ctgaagtacaaaca

SEQ ID NO: 4474041 - DNA, 12 bp, Homo sapiens
ctgaagtgcttg

SEQ ID NO: 4474042 - DNA, 20 bp, Homo sapiens
ctgaagtgcttgcagatcat

SEQ ID NO: 4474043 - DNA, 15 bp, Homo sapiens
ctgaataaagcaatt

SEQ ID NO: 4474044 - DNA, 21 bp, Homo sapiens
ctgaatacacagtattcagag

SEQ ID NO: 4474045 - DNA, 13 bp, Homo sapiens
ctgaatagttaaa

SEQ ID NO: 4474046 - DNA, 18 bp, Homo sapiens
ctgaatagttaaaaatta

SEQ ID NO: 4474047 - DNA, 19 bp, Homo sapiens
ctgaatagttaaaaattaa

SEQ ID NO: 4474048 - DNA, 15 bp, Homo sapiens
ctgaatatcaactct

SEQ ID NO: 4474049 - DNA, 19 bp, Homo sapiens
ctgaatcccccttgccacc

SEQ ID NO: 4474050 - DNA, 15 bp, Homo sapiens
ctgaatctgtgcaaa

SEQ ID NO: 4474051 - DNA, 21 bp, Homo sapiens
ctgaatgatcttgtgtaaggt

SEQ ID NO: 4474052 - DNA, 13 bp, Homo sapiens
ctgaatgtaattt

SEQ ID NO: 4474053 - DNA, 15 bp, Homo sapiens
ctgaatgtaatttgt

SEQ ID NO: 4474054 - DNA, 15 bp, Homo sapiens
ctgaattaaacttaa

SEQ ID NO: 4474055 - DNA, 16 bp, Homo sapiens
ctgaattaattaattt

SEQ ID NO: 4474056 - DNA, 16 bp, Homo sapiens
ctgaattcctttacaa

SEQ ID NO: 4474057 - DNA, 23 bp, Homo sapiens
ctgaattcctttacaactaaata

SEQ ID NO: 4474058 - DNA, 20 bp, Homo sapiens
ctgaattgctttctgctctt

SEQ ID NO: 4474059 - DNA, 19 bp, Homo sapiens
ctgaattgtatcaatttgt

SEQ ID NO: 4474060 - DNA, 15 bp, Homo sapiens
ctgaattgtccccag

SEQ ID NO: 4474061 - DNA, 16 bp, Homo sapiens
ctgaatttgcaaagta

SEQ ID NO: 4474062 - DNA, 21 bp, Homo sapiens
ctgaatttgcaaagtactgta

SEQ ID NO: 4474063 - DNA, 16 bp, Homo sapiens
ctgaattttgggactt

SEQ ID NO: 4474064 - DNA, 18 bp, Homo sapiens
ctgaatttttaaacaagt

SEQ ID NO: 4474065 - DNA, 14 bp, Homo sapiens
ctgaatttttttgt

SEQ ID NO: 4474066 - DNA, 18 bp, Homo sapiens
ctgaatttttttgtaata

SEQ ID NO: 4474067 - DNA, 14 bp, Homo sapiens
ctgacaaattttaa

SEQ ID NO: 4474068 - DNA, 14 bp, Homo sapiens
ctgacaagccatct

SEQ ID NO: 4474069 - DNA, 17 bp, Homo sapiens
ctgacaatccttgagaa

SEQ ID NO: 4474070 - DNA, 21 bp, Homo sapiens
ctgacaatccttgagaatctt

SEQ ID NO: 4474071 - DNA, 19 bp, Homo sapiens
ctgacacaccaggcgctaa

SEQ ID NO: 4474072 - DNA, 12 bp, Homo sapiens
ctgacacccagg

SEQ ID NO: 4474073 - DNA, 14 bp, Homo sapiens
ctgacacccaggcc

SEQ ID NO: 4474074 - DNA, 18 bp, Homo sapiens
ctgacactcaataaacag

SEQ ID NO: 4474075 - DNA, 23 bp, Homo sapiens
ctgacactcaataaacagtcact

SEQ ID NO: 4474076 - DNA, 12 bp, Homo sapiens
ctgacagaggag

SEQ ID NO: 4474077 - DNA, 16 bp, Homo sapiens
ctgacagatgcctggt

SEQ ID NO: 4474078 - DNA, 12 bp, Homo sapiens
ctgacagctctg

SEQ ID NO: 4474079 - DNA, 18 bp, Homo sapiens
ctgacagcttgagaaggt

SEQ ID NO: 4474080 - DNA, 22 bp, Homo sapiens
ctgacagggacatgccctgtgt

SEQ ID NO: 4474081 - DNA, 13 bp, Homo sapiens
ctgacagggagca

SEQ ID NO: 4474082 - DNA, 17 bp, Homo sapiens
ctgacagggagcagccc

SEQ ID NO: 4474083 - DNA, 17 bp, Homo sapiens
ctgacagtccacagggg

SEQ ID NO: 4474084 - DNA, 15 bp, Homo sapiens
ctgacatgtaagaaa

SEQ ID NO: 4474085 - DNA, 20 bp, Homo sapiens
ctgacattgccaaaaaggat

SEQ ID NO: 4474086 - DNA, 12 bp, Homo sapiens
ctgacatttcta

SEQ ID NO: 4474087 - DNA, 14 bp, Homo sapiens
ctgaccaagtttct

SEQ ID NO: 4474088 - DNA, 13 bp, Homo sapiens
ctgaccagctgct

SEQ ID NO: 4474089 - DNA, 16 bp, Homo sapiens
ctgaccagctgctccg

SEQ ID NO: 4474090 - DNA, 15 bp, Homo sapiens
ctgaccatgcatttt

SEQ ID NO: 4474091 - DNA, 19 bp, Homo sapiens
ctgaccatgcgtcaggggc

SEQ ID NO: 4474092 - DNA, 21 bp, Homo sapiens
ctgaccattttggatgtcatt

SEQ ID NO: 4474093 - DNA, 23 bp, Homo sapiens
ctgacccactttgtaatttttgc

SEQ ID NO: 4474094 - DNA, 12 bp, Homo sapiens
ctgacccagtcc

SEQ ID NO: 4474095 - DNA, 13 bp, Homo sapiens
ctgacccagtccc

SEQ ID NO: 4474096 - DNA, 14 bp, Homo sapiens
ctgacccagtccct

SEQ ID NO: 4474097 - DNA, 15 bp, Homo sapiens
ctgacccagtccctg

SEQ ID NO: 4474098 - DNA, 18 bp, Homo sapiens
ctgacccagtccctgggg

SEQ ID NO: 4474099 - DNA, 14 bp, Homo sapiens
ctgaccctcctgtt

SEQ ID NO: 4474100 - DNA, 23 bp, Homo sapiens
ctgaccctcctgttgcacccagc

SEQ ID NO: 4474101 - DNA, 14 bp, Homo sapiens
ctgaccctgctcct

SEQ ID NO: 4474102 - DNA, 18 bp, Homo sapiens
ctgaccctgctcctagca

SEQ ID NO: 4474103 - DNA, 23 bp, Homo sapiens
ctgaccctgctcctagcaccctg

SEQ ID NO: 4474104 - DNA, 17 bp, Homo sapiens
ctgaccctggttctctc

SEQ ID NO: 4474105 - DNA, 11 bp, Homo sapiens
ctgaccgtgac

SEQ ID NO: 4474106 - DNA, 13 bp, Homo sapiens
ctgaccgtgggcg

SEQ ID NO: 4474107 - DNA, 13 bp, Homo sapiens
ctgacctcctctg

SEQ ID NO: 4474108 - DNA, 18 bp, Homo sapiens
ctgacctcctctgggccc

SEQ ID NO: 4474109 - DNA, 14 bp, Homo sapiens
ctgacctgccagcc

SEQ ID NO: 4474110 - DNA, 17 bp, Homo sapiens
ctgaccttccagagccc

SEQ ID NO: 4474111 - DNA, 20 bp, Homo sapiens
ctgaccttccagagcccaag

SEQ ID NO: 4474112 - DNA, 13 bp, Homo sapiens
ctgacgctcagcc

SEQ ID NO: 4474113 - DNA, 14 bp, Homo sapiens
ctgacgctcagccc

SEQ ID NO: 4474114 - DNA, 22 bp, Homo sapiens
ctgacgctcagccccaggccag

SEQ ID NO: 4474115 - DNA, 18 bp, Homo sapiens
ctgacgttaggaccagga

SEQ ID NO: 4474116 - DNA, 19 bp, Homo sapiens
ctgactaaactttttttct

SEQ ID NO: 4474117 - DNA, 22 bp, Homo sapiens
ctgactagaagggccagtcctg

SEQ ID NO: 4474118 - DNA, 21 bp, Homo sapiens
ctgactcaattatttgcatat

SEQ ID NO: 4474119 - DNA, 22 bp, Homo sapiens
ctgactcacacctgaactgaac

SEQ ID NO: 4474120 - DNA, 16 bp, Homo sapiens
ctgactcagggctcct

SEQ ID NO: 4474121 - DNA, 23 bp, Homo sapiens
ctgactcagtgtctgcctttaaa

SEQ ID NO: 4474122 - DNA, 16 bp, Homo sapiens
ctgactcattctgaag

SEQ ID NO: 4474123 - DNA, 23 bp, Homo sapiens
ctgactccctgtgggggtggcca

SEQ ID NO: 4474124 - DNA, 18 bp, Homo sapiens
ctgactccgtcaagctgg

SEQ ID NO: 4474125 - DNA, 22 bp, Homo sapiens
ctgactccgtcaagctggttgt

SEQ ID NO: 4474126 - DNA, 13 bp, Homo sapiens
ctgactcctctgg

SEQ ID NO: 4474127 - DNA, 12 bp, Homo sapiens
ctgactcctgga

SEQ ID NO: 4474128 - DNA, 13 bp, Homo sapiens
ctgactcctggac

SEQ ID NO: 4474129 - DNA, 14 bp, Homo sapiens
ctgactcctggact

SEQ ID NO: 4474130 - DNA, 15 bp, Homo sapiens
ctgactcctggactc

SEQ ID NO: 4474131 - DNA, 21 bp, Homo sapiens
ctgactggatggtccagtgtc

SEQ ID NO: 4474132 - DNA, 20 bp, Homo sapiens
ctgactggattcattctcat

SEQ ID NO: 4474133 - DNA, 21 bp, Homo sapiens
ctgactggattcattctcata

SEQ ID NO: 4474134 - DNA, 17 bp, Homo sapiens
ctgactggtttctcctg

SEQ ID NO: 4474135 - DNA, 14 bp, Homo sapiens
ctgactgttcttgg

SEQ ID NO: 4474136 - DNA, 15 bp, Homo sapiens
ctgacttagcctcct

SEQ ID NO: 4474137 - DNA, 16 bp, Homo sapiens
ctgacttcctctgatt

SEQ ID NO: 4474138 - DNA, 16 bp, Homo sapiens
ctgacttctaagtaaa

SEQ ID NO: 4474139 - DNA, 12 bp, Homo sapiens
ctgacttgcttt

SEQ ID NO: 4474140 - DNA, 18 bp, Homo sapiens
ctgacttggatcccaaag

SEQ ID NO: 4474141 - DNA, 21 bp, Homo sapiens
ctgacttggatcccaaagcaa

SEQ ID NO: 4474142 - DNA, 18 bp, Homo sapiens
ctgagaaagactattcaa

SEQ ID NO: 4474143 - DNA, 22 bp, Homo sapiens
ctgagaaagactattcaaacag

SEQ ID NO: 4474144 - DNA, 22 bp, Homo sapiens
ctgagaaatgaatgctgagacc

SEQ ID NO: 4474145 - DNA, 15 bp, Homo sapiens
ctgagaactgaattt

SEQ ID NO: 4474146 - DNA, 13 bp, Homo sapiens
ctgagaagctctg

SEQ ID NO: 4474147 - DNA, 16 bp, Homo sapiens
ctgagaatgatggttt

SEQ ID NO: 4474148 - DNA, 17 bp, Homo sapiens
ctgagaatgtaagaact

SEQ ID NO: 4474149 - DNA, 21 bp, Homo sapiens
ctgagaccagggtggccacac

SEQ ID NO: 4474150 - DNA, 15 bp, Homo sapiens
ctgagacccctggcc

SEQ ID NO: 4474151 - DNA, 17 bp, Homo sapiens
ctgagacccctggcctc

SEQ ID NO: 4474152 - DNA, 20 bp, Homo sapiens
ctgagaccctgggagagaag

SEQ ID NO: 4474153 - DNA, 19 bp, Homo sapiens
ctgagacctctagagaaaa

SEQ ID NO: 4474154 - DNA, 19 bp, Homo sapiens
ctgagagacccaaggagga

SEQ ID NO: 4474155 - DNA, 20 bp, Homo sapiens
ctgagagacccaaggaggaa

SEQ ID NO: 4474156 - DNA, 14 bp, Homo sapiens
ctgagagaggccat

SEQ ID NO: 4474157 - DNA, 21 bp, Homo sapiens
ctgagagaggccattctttcc

SEQ ID NO: 4474158 - DNA, 19 bp, Homo sapiens
ctgagagccctgctgtggg

SEQ ID NO: 4474159 - DNA, 22 bp, Homo sapiens
ctgagagccggccgtggaagga

SEQ ID NO: 4474160 - DNA, 16 bp, Homo sapiens
ctgagagcctgtggag

SEQ ID NO: 4474161 - DNA, 21 bp, Homo sapiens
ctgagaggcaccagtccagca

SEQ ID NO: 4474162 - DNA, 14 bp, Homo sapiens
ctgagaggcaggca

SEQ ID NO: 4474163 - DNA, 13 bp, Homo sapiens
ctgagagtcagga

SEQ ID NO: 4474164 - DNA, 18 bp, Homo sapiens
ctgagatactgaaatgtg

SEQ ID NO: 4474165 - DNA, 19 bp, Homo sapiens
ctgagatattattttaaat

SEQ ID NO: 4474166 - DNA, 22 bp, Homo sapiens
ctgagatattattttaaatttc

SEQ ID NO: 4474167 - DNA, 13 bp, Homo sapiens
ctgagatcctgga

SEQ ID NO: 4474168 - DNA, 17 bp, Homo sapiens
ctgagatcctggactga

SEQ ID NO: 4474169 - DNA, 21 bp, Homo sapiens
ctgagatcctggactgagggg

SEQ ID NO: 4474170 - DNA, 16 bp, Homo sapiens
ctgagatctgtgtttt

SEQ ID NO: 4474171 - DNA, 18 bp, Homo sapiens
ctgagatggagtgagctg

SEQ ID NO: 4474172 - DNA, 20 bp, Homo sapiens
ctgagatgtgaacacatcag

SEQ ID NO: 4474173 - DNA, 19 bp, Homo sapiens
ctgagatttaacccctcca

SEQ ID NO: 4474174 - DNA, 20 bp, Homo sapiens
ctgagatttaacccctccac

SEQ ID NO: 4474175 - DNA, 18 bp, Homo sapiens
ctgagatttcatctgctc

SEQ ID NO: 4474176 - DNA, 22 bp, Homo sapiens
ctgagatttcatctgctctcct

SEQ ID NO: 4474177 - DNA, 20 bp, Homo sapiens
ctgagcaaaggccctgggta

SEQ ID NO: 4474178 - DNA, 11 bp, Homo sapiens
ctgagcaaata

SEQ ID NO: 4474179 - DNA, 20 bp, Homo sapiens
ctgagcaactcttgattatc

SEQ ID NO: 4474180 - DNA, 21 bp, Homo sapiens
ctgagcacatttgactccact

SEQ ID NO: 4474181 - DNA, 16 bp, Homo sapiens
ctgagcactcctggtg

SEQ ID NO: 4474182 - DNA, 17 bp, Homo sapiens
ctgagcactcctggtgc

SEQ ID NO: 4474183 - DNA, 19 bp, Homo sapiens
ctgagcagccgccagctgg

SEQ ID NO: 4474184 - DNA, 14 bp, Homo sapiens
ctgagcagcctctg

SEQ ID NO: 4474185 - DNA, 19 bp, Homo sapiens
ctgagcagcctctggacag

SEQ ID NO: 4474186 - DNA, 22 bp, Homo sapiens
ctgagcaggggcccctggggac

SEQ ID NO: 4474187 - DNA, 12 bp, Homo sapiens
ctgagcaggtgt

SEQ ID NO: 4474188 - DNA, 16 bp, Homo sapiens
ctgagcatccagacct

SEQ ID NO: 4474189 - DNA, 15 bp, Homo sapiens
ctgagcattcaggca

SEQ ID NO: 4474190 - DNA, 22 bp, Homo sapiens
ctgagcattcaggcagcactga

SEQ ID NO: 4474191 - DNA, 17 bp, Homo sapiens
ctgagccaaggaggcct

SEQ ID NO: 4474192 - DNA, 18 bp, Homo sapiens
ctgagccaaggaggcctg

SEQ ID NO: 4474193 - DNA, 12 bp, Homo sapiens
ctgagccacctg

SEQ ID NO: 4474194 - DNA, 14 bp, Homo sapiens
ctgagccacctgcc

SEQ ID NO: 4474195 - DNA, 13 bp, Homo sapiens
ctgagccagctgc

SEQ ID NO: 4474196 - DNA, 21 bp, Homo sapiens
ctgagccccagcgggctggcg

SEQ ID NO: 4474197 - DNA, 19 bp, Homo sapiens
ctgagcccccaccggaact

SEQ ID NO: 4474198 - DNA, 18 bp, Homo sapiens
ctgagccctcctgagggc

SEQ ID NO: 4474199 - DNA, 16 bp, Homo sapiens
ctgagcgacagtgaga

SEQ ID NO: 4474200 - DNA, 14 bp, Homo sapiens
ctgagcgctcctgc

SEQ ID NO: 4474201 - DNA, 13 bp, Homo sapiens
ctgagctatttca

SEQ ID NO: 4474202 - DNA, 16 bp, Homo sapiens
ctgagctatttcatct

SEQ ID NO: 4474203 - DNA, 18 bp, Homo sapiens
ctgagctattttcctctg

SEQ ID NO: 4474204 - DNA, 22 bp, Homo sapiens
ctgagctattttcctctggccg

SEQ ID NO: 4474205 - DNA, 24 bp, Homo sapiens
ctgagctattttcctctggccgca

SEQ ID NO: 4474206 - DNA, 20 bp, Homo sapiens
ctgagctcacatgggactgg

SEQ ID NO: 4474207 - DNA, 15 bp, Homo sapiens
ctgagctgaggcagc

SEQ ID NO: 4474208 - DNA, 13 bp, Homo sapiens
ctgagctgtgacc

SEQ ID NO: 4474209 - DNA, 21 bp, Homo sapiens
ctgagcttttgagtgttccca

SEQ ID NO: 4474210 - DNA, 22 bp, Homo sapiens
ctgagcttttgatgccaggtgc

SEQ ID NO: 4474211 - DNA, 23 bp, Homo sapiens
ctgagcttttgatgccaggtgca

SEQ ID NO: 4474212 - DNA, 21 bp, Homo sapiens
ctgaggaaattgctttgtatt

SEQ ID NO: 4474213 - DNA, 19 bp, Homo sapiens
ctgaggacctttctgagga

SEQ ID NO: 4474214 - DNA, 22 bp, Homo sapiens
ctgaggactgatttcagagtga

SEQ ID NO: 4474215 - DNA, 14 bp, Homo sapiens
ctgaggaggcctcc

SEQ ID NO: 4474216 - DNA, 15 bp, Homo sapiens
ctgaggaggcctcca

SEQ ID NO: 4474217 - DNA, 15 bp, Homo sapiens
ctgaggcagcagtgt

SEQ ID NO: 4474218 - DNA, 23 bp, Homo sapiens
ctgaggcagcagtgtgaggccag

SEQ ID NO: 4474219 - DNA, 24 bp, Homo sapiens
ctgaggcagcagtgtgaggccagg

SEQ ID NO: 4474220 - DNA, 20 bp, Homo sapiens
ctgaggcaggaggatcactt

SEQ ID NO: 4474221 - DNA, 21 bp, Homo sapiens
ctgaggccaggacgtctgggg

SEQ ID NO: 4474222 - DNA, 17 bp, Homo sapiens
ctgaggccctgggctgg

SEQ ID NO: 4474223 - DNA, 21 bp, Homo sapiens
ctgaggccctgggctgggtgc

SEQ ID NO: 4474224 - DNA, 15 bp, Homo sapiens
ctgaggcctccaagg

SEQ ID NO: 4474225 - DNA, 17 bp, Homo sapiens
ctgaggcctgagcgctc

SEQ ID NO: 4474226 - DNA, 15 bp, Homo sapiens
ctgaggcggaggctg

SEQ ID NO: 4474227 - DNA, 12 bp, Homo sapiens
ctgaggctgagg

SEQ ID NO: 4474228 - DNA, 14 bp, Homo sapiens
ctgaggctgaggca

SEQ ID NO: 4474229 - DNA, 18 bp, Homo sapiens
ctgaggctttggatttga

SEQ ID NO: 4474230 - DNA, 21 bp, Homo sapiens
ctgagggaccaactgggccca

SEQ ID NO: 4474231 - DNA, 16 bp, Homo sapiens
ctgagggactctgaag

SEQ ID NO: 4474232 - DNA, 20 bp, Homo sapiens
ctgagggactctgaagcctc

SEQ ID NO: 4474233 - DNA, 22 bp, Homo sapiens
ctgagggactctgaagcctctg

SEQ ID NO: 4474234 - DNA, 13 bp, Homo sapiens
ctgagggagcctg

SEQ ID NO: 4474235 - DNA, 18 bp, Homo sapiens
ctgagggattgaggggcc

SEQ ID NO: 4474236 - DNA, 23 bp, Homo sapiens
ctgagggattgaggggccctggc

SEQ ID NO: 4474237 - DNA, 16 bp, Homo sapiens
ctgagggcagtcgata

SEQ ID NO: 4474238 - DNA, 18 bp, Homo sapiens
ctgagggctaattctggg

SEQ ID NO: 4474239 - DNA, 14 bp, Homo sapiens
ctgagggctctgtt

SEQ ID NO: 4474240 - DNA, 15 bp, Homo sapiens
ctgagggctctgttt

SEQ ID NO: 4474241 - DNA, 16 bp, Homo sapiens
ctgagggctctgtttg

SEQ ID NO: 4474242 - DNA, 20 bp, Homo sapiens
ctgaggtccttatgtcctgt

SEQ ID NO: 4474243 - DNA, 17 bp, Homo sapiens
ctgaggtcgggagttcg

SEQ ID NO: 4474244 - DNA, 17 bp, Homo sapiens
ctgaggtgaaagggagc

SEQ ID NO: 4474245 - DNA, 18 bp, Homo sapiens
ctgaggtgaacaaggtaa

SEQ ID NO: 4474246 - DNA, 15 bp, Homo sapiens
ctgaggttcctctgc

SEQ ID NO: 4474247 - DNA, 16 bp, Homo sapiens
ctgaggttcctctgcc

SEQ ID NO: 4474248 - DNA, 21 bp, Homo sapiens
ctgaggttcctctgcctgccc

SEQ ID NO: 4474249 - DNA, 17 bp, Homo sapiens
ctgagtactctttctct

SEQ ID NO: 4474250 - DNA, 13 bp, Homo sapiens
ctgagtagtggcc

SEQ ID NO: 4474251 - DNA, 14 bp, Homo sapiens
ctgagtagtggcca

SEQ ID NO: 4474252 - DNA, 23 bp, Homo sapiens
ctgagtagtggccactggggtgc

SEQ ID NO: 4474253 - DNA, 15 bp, Homo sapiens
ctgagtcaccaggaa

SEQ ID NO: 4474254 - DNA, 21 bp, Homo sapiens
ctgagtcatgatctccctgcc

SEQ ID NO: 4474255 - DNA, 12 bp, Homo sapiens
ctgagtccagaa

SEQ ID NO: 4474256 - DNA, 14 bp, Homo sapiens
ctgagtccagaatg

SEQ ID NO: 4474257 - DNA, 13 bp, Homo sapiens
ctgagtccagctc

SEQ ID NO: 4474258 - DNA, 16 bp, Homo sapiens
ctgagtccagctcccc

SEQ ID NO: 4474259 - DNA, 16 bp, Homo sapiens
ctgagtccgggaggca

SEQ ID NO: 4474260 - DNA, 22 bp, Homo sapiens
ctgagtcctttccaggggccaa

SEQ ID NO: 4474261 - DNA, 17 bp, Homo sapiens
ctgagtcgtacagaaag

SEQ ID NO: 4474262 - DNA, 20 bp, Homo sapiens
ctgagtcgtacagaaagctg

SEQ ID NO: 4474263 - DNA, 14 bp, Homo sapiens
ctgagtgacagctt

SEQ ID NO: 4474264 - DNA, 18 bp, Homo sapiens
ctgagtgccttctgtggg

SEQ ID NO: 4474265 - DNA, 20 bp, Homo sapiens
ctgagtgccttctgtgggga

SEQ ID NO: 4474266 - DNA, 21 bp, Homo sapiens
ctgagtgccttctgtggggac

SEQ ID NO: 4474267 - DNA, 13 bp, Homo sapiens
ctgagtgggaagc

SEQ ID NO: 4474268 - DNA, 17 bp, Homo sapiens
ctgagttatcaggtgca

SEQ ID NO: 4474269 - DNA, 18 bp, Homo sapiens
ctgagttcccgggagctg

SEQ ID NO: 4474270 - DNA, 19 bp, Homo sapiens
ctgagttcccgggagctgg

SEQ ID NO: 4474271 - DNA, 22 bp, Homo sapiens
ctgagttcccgggagctgggcc

SEQ ID NO: 4474272 - DNA, 21 bp, Homo sapiens
ctgagttctgtgtattttcag

SEQ ID NO: 4474273 - DNA, 14 bp, Homo sapiens
ctgagttgcacata

SEQ ID NO: 4474274 - DNA, 13 bp, Homo sapiens
ctgagttggcctg

SEQ ID NO: 4474275 - DNA, 23 bp, Homo sapiens
ctgagttggcctggccatttcca

SEQ ID NO: 4474276 - DNA, 17 bp, Homo sapiens
ctgataacaacctggag

SEQ ID NO: 4474277 - DNA, 18 bp, Homo sapiens
ctgataacaacctggaga

SEQ ID NO: 4474278 - DNA, 19 bp, Homo sapiens
ctgataagagaatcaacat

SEQ ID NO: 4474279 - DNA, 18 bp, Homo sapiens
ctgataattttaaattct

SEQ ID NO: 4474280 - DNA, 20 bp, Homo sapiens
ctgatacacagtaattgtga

SEQ ID NO: 4474281 - DNA, 23 bp, Homo sapiens
ctgatactttagtacaatttcaa

SEQ ID NO: 4474282 - DNA, 21 bp, Homo sapiens
ctgatccagtaacctcggaga

SEQ ID NO: 4474283 - DNA, 16 bp, Homo sapiens
ctgatcctaagaattt

SEQ ID NO: 4474284 - DNA, 20 bp, Homo sapiens
ctgatcctaagaatttttca

SEQ ID NO: 4474285 - DNA, 22 bp, Homo sapiens
ctgatctcgtttactccatgtt

SEQ ID NO: 4474286 - DNA, 19 bp, Homo sapiens
ctgatctctgctccctgca

SEQ ID NO: 4474287 - DNA, 13 bp, Homo sapiens
ctgatctgtactt

SEQ ID NO: 4474288 - DNA, 16 bp, Homo sapiens
ctgatctgtactttgt

SEQ ID NO: 4474289 - DNA, 15 bp, Homo sapiens
ctgatcttacagaaa

SEQ ID NO: 4474290 - DNA, 20 bp, Homo sapiens
ctgatcttggaaaaacagcg

SEQ ID NO: 4474291 - DNA, 19 bp, Homo sapiens
ctgatgacgggatgctctt

SEQ ID NO: 4474292 - DNA, 12 bp, Homo sapiens
ctgatgagcaca

SEQ ID NO: 4474293 - DNA, 17 bp, Homo sapiens
ctgatgattttcctttt

SEQ ID NO: 4474294 - DNA, 16 bp, Homo sapiens
ctgatgcagccgtcca

SEQ ID NO: 4474295 - DNA, 12 bp, Homo sapiens
ctgatgctccct

SEQ ID NO: 4474296 - DNA, 15 bp, Homo sapiens
ctgatgctccctccc

SEQ ID NO: 4474297 - DNA, 19 bp, Homo sapiens
ctgatgctccctcccctgc

SEQ ID NO: 4474298 - DNA, 14 bp, Homo sapiens
ctgatgctgggacc

SEQ ID NO: 4474299 - DNA, 15 bp, Homo sapiens
ctgatgctggggaca

SEQ ID NO: 4474300 - DNA, 21 bp, Homo sapiens
ctgatggaaaataccagtgtt

SEQ ID NO: 4474301 - DNA, 21 bp, Homo sapiens
ctgatggaactgtgtatttat

SEQ ID NO: 4474302 - DNA, 14 bp, Homo sapiens
ctgatggacaagga

SEQ ID NO: 4474303 - DNA, 15 bp, Homo sapiens
ctgatggattccaaa

SEQ ID NO: 4474304 - DNA, 23 bp, Homo sapiens
ctgatggattccaaaccaggaca

SEQ ID NO: 4474305 - DNA, 14 bp, Homo sapiens
ctgatggcctttgg

SEQ ID NO: 4474306 - DNA, 16 bp, Homo sapiens
ctgatggcctttggac

SEQ ID NO: 4474307 - DNA, 23 bp, Homo sapiens
ctgatggcctttggacccagggc

SEQ ID NO: 4474308 - DNA, 20 bp, Homo sapiens
ctgatgtacaattaaaaacc

SEQ ID NO: 4474309 - DNA, 17 bp, Homo sapiens
ctgatgtcccagtgctc

SEQ ID NO: 4474310 - DNA, 15 bp, Homo sapiens
ctgatgtgtgaagtg

SEQ ID NO: 4474311 - DNA, 18 bp, Homo sapiens
ctgatgttcctagtgaaa

SEQ ID NO: 4474312 - DNA, 20 bp, Homo sapiens
ctgattaatccattttaaca

SEQ ID NO: 4474313 - DNA, 16 bp, Homo sapiens
ctgattacctgccaat

SEQ ID NO: 4474314 - DNA, 20 bp, Homo sapiens
ctgattataccatgtgtgct

SEQ ID NO: 4474315 - DNA, 15 bp, Homo sapiens
ctgattatgaaatgt

SEQ ID NO: 4474316 - DNA, 12 bp, Homo sapiens
ctgattatttat

SEQ ID NO: 4474317 - DNA, 14 bp, Homo sapiens
ctgattattttagc

SEQ ID NO: 4474318 - DNA, 12 bp, Homo sapiens
ctgattggccac

SEQ ID NO: 4474319 - DNA, 15 bp, Homo sapiens
ctgattggccactgg

SEQ ID NO: 4474320 - DNA, 15 bp, Homo sapiens
ctgatttaacacttt

SEQ ID NO: 4474321 - DNA, 14 bp, Homo sapiens
ctgatttattttgt

SEQ ID NO: 4474322 - DNA, 17 bp, Homo sapiens
ctgatttattttgtatg

SEQ ID NO: 4474323 - DNA, 22 bp, Homo sapiens
ctgatttctatggctttcaaag

SEQ ID NO: 4474324 - DNA, 13 bp, Homo sapiens
ctgatttctgaag

SEQ ID NO: 4474325 - DNA, 19 bp, Homo sapiens
ctgatttgggctgaatgta

SEQ ID NO: 4474326 - DNA, 20 bp, Homo sapiens
ctgatttgggctgaatgtat

SEQ ID NO: 4474327 - DNA, 23 bp, Homo sapiens
ctgatttgggctgaatgtatgta

SEQ ID NO: 4474328 - DNA, 14 bp, Homo sapiens
ctgattttaatgga

SEQ ID NO: 4474329 - DNA, 14 bp, Homo sapiens
ctgatttttaagat

SEQ ID NO: 4474330 - DNA, 23 bp, Homo sapiens
ctgcaaaaaatactttttctaat

SEQ ID NO: 4474331 - DNA, 18 bp, Homo sapiens
ctgcaaaactccaggcag

SEQ ID NO: 4474332 - DNA, 20 bp, Homo sapiens
ctgcaaaactccaggcagga

SEQ ID NO: 4474333 - DNA, 15 bp, Homo sapiens
ctgcaaaaggcctct

SEQ ID NO: 4474334 - DNA, 19 bp, Homo sapiens
ctgcaaaaggcctcttgta

SEQ ID NO: 4474335 - DNA, 15 bp, Homo sapiens
ctgcaaaccttcctg

SEQ ID NO: 4474336 - DNA, 17 bp, Homo sapiens
ctgcaaaccttcctggg

SEQ ID NO: 4474337 - DNA, 20 bp, Homo sapiens
ctgcaaagtgttttgtacca

SEQ ID NO: 4474338 - DNA, 15 bp, Homo sapiens
ctgcaaatcaggctt

SEQ ID NO: 4474339 - DNA, 21 bp, Homo sapiens
ctgcaaatttagtttgttaaa

SEQ ID NO: 4474340 - DNA, 22 bp, Homo sapiens
ctgcaaatttagtttgttaaag

SEQ ID NO: 4474341 - DNA, 15 bp, Homo sapiens
ctgcaacaaaatgta

SEQ ID NO: 4474342 - DNA, 19 bp, Homo sapiens
ctgcaacctcacctcccgg

SEQ ID NO: 4474343 - DNA, 15 bp, Homo sapiens
ctgcaacctctgcct

SEQ ID NO: 4474344 - DNA, 23 bp, Homo sapiens
ctgcaactccatcctcctgtgtc

SEQ ID NO: 4474345 - DNA, 18 bp, Homo sapiens
ctgcaacttccgctgagg

SEQ ID NO: 4474346 - DNA, 13 bp, Homo sapiens
ctgcaagagcctt

SEQ ID NO: 4474347 - DNA, 19 bp, Homo sapiens
ctgcaagagccttggtgtc

SEQ ID NO: 4474348 - DNA, 16 bp, Homo sapiens
ctgcaagagggggggc

SEQ ID NO: 4474349 - DNA, 14 bp, Homo sapiens
ctgcaagatttcac

SEQ ID NO: 4474350 - DNA, 15 bp, Homo sapiens
ctgcaagatttcaca

SEQ ID NO: 4474351 - DNA, 14 bp, Homo sapiens
ctgcaagcacagcc

SEQ ID NO: 4474352 - DNA, 17 bp, Homo sapiens
ctgcaagcacagccctt

SEQ ID NO: 4474353 - DNA, 17 bp, Homo sapiens
ctgcaaggtactctggt

SEQ ID NO: 4474354 - DNA, 22 bp, Homo sapiens
ctgcaagtgaggtgtgtcacaa

SEQ ID NO: 4474355 - DNA, 19 bp, Homo sapiens
ctgcaagttgctctgacct

SEQ ID NO: 4474356 - DNA, 20 bp, Homo sapiens
ctgcaagttgctctgacctc

SEQ ID NO: 4474357 - DNA, 17 bp, Homo sapiens
ctgcaatacattaaaat

SEQ ID NO: 4474358 - DNA, 12 bp, Homo sapiens
ctgcaattttac

SEQ ID NO: 4474359 - DNA, 13 bp, Homo sapiens
ctgcaattttact

SEQ ID NO: 4474360 - DNA, 20 bp, Homo sapiens
ctgcaattttactgtgaaaa

SEQ ID NO: 4474361 - DNA, 18 bp, Homo sapiens
ctgcacaataaaaatgtt

SEQ ID NO: 4474362 - DNA, 22 bp, Homo sapiens
ctgcacaccagagacaagcaga

SEQ ID NO: 4474363 - DNA, 21 bp, Homo sapiens
ctgcacaccttgaatctgcct

SEQ ID NO: 4474364 - DNA, 16 bp, Homo sapiens
ctgcacactatttccc

SEQ ID NO: 4474365 - DNA, 19 bp, Homo sapiens
ctgcacagcaggctgccag

SEQ ID NO: 4474366 - DNA, 20 bp, Homo sapiens
ctgcacaggcacacagggcc

SEQ ID NO: 4474367 - DNA, 22 bp, Homo sapiens
ctgcacaggcacacagggcccg

SEQ ID NO: 4474368 - DNA, 22 bp, Homo sapiens
ctgcacagggcagctgggccca

SEQ ID NO: 4474369 - DNA, 13 bp, Homo sapiens
ctgcacagtcaga

SEQ ID NO: 4474370 - DNA, 18 bp, Homo sapiens
ctgcacagtcagaaggac

SEQ ID NO: 4474371 - DNA, 23 bp, Homo sapiens
ctgcacagtcagaaggacggcag

SEQ ID NO: 4474372 - DNA, 15 bp, Homo sapiens
ctgcacagtttagaa

SEQ ID NO: 4474373 - DNA, 16 bp, Homo sapiens
ctgcacagtttagaac

SEQ ID NO: 4474374 - DNA, 18 bp, Homo sapiens
ctgcacatggcctgagca

SEQ ID NO: 4474375 - DNA, 17 bp, Homo sapiens
ctgcaccacacctggca

SEQ ID NO: 4474376 - DNA, 23 bp, Homo sapiens
ctgcaccccagcattccagctct

SEQ ID NO: 4474377 - DNA, 19 bp, Homo sapiens
ctgcaccccttctctcctc

SEQ ID NO: 4474378 - DNA, 17 bp, Homo sapiens
ctgcacccgcctcgacc

SEQ ID NO: 4474379 - DNA, 18 bp, Homo sapiens
ctgcacccttccacagct

SEQ ID NO: 4474380 - DNA, 21 bp, Homo sapiens
ctgcacccttccacagctggc

SEQ ID NO: 4474381 - DNA, 14 bp, Homo sapiens
ctgcaccggggcct

SEQ ID NO: 4474382 - DNA, 16 bp, Homo sapiens
ctgcaccggggcctgg

SEQ ID NO: 4474383 - DNA, 21 bp, Homo sapiens
ctgcacctccccccactgcag

SEQ ID NO: 4474384 - DNA, 15 bp, Homo sapiens
ctgcacctcctaccc

SEQ ID NO: 4474385 - DNA, 19 bp, Homo sapiens
ctgcacctcctaccctccc

SEQ ID NO: 4474386 - DNA, 13 bp, Homo sapiens
ctgcaccttagaa

SEQ ID NO: 4474387 - DNA, 18 bp, Homo sapiens
ctgcaccttagaaaaaaa

SEQ ID NO: 4474388 - DNA, 15 bp, Homo sapiens
ctgcacgacccctga

SEQ ID NO: 4474389 - DNA, 18 bp, Homo sapiens
ctgcacggtgggccttgc

SEQ ID NO: 4474390 - DNA, 12 bp, Homo sapiens
ctgcacgtcatg

SEQ ID NO: 4474391 - DNA, 16 bp, Homo sapiens
ctgcactactcctctg

SEQ ID NO: 4474392 - DNA, 18 bp, Homo sapiens
ctgcactactcctctgca

SEQ ID NO: 4474393 - DNA, 15 bp, Homo sapiens
ctgcactcagaaaat

SEQ ID NO: 4474394 - DNA, 12 bp, Homo sapiens
ctgcactccagc

SEQ ID NO: 4474395 - DNA, 14 bp, Homo sapiens
ctgcactccagcct

SEQ ID NO: 4474396 - DNA, 17 bp, Homo sapiens
ctgcactccagcctgag

SEQ ID NO: 4474397 - DNA, 20 bp, Homo sapiens
ctgcactccagcctgagcga

SEQ ID NO: 4474398 - DNA, 20 bp, Homo sapiens
ctgcactccagcctgagtga

SEQ ID NO: 4474399 - DNA, 20 bp, Homo sapiens
ctgcactccagcctggggga

SEQ ID NO: 4474400 - DNA, 19 bp, Homo sapiens
ctgcactcccacctgacac

SEQ ID NO: 4474401 - DNA, 12 bp, Homo sapiens
ctgcactgtgaa

SEQ ID NO: 4474402 - DNA, 21 bp, Homo sapiens
ctgcactgtgtcatcttttca

SEQ ID NO: 4474403 - DNA, 14 bp, Homo sapiens
ctgcactttgatgt

SEQ ID NO: 4474404 - DNA, 17 bp, Homo sapiens
ctgcactttgatgtcat

SEQ ID NO: 4474405 - DNA, 12 bp, Homo sapiens
ctgcagaaccca

SEQ ID NO: 4474406 - DNA, 13 bp, Homo sapiens
ctgcagaacccac

SEQ ID NO: 4474407 - DNA, 23 bp, Homo sapiens
ctgcagaacgtattggtccagct

SEQ ID NO: 4474408 - DNA, 13 bp, Homo sapiens
ctgcagaagacag

SEQ ID NO: 4474409 - DNA, 19 bp, Homo sapiens
ctgcagacacctggactga

SEQ ID NO: 4474410 - DNA, 17 bp, Homo sapiens
ctgcagaccatccagag

SEQ ID NO: 4474411 - DNA, 15 bp, Homo sapiens
ctgcagaccccaggt

SEQ ID NO: 4474412 - DNA, 13 bp, Homo sapiens
ctgcagacctcaa

SEQ ID NO: 4474413 - DNA, 17 bp, Homo sapiens
ctgcagacctcaagcca

SEQ ID NO: 4474414 - DNA, 18 bp, Homo sapiens
ctgcagacctcaagccat

SEQ ID NO: 4474415 - DNA, 19 bp, Homo sapiens
ctgcagacctcaagccatc

SEQ ID NO: 4474416 - DNA, 11 bp, Homo sapiens
ctgcagacctg

SEQ ID NO: 4474417 - DNA, 16 bp, Homo sapiens
ctgcagagctgaccca

SEQ ID NO: 4474418 - DNA, 21 bp, Homo sapiens
ctgcagaggggaaagacttcc

SEQ ID NO: 4474419 - DNA, 20 bp, Homo sapiens
ctgcagattagttctttttg

SEQ ID NO: 4474420 - DNA, 16 bp, Homo sapiens
ctgcagattctgagca

SEQ ID NO: 4474421 - DNA, 13 bp, Homo sapiens
ctgcagcaactcc

SEQ ID NO: 4474422 - DNA, 17 bp, Homo sapiens
ctgcagcaactcccacg

SEQ ID NO: 4474423 - DNA, 18 bp, Homo sapiens
ctgcagcaactcccacga

SEQ ID NO: 4474424 - DNA, 20 bp, Homo sapiens
ctgcagcagtcgcccaagca

SEQ ID NO: 4474425 - DNA, 21 bp, Homo sapiens
ctgcagcagtcgcccaagcag

SEQ ID NO: 4474426 - DNA, 23 bp, Homo sapiens
ctgcagccagcccagcccagctg

SEQ ID NO: 4474427 - DNA, 14 bp, Homo sapiens
ctgcagccagggct

SEQ ID NO: 4474428 - DNA, 23 bp, Homo sapiens
ctgcagcctcatactcctgggct

SEQ ID NO: 4474429 - DNA, 20 bp, Homo sapiens
ctgcagctatgcgcaatgtg

SEQ ID NO: 4474430 - DNA, 21 bp, Homo sapiens
ctgcagctatgcgcaatgtgg

SEQ ID NO: 4474431 - DNA, 17 bp, Homo sapiens
ctgcagctccctggctt

SEQ ID NO: 4474432 - DNA, 17 bp, Homo sapiens
ctgcagctgagcctgag

SEQ ID NO: 4474433 - DNA, 19 bp, Homo sapiens
ctgcagctggaatgtgcca

SEQ ID NO: 4474434 - DNA, 22 bp, Homo sapiens
ctgcagctggaatgtgccacag

SEQ ID NO: 4474435 - DNA, 23 bp, Homo sapiens
ctgcagctggaatgtgccacaga

SEQ ID NO: 4474436 - DNA, 24 bp, Homo sapiens
ctgcagctggaatgtgccacagag

SEQ ID NO: 4474437 - DNA, 21 bp, Homo sapiens
ctgcaggaatcacccctctgc

SEQ ID NO: 4474438 - DNA, 22 bp, Homo sapiens
ctgcaggagagagcagcactcc

SEQ ID NO: 4474439 - DNA, 17 bp, Homo sapiens
ctgcaggagtgtcctgc

SEQ ID NO: 4474440 - DNA, 20 bp, Homo sapiens
ctgcaggagtgtcctgccca

SEQ ID NO: 4474441 - DNA, 14 bp, Homo sapiens
ctgcaggcagagct

SEQ ID NO: 4474442 - DNA, 16 bp, Homo sapiens
ctgcaggcagagctgg

SEQ ID NO: 4474443 - DNA, 15 bp, Homo sapiens
ctgcaggcaggaaca

SEQ ID NO: 4474444 - DNA, 11 bp, Homo sapiens
ctgcaggcccc

SEQ ID NO: 4474445 - DNA, 23 bp, Homo sapiens
ctgcaggccccgcttgtccagcg

SEQ ID NO: 4474446 - DNA, 20 bp, Homo sapiens
ctgcagggagccttctgcca

SEQ ID NO: 4474447 - DNA, 15 bp, Homo sapiens
ctgcaggtcagttgt

SEQ ID NO: 4474448 - DNA, 16 bp, Homo sapiens
ctgcagtctcatttct

SEQ ID NO: 4474449 - DNA, 19 bp, Homo sapiens
ctgcagtctcatttctcat

SEQ ID NO: 4474450 - DNA, 14 bp, Homo sapiens
ctgcagtggcctga

SEQ ID NO: 4474451 - DNA, 21 bp, Homo sapiens
ctgcagtggcctgatctctgc

SEQ ID NO: 4474452 - DNA, 15 bp, Homo sapiens
ctgcagttacttttg

SEQ ID NO: 4474453 - DNA, 23 bp, Homo sapiens
ctgcagtttcttgtgtagatttg

SEQ ID NO: 4474454 - DNA, 14 bp, Homo sapiens
ctgcagtttttaat

SEQ ID NO: 4474455 - DNA, 17 bp, Homo sapiens
ctgcagtttttaatttg

SEQ ID NO: 4474456 - DNA, 22 bp, Homo sapiens
ctgcataatgtttctggatttc

SEQ ID NO: 4474457 - DNA, 16 bp, Homo sapiens
ctgcatacaggggagg

SEQ ID NO: 4474458 - DNA, 14 bp, Homo sapiens
ctgcatacttttta

SEQ ID NO: 4474459 - DNA, 17 bp, Homo sapiens
ctgcatagacaaaggcc

SEQ ID NO: 4474460 - DNA, 22 bp, Homo sapiens
ctgcatatgttttccacataaa

SEQ ID NO: 4474461 - DNA, 23 bp, Homo sapiens
ctgcatatgttttccacataaat

SEQ ID NO: 4474462 - DNA, 20 bp, Homo sapiens
ctgcatcagctgctgaaaca

SEQ ID NO: 4474463 - DNA, 12 bp, Homo sapiens
ctgcatcatctt

SEQ ID NO: 4474464 - DNA, 22 bp, Homo sapiens
ctgcatccagagattcattttc

SEQ ID NO: 4474465 - DNA, 19 bp, Homo sapiens
ctgcatcctggcttgaaaa

SEQ ID NO: 4474466 - DNA, 22 bp, Homo sapiens
ctgcatgacctaccaggacaga

SEQ ID NO: 4474467 - DNA, 18 bp, Homo sapiens
ctgcatgcggcccagccc

SEQ ID NO: 4474468 - DNA, 22 bp, Homo sapiens
ctgcatgggaaatagcggccct

SEQ ID NO: 4474469 - DNA, 16 bp, Homo sapiens
ctgcatggtaatttat

SEQ ID NO: 4474470 - DNA, 19 bp, Homo sapiens
ctgcattactccttcagct

SEQ ID NO: 4474471 - DNA, 20 bp, Homo sapiens
ctgcattcaccttagtgcaa

SEQ ID NO: 4474472 - DNA, 19 bp, Homo sapiens
ctgcattgagcatattttc

SEQ ID NO: 4474473 - DNA, 12 bp, Homo sapiens
ctgccaaaataa

SEQ ID NO: 4474474 - DNA, 13 bp, Homo sapiens
ctgccaaaataaa

SEQ ID NO: 4474475 - DNA, 18 bp, Homo sapiens
ctgccaaacctcctgtca

SEQ ID NO: 4474476 - DNA, 20 bp, Homo sapiens
ctgccaaacctcctgtcagt

SEQ ID NO: 4474477 - DNA, 23 bp, Homo sapiens
ctgccaaagtaaaacaatacatc

SEQ ID NO: 4474478 - DNA, 15 bp, Homo sapiens
ctgccaaggccagag

SEQ ID NO: 4474479 - DNA, 22 bp, Homo sapiens
ctgccaaggccagagtggcctg

SEQ ID NO: 4474480 - DNA, 13 bp, Homo sapiens
ctgccacacccag

SEQ ID NO: 4474481 - DNA, 16 bp, Homo sapiens
ctgccacacctgagcc

SEQ ID NO: 4474482 - DNA, 18 bp, Homo sapiens
ctgccacacggaagcaag

SEQ ID NO: 4474483 - DNA, 16 bp, Homo sapiens
ctgccacagccagagg

SEQ ID NO: 4474484 - DNA, 17 bp, Homo sapiens
ctgccacagccagagga

SEQ ID NO: 4474485 - DNA, 23 bp, Homo sapiens
ctgccacatggagccccctctgc

SEQ ID NO: 4474486 - DNA, 17 bp, Homo sapiens
ctgccaccagcccctcc

SEQ ID NO: 4474487 - DNA, 12 bp, Homo sapiens
ctgccaccccta

SEQ ID NO: 4474488 - DNA, 18 bp, Homo sapiens
ctgccacccgcccacccg

SEQ ID NO: 4474489 - DNA, 11 bp, Homo sapiens
ctgccacctcc

SEQ ID NO: 4474490 - DNA, 14 bp, Homo sapiens
ctgccacctcccct

SEQ ID NO: 4474491 - DNA, 15 bp, Homo sapiens
ctgccaccttgtggc

SEQ ID NO: 4474492 - DNA, 12 bp, Homo sapiens
ctgccactctgc

SEQ ID NO: 4474493 - DNA, 23 bp, Homo sapiens
ctgccagaagatcccctcaggac

SEQ ID NO: 4474494 - DNA, 20 bp, Homo sapiens
ctgccagcatttcccttcct

SEQ ID NO: 4474495 - DNA, 14 bp, Homo sapiens
ctgccagccactgt

SEQ ID NO: 4474496 - DNA, 15 bp, Homo sapiens
ctgccagccactgtc

SEQ ID NO: 4474497 - DNA, 21 bp, Homo sapiens
ctgccagccttgagccctggc

SEQ ID NO: 4474498 - DNA, 19 bp, Homo sapiens
ctgccagctctcaggaccg

SEQ ID NO: 4474499 - DNA, 17 bp, Homo sapiens
ctgccagctctgtatca

SEQ ID NO: 4474500 - DNA, 11 bp, Homo sapiens
ctgccaggaga

SEQ ID NO: 4474501 - DNA, 20 bp, Homo sapiens
ctgccaggcacacacagccc

SEQ ID NO: 4474502 - DNA, 22 bp, Homo sapiens
ctgccaggcacacacagcccct

SEQ ID NO: 4474503 - DNA, 15 bp, Homo sapiens
ctgccaggcaggggt

SEQ ID NO: 4474504 - DNA, 14 bp, Homo sapiens
ctgccaggctgcct

SEQ ID NO: 4474505 - DNA, 14 bp, Homo sapiens
ctgccaggctgttt

SEQ ID NO: 4474506 - DNA, 15 bp, Homo sapiens
ctgccaggctgtttc

SEQ ID NO: 4474507 - DNA, 12 bp, Homo sapiens
ctgccagggagc

SEQ ID NO: 4474508 - DNA, 11 bp, Homo sapiens
ctgccagggca

SEQ ID NO: 4474509 - DNA, 17 bp, Homo sapiens
ctgccagtcctagctgc

SEQ ID NO: 4474510 - DNA, 19 bp, Homo sapiens
ctgccagtgaagtccttca

SEQ ID NO: 4474511 - DNA, 20 bp, Homo sapiens
ctgccagtgaagtccttcag

SEQ ID NO: 4474512 - DNA, 18 bp, Homo sapiens
ctgccagtgcagccactg

SEQ ID NO: 4474513 - DNA, 18 bp, Homo sapiens
ctgccagtgccttacctc

SEQ ID NO: 4474514 - DNA, 21 bp, Homo sapiens
ctgccagtgccttacctcctg

SEQ ID NO: 4474515 - DNA, 22 bp, Homo sapiens
ctgccagtgccttacctcctgc

SEQ ID NO: 4474516 - DNA, 23 bp, Homo sapiens
ctgccagtgccttacctcctgcc

SEQ ID NO: 4474517 - DNA, 13 bp, Homo sapiens
ctgccatcctggc

SEQ ID NO: 4474518 - DNA, 19 bp, Homo sapiens
ctgccatcctggcccaggg

SEQ ID NO: 4474519 - DNA, 20 bp, Homo sapiens
ctgccatcctggcccagggc

SEQ ID NO: 4474520 - DNA, 16 bp, Homo sapiens
ctgccatgacagaggc

SEQ ID NO: 4474521 - DNA, 20 bp, Homo sapiens
ctgccatgacagaggctgca

SEQ ID NO: 4474522 - DNA, 17 bp, Homo sapiens
ctgccatgccaggaacc

SEQ ID NO: 4474523 - DNA, 22 bp, Homo sapiens
ctgccatgccaggaacctgtcc

SEQ ID NO: 4474524 - DNA, 15 bp, Homo sapiens
ctgccattacccagt

SEQ ID NO: 4474525 - DNA, 17 bp, Homo sapiens
ctgccattcacttcata

SEQ ID NO: 4474526 - DNA, 15 bp, Homo sapiens
ctgccattctgtgca

SEQ ID NO: 4474527 - DNA, 17 bp, Homo sapiens
ctgccattctgtgcagg

SEQ ID NO: 4474528 - DNA, 16 bp, Homo sapiens
ctgccattcttctggt

SEQ ID NO: 4474529 - DNA, 23 bp, Homo sapiens
ctgccattgggaccctccagtgc

SEQ ID NO: 4474530 - DNA, 12 bp, Homo sapiens
ctgcccaaaatg

SEQ ID NO: 4474531 - DNA, 23 bp, Homo sapiens
ctgcccaaacagctgtatttata

SEQ ID NO: 4474532 - DNA, 14 bp, Homo sapiens
ctgcccaaaccctt

SEQ ID NO: 4474533 - DNA, 20 bp, Homo sapiens
ctgcccaaacccttaactga

SEQ ID NO: 4474534 - DNA, 20 bp, Homo sapiens
ctgcccaaggcctaccccag

SEQ ID NO: 4474535 - DNA, 21 bp, Homo sapiens
ctgcccactctgcaagaagaa

SEQ ID NO: 4474536 - DNA, 18 bp, Homo sapiens
ctgcccagactgatgagc

SEQ ID NO: 4474537 - DNA, 22 bp, Homo sapiens
ctgcccagactgatgagcacat

SEQ ID NO: 4474538 - DNA, 13 bp, Homo sapiens
ctgcccagagctg

SEQ ID NO: 4474539 - DNA, 20 bp, Homo sapiens
ctgcccagccctggcccagg

SEQ ID NO: 4474540 - DNA, 17 bp, Homo sapiens
ctgcccagcctgctctc

SEQ ID NO: 4474541 - DNA, 23 bp, Homo sapiens
ctgcccaggagagccagccctcc

SEQ ID NO: 4474542 - DNA, 15 bp, Homo sapiens
ctgcccatcacaggg

SEQ ID NO: 4474543 - DNA, 18 bp, Homo sapiens
ctgcccatcacagggttg

SEQ ID NO: 4474544 - DNA, 22 bp, Homo sapiens
ctgcccatgtgtcccctcactc

SEQ ID NO: 4474545 - DNA, 14 bp, Homo sapiens
ctgccccaactcct

SEQ ID NO: 4474546 - DNA, 15 bp, Homo sapiens
ctgccccaatcgggt

SEQ ID NO: 4474547 - DNA, 22 bp, Homo sapiens
ctgccccaatcgggtccagaga

SEQ ID NO: 4474548 - DNA, 23 bp, Homo sapiens
ctgccccaatcgggtccagagac

SEQ ID NO: 4474549 - DNA, 22 bp, Homo sapiens
ctgccccaccccatccagccag

SEQ ID NO: 4474550 - DNA, 22 bp, Homo sapiens
ctgccccaggtacacctccccc

SEQ ID NO: 4474551 - DNA, 16 bp, Homo sapiens
ctgccccattgagatc

SEQ ID NO: 4474552 - DNA, 15 bp, Homo sapiens
ctgcccccaccccgg

SEQ ID NO: 4474553 - DNA, 14 bp, Homo sapiens
ctgcccccacccct

SEQ ID NO: 4474554 - DNA, 15 bp, Homo sapiens
ctgcccccacccctt

SEQ ID NO: 4474555 - DNA, 20 bp, Homo sapiens
ctgcccccaccccttcctgt

SEQ ID NO: 4474556 - DNA, 20 bp, Homo sapiens
ctgcccccagaaagcctcct

SEQ ID NO: 4474557 - DNA, 15 bp, Homo sapiens
ctgcccccaggactg

SEQ ID NO: 4474558 - DNA, 16 bp, Homo sapiens
ctgcccccaggactgg

SEQ ID NO: 4474559 - DNA, 18 bp, Homo sapiens
ctgcccccaggactgggc

SEQ ID NO: 4474560 - DNA, 19 bp, Homo sapiens
ctgcccccaggactgggcc

SEQ ID NO: 4474561 - DNA, 13 bp, Homo sapiens
ctgccccccgagg

SEQ ID NO: 4474562 - DNA, 19 bp, Homo sapiens
ctgccccccgaggctgcta

SEQ ID NO: 4474563 - DNA, 22 bp, Homo sapiens
ctgcccccgcgggttctagacg

SEQ ID NO: 4474564 - DNA, 23 bp, Homo sapiens
ctgcccccgctcccgctcccagg

SEQ ID NO: 4474565 - DNA, 18 bp, Homo sapiens
ctgcccccggccccctgg

SEQ ID NO: 4474566 - DNA, 16 bp, Homo sapiens
ctgccccctcccccat

SEQ ID NO: 4474567 - DNA, 14 bp, Homo sapiens
ctgccccctgccag

SEQ ID NO: 4474568 - DNA, 16 bp, Homo sapiens
ctgccccgcccccagt

SEQ ID NO: 4474569 - DNA, 18 bp, Homo sapiens
ctgccccgcccccagtcc

SEQ ID NO: 4474570 - DNA, 17 bp, Homo sapiens
ctgccccggcctcctcg

SEQ ID NO: 4474571 - DNA, 23 bp, Homo sapiens
ctgccccgtgtgtgtggccggcc

SEQ ID NO: 4474572 - DNA, 13 bp, Homo sapiens
ctgcccctccccc

SEQ ID NO: 4474573 - DNA, 14 bp, Homo sapiens
ctgcccctccccca

SEQ ID NO: 4474574 - DNA, 15 bp, Homo sapiens
ctgcccctcccccac

SEQ ID NO: 4474575 - DNA, 16 bp, Homo sapiens
ctgcccctcccccact

SEQ ID NO: 4474576 - DNA, 12 bp, Homo sapiens
ctgcccctgcag

SEQ ID NO: 4474577 - DNA, 14 bp, Homo sapiens
ctgcccctgcagct

SEQ ID NO: 4474578 - DNA, 16 bp, Homo sapiens
ctgcccctgctgtgct

SEQ ID NO: 4474579 - DNA, 12 bp, Homo sapiens
ctgcccctgtct

SEQ ID NO: 4474580 - DNA, 21 bp, Homo sapiens
ctgccccttaaacacaggctg

SEQ ID NO: 4474581 - DNA, 19 bp, Homo sapiens
ctgcccgcgggagacagct

SEQ ID NO: 4474582 - DNA, 21 bp, Homo sapiens
ctgcccggagggttcactgag

SEQ ID NO: 4474583 - DNA, 19 bp, Homo sapiens
ctgcccgggagctcaggaa

SEQ ID NO: 4474584 - DNA, 21 bp, Homo sapiens
ctgcccgtctctctcccatgg

SEQ ID NO: 4474585 - DNA, 22 bp, Homo sapiens
ctgcccgtctctctcccatgga

SEQ ID NO: 4474586 - DNA, 15 bp, Homo sapiens
ctgccctcccaagtc

SEQ ID NO: 4474587 - DNA, 20 bp, Homo sapiens
ctgccctcccaagtcccacc

SEQ ID NO: 4474588 - DNA, 18 bp, Homo sapiens
ctgccctccttgtccacc

SEQ ID NO: 4474589 - DNA, 13 bp, Homo sapiens
ctgccctctccct

SEQ ID NO: 4474590 - DNA, 17 bp, Homo sapiens
ctgccctgcacgtcatg

SEQ ID NO: 4474591 - DNA, 11 bp, Homo sapiens
ctgccctggaa

SEQ ID NO: 4474592 - DNA, 12 bp, Homo sapiens
ctgccctggaaa

SEQ ID NO: 4474593 - DNA, 16 bp, Homo sapiens
ctgccctggctgctgc

SEQ ID NO: 4474594 - DNA, 17 bp, Homo sapiens
ctgccctgtccaaaagc

SEQ ID NO: 4474595 - DNA, 22 bp, Homo sapiens
ctgccctgtgatatgtctgctg

SEQ ID NO: 4474596 - DNA, 21 bp, Homo sapiens
ctgcccttcaccccagtggcc

SEQ ID NO: 4474597 - DNA, 11 bp, Homo sapiens
ctgcccttccc

SEQ ID NO: 4474598 - DNA, 13 bp, Homo sapiens
ctgcccttccctc

SEQ ID NO: 4474599 - DNA, 16 bp, Homo sapiens
ctgcccttgcagggtg

SEQ ID NO: 4474600 - DNA, 16 bp, Homo sapiens
ctgcccttgctgcccg

SEQ ID NO: 4474601 - DNA, 17 bp, Homo sapiens
ctgcccttgctgcccgc

SEQ ID NO: 4474602 - DNA, 20 bp, Homo sapiens
ctgcccttgggtccccccga

SEQ ID NO: 4474603 - DNA, 18 bp, Homo sapiens
ctgcccttttttctgcct

SEQ ID NO: 4474604 - DNA, 20 bp, Homo sapiens
ctgccgacacgctccctccc

SEQ ID NO: 4474605 - DNA, 17 bp, Homo sapiens
ctgccgacttggagact

SEQ ID NO: 4474606 - DNA, 22 bp, Homo sapiens
ctgccgacttggagactcctgg

SEQ ID NO: 4474607 - DNA, 22 bp, Homo sapiens
ctgccgagagtccatcagcctc

SEQ ID NO: 4474608 - DNA, 13 bp, Homo sapiens
ctgccgagccacc

SEQ ID NO: 4474609 - DNA, 20 bp, Homo sapiens
ctgccgagccaccatgcttg

SEQ ID NO: 4474610 - DNA, 18 bp, Homo sapiens
ctgccgattttgtaaatg

SEQ ID NO: 4474611 - DNA, 13 bp, Homo sapiens
ctgccgcagagct

SEQ ID NO: 4474612 - DNA, 14 bp, Homo sapiens
ctgccgctgcacca

SEQ ID NO: 4474613 - DNA, 19 bp, Homo sapiens
ctgccgctgccatgctttg

SEQ ID NO: 4474614 - DNA, 18 bp, Homo sapiens
ctgccgctgccgctgcac

SEQ ID NO: 4474615 - DNA, 19 bp, Homo sapiens
ctgccgctgccgctgcacc

SEQ ID NO: 4474616 - DNA, 23 bp, Homo sapiens
ctgccggtcgggcagccagcaga

SEQ ID NO: 4474617 - DNA, 15 bp, Homo sapiens
ctgccgtaatttaac

SEQ ID NO: 4474618 - DNA, 15 bp, Homo sapiens
ctgccgtgcatggct

SEQ ID NO: 4474619 - DNA, 16 bp, Homo sapiens
ctgccgtgcatggctc

SEQ ID NO: 4474620 - DNA, 15 bp, Homo sapiens
ctgcctaagtggctg

SEQ ID NO: 4474621 - DNA, 18 bp, Homo sapiens
ctgcctaagtggctgctg

SEQ ID NO: 4474622 - DNA, 20 bp, Homo sapiens
ctgcctaagtggctgctgac

SEQ ID NO: 4474623 - DNA, 11 bp, Homo sapiens
ctgcctaataa

SEQ ID NO: 4474624 - DNA, 14 bp, Homo sapiens
ctgcctactcacga

SEQ ID NO: 4474625 - DNA, 17 bp, Homo sapiens
ctgcctagtgggagtta

SEQ ID NO: 4474626 - DNA, 24 bp, Homo sapiens
ctgcctcaatgtgaatcagaccct

SEQ ID NO: 4474627 - DNA, 23 bp, Homo sapiens
ctgcctcacttcctacaagagca

SEQ ID NO: 4474628 - DNA, 19 bp, Homo sapiens
ctgcctcagacgttgcctg

SEQ ID NO: 4474629 - DNA, 15 bp, Homo sapiens
ctgcctcagccaggc

SEQ ID NO: 4474630 - DNA, 18 bp, Homo sapiens
ctgcctcagcctcccaag

SEQ ID NO: 4474631 - DNA, 17 bp, Homo sapiens
ctgcctcagcctcctga

SEQ ID NO: 4474632 - DNA, 15 bp, Homo sapiens
ctgcctcaggccaag

SEQ ID NO: 4474633 - DNA, 15 bp, Homo sapiens
ctgcctccaccctct

SEQ ID NO: 4474634 - DNA, 17 bp, Homo sapiens
ctgcctccaccctctga

SEQ ID NO: 4474635 - DNA, 18 bp, Homo sapiens
ctgcctccaccctctgag

SEQ ID NO: 4474636 - DNA, 20 bp, Homo sapiens
ctgcctccaccctctgagct

SEQ ID NO: 4474637 - DNA, 15 bp, Homo sapiens
ctgcctccagggctg

SEQ ID NO: 4474638 - DNA, 17 bp, Homo sapiens
ctgcctccagggctgga

SEQ ID NO: 4474639 - DNA, 18 bp, Homo sapiens
ctgcctccagggctggac

SEQ ID NO: 4474640 - DNA, 23 bp, Homo sapiens
ctgcctccagggctggactgagg

SEQ ID NO: 4474641 - DNA, 12 bp, Homo sapiens
ctgcctcccact

SEQ ID NO: 4474642 - DNA, 14 bp, Homo sapiens
ctgcctcccacttc

SEQ ID NO: 4474643 - DNA, 13 bp, Homo sapiens
ctgcctcccatgc

SEQ ID NO: 4474644 - DNA, 18 bp, Homo sapiens
ctgcctccctttcataca

SEQ ID NO: 4474645 - DNA, 12 bp, Homo sapiens
ctgcctcctgcc

SEQ ID NO: 4474646 - DNA, 12 bp, Homo sapiens
ctgcctcctggc

SEQ ID NO: 4474647 - DNA, 15 bp, Homo sapiens
ctgcctcgaaacaca

SEQ ID NO: 4474648 - DNA, 18 bp, Homo sapiens
ctgcctcgaaacacagaa

SEQ ID NO: 4474649 - DNA, 19 bp, Homo sapiens
ctgcctcgaaacacagaaa

SEQ ID NO: 4474650 - DNA, 23 bp, Homo sapiens
ctgcctcgctcaccgctggccct

SEQ ID NO: 4474651 - DNA, 21 bp, Homo sapiens
ctgcctctaagctgctctaaa

SEQ ID NO: 4474652 - DNA, 19 bp, Homo sapiens
ctgcctctctttcacacaa

SEQ ID NO: 4474653 - DNA, 10 bp, Homo sapiens
ctgcctctgc

SEQ ID NO: 4474654 - DNA, 11 bp, Homo sapiens
ctgcctctgct

SEQ ID NO: 4474655 - DNA, 17 bp, Homo sapiens
aagtcaaaatatgtaag

SEQ ID NO: 4474656 - DNA, 15 bp, Homo sapiens
aagtcaaacttggat

SEQ ID NO: 4474657 - DNA, 14 bp, Homo sapiens
aagtcaacagtaaa

SEQ ID NO: 4474658 - DNA, 16 bp, Homo sapiens
aagtcaacagtaaacc

SEQ ID NO: 4474659 - DNA, 19 bp, Homo sapiens
aagtcaacagtaaaccact

SEQ ID NO: 4474660 - DNA, 18 bp, Homo sapiens
aagtcaatgtacttgttt

SEQ ID NO: 4474661 - DNA, 22 bp, Homo sapiens
aagtcacatccctgtaaattgc

SEQ ID NO: 4474662 - DNA, 23 bp, Homo sapiens
aagtcacccctttctgtcccact

SEQ ID NO: 4474663 - DNA, 12 bp, Homo sapiens
aagtcagaagtt

SEQ ID NO: 4474664 - DNA, 16 bp, Homo sapiens
aagtcagaatcagaag

SEQ ID NO: 4474665 - DNA, 18 bp, Homo sapiens
aagtcagatgtttgagca

SEQ ID NO: 4474666 - DNA, 19 bp, Homo sapiens
aagtcagtcaacatttaca

SEQ ID NO: 4474667 - DNA, 15 bp, Homo sapiens
aagtcagtttctaca

SEQ ID NO: 4474668 - DNA, 14 bp, Homo sapiens
aagtcatcttgcta

SEQ ID NO: 4474669 - DNA, 20 bp, Homo sapiens
aagtcatcttgctaccagta

SEQ ID NO: 4474670 - DNA, 16 bp, Homo sapiens
aagtcatttttgtatt

SEQ ID NO: 4474671 - DNA, 14 bp, Homo sapiens
aagtcattttttac

SEQ ID NO: 4474672 - DNA, 16 bp, Homo sapiens
aagtcattttttactt

SEQ ID NO: 4474673 - DNA, 18 bp, Homo sapiens
aagtcattttttacttga

SEQ ID NO: 4474674 - DNA, 17 bp, Homo sapiens
aagtccaagcataccaa

SEQ ID NO: 4474675 - DNA, 18 bp, Homo sapiens
aagtccaattttaattta

SEQ ID NO: 4474676 - DNA, 12 bp, Homo sapiens
aagtcccaccct

SEQ ID NO: 4474677 - DNA, 21 bp, Homo sapiens
aagtccccctcctcagccagc

SEQ ID NO: 4474678 - DNA, 17 bp, Homo sapiens
aagtccctgtcacctct

SEQ ID NO: 4474679 - DNA, 20 bp, Homo sapiens
aagtcctaacttcctgtgcc

SEQ ID NO: 4474680 - DNA, 21 bp, Homo sapiens
aagtccttcagtgagcccctc

SEQ ID NO: 4474681 - DNA, 21 bp, Homo sapiens
aagtcctttttttccatcttt

SEQ ID NO: 4474682 - DNA, 15 bp, Homo sapiens
aagtcggaatgtcat

SEQ ID NO: 4474683 - DNA, 15 bp, Homo sapiens
aagtcgttgtgaggg

SEQ ID NO: 4474684 - DNA, 22 bp, Homo sapiens
aagtctaggagctgggaggaaa

SEQ ID NO: 4474685 - DNA, 15 bp, Homo sapiens
aagtctctgctgcta

SEQ ID NO: 4474686 - DNA, 20 bp, Homo sapiens
aagtctgatgttctttccat

SEQ ID NO: 4474687 - DNA, 22 bp, Homo sapiens
aagtctgatgttctttccatga

SEQ ID NO: 4474688 - DNA, 16 bp, Homo sapiens
aagtctgatttttaag

SEQ ID NO: 4474689 - DNA, 18 bp, Homo sapiens
aagtctgatttttaagat

SEQ ID NO: 4474690 - DNA, 18 bp, Homo sapiens
aagtctgcatttcatatt

SEQ ID NO: 4474691 - DNA, 20 bp, Homo sapiens
aagtctgcatttcatattat

SEQ ID NO: 4474692 - DNA, 10 bp, Homo sapiens
aagtctggca

SEQ ID NO: 4474693 - DNA, 23 bp, Homo sapiens
aagtctggcaccatgttggcctc

SEQ ID NO: 4474694 - DNA, 15 bp, Homo sapiens
aagtctgtctttcct

SEQ ID NO: 4474695 - DNA, 21 bp, Homo sapiens
aagtctgttatttattattaa

SEQ ID NO: 4474696 - DNA, 21 bp, Homo sapiens
aagtcttaattgtgtttattt

SEQ ID NO: 4474697 - DNA, 13 bp, Homo sapiens
aagtcttctattt

SEQ ID NO: 4474698 - DNA, 17 bp, Homo sapiens
aagtcttctatttattt

SEQ ID NO: 4474699 - DNA, 14 bp, Homo sapiens
aagtctttcttctt

SEQ ID NO: 4474700 - DNA, 14 bp, Homo sapiens
aagtcttttgttcg

SEQ ID NO: 4474701 - DNA, 20 bp, Homo sapiens
aagtgaaacgtaattgtaca

SEQ ID NO: 4474702 - DNA, 14 bp, Homo sapiens
aagtgaactttgtt

SEQ ID NO: 4474703 - DNA, 16 bp, Homo sapiens
aagtgaattgaagttt

SEQ ID NO: 4474704 - DNA, 17 bp, Homo sapiens
aagtgacaaataagatt

SEQ ID NO: 4474705 - DNA, 18 bp, Homo sapiens
aagtgacaaataagatta

SEQ ID NO: 4474706 - DNA, 14 bp, Homo sapiens
aagtgagacccaaa

SEQ ID NO: 4474707 - DNA, 17 bp, Homo sapiens
aagtgagagaaatgaag

SEQ ID NO: 4474708 - DNA, 23 bp, Homo sapiens
aagtgatcctaaatatgacagtg

SEQ ID NO: 4474709 - DNA, 10 bp, Homo sapiens
aagtgatctt

SEQ ID NO: 4474710 - DNA, 13 bp, Homo sapiens
aagtgatgacata

SEQ ID NO: 4474711 - DNA, 16 bp, Homo sapiens
aagtgattatctcttt

SEQ ID NO: 4474712 - DNA, 16 bp, Homo sapiens
aagtgcaatagattac

SEQ ID NO: 4474713 - DNA, 13 bp, Homo sapiens
aagtgcagagctt

SEQ ID NO: 4474714 - DNA, 22 bp, Homo sapiens
aagtgccagcattccagacttc

SEQ ID NO: 4474715 - DNA, 18 bp, Homo sapiens
aagtgcctcacatttttt

SEQ ID NO: 4474716 - DNA, 14 bp, Homo sapiens
aagtgccttctggg

SEQ ID NO: 4474717 - DNA, 21 bp, Homo sapiens
aagtgctgagattgcagatgt

SEQ ID NO: 4474718 - DNA, 19 bp, Homo sapiens
aagtgctgcactcaaatga

SEQ ID NO: 4474719 - DNA, 13 bp, Homo sapiens
aagtgctgggatt

SEQ ID NO: 4474720 - DNA, 17 bp, Homo sapiens
aagtgctgggattacag

SEQ ID NO: 4474721 - DNA, 14 bp, Homo sapiens
aagtgctgtttatt

SEQ ID NO: 4474722 - DNA, 16 bp, Homo sapiens
aagtgctgtttattaa

SEQ ID NO: 4474723 - DNA, 18 bp, Homo sapiens
aagtgctgtttattaatc

SEQ ID NO: 4474724 - DNA, 20 bp, Homo sapiens
aagtgctgtttattaatctt

SEQ ID NO: 4474725 - DNA, 17 bp, Homo sapiens
aagtgcttaaaaatact

SEQ ID NO: 4474726 - DNA, 22 bp, Homo sapiens
aagtgcttcacaggttttatgt

SEQ ID NO: 4474727 - DNA, 23 bp, Homo sapiens
aagtgcttcacaggttttatgtg

SEQ ID NO: 4474728 - DNA, 13 bp, Homo sapiens
aagtgcttgtata

SEQ ID NO: 4474729 - DNA, 20 bp, Homo sapiens
aagtgcttgtatagctttta

SEQ ID NO: 4474730 - DNA, 20 bp, Homo sapiens
aagtggaacgaaaatgaaag

SEQ ID NO: 4474731 - DNA, 18 bp, Homo sapiens
aagtggaattaaaggaat

SEQ ID NO: 4474732 - DNA, 20 bp, Homo sapiens
aagtggactggcccctgggt

SEQ ID NO: 4474733 - DNA, 14 bp, Homo sapiens
aagtggattttgta

SEQ ID NO: 4474734 - DNA, 18 bp, Homo sapiens
aagtggctcagacccctc

SEQ ID NO: 4474735 - DNA, 12 bp, Homo sapiens
aagtggctgctg

SEQ ID NO: 4474736 - DNA, 16 bp, Homo sapiens
aagtgggccaggacag

SEQ ID NO: 4474737 - DNA, 17 bp, Homo sapiens
aagtggggcagagcctc

SEQ ID NO: 4474738 - DNA, 18 bp, Homo sapiens
aagtggggtgctgggagg

SEQ ID NO: 4474739 - DNA, 19 bp, Homo sapiens
aagtgggttattctggagt

SEQ ID NO: 4474740 - DNA, 23 bp, Homo sapiens
aagtggtaaatactgtgaaatac

SEQ ID NO: 4474741 - DNA, 13 bp, Homo sapiens
aagtggtatagaa

SEQ ID NO: 4474742 - DNA, 17 bp, Homo sapiens
aagtggtatagaaatgc

SEQ ID NO: 4474743 - DNA, 17 bp, Homo sapiens
aagtggttctctgcctt

SEQ ID NO: 4474744 - DNA, 17 bp, Homo sapiens
aagtgtaaacaccatag

SEQ ID NO: 4474745 - DNA, 15 bp, Homo sapiens
aagtgtacagactct

SEQ ID NO: 4474746 - DNA, 16 bp, Homo sapiens
aagtgtcaactctttg

SEQ ID NO: 4474747 - DNA, 19 bp, Homo sapiens
aagtgtgagctcttccctt

SEQ ID NO: 4474748 - DNA, 15 bp, Homo sapiens
aagtgtgctgggcag

SEQ ID NO: 4474749 - DNA, 24 bp, Homo sapiens
aagtgtggaggagaggggtggagg

SEQ ID NO: 4474750 - DNA, 18 bp, Homo sapiens
aagtgtgggtctgtgtgt

SEQ ID NO: 4474751 - DNA, 15 bp, Homo sapiens
aagtgtgtataaaac

SEQ ID NO: 4474752 - DNA, 17 bp, Homo sapiens
aagtgtgtataaaacat

SEQ ID NO: 4474753 - DNA, 20 bp, Homo sapiens
aagtgtgtataaaacattaa

SEQ ID NO: 4474754 - DNA, 18 bp, Homo sapiens
aagtgtgtgattgaaggt

SEQ ID NO: 4474755 - DNA, 14 bp, Homo sapiens
aagtgttcattgtt

SEQ ID NO: 4474756 - DNA, 17 bp, Homo sapiens
aagtgttcattttaagt

SEQ ID NO: 4474757 - DNA, 18 bp, Homo sapiens
aagtgttccctttttcat

SEQ ID NO: 4474758 - DNA, 16 bp, Homo sapiens
aagtgttggaaaaaat

SEQ ID NO: 4474759 - DNA, 15 bp, Homo sapiens
aagttaaaaaacagc

SEQ ID NO: 4474760 - DNA, 22 bp, Homo sapiens
aagttaaagtcacacatttcta

SEQ ID NO: 4474761 - DNA, 21 bp, Homo sapiens
aagttaatagaaagttggcca

SEQ ID NO: 4474762 - DNA, 17 bp, Homo sapiens
aagttaatgtatataaa

SEQ ID NO: 4474763 - DNA, 18 bp, Homo sapiens
aagttaattcttaaaact

SEQ ID NO: 4474764 - DNA, 14 bp, Homo sapiens
aagttacacatttt

SEQ ID NO: 4474765 - DNA, 17 bp, Homo sapiens
aagttacacatttttca

SEQ ID NO: 4474766 - DNA, 19 bp, Homo sapiens
aagttagaacatttgctgt

SEQ ID NO: 4474767 - DNA, 22 bp, Homo sapiens
aagttagagaactaaactagtt

SEQ ID NO: 4474768 - DNA, 16 bp, Homo sapiens
aagttagctttaactt

SEQ ID NO: 4474769 - DNA, 16 bp, Homo sapiens
aagttagtggaaatct

SEQ ID NO: 4474770 - DNA, 15 bp, Homo sapiens
aagttagtttgtata

SEQ ID NO: 4474771 - DNA, 13 bp, Homo sapiens
aagttatagtact

SEQ ID NO: 4474772 - DNA, 14 bp, Homo sapiens
aagttattgcagtt

SEQ ID NO: 4474773 - DNA, 15 bp, Homo sapiens
gaagaggcctttgga

SEQ ID NO: 4474774 - DNA, 19 bp, Homo sapiens
gaagagggaaatgtacact

SEQ ID NO: 4474775 - DNA, 15 bp, Homo sapiens
gaagagggcccagcc

SEQ ID NO: 4474776 - DNA, 19 bp, Homo sapiens
gaagagggcccagcccaga

SEQ ID NO: 4474777 - DNA, 16 bp, Homo sapiens
gaagaggggtggtggg

SEQ ID NO: 4474778 - DNA, 17 bp, Homo sapiens
gaagatcagatgcaatt

SEQ ID NO: 4474779 - DNA, 21 bp, Homo sapiens
gaagatcagcaccctaagaga

SEQ ID NO: 4474780 - DNA, 16 bp, Homo sapiens
gaagatcatggacctg

SEQ ID NO: 4474781 - DNA, 21 bp, Homo sapiens
gaagatcatggacctggtgcc

SEQ ID NO: 4474782 - DNA, 20 bp, Homo sapiens
gaagatcccctcaggactgc

SEQ ID NO: 4474783 - DNA, 16 bp, Homo sapiens
gaagatcttatgcctt

SEQ ID NO: 4474784 - DNA, 13 bp, Homo sapiens
gaagatgcagctc

SEQ ID NO: 4474785 - DNA, 14 bp, Homo sapiens
gaagatgcagctca

SEQ ID NO: 4474786 - DNA, 17 bp, Homo sapiens
gaagatgcctgttaatt

SEQ ID NO: 4474787 - DNA, 19 bp, Homo sapiens
gaagatggagggggctggg

SEQ ID NO: 4474788 - DNA, 16 bp, Homo sapiens
gaagatggctgttagc

SEQ ID NO: 4474789 - DNA, 17 bp, Homo sapiens
gaagatgtagaggagaa

SEQ ID NO: 4474790 - DNA, 18 bp, Homo sapiens
gaagatgtagaggagaaa

SEQ ID NO: 4474791 - DNA, 15 bp, Homo sapiens
gaagatgtgtaaaca

SEQ ID NO: 4474792 - DNA, 16 bp, Homo sapiens
gaagattctcgcccct

SEQ ID NO: 4474793 - DNA, 22 bp, Homo sapiens
gaagattctcgccccttccctc

SEQ ID NO: 4474794 - DNA, 19 bp, Homo sapiens
gaagcaaatggcaaaacca

SEQ ID NO: 4474795 - DNA, 23 bp, Homo sapiens
gaagcaagaggcaagctgaaatt

SEQ ID NO: 4474796 - DNA, 15 bp, Homo sapiens
gaagcaagcagatga

SEQ ID NO: 4474797 - DNA, 13 bp, Homo sapiens
gaagcaagccaga

SEQ ID NO: 4474798 - DNA, 16 bp, Homo sapiens
gaagcaagccagacct

SEQ ID NO: 4474799 - DNA, 16 bp, Homo sapiens
gaagcaagcttaatgg

SEQ ID NO: 4474800 - DNA, 19 bp, Homo sapiens
gaagcaaggagaaaatata

SEQ ID NO: 4474801 - DNA, 17 bp, Homo sapiens
gaagcaatctttgaaat

SEQ ID NO: 4474802 - DNA, 18 bp, Homo sapiens
gaagcaatctttgaaata

SEQ ID NO: 4474803 - DNA, 15 bp, Homo sapiens
gaagcacagaatatt

SEQ ID NO: 4474804 - DNA, 21 bp, Homo sapiens
gaagcaccccatgccaaagct

SEQ ID NO: 4474805 - DNA, 15 bp, Homo sapiens
gaagcacttctgctg

SEQ ID NO: 4474806 - DNA, 16 bp, Homo sapiens
gaagcacttctgctgc

SEQ ID NO: 4474807 - DNA, 18 bp, Homo sapiens
gaagcagaggccctgccc

SEQ ID NO: 4474808 - DNA, 19 bp, Homo sapiens
gaagcagaggccctgcccc

SEQ ID NO: 4474809 - DNA, 16 bp, Homo sapiens
gaagcagcactgtgag

SEQ ID NO: 4474810 - DNA, 17 bp, Homo sapiens
gaagcatagctacaatt

SEQ ID NO: 4474811 - DNA, 14 bp, Homo sapiens
gaagccaaagaaaa

SEQ ID NO: 4474812 - DNA, 20 bp, Homo sapiens
gaagccaagggaaaggggtg

SEQ ID NO: 4474813 - DNA, 13 bp, Homo sapiens
gaagccaagtggg

SEQ ID NO: 4474814 - DNA, 21 bp, Homo sapiens
gaagccaagtggggtgctggg

SEQ ID NO: 4474815 - DNA, 12 bp, Homo sapiens
gaagccacagaa

SEQ ID NO: 4474816 - DNA, 16 bp, Homo sapiens
gaagccacgctgtcct

SEQ ID NO: 4474817 - DNA, 19 bp, Homo sapiens
gaagccacgctgtcctctc

SEQ ID NO: 4474818 - DNA, 21 bp, Homo sapiens
gaagccagagccccaagcagg

SEQ ID NO: 4474819 - DNA, 15 bp, Homo sapiens
gaagccagtcagggc

SEQ ID NO: 4474820 - DNA, 18 bp, Homo sapiens
gaagccatcacttctccc

SEQ ID NO: 4474821 - DNA, 16 bp, Homo sapiens
gaagccattttccagt

SEQ ID NO: 4474822 - DNA, 17 bp, Homo sapiens
gaagcccagcccaagca

SEQ ID NO: 4474823 - DNA, 14 bp, Homo sapiens
gaagcccaggagcc

SEQ ID NO: 4474824 - DNA, 21 bp, Homo sapiens
gaagcccatcctgaccagctg

SEQ ID NO: 4474825 - DNA, 14 bp, Homo sapiens
gaagcccctgggcc

SEQ ID NO: 4474826 - DNA, 11 bp, Homo sapiens
gaagccctcct

SEQ ID NO: 4474827 - DNA, 15 bp, Homo sapiens
gaagccctccttcca

SEQ ID NO: 4474828 - DNA, 16 bp, Homo sapiens
gaagccctccttccac

SEQ ID NO: 4474829 - DNA, 18 bp, Homo sapiens
gaagccctggatttcaga

SEQ ID NO: 4474830 - DNA, 22 bp, Homo sapiens
gaagccgtcctggcgcctggca

SEQ ID NO: 4474831 - DNA, 21 bp, Homo sapiens
gaatgaaattaaatgttgatt

SEQ ID NO: 4474832 - DNA, 20 bp, Homo sapiens
gaatgaaattaacacaaagg

SEQ ID NO: 4474833 - DNA, 15 bp, Homo sapiens
gaatgaatttatctt

SEQ ID NO: 4474834 - DNA, 20 bp, Homo sapiens
gaatgaatttatctttacca

SEQ ID NO: 4474835 - DNA, 13 bp, Homo sapiens
gaatgacttactt

SEQ ID NO: 4474836 - DNA, 15 bp, Homo sapiens
gaatgaggtctgggc

SEQ ID NO: 4474837 - DNA, 18 bp, Homo sapiens
gaatgaggtctgggctag

SEQ ID NO: 4474838 - DNA, 14 bp, Homo sapiens
gaatgaggtgggag

SEQ ID NO: 4474839 - DNA, 15 bp, Homo sapiens
gaatgaggtgggagg

SEQ ID NO: 4474840 - DNA, 13 bp, Homo sapiens
gaatgatctattc

SEQ ID NO: 4474841 - DNA, 22 bp, Homo sapiens
gaatgatcttgtgtaaggtttt

SEQ ID NO: 4474842 - DNA, 21 bp, Homo sapiens
gaatgatggtttccagcttca

SEQ ID NO: 4474843 - DNA, 16 bp, Homo sapiens
gaatgattaaattatg

SEQ ID NO: 4474844 - DNA, 19 bp, Homo sapiens
gaatgattggttaaaatgt

SEQ ID NO: 4474845 - DNA, 21 bp, Homo sapiens
gaatgattggttaaaatgtga

SEQ ID NO: 4474846 - DNA, 19 bp, Homo sapiens
gaatgcaatgtttctaaat

SEQ ID NO: 4474847 - DNA, 16 bp, Homo sapiens
gaatgcacagatatac

SEQ ID NO: 4474848 - DNA, 17 bp, Homo sapiens
gaatgcacagatatact

SEQ ID NO: 4474849 - DNA, 17 bp, Homo sapiens
gaatgcataatgtttaa

SEQ ID NO: 4474850 - DNA, 23 bp, Homo sapiens
gaatgccatttctcacgccctct

SEQ ID NO: 4474851 - DNA, 21 bp, Homo sapiens
gaatgcggccgcattccctga

SEQ ID NO: 4474852 - DNA, 14 bp, Homo sapiens
gaatgctcccagct

SEQ ID NO: 4474853 - DNA, 16 bp, Homo sapiens
gaatgctcccagctgt

SEQ ID NO: 4474854 - DNA, 13 bp, Homo sapiens
gaatgctgtacat

SEQ ID NO: 4474855 - DNA, 14 bp, Homo sapiens
gaatgctgtacatc

SEQ ID NO: 4474856 - DNA, 15 bp, Homo sapiens
gaatgctgtacatct

SEQ ID NO: 4474857 - DNA, 13 bp, Homo sapiens
gaatgctttgaaa

SEQ ID NO: 4474858 - DNA, 22 bp, Homo sapiens
gaatggaagagaaaagacaggg

SEQ ID NO: 4474859 - DNA, 13 bp, Homo sapiens
gaatggcaatggt

SEQ ID NO: 4474860 - DNA, 17 bp, Homo sapiens
gaatggtgcattgtata

SEQ ID NO: 4474861 - DNA, 20 bp, Homo sapiens
gaatgtaatttgtgtaataa

SEQ ID NO: 4474862 - DNA, 20 bp, Homo sapiens
gaatgtacagttgagctcag

SEQ ID NO: 4474863 - DNA, 20 bp, Homo sapiens
gaatgtacatgaagcaatta

SEQ ID NO: 4474864 - DNA, 11 bp, Homo sapiens
gaatgtatgta

SEQ ID NO: 4474865 - DNA, 15 bp, Homo sapiens
gaatgtcagattcct

SEQ ID NO: 4474866 - DNA, 16 bp, Homo sapiens
gaatgtcagtatgtgg

SEQ ID NO: 4474867 - DNA, 16 bp, Homo sapiens
gaatgtgaaaaaggaa

SEQ ID NO: 4474868 - DNA, 14 bp, Homo sapiens
gaatgtgaaagcac

SEQ ID NO: 4474869 - DNA, 18 bp, Homo sapiens
gaatgtgccacagaggcc

SEQ ID NO: 4474870 - DNA, 17 bp, Homo sapiens
gaatgtgtgtgtgtggc

SEQ ID NO: 4474871 - DNA, 23 bp, Homo sapiens
gaatgtgtgtgtgtggcaggggg

SEQ ID NO: 4474872 - DNA, 20 bp, Homo sapiens
gaatgttgcaatgtgaaaaa

SEQ ID NO: 4474873 - DNA, 14 bp, Homo sapiens
gaatgttggataag

SEQ ID NO: 4474874 - DNA, 20 bp, Homo sapiens
gaatgttttgtgtgtaagga

SEQ ID NO: 4474875 - DNA, 18 bp, Homo sapiens
gaatgtttttccctcccc

SEQ ID NO: 4474876 - DNA, 20 bp, Homo sapiens
gaattaaaaggatagtattt

SEQ ID NO: 4474877 - DNA, 21 bp, Homo sapiens
gaattaaaaggatagtatttt

SEQ ID NO: 4474878 - DNA, 11 bp, Homo sapiens
gaattaaaatt

SEQ ID NO: 4474879 - DNA, 23 bp, Homo sapiens
gaattaaatcatcccttaataaa

SEQ ID NO: 4474880 - DNA, 15 bp, Homo sapiens
gaattacgtgctctg

SEQ ID NO: 4474881 - DNA, 18 bp, Homo sapiens
gaattactttattataaa

SEQ ID NO: 4474882 - DNA, 21 bp, Homo sapiens
gaattactttattataaaatg

SEQ ID NO: 4474883 - DNA, 15 bp, Homo sapiens
gaattactttgtgtt

SEQ ID NO: 4474884 - DNA, 12 bp, Homo sapiens
gaattagaaaat

SEQ ID NO: 4474885 - DNA, 16 bp, Homo sapiens
gaattaggctgtaact

SEQ ID NO: 4474886 - DNA, 18 bp, Homo sapiens
gaattaggctgtaactac

SEQ ID NO: 4474887 - DNA, 23 bp, Homo sapiens
gaattaggctgtaactactttat

SEQ ID NO: 4474888 - DNA, 21 bp, Homo sapiens
gaattataactgtaaagatgt

SEQ ID NO: 4474889 - DNA, 13 bp, Homo sapiens
gaattatacagta

SEQ ID NO: 4474890 - DNA, 16 bp, Homo sapiens
gaattatcagcaaaga

SEQ ID NO: 4474891 - DNA, 14 bp, Homo sapiens
gaattattgacact

SEQ ID NO: 4474892 - DNA, 16 bp, Homo sapiens
gaattattgacactga

SEQ ID NO: 4474893 - DNA, 20 bp, Homo sapiens
gaattcaaaagtgattatct

SEQ ID NO: 4474894 - DNA, 16 bp, Homo sapiens
gaattcaaatttgtaa

SEQ ID NO: 4474895 - DNA, 17 bp, Homo sapiens
gaattcaagaaaggaaa

SEQ ID NO: 4474896 - DNA, 19 bp, Homo sapiens
gaattcactgagttttgtt

SEQ ID NO: 4474897 - DNA, 14 bp, Homo sapiens
gaattccaaagcaa

SEQ ID NO: 4474898 - DNA, 15 bp, Homo sapiens
gaattccctccccct

SEQ ID NO: 4474899 - DNA, 16 bp, Homo sapiens
gaattccctccccctc

SEQ ID NO: 4474900 - DNA, 13 bp, Homo sapiens
gaattccctggaa

SEQ ID NO: 4474901 - DNA, 18 bp, Homo sapiens
tcagactgacactactaa

SEQ ID NO: 4474902 - DNA, 15 bp, Homo sapiens
tcagactgcagaggg

SEQ ID NO: 4474903 - DNA, 20 bp, Homo sapiens
tcagactgcctgtctgcttg

SEQ ID NO: 4474904 - DNA, 16 bp, Homo sapiens
tcagacttccaaatcc

SEQ ID NO: 4474905 - DNA, 23 bp, Homo sapiens
tcagactttgtgttcatttcatt

SEQ ID NO: 4474906 - DNA, 16 bp, Homo sapiens
tcagagagacctcatc

SEQ ID NO: 4474907 - DNA, 14 bp, Homo sapiens
tcagagagagtgtt

SEQ ID NO: 4474908 - DNA, 18 bp, Homo sapiens
tcagagatctcccttctc

SEQ ID NO: 4474909 - DNA, 13 bp, Homo sapiens
tcagagcactccc

SEQ ID NO: 4474910 - DNA, 20 bp, Homo sapiens
tcagagcactttaaaaacag

SEQ ID NO: 4474911 - DNA, 23 bp, Homo sapiens
tcagagccactctatgagttgga

SEQ ID NO: 4474912 - DNA, 12 bp, Homo sapiens
tcagagcccagc

SEQ ID NO: 4474913 - DNA, 13 bp, Homo sapiens
tcagagcccagcc

SEQ ID NO: 4474914 - DNA, 16 bp, Homo sapiens
tcagagcccagcccag

SEQ ID NO: 4474915 - DNA, 17 bp, Homo sapiens
tcagagcccagcccagg

SEQ ID NO: 4474916 - DNA, 20 bp, Homo sapiens
tcagagcctttcctcaaaac

SEQ ID NO: 4474917 - DNA, 17 bp, Homo sapiens
tcagagcgccaggaagc

SEQ ID NO: 4474918 - DNA, 20 bp, Homo sapiens
tcagagcgccaggaagccag

SEQ ID NO: 4474919 - DNA, 21 bp, Homo sapiens
tcagagcgccaggaagccaga

SEQ ID NO: 4474920 - DNA, 22 bp, Homo sapiens
tcagagcgccaggaagccagag

SEQ ID NO: 4474921 - DNA, 14 bp, Homo sapiens
tcagagctttgtca

SEQ ID NO: 4474922 - DNA, 23 bp, Homo sapiens
tcagagctttgtcacttgccaca

SEQ ID NO: 4474923 - DNA, 18 bp, Homo sapiens
tcagaggacctgtattta

SEQ ID NO: 4474924 - DNA, 13 bp, Homo sapiens
tcagaggcctgct

SEQ ID NO: 4474925 - DNA, 23 bp, Homo sapiens
tcagagggctgatggattccaaa

SEQ ID NO: 4474926 - DNA, 15 bp, Homo sapiens
tcagaggtccaggcc

SEQ ID NO: 4474927 - DNA, 17 bp, Homo sapiens
tcagaggtccaggcccc

SEQ ID NO: 4474928 - DNA, 22 bp, Homo sapiens
tcagagtatattgttgaagaga

SEQ ID NO: 4474929 - DNA, 23 bp, Homo sapiens
tcagagtccttgcaaaattgtct

SEQ ID NO: 4474930 - DNA, 21 bp, Homo sapiens
tcagagttgctgcaaacctga

SEQ ID NO: 4474931 - DNA, 15 bp, Homo sapiens
tcagataatatgttt

SEQ ID NO: 4474932 - DNA, 13 bp, Homo sapiens
tcagatagtctat

SEQ ID NO: 4474933 - DNA, 17 bp, Homo sapiens
tcagatataaaagactg

SEQ ID NO: 4474934 - DNA, 13 bp, Homo sapiens
tcagatcctgtta

SEQ ID NO: 4474935 - DNA, 17 bp, Homo sapiens
tcagatcctgttacttg

SEQ ID NO: 4474936 - DNA, 18 bp, Homo sapiens
tcagatcctgttacttgc

SEQ ID NO: 4474937 - DNA, 14 bp, Homo sapiens
tcagatctgtctga

SEQ ID NO: 4474938 - DNA, 24 bp, Homo sapiens
tcagatcttaatataaattcactt

SEQ ID NO: 4474939 - DNA, 19 bp, Homo sapiens
tcagatctttctccttgaa

SEQ ID NO: 4474940 - DNA, 20 bp, Homo sapiens
tcagatgcgtgcccagctct

SEQ ID NO: 4474941 - DNA, 21 bp, Homo sapiens
tcagatgcgtgcccagctctt

SEQ ID NO: 4474942 - DNA, 20 bp, Homo sapiens
tcagatggaaaattcatttt

SEQ ID NO: 4474943 - DNA, 15 bp, Homo sapiens
tcagatggtgtcatt

SEQ ID NO: 4474944 - DNA, 16 bp, Homo sapiens
tcagatggtgtcattt

SEQ ID NO: 4474945 - DNA, 14 bp, Homo sapiens
tcagatgtaatgtt

SEQ ID NO: 4474946 - DNA, 19 bp, Homo sapiens
tcagatgtcttctgcctgt

SEQ ID NO: 4474947 - DNA, 20 bp, Homo sapiens
tcagatgtcttctgcctgtt

SEQ ID NO: 4474948 - DNA, 15 bp, Homo sapiens
tcagatgttaaaata

SEQ ID NO: 4474949 - DNA, 16 bp, Homo sapiens
tcagatgttaaaataa

SEQ ID NO: 4474950 - DNA, 18 bp, Homo sapiens
tcagatgttaaaataaat

SEQ ID NO: 4474951 - DNA, 16 bp, Homo sapiens
tcagatgtttcatcaa

SEQ ID NO: 4474952 - DNA, 12 bp, Homo sapiens
tcagatgtttga

SEQ ID NO: 4474953 - DNA, 12 bp, Homo sapiens
tcagattaaatt

SEQ ID NO: 4474954 - DNA, 17 bp, Homo sapiens
tcagattaaattacagc

SEQ ID NO: 4474955 - DNA, 15 bp, Homo sapiens
tcagattcctttccc

SEQ ID NO: 4474956 - DNA, 20 bp, Homo sapiens
tcagattgcttaaaagcatt

SEQ ID NO: 4474957 - DNA, 12 bp, Homo sapiens
tcagattttgat

SEQ ID NO: 4474958 - DNA, 17 bp, Homo sapiens
tcagattttttaaaatt

SEQ ID NO: 4474959 - DNA, 18 bp, Homo sapiens
tcagattttttaaaattt

SEQ ID NO: 4474960 - DNA, 20 bp, Homo sapiens
tcagattttttaaaattttg

SEQ ID NO: 4474961 - DNA, 14 bp, Homo sapiens
tcagattttttcct

SEQ ID NO: 4474962 - DNA, 21 bp, Homo sapiens
tcagcaaacaggatcagttaa

SEQ ID NO: 4474963 - DNA, 15 bp, Homo sapiens
tcagcaaagaaaaaa

SEQ ID NO: 4474964 - DNA, 11 bp, Homo sapiens
tcagcaaccct

SEQ ID NO: 4474965 - DNA, 18 bp, Homo sapiens
tcagcaaccctacagtat

SEQ ID NO: 4474966 - DNA, 21 bp, Homo sapiens
tcagcaagctgcccagccctg

SEQ ID NO: 4474967 - DNA, 17 bp, Homo sapiens
tcagcacatatgggaac

SEQ ID NO: 4474968 - DNA, 15 bp, Homo sapiens
tcagcaccaccctag

SEQ ID NO: 4474969 - DNA, 21 bp, Homo sapiens
tcagcacctacagtgtacagt

SEQ ID NO: 4474970 - DNA, 12 bp, Homo sapiens
tcagcactctgt

SEQ ID NO: 4474971 - DNA, 18 bp, Homo sapiens
tcagcactctgtaaaatg

SEQ ID NO: 4474972 - DNA, 19 bp, Homo sapiens
tcagcactgatggaaaata

SEQ ID NO: 4474973 - DNA, 20 bp, Homo sapiens
tcagcacttaactatgagcc

SEQ ID NO: 4474974 - DNA, 14 bp, Homo sapiens
tcagcacttgtctc

SEQ ID NO: 4474975 - DNA, 23 bp, Homo sapiens
tcagcacttgtctcattttaatg

SEQ ID NO: 4474976 - DNA, 23 bp, Homo sapiens
tcagcactttgggaggctgaggc

SEQ ID NO: 4474977 - DNA, 14 bp, Homo sapiens
tcagcagacactcc

SEQ ID NO: 4474978 - DNA, 18 bp, Homo sapiens
tcagcagacatttatctt

SEQ ID NO: 4474979 - DNA, 18 bp, Homo sapiens
tcagcagcaaattttcag

SEQ ID NO: 4474980 - DNA, 16 bp, Homo sapiens
tcagcagcagctctga

SEQ ID NO: 4474981 - DNA, 13 bp, Homo sapiens
tcagcagccctag

SEQ ID NO: 4474982 - DNA, 21 bp, Homo sapiens
tcagcagccctagcggctgct

SEQ ID NO: 4474983 - DNA, 15 bp, Homo sapiens
tcagcagccctcctc

SEQ ID NO: 4474984 - DNA, 18 bp, Homo sapiens
tcagcagccctcctcacc

SEQ ID NO: 4474985 - DNA, 17 bp, Homo sapiens
tcagcagcctccctgaa

SEQ ID NO: 4474986 - DNA, 18 bp, Homo sapiens
tcagcagtattctatttg

SEQ ID NO: 4474987 - DNA, 14 bp, Homo sapiens
tcagcagtttctga

SEQ ID NO: 4474988 - DNA, 12 bp, Homo sapiens
tcagcagtttta

SEQ ID NO: 4474989 - DNA, 20 bp, Homo sapiens
tcagcatagaaggaagtgtg

SEQ ID NO: 4474990 - DNA, 17 bp, Homo sapiens
tcagcatatgtgtaaag

SEQ ID NO: 4474991 - DNA, 19 bp, Homo sapiens
tcagcatcactgatgggaa

SEQ ID NO: 4474992 - DNA, 23 bp, Homo sapiens
tcagcatcactgatgggaataaa

SEQ ID NO: 4474993 - DNA, 12 bp, Homo sapiens
tcagcatgtcta

SEQ ID NO: 4474994 - DNA, 18 bp, Homo sapiens
tcagcattcttagcctgt

SEQ ID NO: 4474995 - DNA, 20 bp, Homo sapiens
tcagcattcttagcctgtgg

SEQ ID NO: 4474996 - DNA, 16 bp, Homo sapiens
tcagccaaatgcaggg

SEQ ID NO: 4474997 - DNA, 22 bp, Homo sapiens
tcagccaaatttcctgtttgaa

SEQ ID NO: 4474998 - DNA, 14 bp, Homo sapiens
tcagccaagtgcag

SEQ ID NO: 4474999 - DNA, 22 bp, Homo sapiens
tcagccacaaagccccccagct

SEQ ID NO: 4475000 - DNA, 23 bp, Homo sapiens
tcagccacaaagccccccagctc

SEQ ID NO: 4475001 - DNA, 18 bp, Homo sapiens
tcagccacatgccccagg

SEQ ID NO: 4475002 - DNA, 19 bp, Homo sapiens
tcagccacatgccccaggc

SEQ ID NO: 4475003 - DNA, 20 bp, Homo sapiens
tcagccacatgccccaggct

SEQ ID NO: 4475004 - DNA, 14 bp, Homo sapiens
tcagccactgtcac

SEQ ID NO: 4475005 - DNA, 20 bp, Homo sapiens
tcagccactgtcacaggcat

SEQ ID NO: 4475006 - DNA, 17 bp, Homo sapiens
tcagccagccgccctgg

SEQ ID NO: 4475007 - DNA, 19 bp, Homo sapiens
tcagccagccgccctgggc

SEQ ID NO: 4475008 - DNA, 23 bp, Homo sapiens
tcagccatgaggagttgctgttt

SEQ ID NO: 4475009 - DNA, 13 bp, Homo sapiens
tcagcccagaaga

SEQ ID NO: 4475010 - DNA, 15 bp, Homo sapiens
tcagcccagaagaaa

SEQ ID NO: 4475011 - DNA, 16 bp, Homo sapiens
tcagcccagaagaaaa

SEQ ID NO: 4475012 - DNA, 12 bp, Homo sapiens
tcagccccaggc

SEQ ID NO: 4475013 - DNA, 13 bp, Homo sapiens
tcagccccaggcc

SEQ ID NO: 4475014 - DNA, 20 bp, Homo sapiens
tcagccccaggccagctgcg

SEQ ID NO: 4475015 - DNA, 22 bp, Homo sapiens
tcagccccaggccagctgcggc

SEQ ID NO: 4475016 - DNA, 22 bp, Homo sapiens
tcagcccccaccacaaacacag

SEQ ID NO: 4475017 - DNA, 21 bp, Homo sapiens
tcagcccccatcacccaagcc

SEQ ID NO: 4475018 - DNA, 19 bp, Homo sapiens
tcagccccgcctgtcacaa

SEQ ID NO: 4475019 - DNA, 21 bp, Homo sapiens
tcagccccgcctgtcacaata

SEQ ID NO: 4475020 - DNA, 16 bp, Homo sapiens
tcagccccgcgtggaa

SEQ ID NO: 4475021 - DNA, 18 bp, Homo sapiens
tcaggaaagagagcacca

SEQ ID NO: 4475022 - DNA, 17 bp, Homo sapiens
tcaggaaccgaggcagg

SEQ ID NO: 4475023 - DNA, 19 bp, Homo sapiens
tcaggaacctcgagtactg

SEQ ID NO: 4475024 - DNA, 21 bp, Homo sapiens
tcaggaacctcgagtactgtg

SEQ ID NO: 4475025 - DNA, 21 bp, Homo sapiens
tcaggaatatctgttcccagc

SEQ ID NO: 4475026 - DNA, 16 bp, Homo sapiens
tcaggaattccctgga

SEQ ID NO: 4475027 - DNA, 22 bp, Homo sapiens
tcaggaattctaaataaatttc

SEQ ID NO: 4475028 - DNA, 18 bp, Homo sapiens
tcaggaatttaagaattt

SEQ ID NO: 4475029 - DNA, 20 bp, Homo sapiens
tcaggaatttaagaatttgt

SEQ ID NO: 4475030 - DNA, 22 bp, Homo sapiens
tcaggacagcatcccttcccac

SEQ ID NO: 4475031 - DNA, 12 bp, Homo sapiens
tcaggactctgc

SEQ ID NO: 4475032 - DNA, 16 bp, Homo sapiens
tcaggacttgaaagaa

SEQ ID NO: 4475033 - DNA, 17 bp, Homo sapiens
tcaggacttgaaagaaa

SEQ ID NO: 4475034 - DNA, 23 bp, Homo sapiens
tcaggagatggagggcttggccc

SEQ ID NO: 4475035 - DNA, 14 bp, Homo sapiens
tcaggagcttgggc

SEQ ID NO: 4475036 - DNA, 21 bp, Homo sapiens
tcaggaggcgaataaatgttc

SEQ ID NO: 4475037 - DNA, 14 bp, Homo sapiens
tcaggaggctgaga

SEQ ID NO: 4475038 - DNA, 23 bp, Homo sapiens
tcaggaggtcacctgccgccctg

SEQ ID NO: 4475039 - DNA, 22 bp, Homo sapiens
tcaggagtctctggtagcctgc

SEQ ID NO: 4475040 - DNA, 14 bp, Homo sapiens
tcaggagtctgcca

SEQ ID NO: 4475041 - DNA, 16 bp, Homo sapiens
tcaggagtctgccact

SEQ ID NO: 4475042 - DNA, 19 bp, Homo sapiens
tcaggagtctgccacttgt

SEQ ID NO: 4475043 - DNA, 18 bp, Homo sapiens
tcaggagttcaagaccag

SEQ ID NO: 4475044 - DNA, 17 bp, Homo sapiens
tcaggagttcaagacta

SEQ ID NO: 4475045 - DNA, 18 bp, Homo sapiens
tcaggagtttgagaccag

SEQ ID NO: 4475046 - DNA, 20 bp, Homo sapiens
tcaggatccagtctggaaaa

SEQ ID NO: 4475047 - DNA, 21 bp, Homo sapiens
tcaggcaggaagggcaggaag

SEQ ID NO: 4475048 - DNA, 20 bp, Homo sapiens
tcaggcattggatatttttt

SEQ ID NO: 4475049 - DNA, 12 bp, Homo sapiens
tcaggccagccc

SEQ ID NO: 4475050 - DNA, 14 bp, Homo sapiens
tcaggccagcccag

SEQ ID NO: 4475051 - DNA, 21 bp, Homo sapiens
tcaggcccaggagtccaggcc

SEQ ID NO: 4475052 - DNA, 20 bp, Homo sapiens
tcaggccctgactcctctgg

SEQ ID NO: 4475053 - DNA, 18 bp, Homo sapiens
tcaggcctccctctctct

SEQ ID NO: 4475054 - DNA, 15 bp, Homo sapiens
tcaggcctggcctca

SEQ ID NO: 4475055 - DNA, 16 bp, Homo sapiens
tcaggcctggcctcat

SEQ ID NO: 4475056 - DNA, 18 bp, Homo sapiens
tcaggctagccctgccct

SEQ ID NO: 4475057 - DNA, 14 bp, Homo sapiens
tcaggctcaagttt

SEQ ID NO: 4475058 - DNA, 12 bp, Homo sapiens
tcaggctgctgg

SEQ ID NO: 4475059 - DNA, 17 bp, Homo sapiens
tcaggctgctggcgcct

SEQ ID NO: 4475060 - DNA, 22 bp, Homo sapiens
tcaggctgctggcgcctctgca

SEQ ID NO: 4475061 - DNA, 21 bp, Homo sapiens
tcagggaaactaagattcttt

SEQ ID NO: 4475062 - DNA, 21 bp, Homo sapiens
tcagggacagagacacctgca

SEQ ID NO: 4475063 - DNA, 16 bp, Homo sapiens
tcagggaccggtgctg

SEQ ID NO: 4475064 - DNA, 20 bp, Homo sapiens
tcagggaccggtgctgcagg

SEQ ID NO: 4475065 - DNA, 15 bp, Homo sapiens
tcagggacctgctgc

SEQ ID NO: 4475066 - DNA, 23 bp, Homo sapiens
tcagggacctgctgctcagtaag

SEQ ID NO: 4475067 - DNA, 18 bp, Homo sapiens
tcagggagacaggcaggg

SEQ ID NO: 4475068 - DNA, 22 bp, Homo sapiens
tcagggcacagtctccatgtgt

SEQ ID NO: 4475069 - DNA, 17 bp, Homo sapiens
tcagggcggcctcccag

SEQ ID NO: 4475070 - DNA, 16 bp, Homo sapiens
tcagggctcccagggg

SEQ ID NO: 4475071 - DNA, 14 bp, Homo sapiens
tcagggctcctggg

SEQ ID NO: 4475072 - DNA, 13 bp, Homo sapiens
tcagggctgtccc

SEQ ID NO: 4475073 - DNA, 15 bp, Homo sapiens
tcagggctgtcccag

SEQ ID NO: 4475074 - DNA, 19 bp, Homo sapiens
tcagggctgtcccagcccc

SEQ ID NO: 4475075 - DNA, 19 bp, Homo sapiens
tcaggggcctctctcctgc

SEQ ID NO: 4475076 - DNA, 20 bp, Homo sapiens
tcaggggtacattctagctg

SEQ ID NO: 4475077 - DNA, 21 bp, Homo sapiens
tcaggtaacactacagagtac

SEQ ID NO: 4475078 - DNA, 13 bp, Homo sapiens
tcaggtaactttc

SEQ ID NO: 4475079 - DNA, 16 bp, Homo sapiens
tcaggtaatacaaact

SEQ ID NO: 4475080 - DNA, 16 bp, Homo sapiens
tcaggtaatcatttta

SEQ ID NO: 4475081 - DNA, 17 bp, Homo sapiens
tcaggtaatcattttaa

SEQ ID NO: 4475082 - DNA, 16 bp, Homo sapiens
tcaggtaggggggaaa

SEQ ID NO: 4475083 - DNA, 16 bp, Homo sapiens
tcaggtgacctcctgc

SEQ ID NO: 4475084 - DNA, 23 bp, Homo sapiens
tcaggtggttaccaggcactggt

SEQ ID NO: 4475085 - DNA, 16 bp, Homo sapiens
tcaggtgtgctcaggg

SEQ ID NO: 4475086 - DNA, 23 bp, Homo sapiens
tcagtaaaattatactgtgtgtg

SEQ ID NO: 4475087 - DNA, 23 bp, Homo sapiens
tcagtaaagtggttctctgcctt

SEQ ID NO: 4475088 - DNA, 20 bp, Homo sapiens
tcagtaacataactgcttct

SEQ ID NO: 4475089 - DNA, 22 bp, Homo sapiens
tcagtaacataactgcttcttg

SEQ ID NO: 4475090 - DNA, 19 bp, Homo sapiens
tcagtaataaactgtgttt

SEQ ID NO: 4475091 - DNA, 22 bp, Homo sapiens
tcagtaatgcagtttttaaaaa

SEQ ID NO: 4475092 - DNA, 20 bp, Homo sapiens
tcagtacgatcaagttgttg

SEQ ID NO: 4475093 - DNA, 14 bp, Homo sapiens
tcagtactttttta

SEQ ID NO: 4475094 - DNA, 12 bp, Homo sapiens
tcagtagaaagc

SEQ ID NO: 4475095 - DNA, 15 bp, Homo sapiens
tcagtagaaagctaa

SEQ ID NO: 4475096 - DNA, 16 bp, Homo sapiens
tcagtagaaagctaaa

SEQ ID NO: 4475097 - DNA, 22 bp, Homo sapiens
tcagtagaaagctaaagtgatc

SEQ ID NO: 4475098 - DNA, 17 bp, Homo sapiens
tcagtagattgcagaaa

SEQ ID NO: 4475099 - DNA, 23 bp, Homo sapiens
tcagtaggtgcccagaataagtt

SEQ ID NO: 4475100 - DNA, 22 bp, Homo sapiens
tcagtatattttctgtatttaa

SEQ ID NO: 4475101 - DNA, 20 bp, Homo sapiens
aaggagtttaaatgagacta

SEQ ID NO: 4475102 - DNA, 17 bp, Homo sapiens
aaggagtttattacaat

SEQ ID NO: 4475103 - DNA, 22 bp, Homo sapiens
aaggagtttattacaatgtatc

SEQ ID NO: 4475104 - DNA, 15 bp, Homo sapiens
aaggataaatcataa

SEQ ID NO: 4475105 - DNA, 14 bp, Homo sapiens
aaggataaattttt

SEQ ID NO: 4475106 - DNA, 14 bp, Homo sapiens
aaggatacataatg

SEQ ID NO: 4475107 - DNA, 17 bp, Homo sapiens
aaggataccttcttatt

SEQ ID NO: 4475108 - DNA, 22 bp, Homo sapiens
aaggataggccttcattaacaa

SEQ ID NO: 4475109 - DNA, 14 bp, Homo sapiens
aaggatatgattaa

SEQ ID NO: 4475110 - DNA, 23 bp, Homo sapiens
aaggatatgattaatattattaa

SEQ ID NO: 4475111 - DNA, 17 bp, Homo sapiens
aaggatcggactctgcc

SEQ ID NO: 4475112 - DNA, 18 bp, Homo sapiens
aaggatcggactctgccc

SEQ ID NO: 4475113 - DNA, 21 bp, Homo sapiens
aaggatcggactctgcccctg

SEQ ID NO: 4475114 - DNA, 12 bp, Homo sapiens
aaggatgacttt

SEQ ID NO: 4475115 - DNA, 17 bp, Homo sapiens
aaggatgacttttttat

SEQ ID NO: 4475116 - DNA, 19 bp, Homo sapiens
aaggatgacttttttatac

SEQ ID NO: 4475117 - DNA, 17 bp, Homo sapiens
aaggatgccacttggga

SEQ ID NO: 4475118 - DNA, 17 bp, Homo sapiens
aaggatggggttatgaa

SEQ ID NO: 4475119 - DNA, 20 bp, Homo sapiens
aaggatgtaaacagtgcctg

SEQ ID NO: 4475120 - DNA, 18 bp, Homo sapiens
aaggattctgaagtttta

SEQ ID NO: 4475121 - DNA, 13 bp, Homo sapiens
aaggattttacca

SEQ ID NO: 4475122 - DNA, 23 bp, Homo sapiens
aaggattttatgagttcttgttt

SEQ ID NO: 4475123 - DNA, 21 bp, Homo sapiens
aaggcaaaaatagtttggata

SEQ ID NO: 4475124 - DNA, 15 bp, Homo sapiens
aaggcaaaaccgtgc

SEQ ID NO: 4475125 - DNA, 14 bp, Homo sapiens
aaggcaaaattgca

SEQ ID NO: 4475126 - DNA, 15 bp, Homo sapiens
aaggcaaaattgcaa

SEQ ID NO: 4475127 - DNA, 15 bp, Homo sapiens
aaggcaaacccatca

SEQ ID NO: 4475128 - DNA, 20 bp, Homo sapiens
aaggcaaacccatcaacaaa

SEQ ID NO: 4475129 - DNA, 20 bp, Homo sapiens
aaggcaaatattgaagttgt

SEQ ID NO: 4475130 - DNA, 21 bp, Homo sapiens
aaggcaagagggggtggaggg

SEQ ID NO: 4475131 - DNA, 23 bp, Homo sapiens
aaggcaagcatgaataaaattag

SEQ ID NO: 4475132 - DNA, 16 bp, Homo sapiens
aaggcaattttagtgt

SEQ ID NO: 4475133 - DNA, 22 bp, Homo sapiens
aaggcacccatctgtctgccaa

SEQ ID NO: 4475134 - DNA, 22 bp, Homo sapiens
aaggcagagaaatctaagctgt

SEQ ID NO: 4475135 - DNA, 16 bp, Homo sapiens
aaggcagcatgtatag

SEQ ID NO: 4475136 - DNA, 11 bp, Homo sapiens
aaggcagccac

SEQ ID NO: 4475137 - DNA, 16 bp, Homo sapiens
aaggcagctgcctctg

SEQ ID NO: 4475138 - DNA, 15 bp, Homo sapiens
aaggcagtttgcaaa

SEQ ID NO: 4475139 - DNA, 19 bp, Homo sapiens
aaggcagtttgcaaaaaat

SEQ ID NO: 4475140 - DNA, 17 bp, Homo sapiens
aaggcatgttttaaaat

SEQ ID NO: 4475141 - DNA, 18 bp, Homo sapiens
aaggccaaaatcaagagt

SEQ ID NO: 4475142 - DNA, 13 bp, Homo sapiens
aaggccaaggtgc

SEQ ID NO: 4475143 - DNA, 15 bp, Homo sapiens
aaggccaatatacct

SEQ ID NO: 4475144 - DNA, 15 bp, Homo sapiens
aaggccacaggcagt

SEQ ID NO: 4475145 - DNA, 21 bp, Homo sapiens
aaggccagagtggcctggcca

SEQ ID NO: 4475146 - DNA, 16 bp, Homo sapiens
aaggccagtggaagaa

SEQ ID NO: 4475147 - DNA, 14 bp, Homo sapiens
aaggccataaaaca

SEQ ID NO: 4475148 - DNA, 22 bp, Homo sapiens
aaggccgctgttcacccacagg

SEQ ID NO: 4475149 - DNA, 15 bp, Homo sapiens
aaggccgtcatttca

SEQ ID NO: 4475150 - DNA, 17 bp, Homo sapiens
aaggccgtgtctctgag

SEQ ID NO: 4475151 - DNA, 18 bp, Homo sapiens
aaggcctaccccagttcc

SEQ ID NO: 4475152 - DNA, 19 bp, Homo sapiens
aaggcctaccccagttcct

SEQ ID NO: 4475153 - DNA, 23 bp, Homo sapiens
aaggcctaccccagttcctagca

SEQ ID NO: 4475154 - DNA, 20 bp, Homo sapiens
aaggcctcttgtaaagactg

SEQ ID NO: 4475155 - DNA, 21 bp, Homo sapiens
aaggcctcttgtaaagactgg

SEQ ID NO: 4475156 - DNA, 13 bp, Homo sapiens
aaggcggcccctc

SEQ ID NO: 4475157 - DNA, 23 bp, Homo sapiens
aaggctatggggatagatgtgtg

SEQ ID NO: 4475158 - DNA, 14 bp, Homo sapiens
aaggctcagaagga

SEQ ID NO: 4475159 - DNA, 14 bp, Homo sapiens
aaggctcatttaaa

SEQ ID NO: 4475160 - DNA, 18 bp, Homo sapiens
aaggctcatttaaaacag

SEQ ID NO: 4475161 - DNA, 13 bp, Homo sapiens
aaggctctcaccc

SEQ ID NO: 4475162 - DNA, 14 bp, Homo sapiens
aaggctctcccctc

SEQ ID NO: 4475163 - DNA, 23 bp, Homo sapiens
aaggctctcccctctcgccccat

SEQ ID NO: 4475164 - DNA, 19 bp, Homo sapiens
aaggctctctctgtccctg

SEQ ID NO: 4475165 - DNA, 20 bp, Homo sapiens
aaggctgacattcactgagt

SEQ ID NO: 4475166 - DNA, 20 bp, Homo sapiens
aaggctgaggcaggagaatc

SEQ ID NO: 4475167 - DNA, 22 bp, Homo sapiens
aaggctgaggcaggaggatcac

SEQ ID NO: 4475168 - DNA, 23 bp, Homo sapiens
aaggctgaggcaggaggatcact

SEQ ID NO: 4475169 - DNA, 18 bp, Homo sapiens
aaggctgtccacgtactt

SEQ ID NO: 4475170 - DNA, 17 bp, Homo sapiens
aaggctgtgataaccag

SEQ ID NO: 4475171 - DNA, 21 bp, Homo sapiens
aaggctgttaaatacaggaaa

SEQ ID NO: 4475172 - DNA, 15 bp, Homo sapiens
aaggcttaaacccat

SEQ ID NO: 4475173 - DNA, 12 bp, Homo sapiens
aaggcttccagg

SEQ ID NO: 4475174 - DNA, 17 bp, Homo sapiens
aaggcttctctctgtgg

SEQ ID NO: 4475175 - DNA, 14 bp, Homo sapiens
aaggcttgggattt

SEQ ID NO: 4475176 - DNA, 19 bp, Homo sapiens
aaggcttgggatttgctgt

SEQ ID NO: 4475177 - DNA, 21 bp, Homo sapiens
aaggctttaaaagtcattatt

SEQ ID NO: 4475178 - DNA, 17 bp, Homo sapiens
aaggctttttcttccct

SEQ ID NO: 4475179 - DNA, 11 bp, Homo sapiens
aagggaaaaat

SEQ ID NO: 4475180 - DNA, 16 bp, Homo sapiens
aagggaaactggctga

SEQ ID NO: 4475181 - DNA, 20 bp, Homo sapiens
aagggaaagcgggcagcccc

SEQ ID NO: 4475182 - DNA, 21 bp, Homo sapiens
aagggaaattgtttatgtgtt

SEQ ID NO: 4475183 - DNA, 20 bp, Homo sapiens
aagggaacccccaaatttaa

SEQ ID NO: 4475184 - DNA, 15 bp, Homo sapiens
aagggaagagccttt

SEQ ID NO: 4475185 - DNA, 21 bp, Homo sapiens
aagggacacttttatgttttt

SEQ ID NO: 4475186 - DNA, 21 bp, Homo sapiens
aagggacatttctataaaaat

SEQ ID NO: 4475187 - DNA, 15 bp, Homo sapiens
aagggaccagccctt

SEQ ID NO: 4475188 - DNA, 13 bp, Homo sapiens
aagggaccccccc

SEQ ID NO: 4475189 - DNA, 19 bp, Homo sapiens
aagggagaatggtgctgtt

SEQ ID NO: 4475190 - DNA, 23 bp, Homo sapiens
aagggagagttctttgctgcccc

SEQ ID NO: 4475191 - DNA, 18 bp, Homo sapiens
aagggagctatcaggaac

SEQ ID NO: 4475192 - DNA, 13 bp, Homo sapiens
aagggagggggag

SEQ ID NO: 4475193 - DNA, 18 bp, Homo sapiens
aagggagtttaaaaatgg

SEQ ID NO: 4475194 - DNA, 16 bp, Homo sapiens
aagggatattaagaat

SEQ ID NO: 4475195 - DNA, 16 bp, Homo sapiens
aagggatcatcatgca

SEQ ID NO: 4475196 - DNA, 13 bp, Homo sapiens
aagggatcctgcc

SEQ ID NO: 4475197 - DNA, 14 bp, Homo sapiens
aagggatggcaaga

SEQ ID NO: 4475198 - DNA, 17 bp, Homo sapiens
aagggatggcaagatgt

SEQ ID NO: 4475199 - DNA, 22 bp, Homo sapiens
aagggcaacagatcagtaaaga

SEQ ID NO: 4475200 - DNA, 18 bp, Homo sapiens
aagggcagaacactaacc

SEQ ID NO: 4475201 - DNA, 13 bp, Homo sapiens
aagggcagaatga

SEQ ID NO: 4475202 - DNA, 16 bp, Homo sapiens
aagggcattttaaaag

SEQ ID NO: 4475203 - DNA, 9 bp, Homo sapiens
aagggctgg

SEQ ID NO: 4475204 - DNA, 17 bp, Homo sapiens
aagggctggctccccct

SEQ ID NO: 4475205 - DNA, 17 bp, Homo sapiens
aagggctgggccaccag

SEQ ID NO: 4475206 - DNA, 22 bp, Homo sapiens
aagggcttgtttttcttcagca

SEQ ID NO: 4475207 - DNA, 18 bp, Homo sapiens
aagggctttgttttgcac

SEQ ID NO: 4475208 - DNA, 13 bp, Homo sapiens
aaggggaatggaa

SEQ ID NO: 4475209 - DNA, 12 bp, Homo sapiens
aaggggagagcc

SEQ ID NO: 4475210 - DNA, 14 bp, Homo sapiens
aaggggagagcctg

SEQ ID NO: 4475211 - DNA, 14 bp, Homo sapiens
aaggggatttttat

SEQ ID NO: 4475212 - DNA, 20 bp, Homo sapiens
aaggggatttttatgtctgg

SEQ ID NO: 4475213 - DNA, 18 bp, Homo sapiens
aagtaaaagcaaaaaaga

SEQ ID NO: 4475214 - DNA, 20 bp, Homo sapiens
aagtaaaagtctacctgtgt

SEQ ID NO: 4475215 - DNA, 12 bp, Homo sapiens
aagtaaaatgtc

SEQ ID NO: 4475216 - DNA, 17 bp, Homo sapiens
aagtaaagtggttttgt

SEQ ID NO: 4475217 - DNA, 12 bp, Homo sapiens
aagtaaatatat

SEQ ID NO: 4475218 - DNA, 15 bp, Homo sapiens
aagtaaatgtagctc

SEQ ID NO: 4475219 - DNA, 13 bp, Homo sapiens
aagtaaattttac

SEQ ID NO: 4475220 - DNA, 16 bp, Homo sapiens
aagtaacgtgctcact

SEQ ID NO: 4475221 - DNA, 20 bp, Homo sapiens
aagtaacgtgctcactgtgt

SEQ ID NO: 4475222 - DNA, 17 bp, Homo sapiens
aagtaacttatttgact

SEQ ID NO: 4475223 - DNA, 16 bp, Homo sapiens
aagtaagaatggccaa

SEQ ID NO: 4475224 - DNA, 20 bp, Homo sapiens
aagtaaggtgcttggagttt

SEQ ID NO: 4475225 - DNA, 14 bp, Homo sapiens
aagtaatcacttaa

SEQ ID NO: 4475226 - DNA, 20 bp, Homo sapiens
aagtaatgacttagaaactg

SEQ ID NO: 4475227 - DNA, 15 bp, Homo sapiens
aagtacaaacatgaa

SEQ ID NO: 4475228 - DNA, 18 bp, Homo sapiens
aagtacaatgtgtttttc

SEQ ID NO: 4475229 - DNA, 17 bp, Homo sapiens
aagtacacaataagcaa

SEQ ID NO: 4475230 - DNA, 18 bp, Homo sapiens
aagtacacaataagcaaa

SEQ ID NO: 4475231 - DNA, 19 bp, Homo sapiens
aagtacacaataagcaaaa

SEQ ID NO: 4475232 - DNA, 16 bp, Homo sapiens
aagtacactctgctgt

SEQ ID NO: 4475233 - DNA, 13 bp, Homo sapiens
aagtacagaattt

SEQ ID NO: 4475234 - DNA, 14 bp, Homo sapiens
aagtacagcctgga

SEQ ID NO: 4475235 - DNA, 19 bp, Homo sapiens
aagtacagcggctcccctc

SEQ ID NO: 4475236 - DNA, 17 bp, Homo sapiens
aagtacattgcttaaaa

SEQ ID NO: 4475237 - DNA, 23 bp, Homo sapiens
aagtactgctgtaaataaatgct

SEQ ID NO: 4475238 - DNA, 20 bp, Homo sapiens
aagtactggtaagattgtta

SEQ ID NO: 4475239 - DNA, 15 bp, Homo sapiens
aagtactgtaagaat

SEQ ID NO: 4475240 - DNA, 18 bp, Homo sapiens
aagtagattcatgaaaat

SEQ ID NO: 4475241 - DNA, 21 bp, Homo sapiens
aagtagattcatgaaaatgta

SEQ ID NO: 4475242 - DNA, 13 bp, Homo sapiens
aagtagatttcat

SEQ ID NO: 4475243 - DNA, 14 bp, Homo sapiens
aagtagatttcatg

SEQ ID NO: 4475244 - DNA, 18 bp, Homo sapiens
aagtagcaaatgtttact

SEQ ID NO: 4475245 - DNA, 14 bp, Homo sapiens
aagtagcattcatg

SEQ ID NO: 4475246 - DNA, 17 bp, Homo sapiens
aagtagcattcatgtaa

SEQ ID NO: 4475247 - DNA, 21 bp, Homo sapiens
aagtagctgtcagatgtcaca

SEQ ID NO: 4475248 - DNA, 21 bp, Homo sapiens
aagtagggacttctgtcttca

SEQ ID NO: 4475249 - DNA, 19 bp, Homo sapiens
aagtagtacttcttctgta

SEQ ID NO: 4475250 - DNA, 22 bp, Homo sapiens
aagtagtacttcttctgtaata

SEQ ID NO: 4475251 - DNA, 15 bp, Homo sapiens
aagtagttattttat

SEQ ID NO: 4475252 - DNA, 23 bp, Homo sapiens
aagtatagagagaagttcataca

SEQ ID NO: 4475253 - DNA, 19 bp, Homo sapiens
aagtatatcagctactgta

SEQ ID NO: 4475254 - DNA, 19 bp, Homo sapiens
aagtatatgtgagaaatca

SEQ ID NO: 4475255 - DNA, 14 bp, Homo sapiens
aagtatattaaaca

SEQ ID NO: 4475256 - DNA, 19 bp, Homo sapiens
aagtatcatcagtgtagaa

SEQ ID NO: 4475257 - DNA, 20 bp, Homo sapiens
aagtatgcattattaaattg

SEQ ID NO: 4475258 - DNA, 14 bp, Homo sapiens
aagtatgtattatt

SEQ ID NO: 4475259 - DNA, 15 bp, Homo sapiens
aagtattacatgatt

SEQ ID NO: 4475260 - DNA, 17 bp, Homo sapiens
aagtattacatgattta

SEQ ID NO: 4475261 - DNA, 13 bp, Homo sapiens
aagtattatcaga

SEQ ID NO: 4475262 - DNA, 15 bp, Homo sapiens
aagtattatgtctct

SEQ ID NO: 4475263 - DNA, 16 bp, Homo sapiens
aagtattccaccttaa

SEQ ID NO: 4475264 - DNA, 14 bp, Homo sapiens
aagtattctttttc

SEQ ID NO: 4475265 - DNA, 20 bp, Homo sapiens
aagtattgtaaattatattt

SEQ ID NO: 4475266 - DNA, 15 bp, Homo sapiens
aagtatttacttttt

SEQ ID NO: 4475267 - DNA, 20 bp, Homo sapiens
aagtatttactttttaaaaa

SEQ ID NO: 4475268 - DNA, 21 bp, Homo sapiens
aagtatttactttttaaaaat

SEQ ID NO: 4475269 - DNA, 14 bp, Homo sapiens
aagtatttataaaa

SEQ ID NO: 4475270 - DNA, 19 bp, Homo sapiens
aagtatttataaaaatata

SEQ ID NO: 4475271 - DNA, 11 bp, Homo sapiens
aagtatttctg

SEQ ID NO: 4475272 - DNA, 19 bp, Homo sapiens
aagtatttgttaatttaga

SEQ ID NO: 4475273 - DNA, 21 bp, Homo sapiens
aagtatttgttaatttagaaa

SEQ ID NO: 4475274 - DNA, 18 bp, Homo sapiens
aagtattttaattttaaa

SEQ ID NO: 4475275 - DNA, 19 bp, Homo sapiens
aagtattttaattttaaag

SEQ ID NO: 4475276 - DNA, 22 bp, Homo sapiens
aagtattttcataagtatttca

SEQ ID NO: 4475277 - DNA, 16 bp, Homo sapiens
aagtatttttttaatt

SEQ ID NO: 4475278 - DNA, 19 bp, Homo sapiens
aagtatttttttaatttct

SEQ ID NO: 4475279 - DNA, 16 bp, Homo sapiens
aagtcaaaaggtgcct

SEQ ID NO: 4475280 - DNA, 14 bp, Homo sapiens
aagtcaaaatatgt

SEQ ID NO: 4475281 - DNA, 17 bp, Homo sapiens
aagtcaacagtaaacca

SEQ ID NO: 4475282 - DNA, 16 bp, Homo sapiens
aagtcaacctgcctga

SEQ ID NO: 4475283 - DNA, 14 bp, Homo sapiens
aagtcaatgtactt

SEQ ID NO: 4475284 - DNA, 23 bp, Homo sapiens
aagtcagatggaaaattcatttt

SEQ ID NO: 4475285 - DNA, 14 bp, Homo sapiens
aagtcagatgtttg

SEQ ID NO: 4475286 - DNA, 15 bp, Homo sapiens
aagtcagcatatgag

SEQ ID NO: 4475287 - DNA, 18 bp, Homo sapiens
aagtcagtgggaacgtga

SEQ ID NO: 4475288 - DNA, 20 bp, Homo sapiens
aagtcagttgctcaaaaaga

SEQ ID NO: 4475289 - DNA, 13 bp, Homo sapiens
aagtcatcttgct

SEQ ID NO: 4475290 - DNA, 14 bp, Homo sapiens
aagtcatggtcaca

SEQ ID NO: 4475291 - DNA, 19 bp, Homo sapiens
aagtcatggtcacagtaaa

SEQ ID NO: 4475292 - DNA, 12 bp, Homo sapiens
aagtcatttaaa

SEQ ID NO: 4475293 - DNA, 12 bp, Homo sapiens
aagtcatttttg

SEQ ID NO: 4475294 - DNA, 18 bp, Homo sapiens
aagtcatttttgtatttt

SEQ ID NO: 4475295 - DNA, 22 bp, Homo sapiens
aagtcatttttgtatttttcat

SEQ ID NO: 4475296 - DNA, 19 bp, Homo sapiens
aagtccattttttaaaaat

SEQ ID NO: 4475297 - DNA, 20 bp, Homo sapiens
aagtcccaccctcttcccat

SEQ ID NO: 4475298 - DNA, 18 bp, Homo sapiens
aagtccccctcctcagcc

SEQ ID NO: 4475299 - DNA, 13 bp, Homo sapiens
aagtccctccctg

SEQ ID NO: 4475300 - DNA, 12 bp, Homo sapiens
aagtcctgcttt

SEQ ID NO: 4475301 - DNA, 20 bp, Homo sapiens
aagtccttcagtgagcccct

SEQ ID NO: 4475302 - DNA, 21 bp, Homo sapiens
aagtctaactttggttttctt

SEQ ID NO: 4475303 - DNA, 15 bp, Homo sapiens
aagtctacctgtgtt

SEQ ID NO: 4475304 - DNA, 14 bp, Homo sapiens
aagtctagaatcat

SEQ ID NO: 4475305 - DNA, 19 bp, Homo sapiens
aagtctaggagctgggagg

SEQ ID NO: 4475306 - DNA, 22 bp, Homo sapiens
aagtctatctaatgacatgcct

SEQ ID NO: 4475307 - DNA, 17 bp, Homo sapiens
aagtctcaatgaaatag

SEQ ID NO: 4475308 - DNA, 15 bp, Homo sapiens
aagtctcagaagagg

SEQ ID NO: 4475309 - DNA, 20 bp, Homo sapiens
aagtctcataggttaaaaaa

SEQ ID NO: 4475310 - DNA, 13 bp, Homo sapiens
aagtctctattta

SEQ ID NO: 4475311 - DNA, 19 bp, Homo sapiens
aagtctctatttaaattct

SEQ ID NO: 4475312 - DNA, 20 bp, Homo sapiens
aagtctctatttaaattctt

SEQ ID NO: 4475313 - DNA, 19 bp, Homo sapiens
aagtctgcatttcatatta

SEQ ID NO: 4475314 - DNA, 12 bp, Homo sapiens
aagtctgccgat

SEQ ID NO: 4475315 - DNA, 22 bp, Homo sapiens
aagtctgccgattttgtaaatg

SEQ ID NO: 4475316 - DNA, 18 bp, Homo sapiens
aagtctggatctgggacc

SEQ ID NO: 4475317 - DNA, 15 bp, Homo sapiens
aagtctgttatttat

SEQ ID NO: 4475318 - DNA, 14 bp, Homo sapiens
gtccacttgtaaga

SEQ ID NO: 4475319 - DNA, 12 bp, Homo sapiens
gtccagacagcc

SEQ ID NO: 4475320 - DNA, 14 bp, Homo sapiens
gtccagacagcctg

SEQ ID NO: 4475321 - DNA, 15 bp, Homo sapiens
gtccagacagcctgt

SEQ ID NO: 4475322 - DNA, 16 bp, Homo sapiens
gtccagacagcctgta

SEQ ID NO: 4475323 - DNA, 14 bp, Homo sapiens
gtccagacccccca

SEQ ID NO: 4475324 - DNA, 18 bp, Homo sapiens
gtccagaccccccagccc

SEQ ID NO: 4475325 - DNA, 15 bp, Homo sapiens
gtccagcccctcctc

SEQ ID NO: 4475326 - DNA, 16 bp, Homo sapiens
gtccagcccctcctcc

SEQ ID NO: 4475327 - DNA, 22 bp, Homo sapiens
gtccagcccctcctccctcaga

SEQ ID NO: 4475328 - DNA, 13 bp, Homo sapiens
gtccagctggggc

SEQ ID NO: 4475329 - DNA, 16 bp, Homo sapiens
gtccagcttgctcttc

SEQ ID NO: 4475330 - DNA, 17 bp, Homo sapiens
gtccaggaatggtgctt

SEQ ID NO: 4475331 - DNA, 17 bp, Homo sapiens
gtccaggagctaatctg

SEQ ID NO: 4475332 - DNA, 20 bp, Homo sapiens
gtccaggcccccagcccctc

SEQ ID NO: 4475333 - DNA, 18 bp, Homo sapiens
gtccagggaaacagcctc

SEQ ID NO: 4475334 - DNA, 13 bp, Homo sapiens
gtccagggaagct

SEQ ID NO: 4475335 - DNA, 18 bp, Homo sapiens
gtccaggggcccctccag

SEQ ID NO: 4475336 - DNA, 18 bp, Homo sapiens
gtccaggtcccagcccct

SEQ ID NO: 4475337 - DNA, 15 bp, Homo sapiens
gtccaggtccgtagc

SEQ ID NO: 4475338 - DNA, 23 bp, Homo sapiens
gtccaggtccgtagctcccctgg

SEQ ID NO: 4475339 - DNA, 12 bp, Homo sapiens
gtccagtgctct

SEQ ID NO: 4475340 - DNA, 14 bp, Homo sapiens
gtccagtgctctgc

SEQ ID NO: 4475341 - DNA, 17 bp, Homo sapiens
gtccagtgctctgcctc

SEQ ID NO: 4475342 - DNA, 15 bp, Homo sapiens
gtccatagagatgag

SEQ ID NO: 4475343 - DNA, 21 bp, Homo sapiens
gtccatagagatgagcccacc

SEQ ID NO: 4475344 - DNA, 16 bp, Homo sapiens
gtccatatcacacaca

SEQ ID NO: 4475345 - DNA, 22 bp, Homo sapiens
gtccatccccttcccccatccc

SEQ ID NO: 4475346 - DNA, 19 bp, Homo sapiens
gtccatgctaacaaagaca

SEQ ID NO: 4475347 - DNA, 20 bp, Homo sapiens
gtccatgctccagggtcagg

SEQ ID NO: 4475348 - DNA, 20 bp, Homo sapiens
gtccatgtttattgtttttt

SEQ ID NO: 4475349 - DNA, 13 bp, Homo sapiens
gtccattctccca

SEQ ID NO: 4475350 - DNA, 15 bp, Homo sapiens
gtccattctcccagg

SEQ ID NO: 4475351 - DNA, 21 bp, Homo sapiens
gtccattgtccaatcctatgt

SEQ ID NO: 4475352 - DNA, 16 bp, Homo sapiens
gtccatttacacgtat

SEQ ID NO: 4475353 - DNA, 16 bp, Homo sapiens
gtccatttttacaagt

SEQ ID NO: 4475354 - DNA, 16 bp, Homo sapiens
gtcccaagctgggccc

SEQ ID NO: 4475355 - DNA, 13 bp, Homo sapiens
gtcccaagtgcca

SEQ ID NO: 4475356 - DNA, 14 bp, Homo sapiens
gtcccaagtgccaa

SEQ ID NO: 4475357 - DNA, 14 bp, Homo sapiens
gtcccaattaaaat

SEQ ID NO: 4475358 - DNA, 21 bp, Homo sapiens
gtcccacatcagggcggcctc

SEQ ID NO: 4475359 - DNA, 18 bp, Homo sapiens
gtcccaccgggagcctcc

SEQ ID NO: 4475360 - DNA, 16 bp, Homo sapiens
gtcccacgccaggcca

SEQ ID NO: 4475361 - DNA, 24 bp, Homo sapiens
gtcccactacttgtggggctaagg

SEQ ID NO: 4475362 - DNA, 22 bp, Homo sapiens
gtcccagactaaaggatccaga

SEQ ID NO: 4475363 - DNA, 17 bp, Homo sapiens
gtcccagattggctcac

SEQ ID NO: 4475364 - DNA, 15 bp, Homo sapiens
gtcccagcatccctg

SEQ ID NO: 4475365 - DNA, 22 bp, Homo sapiens
gtcccagcatccctggagcagg

SEQ ID NO: 4475366 - DNA, 16 bp, Homo sapiens
gtcccagccaccccgg

SEQ ID NO: 4475367 - DNA, 18 bp, Homo sapiens
gtcccagccaccccgggc

SEQ ID NO: 4475368 - DNA, 21 bp, Homo sapiens
gtcccagccaccccgggctct

SEQ ID NO: 4475369 - DNA, 13 bp, Homo sapiens
gtcccagcccctc

SEQ ID NO: 4475370 - DNA, 16 bp, Homo sapiens
gtcccagcccctcctc

SEQ ID NO: 4475371 - DNA, 19 bp, Homo sapiens
gtcccagcccctcctccct

SEQ ID NO: 4475372 - DNA, 20 bp, Homo sapiens
gtcccagcccctcctccctc

SEQ ID NO: 4475373 - DNA, 17 bp, Homo sapiens
cattcgtgagctgggga

SEQ ID NO: 4475374 - DNA, 18 bp, Homo sapiens
cattcgtgagctggggac

SEQ ID NO: 4475375 - DNA, 22 bp, Homo sapiens
cattctaactcatatgttccca

SEQ ID NO: 4475376 - DNA, 19 bp, Homo sapiens
cattctacacagagcagga

SEQ ID NO: 4475377 - DNA, 14 bp, Homo sapiens
cattctacctgagg

SEQ ID NO: 4475378 - DNA, 16 bp, Homo sapiens
cattctagatcctgca

SEQ ID NO: 4475379 - DNA, 16 bp, Homo sapiens
cattctattttagaat

SEQ ID NO: 4475380 - DNA, 17 bp, Homo sapiens
cattctattttagaata

SEQ ID NO: 4475381 - DNA, 23 bp, Homo sapiens
cattctcagaattcggtgtgctg

SEQ ID NO: 4475382 - DNA, 21 bp, Homo sapiens
cattctcccaggtaccagctg

SEQ ID NO: 4475383 - DNA, 23 bp, Homo sapiens
cattctcccaggtaccagctgcg

SEQ ID NO: 4475384 - DNA, 19 bp, Homo sapiens
cattctcctcagtggcttc

SEQ ID NO: 4475385 - DNA, 16 bp, Homo sapiens
cattctcctgcctcag

SEQ ID NO: 4475386 - DNA, 19 bp, Homo sapiens
cattctcctgcctcagcct

SEQ ID NO: 4475387 - DNA, 20 bp, Homo sapiens
cattctcctgcctcagcctc

SEQ ID NO: 4475388 - DNA, 16 bp, Homo sapiens
cattctcgcttccctg

SEQ ID NO: 4475389 - DNA, 19 bp, Homo sapiens
cattctcgtgagtcattta

SEQ ID NO: 4475390 - DNA, 16 bp, Homo sapiens
cattctctcatagaac

SEQ ID NO: 4475391 - DNA, 15 bp, Homo sapiens
cattctctctcctgt

SEQ ID NO: 4475392 - DNA, 19 bp, Homo sapiens
cattctctgtctcatccat

SEQ ID NO: 4475393 - DNA, 14 bp, Homo sapiens
cattctcttttaat

SEQ ID NO: 4475394 - DNA, 19 bp, Homo sapiens
cattctgcactcagaaaat

SEQ ID NO: 4475395 - DNA, 23 bp, Homo sapiens
cattctgcactcagaaaatggca

SEQ ID NO: 4475396 - DNA, 22 bp, Homo sapiens
cattctgcatcctggcttgaaa

SEQ ID NO: 4475397 - DNA, 13 bp, Homo sapiens
cattctgccaaag

SEQ ID NO: 4475398 - DNA, 18 bp, Homo sapiens
cattctgccaaagtaaaa

SEQ ID NO: 4475399 - DNA, 13 bp, Homo sapiens
cattctgccttgg

SEQ ID NO: 4475400 - DNA, 21 bp, Homo sapiens
gtcaaaggtcgggacagctgt

SEQ ID NO: 4475401 - DNA, 17 bp, Homo sapiens
gtcaaataaacactgtg

SEQ ID NO: 4475402 - DNA, 22 bp, Homo sapiens
gtcaaatggtaggcatttccta

SEQ ID NO: 4475403 - DNA, 14 bp, Homo sapiens
gtcaacaaagtgct

SEQ ID NO: 4475404 - DNA, 19 bp, Homo sapiens
gtcaacagagaaggcagga

SEQ ID NO: 4475405 - DNA, 22 bp, Homo sapiens
gtcaacatagtgagacactgtc

SEQ ID NO: 4475406 - DNA, 13 bp, Homo sapiens
gtcaacatttctc

SEQ ID NO: 4475407 - DNA, 19 bp, Homo sapiens
gtcaacctgggcaaagcct

SEQ ID NO: 4475408 - DNA, 23 bp, Homo sapiens
gtcaacggggggctcctgcccag

SEQ ID NO: 4475409 - DNA, 14 bp, Homo sapiens
gtcaactacacaaa

SEQ ID NO: 4475410 - DNA, 13 bp, Homo sapiens
gtcaactggctgg

SEQ ID NO: 4475411 - DNA, 18 bp, Homo sapiens
gtcaactggctggccagt

SEQ ID NO: 4475412 - DNA, 14 bp, Homo sapiens
gtcaagacatttct

SEQ ID NO: 4475413 - DNA, 18 bp, Homo sapiens
gtcaagattttttttgta

SEQ ID NO: 4475414 - DNA, 15 bp, Homo sapiens
gtcaaggaagctggg

SEQ ID NO: 4475415 - DNA, 16 bp, Homo sapiens
gtcaagtgcctgcacc

SEQ ID NO: 4475416 - DNA, 17 bp, Homo sapiens
gtcaagttcctttgggt

SEQ ID NO: 4475417 - DNA, 12 bp, Homo sapiens
gtcaatgatggt

SEQ ID NO: 4475418 - DNA, 14 bp, Homo sapiens
gtcaatgtgtgcac

SEQ ID NO: 4475419 - DNA, 22 bp, Homo sapiens
gtcaattaaaatgcccatttgt

SEQ ID NO: 4475420 - DNA, 20 bp, Homo sapiens
gtcacaaactgatctaaaat

SEQ ID NO: 4475421 - DNA, 15 bp, Homo sapiens
gtcacaataaagttt

SEQ ID NO: 4475422 - DNA, 18 bp, Homo sapiens
gtcacacaagggaagtgg

SEQ ID NO: 4475423 - DNA, 14 bp, Homo sapiens
gtcacacagggcag

SEQ ID NO: 4475424 - DNA, 20 bp, Homo sapiens
gtcacacagtgttggaggtt

SEQ ID NO: 4475425 - DNA, 14 bp, Homo sapiens
gtcacacatttcta

SEQ ID NO: 4475426 - DNA, 17 bp, Homo sapiens
gtcacagacgtgaaagc

SEQ ID NO: 4475427 - DNA, 21 bp, Homo sapiens
gtcacagacgtgaaagccaga

SEQ ID NO: 4475428 - DNA, 18 bp, Homo sapiens
gtcacagacttctggcct

SEQ ID NO: 4475429 - DNA, 19 bp, Homo sapiens
gtcacagccgtttgaatat

SEQ ID NO: 4475430 - DNA, 14 bp, Homo sapiens
gtcacagcctcctc

SEQ ID NO: 4475431 - DNA, 16 bp, Homo sapiens
gtcacagcctcctctg

SEQ ID NO: 4475432 - DNA, 13 bp, Homo sapiens
gtcacaggaagta

SEQ ID NO: 4475433 - DNA, 15 bp, Homo sapiens
gtcacaggaagtaga

SEQ ID NO: 4475434 - DNA, 16 bp, Homo sapiens
gtcacagtaaaaataa

SEQ ID NO: 4475435 - DNA, 19 bp, Homo sapiens
gtcacagtaaagagtacac

SEQ ID NO: 4475436 - DNA, 16 bp, Homo sapiens
gtcacagtcttgtgaa

SEQ ID NO: 4475437 - DNA, 23 bp, Homo sapiens
gtcacatcacaatattcagtggt

SEQ ID NO: 4475438 - DNA, 22 bp, Homo sapiens
gtcaccaaatagtgtgaaatat

SEQ ID NO: 4475439 - DNA, 14 bp, Homo sapiens
gtcaccaccttccc

SEQ ID NO: 4475440 - DNA, 16 bp, Homo sapiens
gtcaccaccttcccag

SEQ ID NO: 4475441 - DNA, 18 bp, Homo sapiens
gtcaccagctatctgtca

SEQ ID NO: 4475442 - DNA, 16 bp, Homo sapiens
gtcaccgagactcagc

SEQ ID NO: 4475443 - DNA, 18 bp, Homo sapiens
gtcaccgagactcagcct

SEQ ID NO: 4475444 - DNA, 22 bp, Homo sapiens
gtcaccgggatgaacctatcct

SEQ ID NO: 4475445 - DNA, 17 bp, Homo sapiens
gtcaccggtcagtgcct

SEQ ID NO: 4475446 - DNA, 22 bp, Homo sapiens
gtcacctagaacgtgcatcctt

SEQ ID NO: 4475447 - DNA, 19 bp, Homo sapiens
gtcacctctcagctgctgg

SEQ ID NO: 4475448 - DNA, 24 bp, Homo sapiens
gtcacctctcagctgctggatgac

SEQ ID NO: 4475449 - DNA, 17 bp, Homo sapiens
gtcacctgccgccctgt

SEQ ID NO: 4475450 - DNA, 19 bp, Homo sapiens
gtcacctgccgccctgtgg

SEQ ID NO: 4475451 - DNA, 17 bp, Homo sapiens
gtcaccttttctgtggc

SEQ ID NO: 4475452 - DNA, 15 bp, Homo sapiens
gtcactggaaagggg

SEQ ID NO: 4475453 - DNA, 13 bp, Homo sapiens
gtcactggcctct

SEQ ID NO: 4475454 - DNA, 18 bp, Homo sapiens
gtcactggcctctcccca

SEQ ID NO: 4475455 - DNA, 19 bp, Homo sapiens
gtcacttctgctgtacaga

SEQ ID NO: 4475456 - DNA, 21 bp, Homo sapiens
gtcacttgccacatggtgtct

SEQ ID NO: 4475457 - DNA, 14 bp, Homo sapiens
gtcactttttatgc

SEQ ID NO: 4475458 - DNA, 15 bp, Homo sapiens
gtcactttttttctt

SEQ ID NO: 4475459 - DNA, 23 bp, Homo sapiens
gtcagaacattcgaatctctgcc

SEQ ID NO: 4475460 - DNA, 18 bp, Homo sapiens
gtcagaagcctccaagcc

SEQ ID NO: 4475461 - DNA, 20 bp, Homo sapiens
gtcagaagtcaataggccta

SEQ ID NO: 4475462 - DNA, 19 bp, Homo sapiens
gtcagaatgtgaaaaagga

SEQ ID NO: 4475463 - DNA, 22 bp, Homo sapiens
gtcagactttgtgttcatttca

SEQ ID NO: 4475464 - DNA, 12 bp, Homo sapiens
gtcagagagacc

SEQ ID NO: 4475465 - DNA, 16 bp, Homo sapiens
gtcagagagacctcat

SEQ ID NO: 4475466 - DNA, 14 bp, Homo sapiens
gtcagagcccagcc

SEQ ID NO: 4475467 - DNA, 13 bp, Homo sapiens
gtcagaggagaag

SEQ ID NO: 4475468 - DNA, 14 bp, Homo sapiens
gtcagaggagaaga

SEQ ID NO: 4475469 - DNA, 20 bp, Homo sapiens
gtcagagtccagtgctctgc

SEQ ID NO: 4475470 - DNA, 22 bp, Homo sapiens
gtcagatgcgtgcccagctctt

SEQ ID NO: 4475471 - DNA, 14 bp, Homo sapiens
gtcagattaaatta

SEQ ID NO: 4475472 - DNA, 21 bp, Homo sapiens
gtcagcagcagctctgagcca

SEQ ID NO: 4475473 - DNA, 14 bp, Homo sapiens
gtcagcatcactga

SEQ ID NO: 4475474 - DNA, 16 bp, Homo sapiens
gtcagcatcactgatg

SEQ ID NO: 4475475 - DNA, 18 bp, Homo sapiens
gtcagcatcactgatggg

SEQ ID NO: 4475476 - DNA, 19 bp, Homo sapiens
gtcagcatcactgatggga

SEQ ID NO: 4475477 - DNA, 20 bp, Homo sapiens
gtcagcatcactgatgggaa

SEQ ID NO: 4475478 - DNA, 13 bp, Homo sapiens
gtcagccactgtt

SEQ ID NO: 4475479 - DNA, 18 bp, Homo sapiens
gtcagccagccgccctgg

SEQ ID NO: 4475480 - DNA, 21 bp, Homo sapiens
gtcagccagccgccctgggct

SEQ ID NO: 4475481 - DNA, 19 bp, Homo sapiens
gtcagccatcgtcctggga

SEQ ID NO: 4475482 - DNA, 20 bp, Homo sapiens
gtcagccatcgtcctgggac

SEQ ID NO: 4475483 - DNA, 13 bp, Homo sapiens
gtcagccctaggg

SEQ ID NO: 4475484 - DNA, 16 bp, Homo sapiens
gtcagcctccagcctc

SEQ ID NO: 4475485 - DNA, 18 bp, Homo sapiens
gtcagcctccagcctctg

SEQ ID NO: 4475486 - DNA, 19 bp, Homo sapiens
gtcagcctccagcctctgt

SEQ ID NO: 4475487 - DNA, 11 bp, Homo sapiens
gtcagcctctc

SEQ ID NO: 4475488 - DNA, 20 bp, Homo sapiens
gtcagcctctctcccagtct

SEQ ID NO: 4475489 - DNA, 22 bp, Homo sapiens
gtcagctcccctcggagaagag

SEQ ID NO: 4475490 - DNA, 23 bp, Homo sapiens
gtcagctcccctcggagaagagc

SEQ ID NO: 4475491 - DNA, 22 bp, Homo sapiens
gtcagctgggacaccccgactt

SEQ ID NO: 4475492 - DNA, 19 bp, Homo sapiens
gtcagctgggatgtgaagt

SEQ ID NO: 4475493 - DNA, 18 bp, Homo sapiens
gtcagcttttgttgttta

SEQ ID NO: 4475494 - DNA, 16 bp, Homo sapiens
gtcagcttttttcctg

SEQ ID NO: 4475495 - DNA, 15 bp, Homo sapiens
gtcaggacggctcct

SEQ ID NO: 4475496 - DNA, 19 bp, Homo sapiens
gtcaggacggctcctcaga

SEQ ID NO: 4475497 - DNA, 21 bp, Homo sapiens
gtcaggacggctcctcagagc

SEQ ID NO: 4475498 - DNA, 21 bp, Homo sapiens
gtcaggagatcgagaccatcc

SEQ ID NO: 4475499 - DNA, 17 bp, Homo sapiens
gtcaggccctgactcct

SEQ ID NO: 4475500 - DNA, 21 bp, Homo sapiens
gtcaggccctgactcctctgg

SEQ ID NO: 4475501 - DNA, 22 bp, Homo sapiens
gtcaggccctgactcctctggc

SEQ ID NO: 4475502 - DNA, 15 bp, Homo sapiens
gtcagggacctgctg

SEQ ID NO: 4475503 - DNA, 16 bp, Homo sapiens
gtcagggacctgctgc

SEQ ID NO: 4475504 - DNA, 17 bp, Homo sapiens
gtcagggacctgctgct

SEQ ID NO: 4475505 - DNA, 20 bp, Homo sapiens
gtcagggacctgctgctcag

SEQ ID NO: 4475506 - DNA, 18 bp, Homo sapiens
gtcagggaggggcaacca

SEQ ID NO: 4475507 - DNA, 18 bp, Homo sapiens
gtcaggtggttaccaggc

SEQ ID NO: 4475508 - DNA, 21 bp, Homo sapiens
gtcaggtggttaccaggcact

SEQ ID NO: 4475509 - DNA, 20 bp, Homo sapiens
gtcagtacgatcaagttgtt

SEQ ID NO: 4475510 - DNA, 16 bp, Homo sapiens
gtcagtatccaggctt

SEQ ID NO: 4475511 - DNA, 13 bp, Homo sapiens
gtcagtggccagg

SEQ ID NO: 4475512 - DNA, 15 bp, Homo sapiens
gtcagtggccaggtg

SEQ ID NO: 4475513 - DNA, 16 bp, Homo sapiens
gtcagtggccaggtgc

SEQ ID NO: 4475514 - DNA, 21 bp, Homo sapiens
gtcagtgtacacgtctggacc

SEQ ID NO: 4475515 - DNA, 19 bp, Homo sapiens
gtcagttgtgttttttaag

SEQ ID NO: 4475516 - DNA, 18 bp, Homo sapiens
gtcagttgttatttattg

SEQ ID NO: 4475517 - DNA, 21 bp, Homo sapiens
gtcagttgttatttattgaaa

SEQ ID NO: 4475518 - DNA, 21 bp, Homo sapiens
catgttagttaccttatagtt

SEQ ID NO: 4475519 - DNA, 22 bp, Homo sapiens
catgttagttaccttatagtta

SEQ ID NO: 4475520 - DNA, 14 bp, Homo sapiens
catgttatttgtaa

SEQ ID NO: 4475521 - DNA, 15 bp, Homo sapiens
catgttccactaacc

SEQ ID NO: 4475522 - DNA, 13 bp, Homo sapiens
catgttcctcctt

SEQ ID NO: 4475523 - DNA, 18 bp, Homo sapiens
catgttgctgaatttgta

SEQ ID NO: 4475524 - DNA, 17 bp, Homo sapiens
catgttggcctcttcag

SEQ ID NO: 4475525 - DNA, 17 bp, Homo sapiens
catgttggtcaggctgg

SEQ ID NO: 4475526 - DNA, 19 bp, Homo sapiens
catgttgttgtgtgtatat

SEQ ID NO: 4475527 - DNA, 22 bp, Homo sapiens
catgtttattgttttttaaaga

SEQ ID NO: 4475528 - DNA, 15 bp, Homo sapiens
catgtttatttttct

SEQ ID NO: 4475529 - DNA, 19 bp, Homo sapiens
catgtttatttttcttgtc

SEQ ID NO: 4475530 - DNA, 14 bp, Homo sapiens
catgtttcacagtg

SEQ ID NO: 4475531 - DNA, 18 bp, Homo sapiens
catgtttgagctcagacc

SEQ ID NO: 4475532 - DNA, 16 bp, Homo sapiens
catgttttaaaatcta

SEQ ID NO: 4475533 - DNA, 14 bp, Homo sapiens
catgttttaatgta

SEQ ID NO: 4475534 - DNA, 16 bp, Homo sapiens
catgttttttcatttg

SEQ ID NO: 4475535 - DNA, 17 bp, Homo sapiens
cattaaaaaaaacagaa

SEQ ID NO: 4475536 - DNA, 16 bp, Homo sapiens
cattaaacaaataaaa

SEQ ID NO: 4475537 - DNA, 18 bp, Homo sapiens
cattaaactctaaagatt

SEQ ID NO: 4475538 - DNA, 15 bp, Homo sapiens
cattaaagtcagaag

SEQ ID NO: 4475539 - DNA, 17 bp, Homo sapiens
cattaaagtcagaagtt

SEQ ID NO: 4475540 - DNA, 11 bp, Homo sapiens
cattaaataaa

SEQ ID NO: 4475541 - DNA, 18 bp, Homo sapiens
cattaaatgaatattttg

SEQ ID NO: 4475542 - DNA, 15 bp, Homo sapiens
cattaactaaatgct

SEQ ID NO: 4475543 - DNA, 17 bp, Homo sapiens
cattaactaaatgctca

SEQ ID NO: 4475544 - DNA, 18 bp, Homo sapiens
cattaactaaatgctcat

SEQ ID NO: 4475545 - DNA, 19 bp, Homo sapiens
cattaactatttttttcaa

SEQ ID NO: 4475546 - DNA, 12 bp, Homo sapiens
cattaagaaaat

SEQ ID NO: 4475547 - DNA, 22 bp, Homo sapiens
cattaatgcctgctttttggaa

SEQ ID NO: 4475548 - DNA, 19 bp, Homo sapiens
cattaattattattgctgt

SEQ ID NO: 4475549 - DNA, 20 bp, Homo sapiens
cattaattattattgctgtt

SEQ ID NO: 4475550 - DNA, 23 bp, Homo sapiens
catggtaatttatagtttataca

SEQ ID NO: 4475551 - DNA, 16 bp, Homo sapiens
catggtcacacactga

SEQ ID NO: 4475552 - DNA, 21 bp, Homo sapiens
catggtcacacactgatgctt

SEQ ID NO: 4475553 - DNA, 12 bp, Homo sapiens
catggtcacagt

SEQ ID NO: 4475554 - DNA, 17 bp, Homo sapiens
catggtccggtgtcctt

SEQ ID NO: 4475555 - DNA, 20 bp, Homo sapiens
catggtccggtgtccttttc

SEQ ID NO: 4475556 - DNA, 14 bp, Homo sapiens
catggtcctttctg

SEQ ID NO: 4475557 - DNA, 17 bp, Homo sapiens
catggtgaaaagctcca

SEQ ID NO: 4475558 - DNA, 16 bp, Homo sapiens
catggtgaaagggttt

SEQ ID NO: 4475559 - DNA, 20 bp, Homo sapiens
catggtgagtctatttttaa

SEQ ID NO: 4475560 - DNA, 22 bp, Homo sapiens
catggtgagtctatttttaatg

SEQ ID NO: 4475561 - DNA, 14 bp, Homo sapiens
catggtgcctgaga

SEQ ID NO: 4475562 - DNA, 22 bp, Homo sapiens
catggtgcctgagaggcaggca

SEQ ID NO: 4475563 - DNA, 17 bp, Homo sapiens
catggtgtctcacacgt

SEQ ID NO: 4475564 - DNA, 18 bp, Homo sapiens
catggtgtctcccaacat

SEQ ID NO: 4475565 - DNA, 20 bp, Homo sapiens
catggtgtctcccaacatgg

SEQ ID NO: 4475566 - DNA, 16 bp, Homo sapiens
catggttaacaccaga

SEQ ID NO: 4475567 - DNA, 23 bp, Homo sapiens
catggttctgcctcctggccaag

SEQ ID NO: 4475568 - DNA, 13 bp, Homo sapiens
catggttggggga

SEQ ID NO: 4475569 - DNA, 18 bp, Homo sapiens
catggtttaaaagaaaaa

SEQ ID NO: 4475570 - DNA, 19 bp, Homo sapiens
catggtttaaaagaaaaaa

SEQ ID NO: 4475571 - DNA, 16 bp, Homo sapiens
catggtttgatatgta

SEQ ID NO: 4475572 - DNA, 18 bp, Homo sapiens
catggtttggagctgatc

SEQ ID NO: 4475573 - DNA, 16 bp, Homo sapiens
catgtaaactatttgt

SEQ ID NO: 4475574 - DNA, 21 bp, Homo sapiens
catgtaaactatttgtggcaa

SEQ ID NO: 4475575 - DNA, 14 bp, Homo sapiens
catgtaaaggcctt

SEQ ID NO: 4475576 - DNA, 17 bp, Homo sapiens
catgtaaccactgcact

SEQ ID NO: 4475577 - DNA, 16 bp, Homo sapiens
catgtaagaaaatgtt

SEQ ID NO: 4475578 - DNA, 13 bp, Homo sapiens
catgtactacagc

SEQ ID NO: 4475579 - DNA, 14 bp, Homo sapiens
catgtactacagct

SEQ ID NO: 4475580 - DNA, 17 bp, Homo sapiens
catgtactcaagtacca

SEQ ID NO: 4475581 - DNA, 18 bp, Homo sapiens
catgtagaataaatgaag

SEQ ID NO: 4475582 - DNA, 19 bp, Homo sapiens
catgtagaataaatgaaga

SEQ ID NO: 4475583 - DNA, 16 bp, Homo sapiens
catgtagcatataaat

SEQ ID NO: 4475584 - DNA, 16 bp, Homo sapiens
catgtagtaacactaa

SEQ ID NO: 4475585 - DNA, 23 bp, Homo sapiens
catgtagtaacactaatatattt

SEQ ID NO: 4475586 - DNA, 15 bp, Homo sapiens
catgtatagttagaa

SEQ ID NO: 4475587 - DNA, 17 bp, Homo sapiens
catgtatagttgctttt

SEQ ID NO: 4475588 - DNA, 14 bp, Homo sapiens
catgtatgcctgcc

SEQ ID NO: 4475589 - DNA, 15 bp, Homo sapiens
catgtatttatgtaa

SEQ ID NO: 4475590 - DNA, 16 bp, Homo sapiens
catgtatttgttatat

SEQ ID NO: 4475591 - DNA, 22 bp, Homo sapiens
catgtcaacagcgttcctagag

SEQ ID NO: 4475592 - DNA, 13 bp, Homo sapiens
catgtcatttgca

SEQ ID NO: 4475593 - DNA, 14 bp, Homo sapiens
catgtcatttgcac

SEQ ID NO: 4475594 - DNA, 12 bp, Homo sapiens
catgtccaaaga

SEQ ID NO: 4475595 - DNA, 14 bp, Homo sapiens
catgtccaaagagg

SEQ ID NO: 4475596 - DNA, 15 bp, Homo sapiens
catgtccaaagaggc

SEQ ID NO: 4475597 - DNA, 16 bp, Homo sapiens
catgtccaaagaggct

SEQ ID NO: 4475598 - DNA, 20 bp, Homo sapiens
catgtccaaagaggctgccc

SEQ ID NO: 4475599 - DNA, 22 bp, Homo sapiens
catgtccatacactttgttgca

SEQ ID NO: 4475600 - DNA, 18 bp, Homo sapiens
catgtccctacaaagaac

SEQ ID NO: 4475601 - DNA, 13 bp, Homo sapiens
catgtcctgccta

SEQ ID NO: 4475602 - DNA, 15 bp, Homo sapiens
catgtcctgtaaagg

SEQ ID NO: 4475603 - DNA, 15 bp, Homo sapiens
catgtcgctccggtc

SEQ ID NO: 4475604 - DNA, 14 bp, Homo sapiens
catgtcggcctcta

SEQ ID NO: 4475605 - DNA, 21 bp, Homo sapiens
catgtcgtggacacacacaga

SEQ ID NO: 4475606 - DNA, 16 bp, Homo sapiens
catgtctattcagctt

SEQ ID NO: 4475607 - DNA, 13 bp, Homo sapiens
catgtctattgtc

SEQ ID NO: 4475608 - DNA, 22 bp, Homo sapiens
catgtctccccagttccacagc

SEQ ID NO: 4475609 - DNA, 19 bp, Homo sapiens
catgtctgcctatgcactg

SEQ ID NO: 4475610 - DNA, 21 bp, Homo sapiens
catgtctgcctatgcactgaa

SEQ ID NO: 4475611 - DNA, 14 bp, Homo sapiens
catgtctgtatact

SEQ ID NO: 4475612 - DNA, 13 bp, Homo sapiens
catgtcttgtcat

SEQ ID NO: 4475613 - DNA, 14 bp, Homo sapiens
catgtgactctttc

SEQ ID NO: 4475614 - DNA, 17 bp, Homo sapiens
catgtgactctttccaa

SEQ ID NO: 4475615 - DNA, 15 bp, Homo sapiens
catgtgcatgcatac

SEQ ID NO: 4475616 - DNA, 14 bp, Homo sapiens
catgtgcctttctt

SEQ ID NO: 4475617 - DNA, 21 bp, Homo sapiens
catgtgcctttctttgcctct

SEQ ID NO: 4475618 - DNA, 12 bp, Homo sapiens
catgtgctgccc

SEQ ID NO: 4475619 - DNA, 20 bp, Homo sapiens
catgtggcccaactctcctg

SEQ ID NO: 4475620 - DNA, 19 bp, Homo sapiens
catgtggctcctcccagcc

SEQ ID NO: 4475621 - DNA, 20 bp, Homo sapiens
catgtggtaaggtgtgtact

SEQ ID NO: 4475622 - DNA, 18 bp, Homo sapiens
catgtgtcccaggagcag

SEQ ID NO: 4475623 - DNA, 16 bp, Homo sapiens
catgtgtcccctcact

SEQ ID NO: 4475624 - DNA, 17 bp, Homo sapiens
catgtgtcccctcactc

SEQ ID NO: 4475625 - DNA, 21 bp, Homo sapiens
catgtgtgtccacgactgtct

SEQ ID NO: 4475626 - DNA, 23 bp, Homo sapiens
catgtgtgtccacgactgtctcc

SEQ ID NO: 4475627 - DNA, 17 bp, Homo sapiens
catgtgtgtgccaagcc

SEQ ID NO: 4475628 - DNA, 19 bp, Homo sapiens
catgtgtgtgccaagccct

SEQ ID NO: 4475629 - DNA, 22 bp, Homo sapiens
catgtgtgtgccaagccctggc

SEQ ID NO: 4475630 - DNA, 15 bp, Homo sapiens
catgtgttaatctta

SEQ ID NO: 4475631 - DNA, 13 bp, Homo sapiens
catgtgttccctt

SEQ ID NO: 4475632 - DNA, 21 bp, Homo sapiens
catgtgttttcatcatttcag

SEQ ID NO: 4475633 - DNA, 21 bp, Homo sapiens
catgttactggataaattgtt

SEQ ID NO: 4475634 - DNA, 20 bp, Homo sapiens
catgatctccctgccgcctc

SEQ ID NO: 4475635 - DNA, 12 bp, Homo sapiens
catgatctgtat

SEQ ID NO: 4475636 - DNA, 14 bp, Homo sapiens
catgatgcagtctc

SEQ ID NO: 4475637 - DNA, 14 bp, Homo sapiens
catgatggagctga

SEQ ID NO: 4475638 - DNA, 19 bp, Homo sapiens
catgatttcccactgcact

SEQ ID NO: 4475639 - DNA, 23 bp, Homo sapiens
catgatttcccactgcactccag

SEQ ID NO: 4475640 - DNA, 12 bp, Homo sapiens
catgatttcctt

SEQ ID NO: 4475641 - DNA, 14 bp, Homo sapiens
catgatttccttga

SEQ ID NO: 4475642 - DNA, 16 bp, Homo sapiens
catgatttccttgaat

SEQ ID NO: 4475643 - DNA, 18 bp, Homo sapiens
catgatttccttgaatgt

SEQ ID NO: 4475644 - DNA, 18 bp, Homo sapiens
catgattttaagaggctt

SEQ ID NO: 4475645 - DNA, 19 bp, Homo sapiens
catgattttaagaggcttt

SEQ ID NO: 4475646 - DNA, 15 bp, Homo sapiens
catgcaaaagtgggg

SEQ ID NO: 4475647 - DNA, 16 bp, Homo sapiens
catgcaaaatatgttt

SEQ ID NO: 4475648 - DNA, 15 bp, Homo sapiens
catgcaaactgcttt

SEQ ID NO: 4475649 - DNA, 17 bp, Homo sapiens
catgcaaattgtgaaat

SEQ ID NO: 4475650 - DNA, 14 bp, Homo sapiens
catgcaatttgaag

SEQ ID NO: 4475651 - DNA, 15 bp, Homo sapiens
catgcaatttgaagt

SEQ ID NO: 4475652 - DNA, 10 bp, Homo sapiens
catgcacagt

SEQ ID NO: 4475653 - DNA, 20 bp, Homo sapiens
catgcacagtatttgtaatt

SEQ ID NO: 4475654 - DNA, 22 bp, Homo sapiens
catgcacagtatttgtaattaa

SEQ ID NO: 4475655 - DNA, 23 bp, Homo sapiens
catgcactgtaaatatccctccc

SEQ ID NO: 4475656 - DNA, 19 bp, Homo sapiens
catgcactgttccccctgt

SEQ ID NO: 4475657 - DNA, 14 bp, Homo sapiens
catgcagaataatc

SEQ ID NO: 4475658 - DNA, 18 bp, Homo sapiens
catgcataaactaaaaac

SEQ ID NO: 4475659 - DNA, 21 bp, Homo sapiens
catgcatatcattaaacaaat

SEQ ID NO: 4475660 - DNA, 21 bp, Homo sapiens
catgcatgtcctgtaaaggtt

SEQ ID NO: 4475661 - DNA, 12 bp, Homo sapiens
catgcatgtctg

SEQ ID NO: 4475662 - DNA, 15 bp, Homo sapiens
catgcatgtctgcct

SEQ ID NO: 4475663 - DNA, 19 bp, Homo sapiens
catgcatgttctcctctat

SEQ ID NO: 4475664 - DNA, 20 bp, Homo sapiens
catgcattttaggatattct

SEQ ID NO: 4475665 - DNA, 17 bp, Homo sapiens
catgcatttttaaaact

SEQ ID NO: 4475666 - DNA, 15 bp, Homo sapiens
catgccaacacttaa

SEQ ID NO: 4475667 - DNA, 16 bp, Homo sapiens
catgccaaccctgggc

SEQ ID NO: 4475668 - DNA, 18 bp, Homo sapiens
catgccagattctgcctc

SEQ ID NO: 4475669 - DNA, 21 bp, Homo sapiens
catgccagattctgcctctct

SEQ ID NO: 4475670 - DNA, 13 bp, Homo sapiens
catgccaggaacc

SEQ ID NO: 4475671 - DNA, 21 bp, Homo sapiens
catgccaggttaggaaggcag

SEQ ID NO: 4475672 - DNA, 16 bp, Homo sapiens
catgccagtgccttat

SEQ ID NO: 4475673 - DNA, 15 bp, Homo sapiens
catgcccaccccctg

SEQ ID NO: 4475674 - DNA, 13 bp, Homo sapiens
catgcccacctgc

SEQ ID NO: 4475675 - DNA, 15 bp, Homo sapiens
catgccccaggctct

SEQ ID NO: 4475676 - DNA, 18 bp, Homo sapiens
catgccccaggctctcgc

SEQ ID NO: 4475677 - DNA, 13 bp, Homo sapiens
catgccccagtcg

SEQ ID NO: 4475678 - DNA, 13 bp, Homo sapiens
catgcccttctga

SEQ ID NO: 4475679 - DNA, 20 bp, Homo sapiens
catgccggtacacagccagt

SEQ ID NO: 4475680 - DNA, 21 bp, Homo sapiens
catgccggtacacagccagta

SEQ ID NO: 4475681 - DNA, 19 bp, Homo sapiens
catgcctgcgcctgctgcc

SEQ ID NO: 4475682 - DNA, 21 bp, Homo sapiens
catgcctgcgcctgctgcctg

SEQ ID NO: 4475683 - DNA, 16 bp, Homo sapiens
catgcctgtagtctca

SEQ ID NO: 4475684 - DNA, 18 bp, Homo sapiens
catgcctgtagtctcagc

SEQ ID NO: 4475685 - DNA, 21 bp, Homo sapiens
catgctaagagaagtagaaat

SEQ ID NO: 4475686 - DNA, 15 bp, Homo sapiens
catgctatggcattt

SEQ ID NO: 4475687 - DNA, 14 bp, Homo sapiens
catgctcaaccccc

SEQ ID NO: 4475688 - DNA, 18 bp, Homo sapiens
catgctcaacccccctcc

SEQ ID NO: 4475689 - DNA, 20 bp, Homo sapiens
catgctcaacccccctccca

SEQ ID NO: 4475690 - DNA, 21 bp, Homo sapiens
catgctcaacccccctcccag

SEQ ID NO: 4475691 - DNA, 23 bp, Homo sapiens
catgctcaacccccctcccagac

SEQ ID NO: 4475692 - DNA, 17 bp, Homo sapiens
catgctcatgtatattt

SEQ ID NO: 4475693 - DNA, 18 bp, Homo sapiens
catgctcctcacctgtct

SEQ ID NO: 4475694 - DNA, 16 bp, Homo sapiens
catgctctctgcagcc

SEQ ID NO: 4475695 - DNA, 19 bp, Homo sapiens
catgctctctgcagccagc

SEQ ID NO: 4475696 - DNA, 20 bp, Homo sapiens
catgctgatttaccacttat

SEQ ID NO: 4475697 - DNA, 17 bp, Homo sapiens
catgctgccttcaggga

SEQ ID NO: 4475698 - DNA, 18 bp, Homo sapiens
catgctggaacctgcaaa

SEQ ID NO: 4475699 - DNA, 22 bp, Homo sapiens
catgctggaacctgcaaaaaat

SEQ ID NO: 4475700 - DNA, 20 bp, Homo sapiens
catgctggctgaagaggacc

SEQ ID NO: 4475701 - DNA, 13 bp, Homo sapiens
catgctgggattt

SEQ ID NO: 4475702 - DNA, 14 bp, Homo sapiens
catgctgggccact

SEQ ID NO: 4475703 - DNA, 19 bp, Homo sapiens
catgctgtctggccctggg

SEQ ID NO: 4475704 - DNA, 14 bp, Homo sapiens
catgcttaataaac

SEQ ID NO: 4475705 - DNA, 16 bp, Homo sapiens
catgcttcacaatgtt

SEQ ID NO: 4475706 - DNA, 12 bp, Homo sapiens
catgcttcactc

SEQ ID NO: 4475707 - DNA, 20 bp, Homo sapiens
catgcttctcatcttgtgaa

SEQ ID NO: 4475708 - DNA, 13 bp, Homo sapiens
catgctttccatt

SEQ ID NO: 4475709 - DNA, 20 bp, Homo sapiens
catgctttcctaaagtctct

SEQ ID NO: 4475710 - DNA, 15 bp, Homo sapiens
catgctttttggtga

SEQ ID NO: 4475711 - DNA, 13 bp, Homo sapiens
catggaagtaatt

SEQ ID NO: 4475712 - DNA, 20 bp, Homo sapiens
catggaagtaattaaggtac

SEQ ID NO: 4475713 - DNA, 18 bp, Homo sapiens
catggaatcgaagtgttt

SEQ ID NO: 4475714 - DNA, 10 bp, Homo sapiens
aaaaaaaaga

SEQ ID NO: 4475715 - DNA, 12 bp, Homo sapiens
aaaaaaaagctt

SEQ ID NO: 4475716 - DNA, 13 bp, Homo sapiens
aaaaaaaattact

SEQ ID NO: 4475717 - DNA, 18 bp, Homo sapiens
aaaaaaacagtggatcac

SEQ ID NO: 4475718 - DNA, 13 bp, Homo sapiens
aaaaaaacattct

SEQ ID NO: 4475719 - DNA, 14 bp, Homo sapiens
aaaaaaagatctgt

SEQ ID NO: 4475720 - DNA, 12 bp, Homo sapiens
aaaaaaataata

SEQ ID NO: 4475721 - DNA, 10 bp, Homo sapiens
aaaaaaatca

SEQ ID NO: 4475722 - DNA, 11 bp, Homo sapiens
aaaaaacaaat

SEQ ID NO: 4475723 - DNA, 21 bp, Homo sapiens
aaaaaacacttggcatacaaa

SEQ ID NO: 4475724 - DNA, 11 bp, Homo sapiens
aaaaaactttt

SEQ ID NO: 4475725 - DNA, 13 bp, Homo sapiens
aaaaaagaaaaat

SEQ ID NO: 4475726 - DNA, 19 bp, Homo sapiens
aaaaaagattgtattgctg

SEQ ID NO: 4475727 - DNA, 10 bp, Homo sapiens
aaaaaagctc

SEQ ID NO: 4475728 - DNA, 12 bp, Homo sapiens
aaaaaagctcat

SEQ ID NO: 4475729 - DNA, 11 bp, Homo sapiens
aaaaaaggaag

SEQ ID NO: 4475730 - DNA, 11 bp, Homo sapiens
aaaaaagtctc

SEQ ID NO: 4475731 - DNA, 13 bp, Homo sapiens
aaaaaagttttta

SEQ ID NO: 4475732 - DNA, 21 bp, Homo sapiens
aaaaaatagatgtcttttata

SEQ ID NO: 4475733 - DNA, 13 bp, Homo sapiens
aaaaaatatttta

SEQ ID NO: 4475734 - DNA, 14 bp, Homo sapiens
aaaaaatcatctat

SEQ ID NO: 4475735 - DNA, 17 bp, Homo sapiens
aaaaaatcatctatttt

SEQ ID NO: 4475736 - DNA, 12 bp, Homo sapiens
aaaaaattatgg

SEQ ID NO: 4475737 - DNA, 18 bp, Homo sapiens
aaaaacacagcaagggtg

SEQ ID NO: 4475738 - DNA, 12 bp, Homo sapiens
aaaaacattgcc

SEQ ID NO: 4475739 - DNA, 13 bp, Homo sapiens
aaaaacatttaaa

SEQ ID NO: 4475740 - DNA, 23 bp, Homo sapiens
aaaaacattttttatacatttgg

SEQ ID NO: 4475741 - DNA, 17 bp, Homo sapiens
aaaaaccaatttaccca

SEQ ID NO: 4475742 - DNA, 14 bp, Homo sapiens
aaaaactaaaaact

SEQ ID NO: 4475743 - DNA, 21 bp, Homo sapiens
aaaaactattcgaatgaaaag

SEQ ID NO: 4475744 - DNA, 14 bp, Homo sapiens
aaaaactgaagatg

SEQ ID NO: 4475745 - DNA, 15 bp, Homo sapiens
aaaaactgatttgct

SEQ ID NO: 4475746 - DNA, 13 bp, Homo sapiens
aaaaactgggata

SEQ ID NO: 4475747 - DNA, 17 bp, Homo sapiens
aaaaacttttataaatt

SEQ ID NO: 4475748 - DNA, 9 bp, Homo sapiens
aaaaagaaa

SEQ ID NO: 4475749 - DNA, 18 bp, Homo sapiens
aaaaagaaaaatctcatt

SEQ ID NO: 4475750 - DNA, 18 bp, Homo sapiens
aaaaagaagcaacctcag

SEQ ID NO: 4475751 - DNA, 14 bp, Homo sapiens
aaaaagaagccaca

SEQ ID NO: 4475752 - DNA, 17 bp, Homo sapiens
aaaaagagtaatttcat

SEQ ID NO: 4475753 - DNA, 13 bp, Homo sapiens
aaaaagataaaga

SEQ ID NO: 4475754 - DNA, 16 bp, Homo sapiens
aaaaagatttttaaaa

SEQ ID NO: 4475755 - DNA, 21 bp, Homo sapiens
aaaaagctcatttcatgctct

SEQ ID NO: 4475756 - DNA, 19 bp, Homo sapiens
aaaaagcttaaaactttga

SEQ ID NO: 4475757 - DNA, 23 bp, Homo sapiens
aaaaagctttatgattttcataa

SEQ ID NO: 4475758 - DNA, 9 bp, Homo sapiens
aaaaaggaa

SEQ ID NO: 4475759 - DNA, 15 bp, Homo sapiens
aaaaaggatacataa

SEQ ID NO: 4475760 - DNA, 17 bp, Homo sapiens
aaaaaggatacataatg

SEQ ID NO: 4475761 - DNA, 17 bp, Homo sapiens
aaaaaggcaaatattga

SEQ ID NO: 4475762 - DNA, 22 bp, Homo sapiens
aaaaagtagcaaatgtttactg

SEQ ID NO: 4475763 - DNA, 20 bp, Homo sapiens
aaaaagtccaattttaattt

SEQ ID NO: 4475764 - DNA, 23 bp, Homo sapiens
aaaaagtccaattttaatttagt

SEQ ID NO: 4475765 - DNA, 21 bp, Homo sapiens
aaaaagtctctatttaaattc

SEQ ID NO: 4475766 - DNA, 15 bp, Homo sapiens
aaaaagtggggcaga

SEQ ID NO: 4475767 - DNA, 12 bp, Homo sapiens
aaaaagtgtcaa

SEQ ID NO: 4475768 - DNA, 17 bp, Homo sapiens
aaaaagtttgccagaag

SEQ ID NO: 4475769 - DNA, 11 bp, Homo sapiens
aaaaagtttgt

SEQ ID NO: 4475770 - DNA, 14 bp, Homo sapiens
aaaaataagaagaa

SEQ ID NO: 4475771 - DNA, 18 bp, Homo sapiens
aaaaataatcaaaagcta

SEQ ID NO: 4475772 - DNA, 17 bp, Homo sapiens
aaaaatacaatttttat

SEQ ID NO: 4475773 - DNA, 15 bp, Homo sapiens
aaaaatacatagcat

SEQ ID NO: 4475774 - DNA, 23 bp, Homo sapiens
aaaaatacctcaggaaagaatag

SEQ ID NO: 4475775 - DNA, 17 bp, Homo sapiens
aaaaataccttctatgt

SEQ ID NO: 4475776 - DNA, 22 bp, Homo sapiens
aaaaatactcttgatttcacat

SEQ ID NO: 4475777 - DNA, 11 bp, Homo sapiens
aaaaatacttc

SEQ ID NO: 4475778 - DNA, 16 bp, Homo sapiens
aaaaatagaaattaga

SEQ ID NO: 4475779 - DNA, 21 bp, Homo sapiens
aaaaatagagcaaaatcaaca

SEQ ID NO: 4475780 - DNA, 18 bp, Homo sapiens
aaaaatatatatctatct

SEQ ID NO: 4475781 - DNA, 22 bp, Homo sapiens
aaaaatattttctctgtacttt

SEQ ID NO: 4475782 - DNA, 22 bp, Homo sapiens
aaaaatcaactttttattgcct

SEQ ID NO: 4475783 - DNA, 18 bp, Homo sapiens
aaaaatcacaatttttaa

SEQ ID NO: 4475784 - DNA, 12 bp, Homo sapiens
aaaaatcatcta

SEQ ID NO: 4475785 - DNA, 17 bp, Homo sapiens
aaaaatcatctattttg

SEQ ID NO: 4475786 - DNA, 20 bp, Homo sapiens
aaaaatcatctattttgatg

SEQ ID NO: 4475787 - DNA, 21 bp, Homo sapiens
aaaaatcatgccagtattttt

SEQ ID NO: 4475788 - DNA, 15 bp, Homo sapiens
aaaaatccttttgaa

SEQ ID NO: 4475789 - DNA, 20 bp, Homo sapiens
aaaaatctagcacactcttc

SEQ ID NO: 4475790 - DNA, 9 bp, Homo sapiens
aaaaatctc

SEQ ID NO: 4475791 - DNA, 12 bp, Homo sapiens
aaaaatctcatt

SEQ ID NO: 4475792 - DNA, 14 bp, Homo sapiens
aaaaatctcattat

SEQ ID NO: 4475793 - DNA, 18 bp, Homo sapiens
aaaaatctgctgttaact

SEQ ID NO: 4475794 - DNA, 22 bp, Homo sapiens
aaaaatgagcttgattaaatca

SEQ ID NO: 4475795 - DNA, 17 bp, Homo sapiens
aaaaatgcattgaacat

SEQ ID NO: 4475796 - DNA, 20 bp, Homo sapiens
aaaaatgggagacagcctct

SEQ ID NO: 4475797 - DNA, 20 bp, Homo sapiens
aaaaatgtataatgactttt

SEQ ID NO: 4475798 - DNA, 14 bp, Homo sapiens
aaaaatgtcactat

SEQ ID NO: 4475799 - DNA, 12 bp, Homo sapiens
aaaaatgtgtgg

SEQ ID NO: 4475800 - DNA, 22 bp, Homo sapiens
aaaaatgtgtgtattcttaaaa

SEQ ID NO: 4475801 - DNA, 15 bp, Homo sapiens
aaaaatgttttccaa

SEQ ID NO: 4475802 - DNA, 13 bp, Homo sapiens
aaaaattaaaatg

SEQ ID NO: 4475803 - DNA, 17 bp, Homo sapiens
aaaaattaaaatggatg

SEQ ID NO: 4475804 - DNA, 13 bp, Homo sapiens
aaaaattaagctt

SEQ ID NO: 4475805 - DNA, 18 bp, Homo sapiens
aaaaattaattaggaatt

SEQ ID NO: 4475806 - DNA, 15 bp, Homo sapiens
aaaaattatggaata

SEQ ID NO: 4475807 - DNA, 16 bp, Homo sapiens
aaaaattgctctgtgt

SEQ ID NO: 4475808 - DNA, 11 bp, Homo sapiens
aaaaatttcac

SEQ ID NO: 4475809 - DNA, 23 bp, Homo sapiens
aaaaatttgtctgaaacatttca

SEQ ID NO: 4475810 - DNA, 13 bp, Homo sapiens
aaaaattttagct

SEQ ID NO: 4475811 - DNA, 21 bp, Homo sapiens
aaaaattttgtgacattcctt

SEQ ID NO: 4475812 - DNA, 13 bp, Homo sapiens
aaaaatttttgtt

SEQ ID NO: 4475813 - DNA, 14 bp, Homo sapiens
aaaaatttttgttt

SEQ ID NO: 4475814 - DNA, 14 bp, Homo sapiens
aaaacaaaactata

SEQ ID NO: 4475815 - DNA, 10 bp, Homo sapiens
aaaacaaaag

SEQ ID NO: 4475816 - DNA, 12 bp, Homo sapiens
aaaacaaaattt

SEQ ID NO: 4475817 - DNA, 11 bp, Homo sapiens
aaaacaaatgt

SEQ ID NO: 4475818 - DNA, 22 bp, Homo sapiens
aaaacaagtcatttttgtattt

SEQ ID NO: 4475819 - DNA, 15 bp, Homo sapiens
aaaacaagtctataa

SEQ ID NO: 4475820 - DNA, 14 bp, Homo sapiens
aaaacaatacatca

SEQ ID NO: 4475821 - DNA, 15 bp, Homo sapiens
aaaacaatctattta

SEQ ID NO: 4475822 - DNA, 14 bp, Homo sapiens
aaaacaattttctg

SEQ ID NO: 4475823 - DNA, 12 bp, Homo sapiens
aaaacacagcaa

SEQ ID NO: 4475824 - DNA, 11 bp, Homo sapiens
aaaacacatga

SEQ ID NO: 4475825 - DNA, 12 bp, Homo sapiens
aaaacacatgat

SEQ ID NO: 4475826 - DNA, 13 bp, Homo sapiens
aaaacactgtgca

SEQ ID NO: 4475827 - DNA, 18 bp, Homo sapiens
aaaacacttggcatacaa

SEQ ID NO: 4475828 - DNA, 12 bp, Homo sapiens
aaaacagaaaac

SEQ ID NO: 4475829 - DNA, 12 bp, Homo sapiens
aaaacagaaacc

SEQ ID NO: 4475830 - DNA, 15 bp, Homo sapiens
aaaacagaagcaaat

SEQ ID NO: 4475831 - DNA, 19 bp, Homo sapiens
aaaacaggaaaaaaacttt

SEQ ID NO: 4475832 - DNA, 18 bp, Homo sapiens
aaaacagggccacataga

SEQ ID NO: 4475833 - DNA, 17 bp, Homo sapiens
aacttcttgaaaaagat

SEQ ID NO: 4475834 - DNA, 22 bp, Homo sapiens
aacttcttgaaaaagatggctt

SEQ ID NO: 4475835 - DNA, 24 bp, Homo sapiens
aacttgaaacagattcaggccagc

SEQ ID NO: 4475836 - DNA, 13 bp, Homo sapiens
aacttgaaatata

SEQ ID NO: 4475837 - DNA, 14 bp, Homo sapiens
aacttgaaatatat

SEQ ID NO: 4475838 - DNA, 15 bp, Homo sapiens
aacttgaaatatata

SEQ ID NO: 4475839 - DNA, 21 bp, Homo sapiens
aacttgactgggtgagaccca

SEQ ID NO: 4475840 - DNA, 18 bp, Homo sapiens
aacttgaggttctctttt

SEQ ID NO: 4475841 - DNA, 12 bp, Homo sapiens
aacttgatgttc

SEQ ID NO: 4475842 - DNA, 19 bp, Homo sapiens
aacttgatgttccacctgc

SEQ ID NO: 4475843 - DNA, 18 bp, Homo sapiens
aacttgccccaagggttt

SEQ ID NO: 4475844 - DNA, 16 bp, Homo sapiens
aacttgccctgagcac

SEQ ID NO: 4475845 - DNA, 13 bp, Homo sapiens
aacttgcctcttt

SEQ ID NO: 4475846 - DNA, 23 bp, Homo sapiens
aacttgcctcttttacctgctgc

SEQ ID NO: 4475847 - DNA, 14 bp, Homo sapiens
aacttgcttaaatt

SEQ ID NO: 4475848 - DNA, 18 bp, Homo sapiens
aacttgcttaaatttctt

SEQ ID NO: 4475849 - DNA, 20 bp, Homo sapiens
aacttgcttaaatttcttat

SEQ ID NO: 4475850 - DNA, 17 bp, Homo sapiens
aacttgcttctaaatgc

SEQ ID NO: 4475851 - DNA, 14 bp, Homo sapiens
aacttggaatcaag

SEQ ID NO: 4475852 - DNA, 20 bp, Homo sapiens
aacttggtcagagccactct

SEQ ID NO: 4475853 - DNA, 22 bp, Homo sapiens
aacttggttttgctacataatt

SEQ ID NO: 4475854 - DNA, 14 bp, Homo sapiens
aacttgtagcagct

SEQ ID NO: 4475855 - DNA, 15 bp, Homo sapiens
aacttgtatttccaa

SEQ ID NO: 4475856 - DNA, 22 bp, Homo sapiens
aacttgtctggctttggcactc

SEQ ID NO: 4475857 - DNA, 11 bp, Homo sapiens
aacttgtgaat

SEQ ID NO: 4475858 - DNA, 13 bp, Homo sapiens
aacttgtgaatgc

SEQ ID NO: 4475859 - DNA, 19 bp, Homo sapiens
aacttgtgagcatcagagg

SEQ ID NO: 4475860 - DNA, 12 bp, Homo sapiens
aacttgtggcct

SEQ ID NO: 4475861 - DNA, 19 bp, Homo sapiens
aacttgtgtccctaatgtg

SEQ ID NO: 4475862 - DNA, 16 bp, Homo sapiens
aacttgtttgctgtga

SEQ ID NO: 4475863 - DNA, 13 bp, Homo sapiens
aactttaaacctg

SEQ ID NO: 4475864 - DNA, 17 bp, Homo sapiens
aactttaaagataagtc

SEQ ID NO: 4475865 - DNA, 19 bp, Homo sapiens
aactttaaagcgtttgcac

SEQ ID NO: 4475866 - DNA, 14 bp, Homo sapiens
aactttaatacagc

SEQ ID NO: 4475867 - DNA, 14 bp, Homo sapiens
aactttaccaaatg

SEQ ID NO: 4475868 - DNA, 14 bp, Homo sapiens
aactttatttacac

SEQ ID NO: 4475869 - DNA, 16 bp, Homo sapiens
aactttatttttctat

SEQ ID NO: 4475870 - DNA, 22 bp, Homo sapiens
aactttcactataatgtgaaat

SEQ ID NO: 4475871 - DNA, 12 bp, Homo sapiens
aactttcatacc

SEQ ID NO: 4475872 - DNA, 18 bp, Homo sapiens
aactttcataccacttga

SEQ ID NO: 4475873 - DNA, 11 bp, Homo sapiens
aactttcattt

SEQ ID NO: 4475874 - DNA, 16 bp, Homo sapiens
aactttcgaccgactt

SEQ ID NO: 4475875 - DNA, 22 bp, Homo sapiens
aactttctccatttaagacaca

SEQ ID NO: 4475876 - DNA, 23 bp, Homo sapiens
aactttctccatttaagacacat

SEQ ID NO: 4475877 - DNA, 16 bp, Homo sapiens
aactttctctgtgaaa

SEQ ID NO: 4475878 - DNA, 21 bp, Homo sapiens
aactttctctgtgaaagcttt

SEQ ID NO: 4475879 - DNA, 16 bp, Homo sapiens
aactttctgaattatt

SEQ ID NO: 4475880 - DNA, 20 bp, Homo sapiens
aactttgaataaagaatact

SEQ ID NO: 4475881 - DNA, 20 bp, Homo sapiens
aactttgcgggatatttagg

SEQ ID NO: 4475882 - DNA, 13 bp, Homo sapiens
aactttgtatttt

SEQ ID NO: 4475883 - DNA, 17 bp, Homo sapiens
aacttttataaattaaa

SEQ ID NO: 4475884 - DNA, 18 bp, Homo sapiens
aacttttataaattaaat

SEQ ID NO: 4475885 - DNA, 22 bp, Homo sapiens
aacttttatgcagcaaatatat

SEQ ID NO: 4475886 - DNA, 15 bp, Homo sapiens
aacttttcaatgtga

SEQ ID NO: 4475887 - DNA, 20 bp, Homo sapiens
aacttttcaatgtgattctt

SEQ ID NO: 4475888 - DNA, 20 bp, Homo sapiens
aacttttccaagcaaaatct

SEQ ID NO: 4475889 - DNA, 16 bp, Homo sapiens
aacttttctaacagaa

SEQ ID NO: 4475890 - DNA, 16 bp, Homo sapiens
aacttttgaaagatgt

SEQ ID NO: 4475891 - DNA, 14 bp, Homo sapiens
aacttttgtaaata

SEQ ID NO: 4475892 - DNA, 17 bp, Homo sapiens
aacttttgtactgaatt

SEQ ID NO: 4475893 - DNA, 13 bp, Homo sapiens
aacttttgtgaat

SEQ ID NO: 4475894 - DNA, 19 bp, Homo sapiens
aacttttgtgaattaggct

SEQ ID NO: 4475895 - DNA, 14 bp, Homo sapiens
aactttttaaaata

SEQ ID NO: 4475896 - DNA, 12 bp, Homo sapiens
aactttttaatt

SEQ ID NO: 4475897 - DNA, 14 bp, Homo sapiens
aactttttattgcc

SEQ ID NO: 4475898 - DNA, 14 bp, Homo sapiens
aactttttgttcat

SEQ ID NO: 4475899 - DNA, 23 bp, Homo sapiens
aacttttttatttaaaaaactaa

SEQ ID NO: 4475900 - DNA, 14 bp, Homo sapiens
aacttttttccctt

SEQ ID NO: 4475901 - DNA, 19 bp, Homo sapiens
aacttttttgagtcattga

SEQ ID NO: 4475902 - DNA, 15 bp, Homo sapiens
aagaaaaaaagaaaa

SEQ ID NO: 4475903 - DNA, 13 bp, Homo sapiens
aagaaaaaatttt

SEQ ID NO: 4475904 - DNA, 15 bp, Homo sapiens
aagaaaaagaagcaa

SEQ ID NO: 4475905 - DNA, 13 bp, Homo sapiens
aagaaaaatctca

SEQ ID NO: 4475906 - DNA, 14 bp, Homo sapiens
aagaaaaatctcat

SEQ ID NO: 4475907 - DNA, 12 bp, Homo sapiens
aagaaaaattaa

SEQ ID NO: 4475908 - DNA, 19 bp, Homo sapiens
aagaaaaattaattaggaa

SEQ ID NO: 4475909 - DNA, 17 bp, Homo sapiens
aagaaaagaattacaga

SEQ ID NO: 4475910 - DNA, 19 bp, Homo sapiens
aagaaaagcgcgttgtgta

SEQ ID NO: 4475911 - DNA, 23 bp, Homo sapiens
aagaaaagcgcgttgtgtatatt

SEQ ID NO: 4475912 - DNA, 13 bp, Homo sapiens
aagaaaaggattt

SEQ ID NO: 4475913 - DNA, 16 bp, Homo sapiens
aagaaaagtaatgaag

SEQ ID NO: 4475914 - DNA, 13 bp, Homo sapiens
aagaaaatcactt

SEQ ID NO: 4475915 - DNA, 14 bp, Homo sapiens
aagaaaatgtcttt

SEQ ID NO: 4475916 - DNA, 14 bp, Homo sapiens
aagaaaatgttacg

SEQ ID NO: 4475917 - DNA, 22 bp, Homo sapiens
aagaaaatgttacggcatcaca

SEQ ID NO: 4475918 - DNA, 13 bp, Homo sapiens
aagaaaattttcc

SEQ ID NO: 4475919 - DNA, 19 bp, Homo sapiens
aagaaaatttttgtagtag

SEQ ID NO: 4475920 - DNA, 22 bp, Homo sapiens
aagaaaatttttgtagtagcgt

SEQ ID NO: 4475921 - DNA, 15 bp, Homo sapiens
aagaaacaaagatgt

SEQ ID NO: 4475922 - DNA, 16 bp, Homo sapiens
aagaaacaaggttttc

SEQ ID NO: 4475923 - DNA, 19 bp, Homo sapiens
aagaaaccttgctctcctc

SEQ ID NO: 4475924 - DNA, 14 bp, Homo sapiens
aagaaacttgtaaa

SEQ ID NO: 4475925 - DNA, 23 bp, Homo sapiens
aagaaacttgtaaatatcttttt

SEQ ID NO: 4475926 - DNA, 14 bp, Homo sapiens
aagaaagatgtttg

SEQ ID NO: 4475927 - DNA, 16 bp, Homo sapiens
aagaaaggaaaccttt

SEQ ID NO: 4475928 - DNA, 20 bp, Homo sapiens
aagaaaggaagcattgtaaa

SEQ ID NO: 4475929 - DNA, 20 bp, Homo sapiens
aagaaaggctgttaaataca

SEQ ID NO: 4475930 - DNA, 22 bp, Homo sapiens
aagaaagtctatctaatgacat

SEQ ID NO: 4475931 - DNA, 15 bp, Homo sapiens
aagaaataagttttt

SEQ ID NO: 4475932 - DNA, 16 bp, Homo sapiens
aagaaatatacagttt

SEQ ID NO: 4475933 - DNA, 23 bp, Homo sapiens
aagaaatcatgtccatacacttt

SEQ ID NO: 4475934 - DNA, 22 bp, Homo sapiens
aagaaatgattcaaattgctgc

SEQ ID NO: 4475935 - DNA, 20 bp, Homo sapiens
aagaaatggctatgaacaga

SEQ ID NO: 4475936 - DNA, 13 bp, Homo sapiens
aagaaatggtgaa

SEQ ID NO: 4475937 - DNA, 13 bp, Homo sapiens
aagaaatgtaagg

SEQ ID NO: 4475938 - DNA, 17 bp, Homo sapiens
aagaaattcaagaagta

SEQ ID NO: 4475939 - DNA, 11 bp, Homo sapiens
aagaaatttta

SEQ ID NO: 4475940 - DNA, 14 bp, Homo sapiens
aagaacaacaaaga

SEQ ID NO: 4475941 - DNA, 18 bp, Homo sapiens
aagaacaacaaagacatg

SEQ ID NO: 4475942 - DNA, 16 bp, Homo sapiens
aagaacacattttaaa

SEQ ID NO: 4475943 - DNA, 18 bp, Homo sapiens
aagaacatacatgataca

SEQ ID NO: 4475944 - DNA, 14 bp, Homo sapiens
aagaacatgcagtt

SEQ ID NO: 4475945 - DNA, 11 bp, Homo sapiens
aagaacatgtg

SEQ ID NO: 4475946 - DNA, 14 bp, Homo sapiens
aagaacattttata

SEQ ID NO: 4475947 - DNA, 19 bp, Homo sapiens
aagaaccaaactcctattt

SEQ ID NO: 4475948 - DNA, 22 bp, Homo sapiens
aagaaccaaactcctatttcaa

SEQ ID NO: 4475949 - DNA, 22 bp, Homo sapiens
aagaacccatggaaaaatgcca

SEQ ID NO: 4475950 - DNA, 14 bp, Homo sapiens
aagaacgaggttta

SEQ ID NO: 4475951 - DNA, 21 bp, Homo sapiens
aagaacggggctcttctcatt

SEQ ID NO: 4475952 - DNA, 23 bp, Homo sapiens
aagaacggggctcttctcatttc

SEQ ID NO: 4475953 - DNA, 18 bp, Homo sapiens
aagaactcaccagggttt

SEQ ID NO: 4475954 - DNA, 23 bp, Homo sapiens
aaccttgccttgaaatttacaca

SEQ ID NO: 4475955 - DNA, 19 bp, Homo sapiens
aaccttgtttattaaattg

SEQ ID NO: 4475956 - DNA, 15 bp, Homo sapiens
aacctttaaaaatgt

SEQ ID NO: 4475957 - DNA, 19 bp, Homo sapiens
aacctttaaaaatgtataa

SEQ ID NO: 4475958 - DNA, 13 bp, Homo sapiens
aacctttccattt

SEQ ID NO: 4475959 - DNA, 13 bp, Homo sapiens
aacctttccctca

SEQ ID NO: 4475960 - DNA, 17 bp, Homo sapiens
aacctttccctcacccc

SEQ ID NO: 4475961 - DNA, 18 bp, Homo sapiens
aacctttccctcaccccc

SEQ ID NO: 4475962 - DNA, 19 bp, Homo sapiens
aacctttccctcaccccct

SEQ ID NO: 4475963 - DNA, 22 bp, Homo sapiens
aacctttccctcaccccctccc

SEQ ID NO: 4475964 - DNA, 13 bp, Homo sapiens
aacctttcccttc

SEQ ID NO: 4475965 - DNA, 18 bp, Homo sapiens
aacctttccgctgtcgcc

SEQ ID NO: 4475966 - DNA, 16 bp, Homo sapiens
aacctttcttcaccaa

SEQ ID NO: 4475967 - DNA, 18 bp, Homo sapiens
aacctttcttcaccaaat

SEQ ID NO: 4475968 - DNA, 12 bp, Homo sapiens
aacctttttaaa

SEQ ID NO: 4475969 - DNA, 16 bp, Homo sapiens
aacgacccactctgct

SEQ ID NO: 4475970 - DNA, 15 bp, Homo sapiens
aacgagacacattgc

SEQ ID NO: 4475971 - DNA, 22 bp, Homo sapiens
aacgcagttgtgtggcccagca

SEQ ID NO: 4475972 - DNA, 17 bp, Homo sapiens
aacgctaaagagccctt

SEQ ID NO: 4475973 - DNA, 22 bp, Homo sapiens
aacgctaaagagcccttgcctc

SEQ ID NO: 4475974 - DNA, 17 bp, Homo sapiens
aacgctgagccacctgc

SEQ ID NO: 4475975 - DNA, 15 bp, Homo sapiens
aacggattccaaaga

SEQ ID NO: 4475976 - DNA, 18 bp, Homo sapiens
aacggcaacgtagcctgg

SEQ ID NO: 4475977 - DNA, 19 bp, Homo sapiens
aacgggcagtctgctctgc

SEQ ID NO: 4475978 - DNA, 21 bp, Homo sapiens
aacgggcagtctgctctgctg

SEQ ID NO: 4475979 - DNA, 16 bp, Homo sapiens
aacggggctcttctca

SEQ ID NO: 4475980 - DNA, 21 bp, Homo sapiens
aacggggggctcctgcccagg

SEQ ID NO: 4475981 - DNA, 19 bp, Homo sapiens
aacggtgcccatcctgcca

SEQ ID NO: 4475982 - DNA, 18 bp, Homo sapiens
aacgtaattgtacaagca

SEQ ID NO: 4475983 - DNA, 14 bp, Homo sapiens
aacgtgctcactgt

SEQ ID NO: 4475984 - DNA, 21 bp, Homo sapiens
aacgtgggcttaaagcagaag

SEQ ID NO: 4475985 - DNA, 20 bp, Homo sapiens
aacgtttaagccaaaacaat

SEQ ID NO: 4475986 - DNA, 16 bp, Homo sapiens
aactaaactagttttt

SEQ ID NO: 4475987 - DNA, 23 bp, Homo sapiens
aactaaactcttaccatatgttt

SEQ ID NO: 4475988 - DNA, 19 bp, Homo sapiens
aactaaataacacagatat

SEQ ID NO: 4475989 - DNA, 14 bp, Homo sapiens
aactaaattttaaa

SEQ ID NO: 4475990 - DNA, 17 bp, Homo sapiens
aactaaatttttcatag

SEQ ID NO: 4475991 - DNA, 14 bp, Homo sapiens
aactaacatgtcct

SEQ ID NO: 4475992 - DNA, 15 bp, Homo sapiens
aactaactgactctg

SEQ ID NO: 4475993 - DNA, 21 bp, Homo sapiens
aactaagagacagttctctgt

SEQ ID NO: 4475994 - DNA, 15 bp, Homo sapiens
aactaagattctttt

SEQ ID NO: 4475995 - DNA, 17 bp, Homo sapiens
aactaagattcttttaa

SEQ ID NO: 4475996 - DNA, 20 bp, Homo sapiens
aactaagccaggcctggctg

SEQ ID NO: 4475997 - DNA, 16 bp, Homo sapiens
aactaaggcttttatt

SEQ ID NO: 4475998 - DNA, 16 bp, Homo sapiens
aactaataaaataagt

SEQ ID NO: 4475999 - DNA, 18 bp, Homo sapiens
aactaatacgtgccagat

SEQ ID NO: 4476000 - DNA, 23 bp, Homo sapiens
aactacagtgattcatgtagaga

SEQ ID NO: 4476001 - DNA, 14 bp, Homo sapiens
aactacatctgcct

SEQ ID NO: 4476002 - DNA, 17 bp, Homo sapiens
aactacccttaattact

SEQ ID NO: 4476003 - DNA, 18 bp, Homo sapiens
aactacccttaattactt

SEQ ID NO: 4476004 - DNA, 19 bp, Homo sapiens
aactactgaatgaagcagt

SEQ ID NO: 4476005 - DNA, 21 bp, Homo sapiens
aactactgaatgaagcagtat

SEQ ID NO: 4476006 - DNA, 17 bp, Homo sapiens
aactactgcctttagaa

SEQ ID NO: 4476007 - DNA, 22 bp, Homo sapiens
aactacttctcttgttaggtaa

SEQ ID NO: 4476008 - DNA, 15 bp, Homo sapiens
aactactttataact

SEQ ID NO: 4476009 - DNA, 17 bp, Homo sapiens
aactactttataactaa

SEQ ID NO: 4476010 - DNA, 18 bp, Homo sapiens
aactacttttctaaaatc

SEQ ID NO: 4476011 - DNA, 21 bp, Homo sapiens
aactacttttctaaaatctaa

SEQ ID NO: 4476012 - DNA, 15 bp, Homo sapiens
aactagcattgtaaa

SEQ ID NO: 4476013 - DNA, 13 bp, Homo sapiens
aactagcccctgg

SEQ ID NO: 4476014 - DNA, 15 bp, Homo sapiens
aactaggctgagcaa

SEQ ID NO: 4476015 - DNA, 17 bp, Homo sapiens
aactagggccaagccca

SEQ ID NO: 4476016 - DNA, 16 bp, Homo sapiens
aactagggctcatttt

SEQ ID NO: 4476017 - DNA, 23 bp, Homo sapiens
aactagtttttcctatcatgtta

SEQ ID NO: 4476018 - DNA, 14 bp, Homo sapiens
aactataaacttaa

SEQ ID NO: 4476019 - DNA, 23 bp, Homo sapiens
aactataaacttaagggcaagga

SEQ ID NO: 4476020 - DNA, 19 bp, Homo sapiens
aactataacattatataac

SEQ ID NO: 4476021 - DNA, 22 bp, Homo sapiens
aactataacattatataacaaa

SEQ ID NO: 4476022 - DNA, 18 bp, Homo sapiens
aactataagatacaataa

SEQ ID NO: 4476023 - DNA, 20 bp, Homo sapiens
aactataagatacaataaaa

SEQ ID NO: 4476024 - DNA, 17 bp, Homo sapiens
aactatacttgaacaaa

SEQ ID NO: 4476025 - DNA, 20 bp, Homo sapiens
aactatacttgaacaaaagg

SEQ ID NO: 4476026 - DNA, 18 bp, Homo sapiens
aactatcaatatttaagt

SEQ ID NO: 4476027 - DNA, 14 bp, Homo sapiens
aactatcattttta

SEQ ID NO: 4476028 - DNA, 21 bp, Homo sapiens
aactatcctgcgggttttaat

SEQ ID NO: 4476029 - DNA, 13 bp, Homo sapiens
aactatgaaatcg

SEQ ID NO: 4476030 - DNA, 18 bp, Homo sapiens
aactatggatcagaatag

SEQ ID NO: 4476031 - DNA, 14 bp, Homo sapiens
aactatgtaataat

SEQ ID NO: 4476032 - DNA, 20 bp, Homo sapiens
aactattagtattattaaca

SEQ ID NO: 4476033 - DNA, 20 bp, Homo sapiens
aactattcgaatgaaaagac

SEQ ID NO: 4476034 - DNA, 12 bp, Homo sapiens
aactattcttaa

SEQ ID NO: 4476035 - DNA, 21 bp, Homo sapiens
aactattcttaataaaactca

SEQ ID NO: 4476036 - DNA, 19 bp, Homo sapiens
aactattcttcatttacaa

SEQ ID NO: 4476037 - DNA, 19 bp, Homo sapiens
aactattgcctctggacgt

SEQ ID NO: 4476038 - DNA, 13 bp, Homo sapiens
aactatttcagtg

SEQ ID NO: 4476039 - DNA, 15 bp, Homo sapiens
aactatttgtataaa

SEQ ID NO: 4476040 - DNA, 15 bp, Homo sapiens
aactatttttttcaa

SEQ ID NO: 4476041 - DNA, 23 bp, Homo sapiens
aactcaaggataccttcttattt

SEQ ID NO: 4476042 - DNA, 19 bp, Homo sapiens
aactcaagggttttccagg

SEQ ID NO: 4476043 - DNA, 23 bp, Homo sapiens
aactcaccctgggagccagtcct

SEQ ID NO: 4476044 - DNA, 22 bp, Homo sapiens
aactcagtcattagactcctcc

SEQ ID NO: 4476045 - DNA, 18 bp, Homo sapiens
aactcatcacataaagaa

SEQ ID NO: 4476046 - DNA, 14 bp, Homo sapiens
aactcatcattttt

SEQ ID NO: 4476047 - DNA, 15 bp, Homo sapiens
aactcattccagatc

SEQ ID NO: 4476048 - DNA, 23 bp, Homo sapiens
aactcattgcagcagataacttt

SEQ ID NO: 4476049 - DNA, 16 bp, Homo sapiens
aactcatttgaatgct

SEQ ID NO: 4476050 - DNA, 18 bp, Homo sapiens
aactccaaggttcccttg

SEQ ID NO: 4476051 - DNA, 23 bp, Homo sapiens
aactccaccaacccatcagaagg

SEQ ID NO: 4476052 - DNA, 12 bp, Homo sapiens
aactccaggcag

SEQ ID NO: 4476053 - DNA, 15 bp, Homo sapiens
aactccaggggcacc

SEQ ID NO: 4476054 - DNA, 20 bp, Homo sapiens
aactccatggggttcgagac

SEQ ID NO: 4476055 - DNA, 17 bp, Homo sapiens
aactcccccattttaca

SEQ ID NO: 4476056 - DNA, 22 bp, Homo sapiens
aactcccccattttacagattt

SEQ ID NO: 4476057 - DNA, 17 bp, Homo sapiens
aactccctctctgtgca

SEQ ID NO: 4476058 - DNA, 16 bp, Homo sapiens
aactccgcccagcctc

SEQ ID NO: 4476059 - DNA, 13 bp, Homo sapiens
aactcctgccagg

SEQ ID NO: 4476060 - DNA, 18 bp, Homo sapiens
aactcctggaaatatcag

SEQ ID NO: 4476061 - DNA, 17 bp, Homo sapiens
aactcctgtcccttttc

SEQ ID NO: 4476062 - DNA, 21 bp, Homo sapiens
aactcctgtgaccacaacatg

SEQ ID NO: 4476063 - DNA, 18 bp, Homo sapiens
aactcctttcagccacat

SEQ ID NO: 4476064 - DNA, 19 bp, Homo sapiens
aactcctttctgcagacgt

SEQ ID NO: 4476065 - DNA, 19 bp, Homo sapiens
aactcgtgtctggcacagc

SEQ ID NO: 4476066 - DNA, 15 bp, Homo sapiens
aactctaatattgct

SEQ ID NO: 4476067 - DNA, 17 bp, Homo sapiens
aactctaatattgcttc

SEQ ID NO: 4476068 - DNA, 14 bp, Homo sapiens
aactctacccctgc

SEQ ID NO: 4476069 - DNA, 15 bp, Homo sapiens
aactctacccctgct

SEQ ID NO: 4476070 - DNA, 15 bp, Homo sapiens
aactctactgtgtaa

SEQ ID NO: 4476071 - DNA, 19 bp, Homo sapiens
aactctccccagtgcctgc

SEQ ID NO: 4476072 - DNA, 21 bp, Homo sapiens
aactctcctgtggcctgctca

SEQ ID NO: 4476073 - DNA, 17 bp, Homo sapiens
aactctctagcttaagt

SEQ ID NO: 4476074 - DNA, 22 bp, Homo sapiens
aacattgtactgttgctttaat

SEQ ID NO: 4476075 - DNA, 22 bp, Homo sapiens
aacattgtccccaatgaatata

SEQ ID NO: 4476076 - DNA, 16 bp, Homo sapiens
aacatttaaacttttt

SEQ ID NO: 4476077 - DNA, 17 bp, Homo sapiens
aacatttattttgacat

SEQ ID NO: 4476078 - DNA, 19 bp, Homo sapiens
aacatttattttgacataa

SEQ ID NO: 4476079 - DNA, 14 bp, Homo sapiens
aacatttcataatt

SEQ ID NO: 4476080 - DNA, 15 bp, Homo sapiens
aacatttctaagact

SEQ ID NO: 4476081 - DNA, 17 bp, Homo sapiens
aacatttgtttccccca

SEQ ID NO: 4476082 - DNA, 16 bp, Homo sapiens
aacattttaaatgaaa

SEQ ID NO: 4476083 - DNA, 19 bp, Homo sapiens
aacattttacagtaaatgt

SEQ ID NO: 4476084 - DNA, 23 bp, Homo sapiens
aacattttttcttctgaagattc

SEQ ID NO: 4476085 - DNA, 18 bp, Homo sapiens
aaccaaaaagaccagact

SEQ ID NO: 4476086 - DNA, 20 bp, Homo sapiens
aaccaaaaagaccagactaa

SEQ ID NO: 4476087 - DNA, 17 bp, Homo sapiens
aaccaaaaattatgtgt

SEQ ID NO: 4476088 - DNA, 22 bp, Homo sapiens
aaccaaaatgacatctttttaa

SEQ ID NO: 4476089 - DNA, 19 bp, Homo sapiens
aaccaactctaatattgct

SEQ ID NO: 4476090 - DNA, 16 bp, Homo sapiens
aaccaactgccccagg

SEQ ID NO: 4476091 - DNA, 14 bp, Homo sapiens
aaccaagaagggct

SEQ ID NO: 4476092 - DNA, 15 bp, Homo sapiens
aaccaagggtacaga

SEQ ID NO: 4476093 - DNA, 24 bp, Homo sapiens
aaccaatgcctttttagatgtatt

SEQ ID NO: 4476094 - DNA, 14 bp, Homo sapiens
aaccacaagcatct

SEQ ID NO: 4476095 - DNA, 17 bp, Homo sapiens
aaccacaatgtttcttc

SEQ ID NO: 4476096 - DNA, 20 bp, Homo sapiens
aaccacagaaatcacagtca

SEQ ID NO: 4476097 - DNA, 14 bp, Homo sapiens
aaccacagcagaca

SEQ ID NO: 4476098 - DNA, 14 bp, Homo sapiens
aaccacatggcaca

SEQ ID NO: 4476099 - DNA, 17 bp, Homo sapiens
aaccacatggcacagag

SEQ ID NO: 4476100 - DNA, 17 bp, Homo sapiens
aaccacggttatttaag

SEQ ID NO: 4476101 - DNA, 19 bp, Homo sapiens
aaccactgaaaaaatatat

SEQ ID NO: 4476102 - DNA, 20 bp, Homo sapiens
aaccactgaaaaaatatatg

SEQ ID NO: 4476103 - DNA, 21 bp, Homo sapiens
aaccactgtgcgtcttggtgt

SEQ ID NO: 4476104 - DNA, 20 bp, Homo sapiens
aaccagagaatgctttgaaa

SEQ ID NO: 4476105 - DNA, 15 bp, Homo sapiens
aaccagagagaaaga

SEQ ID NO: 4476106 - DNA, 18 bp, Homo sapiens
aaccaggccccagcctcc

SEQ ID NO: 4476107 - DNA, 22 bp, Homo sapiens
aaccaggccccagcctccaggc

SEQ ID NO: 4476108 - DNA, 18 bp, Homo sapiens
aaccaggtccagatgtgc

SEQ ID NO: 4476109 - DNA, 22 bp, Homo sapiens
aaccagtatttttgctgcttct

SEQ ID NO: 4476110 - DNA, 19 bp, Homo sapiens
aaccagtctcctcactctg

SEQ ID NO: 4476111 - DNA, 14 bp, Homo sapiens
aaccagtgtgaacc

SEQ ID NO: 4476112 - DNA, 14 bp, Homo sapiens
aaccatgagcacta

SEQ ID NO: 4476113 - DNA, 15 bp, Homo sapiens
aaccattaaagtcag

SEQ ID NO: 4476114 - DNA, 23 bp, Homo sapiens
aaccattatactttatatctgta

SEQ ID NO: 4476115 - DNA, 19 bp, Homo sapiens
aaccattcaaaaatttcac

SEQ ID NO: 4476116 - DNA, 14 bp, Homo sapiens
aaccatttttgtta

SEQ ID NO: 4476117 - DNA, 22 bp, Homo sapiens
aaccatttttgttactctcttc

SEQ ID NO: 4476118 - DNA, 23 bp, Homo sapiens
aacccaaatgttcatcaatgaat

SEQ ID NO: 4476119 - DNA, 18 bp, Homo sapiens
aacccaaggactgaggga

SEQ ID NO: 4476120 - DNA, 21 bp, Homo sapiens
aacccacctctcctgccctgt

SEQ ID NO: 4476121 - DNA, 12 bp, Homo sapiens
aacccagagagg

SEQ ID NO: 4476122 - DNA, 18 bp, Homo sapiens
aacccatacaatgtatgt

SEQ ID NO: 4476123 - DNA, 13 bp, Homo sapiens
aacccatatttta

SEQ ID NO: 4476124 - DNA, 17 bp, Homo sapiens
aacccatcagaaggaga

SEQ ID NO: 4476125 - DNA, 13 bp, Homo sapiens
aaccccaggcccc

SEQ ID NO: 4476126 - DNA, 20 bp, Homo sapiens
aaccccagggcactgccagc

SEQ ID NO: 4476127 - DNA, 11 bp, Homo sapiens
aacccccaccc

SEQ ID NO: 4476128 - DNA, 13 bp, Homo sapiens
aacccccacccca

SEQ ID NO: 4476129 - DNA, 18 bp, Homo sapiens
aacccccaccccacactt

SEQ ID NO: 4476130 - DNA, 19 bp, Homo sapiens
aacccccaccccacacttg

SEQ ID NO: 4476131 - DNA, 11 bp, Homo sapiens
aaccccccagc

SEQ ID NO: 4476132 - DNA, 14 bp, Homo sapiens
aaccccccagcact

SEQ ID NO: 4476133 - DNA, 18 bp, Homo sapiens
aaccccccagcactgagg

SEQ ID NO: 4476134 - DNA, 23 bp, Homo sapiens
aacccccctcccagacaggccct

SEQ ID NO: 4476135 - DNA, 17 bp, Homo sapiens
aacccctccactgctgg

SEQ ID NO: 4476136 - DNA, 13 bp, Homo sapiens
aacccctcctccc

SEQ ID NO: 4476137 - DNA, 14 bp, Homo sapiens
aacccctcctccct

SEQ ID NO: 4476138 - DNA, 17 bp, Homo sapiens
aacccctcctccctcag

SEQ ID NO: 4476139 - DNA, 19 bp, Homo sapiens
aacccctcctccctcagac

SEQ ID NO: 4476140 - DNA, 11 bp, Homo sapiens
aacccctttcc

SEQ ID NO: 4476141 - DNA, 23 bp, Homo sapiens
aacccgaggttggtttggggaga

SEQ ID NO: 4476142 - DNA, 17 bp, Homo sapiens
aacccgccctcaggggc

SEQ ID NO: 4476143 - DNA, 23 bp, Homo sapiens
aacccgccctcaggggcctctct

SEQ ID NO: 4476144 - DNA, 16 bp, Homo sapiens
aacccgggaggcagag

SEQ ID NO: 4476145 - DNA, 16 bp, Homo sapiens
aaccctacagtatata

SEQ ID NO: 4476146 - DNA, 19 bp, Homo sapiens
aaccctccttggtgcctct

SEQ ID NO: 4476147 - DNA, 21 bp, Homo sapiens
aaccctgacaaattttaatta

SEQ ID NO: 4476148 - DNA, 23 bp, Homo sapiens
aaccctggtgctttccttcatct

SEQ ID NO: 4476149 - DNA, 21 bp, Homo sapiens
aacccttaccccttagcctcc

SEQ ID NO: 4476150 - DNA, 23 bp, Homo sapiens
aacccttaccccttagcctccct

SEQ ID NO: 4476151 - DNA, 14 bp, Homo sapiens
aacccttattccat

SEQ ID NO: 4476152 - DNA, 16 bp, Homo sapiens
aaccgctaaaagaaac

SEQ ID NO: 4476153 - DNA, 22 bp, Homo sapiens
aaccgtctgttatgctgtgaca

SEQ ID NO: 4476154 - DNA, 18 bp, Homo sapiens
aaccgttttgaagctact

SEQ ID NO: 4476155 - DNA, 14 bp, Homo sapiens
aacctaaaaatcaa

SEQ ID NO: 4476156 - DNA, 22 bp, Homo sapiens
aacctaaataaacacatagatt

SEQ ID NO: 4476157 - DNA, 15 bp, Homo sapiens
aacctaatgcactct

SEQ ID NO: 4476158 - DNA, 23 bp, Homo sapiens
aacctacagactccatctcttct

SEQ ID NO: 4476159 - DNA, 13 bp, Homo sapiens
aacctaccagcca

SEQ ID NO: 4476160 - DNA, 15 bp, Homo sapiens
aacctaccagccaga

SEQ ID NO: 4476161 - DNA, 15 bp, Homo sapiens
aacctactaggccat

SEQ ID NO: 4476162 - DNA, 20 bp, Homo sapiens
aacctagttaaagaaaggaa

SEQ ID NO: 4476163 - DNA, 22 bp, Homo sapiens
aacctattctctttttaacaaa

SEQ ID NO: 4476164 - DNA, 16 bp, Homo sapiens
aacctcaactgcctac

SEQ ID NO: 4476165 - DNA, 17 bp, Homo sapiens
aacctcaactgcctact

SEQ ID NO: 4476166 - DNA, 17 bp, Homo sapiens
aacctcagggctcccag

SEQ ID NO: 4476167 - DNA, 22 bp, Homo sapiens
aacctcagggctgtcccagccc

SEQ ID NO: 4476168 - DNA, 15 bp, Homo sapiens
aacctccaaatggaa

SEQ ID NO: 4476169 - DNA, 22 bp, Homo sapiens
aacctccattctattttagaat

SEQ ID NO: 4476170 - DNA, 19 bp, Homo sapiens
aacctccgcctcccgggtt

SEQ ID NO: 4476171 - DNA, 15 bp, Homo sapiens
aacctcgagtactgt

SEQ ID NO: 4476172 - DNA, 19 bp, Homo sapiens
aacctcgagtactgtgggc

SEQ ID NO: 4476173 - DNA, 21 bp, Homo sapiens
aacctctcctgacccctgcct

SEQ ID NO: 4476174 - DNA, 13 bp, Homo sapiens
aacctctgcctcc

SEQ ID NO: 4476175 - DNA, 19 bp, Homo sapiens
aacctgacccctgctcagt

SEQ ID NO: 4476176 - DNA, 21 bp, Homo sapiens
aacctgagctattttcctctg

SEQ ID NO: 4476177 - DNA, 21 bp, Homo sapiens
aacctgcaaaaaatacttttt

SEQ ID NO: 4476178 - DNA, 19 bp, Homo sapiens
aacctgcaagttgctctga

SEQ ID NO: 4476179 - DNA, 19 bp, Homo sapiens
aacctggagagctagaacc

SEQ ID NO: 4476180 - DNA, 10 bp, Homo sapiens
aacctggagg

SEQ ID NO: 4476181 - DNA, 22 bp, Homo sapiens
aacctggagggctggaatctgg

SEQ ID NO: 4476182 - DNA, 17 bp, Homo sapiens
aacctggatccagcact

SEQ ID NO: 4476183 - DNA, 17 bp, Homo sapiens
aacctggtgtgtttctt

SEQ ID NO: 4476184 - DNA, 11 bp, Homo sapiens
aacctgtaaat

SEQ ID NO: 4476185 - DNA, 17 bp, Homo sapiens
aacctgtagaatcaatt

SEQ ID NO: 4476186 - DNA, 18 bp, Homo sapiens
aacctgtatactcttgaa

SEQ ID NO: 4476187 - DNA, 23 bp, Homo sapiens
aacctgtcctaaggaaccttcct

SEQ ID NO: 4476188 - DNA, 20 bp, Homo sapiens
aacctgttatttctatgaaa

SEQ ID NO: 4476189 - DNA, 13 bp, Homo sapiens
aaccttaagtgct

SEQ ID NO: 4476190 - DNA, 18 bp, Homo sapiens
aaccttaatatttcttca

SEQ ID NO: 4476191 - DNA, 23 bp, Homo sapiens
aaccttagtcatcagatatgctt

SEQ ID NO: 4476192 - DNA, 13 bp, Homo sapiens
aaccttgaaatgg

SEQ ID NO: 4476193 - DNA, 14 bp, Homo sapiens
aaccttgcaacggt

SEQ ID NO: 4476194 - DNA, 15 bp, Homo sapiens
aacagaaattgtata

SEQ ID NO: 4476195 - DNA, 15 bp, Homo sapiens
aacagacaaaaacaa

SEQ ID NO: 4476196 - DNA, 18 bp, Homo sapiens
aacagacaaaaacagcct

SEQ ID NO: 4476197 - DNA, 21 bp, Homo sapiens
aacagacaaaaacagcctcac

SEQ ID NO: 4476198 - DNA, 13 bp, Homo sapiens
aacagactctcac

SEQ ID NO: 4476199 - DNA, 17 bp, Homo sapiens
aacagatatcagtgtct

SEQ ID NO: 4476200 - DNA, 21 bp, Homo sapiens
aacagatgtgaaaatatactt

SEQ ID NO: 4476201 - DNA, 18 bp, Homo sapiens
aacagattcaggccagcc

SEQ ID NO: 4476202 - DNA, 13 bp, Homo sapiens
aacagcacacagg

SEQ ID NO: 4476203 - DNA, 18 bp, Homo sapiens
aacagcaccaccatttaa

SEQ ID NO: 4476204 - DNA, 17 bp, Homo sapiens
aacagccctcctctgca

SEQ ID NO: 4476205 - DNA, 13 bp, Homo sapiens
aacagcctcacag

SEQ ID NO: 4476206 - DNA, 14 bp, Homo sapiens
aacagcctcacaga

SEQ ID NO: 4476207 - DNA, 16 bp, Homo sapiens
aacagcctctttttga

SEQ ID NO: 4476208 - DNA, 23 bp, Homo sapiens
aacagcgttcctagagaagacag

SEQ ID NO: 4476209 - DNA, 19 bp, Homo sapiens
aacagctacaaacttttaa

SEQ ID NO: 4476210 - DNA, 18 bp, Homo sapiens
aacagctatgggagcccc

SEQ ID NO: 4476211 - DNA, 19 bp, Homo sapiens
aacagctatgggagcccca

SEQ ID NO: 4476212 - DNA, 12 bp, Homo sapiens
aacagctcccag

SEQ ID NO: 4476213 - DNA, 11 bp, Homo sapiens
aacagctgcct

SEQ ID NO: 4476214 - DNA, 12 bp, Homo sapiens
aacagctgcctt

SEQ ID NO: 4476215 - DNA, 22 bp, Homo sapiens
aacagctgccttagcttcagga

SEQ ID NO: 4476216 - DNA, 23 bp, Homo sapiens
aacagctgccttagcttcaggaa

SEQ ID NO: 4476217 - DNA, 22 bp, Homo sapiens
aacagctggaggaatacatttt

SEQ ID NO: 4476218 - DNA, 20 bp, Homo sapiens
aacagctgtatttatataag

SEQ ID NO: 4476219 - DNA, 18 bp, Homo sapiens
aacagcttttcccaggag

SEQ ID NO: 4476220 - DNA, 19 bp, Homo sapiens
aacagcttttcccaggaga

SEQ ID NO: 4476221 - DNA, 15 bp, Homo sapiens
aacaggaaaaaaact

SEQ ID NO: 4476222 - DNA, 17 bp, Homo sapiens
aacaggaaaaaaacttt

SEQ ID NO: 4476223 - DNA, 20 bp, Homo sapiens
aacaggcaaagttttacaga

SEQ ID NO: 4476224 - DNA, 16 bp, Homo sapiens
aacaggcaggtacagg

SEQ ID NO: 4476225 - DNA, 17 bp, Homo sapiens
aacaggccattgtgaac

SEQ ID NO: 4476226 - DNA, 23 bp, Homo sapiens
aacaggccattgtgaaccaatgc

SEQ ID NO: 4476227 - DNA, 14 bp, Homo sapiens
aacaggctcagagg

SEQ ID NO: 4476228 - DNA, 18 bp, Homo sapiens
aacagggagaagtagcta

SEQ ID NO: 4476229 - DNA, 23 bp, Homo sapiens
aacagggccatgtgctgccctgt

SEQ ID NO: 4476230 - DNA, 17 bp, Homo sapiens
aacagggtccaggaatg

SEQ ID NO: 4476231 - DNA, 15 bp, Homo sapiens
aacaggtaatataaa

SEQ ID NO: 4476232 - DNA, 20 bp, Homo sapiens
aacaggtatttttttaaatc

SEQ ID NO: 4476233 - DNA, 13 bp, Homo sapiens
aacaggttgggat

SEQ ID NO: 4476234 - DNA, 16 bp, Homo sapiens
aacagtattgggcagg

SEQ ID NO: 4476235 - DNA, 17 bp, Homo sapiens
aacagtattgggcagga

SEQ ID NO: 4476236 - DNA, 22 bp, Homo sapiens
aacagtatttctggtgtatatt

SEQ ID NO: 4476237 - DNA, 19 bp, Homo sapiens
aacagtcatctagaattca

SEQ ID NO: 4476238 - DNA, 17 bp, Homo sapiens
aacagtctcaggaaatc

SEQ ID NO: 4476239 - DNA, 14 bp, Homo sapiens
aacagtgcctgctg

SEQ ID NO: 4476240 - DNA, 19 bp, Homo sapiens
aacagtgtctttctagcca

SEQ ID NO: 4476241 - DNA, 13 bp, Homo sapiens
aacagtgtttaaa

SEQ ID NO: 4476242 - DNA, 13 bp, Homo sapiens
aacagtgttttca

SEQ ID NO: 4476243 - DNA, 16 bp, Homo sapiens
aacagttatttctgtt

SEQ ID NO: 4476244 - DNA, 13 bp, Homo sapiens
aacagttctgagc

SEQ ID NO: 4476245 - DNA, 21 bp, Homo sapiens
aacagttctgagctgtaattt

SEQ ID NO: 4476246 - DNA, 18 bp, Homo sapiens
aacagttgcatgtagtaa

SEQ ID NO: 4476247 - DNA, 22 bp, Homo sapiens
aacagttgcatgtagtaacact

SEQ ID NO: 4476248 - DNA, 12 bp, Homo sapiens
aacagttggcac

SEQ ID NO: 4476249 - DNA, 17 bp, Homo sapiens
aacagttggtaactttt

SEQ ID NO: 4476250 - DNA, 14 bp, Homo sapiens
aacagttgtatgtt

SEQ ID NO: 4476251 - DNA, 13 bp, Homo sapiens
aacagttgtattt

SEQ ID NO: 4476252 - DNA, 14 bp, Homo sapiens
aacagtttcatcta

SEQ ID NO: 4476253 - DNA, 16 bp, Homo sapiens
aacataaaaactgatt

SEQ ID NO: 4476254 - DNA, 14 bp, Homo sapiens
aacataaaaatgat

SEQ ID NO: 4476255 - DNA, 14 bp, Homo sapiens
aacataactgcttc

SEQ ID NO: 4476256 - DNA, 17 bp, Homo sapiens
aacataactgcttcttg

SEQ ID NO: 4476257 - DNA, 19 bp, Homo sapiens
aacataatatagcttaaaa

SEQ ID NO: 4476258 - DNA, 16 bp, Homo sapiens
aacatacataatacaa

SEQ ID NO: 4476259 - DNA, 21 bp, Homo sapiens
aacatacattggttttgaaat

SEQ ID NO: 4476260 - DNA, 20 bp, Homo sapiens
aacatactgtaatcaaaagg

SEQ ID NO: 4476261 - DNA, 14 bp, Homo sapiens
aacatacttcaaaa

SEQ ID NO: 4476262 - DNA, 16 bp, Homo sapiens
aacatagaaactcggg

SEQ ID NO: 4476263 - DNA, 23 bp, Homo sapiens
aacatagaaatggaaattttgct

SEQ ID NO: 4476264 - DNA, 21 bp, Homo sapiens
aacatagacagaagaaacaag

SEQ ID NO: 4476265 - DNA, 20 bp, Homo sapiens
aacatagactagagaaaccg

SEQ ID NO: 4476266 - DNA, 22 bp, Homo sapiens
aacataggtttttaaagactag

SEQ ID NO: 4476267 - DNA, 21 bp, Homo sapiens
aacatagtaagttcagcactt

SEQ ID NO: 4476268 - DNA, 17 bp, Homo sapiens
aacatagtgagacactg

SEQ ID NO: 4476269 - DNA, 22 bp, Homo sapiens
aacatatttatttttacctgct

SEQ ID NO: 4476270 - DNA, 19 bp, Homo sapiens
aacatatttttatacttta

SEQ ID NO: 4476271 - DNA, 16 bp, Homo sapiens
aacatcacacctgccc

SEQ ID NO: 4476272 - DNA, 21 bp, Homo sapiens
aacatcactatcaattttaag

SEQ ID NO: 4476273 - DNA, 15 bp, Homo sapiens
aacatcccaagattt

SEQ ID NO: 4476274 - DNA, 16 bp, Homo sapiens
aacatcccattgccct

SEQ ID NO: 4476275 - DNA, 19 bp, Homo sapiens
aacatcccattgccctggt

SEQ ID NO: 4476276 - DNA, 23 bp, Homo sapiens
aacatctgccatttatttcctca

SEQ ID NO: 4476277 - DNA, 20 bp, Homo sapiens
aacatgactctttattgtct

SEQ ID NO: 4476278 - DNA, 14 bp, Homo sapiens
aacatgacttcctt

SEQ ID NO: 4476279 - DNA, 22 bp, Homo sapiens
aacatgattttacaagtataac

SEQ ID NO: 4476280 - DNA, 23 bp, Homo sapiens
aacatgcaataacaagcatgcat

SEQ ID NO: 4476281 - DNA, 12 bp, Homo sapiens
aacatgcagaag

SEQ ID NO: 4476282 - DNA, 22 bp, Homo sapiens
aacatgcagctcttcaacatga

SEQ ID NO: 4476283 - DNA, 15 bp, Homo sapiens
aacatgcagtttgaa

SEQ ID NO: 4476284 - DNA, 17 bp, Homo sapiens
aacatgcagtttgaaat

SEQ ID NO: 4476285 - DNA, 21 bp, Homo sapiens
aacatgcagtttgaaattctg

SEQ ID NO: 4476286 - DNA, 23 bp, Homo sapiens
aacatggaggatggtgtcctgag

SEQ ID NO: 4476287 - DNA, 21 bp, Homo sapiens
aacatgggagcttattgctaa

SEQ ID NO: 4476288 - DNA, 16 bp, Homo sapiens
aacatgggagggatca

SEQ ID NO: 4476289 - DNA, 17 bp, Homo sapiens
aacatgggagggatcag

SEQ ID NO: 4476290 - DNA, 20 bp, Homo sapiens
aacatgggagggatcagccc

SEQ ID NO: 4476291 - DNA, 16 bp, Homo sapiens
aacatggtttaaaaga

SEQ ID NO: 4476292 - DNA, 19 bp, Homo sapiens
aacatgtactacagctata

SEQ ID NO: 4476293 - DNA, 21 bp, Homo sapiens
aacatgtactacagctatatt

SEQ ID NO: 4476294 - DNA, 12 bp, Homo sapiens
aacatgtacttt

SEQ ID NO: 4476295 - DNA, 15 bp, Homo sapiens
aacatgtcagtttta

SEQ ID NO: 4476296 - DNA, 13 bp, Homo sapiens
aacatgtgcttca

SEQ ID NO: 4476297 - DNA, 20 bp, Homo sapiens
aacatgtggctcctcccagc

SEQ ID NO: 4476298 - DNA, 20 bp, Homo sapiens
aacatgttatttgtaataga

SEQ ID NO: 4476299 - DNA, 13 bp, Homo sapiens
aacatgttcctga

SEQ ID NO: 4476300 - DNA, 11 bp, Homo sapiens
aacatgtttcc

SEQ ID NO: 4476301 - DNA, 18 bp, Homo sapiens
aacatgtttctgttttgt

SEQ ID NO: 4476302 - DNA, 15 bp, Homo sapiens
aacattaaatcacag

SEQ ID NO: 4476303 - DNA, 17 bp, Homo sapiens
aacattaagaaaatatt

SEQ ID NO: 4476304 - DNA, 18 bp, Homo sapiens
aacattaatgcctgcttt

SEQ ID NO: 4476305 - DNA, 17 bp, Homo sapiens
aacattattcatctctc

SEQ ID NO: 4476306 - DNA, 12 bp, Homo sapiens
aacattattttt

SEQ ID NO: 4476307 - DNA, 14 bp, Homo sapiens
aacattccagggat

SEQ ID NO: 4476308 - DNA, 13 bp, Homo sapiens
aacattcctccag

SEQ ID NO: 4476309 - DNA, 22 bp, Homo sapiens
aacattcctccagcctcccctc

SEQ ID NO: 4476310 - DNA, 19 bp, Homo sapiens
aacattcgtgagctgggga

SEQ ID NO: 4476311 - DNA, 14 bp, Homo sapiens
aacattgatctgtt

SEQ ID NO: 4476312 - DNA, 13 bp, Homo sapiens
aacattgtactgt

SEQ ID NO: 4476313 - DNA, 20 bp, Homo sapiens
aacattgtactgttgcttta

SEQ ID NO: 4476314 - DNA, 15 bp, Homo sapiens
aaatttgttcttgta

SEQ ID NO: 4476315 - DNA, 15 bp, Homo sapiens
aaatttgttgtttgt

SEQ ID NO: 4476316 - DNA, 14 bp, Homo sapiens
aaattttaaaattg

SEQ ID NO: 4476317 - DNA, 22 bp, Homo sapiens
aaattttaaagccattctgatt

SEQ ID NO: 4476318 - DNA, 14 bp, Homo sapiens
aaattttagaaata

SEQ ID NO: 4476319 - DNA, 17 bp, Homo sapiens
aaattttagtacatttt

SEQ ID NO: 4476320 - DNA, 12 bp, Homo sapiens
aaattttatatg

SEQ ID NO: 4476321 - DNA, 11 bp, Homo sapiens
aaattttatgt

SEQ ID NO: 4476322 - DNA, 22 bp, Homo sapiens
aaattttatgtattttaaaata

SEQ ID NO: 4476323 - DNA, 13 bp, Homo sapiens
aaattttcagcat

SEQ ID NO: 4476324 - DNA, 12 bp, Homo sapiens
aaattttctggt

SEQ ID NO: 4476325 - DNA, 14 bp, Homo sapiens
aaattttcttcagt

SEQ ID NO: 4476326 - DNA, 12 bp, Homo sapiens
aaattttgaatg

SEQ ID NO: 4476327 - DNA, 13 bp, Homo sapiens
aaattttgcactt

SEQ ID NO: 4476328 - DNA, 19 bp, Homo sapiens
aaattttggaatatttgct

SEQ ID NO: 4476329 - DNA, 22 bp, Homo sapiens
aaattttggaatatttgcttta

SEQ ID NO: 4476330 - DNA, 14 bp, Homo sapiens
aaattttgtaagaa

SEQ ID NO: 4476331 - DNA, 18 bp, Homo sapiens
aaattttgtaatgaattc

SEQ ID NO: 4476332 - DNA, 17 bp, Homo sapiens
aaattttgtatgccaat

SEQ ID NO: 4476333 - DNA, 19 bp, Homo sapiens
aaatttttacctttatctt

SEQ ID NO: 4476334 - DNA, 17 bp, Homo sapiens
aaatttttaggcaaaga

SEQ ID NO: 4476335 - DNA, 12 bp, Homo sapiens
aaattttttgac

SEQ ID NO: 4476336 - DNA, 16 bp, Homo sapiens
aaattttttttacatt

SEQ ID NO: 4476337 - DNA, 14 bp, Homo sapiens
aacaaaaaatacat

SEQ ID NO: 4476338 - DNA, 23 bp, Homo sapiens
aacaaaaaggtaaatcccacatc

SEQ ID NO: 4476339 - DNA, 12 bp, Homo sapiens
aacaaaacaaaa

SEQ ID NO: 4476340 - DNA, 14 bp, Homo sapiens
aacaaaacaaaaca

SEQ ID NO: 4476341 - DNA, 19 bp, Homo sapiens
aacaaaagtacattgctta

SEQ ID NO: 4476342 - DNA, 20 bp, Homo sapiens
aacaaaagtacattgcttaa

SEQ ID NO: 4476343 - DNA, 11 bp, Homo sapiens
aacaaaagttt

SEQ ID NO: 4476344 - DNA, 14 bp, Homo sapiens
aacaaaatgtagaa

SEQ ID NO: 4476345 - DNA, 18 bp, Homo sapiens
aacaaaattagccgggca

SEQ ID NO: 4476346 - DNA, 15 bp, Homo sapiens
aacaaaattatttgt

SEQ ID NO: 4476347 - DNA, 19 bp, Homo sapiens
aacaaaccttgccttgaaa

SEQ ID NO: 4476348 - DNA, 20 bp, Homo sapiens
aacaaactcgttttttacaa

SEQ ID NO: 4476349 - DNA, 11 bp, Homo sapiens
aacaaagacat

SEQ ID NO: 4476350 - DNA, 20 bp, Homo sapiens
aacaaagacatgctttccat

SEQ ID NO: 4476351 - DNA, 17 bp, Homo sapiens
aacaaagacatttatat

SEQ ID NO: 4476352 - DNA, 17 bp, Homo sapiens
aacaaagagttcaagaa

SEQ ID NO: 4476353 - DNA, 17 bp, Homo sapiens
aacaaagtcacagtcgt

SEQ ID NO: 4476354 - DNA, 20 bp, Homo sapiens
aacaaatgttagacttgtgt

SEQ ID NO: 4476355 - DNA, 15 bp, Homo sapiens
aacaaattatttttg

SEQ ID NO: 4476356 - DNA, 18 bp, Homo sapiens
aacaaatttacagagaca

SEQ ID NO: 4476357 - DNA, 15 bp, Homo sapiens
aacaaattttctggt

SEQ ID NO: 4476358 - DNA, 13 bp, Homo sapiens
aacaacaattggt

SEQ ID NO: 4476359 - DNA, 12 bp, Homo sapiens
aacaagaaatgg

SEQ ID NO: 4476360 - DNA, 21 bp, Homo sapiens
aacaagagcaaaactccgtct

SEQ ID NO: 4476361 - DNA, 19 bp, Homo sapiens
aacaagagcgaaactccgt

SEQ ID NO: 4476362 - DNA, 22 bp, Homo sapiens
aacaagagtatgtggcaaaaca

SEQ ID NO: 4476363 - DNA, 19 bp, Homo sapiens
aacaagatgtttcatttta

SEQ ID NO: 4476364 - DNA, 20 bp, Homo sapiens
aacaagatttccttgtgcaa

SEQ ID NO: 4476365 - DNA, 20 bp, Homo sapiens
aacaagcatgcataaatcaa

SEQ ID NO: 4476366 - DNA, 18 bp, Homo sapiens
aacaagccaagaaagatg

SEQ ID NO: 4476367 - DNA, 14 bp, Homo sapiens
aacaagcccaaagc

SEQ ID NO: 4476368 - DNA, 14 bp, Homo sapiens
aacaaggaagtcaa

SEQ ID NO: 4476369 - DNA, 14 bp, Homo sapiens
aacaagtatataat

SEQ ID NO: 4476370 - DNA, 12 bp, Homo sapiens
aacaagtatttg

SEQ ID NO: 4476371 - DNA, 20 bp, Homo sapiens
aacaagtatttgttaattta

SEQ ID NO: 4476372 - DNA, 23 bp, Homo sapiens
aacaagtatttgttaatttagaa

SEQ ID NO: 4476373 - DNA, 14 bp, Homo sapiens
aacaagtcattttt

SEQ ID NO: 4476374 - DNA, 15 bp, Homo sapiens
aacaataaagggaga

SEQ ID NO: 4476375 - DNA, 15 bp, Homo sapiens
aacaataatatttca

SEQ ID NO: 4476376 - DNA, 15 bp, Homo sapiens
aacaatacatgagaa

SEQ ID NO: 4476377 - DNA, 15 bp, Homo sapiens
aacaatattactttg

SEQ ID NO: 4476378 - DNA, 20 bp, Homo sapiens
aacaatccattcacaagcct

SEQ ID NO: 4476379 - DNA, 15 bp, Homo sapiens
aacaatctaacaata

SEQ ID NO: 4476380 - DNA, 16 bp, Homo sapiens
aacaatctatttaaaa

SEQ ID NO: 4476381 - DNA, 19 bp, Homo sapiens
aacaatctatttaaaaaac

SEQ ID NO: 4476382 - DNA, 17 bp, Homo sapiens
aacaatcttcctgttta

SEQ ID NO: 4476383 - DNA, 12 bp, Homo sapiens
aacaatgaaaac

SEQ ID NO: 4476384 - DNA, 15 bp, Homo sapiens
aacaatgatgccctg

SEQ ID NO: 4476385 - DNA, 17 bp, Homo sapiens
aacaatgccttgttgta

SEQ ID NO: 4476386 - DNA, 15 bp, Homo sapiens
aacaatgtatacaat

SEQ ID NO: 4476387 - DNA, 15 bp, Homo sapiens
aacaattaattgtct

SEQ ID NO: 4476388 - DNA, 12 bp, Homo sapiens
aacaattctaaa

SEQ ID NO: 4476389 - DNA, 19 bp, Homo sapiens
aacaattctaaaatgattg

SEQ ID NO: 4476390 - DNA, 22 bp, Homo sapiens
aacaatttattttattttagca

SEQ ID NO: 4476391 - DNA, 20 bp, Homo sapiens
aacaattttctgtaatcttt

SEQ ID NO: 4476392 - DNA, 13 bp, Homo sapiens
aacacaaactgta

SEQ ID NO: 4476393 - DNA, 16 bp, Homo sapiens
aacacaaactgtaaat

SEQ ID NO: 4476394 - DNA, 17 bp, Homo sapiens
aacacaaagagatattt

SEQ ID NO: 4476395 - DNA, 13 bp, Homo sapiens
aacacaagcaaaa

SEQ ID NO: 4476396 - DNA, 16 bp, Homo sapiens
aacacaagcaaaaaaa

SEQ ID NO: 4476397 - DNA, 15 bp, Homo sapiens
aacacaccttaaaac

SEQ ID NO: 4476398 - DNA, 14 bp, Homo sapiens
aacacagccctgga

SEQ ID NO: 4476399 - DNA, 22 bp, Homo sapiens
aacacagccctggaaacataca

SEQ ID NO: 4476400 - DNA, 14 bp, Homo sapiens
aacacataatttct

SEQ ID NO: 4476401 - DNA, 17 bp, Homo sapiens
aacacatagattcacct

SEQ ID NO: 4476402 - DNA, 19 bp, Homo sapiens
aacacatgataccagcagc

SEQ ID NO: 4476403 - DNA, 20 bp, Homo sapiens
aacacatgtttttatttcct

SEQ ID NO: 4476404 - DNA, 13 bp, Homo sapiens
aacacattataaa

SEQ ID NO: 4476405 - DNA, 14 bp, Homo sapiens
aacacattataaag

SEQ ID NO: 4476406 - DNA, 22 bp, Homo sapiens
aacacatttgggatgttccttt

SEQ ID NO: 4476407 - DNA, 14 bp, Homo sapiens
aacacattttaaat

SEQ ID NO: 4476408 - DNA, 13 bp, Homo sapiens
aacacatttttaa

SEQ ID NO: 4476409 - DNA, 15 bp, Homo sapiens
aacaccaacataaaa

SEQ ID NO: 4476410 - DNA, 19 bp, Homo sapiens
aacaccattgaaggcttaa

SEQ ID NO: 4476411 - DNA, 15 bp, Homo sapiens
aacaccttaatatgc

SEQ ID NO: 4476412 - DNA, 15 bp, Homo sapiens
aacaccttcctcctg

SEQ ID NO: 4476413 - DNA, 15 bp, Homo sapiens
aacactacagagtac

SEQ ID NO: 4476414 - DNA, 14 bp, Homo sapiens
aacactacttccct

SEQ ID NO: 4476415 - DNA, 16 bp, Homo sapiens
aacactattttcagaa

SEQ ID NO: 4476416 - DNA, 23 bp, Homo sapiens
aacactcagcagacatttatctt

SEQ ID NO: 4476417 - DNA, 17 bp, Homo sapiens
aacactcagtggcccat

SEQ ID NO: 4476418 - DNA, 24 bp, Homo sapiens
aacactcagtggcccatggcattt

SEQ ID NO: 4476419 - DNA, 19 bp, Homo sapiens
aacactgataatcacactg

SEQ ID NO: 4476420 - DNA, 23 bp, Homo sapiens
aacactggtctgctgttccagtg

SEQ ID NO: 4476421 - DNA, 17 bp, Homo sapiens
aacactggtgtgacctg

SEQ ID NO: 4476422 - DNA, 13 bp, Homo sapiens
aacactgtatttt

SEQ ID NO: 4476423 - DNA, 18 bp, Homo sapiens
aacacttaatagcaacag

SEQ ID NO: 4476424 - DNA, 14 bp, Homo sapiens
aacacttaatcatt

SEQ ID NO: 4476425 - DNA, 16 bp, Homo sapiens
aacacttaatcatttt

SEQ ID NO: 4476426 - DNA, 19 bp, Homo sapiens
aacacttaatcattttatg

SEQ ID NO: 4476427 - DNA, 16 bp, Homo sapiens
aacacttatcttctgg

SEQ ID NO: 4476428 - DNA, 17 bp, Homo sapiens
aacacttatcttctgga

SEQ ID NO: 4476429 - DNA, 18 bp, Homo sapiens
aacacttatcttctggat

SEQ ID NO: 4476430 - DNA, 18 bp, Homo sapiens
aacacttggcatacaaaa

SEQ ID NO: 4476431 - DNA, 20 bp, Homo sapiens
aacactttagttatattcac

SEQ ID NO: 4476432 - DNA, 22 bp, Homo sapiens
aacagaaaactcccaatacaaa

SEQ ID NO: 4476433 - DNA, 13 bp, Homo sapiens
aacagaaactaca

SEQ ID NO: 4476434 - DNA, 21 bp, Homo sapiens
aacagaaatcggggaagtggg

SEQ ID NO: 4476435 - DNA, 13 bp, Homo sapiens
aacagaaattatt

SEQ ID NO: 4476436 - DNA, 15 bp, Homo sapiens
aaatgttttatgaca

SEQ ID NO: 4476437 - DNA, 18 bp, Homo sapiens
aaatgttttttaaaatgg

SEQ ID NO: 4476438 - DNA, 21 bp, Homo sapiens
aaattaaaagtttgaaaagca

SEQ ID NO: 4476439 - DNA, 15 bp, Homo sapiens
aaattaaatatttat

SEQ ID NO: 4476440 - DNA, 12 bp, Homo sapiens
aaattaaatcta

SEQ ID NO: 4476441 - DNA, 13 bp, Homo sapiens
aaattaaatctgt

SEQ ID NO: 4476442 - DNA, 11 bp, Homo sapiens
aaattaacaca

SEQ ID NO: 4476443 - DNA, 20 bp, Homo sapiens
aaattaactgggtaatgaaa

SEQ ID NO: 4476444 - DNA, 13 bp, Homo sapiens
aaattaagacttt

SEQ ID NO: 4476445 - DNA, 19 bp, Homo sapiens
aaattaagatcctaaactc

SEQ ID NO: 4476446 - DNA, 20 bp, Homo sapiens
aaattaagatcctaaactct

SEQ ID NO: 4476447 - DNA, 18 bp, Homo sapiens
aaattaagtgtgtataaa

SEQ ID NO: 4476448 - DNA, 18 bp, Homo sapiens
aaattaatatatcattat

SEQ ID NO: 4476449 - DNA, 12 bp, Homo sapiens
aaattaatatct

SEQ ID NO: 4476450 - DNA, 19 bp, Homo sapiens
aaattaatgtaataaagtg

SEQ ID NO: 4476451 - DNA, 20 bp, Homo sapiens
aaattaatgtaataaagtga

SEQ ID NO: 4476452 - DNA, 18 bp, Homo sapiens
aaattaatttgttaatta

SEQ ID NO: 4476453 - DNA, 14 bp, Homo sapiens
aaattacaatttta

SEQ ID NO: 4476454 - DNA, 15 bp, Homo sapiens
aaattacaattttat

SEQ ID NO: 4476455 - DNA, 16 bp, Homo sapiens
aaattacaattttatc

SEQ ID NO: 4476456 - DNA, 16 bp, Homo sapiens
aaattacagtgcagtt

SEQ ID NO: 4476457 - DNA, 17 bp, Homo sapiens
aaattactaatgattta

SEQ ID NO: 4476458 - DNA, 15 bp, Homo sapiens
aaattactatagcaa

SEQ ID NO: 4476459 - DNA, 19 bp, Homo sapiens
aaattactatagcaaagta

SEQ ID NO: 4476460 - DNA, 23 bp, Homo sapiens
aaattactgtttattaaagtaca

SEQ ID NO: 4476461 - DNA, 20 bp, Homo sapiens
aaattactttgattccattt

SEQ ID NO: 4476462 - DNA, 12 bp, Homo sapiens
aaattagaaaat

SEQ ID NO: 4476463 - DNA, 13 bp, Homo sapiens
aaattagaaaata

SEQ ID NO: 4476464 - DNA, 17 bp, Homo sapiens
aaattagaaaatattct

SEQ ID NO: 4476465 - DNA, 15 bp, Homo sapiens
aaattagaaaggaca

SEQ ID NO: 4476466 - DNA, 18 bp, Homo sapiens
aaattagaatgaatttat

SEQ ID NO: 4476467 - DNA, 14 bp, Homo sapiens
aaattagatttgtg

SEQ ID NO: 4476468 - DNA, 16 bp, Homo sapiens
aaattagatttgtgca

SEQ ID NO: 4476469 - DNA, 21 bp, Homo sapiens
aaattagatttgtgcaaacat

SEQ ID NO: 4476470 - DNA, 15 bp, Homo sapiens
aaattaggaataaat

SEQ ID NO: 4476471 - DNA, 22 bp, Homo sapiens
aaattagtcttttgtaatatca

SEQ ID NO: 4476472 - DNA, 16 bp, Homo sapiens
aaattataaggactgc

SEQ ID NO: 4476473 - DNA, 17 bp, Homo sapiens
aaattataaggactgca

SEQ ID NO: 4476474 - DNA, 20 bp, Homo sapiens
aaattataaggactgcatgg

SEQ ID NO: 4476475 - DNA, 22 bp, Homo sapiens
aaattatatatttattttattc

SEQ ID NO: 4476476 - DNA, 14 bp, Homo sapiens
aaattatatgatat

SEQ ID NO: 4476477 - DNA, 18 bp, Homo sapiens
aaattatatgatatgcat

SEQ ID NO: 4476478 - DNA, 20 bp, Homo sapiens
aaattatatgatatgcatgt

SEQ ID NO: 4476479 - DNA, 22 bp, Homo sapiens
aaattatatttgtgctatagta

SEQ ID NO: 4476480 - DNA, 18 bp, Homo sapiens
aaattatgaatattaaag

SEQ ID NO: 4476481 - DNA, 22 bp, Homo sapiens
aaattatgagctatcctttcaa

SEQ ID NO: 4476482 - DNA, 17 bp, Homo sapiens
aaattatggaatatcat

SEQ ID NO: 4476483 - DNA, 18 bp, Homo sapiens
aaattatggaatatcatc

SEQ ID NO: 4476484 - DNA, 23 bp, Homo sapiens
aaattatggaatatcatctgtca

SEQ ID NO: 4476485 - DNA, 18 bp, Homo sapiens
aaattatggcatttctat

SEQ ID NO: 4476486 - DNA, 23 bp, Homo sapiens
aaattatgttactgtatttttca

SEQ ID NO: 4476487 - DNA, 12 bp, Homo sapiens
aaattattactt

SEQ ID NO: 4476488 - DNA, 17 bp, Homo sapiens
aaattattactttaaat

SEQ ID NO: 4476489 - DNA, 24 bp, Homo sapiens
aaattattactttaaattatatga

SEQ ID NO: 4476490 - DNA, 13 bp, Homo sapiens
aaattattagaac

SEQ ID NO: 4476491 - DNA, 17 bp, Homo sapiens
aaattattagaacattc

SEQ ID NO: 4476492 - DNA, 14 bp, Homo sapiens
aaattatttcttaa

SEQ ID NO: 4476493 - DNA, 13 bp, Homo sapiens
aaattatttgcat

SEQ ID NO: 4476494 - DNA, 14 bp, Homo sapiens
aaattattttatat

SEQ ID NO: 4476495 - DNA, 14 bp, Homo sapiens
aaattcaaagcatg

SEQ ID NO: 4476496 - DNA, 18 bp, Homo sapiens
aaattcaataatcttaaa

SEQ ID NO: 4476497 - DNA, 19 bp, Homo sapiens
aaattcacatgatgcactt

SEQ ID NO: 4476498 - DNA, 15 bp, Homo sapiens
aaattcagagtcctt

SEQ ID NO: 4476499 - DNA, 13 bp, Homo sapiens
aaattcagcattt

SEQ ID NO: 4476500 - DNA, 20 bp, Homo sapiens
aaattcagtttttttccagt

SEQ ID NO: 4476501 - DNA, 16 bp, Homo sapiens
aaattcatttctaatt

SEQ ID NO: 4476502 - DNA, 17 bp, Homo sapiens
aaattccactgaaaatt

SEQ ID NO: 4476503 - DNA, 22 bp, Homo sapiens
aaattccactgaaaatttaaca

SEQ ID NO: 4476504 - DNA, 21 bp, Homo sapiens
aaattcccttttcaccttttc

SEQ ID NO: 4476505 - DNA, 21 bp, Homo sapiens
aaattccgattagacctttat

SEQ ID NO: 4476506 - DNA, 19 bp, Homo sapiens
aaattctataggaacatat

SEQ ID NO: 4476507 - DNA, 22 bp, Homo sapiens
aaattctataggaacatatgaa

SEQ ID NO: 4476508 - DNA, 23 bp, Homo sapiens
aaattctataggaacatatgaaa

SEQ ID NO: 4476509 - DNA, 12 bp, Homo sapiens
aaattctgaatt

SEQ ID NO: 4476510 - DNA, 19 bp, Homo sapiens
aaattctgaatttgcaaag

SEQ ID NO: 4476511 - DNA, 20 bp, Homo sapiens
aaattctgaatttgcaaagt

SEQ ID NO: 4476512 - DNA, 20 bp, Homo sapiens
aaattctttcccagtctgtc

SEQ ID NO: 4476513 - DNA, 21 bp, Homo sapiens
aaattcttttttaaattttct

SEQ ID NO: 4476514 - DNA, 14 bp, Homo sapiens
aaattgaatgcaaa

SEQ ID NO: 4476515 - DNA, 21 bp, Homo sapiens
aaattgatattatattaaaca

SEQ ID NO: 4476516 - DNA, 13 bp, Homo sapiens
aaattgcaaatct

SEQ ID NO: 4476517 - DNA, 17 bp, Homo sapiens
aaattgctaatgttgct

SEQ ID NO: 4476518 - DNA, 21 bp, Homo sapiens
aaattgctctgtgtatatctc

SEQ ID NO: 4476519 - DNA, 15 bp, Homo sapiens
aaattgctgcttgga

SEQ ID NO: 4476520 - DNA, 13 bp, Homo sapiens
aaattgcttctag

SEQ ID NO: 4476521 - DNA, 18 bp, Homo sapiens
aaattgctttgtattgta

SEQ ID NO: 4476522 - DNA, 19 bp, Homo sapiens
aaattgggctggattgtgc

SEQ ID NO: 4476523 - DNA, 19 bp, Homo sapiens
aaattggtatatttgaaat

SEQ ID NO: 4476524 - DNA, 18 bp, Homo sapiens
aaattgtacattttgtaa

SEQ ID NO: 4476525 - DNA, 12 bp, Homo sapiens
aaattgtataaa

SEQ ID NO: 4476526 - DNA, 13 bp, Homo sapiens
aaattgtatacca

SEQ ID NO: 4476527 - DNA, 20 bp, Homo sapiens
aaattgtataccaatgtgtt

SEQ ID NO: 4476528 - DNA, 14 bp, Homo sapiens
aaattgtctgccat

SEQ ID NO: 4476529 - DNA, 18 bp, Homo sapiens
aaattgtgcataatgctt

SEQ ID NO: 4476530 - DNA, 19 bp, Homo sapiens
aaattgtgcataatgcttt

SEQ ID NO: 4476531 - DNA, 22 bp, Homo sapiens
aaattgtgcttctccccagaat

SEQ ID NO: 4476532 - DNA, 19 bp, Homo sapiens
aaattgtttagtggaaaat

SEQ ID NO: 4476533 - DNA, 21 bp, Homo sapiens
aaatttaagaaaacaagtata

SEQ ID NO: 4476534 - DNA, 19 bp, Homo sapiens
aaatttaatccttctttgt

SEQ ID NO: 4476535 - DNA, 13 bp, Homo sapiens
aaatttacacagt

SEQ ID NO: 4476536 - DNA, 22 bp, Homo sapiens
aaatttacacagtgagactgta

SEQ ID NO: 4476537 - DNA, 23 bp, Homo sapiens
aaatttacacagtgagactgtac

SEQ ID NO: 4476538 - DNA, 12 bp, Homo sapiens
aaatttatgtga

SEQ ID NO: 4476539 - DNA, 10 bp, Homo sapiens
aaatttattt

SEQ ID NO: 4476540 - DNA, 19 bp, Homo sapiens
aaatttatttccaatgttt

SEQ ID NO: 4476541 - DNA, 21 bp, Homo sapiens
aaatttcacgattcatttttg

SEQ ID NO: 4476542 - DNA, 20 bp, Homo sapiens
aaatttcataattctgaaac

SEQ ID NO: 4476543 - DNA, 22 bp, Homo sapiens
aaatttctagcctgcactttga

SEQ ID NO: 4476544 - DNA, 21 bp, Homo sapiens
aaatttctataaatttaagaa

SEQ ID NO: 4476545 - DNA, 18 bp, Homo sapiens
aaatttctgtaaaacagg

SEQ ID NO: 4476546 - DNA, 11 bp, Homo sapiens
aaatttcttat

SEQ ID NO: 4476547 - DNA, 14 bp, Homo sapiens
aaatttcttatgtg

SEQ ID NO: 4476548 - DNA, 17 bp, Homo sapiens
aaatttcttatgtgaca

SEQ ID NO: 4476549 - DNA, 16 bp, Homo sapiens
aaatttgaataagcag

SEQ ID NO: 4476550 - DNA, 17 bp, Homo sapiens
aaatttgactaatttta

SEQ ID NO: 4476551 - DNA, 20 bp, Homo sapiens
aaatttgactaattttacat

SEQ ID NO: 4476552 - DNA, 18 bp, Homo sapiens
aaatttgacttttctgta

SEQ ID NO: 4476553 - DNA, 21 bp, Homo sapiens
aaatttgtaataaaactattt

SEQ ID NO: 4476554 - DNA, 21 bp, Homo sapiens
aaatttgtctgaaacatttca

SEQ ID NO: 4476555 - DNA, 17 bp, Homo sapiens
aaatttgtgctttttaa

SEQ ID NO: 4476556 - DNA, 13 bp, Homo sapiens
aaatcttgaaatt

SEQ ID NO: 4476557 - DNA, 22 bp, Homo sapiens
aaatcttggttgatgccaaaaa

SEQ ID NO: 4476558 - DNA, 17 bp, Homo sapiens
aaatcttgtttgttact

SEQ ID NO: 4476559 - DNA, 11 bp, Homo sapiens
aaatcttttac

SEQ ID NO: 4476560 - DNA, 17 bp, Homo sapiens
aaatcttttacattttt

SEQ ID NO: 4476561 - DNA, 17 bp, Homo sapiens
aaatctttttgcttcta

SEQ ID NO: 4476562 - DNA, 15 bp, Homo sapiens
aaatgaaaatgtctt

SEQ ID NO: 4476563 - DNA, 17 bp, Homo sapiens
aaatgaaaatgtcttgt

SEQ ID NO: 4476564 - DNA, 13 bp, Homo sapiens
aaatgaaaattgt

SEQ ID NO: 4476565 - DNA, 14 bp, Homo sapiens
aaatgaaaattgta

SEQ ID NO: 4476566 - DNA, 14 bp, Homo sapiens
aaatgaaacaaaaa

SEQ ID NO: 4476567 - DNA, 21 bp, Homo sapiens
aaatgaaagcagggacttgaa

SEQ ID NO: 4476568 - DNA, 15 bp, Homo sapiens
aaatgaaagggaaac

SEQ ID NO: 4476569 - DNA, 16 bp, Homo sapiens
aaatgaaagggaaact

SEQ ID NO: 4476570 - DNA, 14 bp, Homo sapiens
aaatgaaagtgtta

SEQ ID NO: 4476571 - DNA, 15 bp, Homo sapiens
aaatgaaatgtatgc

SEQ ID NO: 4476572 - DNA, 21 bp, Homo sapiens
aaatgaataatgcctttgtaa

SEQ ID NO: 4476573 - DNA, 11 bp, Homo sapiens
aaatgaatgtg

SEQ ID NO: 4476574 - DNA, 18 bp, Homo sapiens
aaatgaattgaaaaacaa

SEQ ID NO: 4476575 - DNA, 17 bp, Homo sapiens
aaatgaatttttattga

SEQ ID NO: 4476576 - DNA, 15 bp, Homo sapiens
aaatgacattttact

SEQ ID NO: 4476577 - DNA, 16 bp, Homo sapiens
aaatgactgaagtgct

SEQ ID NO: 4476578 - DNA, 14 bp, Homo sapiens
aaatgactggctcc

SEQ ID NO: 4476579 - DNA, 16 bp, Homo sapiens
aaatgacttatttctg

SEQ ID NO: 4476580 - DNA, 22 bp, Homo sapiens
aaatgagaaaggatttcctttc

SEQ ID NO: 4476581 - DNA, 21 bp, Homo sapiens
aaatgagaaggcagccaccag

SEQ ID NO: 4476582 - DNA, 17 bp, Homo sapiens
aaatgagatttcttatt

SEQ ID NO: 4476583 - DNA, 18 bp, Homo sapiens
aaatgagcttgattaaat

SEQ ID NO: 4476584 - DNA, 21 bp, Homo sapiens
aaatgagggaagaacattatt

SEQ ID NO: 4476585 - DNA, 14 bp, Homo sapiens
aaatgagtcatttg

SEQ ID NO: 4476586 - DNA, 16 bp, Homo sapiens
aaatgagtcatttgtt

SEQ ID NO: 4476587 - DNA, 22 bp, Homo sapiens
aaatgagtcatttgtttaaaca

SEQ ID NO: 4476588 - DNA, 13 bp, Homo sapiens
aaatgataaagac

SEQ ID NO: 4476589 - DNA, 16 bp, Homo sapiens
aaatgataaagacttt

SEQ ID NO: 4476590 - DNA, 17 bp, Homo sapiens
aaatgataaagactttt

SEQ ID NO: 4476591 - DNA, 19 bp, Homo sapiens
aaatgataaagacttttat

SEQ ID NO: 4476592 - DNA, 12 bp, Homo sapiens
aaatgatagata

SEQ ID NO: 4476593 - DNA, 13 bp, Homo sapiens
aaatgatctaaac

SEQ ID NO: 4476594 - DNA, 12 bp, Homo sapiens
aaatgatgattg

SEQ ID NO: 4476595 - DNA, 21 bp, Homo sapiens
aaatgatggatcaccattata

SEQ ID NO: 4476596 - DNA, 14 bp, Homo sapiens
aaatgattgtagta

SEQ ID NO: 4476597 - DNA, 21 bp, Homo sapiens
aaatgatttaaatttaagtaa

SEQ ID NO: 4476598 - DNA, 12 bp, Homo sapiens
aaatgcaataac

SEQ ID NO: 4476599 - DNA, 14 bp, Homo sapiens
aaatgcaataactc

SEQ ID NO: 4476600 - DNA, 15 bp, Homo sapiens
aaatgcaataagatt

SEQ ID NO: 4476601 - DNA, 15 bp, Homo sapiens
aaatgcaatatttgt

SEQ ID NO: 4476602 - DNA, 21 bp, Homo sapiens
aaatgcacccatcagcactct

SEQ ID NO: 4476603 - DNA, 19 bp, Homo sapiens
aaatgcactaagacaagaa

SEQ ID NO: 4476604 - DNA, 23 bp, Homo sapiens
aaatgcactaagacaagaacatt

SEQ ID NO: 4476605 - DNA, 14 bp, Homo sapiens
aaatgcagaactta

SEQ ID NO: 4476606 - DNA, 22 bp, Homo sapiens
aaatgcagacaacaccttcctc

SEQ ID NO: 4476607 - DNA, 17 bp, Homo sapiens
aaatgcagtatataggt

SEQ ID NO: 4476608 - DNA, 23 bp, Homo sapiens
aaatgcatccattcctcagggac

SEQ ID NO: 4476609 - DNA, 15 bp, Homo sapiens
aaatgcattgaacat

SEQ ID NO: 4476610 - DNA, 21 bp, Homo sapiens
aaatgcattgaacatcttgca

SEQ ID NO: 4476611 - DNA, 16 bp, Homo sapiens
aaatgcatttttatca

SEQ ID NO: 4476612 - DNA, 18 bp, Homo sapiens
aaatgcatttttatcatg

SEQ ID NO: 4476613 - DNA, 11 bp, Homo sapiens
aaatgccaaaa

SEQ ID NO: 4476614 - DNA, 12 bp, Homo sapiens
aaatgcccagtt

SEQ ID NO: 4476615 - DNA, 13 bp, Homo sapiens
aaatgcctcttaa

SEQ ID NO: 4476616 - DNA, 14 bp, Homo sapiens
aaatgcctcttaaa

SEQ ID NO: 4476617 - DNA, 17 bp, Homo sapiens
aaatgcctcttaaatta

SEQ ID NO: 4476618 - DNA, 15 bp, Homo sapiens
aaatgcctgactcag

SEQ ID NO: 4476619 - DNA, 20 bp, Homo sapiens
aaatgctcctagaagtctta

SEQ ID NO: 4476620 - DNA, 13 bp, Homo sapiens
aaatgctctaatg

SEQ ID NO: 4476621 - DNA, 22 bp, Homo sapiens
aaatgctgggggtaggtggcta

SEQ ID NO: 4476622 - DNA, 18 bp, Homo sapiens
aaatgcttaaatttcaga

SEQ ID NO: 4476623 - DNA, 21 bp, Homo sapiens
aaatgcttttcactttctgtc

SEQ ID NO: 4476624 - DNA, 18 bp, Homo sapiens
aaatgctttttatttctg

SEQ ID NO: 4476625 - DNA, 23 bp, Homo sapiens
aaatggaataacatatcaaatga

SEQ ID NO: 4476626 - DNA, 22 bp, Homo sapiens
aaatggacaaggcctaattttt

SEQ ID NO: 4476627 - DNA, 14 bp, Homo sapiens
aaatggagctcagt

SEQ ID NO: 4476628 - DNA, 23 bp, Homo sapiens
aaatggatgccttgaataataag

SEQ ID NO: 4476629 - DNA, 16 bp, Homo sapiens
aaatggcgaacatgtg

SEQ ID NO: 4476630 - DNA, 15 bp, Homo sapiens
aaatggctatgaaca

SEQ ID NO: 4476631 - DNA, 21 bp, Homo sapiens
aaatggctgtaatcatttgtt

SEQ ID NO: 4476632 - DNA, 16 bp, Homo sapiens
aaatgggtcttttata

SEQ ID NO: 4476633 - DNA, 18 bp, Homo sapiens
aaatggtatgccaactta

SEQ ID NO: 4476634 - DNA, 14 bp, Homo sapiens
aaatggttaagaca

SEQ ID NO: 4476635 - DNA, 21 bp, Homo sapiens
aaatggtttctcattaaactc

SEQ ID NO: 4476636 - DNA, 12 bp, Homo sapiens
aaatggtttttt

SEQ ID NO: 4476637 - DNA, 17 bp, Homo sapiens
aaatgtaaaaatgaagg

SEQ ID NO: 4476638 - DNA, 21 bp, Homo sapiens
aaatgtaaaaatgaaggaatt

SEQ ID NO: 4476639 - DNA, 21 bp, Homo sapiens
aaatgtaactgtccgtagtat

SEQ ID NO: 4476640 - DNA, 16 bp, Homo sapiens
aaatgtaagggaaact

SEQ ID NO: 4476641 - DNA, 22 bp, Homo sapiens
aaatgtaagggaaactgccagc

SEQ ID NO: 4476642 - DNA, 21 bp, Homo sapiens
aaatgtaagttgagaaaaatt

SEQ ID NO: 4476643 - DNA, 16 bp, Homo sapiens
aaatgtaatagtttat

SEQ ID NO: 4476644 - DNA, 12 bp, Homo sapiens
aaatgtacactt

SEQ ID NO: 4476645 - DNA, 18 bp, Homo sapiens
aaatgtacatcagtttgt

SEQ ID NO: 4476646 - DNA, 19 bp, Homo sapiens
aaatgtacccgagcacata

SEQ ID NO: 4476647 - DNA, 15 bp, Homo sapiens
aaatgtagaaataaa

SEQ ID NO: 4476648 - DNA, 20 bp, Homo sapiens
aaatgtagaatattcagaca

SEQ ID NO: 4476649 - DNA, 17 bp, Homo sapiens
aaatgtagcttcagtca

SEQ ID NO: 4476650 - DNA, 20 bp, Homo sapiens
aaatgtagttttgtatacag

SEQ ID NO: 4476651 - DNA, 13 bp, Homo sapiens
aaatgtataaaaa

SEQ ID NO: 4476652 - DNA, 21 bp, Homo sapiens
aaatgtataaaaattatcaaa

SEQ ID NO: 4476653 - DNA, 15 bp, Homo sapiens
aaatgtatctaagaa

SEQ ID NO: 4476654 - DNA, 11 bp, Homo sapiens
aaatgtattat

SEQ ID NO: 4476655 - DNA, 14 bp, Homo sapiens
aaatgtattccttt

SEQ ID NO: 4476656 - DNA, 14 bp, Homo sapiens
aaatgtattgattc

SEQ ID NO: 4476657 - DNA, 10 bp, Homo sapiens
aaatgtattt

SEQ ID NO: 4476658 - DNA, 16 bp, Homo sapiens
aaatgtattttacata

SEQ ID NO: 4476659 - DNA, 15 bp, Homo sapiens
aaatgtatttttcta

SEQ ID NO: 4476660 - DNA, 19 bp, Homo sapiens
aaatgtcagtgtttgggaa

SEQ ID NO: 4476661 - DNA, 21 bp, Homo sapiens
aaatgtcagtgtttgggaaat

SEQ ID NO: 4476662 - DNA, 16 bp, Homo sapiens
aaatgtcctttctcag

SEQ ID NO: 4476663 - DNA, 18 bp, Homo sapiens
aaatgtgaaatgctttta

SEQ ID NO: 4476664 - DNA, 22 bp, Homo sapiens
aaatgtgcaatttgtaaatatt

SEQ ID NO: 4476665 - DNA, 18 bp, Homo sapiens
aaatgtgccttcattttt

SEQ ID NO: 4476666 - DNA, 15 bp, Homo sapiens
aaatgtggattttgt

SEQ ID NO: 4476667 - DNA, 15 bp, Homo sapiens
aaatgtggcaaaaaa

SEQ ID NO: 4476668 - DNA, 11 bp, Homo sapiens
aaatgtgtatt

SEQ ID NO: 4476669 - DNA, 20 bp, Homo sapiens
aaatgtgtatttcttaagaa

SEQ ID NO: 4476670 - DNA, 18 bp, Homo sapiens
aaatgtgtgtattcttaa

SEQ ID NO: 4476671 - DNA, 13 bp, Homo sapiens
aaatgttcatcaa

SEQ ID NO: 4476672 - DNA, 11 bp, Homo sapiens
aaatgttcttt

SEQ ID NO: 4476673 - DNA, 19 bp, Homo sapiens
aaatgttggtcattttatg

SEQ ID NO: 4476674 - DNA, 12 bp, Homo sapiens
aaatgtttaaag

SEQ ID NO: 4476675 - DNA, 13 bp, Homo sapiens
aaatgtttcaaaa

SEQ ID NO: 4476676 - DNA, 17 bp, Homo sapiens
aaatgtttcaaaataga

SEQ ID NO: 4476677 - DNA, 19 bp, Homo sapiens
aaatgtttcaaaatagaca

SEQ ID NO: 4476678 - DNA, 19 bp, Homo sapiens
aaaccaaactaggagatga

SEQ ID NO: 4476679 - DNA, 23 bp, Homo sapiens
aaaccaaactgggtcttcagctt

SEQ ID NO: 4476680 - DNA, 22 bp, Homo sapiens
aaaccaaactggttcacctgaa

SEQ ID NO: 4476681 - DNA, 14 bp, Homo sapiens
aaaccaactctaat

SEQ ID NO: 4476682 - DNA, 17 bp, Homo sapiens
aaaccaactctaatatt

SEQ ID NO: 4476683 - DNA, 21 bp, Homo sapiens
aaaccaactctaatattgctt

SEQ ID NO: 4476684 - DNA, 15 bp, Homo sapiens
aaaccacaaaaaaat

SEQ ID NO: 4476685 - DNA, 15 bp, Homo sapiens
aaaccacagcagttg

SEQ ID NO: 4476686 - DNA, 16 bp, Homo sapiens
aaaccactgaaaaaat

SEQ ID NO: 4476687 - DNA, 17 bp, Homo sapiens
aaaccactgaaaaaata

SEQ ID NO: 4476688 - DNA, 16 bp, Homo sapiens
aaaccagaacccagtg

SEQ ID NO: 4476689 - DNA, 23 bp, Homo sapiens
aaaccaggacactaccctgagat

SEQ ID NO: 4476690 - DNA, 17 bp, Homo sapiens
aaaccagtatttaagct

SEQ ID NO: 4476691 - DNA, 16 bp, Homo sapiens
aaaccagtgtgaaccc

SEQ ID NO: 4476692 - DNA, 19 bp, Homo sapiens
aaaccagtgttagggaagg

SEQ ID NO: 4476693 - DNA, 16 bp, Homo sapiens
aaaccatttttgttac

SEQ ID NO: 4476694 - DNA, 13 bp, Homo sapiens
aaacccaagtccc

SEQ ID NO: 4476695 - DNA, 18 bp, Homo sapiens
aaacccacctgctagtgt

SEQ ID NO: 4476696 - DNA, 13 bp, Homo sapiens
aaacccaggctgt

SEQ ID NO: 4476697 - DNA, 19 bp, Homo sapiens
aaacccaggttcatgaata

SEQ ID NO: 4476698 - DNA, 22 bp, Homo sapiens
aaacccatacaatgtatgtaca

SEQ ID NO: 4476699 - DNA, 23 bp, Homo sapiens
aaacccatacaatgtatgtacaa

SEQ ID NO: 4476700 - DNA, 11 bp, Homo sapiens
aaaccccagcc

SEQ ID NO: 4476701 - DNA, 16 bp, Homo sapiens
aaacccccttttccct

SEQ ID NO: 4476702 - DNA, 18 bp, Homo sapiens
aaacccccttttcccttc

SEQ ID NO: 4476703 - DNA, 21 bp, Homo sapiens
aaacccccttttcccttcagc

SEQ ID NO: 4476704 - DNA, 15 bp, Homo sapiens
aaaccctcagagcct

SEQ ID NO: 4476705 - DNA, 12 bp, Homo sapiens
aaaccctgtctc

SEQ ID NO: 4476706 - DNA, 16 bp, Homo sapiens
aaacccttgctttcct

SEQ ID NO: 4476707 - DNA, 16 bp, Homo sapiens
aaaccgctaaaagaaa

SEQ ID NO: 4476708 - DNA, 23 bp, Homo sapiens
aaaccgctaaaagaaactttctt

SEQ ID NO: 4476709 - DNA, 17 bp, Homo sapiens
aaaccgtaaagtgcctt

SEQ ID NO: 4476710 - DNA, 14 bp, Homo sapiens
aaacctaaaaatca

SEQ ID NO: 4476711 - DNA, 23 bp, Homo sapiens
aaacctaaagaggaaaagtgcaa

SEQ ID NO: 4476712 - DNA, 15 bp, Homo sapiens
aaacctaacaggaga

SEQ ID NO: 4476713 - DNA, 22 bp, Homo sapiens
aaacctgatgctggggacacag

SEQ ID NO: 4476714 - DNA, 15 bp, Homo sapiens
aaacctgcagttttt

SEQ ID NO: 4476715 - DNA, 20 bp, Homo sapiens
aaacctggaacatctcacct

SEQ ID NO: 4476716 - DNA, 22 bp, Homo sapiens
aaacctggagatgcagctactg

SEQ ID NO: 4476717 - DNA, 12 bp, Homo sapiens
aaacctggttca

SEQ ID NO: 4476718 - DNA, 15 bp, Homo sapiens
aaacctgttcttcct

SEQ ID NO: 4476719 - DNA, 13 bp, Homo sapiens
aaaccttaagtgc

SEQ ID NO: 4476720 - DNA, 14 bp, Homo sapiens
aaaccttaatattt

SEQ ID NO: 4476721 - DNA, 21 bp, Homo sapiens
aaaccttaatatttcttcaaa

SEQ ID NO: 4476722 - DNA, 23 bp, Homo sapiens
aaaccttccacccagtgctgaat

SEQ ID NO: 4476723 - DNA, 15 bp, Homo sapiens
aaacctttccatttt

SEQ ID NO: 4476724 - DNA, 19 bp, Homo sapiens
aaacctttggctacacaat

SEQ ID NO: 4476725 - DNA, 15 bp, Homo sapiens
aaaccttttattata

SEQ ID NO: 4476726 - DNA, 22 bp, Homo sapiens
aaacgcagttgtgtggcccagc

SEQ ID NO: 4476727 - DNA, 20 bp, Homo sapiens
aaacggcaacgtagcctggg

SEQ ID NO: 4476728 - DNA, 17 bp, Homo sapiens
aaacgtaatttgttata

SEQ ID NO: 4476729 - DNA, 19 bp, Homo sapiens
aaacgtagcatgtggcatc

SEQ ID NO: 4476730 - DNA, 23 bp, Homo sapiens
aaacgtgttgtatctacagtaat

SEQ ID NO: 4476731 - DNA, 17 bp, Homo sapiens
aaactaaaaaattaaac

SEQ ID NO: 4476732 - DNA, 12 bp, Homo sapiens
aaactaaaaact

SEQ ID NO: 4476733 - DNA, 17 bp, Homo sapiens
aaactaaacagaaaact

SEQ ID NO: 4476734 - DNA, 21 bp, Homo sapiens
aaactaacagctacaaacttt

SEQ ID NO: 4476735 - DNA, 15 bp, Homo sapiens
aaactaaccttgaat

SEQ ID NO: 4476736 - DNA, 15 bp, Homo sapiens
aaactaagattcttt

SEQ ID NO: 4476737 - DNA, 14 bp, Homo sapiens
aaactaagccaggc

SEQ ID NO: 4476738 - DNA, 11 bp, Homo sapiens
aaactaatcca

SEQ ID NO: 4476739 - DNA, 13 bp, Homo sapiens
aaactaatgtgtc

SEQ ID NO: 4476740 - DNA, 15 bp, Homo sapiens
aaactacaaacgttt

SEQ ID NO: 4476741 - DNA, 19 bp, Homo sapiens
aaactacaaacgtttgaca

SEQ ID NO: 4476742 - DNA, 16 bp, Homo sapiens
aaactactgaatgaag

SEQ ID NO: 4476743 - DNA, 21 bp, Homo sapiens
aaactactgaatgaagcagta

SEQ ID NO: 4476744 - DNA, 21 bp, Homo sapiens
aaactactgattgaatgttaa

SEQ ID NO: 4476745 - DNA, 19 bp, Homo sapiens
aaactactgcctttagaaa

SEQ ID NO: 4476746 - DNA, 21 bp, Homo sapiens
aaactactgcctttagaaaat

SEQ ID NO: 4476747 - DNA, 15 bp, Homo sapiens
aaactagctgtcact

SEQ ID NO: 4476748 - DNA, 13 bp, Homo sapiens
aaactagtactat

SEQ ID NO: 4476749 - DNA, 23 bp, Homo sapiens
aaactataacattatataacaaa

SEQ ID NO: 4476750 - DNA, 19 bp, Homo sapiens
aaactatacttgaacaaaa

SEQ ID NO: 4476751 - DNA, 20 bp, Homo sapiens
aaactatacttgaacaaaag

SEQ ID NO: 4476752 - DNA, 22 bp, Homo sapiens
aaactatacttgaacaaaaggg

SEQ ID NO: 4476753 - DNA, 17 bp, Homo sapiens
aaactatgatttatttt

SEQ ID NO: 4476754 - DNA, 22 bp, Homo sapiens
aaactatgtgttcaatgaaata

SEQ ID NO: 4476755 - DNA, 13 bp, Homo sapiens
aaactatgtgttt

SEQ ID NO: 4476756 - DNA, 13 bp, Homo sapiens
aaactattcttaa

SEQ ID NO: 4476757 - DNA, 14 bp, Homo sapiens
aaactattcttaat

SEQ ID NO: 4476758 - DNA, 22 bp, Homo sapiens
aaactcacggaccactcgaggc

SEQ ID NO: 4476759 - DNA, 23 bp, Homo sapiens
aaactcactcactgtttataaat

SEQ ID NO: 4476760 - DNA, 19 bp, Homo sapiens
aaactcattgcagcagata

SEQ ID NO: 4476761 - DNA, 18 bp, Homo sapiens
aaactccacatctgcctt

SEQ ID NO: 4476762 - DNA, 14 bp, Homo sapiens
aaactcctgaaaaa

SEQ ID NO: 4476763 - DNA, 16 bp, Homo sapiens
aaactcgttttttaca

SEQ ID NO: 4476764 - DNA, 15 bp, Homo sapiens
aaactctctagctta

SEQ ID NO: 4476765 - DNA, 17 bp, Homo sapiens
aaactctctagcttaag

SEQ ID NO: 4476766 - DNA, 21 bp, Homo sapiens
aaactctcttctctttctctc

SEQ ID NO: 4476767 - DNA, 23 bp, Homo sapiens
aaactctgcatccagagattcat

SEQ ID NO: 4476768 - DNA, 12 bp, Homo sapiens
aaactgaagatg

SEQ ID NO: 4476769 - DNA, 21 bp, Homo sapiens
aaactgaagatgaaatatata

SEQ ID NO: 4476770 - DNA, 20 bp, Homo sapiens
aaactgagaaatgaatgctg

SEQ ID NO: 4476771 - DNA, 16 bp, Homo sapiens
aaactgatctaaaatg

SEQ ID NO: 4476772 - DNA, 17 bp, Homo sapiens
aaactgatttctcacgg

SEQ ID NO: 4476773 - DNA, 15 bp, Homo sapiens
aaactgcactgtcaa

SEQ ID NO: 4476774 - DNA, 12 bp, Homo sapiens
aaactgcatttg

SEQ ID NO: 4476775 - DNA, 14 bp, Homo sapiens
aaactgccagcaac

SEQ ID NO: 4476776 - DNA, 14 bp, Homo sapiens
aaactgctttattt

SEQ ID NO: 4476777 - DNA, 15 bp, Homo sapiens
aaactgctttatttt

SEQ ID NO: 4476778 - DNA, 9 bp, Homo sapiens
aaactggct

SEQ ID NO: 4476779 - DNA, 12 bp, Homo sapiens
aaactgggaaac

SEQ ID NO: 4476780 - DNA, 16 bp, Homo sapiens
aaactgggataactga

SEQ ID NO: 4476781 - DNA, 19 bp, Homo sapiens
aaactgggataactgattt

SEQ ID NO: 4476782 - DNA, 21 bp, Homo sapiens
aaactgggtcttcagctttat

SEQ ID NO: 4476783 - DNA, 15 bp, Homo sapiens
aaactgtagaaatga

SEQ ID NO: 4476784 - DNA, 16 bp, Homo sapiens
aaactgtagaaatgat

SEQ ID NO: 4476785 - DNA, 19 bp, Homo sapiens
aaactgtatcatctttgcc

SEQ ID NO: 4476786 - DNA, 17 bp, Homo sapiens
aaactgtgaaaatagtg

SEQ ID NO: 4476787 - DNA, 18 bp, Homo sapiens
aaactgtgaaaatagtgt

SEQ ID NO: 4476788 - DNA, 21 bp, Homo sapiens
aaactgtgcaactttttaaag

SEQ ID NO: 4476789 - DNA, 15 bp, Homo sapiens
aaactgtgttgccac

SEQ ID NO: 4476790 - DNA, 22 bp, Homo sapiens
aaactgttaacttattcaaaga

SEQ ID NO: 4476791 - DNA, 13 bp, Homo sapiens
aaacttaaaaaca

SEQ ID NO: 4476792 - DNA, 17 bp, Homo sapiens
aaacttaaatgttatta

SEQ ID NO: 4476793 - DNA, 14 bp, Homo sapiens
aaacttaagggcaa

SEQ ID NO: 4476794 - DNA, 15 bp, Homo sapiens
aaacttaagggcaag

SEQ ID NO: 4476795 - DNA, 20 bp, Homo sapiens
aaacttatgctgatttattt

SEQ ID NO: 4476796 - DNA, 21 bp, Homo sapiens
aaacttcatgtaattttattt

SEQ ID NO: 4476797 - DNA, 18 bp, Homo sapiens
aaacttccaaagaaagtt

SEQ ID NO: 4476798 - DNA, 20 bp, Homo sapiens
aaacttgaaatatataatat

SEQ ID NO: 4476799 - DNA, 23 bp, Homo sapiens
aaaattacctgtgtgagatttta

SEQ ID NO: 4476800 - DNA, 14 bp, Homo sapiens
aaaattactgttta

SEQ ID NO: 4476801 - DNA, 22 bp, Homo sapiens
aaaattagaaaggacaacagtt

SEQ ID NO: 4476802 - DNA, 16 bp, Homo sapiens
aaaattagttgggcat

SEQ ID NO: 4476803 - DNA, 15 bp, Homo sapiens
aaaattatactgtgt

SEQ ID NO: 4476804 - DNA, 13 bp, Homo sapiens
aaaattatggaat

SEQ ID NO: 4476805 - DNA, 20 bp, Homo sapiens
aaaattatggaatatcatct

SEQ ID NO: 4476806 - DNA, 24 bp, Homo sapiens
aaaattatggaatatcatctgtca

SEQ ID NO: 4476807 - DNA, 12 bp, Homo sapiens
aaaattattttg

SEQ ID NO: 4476808 - DNA, 16 bp, Homo sapiens
aaaattattttgacat

SEQ ID NO: 4476809 - DNA, 19 bp, Homo sapiens
aaaattcagcaaagtggtt

SEQ ID NO: 4476810 - DNA, 13 bp, Homo sapiens
aaaattcatttct

SEQ ID NO: 4476811 - DNA, 12 bp, Homo sapiens
aaaattcatttg

SEQ ID NO: 4476812 - DNA, 13 bp, Homo sapiens
aaaattccactca

SEQ ID NO: 4476813 - DNA, 13 bp, Homo sapiens
aaaattctcctga

SEQ ID NO: 4476814 - DNA, 13 bp, Homo sapiens
aaaattgatatta

SEQ ID NO: 4476815 - DNA, 15 bp, Homo sapiens
aaaattgatattata

SEQ ID NO: 4476816 - DNA, 21 bp, Homo sapiens
aaaattgatatttttatacaa

SEQ ID NO: 4476817 - DNA, 21 bp, Homo sapiens
aaaattggtatatttgaaata

SEQ ID NO: 4476818 - DNA, 22 bp, Homo sapiens
aaaattggtatatttgaaataa

SEQ ID NO: 4476819 - DNA, 12 bp, Homo sapiens
aaaattgtataa

SEQ ID NO: 4476820 - DNA, 14 bp, Homo sapiens
aaaattgtgcataa

SEQ ID NO: 4476821 - DNA, 17 bp, Homo sapiens
aaaatttaaaagtaaaa

SEQ ID NO: 4476822 - DNA, 19 bp, Homo sapiens
aaaatttaaaagtaaaatg

SEQ ID NO: 4476823 - DNA, 12 bp, Homo sapiens
aaaatttataag

SEQ ID NO: 4476824 - DNA, 19 bp, Homo sapiens
aaaatttcataattctgaa

SEQ ID NO: 4476825 - DNA, 15 bp, Homo sapiens
aaaatttgtagaatt

SEQ ID NO: 4476826 - DNA, 22 bp, Homo sapiens
aaaatttgtgtaaatttgtatc

SEQ ID NO: 4476827 - DNA, 18 bp, Homo sapiens
aaaatttgttattttgca

SEQ ID NO: 4476828 - DNA, 13 bp, Homo sapiens
aaaatttgttgca

SEQ ID NO: 4476829 - DNA, 14 bp, Homo sapiens
aaaatttgttttca

SEQ ID NO: 4476830 - DNA, 12 bp, Homo sapiens
aaaattttaaca

SEQ ID NO: 4476831 - DNA, 17 bp, Homo sapiens
aaaattttattttaaat

SEQ ID NO: 4476832 - DNA, 13 bp, Homo sapiens
aaaattttgactt

SEQ ID NO: 4476833 - DNA, 20 bp, Homo sapiens
aaaattttgtgacattcctt

SEQ ID NO: 4476834 - DNA, 21 bp, Homo sapiens
aaaattttgtgacattccttc

SEQ ID NO: 4476835 - DNA, 12 bp, Homo sapiens
aaacaaaaaact

SEQ ID NO: 4476836 - DNA, 20 bp, Homo sapiens
aaacaaaactatacttgaac

SEQ ID NO: 4476837 - DNA, 9 bp, Homo sapiens
aaacaaaag

SEQ ID NO: 4476838 - DNA, 14 bp, Homo sapiens
aaacaaaatgtttt

SEQ ID NO: 4476839 - DNA, 15 bp, Homo sapiens
aaacaaaatttctat

SEQ ID NO: 4476840 - DNA, 13 bp, Homo sapiens
aaacaaaatttga

SEQ ID NO: 4476841 - DNA, 12 bp, Homo sapiens
aaacaaataaaa

SEQ ID NO: 4476842 - DNA, 14 bp, Homo sapiens
aaacaaatgttcat

SEQ ID NO: 4476843 - DNA, 16 bp, Homo sapiens
aaacaacaatttctac

SEQ ID NO: 4476844 - DNA, 22 bp, Homo sapiens
aaacaacagctcgatccaaatt

SEQ ID NO: 4476845 - DNA, 17 bp, Homo sapiens
aaacaacatttatatgt

SEQ ID NO: 4476846 - DNA, 18 bp, Homo sapiens
aaacaacatttatatgta

SEQ ID NO: 4476847 - DNA, 14 bp, Homo sapiens
aaacaaggcattca

SEQ ID NO: 4476848 - DNA, 16 bp, Homo sapiens
aaacaaggttttcagt

SEQ ID NO: 4476849 - DNA, 23 bp, Homo sapiens
aaacaagtatttgttaatttaga

SEQ ID NO: 4476850 - DNA, 14 bp, Homo sapiens
aaacaataaagata

SEQ ID NO: 4476851 - DNA, 19 bp, Homo sapiens
aaacaatctatttaaaaaa

SEQ ID NO: 4476852 - DNA, 18 bp, Homo sapiens
aaacaatggggctggttt

SEQ ID NO: 4476853 - DNA, 17 bp, Homo sapiens
aaacaatttattttatt

SEQ ID NO: 4476854 - DNA, 17 bp, Homo sapiens
aaacaattttctgtaat

SEQ ID NO: 4476855 - DNA, 20 bp, Homo sapiens
aaacaattttctgtaatctt

SEQ ID NO: 4476856 - DNA, 14 bp, Homo sapiens
aaacacacctcgtg

SEQ ID NO: 4476857 - DNA, 18 bp, Homo sapiens
aaacacaggctgtcctta

SEQ ID NO: 4476858 - DNA, 11 bp, Homo sapiens
aaacacatgat

SEQ ID NO: 4476859 - DNA, 20 bp, Homo sapiens
aaacacccttcagcaatgat

SEQ ID NO: 4476860 - DNA, 15 bp, Homo sapiens
aaacacctcacacct

SEQ ID NO: 4476861 - DNA, 21 bp, Homo sapiens
aaacacctcacacctcactct

SEQ ID NO: 4476862 - DNA, 19 bp, Homo sapiens
aaacactacacatttgaaa

SEQ ID NO: 4476863 - DNA, 21 bp, Homo sapiens
aaacactacacatttgaaaca

SEQ ID NO: 4476864 - DNA, 22 bp, Homo sapiens
aaacactcaagttgattagaaa

SEQ ID NO: 4476865 - DNA, 15 bp, Homo sapiens
aaacactgcaaattt

SEQ ID NO: 4476866 - DNA, 22 bp, Homo sapiens
aaacactgcaaattttaactgt

SEQ ID NO: 4476867 - DNA, 13 bp, Homo sapiens
aaacactgtgcac

SEQ ID NO: 4476868 - DNA, 18 bp, Homo sapiens
aaacacttcgttcgcaga

SEQ ID NO: 4476869 - DNA, 16 bp, Homo sapiens
aaacagacaaaaacaa

SEQ ID NO: 4476870 - DNA, 18 bp, Homo sapiens
aaacagagtggcctccct

SEQ ID NO: 4476871 - DNA, 21 bp, Homo sapiens
aaacagagtggcctccctgct

SEQ ID NO: 4476872 - DNA, 19 bp, Homo sapiens
aaacagcaccaccatttaa

SEQ ID NO: 4476873 - DNA, 22 bp, Homo sapiens
aaacagcaccaccatttaattt

SEQ ID NO: 4476874 - DNA, 14 bp, Homo sapiens
aaacagctattata

SEQ ID NO: 4476875 - DNA, 12 bp, Homo sapiens
aaacagctgcct

SEQ ID NO: 4476876 - DNA, 14 bp, Homo sapiens
aaacagctgcctta

SEQ ID NO: 4476877 - DNA, 18 bp, Homo sapiens
aaacagctgccttagctt

SEQ ID NO: 4476878 - DNA, 22 bp, Homo sapiens
aaacagctgccttagcttcagg

SEQ ID NO: 4476879 - DNA, 15 bp, Homo sapiens
aaacaggaaaaaaac

SEQ ID NO: 4476880 - DNA, 13 bp, Homo sapiens
aaacaggcaaagt

SEQ ID NO: 4476881 - DNA, 21 bp, Homo sapiens
aaacaggcaaagttttacaga

SEQ ID NO: 4476882 - DNA, 17 bp, Homo sapiens
aaacagggacaaagaaa

SEQ ID NO: 4476883 - DNA, 22 bp, Homo sapiens
aaacagggctgccttctggcct

SEQ ID NO: 4476884 - DNA, 17 bp, Homo sapiens
aaacagggtccaggaat

SEQ ID NO: 4476885 - DNA, 19 bp, Homo sapiens
aaacagggtccaggaatgg

SEQ ID NO: 4476886 - DNA, 13 bp, Homo sapiens
aaacagtacagaa

SEQ ID NO: 4476887 - DNA, 18 bp, Homo sapiens
aaacagttgcatgtagta

SEQ ID NO: 4476888 - DNA, 24 bp, Homo sapiens
aaacagttgcatgtagtaacacta

SEQ ID NO: 4476889 - DNA, 14 bp, Homo sapiens
aaacagttggcact

SEQ ID NO: 4476890 - DNA, 18 bp, Homo sapiens
aaacagttggtaactttt

SEQ ID NO: 4476891 - DNA, 21 bp, Homo sapiens
aaacagtttcatctaaatgaa

SEQ ID NO: 4476892 - DNA, 13 bp, Homo sapiens
aaacataaaaact

SEQ ID NO: 4476893 - DNA, 16 bp, Homo sapiens
aaacatacataataca

SEQ ID NO: 4476894 - DNA, 21 bp, Homo sapiens
aaacatcactatcaattttaa

SEQ ID NO: 4476895 - DNA, 16 bp, Homo sapiens
aaacatcataaatctt

SEQ ID NO: 4476896 - DNA, 15 bp, Homo sapiens
aaacatctcatcatg

SEQ ID NO: 4476897 - DNA, 23 bp, Homo sapiens
aaacatctcatcatgtctattgt

SEQ ID NO: 4476898 - DNA, 18 bp, Homo sapiens
aaacatgcttataacatt

SEQ ID NO: 4476899 - DNA, 19 bp, Homo sapiens
aaacatgcttataacatta

SEQ ID NO: 4476900 - DNA, 20 bp, Homo sapiens
aaacatgcttataacattaa

SEQ ID NO: 4476901 - DNA, 16 bp, Homo sapiens
aaacatggagaaatct

SEQ ID NO: 4476902 - DNA, 20 bp, Homo sapiens
aaacatgtactacagctata

SEQ ID NO: 4476903 - DNA, 12 bp, Homo sapiens
aaacatgtatgt

SEQ ID NO: 4476904 - DNA, 20 bp, Homo sapiens
aaacatgtttatttttcttg

SEQ ID NO: 4476905 - DNA, 21 bp, Homo sapiens
aaacattaattgctaacaatt

SEQ ID NO: 4476906 - DNA, 22 bp, Homo sapiens
aaacattaattgctaacaattg

SEQ ID NO: 4476907 - DNA, 13 bp, Homo sapiens
aaacattcccctc

SEQ ID NO: 4476908 - DNA, 17 bp, Homo sapiens
aaacattcgtgagctgg

SEQ ID NO: 4476909 - DNA, 17 bp, Homo sapiens
aaacattgcctttgaat

SEQ ID NO: 4476910 - DNA, 17 bp, Homo sapiens
aaacatttattttgaca

SEQ ID NO: 4476911 - DNA, 14 bp, Homo sapiens
aaacatttcataat

SEQ ID NO: 4476912 - DNA, 22 bp, Homo sapiens
aaacatttcataatttgtttcc

SEQ ID NO: 4476913 - DNA, 18 bp, Homo sapiens
aaacatttctaagactac

SEQ ID NO: 4476914 - DNA, 16 bp, Homo sapiens
aaacatttgattaata

SEQ ID NO: 4476915 - DNA, 22 bp, Homo sapiens
aaacatttgattaataaaatat

SEQ ID NO: 4476916 - DNA, 13 bp, Homo sapiens
aaacattttgact

SEQ ID NO: 4476917 - DNA, 17 bp, Homo sapiens
aaacattttttcttctg

SEQ ID NO: 4476918 - DNA, 13 bp, Homo sapiens
aaaccaaaaacat

SEQ ID NO: 4476919 - DNA, 17 bp, Homo sapiens
aaaccaaaatgacatct

SEQ ID NO: 4476920 - DNA, 18 bp, Homo sapiens
aaaagtgggcttgattct

SEQ ID NO: 4476921 - DNA, 13 bp, Homo sapiens
aaaagtgtacaga

SEQ ID NO: 4476922 - DNA, 15 bp, Homo sapiens
aaaagttctttcaac

SEQ ID NO: 4476923 - DNA, 20 bp, Homo sapiens
aaaagttgaaccattatact

SEQ ID NO: 4476924 - DNA, 22 bp, Homo sapiens
aaaagttgcaaagtggaattaa

SEQ ID NO: 4476925 - DNA, 17 bp, Homo sapiens
aaaagtttattgtttga

SEQ ID NO: 4476926 - DNA, 17 bp, Homo sapiens
aaaagtttgccagaagt

SEQ ID NO: 4476927 - DNA, 13 bp, Homo sapiens
aaaataaaacaca

SEQ ID NO: 4476928 - DNA, 22 bp, Homo sapiens
aaaataaagacaaccatattta

SEQ ID NO: 4476929 - DNA, 18 bp, Homo sapiens
aaaataaagatcacacat

SEQ ID NO: 4476930 - DNA, 15 bp, Homo sapiens
aaaataaatagaaaa

SEQ ID NO: 4476931 - DNA, 17 bp, Homo sapiens
aaaataaatatatctac

SEQ ID NO: 4476932 - DNA, 13 bp, Homo sapiens
aaaataaatgaaa

SEQ ID NO: 4476933 - DNA, 12 bp, Homo sapiens
aaaataaattta

SEQ ID NO: 4476934 - DNA, 20 bp, Homo sapiens
aaaataaccctttggttttt

SEQ ID NO: 4476935 - DNA, 17 bp, Homo sapiens
aaaataacctaattaat

SEQ ID NO: 4476936 - DNA, 17 bp, Homo sapiens
aaaataactaaaatgta

SEQ ID NO: 4476937 - DNA, 15 bp, Homo sapiens
aaaataactgaattt

SEQ ID NO: 4476938 - DNA, 18 bp, Homo sapiens
aaaataacttagactcta

SEQ ID NO: 4476939 - DNA, 14 bp, Homo sapiens
aaaataacttcatt

SEQ ID NO: 4476940 - DNA, 22 bp, Homo sapiens
aaaataacttcattgtttggac

SEQ ID NO: 4476941 - DNA, 16 bp, Homo sapiens
aaaataagaatagaaa

SEQ ID NO: 4476942 - DNA, 12 bp, Homo sapiens
aaaataagacaa

SEQ ID NO: 4476943 - DNA, 16 bp, Homo sapiens
aaaataatagttttag

SEQ ID NO: 4476944 - DNA, 23 bp, Homo sapiens
aaaataatcaaaagctatttaaa

SEQ ID NO: 4476945 - DNA, 18 bp, Homo sapiens
aaaataatgtactgaatt

SEQ ID NO: 4476946 - DNA, 16 bp, Homo sapiens
aaaataattcatatct

SEQ ID NO: 4476947 - DNA, 14 bp, Homo sapiens
aaaatacacactca

SEQ ID NO: 4476948 - DNA, 19 bp, Homo sapiens
aaaatacacgtttatctta

SEQ ID NO: 4476949 - DNA, 21 bp, Homo sapiens
aaaataccagagccttcaagt

SEQ ID NO: 4476950 - DNA, 15 bp, Homo sapiens
aaaataccagtgttg

SEQ ID NO: 4476951 - DNA, 16 bp, Homo sapiens
aaaatacctcaggaaa

SEQ ID NO: 4476952 - DNA, 24 bp, Homo sapiens
aaaataccttctatgtattagtgt

SEQ ID NO: 4476953 - DNA, 15 bp, Homo sapiens
aaaatactttgagtt

SEQ ID NO: 4476954 - DNA, 16 bp, Homo sapiens
aaaatagaaaagttat

SEQ ID NO: 4476955 - DNA, 13 bp, Homo sapiens
aaaatagaaatta

SEQ ID NO: 4476956 - DNA, 20 bp, Homo sapiens
aaaatagaaattttgtaaga

SEQ ID NO: 4476957 - DNA, 17 bp, Homo sapiens
aaaatagcaaaagaaga

SEQ ID NO: 4476958 - DNA, 20 bp, Homo sapiens
aaaatagctaaatacctcaa

SEQ ID NO: 4476959 - DNA, 20 bp, Homo sapiens
aaaatataaattgtacattt

SEQ ID NO: 4476960 - DNA, 21 bp, Homo sapiens
aaaatataaattgtacatttt

SEQ ID NO: 4476961 - DNA, 16 bp, Homo sapiens
aaaatataagtaaagt

SEQ ID NO: 4476962 - DNA, 22 bp, Homo sapiens
aaaatatacttgactctaatat

SEQ ID NO: 4476963 - DNA, 18 bp, Homo sapiens
aaaatatagcctttaaat

SEQ ID NO: 4476964 - DNA, 17 bp, Homo sapiens
aaaatatatctggaact

SEQ ID NO: 4476965 - DNA, 14 bp, Homo sapiens
aaaatatatgtatt

SEQ ID NO: 4476966 - DNA, 13 bp, Homo sapiens
aaaatatctattt

SEQ ID NO: 4476967 - DNA, 12 bp, Homo sapiens
aaaatatcttgg

SEQ ID NO: 4476968 - DNA, 16 bp, Homo sapiens
aaaatatgtactgtat

SEQ ID NO: 4476969 - DNA, 23 bp, Homo sapiens
aaaatattactctagtttattct

SEQ ID NO: 4476970 - DNA, 11 bp, Homo sapiens
aaaatattgtt

SEQ ID NO: 4476971 - DNA, 14 bp, Homo sapiens
aaaatattgtttct

SEQ ID NO: 4476972 - DNA, 12 bp, Homo sapiens
aaaatatttaaa

SEQ ID NO: 4476973 - DNA, 16 bp, Homo sapiens
aaaatatttaaaaatg

SEQ ID NO: 4476974 - DNA, 19 bp, Homo sapiens
aaaatatttaaaaatgtct

SEQ ID NO: 4476975 - DNA, 17 bp, Homo sapiens
aaaatatttaatatcaa

SEQ ID NO: 4476976 - DNA, 13 bp, Homo sapiens
aaaatattttgaa

SEQ ID NO: 4476977 - DNA, 16 bp, Homo sapiens
aaaatcaagagtgaga

SEQ ID NO: 4476978 - DNA, 17 bp, Homo sapiens
aaaatcaagtggtattt

SEQ ID NO: 4476979 - DNA, 21 bp, Homo sapiens
aaaatcaagttatttcctttt

SEQ ID NO: 4476980 - DNA, 11 bp, Homo sapiens
aaaatcactaa

SEQ ID NO: 4476981 - DNA, 20 bp, Homo sapiens
aaaatcactttcataatctt

SEQ ID NO: 4476982 - DNA, 19 bp, Homo sapiens
aaaatcaggtattaatctt

SEQ ID NO: 4476983 - DNA, 21 bp, Homo sapiens
aaaatcaggtggcttttgcgg

SEQ ID NO: 4476984 - DNA, 14 bp, Homo sapiens
aaaatcatctattt

SEQ ID NO: 4476985 - DNA, 15 bp, Homo sapiens
aaaatcatctatttt

SEQ ID NO: 4476986 - DNA, 10 bp, Homo sapiens
aaaatcattt

SEQ ID NO: 4476987 - DNA, 16 bp, Homo sapiens
aaaatccagactttct

SEQ ID NO: 4476988 - DNA, 19 bp, Homo sapiens
aaaatccattccaggtagc

SEQ ID NO: 4476989 - DNA, 16 bp, Homo sapiens
aaaatccatttaatca

SEQ ID NO: 4476990 - DNA, 19 bp, Homo sapiens
aaaatcctgcccaaaatgt

SEQ ID NO: 4476991 - DNA, 22 bp, Homo sapiens
aaaatcctgcccaaaatgtgaa

SEQ ID NO: 4476992 - DNA, 21 bp, Homo sapiens
aaaatccttgtgacttacaat

SEQ ID NO: 4476993 - DNA, 15 bp, Homo sapiens
aaaatctcaattgaa

SEQ ID NO: 4476994 - DNA, 14 bp, Homo sapiens
aaaatctcattatt

SEQ ID NO: 4476995 - DNA, 13 bp, Homo sapiens
aaaatctccatta

SEQ ID NO: 4476996 - DNA, 14 bp, Homo sapiens
aaaatctcctaaat

SEQ ID NO: 4476997 - DNA, 13 bp, Homo sapiens
aaaatctgaagag

SEQ ID NO: 4476998 - DNA, 17 bp, Homo sapiens
aaaatctgctgttaact

SEQ ID NO: 4476999 - DNA, 20 bp, Homo sapiens
aaaatctgtcacgtagaact

SEQ ID NO: 4477000 - DNA, 16 bp, Homo sapiens
aaaatgaaaattgtat

SEQ ID NO: 4477001 - DNA, 21 bp, Homo sapiens
aaaatgaaacaacaaaacaat

SEQ ID NO: 4477002 - DNA, 14 bp, Homo sapiens
aaaatgaaagctac

SEQ ID NO: 4477003 - DNA, 16 bp, Homo sapiens
aaaatgaaatgctaca

SEQ ID NO: 4477004 - DNA, 17 bp, Homo sapiens
aaaatgaagctgacaat

SEQ ID NO: 4477005 - DNA, 13 bp, Homo sapiens
aaaatgaagggat

SEQ ID NO: 4477006 - DNA, 23 bp, Homo sapiens
aaaatgaatgaggtctgggctag

SEQ ID NO: 4477007 - DNA, 16 bp, Homo sapiens
aaaatgaatttttatt

SEQ ID NO: 4477008 - DNA, 15 bp, Homo sapiens
aaaatgacatctttt

SEQ ID NO: 4477009 - DNA, 13 bp, Homo sapiens
aaaatgagatttc

SEQ ID NO: 4477010 - DNA, 17 bp, Homo sapiens
aaaatgagatttcttat

SEQ ID NO: 4477011 - DNA, 13 bp, Homo sapiens
aaaatgagccctg

SEQ ID NO: 4477012 - DNA, 14 bp, Homo sapiens
aaaatgagtttgta

SEQ ID NO: 4477013 - DNA, 23 bp, Homo sapiens
aaaatgagtttttatggggctga

SEQ ID NO: 4477014 - DNA, 11 bp, Homo sapiens
aaaatgcaata

SEQ ID NO: 4477015 - DNA, 17 bp, Homo sapiens
aaaatgccatcaaatga

SEQ ID NO: 4477016 - DNA, 19 bp, Homo sapiens
aaaatgctcctagaagtct

SEQ ID NO: 4477017 - DNA, 21 bp, Homo sapiens
aaaatgctcctagaagtctta

SEQ ID NO: 4477018 - DNA, 14 bp, Homo sapiens
aaaatgctctaatg

SEQ ID NO: 4477019 - DNA, 12 bp, Homo sapiens
aaaatgctgctc

SEQ ID NO: 4477020 - DNA, 18 bp, Homo sapiens
aaaatgctttttatttct

SEQ ID NO: 4477021 - DNA, 22 bp, Homo sapiens
aaaatgctttttatttctgcat

SEQ ID NO: 4477022 - DNA, 18 bp, Homo sapiens
aaaatggaaaagagagat

SEQ ID NO: 4477023 - DNA, 22 bp, Homo sapiens
aaaatggaggccattgtgtgag

SEQ ID NO: 4477024 - DNA, 13 bp, Homo sapiens
aaaatggtatcaa

SEQ ID NO: 4477025 - DNA, 15 bp, Homo sapiens
aaaatgtaaactgct

SEQ ID NO: 4477026 - DNA, 18 bp, Homo sapiens
aaaatgtacttaaatgag

SEQ ID NO: 4477027 - DNA, 14 bp, Homo sapiens
aaaatgtatatgca

SEQ ID NO: 4477028 - DNA, 13 bp, Homo sapiens
aaaatgtgaaatg

SEQ ID NO: 4477029 - DNA, 21 bp, Homo sapiens
aaaatgtgaaatgcttttata

SEQ ID NO: 4477030 - DNA, 16 bp, Homo sapiens
aaaatgtgatttttct

SEQ ID NO: 4477031 - DNA, 19 bp, Homo sapiens
aaaatgtgctatactgcat

SEQ ID NO: 4477032 - DNA, 16 bp, Homo sapiens
aaaatgtgtgtattct

SEQ ID NO: 4477033 - DNA, 18 bp, Homo sapiens
aaaatgttcccttgacca

SEQ ID NO: 4477034 - DNA, 15 bp, Homo sapiens
aaaatgtttgagcac

SEQ ID NO: 4477035 - DNA, 14 bp, Homo sapiens
aaaatgttttccaa

SEQ ID NO: 4477036 - DNA, 19 bp, Homo sapiens
aaaatgttttccaatattt

SEQ ID NO: 4477037 - DNA, 16 bp, Homo sapiens
aaaatgttttttgata

SEQ ID NO: 4477038 - DNA, 15 bp, Homo sapiens
aaaattaaatctaga

SEQ ID NO: 4477039 - DNA, 19 bp, Homo sapiens
aaaattaatgtaataaagt

SEQ ID NO: 4477040 - DNA, 22 bp, Homo sapiens
aaaattaatgtaataaagtgaa

SEQ ID NO: 4477041 - DNA, 21 bp, Homo sapiens
aaaattacatgttttttcatt

SEQ ID NO: 4477042 - DNA, 18 bp, Homo sapiens
aaaacagggtccaggaat

SEQ ID NO: 4477043 - DNA, 21 bp, Homo sapiens
aaaacaggtcttcatcgaatc

SEQ ID NO: 4477044 - DNA, 20 bp, Homo sapiens
aaaacataatcttctgcctt

SEQ ID NO: 4477045 - DNA, 24 bp, Homo sapiens
aaaacataatcttctgccttctca

SEQ ID NO: 4477046 - DNA, 23 bp, Homo sapiens
aaaacatacgaaaaagtgattgt

SEQ ID NO: 4477047 - DNA, 15 bp, Homo sapiens
aaaacatacttcaaa

SEQ ID NO: 4477048 - DNA, 16 bp, Homo sapiens
aaaacatacttcaaaa

SEQ ID NO: 4477049 - DNA, 23 bp, Homo sapiens
aaaacatagaaatggaaattttg

SEQ ID NO: 4477050 - DNA, 12 bp, Homo sapiens
aaaacatagctt

SEQ ID NO: 4477051 - DNA, 15 bp, Homo sapiens
aaaacatgtactaca

SEQ ID NO: 4477052 - DNA, 16 bp, Homo sapiens
aaaacattctatctac

SEQ ID NO: 4477053 - DNA, 22 bp, Homo sapiens
aaaacatttattttgacataaa

SEQ ID NO: 4477054 - DNA, 14 bp, Homo sapiens
aaaaccaaaatgac

SEQ ID NO: 4477055 - DNA, 14 bp, Homo sapiens
aaaaccaaactggg

SEQ ID NO: 4477056 - DNA, 17 bp, Homo sapiens
aaaaccaaactgggtct

SEQ ID NO: 4477057 - DNA, 22 bp, Homo sapiens
aaaaccaaactgggtcttcagc

SEQ ID NO: 4477058 - DNA, 13 bp, Homo sapiens
aaaaccaaagagg

SEQ ID NO: 4477059 - DNA, 13 bp, Homo sapiens
aaaacccagagag

SEQ ID NO: 4477060 - DNA, 15 bp, Homo sapiens
aaaacccagagagga

SEQ ID NO: 4477061 - DNA, 21 bp, Homo sapiens
aaaaccctcagcactgttaca

SEQ ID NO: 4477062 - DNA, 13 bp, Homo sapiens
aaaacctaaaggt

SEQ ID NO: 4477063 - DNA, 19 bp, Homo sapiens
aaaaccttagtcatcagat

SEQ ID NO: 4477064 - DNA, 16 bp, Homo sapiens
aaaacgagtctttcat

SEQ ID NO: 4477065 - DNA, 19 bp, Homo sapiens
aaaacgatgaagttatgct

SEQ ID NO: 4477066 - DNA, 20 bp, Homo sapiens
aaaactaaggatttttcaag

SEQ ID NO: 4477067 - DNA, 23 bp, Homo sapiens
aaaactaaggcttttatttctgt

SEQ ID NO: 4477068 - DNA, 13 bp, Homo sapiens
aaaactagcaact

SEQ ID NO: 4477069 - DNA, 21 bp, Homo sapiens
aaaactatacttgaacaaaag

SEQ ID NO: 4477070 - DNA, 13 bp, Homo sapiens
aaaactatgtgtt

SEQ ID NO: 4477071 - DNA, 14 bp, Homo sapiens
aaaactcactgtga

SEQ ID NO: 4477072 - DNA, 15 bp, Homo sapiens
aaaactcactgtgat

SEQ ID NO: 4477073 - DNA, 19 bp, Homo sapiens
aaaactcagcctgggacag

SEQ ID NO: 4477074 - DNA, 12 bp, Homo sapiens
aaaactcatgat

SEQ ID NO: 4477075 - DNA, 15 bp, Homo sapiens
aaaactcatgatcaa

SEQ ID NO: 4477076 - DNA, 17 bp, Homo sapiens
aaaactcccaatacaaa

SEQ ID NO: 4477077 - DNA, 22 bp, Homo sapiens
aaaactcccaatacaaagatga

SEQ ID NO: 4477078 - DNA, 14 bp, Homo sapiens
aaaactctctccca

SEQ ID NO: 4477079 - DNA, 15 bp, Homo sapiens
aaaactgacagagga

SEQ ID NO: 4477080 - DNA, 22 bp, Homo sapiens
aaaactgaccatcagtatattt

SEQ ID NO: 4477081 - DNA, 22 bp, Homo sapiens
aaaactgggattaagaaacctt

SEQ ID NO: 4477082 - DNA, 11 bp, Homo sapiens
aaaactgtaaa

SEQ ID NO: 4477083 - DNA, 19 bp, Homo sapiens
aaaactgtgcaacttttta

SEQ ID NO: 4477084 - DNA, 15 bp, Homo sapiens
aaaacttcagacata

SEQ ID NO: 4477085 - DNA, 19 bp, Homo sapiens
aaaacttggttttatggtt

SEQ ID NO: 4477086 - DNA, 15 bp, Homo sapiens
aaaactttaaacctg

SEQ ID NO: 4477087 - DNA, 12 bp, Homo sapiens
aaaactttattt

SEQ ID NO: 4477088 - DNA, 13 bp, Homo sapiens
aaaactttatttt

SEQ ID NO: 4477089 - DNA, 15 bp, Homo sapiens
aaaactttattttat

SEQ ID NO: 4477090 - DNA, 16 bp, Homo sapiens
aaaactttattttata

SEQ ID NO: 4477091 - DNA, 20 bp, Homo sapiens
aaaactttattttatataat

SEQ ID NO: 4477092 - DNA, 13 bp, Homo sapiens
aaaacttttataa

SEQ ID NO: 4477093 - DNA, 21 bp, Homo sapiens
aaaacttttataaattaaata

SEQ ID NO: 4477094 - DNA, 14 bp, Homo sapiens
aaaagaaaattgat

SEQ ID NO: 4477095 - DNA, 15 bp, Homo sapiens
aaaagaaaatttttg

SEQ ID NO: 4477096 - DNA, 17 bp, Homo sapiens
aaaagaaagaaaatcag

SEQ ID NO: 4477097 - DNA, 16 bp, Homo sapiens
aaaagaacatgcagtt

SEQ ID NO: 4477098 - DNA, 18 bp, Homo sapiens
aaaagaacatgcagtttg

SEQ ID NO: 4477099 - DNA, 14 bp, Homo sapiens
aaaagaagtagtgt

SEQ ID NO: 4477100 - DNA, 23 bp, Homo sapiens
aaaagaagtgaagtcttgggtat

SEQ ID NO: 4477101 - DNA, 13 bp, Homo sapiens
aaaagaatatttt

SEQ ID NO: 4477102 - DNA, 11 bp, Homo sapiens
aaaagaatgac

SEQ ID NO: 4477103 - DNA, 24 bp, Homo sapiens
aaaagaattttagtgttaatgact

SEQ ID NO: 4477104 - DNA, 13 bp, Homo sapiens
aaaagactccaaa

SEQ ID NO: 4477105 - DNA, 16 bp, Homo sapiens
aaaagagcatggatgc

SEQ ID NO: 4477106 - DNA, 15 bp, Homo sapiens
aaaagataatatttt

SEQ ID NO: 4477107 - DNA, 19 bp, Homo sapiens
aaaagataatattttacat

SEQ ID NO: 4477108 - DNA, 22 bp, Homo sapiens
aaaagataatattttacataca

SEQ ID NO: 4477109 - DNA, 18 bp, Homo sapiens
aaaagatgaaagagcagt

SEQ ID NO: 4477110 - DNA, 19 bp, Homo sapiens
aaaagatggcttatgtcat

SEQ ID NO: 4477111 - DNA, 22 bp, Homo sapiens
aaaagatggtaaaccagatctg

SEQ ID NO: 4477112 - DNA, 16 bp, Homo sapiens
aaaagattctgtgtca

SEQ ID NO: 4477113 - DNA, 14 bp, Homo sapiens
aaaagattgctgaa

SEQ ID NO: 4477114 - DNA, 16 bp, Homo sapiens
aaaagattgctgaaat

SEQ ID NO: 4477115 - DNA, 13 bp, Homo sapiens
aaaagcaaaataa

SEQ ID NO: 4477116 - DNA, 15 bp, Homo sapiens
aaaagcaatattgta

SEQ ID NO: 4477117 - DNA, 22 bp, Homo sapiens
aaaagcacaaagttctcagagc

SEQ ID NO: 4477118 - DNA, 17 bp, Homo sapiens
aaaagcacaagtacttt

SEQ ID NO: 4477119 - DNA, 13 bp, Homo sapiens
aaaagcagacatt

SEQ ID NO: 4477120 - DNA, 14 bp, Homo sapiens
aaaagcagacattt

SEQ ID NO: 4477121 - DNA, 15 bp, Homo sapiens
aaaagcatttttatt

SEQ ID NO: 4477122 - DNA, 20 bp, Homo sapiens
aaaagcatttttattatatt

SEQ ID NO: 4477123 - DNA, 14 bp, Homo sapiens
aaaagccttccagt

SEQ ID NO: 4477124 - DNA, 20 bp, Homo sapiens
aaaagcgacccattcagaga

SEQ ID NO: 4477125 - DNA, 17 bp, Homo sapiens
aaaagctataaagcagt

SEQ ID NO: 4477126 - DNA, 21 bp, Homo sapiens
aaaagctataaagcagtattt

SEQ ID NO: 4477127 - DNA, 13 bp, Homo sapiens
aaaagctctttta

SEQ ID NO: 4477128 - DNA, 17 bp, Homo sapiens
aaaagctggattttctt

SEQ ID NO: 4477129 - DNA, 13 bp, Homo sapiens
aaaagctttcatg

SEQ ID NO: 4477130 - DNA, 11 bp, Homo sapiens
aaaaggaaaaa

SEQ ID NO: 4477131 - DNA, 11 bp, Homo sapiens
aaaaggaaagc

SEQ ID NO: 4477132 - DNA, 22 bp, Homo sapiens
aaaaggaaagtttgccaggagg

SEQ ID NO: 4477133 - DNA, 23 bp, Homo sapiens
aaaaggaaagtttgccaggagga

SEQ ID NO: 4477134 - DNA, 17 bp, Homo sapiens
aaaaggaatgatatatt

SEQ ID NO: 4477135 - DNA, 14 bp, Homo sapiens
aaaaggacaaataa

SEQ ID NO: 4477136 - DNA, 21 bp, Homo sapiens
aaaaggacaaataaaacatgg

SEQ ID NO: 4477137 - DNA, 15 bp, Homo sapiens
aaaaggatacataat

SEQ ID NO: 4477138 - DNA, 15 bp, Homo sapiens
aaaaggatagtattt

SEQ ID NO: 4477139 - DNA, 23 bp, Homo sapiens
aaaaggcaaatattgaagttgtt

SEQ ID NO: 4477140 - DNA, 18 bp, Homo sapiens
aaaaggccaatataccta

SEQ ID NO: 4477141 - DNA, 14 bp, Homo sapiens
aaaaggcccatgta

SEQ ID NO: 4477142 - DNA, 22 bp, Homo sapiens
aaaaggcctcttgtaaagactg

SEQ ID NO: 4477143 - DNA, 23 bp, Homo sapiens
aaaaggcctcttgtaaagactgg

SEQ ID NO: 4477144 - DNA, 18 bp, Homo sapiens
aaaaggctaagaatagtg

SEQ ID NO: 4477145 - DNA, 14 bp, Homo sapiens
aaaaggctgagaag

SEQ ID NO: 4477146 - DNA, 18 bp, Homo sapiens
aaaagggaactgaacatt

SEQ ID NO: 4477147 - DNA, 20 bp, Homo sapiens
aaaagggtgtatagtgttca

SEQ ID NO: 4477148 - DNA, 19 bp, Homo sapiens
aaaaggtttatgaaaaaga

SEQ ID NO: 4477149 - DNA, 20 bp, Homo sapiens
aaaaggtttcccaaaacaat

SEQ ID NO: 4477150 - DNA, 14 bp, Homo sapiens
aaaagtaatcatgt

SEQ ID NO: 4477151 - DNA, 23 bp, Homo sapiens
aaaagtacattgcttaaaatata

SEQ ID NO: 4477152 - DNA, 22 bp, Homo sapiens
aaaagtacctctgcattgagca

SEQ ID NO: 4477153 - DNA, 22 bp, Homo sapiens
aaaagtagcaaatgtttactgt

SEQ ID NO: 4477154 - DNA, 19 bp, Homo sapiens
aaaagtagtttgaatgttt

SEQ ID NO: 4477155 - DNA, 19 bp, Homo sapiens
aaaagtattttttcaagtt

SEQ ID NO: 4477156 - DNA, 13 bp, Homo sapiens
aaaagtccctccc

SEQ ID NO: 4477157 - DNA, 21 bp, Homo sapiens
aaaagtctacctgtgtttttt

SEQ ID NO: 4477158 - DNA, 20 bp, Homo sapiens
aaaagtctctatttaaattc

SEQ ID NO: 4477159 - DNA, 20 bp, Homo sapiens
aaaagtgaaacgtaattgta

SEQ ID NO: 4477160 - DNA, 15 bp, Homo sapiens
aaaagtgattgtgaa

SEQ ID NO: 4477161 - DNA, 13 bp, Homo sapiens
aaaagtgcaatgc

SEQ ID NO: 4477162 - DNA, 18 bp, Homo sapiens
aaaagtgcttcattcttt

SEQ ID NO: 4477163 - DNA, 19 bp, Homo sapiens
aaataggagggaaaccttt

SEQ ID NO: 4477164 - DNA, 14 bp, Homo sapiens
aaataggattttta

SEQ ID NO: 4477165 - DNA, 16 bp, Homo sapiens
aaataggatttttaga

SEQ ID NO: 4477166 - DNA, 23 bp, Homo sapiens
aaatagtcaaaaattaaatatat

SEQ ID NO: 4477167 - DNA, 23 bp, Homo sapiens
aaatagtcctgaagttcttggat

SEQ ID NO: 4477168 - DNA, 15 bp, Homo sapiens
aaatagtgtgaaata

SEQ ID NO: 4477169 - DNA, 17 bp, Homo sapiens
aaatagttaagacatga

SEQ ID NO: 4477170 - DNA, 22 bp, Homo sapiens
aaatagttaagacatgatttcc

SEQ ID NO: 4477171 - DNA, 20 bp, Homo sapiens
aaatagttgcatagcagtat

SEQ ID NO: 4477172 - DNA, 23 bp, Homo sapiens
aaatagttgcatagcagtatatg

SEQ ID NO: 4477173 - DNA, 20 bp, Homo sapiens
aaatagtttggatatgtaaa

SEQ ID NO: 4477174 - DNA, 16 bp, Homo sapiens
aaatatacagtttgac

SEQ ID NO: 4477175 - DNA, 16 bp, Homo sapiens
aaatatataatatact

SEQ ID NO: 4477176 - DNA, 24 bp, Homo sapiens
aaatatatagcttgaaagcagtta

SEQ ID NO: 4477177 - DNA, 22 bp, Homo sapiens
aaatatatatctatctatttga

SEQ ID NO: 4477178 - DNA, 12 bp, Homo sapiens
aaatatatatta

SEQ ID NO: 4477179 - DNA, 14 bp, Homo sapiens
aaatatatattata

SEQ ID NO: 4477180 - DNA, 15 bp, Homo sapiens
aaatatatcctgtgt

SEQ ID NO: 4477181 - DNA, 21 bp, Homo sapiens
aaatatatgaagacaataatt

SEQ ID NO: 4477182 - DNA, 22 bp, Homo sapiens
aaatatatgtatttttatataa

SEQ ID NO: 4477183 - DNA, 19 bp, Homo sapiens
aaatatattcaaattatgt

SEQ ID NO: 4477184 - DNA, 14 bp, Homo sapiens
aaatatattttctt

SEQ ID NO: 4477185 - DNA, 16 bp, Homo sapiens
aaatatcagcttttct

SEQ ID NO: 4477186 - DNA, 21 bp, Homo sapiens
aaatatcagcttttcttattc

SEQ ID NO: 4477187 - DNA, 17 bp, Homo sapiens
aaatatcagtattctga

SEQ ID NO: 4477188 - DNA, 18 bp, Homo sapiens
aaatatcagttactcagc

SEQ ID NO: 4477189 - DNA, 16 bp, Homo sapiens
aaatatccatttatct

SEQ ID NO: 4477190 - DNA, 19 bp, Homo sapiens
aaatatcccgggggtgggg

SEQ ID NO: 4477191 - DNA, 15 bp, Homo sapiens
aaatatctctgagtt

SEQ ID NO: 4477192 - DNA, 15 bp, Homo sapiens
aaatatctgtgaaat

SEQ ID NO: 4477193 - DNA, 21 bp, Homo sapiens
aaatatctgtgaaatatcatc

SEQ ID NO: 4477194 - DNA, 13 bp, Homo sapiens
aaatatctgttat

SEQ ID NO: 4477195 - DNA, 21 bp, Homo sapiens
aaatatgaaccctttgtttct

SEQ ID NO: 4477196 - DNA, 16 bp, Homo sapiens
aaatatgcaaagcact

SEQ ID NO: 4477197 - DNA, 16 bp, Homo sapiens
aaatatgcctttttga

SEQ ID NO: 4477198 - DNA, 13 bp, Homo sapiens
aaatatgtactgt

SEQ ID NO: 4477199 - DNA, 21 bp, Homo sapiens
aaatatgtatttaccaaaaat

SEQ ID NO: 4477200 - DNA, 16 bp, Homo sapiens
aaatatgtgaagtttt

SEQ ID NO: 4477201 - DNA, 15 bp, Homo sapiens
aaatattagcaaaga

SEQ ID NO: 4477202 - DNA, 16 bp, Homo sapiens
aaatattatttgtgtt

SEQ ID NO: 4477203 - DNA, 12 bp, Homo sapiens
aaatattcagaa

SEQ ID NO: 4477204 - DNA, 14 bp, Homo sapiens
aaatattcagaaat

SEQ ID NO: 4477205 - DNA, 13 bp, Homo sapiens
aaatattcagaat

SEQ ID NO: 4477206 - DNA, 15 bp, Homo sapiens
aaatattctctattt

SEQ ID NO: 4477207 - DNA, 23 bp, Homo sapiens
aaatattgaagttgtttatcaac

SEQ ID NO: 4477208 - DNA, 17 bp, Homo sapiens
aaatattgttctgctgt

SEQ ID NO: 4477209 - DNA, 16 bp, Homo sapiens
aaatattgtttctgca

SEQ ID NO: 4477210 - DNA, 21 bp, Homo sapiens
aaatattgtttctgcattcat

SEQ ID NO: 4477211 - DNA, 13 bp, Homo sapiens
aaatatttaatat

SEQ ID NO: 4477212 - DNA, 10 bp, Homo sapiens
aaatatttat

SEQ ID NO: 4477213 - DNA, 13 bp, Homo sapiens
aaatatttcactt

SEQ ID NO: 4477214 - DNA, 20 bp, Homo sapiens
aaatatttcttaagtataaa

SEQ ID NO: 4477215 - DNA, 17 bp, Homo sapiens
aaatatttgactattct

SEQ ID NO: 4477216 - DNA, 22 bp, Homo sapiens
aaatatttgttacttttagttc

SEQ ID NO: 4477217 - DNA, 15 bp, Homo sapiens
aaatattttaaagaa

SEQ ID NO: 4477218 - DNA, 12 bp, Homo sapiens
aaatattttcta

SEQ ID NO: 4477219 - DNA, 22 bp, Homo sapiens
aaatattttgaatcaataatat

SEQ ID NO: 4477220 - DNA, 14 bp, Homo sapiens
aaatcaaaaacagg

SEQ ID NO: 4477221 - DNA, 19 bp, Homo sapiens
aaatcaaatatgcaaagca

SEQ ID NO: 4477222 - DNA, 13 bp, Homo sapiens
aaatcaaatgaat

SEQ ID NO: 4477223 - DNA, 12 bp, Homo sapiens
aaatcaacatga

SEQ ID NO: 4477224 - DNA, 11 bp, Homo sapiens
aaatcaacttt

SEQ ID NO: 4477225 - DNA, 12 bp, Homo sapiens
aaatcaactttt

SEQ ID NO: 4477226 - DNA, 21 bp, Homo sapiens
aaatcaactttttattgcctt

SEQ ID NO: 4477227 - DNA, 20 bp, Homo sapiens
aaatcaaggaaaggctcatt

SEQ ID NO: 4477228 - DNA, 22 bp, Homo sapiens
aaatcaatacactagttgtttc

SEQ ID NO: 4477229 - DNA, 19 bp, Homo sapiens
aaatcaattactggtccaa

SEQ ID NO: 4477230 - DNA, 23 bp, Homo sapiens
aaatcaattactggtccaaaaga

SEQ ID NO: 4477231 - DNA, 17 bp, Homo sapiens
aaatcacagaaaattta

SEQ ID NO: 4477232 - DNA, 20 bp, Homo sapiens
aaatcacgctttttgaaaaa

SEQ ID NO: 4477233 - DNA, 18 bp, Homo sapiens
aaatcactaacattatat

SEQ ID NO: 4477234 - DNA, 12 bp, Homo sapiens
aaatcagaagtc

SEQ ID NO: 4477235 - DNA, 21 bp, Homo sapiens
aaatcagaagtcatcttgcta

SEQ ID NO: 4477236 - DNA, 22 bp, Homo sapiens
aaatcagtatattttctgtatt

SEQ ID NO: 4477237 - DNA, 14 bp, Homo sapiens
aaatcagtcaagct

SEQ ID NO: 4477238 - DNA, 13 bp, Homo sapiens
aaatcatctattt

SEQ ID NO: 4477239 - DNA, 14 bp, Homo sapiens
aaatcatctatttt

SEQ ID NO: 4477240 - DNA, 17 bp, Homo sapiens
aaatcatctattttgat

SEQ ID NO: 4477241 - DNA, 14 bp, Homo sapiens
aaatcatgtttatt

SEQ ID NO: 4477242 - DNA, 15 bp, Homo sapiens
aaatcatttagatgc

SEQ ID NO: 4477243 - DNA, 16 bp, Homo sapiens
aaatcatttagatgca

SEQ ID NO: 4477244 - DNA, 11 bp, Homo sapiens
aaatcatttct

SEQ ID NO: 4477245 - DNA, 12 bp, Homo sapiens
aaatcatttctg

SEQ ID NO: 4477246 - DNA, 21 bp, Homo sapiens
aaatcatttctgcatcagctg

SEQ ID NO: 4477247 - DNA, 20 bp, Homo sapiens
aaatcatttggcttgctgtt

SEQ ID NO: 4477248 - DNA, 21 bp, Homo sapiens
aaatcatttggcttgctgttt

SEQ ID NO: 4477249 - DNA, 19 bp, Homo sapiens
aaatcatttggttaaatca

SEQ ID NO: 4477250 - DNA, 12 bp, Homo sapiens
aaatcatttgtt

SEQ ID NO: 4477251 - DNA, 14 bp, Homo sapiens
aaatcattttgcaa

SEQ ID NO: 4477252 - DNA, 13 bp, Homo sapiens
aaatccaaaaaaa

SEQ ID NO: 4477253 - DNA, 17 bp, Homo sapiens
aaatccaagatgctggc

SEQ ID NO: 4477254 - DNA, 14 bp, Homo sapiens
aaatccagactttc

SEQ ID NO: 4477255 - DNA, 22 bp, Homo sapiens
aaatccagactttctttttcta

SEQ ID NO: 4477256 - DNA, 13 bp, Homo sapiens
aaatcccaaatcc

SEQ ID NO: 4477257 - DNA, 21 bp, Homo sapiens
aaatccggtcagccaagtgca

SEQ ID NO: 4477258 - DNA, 16 bp, Homo sapiens
aaatcctatttaaaga

SEQ ID NO: 4477259 - DNA, 20 bp, Homo sapiens
aaatcctatttaaagacctg

SEQ ID NO: 4477260 - DNA, 12 bp, Homo sapiens
aaatcctctggc

SEQ ID NO: 4477261 - DNA, 12 bp, Homo sapiens
aaatcctggaag

SEQ ID NO: 4477262 - DNA, 19 bp, Homo sapiens
aaatcctggaaggacacag

SEQ ID NO: 4477263 - DNA, 23 bp, Homo sapiens
aaatcgccaggactggtgaatat

SEQ ID NO: 4477264 - DNA, 15 bp, Homo sapiens
aaatctaaaatgcaa

SEQ ID NO: 4477265 - DNA, 17 bp, Homo sapiens
aaatctaaaatttcata

SEQ ID NO: 4477266 - DNA, 19 bp, Homo sapiens
aaatctacactccagtgag

SEQ ID NO: 4477267 - DNA, 16 bp, Homo sapiens
aaatctagacattctt

SEQ ID NO: 4477268 - DNA, 23 bp, Homo sapiens
aaatctagacattcttttaatgc

SEQ ID NO: 4477269 - DNA, 17 bp, Homo sapiens
aaatctaggatgtgatg

SEQ ID NO: 4477270 - DNA, 12 bp, Homo sapiens
aaatctattgac

SEQ ID NO: 4477271 - DNA, 22 bp, Homo sapiens
aaatctattgacttttcaataa

SEQ ID NO: 4477272 - DNA, 20 bp, Homo sapiens
aaatctattgggttaatttc

SEQ ID NO: 4477273 - DNA, 12 bp, Homo sapiens
aaatctcagatt

SEQ ID NO: 4477274 - DNA, 18 bp, Homo sapiens
aaatctcattatttcaaa

SEQ ID NO: 4477275 - DNA, 19 bp, Homo sapiens
aaatctcattatttcaaaa

SEQ ID NO: 4477276 - DNA, 13 bp, Homo sapiens
aaatctcctattt

SEQ ID NO: 4477277 - DNA, 13 bp, Homo sapiens
aaatctgaacatt

SEQ ID NO: 4477278 - DNA, 20 bp, Homo sapiens
aaatctgctggagtttcatg

SEQ ID NO: 4477279 - DNA, 22 bp, Homo sapiens
aaatctggggaagaggttttat

SEQ ID NO: 4477280 - DNA, 16 bp, Homo sapiens
aaatctgtcaagagta

SEQ ID NO: 4477281 - DNA, 20 bp, Homo sapiens
aaatctgtcaagagtagtta

SEQ ID NO: 4477282 - DNA, 22 bp, Homo sapiens
aaatctgtccaaaggaggctgg

SEQ ID NO: 4477283 - DNA, 19 bp, Homo sapiens
aaatctgtgcctgagaaca

SEQ ID NO: 4477284 - DNA, 18 bp, Homo sapiens
aaagtatttactttttaa

SEQ ID NO: 4477285 - DNA, 22 bp, Homo sapiens
aaagtatttactttttaaaaat

SEQ ID NO: 4477286 - DNA, 20 bp, Homo sapiens
aaagtatttataaaaatata

SEQ ID NO: 4477287 - DNA, 16 bp, Homo sapiens
aaagtcaatgtacttg

SEQ ID NO: 4477288 - DNA, 21 bp, Homo sapiens
aaagtccataccttatatatg

SEQ ID NO: 4477289 - DNA, 19 bp, Homo sapiens
aaagtccctccctgcctga

SEQ ID NO: 4477290 - DNA, 18 bp, Homo sapiens
aaagtcgttttccaaact

SEQ ID NO: 4477291 - DNA, 16 bp, Homo sapiens
aaagtctgtctttcct

SEQ ID NO: 4477292 - DNA, 14 bp, Homo sapiens
aaagtgaactttgt

SEQ ID NO: 4477293 - DNA, 13 bp, Homo sapiens
aaagtgaagcaaa

SEQ ID NO: 4477294 - DNA, 23 bp, Homo sapiens
aaagtgaagcaaatcagaaactt

SEQ ID NO: 4477295 - DNA, 21 bp, Homo sapiens
aaagtgatcctaaatatgaca

SEQ ID NO: 4477296 - DNA, 17 bp, Homo sapiens
aaagtgatgacatattt

SEQ ID NO: 4477297 - DNA, 14 bp, Homo sapiens
aaagtgcaatgcgt

SEQ ID NO: 4477298 - DNA, 18 bp, Homo sapiens
aaagtgctgggattacag

SEQ ID NO: 4477299 - DNA, 22 bp, Homo sapiens
aaagtgcttcattctttgcagg

SEQ ID NO: 4477300 - DNA, 19 bp, Homo sapiens
aaagtggccaagaagcagt

SEQ ID NO: 4477301 - DNA, 17 bp, Homo sapiens
aaagtgggcttgattct

SEQ ID NO: 4477302 - DNA, 13 bp, Homo sapiens
aaagtggtaaata

SEQ ID NO: 4477303 - DNA, 16 bp, Homo sapiens
aaagtggtaaatactg

SEQ ID NO: 4477304 - DNA, 20 bp, Homo sapiens
aaagtggtacttgatcattt

SEQ ID NO: 4477305 - DNA, 16 bp, Homo sapiens
aaagtggtatagaaat

SEQ ID NO: 4477306 - DNA, 20 bp, Homo sapiens
aaagtggtatagaaatgctg

SEQ ID NO: 4477307 - DNA, 15 bp, Homo sapiens
aaagtgtaacagata

SEQ ID NO: 4477308 - DNA, 14 bp, Homo sapiens
aaagtgtatttgga

SEQ ID NO: 4477309 - DNA, 11 bp, Homo sapiens
aaagtgttttc

SEQ ID NO: 4477310 - DNA, 15 bp, Homo sapiens
aaagtgttttcagag

SEQ ID NO: 4477311 - DNA, 21 bp, Homo sapiens
aaagtgttttgccctatatac

SEQ ID NO: 4477312 - DNA, 16 bp, Homo sapiens
aaagttaaacattgaa

SEQ ID NO: 4477313 - DNA, 12 bp, Homo sapiens
aaagttaacatt

SEQ ID NO: 4477314 - DNA, 20 bp, Homo sapiens
aaagttagtatcttttgata

SEQ ID NO: 4477315 - DNA, 22 bp, Homo sapiens
aaagttatatttcagatgtaat

SEQ ID NO: 4477316 - DNA, 18 bp, Homo sapiens
aaagttattagtggttta

SEQ ID NO: 4477317 - DNA, 20 bp, Homo sapiens
aaagttattcttgtcatttt

SEQ ID NO: 4477318 - DNA, 18 bp, Homo sapiens
aaagttcaacatgttatt

SEQ ID NO: 4477319 - DNA, 14 bp, Homo sapiens
aaagttctcagagc

SEQ ID NO: 4477320 - DNA, 14 bp, Homo sapiens
aaagttctgtactc

SEQ ID NO: 4477321 - DNA, 21 bp, Homo sapiens
aaagttctgtactcaaatgta

SEQ ID NO: 4477322 - DNA, 18 bp, Homo sapiens
aaagttctgtgtatttaa

SEQ ID NO: 4477323 - DNA, 21 bp, Homo sapiens
aaagttctgtgtatttaattg

SEQ ID NO: 4477324 - DNA, 20 bp, Homo sapiens
aaagttgaaccattatactt

SEQ ID NO: 4477325 - DNA, 17 bp, Homo sapiens
aaagttgataaagattt

SEQ ID NO: 4477326 - DNA, 12 bp, Homo sapiens
aaagttgcagat

SEQ ID NO: 4477327 - DNA, 18 bp, Homo sapiens
aaagttggtattaataaa

SEQ ID NO: 4477328 - DNA, 13 bp, Homo sapiens
aaagttgtaaaat

SEQ ID NO: 4477329 - DNA, 18 bp, Homo sapiens
aaagttgtaaaatagaaa

SEQ ID NO: 4477330 - DNA, 17 bp, Homo sapiens
aaagttgtacatgataa

SEQ ID NO: 4477331 - DNA, 13 bp, Homo sapiens
aaagtttaaatgt

SEQ ID NO: 4477332 - DNA, 21 bp, Homo sapiens
aaagtttaaatgtattttaca

SEQ ID NO: 4477333 - DNA, 20 bp, Homo sapiens
aaagtttcacctgtattgaa

SEQ ID NO: 4477334 - DNA, 18 bp, Homo sapiens
aaagtttgccaggaggaa

SEQ ID NO: 4477335 - DNA, 14 bp, Homo sapiens
aaagttttacagag

SEQ ID NO: 4477336 - DNA, 15 bp, Homo sapiens
aaagttttacagaga

SEQ ID NO: 4477337 - DNA, 22 bp, Homo sapiens
aaagttttacagagaggataca

SEQ ID NO: 4477338 - DNA, 18 bp, Homo sapiens
aaagttttgtaaaagaaa

SEQ ID NO: 4477339 - DNA, 11 bp, Homo sapiens
aaagtttttta

SEQ ID NO: 4477340 - DNA, 13 bp, Homo sapiens
aaataaaaagaaa

SEQ ID NO: 4477341 - DNA, 15 bp, Homo sapiens
aaataaaaatggata

SEQ ID NO: 4477342 - DNA, 12 bp, Homo sapiens
aaataaaagcac

SEQ ID NO: 4477343 - DNA, 23 bp, Homo sapiens
aaataaaatgaaaattgtattat

SEQ ID NO: 4477344 - DNA, 21 bp, Homo sapiens
aaataaacacatagattcacc

SEQ ID NO: 4477345 - DNA, 15 bp, Homo sapiens
aaataaacacgattt

SEQ ID NO: 4477346 - DNA, 12 bp, Homo sapiens
aaataaacactg

SEQ ID NO: 4477347 - DNA, 13 bp, Homo sapiens
aaataaacactgt

SEQ ID NO: 4477348 - DNA, 13 bp, Homo sapiens
aaataaaccactg

SEQ ID NO: 4477349 - DNA, 21 bp, Homo sapiens
aaataaactatttatatcaca

SEQ ID NO: 4477350 - DNA, 13 bp, Homo sapiens
aaataaagaagta

SEQ ID NO: 4477351 - DNA, 19 bp, Homo sapiens
aaataaagacaaccatatt

SEQ ID NO: 4477352 - DNA, 17 bp, Homo sapiens
aaataaagatcacacat

SEQ ID NO: 4477353 - DNA, 13 bp, Homo sapiens
aaataaatatacc

SEQ ID NO: 4477354 - DNA, 20 bp, Homo sapiens
aaataaatcttagtgttcaa

SEQ ID NO: 4477355 - DNA, 16 bp, Homo sapiens
aaataaatttatatga

SEQ ID NO: 4477356 - DNA, 16 bp, Homo sapiens
aaataaatttcccagt

SEQ ID NO: 4477357 - DNA, 13 bp, Homo sapiens
aaataacacagat

SEQ ID NO: 4477358 - DNA, 23 bp, Homo sapiens
aaataacacagatattgttataa

SEQ ID NO: 4477359 - DNA, 18 bp, Homo sapiens
aaataaccccattctttg

SEQ ID NO: 4477360 - DNA, 15 bp, Homo sapiens
aaataactaaaatgt

SEQ ID NO: 4477361 - DNA, 12 bp, Homo sapiens
aaataagaaact

SEQ ID NO: 4477362 - DNA, 15 bp, Homo sapiens
aaataagaaactttt

SEQ ID NO: 4477363 - DNA, 21 bp, Homo sapiens
aaataagaaacttttttattt

SEQ ID NO: 4477364 - DNA, 19 bp, Homo sapiens
aaataagacaaaaataata

SEQ ID NO: 4477365 - DNA, 15 bp, Homo sapiens
aaataagtaatatct

SEQ ID NO: 4477366 - DNA, 13 bp, Homo sapiens
aaataagtcaaca

SEQ ID NO: 4477367 - DNA, 14 bp, Homo sapiens
aaataagtcaacag

SEQ ID NO: 4477368 - DNA, 21 bp, Homo sapiens
aaataagtggattttgtattt

SEQ ID NO: 4477369 - DNA, 16 bp, Homo sapiens
aaataataaagatggt

SEQ ID NO: 4477370 - DNA, 15 bp, Homo sapiens
aaataataataatgt

SEQ ID NO: 4477371 - DNA, 17 bp, Homo sapiens
aaataatgcttttctaa

SEQ ID NO: 4477372 - DNA, 23 bp, Homo sapiens
aaataatgtactgaattctttat

SEQ ID NO: 4477373 - DNA, 20 bp, Homo sapiens
aaataattatttattacata

SEQ ID NO: 4477374 - DNA, 12 bp, Homo sapiens
aaataattcata

SEQ ID NO: 4477375 - DNA, 21 bp, Homo sapiens
aaatacaatggtttctgaaag

SEQ ID NO: 4477376 - DNA, 15 bp, Homo sapiens
aaatacacactcaaa

SEQ ID NO: 4477377 - DNA, 13 bp, Homo sapiens
aaatacaggaaac

SEQ ID NO: 4477378 - DNA, 14 bp, Homo sapiens
aaatacaggaaaca

SEQ ID NO: 4477379 - DNA, 14 bp, Homo sapiens
aaataccacaagcc

SEQ ID NO: 4477380 - DNA, 19 bp, Homo sapiens
aaataccacaagcctgaga

SEQ ID NO: 4477381 - DNA, 13 bp, Homo sapiens
aaataccagagcc

SEQ ID NO: 4477382 - DNA, 14 bp, Homo sapiens
aaataccagagcct

SEQ ID NO: 4477383 - DNA, 15 bp, Homo sapiens
aaatacctcaggaaa

SEQ ID NO: 4477384 - DNA, 16 bp, Homo sapiens
aaataccttctatgta

SEQ ID NO: 4477385 - DNA, 18 bp, Homo sapiens
aaataccttctatgtatt

SEQ ID NO: 4477386 - DNA, 18 bp, Homo sapiens
aaatactgtcaaacaata

SEQ ID NO: 4477387 - DNA, 18 bp, Homo sapiens
aaatacttaacacgtgaa

SEQ ID NO: 4477388 - DNA, 14 bp, Homo sapiens
aaatacttagcaaa

SEQ ID NO: 4477389 - DNA, 16 bp, Homo sapiens
aaatacttagcaaaaa

SEQ ID NO: 4477390 - DNA, 16 bp, Homo sapiens
aaatactttttctaat

SEQ ID NO: 4477391 - DNA, 18 bp, Homo sapiens
aaatactttttctaatga

SEQ ID NO: 4477392 - DNA, 14 bp, Homo sapiens
aaatagaaaagtta

SEQ ID NO: 4477393 - DNA, 15 bp, Homo sapiens
aaatagaaaagttat

SEQ ID NO: 4477394 - DNA, 16 bp, Homo sapiens
aaatagaaaagttatt

SEQ ID NO: 4477395 - DNA, 23 bp, Homo sapiens
aaatagaaagagttctatggaga

SEQ ID NO: 4477396 - DNA, 17 bp, Homo sapiens
aaatagaaattagattt

SEQ ID NO: 4477397 - DNA, 19 bp, Homo sapiens
aaatagaaattttgtaaga

SEQ ID NO: 4477398 - DNA, 19 bp, Homo sapiens
aaatagacaaaaagtatat

SEQ ID NO: 4477399 - DNA, 18 bp, Homo sapiens
aaatagagcaaaatcaac

SEQ ID NO: 4477400 - DNA, 23 bp, Homo sapiens
aaatagagcaaaatcaacatgac

SEQ ID NO: 4477401 - DNA, 16 bp, Homo sapiens
aaatagatgtctttta

SEQ ID NO: 4477402 - DNA, 23 bp, Homo sapiens
aaatagatttcagctatgcagaa

SEQ ID NO: 4477403 - DNA, 12 bp, Homo sapiens
aaatagcaataa

SEQ ID NO: 4477404 - DNA, 15 bp, Homo sapiens
aaatagcggccctgg

SEQ ID NO: 4477405 - DNA, 16 bp, Homo sapiens
aaacttggaatcaagg

SEQ ID NO: 4477406 - DNA, 19 bp, Homo sapiens
aaacttggacccttggaaa

SEQ ID NO: 4477407 - DNA, 20 bp, Homo sapiens
aaacttggacccttggaaaa

SEQ ID NO: 4477408 - DNA, 18 bp, Homo sapiens
aaacttggatacttggat

SEQ ID NO: 4477409 - DNA, 12 bp, Homo sapiens
aaacttgggcac

SEQ ID NO: 4477410 - DNA, 12 bp, Homo sapiens
aaacttgtaaat

SEQ ID NO: 4477411 - DNA, 12 bp, Homo sapiens
aaacttgtgaat

SEQ ID NO: 4477412 - DNA, 18 bp, Homo sapiens
aaacttgtgagcatcaga

SEQ ID NO: 4477413 - DNA, 13 bp, Homo sapiens
aaacttgtgtatt

SEQ ID NO: 4477414 - DNA, 19 bp, Homo sapiens
aaacttgtttgctgtgaac

SEQ ID NO: 4477415 - DNA, 20 bp, Homo sapiens
aaacttgtttgctgtgaaca

SEQ ID NO: 4477416 - DNA, 24 bp, Homo sapiens
aaactttaggtttttttaatgata

SEQ ID NO: 4477417 - DNA, 19 bp, Homo sapiens
aaactttattttatataat

SEQ ID NO: 4477418 - DNA, 21 bp, Homo sapiens
aaactttattttatataataa

SEQ ID NO: 4477419 - DNA, 15 bp, Homo sapiens
aaactttctccattt

SEQ ID NO: 4477420 - DNA, 11 bp, Homo sapiens
aaactttgtca

SEQ ID NO: 4477421 - DNA, 16 bp, Homo sapiens
aaactttgtcacttct

SEQ ID NO: 4477422 - DNA, 22 bp, Homo sapiens
aaactttgtttttggtttttta

SEQ ID NO: 4477423 - DNA, 21 bp, Homo sapiens
aaacttttataaattaaatat

SEQ ID NO: 4477424 - DNA, 21 bp, Homo sapiens
aaactttttgaccagtttctt

SEQ ID NO: 4477425 - DNA, 22 bp, Homo sapiens
aaactttttgaccagtttcttt

SEQ ID NO: 4477426 - DNA, 14 bp, Homo sapiens
aaactttttgttca

SEQ ID NO: 4477427 - DNA, 15 bp, Homo sapiens
aaactttttttctgt

SEQ ID NO: 4477428 - DNA, 22 bp, Homo sapiens
aaactttttttctgtaccagtt

SEQ ID NO: 4477429 - DNA, 13 bp, Homo sapiens
aaagaaaaacaaa

SEQ ID NO: 4477430 - DNA, 22 bp, Homo sapiens
aaagaaaaattaattaggaatt

SEQ ID NO: 4477431 - DNA, 12 bp, Homo sapiens
aaagaaactttc

SEQ ID NO: 4477432 - DNA, 12 bp, Homo sapiens
aaagaaaggaaa

SEQ ID NO: 4477433 - DNA, 21 bp, Homo sapiens
aaagaaagggaaactggctga

SEQ ID NO: 4477434 - DNA, 10 bp, Homo sapiens
aaagaaagtg

SEQ ID NO: 4477435 - DNA, 17 bp, Homo sapiens
aaagaaatatacagttt

SEQ ID NO: 4477436 - DNA, 15 bp, Homo sapiens
aaagaaatcttgctt

SEQ ID NO: 4477437 - DNA, 12 bp, Homo sapiens
aaagaaatgcac

SEQ ID NO: 4477438 - DNA, 15 bp, Homo sapiens
aaagaaatgtaaggg

SEQ ID NO: 4477439 - DNA, 21 bp, Homo sapiens
aaagaacatgcagtttgaaat

SEQ ID NO: 4477440 - DNA, 19 bp, Homo sapiens
aaagaagaagaagaaggag

SEQ ID NO: 4477441 - DNA, 13 bp, Homo sapiens
aaagaagagaagt

SEQ ID NO: 4477442 - DNA, 22 bp, Homo sapiens
aaagaagagcgagagatcaaag

SEQ ID NO: 4477443 - DNA, 13 bp, Homo sapiens
aaagaagcagacc

SEQ ID NO: 4477444 - DNA, 12 bp, Homo sapiens
aaagaagccata

SEQ ID NO: 4477445 - DNA, 17 bp, Homo sapiens
aaagaaggaaagatggt

SEQ ID NO: 4477446 - DNA, 24 bp, Homo sapiens
aaagaagtgtggggattttcactg

SEQ ID NO: 4477447 - DNA, 18 bp, Homo sapiens
aaagaataaaatgtttct

SEQ ID NO: 4477448 - DNA, 15 bp, Homo sapiens
aaagaatacttgaac

SEQ ID NO: 4477449 - DNA, 12 bp, Homo sapiens
aaagaatagaaa

SEQ ID NO: 4477450 - DNA, 15 bp, Homo sapiens
aaagaatattttgat

SEQ ID NO: 4477451 - DNA, 20 bp, Homo sapiens
aaagaatattttgatgcaga

SEQ ID NO: 4477452 - DNA, 15 bp, Homo sapiens
aaagaatcattattt

SEQ ID NO: 4477453 - DNA, 19 bp, Homo sapiens
aaagaatcattatttatta

SEQ ID NO: 4477454 - DNA, 23 bp, Homo sapiens
aaagaatcattatttattaaatt

SEQ ID NO: 4477455 - DNA, 13 bp, Homo sapiens
aaagaatgactat

SEQ ID NO: 4477456 - DNA, 13 bp, Homo sapiens
aaagaatgttact

SEQ ID NO: 4477457 - DNA, 14 bp, Homo sapiens
aaagacaagaaaat

SEQ ID NO: 4477458 - DNA, 16 bp, Homo sapiens
aaagacagcagacaaa

SEQ ID NO: 4477459 - DNA, 22 bp, Homo sapiens
aaagacagcagacaaaatgaaa

SEQ ID NO: 4477460 - DNA, 22 bp, Homo sapiens
aaagacagcgataagctttcaa

SEQ ID NO: 4477461 - DNA, 20 bp, Homo sapiens
aaagacagggtgggagggag

SEQ ID NO: 4477462 - DNA, 22 bp, Homo sapiens
aaagacagggtgggagggagga

SEQ ID NO: 4477463 - DNA, 23 bp, Homo sapiens
aaagacagggtgggagggaggag

SEQ ID NO: 4477464 - DNA, 14 bp, Homo sapiens
aaagacatctgcct

SEQ ID NO: 4477465 - DNA, 16 bp, Homo sapiens
aaagacatgctttcca

SEQ ID NO: 4477466 - DNA, 19 bp, Homo sapiens
aaagacattgtttttaaaa

SEQ ID NO: 4477467 - DNA, 18 bp, Homo sapiens
aaagacgcaaggtgtgct

SEQ ID NO: 4477468 - DNA, 22 bp, Homo sapiens
aaagacgctaataaaaatttat

SEQ ID NO: 4477469 - DNA, 23 bp, Homo sapiens
aaagactagagcaaaataatgca

SEQ ID NO: 4477470 - DNA, 14 bp, Homo sapiens
aaagactattcaaa

SEQ ID NO: 4477471 - DNA, 18 bp, Homo sapiens
aaagactattcaaacagt

SEQ ID NO: 4477472 - DNA, 21 bp, Homo sapiens
aaagactattcaaacagtctc

SEQ ID NO: 4477473 - DNA, 14 bp, Homo sapiens
aaagactcaaattt

SEQ ID NO: 4477474 - DNA, 13 bp, Homo sapiens
aaagactccaaag

SEQ ID NO: 4477475 - DNA, 15 bp, Homo sapiens
aaagactccaaagaa

SEQ ID NO: 4477476 - DNA, 19 bp, Homo sapiens
aaagactgaccaatattgt

SEQ ID NO: 4477477 - DNA, 15 bp, Homo sapiens
aaagacttgctttaa

SEQ ID NO: 4477478 - DNA, 19 bp, Homo sapiens
aaagagaaacagttggtaa

SEQ ID NO: 4477479 - DNA, 23 bp, Homo sapiens
aaagagaaactttgtgctacatg

SEQ ID NO: 4477480 - DNA, 15 bp, Homo sapiens
aaagagaagatgcct

SEQ ID NO: 4477481 - DNA, 22 bp, Homo sapiens
aaagagacaaactgtaaaaaat

SEQ ID NO: 4477482 - DNA, 13 bp, Homo sapiens
aaagagacagtga

SEQ ID NO: 4477483 - DNA, 21 bp, Homo sapiens
aaagagacagtgatattggaa

SEQ ID NO: 4477484 - DNA, 20 bp, Homo sapiens
aaagagaccacccatatcat

SEQ ID NO: 4477485 - DNA, 18 bp, Homo sapiens
aaagagagaaacactgaa

SEQ ID NO: 4477486 - DNA, 21 bp, Homo sapiens
aaagagcatggatgcatttca

SEQ ID NO: 4477487 - DNA, 22 bp, Homo sapiens
aaagagcatggatgcatttcaa

SEQ ID NO: 4477488 - DNA, 19 bp, Homo sapiens
aaagaggcaccaggaagcc

SEQ ID NO: 4477489 - DNA, 15 bp, Homo sapiens
aaagaggcagcttga

SEQ ID NO: 4477490 - DNA, 12 bp, Homo sapiens
aaagaggcatct

SEQ ID NO: 4477491 - DNA, 21 bp, Homo sapiens
aaagaggctctggacagcaga

SEQ ID NO: 4477492 - DNA, 15 bp, Homo sapiens
aaagaggtgaacatt

SEQ ID NO: 4477493 - DNA, 18 bp, Homo sapiens
aaagagtagaattgcatt

SEQ ID NO: 4477494 - DNA, 17 bp, Homo sapiens
aaagagtgtgttataaa

SEQ ID NO: 4477495 - DNA, 19 bp, Homo sapiens
aaagagttattcaaatgaa

SEQ ID NO: 4477496 - DNA, 14 bp, Homo sapiens
aaagagttttctat

SEQ ID NO: 4477497 - DNA, 19 bp, Homo sapiens
aaagataatctcagtgctt

SEQ ID NO: 4477498 - DNA, 23 bp, Homo sapiens
aaagatcatttataatactgttt

SEQ ID NO: 4477499 - DNA, 16 bp, Homo sapiens
aaagatccttcatttt

SEQ ID NO: 4477500 - DNA, 17 bp, Homo sapiens
aaagatgaaagagcagt

SEQ ID NO: 4477501 - DNA, 17 bp, Homo sapiens
aaagatgccccattcct

SEQ ID NO: 4477502 - DNA, 22 bp, Homo sapiens
aaagatgccccattccttgcgc

SEQ ID NO: 4477503 - DNA, 17 bp, Homo sapiens
aaagatggcttatgtca

SEQ ID NO: 4477504 - DNA, 17 bp, Homo sapiens
aaagatggttaaacatt

SEQ ID NO: 4477505 - DNA, 19 bp, Homo sapiens
aaagatggttaaacatttt

SEQ ID NO: 4477506 - DNA, 13 bp, Homo sapiens
aaagatgtatata

SEQ ID NO: 4477507 - DNA, 23 bp, Homo sapiens
aaagattctgtgtcagagcccag

SEQ ID NO: 4477508 - DNA, 21 bp, Homo sapiens
aaagattggttgcctctgcct

SEQ ID NO: 4477509 - DNA, 14 bp, Homo sapiens
aaagatttattgta

SEQ ID NO: 4477510 - DNA, 21 bp, Homo sapiens
aaagatttcatatctaacttt

SEQ ID NO: 4477511 - DNA, 21 bp, Homo sapiens
aaagatttgtgaactggaaga

SEQ ID NO: 4477512 - DNA, 19 bp, Homo sapiens
aaagatttgtttgtgttta

SEQ ID NO: 4477513 - DNA, 19 bp, Homo sapiens
aaagattttttaataattt

SEQ ID NO: 4477514 - DNA, 22 bp, Homo sapiens
aaagattttttaataatttaga

SEQ ID NO: 4477515 - DNA, 16 bp, Homo sapiens
aaagcaaaagcaaggg

SEQ ID NO: 4477516 - DNA, 17 bp, Homo sapiens
aaagcaaaaggctgaga

SEQ ID NO: 4477517 - DNA, 18 bp, Homo sapiens
aaagcaaaataaaaacta

SEQ ID NO: 4477518 - DNA, 19 bp, Homo sapiens
aaagcaaccacaaatgcat

SEQ ID NO: 4477519 - DNA, 22 bp, Homo sapiens
aaagcaagcattcagaagaaaa

SEQ ID NO: 4477520 - DNA, 14 bp, Homo sapiens
aaagcaaggaaact

SEQ ID NO: 4477521 - DNA, 13 bp, Homo sapiens
aaagcaattatat

SEQ ID NO: 4477522 - DNA, 16 bp, Homo sapiens
aaagcaattatattgt

SEQ ID NO: 4477523 - DNA, 22 bp, Homo sapiens
aaagcacaaagttctcagagct

SEQ ID NO: 4477524 - DNA, 21 bp, Homo sapiens
aaagcactgacttctaagtaa

SEQ ID NO: 4477525 - DNA, 20 bp, Homo sapiens
aaagcactggtttcaagaat

SEQ ID NO: 4477526 - DNA, 22 bp, Homo sapiens
aaagcactggtttcaagaatat

SEQ ID NO: 4477527 - DNA, 17 bp, Homo sapiens
aaagcagggacttgaac

SEQ ID NO: 4477528 - DNA, 17 bp, Homo sapiens
aaagcaggtttcaagga

SEQ ID NO: 4477529 - DNA, 15 bp, Homo sapiens
aaagcagtatttttc

SEQ ID NO: 4477530 - DNA, 17 bp, Homo sapiens
aaagcagttaaactgat

SEQ ID NO: 4477531 - DNA, 13 bp, Homo sapiens
aaagcataaaatg

SEQ ID NO: 4477532 - DNA, 19 bp, Homo sapiens
aaagcatcaccactcattt

SEQ ID NO: 4477533 - DNA, 20 bp, Homo sapiens
aaagcatgccgttctgcacc

SEQ ID NO: 4477534 - DNA, 20 bp, Homo sapiens
aaagcatttttattatattt

SEQ ID NO: 4477535 - DNA, 14 bp, Homo sapiens
aaagccaagggcaa

SEQ ID NO: 4477536 - DNA, 19 bp, Homo sapiens
aaagccaagtgttttgtat

SEQ ID NO: 4477537 - DNA, 16 bp, Homo sapiens
aaagccacgccctccc

SEQ ID NO: 4477538 - DNA, 21 bp, Homo sapiens
aaagccccccagctcccacac

SEQ ID NO: 4477539 - DNA, 19 bp, Homo sapiens
aaagcctccgcctgctgtg

SEQ ID NO: 4477540 - DNA, 22 bp, Homo sapiens
aaagcctcctgccccctgccag

SEQ ID NO: 4477541 - DNA, 15 bp, Homo sapiens
aaagccttagggaag

SEQ ID NO: 4477542 - DNA, 19 bp, Homo sapiens
aaagcctttgtatctttct

SEQ ID NO: 4477543 - DNA, 20 bp, Homo sapiens
aaagccttttgctttatgct

SEQ ID NO: 4477544 - DNA, 21 bp, Homo sapiens
aaagccttttgctttatgctt

SEQ ID NO: 4477545 - DNA, 23 bp, Homo sapiens
aaagccttttgctttatgcttga

SEQ ID NO: 4477546 - DNA, 15 bp, Homo sapiens
aaagcggtccctgtc

SEQ ID NO: 4477547 - DNA, 21 bp, Homo sapiens
aaagcgtgtgagtgagggaga

SEQ ID NO: 4477548 - DNA, 12 bp, Homo sapiens
aaagctaaactg

SEQ ID NO: 4477549 - DNA, 13 bp, Homo sapiens
aaagctaaactga

SEQ ID NO: 4477550 - DNA, 14 bp, Homo sapiens
aaagctaaactgaa

SEQ ID NO: 4477551 - DNA, 14 bp, Homo sapiens
aaagctaatgtgca

SEQ ID NO: 4477552 - DNA, 18 bp, Homo sapiens
aaagctcaaatgaaatgt

SEQ ID NO: 4477553 - DNA, 21 bp, Homo sapiens
aaagctcttcctaatcgctaa

SEQ ID NO: 4477554 - DNA, 15 bp, Homo sapiens
aaagctgacattgcc

SEQ ID NO: 4477555 - DNA, 18 bp, Homo sapiens
aaagctgacattgccaaa

SEQ ID NO: 4477556 - DNA, 14 bp, Homo sapiens
aaagctgatttttt

SEQ ID NO: 4477557 - DNA, 22 bp, Homo sapiens
aaagctgctaaatctcctattt

SEQ ID NO: 4477558 - DNA, 18 bp, Homo sapiens
aaagctgtgtgtttggaa

SEQ ID NO: 4477559 - DNA, 17 bp, Homo sapiens
aaagctgttcttgaaag

SEQ ID NO: 4477560 - DNA, 20 bp, Homo sapiens
aaagcttatccataaaaaaa

SEQ ID NO: 4477561 - DNA, 19 bp, Homo sapiens
aaagcttgatttgatcttt

SEQ ID NO: 4477562 - DNA, 22 bp, Homo sapiens
aaagcttgatttgatctttgtt

SEQ ID NO: 4477563 - DNA, 15 bp, Homo sapiens
aaagctttatctttg

SEQ ID NO: 4477564 - DNA, 19 bp, Homo sapiens
aaagctttatctttgtgta

SEQ ID NO: 4477565 - DNA, 19 bp, Homo sapiens
aaagctttatgattttcat

SEQ ID NO: 4477566 - DNA, 19 bp, Homo sapiens
aaagctttggaaaaatctt

SEQ ID NO: 4477567 - DNA, 22 bp, Homo sapiens
aaagctttggaaaaatcttttt

SEQ ID NO: 4477568 - DNA, 19 bp, Homo sapiens
aaagcttttaaaatgtaga

SEQ ID NO: 4477569 - DNA, 12 bp, Homo sapiens
aaagcttttcag

SEQ ID NO: 4477570 - DNA, 20 bp, Homo sapiens
aaaggaaaaaatgcaaacgt

SEQ ID NO: 4477571 - DNA, 15 bp, Homo sapiens
aaaggaaaaacaaac

SEQ ID NO: 4477572 - DNA, 14 bp, Homo sapiens
aaaggaaaaagctc

SEQ ID NO: 4477573 - DNA, 17 bp, Homo sapiens
aaaggaaaaagctccat

SEQ ID NO: 4477574 - DNA, 15 bp, Homo sapiens
aaaggaaaacaaaaa

SEQ ID NO: 4477575 - DNA, 13 bp, Homo sapiens
aaaggaaaagaaa

SEQ ID NO: 4477576 - DNA, 12 bp, Homo sapiens
aaaggaaacctt

SEQ ID NO: 4477577 - DNA, 15 bp, Homo sapiens
aaaggaaatcaaatg

SEQ ID NO: 4477578 - DNA, 16 bp, Homo sapiens
aaaggaagacagttct

SEQ ID NO: 4477579 - DNA, 14 bp, Homo sapiens
aaaggaagtctagg

SEQ ID NO: 4477580 - DNA, 14 bp, Homo sapiens
aaaggaatgtgtaa

SEQ ID NO: 4477581 - DNA, 14 bp, Homo sapiens
aaaggacatcagca

SEQ ID NO: 4477582 - DNA, 19 bp, Homo sapiens
aaaggaccagctttgagct

SEQ ID NO: 4477583 - DNA, 15 bp, Homo sapiens
aaaggactattatgt

SEQ ID NO: 4477584 - DNA, 13 bp, Homo sapiens
aaaggactgtaat

SEQ ID NO: 4477585 - DNA, 12 bp, Homo sapiens
aaaggagacata

SEQ ID NO: 4477586 - DNA, 19 bp, Homo sapiens
aaaggagccttttgctctc

SEQ ID NO: 4477587 - DNA, 18 bp, Homo sapiens
aaaggaggggaaacaatg

SEQ ID NO: 4477588 - DNA, 21 bp, Homo sapiens
aaaggaggggaaacaatgaaa

SEQ ID NO: 4477589 - DNA, 19 bp, Homo sapiens
aaaggatgtaaacagtgcc

SEQ ID NO: 4477590 - DNA, 21 bp, Homo sapiens
aaaggatgtaaacagtgcctg

SEQ ID NO: 4477591 - DNA, 14 bp, Homo sapiens
aaaggattttacca

SEQ ID NO: 4477592 - DNA, 16 bp, Homo sapiens
aaaggattttaccaaa

SEQ ID NO: 4477593 - DNA, 20 bp, Homo sapiens
aaaggattttaccaaagcat

SEQ ID NO: 4477594 - DNA, 16 bp, Homo sapiens
aaaggcagctgcctct

SEQ ID NO: 4477595 - DNA, 19 bp, Homo sapiens
aaaggcagctgcctctgct

SEQ ID NO: 4477596 - DNA, 20 bp, Homo sapiens
aaaggcagctgcctctgctc

SEQ ID NO: 4477597 - DNA, 13 bp, Homo sapiens
aaaggcagttttc

SEQ ID NO: 4477598 - DNA, 14 bp, Homo sapiens
aaaggcagttttct

SEQ ID NO: 4477599 - DNA, 16 bp, Homo sapiens
aaaggcagttttctaa

SEQ ID NO: 4477600 - DNA, 15 bp, Homo sapiens
aaaggccacctagct

SEQ ID NO: 4477601 - DNA, 21 bp, Homo sapiens
aaaggcctcttgtaaagactg

SEQ ID NO: 4477602 - DNA, 16 bp, Homo sapiens
aaaggctgacattcac

SEQ ID NO: 4477603 - DNA, 19 bp, Homo sapiens
aaaggctgacattcactga

SEQ ID NO: 4477604 - DNA, 15 bp, Homo sapiens
aaaggctgttaaata

SEQ ID NO: 4477605 - DNA, 20 bp, Homo sapiens
aaaggctgttaaatacagga

SEQ ID NO: 4477606 - DNA, 15 bp, Homo sapiens
aaagggaaactggga

SEQ ID NO: 4477607 - DNA, 16 bp, Homo sapiens
aaagggaactgaacat

SEQ ID NO: 4477608 - DNA, 21 bp, Homo sapiens
aaagggaactgaacattccag

SEQ ID NO: 4477609 - DNA, 17 bp, Homo sapiens
aaagggagaaatgccag

SEQ ID NO: 4477610 - DNA, 18 bp, Homo sapiens
aaagggagctatcaggaa

SEQ ID NO: 4477611 - DNA, 20 bp, Homo sapiens
aaagggatcatcatgcagct

SEQ ID NO: 4477612 - DNA, 20 bp, Homo sapiens
aaagggatggcaagatgtgg

SEQ ID NO: 4477613 - DNA, 18 bp, Homo sapiens
aaagggctggctccccct

SEQ ID NO: 4477614 - DNA, 22 bp, Homo sapiens
aaagggcttcggccacaggcag

SEQ ID NO: 4477615 - DNA, 14 bp, Homo sapiens
aaaggggagagcct

SEQ ID NO: 4477616 - DNA, 22 bp, Homo sapiens
aaagggtcaatgctatttttgt

SEQ ID NO: 4477617 - DNA, 13 bp, Homo sapiens
aaagggtttgata

SEQ ID NO: 4477618 - DNA, 14 bp, Homo sapiens
aaaggtaaatacaa

SEQ ID NO: 4477619 - DNA, 23 bp, Homo sapiens
aaaggtgacatcggaaaaataat

SEQ ID NO: 4477620 - DNA, 21 bp, Homo sapiens
aaaggtgagtttgagctgcct

SEQ ID NO: 4477621 - DNA, 17 bp, Homo sapiens
aaaggtgtgagactggg

SEQ ID NO: 4477622 - DNA, 19 bp, Homo sapiens
aaaggtgtgagactgggaa

SEQ ID NO: 4477623 - DNA, 19 bp, Homo sapiens
aaaggttagagaataaatt

SEQ ID NO: 4477624 - DNA, 21 bp, Homo sapiens
aaaggtttatttttctgttac

SEQ ID NO: 4477625 - DNA, 12 bp, Homo sapiens
aaaggttttttt

SEQ ID NO: 4477626 - DNA, 18 bp, Homo sapiens
aaaggttttttttcagtt

SEQ ID NO: 4477627 - DNA, 14 bp, Homo sapiens
aaagtaaaatgtct

SEQ ID NO: 4477628 - DNA, 14 bp, Homo sapiens
aaagtaaaccacaa

SEQ ID NO: 4477629 - DNA, 21 bp, Homo sapiens
aaagtaaaccacaaaaaaata

SEQ ID NO: 4477630 - DNA, 17 bp, Homo sapiens
aaagtaaacttgtgtat

SEQ ID NO: 4477631 - DNA, 18 bp, Homo sapiens
aaagtaagcatttccagc

SEQ ID NO: 4477632 - DNA, 13 bp, Homo sapiens
aaagtaatcactt

SEQ ID NO: 4477633 - DNA, 19 bp, Homo sapiens
aaagtacaaccatagagga

SEQ ID NO: 4477634 - DNA, 15 bp, Homo sapiens
aaagtacactctgct

SEQ ID NO: 4477635 - DNA, 22 bp, Homo sapiens
aaagtacattctggggaaacaa

SEQ ID NO: 4477636 - DNA, 15 bp, Homo sapiens
aaagtacattgctta

SEQ ID NO: 4477637 - DNA, 15 bp, Homo sapiens
aaagtagattcatga

SEQ ID NO: 4477638 - DNA, 19 bp, Homo sapiens
aaagtagattcatgaaaat

SEQ ID NO: 4477639 - DNA, 12 bp, Homo sapiens
aaagtagtactt

SEQ ID NO: 4477640 - DNA, 14 bp, Homo sapiens
aaagtatgcattat

SEQ ID NO: 4477641 - DNA, 18 bp, Homo sapiens
aaagtatgcattattaaa

SEQ ID NO: 4477642 - DNA, 17 bp, Homo sapiens
aaagtatgtattattta

SEQ ID NO: 4477643 - DNA, 14 bp, Homo sapiens
aaagtattccacct

SEQ ID NO: 4477644 - DNA, 12 bp, Homo sapiens
aaagtattcttc

SEQ ID NO: 4477645 - DNA, 15 bp, Homo sapiens
aaagtatttactttt

SEQ ID NO: 4477646 - DNA, 17 bp, Homo sapiens
actactaaggaaaataa

SEQ ID NO: 4477647 - DNA, 22 bp, Homo sapiens
actactaaggccttttatgtaa

SEQ ID NO: 4477648 - DNA, 13 bp, Homo sapiens
actactctgtgcc

SEQ ID NO: 4477649 - DNA, 18 bp, Homo sapiens
actactgggtgtcatttc

SEQ ID NO: 4477650 - DNA, 20 bp, Homo sapiens
actactgggtgtcatttcat

SEQ ID NO: 4477651 - DNA, 15 bp, Homo sapiens
actacttaccatttg

SEQ ID NO: 4477652 - DNA, 15 bp, Homo sapiens
actacttatctctaa

SEQ ID NO: 4477653 - DNA, 19 bp, Homo sapiens
actactttgttaggatttt

SEQ ID NO: 4477654 - DNA, 18 bp, Homo sapiens
actagaaagaaggaccca

SEQ ID NO: 4477655 - DNA, 15 bp, Homo sapiens
actagaacctggagg

SEQ ID NO: 4477656 - DNA, 16 bp, Homo sapiens
actagagaatgcacag

SEQ ID NO: 4477657 - DNA, 20 bp, Homo sapiens
actagagaatgcacagatat

SEQ ID NO: 4477658 - DNA, 17 bp, Homo sapiens
actagagatattttgta

SEQ ID NO: 4477659 - DNA, 14 bp, Homo sapiens
actagaggtgagaa

SEQ ID NO: 4477660 - DNA, 16 bp, Homo sapiens
actagatgtagtattt

SEQ ID NO: 4477661 - DNA, 12 bp, Homo sapiens
actagcaactct

SEQ ID NO: 4477662 - DNA, 23 bp, Homo sapiens
actagcaatctcttcattattct

SEQ ID NO: 4477663 - DNA, 18 bp, Homo sapiens
actagcattacattatta

SEQ ID NO: 4477664 - DNA, 13 bp, Homo sapiens
actagcctggcca

SEQ ID NO: 4477665 - DNA, 11 bp, Homo sapiens
actagctttgc

SEQ ID NO: 4477666 - DNA, 15 bp, Homo sapiens
actaggaatcccaga

SEQ ID NO: 4477667 - DNA, 21 bp, Homo sapiens
actaggatattgaatgtgaaa

SEQ ID NO: 4477668 - DNA, 14 bp, Homo sapiens
actaggctcagaga

SEQ ID NO: 4477669 - DNA, 18 bp, Homo sapiens
actagggactatcaggta

SEQ ID NO: 4477670 - DNA, 20 bp, Homo sapiens
actagggatccctcatctgt

SEQ ID NO: 4477671 - DNA, 16 bp, Homo sapiens
actagggattcaggct

SEQ ID NO: 4477672 - DNA, 17 bp, Homo sapiens
actagggattcaggctg

SEQ ID NO: 4477673 - DNA, 18 bp, Homo sapiens
actagggattcaggctgc

SEQ ID NO: 4477674 - DNA, 21 bp, Homo sapiens
actagggattcaggctgcttg

SEQ ID NO: 4477675 - DNA, 22 bp, Homo sapiens
actagtcattaacccatctctg

SEQ ID NO: 4477676 - DNA, 23 bp, Homo sapiens
actagtgcaattccaagaaaata

SEQ ID NO: 4477677 - DNA, 13 bp, Homo sapiens
actataaaagctt

SEQ ID NO: 4477678 - DNA, 19 bp, Homo sapiens
actataaacttaagggcaa

SEQ ID NO: 4477679 - DNA, 13 bp, Homo sapiens
actataacattat

SEQ ID NO: 4477680 - DNA, 14 bp, Homo sapiens
actataacattata

SEQ ID NO: 4477681 - DNA, 16 bp, Homo sapiens
actataacattatata

SEQ ID NO: 4477682 - DNA, 22 bp, Homo sapiens
actataacattatataacaaaa

SEQ ID NO: 4477683 - DNA, 20 bp, Homo sapiens
actataatcaaatgatttca

SEQ ID NO: 4477684 - DNA, 22 bp, Homo sapiens
actataatcaaatgatttcata

SEQ ID NO: 4477685 - DNA, 15 bp, Homo sapiens
actataatgtgaaat

SEQ ID NO: 4477686 - DNA, 19 bp, Homo sapiens
actataatgtgaaatgtaa

SEQ ID NO: 4477687 - DNA, 15 bp, Homo sapiens
actatacttgaacaa

SEQ ID NO: 4477688 - DNA, 17 bp, Homo sapiens
actatacttgaacaaaa

SEQ ID NO: 4477689 - DNA, 19 bp, Homo sapiens
actatacttgatagtttgg

SEQ ID NO: 4477690 - DNA, 17 bp, Homo sapiens
actatatagaatttcct

SEQ ID NO: 4477691 - DNA, 21 bp, Homo sapiens
actatatagaatttcctgtaa

SEQ ID NO: 4477692 - DNA, 17 bp, Homo sapiens
actatcaatatttaagt

SEQ ID NO: 4477693 - DNA, 20 bp, Homo sapiens
actatcaattttaaggaaac

SEQ ID NO: 4477694 - DNA, 15 bp, Homo sapiens
actatcacacatgaa

SEQ ID NO: 4477695 - DNA, 18 bp, Homo sapiens
actatcacacatgaataa

SEQ ID NO: 4477696 - DNA, 15 bp, Homo sapiens
actatcctgtaaata

SEQ ID NO: 4477697 - DNA, 23 bp, Homo sapiens
actatctcatgccagtgccttat

SEQ ID NO: 4477698 - DNA, 20 bp, Homo sapiens
actatgaaaagctagaattg

SEQ ID NO: 4477699 - DNA, 15 bp, Homo sapiens
actatgattattaac

SEQ ID NO: 4477700 - DNA, 14 bp, Homo sapiens
actatgatttattt

SEQ ID NO: 4477701 - DNA, 18 bp, Homo sapiens
actatggagtcttgtgaa

SEQ ID NO: 4477702 - DNA, 22 bp, Homo sapiens
actatggtatgctggccagcac

SEQ ID NO: 4477703 - DNA, 12 bp, Homo sapiens
actatgtaaact

SEQ ID NO: 4477704 - DNA, 16 bp, Homo sapiens
actatgtctgaacata

SEQ ID NO: 4477705 - DNA, 23 bp, Homo sapiens
actatgtctgaacatagaaactc

SEQ ID NO: 4477706 - DNA, 14 bp, Homo sapiens
actatgtgtttttc

SEQ ID NO: 4477707 - DNA, 17 bp, Homo sapiens
actattaagcaagaatg

SEQ ID NO: 4477708 - DNA, 19 bp, Homo sapiens
actattatgtggaataata

SEQ ID NO: 4477709 - DNA, 15 bp, Homo sapiens
actattcatggctac

SEQ ID NO: 4477710 - DNA, 18 bp, Homo sapiens
actattcgaatgaaaaga

SEQ ID NO: 4477711 - DNA, 13 bp, Homo sapiens
actattcttcatt

SEQ ID NO: 4477712 - DNA, 21 bp, Homo sapiens
actatttatatcacacaatat

SEQ ID NO: 4477713 - DNA, 17 bp, Homo sapiens
actatttgctaatgtat

SEQ ID NO: 4477714 - DNA, 14 bp, Homo sapiens
actattttcagaat

SEQ ID NO: 4477715 - DNA, 16 bp, Homo sapiens
actattttcagaatct

SEQ ID NO: 4477716 - DNA, 13 bp, Homo sapiens
actattttctatt

SEQ ID NO: 4477717 - DNA, 14 bp, Homo sapiens
actatttttctatg

SEQ ID NO: 4477718 - DNA, 23 bp, Homo sapiens
actcaaactgaggaatttcacct

SEQ ID NO: 4477719 - DNA, 13 bp, Homo sapiens
actcaaattttgt

SEQ ID NO: 4477720 - DNA, 22 bp, Homo sapiens
actcaaattttgtaccaagtaa

SEQ ID NO: 4477721 - DNA, 15 bp, Homo sapiens
actcaacagagagga

SEQ ID NO: 4477722 - DNA, 21 bp, Homo sapiens
actcaagagaatttatgtgaa

SEQ ID NO: 4477723 - DNA, 12 bp, Homo sapiens
actcaaggaaaa

SEQ ID NO: 4477724 - DNA, 21 bp, Homo sapiens
actcaaggataccttcttatt

SEQ ID NO: 4477725 - DNA, 23 bp, Homo sapiens
actcaagtaccaccaagggatct

SEQ ID NO: 4477726 - DNA, 18 bp, Homo sapiens
actcaagttgattagaaa

SEQ ID NO: 4477727 - DNA, 14 bp, Homo sapiens
actcaataaacagt

SEQ ID NO: 4477728 - DNA, 15 bp, Homo sapiens
actcaataaacagtc

SEQ ID NO: 4477729 - DNA, 19 bp, Homo sapiens
actcaataaacagtcactg

SEQ ID NO: 4477730 - DNA, 19 bp, Homo sapiens
actcaatgtggaaaaaata

SEQ ID NO: 4477731 - DNA, 17 bp, Homo sapiens
actcaattatttgcata

SEQ ID NO: 4477732 - DNA, 15 bp, Homo sapiens
actcacacagccagg

SEQ ID NO: 4477733 - DNA, 13 bp, Homo sapiens
actcacatagcca

SEQ ID NO: 4477734 - DNA, 19 bp, Homo sapiens
actcacattgagagtaagc

SEQ ID NO: 4477735 - DNA, 16 bp, Homo sapiens
actcaccctgggagcc

SEQ ID NO: 4477736 - DNA, 17 bp, Homo sapiens
actcacctctctctaag

SEQ ID NO: 4477737 - DNA, 11 bp, Homo sapiens
actcacctctg

SEQ ID NO: 4477738 - DNA, 20 bp, Homo sapiens
actcacggaccactcgaggc

SEQ ID NO: 4477739 - DNA, 17 bp, Homo sapiens
actcactaacagggaga

SEQ ID NO: 4477740 - DNA, 14 bp, Homo sapiens
actcactcactctg

SEQ ID NO: 4477741 - DNA, 15 bp, Homo sapiens
actcactcactctga

SEQ ID NO: 4477742 - DNA, 13 bp, Homo sapiens
actcactcattcc

SEQ ID NO: 4477743 - DNA, 14 bp, Homo sapiens
actcactcctgaga

SEQ ID NO: 4477744 - DNA, 22 bp, Homo sapiens
actcactcctgagacccctggc

SEQ ID NO: 4477745 - DNA, 18 bp, Homo sapiens
actcactgtgatcaatat

SEQ ID NO: 4477746 - DNA, 12 bp, Homo sapiens
actcactgttta

SEQ ID NO: 4477747 - DNA, 16 bp, Homo sapiens
actcactgtttataaa

SEQ ID NO: 4477748 - DNA, 21 bp, Homo sapiens
actcactttcccttgtgtcaa

SEQ ID NO: 4477749 - DNA, 21 bp, Homo sapiens
actcagagaaaaatgctcccc

SEQ ID NO: 4477750 - DNA, 22 bp, Homo sapiens
actcagagaaaaatgctcccca

SEQ ID NO: 4477751 - DNA, 15 bp, Homo sapiens
actcagaggtccagg

SEQ ID NO: 4477752 - DNA, 18 bp, Homo sapiens
actcagaggtccaggccc

SEQ ID NO: 4477753 - DNA, 19 bp, Homo sapiens
actcagaggtccaggcccc

SEQ ID NO: 4477754 - DNA, 18 bp, Homo sapiens
actcagcagacatttatc

SEQ ID NO: 4477755 - DNA, 17 bp, Homo sapiens
actcagcagcagagagc

SEQ ID NO: 4477756 - DNA, 19 bp, Homo sapiens
actcagcagcagagagccc

SEQ ID NO: 4477757 - DNA, 13 bp, Homo sapiens
actcagcagccct

SEQ ID NO: 4477758 - DNA, 14 bp, Homo sapiens
actcagcagccctc

SEQ ID NO: 4477759 - DNA, 15 bp, Homo sapiens
actcagcagccctcc

SEQ ID NO: 4477760 - DNA, 17 bp, Homo sapiens
actcagcagccctcctc

SEQ ID NO: 4477761 - DNA, 19 bp, Homo sapiens
actcagcagccctcctcac

SEQ ID NO: 4477762 - DNA, 17 bp, Homo sapiens
actcagccacaaagccc

SEQ ID NO: 4477763 - DNA, 21 bp, Homo sapiens
actcagccacaaagcccccca

SEQ ID NO: 4477764 - DNA, 22 bp, Homo sapiens
actcagccactgtcacaggcat

SEQ ID NO: 4477765 - DNA, 16 bp, Homo sapiens
actcagccctgggccc

SEQ ID NO: 4477766 - DNA, 13 bp, Homo sapiens
actcagcctctgc

SEQ ID NO: 4477767 - DNA, 18 bp, Homo sapiens
acggaagcaagcagatga

SEQ ID NO: 4477768 - DNA, 14 bp, Homo sapiens
acggaccactcgag

SEQ ID NO: 4477769 - DNA, 18 bp, Homo sapiens
acggagccactcctctga

SEQ ID NO: 4477770 - DNA, 21 bp, Homo sapiens
acggagccactcctctgactc

SEQ ID NO: 4477771 - DNA, 21 bp, Homo sapiens
acggatgcccattcctgcctg

SEQ ID NO: 4477772 - DNA, 22 bp, Homo sapiens
acggatgcccattcctgcctgg

SEQ ID NO: 4477773 - DNA, 23 bp, Homo sapiens
acggatgcccattcctgcctggt

SEQ ID NO: 4477774 - DNA, 19 bp, Homo sapiens
acggatggtgcatgggctc

SEQ ID NO: 4477775 - DNA, 22 bp, Homo sapiens
acggcaacctgcggaaggaggt

SEQ ID NO: 4477776 - DNA, 17 bp, Homo sapiens
acggcaacgtagcctgg

SEQ ID NO: 4477777 - DNA, 15 bp, Homo sapiens
acggcaggctcactg

SEQ ID NO: 4477778 - DNA, 19 bp, Homo sapiens
acggcctgatgctccctcc

SEQ ID NO: 4477779 - DNA, 18 bp, Homo sapiens
acggcgggatcctccaca

SEQ ID NO: 4477780 - DNA, 17 bp, Homo sapiens
acgggaagtttagagag

SEQ ID NO: 4477781 - DNA, 16 bp, Homo sapiens
acgggatgctctttaa

SEQ ID NO: 4477782 - DNA, 19 bp, Homo sapiens
acgggcagtctgctctgct

SEQ ID NO: 4477783 - DNA, 15 bp, Homo sapiens
acggggggccccagt

SEQ ID NO: 4477784 - DNA, 20 bp, Homo sapiens
acggggggctcctgcccagg

SEQ ID NO: 4477785 - DNA, 22 bp, Homo sapiens
acgggtgcccgtaatcccagct

SEQ ID NO: 4477786 - DNA, 15 bp, Homo sapiens
acggtccccacccct

SEQ ID NO: 4477787 - DNA, 16 bp, Homo sapiens
acggtccccacccctc

SEQ ID NO: 4477788 - DNA, 19 bp, Homo sapiens
acggtctgtgtgctgtttg

SEQ ID NO: 4477789 - DNA, 16 bp, Homo sapiens
acggttatttaagcat

SEQ ID NO: 4477790 - DNA, 13 bp, Homo sapiens
acgtaaagaattt

SEQ ID NO: 4477791 - DNA, 18 bp, Homo sapiens
acgtaaagctagaaatga

SEQ ID NO: 4477792 - DNA, 15 bp, Homo sapiens
acgtataaatatcag

SEQ ID NO: 4477793 - DNA, 17 bp, Homo sapiens
acgtattgctgtgtctc

SEQ ID NO: 4477794 - DNA, 16 bp, Homo sapiens
acgtatttaatagcaa

SEQ ID NO: 4477795 - DNA, 19 bp, Homo sapiens
acgtcactttttggccatg

SEQ ID NO: 4477796 - DNA, 23 bp, Homo sapiens
acgtcaggccctgactcctctgg

SEQ ID NO: 4477797 - DNA, 16 bp, Homo sapiens
acgtcaggcctggcct

SEQ ID NO: 4477798 - DNA, 22 bp, Homo sapiens
acgtccaggtccgtagctcccc

SEQ ID NO: 4477799 - DNA, 24 bp, Homo sapiens
acgtccaggtccgtagctcccctg

SEQ ID NO: 4477800 - DNA, 19 bp, Homo sapiens
acgtcccagcatccctgga

SEQ ID NO: 4477801 - DNA, 23 bp, Homo sapiens
acgtcccctccgccgtgccggcg

SEQ ID NO: 4477802 - DNA, 19 bp, Homo sapiens
acgtcccgctgctgtgctc

SEQ ID NO: 4477803 - DNA, 21 bp, Homo sapiens
acgtctagatgggttcttagc

SEQ ID NO: 4477804 - DNA, 17 bp, Homo sapiens
acgtctagctatgctgt

SEQ ID NO: 4477805 - DNA, 20 bp, Homo sapiens
acgtctgtcaggggcttgga

SEQ ID NO: 4477806 - DNA, 22 bp, Homo sapiens
acgtgaggggggggtgggtgag

SEQ ID NO: 4477807 - DNA, 14 bp, Homo sapiens
acgtgccaccatga

SEQ ID NO: 4477808 - DNA, 18 bp, Homo sapiens
acgtgccagatataactg

SEQ ID NO: 4477809 - DNA, 19 bp, Homo sapiens
acgtgccagatataactgt

SEQ ID NO: 4477810 - DNA, 20 bp, Homo sapiens
acgtgcctgtagtcccagct

SEQ ID NO: 4477811 - DNA, 17 bp, Homo sapiens
acgtgctaggggatgag

SEQ ID NO: 4477812 - DNA, 15 bp, Homo sapiens
acgtggagagctggt

SEQ ID NO: 4477813 - DNA, 18 bp, Homo sapiens
acgtggagagctggtgcc

SEQ ID NO: 4477814 - DNA, 21 bp, Homo sapiens
acgtgggcttaaagcagaagc

SEQ ID NO: 4477815 - DNA, 12 bp, Homo sapiens
acgtggtgggac

SEQ ID NO: 4477816 - DNA, 14 bp, Homo sapiens
acgttatatattgt

SEQ ID NO: 4477817 - DNA, 15 bp, Homo sapiens
acgttatatattgta

SEQ ID NO: 4477818 - DNA, 16 bp, Homo sapiens
acgttatatattgtat

SEQ ID NO: 4477819 - DNA, 17 bp, Homo sapiens
acgttcatcacctgcta

SEQ ID NO: 4477820 - DNA, 14 bp, Homo sapiens
acgttccagccggc

SEQ ID NO: 4477821 - DNA, 20 bp, Homo sapiens
acgttctgttaatttagtaa

SEQ ID NO: 4477822 - DNA, 13 bp, Homo sapiens
acgttgctgagcc

SEQ ID NO: 4477823 - DNA, 21 bp, Homo sapiens
acgttgctgagccagctgcag

SEQ ID NO: 4477824 - DNA, 13 bp, Homo sapiens
acgtttaaagttc

SEQ ID NO: 4477825 - DNA, 18 bp, Homo sapiens
acgtttaaagttctgtgt

SEQ ID NO: 4477826 - DNA, 19 bp, Homo sapiens
acgtttaagccaaaacaat

SEQ ID NO: 4477827 - DNA, 17 bp, Homo sapiens
acgtttaatcccagcac

SEQ ID NO: 4477828 - DNA, 20 bp, Homo sapiens
acgtttccccaataaagcct

SEQ ID NO: 4477829 - DNA, 22 bp, Homo sapiens
acgtttccccaataaagccttt

SEQ ID NO: 4477830 - DNA, 11 bp, Homo sapiens
acgtttgaagt

SEQ ID NO: 4477831 - DNA, 16 bp, Homo sapiens
acgtttgacaaacaca

SEQ ID NO: 4477832 - DNA, 21 bp, Homo sapiens
acgtttttcttcttgggcccg

SEQ ID NO: 4477833 - DNA, 17 bp, Homo sapiens
acgttttttcctcagtg

SEQ ID NO: 4477834 - DNA, 18 bp, Homo sapiens
acgttttttcctcagtgc

SEQ ID NO: 4477835 - DNA, 14 bp, Homo sapiens
actaaaatgttcta

SEQ ID NO: 4477836 - DNA, 18 bp, Homo sapiens
actaaaattatgttactg

SEQ ID NO: 4477837 - DNA, 13 bp, Homo sapiens
actaaaatttaca

SEQ ID NO: 4477838 - DNA, 16 bp, Homo sapiens
actaaaatttacacat

SEQ ID NO: 4477839 - DNA, 11 bp, Homo sapiens
actaaacagaa

SEQ ID NO: 4477840 - DNA, 20 bp, Homo sapiens
actaaaccccatacctggaa

SEQ ID NO: 4477841 - DNA, 17 bp, Homo sapiens
actaaactcttaccata

SEQ ID NO: 4477842 - DNA, 19 bp, Homo sapiens
actaaactttttttctgta

SEQ ID NO: 4477843 - DNA, 21 bp, Homo sapiens
actaaataacacagatattgt

SEQ ID NO: 4477844 - DNA, 19 bp, Homo sapiens
actaaatatatattatgca

SEQ ID NO: 4477845 - DNA, 13 bp, Homo sapiens
actaaatctttta

SEQ ID NO: 4477846 - DNA, 18 bp, Homo sapiens
actaaattcaaagaagta

SEQ ID NO: 4477847 - DNA, 13 bp, Homo sapiens
actaaattttaaa

SEQ ID NO: 4477848 - DNA, 15 bp, Homo sapiens
actaaattttaaagc

SEQ ID NO: 4477849 - DNA, 14 bp, Homo sapiens
actaacaatgcctt

SEQ ID NO: 4477850 - DNA, 18 bp, Homo sapiens
actaacagctacaaactt

SEQ ID NO: 4477851 - DNA, 22 bp, Homo sapiens
actaacagctacaaacttttaa

SEQ ID NO: 4477852 - DNA, 17 bp, Homo sapiens
actaaccatccccaact

SEQ ID NO: 4477853 - DNA, 14 bp, Homo sapiens
actaaccccgggcg

SEQ ID NO: 4477854 - DNA, 20 bp, Homo sapiens
actaactcatagattgcaaa

SEQ ID NO: 4477855 - DNA, 17 bp, Homo sapiens
actaacttgacttttaa

SEQ ID NO: 4477856 - DNA, 13 bp, Homo sapiens
actaactttggtc

SEQ ID NO: 4477857 - DNA, 14 bp, Homo sapiens
actaagacaagaac

SEQ ID NO: 4477858 - DNA, 17 bp, Homo sapiens
actaagattcttttaaa

SEQ ID NO: 4477859 - DNA, 21 bp, Homo sapiens
actaagattcttttaaattag

SEQ ID NO: 4477860 - DNA, 18 bp, Homo sapiens
actaagccaggcctggct

SEQ ID NO: 4477861 - DNA, 19 bp, Homo sapiens
actaagcctacctgctctc

SEQ ID NO: 4477862 - DNA, 15 bp, Homo sapiens
actaaggccttttat

SEQ ID NO: 4477863 - DNA, 21 bp, Homo sapiens
actaaggccttttatgtaatt

SEQ ID NO: 4477864 - DNA, 13 bp, Homo sapiens
actaataaaataa

SEQ ID NO: 4477865 - DNA, 14 bp, Homo sapiens
actaataaagtgcc

SEQ ID NO: 4477866 - DNA, 21 bp, Homo sapiens
actaatatatgaaataagtaa

SEQ ID NO: 4477867 - DNA, 19 bp, Homo sapiens
actaatattttatgtgaga

SEQ ID NO: 4477868 - DNA, 21 bp, Homo sapiens
actaatcacaaactgaatgac

SEQ ID NO: 4477869 - DNA, 17 bp, Homo sapiens
actaattatactacttt

SEQ ID NO: 4477870 - DNA, 22 bp, Homo sapiens
actaattattattttaaaatat

SEQ ID NO: 4477871 - DNA, 13 bp, Homo sapiens
actaattccacac

SEQ ID NO: 4477872 - DNA, 20 bp, Homo sapiens
actaatttcaaaatgctttt

SEQ ID NO: 4477873 - DNA, 19 bp, Homo sapiens
actacaaatcaagtatttg

SEQ ID NO: 4477874 - DNA, 16 bp, Homo sapiens
actacacaatacagta

SEQ ID NO: 4477875 - DNA, 17 bp, Homo sapiens
actacacaatacagtat

SEQ ID NO: 4477876 - DNA, 13 bp, Homo sapiens
actacacacagta

SEQ ID NO: 4477877 - DNA, 12 bp, Homo sapiens
actacacatttg

SEQ ID NO: 4477878 - DNA, 17 bp, Homo sapiens
actacacatttgaaaca

SEQ ID NO: 4477879 - DNA, 23 bp, Homo sapiens
actacaccatgtttgagctcaga

SEQ ID NO: 4477880 - DNA, 13 bp, Homo sapiens
actacacctggct

SEQ ID NO: 4477881 - DNA, 20 bp, Homo sapiens
actacatgagaacaaacaga

SEQ ID NO: 4477882 - DNA, 21 bp, Homo sapiens
actacatgcataaactaaaaa

SEQ ID NO: 4477883 - DNA, 18 bp, Homo sapiens
actaccctattctctctt

SEQ ID NO: 4477884 - DNA, 15 bp, Homo sapiens
actacccttaattac

SEQ ID NO: 4477885 - DNA, 17 bp, Homo sapiens
actacgcactggacagc

SEQ ID NO: 4477886 - DNA, 16 bp, Homo sapiens
actacgtcttaagtca

SEQ ID NO: 4477887 - DNA, 14 bp, Homo sapiens
accttgctctcctc

SEQ ID NO: 4477888 - DNA, 17 bp, Homo sapiens
accttgctctcctcatc

SEQ ID NO: 4477889 - DNA, 19 bp, Homo sapiens
accttgctctcctcatctc

SEQ ID NO: 4477890 - DNA, 17 bp, Homo sapiens
accttgcttttgcttct

SEQ ID NO: 4477891 - DNA, 21 bp, Homo sapiens
accttggaaacagttggcact

SEQ ID NO: 4477892 - DNA, 22 bp, Homo sapiens
accttggaaacagttggcactg

SEQ ID NO: 4477893 - DNA, 18 bp, Homo sapiens
accttgtggataagtggc

SEQ ID NO: 4477894 - DNA, 23 bp, Homo sapiens
accttgttcctgtaaaatccatt

SEQ ID NO: 4477895 - DNA, 17 bp, Homo sapiens
accttgtttattagcat

SEQ ID NO: 4477896 - DNA, 15 bp, Homo sapiens
acctttaaaaatgta

SEQ ID NO: 4477897 - DNA, 16 bp, Homo sapiens
acctttaaaaatgtat

SEQ ID NO: 4477898 - DNA, 20 bp, Homo sapiens
acctttaaaaatgtataatg

SEQ ID NO: 4477899 - DNA, 15 bp, Homo sapiens
acctttaaaataata

SEQ ID NO: 4477900 - DNA, 18 bp, Homo sapiens
acctttatatctgtcttt

SEQ ID NO: 4477901 - DNA, 20 bp, Homo sapiens
acctttatttattaaacttc

SEQ ID NO: 4477902 - DNA, 21 bp, Homo sapiens
acctttcccacctctctcccc

SEQ ID NO: 4477903 - DNA, 13 bp, Homo sapiens
acctttccctcac

SEQ ID NO: 4477904 - DNA, 19 bp, Homo sapiens
acctttccgctgtcgcccc

SEQ ID NO: 4477905 - DNA, 14 bp, Homo sapiens
acctttctgaggag

SEQ ID NO: 4477906 - DNA, 11 bp, Homo sapiens
acctttgctat

SEQ ID NO: 4477907 - DNA, 18 bp, Homo sapiens
acctttgctatgtaaggg

SEQ ID NO: 4477908 - DNA, 14 bp, Homo sapiens
accttttaaaattg

SEQ ID NO: 4477909 - DNA, 16 bp, Homo sapiens
accttttaaaattgaa

SEQ ID NO: 4477910 - DNA, 19 bp, Homo sapiens
accttttaccagcttttaa

SEQ ID NO: 4477911 - DNA, 20 bp, Homo sapiens
accttttatgaatcaaatat

SEQ ID NO: 4477912 - DNA, 20 bp, Homo sapiens
accttttatgtagtaattga

SEQ ID NO: 4477913 - DNA, 13 bp, Homo sapiens
accttttattata

SEQ ID NO: 4477914 - DNA, 20 bp, Homo sapiens
accttttattgacacagaaa

SEQ ID NO: 4477915 - DNA, 20 bp, Homo sapiens
accttttctgtggctggctc

SEQ ID NO: 4477916 - DNA, 13 bp, Homo sapiens
accttttggggga

SEQ ID NO: 4477917 - DNA, 17 bp, Homo sapiens
accttttgggggagggc

SEQ ID NO: 4477918 - DNA, 23 bp, Homo sapiens
acctttttatatttaaaaaatta

SEQ ID NO: 4477919 - DNA, 18 bp, Homo sapiens
accttttttttttttcca

SEQ ID NO: 4477920 - DNA, 18 bp, Homo sapiens
acgaaagtatttactttt

SEQ ID NO: 4477921 - DNA, 22 bp, Homo sapiens
acgaaagtatttactttttaaa

SEQ ID NO: 4477922 - DNA, 15 bp, Homo sapiens
acgaacccacctgct

SEQ ID NO: 4477923 - DNA, 22 bp, Homo sapiens
acgaatacttttgccctttgat

SEQ ID NO: 4477924 - DNA, 17 bp, Homo sapiens
acgaatcttatttttcc

SEQ ID NO: 4477925 - DNA, 21 bp, Homo sapiens
acgaatcttatttttcctgtc

SEQ ID NO: 4477926 - DNA, 23 bp, Homo sapiens
acgaatcttatttttcctgtcct

SEQ ID NO: 4477927 - DNA, 21 bp, Homo sapiens
acgacaaagctgctaaatctc

SEQ ID NO: 4477928 - DNA, 19 bp, Homo sapiens
acgacacatatacatatga

SEQ ID NO: 4477929 - DNA, 18 bp, Homo sapiens
acgactgcgggagccaga

SEQ ID NO: 4477930 - DNA, 19 bp, Homo sapiens
acgactgcgggagccagac

SEQ ID NO: 4477931 - DNA, 19 bp, Homo sapiens
acgactgtatattgctaag

SEQ ID NO: 4477932 - DNA, 19 bp, Homo sapiens
acgactgttgtacaagctc

SEQ ID NO: 4477933 - DNA, 22 bp, Homo sapiens
acgagacaacagcacacaggca

SEQ ID NO: 4477934 - DNA, 20 bp, Homo sapiens
acgagcaggctactgtcagc

SEQ ID NO: 4477935 - DNA, 14 bp, Homo sapiens
acgagccacaagct

SEQ ID NO: 4477936 - DNA, 15 bp, Homo sapiens
acgagccacaagctg

SEQ ID NO: 4477937 - DNA, 17 bp, Homo sapiens
acgagccacaagctgca

SEQ ID NO: 4477938 - DNA, 22 bp, Homo sapiens
acgaggaatctgtgggtctggg

SEQ ID NO: 4477939 - DNA, 19 bp, Homo sapiens
acgaggcattcgggccggt

SEQ ID NO: 4477940 - DNA, 23 bp, Homo sapiens
acgaggccctcgggcccagcccc

SEQ ID NO: 4477941 - DNA, 20 bp, Homo sapiens
acgagggaggaacacctgat

SEQ ID NO: 4477942 - DNA, 19 bp, Homo sapiens
acgatcaagttgttgactg

SEQ ID NO: 4477943 - DNA, 13 bp, Homo sapiens
acgatcaggagga

SEQ ID NO: 4477944 - DNA, 15 bp, Homo sapiens
acgatccttcaaagt

SEQ ID NO: 4477945 - DNA, 14 bp, Homo sapiens
acgatgtggccctg

SEQ ID NO: 4477946 - DNA, 16 bp, Homo sapiens
acgatgtggccctggc

SEQ ID NO: 4477947 - DNA, 18 bp, Homo sapiens
acgatgtggccctggcct

SEQ ID NO: 4477948 - DNA, 13 bp, Homo sapiens
acgattttgcaca

SEQ ID NO: 4477949 - DNA, 23 bp, Homo sapiens
acgcaatgaaaagtcgttttcca

SEQ ID NO: 4477950 - DNA, 16 bp, Homo sapiens
acgcacacagctgagc

SEQ ID NO: 4477951 - DNA, 21 bp, Homo sapiens
acgcaccaatcagcactctgt

SEQ ID NO: 4477952 - DNA, 22 bp, Homo sapiens
acgcaccaccatgccaggctaa

SEQ ID NO: 4477953 - DNA, 16 bp, Homo sapiens
acgcacccgtatctgc

SEQ ID NO: 4477954 - DNA, 19 bp, Homo sapiens
acgcacccgtatctgccct

SEQ ID NO: 4477955 - DNA, 20 bp, Homo sapiens
acgcagccctagagcctgcc

SEQ ID NO: 4477956 - DNA, 14 bp, Homo sapiens
acgcaggaggagaa

SEQ ID NO: 4477957 - DNA, 21 bp, Homo sapiens
acgcaggaggagaaaagaaat

SEQ ID NO: 4477958 - DNA, 19 bp, Homo sapiens
acgcaggcccccaggtgcc

SEQ ID NO: 4477959 - DNA, 22 bp, Homo sapiens
acgcaggcccccaggtgccagt

SEQ ID NO: 4477960 - DNA, 18 bp, Homo sapiens
acgcagttgattccttga

SEQ ID NO: 4477961 - DNA, 18 bp, Homo sapiens
acgcagttgtgtggccca

SEQ ID NO: 4477962 - DNA, 22 bp, Homo sapiens
acgcattttggtttttcctcat

SEQ ID NO: 4477963 - DNA, 20 bp, Homo sapiens
acgccaatgttatgccagct

SEQ ID NO: 4477964 - DNA, 15 bp, Homo sapiens
acgccactcatttca

SEQ ID NO: 4477965 - DNA, 16 bp, Homo sapiens
acgccactcatttcat

SEQ ID NO: 4477966 - DNA, 17 bp, Homo sapiens
acgccactcatttcatc

SEQ ID NO: 4477967 - DNA, 13 bp, Homo sapiens
acgccaggccagc

SEQ ID NO: 4477968 - DNA, 20 bp, Homo sapiens
acgccattgtactccagcct

SEQ ID NO: 4477969 - DNA, 15 bp, Homo sapiens
acgcccctcccaagc

SEQ ID NO: 4477970 - DNA, 16 bp, Homo sapiens
acgcccctcccaagcg

SEQ ID NO: 4477971 - DNA, 14 bp, Homo sapiens
acgccctccctgct

SEQ ID NO: 4477972 - DNA, 21 bp, Homo sapiens
acgccctctatcatggtgaaa

SEQ ID NO: 4477973 - DNA, 16 bp, Homo sapiens
acgccggccacacccc

SEQ ID NO: 4477974 - DNA, 20 bp, Homo sapiens
acgccggggacagaggcctg

SEQ ID NO: 4477975 - DNA, 14 bp, Homo sapiens
acgcctcctggcca

SEQ ID NO: 4477976 - DNA, 13 bp, Homo sapiens
acgcctgaggaac

SEQ ID NO: 4477977 - DNA, 15 bp, Homo sapiens
acgcctgaggcaatt

SEQ ID NO: 4477978 - DNA, 14 bp, Homo sapiens
acgcctgcaggaga

SEQ ID NO: 4477979 - DNA, 21 bp, Homo sapiens
acgcctgtaatcccagcactt

SEQ ID NO: 4477980 - DNA, 19 bp, Homo sapiens
acgcctgtaatcccagcag

SEQ ID NO: 4477981 - DNA, 16 bp, Homo sapiens
acgcgacttccacaaa

SEQ ID NO: 4477982 - DNA, 18 bp, Homo sapiens
acgcggcgggaggcccac

SEQ ID NO: 4477983 - DNA, 20 bp, Homo sapiens
acgcggcgggaggcccacgg

SEQ ID NO: 4477984 - DNA, 12 bp, Homo sapiens
acgcgtatttac

SEQ ID NO: 4477985 - DNA, 21 bp, Homo sapiens
acgctaataagtgacaaataa

SEQ ID NO: 4477986 - DNA, 22 bp, Homo sapiens
acgctcagccccaggccagctg

SEQ ID NO: 4477987 - DNA, 17 bp, Homo sapiens
acgctccagctgccccg

SEQ ID NO: 4477988 - DNA, 19 bp, Homo sapiens
acgctccctccccctgccc

SEQ ID NO: 4477989 - DNA, 22 bp, Homo sapiens
acgctctaaggcaggatgtggc

SEQ ID NO: 4477990 - DNA, 23 bp, Homo sapiens
acgctgaactgacaatgaaggga

SEQ ID NO: 4477991 - DNA, 16 bp, Homo sapiens
acgctgcagaccccag

SEQ ID NO: 4477992 - DNA, 17 bp, Homo sapiens
acgctgcagaccccagg

SEQ ID NO: 4477993 - DNA, 22 bp, Homo sapiens
acgctgccgctgccgctgcacc

SEQ ID NO: 4477994 - DNA, 22 bp, Homo sapiens
acgctggcgacacactccgtcc

SEQ ID NO: 4477995 - DNA, 12 bp, Homo sapiens
acgctgggccta

SEQ ID NO: 4477996 - DNA, 14 bp, Homo sapiens
acgctgtcctctcg

SEQ ID NO: 4477997 - DNA, 21 bp, Homo sapiens
acgcttaaaggtgtcttcctc

SEQ ID NO: 4477998 - DNA, 20 bp, Homo sapiens
acgcttaacctttccgctgt

SEQ ID NO: 4477999 - DNA, 17 bp, Homo sapiens
acgcttctgagcagggg

SEQ ID NO: 4478000 - DNA, 16 bp, Homo sapiens
acgctttgattcatag

SEQ ID NO: 4478001 - DNA, 14 bp, Homo sapiens
acgctttgtttact

SEQ ID NO: 4478002 - DNA, 17 bp, Homo sapiens
acgctttttgaaaaagc

SEQ ID NO: 4478003 - DNA, 13 bp, Homo sapiens
acggaaaatgctt

SEQ ID NO: 4478004 - DNA, 15 bp, Homo sapiens
acggaaagtgctgtc

SEQ ID NO: 4478005 - DNA, 21 bp, Homo sapiens
acggaaagtttttagaatgtt

SEQ ID NO: 4478006 - DNA, 20 bp, Homo sapiens
acctgaaaacactgtgcaca

SEQ ID NO: 4478007 - DNA, 18 bp, Homo sapiens
acctgaaagaacatacat

SEQ ID NO: 4478008 - DNA, 19 bp, Homo sapiens
acctgacacaccaggcgct

SEQ ID NO: 4478009 - DNA, 16 bp, Homo sapiens
acctgacactcccttg

SEQ ID NO: 4478010 - DNA, 17 bp, Homo sapiens
acctgaccaacatggag

SEQ ID NO: 4478011 - DNA, 16 bp, Homo sapiens
acctgacccctgctca

SEQ ID NO: 4478012 - DNA, 14 bp, Homo sapiens
acctgaccgtgggc

SEQ ID NO: 4478013 - DNA, 18 bp, Homo sapiens
acctgaccgtgggcgggg

SEQ ID NO: 4478014 - DNA, 12 bp, Homo sapiens
acctgagatctg

SEQ ID NO: 4478015 - DNA, 18 bp, Homo sapiens
acctgagcgggagtcagg

SEQ ID NO: 4478016 - DNA, 20 bp, Homo sapiens
acctgagcgggagtcaggga

SEQ ID NO: 4478017 - DNA, 12 bp, Homo sapiens
acctgagctaaa

SEQ ID NO: 4478018 - DNA, 20 bp, Homo sapiens
acctgagctagaagctggag

SEQ ID NO: 4478019 - DNA, 19 bp, Homo sapiens
acctgaggtcaggagttca

SEQ ID NO: 4478020 - DNA, 20 bp, Homo sapiens
acctgattgatcacacagtg

SEQ ID NO: 4478021 - DNA, 14 bp, Homo sapiens
acctgattggccac

SEQ ID NO: 4478022 - DNA, 17 bp, Homo sapiens
acctgattttttttcct

SEQ ID NO: 4478023 - DNA, 15 bp, Homo sapiens
acctgcaaaaaatac

SEQ ID NO: 4478024 - DNA, 17 bp, Homo sapiens
acctgcaagttgctctg

SEQ ID NO: 4478025 - DNA, 21 bp, Homo sapiens
acctgcaagttgctctgacct

SEQ ID NO: 4478026 - DNA, 20 bp, Homo sapiens
acctgcacactgtcctatta

SEQ ID NO: 4478027 - DNA, 14 bp, Homo sapiens
acctgcacctcccc

SEQ ID NO: 4478028 - DNA, 15 bp, Homo sapiens
acctgcacctccccc

SEQ ID NO: 4478029 - DNA, 17 bp, Homo sapiens
acctgcacctcccccca

SEQ ID NO: 4478030 - DNA, 19 bp, Homo sapiens
acctgcagcggctgccctc

SEQ ID NO: 4478031 - DNA, 22 bp, Homo sapiens
acctgcagcggctgccctctgg

SEQ ID NO: 4478032 - DNA, 20 bp, Homo sapiens
acctgccacaaaccaccagg

SEQ ID NO: 4478033 - DNA, 21 bp, Homo sapiens
acctgccactcacacagccag

SEQ ID NO: 4478034 - DNA, 13 bp, Homo sapiens
acctgccagccac

SEQ ID NO: 4478035 - DNA, 21 bp, Homo sapiens
acctgccagccactgtcaccg

SEQ ID NO: 4478036 - DNA, 20 bp, Homo sapiens
acctgccaggcaggggtggg

SEQ ID NO: 4478037 - DNA, 22 bp, Homo sapiens
acctgccccgtgtgtgtggccg

SEQ ID NO: 4478038 - DNA, 17 bp, Homo sapiens
acctgccctcaagggtg

SEQ ID NO: 4478039 - DNA, 21 bp, Homo sapiens
acctgcccttttttctgcctc

SEQ ID NO: 4478040 - DNA, 17 bp, Homo sapiens
acctgccgacctcgtcc

SEQ ID NO: 4478041 - DNA, 18 bp, Homo sapiens
acctgccgacctcgtcct

SEQ ID NO: 4478042 - DNA, 16 bp, Homo sapiens
acctgccgagagtcca

SEQ ID NO: 4478043 - DNA, 23 bp, Homo sapiens
acctgcctcggcctcccaaagtg

SEQ ID NO: 4478044 - DNA, 16 bp, Homo sapiens
acctgccttctaccct

SEQ ID NO: 4478045 - DNA, 15 bp, Homo sapiens
acctgcggaaggagg

SEQ ID NO: 4478046 - DNA, 13 bp, Homo sapiens
acctgctcaggcg

SEQ ID NO: 4478047 - DNA, 15 bp, Homo sapiens
acctgctcaggcgtc

SEQ ID NO: 4478048 - DNA, 21 bp, Homo sapiens
acctgctcccagtcctgcctg

SEQ ID NO: 4478049 - DNA, 13 bp, Homo sapiens
acctgctctgtcc

SEQ ID NO: 4478050 - DNA, 17 bp, Homo sapiens
acctggaaactgctcag

SEQ ID NO: 4478051 - DNA, 16 bp, Homo sapiens
acctggaacatctcac

SEQ ID NO: 4478052 - DNA, 21 bp, Homo sapiens
acctggaagatcatggacctg

SEQ ID NO: 4478053 - DNA, 19 bp, Homo sapiens
acctggaatctacaagcca

SEQ ID NO: 4478054 - DNA, 22 bp, Homo sapiens
acctggacttaagcatctggct

SEQ ID NO: 4478055 - DNA, 13 bp, Homo sapiens
acctggagaccag

SEQ ID NO: 4478056 - DNA, 20 bp, Homo sapiens
acctggagagccagaacctg

SEQ ID NO: 4478057 - DNA, 22 bp, Homo sapiens
acctggagagccagaacctgga

SEQ ID NO: 4478058 - DNA, 16 bp, Homo sapiens
acctggagatgcagct

SEQ ID NO: 4478059 - DNA, 21 bp, Homo sapiens
acctggagggctagaacctag

SEQ ID NO: 4478060 - DNA, 20 bp, Homo sapiens
acctggagggctagaacctg

SEQ ID NO: 4478061 - DNA, 14 bp, Homo sapiens
acctggaggggcta

SEQ ID NO: 4478062 - DNA, 22 bp, Homo sapiens
acctggagtggatctatttaca

SEQ ID NO: 4478063 - DNA, 22 bp, Homo sapiens
acctggattgtgcctaatgtgt

SEQ ID NO: 4478064 - DNA, 16 bp, Homo sapiens
acctggcaaaggaccc

SEQ ID NO: 4478065 - DNA, 16 bp, Homo sapiens
acctggcactgggagg

SEQ ID NO: 4478066 - DNA, 21 bp, Homo sapiens
acctggcatggtgcagggaga

SEQ ID NO: 4478067 - DNA, 22 bp, Homo sapiens
acctggcctgagcctcctgaag

SEQ ID NO: 4478068 - DNA, 14 bp, Homo sapiens
acctggctctgtgg

SEQ ID NO: 4478069 - DNA, 21 bp, Homo sapiens
acctggctgaggttcctctgc

SEQ ID NO: 4478070 - DNA, 22 bp, Homo sapiens
acctgggaggcggatgttgaag

SEQ ID NO: 4478071 - DNA, 23 bp, Homo sapiens
acctgggcactccgcgccgatgc

SEQ ID NO: 4478072 - DNA, 23 bp, Homo sapiens
acctggggagtggttaggcagca

SEQ ID NO: 4478073 - DNA, 16 bp, Homo sapiens
acctggtgctgcctct

SEQ ID NO: 4478074 - DNA, 12 bp, Homo sapiens
acctggtggcac

SEQ ID NO: 4478075 - DNA, 20 bp, Homo sapiens
acctggtggcaccagatgca

SEQ ID NO: 4478076 - DNA, 11 bp, Homo sapiens
acctgtaaaac

SEQ ID NO: 4478077 - DNA, 14 bp, Homo sapiens
acctgtaaaacttt

SEQ ID NO: 4478078 - DNA, 20 bp, Homo sapiens
acctgtaaaactttatttta

SEQ ID NO: 4478079 - DNA, 22 bp, Homo sapiens
acctgtaaaactttattttata

SEQ ID NO: 4478080 - DNA, 12 bp, Homo sapiens
acctgtaaatta

SEQ ID NO: 4478081 - DNA, 18 bp, Homo sapiens
acctgtaaattattttaa

SEQ ID NO: 4478082 - DNA, 17 bp, Homo sapiens
acctgtaacttttgtaa

SEQ ID NO: 4478083 - DNA, 18 bp, Homo sapiens
acctgtatactcttgaat

SEQ ID NO: 4478084 - DNA, 18 bp, Homo sapiens
acctgtatttaagcaaat

SEQ ID NO: 4478085 - DNA, 18 bp, Homo sapiens
acctgtcaaaaattttga

SEQ ID NO: 4478086 - DNA, 15 bp, Homo sapiens
acctgtcagaataaa

SEQ ID NO: 4478087 - DNA, 23 bp, Homo sapiens
acctgtcagaataaaaatgtggt

SEQ ID NO: 4478088 - DNA, 22 bp, Homo sapiens
acctgtcctaaggaaccttcct

SEQ ID NO: 4478089 - DNA, 14 bp, Homo sapiens
acctgtcctcctgg

SEQ ID NO: 4478090 - DNA, 15 bp, Homo sapiens
acctgtcctcctggt

SEQ ID NO: 4478091 - DNA, 18 bp, Homo sapiens
acctgtcctcctggtggg

SEQ ID NO: 4478092 - DNA, 20 bp, Homo sapiens
acctgtggaacataaaaagg

SEQ ID NO: 4478093 - DNA, 14 bp, Homo sapiens
acctgtggggcctg

SEQ ID NO: 4478094 - DNA, 20 bp, Homo sapiens
acctgtgtttttttctaaaa

SEQ ID NO: 4478095 - DNA, 17 bp, Homo sapiens
acctgttacctactttg

SEQ ID NO: 4478096 - DNA, 22 bp, Homo sapiens
accttaaaattgatattatatt

SEQ ID NO: 4478097 - DNA, 12 bp, Homo sapiens
accttaaattaa

SEQ ID NO: 4478098 - DNA, 13 bp, Homo sapiens
accttaaattaaa

SEQ ID NO: 4478099 - DNA, 22 bp, Homo sapiens
accttaaattaaacaatttatt

SEQ ID NO: 4478100 - DNA, 18 bp, Homo sapiens
accttaggctttgtatga

SEQ ID NO: 4478101 - DNA, 19 bp, Homo sapiens
accttaggttctttctgaa

SEQ ID NO: 4478102 - DNA, 15 bp, Homo sapiens
accttatcctgcatt

SEQ ID NO: 4478103 - DNA, 13 bp, Homo sapiens
accttatttattt

SEQ ID NO: 4478104 - DNA, 17 bp, Homo sapiens
accttatttatttttgt

SEQ ID NO: 4478105 - DNA, 19 bp, Homo sapiens
accttatttatttttgtgt

SEQ ID NO: 4478106 - DNA, 19 bp, Homo sapiens
accttcaaactagggccaa

SEQ ID NO: 4478107 - DNA, 16 bp, Homo sapiens
accttcaacccagtgg

SEQ ID NO: 4478108 - DNA, 20 bp, Homo sapiens
accttcacgattaactgtga

SEQ ID NO: 4478109 - DNA, 19 bp, Homo sapiens
accttcagttatgattttt

SEQ ID NO: 4478110 - DNA, 20 bp, Homo sapiens
accttcattctgagaccaaa

SEQ ID NO: 4478111 - DNA, 15 bp, Homo sapiens
accttcatttaaaaa

SEQ ID NO: 4478112 - DNA, 14 bp, Homo sapiens
accttccacccagt

SEQ ID NO: 4478113 - DNA, 15 bp, Homo sapiens
accttcctcctgcag

SEQ ID NO: 4478114 - DNA, 23 bp, Homo sapiens
accttcctgggaggacaggcagg

SEQ ID NO: 4478115 - DNA, 19 bp, Homo sapiens
accttcctgtccctgaggt

SEQ ID NO: 4478116 - DNA, 22 bp, Homo sapiens
accttcctgtgggtgttctttc

SEQ ID NO: 4478117 - DNA, 24 bp, Homo sapiens
accttcctgtgggtgttctttcct

SEQ ID NO: 4478118 - DNA, 20 bp, Homo sapiens
accttctatgtattagtgtc

SEQ ID NO: 4478119 - DNA, 17 bp, Homo sapiens
accttctttctggactg

SEQ ID NO: 4478120 - DNA, 18 bp, Homo sapiens
accttctttctggactgg

SEQ ID NO: 4478121 - DNA, 20 bp, Homo sapiens
accttctttctggactggcg

SEQ ID NO: 4478122 - DNA, 22 bp, Homo sapiens
accttgaaaaaaaacagtggat

SEQ ID NO: 4478123 - DNA, 23 bp, Homo sapiens
accttgaaaaaaaacagtggatc

SEQ ID NO: 4478124 - DNA, 13 bp, Homo sapiens
accttgccttgaa

SEQ ID NO: 4478125 - DNA, 16 bp, Homo sapiens
acctaaccccagggca

SEQ ID NO: 4478126 - DNA, 19 bp, Homo sapiens
acctaaccccagggcactg

SEQ ID NO: 4478127 - DNA, 16 bp, Homo sapiens
acctaacccctttcct

SEQ ID NO: 4478128 - DNA, 15 bp, Homo sapiens
acctaacttatggac

SEQ ID NO: 4478129 - DNA, 14 bp, Homo sapiens
acctaagcacttct

SEQ ID NO: 4478130 - DNA, 20 bp, Homo sapiens
acctaatcaccatgtaagca

SEQ ID NO: 4478131 - DNA, 11 bp, Homo sapiens
acctaatccaa

SEQ ID NO: 4478132 - DNA, 22 bp, Homo sapiens
acctaatgaaagtgatgacata

SEQ ID NO: 4478133 - DNA, 18 bp, Homo sapiens
acctaatttcattttagt

SEQ ID NO: 4478134 - DNA, 17 bp, Homo sapiens
acctacagacaaggagg

SEQ ID NO: 4478135 - DNA, 17 bp, Homo sapiens
acctacagttttaactg

SEQ ID NO: 4478136 - DNA, 16 bp, Homo sapiens
acctaccaggacagaa

SEQ ID NO: 4478137 - DNA, 18 bp, Homo sapiens
acctagactctccctgta

SEQ ID NO: 4478138 - DNA, 12 bp, Homo sapiens
acctagattttt

SEQ ID NO: 4478139 - DNA, 17 bp, Homo sapiens
acctagctacactgagc

SEQ ID NO: 4478140 - DNA, 18 bp, Homo sapiens
acctaggccactcctcca

SEQ ID NO: 4478141 - DNA, 12 bp, Homo sapiens
acctaggctagg

SEQ ID NO: 4478142 - DNA, 17 bp, Homo sapiens
acctaggctagggtggg

SEQ ID NO: 4478143 - DNA, 14 bp, Homo sapiens
acctagtactgccc

SEQ ID NO: 4478144 - DNA, 19 bp, Homo sapiens
acctatgagtgagaatatg

SEQ ID NO: 4478145 - DNA, 19 bp, Homo sapiens
acctatgatattttctgtg

SEQ ID NO: 4478146 - DNA, 12 bp, Homo sapiens
acctattaggtg

SEQ ID NO: 4478147 - DNA, 12 bp, Homo sapiens
acctatttaatg

SEQ ID NO: 4478148 - DNA, 12 bp, Homo sapiens
acctatttccat

SEQ ID NO: 4478149 - DNA, 20 bp, Homo sapiens
acctatttttgacatggaaa

SEQ ID NO: 4478150 - DNA, 16 bp, Homo sapiens
acctcaacaagaagaa

SEQ ID NO: 4478151 - DNA, 15 bp, Homo sapiens
acctcaacctgtaaa

SEQ ID NO: 4478152 - DNA, 16 bp, Homo sapiens
acctcaactgcctact

SEQ ID NO: 4478153 - DNA, 22 bp, Homo sapiens
acctcaactgcctactccaaaa

SEQ ID NO: 4478154 - DNA, 14 bp, Homo sapiens
acctcaagaccccc

SEQ ID NO: 4478155 - DNA, 13 bp, Homo sapiens
acctcaagccatc

SEQ ID NO: 4478156 - DNA, 14 bp, Homo sapiens
acctcaagccccat

SEQ ID NO: 4478157 - DNA, 22 bp, Homo sapiens
acctcaagtaataggcatttta

SEQ ID NO: 4478158 - DNA, 14 bp, Homo sapiens
acctcaccttcctg

SEQ ID NO: 4478159 - DNA, 17 bp, Homo sapiens
acctcaccttcctgtgg

SEQ ID NO: 4478160 - DNA, 19 bp, Homo sapiens
acctcaccttcctgtgggt

SEQ ID NO: 4478161 - DNA, 16 bp, Homo sapiens
acctcactatggtatg

SEQ ID NO: 4478162 - DNA, 14 bp, Homo sapiens
acctcactctttat

SEQ ID NO: 4478163 - DNA, 17 bp, Homo sapiens
acctcactctttatagt

SEQ ID NO: 4478164 - DNA, 18 bp, Homo sapiens
acctcagaggccacttgc

SEQ ID NO: 4478165 - DNA, 17 bp, Homo sapiens
acctcagattcttcatt

SEQ ID NO: 4478166 - DNA, 15 bp, Homo sapiens
acctcagcactgtgg

SEQ ID NO: 4478167 - DNA, 14 bp, Homo sapiens
acctcagccatgag

SEQ ID NO: 4478168 - DNA, 22 bp, Homo sapiens
acctcagccatgaggagttgct

SEQ ID NO: 4478169 - DNA, 17 bp, Homo sapiens
acctcaggaaagaatag

SEQ ID NO: 4478170 - DNA, 23 bp, Homo sapiens
acctcaggaaagaatagaaagaa

SEQ ID NO: 4478171 - DNA, 12 bp, Homo sapiens
acctcaggctcc

SEQ ID NO: 4478172 - DNA, 14 bp, Homo sapiens
acctcaggctccta

SEQ ID NO: 4478173 - DNA, 13 bp, Homo sapiens
acctcagggctcc

SEQ ID NO: 4478174 - DNA, 12 bp, Homo sapiens
acctcagggctg

SEQ ID NO: 4478175 - DNA, 17 bp, Homo sapiens
acctcagggctgtccca

SEQ ID NO: 4478176 - DNA, 18 bp, Homo sapiens
acctcagggctgtcccag

SEQ ID NO: 4478177 - DNA, 20 bp, Homo sapiens
acctcagggctgtcccagcc

SEQ ID NO: 4478178 - DNA, 21 bp, Homo sapiens
acctcagggctgtcccagccc

SEQ ID NO: 4478179 - DNA, 22 bp, Homo sapiens
acctcagggctgtcccagcccc

SEQ ID NO: 4478180 - DNA, 16 bp, Homo sapiens
acctcaggtgccaacc

SEQ ID NO: 4478181 - DNA, 15 bp, Homo sapiens
acctcagtaatttag

SEQ ID NO: 4478182 - DNA, 19 bp, Homo sapiens
acctcagtggatcttcaga

SEQ ID NO: 4478183 - DNA, 16 bp, Homo sapiens
acctcagttcccttgg

SEQ ID NO: 4478184 - DNA, 17 bp, Homo sapiens
acctcagttcccttggc

SEQ ID NO: 4478185 - DNA, 22 bp, Homo sapiens
acctcagttcccttggcctcag

SEQ ID NO: 4478186 - DNA, 23 bp, Homo sapiens
acctcagttcccttggcctcaga

SEQ ID NO: 4478187 - DNA, 18 bp, Homo sapiens
acctcagttttatgcccc

SEQ ID NO: 4478188 - DNA, 13 bp, Homo sapiens
acctcatcctgct

SEQ ID NO: 4478189 - DNA, 16 bp, Homo sapiens
acctcatctttctcct

SEQ ID NO: 4478190 - DNA, 23 bp, Homo sapiens
acctcatgcccaccccctgccct

SEQ ID NO: 4478191 - DNA, 17 bp, Homo sapiens
acctccaagcatttcat

SEQ ID NO: 4478192 - DNA, 23 bp, Homo sapiens
acctccaataaagtgccttctgg

SEQ ID NO: 4478193 - DNA, 14 bp, Homo sapiens
acctccacatcctc

SEQ ID NO: 4478194 - DNA, 15 bp, Homo sapiens
acctccagcagactc

SEQ ID NO: 4478195 - DNA, 14 bp, Homo sapiens
acctccccaaagca

SEQ ID NO: 4478196 - DNA, 17 bp, Homo sapiens
acctccccccactgcag

SEQ ID NO: 4478197 - DNA, 22 bp, Homo sapiens
acctccccccactgcaggcccc

SEQ ID NO: 4478198 - DNA, 16 bp, Homo sapiens
acctccccctgcgccc

SEQ ID NO: 4478199 - DNA, 21 bp, Homo sapiens
acctccccctgcgccccgcac

SEQ ID NO: 4478200 - DNA, 21 bp, Homo sapiens
acctccccctttcacactgga

SEQ ID NO: 4478201 - DNA, 20 bp, Homo sapiens
acctcccctatccacccagc

SEQ ID NO: 4478202 - DNA, 21 bp, Homo sapiens
acctcccctatccacccagcc

SEQ ID NO: 4478203 - DNA, 21 bp, Homo sapiens
acctcccttaagcagcaacag

SEQ ID NO: 4478204 - DNA, 14 bp, Homo sapiens
acctcctaccctcc

SEQ ID NO: 4478205 - DNA, 17 bp, Homo sapiens
acctcctaccctcccac

SEQ ID NO: 4478206 - DNA, 16 bp, Homo sapiens
acctcctgcccaggag

SEQ ID NO: 4478207 - DNA, 17 bp, Homo sapiens
acctcctgcccaggaga

SEQ ID NO: 4478208 - DNA, 18 bp, Homo sapiens
acctcctgcccaggagag

SEQ ID NO: 4478209 - DNA, 21 bp, Homo sapiens
acctcctgcccaggagagcca

SEQ ID NO: 4478210 - DNA, 19 bp, Homo sapiens
acctccttagccctgtctg

SEQ ID NO: 4478211 - DNA, 14 bp, Homo sapiens
acctcgagatgggt

SEQ ID NO: 4478212 - DNA, 15 bp, Homo sapiens
acctcgagtactgtg

SEQ ID NO: 4478213 - DNA, 18 bp, Homo sapiens
acctcgagtactgtgggc

SEQ ID NO: 4478214 - DNA, 18 bp, Homo sapiens
acctcgctggactctcag

SEQ ID NO: 4478215 - DNA, 18 bp, Homo sapiens
acctcggagacgggaccc

SEQ ID NO: 4478216 - DNA, 15 bp, Homo sapiens
acctcgggcctgctg

SEQ ID NO: 4478217 - DNA, 20 bp, Homo sapiens
acctcggggacaccagagct

SEQ ID NO: 4478218 - DNA, 21 bp, Homo sapiens
acctcggggacaccagagctg

SEQ ID NO: 4478219 - DNA, 19 bp, Homo sapiens
acctcgtcaagagcatgca

SEQ ID NO: 4478220 - DNA, 14 bp, Homo sapiens
acctcgtcctcccc

SEQ ID NO: 4478221 - DNA, 16 bp, Homo sapiens
acctctcagctgctgg

SEQ ID NO: 4478222 - DNA, 21 bp, Homo sapiens
acctctcagctgctggatgac

SEQ ID NO: 4478223 - DNA, 16 bp, Homo sapiens
acctctccatcctgct

SEQ ID NO: 4478224 - DNA, 16 bp, Homo sapiens
acctctcctgccctgt

SEQ ID NO: 4478225 - DNA, 20 bp, Homo sapiens
acctctctctaagtttagaa

SEQ ID NO: 4478226 - DNA, 17 bp, Homo sapiens
acctctgatttattttg

SEQ ID NO: 4478227 - DNA, 15 bp, Homo sapiens
acctctgcctcaatg

SEQ ID NO: 4478228 - DNA, 15 bp, Homo sapiens
acctctgcttttatc

SEQ ID NO: 4478229 - DNA, 24 bp, Homo sapiens
acctctgcttttatctcagatgtt

SEQ ID NO: 4478230 - DNA, 16 bp, Homo sapiens
acctctggactggcta

SEQ ID NO: 4478231 - DNA, 15 bp, Homo sapiens
acctcttcacctgac

SEQ ID NO: 4478232 - DNA, 15 bp, Homo sapiens
acctcttcagaggcc

SEQ ID NO: 4478233 - DNA, 17 bp, Homo sapiens
acctcttcagaggccct

SEQ ID NO: 4478234 - DNA, 18 bp, Homo sapiens
acctcttcagaggccctc

SEQ ID NO: 4478235 - DNA, 13 bp, Homo sapiens
acctcttccccag

SEQ ID NO: 4478236 - DNA, 22 bp, Homo sapiens
acctcttccccagaaaggagac

SEQ ID NO: 4478237 - DNA, 12 bp, Homo sapiens
acctcttccgac

SEQ ID NO: 4478238 - DNA, 22 bp, Homo sapiens
acctcttccgactctttctgag

SEQ ID NO: 4478239 - DNA, 19 bp, Homo sapiens
acctcttctaccctcatca

SEQ ID NO: 4478240 - DNA, 11 bp, Homo sapiens
acctcttgcct

SEQ ID NO: 4478241 - DNA, 22 bp, Homo sapiens
acctcttttgcttgccaaagta

SEQ ID NO: 4478242 - DNA, 14 bp, Homo sapiens
acctctttttcctc

SEQ ID NO: 4478243 - DNA, 15 bp, Homo sapiens
acctctttttcctcc

SEQ ID NO: 4478244 - DNA, 16 bp, Homo sapiens
acctctttttcctcct

SEQ ID NO: 4478245 - DNA, 19 bp, Homo sapiens
acctgaaaacactgtgcac

SEQ ID NO: 4478246 - DNA, 23 bp, Homo sapiens
acccctgcctccaccctctgagc

SEQ ID NO: 4478247 - DNA, 23 bp, Homo sapiens
acccctgcctgttggcaggccca

SEQ ID NO: 4478248 - DNA, 22 bp, Homo sapiens
acccctgctcccattcctccct

SEQ ID NO: 4478249 - DNA, 16 bp, Homo sapiens
acccctggttctcatc

SEQ ID NO: 4478250 - DNA, 16 bp, Homo sapiens
accccttagcctccct

SEQ ID NO: 4478251 - DNA, 18 bp, Homo sapiens
accccttagcctccctga

SEQ ID NO: 4478252 - DNA, 12 bp, Homo sapiens
acccctttcctg

SEQ ID NO: 4478253 - DNA, 23 bp, Homo sapiens
acccgattccaccaaatgtgctt

SEQ ID NO: 4478254 - DNA, 19 bp, Homo sapiens
acccgcccacccgccttgt

SEQ ID NO: 4478255 - DNA, 13 bp, Homo sapiens
acccgccctcagg

SEQ ID NO: 4478256 - DNA, 14 bp, Homo sapiens
acccgcccttccga

SEQ ID NO: 4478257 - DNA, 21 bp, Homo sapiens
acccgcctcgacctccccacc

SEQ ID NO: 4478258 - DNA, 15 bp, Homo sapiens
acccgccttgtgaga

SEQ ID NO: 4478259 - DNA, 21 bp, Homo sapiens
acccggcccggctgagccctg

SEQ ID NO: 4478260 - DNA, 22 bp, Homo sapiens
acccggcccggctgagccctgc

SEQ ID NO: 4478261 - DNA, 15 bp, Homo sapiens
acccgggaggcagag

SEQ ID NO: 4478262 - DNA, 14 bp, Homo sapiens
acccgggggacaga

SEQ ID NO: 4478263 - DNA, 15 bp, Homo sapiens
acccgtatctgccct

SEQ ID NO: 4478264 - DNA, 13 bp, Homo sapiens
acccgtccccaca

SEQ ID NO: 4478265 - DNA, 15 bp, Homo sapiens
acccgtccccacacg

SEQ ID NO: 4478266 - DNA, 18 bp, Homo sapiens
acccgtccccacacgagg

SEQ ID NO: 4478267 - DNA, 17 bp, Homo sapiens
acccgtctccagctgct

SEQ ID NO: 4478268 - DNA, 18 bp, Homo sapiens
acccgtggggtgctgccc

SEQ ID NO: 4478269 - DNA, 16 bp, Homo sapiens
accctaaatcttgact

SEQ ID NO: 4478270 - DNA, 13 bp, Homo sapiens
accctaaccaagt

SEQ ID NO: 4478271 - DNA, 16 bp, Homo sapiens
accctaaccaagttcc

SEQ ID NO: 4478272 - DNA, 14 bp, Homo sapiens
accctaagatgaag

SEQ ID NO: 4478273 - DNA, 15 bp, Homo sapiens
accctatctgtgatt

SEQ ID NO: 4478274 - DNA, 14 bp, Homo sapiens
accctatgggtcta

SEQ ID NO: 4478275 - DNA, 13 bp, Homo sapiens
accctcagagcct

SEQ ID NO: 4478276 - DNA, 14 bp, Homo sapiens
accctcagcagctc

SEQ ID NO: 4478277 - DNA, 23 bp, Homo sapiens
accctcagcagctctggctctgc

SEQ ID NO: 4478278 - DNA, 18 bp, Homo sapiens
accctcagggagcctccc

SEQ ID NO: 4478279 - DNA, 13 bp, Homo sapiens
accctcatctttc

SEQ ID NO: 4478280 - DNA, 19 bp, Homo sapiens
accctcatctttcttccaa

SEQ ID NO: 4478281 - DNA, 16 bp, Homo sapiens
accctcattgtgtttc

SEQ ID NO: 4478282 - DNA, 11 bp, Homo sapiens
accctccctcc

SEQ ID NO: 4478283 - DNA, 17 bp, Homo sapiens
accctccctccctaccc

SEQ ID NO: 4478284 - DNA, 12 bp, Homo sapiens
accctccctgga

SEQ ID NO: 4478285 - DNA, 23 bp, Homo sapiens
accctcctgacccccatgtaaat

SEQ ID NO: 4478286 - DNA, 20 bp, Homo sapiens
accctcctgtcttcccaggg

SEQ ID NO: 4478287 - DNA, 23 bp, Homo sapiens
accctcctgtcttcccagggtag

SEQ ID NO: 4478288 - DNA, 19 bp, Homo sapiens
accctcctgttgcacccag

SEQ ID NO: 4478289 - DNA, 22 bp, Homo sapiens
accctcctgttgcacccagccc

SEQ ID NO: 4478290 - DNA, 20 bp, Homo sapiens
accctctcctgggggtggca

SEQ ID NO: 4478291 - DNA, 13 bp, Homo sapiens
accctctgagctt

SEQ ID NO: 4478292 - DNA, 21 bp, Homo sapiens
accctctgagctttgcatgtt

SEQ ID NO: 4478293 - DNA, 18 bp, Homo sapiens
accctcttgcccatcctg

SEQ ID NO: 4478294 - DNA, 21 bp, Homo sapiens
accctgacaaattttaattat

SEQ ID NO: 4478295 - DNA, 21 bp, Homo sapiens
accctgacctccgcccctgcc

SEQ ID NO: 4478296 - DNA, 17 bp, Homo sapiens
accctgaggccctgggc

SEQ ID NO: 4478297 - DNA, 22 bp, Homo sapiens
accctgccaagactcctcaggc

SEQ ID NO: 4478298 - DNA, 13 bp, Homo sapiens
accctgccatgga

SEQ ID NO: 4478299 - DNA, 14 bp, Homo sapiens
accctgccatggaa

SEQ ID NO: 4478300 - DNA, 17 bp, Homo sapiens
accctgcccagagctga

SEQ ID NO: 4478301 - DNA, 18 bp, Homo sapiens
accctgcccagagctgag

SEQ ID NO: 4478302 - DNA, 14 bp, Homo sapiens
accctgcccccact

SEQ ID NO: 4478303 - DNA, 14 bp, Homo sapiens
accctgcctccctt

SEQ ID NO: 4478304 - DNA, 14 bp, Homo sapiens
accctgcttaggat

SEQ ID NO: 4478305 - DNA, 23 bp, Homo sapiens
accctgcttcattgacctctact

SEQ ID NO: 4478306 - DNA, 11 bp, Homo sapiens
accctggcctg

SEQ ID NO: 4478307 - DNA, 16 bp, Homo sapiens
accctggcctgaactg

SEQ ID NO: 4478308 - DNA, 20 bp, Homo sapiens
accctggcctgaactgagga

SEQ ID NO: 4478309 - DNA, 15 bp, Homo sapiens
accctgggagagaag

SEQ ID NO: 4478310 - DNA, 17 bp, Homo sapiens
accctgggcagtgagtg

SEQ ID NO: 4478311 - DNA, 23 bp, Homo sapiens
accctggggcgtgcagcagggaa

SEQ ID NO: 4478312 - DNA, 18 bp, Homo sapiens
accctgggtgggctctgt

SEQ ID NO: 4478313 - DNA, 18 bp, Homo sapiens
accctgtccggcccagtg

SEQ ID NO: 4478314 - DNA, 21 bp, Homo sapiens
accctgtccggcccagtgcca

SEQ ID NO: 4478315 - DNA, 23 bp, Homo sapiens
accctgtcctgcacaccctgggc

SEQ ID NO: 4478316 - DNA, 19 bp, Homo sapiens
accctgtgacatggtgcct

SEQ ID NO: 4478317 - DNA, 14 bp, Homo sapiens
accctgtgcaggag

SEQ ID NO: 4478318 - DNA, 19 bp, Homo sapiens
accctgttcccaagcaaag

SEQ ID NO: 4478319 - DNA, 15 bp, Homo sapiens
acccttaactgacat

SEQ ID NO: 4478320 - DNA, 17 bp, Homo sapiens
acccttaggatggggct

SEQ ID NO: 4478321 - DNA, 15 bp, Homo sapiens
acccttattgctgtc

SEQ ID NO: 4478322 - DNA, 19 bp, Homo sapiens
acccttattgctgtcctgg

SEQ ID NO: 4478323 - DNA, 17 bp, Homo sapiens
acccttccacagctggc

SEQ ID NO: 4478324 - DNA, 23 bp, Homo sapiens
acccttcccggcccccggccaag

SEQ ID NO: 4478325 - DNA, 20 bp, Homo sapiens
acccttccgacaggagcact

SEQ ID NO: 4478326 - DNA, 18 bp, Homo sapiens
acccttcctgagctttat

SEQ ID NO: 4478327 - DNA, 20 bp, Homo sapiens
acccttctgggtccagggag

SEQ ID NO: 4478328 - DNA, 21 bp, Homo sapiens
acccttgcatccattgttgtg

SEQ ID NO: 4478329 - DNA, 21 bp, Homo sapiens
acccttggaaaacaaaagttt

SEQ ID NO: 4478330 - DNA, 14 bp, Homo sapiens
accctttccttcct

SEQ ID NO: 4478331 - DNA, 21 bp, Homo sapiens
accctttccttccttccctgg

SEQ ID NO: 4478332 - DNA, 23 bp, Homo sapiens
accctttccttccttccctggct

SEQ ID NO: 4478333 - DNA, 23 bp, Homo sapiens
accctttcttttgaatcaatctg

SEQ ID NO: 4478334 - DNA, 12 bp, Homo sapiens
acccttttccag

SEQ ID NO: 4478335 - DNA, 16 bp, Homo sapiens
acccttttcccccttc

SEQ ID NO: 4478336 - DNA, 17 bp, Homo sapiens
acccttttcccccttcc

SEQ ID NO: 4478337 - DNA, 18 bp, Homo sapiens
acccttttcccccttccc

SEQ ID NO: 4478338 - DNA, 19 bp, Homo sapiens
acccttttcccccttccca

SEQ ID NO: 4478339 - DNA, 20 bp, Homo sapiens
accgaagtggactggcccct

SEQ ID NO: 4478340 - DNA, 14 bp, Homo sapiens
accgactttcccca

SEQ ID NO: 4478341 - DNA, 18 bp, Homo sapiens
accgagactcagcctctg

SEQ ID NO: 4478342 - DNA, 21 bp, Homo sapiens
accgagactcagcctctgctg

SEQ ID NO: 4478343 - DNA, 23 bp, Homo sapiens
accgagagtagccgagagcctgc

SEQ ID NO: 4478344 - DNA, 21 bp, Homo sapiens
accgccacacacacaggagca

SEQ ID NO: 4478345 - DNA, 20 bp, Homo sapiens
accgccacgtcccagcatcc

SEQ ID NO: 4478346 - DNA, 17 bp, Homo sapiens
accgccttgcccagcct

SEQ ID NO: 4478347 - DNA, 14 bp, Homo sapiens
accgcgtcccagct

SEQ ID NO: 4478348 - DNA, 17 bp, Homo sapiens
accgcgtcccagctccc

SEQ ID NO: 4478349 - DNA, 21 bp, Homo sapiens
accgcgtcccagctcccctct

SEQ ID NO: 4478350 - DNA, 15 bp, Homo sapiens
accgctaaaagaaac

SEQ ID NO: 4478351 - DNA, 16 bp, Homo sapiens
accgctaaaagaaact

SEQ ID NO: 4478352 - DNA, 22 bp, Homo sapiens
accgctctcttttctgtacttc

SEQ ID NO: 4478353 - DNA, 21 bp, Homo sapiens
accgctgcctaagtggctgct

SEQ ID NO: 4478354 - DNA, 18 bp, Homo sapiens
accgctggcccttagaga

SEQ ID NO: 4478355 - DNA, 20 bp, Homo sapiens
accgggagcctccccctcag

SEQ ID NO: 4478356 - DNA, 16 bp, Homo sapiens
accggtcagtgccttt

SEQ ID NO: 4478357 - DNA, 17 bp, Homo sapiens
accggtgctgcaggagt

SEQ ID NO: 4478358 - DNA, 16 bp, Homo sapiens
accgtctacatttcac

SEQ ID NO: 4478359 - DNA, 16 bp, Homo sapiens
accgtgaaccagaggg

SEQ ID NO: 4478360 - DNA, 18 bp, Homo sapiens
accgtgaccgtttgctat

SEQ ID NO: 4478361 - DNA, 12 bp, Homo sapiens
accgtgcctggc

SEQ ID NO: 4478362 - DNA, 14 bp, Homo sapiens
accgttttgtattg

SEQ ID NO: 4478363 - DNA, 12 bp, Homo sapiens
acctaaagaaaa

SEQ ID NO: 4478364 - DNA, 17 bp, Homo sapiens
acctaaagaaaaacaaa

SEQ ID NO: 4478365 - DNA, 17 bp, Homo sapiens
acctaaagcaagcctga

SEQ ID NO: 4478366 - DNA, 17 bp, Homo sapiens
acccactttgtaatttt

SEQ ID NO: 4478367 - DNA, 19 bp, Homo sapiens
acccactttgtaatttttg

SEQ ID NO: 4478368 - DNA, 23 bp, Homo sapiens
acccagaatggagcctgctctcc

SEQ ID NO: 4478369 - DNA, 13 bp, Homo sapiens
acccagacccagt

SEQ ID NO: 4478370 - DNA, 15 bp, Homo sapiens
acccagacccagtgg

SEQ ID NO: 4478371 - DNA, 17 bp, Homo sapiens
acccagagaagcccctt

SEQ ID NO: 4478372 - DNA, 18 bp, Homo sapiens
acccagagaagccccttc

SEQ ID NO: 4478373 - DNA, 19 bp, Homo sapiens
acccagagaagccccttcc

SEQ ID NO: 4478374 - DNA, 24 bp, Homo sapiens
acccagagcaccccctgctccacc

SEQ ID NO: 4478375 - DNA, 23 bp, Homo sapiens
acccagaggggacgctgaggaag

SEQ ID NO: 4478376 - DNA, 21 bp, Homo sapiens
acccagaggtccaggtcccag

SEQ ID NO: 4478377 - DNA, 22 bp, Homo sapiens
acccagaggtccaggtcccagc

SEQ ID NO: 4478378 - DNA, 14 bp, Homo sapiens
acccagcccattct

SEQ ID NO: 4478379 - DNA, 13 bp, Homo sapiens
acccagccctggt

SEQ ID NO: 4478380 - DNA, 15 bp, Homo sapiens
acccagccctggtct

SEQ ID NO: 4478381 - DNA, 11 bp, Homo sapiens
acccaggaagg

SEQ ID NO: 4478382 - DNA, 14 bp, Homo sapiens
acccaggaggtgga

SEQ ID NO: 4478383 - DNA, 15 bp, Homo sapiens
acccaggagtccaga

SEQ ID NO: 4478384 - DNA, 18 bp, Homo sapiens
acccaggagtccagaccc

SEQ ID NO: 4478385 - DNA, 17 bp, Homo sapiens
acccaggcaggtgcagg

SEQ ID NO: 4478386 - DNA, 20 bp, Homo sapiens
acccaggctggagtgcggtg

SEQ ID NO: 4478387 - DNA, 24 bp, Homo sapiens
acccagggcctgacttgagccact

SEQ ID NO: 4478388 - DNA, 20 bp, Homo sapiens
acccaggggaaggccctgag

SEQ ID NO: 4478389 - DNA, 19 bp, Homo sapiens
acccaggggtccaggcccc

SEQ ID NO: 4478390 - DNA, 13 bp, Homo sapiens
acccaggtgggtc

SEQ ID NO: 4478391 - DNA, 14 bp, Homo sapiens
acccaggtgggtcc

SEQ ID NO: 4478392 - DNA, 16 bp, Homo sapiens
acccagtcctgcccgc

SEQ ID NO: 4478393 - DNA, 15 bp, Homo sapiens
acccagtctcagaca

SEQ ID NO: 4478394 - DNA, 14 bp, Homo sapiens
acccagtgggaaga

SEQ ID NO: 4478395 - DNA, 18 bp, Homo sapiens
acccagtgggtctgggat

SEQ ID NO: 4478396 - DNA, 18 bp, Homo sapiens
acccagttgcctccaggg

SEQ ID NO: 4478397 - DNA, 16 bp, Homo sapiens
acccatacaatgtatg

SEQ ID NO: 4478398 - DNA, 21 bp, Homo sapiens
acccatacaatgtatgtacaa

SEQ ID NO: 4478399 - DNA, 16 bp, Homo sapiens
acccatattgtaaaac

SEQ ID NO: 4478400 - DNA, 15 bp, Homo sapiens
acccatcagcactct

SEQ ID NO: 4478401 - DNA, 17 bp, Homo sapiens
acccatcagtgctctgt

SEQ ID NO: 4478402 - DNA, 13 bp, Homo sapiens
acccatctgtagt

SEQ ID NO: 4478403 - DNA, 20 bp, Homo sapiens
acccatgaaattgaccccca

SEQ ID NO: 4478404 - DNA, 16 bp, Homo sapiens
acccatgccagagagg

SEQ ID NO: 4478405 - DNA, 23 bp, Homo sapiens
acccatgcgccttcgtgcctgag

SEQ ID NO: 4478406 - DNA, 14 bp, Homo sapiens
acccatgggctctg

SEQ ID NO: 4478407 - DNA, 16 bp, Homo sapiens
acccatgtaaccactg

SEQ ID NO: 4478408 - DNA, 23 bp, Homo sapiens
acccatgtcaccggtcagtgcct

SEQ ID NO: 4478409 - DNA, 17 bp, Homo sapiens
accccaaaccccagccc

SEQ ID NO: 4478410 - DNA, 14 bp, Homo sapiens
accccaactctccc

SEQ ID NO: 4478411 - DNA, 15 bp, Homo sapiens
accccaagactccca

SEQ ID NO: 4478412 - DNA, 16 bp, Homo sapiens
accccaagaggaagtt

SEQ ID NO: 4478413 - DNA, 20 bp, Homo sapiens
accccaatttcggatttttt

SEQ ID NO: 4478414 - DNA, 15 bp, Homo sapiens
accccacagctgggg

SEQ ID NO: 4478415 - DNA, 15 bp, Homo sapiens
accccaccctccctg

SEQ ID NO: 4478416 - DNA, 19 bp, Homo sapiens
accccagactagatgtagt

SEQ ID NO: 4478417 - DNA, 13 bp, Homo sapiens
accccagaggcag

SEQ ID NO: 4478418 - DNA, 23 bp, Homo sapiens
accccagaggcagaggttgcagt

SEQ ID NO: 4478419 - DNA, 20 bp, Homo sapiens
accccaggacgccactcatt

SEQ ID NO: 4478420 - DNA, 21 bp, Homo sapiens
accccaggacgccactcattt

SEQ ID NO: 4478421 - DNA, 15 bp, Homo sapiens
accccagggcactgc

SEQ ID NO: 4478422 - DNA, 21 bp, Homo sapiens
accccagggtcataagtgggg

SEQ ID NO: 4478423 - DNA, 16 bp, Homo sapiens
accccagtggccactc

SEQ ID NO: 4478424 - DNA, 16 bp, Homo sapiens
accccagttcctagca

SEQ ID NO: 4478425 - DNA, 23 bp, Homo sapiens
accccagttcctagcactgcccc

SEQ ID NO: 4478426 - DNA, 16 bp, Homo sapiens
accccatgccaaagct

SEQ ID NO: 4478427 - DNA, 22 bp, Homo sapiens
acccccaaatacatcctgcgga

SEQ ID NO: 4478428 - DNA, 14 bp, Homo sapiens
acccccaaatttaa

SEQ ID NO: 4478429 - DNA, 17 bp, Homo sapiens
acccccaacttcaccac

SEQ ID NO: 4478430 - DNA, 14 bp, Homo sapiens
acccccaccccaca

SEQ ID NO: 4478431 - DNA, 17 bp, Homo sapiens
acccccaccccacactt

SEQ ID NO: 4478432 - DNA, 12 bp, Homo sapiens
acccccagcact

SEQ ID NO: 4478433 - DNA, 13 bp, Homo sapiens
acccccagcccac

SEQ ID NO: 4478434 - DNA, 20 bp, Homo sapiens
acccccagcccacagagcct

SEQ ID NO: 4478435 - DNA, 13 bp, Homo sapiens
acccccagccccg

SEQ ID NO: 4478436 - DNA, 20 bp, Homo sapiens
acccccagccccgactccag

SEQ ID NO: 4478437 - DNA, 21 bp, Homo sapiens
acccccagccccgactccagc

SEQ ID NO: 4478438 - DNA, 14 bp, Homo sapiens
acccccagccttgc

SEQ ID NO: 4478439 - DNA, 14 bp, Homo sapiens
acccccatgctgcc

SEQ ID NO: 4478440 - DNA, 14 bp, Homo sapiens
acccccatgtaaat

SEQ ID NO: 4478441 - DNA, 16 bp, Homo sapiens
acccccatgtaaatat

SEQ ID NO: 4478442 - DNA, 17 bp, Homo sapiens
acccccctcccagacag

SEQ ID NO: 4478443 - DNA, 19 bp, Homo sapiens
acccccctctctttctctg

SEQ ID NO: 4478444 - DNA, 16 bp, Homo sapiens
acccccgaggggaggg

SEQ ID NO: 4478445 - DNA, 17 bp, Homo sapiens
acccccgaggggagggc

SEQ ID NO: 4478446 - DNA, 16 bp, Homo sapiens
accccctcccaccccc

SEQ ID NO: 4478447 - DNA, 12 bp, Homo sapiens
accccctcccca

SEQ ID NO: 4478448 - DNA, 13 bp, Homo sapiens
accccctgccctg

SEQ ID NO: 4478449 - DNA, 15 bp, Homo sapiens
accccctgccctgca

SEQ ID NO: 4478450 - DNA, 22 bp, Homo sapiens
accccctgtcccattctagatc

SEQ ID NO: 4478451 - DNA, 13 bp, Homo sapiens
accccctgtgcct

SEQ ID NO: 4478452 - DNA, 16 bp, Homo sapiens
acccccttcagtgccc

SEQ ID NO: 4478453 - DNA, 18 bp, Homo sapiens
acccccttctccatccac

SEQ ID NO: 4478454 - DNA, 17 bp, Homo sapiens
acccccttttcccttca

SEQ ID NO: 4478455 - DNA, 21 bp, Homo sapiens
accccgggctctctgctgtac

SEQ ID NO: 4478456 - DNA, 15 bp, Homo sapiens
accccggggaccctg

SEQ ID NO: 4478457 - DNA, 22 bp, Homo sapiens
accccgtctggggttcagcccc

SEQ ID NO: 4478458 - DNA, 14 bp, Homo sapiens
acccctaaactcca

SEQ ID NO: 4478459 - DNA, 16 bp, Homo sapiens
acccctaaactccagg

SEQ ID NO: 4478460 - DNA, 14 bp, Homo sapiens
acccctaagagact

SEQ ID NO: 4478461 - DNA, 17 bp, Homo sapiens
acccctcagccccagcc

SEQ ID NO: 4478462 - DNA, 21 bp, Homo sapiens
acccctcagccccagcccaga

SEQ ID NO: 4478463 - DNA, 13 bp, Homo sapiens
acccctccactgc

SEQ ID NO: 4478464 - DNA, 14 bp, Homo sapiens
acccctccactgct

SEQ ID NO: 4478465 - DNA, 16 bp, Homo sapiens
acccctccctttctcc

SEQ ID NO: 4478466 - DNA, 18 bp, Homo sapiens
acccctccctttctcccc

SEQ ID NO: 4478467 - DNA, 19 bp, Homo sapiens
acccctccctttctcccct

SEQ ID NO: 4478468 - DNA, 23 bp, Homo sapiens
acccctccctttctcccctgccc

SEQ ID NO: 4478469 - DNA, 16 bp, Homo sapiens
acccctccggccccgt

SEQ ID NO: 4478470 - DNA, 11 bp, Homo sapiens
acccctcctcc

SEQ ID NO: 4478471 - DNA, 12 bp, Homo sapiens
acccctcctccc

SEQ ID NO: 4478472 - DNA, 13 bp, Homo sapiens
acccctcctccct

SEQ ID NO: 4478473 - DNA, 22 bp, Homo sapiens
acccctcctccctcagactcag

SEQ ID NO: 4478474 - DNA, 12 bp, Homo sapiens
acccctccttcc

SEQ ID NO: 4478475 - DNA, 16 bp, Homo sapiens
acccctccttccccag

SEQ ID NO: 4478476 - DNA, 22 bp, Homo sapiens
acccctccttccccagacccag

SEQ ID NO: 4478477 - DNA, 23 bp, Homo sapiens
acccctccttccccagacccaga

SEQ ID NO: 4478478 - DNA, 16 bp, Homo sapiens
acccctcgccccagcc

SEQ ID NO: 4478479 - DNA, 13 bp, Homo sapiens
acccctctgcccc

SEQ ID NO: 4478480 - DNA, 19 bp, Homo sapiens
acccctctgcccctgcagc

SEQ ID NO: 4478481 - DNA, 23 bp, Homo sapiens
acccctgagttgggcagccagga

SEQ ID NO: 4478482 - DNA, 10 bp, Homo sapiens
acccctgccc

SEQ ID NO: 4478483 - DNA, 13 bp, Homo sapiens
acccctgccccca

SEQ ID NO: 4478484 - DNA, 15 bp, Homo sapiens
acccctgcccccagg

SEQ ID NO: 4478485 - DNA, 13 bp, Homo sapiens
acccctgcctcca

SEQ ID NO: 4478486 - DNA, 15 bp, Homo sapiens
acccctgcctccacc

SEQ ID NO: 4478487 - DNA, 15 bp, Homo sapiens
accaggactccctcc

SEQ ID NO: 4478488 - DNA, 14 bp, Homo sapiens
accaggagaaccac

SEQ ID NO: 4478489 - DNA, 18 bp, Homo sapiens
accaggagaaccactaca

SEQ ID NO: 4478490 - DNA, 19 bp, Homo sapiens
accaggagaaccactacat

SEQ ID NO: 4478491 - DNA, 17 bp, Homo sapiens
accaggaggattgcctt

SEQ ID NO: 4478492 - DNA, 18 bp, Homo sapiens
accaggatttattttgag

SEQ ID NO: 4478493 - DNA, 17 bp, Homo sapiens
accaggcaccaaaagaa

SEQ ID NO: 4478494 - DNA, 21 bp, Homo sapiens
accaggcaccaaaagaagtaa

SEQ ID NO: 4478495 - DNA, 22 bp, Homo sapiens
accaggcacgaacccacctgct

SEQ ID NO: 4478496 - DNA, 19 bp, Homo sapiens
accaggccagagcaaacag

SEQ ID NO: 4478497 - DNA, 16 bp, Homo sapiens
accaggccagctcagg

SEQ ID NO: 4478498 - DNA, 21 bp, Homo sapiens
accaggccccagcctccaggc

SEQ ID NO: 4478499 - DNA, 19 bp, Homo sapiens
accaggctggagtgcagtg

SEQ ID NO: 4478500 - DNA, 19 bp, Homo sapiens
accagggatgctgggctgg

SEQ ID NO: 4478501 - DNA, 20 bp, Homo sapiens
accagggatgctgggctggg

SEQ ID NO: 4478502 - DNA, 21 bp, Homo sapiens
accagggatgctgggctgggc

SEQ ID NO: 4478503 - DNA, 14 bp, Homo sapiens
accagggcgcaagc

SEQ ID NO: 4478504 - DNA, 17 bp, Homo sapiens
accagggctccaggagc

SEQ ID NO: 4478505 - DNA, 12 bp, Homo sapiens
accaggggccaa

SEQ ID NO: 4478506 - DNA, 21 bp, Homo sapiens
accagggtccttttgacactg

SEQ ID NO: 4478507 - DNA, 13 bp, Homo sapiens
accagggtggcca

SEQ ID NO: 4478508 - DNA, 14 bp, Homo sapiens
accagggtggccac

SEQ ID NO: 4478509 - DNA, 20 bp, Homo sapiens
accagggtggccacacaggc

SEQ ID NO: 4478510 - DNA, 22 bp, Homo sapiens
accagggtggccacacaggcag

SEQ ID NO: 4478511 - DNA, 20 bp, Homo sapiens
accagggttgaccccagagg

SEQ ID NO: 4478512 - DNA, 13 bp, Homo sapiens
accaggtgccttt

SEQ ID NO: 4478513 - DNA, 14 bp, Homo sapiens
accagtacttctaa

SEQ ID NO: 4478514 - DNA, 17 bp, Homo sapiens
accagtacttctaagag

SEQ ID NO: 4478515 - DNA, 14 bp, Homo sapiens
accagtagcttccc

SEQ ID NO: 4478516 - DNA, 23 bp, Homo sapiens
accagtagcttcccaaaaacagc

SEQ ID NO: 4478517 - DNA, 20 bp, Homo sapiens
accagtaggggcttataata

SEQ ID NO: 4478518 - DNA, 17 bp, Homo sapiens
accagtatttaagcttt

SEQ ID NO: 4478519 - DNA, 18 bp, Homo sapiens
accagtatttttgctgct

SEQ ID NO: 4478520 - DNA, 17 bp, Homo sapiens
accagtcccatgctggc

SEQ ID NO: 4478521 - DNA, 17 bp, Homo sapiens
accagtctcctcactct

SEQ ID NO: 4478522 - DNA, 20 bp, Homo sapiens
accagtctcctcactctgtc

SEQ ID NO: 4478523 - DNA, 10 bp, Homo sapiens
accagtgcct

SEQ ID NO: 4478524 - DNA, 23 bp, Homo sapiens
accagtggcgttgttgcatgttt

SEQ ID NO: 4478525 - DNA, 11 bp, Homo sapiens
accagtgtgaa

SEQ ID NO: 4478526 - DNA, 17 bp, Homo sapiens
accagtgttcctgaagc

SEQ ID NO: 4478527 - DNA, 21 bp, Homo sapiens
accagtgttcctgaagctgct

SEQ ID NO: 4478528 - DNA, 23 bp, Homo sapiens
accagtgttcctgaagctgctgt

SEQ ID NO: 4478529 - DNA, 16 bp, Homo sapiens
accagttctcatgggt

SEQ ID NO: 4478530 - DNA, 12 bp, Homo sapiens
accagtttctta

SEQ ID NO: 4478531 - DNA, 14 bp, Homo sapiens
accagtttcttaaa

SEQ ID NO: 4478532 - DNA, 16 bp, Homo sapiens
accatagaaaaatgta

SEQ ID NO: 4478533 - DNA, 15 bp, Homo sapiens
accatatagatttta

SEQ ID NO: 4478534 - DNA, 17 bp, Homo sapiens
accatattacctggatt

SEQ ID NO: 4478535 - DNA, 16 bp, Homo sapiens
accatattggtcacgt

SEQ ID NO: 4478536 - DNA, 13 bp, Homo sapiens
accatatttagca

SEQ ID NO: 4478537 - DNA, 15 bp, Homo sapiens
accatatttagcagt

SEQ ID NO: 4478538 - DNA, 13 bp, Homo sapiens
accatcagctctg

SEQ ID NO: 4478539 - DNA, 22 bp, Homo sapiens
accatccactctaccctcccac

SEQ ID NO: 4478540 - DNA, 17 bp, Homo sapiens
accatccattctcctca

SEQ ID NO: 4478541 - DNA, 17 bp, Homo sapiens
accatccccaactccat

SEQ ID NO: 4478542 - DNA, 12 bp, Homo sapiens
accatcctggct

SEQ ID NO: 4478543 - DNA, 13 bp, Homo sapiens
accatcctggcta

SEQ ID NO: 4478544 - DNA, 16 bp, Homo sapiens
accatctatgtgaata

SEQ ID NO: 4478545 - DNA, 16 bp, Homo sapiens
accatctggggcacct

SEQ ID NO: 4478546 - DNA, 17 bp, Homo sapiens
accatcttttattcttt

SEQ ID NO: 4478547 - DNA, 21 bp, Homo sapiens
accatgagcactactctacca

SEQ ID NO: 4478548 - DNA, 20 bp, Homo sapiens
accatgatcacttatcagtt

SEQ ID NO: 4478549 - DNA, 15 bp, Homo sapiens
accatgcaaattgtg

SEQ ID NO: 4478550 - DNA, 17 bp, Homo sapiens
accatgcaaattgtgaa

SEQ ID NO: 4478551 - DNA, 16 bp, Homo sapiens
accatgcactgtaaat

SEQ ID NO: 4478552 - DNA, 17 bp, Homo sapiens
accatgcactgtaaata

SEQ ID NO: 4478553 - DNA, 19 bp, Homo sapiens
accatgccagattctgcct

SEQ ID NO: 4478554 - DNA, 20 bp, Homo sapiens
accatgccagattctgcctc

SEQ ID NO: 4478555 - DNA, 20 bp, Homo sapiens
accatgccaggctaattttt

SEQ ID NO: 4478556 - DNA, 20 bp, Homo sapiens
accatgcctcactaattttt

SEQ ID NO: 4478557 - DNA, 17 bp, Homo sapiens
accatgcgtcaggggcc

SEQ ID NO: 4478558 - DNA, 16 bp, Homo sapiens
accatgcttgcctgaa

SEQ ID NO: 4478559 - DNA, 16 bp, Homo sapiens
accatggttctgcctc

SEQ ID NO: 4478560 - DNA, 18 bp, Homo sapiens
accatgtaagcactctgg

SEQ ID NO: 4478561 - DNA, 18 bp, Homo sapiens
accatgtcatttcagaag

SEQ ID NO: 4478562 - DNA, 22 bp, Homo sapiens
accatgtggataactttacaga

SEQ ID NO: 4478563 - DNA, 15 bp, Homo sapiens
accatgttagccagg

SEQ ID NO: 4478564 - DNA, 16 bp, Homo sapiens
accatgttatattgct

SEQ ID NO: 4478565 - DNA, 15 bp, Homo sapiens
accatgtttcaaaca

SEQ ID NO: 4478566 - DNA, 12 bp, Homo sapiens
accatgtttgag

SEQ ID NO: 4478567 - DNA, 20 bp, Homo sapiens
accatgtttgagctcagacc

SEQ ID NO: 4478568 - DNA, 21 bp, Homo sapiens
accatgtttgagctcagaccc

SEQ ID NO: 4478569 - DNA, 13 bp, Homo sapiens
accattaaagtca

SEQ ID NO: 4478570 - DNA, 15 bp, Homo sapiens
accattaaagtcaga

SEQ ID NO: 4478571 - DNA, 14 bp, Homo sapiens
accattatacttta

SEQ ID NO: 4478572 - DNA, 17 bp, Homo sapiens
accattatactttatat

SEQ ID NO: 4478573 - DNA, 18 bp, Homo sapiens
accattatactttatatc

SEQ ID NO: 4478574 - DNA, 23 bp, Homo sapiens
accattatgatcaaaaactgcct

SEQ ID NO: 4478575 - DNA, 20 bp, Homo sapiens
accattatggataaagatga

SEQ ID NO: 4478576 - DNA, 19 bp, Homo sapiens
accattcacaataaaagct

SEQ ID NO: 4478577 - DNA, 13 bp, Homo sapiens
accattgaaggct

SEQ ID NO: 4478578 - DNA, 17 bp, Homo sapiens
accattggctgcgctaa

SEQ ID NO: 4478579 - DNA, 13 bp, Homo sapiens
accatttaatttc

SEQ ID NO: 4478580 - DNA, 23 bp, Homo sapiens
accatttctgggggccgcagagg

SEQ ID NO: 4478581 - DNA, 19 bp, Homo sapiens
accatttgctactgtacat

SEQ ID NO: 4478582 - DNA, 15 bp, Homo sapiens
accatttgtgtctct

SEQ ID NO: 4478583 - DNA, 23 bp, Homo sapiens
accattttgttattgactaacag

SEQ ID NO: 4478584 - DNA, 11 bp, Homo sapiens
accatttttca

SEQ ID NO: 4478585 - DNA, 16 bp, Homo sapiens
acccaaatgttcatca

SEQ ID NO: 4478586 - DNA, 20 bp, Homo sapiens
acccaaattgagtttaacaa

SEQ ID NO: 4478587 - DNA, 15 bp, Homo sapiens
acccaacagtttatt

SEQ ID NO: 4478588 - DNA, 23 bp, Homo sapiens
acccaacagtttatttttattat

SEQ ID NO: 4478589 - DNA, 17 bp, Homo sapiens
acccaacctcaccctcc

SEQ ID NO: 4478590 - DNA, 19 bp, Homo sapiens
acccaactccacagggctg

SEQ ID NO: 4478591 - DNA, 13 bp, Homo sapiens
acccaagagaact

SEQ ID NO: 4478592 - DNA, 22 bp, Homo sapiens
acccaagatgggcatcttttgt

SEQ ID NO: 4478593 - DNA, 16 bp, Homo sapiens
acccaagcctgctggc

SEQ ID NO: 4478594 - DNA, 18 bp, Homo sapiens
acccaaggattctgttct

SEQ ID NO: 4478595 - DNA, 16 bp, Homo sapiens
acccaagtccaagcat

SEQ ID NO: 4478596 - DNA, 17 bp, Homo sapiens
acccacaagaaatgaaa

SEQ ID NO: 4478597 - DNA, 21 bp, Homo sapiens
acccacaagaaatgaaagcag

SEQ ID NO: 4478598 - DNA, 17 bp, Homo sapiens
acccacacctctgccag

SEQ ID NO: 4478599 - DNA, 13 bp, Homo sapiens
acccacagggcta

SEQ ID NO: 4478600 - DNA, 15 bp, Homo sapiens
acccaccaggccagc

SEQ ID NO: 4478601 - DNA, 20 bp, Homo sapiens
acccaccaggccagctcagg

SEQ ID NO: 4478602 - DNA, 21 bp, Homo sapiens
acccaccaggccagctcagga

SEQ ID NO: 4478603 - DNA, 15 bp, Homo sapiens
acccaccccaactct

SEQ ID NO: 4478604 - DNA, 23 bp, Homo sapiens
acccacccccagccttgcccagc

SEQ ID NO: 4478605 - DNA, 15 bp, Homo sapiens
acccaccgtggagga

SEQ ID NO: 4478606 - DNA, 13 bp, Homo sapiens
acccacctgctga

SEQ ID NO: 4478607 - DNA, 13 bp, Homo sapiens
acccacctggctt

SEQ ID NO: 4478608 - DNA, 24 bp, Homo sapiens
accaacatggagaaaccctgtctc

SEQ ID NO: 4478609 - DNA, 13 bp, Homo sapiens
accaaccacagca

SEQ ID NO: 4478610 - DNA, 12 bp, Homo sapiens
accaacttacaa

SEQ ID NO: 4478611 - DNA, 23 bp, Homo sapiens
accaagattatgtgacttgcaat

SEQ ID NO: 4478612 - DNA, 13 bp, Homo sapiens
accaagcaggaaa

SEQ ID NO: 4478613 - DNA, 17 bp, Homo sapiens
accaagctcacagttcc

SEQ ID NO: 4478614 - DNA, 21 bp, Homo sapiens
accaagctgctctccttcact

SEQ ID NO: 4478615 - DNA, 23 bp, Homo sapiens
accaaggctgagacagtgaattt

SEQ ID NO: 4478616 - DNA, 19 bp, Homo sapiens
accaaggctgattaaacca

SEQ ID NO: 4478617 - DNA, 21 bp, Homo sapiens
accaaggtacaactgtattta

SEQ ID NO: 4478618 - DNA, 23 bp, Homo sapiens
accaagtaaccaggccccagcct

SEQ ID NO: 4478619 - DNA, 17 bp, Homo sapiens
accaagtcagacaccaa

SEQ ID NO: 4478620 - DNA, 14 bp, Homo sapiens
accaatattgtaca

SEQ ID NO: 4478621 - DNA, 15 bp, Homo sapiens
accaatattgtacag

SEQ ID NO: 4478622 - DNA, 16 bp, Homo sapiens
accaatattgtacagt

SEQ ID NO: 4478623 - DNA, 17 bp, Homo sapiens
accaatattgtacagtt

SEQ ID NO: 4478624 - DNA, 21 bp, Homo sapiens
accaatcagcactctgtaaaa

SEQ ID NO: 4478625 - DNA, 13 bp, Homo sapiens
accaatcccaact

SEQ ID NO: 4478626 - DNA, 13 bp, Homo sapiens
accaatcctggac

SEQ ID NO: 4478627 - DNA, 15 bp, Homo sapiens
accaatcttgtttat

SEQ ID NO: 4478628 - DNA, 17 bp, Homo sapiens
accaatcttgtttatag

SEQ ID NO: 4478629 - DNA, 22 bp, Homo sapiens
accaatgaaaacatgtactaca

SEQ ID NO: 4478630 - DNA, 16 bp, Homo sapiens
accaatgcctttttag

SEQ ID NO: 4478631 - DNA, 17 bp, Homo sapiens
accaatgcctttttaga

SEQ ID NO: 4478632 - DNA, 16 bp, Homo sapiens
accaatggcattatta

SEQ ID NO: 4478633 - DNA, 12 bp, Homo sapiens
accaatgtcttg

SEQ ID NO: 4478634 - DNA, 16 bp, Homo sapiens
accaatgtgttttctg

SEQ ID NO: 4478635 - DNA, 19 bp, Homo sapiens
accaatgtgttttctgtag

SEQ ID NO: 4478636 - DNA, 22 bp, Homo sapiens
accaattactgcactcttaaac

SEQ ID NO: 4478637 - DNA, 23 bp, Homo sapiens
accaattactgcactcttaaaca

SEQ ID NO: 4478638 - DNA, 14 bp, Homo sapiens
accacaaaatatac

SEQ ID NO: 4478639 - DNA, 13 bp, Homo sapiens
accacaacatgag

SEQ ID NO: 4478640 - DNA, 18 bp, Homo sapiens
accacaatgtttcttcat

SEQ ID NO: 4478641 - DNA, 19 bp, Homo sapiens
accacaatgtttcttcatt

SEQ ID NO: 4478642 - DNA, 14 bp, Homo sapiens
accacacattttat

SEQ ID NO: 4478643 - DNA, 11 bp, Homo sapiens
accacagcaga

SEQ ID NO: 4478644 - DNA, 15 bp, Homo sapiens
accacagcagacacc

SEQ ID NO: 4478645 - DNA, 17 bp, Homo sapiens
accacaggaagatggga

SEQ ID NO: 4478646 - DNA, 14 bp, Homo sapiens
accacatcctccgt

SEQ ID NO: 4478647 - DNA, 22 bp, Homo sapiens
accacatcctccgtccagccgc

SEQ ID NO: 4478648 - DNA, 17 bp, Homo sapiens
accacatgctattgtct

SEQ ID NO: 4478649 - DNA, 14 bp, Homo sapiens
accaccatttaatt

SEQ ID NO: 4478650 - DNA, 17 bp, Homo sapiens
accaccatttaatttca

SEQ ID NO: 4478651 - DNA, 22 bp, Homo sapiens
accaccatttaatttcatgtat

SEQ ID NO: 4478652 - DNA, 20 bp, Homo sapiens
accacccaacctcaccctcc

SEQ ID NO: 4478653 - DNA, 14 bp, Homo sapiens
accacccatatcat

SEQ ID NO: 4478654 - DNA, 15 bp, Homo sapiens
accacccctgcctcc

SEQ ID NO: 4478655 - DNA, 20 bp, Homo sapiens
accacccctgcctccaccct

SEQ ID NO: 4478656 - DNA, 21 bp, Homo sapiens
accaccctagtcccttcccct

SEQ ID NO: 4478657 - DNA, 13 bp, Homo sapiens
accaccctgagcc

SEQ ID NO: 4478658 - DNA, 21 bp, Homo sapiens
accaccctgagccggccccag

SEQ ID NO: 4478659 - DNA, 14 bp, Homo sapiens
accaccttcccagc

SEQ ID NO: 4478660 - DNA, 16 bp, Homo sapiens
accaccttcccagctc

SEQ ID NO: 4478661 - DNA, 17 bp, Homo sapiens
accaccttcccagctct

SEQ ID NO: 4478662 - DNA, 19 bp, Homo sapiens
accaccttcccagctctcc

SEQ ID NO: 4478663 - DNA, 22 bp, Homo sapiens
accaccttcccagctctccctc

SEQ ID NO: 4478664 - DNA, 16 bp, Homo sapiens
accacgactggccagg

SEQ ID NO: 4478665 - DNA, 18 bp, Homo sapiens
accacgatgtggccctgg

SEQ ID NO: 4478666 - DNA, 19 bp, Homo sapiens
accacgatgtggccctggc

SEQ ID NO: 4478667 - DNA, 22 bp, Homo sapiens
accacgatgtggccctggcctg

SEQ ID NO: 4478668 - DNA, 18 bp, Homo sapiens
accacgcctcttgaccag

SEQ ID NO: 4478669 - DNA, 22 bp, Homo sapiens
accacgtcgggcttccctggcc

SEQ ID NO: 4478670 - DNA, 15 bp, Homo sapiens
accactaaccatccc

SEQ ID NO: 4478671 - DNA, 18 bp, Homo sapiens
accactaaccatccccaa

SEQ ID NO: 4478672 - DNA, 17 bp, Homo sapiens
accactacatgcagccc

SEQ ID NO: 4478673 - DNA, 22 bp, Homo sapiens
accactaccagccagcctcaga

SEQ ID NO: 4478674 - DNA, 15 bp, Homo sapiens
accactatgaagcta

SEQ ID NO: 4478675 - DNA, 19 bp, Homo sapiens
accactcgaggcctgcaaa

SEQ ID NO: 4478676 - DNA, 23 bp, Homo sapiens
accactcttctttaagccataga

SEQ ID NO: 4478677 - DNA, 16 bp, Homo sapiens
accactgaaaaaatat

SEQ ID NO: 4478678 - DNA, 13 bp, Homo sapiens
accactgatatca

SEQ ID NO: 4478679 - DNA, 17 bp, Homo sapiens
accactgcactccagcc

SEQ ID NO: 4478680 - DNA, 18 bp, Homo sapiens
accactgcactccagcct

SEQ ID NO: 4478681 - DNA, 19 bp, Homo sapiens
accactgcactccagcctg

SEQ ID NO: 4478682 - DNA, 20 bp, Homo sapiens
accactgcactccagcctgg

SEQ ID NO: 4478683 - DNA, 14 bp, Homo sapiens
accactgcagaaga

SEQ ID NO: 4478684 - DNA, 20 bp, Homo sapiens
accactgccattacccagtg

SEQ ID NO: 4478685 - DNA, 23 bp, Homo sapiens
accactgggccataatgttgctt

SEQ ID NO: 4478686 - DNA, 16 bp, Homo sapiens
accacttagatttaaa

SEQ ID NO: 4478687 - DNA, 20 bp, Homo sapiens
accacttccaggggaacctg

SEQ ID NO: 4478688 - DNA, 17 bp, Homo sapiens
accacttcgcacacacc

SEQ ID NO: 4478689 - DNA, 13 bp, Homo sapiens
accacttgctgca

SEQ ID NO: 4478690 - DNA, 16 bp, Homo sapiens
accagaaacagggaca

SEQ ID NO: 4478691 - DNA, 17 bp, Homo sapiens
accagaaagcttcatcc

SEQ ID NO: 4478692 - DNA, 21 bp, Homo sapiens
accagaaatgtttatggaaat

SEQ ID NO: 4478693 - DNA, 18 bp, Homo sapiens
accagaacgcaccccact

SEQ ID NO: 4478694 - DNA, 16 bp, Homo sapiens
accagaagtgtttcag

SEQ ID NO: 4478695 - DNA, 18 bp, Homo sapiens
accagagaaaaagggagg

SEQ ID NO: 4478696 - DNA, 13 bp, Homo sapiens
accagagagaaag

SEQ ID NO: 4478697 - DNA, 17 bp, Homo sapiens
accagagccgggaggaa

SEQ ID NO: 4478698 - DNA, 19 bp, Homo sapiens
accagagccttcaagtgcc

SEQ ID NO: 4478699 - DNA, 23 bp, Homo sapiens
accagagccttcaagtgccaaac

SEQ ID NO: 4478700 - DNA, 15 bp, Homo sapiens
accagagctgtctga

SEQ ID NO: 4478701 - DNA, 15 bp, Homo sapiens
accagagggtgtggc

SEQ ID NO: 4478702 - DNA, 16 bp, Homo sapiens
accagagggtgtggct

SEQ ID NO: 4478703 - DNA, 22 bp, Homo sapiens
accagagggtgtggctttccag

SEQ ID NO: 4478704 - DNA, 19 bp, Homo sapiens
accagagtcttaagggtca

SEQ ID NO: 4478705 - DNA, 14 bp, Homo sapiens
accagatcaggaga

SEQ ID NO: 4478706 - DNA, 21 bp, Homo sapiens
accagattctgcctatgtaaa

SEQ ID NO: 4478707 - DNA, 16 bp, Homo sapiens
accagccagcctcaga

SEQ ID NO: 4478708 - DNA, 16 bp, Homo sapiens
accagccatcctccct

SEQ ID NO: 4478709 - DNA, 18 bp, Homo sapiens
accagcccattggccgag

SEQ ID NO: 4478710 - DNA, 23 bp, Homo sapiens
accagcccattggccgagctcct

SEQ ID NO: 4478711 - DNA, 18 bp, Homo sapiens
accagcccccgccccaga

SEQ ID NO: 4478712 - DNA, 21 bp, Homo sapiens
accagcccccgccccagagtg

SEQ ID NO: 4478713 - DNA, 23 bp, Homo sapiens
accagcccccgccccagagtggc

SEQ ID NO: 4478714 - DNA, 14 bp, Homo sapiens
accagccttgctct

SEQ ID NO: 4478715 - DNA, 16 bp, Homo sapiens
accagccttgctctct

SEQ ID NO: 4478716 - DNA, 23 bp, Homo sapiens
accagccttgctctcttcaataa

SEQ ID NO: 4478717 - DNA, 23 bp, Homo sapiens
accagcgaggaggctccagaggg

SEQ ID NO: 4478718 - DNA, 15 bp, Homo sapiens
accagctatctgtca

SEQ ID NO: 4478719 - DNA, 23 bp, Homo sapiens
accagctatctgtcatctctctg

SEQ ID NO: 4478720 - DNA, 12 bp, Homo sapiens
accagctgcaaa

SEQ ID NO: 4478721 - DNA, 15 bp, Homo sapiens
accagctgcaaagtg

SEQ ID NO: 4478722 - DNA, 16 bp, Homo sapiens
accagctgcgcttgct

SEQ ID NO: 4478723 - DNA, 18 bp, Homo sapiens
accagctgcgcttgcttt

SEQ ID NO: 4478724 - DNA, 12 bp, Homo sapiens
accaggaagccg

SEQ ID NO: 4478725 - DNA, 15 bp, Homo sapiens
accaggacaggacca

SEQ ID NO: 4478726 - DNA, 12 bp, Homo sapiens
accaggaccctg

SEQ ID NO: 4478727 - DNA, 22 bp, Homo sapiens
accaggactagggctggagtga

SEQ ID NO: 4478728 - DNA, 14 bp, Homo sapiens
acattaaatcacag

SEQ ID NO: 4478729 - DNA, 15 bp, Homo sapiens
acattaacaaataaa

SEQ ID NO: 4478730 - DNA, 14 bp, Homo sapiens
acattaacggtgct

SEQ ID NO: 4478731 - DNA, 17 bp, Homo sapiens
acattaacggtgctaaa

SEQ ID NO: 4478732 - DNA, 14 bp, Homo sapiens
acattaaggagcag

SEQ ID NO: 4478733 - DNA, 19 bp, Homo sapiens
acattaatccacatgtttc

SEQ ID NO: 4478734 - DNA, 17 bp, Homo sapiens
acattacggtacagaca

SEQ ID NO: 4478735 - DNA, 14 bp, Homo sapiens
acattactttttat

SEQ ID NO: 4478736 - DNA, 12 bp, Homo sapiens
acattagaaaaa

SEQ ID NO: 4478737 - DNA, 15 bp, Homo sapiens
acattagaaatattc

SEQ ID NO: 4478738 - DNA, 18 bp, Homo sapiens
acattataacaactattt

SEQ ID NO: 4478739 - DNA, 18 bp, Homo sapiens
acattataataaaatttc

SEQ ID NO: 4478740 - DNA, 12 bp, Homo sapiens
acattatataac

SEQ ID NO: 4478741 - DNA, 15 bp, Homo sapiens
acattatataacaaa

SEQ ID NO: 4478742 - DNA, 17 bp, Homo sapiens
acattatataacaaaaa

SEQ ID NO: 4478743 - DNA, 14 bp, Homo sapiens
acattatattgcaa

SEQ ID NO: 4478744 - DNA, 18 bp, Homo sapiens
acattatattgcaatgaa

SEQ ID NO: 4478745 - DNA, 21 bp, Homo sapiens
acattatcttcatatgtcacc

SEQ ID NO: 4478746 - DNA, 20 bp, Homo sapiens
acattatgtggaatcctaaa

SEQ ID NO: 4478747 - DNA, 13 bp, Homo sapiens
acattattaaacg

SEQ ID NO: 4478748 - DNA, 11 bp, Homo sapiens
acattcaactc

SEQ ID NO: 4478749 - DNA, 11 bp, Homo sapiens
acattcactgg

SEQ ID NO: 4478750 - DNA, 16 bp, Homo sapiens
acattcacttttgtta

SEQ ID NO: 4478751 - DNA, 21 bp, Homo sapiens
acattcacttttgttaacagt

SEQ ID NO: 4478752 - DNA, 16 bp, Homo sapiens
acattcgaatctctgc

SEQ ID NO: 4478753 - DNA, 16 bp, Homo sapiens
acattcgtgagctggg

SEQ ID NO: 4478754 - DNA, 17 bp, Homo sapiens
acattctagctgagaag

SEQ ID NO: 4478755 - DNA, 18 bp, Homo sapiens
acattctatctactgatt

SEQ ID NO: 4478756 - DNA, 12 bp, Homo sapiens
acattctcacat

SEQ ID NO: 4478757 - DNA, 16 bp, Homo sapiens
acattctctcatagaa

SEQ ID NO: 4478758 - DNA, 22 bp, Homo sapiens
acattcttccatcatcactgta

SEQ ID NO: 4478759 - DNA, 21 bp, Homo sapiens
acattcttgcttgtgtgtctg

SEQ ID NO: 4478760 - DNA, 18 bp, Homo sapiens
acattgaagtaatgaatt

SEQ ID NO: 4478761 - DNA, 19 bp, Homo sapiens
acattgaagtaatgaattt

SEQ ID NO: 4478762 - DNA, 22 bp, Homo sapiens
acattgagtagacacatttaag

SEQ ID NO: 4478763 - DNA, 19 bp, Homo sapiens
acattgagtttacttataa

SEQ ID NO: 4478764 - DNA, 20 bp, Homo sapiens
acattgagtttacttataaa

SEQ ID NO: 4478765 - DNA, 20 bp, Homo sapiens
acattgatccagtcatttta

SEQ ID NO: 4478766 - DNA, 16 bp, Homo sapiens
acattgcccctctgcc

SEQ ID NO: 4478767 - DNA, 18 bp, Homo sapiens
acattgcccctctgcctt

SEQ ID NO: 4478768 - DNA, 21 bp, Homo sapiens
acattgcccctctgccttgcc

SEQ ID NO: 4478769 - DNA, 23 bp, Homo sapiens
acattgcgtttgaccttttatgt

SEQ ID NO: 4478770 - DNA, 15 bp, Homo sapiens
acattgctctatgtc

SEQ ID NO: 4478771 - DNA, 11 bp, Homo sapiens
acattgcttaa

SEQ ID NO: 4478772 - DNA, 15 bp, Homo sapiens
acattggacagaaaa

SEQ ID NO: 4478773 - DNA, 19 bp, Homo sapiens
acattggacagaaaatgca

SEQ ID NO: 4478774 - DNA, 20 bp, Homo sapiens
acattggacagaaaatgcaa

SEQ ID NO: 4478775 - DNA, 16 bp, Homo sapiens
acattggttttgaaat

SEQ ID NO: 4478776 - DNA, 14 bp, Homo sapiens
acattgttgagcta

SEQ ID NO: 4478777 - DNA, 16 bp, Homo sapiens
acatttaaacctttta

SEQ ID NO: 4478778 - DNA, 16 bp, Homo sapiens
acatttaaacttttta

SEQ ID NO: 4478779 - DNA, 20 bp, Homo sapiens
acatttaaactttttaaaat

SEQ ID NO: 4478780 - DNA, 15 bp, Homo sapiens
acatttaataaaact

SEQ ID NO: 4478781 - DNA, 16 bp, Homo sapiens
acatttaataaaactg

SEQ ID NO: 4478782 - DNA, 21 bp, Homo sapiens
acatttactacagtttttaac

SEQ ID NO: 4478783 - DNA, 14 bp, Homo sapiens
acatttactgacca

SEQ ID NO: 4478784 - DNA, 13 bp, Homo sapiens
acatttagaaaag

SEQ ID NO: 4478785 - DNA, 17 bp, Homo sapiens
acatttagaaatgttta

SEQ ID NO: 4478786 - DNA, 16 bp, Homo sapiens
acatttagaagaaaga

SEQ ID NO: 4478787 - DNA, 20 bp, Homo sapiens
acatttatatgggtttattt

SEQ ID NO: 4478788 - DNA, 12 bp, Homo sapiens
acatttatcttt

SEQ ID NO: 4478789 - DNA, 15 bp, Homo sapiens
acatttatgttcctt

SEQ ID NO: 4478790 - DNA, 13 bp, Homo sapiens
acatttcaaaact

SEQ ID NO: 4478791 - DNA, 16 bp, Homo sapiens
acatttcacattattc

SEQ ID NO: 4478792 - DNA, 14 bp, Homo sapiens
acatttcactaaaa

SEQ ID NO: 4478793 - DNA, 23 bp, Homo sapiens
acatttcataatttgtttccagc

SEQ ID NO: 4478794 - DNA, 20 bp, Homo sapiens
acatttcatgtagtaagatt

SEQ ID NO: 4478795 - DNA, 21 bp, Homo sapiens
acatttcattgtacaagtatt

SEQ ID NO: 4478796 - DNA, 15 bp, Homo sapiens
acatttctaagacta

SEQ ID NO: 4478797 - DNA, 17 bp, Homo sapiens
acatttctcatgttgaa

SEQ ID NO: 4478798 - DNA, 20 bp, Homo sapiens
acatttctctaactcctgcc

SEQ ID NO: 4478799 - DNA, 14 bp, Homo sapiens
acatttctcttccc

SEQ ID NO: 4478800 - DNA, 15 bp, Homo sapiens
acatttcttaaaaca

SEQ ID NO: 4478801 - DNA, 23 bp, Homo sapiens
acatttgccttttgttaaaagat

SEQ ID NO: 4478802 - DNA, 18 bp, Homo sapiens
acatttggaatacttttt

SEQ ID NO: 4478803 - DNA, 20 bp, Homo sapiens
acatttggagtgttcccctt

SEQ ID NO: 4478804 - DNA, 21 bp, Homo sapiens
acatttgggagtttttatgag

SEQ ID NO: 4478805 - DNA, 14 bp, Homo sapiens
acatttgtttcccc

SEQ ID NO: 4478806 - DNA, 16 bp, Homo sapiens
acatttgtttccccca

SEQ ID NO: 4478807 - DNA, 20 bp, Homo sapiens
acattttaaaaaatggtcac

SEQ ID NO: 4478808 - DNA, 12 bp, Homo sapiens
acattttaaata

SEQ ID NO: 4478809 - DNA, 16 bp, Homo sapiens
acattttaaatactct

SEQ ID NO: 4478810 - DNA, 14 bp, Homo sapiens
acattttacagtaa

SEQ ID NO: 4478811 - DNA, 15 bp, Homo sapiens
acattttacattaaa

SEQ ID NO: 4478812 - DNA, 14 bp, Homo sapiens
acattttactattt

SEQ ID NO: 4478813 - DNA, 15 bp, Homo sapiens
acattttataaaaca

SEQ ID NO: 4478814 - DNA, 16 bp, Homo sapiens
acattttataaagtta

SEQ ID NO: 4478815 - DNA, 15 bp, Homo sapiens
acattttatatgtga

SEQ ID NO: 4478816 - DNA, 14 bp, Homo sapiens
acattttatgagag

SEQ ID NO: 4478817 - DNA, 15 bp, Homo sapiens
acattttatgtcttt

SEQ ID NO: 4478818 - DNA, 13 bp, Homo sapiens
acattttattaag

SEQ ID NO: 4478819 - DNA, 21 bp, Homo sapiens
acattttccgcccactcctgg

SEQ ID NO: 4478820 - DNA, 14 bp, Homo sapiens
acattttgatttcc

SEQ ID NO: 4478821 - DNA, 16 bp, Homo sapiens
acattttgtaaaatat

SEQ ID NO: 4478822 - DNA, 17 bp, Homo sapiens
acattttgtaaaatatt

SEQ ID NO: 4478823 - DNA, 16 bp, Homo sapiens
acattttgtttttact

SEQ ID NO: 4478824 - DNA, 20 bp, Homo sapiens
acattttgtttttactgtat

SEQ ID NO: 4478825 - DNA, 14 bp, Homo sapiens
acatttttcaactt

SEQ ID NO: 4478826 - DNA, 16 bp, Homo sapiens
acatttttcaactttg

SEQ ID NO: 4478827 - DNA, 23 bp, Homo sapiens
acatttttcaactttgaataaag

SEQ ID NO: 4478828 - DNA, 14 bp, Homo sapiens
acatttttcattca

SEQ ID NO: 4478829 - DNA, 18 bp, Homo sapiens
acatttttggatttctgt

SEQ ID NO: 4478830 - DNA, 16 bp, Homo sapiens
acattttttaactttc

SEQ ID NO: 4478831 - DNA, 14 bp, Homo sapiens
acattttttcttct

SEQ ID NO: 4478832 - DNA, 13 bp, Homo sapiens
acatttttttcta

SEQ ID NO: 4478833 - DNA, 13 bp, Homo sapiens
accaaaaacaagt

SEQ ID NO: 4478834 - DNA, 16 bp, Homo sapiens
accaaaaacatttgat

SEQ ID NO: 4478835 - DNA, 22 bp, Homo sapiens
accaaaaacatttgattaataa

SEQ ID NO: 4478836 - DNA, 16 bp, Homo sapiens
accaaacacccagagg

SEQ ID NO: 4478837 - DNA, 19 bp, Homo sapiens
accaaacacccagaggtct

SEQ ID NO: 4478838 - DNA, 17 bp, Homo sapiens
accaaactactgaatga

SEQ ID NO: 4478839 - DNA, 15 bp, Homo sapiens
accaaagagggcttc

SEQ ID NO: 4478840 - DNA, 13 bp, Homo sapiens
accaaagcatcaa

SEQ ID NO: 4478841 - DNA, 24 bp, Homo sapiens
accaaagcatcaatacaaccagcc

SEQ ID NO: 4478842 - DNA, 19 bp, Homo sapiens
accaaaggagacatatcac

SEQ ID NO: 4478843 - DNA, 21 bp, Homo sapiens
accaaagtcctttttttccat

SEQ ID NO: 4478844 - DNA, 17 bp, Homo sapiens
accaaatctcagttgtt

SEQ ID NO: 4478845 - DNA, 19 bp, Homo sapiens
accaaatgaaatgccaaag

SEQ ID NO: 4478846 - DNA, 23 bp, Homo sapiens
accaaatggcacttttgatgaaa

SEQ ID NO: 4478847 - DNA, 20 bp, Homo sapiens
accaaatgtgctttgagaag

SEQ ID NO: 4478848 - DNA, 22 bp, Homo sapiens
accaaattagtgaaccaaaaat

SEQ ID NO: 4478849 - DNA, 14 bp, Homo sapiens
accaacacgagcag

SEQ ID NO: 4478850 - DNA, 13 bp, Homo sapiens
acatatggaattt

SEQ ID NO: 4478851 - DNA, 20 bp, Homo sapiens
acatatggaattttgcaaag

SEQ ID NO: 4478852 - DNA, 13 bp, Homo sapiens
acatattcatgaa

SEQ ID NO: 4478853 - DNA, 22 bp, Homo sapiens
acatattgagaacctaatgcac

SEQ ID NO: 4478854 - DNA, 14 bp, Homo sapiens
acatatttaactgg

SEQ ID NO: 4478855 - DNA, 15 bp, Homo sapiens
acatatttaactggt

SEQ ID NO: 4478856 - DNA, 20 bp, Homo sapiens
acatatttaactggtgcact

SEQ ID NO: 4478857 - DNA, 12 bp, Homo sapiens
acatatttaatg

SEQ ID NO: 4478858 - DNA, 17 bp, Homo sapiens
acatatttaatgtttta

SEQ ID NO: 4478859 - DNA, 19 bp, Homo sapiens
acatatttgtatgtttttc

SEQ ID NO: 4478860 - DNA, 23 bp, Homo sapiens
acatatttgtatgtttttctgta

SEQ ID NO: 4478861 - DNA, 20 bp, Homo sapiens
acatatttttatactttatt

SEQ ID NO: 4478862 - DNA, 21 bp, Homo sapiens
acatatttttatactttattg

SEQ ID NO: 4478863 - DNA, 21 bp, Homo sapiens
acatattttttatatctggaa

SEQ ID NO: 4478864 - DNA, 22 bp, Homo sapiens
acatattttttatatctggaat

SEQ ID NO: 4478865 - DNA, 16 bp, Homo sapiens
acatcaaagcttcttc

SEQ ID NO: 4478866 - DNA, 18 bp, Homo sapiens
acatcaacaagaagaaac

SEQ ID NO: 4478867 - DNA, 13 bp, Homo sapiens
acatcaacagata

SEQ ID NO: 4478868 - DNA, 22 bp, Homo sapiens
acatcaacattccagggatgag

SEQ ID NO: 4478869 - DNA, 22 bp, Homo sapiens
acatcaagactatctacaaaaa

SEQ ID NO: 4478870 - DNA, 20 bp, Homo sapiens
acatcaagtccatctgacaa

SEQ ID NO: 4478871 - DNA, 18 bp, Homo sapiens
acatcacacccatttaaa

SEQ ID NO: 4478872 - DNA, 15 bp, Homo sapiens
acatcacatcttatt

SEQ ID NO: 4478873 - DNA, 14 bp, Homo sapiens
acatcactatcaat

SEQ ID NO: 4478874 - DNA, 16 bp, Homo sapiens
acatcactatcaattt

SEQ ID NO: 4478875 - DNA, 18 bp, Homo sapiens
acatcaggaaagagagca

SEQ ID NO: 4478876 - DNA, 21 bp, Homo sapiens
acatcagggcggcctcccagg

SEQ ID NO: 4478877 - DNA, 21 bp, Homo sapiens
acatcagtagcatttttctaa

SEQ ID NO: 4478878 - DNA, 14 bp, Homo sapiens
acatcagtttgttc

SEQ ID NO: 4478879 - DNA, 18 bp, Homo sapiens
acatcagtttgttccttt

SEQ ID NO: 4478880 - DNA, 16 bp, Homo sapiens
acatcccattgccctg

SEQ ID NO: 4478881 - DNA, 23 bp, Homo sapiens
acatcctaaggttcttgctttct

SEQ ID NO: 4478882 - DNA, 16 bp, Homo sapiens
acatcctctgatagct

SEQ ID NO: 4478883 - DNA, 22 bp, Homo sapiens
acatcctctgatagctgtttca

SEQ ID NO: 4478884 - DNA, 15 bp, Homo sapiens
acatcggaaaaataa

SEQ ID NO: 4478885 - DNA, 16 bp, Homo sapiens
acatctaacctcatct

SEQ ID NO: 4478886 - DNA, 18 bp, Homo sapiens
acatctattttggattgt

SEQ ID NO: 4478887 - DNA, 21 bp, Homo sapiens
acatctgcctgtaattaaact

SEQ ID NO: 4478888 - DNA, 11 bp, Homo sapiens
acatctgcctt

SEQ ID NO: 4478889 - DNA, 13 bp, Homo sapiens
acatctgccttaa

SEQ ID NO: 4478890 - DNA, 23 bp, Homo sapiens
acatctgccttaaaaccaaagag

SEQ ID NO: 4478891 - DNA, 17 bp, Homo sapiens
acatctggcatggctcc

SEQ ID NO: 4478892 - DNA, 15 bp, Homo sapiens
acatctgtgtcttgt

SEQ ID NO: 4478893 - DNA, 20 bp, Homo sapiens
acatcttaaattcatttcta

SEQ ID NO: 4478894 - DNA, 14 bp, Homo sapiens
acatcttatttatt

SEQ ID NO: 4478895 - DNA, 15 bp, Homo sapiens
acatcttctttggaa

SEQ ID NO: 4478896 - DNA, 13 bp, Homo sapiens
acatctttcccta

SEQ ID NO: 4478897 - DNA, 16 bp, Homo sapiens
acatcttttaactgcc

SEQ ID NO: 4478898 - DNA, 22 bp, Homo sapiens
acatctttttaaagcttatcca

SEQ ID NO: 4478899 - DNA, 15 bp, Homo sapiens
acatgaaaaatttta

SEQ ID NO: 4478900 - DNA, 14 bp, Homo sapiens
acatgaacagcttg

SEQ ID NO: 4478901 - DNA, 22 bp, Homo sapiens
acatgaagattctttcccaatt

SEQ ID NO: 4478902 - DNA, 21 bp, Homo sapiens
acatgaagcaattagtctgaa

SEQ ID NO: 4478903 - DNA, 17 bp, Homo sapiens
acatgaagctgtataat

SEQ ID NO: 4478904 - DNA, 19 bp, Homo sapiens
acatgaagctgttgtgtga

SEQ ID NO: 4478905 - DNA, 15 bp, Homo sapiens
acatgaaggtaaata

SEQ ID NO: 4478906 - DNA, 16 bp, Homo sapiens
acatgaaggtaaataa

SEQ ID NO: 4478907 - DNA, 23 bp, Homo sapiens
acatgaaggtaaataaaaagaaa

SEQ ID NO: 4478908 - DNA, 23 bp, Homo sapiens
acatgaataaagcctttgtatct

SEQ ID NO: 4478909 - DNA, 13 bp, Homo sapiens
acatgacatccag

SEQ ID NO: 4478910 - DNA, 21 bp, Homo sapiens
acatgacatccagagatgact

SEQ ID NO: 4478911 - DNA, 17 bp, Homo sapiens
acatgacattcttagct

SEQ ID NO: 4478912 - DNA, 18 bp, Homo sapiens
acatgacgtggtaaaatg

SEQ ID NO: 4478913 - DNA, 21 bp, Homo sapiens
acatgacgtggtaaaatgtga

SEQ ID NO: 4478914 - DNA, 22 bp, Homo sapiens
acatgacgtggtaaaatgtgaa

SEQ ID NO: 4478915 - DNA, 17 bp, Homo sapiens
acatgactctttattgt

SEQ ID NO: 4478916 - DNA, 19 bp, Homo sapiens
acatgacttccttatttct

SEQ ID NO: 4478917 - DNA, 15 bp, Homo sapiens
acatgagaacaaaca

SEQ ID NO: 4478918 - DNA, 13 bp, Homo sapiens
acatgagttcaaa

SEQ ID NO: 4478919 - DNA, 15 bp, Homo sapiens
acatgataagacatt

SEQ ID NO: 4478920 - DNA, 16 bp, Homo sapiens
acatgataagacattt

SEQ ID NO: 4478921 - DNA, 16 bp, Homo sapiens
acatgatttaaagact

SEQ ID NO: 4478922 - DNA, 23 bp, Homo sapiens
acatgatttaaagactacaataa

SEQ ID NO: 4478923 - DNA, 16 bp, Homo sapiens
acatgcaacagaagtg

SEQ ID NO: 4478924 - DNA, 11 bp, Homo sapiens
acatgcaataa

SEQ ID NO: 4478925 - DNA, 13 bp, Homo sapiens
acatgcacagtca

SEQ ID NO: 4478926 - DNA, 18 bp, Homo sapiens
acatgcagcccatgccca

SEQ ID NO: 4478927 - DNA, 19 bp, Homo sapiens
acatgcagtttgaaattct

SEQ ID NO: 4478928 - DNA, 17 bp, Homo sapiens
acatgcatacttacaga

SEQ ID NO: 4478929 - DNA, 18 bp, Homo sapiens
acatgcatgttctcctct

SEQ ID NO: 4478930 - DNA, 15 bp, Homo sapiens
acatgccacctggca

SEQ ID NO: 4478931 - DNA, 15 bp, Homo sapiens
acatgccccaggctc

SEQ ID NO: 4478932 - DNA, 17 bp, Homo sapiens
acatgccccttggtcct

SEQ ID NO: 4478933 - DNA, 14 bp, Homo sapiens
acatgccctgtgtg

SEQ ID NO: 4478934 - DNA, 14 bp, Homo sapiens
acatgcctgcgcct

SEQ ID NO: 4478935 - DNA, 21 bp, Homo sapiens
acatgctgtatatgcaatgtc

SEQ ID NO: 4478936 - DNA, 15 bp, Homo sapiens
acatgctgtctggcc

SEQ ID NO: 4478937 - DNA, 19 bp, Homo sapiens
acatgctgtctggccctgg

SEQ ID NO: 4478938 - DNA, 15 bp, Homo sapiens
acatgcttataacat

SEQ ID NO: 4478939 - DNA, 18 bp, Homo sapiens
acatgcttataacattaa

SEQ ID NO: 4478940 - DNA, 15 bp, Homo sapiens
acatgcttgaatgga

SEQ ID NO: 4478941 - DNA, 15 bp, Homo sapiens
acatggagctgtcat

SEQ ID NO: 4478942 - DNA, 16 bp, Homo sapiens
acatggagctgtcatc

SEQ ID NO: 4478943 - DNA, 13 bp, Homo sapiens
acatgggagcagt

SEQ ID NO: 4478944 - DNA, 23 bp, Homo sapiens
acatgggagcagtccatgcatga

SEQ ID NO: 4478945 - DNA, 16 bp, Homo sapiens
acatgggagggatcag

SEQ ID NO: 4478946 - DNA, 18 bp, Homo sapiens
acatggtgaaacccccat

SEQ ID NO: 4478947 - DNA, 21 bp, Homo sapiens
acatggtgagtctatttttaa

SEQ ID NO: 4478948 - DNA, 13 bp, Homo sapiens
acatggtgcctga

SEQ ID NO: 4478949 - DNA, 20 bp, Homo sapiens
acatggtgcctgagaggcag

SEQ ID NO: 4478950 - DNA, 23 bp, Homo sapiens
acatggtgcctgagaggcaggca

SEQ ID NO: 4478951 - DNA, 15 bp, Homo sapiens
acatggtgtctccca

SEQ ID NO: 4478952 - DNA, 20 bp, Homo sapiens
acatggttgggggaatgcac

SEQ ID NO: 4478953 - DNA, 13 bp, Homo sapiens
acatgtaagaaaa

SEQ ID NO: 4478954 - DNA, 23 bp, Homo sapiens
acatgtactacagctatatttga

SEQ ID NO: 4478955 - DNA, 17 bp, Homo sapiens
acatgtaggaagtagga

SEQ ID NO: 4478956 - DNA, 14 bp, Homo sapiens
acatgtatttatgt

SEQ ID NO: 4478957 - DNA, 19 bp, Homo sapiens
acatgtcacaatacagtaa

SEQ ID NO: 4478958 - DNA, 23 bp, Homo sapiens
acatgtcctgcctattatctgtc

SEQ ID NO: 4478959 - DNA, 17 bp, Homo sapiens
acatgtctgttctacat

SEQ ID NO: 4478960 - DNA, 17 bp, Homo sapiens
acatgtgagatagtttt

SEQ ID NO: 4478961 - DNA, 21 bp, Homo sapiens
acatgtgagatagttttcatt

SEQ ID NO: 4478962 - DNA, 21 bp, Homo sapiens
acatgttatcaaatctgggta

SEQ ID NO: 4478963 - DNA, 17 bp, Homo sapiens
acatgttggaaatgtgt

SEQ ID NO: 4478964 - DNA, 16 bp, Homo sapiens
acatgtttaactttaa

SEQ ID NO: 4478965 - DNA, 13 bp, Homo sapiens
acatgtttctgtt

SEQ ID NO: 4478966 - DNA, 17 bp, Homo sapiens
acatgtttctgttttgt

SEQ ID NO: 4478967 - DNA, 14 bp, Homo sapiens
acatgttttttcat

SEQ ID NO: 4478968 - DNA, 17 bp, Homo sapiens
acatgttttttcatttg

SEQ ID NO: 4478969 - DNA, 14 bp, Homo sapiens
acattaaaataact

SEQ ID NO: 4478970 - DNA, 14 bp, Homo sapiens
acagtattcagagt

SEQ ID NO: 4478971 - DNA, 15 bp, Homo sapiens
acagtattgggcagg

SEQ ID NO: 4478972 - DNA, 12 bp, Homo sapiens
acagtatttctc

SEQ ID NO: 4478973 - DNA, 23 bp, Homo sapiens
acagtatttctcttttattctgt

SEQ ID NO: 4478974 - DNA, 18 bp, Homo sapiens
acagtatttgtaattaaa

SEQ ID NO: 4478975 - DNA, 18 bp, Homo sapiens
acagtcactgatgtacaa

SEQ ID NO: 4478976 - DNA, 24 bp, Homo sapiens
acagtcatacaagtcatggtcaca

SEQ ID NO: 4478977 - DNA, 21 bp, Homo sapiens
acagtcatctagaattcactg

SEQ ID NO: 4478978 - DNA, 13 bp, Homo sapiens
acagtccacaggg

SEQ ID NO: 4478979 - DNA, 13 bp, Homo sapiens
acagtccctgctg

SEQ ID NO: 4478980 - DNA, 20 bp, Homo sapiens
acagtcgctcagtctgttca

SEQ ID NO: 4478981 - DNA, 14 bp, Homo sapiens
acagtctaaagctg

SEQ ID NO: 4478982 - DNA, 15 bp, Homo sapiens
acagtctaaagctgg

SEQ ID NO: 4478983 - DNA, 15 bp, Homo sapiens
acagtctctactgtt

SEQ ID NO: 4478984 - DNA, 17 bp, Homo sapiens
acagtctctactgttat

SEQ ID NO: 4478985 - DNA, 16 bp, Homo sapiens
acagtctggagaaggt

SEQ ID NO: 4478986 - DNA, 14 bp, Homo sapiens
acagtcttcatttt

SEQ ID NO: 4478987 - DNA, 18 bp, Homo sapiens
acagtgaggcaggagaag

SEQ ID NO: 4478988 - DNA, 14 bp, Homo sapiens
acagtgatgaatgt

SEQ ID NO: 4478989 - DNA, 21 bp, Homo sapiens
acagtgatgaatgtactatgt

SEQ ID NO: 4478990 - DNA, 24 bp, Homo sapiens
acagtgatgctgtgctatgaattt

SEQ ID NO: 4478991 - DNA, 21 bp, Homo sapiens
acagtgattaccagggactga

SEQ ID NO: 4478992 - DNA, 10 bp, Homo sapiens
acagtgcaag

SEQ ID NO: 4478993 - DNA, 20 bp, Homo sapiens
acagtgcagagccttctcag

SEQ ID NO: 4478994 - DNA, 14 bp, Homo sapiens
acagtgcagggcaa

SEQ ID NO: 4478995 - DNA, 11 bp, Homo sapiens
acagtgcagtt

SEQ ID NO: 4478996 - DNA, 15 bp, Homo sapiens
acagtgccattgtct

SEQ ID NO: 4478997 - DNA, 11 bp, Homo sapiens
acagtgcctgc

SEQ ID NO: 4478998 - DNA, 16 bp, Homo sapiens
acagtgctcttttctc

SEQ ID NO: 4478999 - DNA, 14 bp, Homo sapiens
acagtgctgtctga

SEQ ID NO: 4479000 - DNA, 23 bp, Homo sapiens
acagtgctgtctgatctgtgctt

SEQ ID NO: 4479001 - DNA, 21 bp, Homo sapiens
acagtgcttttaagtgaaaat

SEQ ID NO: 4479002 - DNA, 15 bp, Homo sapiens
acagtggatcacaaa

SEQ ID NO: 4479003 - DNA, 17 bp, Homo sapiens
acagtggcgggcccact

SEQ ID NO: 4479004 - DNA, 18 bp, Homo sapiens
acagtggctcacacctgt

SEQ ID NO: 4479005 - DNA, 14 bp, Homo sapiens
acagtggctgctct

SEQ ID NO: 4479006 - DNA, 15 bp, Homo sapiens
acagtggctgctctg

SEQ ID NO: 4479007 - DNA, 23 bp, Homo sapiens
acagtgggcagcacctttctagc

SEQ ID NO: 4479008 - DNA, 19 bp, Homo sapiens
acagtgggcgttgggagcc

SEQ ID NO: 4479009 - DNA, 19 bp, Homo sapiens
acagtgtaatccaggggtg

SEQ ID NO: 4479010 - DNA, 15 bp, Homo sapiens
acagtgtacagtctt

SEQ ID NO: 4479011 - DNA, 19 bp, Homo sapiens
acagtgttagtgctggtca

SEQ ID NO: 4479012 - DNA, 14 bp, Homo sapiens
acagtgttttcaga

SEQ ID NO: 4479013 - DNA, 13 bp, Homo sapiens
acagttaaataaa

SEQ ID NO: 4479014 - DNA, 19 bp, Homo sapiens
acagttataaaattaaaag

SEQ ID NO: 4479015 - DNA, 13 bp, Homo sapiens
acagttcatttaa

SEQ ID NO: 4479016 - DNA, 13 bp, Homo sapiens
acagttcctggga

SEQ ID NO: 4479017 - DNA, 13 bp, Homo sapiens
acagttctgagct

SEQ ID NO: 4479018 - DNA, 14 bp, Homo sapiens
acagttctgagctg

SEQ ID NO: 4479019 - DNA, 15 bp, Homo sapiens
acagttctgtaatgt

SEQ ID NO: 4479020 - DNA, 16 bp, Homo sapiens
acagttctgtaatgta

SEQ ID NO: 4479021 - DNA, 19 bp, Homo sapiens
acagttcttggtgactgtc

SEQ ID NO: 4479022 - DNA, 17 bp, Homo sapiens
acagttgaaaacttgta

SEQ ID NO: 4479023 - DNA, 22 bp, Homo sapiens
acagttgaagggaggggctgtg

SEQ ID NO: 4479024 - DNA, 13 bp, Homo sapiens
acagttgcatgta

SEQ ID NO: 4479025 - DNA, 21 bp, Homo sapiens
acagttgccacatcacacaga

SEQ ID NO: 4479026 - DNA, 18 bp, Homo sapiens
acagttgctgttgtgtga

SEQ ID NO: 4479027 - DNA, 24 bp, Homo sapiens
acagttggtaacttttgtgaatta

SEQ ID NO: 4479028 - DNA, 16 bp, Homo sapiens
acagttgtatgtttgc

SEQ ID NO: 4479029 - DNA, 19 bp, Homo sapiens
acagtttatcatgaagcct

SEQ ID NO: 4479030 - DNA, 15 bp, Homo sapiens
acagtttatttttat

SEQ ID NO: 4479031 - DNA, 21 bp, Homo sapiens
acagttttaaagaatcattat

SEQ ID NO: 4479032 - DNA, 19 bp, Homo sapiens
acagttttaactgtggata

SEQ ID NO: 4479033 - DNA, 16 bp, Homo sapiens
acagttttctgagaaa

SEQ ID NO: 4479034 - DNA, 12 bp, Homo sapiens
acagttttgtct

SEQ ID NO: 4479035 - DNA, 19 bp, Homo sapiens
acagtttttaactctactg

SEQ ID NO: 4479036 - DNA, 15 bp, Homo sapiens
acataaaaaggacat

SEQ ID NO: 4479037 - DNA, 19 bp, Homo sapiens
acataaaaatgatctaaac

SEQ ID NO: 4479038 - DNA, 21 bp, Homo sapiens
acataaaccatttttgttact

SEQ ID NO: 4479039 - DNA, 12 bp, Homo sapiens
acataaagaaat

SEQ ID NO: 4479040 - DNA, 15 bp, Homo sapiens
acataaagttgtatt

SEQ ID NO: 4479041 - DNA, 20 bp, Homo sapiens
acataactgaaaatgtgcta

SEQ ID NO: 4479042 - DNA, 14 bp, Homo sapiens
acataactgcttct

SEQ ID NO: 4479043 - DNA, 16 bp, Homo sapiens
acataactgcttcttg

SEQ ID NO: 4479044 - DNA, 18 bp, Homo sapiens
acataactgcttcttgga

SEQ ID NO: 4479045 - DNA, 21 bp, Homo sapiens
acataactgcttcttggagct

SEQ ID NO: 4479046 - DNA, 12 bp, Homo sapiens
acataagaaggc

SEQ ID NO: 4479047 - DNA, 15 bp, Homo sapiens
acataagaaggcaat

SEQ ID NO: 4479048 - DNA, 13 bp, Homo sapiens
acataagagaaag

SEQ ID NO: 4479049 - DNA, 17 bp, Homo sapiens
acataagagagatgaga

SEQ ID NO: 4479050 - DNA, 15 bp, Homo sapiens
acataaggatgactt

SEQ ID NO: 4479051 - DNA, 20 bp, Homo sapiens
acataagttaatagaaagtt

SEQ ID NO: 4479052 - DNA, 19 bp, Homo sapiens
acataatgggccactgaaa

SEQ ID NO: 4479053 - DNA, 20 bp, Homo sapiens
acataatgggccactgaaat

SEQ ID NO: 4479054 - DNA, 17 bp, Homo sapiens
acataattatccaggaa

SEQ ID NO: 4479055 - DNA, 21 bp, Homo sapiens
acataattatttctaacacta

SEQ ID NO: 4479056 - DNA, 19 bp, Homo sapiens
acataattgcatgaaaata

SEQ ID NO: 4479057 - DNA, 19 bp, Homo sapiens
acataatttagttgtttct

SEQ ID NO: 4479058 - DNA, 21 bp, Homo sapiens
acataatttagtttcatataa

SEQ ID NO: 4479059 - DNA, 15 bp, Homo sapiens
acatacataatacaa

SEQ ID NO: 4479060 - DNA, 19 bp, Homo sapiens
acatacctaccagtattat

SEQ ID NO: 4479061 - DNA, 15 bp, Homo sapiens
acatacgcttttaat

SEQ ID NO: 4479062 - DNA, 16 bp, Homo sapiens
acatacgggaagttta

SEQ ID NO: 4479063 - DNA, 19 bp, Homo sapiens
acatacgggaagtttattt

SEQ ID NO: 4479064 - DNA, 13 bp, Homo sapiens
acatactcatttt

SEQ ID NO: 4479065 - DNA, 17 bp, Homo sapiens
acatactcatttttcat

SEQ ID NO: 4479066 - DNA, 18 bp, Homo sapiens
acatactgtaatcaaaag

SEQ ID NO: 4479067 - DNA, 16 bp, Homo sapiens
acatactttacagtaa

SEQ ID NO: 4479068 - DNA, 15 bp, Homo sapiens
acatactttatcaat

SEQ ID NO: 4479069 - DNA, 22 bp, Homo sapiens
acatactttcatcctgactctg

SEQ ID NO: 4479070 - DNA, 20 bp, Homo sapiens
acatagaaatggaaattttg

SEQ ID NO: 4479071 - DNA, 15 bp, Homo sapiens
acatagagcttttta

SEQ ID NO: 4479072 - DNA, 17 bp, Homo sapiens
acatagagctttttaat

SEQ ID NO: 4479073 - DNA, 20 bp, Homo sapiens
acatagaggtatattggaag

SEQ ID NO: 4479074 - DNA, 20 bp, Homo sapiens
acatagattcacctgtaaaa

SEQ ID NO: 4479075 - DNA, 22 bp, Homo sapiens
acatagcaaataaaataaatga

SEQ ID NO: 4479076 - DNA, 18 bp, Homo sapiens
acatagccaactctccca

SEQ ID NO: 4479077 - DNA, 21 bp, Homo sapiens
acataggcttctattacctat

SEQ ID NO: 4479078 - DNA, 20 bp, Homo sapiens
acataggtttttaaagacta

SEQ ID NO: 4479079 - DNA, 15 bp, Homo sapiens
acatagtattatgtc

SEQ ID NO: 4479080 - DNA, 18 bp, Homo sapiens
acatagtctgaagtgaag

SEQ ID NO: 4479081 - DNA, 17 bp, Homo sapiens
acatagttctgtaataa

SEQ ID NO: 4479082 - DNA, 18 bp, Homo sapiens
acatagttctgtaataaa

SEQ ID NO: 4479083 - DNA, 21 bp, Homo sapiens
acatataccacccatagtgct

SEQ ID NO: 4479084 - DNA, 19 bp, Homo sapiens
acatatatataacaaataa

SEQ ID NO: 4479085 - DNA, 16 bp, Homo sapiens
acatatcactgctgct

SEQ ID NO: 4479086 - DNA, 17 bp, Homo sapiens
acatatcctttggtcct

SEQ ID NO: 4479087 - DNA, 20 bp, Homo sapiens
acatatcctttggtcctggt

SEQ ID NO: 4479088 - DNA, 15 bp, Homo sapiens
acatatcttagatgg

SEQ ID NO: 4479089 - DNA, 15 bp, Homo sapiens
acatatgaaaataca

SEQ ID NO: 4479090 - DNA, 18 bp, Homo sapiens
acatatgatctgtctgtg

SEQ ID NO: 4479091 - DNA, 19 bp, Homo sapiens
acagcctcctctgtctgcc

SEQ ID NO: 4479092 - DNA, 22 bp, Homo sapiens
acagcctcctctgtctgccctt

SEQ ID NO: 4479093 - DNA, 14 bp, Homo sapiens
acagcctctacagc

SEQ ID NO: 4479094 - DNA, 18 bp, Homo sapiens
acagcctctacagccgtc

SEQ ID NO: 4479095 - DNA, 17 bp, Homo sapiens
acagcctctctcttttc

SEQ ID NO: 4479096 - DNA, 13 bp, Homo sapiens
acagcctcttttt

SEQ ID NO: 4479097 - DNA, 20 bp, Homo sapiens
acagcctgtggcggtgcctg

SEQ ID NO: 4479098 - DNA, 18 bp, Homo sapiens
acagcctgtttctatcct

SEQ ID NO: 4479099 - DNA, 23 bp, Homo sapiens
acagcctgtttctatcctgttta

SEQ ID NO: 4479100 - DNA, 21 bp, Homo sapiens
acagccttttttcctgggcca

SEQ ID NO: 4479101 - DNA, 19 bp, Homo sapiens
acagcgataagctttcaat

SEQ ID NO: 4479102 - DNA, 22 bp, Homo sapiens
acagcgctcgatggacctcagc

SEQ ID NO: 4479103 - DNA, 22 bp, Homo sapiens
acagcggtcagatagcatcaga

SEQ ID NO: 4479104 - DNA, 13 bp, Homo sapiens
acagcgttcctag

SEQ ID NO: 4479105 - DNA, 22 bp, Homo sapiens
acagcgttcctagagaagacag

SEQ ID NO: 4479106 - DNA, 22 bp, Homo sapiens
acagctaaccacttcgcacaca

SEQ ID NO: 4479107 - DNA, 21 bp, Homo sapiens
acagctaattctactcacagt

SEQ ID NO: 4479108 - DNA, 13 bp, Homo sapiens
acagctacaaact

SEQ ID NO: 4479109 - DNA, 18 bp, Homo sapiens
acagctacaaacttttaa

SEQ ID NO: 4479110 - DNA, 22 bp, Homo sapiens
acagctaggacttaaccttgaa

SEQ ID NO: 4479111 - DNA, 13 bp, Homo sapiens
acagctatttaga

SEQ ID NO: 4479112 - DNA, 19 bp, Homo sapiens
acagctcattaaacttttt

SEQ ID NO: 4479113 - DNA, 13 bp, Homo sapiens
acagctcccaccc

SEQ ID NO: 4479114 - DNA, 19 bp, Homo sapiens
acagctctgtttagaggag

SEQ ID NO: 4479115 - DNA, 16 bp, Homo sapiens
acagctgagtgggaac

SEQ ID NO: 4479116 - DNA, 17 bp, Homo sapiens
acagctgataaatttaa

SEQ ID NO: 4479117 - DNA, 21 bp, Homo sapiens
acagctgataaatttaatcct

SEQ ID NO: 4479118 - DNA, 12 bp, Homo sapiens
acagctgcctta

SEQ ID NO: 4479119 - DNA, 17 bp, Homo sapiens
acagctgccttagcttc

SEQ ID NO: 4479120 - DNA, 19 bp, Homo sapiens
acagctgccttagcttcag

SEQ ID NO: 4479121 - DNA, 22 bp, Homo sapiens
acagctgcctttcgtgatctta

SEQ ID NO: 4479122 - DNA, 17 bp, Homo sapiens
acagctgctgttctcag

SEQ ID NO: 4479123 - DNA, 12 bp, Homo sapiens
acagctggcctg

SEQ ID NO: 4479124 - DNA, 22 bp, Homo sapiens
acagctggtgcaaattcagaac

SEQ ID NO: 4479125 - DNA, 14 bp, Homo sapiens
acagctgtccctgt

SEQ ID NO: 4479126 - DNA, 18 bp, Homo sapiens
acagctgtccctgtcacc

SEQ ID NO: 4479127 - DNA, 17 bp, Homo sapiens
acagctgtgccgggagg

SEQ ID NO: 4479128 - DNA, 18 bp, Homo sapiens
acagcttagatttcatag

SEQ ID NO: 4479129 - DNA, 21 bp, Homo sapiens
acagcttcattttatttttga

SEQ ID NO: 4479130 - DNA, 13 bp, Homo sapiens
acagcttctctgc

SEQ ID NO: 4479131 - DNA, 14 bp, Homo sapiens
acagcttctctgca

SEQ ID NO: 4479132 - DNA, 17 bp, Homo sapiens
acagcttctctgcagta

SEQ ID NO: 4479133 - DNA, 20 bp, Homo sapiens
acagctttcatgattagcaa

SEQ ID NO: 4479134 - DNA, 21 bp, Homo sapiens
acagctttgtatgtttatgaa

SEQ ID NO: 4479135 - DNA, 17 bp, Homo sapiens
acaggaaaaaaactttt

SEQ ID NO: 4479136 - DNA, 23 bp, Homo sapiens
acaggaaaaaaacttttataaat

SEQ ID NO: 4479137 - DNA, 16 bp, Homo sapiens
acaggaaaatcctctg

SEQ ID NO: 4479138 - DNA, 18 bp, Homo sapiens
acaggaaaatcctctggc

SEQ ID NO: 4479139 - DNA, 19 bp, Homo sapiens
acaggaaactcctgtgacc

SEQ ID NO: 4479140 - DNA, 19 bp, Homo sapiens
acaggaaagccctccccct

SEQ ID NO: 4479141 - DNA, 23 bp, Homo sapiens
acaggaaatgggaaaaaacttaa

SEQ ID NO: 4479142 - DNA, 17 bp, Homo sapiens
acaggaaggaggggaga

SEQ ID NO: 4479143 - DNA, 17 bp, Homo sapiens
acaggaagtagaggagg

SEQ ID NO: 4479144 - DNA, 15 bp, Homo sapiens
acaggaatgaagaac

SEQ ID NO: 4479145 - DNA, 13 bp, Homo sapiens
acaggaatttaga

SEQ ID NO: 4479146 - DNA, 14 bp, Homo sapiens
acaggacagaatgt

SEQ ID NO: 4479147 - DNA, 15 bp, Homo sapiens
acaggacagaatgtg

SEQ ID NO: 4479148 - DNA, 13 bp, Homo sapiens
acaggagaaagga

SEQ ID NO: 4479149 - DNA, 12 bp, Homo sapiens
acaggagcactg

SEQ ID NO: 4479150 - DNA, 17 bp, Homo sapiens
acaggagcctagcggag

SEQ ID NO: 4479151 - DNA, 15 bp, Homo sapiens
acaggagggcagccc

SEQ ID NO: 4479152 - DNA, 17 bp, Homo sapiens
acaggagtgtcctcttc

SEQ ID NO: 4479153 - DNA, 14 bp, Homo sapiens
acaggatgaggaca

SEQ ID NO: 4479154 - DNA, 16 bp, Homo sapiens
acaggatgaggacaga

SEQ ID NO: 4479155 - DNA, 21 bp, Homo sapiens
acaggattaatatattgaaca

SEQ ID NO: 4479156 - DNA, 15 bp, Homo sapiens
acaggatttggccac

SEQ ID NO: 4479157 - DNA, 16 bp, Homo sapiens
acaggatttggccaca

SEQ ID NO: 4479158 - DNA, 21 bp, Homo sapiens
acaggatttggccacactggg

SEQ ID NO: 4479159 - DNA, 16 bp, Homo sapiens
acaggcaaagttttac

SEQ ID NO: 4479160 - DNA, 23 bp, Homo sapiens
acaggcagccagccgtggccaga

SEQ ID NO: 4479161 - DNA, 16 bp, Homo sapiens
acaggcagcccagcag

SEQ ID NO: 4479162 - DNA, 17 bp, Homo sapiens
acaggcagcccagcagt

SEQ ID NO: 4479163 - DNA, 17 bp, Homo sapiens
acaggccctccctgtct

SEQ ID NO: 4479164 - DNA, 17 bp, Homo sapiens
acaggcctatttaacaa

SEQ ID NO: 4479165 - DNA, 17 bp, Homo sapiens
acaggcctcttcctgtt

SEQ ID NO: 4479166 - DNA, 21 bp, Homo sapiens
acaggcctgagatttcatctg

SEQ ID NO: 4479167 - DNA, 13 bp, Homo sapiens
acaggcgggctcg

SEQ ID NO: 4479168 - DNA, 20 bp, Homo sapiens
acaggctggaagatagctgt

SEQ ID NO: 4479169 - DNA, 13 bp, Homo sapiens
acaggctgggtcc

SEQ ID NO: 4479170 - DNA, 22 bp, Homo sapiens
acaggctgggtcctgccagctg

SEQ ID NO: 4479171 - DNA, 20 bp, Homo sapiens
acagggaacattggagctga

SEQ ID NO: 4479172 - DNA, 14 bp, Homo sapiens
acagggaagctcac

SEQ ID NO: 4479173 - DNA, 13 bp, Homo sapiens
acagggacatgcc

SEQ ID NO: 4479174 - DNA, 16 bp, Homo sapiens
acagggaggattgaaa

SEQ ID NO: 4479175 - DNA, 18 bp, Homo sapiens
acagggataaggcctgtg

SEQ ID NO: 4479176 - DNA, 13 bp, Homo sapiens
acagggcagaaat

SEQ ID NO: 4479177 - DNA, 16 bp, Homo sapiens
acagggcagctgggcc

SEQ ID NO: 4479178 - DNA, 18 bp, Homo sapiens
acagggcagctgggccca

SEQ ID NO: 4479179 - DNA, 21 bp, Homo sapiens
acagggcagctgggcccaacc

SEQ ID NO: 4479180 - DNA, 16 bp, Homo sapiens
acagggccatgtgctg

SEQ ID NO: 4479181 - DNA, 18 bp, Homo sapiens
acagggccatgtgctgcc

SEQ ID NO: 4479182 - DNA, 19 bp, Homo sapiens
acagggccatgtgctgccc

SEQ ID NO: 4479183 - DNA, 17 bp, Homo sapiens
acagggcctctgcggag

SEQ ID NO: 4479184 - DNA, 18 bp, Homo sapiens
acagggctggcccagccc

SEQ ID NO: 4479185 - DNA, 20 bp, Homo sapiens
acagggctggcccagccctg

SEQ ID NO: 4479186 - DNA, 22 bp, Homo sapiens
acagggctgttttgcctcccca

SEQ ID NO: 4479187 - DNA, 20 bp, Homo sapiens
acaggggaggggcgcacccc

SEQ ID NO: 4479188 - DNA, 17 bp, Homo sapiens
acagggtagcaggtacc

SEQ ID NO: 4479189 - DNA, 16 bp, Homo sapiens
acagggtccaggaatg

SEQ ID NO: 4479190 - DNA, 18 bp, Homo sapiens
acagggtgggagggagga

SEQ ID NO: 4479191 - DNA, 16 bp, Homo sapiens
acaggtaaaacagggc

SEQ ID NO: 4479192 - DNA, 22 bp, Homo sapiens
acaggtagaattatctaattta

SEQ ID NO: 4479193 - DNA, 13 bp, Homo sapiens
acaggtagcacag

SEQ ID NO: 4479194 - DNA, 19 bp, Homo sapiens
acaggtggacaaatgttgt

SEQ ID NO: 4479195 - DNA, 11 bp, Homo sapiens
acaggttggga

SEQ ID NO: 4479196 - DNA, 18 bp, Homo sapiens
acaggttttatgtgttct

SEQ ID NO: 4479197 - DNA, 14 bp, Homo sapiens
acagtaaaaataaa

SEQ ID NO: 4479198 - DNA, 14 bp, Homo sapiens
acagtaaaattaag

SEQ ID NO: 4479199 - DNA, 17 bp, Homo sapiens
acagtaaaccactgaaa

SEQ ID NO: 4479200 - DNA, 20 bp, Homo sapiens
acagtaaaccactgaaaaaa

SEQ ID NO: 4479201 - DNA, 19 bp, Homo sapiens
acagtaaagagtacactca

SEQ ID NO: 4479202 - DNA, 16 bp, Homo sapiens
acagtaatgtcataaa

SEQ ID NO: 4479203 - DNA, 18 bp, Homo sapiens
acagtacctgattgtatt

SEQ ID NO: 4479204 - DNA, 16 bp, Homo sapiens
acagtacggatttgtc

SEQ ID NO: 4479205 - DNA, 14 bp, Homo sapiens
acagtagtcttgat

SEQ ID NO: 4479206 - DNA, 18 bp, Homo sapiens
acagtatataagcttttt

SEQ ID NO: 4479207 - DNA, 23 bp, Homo sapiens
acagtatattttatttcaatgta

SEQ ID NO: 4479208 - DNA, 19 bp, Homo sapiens
acagtattaacatcaaaga

SEQ ID NO: 4479209 - DNA, 20 bp, Homo sapiens
acagtattatacgctggcaa

SEQ ID NO: 4479210 - DNA, 21 bp, Homo sapiens
acagtattatagacaaaagaa

SEQ ID NO: 4479211 - DNA, 22 bp, Homo sapiens
acagaagctatttcatttgctg

SEQ ID NO: 4479212 - DNA, 19 bp, Homo sapiens
acagaatattaaatattat

SEQ ID NO: 4479213 - DNA, 22 bp, Homo sapiens
acagaatatttttatatttcct

SEQ ID NO: 4479214 - DNA, 23 bp, Homo sapiens
acagaatatttttatatttcctt

SEQ ID NO: 4479215 - DNA, 19 bp, Homo sapiens
acagaatcttgttttgaaa

SEQ ID NO: 4479216 - DNA, 16 bp, Homo sapiens
acagaatgtgttcttt

SEQ ID NO: 4479217 - DNA, 23 bp, Homo sapiens
acagaatttgaattatcagcaaa

SEQ ID NO: 4479218 - DNA, 13 bp, Homo sapiens
acagacaaaaaca

SEQ ID NO: 4479219 - DNA, 14 bp, Homo sapiens
acagacaaggagga

SEQ ID NO: 4479220 - DNA, 21 bp, Homo sapiens
acagacactcccacttggcat

SEQ ID NO: 4479221 - DNA, 13 bp, Homo sapiens
acagacaggagaa

SEQ ID NO: 4479222 - DNA, 15 bp, Homo sapiens
acagacaggagaaat

SEQ ID NO: 4479223 - DNA, 14 bp, Homo sapiens
acagacatatttaa

SEQ ID NO: 4479224 - DNA, 23 bp, Homo sapiens
acagaccacaggaagatgggagg

SEQ ID NO: 4479225 - DNA, 14 bp, Homo sapiens
acagaccccagctg

SEQ ID NO: 4479226 - DNA, 14 bp, Homo sapiens
acagactatttgct

SEQ ID NO: 4479227 - DNA, 14 bp, Homo sapiens
acagactccatctc

SEQ ID NO: 4479228 - DNA, 15 bp, Homo sapiens
acagactccatctct

SEQ ID NO: 4479229 - DNA, 24 bp, Homo sapiens
acagactccatctcttctgcaagc

SEQ ID NO: 4479230 - DNA, 16 bp, Homo sapiens
acagactcttcacaga

SEQ ID NO: 4479231 - DNA, 17 bp, Homo sapiens
acagactcttcacagat

SEQ ID NO: 4479232 - DNA, 17 bp, Homo sapiens
acagagaaatacaaaat

SEQ ID NO: 4479233 - DNA, 19 bp, Homo sapiens
acagagaatttctaaagta

SEQ ID NO: 4479234 - DNA, 21 bp, Homo sapiens
acagagactcagatgaggaca

SEQ ID NO: 4479235 - DNA, 13 bp, Homo sapiens
acagagaggacca

SEQ ID NO: 4479236 - DNA, 18 bp, Homo sapiens
acagagcacctgtagctg

SEQ ID NO: 4479237 - DNA, 20 bp, Homo sapiens
acagagcaggggctccagca

SEQ ID NO: 4479238 - DNA, 17 bp, Homo sapiens
acagagcccccctagca

SEQ ID NO: 4479239 - DNA, 20 bp, Homo sapiens
acagagcctggccccaggcc

SEQ ID NO: 4479240 - DNA, 17 bp, Homo sapiens
acagagcgagactccat

SEQ ID NO: 4479241 - DNA, 14 bp, Homo sapiens
acagagcttccctg

SEQ ID NO: 4479242 - DNA, 21 bp, Homo sapiens
acagaggaaagggctggctcc

SEQ ID NO: 4479243 - DNA, 12 bp, Homo sapiens
acagaggaagaa

SEQ ID NO: 4479244 - DNA, 20 bp, Homo sapiens
acagaggagggcgtgactca

SEQ ID NO: 4479245 - DNA, 15 bp, Homo sapiens
acagaggccccacct

SEQ ID NO: 4479246 - DNA, 14 bp, Homo sapiens
acagaggcctgccc

SEQ ID NO: 4479247 - DNA, 15 bp, Homo sapiens
acagagggaagccag

SEQ ID NO: 4479248 - DNA, 19 bp, Homo sapiens
acagagggagacagggctg

SEQ ID NO: 4479249 - DNA, 13 bp, Homo sapiens
acagagggagttt

SEQ ID NO: 4479250 - DNA, 20 bp, Homo sapiens
acagagggctagggaggtgg

SEQ ID NO: 4479251 - DNA, 14 bp, Homo sapiens
acagaggtaactat

SEQ ID NO: 4479252 - DNA, 23 bp, Homo sapiens
acagaggttgtagtgagccaaga

SEQ ID NO: 4479253 - DNA, 16 bp, Homo sapiens
acagagtgagaccctg

SEQ ID NO: 4479254 - DNA, 17 bp, Homo sapiens
acagagtgagactccat

SEQ ID NO: 4479255 - DNA, 15 bp, Homo sapiens
acagagtgctggact

SEQ ID NO: 4479256 - DNA, 19 bp, Homo sapiens
acagagtggcctccctgct

SEQ ID NO: 4479257 - DNA, 18 bp, Homo sapiens
acagagtttcaccatgtt

SEQ ID NO: 4479258 - DNA, 18 bp, Homo sapiens
acagataactgaaaatta

SEQ ID NO: 4479259 - DNA, 16 bp, Homo sapiens
acagataacttcttta

SEQ ID NO: 4479260 - DNA, 15 bp, Homo sapiens
acagatatactttgt

SEQ ID NO: 4479261 - DNA, 21 bp, Homo sapiens
acagatattgttataaataaa

SEQ ID NO: 4479262 - DNA, 14 bp, Homo sapiens
acagatccccagcc

SEQ ID NO: 4479263 - DNA, 20 bp, Homo sapiens
acagatccccagcccctcct

SEQ ID NO: 4479264 - DNA, 13 bp, Homo sapiens
acagatgagcagg

SEQ ID NO: 4479265 - DNA, 16 bp, Homo sapiens
acagatgagcaggagc

SEQ ID NO: 4479266 - DNA, 17 bp, Homo sapiens
acagatgagcaggagct

SEQ ID NO: 4479267 - DNA, 13 bp, Homo sapiens
acagatgagtcac

SEQ ID NO: 4479268 - DNA, 13 bp, Homo sapiens
acagatgcctggt

SEQ ID NO: 4479269 - DNA, 19 bp, Homo sapiens
acagatgcctggtgagcag

SEQ ID NO: 4479270 - DNA, 18 bp, Homo sapiens
acagatgctggtggagga

SEQ ID NO: 4479271 - DNA, 20 bp, Homo sapiens
acagatggagcaaatgtcct

SEQ ID NO: 4479272 - DNA, 13 bp, Homo sapiens
acagatgtgaaaa

SEQ ID NO: 4479273 - DNA, 17 bp, Homo sapiens
acagatgtgaaaatata

SEQ ID NO: 4479274 - DNA, 16 bp, Homo sapiens
acagatgtgaaatgaa

SEQ ID NO: 4479275 - DNA, 20 bp, Homo sapiens
acagatgtttgttttcaaaa

SEQ ID NO: 4479276 - DNA, 23 bp, Homo sapiens
acagatgtttttaattctagtat

SEQ ID NO: 4479277 - DNA, 23 bp, Homo sapiens
acagattaacctgaaagaacata

SEQ ID NO: 4479278 - DNA, 18 bp, Homo sapiens
acagattcaggccagccc

SEQ ID NO: 4479279 - DNA, 12 bp, Homo sapiens
acagattctttt

SEQ ID NO: 4479280 - DNA, 20 bp, Homo sapiens
acagattctttttttctgtc

SEQ ID NO: 4479281 - DNA, 16 bp, Homo sapiens
acagatttttatctta

SEQ ID NO: 4479282 - DNA, 15 bp, Homo sapiens
acagatttttttgta

SEQ ID NO: 4479283 - DNA, 16 bp, Homo sapiens
acagcaagatgtttct

SEQ ID NO: 4479284 - DNA, 15 bp, Homo sapiens
acagcaagccatcat

SEQ ID NO: 4479285 - DNA, 19 bp, Homo sapiens
acagcaagtacagcggctc

SEQ ID NO: 4479286 - DNA, 16 bp, Homo sapiens
acagcacagggaagca

SEQ ID NO: 4479287 - DNA, 18 bp, Homo sapiens
acagcaccaaaggctcag

SEQ ID NO: 4479288 - DNA, 13 bp, Homo sapiens
acagcactactct

SEQ ID NO: 4479289 - DNA, 17 bp, Homo sapiens
acagcactactgggtgt

SEQ ID NO: 4479290 - DNA, 18 bp, Homo sapiens
acagcactactgggtgtc

SEQ ID NO: 4479291 - DNA, 21 bp, Homo sapiens
acagcactactgggtgtcatt

SEQ ID NO: 4479292 - DNA, 19 bp, Homo sapiens
acagcacttttcctcttct

SEQ ID NO: 4479293 - DNA, 13 bp, Homo sapiens
acagcagaagcct

SEQ ID NO: 4479294 - DNA, 17 bp, Homo sapiens
acagcagacaccattca

SEQ ID NO: 4479295 - DNA, 22 bp, Homo sapiens
acagcagacaccattcattcca

SEQ ID NO: 4479296 - DNA, 14 bp, Homo sapiens
acagcagcagcctg

SEQ ID NO: 4479297 - DNA, 16 bp, Homo sapiens
acagcagcagcctgca

SEQ ID NO: 4479298 - DNA, 17 bp, Homo sapiens
acagcagcagcctgcac

SEQ ID NO: 4479299 - DNA, 19 bp, Homo sapiens
acagcagcagcctgcacct

SEQ ID NO: 4479300 - DNA, 21 bp, Homo sapiens
acagcagcagcctgcacctgc

SEQ ID NO: 4479301 - DNA, 23 bp, Homo sapiens
acagcagcagcctgcacctgccc

SEQ ID NO: 4479302 - DNA, 17 bp, Homo sapiens
acagcagccccaggaga

SEQ ID NO: 4479303 - DNA, 18 bp, Homo sapiens
acagcagccccaggagaa

SEQ ID NO: 4479304 - DNA, 19 bp, Homo sapiens
acagcagccccccagcact

SEQ ID NO: 4479305 - DNA, 16 bp, Homo sapiens
acagcaggctgccagt

SEQ ID NO: 4479306 - DNA, 15 bp, Homo sapiens
acagcagttgaaaag

SEQ ID NO: 4479307 - DNA, 20 bp, Homo sapiens
acagcatcgggagcacccag

SEQ ID NO: 4479308 - DNA, 21 bp, Homo sapiens
acagcatcgggagcacccaga

SEQ ID NO: 4479309 - DNA, 21 bp, Homo sapiens
acagcatgtgttaatcttaat

SEQ ID NO: 4479310 - DNA, 18 bp, Homo sapiens
acagccaactagcccctg

SEQ ID NO: 4479311 - DNA, 20 bp, Homo sapiens
acagccaagattttcctctt

SEQ ID NO: 4479312 - DNA, 23 bp, Homo sapiens
acagccaaggggatatttactgc

SEQ ID NO: 4479313 - DNA, 14 bp, Homo sapiens
acagccaagttgtg

SEQ ID NO: 4479314 - DNA, 16 bp, Homo sapiens
acagccagactggcac

SEQ ID NO: 4479315 - DNA, 15 bp, Homo sapiens
acagccagaggaggg

SEQ ID NO: 4479316 - DNA, 21 bp, Homo sapiens
acagccagttttactgtgatt

SEQ ID NO: 4479317 - DNA, 16 bp, Homo sapiens
acagcccaaaatttga

SEQ ID NO: 4479318 - DNA, 13 bp, Homo sapiens
acagcccaagagg

SEQ ID NO: 4479319 - DNA, 15 bp, Homo sapiens
acagcccaggatact

SEQ ID NO: 4479320 - DNA, 20 bp, Homo sapiens
acagcccaggatactggcac

SEQ ID NO: 4479321 - DNA, 21 bp, Homo sapiens
acagcccaggatactggcaca

SEQ ID NO: 4479322 - DNA, 19 bp, Homo sapiens
acagccccggggccccctg

SEQ ID NO: 4479323 - DNA, 20 bp, Homo sapiens
acagcccctatagcactgag

SEQ ID NO: 4479324 - DNA, 14 bp, Homo sapiens
acagcccctggagc

SEQ ID NO: 4479325 - DNA, 20 bp, Homo sapiens
acagccctggcaaatgcctg

SEQ ID NO: 4479326 - DNA, 21 bp, Homo sapiens
acagcctaaagctaaaaatat

SEQ ID NO: 4479327 - DNA, 15 bp, Homo sapiens
acagcctcccctgcc

SEQ ID NO: 4479328 - DNA, 18 bp, Homo sapiens
acagcctcccctgccagg

SEQ ID NO: 4479329 - DNA, 21 bp, Homo sapiens
acagcctcccctgccagggca

SEQ ID NO: 4479330 - DNA, 12 bp, Homo sapiens
acagcctcctct

SEQ ID NO: 4479331 - DNA, 23 bp, Homo sapiens
acaccatgtttgagctcagaccc

SEQ ID NO: 4479332 - DNA, 16 bp, Homo sapiens
acaccattaccaaaat

SEQ ID NO: 4479333 - DNA, 18 bp, Homo sapiens
acaccattatgtttaaga

SEQ ID NO: 4479334 - DNA, 14 bp, Homo sapiens
acaccattcattcc

SEQ ID NO: 4479335 - DNA, 17 bp, Homo sapiens
acaccattgaaggctta

SEQ ID NO: 4479336 - DNA, 21 bp, Homo sapiens
acacccaaggattctgttctg

SEQ ID NO: 4479337 - DNA, 13 bp, Homo sapiens
acacccagaggtc

SEQ ID NO: 4479338 - DNA, 13 bp, Homo sapiens
acacccaggaagg

SEQ ID NO: 4479339 - DNA, 22 bp, Homo sapiens
acacccaggggaaggccctgag

SEQ ID NO: 4479340 - DNA, 15 bp, Homo sapiens
acacccctctgctgc

SEQ ID NO: 4479341 - DNA, 20 bp, Homo sapiens
acaccctgagcttttgccac

SEQ ID NO: 4479342 - DNA, 11 bp, Homo sapiens
acaccctggcc

SEQ ID NO: 4479343 - DNA, 12 bp, Homo sapiens
acaccctggcct

SEQ ID NO: 4479344 - DNA, 17 bp, Homo sapiens
acaccctggcctgaact

SEQ ID NO: 4479345 - DNA, 24 bp, Homo sapiens
acaccgagtctctgtataatctat

SEQ ID NO: 4479346 - DNA, 18 bp, Homo sapiens
acaccgcgtcccagctcc

SEQ ID NO: 4479347 - DNA, 20 bp, Homo sapiens
acaccgcgtcccagctcccc

SEQ ID NO: 4479348 - DNA, 18 bp, Homo sapiens
acaccgtacatctgcaat

SEQ ID NO: 4479349 - DNA, 23 bp, Homo sapiens
acacctagccagctgtcaagggc

SEQ ID NO: 4479350 - DNA, 20 bp, Homo sapiens
acacctaggctagggtgggg

SEQ ID NO: 4479351 - DNA, 14 bp, Homo sapiens
acacctccccctgc

SEQ ID NO: 4479352 - DNA, 19 bp, Homo sapiens
acacctccccctgcgcccc

SEQ ID NO: 4479353 - DNA, 22 bp, Homo sapiens
acacctccccctgcgccccgca

SEQ ID NO: 4479354 - DNA, 13 bp, Homo sapiens
acacctccccctt

SEQ ID NO: 4479355 - DNA, 16 bp, Homo sapiens
acacctccctgtgaag

SEQ ID NO: 4479356 - DNA, 15 bp, Homo sapiens
acacctcctcccgaa

SEQ ID NO: 4479357 - DNA, 19 bp, Homo sapiens
acacctgcccgctccccac

SEQ ID NO: 4479358 - DNA, 18 bp, Homo sapiens
acacctgccttctaccct

SEQ ID NO: 4479359 - DNA, 15 bp, Homo sapiens
acacctggactgagc

SEQ ID NO: 4479360 - DNA, 21 bp, Homo sapiens
acacctggcatggtgcaggga

SEQ ID NO: 4479361 - DNA, 23 bp, Homo sapiens
acacctggctgaggttcctctgc

SEQ ID NO: 4479362 - DNA, 12 bp, Homo sapiens
acacctgtacat

SEQ ID NO: 4479363 - DNA, 17 bp, Homo sapiens
acaccttcctcctgcag

SEQ ID NO: 4479364 - DNA, 20 bp, Homo sapiens
acaccttcctcctgcagaca

SEQ ID NO: 4479365 - DNA, 19 bp, Homo sapiens
acaccttggggtccctcca

SEQ ID NO: 4479366 - DNA, 23 bp, Homo sapiens
acaccttggggtccctccacccc

SEQ ID NO: 4479367 - DNA, 14 bp, Homo sapiens
acacgaaagaaatg

SEQ ID NO: 4479368 - DNA, 15 bp, Homo sapiens
acacgaaagaaatgt

SEQ ID NO: 4479369 - DNA, 19 bp, Homo sapiens
acacgagcaggctactgtc

SEQ ID NO: 4479370 - DNA, 21 bp, Homo sapiens
acacgagcaggctactgtcag

SEQ ID NO: 4479371 - DNA, 12 bp, Homo sapiens
acacgagccaca

SEQ ID NO: 4479372 - DNA, 13 bp, Homo sapiens
acacgcagttgct

SEQ ID NO: 4479373 - DNA, 16 bp, Homo sapiens
acacgcttctgagcag

SEQ ID NO: 4479374 - DNA, 19 bp, Homo sapiens
acacgtatttgaatggcct

SEQ ID NO: 4479375 - DNA, 17 bp, Homo sapiens
acacgttctgatttctg

SEQ ID NO: 4479376 - DNA, 17 bp, Homo sapiens
acacgtttaatcccagc

SEQ ID NO: 4479377 - DNA, 18 bp, Homo sapiens
acacgtttaatcccagca

SEQ ID NO: 4479378 - DNA, 22 bp, Homo sapiens
acacgtttaatcccagcacttt

SEQ ID NO: 4479379 - DNA, 20 bp, Homo sapiens
acactaatatatttaaaaat

SEQ ID NO: 4479380 - DNA, 21 bp, Homo sapiens
acactaatatatttaaaaata

SEQ ID NO: 4479381 - DNA, 19 bp, Homo sapiens
acactatcatagttaacat

SEQ ID NO: 4479382 - DNA, 13 bp, Homo sapiens
acactattttcag

SEQ ID NO: 4479383 - DNA, 17 bp, Homo sapiens
acactcaaatcaagaaa

SEQ ID NO: 4479384 - DNA, 17 bp, Homo sapiens
acactcaaggacaggag

SEQ ID NO: 4479385 - DNA, 21 bp, Homo sapiens
acactcaaggacaggagcctg

SEQ ID NO: 4479386 - DNA, 22 bp, Homo sapiens
acactcaaggacaggagcctgg

SEQ ID NO: 4479387 - DNA, 23 bp, Homo sapiens
acactcaaggacaggagcctggt

SEQ ID NO: 4479388 - DNA, 21 bp, Homo sapiens
acactcactcctgagacccct

SEQ ID NO: 4479389 - DNA, 17 bp, Homo sapiens
acactcagccactgtca

SEQ ID NO: 4479390 - DNA, 16 bp, Homo sapiens
acactccacattcttc

SEQ ID NO: 4479391 - DNA, 19 bp, Homo sapiens
acactccccacttcacttt

SEQ ID NO: 4479392 - DNA, 14 bp, Homo sapiens
acactcccttgggc

SEQ ID NO: 4479393 - DNA, 22 bp, Homo sapiens
acactcctctatcatgcaaaaa

SEQ ID NO: 4479394 - DNA, 15 bp, Homo sapiens
acactcgtcacccca

SEQ ID NO: 4479395 - DNA, 18 bp, Homo sapiens
acactctatatgtagtgc

SEQ ID NO: 4479396 - DNA, 13 bp, Homo sapiens
acactctcctggg

SEQ ID NO: 4479397 - DNA, 14 bp, Homo sapiens
acactctcctgggc

SEQ ID NO: 4479398 - DNA, 15 bp, Homo sapiens
acactctcctgggcc

SEQ ID NO: 4479399 - DNA, 16 bp, Homo sapiens
acactctcctgggccc

SEQ ID NO: 4479400 - DNA, 21 bp, Homo sapiens
acactctcctgggcccctccc

SEQ ID NO: 4479401 - DNA, 16 bp, Homo sapiens
acactctgctgtttga

SEQ ID NO: 4479402 - DNA, 23 bp, Homo sapiens
acactctgtattgaaaatggctt

SEQ ID NO: 4479403 - DNA, 13 bp, Homo sapiens
acactgaaagttt

SEQ ID NO: 4479404 - DNA, 17 bp, Homo sapiens
acactgaaagttttgta

SEQ ID NO: 4479405 - DNA, 12 bp, Homo sapiens
acactgaaataa

SEQ ID NO: 4479406 - DNA, 15 bp, Homo sapiens
acactgaccaagtgc

SEQ ID NO: 4479407 - DNA, 18 bp, Homo sapiens
acactgcaagagccttgg

SEQ ID NO: 4479408 - DNA, 15 bp, Homo sapiens
acactgcactttgtt

SEQ ID NO: 4479409 - DNA, 18 bp, Homo sapiens
acactgcactttgtttag

SEQ ID NO: 4479410 - DNA, 14 bp, Homo sapiens
acactgccaccttg

SEQ ID NO: 4479411 - DNA, 13 bp, Homo sapiens
acactgctctaac

SEQ ID NO: 4479412 - DNA, 21 bp, Homo sapiens
acactggggctgacacccagg

SEQ ID NO: 4479413 - DNA, 22 bp, Homo sapiens
acactggggctgacacccaggc

SEQ ID NO: 4479414 - DNA, 13 bp, Homo sapiens
acactgggtggtg

SEQ ID NO: 4479415 - DNA, 19 bp, Homo sapiens
acactgggtggtggcctgg

SEQ ID NO: 4479416 - DNA, 18 bp, Homo sapiens
acactgtatgttatagaa

SEQ ID NO: 4479417 - DNA, 18 bp, Homo sapiens
acactgtattttaatgta

SEQ ID NO: 4479418 - DNA, 19 bp, Homo sapiens
acactgttagaacactatt

SEQ ID NO: 4479419 - DNA, 15 bp, Homo sapiens
acactgtttccatgt

SEQ ID NO: 4479420 - DNA, 13 bp, Homo sapiens
acacttaatcatt

SEQ ID NO: 4479421 - DNA, 15 bp, Homo sapiens
acacttatattttat

SEQ ID NO: 4479422 - DNA, 18 bp, Homo sapiens
acacttatggaattttta

SEQ ID NO: 4479423 - DNA, 18 bp, Homo sapiens
acacttcacgtattcttg

SEQ ID NO: 4479424 - DNA, 20 bp, Homo sapiens
acacttccagtctggagagc

SEQ ID NO: 4479425 - DNA, 20 bp, Homo sapiens
acacttctgtgagaccccca

SEQ ID NO: 4479426 - DNA, 14 bp, Homo sapiens
acacttgctcccaa

SEQ ID NO: 4479427 - DNA, 17 bp, Homo sapiens
acacttggcatacaaaa

SEQ ID NO: 4479428 - DNA, 22 bp, Homo sapiens
acactttaattaccaacctgtt

SEQ ID NO: 4479429 - DNA, 21 bp, Homo sapiens
acactttgccaaggctctccc

SEQ ID NO: 4479430 - DNA, 17 bp, Homo sapiens
acactttttacagcagc

SEQ ID NO: 4479431 - DNA, 20 bp, Homo sapiens
acactttttacagcagcaat

SEQ ID NO: 4479432 - DNA, 21 bp, Homo sapiens
acactttttacagcagcaata

SEQ ID NO: 4479433 - DNA, 21 bp, Homo sapiens
acagaaaaagaaggttgaggg

SEQ ID NO: 4479434 - DNA, 9 bp, Homo sapiens
acagaaaac

SEQ ID NO: 4479435 - DNA, 22 bp, Homo sapiens
acagaaaacatgtataaatata

SEQ ID NO: 4479436 - DNA, 21 bp, Homo sapiens
acagaaaacctgatgctgggg

SEQ ID NO: 4479437 - DNA, 22 bp, Homo sapiens
acagaaaactcccaatacaaag

SEQ ID NO: 4479438 - DNA, 12 bp, Homo sapiens
acagaaaattta

SEQ ID NO: 4479439 - DNA, 17 bp, Homo sapiens
acagaaaatttaactta

SEQ ID NO: 4479440 - DNA, 20 bp, Homo sapiens
acagaaacctttttaaaaat

SEQ ID NO: 4479441 - DNA, 23 bp, Homo sapiens
acagaaactaaactcttaccata

SEQ ID NO: 4479442 - DNA, 15 bp, Homo sapiens
acagaaagagggaca

SEQ ID NO: 4479443 - DNA, 15 bp, Homo sapiens
acagaaattgtatat

SEQ ID NO: 4479444 - DNA, 14 bp, Homo sapiens
acagaacccacagt

SEQ ID NO: 4479445 - DNA, 17 bp, Homo sapiens
acagaacccacagtaga

SEQ ID NO: 4479446 - DNA, 17 bp, Homo sapiens
acagaaccttcaaccca

SEQ ID NO: 4479447 - DNA, 18 bp, Homo sapiens
acagaactctttcaaaac

SEQ ID NO: 4479448 - DNA, 12 bp, Homo sapiens
acagaagaaaca

SEQ ID NO: 4479449 - DNA, 14 bp, Homo sapiens
acagaagaaacaag

SEQ ID NO: 4479450 - DNA, 15 bp, Homo sapiens
acagaagctatttca

SEQ ID NO: 4479451 - DNA, 13 bp, Homo sapiens
acaatattcctat

SEQ ID NO: 4479452 - DNA, 19 bp, Homo sapiens
acaatcaaaggaaaatagt

SEQ ID NO: 4479453 - DNA, 18 bp, Homo sapiens
acaatcagctccttcctg

SEQ ID NO: 4479454 - DNA, 18 bp, Homo sapiens
acaatctaacaataatat

SEQ ID NO: 4479455 - DNA, 13 bp, Homo sapiens
acaatctcttaaa

SEQ ID NO: 4479456 - DNA, 15 bp, Homo sapiens
acaatcttatgtttc

SEQ ID NO: 4479457 - DNA, 16 bp, Homo sapiens
acaatctttcatgtct

SEQ ID NO: 4479458 - DNA, 14 bp, Homo sapiens
acaatgaaaacaaa

SEQ ID NO: 4479459 - DNA, 14 bp, Homo sapiens
acaatgaaattttt

SEQ ID NO: 4479460 - DNA, 24 bp, Homo sapiens
acaatgaacatccctttttcaatg

SEQ ID NO: 4479461 - DNA, 16 bp, Homo sapiens
acaatgacatttatat

SEQ ID NO: 4479462 - DNA, 16 bp, Homo sapiens
acaatgccttgttgta

SEQ ID NO: 4479463 - DNA, 19 bp, Homo sapiens
acaatggggctggttttgc

SEQ ID NO: 4479464 - DNA, 14 bp, Homo sapiens
acaatgtacaatta

SEQ ID NO: 4479465 - DNA, 16 bp, Homo sapiens
acaatgtagaaaatga

SEQ ID NO: 4479466 - DNA, 11 bp, Homo sapiens
acaatgtatac

SEQ ID NO: 4479467 - DNA, 17 bp, Homo sapiens
acaatgtatacaatgca

SEQ ID NO: 4479468 - DNA, 22 bp, Homo sapiens
acaatgtatctttattaaaaca

SEQ ID NO: 4479469 - DNA, 15 bp, Homo sapiens
acaatgtatgtacaa

SEQ ID NO: 4479470 - DNA, 22 bp, Homo sapiens
acaatgtatgtacaatacaatg

SEQ ID NO: 4479471 - DNA, 18 bp, Homo sapiens
acaatgtgattttatggt

SEQ ID NO: 4479472 - DNA, 17 bp, Homo sapiens
acaatgtttcttcattt

SEQ ID NO: 4479473 - DNA, 18 bp, Homo sapiens
acaattaaaccgcatgtg

SEQ ID NO: 4479474 - DNA, 13 bp, Homo sapiens
acaattagatttc

SEQ ID NO: 4479475 - DNA, 14 bp, Homo sapiens
acaattcctccaga

SEQ ID NO: 4479476 - DNA, 20 bp, Homo sapiens
acaattcctccagagacact

SEQ ID NO: 4479477 - DNA, 17 bp, Homo sapiens
acaattctaaaatgatt

SEQ ID NO: 4479478 - DNA, 24 bp, Homo sapiens
acaattgatctgtcatccatattt

SEQ ID NO: 4479479 - DNA, 22 bp, Homo sapiens
acaattggtaaaactcactgtg

SEQ ID NO: 4479480 - DNA, 23 bp, Homo sapiens
acaattggtaaaactcactgtga

SEQ ID NO: 4479481 - DNA, 18 bp, Homo sapiens
acaattggtgtcattttc

SEQ ID NO: 4479482 - DNA, 21 bp, Homo sapiens
acaattgtcgaaaagagtctt

SEQ ID NO: 4479483 - DNA, 21 bp, Homo sapiens
acaatttgcacaatatttctt

SEQ ID NO: 4479484 - DNA, 19 bp, Homo sapiens
acaatttgtttttgcattt

SEQ ID NO: 4479485 - DNA, 23 bp, Homo sapiens
acaatttgtttttgcatttttgt

SEQ ID NO: 4479486 - DNA, 13 bp, Homo sapiens
acaattttaaagt

SEQ ID NO: 4479487 - DNA, 15 bp, Homo sapiens
acaattttcctgtgg

SEQ ID NO: 4479488 - DNA, 23 bp, Homo sapiens
acaattttctgtaatcttttatt

SEQ ID NO: 4479489 - DNA, 19 bp, Homo sapiens
acaatttttatttctttta

SEQ ID NO: 4479490 - DNA, 21 bp, Homo sapiens
acaatttttatttcttttact

SEQ ID NO: 4479491 - DNA, 22 bp, Homo sapiens
acaattttttatcatgcatgtc

SEQ ID NO: 4479492 - DNA, 18 bp, Homo sapiens
acacaaaaataaagacta

SEQ ID NO: 4479493 - DNA, 16 bp, Homo sapiens
acacaaactgtaaata

SEQ ID NO: 4479494 - DNA, 18 bp, Homo sapiens
acacaacccaataggagt

SEQ ID NO: 4479495 - DNA, 19 bp, Homo sapiens
acacaacgattatagtaac

SEQ ID NO: 4479496 - DNA, 17 bp, Homo sapiens
acacaacggcagtgaag

SEQ ID NO: 4479497 - DNA, 18 bp, Homo sapiens
acacaataggtctttctc

SEQ ID NO: 4479498 - DNA, 23 bp, Homo sapiens
acacaataggtctttctctcagt

SEQ ID NO: 4479499 - DNA, 22 bp, Homo sapiens
acacaatggtttttaaattttg

SEQ ID NO: 4479500 - DNA, 23 bp, Homo sapiens
acacaatttaattcctcttttta

SEQ ID NO: 4479501 - DNA, 18 bp, Homo sapiens
acacaatttcatttccag

SEQ ID NO: 4479502 - DNA, 21 bp, Homo sapiens
acacaatttcatttccagcat

SEQ ID NO: 4479503 - DNA, 16 bp, Homo sapiens
acacacaataaagaac

SEQ ID NO: 4479504 - DNA, 13 bp, Homo sapiens
acacacagcagtg

SEQ ID NO: 4479505 - DNA, 12 bp, Homo sapiens
acacacatgcat

SEQ ID NO: 4479506 - DNA, 17 bp, Homo sapiens
acacacattctgccttg

SEQ ID NO: 4479507 - DNA, 14 bp, Homo sapiens
acacaccaatcagc

SEQ ID NO: 4479508 - DNA, 14 bp, Homo sapiens
acacaccttaaaac

SEQ ID NO: 4479509 - DNA, 15 bp, Homo sapiens
acacactcaaatcaa

SEQ ID NO: 4479510 - DNA, 16 bp, Homo sapiens
acacactcagccacaa

SEQ ID NO: 4479511 - DNA, 15 bp, Homo sapiens
acacactgcacatct

SEQ ID NO: 4479512 - DNA, 16 bp, Homo sapiens
acacactgtgctttct

SEQ ID NO: 4479513 - DNA, 19 bp, Homo sapiens
acacactgtgctttctatt

SEQ ID NO: 4479514 - DNA, 21 bp, Homo sapiens
acacactgtgctttctattgt

SEQ ID NO: 4479515 - DNA, 20 bp, Homo sapiens
acacagaaaatgttgagaat

SEQ ID NO: 4479516 - DNA, 21 bp, Homo sapiens
acacagaaacctttttaaaaa

SEQ ID NO: 4479517 - DNA, 16 bp, Homo sapiens
acacagaatagtttac

SEQ ID NO: 4479518 - DNA, 15 bp, Homo sapiens
acacagagaaataca

SEQ ID NO: 4479519 - DNA, 19 bp, Homo sapiens
acacagagaaatacaaaat

SEQ ID NO: 4479520 - DNA, 15 bp, Homo sapiens
acacagagtgaggga

SEQ ID NO: 4479521 - DNA, 16 bp, Homo sapiens
acacagatagaccttt

SEQ ID NO: 4479522 - DNA, 14 bp, Homo sapiens
acacagcagtgtga

SEQ ID NO: 4479523 - DNA, 16 bp, Homo sapiens
acacagcatcagctca

SEQ ID NO: 4479524 - DNA, 18 bp, Homo sapiens
acacagcattgtatatgt

SEQ ID NO: 4479525 - DNA, 13 bp, Homo sapiens
acacagcccaaga

SEQ ID NO: 4479526 - DNA, 17 bp, Homo sapiens
acacagctgagcactta

SEQ ID NO: 4479527 - DNA, 13 bp, Homo sapiens
acacagctgcttt

SEQ ID NO: 4479528 - DNA, 18 bp, Homo sapiens
acacaggcagccagccgt

SEQ ID NO: 4479529 - DNA, 20 bp, Homo sapiens
acacaggcagccagccgtgg

SEQ ID NO: 4479530 - DNA, 14 bp, Homo sapiens
acacaggcagggcc

SEQ ID NO: 4479531 - DNA, 15 bp, Homo sapiens
acacaggcagggcct

SEQ ID NO: 4479532 - DNA, 16 bp, Homo sapiens
acacaggctgtcctta

SEQ ID NO: 4479533 - DNA, 16 bp, Homo sapiens
acacaggggcttgact

SEQ ID NO: 4479534 - DNA, 22 bp, Homo sapiens
acacaggggcttgactttttca

SEQ ID NO: 4479535 - DNA, 19 bp, Homo sapiens
acacaggtctcattgcttc

SEQ ID NO: 4479536 - DNA, 21 bp, Homo sapiens
acacagtattcagagtctctg

SEQ ID NO: 4479537 - DNA, 15 bp, Homo sapiens
acacagtgagactgt

SEQ ID NO: 4479538 - DNA, 16 bp, Homo sapiens
acacagtgagactgta

SEQ ID NO: 4479539 - DNA, 19 bp, Homo sapiens
acacagtgatgaatgtact

SEQ ID NO: 4479540 - DNA, 14 bp, Homo sapiens
acacagtgttagtg

SEQ ID NO: 4479541 - DNA, 20 bp, Homo sapiens
acacagtgttagtgctggtc

SEQ ID NO: 4479542 - DNA, 18 bp, Homo sapiens
acacagttcctgggaaca

SEQ ID NO: 4479543 - DNA, 14 bp, Homo sapiens
acacagttttgtct

SEQ ID NO: 4479544 - DNA, 15 bp, Homo sapiens
acacataatttctgt

SEQ ID NO: 4479545 - DNA, 20 bp, Homo sapiens
acacatagttctgtaataaa

SEQ ID NO: 4479546 - DNA, 20 bp, Homo sapiens
acacatattgttttaaaata

SEQ ID NO: 4479547 - DNA, 20 bp, Homo sapiens
acacatcaagactatctaca

SEQ ID NO: 4479548 - DNA, 19 bp, Homo sapiens
acacatgccaacacttaat

SEQ ID NO: 4479549 - DNA, 19 bp, Homo sapiens
acacatgtgttatctacct

SEQ ID NO: 4479550 - DNA, 23 bp, Homo sapiens
acacatgtgttatctacctcaag

SEQ ID NO: 4479551 - DNA, 21 bp, Homo sapiens
acacattataaagttcagatg

SEQ ID NO: 4479552 - DNA, 14 bp, Homo sapiens
acacattctgcctt

SEQ ID NO: 4479553 - DNA, 17 bp, Homo sapiens
acacattcttgcttgtg

SEQ ID NO: 4479554 - DNA, 20 bp, Homo sapiens
acacattgcagcttcaactt

SEQ ID NO: 4479555 - DNA, 19 bp, Homo sapiens
acacatttcttaaaacaca

SEQ ID NO: 4479556 - DNA, 21 bp, Homo sapiens
acacatttgggatgttccttt

SEQ ID NO: 4479557 - DNA, 22 bp, Homo sapiens
acacatttttggatttctgtga

SEQ ID NO: 4479558 - DNA, 23 bp, Homo sapiens
acacatttttggatttctgtgaa

SEQ ID NO: 4479559 - DNA, 17 bp, Homo sapiens
acaccaatcagcgctct

SEQ ID NO: 4479560 - DNA, 16 bp, Homo sapiens
acaccaatgaaaacat

SEQ ID NO: 4479561 - DNA, 23 bp, Homo sapiens
acaccaatgccgccgtgtttcct

SEQ ID NO: 4479562 - DNA, 21 bp, Homo sapiens
acaccactgccattacccagt

SEQ ID NO: 4479563 - DNA, 12 bp, Homo sapiens
acaccagagctg

SEQ ID NO: 4479564 - DNA, 13 bp, Homo sapiens
acaccagagctgc

SEQ ID NO: 4479565 - DNA, 17 bp, Homo sapiens
acaccagagctgccgac

SEQ ID NO: 4479566 - DNA, 12 bp, Homo sapiens
acaccagccagg

SEQ ID NO: 4479567 - DNA, 17 bp, Homo sapiens
acaccagccaggctctg

SEQ ID NO: 4479568 - DNA, 20 bp, Homo sapiens
acaccataagctactgccat

SEQ ID NO: 4479569 - DNA, 22 bp, Homo sapiens
acaccataagctactgccatcc

SEQ ID NO: 4479570 - DNA, 15 bp, Homo sapiens
acaccatgtgcaata

SEQ ID NO: 4479571 - DNA, 17 bp, Homo sapiens
aatattccctagaaact

SEQ ID NO: 4479572 - DNA, 12 bp, Homo sapiens
aatattctctct

SEQ ID NO: 4479573 - DNA, 14 bp, Homo sapiens
aatattctgaatca

SEQ ID NO: 4479574 - DNA, 18 bp, Homo sapiens
aatattctgttttgttaa

SEQ ID NO: 4479575 - DNA, 16 bp, Homo sapiens
aatattgaaaattgaa

SEQ ID NO: 4479576 - DNA, 15 bp, Homo sapiens
aatattgaagttgtt

SEQ ID NO: 4479577 - DNA, 18 bp, Homo sapiens
aatattgagcaatatgtc

SEQ ID NO: 4479578 - DNA, 19 bp, Homo sapiens
aatattgagcagaattcat

SEQ ID NO: 4479579 - DNA, 21 bp, Homo sapiens
aatattgcccaaataatattt

SEQ ID NO: 4479580 - DNA, 17 bp, Homo sapiens
aatattgctaaaagcat

SEQ ID NO: 4479581 - DNA, 21 bp, Homo sapiens
aatattgctaaaagcatgtat

SEQ ID NO: 4479582 - DNA, 19 bp, Homo sapiens
aatattgcttcaatttcaa

SEQ ID NO: 4479583 - DNA, 20 bp, Homo sapiens
aatattgcttcaatttcaaa

SEQ ID NO: 4479584 - DNA, 22 bp, Homo sapiens
aatattgcttcttgtgttttac

SEQ ID NO: 4479585 - DNA, 14 bp, Homo sapiens
aatattgtatattt

SEQ ID NO: 4479586 - DNA, 22 bp, Homo sapiens
aatattgtgttgtgcagcatta

SEQ ID NO: 4479587 - DNA, 23 bp, Homo sapiens
aatattgtttctgcattcatttt

SEQ ID NO: 4479588 - DNA, 18 bp, Homo sapiens
aatattgttttacaatag

SEQ ID NO: 4479589 - DNA, 18 bp, Homo sapiens
aatattgtttttctttct

SEQ ID NO: 4479590 - DNA, 19 bp, Homo sapiens
aatatttaagtgaaggaga

SEQ ID NO: 4479591 - DNA, 20 bp, Homo sapiens
aatatttaagtgaaggagaa

SEQ ID NO: 4479592 - DNA, 22 bp, Homo sapiens
aatatttaggagtctattttgt

SEQ ID NO: 4479593 - DNA, 22 bp, Homo sapiens
aatatttattcattatttgtca

SEQ ID NO: 4479594 - DNA, 19 bp, Homo sapiens
aatatttattttcttcccc

SEQ ID NO: 4479595 - DNA, 14 bp, Homo sapiens
aatatttcaagtgc

SEQ ID NO: 4479596 - DNA, 12 bp, Homo sapiens
aatatttcttaa

SEQ ID NO: 4479597 - DNA, 12 bp, Homo sapiens
aatatttcttca

SEQ ID NO: 4479598 - DNA, 15 bp, Homo sapiens
aatatttcttcaaat

SEQ ID NO: 4479599 - DNA, 22 bp, Homo sapiens
aatatttcttttgttgtacttt

SEQ ID NO: 4479600 - DNA, 14 bp, Homo sapiens
aatatttgaattgc

SEQ ID NO: 4479601 - DNA, 13 bp, Homo sapiens
aatatttgcttta

SEQ ID NO: 4479602 - DNA, 15 bp, Homo sapiens
aatatttgctttata

SEQ ID NO: 4479603 - DNA, 14 bp, Homo sapiens
aatatttgttttaa

SEQ ID NO: 4479604 - DNA, 10 bp, Homo sapiens
aatattttaa

SEQ ID NO: 4479605 - DNA, 11 bp, Homo sapiens
aatattttaaa

SEQ ID NO: 4479606 - DNA, 14 bp, Homo sapiens
aatattttaacttt

SEQ ID NO: 4479607 - DNA, 14 bp, Homo sapiens
aatattttaataaa

SEQ ID NO: 4479608 - DNA, 21 bp, Homo sapiens
aatattttaggtgtaaaataa

SEQ ID NO: 4479609 - DNA, 13 bp, Homo sapiens
aatattttatcct

SEQ ID NO: 4479610 - DNA, 20 bp, Homo sapiens
aatattttcaagtttttcat

SEQ ID NO: 4479611 - DNA, 14 bp, Homo sapiens
aatattttcttttc

SEQ ID NO: 4479612 - DNA, 15 bp, Homo sapiens
aatattttgaatcaa

SEQ ID NO: 4479613 - DNA, 16 bp, Homo sapiens
aatattttgaatcaat

SEQ ID NO: 4479614 - DNA, 18 bp, Homo sapiens
aatattttgaatcaataa

SEQ ID NO: 4479615 - DNA, 11 bp, Homo sapiens
aatattttgat

SEQ ID NO: 4479616 - DNA, 15 bp, Homo sapiens
aatattttgataata

SEQ ID NO: 4479617 - DNA, 22 bp, Homo sapiens
aatattttgataataatattgt

SEQ ID NO: 4479618 - DNA, 19 bp, Homo sapiens
aatatttttatatttcctt

SEQ ID NO: 4479619 - DNA, 20 bp, Homo sapiens
aatatttttatatttccttt

SEQ ID NO: 4479620 - DNA, 23 bp, Homo sapiens
aatattttttgaaggtttcagat

SEQ ID NO: 4479621 - DNA, 18 bp, Homo sapiens
aatcaaaaacaggcaggt

SEQ ID NO: 4479622 - DNA, 14 bp, Homo sapiens
aatcaaactttaca

SEQ ID NO: 4479623 - DNA, 22 bp, Homo sapiens
aatcaaataaaaattctagatt

SEQ ID NO: 4479624 - DNA, 22 bp, Homo sapiens
aatcaaatgaatgattaaatta

SEQ ID NO: 4479625 - DNA, 18 bp, Homo sapiens
aatcaaatgatttcatat

SEQ ID NO: 4479626 - DNA, 17 bp, Homo sapiens
aatcaacaccttaatat

SEQ ID NO: 4479627 - DNA, 20 bp, Homo sapiens
aatcaaccacctatttttga

SEQ ID NO: 4479628 - DNA, 10 bp, Homo sapiens
aatcaacttt

SEQ ID NO: 4479629 - DNA, 19 bp, Homo sapiens
aatcaactttttattgcct

SEQ ID NO: 4479630 - DNA, 22 bp, Homo sapiens
aatcaactttttattgccttct

SEQ ID NO: 4479631 - DNA, 23 bp, Homo sapiens
aatcaactttttattgccttctc

SEQ ID NO: 4479632 - DNA, 15 bp, Homo sapiens
aatcaagaaacttaa

SEQ ID NO: 4479633 - DNA, 18 bp, Homo sapiens
aatcaaggttataatttt

SEQ ID NO: 4479634 - DNA, 19 bp, Homo sapiens
aatcaatacactagttgtt

SEQ ID NO: 4479635 - DNA, 20 bp, Homo sapiens
aatcaatacactagttgttt

SEQ ID NO: 4479636 - DNA, 12 bp, Homo sapiens
aatcaatagttg

SEQ ID NO: 4479637 - DNA, 16 bp, Homo sapiens
aatcaatataatctga

SEQ ID NO: 4479638 - DNA, 15 bp, Homo sapiens
aatcaatctggcttc

SEQ ID NO: 4479639 - DNA, 17 bp, Homo sapiens
aatcacaaaggctgaca

SEQ ID NO: 4479640 - DNA, 22 bp, Homo sapiens
aatcacaaaggctgacattcac

SEQ ID NO: 4479641 - DNA, 20 bp, Homo sapiens
aatcacagcccaaaatttga

SEQ ID NO: 4479642 - DNA, 22 bp, Homo sapiens
aatcacagcccaaaatttgatg

SEQ ID NO: 4479643 - DNA, 13 bp, Homo sapiens
aatcaccatgtaa

SEQ ID NO: 4479644 - DNA, 13 bp, Homo sapiens
aatcacccctctg

SEQ ID NO: 4479645 - DNA, 19 bp, Homo sapiens
aatcacctgaaccccagag

SEQ ID NO: 4479646 - DNA, 20 bp, Homo sapiens
aatcacctgaaccccagagg

SEQ ID NO: 4479647 - DNA, 14 bp, Homo sapiens
aatcacgctttttg

SEQ ID NO: 4479648 - DNA, 21 bp, Homo sapiens
aatcacgtaaagctagaaatg

SEQ ID NO: 4479649 - DNA, 19 bp, Homo sapiens
aatcactgttgctttgaaa

SEQ ID NO: 4479650 - DNA, 17 bp, Homo sapiens
aatcacttaacattcct

SEQ ID NO: 4479651 - DNA, 15 bp, Homo sapiens
aatcactttcataat

SEQ ID NO: 4479652 - DNA, 20 bp, Homo sapiens
aatcagaagtcatcttgcta

SEQ ID NO: 4479653 - DNA, 12 bp, Homo sapiens
aatcagaataaa

SEQ ID NO: 4479654 - DNA, 18 bp, Homo sapiens
aatcagaataaagttgta

SEQ ID NO: 4479655 - DNA, 19 bp, Homo sapiens
aatcagaataaagttgtat

SEQ ID NO: 4479656 - DNA, 16 bp, Homo sapiens
aatcagagaaggaaca

SEQ ID NO: 4479657 - DNA, 16 bp, Homo sapiens
aatcagatggtgtcat

SEQ ID NO: 4479658 - DNA, 21 bp, Homo sapiens
aatcagatggtgtcatttagt

SEQ ID NO: 4479659 - DNA, 17 bp, Homo sapiens
aatcagattgcttaaaa

SEQ ID NO: 4479660 - DNA, 18 bp, Homo sapiens
aatcagattgcttaaaag

SEQ ID NO: 4479661 - DNA, 12 bp, Homo sapiens
aatcagcactct

SEQ ID NO: 4479662 - DNA, 21 bp, Homo sapiens
aatcagcttttgttctagact

SEQ ID NO: 4479663 - DNA, 11 bp, Homo sapiens
aatcagtaatt

SEQ ID NO: 4479664 - DNA, 14 bp, Homo sapiens
aatcagtagaaagc

SEQ ID NO: 4479665 - DNA, 18 bp, Homo sapiens
aatcagtagaaagctaaa

SEQ ID NO: 4479666 - DNA, 24 bp, Homo sapiens
aatcagtctcagaatgtcattttg

SEQ ID NO: 4479667 - DNA, 22 bp, Homo sapiens
aatcagttatacagttataaaa

SEQ ID NO: 4479668 - DNA, 17 bp, Homo sapiens
aatcagttcattagaaa

SEQ ID NO: 4479669 - DNA, 20 bp, Homo sapiens
aatcagttcattagaaatat

SEQ ID NO: 4479670 - DNA, 19 bp, Homo sapiens
aatcatacaaactctcacc

SEQ ID NO: 4479671 - DNA, 20 bp, Homo sapiens
aatcatacaaactctcacca

SEQ ID NO: 4479672 - DNA, 22 bp, Homo sapiens
aatcatagtactctttgtagca

SEQ ID NO: 4479673 - DNA, 13 bp, Homo sapiens
aatcatatataat

SEQ ID NO: 4479674 - DNA, 12 bp, Homo sapiens
aatcatcaagta

SEQ ID NO: 4479675 - DNA, 15 bp, Homo sapiens
aatcatgccagtatt

SEQ ID NO: 4479676 - DNA, 17 bp, Homo sapiens
aatcatgccagtatttt

SEQ ID NO: 4479677 - DNA, 19 bp, Homo sapiens
aatcatgtttattttgagt

SEQ ID NO: 4479678 - DNA, 21 bp, Homo sapiens
aatcattaatttcaaaattta

SEQ ID NO: 4479679 - DNA, 17 bp, Homo sapiens
aatcattatctcacttt

SEQ ID NO: 4479680 - DNA, 12 bp, Homo sapiens
aatcattattta

SEQ ID NO: 4479681 - DNA, 22 bp, Homo sapiens
aatcattatttattaaattttt

SEQ ID NO: 4479682 - DNA, 17 bp, Homo sapiens
aatcattgttttgaata

SEQ ID NO: 4479683 - DNA, 16 bp, Homo sapiens
aatcatttagatgcac

SEQ ID NO: 4479684 - DNA, 22 bp, Homo sapiens
aatcatttgtttacatttgatg

SEQ ID NO: 4479685 - DNA, 17 bp, Homo sapiens
aatcattttaggaaagg

SEQ ID NO: 4479686 - DNA, 22 bp, Homo sapiens
aatcattttatggcacctattt

SEQ ID NO: 4479687 - DNA, 13 bp, Homo sapiens
aatcattttcatt

SEQ ID NO: 4479688 - DNA, 13 bp, Homo sapiens
aatcattttgcaa

SEQ ID NO: 4479689 - DNA, 20 bp, Homo sapiens
aatcatttttatattataac

SEQ ID NO: 4479690 - DNA, 19 bp, Homo sapiens
aatccaaaaagctctgaaa

SEQ ID NO: 4479691 - DNA, 16 bp, Homo sapiens
aataggcattttaagt

SEQ ID NO: 4479692 - DNA, 20 bp, Homo sapiens
aatagggctaaatgtttaaa

SEQ ID NO: 4479693 - DNA, 22 bp, Homo sapiens
aatagggctaaatgtttaaaga

SEQ ID NO: 4479694 - DNA, 19 bp, Homo sapiens
aataggtgcagtctttgag

SEQ ID NO: 4479695 - DNA, 16 bp, Homo sapiens
aataggtttgtaaaat

SEQ ID NO: 4479696 - DNA, 16 bp, Homo sapiens
aatagtaaactaaagt

SEQ ID NO: 4479697 - DNA, 20 bp, Homo sapiens
aatagtaaactaaagtatgg

SEQ ID NO: 4479698 - DNA, 21 bp, Homo sapiens
aatagtaatttgtaaagttgg

SEQ ID NO: 4479699 - DNA, 15 bp, Homo sapiens
aatagtatacattgt

SEQ ID NO: 4479700 - DNA, 16 bp, Homo sapiens
aatagtatttcccatt

SEQ ID NO: 4479701 - DNA, 21 bp, Homo sapiens
aatagtatttctcctttgcaa

SEQ ID NO: 4479702 - DNA, 22 bp, Homo sapiens
aatagtatttctcctttgcaat

SEQ ID NO: 4479703 - DNA, 17 bp, Homo sapiens
aatagtcggtgaagaaa

SEQ ID NO: 4479704 - DNA, 15 bp, Homo sapiens
aatagtggaacattt

SEQ ID NO: 4479705 - DNA, 20 bp, Homo sapiens
aatagtggttaacagagcta

SEQ ID NO: 4479706 - DNA, 20 bp, Homo sapiens
aatagtgtcctatgcaataa

SEQ ID NO: 4479707 - DNA, 15 bp, Homo sapiens
aatagtgtgaaatat

SEQ ID NO: 4479708 - DNA, 15 bp, Homo sapiens
aatagtgtgatgttt

SEQ ID NO: 4479709 - DNA, 16 bp, Homo sapiens
aatagttaaaaattaa

SEQ ID NO: 4479710 - DNA, 21 bp, Homo sapiens
aatagttaaaaattaaatatt

SEQ ID NO: 4479711 - DNA, 22 bp, Homo sapiens
aatagttaagacatgatttcct

SEQ ID NO: 4479712 - DNA, 13 bp, Homo sapiens
aatagttttatgc

SEQ ID NO: 4479713 - DNA, 22 bp, Homo sapiens
aatagtttttcactttgtgtat

SEQ ID NO: 4479714 - DNA, 23 bp, Homo sapiens
aatagtttttcactttgtgtatt

SEQ ID NO: 4479715 - DNA, 13 bp, Homo sapiens
aatataaaaataa

SEQ ID NO: 4479716 - DNA, 11 bp, Homo sapiens
aatataaatga

SEQ ID NO: 4479717 - DNA, 12 bp, Homo sapiens
aatataaatgtg

SEQ ID NO: 4479718 - DNA, 17 bp, Homo sapiens
aatataaattcactttc

SEQ ID NO: 4479719 - DNA, 21 bp, Homo sapiens
aatataagaaaagtaatgaag

SEQ ID NO: 4479720 - DNA, 13 bp, Homo sapiens
aatataagaagca

SEQ ID NO: 4479721 - DNA, 21 bp, Homo sapiens
aatataaggaaagcaataaat

SEQ ID NO: 4479722 - DNA, 19 bp, Homo sapiens
aatataaggactttttgat

SEQ ID NO: 4479723 - DNA, 14 bp, Homo sapiens
aatataagtaaagt

SEQ ID NO: 4479724 - DNA, 14 bp, Homo sapiens
aatataagtttctt

SEQ ID NO: 4479725 - DNA, 16 bp, Homo sapiens
aatataagtttctttg

SEQ ID NO: 4479726 - DNA, 15 bp, Homo sapiens
aatataatgtatttt

SEQ ID NO: 4479727 - DNA, 18 bp, Homo sapiens
aatataatgtattttctt

SEQ ID NO: 4479728 - DNA, 13 bp, Homo sapiens
aatatacagtttg

SEQ ID NO: 4479729 - DNA, 17 bp, Homo sapiens
aatatacagtttgactt

SEQ ID NO: 4479730 - DNA, 21 bp, Homo sapiens
aatatactttactttttccat

SEQ ID NO: 4479731 - DNA, 18 bp, Homo sapiens
aatatactttttttgtta

SEQ ID NO: 4479732 - DNA, 13 bp, Homo sapiens
aatatagaaaaaa

SEQ ID NO: 4479733 - DNA, 19 bp, Homo sapiens
aatatagacattctcacat

SEQ ID NO: 4479734 - DNA, 21 bp, Homo sapiens
aatatagagacaggacagaat

SEQ ID NO: 4479735 - DNA, 11 bp, Homo sapiens
aatatagagat

SEQ ID NO: 4479736 - DNA, 18 bp, Homo sapiens
aatatagagatatttttg

SEQ ID NO: 4479737 - DNA, 20 bp, Homo sapiens
aatatagagatatttttgta

SEQ ID NO: 4479738 - DNA, 21 bp, Homo sapiens
aatatagagatatttttgtac

SEQ ID NO: 4479739 - DNA, 15 bp, Homo sapiens
aatatagcctttaaa

SEQ ID NO: 4479740 - DNA, 12 bp, Homo sapiens
aatatagcttaa

SEQ ID NO: 4479741 - DNA, 14 bp, Homo sapiens
aatatagcttaaaa

SEQ ID NO: 4479742 - DNA, 18 bp, Homo sapiens
aatataggtcctgtgtta

SEQ ID NO: 4479743 - DNA, 20 bp, Homo sapiens
aatatagtgaaatggccact

SEQ ID NO: 4479744 - DNA, 15 bp, Homo sapiens
aatatataatatact

SEQ ID NO: 4479745 - DNA, 14 bp, Homo sapiens
aatatataatttaa

SEQ ID NO: 4479746 - DNA, 15 bp, Homo sapiens
aatatataatttaat

SEQ ID NO: 4479747 - DNA, 20 bp, Homo sapiens
aatatatagtgggtacatca

SEQ ID NO: 4479748 - DNA, 13 bp, Homo sapiens
aatatatataaag

SEQ ID NO: 4479749 - DNA, 16 bp, Homo sapiens
aatatatatatatatt

SEQ ID NO: 4479750 - DNA, 22 bp, Homo sapiens
aatatatatctatctatttgag

SEQ ID NO: 4479751 - DNA, 14 bp, Homo sapiens
aatatatattatat

SEQ ID NO: 4479752 - DNA, 20 bp, Homo sapiens
aatatatctgtaaagataat

SEQ ID NO: 4479753 - DNA, 12 bp, Homo sapiens
aatatatgaaat

SEQ ID NO: 4479754 - DNA, 20 bp, Homo sapiens
aatatatgccttgtataata

SEQ ID NO: 4479755 - DNA, 22 bp, Homo sapiens
aatatatggcatttgcagattt

SEQ ID NO: 4479756 - DNA, 19 bp, Homo sapiens
aatatatgggggaaaatta

SEQ ID NO: 4479757 - DNA, 16 bp, Homo sapiens
aatatatgtatataca

SEQ ID NO: 4479758 - DNA, 14 bp, Homo sapiens
aatatatgtatttt

SEQ ID NO: 4479759 - DNA, 13 bp, Homo sapiens
aatatatgtgaaa

SEQ ID NO: 4479760 - DNA, 18 bp, Homo sapiens
aatatattacttaactgt

SEQ ID NO: 4479761 - DNA, 14 bp, Homo sapiens
aatatatttcttct

SEQ ID NO: 4479762 - DNA, 20 bp, Homo sapiens
aatatatttcttcttctaag

SEQ ID NO: 4479763 - DNA, 23 bp, Homo sapiens
aatatattttctttctagtttgt

SEQ ID NO: 4479764 - DNA, 16 bp, Homo sapiens
aatatcaaaagaaaat

SEQ ID NO: 4479765 - DNA, 17 bp, Homo sapiens
aatatcaaaagaaaatt

SEQ ID NO: 4479766 - DNA, 19 bp, Homo sapiens
aatatcaaataaaattatt

SEQ ID NO: 4479767 - DNA, 20 bp, Homo sapiens
aatatcaaatgcagtatatt

SEQ ID NO: 4479768 - DNA, 21 bp, Homo sapiens
aatatcaaatgcagtatattt

SEQ ID NO: 4479769 - DNA, 17 bp, Homo sapiens
aatatcactcattaatt

SEQ ID NO: 4479770 - DNA, 16 bp, Homo sapiens
aatatcagctttgata

SEQ ID NO: 4479771 - DNA, 18 bp, Homo sapiens
aatatcagtattctgaca

SEQ ID NO: 4479772 - DNA, 21 bp, Homo sapiens
aatatcagttactcagccctg

SEQ ID NO: 4479773 - DNA, 16 bp, Homo sapiens
aatatccatttatctt

SEQ ID NO: 4479774 - DNA, 17 bp, Homo sapiens
aatatcccgggggtggg

SEQ ID NO: 4479775 - DNA, 21 bp, Homo sapiens
aatatcccttggacattttat

SEQ ID NO: 4479776 - DNA, 22 bp, Homo sapiens
aatatcccttggacattttatg

SEQ ID NO: 4479777 - DNA, 23 bp, Homo sapiens
aatatcgttagggtgaagcatta

SEQ ID NO: 4479778 - DNA, 20 bp, Homo sapiens
aatatctaaagttatatttc

SEQ ID NO: 4479779 - DNA, 23 bp, Homo sapiens
aatatctatttgaataaattatg

SEQ ID NO: 4479780 - DNA, 18 bp, Homo sapiens
aatatctctgagttctgt

SEQ ID NO: 4479781 - DNA, 19 bp, Homo sapiens
aatatctgaacatttacta

SEQ ID NO: 4479782 - DNA, 19 bp, Homo sapiens
aatatctgtgaaatatcat

SEQ ID NO: 4479783 - DNA, 18 bp, Homo sapiens
aatatctgttcccagccc

SEQ ID NO: 4479784 - DNA, 20 bp, Homo sapiens
aatatgaaaaccgtaaagtg

SEQ ID NO: 4479785 - DNA, 18 bp, Homo sapiens
aatatgaaccctttgttt

SEQ ID NO: 4479786 - DNA, 22 bp, Homo sapiens
aatatgaattcaagaaaggaaa

SEQ ID NO: 4479787 - DNA, 22 bp, Homo sapiens
aatatgacagctgtccctgtca

SEQ ID NO: 4479788 - DNA, 19 bp, Homo sapiens
aatatgactttttataaaa

SEQ ID NO: 4479789 - DNA, 20 bp, Homo sapiens
aatatgatcaggtaactttc

SEQ ID NO: 4479790 - DNA, 16 bp, Homo sapiens
aatatgatgacaatca

SEQ ID NO: 4479791 - DNA, 15 bp, Homo sapiens
aatatgcaaagcact

SEQ ID NO: 4479792 - DNA, 14 bp, Homo sapiens
aatatgcaagcagc

SEQ ID NO: 4479793 - DNA, 21 bp, Homo sapiens
aatatgcaaggcggtacacta

SEQ ID NO: 4479794 - DNA, 17 bp, Homo sapiens
aatatgcctttttgaag

SEQ ID NO: 4479795 - DNA, 13 bp, Homo sapiens
aatatgtcagatg

SEQ ID NO: 4479796 - DNA, 23 bp, Homo sapiens
aatatgtttagttttacatttta

SEQ ID NO: 4479797 - DNA, 14 bp, Homo sapiens
aatattaaatatta

SEQ ID NO: 4479798 - DNA, 15 bp, Homo sapiens
aatattaacattctt

SEQ ID NO: 4479799 - DNA, 22 bp, Homo sapiens
aatattaacctaatcaccatgt

SEQ ID NO: 4479800 - DNA, 18 bp, Homo sapiens
aatattacctaatgaaag

SEQ ID NO: 4479801 - DNA, 19 bp, Homo sapiens
aatattacctaatgaaagt

SEQ ID NO: 4479802 - DNA, 20 bp, Homo sapiens
aatattactcctatttttgt

SEQ ID NO: 4479803 - DNA, 20 bp, Homo sapiens
aatattactttgtcttttca

SEQ ID NO: 4479804 - DNA, 15 bp, Homo sapiens
aatattagtgcagtt

SEQ ID NO: 4479805 - DNA, 14 bp, Homo sapiens
aatattattgaact

SEQ ID NO: 4479806 - DNA, 19 bp, Homo sapiens
aatattcagacaaaatgga

SEQ ID NO: 4479807 - DNA, 18 bp, Homo sapiens
aatattcagccagcttaa

SEQ ID NO: 4479808 - DNA, 24 bp, Homo sapiens
aatattcagccagcttaaacccat

SEQ ID NO: 4479809 - DNA, 23 bp, Homo sapiens
aatattcatattggaaaaatcac

SEQ ID NO: 4479810 - DNA, 15 bp, Homo sapiens
aatattccctagaaa

SEQ ID NO: 4479811 - DNA, 14 bp, Homo sapiens
aataagcaggatgt

SEQ ID NO: 4479812 - DNA, 15 bp, Homo sapiens
aataaggaatagctt

SEQ ID NO: 4479813 - DNA, 18 bp, Homo sapiens
aataaggcacccatctgt

SEQ ID NO: 4479814 - DNA, 14 bp, Homo sapiens
aataagtaaatgta

SEQ ID NO: 4479815 - DNA, 14 bp, Homo sapiens
aataagtcaacagt

SEQ ID NO: 4479816 - DNA, 22 bp, Homo sapiens
aataagtcaacagtaaaccact

SEQ ID NO: 4479817 - DNA, 20 bp, Homo sapiens
aataagtggattttgtattt

SEQ ID NO: 4479818 - DNA, 14 bp, Homo sapiens
aataagttattgca

SEQ ID NO: 4479819 - DNA, 18 bp, Homo sapiens
aataagttattgcagttt

SEQ ID NO: 4479820 - DNA, 20 bp, Homo sapiens
aataagtttttgtttcacag

SEQ ID NO: 4479821 - DNA, 15 bp, Homo sapiens
aataataaaaagcaa

SEQ ID NO: 4479822 - DNA, 16 bp, Homo sapiens
aataataatagtacta

SEQ ID NO: 4479823 - DNA, 12 bp, Homo sapiens
aataatattgtt

SEQ ID NO: 4479824 - DNA, 21 bp, Homo sapiens
aataatattgtttttctttct

SEQ ID NO: 4479825 - DNA, 14 bp, Homo sapiens
aataatatttcaag

SEQ ID NO: 4479826 - DNA, 13 bp, Homo sapiens
aataatctatatt

SEQ ID NO: 4479827 - DNA, 14 bp, Homo sapiens
aataatctatatta

SEQ ID NO: 4479828 - DNA, 12 bp, Homo sapiens
aataatgcagta

SEQ ID NO: 4479829 - DNA, 15 bp, Homo sapiens
aataatgcagtatgg

SEQ ID NO: 4479830 - DNA, 16 bp, Homo sapiens
aataatgccaatgaac

SEQ ID NO: 4479831 - DNA, 23 bp, Homo sapiens
aataatgcctccaattttttctt

SEQ ID NO: 4479832 - DNA, 16 bp, Homo sapiens
aataatgcctttgtaa

SEQ ID NO: 4479833 - DNA, 18 bp, Homo sapiens
aataatgcttttctaatt

SEQ ID NO: 4479834 - DNA, 19 bp, Homo sapiens
aataatgcttttctaatta

SEQ ID NO: 4479835 - DNA, 23 bp, Homo sapiens
aataatgcttttctaattaatag

SEQ ID NO: 4479836 - DNA, 12 bp, Homo sapiens
aataatgtctct

SEQ ID NO: 4479837 - DNA, 19 bp, Homo sapiens
aataattacaaattttgca

SEQ ID NO: 4479838 - DNA, 16 bp, Homo sapiens
aataattatttattac

SEQ ID NO: 4479839 - DNA, 22 bp, Homo sapiens
aataattctgagttttgtgttt

SEQ ID NO: 4479840 - DNA, 21 bp, Homo sapiens
aataattgaagtgttcccttt

SEQ ID NO: 4479841 - DNA, 19 bp, Homo sapiens
aataattggagaagattta

SEQ ID NO: 4479842 - DNA, 23 bp, Homo sapiens
aataatttaactacccttaatta

SEQ ID NO: 4479843 - DNA, 14 bp, Homo sapiens
aatacaaaaattag

SEQ ID NO: 4479844 - DNA, 14 bp, Homo sapiens
aatacaaagatgac

SEQ ID NO: 4479845 - DNA, 18 bp, Homo sapiens
aatacaaagtggaaactt

SEQ ID NO: 4479846 - DNA, 15 bp, Homo sapiens
aatacaaattgagga

SEQ ID NO: 4479847 - DNA, 13 bp, Homo sapiens
aatacaaccagcc

SEQ ID NO: 4479848 - DNA, 20 bp, Homo sapiens
aatacaaccagcccaaccat

SEQ ID NO: 4479849 - DNA, 14 bp, Homo sapiens
aatacaatgtacaa

SEQ ID NO: 4479850 - DNA, 18 bp, Homo sapiens
aatacaatttttatttct

SEQ ID NO: 4479851 - DNA, 16 bp, Homo sapiens
aatacacgtttatctt

SEQ ID NO: 4479852 - DNA, 15 bp, Homo sapiens
aatacagaatcttgt

SEQ ID NO: 4479853 - DNA, 16 bp, Homo sapiens
aatacagtattataga

SEQ ID NO: 4479854 - DNA, 20 bp, Homo sapiens
aatacagtattatagacaaa

SEQ ID NO: 4479855 - DNA, 18 bp, Homo sapiens
aatacagtcttccacaaa

SEQ ID NO: 4479856 - DNA, 21 bp, Homo sapiens
aatacagtcttccatttgcaa

SEQ ID NO: 4479857 - DNA, 16 bp, Homo sapiens
aatacagttatttcat

SEQ ID NO: 4479858 - DNA, 14 bp, Homo sapiens
aatacatactaatg

SEQ ID NO: 4479859 - DNA, 19 bp, Homo sapiens
aatacatcacatcttattt

SEQ ID NO: 4479860 - DNA, 22 bp, Homo sapiens
aatacatcacatcttatttatt

SEQ ID NO: 4479861 - DNA, 13 bp, Homo sapiens
aatacatctttcc

SEQ ID NO: 4479862 - DNA, 14 bp, Homo sapiens
aatacatctttccc

SEQ ID NO: 4479863 - DNA, 22 bp, Homo sapiens
aatacatgctaagagaagtaga

SEQ ID NO: 4479864 - DNA, 19 bp, Homo sapiens
aatacattaacggtgctaa

SEQ ID NO: 4479865 - DNA, 16 bp, Homo sapiens
aataccacaagcctga

SEQ ID NO: 4479866 - DNA, 20 bp, Homo sapiens
aataccagagccttcaagtg

SEQ ID NO: 4479867 - DNA, 22 bp, Homo sapiens
aataccagagccttcaagtgcc

SEQ ID NO: 4479868 - DNA, 20 bp, Homo sapiens
aataccccaagactcccatg

SEQ ID NO: 4479869 - DNA, 16 bp, Homo sapiens
aatacctcaggaaaga

SEQ ID NO: 4479870 - DNA, 12 bp, Homo sapiens
aatacctgctca

SEQ ID NO: 4479871 - DNA, 17 bp, Homo sapiens
aataccttctatgtatt

SEQ ID NO: 4479872 - DNA, 18 bp, Homo sapiens
aataccttctatgtatta

SEQ ID NO: 4479873 - DNA, 18 bp, Homo sapiens
aatacgttaggaggacaa

SEQ ID NO: 4479874 - DNA, 15 bp, Homo sapiens
aatactaaggaacca

SEQ ID NO: 4479875 - DNA, 18 bp, Homo sapiens
aatactacaatagtttta

SEQ ID NO: 4479876 - DNA, 14 bp, Homo sapiens
aatactatgcagta

SEQ ID NO: 4479877 - DNA, 18 bp, Homo sapiens
aatactatgcagtatctc

SEQ ID NO: 4479878 - DNA, 17 bp, Homo sapiens
aatactctacttacagt

SEQ ID NO: 4479879 - DNA, 17 bp, Homo sapiens
aatactctatttttaca

SEQ ID NO: 4479880 - DNA, 13 bp, Homo sapiens
aatactctgccct

SEQ ID NO: 4479881 - DNA, 23 bp, Homo sapiens
aatactctgccctctagagcctt

SEQ ID NO: 4479882 - DNA, 18 bp, Homo sapiens
aatactcttgatttcaca

SEQ ID NO: 4479883 - DNA, 14 bp, Homo sapiens
aatactgcaaatca

SEQ ID NO: 4479884 - DNA, 15 bp, Homo sapiens
aatactgtacagggg

SEQ ID NO: 4479885 - DNA, 16 bp, Homo sapiens
aatactgtattttgta

SEQ ID NO: 4479886 - DNA, 15 bp, Homo sapiens
aatactgtctgtatc

SEQ ID NO: 4479887 - DNA, 15 bp, Homo sapiens
aatactgtgaaatac

SEQ ID NO: 4479888 - DNA, 20 bp, Homo sapiens
aatactgttttaaaatgtga

SEQ ID NO: 4479889 - DNA, 21 bp, Homo sapiens
aatacttaacacgtgaatatt

SEQ ID NO: 4479890 - DNA, 17 bp, Homo sapiens
aatacttagcaaaaagt

SEQ ID NO: 4479891 - DNA, 16 bp, Homo sapiens
aatacttctcattttt

SEQ ID NO: 4479892 - DNA, 15 bp, Homo sapiens
aatacttctttgtta

SEQ ID NO: 4479893 - DNA, 19 bp, Homo sapiens
aatacttctttgttattat

SEQ ID NO: 4479894 - DNA, 14 bp, Homo sapiens
aatacttgaacttg

SEQ ID NO: 4479895 - DNA, 18 bp, Homo sapiens
aatacttgaacttgcctc

SEQ ID NO: 4479896 - DNA, 15 bp, Homo sapiens
aatactttcttttat

SEQ ID NO: 4479897 - DNA, 11 bp, Homo sapiens
aatacttttgc

SEQ ID NO: 4479898 - DNA, 20 bp, Homo sapiens
aatacttttgctttcaggga

SEQ ID NO: 4479899 - DNA, 16 bp, Homo sapiens
aatactttttaaatta

SEQ ID NO: 4479900 - DNA, 17 bp, Homo sapiens
aatactttttctaatga

SEQ ID NO: 4479901 - DNA, 15 bp, Homo sapiens
aatagaaaagttatt

SEQ ID NO: 4479902 - DNA, 20 bp, Homo sapiens
aatagaaaatgtaataactt

SEQ ID NO: 4479903 - DNA, 15 bp, Homo sapiens
aatagaaagaagcca

SEQ ID NO: 4479904 - DNA, 13 bp, Homo sapiens
aatagaaatgcat

SEQ ID NO: 4479905 - DNA, 20 bp, Homo sapiens
aatagaaattagatttgtgc

SEQ ID NO: 4479906 - DNA, 17 bp, Homo sapiens
aatagaaattttgtaag

SEQ ID NO: 4479907 - DNA, 19 bp, Homo sapiens
aatagaaattttgtaagaa

SEQ ID NO: 4479908 - DNA, 15 bp, Homo sapiens
aatagaataaaggca

SEQ ID NO: 4479909 - DNA, 15 bp, Homo sapiens
aatagacaaaaagta

SEQ ID NO: 4479910 - DNA, 13 bp, Homo sapiens
aatagacaagttt

SEQ ID NO: 4479911 - DNA, 21 bp, Homo sapiens
aatagacaagttttgtttcct

SEQ ID NO: 4479912 - DNA, 16 bp, Homo sapiens
aatagagcaaaatcaa

SEQ ID NO: 4479913 - DNA, 14 bp, Homo sapiens
aatagagcctgagg

SEQ ID NO: 4479914 - DNA, 15 bp, Homo sapiens
aatagaggaagaaat

SEQ ID NO: 4479915 - DNA, 18 bp, Homo sapiens
aatagatatgaaagctga

SEQ ID NO: 4479916 - DNA, 21 bp, Homo sapiens
aatagatggggcatataataa

SEQ ID NO: 4479917 - DNA, 22 bp, Homo sapiens
aatagatggggcatataataaa

SEQ ID NO: 4479918 - DNA, 19 bp, Homo sapiens
aatagatgtttgatagatt

SEQ ID NO: 4479919 - DNA, 22 bp, Homo sapiens
aatagatgtttgatagattttc

SEQ ID NO: 4479920 - DNA, 22 bp, Homo sapiens
aatagatttcagctatgcagaa

SEQ ID NO: 4479921 - DNA, 15 bp, Homo sapiens
aatagcaaagaattg

SEQ ID NO: 4479922 - DNA, 13 bp, Homo sapiens
aatagcactaacc

SEQ ID NO: 4479923 - DNA, 13 bp, Homo sapiens
aatagcacttttt

SEQ ID NO: 4479924 - DNA, 17 bp, Homo sapiens
aatagccaaagatttca

SEQ ID NO: 4479925 - DNA, 12 bp, Homo sapiens
aatagcctggcc

SEQ ID NO: 4479926 - DNA, 15 bp, Homo sapiens
aatagcggccctgga

SEQ ID NO: 4479927 - DNA, 18 bp, Homo sapiens
aatagctatttttttcct

SEQ ID NO: 4479928 - DNA, 18 bp, Homo sapiens
aatagctgtaaacttcca

SEQ ID NO: 4479929 - DNA, 17 bp, Homo sapiens
aataggagggaaacctt

SEQ ID NO: 4479930 - DNA, 14 bp, Homo sapiens
aataggagtatttt

SEQ ID NO: 4479931 - DNA, 23 bp, Homo sapiens
aataggcagggggccctgcccca

SEQ ID NO: 4479932 - DNA, 20 bp, Homo sapiens
aagttcattgcaattaaact

SEQ ID NO: 4479933 - DNA, 19 bp, Homo sapiens
aagttccaagttgctaata

SEQ ID NO: 4479934 - DNA, 20 bp, Homo sapiens
aagttccattatgaaaatct

SEQ ID NO: 4479935 - DNA, 16 bp, Homo sapiens
aagttccctggagaaa

SEQ ID NO: 4479936 - DNA, 14 bp, Homo sapiens
aagttcctttgggt

SEQ ID NO: 4479937 - DNA, 15 bp, Homo sapiens
aagttcgtctgttgt

SEQ ID NO: 4479938 - DNA, 14 bp, Homo sapiens
aagttctcagagct

SEQ ID NO: 4479939 - DNA, 15 bp, Homo sapiens
aagttctcagagctc

SEQ ID NO: 4479940 - DNA, 17 bp, Homo sapiens
aagttctgtgtatttaa

SEQ ID NO: 4479941 - DNA, 16 bp, Homo sapiens
aagttcttaaaaaatt

SEQ ID NO: 4479942 - DNA, 22 bp, Homo sapiens
aagttcttagttgctgtatgtc

SEQ ID NO: 4479943 - DNA, 17 bp, Homo sapiens
aagttcttattttagta

SEQ ID NO: 4479944 - DNA, 19 bp, Homo sapiens
aagttgaaccattatactt

SEQ ID NO: 4479945 - DNA, 22 bp, Homo sapiens
aagttgaaccattatactttat

SEQ ID NO: 4479946 - DNA, 21 bp, Homo sapiens
aagttgaataaacataaaagc

SEQ ID NO: 4479947 - DNA, 12 bp, Homo sapiens
aagttgaccttt

SEQ ID NO: 4479948 - DNA, 21 bp, Homo sapiens
aagttgacttatagtacatga

SEQ ID NO: 4479949 - DNA, 23 bp, Homo sapiens
aagttgacttatagtacatgata

SEQ ID NO: 4479950 - DNA, 17 bp, Homo sapiens
aagttgagaaaaattta

SEQ ID NO: 4479951 - DNA, 21 bp, Homo sapiens
aagttgagcgtgcgcactgca

SEQ ID NO: 4479952 - DNA, 16 bp, Homo sapiens
aagttgagtatccctt

SEQ ID NO: 4479953 - DNA, 22 bp, Homo sapiens
aagttgctctgacctcctctgg

SEQ ID NO: 4479954 - DNA, 16 bp, Homo sapiens
aagttggcttctgttt

SEQ ID NO: 4479955 - DNA, 19 bp, Homo sapiens
aagttggcttctgtttcta

SEQ ID NO: 4479956 - DNA, 16 bp, Homo sapiens
aagttggtattaataa

SEQ ID NO: 4479957 - DNA, 21 bp, Homo sapiens
aagttggtattaataaaaaga

SEQ ID NO: 4479958 - DNA, 16 bp, Homo sapiens
aagttggttggataag

SEQ ID NO: 4479959 - DNA, 15 bp, Homo sapiens
aagttgtaaaataga

SEQ ID NO: 4479960 - DNA, 14 bp, Homo sapiens
aagttgtaaagtat

SEQ ID NO: 4479961 - DNA, 20 bp, Homo sapiens
aagttgtgcttgagccagga

SEQ ID NO: 4479962 - DNA, 18 bp, Homo sapiens
aagttgtggggagatcca

SEQ ID NO: 4479963 - DNA, 20 bp, Homo sapiens
aagtttaacaaatgactgta

SEQ ID NO: 4479964 - DNA, 16 bp, Homo sapiens
aagtttaattgtctca

SEQ ID NO: 4479965 - DNA, 20 bp, Homo sapiens
aagtttcaagttttaaagtt

SEQ ID NO: 4479966 - DNA, 16 bp, Homo sapiens
aagtttcagagtatat

SEQ ID NO: 4479967 - DNA, 20 bp, Homo sapiens
aagtttgaaaagcaatattg

SEQ ID NO: 4479968 - DNA, 20 bp, Homo sapiens
aagttttaactttaatacag

SEQ ID NO: 4479969 - DNA, 16 bp, Homo sapiens
aagttttagttaaaac

SEQ ID NO: 4479970 - DNA, 19 bp, Homo sapiens
aagttttagttaaaactca

SEQ ID NO: 4479971 - DNA, 20 bp, Homo sapiens
aagttttagttaaaactcat

SEQ ID NO: 4479972 - DNA, 23 bp, Homo sapiens
aagttttccttgctatttcaata

SEQ ID NO: 4479973 - DNA, 16 bp, Homo sapiens
aagttttgaaggaaac

SEQ ID NO: 4479974 - DNA, 13 bp, Homo sapiens
aagttttgtaaaa

SEQ ID NO: 4479975 - DNA, 16 bp, Homo sapiens
aagttttgtttcctca

SEQ ID NO: 4479976 - DNA, 16 bp, Homo sapiens
aagtttttaaaaataa

SEQ ID NO: 4479977 - DNA, 17 bp, Homo sapiens
aagtttttcatactgta

SEQ ID NO: 4479978 - DNA, 20 bp, Homo sapiens
aagtttttcatactgtacac

SEQ ID NO: 4479979 - DNA, 23 bp, Homo sapiens
aagtttttcatactgtacacatt

SEQ ID NO: 4479980 - DNA, 17 bp, Homo sapiens
aagtttttctctttttc

SEQ ID NO: 4479981 - DNA, 16 bp, Homo sapiens
aagttttttactttgg

SEQ ID NO: 4479982 - DNA, 20 bp, Homo sapiens
aagttttttatactgcactt

SEQ ID NO: 4479983 - DNA, 13 bp, Homo sapiens
aataaaaaatctg

SEQ ID NO: 4479984 - DNA, 17 bp, Homo sapiens
aataaaaaatgaaaaga

SEQ ID NO: 4479985 - DNA, 20 bp, Homo sapiens
aataaaaacattttgaagtg

SEQ ID NO: 4479986 - DNA, 19 bp, Homo sapiens
aataaaaagatcactttct

SEQ ID NO: 4479987 - DNA, 11 bp, Homo sapiens
aataaaaagga

SEQ ID NO: 4479988 - DNA, 20 bp, Homo sapiens
aataaaacaaataaatatga

SEQ ID NO: 4479989 - DNA, 12 bp, Homo sapiens
aataaaactgtc

SEQ ID NO: 4479990 - DNA, 23 bp, Homo sapiens
aataaaactgtttgacttctcaa

SEQ ID NO: 4479991 - DNA, 16 bp, Homo sapiens
aataaaagataaaaga

SEQ ID NO: 4479992 - DNA, 12 bp, Homo sapiens
aataaaagcaca

SEQ ID NO: 4479993 - DNA, 13 bp, Homo sapiens
aataaaagcacaa

SEQ ID NO: 4479994 - DNA, 13 bp, Homo sapiens
aataaaatacttt

SEQ ID NO: 4479995 - DNA, 13 bp, Homo sapiens
aataaaatgaaaa

SEQ ID NO: 4479996 - DNA, 14 bp, Homo sapiens
aataaaatgcctca

SEQ ID NO: 4479997 - DNA, 18 bp, Homo sapiens
aataaaatgtttctctct

SEQ ID NO: 4479998 - DNA, 13 bp, Homo sapiens
aataaaattctgt

SEQ ID NO: 4479999 - DNA, 11 bp, Homo sapiens
aataaaatttg

SEQ ID NO: 4480000 - DNA, 16 bp, Homo sapiens
aataaaatttgttgca

SEQ ID NO: 4480001 - DNA, 21 bp, Homo sapiens
aataaacacatagattcacct

SEQ ID NO: 4480002 - DNA, 11 bp, Homo sapiens
aataaacagtc

SEQ ID NO: 4480003 - DNA, 18 bp, Homo sapiens
aataaacagtcactggaa

SEQ ID NO: 4480004 - DNA, 12 bp, Homo sapiens
aataaaccacaa

SEQ ID NO: 4480005 - DNA, 18 bp, Homo sapiens
aataaaccacaagcatct

SEQ ID NO: 4480006 - DNA, 14 bp, Homo sapiens
aataaaccagtgtg

SEQ ID NO: 4480007 - DNA, 15 bp, Homo sapiens
aataaaccctcagag

SEQ ID NO: 4480008 - DNA, 20 bp, Homo sapiens
aataaactactctttgattt

SEQ ID NO: 4480009 - DNA, 12 bp, Homo sapiens
aataaagcaatt

SEQ ID NO: 4480010 - DNA, 12 bp, Homo sapiens
aataaagccttt

SEQ ID NO: 4480011 - DNA, 16 bp, Homo sapiens
aataaaggatgtgatt

SEQ ID NO: 4480012 - DNA, 18 bp, Homo sapiens
aataaaggatgtgattgt

SEQ ID NO: 4480013 - DNA, 11 bp, Homo sapiens
aataaaggcag

SEQ ID NO: 4480014 - DNA, 12 bp, Homo sapiens
aataaaggcagc

SEQ ID NO: 4480015 - DNA, 19 bp, Homo sapiens
aataaaggcagctgcctct

SEQ ID NO: 4480016 - DNA, 21 bp, Homo sapiens
aataaaggcagctgcctctgc

SEQ ID NO: 4480017 - DNA, 23 bp, Homo sapiens
aataaaggcagctgcctctgctc

SEQ ID NO: 4480018 - DNA, 13 bp, Homo sapiens
aataaagggacca

SEQ ID NO: 4480019 - DNA, 12 bp, Homo sapiens
aataaagtataa

SEQ ID NO: 4480020 - DNA, 15 bp, Homo sapiens
aataaagtattccac

SEQ ID NO: 4480021 - DNA, 16 bp, Homo sapiens
aataaagtgttttcag

SEQ ID NO: 4480022 - DNA, 17 bp, Homo sapiens
aataaagtgttttcaga

SEQ ID NO: 4480023 - DNA, 18 bp, Homo sapiens
aataaagtgttttcagag

SEQ ID NO: 4480024 - DNA, 21 bp, Homo sapiens
aataaagttctgcaaaataca

SEQ ID NO: 4480025 - DNA, 15 bp, Homo sapiens
aataaagttgcagat

SEQ ID NO: 4480026 - DNA, 23 bp, Homo sapiens
aataaataaaattcatttctaca

SEQ ID NO: 4480027 - DNA, 14 bp, Homo sapiens
aataaatactcagt

SEQ ID NO: 4480028 - DNA, 14 bp, Homo sapiens
aataaatagaaaga

SEQ ID NO: 4480029 - DNA, 19 bp, Homo sapiens
aataaatctaggatgtgat

SEQ ID NO: 4480030 - DNA, 22 bp, Homo sapiens
aataaatctcttctttgctgca

SEQ ID NO: 4480031 - DNA, 15 bp, Homo sapiens
aataaatctttcaaa

SEQ ID NO: 4480032 - DNA, 22 bp, Homo sapiens
aataaatgattatattcacaga

SEQ ID NO: 4480033 - DNA, 22 bp, Homo sapiens
aataaatgtgaaacatcttctc

SEQ ID NO: 4480034 - DNA, 21 bp, Homo sapiens
aataaatgtgccttcattttt

SEQ ID NO: 4480035 - DNA, 15 bp, Homo sapiens
aataaatgttttagt

SEQ ID NO: 4480036 - DNA, 22 bp, Homo sapiens
aataaattgatttttataaata

SEQ ID NO: 4480037 - DNA, 21 bp, Homo sapiens
aataaatttgacttttctgta

SEQ ID NO: 4480038 - DNA, 13 bp, Homo sapiens
aataaattttcta

SEQ ID NO: 4480039 - DNA, 22 bp, Homo sapiens
aataaattttttataaaagtgt

SEQ ID NO: 4480040 - DNA, 14 bp, Homo sapiens
aataacactgtatt

SEQ ID NO: 4480041 - DNA, 15 bp, Homo sapiens
aataacactgtattt

SEQ ID NO: 4480042 - DNA, 15 bp, Homo sapiens
aataactgaatttgg

SEQ ID NO: 4480043 - DNA, 22 bp, Homo sapiens
aataactgagatattattttaa

SEQ ID NO: 4480044 - DNA, 21 bp, Homo sapiens
aataactggaacaaattattt

SEQ ID NO: 4480045 - DNA, 12 bp, Homo sapiens
aataactgtgta

SEQ ID NO: 4480046 - DNA, 15 bp, Homo sapiens
aataactgtgtactg

SEQ ID NO: 4480047 - DNA, 23 bp, Homo sapiens
aataacttagactctagtattta

SEQ ID NO: 4480048 - DNA, 20 bp, Homo sapiens
aataactttctctgtgaaag

SEQ ID NO: 4480049 - DNA, 22 bp, Homo sapiens
aataagaaacaactctttgaga

SEQ ID NO: 4480050 - DNA, 22 bp, Homo sapiens
aataagattggtgttcgtttcc

SEQ ID NO: 4480051 - DNA, 22 bp, Homo sapiens
aataagatttagttgagttatt

SEQ ID NO: 4480052 - DNA, 18 bp, Homo sapiens
aataagatttttcaaaat

SEQ ID NO: 4480053 - DNA, 13 bp, Homo sapiens
aagcctgtgcaaa

SEQ ID NO: 4480054 - DNA, 15 bp, Homo sapiens
aagcctgtggatgat

SEQ ID NO: 4480055 - DNA, 22 bp, Homo sapiens
aagcctgttccataggaaggct

SEQ ID NO: 4480056 - DNA, 15 bp, Homo sapiens
aagcctgttgtttaa

SEQ ID NO: 4480057 - DNA, 18 bp, Homo sapiens
aagccttatgaaaattat

SEQ ID NO: 4480058 - DNA, 18 bp, Homo sapiens
aagccttggaaccagccc

SEQ ID NO: 4480059 - DNA, 19 bp, Homo sapiens
aagcctttgtatctttctt

SEQ ID NO: 4480060 - DNA, 18 bp, Homo sapiens
aagcgagcacagtattat

SEQ ID NO: 4480061 - DNA, 17 bp, Homo sapiens
aagcggaacatgtgctt

SEQ ID NO: 4480062 - DNA, 14 bp, Homo sapiens
aagcgggaaacatg

SEQ ID NO: 4480063 - DNA, 20 bp, Homo sapiens
aagcgttcctggccttctga

SEQ ID NO: 4480064 - DNA, 23 bp, Homo sapiens
aagctaaaacctgagctagaagc

SEQ ID NO: 4480065 - DNA, 14 bp, Homo sapiens
aagcaatattgtat

SEQ ID NO: 4480066 - DNA, 17 bp, Homo sapiens
aagcaatcctcctgcct

SEQ ID NO: 4480067 - DNA, 14 bp, Homo sapiens
aagcaatcttttat

SEQ ID NO: 4480068 - DNA, 16 bp, Homo sapiens
aagcaattatattgtc

SEQ ID NO: 4480069 - DNA, 15 bp, Homo sapiens
aagcaattccaacct

SEQ ID NO: 4480070 - DNA, 16 bp, Homo sapiens
aagcacaaagttctca

SEQ ID NO: 4480071 - DNA, 17 bp, Homo sapiens
aagcacaagtacttttg

SEQ ID NO: 4480072 - DNA, 18 bp, Homo sapiens
aagcacacacaataaaga

SEQ ID NO: 4480073 - DNA, 15 bp, Homo sapiens
aagcacactggaata

SEQ ID NO: 4480074 - DNA, 15 bp, Homo sapiens
aagcacagaatattt

SEQ ID NO: 4480075 - DNA, 17 bp, Homo sapiens
aagcacagagcctggcc

SEQ ID NO: 4480076 - DNA, 19 bp, Homo sapiens
aagcacagagcctggcccc

SEQ ID NO: 4480077 - DNA, 11 bp, Homo sapiens
aagcacagagg

SEQ ID NO: 4480078 - DNA, 14 bp, Homo sapiens
aagcaccccatgcc

SEQ ID NO: 4480079 - DNA, 20 bp, Homo sapiens
aagcactaaaaagttgaacc

SEQ ID NO: 4480080 - DNA, 21 bp, Homo sapiens
aagcactaaaaagttgaacca

SEQ ID NO: 4480081 - DNA, 13 bp, Homo sapiens
aagcactagagaa

SEQ ID NO: 4480082 - DNA, 19 bp, Homo sapiens
aagcactctggatgatgga

SEQ ID NO: 4480083 - DNA, 19 bp, Homo sapiens
aagcactgacttctaagta

SEQ ID NO: 4480084 - DNA, 20 bp, Homo sapiens
aagcactgacttctaagtaa

SEQ ID NO: 4480085 - DNA, 22 bp, Homo sapiens
aagcactggtttcaagaatatg

SEQ ID NO: 4480086 - DNA, 15 bp, Homo sapiens
aagcacttcccagga

SEQ ID NO: 4480087 - DNA, 19 bp, Homo sapiens
aagcacttcccaggatctg

SEQ ID NO: 4480088 - DNA, 21 bp, Homo sapiens
aagcacttgctcaaaatctgt

SEQ ID NO: 4480089 - DNA, 17 bp, Homo sapiens
aagcagaaacagcatat

SEQ ID NO: 4480090 - DNA, 11 bp, Homo sapiens
aagcagaagga

SEQ ID NO: 4480091 - DNA, 20 bp, Homo sapiens
aagcagaggccctgccccca

SEQ ID NO: 4480092 - DNA, 21 bp, Homo sapiens
aagcagaggccctgcccccac

SEQ ID NO: 4480093 - DNA, 22 bp, Homo sapiens
aagcagaggccctgcccccacc

SEQ ID NO: 4480094 - DNA, 14 bp, Homo sapiens
aagcagaggctttg

SEQ ID NO: 4480095 - DNA, 19 bp, Homo sapiens
aagcagatttctgcttcct

SEQ ID NO: 4480096 - DNA, 12 bp, Homo sapiens
aagcagcaacag

SEQ ID NO: 4480097 - DNA, 18 bp, Homo sapiens
aagcagcaggcctctggt

SEQ ID NO: 4480098 - DNA, 18 bp, Homo sapiens
aagcagcctttgtggttt

SEQ ID NO: 4480099 - DNA, 22 bp, Homo sapiens
aagcaggaaaaaaggaatattt

SEQ ID NO: 4480100 - DNA, 14 bp, Homo sapiens
aagcaggacagaca

SEQ ID NO: 4480101 - DNA, 11 bp, Homo sapiens
aagcaggctgg

SEQ ID NO: 4480102 - DNA, 16 bp, Homo sapiens
aagcaggtttcaagga

SEQ ID NO: 4480103 - DNA, 12 bp, Homo sapiens
aagcagtatttt

SEQ ID NO: 4480104 - DNA, 14 bp, Homo sapiens
aagcagtcttgctc

SEQ ID NO: 4480105 - DNA, 17 bp, Homo sapiens
aagcagtggatacgtgt

SEQ ID NO: 4480106 - DNA, 21 bp, Homo sapiens
aagcagttatggtgatgactt

SEQ ID NO: 4480107 - DNA, 20 bp, Homo sapiens
aagcataaagttacctacat

SEQ ID NO: 4480108 - DNA, 19 bp, Homo sapiens
aagcatcagttctacggat

SEQ ID NO: 4480109 - DNA, 22 bp, Homo sapiens
aagcatcatcacgacacatttg

SEQ ID NO: 4480110 - DNA, 14 bp, Homo sapiens
aagcatccctcacc

SEQ ID NO: 4480111 - DNA, 16 bp, Homo sapiens
aagcatgaataaaatt

SEQ ID NO: 4480112 - DNA, 20 bp, Homo sapiens
aagcatgaataaaattaggt

SEQ ID NO: 4480113 - DNA, 22 bp, Homo sapiens
aagcatgaataacatttaaatt

SEQ ID NO: 4480114 - DNA, 23 bp, Homo sapiens
aagcatgaataacatttaaattc

SEQ ID NO: 4480115 - DNA, 15 bp, Homo sapiens
aagcatgcataaatc

SEQ ID NO: 4480116 - DNA, 16 bp, Homo sapiens
aagcatgcataaatca

SEQ ID NO: 4480117 - DNA, 23 bp, Homo sapiens
aagcatgcattgaaaaatttcta

SEQ ID NO: 4480118 - DNA, 15 bp, Homo sapiens
aagcatggctatttt

SEQ ID NO: 4480119 - DNA, 18 bp, Homo sapiens
aagcatggtgtcagtttt

SEQ ID NO: 4480120 - DNA, 19 bp, Homo sapiens
aagcatgtaacttatatta

SEQ ID NO: 4480121 - DNA, 20 bp, Homo sapiens
aagcatgtttattctgttcc

SEQ ID NO: 4480122 - DNA, 12 bp, Homo sapiens
aagcattcacaa

SEQ ID NO: 4480123 - DNA, 21 bp, Homo sapiens
aagcattcagaagaaaaagaa

SEQ ID NO: 4480124 - DNA, 21 bp, Homo sapiens
aagcattgcctggccttcctg

SEQ ID NO: 4480125 - DNA, 17 bp, Homo sapiens
aagcattgtaaaataat

SEQ ID NO: 4480126 - DNA, 18 bp, Homo sapiens
aagcattgtaaaataatt

SEQ ID NO: 4480127 - DNA, 13 bp, Homo sapiens
aagcattgtaaat

SEQ ID NO: 4480128 - DNA, 18 bp, Homo sapiens
aagcattgtaaatgtgct

SEQ ID NO: 4480129 - DNA, 12 bp, Homo sapiens
aagcatttcatg

SEQ ID NO: 4480130 - DNA, 23 bp, Homo sapiens
aagcatttcatgaaaaagctgct

SEQ ID NO: 4480131 - DNA, 23 bp, Homo sapiens
aagcatttttattatatttatgt

SEQ ID NO: 4480132 - DNA, 21 bp, Homo sapiens
aagccaaaagtccctccctgc

SEQ ID NO: 4480133 - DNA, 11 bp, Homo sapiens
aagccaaagaa

SEQ ID NO: 4480134 - DNA, 12 bp, Homo sapiens
aagccaaagaaa

SEQ ID NO: 4480135 - DNA, 13 bp, Homo sapiens
aagccaaagaaaa

SEQ ID NO: 4480136 - DNA, 15 bp, Homo sapiens
aagccaaagaaatga

SEQ ID NO: 4480137 - DNA, 19 bp, Homo sapiens
aagccaaagagcctcccac

SEQ ID NO: 4480138 - DNA, 19 bp, Homo sapiens
aagccaagtggggtgctgg

SEQ ID NO: 4480139 - DNA, 16 bp, Homo sapiens
aagccaagttttctca

SEQ ID NO: 4480140 - DNA, 14 bp, Homo sapiens
aagccacaggcctg

SEQ ID NO: 4480141 - DNA, 15 bp, Homo sapiens
aagccacaggcctga

SEQ ID NO: 4480142 - DNA, 17 bp, Homo sapiens
aagccacaggcctgaga

SEQ ID NO: 4480143 - DNA, 16 bp, Homo sapiens
aagccacgccctccct

SEQ ID NO: 4480144 - DNA, 17 bp, Homo sapiens
aagccacgccctccctg

SEQ ID NO: 4480145 - DNA, 16 bp, Homo sapiens
aagccacgctgtcctc

SEQ ID NO: 4480146 - DNA, 22 bp, Homo sapiens
aagccagaacctcagaggccac

SEQ ID NO: 4480147 - DNA, 20 bp, Homo sapiens
aagccagacctagcaggctg

SEQ ID NO: 4480148 - DNA, 15 bp, Homo sapiens
aagccagagcctggg

SEQ ID NO: 4480149 - DNA, 20 bp, Homo sapiens
aagccagccaagctttaaat

SEQ ID NO: 4480150 - DNA, 19 bp, Homo sapiens
aagccagcgtcctcctctg

SEQ ID NO: 4480151 - DNA, 22 bp, Homo sapiens
aagccaggcctggctggaggag

SEQ ID NO: 4480152 - DNA, 17 bp, Homo sapiens
aagccagttgcttcttc

SEQ ID NO: 4480153 - DNA, 20 bp, Homo sapiens
aagccatcacttctccccgc

SEQ ID NO: 4480154 - DNA, 21 bp, Homo sapiens
aagccatcacttctccccgca

SEQ ID NO: 4480155 - DNA, 21 bp, Homo sapiens
aagccatggctgacctctgga

SEQ ID NO: 4480156 - DNA, 21 bp, Homo sapiens
aagccatgtactcaagtacca

SEQ ID NO: 4480157 - DNA, 22 bp, Homo sapiens
aagccattaaatgaatattttg

SEQ ID NO: 4480158 - DNA, 14 bp, Homo sapiens
aagcccagttcatc

SEQ ID NO: 4480159 - DNA, 15 bp, Homo sapiens
aagcccatcctgacc

SEQ ID NO: 4480160 - DNA, 15 bp, Homo sapiens
aagccccatttcctc

SEQ ID NO: 4480161 - DNA, 16 bp, Homo sapiens
aagccccccagctccc

SEQ ID NO: 4480162 - DNA, 17 bp, Homo sapiens
aagccccccagctccca

SEQ ID NO: 4480163 - DNA, 20 bp, Homo sapiens
aagccccccagctcccacac

SEQ ID NO: 4480164 - DNA, 15 bp, Homo sapiens
aagcccgcttgctcg

SEQ ID NO: 4480165 - DNA, 21 bp, Homo sapiens
aagccctcctccccagagctg

SEQ ID NO: 4480166 - DNA, 12 bp, Homo sapiens
aagccctgaggg

SEQ ID NO: 4480167 - DNA, 13 bp, Homo sapiens
aagccctgcccac

SEQ ID NO: 4480168 - DNA, 23 bp, Homo sapiens
aagccctggcccccacagcgctc

SEQ ID NO: 4480169 - DNA, 16 bp, Homo sapiens
aagcccttaataataa

SEQ ID NO: 4480170 - DNA, 16 bp, Homo sapiens
aagccctttttatcag

SEQ ID NO: 4480171 - DNA, 15 bp, Homo sapiens
aagccgaccttccct

SEQ ID NO: 4480172 - DNA, 23 bp, Homo sapiens
aagcctaaaagtgggcttgattc

SEQ ID NO: 4480173 - DNA, 15 bp, Homo sapiens
aagcctaaatttgtg

SEQ ID NO: 4480174 - DNA, 16 bp, Homo sapiens
aagcctaaatttgtgc

SEQ ID NO: 4480175 - DNA, 18 bp, Homo sapiens
aagcctccaagcacagag

SEQ ID NO: 4480176 - DNA, 15 bp, Homo sapiens
aagcctcctgttggc

SEQ ID NO: 4480177 - DNA, 17 bp, Homo sapiens
aagcctctctccttggc

SEQ ID NO: 4480178 - DNA, 12 bp, Homo sapiens
aagcctctggct

SEQ ID NO: 4480179 - DNA, 12 bp, Homo sapiens
aagcctctgtcc

SEQ ID NO: 4480180 - DNA, 19 bp, Homo sapiens
aagcctgacttcacatctg

SEQ ID NO: 4480181 - DNA, 20 bp, Homo sapiens
aagcctgacttcacatctgc

SEQ ID NO: 4480182 - DNA, 21 bp, Homo sapiens
aagcctgcacaataaaaatgt

SEQ ID NO: 4480183 - DNA, 13 bp, Homo sapiens
aagcctgcctccc

SEQ ID NO: 4480184 - DNA, 22 bp, Homo sapiens
aagcctgctggctgcggccccc

SEQ ID NO: 4480185 - DNA, 17 bp, Homo sapiens
aagcctgtaatcccagc

SEQ ID NO: 4480186 - DNA, 13 bp, Homo sapiens
aagagacaaagat

SEQ ID NO: 4480187 - DNA, 15 bp, Homo sapiens
aagagacaaagattt

SEQ ID NO: 4480188 - DNA, 22 bp, Homo sapiens
aagagacagagacaagtaattt

SEQ ID NO: 4480189 - DNA, 16 bp, Homo sapiens
aagagacagcccagga

SEQ ID NO: 4480190 - DNA, 14 bp, Homo sapiens
aagagacatttcaa

SEQ ID NO: 4480191 - DNA, 18 bp, Homo sapiens
aagagacatttcaaaact

SEQ ID NO: 4480192 - DNA, 16 bp, Homo sapiens
aagagagattggattt

SEQ ID NO: 4480193 - DNA, 19 bp, Homo sapiens
aagagagtttttaatagaa

SEQ ID NO: 4480194 - DNA, 17 bp, Homo sapiens
aagagatctacacatgt

SEQ ID NO: 4480195 - DNA, 15 bp, Homo sapiens
aagagatgaaataat

SEQ ID NO: 4480196 - DNA, 19 bp, Homo sapiens
aagagatggaaaaaaagta

SEQ ID NO: 4480197 - DNA, 13 bp, Homo sapiens
aagagcacactgc

SEQ ID NO: 4480198 - DNA, 13 bp, Homo sapiens
aagagcagcctgt

SEQ ID NO: 4480199 - DNA, 16 bp, Homo sapiens
aagagcagcctgtggc

SEQ ID NO: 4480200 - DNA, 19 bp, Homo sapiens
aagagcagcctgtggcatc

SEQ ID NO: 4480201 - DNA, 22 bp, Homo sapiens
aagagcaggactccaggcccaa

SEQ ID NO: 4480202 - DNA, 14 bp, Homo sapiens
aagagcatggatgc

SEQ ID NO: 4480203 - DNA, 17 bp, Homo sapiens
aagagcatggatgcatt

SEQ ID NO: 4480204 - DNA, 14 bp, Homo sapiens
aagagccacctgca

SEQ ID NO: 4480205 - DNA, 9 bp, Homo sapiens
aagagccat

SEQ ID NO: 4480206 - DNA, 16 bp, Homo sapiens
aagagcccttgcctcc

SEQ ID NO: 4480207 - DNA, 18 bp, Homo sapiens
aagagcccttgcctcccc

SEQ ID NO: 4480208 - DNA, 22 bp, Homo sapiens
aagagccttggtgtccacctgg

SEQ ID NO: 4480209 - DNA, 21 bp, Homo sapiens
aagagcgagagatcaaagatg

SEQ ID NO: 4480210 - DNA, 14 bp, Homo sapiens
aagagctattttag

SEQ ID NO: 4480211 - DNA, 18 bp, Homo sapiens
aagagctattttagaaag

SEQ ID NO: 4480212 - DNA, 19 bp, Homo sapiens
aagagctattttagaaagc

SEQ ID NO: 4480213 - DNA, 20 bp, Homo sapiens
aagagctattttagaaagct

SEQ ID NO: 4480214 - DNA, 13 bp, Homo sapiens
aagagctgccctc

SEQ ID NO: 4480215 - DNA, 19 bp, Homo sapiens
aagagctgttcacagccag

SEQ ID NO: 4480216 - DNA, 18 bp, Homo sapiens
aagagcttgcacagccaa

SEQ ID NO: 4480217 - DNA, 17 bp, Homo sapiens
aagaggaagttcagatc

SEQ ID NO: 4480218 - DNA, 14 bp, Homo sapiens
aagaggaatctgtt

SEQ ID NO: 4480219 - DNA, 22 bp, Homo sapiens
aagaggaatctgtttctctgct

SEQ ID NO: 4480220 - DNA, 17 bp, Homo sapiens
aagaggatgatttcaga

SEQ ID NO: 4480221 - DNA, 19 bp, Homo sapiens
aagaggccatttaagtatc

SEQ ID NO: 4480222 - DNA, 17 bp, Homo sapiens
aagaggctgcccctctc

SEQ ID NO: 4480223 - DNA, 22 bp, Homo sapiens
aagaggctgcccctctcaccaa

SEQ ID NO: 4480224 - DNA, 17 bp, Homo sapiens
aagaggcttctcctgtt

SEQ ID NO: 4480225 - DNA, 20 bp, Homo sapiens
aagaggcttctcctgtttta

SEQ ID NO: 4480226 - DNA, 17 bp, Homo sapiens
aagagggacgcctgggg

SEQ ID NO: 4480227 - DNA, 16 bp, Homo sapiens
aagagggcaagcctct

SEQ ID NO: 4480228 - DNA, 14 bp, Homo sapiens
aagagggcccagcc

SEQ ID NO: 4480229 - DNA, 20 bp, Homo sapiens
aagagggctttttaaatttg

SEQ ID NO: 4480230 - DNA, 18 bp, Homo sapiens
aagaggggtcaagagtta

SEQ ID NO: 4480231 - DNA, 23 bp, Homo sapiens
aagaggttgggcttccatgcctg

SEQ ID NO: 4480232 - DNA, 17 bp, Homo sapiens
aagagtacactcagcca

SEQ ID NO: 4480233 - DNA, 19 bp, Homo sapiens
aagagtacactcagccact

SEQ ID NO: 4480234 - DNA, 15 bp, Homo sapiens
aagagtggtggccta

SEQ ID NO: 4480235 - DNA, 14 bp, Homo sapiens
aagagttcaagaaa

SEQ ID NO: 4480236 - DNA, 16 bp, Homo sapiens
aagagttcaagaaata

SEQ ID NO: 4480237 - DNA, 17 bp, Homo sapiens
aagagttgtgcacgcag

SEQ ID NO: 4480238 - DNA, 18 bp, Homo sapiens
aagataaagaccagaaat

SEQ ID NO: 4480239 - DNA, 18 bp, Homo sapiens
aagataatattttacata

SEQ ID NO: 4480240 - DNA, 19 bp, Homo sapiens
aagataatttatttcaata

SEQ ID NO: 4480241 - DNA, 16 bp, Homo sapiens
aagatacaataaaaca

SEQ ID NO: 4480242 - DNA, 21 bp, Homo sapiens
aagatacactcaagcatgaag

SEQ ID NO: 4480243 - DNA, 21 bp, Homo sapiens
aagatacactgcactttgttt

SEQ ID NO: 4480244 - DNA, 14 bp, Homo sapiens
aagatacttaagtg

SEQ ID NO: 4480245 - DNA, 15 bp, Homo sapiens
aagatagcagggcat

SEQ ID NO: 4480246 - DNA, 20 bp, Homo sapiens
aagatagtcttggaagctgt

SEQ ID NO: 4480247 - DNA, 14 bp, Homo sapiens
aagatagtgtaact

SEQ ID NO: 4480248 - DNA, 19 bp, Homo sapiens
aagatatatgtgtatacat

SEQ ID NO: 4480249 - DNA, 13 bp, Homo sapiens
aagatatggagaa

SEQ ID NO: 4480250 - DNA, 15 bp, Homo sapiens
aagatatggagaatt

SEQ ID NO: 4480251 - DNA, 14 bp, Homo sapiens
aagatattatttgt

SEQ ID NO: 4480252 - DNA, 20 bp, Homo sapiens
aagatattatttgtcttaaa

SEQ ID NO: 4480253 - DNA, 19 bp, Homo sapiens
aagatattttaaaatctgt

SEQ ID NO: 4480254 - DNA, 19 bp, Homo sapiens
aagatcacacatcaagact

SEQ ID NO: 4480255 - DNA, 21 bp, Homo sapiens
aagatcacacatcaagactat

SEQ ID NO: 4480256 - DNA, 19 bp, Homo sapiens
aagatccagaaatacttaa

SEQ ID NO: 4480257 - DNA, 19 bp, Homo sapiens
aagatccccaactgctcca

SEQ ID NO: 4480258 - DNA, 15 bp, Homo sapiens
aagatcccctcagga

SEQ ID NO: 4480259 - DNA, 16 bp, Homo sapiens
aagatcccctcaggac

SEQ ID NO: 4480260 - DNA, 14 bp, Homo sapiens
aagatcctaaactc

SEQ ID NO: 4480261 - DNA, 15 bp, Homo sapiens
aagatcctaaactct

SEQ ID NO: 4480262 - DNA, 14 bp, Homo sapiens
aagatctctttcta

SEQ ID NO: 4480263 - DNA, 13 bp, Homo sapiens
aagatcttgcaga

SEQ ID NO: 4480264 - DNA, 14 bp, Homo sapiens
aagatgaaaatatt

SEQ ID NO: 4480265 - DNA, 14 bp, Homo sapiens
aagatgaaacatca

SEQ ID NO: 4480266 - DNA, 22 bp, Homo sapiens
aagatgatttaagtatacagga

SEQ ID NO: 4480267 - DNA, 19 bp, Homo sapiens
aagatggcttatgtcatca

SEQ ID NO: 4480268 - DNA, 12 bp, Homo sapiens
aagatgggacag

SEQ ID NO: 4480269 - DNA, 13 bp, Homo sapiens
aagatggttttga

SEQ ID NO: 4480270 - DNA, 13 bp, Homo sapiens
aagatgtagagga

SEQ ID NO: 4480271 - DNA, 19 bp, Homo sapiens
aagatgtagaggagaaact

SEQ ID NO: 4480272 - DNA, 12 bp, Homo sapiens
aagatgtgaatt

SEQ ID NO: 4480273 - DNA, 16 bp, Homo sapiens
aagatgtgaattattg

SEQ ID NO: 4480274 - DNA, 16 bp, Homo sapiens
aagatgtgttcttatt

SEQ ID NO: 4480275 - DNA, 17 bp, Homo sapiens
aagatgtgttcttattt

SEQ ID NO: 4480276 - DNA, 12 bp, Homo sapiens
aagattaatttt

SEQ ID NO: 4480277 - DNA, 18 bp, Homo sapiens
aagattagggaaaatgga

SEQ ID NO: 4480278 - DNA, 22 bp, Homo sapiens
aagattattgtgacttcactgt

SEQ ID NO: 4480279 - DNA, 12 bp, Homo sapiens
aagattcccaga

SEQ ID NO: 4480280 - DNA, 22 bp, Homo sapiens
aagattctatgttaatatttta

SEQ ID NO: 4480281 - DNA, 19 bp, Homo sapiens
aagattctcgccccttccc

SEQ ID NO: 4480282 - DNA, 17 bp, Homo sapiens
aagattggttataatag

SEQ ID NO: 4480283 - DNA, 18 bp, Homo sapiens
aagattgtccttttctcc

SEQ ID NO: 4480284 - DNA, 20 bp, Homo sapiens
aagatttcatatctaacttt

SEQ ID NO: 4480285 - DNA, 15 bp, Homo sapiens
aagatttctctaata

SEQ ID NO: 4480286 - DNA, 16 bp, Homo sapiens
aagatttgatgtatgt

SEQ ID NO: 4480287 - DNA, 15 bp, Homo sapiens
aagatttgcccattt

SEQ ID NO: 4480288 - DNA, 22 bp, Homo sapiens
aagatttgtgtttttctttttc

SEQ ID NO: 4480289 - DNA, 20 bp, Homo sapiens
aagattttgttttgttggac

SEQ ID NO: 4480290 - DNA, 18 bp, Homo sapiens
aagatttttaaaatgaat

SEQ ID NO: 4480291 - DNA, 14 bp, Homo sapiens
aagattttttcatt

SEQ ID NO: 4480292 - DNA, 15 bp, Homo sapiens
aagatttttttcctg

SEQ ID NO: 4480293 - DNA, 20 bp, Homo sapiens
aagcaaaatctaaaatgttt

SEQ ID NO: 4480294 - DNA, 22 bp, Homo sapiens
aagcaaactatgatttattttg

SEQ ID NO: 4480295 - DNA, 20 bp, Homo sapiens
aagcaacattcatagtcttt

SEQ ID NO: 4480296 - DNA, 19 bp, Homo sapiens
aagcaacctcagtaattta

SEQ ID NO: 4480297 - DNA, 19 bp, Homo sapiens
aagcaactacaacttctcc

SEQ ID NO: 4480298 - DNA, 15 bp, Homo sapiens
aagcaacttgcttct

SEQ ID NO: 4480299 - DNA, 22 bp, Homo sapiens
aagcaagaggcaagctgaaatt

SEQ ID NO: 4480300 - DNA, 23 bp, Homo sapiens
aagcaagaggcaagctgaaattt

SEQ ID NO: 4480301 - DNA, 17 bp, Homo sapiens
aagcaagatgagctgtg

SEQ ID NO: 4480302 - DNA, 18 bp, Homo sapiens
aagcaagatgagctgtgc

SEQ ID NO: 4480303 - DNA, 14 bp, Homo sapiens
aagcaagcagatga

SEQ ID NO: 4480304 - DNA, 15 bp, Homo sapiens
aagcaagctaacctt

SEQ ID NO: 4480305 - DNA, 22 bp, Homo sapiens
aagcaataactatttttcctca

SEQ ID NO: 4480306 - DNA, 17 bp, Homo sapiens
aagcaatactgtttcca

SEQ ID NO: 4480307 - DNA, 14 bp, Homo sapiens
aagaactgtacatt

SEQ ID NO: 4480308 - DNA, 16 bp, Homo sapiens
aagaactgtacattgt

SEQ ID NO: 4480309 - DNA, 12 bp, Homo sapiens
aagaactgtgtc

SEQ ID NO: 4480310 - DNA, 23 bp, Homo sapiens
aagaactgttgcctaattggaaa

SEQ ID NO: 4480311 - DNA, 13 bp, Homo sapiens
aagaagaaactca

SEQ ID NO: 4480312 - DNA, 23 bp, Homo sapiens
aagaagaaacttgtaaatatctt

SEQ ID NO: 4480313 - DNA, 12 bp, Homo sapiens
aagaagaaagca

SEQ ID NO: 4480314 - DNA, 13 bp, Homo sapiens
aagaagaaagcaa

SEQ ID NO: 4480315 - DNA, 13 bp, Homo sapiens
aagaagaagaagg

SEQ ID NO: 4480316 - DNA, 15 bp, Homo sapiens
aagaagaaggagagc

SEQ ID NO: 4480317 - DNA, 19 bp, Homo sapiens
aagaagagcgagagatcaa

SEQ ID NO: 4480318 - DNA, 22 bp, Homo sapiens
aagaagagcgagagatcaaaga

SEQ ID NO: 4480319 - DNA, 22 bp, Homo sapiens
aagaagcagtggccttattgca

SEQ ID NO: 4480320 - DNA, 23 bp, Homo sapiens
aagaagccatatatgaccagaag

SEQ ID NO: 4480321 - DNA, 14 bp, Homo sapiens
aagaagcttccaca

SEQ ID NO: 4480322 - DNA, 18 bp, Homo sapiens
aagaaggaaagatggtta

SEQ ID NO: 4480323 - DNA, 13 bp, Homo sapiens
aagaaggaaggcc

SEQ ID NO: 4480324 - DNA, 16 bp, Homo sapiens
aagaaggagagcaaga

SEQ ID NO: 4480325 - DNA, 15 bp, Homo sapiens
aagaaggcaaaaata

SEQ ID NO: 4480326 - DNA, 15 bp, Homo sapiens
aagaaggcaatatta

SEQ ID NO: 4480327 - DNA, 22 bp, Homo sapiens
aagaaggcaattttagtgtatt

SEQ ID NO: 4480328 - DNA, 23 bp, Homo sapiens
aagaaggcatcgtcatgcacagt

SEQ ID NO: 4480329 - DNA, 22 bp, Homo sapiens
aagaagtgaaaatctacactcc

SEQ ID NO: 4480330 - DNA, 20 bp, Homo sapiens
aagaagtggctgccacaccc

SEQ ID NO: 4480331 - DNA, 19 bp, Homo sapiens
aagaagtgtgtcaccctta

SEQ ID NO: 4480332 - DNA, 19 bp, Homo sapiens
aagaagttaattcttaaaa

SEQ ID NO: 4480333 - DNA, 14 bp, Homo sapiens
aagaagtttttggt

SEQ ID NO: 4480334 - DNA, 17 bp, Homo sapiens
aagaagttttttacttt

SEQ ID NO: 4480335 - DNA, 12 bp, Homo sapiens
aagaataaaatg

SEQ ID NO: 4480336 - DNA, 14 bp, Homo sapiens
aagaataataaaat

SEQ ID NO: 4480337 - DNA, 16 bp, Homo sapiens
aagaataatcacgctt

SEQ ID NO: 4480338 - DNA, 18 bp, Homo sapiens
aagaataatttatagtaa

SEQ ID NO: 4480339 - DNA, 12 bp, Homo sapiens
aagaatacttct

SEQ ID NO: 4480340 - DNA, 22 bp, Homo sapiens
aagaatacttctcattttttaa

SEQ ID NO: 4480341 - DNA, 17 bp, Homo sapiens
aagaatacttgaacttg

SEQ ID NO: 4480342 - DNA, 18 bp, Homo sapiens
aagaatatttttagacta

SEQ ID NO: 4480343 - DNA, 12 bp, Homo sapiens
aagaatctcatc

SEQ ID NO: 4480344 - DNA, 20 bp, Homo sapiens
aagaatctcatctcagtgaa

SEQ ID NO: 4480345 - DNA, 17 bp, Homo sapiens
aagaatgaaatgaatga

SEQ ID NO: 4480346 - DNA, 12 bp, Homo sapiens
aagaatgaatat

SEQ ID NO: 4480347 - DNA, 16 bp, Homo sapiens
aagaatgcaagagtgg

SEQ ID NO: 4480348 - DNA, 18 bp, Homo sapiens
aagaatgcagtacagaat

SEQ ID NO: 4480349 - DNA, 15 bp, Homo sapiens
aagaatgccatttct

SEQ ID NO: 4480350 - DNA, 13 bp, Homo sapiens
aagaatgcttaaa

SEQ ID NO: 4480351 - DNA, 21 bp, Homo sapiens
aagaatgtcaggaatttaaga

SEQ ID NO: 4480352 - DNA, 13 bp, Homo sapiens
aagaatgtctatt

SEQ ID NO: 4480353 - DNA, 17 bp, Homo sapiens
aagaatgtctatttcca

SEQ ID NO: 4480354 - DNA, 17 bp, Homo sapiens
aagaatgttactgcctt

SEQ ID NO: 4480355 - DNA, 12 bp, Homo sapiens
aagaattaatga

SEQ ID NO: 4480356 - DNA, 13 bp, Homo sapiens
aagaattactttg

SEQ ID NO: 4480357 - DNA, 17 bp, Homo sapiens
aagaattattttaacaa

SEQ ID NO: 4480358 - DNA, 13 bp, Homo sapiens
aagaattcaaatt

SEQ ID NO: 4480359 - DNA, 17 bp, Homo sapiens
aagaattcaaatttgta

SEQ ID NO: 4480360 - DNA, 13 bp, Homo sapiens
aagaattccaaag

SEQ ID NO: 4480361 - DNA, 18 bp, Homo sapiens
aagaattgaacccaggag

SEQ ID NO: 4480362 - DNA, 20 bp, Homo sapiens
aagaattgccagtcttttgt

SEQ ID NO: 4480363 - DNA, 15 bp, Homo sapiens
aagaattggaagtta

SEQ ID NO: 4480364 - DNA, 22 bp, Homo sapiens
aagaattgttagcaaatgacag

SEQ ID NO: 4480365 - DNA, 17 bp, Homo sapiens
aagaatttgaagacttc

SEQ ID NO: 4480366 - DNA, 11 bp, Homo sapiens
aagaatttgtt

SEQ ID NO: 4480367 - DNA, 14 bp, Homo sapiens
aagaatttgtttaa

SEQ ID NO: 4480368 - DNA, 21 bp, Homo sapiens
aagacaaaacgagtctttcat

SEQ ID NO: 4480369 - DNA, 14 bp, Homo sapiens
aagacaaaagtctg

SEQ ID NO: 4480370 - DNA, 21 bp, Homo sapiens
aagacaaataaatgattatat

SEQ ID NO: 4480371 - DNA, 18 bp, Homo sapiens
aagacaaattttgcatat

SEQ ID NO: 4480372 - DNA, 13 bp, Homo sapiens
aagacaacagaaa

SEQ ID NO: 4480373 - DNA, 15 bp, Homo sapiens
aagacaacagaaaga

SEQ ID NO: 4480374 - DNA, 17 bp, Homo sapiens
aagacaagctgtataaa

SEQ ID NO: 4480375 - DNA, 22 bp, Homo sapiens
aagacaatagcacttaaattcc

SEQ ID NO: 4480376 - DNA, 21 bp, Homo sapiens
aagacacactccccacttcac

SEQ ID NO: 4480377 - DNA, 21 bp, Homo sapiens
aagacacagaatagtttacac

SEQ ID NO: 4480378 - DNA, 11 bp, Homo sapiens
aagacacattg

SEQ ID NO: 4480379 - DNA, 20 bp, Homo sapiens
aagacagatgccccagagct

SEQ ID NO: 4480380 - DNA, 22 bp, Homo sapiens
aagacagatgccccagagctgt

SEQ ID NO: 4480381 - DNA, 16 bp, Homo sapiens
aagacagcagcagcct

SEQ ID NO: 4480382 - DNA, 19 bp, Homo sapiens
aagacagcagcagcctgca

SEQ ID NO: 4480383 - DNA, 17 bp, Homo sapiens
aagacagtgccctgaga

SEQ ID NO: 4480384 - DNA, 13 bp, Homo sapiens
aagacatctgcct

SEQ ID NO: 4480385 - DNA, 20 bp, Homo sapiens
aagacatctgcctgtaatta

SEQ ID NO: 4480386 - DNA, 14 bp, Homo sapiens
aagacatgatttcc

SEQ ID NO: 4480387 - DNA, 20 bp, Homo sapiens
aagacatgatttccttgaat

SEQ ID NO: 4480388 - DNA, 21 bp, Homo sapiens
aagacattgtttttaaaaaaa

SEQ ID NO: 4480389 - DNA, 11 bp, Homo sapiens
aagacatttct

SEQ ID NO: 4480390 - DNA, 17 bp, Homo sapiens
aagacattttgttttta

SEQ ID NO: 4480391 - DNA, 19 bp, Homo sapiens
aagacattttgtttttact

SEQ ID NO: 4480392 - DNA, 22 bp, Homo sapiens
aagacatttttcattcatgaat

SEQ ID NO: 4480393 - DNA, 21 bp, Homo sapiens
aagacattttttaaaagcctt

SEQ ID NO: 4480394 - DNA, 14 bp, Homo sapiens
aagaccaatttatg

SEQ ID NO: 4480395 - DNA, 19 bp, Homo sapiens
aagaccaatttatgggaga

SEQ ID NO: 4480396 - DNA, 14 bp, Homo sapiens
aagaccagaaattc

SEQ ID NO: 4480397 - DNA, 12 bp, Homo sapiens
aagaccagcctg

SEQ ID NO: 4480398 - DNA, 14 bp, Homo sapiens
aagacctgaatccc

SEQ ID NO: 4480399 - DNA, 17 bp, Homo sapiens
aagacgcaaggtgtgct

SEQ ID NO: 4480400 - DNA, 13 bp, Homo sapiens
aagacgccttcat

SEQ ID NO: 4480401 - DNA, 18 bp, Homo sapiens
aagacgtgaatgtctcag

SEQ ID NO: 4480402 - DNA, 22 bp, Homo sapiens
aagacgtgattttgctgtagaa

SEQ ID NO: 4480403 - DNA, 23 bp, Homo sapiens
aagacgtgattttgctgtagaag

SEQ ID NO: 4480404 - DNA, 15 bp, Homo sapiens
aagactacaataaaa

SEQ ID NO: 4480405 - DNA, 18 bp, Homo sapiens
aagactactggcctctgt

SEQ ID NO: 4480406 - DNA, 14 bp, Homo sapiens
aagactcaaatttt

SEQ ID NO: 4480407 - DNA, 23 bp, Homo sapiens
aagactcaagtgggaacgactgg

SEQ ID NO: 4480408 - DNA, 22 bp, Homo sapiens
aagactcccatgagggagatgc

SEQ ID NO: 4480409 - DNA, 22 bp, Homo sapiens
aagactggaagctaatttgcat

SEQ ID NO: 4480410 - DNA, 17 bp, Homo sapiens
aagactggttttctgcc

SEQ ID NO: 4480411 - DNA, 20 bp, Homo sapiens
aagactggttttctgccaat

SEQ ID NO: 4480412 - DNA, 24 bp, Homo sapiens
aagacttaaagggcccaatgaatt

SEQ ID NO: 4480413 - DNA, 14 bp, Homo sapiens
aagacttgtgctta

SEQ ID NO: 4480414 - DNA, 21 bp, Homo sapiens
aagacttttatgtgagatttc

SEQ ID NO: 4480415 - DNA, 20 bp, Homo sapiens
aagacttttggtagagaagg

SEQ ID NO: 4480416 - DNA, 21 bp, Homo sapiens
aagacttttggtagagaagga

SEQ ID NO: 4480417 - DNA, 15 bp, Homo sapiens
aagagaaaagacagg

SEQ ID NO: 4480418 - DNA, 20 bp, Homo sapiens
aagagaaaagacagggtggg

SEQ ID NO: 4480419 - DNA, 18 bp, Homo sapiens
aagagaaactttgtgcta

SEQ ID NO: 4480420 - DNA, 20 bp, Homo sapiens
aagagaaactttgtgctaca

SEQ ID NO: 4480421 - DNA, 19 bp, Homo sapiens
aagagaaaggactcagtgt

SEQ ID NO: 4480422 - DNA, 20 bp, Homo sapiens
aagagaagagggcccagccc

SEQ ID NO: 4480423 - DNA, 21 bp, Homo sapiens
aagagaagagggcccagccca

SEQ ID NO: 4480424 - DNA, 22 bp, Homo sapiens
aagagaagagggcccagcccag

SEQ ID NO: 4480425 - DNA, 16 bp, Homo sapiens
aagagaagatgcctgt

SEQ ID NO: 4480426 - DNA, 13 bp, Homo sapiens
aagagaagtagaa

SEQ ID NO: 4480427 - DNA, 20 bp, Homo sapiens
aagagaatgatgctcaaaat

SEQ ID NO: 4480428 - DNA, 11 bp, Homo sapiens
aactctgcata

SEQ ID NO: 4480429 - DNA, 21 bp, Homo sapiens
aactctggacactctatatgt

SEQ ID NO: 4480430 - DNA, 19 bp, Homo sapiens
aactctgttcccccaccct

SEQ ID NO: 4480431 - DNA, 21 bp, Homo sapiens
aactcttctttgctgcattcc

SEQ ID NO: 4480432 - DNA, 22 bp, Homo sapiens
aactcttggttcgatacctgga

SEQ ID NO: 4480433 - DNA, 13 bp, Homo sapiens
aactctttcaaaa

SEQ ID NO: 4480434 - DNA, 13 bp, Homo sapiens
aactctttcggta

SEQ ID NO: 4480435 - DNA, 15 bp, Homo sapiens
aactgaacattccag

SEQ ID NO: 4480436 - DNA, 19 bp, Homo sapiens
aactgaagcataaagaatt

SEQ ID NO: 4480437 - DNA, 12 bp, Homo sapiens
aactgaatgaga

SEQ ID NO: 4480438 - DNA, 13 bp, Homo sapiens
aactgaatttgga

SEQ ID NO: 4480439 - DNA, 18 bp, Homo sapiens
aactgagaaatgaatgct

SEQ ID NO: 4480440 - DNA, 20 bp, Homo sapiens
aactgagatgtgaacacatc

SEQ ID NO: 4480441 - DNA, 15 bp, Homo sapiens
aactgagccccagcg

SEQ ID NO: 4480442 - DNA, 18 bp, Homo sapiens
aactgaggaatttcacct

SEQ ID NO: 4480443 - DNA, 21 bp, Homo sapiens
aactgatccagtataagacta

SEQ ID NO: 4480444 - DNA, 23 bp, Homo sapiens
aactgatcttttcctgccagaag

SEQ ID NO: 4480445 - DNA, 17 bp, Homo sapiens
aactgattagtattcag

SEQ ID NO: 4480446 - DNA, 20 bp, Homo sapiens
aactgattagtattcaggca

SEQ ID NO: 4480447 - DNA, 19 bp, Homo sapiens
aactgattcttatgattac

SEQ ID NO: 4480448 - DNA, 17 bp, Homo sapiens
aactgatttaacacttt

SEQ ID NO: 4480449 - DNA, 15 bp, Homo sapiens
aactgatttctatgg

SEQ ID NO: 4480450 - DNA, 19 bp, Homo sapiens
aactgatttctatggcttt

SEQ ID NO: 4480451 - DNA, 17 bp, Homo sapiens
aactgcagacctgtcct

SEQ ID NO: 4480452 - DNA, 14 bp, Homo sapiens
aactgcagggaaaa

SEQ ID NO: 4480453 - DNA, 23 bp, Homo sapiens
aactgcagggaaaattatttgca

SEQ ID NO: 4480454 - DNA, 22 bp, Homo sapiens
aactgcatcccacgttctgtta

SEQ ID NO: 4480455 - DNA, 21 bp, Homo sapiens
aactgcattggttttccatga

SEQ ID NO: 4480456 - DNA, 17 bp, Homo sapiens
aactgccaaacctcctg

SEQ ID NO: 4480457 - DNA, 16 bp, Homo sapiens
aactgccaggctgcct

SEQ ID NO: 4480458 - DNA, 18 bp, Homo sapiens
aactgccaggctgcctcc

SEQ ID NO: 4480459 - DNA, 20 bp, Homo sapiens
aactgccaggctgcctcctg

SEQ ID NO: 4480460 - DNA, 24 bp, Homo sapiens
aactgccaggctgcctcctgccct

SEQ ID NO: 4480461 - DNA, 16 bp, Homo sapiens
aactgccgctggaggc

SEQ ID NO: 4480462 - DNA, 20 bp, Homo sapiens
aactgcctactccaaaatgt

SEQ ID NO: 4480463 - DNA, 18 bp, Homo sapiens
aactgctccagcctctgc

SEQ ID NO: 4480464 - DNA, 14 bp, Homo sapiens
aactgcttcttgga

SEQ ID NO: 4480465 - DNA, 17 bp, Homo sapiens
aactgcttcttggagct

SEQ ID NO: 4480466 - DNA, 17 bp, Homo sapiens
aactgctttattttccc

SEQ ID NO: 4480467 - DNA, 18 bp, Homo sapiens
aactgctttattttccct

SEQ ID NO: 4480468 - DNA, 13 bp, Homo sapiens
aactggaataata

SEQ ID NO: 4480469 - DNA, 15 bp, Homo sapiens
aactggaataatatt

SEQ ID NO: 4480470 - DNA, 21 bp, Homo sapiens
aactggacacaataggtcttt

SEQ ID NO: 4480471 - DNA, 19 bp, Homo sapiens
aactggactggttcaaatg

SEQ ID NO: 4480472 - DNA, 23 bp, Homo sapiens
aactggcaggggagacaggagcc

SEQ ID NO: 4480473 - DNA, 16 bp, Homo sapiens
aactggcatgtcattt

SEQ ID NO: 4480474 - DNA, 22 bp, Homo sapiens
aactggccctatttagatgata

SEQ ID NO: 4480475 - DNA, 13 bp, Homo sapiens
aactggctggcca

SEQ ID NO: 4480476 - DNA, 17 bp, Homo sapiens
aactggctggccagtct

SEQ ID NO: 4480477 - DNA, 15 bp, Homo sapiens
aactgggaaactggg

SEQ ID NO: 4480478 - DNA, 14 bp, Homo sapiens
aactgggataactg

SEQ ID NO: 4480479 - DNA, 13 bp, Homo sapiens
aactggtatttta

SEQ ID NO: 4480480 - DNA, 14 bp, Homo sapiens
aactggtcttcctt

SEQ ID NO: 4480481 - DNA, 15 bp, Homo sapiens
aactggtcttccttt

SEQ ID NO: 4480482 - DNA, 17 bp, Homo sapiens
aactggtcttccttttt

SEQ ID NO: 4480483 - DNA, 14 bp, Homo sapiens
aactggttcaggct

SEQ ID NO: 4480484 - DNA, 14 bp, Homo sapiens
aactggttcctaca

SEQ ID NO: 4480485 - DNA, 20 bp, Homo sapiens
aactgtaaaaaatgtgtgta

SEQ ID NO: 4480486 - DNA, 23 bp, Homo sapiens
aactgtaaaagtgtacagactct

SEQ ID NO: 4480487 - DNA, 12 bp, Homo sapiens
aactgtaaatca

SEQ ID NO: 4480488 - DNA, 11 bp, Homo sapiens
aactgtacatt

SEQ ID NO: 4480489 - DNA, 14 bp, Homo sapiens
aactgtacattgtg

SEQ ID NO: 4480490 - DNA, 16 bp, Homo sapiens
aactgtacattgtgag

SEQ ID NO: 4480491 - DNA, 14 bp, Homo sapiens
aactgtagaaatga

SEQ ID NO: 4480492 - DNA, 17 bp, Homo sapiens
aactgtagaaatgatga

SEQ ID NO: 4480493 - DNA, 10 bp, Homo sapiens
aactgtattt

SEQ ID NO: 4480494 - DNA, 17 bp, Homo sapiens
aactgtatttcagtatt

SEQ ID NO: 4480495 - DNA, 14 bp, Homo sapiens
aactgtattttgaa

SEQ ID NO: 4480496 - DNA, 21 bp, Homo sapiens
aactgtatttttgaagactat

SEQ ID NO: 4480497 - DNA, 21 bp, Homo sapiens
aactgtcattgtgtgtggaat

SEQ ID NO: 4480498 - DNA, 13 bp, Homo sapiens
aactgtcccagct

SEQ ID NO: 4480499 - DNA, 17 bp, Homo sapiens
aactgtcccagctacca

SEQ ID NO: 4480500 - DNA, 18 bp, Homo sapiens
aactgtccgtaagcagta

SEQ ID NO: 4480501 - DNA, 15 bp, Homo sapiens
aactgtcttcctcaa

SEQ ID NO: 4480502 - DNA, 13 bp, Homo sapiens
aactgtcttgttt

SEQ ID NO: 4480503 - DNA, 16 bp, Homo sapiens
aactgtcttgtttcag

SEQ ID NO: 4480504 - DNA, 18 bp, Homo sapiens
aactgtcttgtttcagtg

SEQ ID NO: 4480505 - DNA, 21 bp, Homo sapiens
aactgtgaatacttgaactct

SEQ ID NO: 4480506 - DNA, 16 bp, Homo sapiens
aactgtgcaacttttt

SEQ ID NO: 4480507 - DNA, 18 bp, Homo sapiens
aactgtgcaactttttaa

SEQ ID NO: 4480508 - DNA, 11 bp, Homo sapiens
aactgtggata

SEQ ID NO: 4480509 - DNA, 12 bp, Homo sapiens
aactgtgtattt

SEQ ID NO: 4480510 - DNA, 18 bp, Homo sapiens
aactgtgtatttatttaa

SEQ ID NO: 4480511 - DNA, 15 bp, Homo sapiens
aactgtgtgattaaa

SEQ ID NO: 4480512 - DNA, 12 bp, Homo sapiens
aactgtgtgtga

SEQ ID NO: 4480513 - DNA, 14 bp, Homo sapiens
aactgtgtgtgaat

SEQ ID NO: 4480514 - DNA, 13 bp, Homo sapiens
aactgtgtttcaa

SEQ ID NO: 4480515 - DNA, 18 bp, Homo sapiens
aactgtgtttcaaatgga

SEQ ID NO: 4480516 - DNA, 15 bp, Homo sapiens
aactgttaacttatt

SEQ ID NO: 4480517 - DNA, 20 bp, Homo sapiens
aactgttacaacttgtattt

SEQ ID NO: 4480518 - DNA, 23 bp, Homo sapiens
aactgttacaacttgtatttcca

SEQ ID NO: 4480519 - DNA, 15 bp, Homo sapiens
aactgttacagtaat

SEQ ID NO: 4480520 - DNA, 23 bp, Homo sapiens
aactgttcctcatgttgctgaat

SEQ ID NO: 4480521 - DNA, 19 bp, Homo sapiens
aactgttggaatggatttt

SEQ ID NO: 4480522 - DNA, 13 bp, Homo sapiens
aactgtttatatg

SEQ ID NO: 4480523 - DNA, 16 bp, Homo sapiens
aactgtttcaagccct

SEQ ID NO: 4480524 - DNA, 14 bp, Homo sapiens
aactgtttccttca

SEQ ID NO: 4480525 - DNA, 19 bp, Homo sapiens
aactgtttgacttctcaag

SEQ ID NO: 4480526 - DNA, 18 bp, Homo sapiens
aactgttttagaaattgg

SEQ ID NO: 4480527 - DNA, 20 bp, Homo sapiens
aactgttttagaaattggta

SEQ ID NO: 4480528 - DNA, 16 bp, Homo sapiens
aacttaaaaaactgca

SEQ ID NO: 4480529 - DNA, 15 bp, Homo sapiens
aacttaaatgttatt

SEQ ID NO: 4480530 - DNA, 21 bp, Homo sapiens
aacttaaatgttattatctgg

SEQ ID NO: 4480531 - DNA, 14 bp, Homo sapiens
aacttacttagtgt

SEQ ID NO: 4480532 - DNA, 22 bp, Homo sapiens
aacttagcttttgatgtctcca

SEQ ID NO: 4480533 - DNA, 23 bp, Homo sapiens
aacttatattaatagtaatttgt

SEQ ID NO: 4480534 - DNA, 20 bp, Homo sapiens
aacttatggactgttttgat

SEQ ID NO: 4480535 - DNA, 22 bp, Homo sapiens
aacttatggactgttttgatag

SEQ ID NO: 4480536 - DNA, 22 bp, Homo sapiens
aacttattcaaagagaaaacat

SEQ ID NO: 4480537 - DNA, 17 bp, Homo sapiens
aacttattgctgatttt

SEQ ID NO: 4480538 - DNA, 16 bp, Homo sapiens
aacttcaaatatagag

SEQ ID NO: 4480539 - DNA, 13 bp, Homo sapiens
aacttcagacata

SEQ ID NO: 4480540 - DNA, 15 bp, Homo sapiens
aacttcagcaaccct

SEQ ID NO: 4480541 - DNA, 15 bp, Homo sapiens
aacttcatggatcag

SEQ ID NO: 4480542 - DNA, 16 bp, Homo sapiens
aacttccaaagaaagt

SEQ ID NO: 4480543 - DNA, 15 bp, Homo sapiens
aacttccgctgaggg

SEQ ID NO: 4480544 - DNA, 19 bp, Homo sapiens
aacttcctgtgcctttcct

SEQ ID NO: 4480545 - DNA, 13 bp, Homo sapiens
aacttcctgtggc

SEQ ID NO: 4480546 - DNA, 15 bp, Homo sapiens
aacttcttatggaat

SEQ ID NO: 4480547 - DNA, 19 bp, Homo sapiens
aacttcttatggaattgat

SEQ ID NO: 4480548 - DNA, 13 bp, Homo sapiens
aacttcttgaaaa

SEQ ID NO: 4480549 - DNA, 12 bp, Homo sapiens
acaaagatttct

SEQ ID NO: 4480550 - DNA, 16 bp, Homo sapiens
acaaagcacaccatat

SEQ ID NO: 4480551 - DNA, 18 bp, Homo sapiens
acaaagccccccagctcc

SEQ ID NO: 4480552 - DNA, 20 bp, Homo sapiens
acaaagccccccagctccca

SEQ ID NO: 4480553 - DNA, 16 bp, Homo sapiens
acaaagctgctaaatc

SEQ ID NO: 4480554 - DNA, 15 bp, Homo sapiens
acaaagctttctttt

SEQ ID NO: 4480555 - DNA, 20 bp, Homo sapiens
acaaaggcatgttttaaaat

SEQ ID NO: 4480556 - DNA, 14 bp, Homo sapiens
acaaaggccacagg

SEQ ID NO: 4480557 - DNA, 22 bp, Homo sapiens
acaaaggctgacattcactgag

SEQ ID NO: 4480558 - DNA, 17 bp, Homo sapiens
acaaaggggcttaatta

SEQ ID NO: 4480559 - DNA, 12 bp, Homo sapiens
acaaagtgcttt

SEQ ID NO: 4480560 - DNA, 18 bp, Homo sapiens
acaaagttccacttccag

SEQ ID NO: 4480561 - DNA, 22 bp, Homo sapiens
acaaagtttcagagtatattgt

SEQ ID NO: 4480562 - DNA, 18 bp, Homo sapiens
acaaataaaatacttttt

SEQ ID NO: 4480563 - DNA, 13 bp, Homo sapiens
acaaataaatatg

SEQ ID NO: 4480564 - DNA, 14 bp, Homo sapiens
acaaataaatgatt

SEQ ID NO: 4480565 - DNA, 15 bp, Homo sapiens
acaaataaatgatta

SEQ ID NO: 4480566 - DNA, 19 bp, Homo sapiens
acaaataagtaatatcttt

SEQ ID NO: 4480567 - DNA, 14 bp, Homo sapiens
acaaataatttaga

SEQ ID NO: 4480568 - DNA, 20 bp, Homo sapiens
acaaatacaaagtggaaact

SEQ ID NO: 4480569 - DNA, 20 bp, Homo sapiens
acaaataggatgtactgttg

SEQ ID NO: 4480570 - DNA, 15 bp, Homo sapiens
acaaatattatttgt

SEQ ID NO: 4480571 - DNA, 15 bp, Homo sapiens
acaaatattctgaat

SEQ ID NO: 4480572 - DNA, 15 bp, Homo sapiens
acaaatatttcactt

SEQ ID NO: 4480573 - DNA, 14 bp, Homo sapiens
acaaatcagaagtc

SEQ ID NO: 4480574 - DNA, 15 bp, Homo sapiens
acaaatcagaagtca

SEQ ID NO: 4480575 - DNA, 16 bp, Homo sapiens
acaaatcagaagtcat

SEQ ID NO: 4480576 - DNA, 12 bp, Homo sapiens
acaaatcagtaa

SEQ ID NO: 4480577 - DNA, 13 bp, Homo sapiens
acaaatcagtaat

SEQ ID NO: 4480578 - DNA, 17 bp, Homo sapiens
acaaatgacagatcttt

SEQ ID NO: 4480579 - DNA, 22 bp, Homo sapiens
acaaatgcaaatttctataaat

SEQ ID NO: 4480580 - DNA, 19 bp, Homo sapiens
acaaatttggccttaagaa

SEQ ID NO: 4480581 - DNA, 23 bp, Homo sapiens
acaaattttttaatttccaaaat

SEQ ID NO: 4480582 - DNA, 13 bp, Homo sapiens
acaacaagaaact

SEQ ID NO: 4480583 - DNA, 18 bp, Homo sapiens
acaacaattggtaaaact

SEQ ID NO: 4480584 - DNA, 16 bp, Homo sapiens
acaacacttaatagca

SEQ ID NO: 4480585 - DNA, 17 bp, Homo sapiens
acaacagagacagtgaa

SEQ ID NO: 4480586 - DNA, 18 bp, Homo sapiens
acaacagctcgatccaaa

SEQ ID NO: 4480587 - DNA, 20 bp, Homo sapiens
acaacagctcgatccaaatt

SEQ ID NO: 4480588 - DNA, 16 bp, Homo sapiens
acaacaggtaaaacag

SEQ ID NO: 4480589 - DNA, 18 bp, Homo sapiens
acaacagtcttcattttt

SEQ ID NO: 4480590 - DNA, 22 bp, Homo sapiens
acaacatagcagatctgttttg

SEQ ID NO: 4480591 - DNA, 22 bp, Homo sapiens
acaacatgcatgttctcctcta

SEQ ID NO: 4480592 - DNA, 15 bp, Homo sapiens
acaacatggtgctac

SEQ ID NO: 4480593 - DNA, 17 bp, Homo sapiens
acaacatttacaactca

SEQ ID NO: 4480594 - DNA, 17 bp, Homo sapiens
acaacatttatatgtag

SEQ ID NO: 4480595 - DNA, 14 bp, Homo sapiens
acaacatttctata

SEQ ID NO: 4480596 - DNA, 20 bp, Homo sapiens
acaacatttctatagccaaa

SEQ ID NO: 4480597 - DNA, 18 bp, Homo sapiens
acaaccactgggatcagc

SEQ ID NO: 4480598 - DNA, 16 bp, Homo sapiens
acaaccatatttagca

SEQ ID NO: 4480599 - DNA, 22 bp, Homo sapiens
acaaccatgtcatttcagaagt

SEQ ID NO: 4480600 - DNA, 11 bp, Homo sapiens
acaaccctgac

SEQ ID NO: 4480601 - DNA, 23 bp, Homo sapiens
acaaccttcatttaaaaaggttt

SEQ ID NO: 4480602 - DNA, 13 bp, Homo sapiens
acaactaaataac

SEQ ID NO: 4480603 - DNA, 18 bp, Homo sapiens
acaactatttactttttt

SEQ ID NO: 4480604 - DNA, 19 bp, Homo sapiens
acaacttcccattaaaaat

SEQ ID NO: 4480605 - DNA, 14 bp, Homo sapiens
acaacttgtagcag

SEQ ID NO: 4480606 - DNA, 16 bp, Homo sapiens
acaactttcatttaac

SEQ ID NO: 4480607 - DNA, 14 bp, Homo sapiens
acaactttttaaat

SEQ ID NO: 4480608 - DNA, 21 bp, Homo sapiens
acaagaaactgtccaaatgct

SEQ ID NO: 4480609 - DNA, 14 bp, Homo sapiens
acaagaacattctc

SEQ ID NO: 4480610 - DNA, 19 bp, Homo sapiens
acaagaagaatttgaagac

SEQ ID NO: 4480611 - DNA, 15 bp, Homo sapiens
acaagaagcattttg

SEQ ID NO: 4480612 - DNA, 17 bp, Homo sapiens
acaagaaggtttctgtc

SEQ ID NO: 4480613 - DNA, 20 bp, Homo sapiens
acaagacccaaaaggcagaa

SEQ ID NO: 4480614 - DNA, 14 bp, Homo sapiens
acaagagaaaaagc

SEQ ID NO: 4480615 - DNA, 18 bp, Homo sapiens
acaagagatctacacatg

SEQ ID NO: 4480616 - DNA, 16 bp, Homo sapiens
acaagagcagcctgtg

SEQ ID NO: 4480617 - DNA, 20 bp, Homo sapiens
acaagagcagcctgtggcat

SEQ ID NO: 4480618 - DNA, 16 bp, Homo sapiens
acaagagcgaaactcc

SEQ ID NO: 4480619 - DNA, 19 bp, Homo sapiens
acaagagggcaagcctcta

SEQ ID NO: 4480620 - DNA, 23 bp, Homo sapiens
acaagatgcactcgctgtgattt

SEQ ID NO: 4480621 - DNA, 15 bp, Homo sapiens
acaagatgggacagc

SEQ ID NO: 4480622 - DNA, 16 bp, Homo sapiens
acaagatgggacagca

SEQ ID NO: 4480623 - DNA, 20 bp, Homo sapiens
acaagatgggacagcaacaa

SEQ ID NO: 4480624 - DNA, 18 bp, Homo sapiens
acaagattcccagagaca

SEQ ID NO: 4480625 - DNA, 20 bp, Homo sapiens
acaagcatgcataaatcaat

SEQ ID NO: 4480626 - DNA, 18 bp, Homo sapiens
acaagccaaaagtccctc

SEQ ID NO: 4480627 - DNA, 21 bp, Homo sapiens
acaagccaaaagtccctccct

SEQ ID NO: 4480628 - DNA, 21 bp, Homo sapiens
acaagcctcctgtacctcagt

SEQ ID NO: 4480629 - DNA, 17 bp, Homo sapiens
acaagcctgagaactga

SEQ ID NO: 4480630 - DNA, 18 bp, Homo sapiens
acaagccttactcacctc

SEQ ID NO: 4480631 - DNA, 24 bp, Homo sapiens
acaagccttactcacctctctcta

SEQ ID NO: 4480632 - DNA, 19 bp, Homo sapiens
acaagctcatccctggact

SEQ ID NO: 4480633 - DNA, 16 bp, Homo sapiens
acaagctgcactgtga

SEQ ID NO: 4480634 - DNA, 17 bp, Homo sapiens
acaagctgcactgtgaa

SEQ ID NO: 4480635 - DNA, 18 bp, Homo sapiens
acaagctgcactgtgaac

SEQ ID NO: 4480636 - DNA, 13 bp, Homo sapiens
acaaggaataaat

SEQ ID NO: 4480637 - DNA, 23 bp, Homo sapiens
acaaggcattcagcagtttctga

SEQ ID NO: 4480638 - DNA, 22 bp, Homo sapiens
acaagggtccgtggaccaggag

SEQ ID NO: 4480639 - DNA, 22 bp, Homo sapiens
acaaggtaggctgcaaaattaa

SEQ ID NO: 4480640 - DNA, 21 bp, Homo sapiens
acaaggtggggattgcccctg

SEQ ID NO: 4480641 - DNA, 13 bp, Homo sapiens
acaagtaatgtaa

SEQ ID NO: 4480642 - DNA, 11 bp, Homo sapiens
acaagtactgg

SEQ ID NO: 4480643 - DNA, 17 bp, Homo sapiens
acaagtgccgcaaattg

SEQ ID NO: 4480644 - DNA, 20 bp, Homo sapiens
acaagtgccgcaaattgtac

SEQ ID NO: 4480645 - DNA, 20 bp, Homo sapiens
acaagttccattatgaaaat

SEQ ID NO: 4480646 - DNA, 13 bp, Homo sapiens
acaagttccctgg

SEQ ID NO: 4480647 - DNA, 16 bp, Homo sapiens
acaagttccctggaga

SEQ ID NO: 4480648 - DNA, 14 bp, Homo sapiens
acaagttctatttc

SEQ ID NO: 4480649 - DNA, 14 bp, Homo sapiens
acaagttttagtta

SEQ ID NO: 4480650 - DNA, 23 bp, Homo sapiens
acaagttttagttaaaactcatc

SEQ ID NO: 4480651 - DNA, 14 bp, Homo sapiens
acaataaagtttat

SEQ ID NO: 4480652 - DNA, 15 bp, Homo sapiens
acaataaagtttatt

SEQ ID NO: 4480653 - DNA, 17 bp, Homo sapiens
acaataaagtttattat

SEQ ID NO: 4480654 - DNA, 15 bp, Homo sapiens
acaataatatttcaa

SEQ ID NO: 4480655 - DNA, 22 bp, Homo sapiens
acaataattctacatgttgtct

SEQ ID NO: 4480656 - DNA, 18 bp, Homo sapiens
acaatacaatgtacaatt

SEQ ID NO: 4480657 - DNA, 16 bp, Homo sapiens
acaatacatgagaaag

SEQ ID NO: 4480658 - DNA, 19 bp, Homo sapiens
acaatagccgatatcagaa

SEQ ID NO: 4480659 - DNA, 19 bp, Homo sapiens
acaataggtctttctctca

SEQ ID NO: 4480660 - DNA, 20 bp, Homo sapiens
acaataggtctttctctcag

SEQ ID NO: 4480661 - DNA, 16 bp, Homo sapiens
acaatagtatacattt

SEQ ID NO: 4480662 - DNA, 17 bp, Homo sapiens
acaatagtatacatttt

SEQ ID NO: 4480663 - DNA, 13 bp, Homo sapiens
acaatagtatttc

SEQ ID NO: 4480664 - DNA, 15 bp, Homo sapiens
acaatagtatttctc

SEQ ID NO: 4480665 - DNA, 17 bp, Homo sapiens
acaatagtatttctcct

SEQ ID NO: 4480666 - DNA, 14 bp, Homo sapiens
acaatatgtgccaa

SEQ ID NO: 4480667 - DNA, 20 bp, Homo sapiens
acaatatgtgccaatcaata

SEQ ID NO: 4480668 - DNA, 19 bp, Homo sapiens
acaatattactttgtcttt

SEQ ID NO: 4480669 - DNA, 22 bp, Homo sapiens
acaatattactttgtcttttca

SEQ ID NO: 4480670 - DNA, 17 bp, Homo sapiens
aatttgattattaacat

SEQ ID NO: 4480671 - DNA, 17 bp, Homo sapiens
aatttgattgatttgaa

SEQ ID NO: 4480672 - DNA, 14 bp, Homo sapiens
aatttgcaaagtac

SEQ ID NO: 4480673 - DNA, 19 bp, Homo sapiens
aatttgcaaagtactgtaa

SEQ ID NO: 4480674 - DNA, 15 bp, Homo sapiens
aatttgcacaatatt

SEQ ID NO: 4480675 - DNA, 23 bp, Homo sapiens
aatttgcattaaattcacaaact

SEQ ID NO: 4480676 - DNA, 14 bp, Homo sapiens
aatttgctgccaaa

SEQ ID NO: 4480677 - DNA, 20 bp, Homo sapiens
aatttgctgccaaatgcgta

SEQ ID NO: 4480678 - DNA, 20 bp, Homo sapiens
aatttggagcacaaaattca

SEQ ID NO: 4480679 - DNA, 12 bp, Homo sapiens
aatttggattta

SEQ ID NO: 4480680 - DNA, 20 bp, Homo sapiens
aatttggccttaagaactgt

SEQ ID NO: 4480681 - DNA, 21 bp, Homo sapiens
aatttggtaaaaatgctgctc

SEQ ID NO: 4480682 - DNA, 13 bp, Homo sapiens
aatttggtacaca

SEQ ID NO: 4480683 - DNA, 18 bp, Homo sapiens
aatttggtagatgacaaa

SEQ ID NO: 4480684 - DNA, 22 bp, Homo sapiens
aatttgtaaagttggttggata

SEQ ID NO: 4480685 - DNA, 14 bp, Homo sapiens
aatttgtaaatatt

SEQ ID NO: 4480686 - DNA, 23 bp, Homo sapiens
aatttgtaagcaacttgcttcta

SEQ ID NO: 4480687 - DNA, 22 bp, Homo sapiens
aatttgtaataaaactatttgt

SEQ ID NO: 4480688 - DNA, 22 bp, Homo sapiens
aatttgtaatgattttggaact

SEQ ID NO: 4480689 - DNA, 13 bp, Homo sapiens
aatttgtagaatt

SEQ ID NO: 4480690 - DNA, 16 bp, Homo sapiens
aatttgtgtaataaag

SEQ ID NO: 4480691 - DNA, 17 bp, Homo sapiens
aatttgtgtaataaagt

SEQ ID NO: 4480692 - DNA, 22 bp, Homo sapiens
aatttgtgtaataaagtgtttt

SEQ ID NO: 4480693 - DNA, 14 bp, Homo sapiens
aatttgtgtgtttt

SEQ ID NO: 4480694 - DNA, 21 bp, Homo sapiens
aatttgtttaatctacattat

SEQ ID NO: 4480695 - DNA, 15 bp, Homo sapiens
aatttgtttcatcta

SEQ ID NO: 4480696 - DNA, 17 bp, Homo sapiens
aatttgtttcatctatt

SEQ ID NO: 4480697 - DNA, 17 bp, Homo sapiens
aatttgttttagccatt

SEQ ID NO: 4480698 - DNA, 14 bp, Homo sapiens
aatttgttttcaac

SEQ ID NO: 4480699 - DNA, 16 bp, Homo sapiens
aatttgtttttgcatt

SEQ ID NO: 4480700 - DNA, 13 bp, Homo sapiens
aattttaaagtat

SEQ ID NO: 4480701 - DNA, 14 bp, Homo sapiens
aattttaaagtatg

SEQ ID NO: 4480702 - DNA, 12 bp, Homo sapiens
aattttaaagtt

SEQ ID NO: 4480703 - DNA, 15 bp, Homo sapiens
aattttaaagttctt

SEQ ID NO: 4480704 - DNA, 11 bp, Homo sapiens
aattttaactg

SEQ ID NO: 4480705 - DNA, 13 bp, Homo sapiens
aattttaactgta

SEQ ID NO: 4480706 - DNA, 21 bp, Homo sapiens
aattttacactctgtattgaa

SEQ ID NO: 4480707 - DNA, 20 bp, Homo sapiens
aattttacatgtttataaat

SEQ ID NO: 4480708 - DNA, 14 bp, Homo sapiens
aattttactgtgaa

SEQ ID NO: 4480709 - DNA, 19 bp, Homo sapiens
aattttagtagagacaggg

SEQ ID NO: 4480710 - DNA, 16 bp, Homo sapiens
aattttagtttttcat

SEQ ID NO: 4480711 - DNA, 18 bp, Homo sapiens
aattttagtttttcatta

SEQ ID NO: 4480712 - DNA, 16 bp, Homo sapiens
aattttatatgtaaat

SEQ ID NO: 4480713 - DNA, 17 bp, Homo sapiens
aattttattttaaattt

SEQ ID NO: 4480714 - DNA, 19 bp, Homo sapiens
aattttcaagtaattgtga

SEQ ID NO: 4480715 - DNA, 16 bp, Homo sapiens
aattttctaaaagctt

SEQ ID NO: 4480716 - DNA, 16 bp, Homo sapiens
aattttctgtaatctt

SEQ ID NO: 4480717 - DNA, 22 bp, Homo sapiens
aattttgcatattctctatttt

SEQ ID NO: 4480718 - DNA, 16 bp, Homo sapiens
aattttgtatgccaat

SEQ ID NO: 4480719 - DNA, 15 bp, Homo sapiens
aatttttaaacaagt

SEQ ID NO: 4480720 - DNA, 15 bp, Homo sapiens
aatttttatttcttt

SEQ ID NO: 4480721 - DNA, 12 bp, Homo sapiens
aatttttcatag

SEQ ID NO: 4480722 - DNA, 14 bp, Homo sapiens
aatttttccaacta

SEQ ID NO: 4480723 - DNA, 18 bp, Homo sapiens
aatttttgcttttagaaa

SEQ ID NO: 4480724 - DNA, 17 bp, Homo sapiens
aattttttaaaagagac

SEQ ID NO: 4480725 - DNA, 17 bp, Homo sapiens
aattttttataaaagtg

SEQ ID NO: 4480726 - DNA, 20 bp, Homo sapiens
aattttttatcatgcatgtc

SEQ ID NO: 4480727 - DNA, 20 bp, Homo sapiens
aattttttgacctattttag

SEQ ID NO: 4480728 - DNA, 16 bp, Homo sapiens
aattttttggtacaaa

SEQ ID NO: 4480729 - DNA, 20 bp, Homo sapiens
aatttttttcacctagattt

SEQ ID NO: 4480730 - DNA, 16 bp, Homo sapiens
aatttttttgtaataa

SEQ ID NO: 4480731 - DNA, 18 bp, Homo sapiens
aatttttttgtattttag

SEQ ID NO: 4480732 - DNA, 19 bp, Homo sapiens
aattttttttaaaatagaa

SEQ ID NO: 4480733 - DNA, 20 bp, Homo sapiens
aattttttttaaaatagaaa

SEQ ID NO: 4480734 - DNA, 19 bp, Homo sapiens
aatttttttttaaatttta

SEQ ID NO: 4480735 - DNA, 21 bp, Homo sapiens
acaaaaaaatacctcaggaaa

SEQ ID NO: 4480736 - DNA, 13 bp, Homo sapiens
acaaaaaaggttt

SEQ ID NO: 4480737 - DNA, 13 bp, Homo sapiens
acaaaaaatacat

SEQ ID NO: 4480738 - DNA, 15 bp, Homo sapiens
acaaaaacacagcaa

SEQ ID NO: 4480739 - DNA, 16 bp, Homo sapiens
acaaaaaggcaaatat

SEQ ID NO: 4480740 - DNA, 20 bp, Homo sapiens
acaaaaaggcaaatattgaa

SEQ ID NO: 4480741 - DNA, 15 bp, Homo sapiens
acaaaaagtgcttca

SEQ ID NO: 4480742 - DNA, 10 bp, Homo sapiens
acaaaaataa

SEQ ID NO: 4480743 - DNA, 14 bp, Homo sapiens
acaaaaataaattt

SEQ ID NO: 4480744 - DNA, 13 bp, Homo sapiens
acaaaaatttatt

SEQ ID NO: 4480745 - DNA, 18 bp, Homo sapiens
acaaaacaaaacaaaact

SEQ ID NO: 4480746 - DNA, 20 bp, Homo sapiens
acaaaactacttttctaaaa

SEQ ID NO: 4480747 - DNA, 21 bp, Homo sapiens
acaaaagagcatggatgcatt

SEQ ID NO: 4480748 - DNA, 21 bp, Homo sapiens
acaaaaggaatgtgtaagtct

SEQ ID NO: 4480749 - DNA, 13 bp, Homo sapiens
acaaaagggtgta

SEQ ID NO: 4480750 - DNA, 19 bp, Homo sapiens
acaaaagggtgtatagtgt

SEQ ID NO: 4480751 - DNA, 14 bp, Homo sapiens
acaaaagtacattg

SEQ ID NO: 4480752 - DNA, 19 bp, Homo sapiens
acaaaagtacattgcttaa

SEQ ID NO: 4480753 - DNA, 22 bp, Homo sapiens
acaaaataaccaatcctggaca

SEQ ID NO: 4480754 - DNA, 16 bp, Homo sapiens
acaaaatacacattct

SEQ ID NO: 4480755 - DNA, 12 bp, Homo sapiens
acaaaatataca

SEQ ID NO: 4480756 - DNA, 12 bp, Homo sapiens
acaaaatattta

SEQ ID NO: 4480757 - DNA, 13 bp, Homo sapiens
acaaaatatttaa

SEQ ID NO: 4480758 - DNA, 14 bp, Homo sapiens
acaaaatatttaag

SEQ ID NO: 4480759 - DNA, 20 bp, Homo sapiens
acaaaatcaggtaactaact

SEQ ID NO: 4480760 - DNA, 20 bp, Homo sapiens
acaaaatggggcagaagaga

SEQ ID NO: 4480761 - DNA, 22 bp, Homo sapiens
acaaaatgtagaatattcagac

SEQ ID NO: 4480762 - DNA, 16 bp, Homo sapiens
acaaaatgtatgtctg

SEQ ID NO: 4480763 - DNA, 18 bp, Homo sapiens
acaaaattagaaaggaca

SEQ ID NO: 4480764 - DNA, 19 bp, Homo sapiens
acaaaattagaaaggacaa

SEQ ID NO: 4480765 - DNA, 16 bp, Homo sapiens
acaaaattatttgtaa

SEQ ID NO: 4480766 - DNA, 13 bp, Homo sapiens
acaaaattcaaag

SEQ ID NO: 4480767 - DNA, 18 bp, Homo sapiens
acaaaattcaaagcatgg

SEQ ID NO: 4480768 - DNA, 15 bp, Homo sapiens
acaaaatttcacagt

SEQ ID NO: 4480769 - DNA, 18 bp, Homo sapiens
acaaaatttcacagttct

SEQ ID NO: 4480770 - DNA, 19 bp, Homo sapiens
acaaaatttcacagttctg

SEQ ID NO: 4480771 - DNA, 13 bp, Homo sapiens
acaaacaatgaaa

SEQ ID NO: 4480772 - DNA, 14 bp, Homo sapiens
acaaacagtatttc

SEQ ID NO: 4480773 - DNA, 11 bp, Homo sapiens
acaaacatgaa

SEQ ID NO: 4480774 - DNA, 14 bp, Homo sapiens
acaaacatgaaaaa

SEQ ID NO: 4480775 - DNA, 17 bp, Homo sapiens
acaaaccaccaggactg

SEQ ID NO: 4480776 - DNA, 14 bp, Homo sapiens
acaaacgtttgaca

SEQ ID NO: 4480777 - DNA, 20 bp, Homo sapiens
acaaactcgttttttacaaa

SEQ ID NO: 4480778 - DNA, 18 bp, Homo sapiens
acaaactgtaaaaaatgt

SEQ ID NO: 4480779 - DNA, 13 bp, Homo sapiens
acaaactgtaaat

SEQ ID NO: 4480780 - DNA, 12 bp, Homo sapiens
acaaactgtgaa

SEQ ID NO: 4480781 - DNA, 19 bp, Homo sapiens
acaaactgtgaaaatagtg

SEQ ID NO: 4480782 - DNA, 13 bp, Homo sapiens
acaaactttgttt

SEQ ID NO: 4480783 - DNA, 15 bp, Homo sapiens
acaaactttgttttt

SEQ ID NO: 4480784 - DNA, 15 bp, Homo sapiens
acaaacttttaagat

SEQ ID NO: 4480785 - DNA, 15 bp, Homo sapiens
acaaagaaaaattaa

SEQ ID NO: 4480786 - DNA, 22 bp, Homo sapiens
acaaagaaaaattaattaggaa

SEQ ID NO: 4480787 - DNA, 12 bp, Homo sapiens
acaaagaaaatt

SEQ ID NO: 4480788 - DNA, 20 bp, Homo sapiens
acaaagaaacaaagatgtta

SEQ ID NO: 4480789 - DNA, 22 bp, Homo sapiens
acaaagaaatccccccttcaga

SEQ ID NO: 4480790 - DNA, 19 bp, Homo sapiens
acaaagacatgctttccat

SEQ ID NO: 4480791 - DNA, 17 bp, Homo sapiens
acaaagacttgctttaa

SEQ ID NO: 4480792 - DNA, 15 bp, Homo sapiens
aattggtgtcatttt

SEQ ID NO: 4480793 - DNA, 21 bp, Homo sapiens
aattggtgtcattttcttgat

SEQ ID NO: 4480794 - DNA, 13 bp, Homo sapiens
aattgtaaactgt

SEQ ID NO: 4480795 - DNA, 20 bp, Homo sapiens
aattgtaattccaaaatcca

SEQ ID NO: 4480796 - DNA, 15 bp, Homo sapiens
aattgtacattttgt

SEQ ID NO: 4480797 - DNA, 19 bp, Homo sapiens
aattgtataccaatgtgtt

SEQ ID NO: 4480798 - DNA, 21 bp, Homo sapiens
aattgtataccaatgtgtttt

SEQ ID NO: 4480799 - DNA, 13 bp, Homo sapiens
aattgtccccagt

SEQ ID NO: 4480800 - DNA, 17 bp, Homo sapiens
aattgtctaaaatgtca

SEQ ID NO: 4480801 - DNA, 18 bp, Homo sapiens
aattgtctaaaatgtcag

SEQ ID NO: 4480802 - DNA, 20 bp, Homo sapiens
aattgtctcaacgcctcccc

SEQ ID NO: 4480803 - DNA, 14 bp, Homo sapiens
aattgtctttcctt

SEQ ID NO: 4480804 - DNA, 11 bp, Homo sapiens
aattgtgatgt

SEQ ID NO: 4480805 - DNA, 14 bp, Homo sapiens
aattgtgatgtgtc

SEQ ID NO: 4480806 - DNA, 20 bp, Homo sapiens
aattgtgcttctccccagaa

SEQ ID NO: 4480807 - DNA, 22 bp, Homo sapiens
aattgtgctttcaccagaattt

SEQ ID NO: 4480808 - DNA, 22 bp, Homo sapiens
aattgtgtcttaatctctccat

SEQ ID NO: 4480809 - DNA, 15 bp, Homo sapiens
aattgtgtggattct

SEQ ID NO: 4480810 - DNA, 21 bp, Homo sapiens
aatttaaaagtaaaatgtctt

SEQ ID NO: 4480811 - DNA, 11 bp, Homo sapiens
aatttaaatgt

SEQ ID NO: 4480812 - DNA, 13 bp, Homo sapiens
aatttaaatgtta

SEQ ID NO: 4480813 - DNA, 19 bp, Homo sapiens
aatttaacaccctttagaa

SEQ ID NO: 4480814 - DNA, 23 bp, Homo sapiens
aatttaactacccttaattactt

SEQ ID NO: 4480815 - DNA, 16 bp, Homo sapiens
aatttaagaatttgtt

SEQ ID NO: 4480816 - DNA, 15 bp, Homo sapiens
aatttaagcttaagc

SEQ ID NO: 4480817 - DNA, 17 bp, Homo sapiens
aatttaataaaaaggaa

SEQ ID NO: 4480818 - DNA, 19 bp, Homo sapiens
aatttaataaaaaggaata

SEQ ID NO: 4480819 - DNA, 15 bp, Homo sapiens
aatttaatacttttc

SEQ ID NO: 4480820 - DNA, 18 bp, Homo sapiens
aatttaatccttctttgt

SEQ ID NO: 4480821 - DNA, 20 bp, Homo sapiens
aatttaatccttctttgtaa

SEQ ID NO: 4480822 - DNA, 21 bp, Homo sapiens
aatttaatccttctttgtaat

SEQ ID NO: 4480823 - DNA, 18 bp, Homo sapiens
aatttaatgtaaataaaa

SEQ ID NO: 4480824 - DNA, 13 bp, Homo sapiens
aatttaattgctt

SEQ ID NO: 4480825 - DNA, 14 bp, Homo sapiens
aatttaattgcttt

SEQ ID NO: 4480826 - DNA, 16 bp, Homo sapiens
aatttaattgctttga

SEQ ID NO: 4480827 - DNA, 17 bp, Homo sapiens
aatttaattgctttgaa

SEQ ID NO: 4480828 - DNA, 15 bp, Homo sapiens
aatttacaaaattta

SEQ ID NO: 4480829 - DNA, 16 bp, Homo sapiens
aatttacaaaatttat

SEQ ID NO: 4480830 - DNA, 23 bp, Homo sapiens
aatttacaagatattattaattt

SEQ ID NO: 4480831 - DNA, 15 bp, Homo sapiens
aatttacacatctta

SEQ ID NO: 4480832 - DNA, 17 bp, Homo sapiens
aatttacacatcttaaa

SEQ ID NO: 4480833 - DNA, 13 bp, Homo sapiens
aatttacctaaga

SEQ ID NO: 4480834 - DNA, 19 bp, Homo sapiens
aatttacttaagtgttcat

SEQ ID NO: 4480835 - DNA, 14 bp, Homo sapiens
aatttactttgtag

SEQ ID NO: 4480836 - DNA, 16 bp, Homo sapiens
aatttagaaaaagaac

SEQ ID NO: 4480837 - DNA, 21 bp, Homo sapiens
aatttagaaactaattgactt

SEQ ID NO: 4480838 - DNA, 15 bp, Homo sapiens
aatttagaaatcatt

SEQ ID NO: 4480839 - DNA, 20 bp, Homo sapiens
aatttagaaatcattttgca

SEQ ID NO: 4480840 - DNA, 21 bp, Homo sapiens
aatttagaaatcattttgcaa

SEQ ID NO: 4480841 - DNA, 21 bp, Homo sapiens
aatttagagataggaaactga

SEQ ID NO: 4480842 - DNA, 16 bp, Homo sapiens
aatttagatcttatat

SEQ ID NO: 4480843 - DNA, 15 bp, Homo sapiens
aatttagtaaatgtt

SEQ ID NO: 4480844 - DNA, 16 bp, Homo sapiens
aatttagtaaatgtta

SEQ ID NO: 4480845 - DNA, 21 bp, Homo sapiens
aatttagtttcatataaagta

SEQ ID NO: 4480846 - DNA, 16 bp, Homo sapiens
aatttagtttgttaaa

SEQ ID NO: 4480847 - DNA, 18 bp, Homo sapiens
aatttagtttgttaaagc

SEQ ID NO: 4480848 - DNA, 21 bp, Homo sapiens
aatttataatataaatatatg

SEQ ID NO: 4480849 - DNA, 15 bp, Homo sapiens
aatttataatgtatt

SEQ ID NO: 4480850 - DNA, 16 bp, Homo sapiens
aatttataatgtattt

SEQ ID NO: 4480851 - DNA, 17 bp, Homo sapiens
aatttatacttaaaaaa

SEQ ID NO: 4480852 - DNA, 15 bp, Homo sapiens
aatttatagtaatga

SEQ ID NO: 4480853 - DNA, 19 bp, Homo sapiens
aatttatctttaccaaaaa

SEQ ID NO: 4480854 - DNA, 21 bp, Homo sapiens
aatttatgaattgaattatct

SEQ ID NO: 4480855 - DNA, 19 bp, Homo sapiens
aatttattatatatttaca

SEQ ID NO: 4480856 - DNA, 21 bp, Homo sapiens
aatttattatatatttacaga

SEQ ID NO: 4480857 - DNA, 19 bp, Homo sapiens
aatttattctacttttaaa

SEQ ID NO: 4480858 - DNA, 14 bp, Homo sapiens
aatttattggggtg

SEQ ID NO: 4480859 - DNA, 23 bp, Homo sapiens
aatttatttcaataaatctttca

SEQ ID NO: 4480860 - DNA, 14 bp, Homo sapiens
aatttatttccact

SEQ ID NO: 4480861 - DNA, 21 bp, Homo sapiens
aatttatttccactaaaaata

SEQ ID NO: 4480862 - DNA, 12 bp, Homo sapiens
aatttcaaaatg

SEQ ID NO: 4480863 - DNA, 16 bp, Homo sapiens
aatttcaaaatgcttt

SEQ ID NO: 4480864 - DNA, 16 bp, Homo sapiens
aatttcaaacttttga

SEQ ID NO: 4480865 - DNA, 19 bp, Homo sapiens
aatttcaaacttttgaaag

SEQ ID NO: 4480866 - DNA, 22 bp, Homo sapiens
aatttcaaacttttgaaagatg

SEQ ID NO: 4480867 - DNA, 14 bp, Homo sapiens
aatttcaaatctgt

SEQ ID NO: 4480868 - DNA, 17 bp, Homo sapiens
aatttcaaatctgtaat

SEQ ID NO: 4480869 - DNA, 19 bp, Homo sapiens
aatttcacctgtaaacctg

SEQ ID NO: 4480870 - DNA, 20 bp, Homo sapiens
aatttcacctgtaaacctga

SEQ ID NO: 4480871 - DNA, 12 bp, Homo sapiens
aatttcaggaaa

SEQ ID NO: 4480872 - DNA, 18 bp, Homo sapiens
aatttcataattctgaaa

SEQ ID NO: 4480873 - DNA, 18 bp, Homo sapiens
aatttcatagctgtactt

SEQ ID NO: 4480874 - DNA, 20 bp, Homo sapiens
aatttcatagctgtacttct

SEQ ID NO: 4480875 - DNA, 18 bp, Homo sapiens
aatttcatttaaatatct

SEQ ID NO: 4480876 - DNA, 15 bp, Homo sapiens
aatttcatttccagc

SEQ ID NO: 4480877 - DNA, 22 bp, Homo sapiens
aatttccaaaataatctatatt

SEQ ID NO: 4480878 - DNA, 21 bp, Homo sapiens
aatttccacaaaatctgtcca

SEQ ID NO: 4480879 - DNA, 11 bp, Homo sapiens
aatttcctggc

SEQ ID NO: 4480880 - DNA, 13 bp, Homo sapiens
aatttcctgtaat

SEQ ID NO: 4480881 - DNA, 19 bp, Homo sapiens
aatttcctgtaatatattt

SEQ ID NO: 4480882 - DNA, 17 bp, Homo sapiens
aatttcctttttgacac

SEQ ID NO: 4480883 - DNA, 18 bp, Homo sapiens
aatttcctttttgacact

SEQ ID NO: 4480884 - DNA, 19 bp, Homo sapiens
aatttcctttttgacactg

SEQ ID NO: 4480885 - DNA, 20 bp, Homo sapiens
aatttcctttttgacactga

SEQ ID NO: 4480886 - DNA, 22 bp, Homo sapiens
aatttcctttttgacactgaaa

SEQ ID NO: 4480887 - DNA, 19 bp, Homo sapiens
aatttcgcttcttagaaca

SEQ ID NO: 4480888 - DNA, 20 bp, Homo sapiens
aatttcggattttttccaaa

SEQ ID NO: 4480889 - DNA, 18 bp, Homo sapiens
aatttctaaagtaaaatt

SEQ ID NO: 4480890 - DNA, 23 bp, Homo sapiens
aatttctaaagtaaaattgaagc

SEQ ID NO: 4480891 - DNA, 16 bp, Homo sapiens
aatttctactttgaag

SEQ ID NO: 4480892 - DNA, 15 bp, Homo sapiens
aatttctgaagaagt

SEQ ID NO: 4480893 - DNA, 20 bp, Homo sapiens
aatttctgaagaagttaatt

SEQ ID NO: 4480894 - DNA, 14 bp, Homo sapiens
aatttctgtacatt

SEQ ID NO: 4480895 - DNA, 15 bp, Homo sapiens
aatttctgtacattt

SEQ ID NO: 4480896 - DNA, 18 bp, Homo sapiens
aatttctgtacatttgca

SEQ ID NO: 4480897 - DNA, 17 bp, Homo sapiens
aatttctgtctttctgc

SEQ ID NO: 4480898 - DNA, 15 bp, Homo sapiens
aatttcttaacttct

SEQ ID NO: 4480899 - DNA, 15 bp, Homo sapiens
aatttctttaaatgt

SEQ ID NO: 4480900 - DNA, 17 bp, Homo sapiens
aatttcttttattaata

SEQ ID NO: 4480901 - DNA, 19 bp, Homo sapiens
aatttcttttattaatact

SEQ ID NO: 4480902 - DNA, 17 bp, Homo sapiens
aatttgaagacttcaaa

SEQ ID NO: 4480903 - DNA, 15 bp, Homo sapiens
aatttgaagtaactt

SEQ ID NO: 4480904 - DNA, 17 bp, Homo sapiens
aatttgactaattttac

SEQ ID NO: 4480905 - DNA, 18 bp, Homo sapiens
aatttgacttttctgtaa

SEQ ID NO: 4480906 - DNA, 19 bp, Homo sapiens
aatttgacttttctgtaat

SEQ ID NO: 4480907 - DNA, 18 bp, Homo sapiens
aatttgagagaaatatga

SEQ ID NO: 4480908 - DNA, 20 bp, Homo sapiens
aatttgagagaaatatgaag

SEQ ID NO: 4480909 - DNA, 22 bp, Homo sapiens
aatttgaggtctacattcttgg

SEQ ID NO: 4480910 - DNA, 18 bp, Homo sapiens
aatttgatgcccaatata

SEQ ID NO: 4480911 - DNA, 19 bp, Homo sapiens
aatttgatgcccaatatat

SEQ ID NO: 4480912 - DNA, 19 bp, Homo sapiens
aattatatgatatgcatgt

SEQ ID NO: 4480913 - DNA, 13 bp, Homo sapiens
aattatatttgtg

SEQ ID NO: 4480914 - DNA, 23 bp, Homo sapiens
aattatatttgtgctatagtatt

SEQ ID NO: 4480915 - DNA, 23 bp, Homo sapiens
aattatattttgttgctttctta

SEQ ID NO: 4480916 - DNA, 21 bp, Homo sapiens
aattatcagcaaagaaaaaaa

SEQ ID NO: 4480917 - DNA, 23 bp, Homo sapiens
aattatctatagctaagtacaca

SEQ ID NO: 4480918 - DNA, 19 bp, Homo sapiens
aattatctgattaagcatt

SEQ ID NO: 4480919 - DNA, 18 bp, Homo sapiens
aattatgcactaaatatg

SEQ ID NO: 4480920 - DNA, 19 bp, Homo sapiens
aattatgccttttttgatc

SEQ ID NO: 4480921 - DNA, 13 bp, Homo sapiens
aattatggaatat

SEQ ID NO: 4480922 - DNA, 23 bp, Homo sapiens
aattatggaatatcatctgtcat

SEQ ID NO: 4480923 - DNA, 16 bp, Homo sapiens
aattatggcatttcta

SEQ ID NO: 4480924 - DNA, 17 bp, Homo sapiens
aattatggcatttctat

SEQ ID NO: 4480925 - DNA, 13 bp, Homo sapiens
aattatgtctctt

SEQ ID NO: 4480926 - DNA, 20 bp, Homo sapiens
aattatgtctcttgagcatc

SEQ ID NO: 4480927 - DNA, 20 bp, Homo sapiens
aattatgtgacattttacat

SEQ ID NO: 4480928 - DNA, 22 bp, Homo sapiens
aattattaatgaaaataagaat

SEQ ID NO: 4480929 - DNA, 15 bp, Homo sapiens
aattattactttaaa

SEQ ID NO: 4480930 - DNA, 17 bp, Homo sapiens
aattattataaaaatat

SEQ ID NO: 4480931 - DNA, 15 bp, Homo sapiens
aattattattttaaa

SEQ ID NO: 4480932 - DNA, 17 bp, Homo sapiens
aattattccaaaccaaa

SEQ ID NO: 4480933 - DNA, 15 bp, Homo sapiens
aattattgatatata

SEQ ID NO: 4480934 - DNA, 15 bp, Homo sapiens
aattattgtagacat

SEQ ID NO: 4480935 - DNA, 16 bp, Homo sapiens
aattattgtagacatg

SEQ ID NO: 4480936 - DNA, 15 bp, Homo sapiens
aattatttaagattt

SEQ ID NO: 4480937 - DNA, 22 bp, Homo sapiens
aattatttcatgattagaaatt

SEQ ID NO: 4480938 - DNA, 14 bp, Homo sapiens
aattatttgcatat

SEQ ID NO: 4480939 - DNA, 21 bp, Homo sapiens
aattattttaaattataagga

SEQ ID NO: 4480940 - DNA, 13 bp, Homo sapiens
aattcaaaatgct

SEQ ID NO: 4480941 - DNA, 17 bp, Homo sapiens
aattcaaataaaaatcc

SEQ ID NO: 4480942 - DNA, 18 bp, Homo sapiens
aattcaagaaatgacagt

SEQ ID NO: 4480943 - DNA, 22 bp, Homo sapiens
aattcaagaagtatttttttaa

SEQ ID NO: 4480944 - DNA, 15 bp, Homo sapiens
aattcaatacaaaca

SEQ ID NO: 4480945 - DNA, 13 bp, Homo sapiens
aattcaattcaaa

SEQ ID NO: 4480946 - DNA, 17 bp, Homo sapiens
aattcaatttggattta

SEQ ID NO: 4480947 - DNA, 14 bp, Homo sapiens
aattcacaaacttt

SEQ ID NO: 4480948 - DNA, 16 bp, Homo sapiens
aattcactttcatttt

SEQ ID NO: 4480949 - DNA, 15 bp, Homo sapiens
aattcagcagtttta

SEQ ID NO: 4480950 - DNA, 16 bp, Homo sapiens
aattcagcagttttat

SEQ ID NO: 4480951 - DNA, 20 bp, Homo sapiens
aattcaggcatattttaact

SEQ ID NO: 4480952 - DNA, 15 bp, Homo sapiens
aattcaggtttttcc

SEQ ID NO: 4480953 - DNA, 14 bp, Homo sapiens
aattcagttttttt

SEQ ID NO: 4480954 - DNA, 15 bp, Homo sapiens
aattcataaaaacaa

SEQ ID NO: 4480955 - DNA, 22 bp, Homo sapiens
aattcatgacattatgtggaat

SEQ ID NO: 4480956 - DNA, 17 bp, Homo sapiens
aattcatgggctgtgtg

SEQ ID NO: 4480957 - DNA, 13 bp, Homo sapiens
aattcatttctaa

SEQ ID NO: 4480958 - DNA, 18 bp, Homo sapiens
aattcatttctagactca

SEQ ID NO: 4480959 - DNA, 19 bp, Homo sapiens
aattcatttctagactcaa

SEQ ID NO: 4480960 - DNA, 22 bp, Homo sapiens
aattcatttgcttgcaatctaa

SEQ ID NO: 4480961 - DNA, 14 bp, Homo sapiens
aattccaaaatcca

SEQ ID NO: 4480962 - DNA, 14 bp, Homo sapiens
aattccaagaaaat

SEQ ID NO: 4480963 - DNA, 16 bp, Homo sapiens
aattccacaccctcac

SEQ ID NO: 4480964 - DNA, 18 bp, Homo sapiens
aattccacagattatcaa

SEQ ID NO: 4480965 - DNA, 16 bp, Homo sapiens
aattccactgaaaatt

SEQ ID NO: 4480966 - DNA, 21 bp, Homo sapiens
aattcccgttttgtcactttt

SEQ ID NO: 4480967 - DNA, 13 bp, Homo sapiens
aattccctccccc

SEQ ID NO: 4480968 - DNA, 19 bp, Homo sapiens
aattcccttctttttcatc

SEQ ID NO: 4480969 - DNA, 10 bp, Homo sapiens
aattcctaca

SEQ ID NO: 4480970 - DNA, 19 bp, Homo sapiens
aattcctacagcactactg

SEQ ID NO: 4480971 - DNA, 12 bp, Homo sapiens
aattcctataag

SEQ ID NO: 4480972 - DNA, 15 bp, Homo sapiens
aattcctataaggaa

SEQ ID NO: 4480973 - DNA, 21 bp, Homo sapiens
aattcctccagagacactgag

SEQ ID NO: 4480974 - DNA, 22 bp, Homo sapiens
aattcctccagagacactgagc

SEQ ID NO: 4480975 - DNA, 13 bp, Homo sapiens
aattcctctcaaa

SEQ ID NO: 4480976 - DNA, 21 bp, Homo sapiens
aattcctttacaactaaataa

SEQ ID NO: 4480977 - DNA, 15 bp, Homo sapiens
aattcggtgtgcacc

SEQ ID NO: 4480978 - DNA, 15 bp, Homo sapiens
aattctaatctaaca

SEQ ID NO: 4480979 - DNA, 22 bp, Homo sapiens
aattctataaggccataaaaca

SEQ ID NO: 4480980 - DNA, 14 bp, Homo sapiens
aattctatttgctg

SEQ ID NO: 4480981 - DNA, 18 bp, Homo sapiens
aattctccaggattttaa

SEQ ID NO: 4480982 - DNA, 15 bp, Homo sapiens
aattctcccctccct

SEQ ID NO: 4480983 - DNA, 16 bp, Homo sapiens
aattctcccctccctc

SEQ ID NO: 4480984 - DNA, 15 bp, Homo sapiens
aattctgaaacaact

SEQ ID NO: 4480985 - DNA, 16 bp, Homo sapiens
aattctgaaatacttt

SEQ ID NO: 4480986 - DNA, 18 bp, Homo sapiens
aattctgaatttgcaaag

SEQ ID NO: 4480987 - DNA, 19 bp, Homo sapiens
aattctgaatttgcaaagt

SEQ ID NO: 4480988 - DNA, 20 bp, Homo sapiens
aattctgaatttgcaaagta

SEQ ID NO: 4480989 - DNA, 21 bp, Homo sapiens
aattctgactgtccaggagct

SEQ ID NO: 4480990 - DNA, 19 bp, Homo sapiens
aattcttggttgaggaaac

SEQ ID NO: 4480991 - DNA, 21 bp, Homo sapiens
aattctttctgttgaaaagca

SEQ ID NO: 4480992 - DNA, 22 bp, Homo sapiens
aattctttgacctgttgggagt

SEQ ID NO: 4480993 - DNA, 16 bp, Homo sapiens
aattctttgtttatgc

SEQ ID NO: 4480994 - DNA, 17 bp, Homo sapiens
aattcttttgaattgtt

SEQ ID NO: 4480995 - DNA, 13 bp, Homo sapiens
aattgaaaaacaa

SEQ ID NO: 4480996 - DNA, 23 bp, Homo sapiens
aattgaaaaacaattttctgtaa

SEQ ID NO: 4480997 - DNA, 15 bp, Homo sapiens
aattgaaaagaagta

SEQ ID NO: 4480998 - DNA, 18 bp, Homo sapiens
aattgaaaaggaacttgc

SEQ ID NO: 4480999 - DNA, 22 bp, Homo sapiens
aattgaaataaataaaaatgca

SEQ ID NO: 4481000 - DNA, 23 bp, Homo sapiens
aattgaacgactgtatattgcta

SEQ ID NO: 4481001 - DNA, 23 bp, Homo sapiens
aattgaatagtttatttctgtga

SEQ ID NO: 4481002 - DNA, 19 bp, Homo sapiens
aattgacccacaagaaatg

SEQ ID NO: 4481003 - DNA, 19 bp, Homo sapiens
aattgagaaaaatatatac

SEQ ID NO: 4481004 - DNA, 23 bp, Homo sapiens
aattgagaaaaatatatactaaa

SEQ ID NO: 4481005 - DNA, 18 bp, Homo sapiens
aattgagaataagaattt

SEQ ID NO: 4481006 - DNA, 18 bp, Homo sapiens
aattgagtgtttaaagtt

SEQ ID NO: 4481007 - DNA, 21 bp, Homo sapiens
aattgagtttaacaataataa

SEQ ID NO: 4481008 - DNA, 18 bp, Homo sapiens
aattgatacctgttcctt

SEQ ID NO: 4481009 - DNA, 21 bp, Homo sapiens
aattgatattatattaaacat

SEQ ID NO: 4481010 - DNA, 22 bp, Homo sapiens
aattgatattatattaaacata

SEQ ID NO: 4481011 - DNA, 15 bp, Homo sapiens
aattgatcagatgct

SEQ ID NO: 4481012 - DNA, 22 bp, Homo sapiens
aattgatcattttccccccact

SEQ ID NO: 4481013 - DNA, 20 bp, Homo sapiens
aattgatttgcattgaacac

SEQ ID NO: 4481014 - DNA, 23 bp, Homo sapiens
aattgatttgcattgaacacaaa

SEQ ID NO: 4481015 - DNA, 13 bp, Homo sapiens
aattgcagtcatt

SEQ ID NO: 4481016 - DNA, 14 bp, Homo sapiens
aattgcagtttcat

SEQ ID NO: 4481017 - DNA, 20 bp, Homo sapiens
aattgcagtttcatgtatgt

SEQ ID NO: 4481018 - DNA, 21 bp, Homo sapiens
aattgcagtttcatgtatgta

SEQ ID NO: 4481019 - DNA, 13 bp, Homo sapiens
aattgcatgaaaa

SEQ ID NO: 4481020 - DNA, 11 bp, Homo sapiens
aattgcattga

SEQ ID NO: 4481021 - DNA, 13 bp, Homo sapiens
aattgccccatcc

SEQ ID NO: 4481022 - DNA, 22 bp, Homo sapiens
aattgcgctcaggggctccatg

SEQ ID NO: 4481023 - DNA, 15 bp, Homo sapiens
aattgctaatgttgc

SEQ ID NO: 4481024 - DNA, 22 bp, Homo sapiens
aattgctctgtgtatatctctt

SEQ ID NO: 4481025 - DNA, 12 bp, Homo sapiens
aattgctttgaa

SEQ ID NO: 4481026 - DNA, 13 bp, Homo sapiens
aattgctttgaag

SEQ ID NO: 4481027 - DNA, 16 bp, Homo sapiens
aattggaggaaagcaa

SEQ ID NO: 4481028 - DNA, 18 bp, Homo sapiens
aattggcataatttgtct

SEQ ID NO: 4481029 - DNA, 15 bp, Homo sapiens
aattgggttcatgat

SEQ ID NO: 4481030 - DNA, 20 bp, Homo sapiens
aattgggttcatgatgcagt

SEQ ID NO: 4481031 - DNA, 16 bp, Homo sapiens
aattggtcatggtaga

SEQ ID NO: 4481032 - DNA, 17 bp, Homo sapiens
aatgtgccacagaggcc

SEQ ID NO: 4481033 - DNA, 19 bp, Homo sapiens
aatgtgccacagaggcccc

SEQ ID NO: 4481034 - DNA, 20 bp, Homo sapiens
aatgtgcctaatggagaaga

SEQ ID NO: 4481035 - DNA, 21 bp, Homo sapiens
aatgtgctcaaattactaatg

SEQ ID NO: 4481036 - DNA, 20 bp, Homo sapiens
aatgtggaaaaaatatttta

SEQ ID NO: 4481037 - DNA, 22 bp, Homo sapiens
aatgtggcaaggaaaaacaggt

SEQ ID NO: 4481038 - DNA, 18 bp, Homo sapiens
aatgtggccaagcctatc

SEQ ID NO: 4481039 - DNA, 16 bp, Homo sapiens
aatgtggctgaagttg

SEQ ID NO: 4481040 - DNA, 13 bp, Homo sapiens
aatgtgtaagaac

SEQ ID NO: 4481041 - DNA, 13 bp, Homo sapiens
aatgtgtgcttta

SEQ ID NO: 4481042 - DNA, 20 bp, Homo sapiens
aatgtgtgctttattgaatt

SEQ ID NO: 4481043 - DNA, 15 bp, Homo sapiens
aatgtgtgtatgtgt

SEQ ID NO: 4481044 - DNA, 21 bp, Homo sapiens
aatgtgtgtgtgtggcagggg

SEQ ID NO: 4481045 - DNA, 22 bp, Homo sapiens
aatgtgttcttttctcctttac

SEQ ID NO: 4481046 - DNA, 23 bp, Homo sapiens
aatgtgttcttttctcctttacc

SEQ ID NO: 4481047 - DNA, 15 bp, Homo sapiens
aatgttaaagtcagt

SEQ ID NO: 4481048 - DNA, 14 bp, Homo sapiens
aatgttaactgttc

SEQ ID NO: 4481049 - DNA, 16 bp, Homo sapiens
aatgttaatgatatgt

SEQ ID NO: 4481050 - DNA, 20 bp, Homo sapiens
aatgttaattttttggtaca

SEQ ID NO: 4481051 - DNA, 15 bp, Homo sapiens
aatgttactgcctta

SEQ ID NO: 4481052 - DNA, 16 bp, Homo sapiens
aatgttacttctgata

SEQ ID NO: 4481053 - DNA, 20 bp, Homo sapiens
aatgttacttctgatacttt

SEQ ID NO: 4481054 - DNA, 22 bp, Homo sapiens
aatgttagaagaggcctttgga

SEQ ID NO: 4481055 - DNA, 19 bp, Homo sapiens
aatgttagacttgtgtgca

SEQ ID NO: 4481056 - DNA, 18 bp, Homo sapiens
aatgttagatattgctac

SEQ ID NO: 4481057 - DNA, 15 bp, Homo sapiens
aatgttagatgctta

SEQ ID NO: 4481058 - DNA, 22 bp, Homo sapiens
aatgttatgactatgtaaacta

SEQ ID NO: 4481059 - DNA, 14 bp, Homo sapiens
aatgttattgtgta

SEQ ID NO: 4481060 - DNA, 18 bp, Homo sapiens
aatgttattttcttctaa

SEQ ID NO: 4481061 - DNA, 20 bp, Homo sapiens
aatgttattttcttctaagt

SEQ ID NO: 4481062 - DNA, 19 bp, Homo sapiens
aatgttcattttgaaaata

SEQ ID NO: 4481063 - DNA, 20 bp, Homo sapiens
aatgttcattttgaaaatat

SEQ ID NO: 4481064 - DNA, 21 bp, Homo sapiens
aatgttcattttgaaaatatg

SEQ ID NO: 4481065 - DNA, 18 bp, Homo sapiens
aatgttccttttttgtat

SEQ ID NO: 4481066 - DNA, 21 bp, Homo sapiens
aatgttctggcactattataa

SEQ ID NO: 4481067 - DNA, 17 bp, Homo sapiens
aatgttctttggaaagt

SEQ ID NO: 4481068 - DNA, 16 bp, Homo sapiens
aatgttggataaggaa

SEQ ID NO: 4481069 - DNA, 17 bp, Homo sapiens
aatgttggataaggaat

SEQ ID NO: 4481070 - DNA, 23 bp, Homo sapiens
aatgttgtcctgttaatttatag

SEQ ID NO: 4481071 - DNA, 12 bp, Homo sapiens
aatgtttaaaga

SEQ ID NO: 4481072 - DNA, 13 bp, Homo sapiens
aatgtttactata

SEQ ID NO: 4481073 - DNA, 13 bp, Homo sapiens
aatgtttactgta

SEQ ID NO: 4481074 - DNA, 20 bp, Homo sapiens
aatgtttatggaaatattaa

SEQ ID NO: 4481075 - DNA, 23 bp, Homo sapiens
aatgtttattccttctgtagtgt

SEQ ID NO: 4481076 - DNA, 16 bp, Homo sapiens
aatgtttctggatttc

SEQ ID NO: 4481077 - DNA, 12 bp, Homo sapiens
aatgtttcttag

SEQ ID NO: 4481078 - DNA, 20 bp, Homo sapiens
aatgtttcttcatttctctg

SEQ ID NO: 4481079 - DNA, 15 bp, Homo sapiens
aatgtttggatggtt

SEQ ID NO: 4481080 - DNA, 14 bp, Homo sapiens
aatgttttaaatgt

SEQ ID NO: 4481081 - DNA, 16 bp, Homo sapiens
aatgttttctttgcaa

SEQ ID NO: 4481082 - DNA, 17 bp, Homo sapiens
aatgttttctttgcaaa

SEQ ID NO: 4481083 - DNA, 22 bp, Homo sapiens
aatgtttttaaaaagagtaatt

SEQ ID NO: 4481084 - DNA, 16 bp, Homo sapiens
aatgtttttccctccc

SEQ ID NO: 4481085 - DNA, 18 bp, Homo sapiens
aatgtttttccctcccca

SEQ ID NO: 4481086 - DNA, 21 bp, Homo sapiens
aatgtttttccctccccagaa

SEQ ID NO: 4481087 - DNA, 23 bp, Homo sapiens
aatgttttttaaaatggttatgt

SEQ ID NO: 4481088 - DNA, 16 bp, Homo sapiens
aattaaaaactttaaa

SEQ ID NO: 4481089 - DNA, 14 bp, Homo sapiens
aattaaaaatgaaa

SEQ ID NO: 4481090 - DNA, 13 bp, Homo sapiens
aattaaaattgtg

SEQ ID NO: 4481091 - DNA, 15 bp, Homo sapiens
aattaaaattgtgca

SEQ ID NO: 4481092 - DNA, 19 bp, Homo sapiens
aattaaaattgtgcataat

SEQ ID NO: 4481093 - DNA, 16 bp, Homo sapiens
aattaaactagtttaa

SEQ ID NO: 4481094 - DNA, 16 bp, Homo sapiens
aattaaagtactttaa

SEQ ID NO: 4481095 - DNA, 14 bp, Homo sapiens
aattaaatagtgtg

SEQ ID NO: 4481096 - DNA, 15 bp, Homo sapiens
aattaaatatatata

SEQ ID NO: 4481097 - DNA, 14 bp, Homo sapiens
aattaaatatatgt

SEQ ID NO: 4481098 - DNA, 23 bp, Homo sapiens
aattaaatatatgtatgtaaaaa

SEQ ID NO: 4481099 - DNA, 15 bp, Homo sapiens
aattaaatatttatt

SEQ ID NO: 4481100 - DNA, 11 bp, Homo sapiens
aattaaatgtg

SEQ ID NO: 4481101 - DNA, 19 bp, Homo sapiens
aattaacaaagaatttcag

SEQ ID NO: 4481102 - DNA, 15 bp, Homo sapiens
aattaacacaaagga

SEQ ID NO: 4481103 - DNA, 18 bp, Homo sapiens
aattaactgggtaatgaa

SEQ ID NO: 4481104 - DNA, 21 bp, Homo sapiens
aattaactgggtaatgaaaca

SEQ ID NO: 4481105 - DNA, 15 bp, Homo sapiens
aattaagaaaactat

SEQ ID NO: 4481106 - DNA, 13 bp, Homo sapiens
aattaagaaggca

SEQ ID NO: 4481107 - DNA, 14 bp, Homo sapiens
aattaagaaggcaa

SEQ ID NO: 4481108 - DNA, 16 bp, Homo sapiens
aattaagaaggcaaaa

SEQ ID NO: 4481109 - DNA, 19 bp, Homo sapiens
aattaagaaggcaaaaatg

SEQ ID NO: 4481110 - DNA, 20 bp, Homo sapiens
aattaagatcctaaactctc

SEQ ID NO: 4481111 - DNA, 22 bp, Homo sapiens
aattaagatcctaaactctcta

SEQ ID NO: 4481112 - DNA, 15 bp, Homo sapiens
aattaagatttcctt

SEQ ID NO: 4481113 - DNA, 21 bp, Homo sapiens
aattaatatggtgtatttttc

SEQ ID NO: 4481114 - DNA, 20 bp, Homo sapiens
aattaatgacttactttaat

SEQ ID NO: 4481115 - DNA, 15 bp, Homo sapiens
aattaatgtaataaa

SEQ ID NO: 4481116 - DNA, 13 bp, Homo sapiens
aattaattaaaag

SEQ ID NO: 4481117 - DNA, 14 bp, Homo sapiens
aattaattaaatga

SEQ ID NO: 4481118 - DNA, 15 bp, Homo sapiens
aattacaagccctgg

SEQ ID NO: 4481119 - DNA, 18 bp, Homo sapiens
aattacactataatataa

SEQ ID NO: 4481120 - DNA, 17 bp, Homo sapiens
aattacagcttttatgg

SEQ ID NO: 4481121 - DNA, 19 bp, Homo sapiens
aattacagggtgactcaca

SEQ ID NO: 4481122 - DNA, 18 bp, Homo sapiens
aattacctggatgttctt

SEQ ID NO: 4481123 - DNA, 18 bp, Homo sapiens
aattacctttacatatat

SEQ ID NO: 4481124 - DNA, 15 bp, Homo sapiens
aattactaattctag

SEQ ID NO: 4481125 - DNA, 18 bp, Homo sapiens
aattactcactaaagggc

SEQ ID NO: 4481126 - DNA, 14 bp, Homo sapiens
aattactggtccaa

SEQ ID NO: 4481127 - DNA, 17 bp, Homo sapiens
aattactttattataaa

SEQ ID NO: 4481128 - DNA, 15 bp, Homo sapiens
aattactttctgaat

SEQ ID NO: 4481129 - DNA, 19 bp, Homo sapiens
aattactttgattccattt

SEQ ID NO: 4481130 - DNA, 22 bp, Homo sapiens
aattactttggggctaatttaa

SEQ ID NO: 4481131 - DNA, 14 bp, Homo sapiens
aattactttggtag

SEQ ID NO: 4481132 - DNA, 17 bp, Homo sapiens
aattagaaaattagtga

SEQ ID NO: 4481133 - DNA, 17 bp, Homo sapiens
aattagacactttggaa

SEQ ID NO: 4481134 - DNA, 15 bp, Homo sapiens
aattagactgtgatt

SEQ ID NO: 4481135 - DNA, 23 bp, Homo sapiens
aattagactgtgattcagaaaat

SEQ ID NO: 4481136 - DNA, 16 bp, Homo sapiens
aattagatccattaat

SEQ ID NO: 4481137 - DNA, 21 bp, Homo sapiens
aattagatccattaatttaaa

SEQ ID NO: 4481138 - DNA, 23 bp, Homo sapiens
aattagatccattaatttaaatg

SEQ ID NO: 4481139 - DNA, 16 bp, Homo sapiens
aattaggctgtaacta

SEQ ID NO: 4481140 - DNA, 19 bp, Homo sapiens
aattaggctgtaactactt

SEQ ID NO: 4481141 - DNA, 22 bp, Homo sapiens
aattaggctgtaactactttat

SEQ ID NO: 4481142 - DNA, 21 bp, Homo sapiens
aattagtacagaaatatccat

SEQ ID NO: 4481143 - DNA, 21 bp, Homo sapiens
aattagtgaccattattcaca

SEQ ID NO: 4481144 - DNA, 23 bp, Homo sapiens
aattagtgaccattattcacagg

SEQ ID NO: 4481145 - DNA, 15 bp, Homo sapiens
aattagtgccactta

SEQ ID NO: 4481146 - DNA, 17 bp, Homo sapiens
aattagtgccacttaat

SEQ ID NO: 4481147 - DNA, 16 bp, Homo sapiens
aattataaatgtgttt

SEQ ID NO: 4481148 - DNA, 15 bp, Homo sapiens
aattataaggactgc

SEQ ID NO: 4481149 - DNA, 14 bp, Homo sapiens
aattatactacttt

SEQ ID NO: 4481150 - DNA, 17 bp, Homo sapiens
aattatataactgtatt

SEQ ID NO: 4481151 - DNA, 12 bp, Homo sapiens
aattatatattt

SEQ ID NO: 4481152 - DNA, 14 bp, Homo sapiens
aatgctcccagctg

SEQ ID NO: 4481153 - DNA, 23 bp, Homo sapiens
aatgctgtacatctattttggat

SEQ ID NO: 4481154 - DNA, 22 bp, Homo sapiens
aatgctgtatttttacagctac

SEQ ID NO: 4481155 - DNA, 22 bp, Homo sapiens
aatgcttaatcagatagatatt

SEQ ID NO: 4481156 - DNA, 15 bp, Homo sapiens
aatgcttcattgaaa

SEQ ID NO: 4481157 - DNA, 16 bp, Homo sapiens
aatgcttcttaaagtt

SEQ ID NO: 4481158 - DNA, 11 bp, Homo sapiens
aatgctttctg

SEQ ID NO: 4481159 - DNA, 15 bp, Homo sapiens
aatgctttctgtatg

SEQ ID NO: 4481160 - DNA, 14 bp, Homo sapiens
aatgcttttagtgt

SEQ ID NO: 4481161 - DNA, 21 bp, Homo sapiens
aatgcttttagtgtgtgcata

SEQ ID NO: 4481162 - DNA, 13 bp, Homo sapiens
aatgcttttctaa

SEQ ID NO: 4481163 - DNA, 13 bp, Homo sapiens
aatggaaagcttt

SEQ ID NO: 4481164 - DNA, 16 bp, Homo sapiens
aatggaagaaatggct

SEQ ID NO: 4481165 - DNA, 16 bp, Homo sapiens
aatggaagagagaaag

SEQ ID NO: 4481166 - DNA, 19 bp, Homo sapiens
aatggactggtttgagatt

SEQ ID NO: 4481167 - DNA, 21 bp, Homo sapiens
aatggaggaactttccaaaca

SEQ ID NO: 4481168 - DNA, 20 bp, Homo sapiens
aatggaggaagaacaacaaa

SEQ ID NO: 4481169 - DNA, 22 bp, Homo sapiens
aatggatatagaaaatcttagt

SEQ ID NO: 4481170 - DNA, 23 bp, Homo sapiens
aatggatatagaaaatcttagta

SEQ ID NO: 4481171 - DNA, 13 bp, Homo sapiens
aatggatccacaa

SEQ ID NO: 4481172 - DNA, 14 bp, Homo sapiens
aatggattgttaat

SEQ ID NO: 4481173 - DNA, 12 bp, Homo sapiens
aatggcagcaga

SEQ ID NO: 4481174 - DNA, 18 bp, Homo sapiens
aatggcagcagaaaactt

SEQ ID NO: 4481175 - DNA, 14 bp, Homo sapiens
aatggccttcatat

SEQ ID NO: 4481176 - DNA, 15 bp, Homo sapiens
aatggctatgaacag

SEQ ID NO: 4481177 - DNA, 23 bp, Homo sapiens
aatggctatgaacagaaactaca

SEQ ID NO: 4481178 - DNA, 14 bp, Homo sapiens
aatggctattaaca

SEQ ID NO: 4481179 - DNA, 16 bp, Homo sapiens
aatggctgataatttt

SEQ ID NO: 4481180 - DNA, 18 bp, Homo sapiens
aatggctgataattttaa

SEQ ID NO: 4481181 - DNA, 21 bp, Homo sapiens
aatgggaaaaaacttaaaaat

SEQ ID NO: 4481182 - DNA, 21 bp, Homo sapiens
aatgggaattgcgctcagggg

SEQ ID NO: 4481183 - DNA, 23 bp, Homo sapiens
aatgggatggtcggatctcacag

SEQ ID NO: 4481184 - DNA, 20 bp, Homo sapiens
aatgggccactgaaatctgt

SEQ ID NO: 4481185 - DNA, 23 bp, Homo sapiens
aatgggctttcccccaactcagg

SEQ ID NO: 4481186 - DNA, 15 bp, Homo sapiens
aatgggtaagggagg

SEQ ID NO: 4481187 - DNA, 17 bp, Homo sapiens
aatgggtaagggaggga

SEQ ID NO: 4481188 - DNA, 18 bp, Homo sapiens
aatgggtaagggagggaa

SEQ ID NO: 4481189 - DNA, 17 bp, Homo sapiens
aatggtaggcatttcct

SEQ ID NO: 4481190 - DNA, 18 bp, Homo sapiens
aatggtaggcatttccta

SEQ ID NO: 4481191 - DNA, 14 bp, Homo sapiens
aatggtccaggaga

SEQ ID NO: 4481192 - DNA, 22 bp, Homo sapiens
aatggtgcgtggcttccctgtc

SEQ ID NO: 4481193 - DNA, 22 bp, Homo sapiens
aatggtgttttgtcagacttcc

SEQ ID NO: 4481194 - DNA, 16 bp, Homo sapiens
aatggtttaaatggtc

SEQ ID NO: 4481195 - DNA, 20 bp, Homo sapiens
aatggtttctcattaaactc

SEQ ID NO: 4481196 - DNA, 21 bp, Homo sapiens
aatggtttggtgctttttata

SEQ ID NO: 4481197 - DNA, 16 bp, Homo sapiens
aatggtttttaaattt

SEQ ID NO: 4481198 - DNA, 13 bp, Homo sapiens
aatgtaaaaatga

SEQ ID NO: 4481199 - DNA, 23 bp, Homo sapiens
aatgtaaactgctcgccttattc

SEQ ID NO: 4481200 - DNA, 15 bp, Homo sapiens
aatgtaaagatttgc

SEQ ID NO: 4481201 - DNA, 23 bp, Homo sapiens
aatgtaaaggagtcaaaactaca

SEQ ID NO: 4481202 - DNA, 20 bp, Homo sapiens
aatgtaaagttatgtattta

SEQ ID NO: 4481203 - DNA, 22 bp, Homo sapiens
aatgtaaagttatgtatttaaa

SEQ ID NO: 4481204 - DNA, 13 bp, Homo sapiens
aatgtaaataaac

SEQ ID NO: 4481205 - DNA, 21 bp, Homo sapiens
aatgtaaataaactatttata

SEQ ID NO: 4481206 - DNA, 17 bp, Homo sapiens
aatgtaaatattttaaa

SEQ ID NO: 4481207 - DNA, 19 bp, Homo sapiens
aatgtaaatattttaaaga

SEQ ID NO: 4481208 - DNA, 22 bp, Homo sapiens
aatgtaaatattttaaagaatt

SEQ ID NO: 4481209 - DNA, 16 bp, Homo sapiens
aatgtaagcatacttt

SEQ ID NO: 4481210 - DNA, 15 bp, Homo sapiens
aatgtaataaagtga

SEQ ID NO: 4481211 - DNA, 16 bp, Homo sapiens
aatgtaatagggaaaa

SEQ ID NO: 4481212 - DNA, 13 bp, Homo sapiens
aatgtaatttcag

SEQ ID NO: 4481213 - DNA, 15 bp, Homo sapiens
aatgtaatttcagtt

SEQ ID NO: 4481214 - DNA, 14 bp, Homo sapiens
aatgtaatttgtgt

SEQ ID NO: 4481215 - DNA, 18 bp, Homo sapiens
aatgtaatttgtgtaata

SEQ ID NO: 4481216 - DNA, 20 bp, Homo sapiens
aatgtacaattatgtctctt

SEQ ID NO: 4481217 - DNA, 11 bp, Homo sapiens
aatgtacactt

SEQ ID NO: 4481218 - DNA, 17 bp, Homo sapiens
aatgtacactttttaca

SEQ ID NO: 4481219 - DNA, 17 bp, Homo sapiens
aatgtacagacatattt

SEQ ID NO: 4481220 - DNA, 16 bp, Homo sapiens
aatgtacagttgaaat

SEQ ID NO: 4481221 - DNA, 15 bp, Homo sapiens
aatgtaccttctttc

SEQ ID NO: 4481222 - DNA, 21 bp, Homo sapiens
aatgtaccttctttcactctg

SEQ ID NO: 4481223 - DNA, 13 bp, Homo sapiens
aatgtacgtcatt

SEQ ID NO: 4481224 - DNA, 17 bp, Homo sapiens
aatgtactgaattcttt

SEQ ID NO: 4481225 - DNA, 14 bp, Homo sapiens
aatgtacttgtttg

SEQ ID NO: 4481226 - DNA, 16 bp, Homo sapiens
aatgtacttgtttgaa

SEQ ID NO: 4481227 - DNA, 18 bp, Homo sapiens
aatgtacttgtttgaata

SEQ ID NO: 4481228 - DNA, 17 bp, Homo sapiens
aatgtagggttatattt

SEQ ID NO: 4481229 - DNA, 19 bp, Homo sapiens
aatgtagggttatatttgg

SEQ ID NO: 4481230 - DNA, 13 bp, Homo sapiens
aatgtataaaaat

SEQ ID NO: 4481231 - DNA, 22 bp, Homo sapiens
aatgtataaaaattatcaaaaa

SEQ ID NO: 4481232 - DNA, 15 bp, Homo sapiens
aatgtatacaatgca

SEQ ID NO: 4481233 - DNA, 17 bp, Homo sapiens
aatgtatacaatgcact

SEQ ID NO: 4481234 - DNA, 13 bp, Homo sapiens
aatgtatctttat

SEQ ID NO: 4481235 - DNA, 17 bp, Homo sapiens
aatgtatctttattaaa

SEQ ID NO: 4481236 - DNA, 21 bp, Homo sapiens
aatgtatctttattaaaacaa

SEQ ID NO: 4481237 - DNA, 20 bp, Homo sapiens
aatgtatgcattcacattta

SEQ ID NO: 4481238 - DNA, 15 bp, Homo sapiens
aatgtatgtacaata

SEQ ID NO: 4481239 - DNA, 17 bp, Homo sapiens
aatgtatgtacaataca

SEQ ID NO: 4481240 - DNA, 17 bp, Homo sapiens
aatgtatgttaccaaaa

SEQ ID NO: 4481241 - DNA, 16 bp, Homo sapiens
aatgtattcctttaaa

SEQ ID NO: 4481242 - DNA, 13 bp, Homo sapiens
aatgtatttgaaa

SEQ ID NO: 4481243 - DNA, 16 bp, Homo sapiens
aatgtatttgaaaatt

SEQ ID NO: 4481244 - DNA, 17 bp, Homo sapiens
aatgtattttcttttta

SEQ ID NO: 4481245 - DNA, 16 bp, Homo sapiens
aatgtcacaacatggt

SEQ ID NO: 4481246 - DNA, 19 bp, Homo sapiens
aatgtcaccaccttcccag

SEQ ID NO: 4481247 - DNA, 20 bp, Homo sapiens
aatgtcaccaccttcccagc

SEQ ID NO: 4481248 - DNA, 23 bp, Homo sapiens
aatgtcaccaccttcccagctct

SEQ ID NO: 4481249 - DNA, 19 bp, Homo sapiens
aatgtcagatgcgtgccca

SEQ ID NO: 4481250 - DNA, 12 bp, Homo sapiens
aatgtcagtgtt

SEQ ID NO: 4481251 - DNA, 19 bp, Homo sapiens
aatgtcagttgttatttat

SEQ ID NO: 4481252 - DNA, 18 bp, Homo sapiens
aatgtcattgtctactcc

SEQ ID NO: 4481253 - DNA, 23 bp, Homo sapiens
aatgtcctccagaagcctctggc

SEQ ID NO: 4481254 - DNA, 19 bp, Homo sapiens
aatgtcgcagactcctcca

SEQ ID NO: 4481255 - DNA, 18 bp, Homo sapiens
aatgtctaaaaacatttg

SEQ ID NO: 4481256 - DNA, 16 bp, Homo sapiens
aatgtctgaagtacaa

SEQ ID NO: 4481257 - DNA, 22 bp, Homo sapiens
aatgtctgaagtacaaacatga

SEQ ID NO: 4481258 - DNA, 12 bp, Homo sapiens
aatgtctgtgaa

SEQ ID NO: 4481259 - DNA, 19 bp, Homo sapiens
aatgtcttgctgttgacat

SEQ ID NO: 4481260 - DNA, 15 bp, Homo sapiens
aatgtctttccaaat

SEQ ID NO: 4481261 - DNA, 15 bp, Homo sapiens
aatgtgaaaaatctg

SEQ ID NO: 4481262 - DNA, 16 bp, Homo sapiens
aatgtgaaatgtaact

SEQ ID NO: 4481263 - DNA, 23 bp, Homo sapiens
aatgtgaatcagaccctacccca

SEQ ID NO: 4481264 - DNA, 16 bp, Homo sapiens
aatgtgaggcaataag

SEQ ID NO: 4481265 - DNA, 18 bp, Homo sapiens
aatgtgaggcaataagaa

SEQ ID NO: 4481266 - DNA, 22 bp, Homo sapiens
aatgtgagtagttactaaaatt

SEQ ID NO: 4481267 - DNA, 17 bp, Homo sapiens
aatgtgattcttctaaa

SEQ ID NO: 4481268 - DNA, 15 bp, Homo sapiens
aatgtgcagaaaata

SEQ ID NO: 4481269 - DNA, 20 bp, Homo sapiens
aatgtgcagaaaatatttaa

SEQ ID NO: 4481270 - DNA, 22 bp, Homo sapiens
aatgtgcagaaaatatttaata

SEQ ID NO: 4481271 - DNA, 23 bp, Homo sapiens
aatgtgcagggatattgccttat

SEQ ID NO: 4481272 - DNA, 22 bp, Homo sapiens
aatgaaaataaaacacacctcg

SEQ ID NO: 4481273 - DNA, 15 bp, Homo sapiens
aatgaaaatgtccat

SEQ ID NO: 4481274 - DNA, 13 bp, Homo sapiens
aatgaaaattgta

SEQ ID NO: 4481275 - DNA, 14 bp, Homo sapiens
aatgaaaattgtat

SEQ ID NO: 4481276 - DNA, 14 bp, Homo sapiens
aatgaaaattttaa

SEQ ID NO: 4481277 - DNA, 17 bp, Homo sapiens
aatgaaaattttaagaa

SEQ ID NO: 4481278 - DNA, 21 bp, Homo sapiens
aatgaaacaaaaaaaaaatga

SEQ ID NO: 4481279 - DNA, 14 bp, Homo sapiens
aatgaaagggaaac

SEQ ID NO: 4481280 - DNA, 15 bp, Homo sapiens
aatgaaagtgttaat

SEQ ID NO: 4481281 - DNA, 15 bp, Homo sapiens
aatgaaatgccaaag

SEQ ID NO: 4481282 - DNA, 16 bp, Homo sapiens
aatgaaatgccaaagg

SEQ ID NO: 4481283 - DNA, 21 bp, Homo sapiens
aatgaaatgccaaaggaagtt

SEQ ID NO: 4481284 - DNA, 15 bp, Homo sapiens
aatgaaattaacaca

SEQ ID NO: 4481285 - DNA, 16 bp, Homo sapiens
aatgaacaaaattatt

SEQ ID NO: 4481286 - DNA, 21 bp, Homo sapiens
aatgaagaactgttgcctaat

SEQ ID NO: 4481287 - DNA, 15 bp, Homo sapiens
aatgaagaatcacga

SEQ ID NO: 4481288 - DNA, 14 bp, Homo sapiens
aatgaagcagtatt

SEQ ID NO: 4481289 - DNA, 12 bp, Homo sapiens
aatgaagctttg

SEQ ID NO: 4481290 - DNA, 22 bp, Homo sapiens
aatgaaggaaataaaaaagtct

SEQ ID NO: 4481291 - DNA, 23 bp, Homo sapiens
aatgaaggaaataaaaaagtctc

SEQ ID NO: 4481292 - DNA, 12 bp, Homo sapiens
aatgaagggaaa

SEQ ID NO: 4481293 - DNA, 18 bp, Homo sapiens
aatgaagggaaattgttt

SEQ ID NO: 4481294 - DNA, 21 bp, Homo sapiens
aatgaataatggaaaatgcca

SEQ ID NO: 4481295 - DNA, 18 bp, Homo sapiens
aatgaatattttgataat

SEQ ID NO: 4481296 - DNA, 16 bp, Homo sapiens
aatgaatgaggtctgg

SEQ ID NO: 4481297 - DNA, 19 bp, Homo sapiens
aatgaatgaggtctgggct

SEQ ID NO: 4481298 - DNA, 14 bp, Homo sapiens
aatgaatgattcta

SEQ ID NO: 4481299 - DNA, 18 bp, Homo sapiens
aatgaatgccgaatttgg

SEQ ID NO: 4481300 - DNA, 21 bp, Homo sapiens
aatgaatggaggaactttcca

SEQ ID NO: 4481301 - DNA, 22 bp, Homo sapiens
aatgaatggctaagcaaaatgt

SEQ ID NO: 4481302 - DNA, 14 bp, Homo sapiens
aatgaatgtgctga

SEQ ID NO: 4481303 - DNA, 16 bp, Homo sapiens
aatgaattcctagaat

SEQ ID NO: 4481304 - DNA, 12 bp, Homo sapiens
aatgaattgaaa

SEQ ID NO: 4481305 - DNA, 13 bp, Homo sapiens
aatgaattgtcct

SEQ ID NO: 4481306 - DNA, 17 bp, Homo sapiens
aatgaatttttatgata

SEQ ID NO: 4481307 - DNA, 14 bp, Homo sapiens
aatgacagatttct

SEQ ID NO: 4481308 - DNA, 13 bp, Homo sapiens
aatgacatctttt

SEQ ID NO: 4481309 - DNA, 22 bp, Homo sapiens
aatgacatctttttaaagctta

SEQ ID NO: 4481310 - DNA, 23 bp, Homo sapiens
aatgactatataatttatttcca

SEQ ID NO: 4481311 - DNA, 21 bp, Homo sapiens
aatgactctttctgaaggaag

SEQ ID NO: 4481312 - DNA, 15 bp, Homo sapiens
aatgacttagaaact

SEQ ID NO: 4481313 - DNA, 15 bp, Homo sapiens
aatgacttatttctg

SEQ ID NO: 4481314 - DNA, 23 bp, Homo sapiens
aatgacttatttctgctctggaa

SEQ ID NO: 4481315 - DNA, 12 bp, Homo sapiens
aatgagaaagga

SEQ ID NO: 4481316 - DNA, 18 bp, Homo sapiens
aatgagaaaggacagagc

SEQ ID NO: 4481317 - DNA, 17 bp, Homo sapiens
aatgagaaggcagccac

SEQ ID NO: 4481318 - DNA, 15 bp, Homo sapiens
aatgagaatagaaac

SEQ ID NO: 4481319 - DNA, 13 bp, Homo sapiens
aatgagaatctac

SEQ ID NO: 4481320 - DNA, 17 bp, Homo sapiens
aatgagagtgcactgct

SEQ ID NO: 4481321 - DNA, 23 bp, Homo sapiens
aatgagcacccattccaaagctt

SEQ ID NO: 4481322 - DNA, 18 bp, Homo sapiens
aatgagccatgatttccc

SEQ ID NO: 4481323 - DNA, 12 bp, Homo sapiens
aatgagccctgg

SEQ ID NO: 4481324 - DNA, 13 bp, Homo sapiens
aatgagccctggc

SEQ ID NO: 4481325 - DNA, 14 bp, Homo sapiens
aatgagccctggct

SEQ ID NO: 4481326 - DNA, 15 bp, Homo sapiens
aatgagccctggctc

SEQ ID NO: 4481327 - DNA, 19 bp, Homo sapiens
aatgagctattaaaactca

SEQ ID NO: 4481328 - DNA, 22 bp, Homo sapiens
aatgagctcgcatttgtcaatg

SEQ ID NO: 4481329 - DNA, 18 bp, Homo sapiens
aatgagcttgattaaatc

SEQ ID NO: 4481330 - DNA, 16 bp, Homo sapiens
aatgaggagagaaaat

SEQ ID NO: 4481331 - DNA, 15 bp, Homo sapiens
aatgaggtcagcatg

SEQ ID NO: 4481332 - DNA, 17 bp, Homo sapiens
aatgagtcatttgttta

SEQ ID NO: 4481333 - DNA, 18 bp, Homo sapiens
aatgagtcatttgtttaa

SEQ ID NO: 4481334 - DNA, 21 bp, Homo sapiens
aatgagtcatttgtttaaaca

SEQ ID NO: 4481335 - DNA, 15 bp, Homo sapiens
aatgagtctgtaatt

SEQ ID NO: 4481336 - DNA, 20 bp, Homo sapiens
aatgagtctgtaattttacg

SEQ ID NO: 4481337 - DNA, 12 bp, Homo sapiens
aatgataaaaca

SEQ ID NO: 4481338 - DNA, 14 bp, Homo sapiens
aatgataaagactt

SEQ ID NO: 4481339 - DNA, 15 bp, Homo sapiens
aatgataaagacttt

SEQ ID NO: 4481340 - DNA, 15 bp, Homo sapiens
aatgatactgattat

SEQ ID NO: 4481341 - DNA, 18 bp, Homo sapiens
aatgatactgattatgaa

SEQ ID NO: 4481342 - DNA, 23 bp, Homo sapiens
aatgatatactgatcttcattac

SEQ ID NO: 4481343 - DNA, 21 bp, Homo sapiens
aatgatattgctctatatgta

SEQ ID NO: 4481344 - DNA, 19 bp, Homo sapiens
aatgatcacatctaaagct

SEQ ID NO: 4481345 - DNA, 16 bp, Homo sapiens
aatgatccccagctgt

SEQ ID NO: 4481346 - DNA, 19 bp, Homo sapiens
aatgatccccagctgttta

SEQ ID NO: 4481347 - DNA, 20 bp, Homo sapiens
aatgatccccagctgtttat

SEQ ID NO: 4481348 - DNA, 19 bp, Homo sapiens
aatgatgacaaaaaatgtt

SEQ ID NO: 4481349 - DNA, 22 bp, Homo sapiens
aatgattaaaatgtttgagcac

SEQ ID NO: 4481350 - DNA, 20 bp, Homo sapiens
aatgattaagggacatttct

SEQ ID NO: 4481351 - DNA, 13 bp, Homo sapiens
aatgattatattc

SEQ ID NO: 4481352 - DNA, 21 bp, Homo sapiens
aatgattatattcacagactg

SEQ ID NO: 4481353 - DNA, 22 bp, Homo sapiens
aatgattcaaattgctgcttgg

SEQ ID NO: 4481354 - DNA, 13 bp, Homo sapiens
aatgattcagtgt

SEQ ID NO: 4481355 - DNA, 17 bp, Homo sapiens
aatgattggttaaaatg

SEQ ID NO: 4481356 - DNA, 13 bp, Homo sapiens
aatgatttcatat

SEQ ID NO: 4481357 - DNA, 14 bp, Homo sapiens
aatgatttcatatt

SEQ ID NO: 4481358 - DNA, 15 bp, Homo sapiens
aatgatttcatattg

SEQ ID NO: 4481359 - DNA, 16 bp, Homo sapiens
aatgatttcatattga

SEQ ID NO: 4481360 - DNA, 13 bp, Homo sapiens
aatgattttggaa

SEQ ID NO: 4481361 - DNA, 23 bp, Homo sapiens
aatgattttggaactgtgtttca

SEQ ID NO: 4481362 - DNA, 16 bp, Homo sapiens
aatgcaataactctgg

SEQ ID NO: 4481363 - DNA, 12 bp, Homo sapiens
aatgcaataaga

SEQ ID NO: 4481364 - DNA, 19 bp, Homo sapiens
aatgcacatatagacacat

SEQ ID NO: 4481365 - DNA, 14 bp, Homo sapiens
aatgcaccaatcag

SEQ ID NO: 4481366 - DNA, 19 bp, Homo sapiens
aatgcaccaatcttgttta

SEQ ID NO: 4481367 - DNA, 13 bp, Homo sapiens
aatgcagtacaga

SEQ ID NO: 4481368 - DNA, 15 bp, Homo sapiens
aatgcagtatatttc

SEQ ID NO: 4481369 - DNA, 15 bp, Homo sapiens
aatgcagtatggtac

SEQ ID NO: 4481370 - DNA, 22 bp, Homo sapiens
aatgcataaatgcataatttat

SEQ ID NO: 4481371 - DNA, 14 bp, Homo sapiens
aatgcatacaagtt

SEQ ID NO: 4481372 - DNA, 22 bp, Homo sapiens
aatgcatttttatcatgtaaca

SEQ ID NO: 4481373 - DNA, 18 bp, Homo sapiens
aatgccaaaatgtactta

SEQ ID NO: 4481374 - DNA, 15 bp, Homo sapiens
aatgccaaagccatt

SEQ ID NO: 4481375 - DNA, 14 bp, Homo sapiens
aatgccaatgaaca

SEQ ID NO: 4481376 - DNA, 15 bp, Homo sapiens
aatgccaatgaacat

SEQ ID NO: 4481377 - DNA, 18 bp, Homo sapiens
aatgccacctagactctc

SEQ ID NO: 4481378 - DNA, 19 bp, Homo sapiens
aatgccacctagactctcc

SEQ ID NO: 4481379 - DNA, 14 bp, Homo sapiens
aatgccacttaaca

SEQ ID NO: 4481380 - DNA, 16 bp, Homo sapiens
aatgccacttaacagg

SEQ ID NO: 4481381 - DNA, 13 bp, Homo sapiens
aatgccatgaatt

SEQ ID NO: 4481382 - DNA, 16 bp, Homo sapiens
aatgccattatccctg

SEQ ID NO: 4481383 - DNA, 14 bp, Homo sapiens
aatgcccatttttg

SEQ ID NO: 4481384 - DNA, 21 bp, Homo sapiens
aatgccgaatttggtacacat

SEQ ID NO: 4481385 - DNA, 18 bp, Homo sapiens
aatgccgcgatgggtcag

SEQ ID NO: 4481386 - DNA, 17 bp, Homo sapiens
aatgcctattgtaatat

SEQ ID NO: 4481387 - DNA, 17 bp, Homo sapiens
aatgcctgctttttgga

SEQ ID NO: 4481388 - DNA, 20 bp, Homo sapiens
aatgcctgctttttggaaag

SEQ ID NO: 4481389 - DNA, 15 bp, Homo sapiens
aatgccttgttgtat

SEQ ID NO: 4481390 - DNA, 23 bp, Homo sapiens
aatgcgtgttgtacatacagagg

SEQ ID NO: 4481391 - DNA, 16 bp, Homo sapiens
aatgctacaaaaattg

SEQ ID NO: 4481392 - DNA, 15 bp, Homo sapiens
aatgctcaagaatgt

SEQ ID NO: 4481393 - DNA, 22 bp, Homo sapiens
aatccaaaaagctctgaaaaca

SEQ ID NO: 4481394 - DNA, 13 bp, Homo sapiens
aatccaaatggcg

SEQ ID NO: 4481395 - DNA, 22 bp, Homo sapiens
aatccaagatattttaaaatct

SEQ ID NO: 4481396 - DNA, 19 bp, Homo sapiens
aatccaatattttgccttt

SEQ ID NO: 4481397 - DNA, 20 bp, Homo sapiens
aatccagactttctttttct

SEQ ID NO: 4481398 - DNA, 20 bp, Homo sapiens
aatccaggctgttctcagcg

SEQ ID NO: 4481399 - DNA, 15 bp, Homo sapiens
aatccagtttctttc

SEQ ID NO: 4481400 - DNA, 13 bp, Homo sapiens
aatccattccagg

SEQ ID NO: 4481401 - DNA, 19 bp, Homo sapiens
aatccattgaactggaaga

SEQ ID NO: 4481402 - DNA, 14 bp, Homo sapiens
aatccatttaatca

SEQ ID NO: 4481403 - DNA, 14 bp, Homo sapiens
aatccattttaaca

SEQ ID NO: 4481404 - DNA, 18 bp, Homo sapiens
aatcccaaatttgattga

SEQ ID NO: 4481405 - DNA, 15 bp, Homo sapiens
aatcccaatgtttga

SEQ ID NO: 4481406 - DNA, 12 bp, Homo sapiens
aatcccaccaga

SEQ ID NO: 4481407 - DNA, 20 bp, Homo sapiens
aatcccagcactttgggagg

SEQ ID NO: 4481408 - DNA, 16 bp, Homo sapiens
aatcccatctctacaa

SEQ ID NO: 4481409 - DNA, 23 bp, Homo sapiens
aatccccccttcagaacagaggc

SEQ ID NO: 4481410 - DNA, 18 bp, Homo sapiens
aatcccccttgccacccc

SEQ ID NO: 4481411 - DNA, 16 bp, Homo sapiens
aatccgagtgtttgcc

SEQ ID NO: 4481412 - DNA, 17 bp, Homo sapiens
aatccggtcagccaagt

SEQ ID NO: 4481413 - DNA, 14 bp, Homo sapiens
aatccgtattgaat

SEQ ID NO: 4481414 - DNA, 16 bp, Homo sapiens
aatcctaatttctcct

SEQ ID NO: 4481415 - DNA, 19 bp, Homo sapiens
aatcctaatttctcctccc

SEQ ID NO: 4481416 - DNA, 17 bp, Homo sapiens
aatcctacctcaaaatt

SEQ ID NO: 4481417 - DNA, 20 bp, Homo sapiens
aatcctaccttgcttttgct

SEQ ID NO: 4481418 - DNA, 21 bp, Homo sapiens
aatcctaccttgcttttgctt

SEQ ID NO: 4481419 - DNA, 19 bp, Homo sapiens
aatcctcctgcctcagcct

SEQ ID NO: 4481420 - DNA, 17 bp, Homo sapiens
aatcctgaactttctcc

SEQ ID NO: 4481421 - DNA, 17 bp, Homo sapiens
aatcctggaaggacaca

SEQ ID NO: 4481422 - DNA, 11 bp, Homo sapiens
aatcctgtgtt

SEQ ID NO: 4481423 - DNA, 13 bp, Homo sapiens
aatcctgtgtttc

SEQ ID NO: 4481424 - DNA, 22 bp, Homo sapiens
aatcctgtttttagtgctgact

SEQ ID NO: 4481425 - DNA, 19 bp, Homo sapiens
aatccttctattctagcct

SEQ ID NO: 4481426 - DNA, 17 bp, Homo sapiens
aatccttgataatatat

SEQ ID NO: 4481427 - DNA, 22 bp, Homo sapiens
aatccttgtgacttacaatttg

SEQ ID NO: 4481428 - DNA, 18 bp, Homo sapiens
aatcctttattattattt

SEQ ID NO: 4481429 - DNA, 17 bp, Homo sapiens
aatccttttccttattt

SEQ ID NO: 4481430 - DNA, 16 bp, Homo sapiens
aatcgaagcaaaagta

SEQ ID NO: 4481431 - DNA, 17 bp, Homo sapiens
aatcgagactgcaatgt

SEQ ID NO: 4481432 - DNA, 14 bp, Homo sapiens
aatcggactgccaa

SEQ ID NO: 4481433 - DNA, 20 bp, Homo sapiens
aatcggactgccaaattctc

SEQ ID NO: 4481434 - DNA, 23 bp, Homo sapiens
aatcgtggcacgtattgctgtgt

SEQ ID NO: 4481435 - DNA, 20 bp, Homo sapiens
aatctaaaagctctgttcca

SEQ ID NO: 4481436 - DNA, 13 bp, Homo sapiens
aatctaaaatgtt

SEQ ID NO: 4481437 - DNA, 14 bp, Homo sapiens
aatctaaaatttca

SEQ ID NO: 4481438 - DNA, 14 bp, Homo sapiens
aatctaacaatgga

SEQ ID NO: 4481439 - DNA, 14 bp, Homo sapiens
aatctaacattatt

SEQ ID NO: 4481440 - DNA, 15 bp, Homo sapiens
aatctaacattatta

SEQ ID NO: 4481441 - DNA, 14 bp, Homo sapiens
aatctaagtatatg

SEQ ID NO: 4481442 - DNA, 18 bp, Homo sapiens
aatctacaccaatgaaaa

SEQ ID NO: 4481443 - DNA, 15 bp, Homo sapiens
aatctactgtatcaa

SEQ ID NO: 4481444 - DNA, 22 bp, Homo sapiens
aatctactgtatcaataaaatt

SEQ ID NO: 4481445 - DNA, 18 bp, Homo sapiens
aatctagaagatgtgtaa

SEQ ID NO: 4481446 - DNA, 14 bp, Homo sapiens
aatctagaggaaaa

SEQ ID NO: 4481447 - DNA, 19 bp, Homo sapiens
aatctagaggaaaagaaag

SEQ ID NO: 4481448 - DNA, 22 bp, Homo sapiens
aatctatattaaatgagggttt

SEQ ID NO: 4481449 - DNA, 14 bp, Homo sapiens
aatctcaaaattag

SEQ ID NO: 4481450 - DNA, 11 bp, Homo sapiens
aatctcattcc

SEQ ID NO: 4481451 - DNA, 21 bp, Homo sapiens
aatctccaatccacacatatt

SEQ ID NO: 4481452 - DNA, 11 bp, Homo sapiens
aatctccatta

SEQ ID NO: 4481453 - DNA, 22 bp, Homo sapiens
aatctcccattttggaatttgc

SEQ ID NO: 4481454 - DNA, 18 bp, Homo sapiens
aatctcctctaaaacaac

SEQ ID NO: 4481455 - DNA, 16 bp, Homo sapiens
aatctctccattcccg

SEQ ID NO: 4481456 - DNA, 14 bp, Homo sapiens
aatctctgcccctc

SEQ ID NO: 4481457 - DNA, 17 bp, Homo sapiens
aatctcttcaaattctt

SEQ ID NO: 4481458 - DNA, 21 bp, Homo sapiens
aatctcttcatgcttgacata

SEQ ID NO: 4481459 - DNA, 15 bp, Homo sapiens
aatctcttcattatt

SEQ ID NO: 4481460 - DNA, 19 bp, Homo sapiens
aatctcttcttatacagat

SEQ ID NO: 4481461 - DNA, 21 bp, Homo sapiens
aatctgaagaggcttctcctg

SEQ ID NO: 4481462 - DNA, 13 bp, Homo sapiens
aatctgaatgtaa

SEQ ID NO: 4481463 - DNA, 16 bp, Homo sapiens
aatctgaatgtaattt

SEQ ID NO: 4481464 - DNA, 14 bp, Homo sapiens
aatctgatggcctt

SEQ ID NO: 4481465 - DNA, 15 bp, Homo sapiens
aatctgatggcctta

SEQ ID NO: 4481466 - DNA, 16 bp, Homo sapiens
aatctgatggccttaa

SEQ ID NO: 4481467 - DNA, 16 bp, Homo sapiens
aatctgcattattgga

SEQ ID NO: 4481468 - DNA, 21 bp, Homo sapiens
aatctgcttttcctctgcctt

SEQ ID NO: 4481469 - DNA, 19 bp, Homo sapiens
aatctggagagctagaacc

SEQ ID NO: 4481470 - DNA, 19 bp, Homo sapiens
aatctggatgcctcattat

SEQ ID NO: 4481471 - DNA, 23 bp, Homo sapiens
aatctggccaccccagccagcag

SEQ ID NO: 4481472 - DNA, 14 bp, Homo sapiens
aatctggcttctgc

SEQ ID NO: 4481473 - DNA, 22 bp, Homo sapiens
aatctggggaagaggttttatt

SEQ ID NO: 4481474 - DNA, 11 bp, Homo sapiens
aatctgtaaac

SEQ ID NO: 4481475 - DNA, 23 bp, Homo sapiens
aatctgtaaactgtgtattccaa

SEQ ID NO: 4481476 - DNA, 20 bp, Homo sapiens
aatctgtataatactttgta

SEQ ID NO: 4481477 - DNA, 19 bp, Homo sapiens
aatctgtcagtgtttgtat

SEQ ID NO: 4481478 - DNA, 23 bp, Homo sapiens
aatctgtgaagcctttatctatg

SEQ ID NO: 4481479 - DNA, 20 bp, Homo sapiens
aatctgtgacctgtcagaat

SEQ ID NO: 4481480 - DNA, 12 bp, Homo sapiens
aatctgtgatga

SEQ ID NO: 4481481 - DNA, 15 bp, Homo sapiens
aatctgtgcaaacag

SEQ ID NO: 4481482 - DNA, 18 bp, Homo sapiens
aatctgtgtgcatatttg

SEQ ID NO: 4481483 - DNA, 19 bp, Homo sapiens
aatctgtgtgcatatttgt

SEQ ID NO: 4481484 - DNA, 18 bp, Homo sapiens
aatctgtttctctgctgt

SEQ ID NO: 4481485 - DNA, 17 bp, Homo sapiens
aatcttaaagacaaatt

SEQ ID NO: 4481486 - DNA, 22 bp, Homo sapiens
aatcttagataacttcttgaaa

SEQ ID NO: 4481487 - DNA, 21 bp, Homo sapiens
aatcttagtatagtagaaaga

SEQ ID NO: 4481488 - DNA, 14 bp, Homo sapiens
aatcttagtgttca

SEQ ID NO: 4481489 - DNA, 13 bp, Homo sapiens
aatcttatttttc

SEQ ID NO: 4481490 - DNA, 15 bp, Homo sapiens
aatcttatttttcct

SEQ ID NO: 4481491 - DNA, 22 bp, Homo sapiens
aatcttatttttcctgtcctgc

SEQ ID NO: 4481492 - DNA, 23 bp, Homo sapiens
aatcttgccttctggtttcttcc

SEQ ID NO: 4481493 - DNA, 19 bp, Homo sapiens
aatcttggttgatgccaaa

SEQ ID NO: 4481494 - DNA, 19 bp, Homo sapiens
aatcttgtaggtcattgca

SEQ ID NO: 4481495 - DNA, 21 bp, Homo sapiens
aatcttgttactgctgattct

SEQ ID NO: 4481496 - DNA, 23 bp, Homo sapiens
aatcttgtttgttactgtcattc

SEQ ID NO: 4481497 - DNA, 17 bp, Homo sapiens
aatcttgttttgaaaat

SEQ ID NO: 4481498 - DNA, 22 bp, Homo sapiens
aatctttacctgtatacagtgc

SEQ ID NO: 4481499 - DNA, 23 bp, Homo sapiens
aatctttacctgtatacagtgca

SEQ ID NO: 4481500 - DNA, 21 bp, Homo sapiens
aatctttgaaaggttagagaa

SEQ ID NO: 4481501 - DNA, 14 bp, Homo sapiens
aatctttgaaataa

SEQ ID NO: 4481502 - DNA, 18 bp, Homo sapiens
aatctttgtaccaaaatt

SEQ ID NO: 4481503 - DNA, 20 bp, Homo sapiens
aatctttgtaccaaaatttt

SEQ ID NO: 4481504 - DNA, 12 bp, Homo sapiens
aatcttttacaa

SEQ ID NO: 4481505 - DNA, 23 bp, Homo sapiens
aatcttttacaactgcctcgaaa

SEQ ID NO: 4481506 - DNA, 21 bp, Homo sapiens
aatctttttatcccatttagt

SEQ ID NO: 4481507 - DNA, 15 bp, Homo sapiens
aatctttttgcttct

SEQ ID NO: 4481508 - DNA, 19 bp, Homo sapiens
aatctttttgcttctactt

SEQ ID NO: 4481509 - DNA, 17 bp, Homo sapiens
aatgaaaacatgtacta

SEQ ID NO: 4481510 - DNA, 19 bp, Homo sapiens
aatgaaaacatgtactaca

SEQ ID NO: 4481511 - DNA, 22 bp, Homo sapiens
aatgaaaacatgtactacagct

SEQ ID NO: 4481512 - DNA, 17 bp, Homo sapiens
aatgaaaataaaacaca

SEQ ID NO: 4481513 - DNA, 13 bp, Homo sapiens
cagagctttgtca

SEQ ID NO: 4481514 - DNA, 16 bp, Homo sapiens
cagagctttgtcactt

SEQ ID NO: 4481515 - DNA, 22 bp, Homo sapiens
cagagctttgtcacttgccaca

SEQ ID NO: 4481516 - DNA, 13 bp, Homo sapiens
cagagcttttcag

SEQ ID NO: 4481517 - DNA, 14 bp, Homo sapiens
cagagcttttcaga

SEQ ID NO: 4481518 - DNA, 15 bp, Homo sapiens
cagagcttttcagat

SEQ ID NO: 4481519 - DNA, 18 bp, Homo sapiens
cagaggaaagggctggct

SEQ ID NO: 4481520 - DNA, 19 bp, Homo sapiens
cagaggaaagggctggctc

SEQ ID NO: 4481521 - DNA, 20 bp, Homo sapiens
cagaggaaagggctggctcc

SEQ ID NO: 4481522 - DNA, 15 bp, Homo sapiens
cagaggaagcccagc

SEQ ID NO: 4481523 - DNA, 19 bp, Homo sapiens
cagaggaaggggccagagg

SEQ ID NO: 4481524 - DNA, 14 bp, Homo sapiens
cagaggacctgtat

SEQ ID NO: 4481525 - DNA, 17 bp, Homo sapiens
cagaggacctgtattta

SEQ ID NO: 4481526 - DNA, 21 bp, Homo sapiens
cagaggacctgtatttaagca

SEQ ID NO: 4481527 - DNA, 18 bp, Homo sapiens
cagaggagccaccagttc

SEQ ID NO: 4481528 - DNA, 11 bp, Homo sapiens
cagaggagctt

SEQ ID NO: 4481529 - DNA, 20 bp, Homo sapiens
cagaggagcttttctggaat

SEQ ID NO: 4481530 - DNA, 18 bp, Homo sapiens
cagaggatgtggcctggt

SEQ ID NO: 4481531 - DNA, 21 bp, Homo sapiens
cagaggattgctgccccatca

SEQ ID NO: 4481532 - DNA, 18 bp, Homo sapiens
cagaggcagaggttgcag

SEQ ID NO: 4481533 - DNA, 19 bp, Homo sapiens
cagaggcagaggttgcagt

SEQ ID NO: 4481534 - DNA, 15 bp, Homo sapiens
cagaggcaggctggg

SEQ ID NO: 4481535 - DNA, 15 bp, Homo sapiens
cagaggccacttgct

SEQ ID NO: 4481536 - DNA, 20 bp, Homo sapiens
cagaggccacttgcttgctg

SEQ ID NO: 4481537 - DNA, 15 bp, Homo sapiens
cagaggccagaccca

SEQ ID NO: 4481538 - DNA, 11 bp, Homo sapiens
cagaggcccca

SEQ ID NO: 4481539 - DNA, 12 bp, Homo sapiens
cagaggccccac

SEQ ID NO: 4481540 - DNA, 21 bp, Homo sapiens
cagaggccccacctgaagggt

SEQ ID NO: 4481541 - DNA, 11 bp, Homo sapiens
cagaggccctg

SEQ ID NO: 4481542 - DNA, 15 bp, Homo sapiens
cagaggccctgcccc

SEQ ID NO: 4481543 - DNA, 20 bp, Homo sapiens
cagaggccctgcccccaccc

SEQ ID NO: 4481544 - DNA, 12 bp, Homo sapiens
cagaggccctgg

SEQ ID NO: 4481545 - DNA, 14 bp, Homo sapiens
cagaggccctggag

SEQ ID NO: 4481546 - DNA, 17 bp, Homo sapiens
cagaggccctggaggga

SEQ ID NO: 4481547 - DNA, 12 bp, Homo sapiens
cagaggcctgac

SEQ ID NO: 4481548 - DNA, 14 bp, Homo sapiens
cagaggcctgactg

SEQ ID NO: 4481549 - DNA, 13 bp, Homo sapiens
cagaggcctgccc

SEQ ID NO: 4481550 - DNA, 16 bp, Homo sapiens
cagaggcctgctgcca

SEQ ID NO: 4481551 - DNA, 22 bp, Homo sapiens
cagaggcctgctgccagtgcag

SEQ ID NO: 4481552 - DNA, 23 bp, Homo sapiens
cagaggctaattcagtgtcacat

SEQ ID NO: 4481553 - DNA, 14 bp, Homo sapiens
cagaggctggaggc

SEQ ID NO: 4481554 - DNA, 17 bp, Homo sapiens
cagaggctggaggcagg

SEQ ID NO: 4481555 - DNA, 21 bp, Homo sapiens
cagaggctggaggcagggcct

SEQ ID NO: 4481556 - DNA, 15 bp, Homo sapiens
cagaggcttcttcag

SEQ ID NO: 4481557 - DNA, 20 bp, Homo sapiens
cagagggaccaaattgcttc

SEQ ID NO: 4481558 - DNA, 21 bp, Homo sapiens
cagagggaccaaattgcttct

SEQ ID NO: 4481559 - DNA, 22 bp, Homo sapiens
cagagggaccaaattgcttcta

SEQ ID NO: 4481560 - DNA, 19 bp, Homo sapiens
cagagggagaatccaaggg

SEQ ID NO: 4481561 - DNA, 18 bp, Homo sapiens
cagagggagacagggctg

SEQ ID NO: 4481562 - DNA, 23 bp, Homo sapiens
cagagggagacagggctgctccc

SEQ ID NO: 4481563 - DNA, 12 bp, Homo sapiens
cagagggagttt

SEQ ID NO: 4481564 - DNA, 12 bp, Homo sapiens
cagagggcacat

SEQ ID NO: 4481565 - DNA, 17 bp, Homo sapiens
cagagggcacatgaaca

SEQ ID NO: 4481566 - DNA, 18 bp, Homo sapiens
cagagggcacatgaacag

SEQ ID NO: 4481567 - DNA, 17 bp, Homo sapiens
cagagggcagaggctgg

SEQ ID NO: 4481568 - DNA, 11 bp, Homo sapiens
cagagggctgg

SEQ ID NO: 4481569 - DNA, 13 bp, Homo sapiens
cagagggctggag

SEQ ID NO: 4481570 - DNA, 17 bp, Homo sapiens
cagagggctggaggccc

SEQ ID NO: 4481571 - DNA, 19 bp, Homo sapiens
cagagggctggaggcccag

SEQ ID NO: 4481572 - DNA, 20 bp, Homo sapiens
cagagggctggaggcccagg

SEQ ID NO: 4481573 - DNA, 21 bp, Homo sapiens
cagagggctggaggcccaggc

SEQ ID NO: 4481574 - DNA, 22 bp, Homo sapiens
cagaggtagtctcactgcttga

SEQ ID NO: 4481575 - DNA, 13 bp, Homo sapiens
cagaggtcacttc

SEQ ID NO: 4481576 - DNA, 14 bp, Homo sapiens
cagaggtccaggtc

SEQ ID NO: 4481577 - DNA, 13 bp, Homo sapiens
cagaggtggcagg

SEQ ID NO: 4481578 - DNA, 19 bp, Homo sapiens
cagaggtgggatcctccct

SEQ ID NO: 4481579 - DNA, 17 bp, Homo sapiens
cagaggttgcagtgagc

SEQ ID NO: 4481580 - DNA, 22 bp, Homo sapiens
cagaggttgcagtgagctgaga

SEQ ID NO: 4481581 - DNA, 20 bp, Homo sapiens
cagaggttgtagtgagccaa

SEQ ID NO: 4481582 - DNA, 16 bp, Homo sapiens
cagagtaacaggatca

SEQ ID NO: 4481583 - DNA, 20 bp, Homo sapiens
cagagtatgtccgatggtat

SEQ ID NO: 4481584 - DNA, 22 bp, Homo sapiens
cagagtatgtccgatggtatct

SEQ ID NO: 4481585 - DNA, 23 bp, Homo sapiens
cagagtcagaggagaagagacat

SEQ ID NO: 4481586 - DNA, 22 bp, Homo sapiens
cagagtccagtgctctgcctca

SEQ ID NO: 4481587 - DNA, 20 bp, Homo sapiens
cagagtcttcactaaccttt

SEQ ID NO: 4481588 - DNA, 21 bp, Homo sapiens
cagagtgaatgtcccccatca

SEQ ID NO: 4481589 - DNA, 14 bp, Homo sapiens
cagagtgagaccca

SEQ ID NO: 4481590 - DNA, 14 bp, Homo sapiens
cagagtgccactgc

SEQ ID NO: 4481591 - DNA, 15 bp, Homo sapiens
cagagtgctggactg

SEQ ID NO: 4481592 - DNA, 15 bp, Homo sapiens
cagagtgcttttctg

SEQ ID NO: 4481593 - DNA, 13 bp, Homo sapiens
cagagtggcccac

SEQ ID NO: 4481594 - DNA, 23 bp, Homo sapiens
cagagtggcctccctgctgtgcc

SEQ ID NO: 4481595 - DNA, 16 bp, Homo sapiens
cagagtggtttccaat

SEQ ID NO: 4481596 - DNA, 13 bp, Homo sapiens
cagagttacagtt

SEQ ID NO: 4481597 - DNA, 18 bp, Homo sapiens
cagagttacagttctgtg

SEQ ID NO: 4481598 - DNA, 18 bp, Homo sapiens
cagagttcagacttcgct

SEQ ID NO: 4481599 - DNA, 15 bp, Homo sapiens
cagagtttctgcagt

SEQ ID NO: 4481600 - DNA, 22 bp, Homo sapiens
cagataacttttttgagtcatt

SEQ ID NO: 4481601 - DNA, 18 bp, Homo sapiens
cagataccttgaaaggaa

SEQ ID NO: 4481602 - DNA, 17 bp, Homo sapiens
cagatataactgtcttg

SEQ ID NO: 4481603 - DNA, 18 bp, Homo sapiens
cagatattgttataaata

SEQ ID NO: 4481604 - DNA, 18 bp, Homo sapiens
cagatcaggagagcaagg

SEQ ID NO: 4481605 - DNA, 19 bp, Homo sapiens
cagatcctctctggggctg

SEQ ID NO: 4481606 - DNA, 23 bp, Homo sapiens
cagatcctgggtactgaaagcct

SEQ ID NO: 4481607 - DNA, 19 bp, Homo sapiens
cagatctatatggcaaata

SEQ ID NO: 4481608 - DNA, 15 bp, Homo sapiens
cagatctgtctccaa

SEQ ID NO: 4481609 - DNA, 16 bp, Homo sapiens
cagatctgtctccaag

SEQ ID NO: 4481610 - DNA, 18 bp, Homo sapiens
cagatctgtctgatagga

SEQ ID NO: 4481611 - DNA, 17 bp, Homo sapiens
cagatgagagtttctgg

SEQ ID NO: 4481612 - DNA, 16 bp, Homo sapiens
cagatgaggcccccgc

SEQ ID NO: 4481613 - DNA, 21 bp, Homo sapiens
cagatgaggtcaacacaggta

SEQ ID NO: 4481614 - DNA, 15 bp, Homo sapiens
cagatgatgccagct

SEQ ID NO: 4481615 - DNA, 17 bp, Homo sapiens
cagatgatgccagctgt

SEQ ID NO: 4481616 - DNA, 14 bp, Homo sapiens
cagatgcagggctg

SEQ ID NO: 4481617 - DNA, 17 bp, Homo sapiens
cagatgcccgagcaccg

SEQ ID NO: 4481618 - DNA, 14 bp, Homo sapiens
cagatgcctggtga

SEQ ID NO: 4481619 - DNA, 17 bp, Homo sapiens
cagatgcctggtgagca

SEQ ID NO: 4481620 - DNA, 16 bp, Homo sapiens
cagatgcgtgcccagc

SEQ ID NO: 4481621 - DNA, 22 bp, Homo sapiens
cagatgctgaattgagaataag

SEQ ID NO: 4481622 - DNA, 23 bp, Homo sapiens
cagatgctggtggaggaagggct

SEQ ID NO: 4481623 - DNA, 14 bp, Homo sapiens
cagatgctttcctg

SEQ ID NO: 4481624 - DNA, 21 bp, Homo sapiens
cagatgctttcctgcacatta

SEQ ID NO: 4481625 - DNA, 19 bp, Homo sapiens
cagatggaaaattcatttt

SEQ ID NO: 4481626 - DNA, 19 bp, Homo sapiens
cagatggactccagcctgc

SEQ ID NO: 4481627 - DNA, 18 bp, Homo sapiens
cagatggagcaaatgtcc

SEQ ID NO: 4481628 - DNA, 16 bp, Homo sapiens
cagatggcccctccac

SEQ ID NO: 4481629 - DNA, 18 bp, Homo sapiens
cagatggcccctccactg

SEQ ID NO: 4481630 - DNA, 14 bp, Homo sapiens
cagatggtgtcatt

SEQ ID NO: 4481631 - DNA, 12 bp, Homo sapiens
cagatgtaatgt

SEQ ID NO: 4481632 - DNA, 13 bp, Homo sapiens
cagatgtaatgtt

SEQ ID NO: 4481633 - DNA, 14 bp, Homo sapiens
cagatgtaatgttt

SEQ ID NO: 4481634 - DNA, 18 bp, Homo sapiens
cagacccaggagtccaga

SEQ ID NO: 4481635 - DNA, 21 bp, Homo sapiens
cagacccaggagtccagaccc

SEQ ID NO: 4481636 - DNA, 19 bp, Homo sapiens
cagacccaggagtccagcc

SEQ ID NO: 4481637 - DNA, 18 bp, Homo sapiens
cagacccaggggtccagg

SEQ ID NO: 4481638 - DNA, 12 bp, Homo sapiens
cagaccccagcg

SEQ ID NO: 4481639 - DNA, 15 bp, Homo sapiens
cagaccccagcggct

SEQ ID NO: 4481640 - DNA, 16 bp, Homo sapiens
cagacccccactctca

SEQ ID NO: 4481641 - DNA, 13 bp, Homo sapiens
cagaccccctgag

SEQ ID NO: 4481642 - DNA, 11 bp, Homo sapiens
cagacccctgc

SEQ ID NO: 4481643 - DNA, 15 bp, Homo sapiens
cagaccctaccccac

SEQ ID NO: 4481644 - DNA, 20 bp, Homo sapiens
cagacctagcaggctgttcc

SEQ ID NO: 4481645 - DNA, 13 bp, Homo sapiens
cagacctgagcgg

SEQ ID NO: 4481646 - DNA, 11 bp, Homo sapiens
cagacctggag

SEQ ID NO: 4481647 - DNA, 13 bp, Homo sapiens
cagacctgtcctc

SEQ ID NO: 4481648 - DNA, 14 bp, Homo sapiens
cagacgagacaaca

SEQ ID NO: 4481649 - DNA, 18 bp, Homo sapiens
cagacgagacaacagcac

SEQ ID NO: 4481650 - DNA, 22 bp, Homo sapiens
cagacggatgcccattcctgcc

SEQ ID NO: 4481651 - DNA, 17 bp, Homo sapiens
cagacgggctgagagga

SEQ ID NO: 4481652 - DNA, 17 bp, Homo sapiens
cagacggtctgtgtgct

SEQ ID NO: 4481653 - DNA, 21 bp, Homo sapiens
cagacggtctgtgtgctgttt

SEQ ID NO: 4481654 - DNA, 22 bp, Homo sapiens
cagacgtctgtcaggggcttgg

SEQ ID NO: 4481655 - DNA, 23 bp, Homo sapiens
cagacgtctgtcaggggcttgga

SEQ ID NO: 4481656 - DNA, 18 bp, Homo sapiens
cagacgtgtgacctccat

SEQ ID NO: 4481657 - DNA, 15 bp, Homo sapiens
cagacgttgcctgag

SEQ ID NO: 4481658 - DNA, 18 bp, Homo sapiens
cagacgttgcctgagaag

SEQ ID NO: 4481659 - DNA, 20 bp, Homo sapiens
cagactagatgtagtatttt

SEQ ID NO: 4481660 - DNA, 19 bp, Homo sapiens
cagactagccactcctgcc

SEQ ID NO: 4481661 - DNA, 21 bp, Homo sapiens
cagactatttgctaatgtata

SEQ ID NO: 4481662 - DNA, 17 bp, Homo sapiens
cagactcagaggtccag

SEQ ID NO: 4481663 - DNA, 18 bp, Homo sapiens
cagactcagaggtccagg

SEQ ID NO: 4481664 - DNA, 21 bp, Homo sapiens
cagactcagaggtccaggccc

SEQ ID NO: 4481665 - DNA, 22 bp, Homo sapiens
cagactccatctcttctgcaag

SEQ ID NO: 4481666 - DNA, 18 bp, Homo sapiens
cagactccttcaacaatt

SEQ ID NO: 4481667 - DNA, 17 bp, Homo sapiens
cagactctcagcccaga

SEQ ID NO: 4481668 - DNA, 12 bp, Homo sapiens
cagactctcagg

SEQ ID NO: 4481669 - DNA, 13 bp, Homo sapiens
cagactctcaggt

SEQ ID NO: 4481670 - DNA, 14 bp, Homo sapiens
cagactcttcacag

SEQ ID NO: 4481671 - DNA, 15 bp, Homo sapiens
cagactgacactact

SEQ ID NO: 4481672 - DNA, 14 bp, Homo sapiens
cagactgatgagca

SEQ ID NO: 4481673 - DNA, 19 bp, Homo sapiens
cagactgatgagcacatct

SEQ ID NO: 4481674 - DNA, 23 bp, Homo sapiens
cagactgcagaggggaaagactt

SEQ ID NO: 4481675 - DNA, 15 bp, Homo sapiens
cagactgcctgtctg

SEQ ID NO: 4481676 - DNA, 18 bp, Homo sapiens
cagactgcctgtctgctt

SEQ ID NO: 4481677 - DNA, 21 bp, Homo sapiens
cagactgcctgtctgcttgca

SEQ ID NO: 4481678 - DNA, 23 bp, Homo sapiens
cagactggcggagaaggagagga

SEQ ID NO: 4481679 - DNA, 22 bp, Homo sapiens
cagacttccaaatcctggaagg

SEQ ID NO: 4481680 - DNA, 12 bp, Homo sapiens
cagacttcccac

SEQ ID NO: 4481681 - DNA, 14 bp, Homo sapiens
cagacttcccagct

SEQ ID NO: 4481682 - DNA, 16 bp, Homo sapiens
cagactttctttttct

SEQ ID NO: 4481683 - DNA, 12 bp, Homo sapiens
cagagaaaaagg

SEQ ID NO: 4481684 - DNA, 18 bp, Homo sapiens
cagagaaaaatgctcccc

SEQ ID NO: 4481685 - DNA, 19 bp, Homo sapiens
cagagaaaatgagaaagga

SEQ ID NO: 4481686 - DNA, 24 bp, Homo sapiens
cagagaaaatgagaaaggacagag

SEQ ID NO: 4481687 - DNA, 22 bp, Homo sapiens
cagagaaagaaagggaaactgg

SEQ ID NO: 4481688 - DNA, 16 bp, Homo sapiens
cagagaaatacaaaat

SEQ ID NO: 4481689 - DNA, 17 bp, Homo sapiens
cagagaagccccttccc

SEQ ID NO: 4481690 - DNA, 14 bp, Homo sapiens
cagagaaggaaaag

SEQ ID NO: 4481691 - DNA, 13 bp, Homo sapiens
cagagaatttcta

SEQ ID NO: 4481692 - DNA, 20 bp, Homo sapiens
cagagaatttctaaagtaaa

SEQ ID NO: 4481693 - DNA, 14 bp, Homo sapiens
cagagacaacaggt

SEQ ID NO: 4481694 - DNA, 15 bp, Homo sapiens
cagagacaagtaatt

SEQ ID NO: 4481695 - DNA, 13 bp, Homo sapiens
cagagacacctgc

SEQ ID NO: 4481696 - DNA, 14 bp, Homo sapiens
cagagacactgagc

SEQ ID NO: 4481697 - DNA, 16 bp, Homo sapiens
cagagacactgagcca

SEQ ID NO: 4481698 - DNA, 18 bp, Homo sapiens
cagagacactgagccagt

SEQ ID NO: 4481699 - DNA, 21 bp, Homo sapiens
cagagacaggaaaatcctctg

SEQ ID NO: 4481700 - DNA, 16 bp, Homo sapiens
cagagaccacaccact

SEQ ID NO: 4481701 - DNA, 23 bp, Homo sapiens
cagagagacctcatcctgctctt

SEQ ID NO: 4481702 - DNA, 20 bp, Homo sapiens
cagagaggcactcagtgagc

SEQ ID NO: 4481703 - DNA, 14 bp, Homo sapiens
cagagatctccctt

SEQ ID NO: 4481704 - DNA, 18 bp, Homo sapiens
cagagatgcctccaccgc

SEQ ID NO: 4481705 - DNA, 21 bp, Homo sapiens
cagagatgcctccaccgctgc

SEQ ID NO: 4481706 - DNA, 14 bp, Homo sapiens
cagagatgtgcacc

SEQ ID NO: 4481707 - DNA, 14 bp, Homo sapiens
cagagattcatttt

SEQ ID NO: 4481708 - DNA, 17 bp, Homo sapiens
cagagcaaacagaaaaa

SEQ ID NO: 4481709 - DNA, 20 bp, Homo sapiens
cagagcaagaccctgtctca

SEQ ID NO: 4481710 - DNA, 20 bp, Homo sapiens
cagagcaagagtctgtctca

SEQ ID NO: 4481711 - DNA, 15 bp, Homo sapiens
cagagcaccccctgc

SEQ ID NO: 4481712 - DNA, 20 bp, Homo sapiens
cagagcaccccctgctccac

SEQ ID NO: 4481713 - DNA, 14 bp, Homo sapiens
cagagcacctgtag

SEQ ID NO: 4481714 - DNA, 14 bp, Homo sapiens
cagagcactcccta

SEQ ID NO: 4481715 - DNA, 21 bp, Homo sapiens
cagagcactttaaaaacaggc

SEQ ID NO: 4481716 - DNA, 12 bp, Homo sapiens
cagagcagagcc

SEQ ID NO: 4481717 - DNA, 14 bp, Homo sapiens
cagagcaggactgc

SEQ ID NO: 4481718 - DNA, 18 bp, Homo sapiens
cagagcaggggctccagc

SEQ ID NO: 4481719 - DNA, 16 bp, Homo sapiens
cagagcatctgcccca

SEQ ID NO: 4481720 - DNA, 20 bp, Homo sapiens
cagagcatctgccccaggta

SEQ ID NO: 4481721 - DNA, 13 bp, Homo sapiens
cagagccacctgg

SEQ ID NO: 4481722 - DNA, 14 bp, Homo sapiens
cagagccagcctgg

SEQ ID NO: 4481723 - DNA, 17 bp, Homo sapiens
cagagccagcctggctc

SEQ ID NO: 4481724 - DNA, 22 bp, Homo sapiens
cagagccagcctggctctgccc

SEQ ID NO: 4481725 - DNA, 23 bp, Homo sapiens
cagagccagcctggctctgcccc

SEQ ID NO: 4481726 - DNA, 13 bp, Homo sapiens
cagagccagggca

SEQ ID NO: 4481727 - DNA, 16 bp, Homo sapiens
cagagccagggcaggg

SEQ ID NO: 4481728 - DNA, 18 bp, Homo sapiens
cagagccagggcagggcg

SEQ ID NO: 4481729 - DNA, 14 bp, Homo sapiens
cagagccccaagca

SEQ ID NO: 4481730 - DNA, 16 bp, Homo sapiens
cagagccccaagcagg

SEQ ID NO: 4481731 - DNA, 13 bp, Homo sapiens
cagagccccacag

SEQ ID NO: 4481732 - DNA, 15 bp, Homo sapiens
cagagccccacagcc

SEQ ID NO: 4481733 - DNA, 14 bp, Homo sapiens
cagagcccccctag

SEQ ID NO: 4481734 - DNA, 14 bp, Homo sapiens
cagagccgggagga

SEQ ID NO: 4481735 - DNA, 23 bp, Homo sapiens
cagagcctcccaaggagaacaaa

SEQ ID NO: 4481736 - DNA, 14 bp, Homo sapiens
cagagcctgaattt

SEQ ID NO: 4481737 - DNA, 18 bp, Homo sapiens
cagagcctgacgctcagc

SEQ ID NO: 4481738 - DNA, 20 bp, Homo sapiens
cagagcctgacgctcagccc

SEQ ID NO: 4481739 - DNA, 22 bp, Homo sapiens
cagagcctgacgctcagcccca

SEQ ID NO: 4481740 - DNA, 20 bp, Homo sapiens
cagagcctggggtgttctct

SEQ ID NO: 4481741 - DNA, 16 bp, Homo sapiens
cagagccttcaagtgc

SEQ ID NO: 4481742 - DNA, 20 bp, Homo sapiens
cagagccttcaagtgccaaa

SEQ ID NO: 4481743 - DNA, 21 bp, Homo sapiens
cagagccttctcagaagcaca

SEQ ID NO: 4481744 - DNA, 20 bp, Homo sapiens
cagagcgagactccatctct

SEQ ID NO: 4481745 - DNA, 15 bp, Homo sapiens
cagagcgcacaggga

SEQ ID NO: 4481746 - DNA, 20 bp, Homo sapiens
cagagcgccaggaagccaga

SEQ ID NO: 4481747 - DNA, 14 bp, Homo sapiens
cagagcgtccttgg

SEQ ID NO: 4481748 - DNA, 22 bp, Homo sapiens
cagagctgccgacttggagact

SEQ ID NO: 4481749 - DNA, 18 bp, Homo sapiens
cagagctggcgctcagca

SEQ ID NO: 4481750 - DNA, 19 bp, Homo sapiens
cagagctggcgctcagcag

SEQ ID NO: 4481751 - DNA, 20 bp, Homo sapiens
cagagctgtttatggcctca

SEQ ID NO: 4481752 - DNA, 22 bp, Homo sapiens
cagagctgtttatggcctcagc

SEQ ID NO: 4481753 - DNA, 23 bp, Homo sapiens
cagagcttccctgactcattctg

SEQ ID NO: 4481754 - DNA, 18 bp, Homo sapiens
cagagcttgtggaaagcg

SEQ ID NO: 4481755 - DNA, 19 bp, Homo sapiens
cagaagggggtggtgtctc

SEQ ID NO: 4481756 - DNA, 20 bp, Homo sapiens
cagaagggggtggtgtctcc

SEQ ID NO: 4481757 - DNA, 21 bp, Homo sapiens
cagaagggggtggtgtctcca

SEQ ID NO: 4481758 - DNA, 13 bp, Homo sapiens
cagaagtaagcct

SEQ ID NO: 4481759 - DNA, 16 bp, Homo sapiens
cagaagtcatcttgct

SEQ ID NO: 4481760 - DNA, 20 bp, Homo sapiens
cagaagtccacaggacgcac

SEQ ID NO: 4481761 - DNA, 14 bp, Homo sapiens
cagaagtgcatctg

SEQ ID NO: 4481762 - DNA, 17 bp, Homo sapiens
cagaagtgtgactggct

SEQ ID NO: 4481763 - DNA, 19 bp, Homo sapiens
cagaagtgtttcagatttt

SEQ ID NO: 4481764 - DNA, 23 bp, Homo sapiens
cagaagtgtttcagattttttaa

SEQ ID NO: 4481765 - DNA, 19 bp, Homo sapiens
cagaagttagtttgtatat

SEQ ID NO: 4481766 - DNA, 21 bp, Homo sapiens
cagaataagttattgcagttt

SEQ ID NO: 4481767 - DNA, 20 bp, Homo sapiens
cagaataatcaaatacattt

SEQ ID NO: 4481768 - DNA, 15 bp, Homo sapiens
cagaataatcctgtt

SEQ ID NO: 4481769 - DNA, 19 bp, Homo sapiens
cagaataatcctgttttac

SEQ ID NO: 4481770 - DNA, 15 bp, Homo sapiens
cagaatagccacatt

SEQ ID NO: 4481771 - DNA, 21 bp, Homo sapiens
cagaatatttttatatttcct

SEQ ID NO: 4481772 - DNA, 15 bp, Homo sapiens
cagaatctgaatgta

SEQ ID NO: 4481773 - DNA, 20 bp, Homo sapiens
cagaatcttgttttgaaaat

SEQ ID NO: 4481774 - DNA, 19 bp, Homo sapiens
cagaatgcggcctctgaga

SEQ ID NO: 4481775 - DNA, 16 bp, Homo sapiens
cagaatgctgtacatc

SEQ ID NO: 4481776 - DNA, 16 bp, Homo sapiens
cagaatgtaaaaaaga

SEQ ID NO: 4481777 - DNA, 12 bp, Homo sapiens
cagaatgtcaga

SEQ ID NO: 4481778 - DNA, 21 bp, Homo sapiens
cagaatgtcattttggtactt

SEQ ID NO: 4481779 - DNA, 17 bp, Homo sapiens
cagaatgtgaaaaagga

SEQ ID NO: 4481780 - DNA, 15 bp, Homo sapiens
cagaatgtgttcttt

SEQ ID NO: 4481781 - DNA, 20 bp, Homo sapiens
cagaatgtgttcttttctcc

SEQ ID NO: 4481782 - DNA, 15 bp, Homo sapiens
cagaattcaaaagtg

SEQ ID NO: 4481783 - DNA, 16 bp, Homo sapiens
cagaattcaaaagtga

SEQ ID NO: 4481784 - DNA, 14 bp, Homo sapiens
cagaattggcataa

SEQ ID NO: 4481785 - DNA, 18 bp, Homo sapiens
cagaattggcataatttg

SEQ ID NO: 4481786 - DNA, 13 bp, Homo sapiens
cagaatttgaatt

SEQ ID NO: 4481787 - DNA, 22 bp, Homo sapiens
cagaatttgtgttgaaggaact

SEQ ID NO: 4481788 - DNA, 19 bp, Homo sapiens
cagaattttctggcctttc

SEQ ID NO: 4481789 - DNA, 18 bp, Homo sapiens
cagacaaaaacagcctca

SEQ ID NO: 4481790 - DNA, 11 bp, Homo sapiens
cagacaaaatg

SEQ ID NO: 4481791 - DNA, 20 bp, Homo sapiens
cagacaaaatgaaagaaaat

SEQ ID NO: 4481792 - DNA, 23 bp, Homo sapiens
cagacaaagatgtcttaacctca

SEQ ID NO: 4481793 - DNA, 21 bp, Homo sapiens
cagacaacaccttcctcctgc

SEQ ID NO: 4481794 - DNA, 21 bp, Homo sapiens
cagacaagagggcaagcctct

SEQ ID NO: 4481795 - DNA, 12 bp, Homo sapiens
cagacaaggagg

SEQ ID NO: 4481796 - DNA, 22 bp, Homo sapiens
cagacaataaaccctcagagcc

SEQ ID NO: 4481797 - DNA, 21 bp, Homo sapiens
cagacacctaaccccagggca

SEQ ID NO: 4481798 - DNA, 15 bp, Homo sapiens
cagacacctggactg

SEQ ID NO: 4481799 - DNA, 19 bp, Homo sapiens
cagacacgagccacctcac

SEQ ID NO: 4481800 - DNA, 19 bp, Homo sapiens
cagacactaaatgcagaca

SEQ ID NO: 4481801 - DNA, 19 bp, Homo sapiens
cagacagatgttgggagga

SEQ ID NO: 4481802 - DNA, 21 bp, Homo sapiens
cagacagatgttgggaggata

SEQ ID NO: 4481803 - DNA, 16 bp, Homo sapiens
cagacagcctgtatct

SEQ ID NO: 4481804 - DNA, 21 bp, Homo sapiens
cagacaggagaaatgcatcca

SEQ ID NO: 4481805 - DNA, 13 bp, Homo sapiens
cagacaggccctc

SEQ ID NO: 4481806 - DNA, 23 bp, Homo sapiens
cagacagggtgggcttcctgccc

SEQ ID NO: 4481807 - DNA, 17 bp, Homo sapiens
cagacatagaattaaca

SEQ ID NO: 4481808 - DNA, 18 bp, Homo sapiens
cagacatatgggatattc

SEQ ID NO: 4481809 - DNA, 22 bp, Homo sapiens
cagacatcatgttacttaaaaa

SEQ ID NO: 4481810 - DNA, 20 bp, Homo sapiens
cagacatctgaggttttatt

SEQ ID NO: 4481811 - DNA, 22 bp, Homo sapiens
cagacattcacctgtatatttc

SEQ ID NO: 4481812 - DNA, 21 bp, Homo sapiens
cagacattgttacaaggacat

SEQ ID NO: 4481813 - DNA, 13 bp, Homo sapiens
cagacatttatct

SEQ ID NO: 4481814 - DNA, 13 bp, Homo sapiens
cagacattttaaa

SEQ ID NO: 4481815 - DNA, 20 bp, Homo sapiens
cagaccaaggcgagtttccc

SEQ ID NO: 4481816 - DNA, 12 bp, Homo sapiens
cagaccacagga

SEQ ID NO: 4481817 - DNA, 16 bp, Homo sapiens
cagaccacttgccacg

SEQ ID NO: 4481818 - DNA, 16 bp, Homo sapiens
cagaccagagctgtct

SEQ ID NO: 4481819 - DNA, 22 bp, Homo sapiens
cagaccagagctgtctgaactc

SEQ ID NO: 4481820 - DNA, 19 bp, Homo sapiens
cagaccattggggctccca

SEQ ID NO: 4481821 - DNA, 20 bp, Homo sapiens
cagaccattggggctcccag

SEQ ID NO: 4481822 - DNA, 23 bp, Homo sapiens
cagacccactcccaaagctcaga

SEQ ID NO: 4481823 - DNA, 10 bp, Homo sapiens
cagacccaga

SEQ ID NO: 4481824 - DNA, 11 bp, Homo sapiens
cagacccagcg

SEQ ID NO: 4481825 - DNA, 19 bp, Homo sapiens
cagacccaggacccccgag

SEQ ID NO: 4481826 - DNA, 20 bp, Homo sapiens
cagcccattctctctcctgt

SEQ ID NO: 4481827 - DNA, 21 bp, Homo sapiens
cagcccattctctctcctgtc

SEQ ID NO: 4481828 - DNA, 17 bp, Homo sapiens
cagccccaactccaggg

SEQ ID NO: 4481829 - DNA, 13 bp, Homo sapiens
cagccccacttca

SEQ ID NO: 4481830 - DNA, 15 bp, Homo sapiens
cagccccagcccaga

SEQ ID NO: 4481831 - DNA, 16 bp, Homo sapiens
cagccccaggccagct

SEQ ID NO: 4481832 - DNA, 23 bp, Homo sapiens
cagccccatcagaacctgagcta

SEQ ID NO: 4481833 - DNA, 19 bp, Homo sapiens
cagcccccacagtgctgtc

SEQ ID NO: 4481834 - DNA, 21 bp, Homo sapiens
cagcccccacagtgctgtctg

SEQ ID NO: 4481835 - DNA, 20 bp, Homo sapiens
cagcccccatcacccaagcc

SEQ ID NO: 4481836 - DNA, 18 bp, Homo sapiens
cagcccccgccccagagt

SEQ ID NO: 4481837 - DNA, 23 bp, Homo sapiens
cagcccccgccccagagtggccc

SEQ ID NO: 4481838 - DNA, 22 bp, Homo sapiens
cagccccctcccaccgctgcct

SEQ ID NO: 4481839 - DNA, 15 bp, Homo sapiens
cagccccgcctgtca

SEQ ID NO: 4481840 - DNA, 18 bp, Homo sapiens
cagccccgcctgtcacaa

SEQ ID NO: 4481841 - DNA, 22 bp, Homo sapiens
cagcccctatagcactgagctc

SEQ ID NO: 4481842 - DNA, 14 bp, Homo sapiens
cagcccctccccag

SEQ ID NO: 4481843 - DNA, 15 bp, Homo sapiens
cagcccctcctccct

SEQ ID NO: 4481844 - DNA, 16 bp, Homo sapiens
cagcccctcctccctc

SEQ ID NO: 4481845 - DNA, 17 bp, Homo sapiens
cagcccctcctccctca

SEQ ID NO: 4481846 - DNA, 18 bp, Homo sapiens
cagcccctcctccctcaa

SEQ ID NO: 4481847 - DNA, 21 bp, Homo sapiens
cagcccctcctccctcaaacc

SEQ ID NO: 4481848 - DNA, 22 bp, Homo sapiens
cagcccctcctccctcagaccc

SEQ ID NO: 4481849 - DNA, 19 bp, Homo sapiens
cagcccctcctccctcagg

SEQ ID NO: 4481850 - DNA, 14 bp, Homo sapiens
cagcccctcctctg

SEQ ID NO: 4481851 - DNA, 20 bp, Homo sapiens
cagcccctcctctgccacct

SEQ ID NO: 4481852 - DNA, 19 bp, Homo sapiens
cagcccctgagagcctgtg

SEQ ID NO: 4481853 - DNA, 23 bp, Homo sapiens
cagcccctgagagcctgtggagg

SEQ ID NO: 4481854 - DNA, 22 bp, Homo sapiens
cagcccctgcagattctgagca

SEQ ID NO: 4481855 - DNA, 12 bp, Homo sapiens
cagcccctggag

SEQ ID NO: 4481856 - DNA, 15 bp, Homo sapiens
cagcccctggagcct

SEQ ID NO: 4481857 - DNA, 20 bp, Homo sapiens
cagcccctggagcctcagaa

SEQ ID NO: 4481858 - DNA, 14 bp, Homo sapiens
cagcccctggggcc

SEQ ID NO: 4481859 - DNA, 14 bp, Homo sapiens
cagcccgcacacct

SEQ ID NO: 4481860 - DNA, 13 bp, Homo sapiens
cagcccgcctgcc

SEQ ID NO: 4481861 - DNA, 14 bp, Homo sapiens
cagcccgcctgccg

SEQ ID NO: 4481862 - DNA, 15 bp, Homo sapiens
cagcccgctgagtgg

SEQ ID NO: 4481863 - DNA, 18 bp, Homo sapiens
cagccctagggtggagag

SEQ ID NO: 4481864 - DNA, 14 bp, Homo sapiens
cagccctcatcccg

SEQ ID NO: 4481865 - DNA, 14 bp, Homo sapiens
cagccctccctgtc

SEQ ID NO: 4481866 - DNA, 16 bp, Homo sapiens
cagccctccctgtcct

SEQ ID NO: 4481867 - DNA, 20 bp, Homo sapiens
cagccctccctgtcctcctc

SEQ ID NO: 4481868 - DNA, 18 bp, Homo sapiens
cagccctctctctcactc

SEQ ID NO: 4481869 - DNA, 22 bp, Homo sapiens
cagccctgaggtgaaagggagc

SEQ ID NO: 4481870 - DNA, 15 bp, Homo sapiens
cagccctgcagccca

SEQ ID NO: 4481871 - DNA, 13 bp, Homo sapiens
cagccctgctaga

SEQ ID NO: 4481872 - DNA, 17 bp, Homo sapiens
cagccctgctccctgcc

SEQ ID NO: 4481873 - DNA, 18 bp, Homo sapiens
cagccctgctccctgcct

SEQ ID NO: 4481874 - DNA, 13 bp, Homo sapiens
cagccctggatgg

SEQ ID NO: 4481875 - DNA, 16 bp, Homo sapiens
cagccctggatggtgg

SEQ ID NO: 4481876 - DNA, 21 bp, Homo sapiens
cagccctggcaaatgcctgac

SEQ ID NO: 4481877 - DNA, 12 bp, Homo sapiens
cagccctggccc

SEQ ID NO: 4481878 - DNA, 15 bp, Homo sapiens
cagccctggccccca

SEQ ID NO: 4481879 - DNA, 22 bp, Homo sapiens
cagccctggcccccatcagccc

SEQ ID NO: 4481880 - DNA, 19 bp, Homo sapiens
cagccctgggccccaccac

SEQ ID NO: 4481881 - DNA, 22 bp, Homo sapiens
cagccctgggccccaccaccta

SEQ ID NO: 4481882 - DNA, 15 bp, Homo sapiens
cagccctggtctcag

SEQ ID NO: 4481883 - DNA, 17 bp, Homo sapiens
cagcccttcatgggtgg

SEQ ID NO: 4481884 - DNA, 15 bp, Homo sapiens
cagccgccagctggg

SEQ ID NO: 4481885 - DNA, 18 bp, Homo sapiens
cagccgccagctgggagc

SEQ ID NO: 4481886 - DNA, 22 bp, Homo sapiens
cagccgccattgccaccaggag

SEQ ID NO: 4481887 - DNA, 13 bp, Homo sapiens
cagccgggcacag

SEQ ID NO: 4481888 - DNA, 18 bp, Homo sapiens
cagccgggcacagtggcg

SEQ ID NO: 4481889 - DNA, 21 bp, Homo sapiens
cagccgggttagcatgtgtga

SEQ ID NO: 4481890 - DNA, 17 bp, Homo sapiens
cagccggtacctgggaa

SEQ ID NO: 4481891 - DNA, 16 bp, Homo sapiens
cagccgtattttacat

SEQ ID NO: 4481892 - DNA, 21 bp, Homo sapiens
cagcctaaagtacagcctgga

SEQ ID NO: 4481893 - DNA, 16 bp, Homo sapiens
cagcctatagcagaag

SEQ ID NO: 4481894 - DNA, 13 bp, Homo sapiens
cagcctcacagaa

SEQ ID NO: 4481895 - DNA, 19 bp, Homo sapiens
cagcctcagaaggccccag

SEQ ID NO: 4481896 - DNA, 22 bp, Homo sapiens
cagcctcagaaggccccagaga

SEQ ID NO: 4481897 - DNA, 17 bp, Homo sapiens
cagcctcatgactttat

SEQ ID NO: 4481898 - DNA, 17 bp, Homo sapiens
cagcctccagcctctgt

SEQ ID NO: 4481899 - DNA, 12 bp, Homo sapiens
cagcctccaggc

SEQ ID NO: 4481900 - DNA, 13 bp, Homo sapiens
cagcctcccacaa

SEQ ID NO: 4481901 - DNA, 11 bp, Homo sapiens
cagcctcccat

SEQ ID NO: 4481902 - DNA, 19 bp, Homo sapiens
cagcctcccctcccctggg

SEQ ID NO: 4481903 - DNA, 22 bp, Homo sapiens
cagcctcccctcccctggggac

SEQ ID NO: 4481904 - DNA, 16 bp, Homo sapiens
cagcctcccctgccag

SEQ ID NO: 4481905 - DNA, 17 bp, Homo sapiens
cagcctcccctgccagg

SEQ ID NO: 4481906 - DNA, 18 bp, Homo sapiens
cagcctcccctgccaggg

SEQ ID NO: 4481907 - DNA, 22 bp, Homo sapiens
cagcctcccctgccagggcagg

SEQ ID NO: 4481908 - DNA, 19 bp, Homo sapiens
cagcctccctagtagctgg

SEQ ID NO: 4481909 - DNA, 17 bp, Homo sapiens
cagcctccgagagggag

SEQ ID NO: 4481910 - DNA, 20 bp, Homo sapiens
cagcctccgagagggagaga

SEQ ID NO: 4481911 - DNA, 14 bp, Homo sapiens
cagcctcctctgga

SEQ ID NO: 4481912 - DNA, 23 bp, Homo sapiens
cagcctcctctggacggcaggct

SEQ ID NO: 4481913 - DNA, 22 bp, Homo sapiens
cagcctcgttggaagaggaaca

SEQ ID NO: 4481914 - DNA, 23 bp, Homo sapiens
cagcctcgttggaagaggaacag

SEQ ID NO: 4481915 - DNA, 19 bp, Homo sapiens
cagcctctacagccgtccc

SEQ ID NO: 4481916 - DNA, 24 bp, Homo sapiens
cagcctctccactcatgtgactct

SEQ ID NO: 4481917 - DNA, 19 bp, Homo sapiens
cagcctctccgactctgca

SEQ ID NO: 4481918 - DNA, 15 bp, Homo sapiens
cagcctctctcccag

SEQ ID NO: 4481919 - DNA, 16 bp, Homo sapiens
cagcctctctcccagt

SEQ ID NO: 4481920 - DNA, 14 bp, Homo sapiens
cagcctctgccgct

SEQ ID NO: 4481921 - DNA, 17 bp, Homo sapiens
cagcctctgccgctgcc

SEQ ID NO: 4481922 - DNA, 21 bp, Homo sapiens
cagcctctgccgctgccatgc

SEQ ID NO: 4481923 - DNA, 12 bp, Homo sapiens
cagcctctgctg

SEQ ID NO: 4481924 - DNA, 17 bp, Homo sapiens
cagcctctggacagcca

SEQ ID NO: 4481925 - DNA, 21 bp, Homo sapiens
cagcctctggacagccagtga

SEQ ID NO: 4481926 - DNA, 20 bp, Homo sapiens
cagcctgagtgacagagcga

SEQ ID NO: 4481927 - DNA, 12 bp, Homo sapiens
cagcctgcacct

SEQ ID NO: 4481928 - DNA, 14 bp, Homo sapiens
cagcctgcacctgc

SEQ ID NO: 4481929 - DNA, 20 bp, Homo sapiens
cagcctgcacctgccccgtg

SEQ ID NO: 4481930 - DNA, 22 bp, Homo sapiens
cagcctgcacctgccccgtgtg

SEQ ID NO: 4481931 - DNA, 17 bp, Homo sapiens
cagcctgctttcctgca

SEQ ID NO: 4481932 - DNA, 16 bp, Homo sapiens
cagcctggcacgaagg

SEQ ID NO: 4481933 - DNA, 23 bp, Homo sapiens
cagcctggctgtggcctaacctg

SEQ ID NO: 4481934 - DNA, 11 bp, Homo sapiens
cagcctgggac

SEQ ID NO: 4481935 - DNA, 13 bp, Homo sapiens
cagcctgggagcc

SEQ ID NO: 4481936 - DNA, 16 bp, Homo sapiens
cagcctgggagcccag

SEQ ID NO: 4481937 - DNA, 12 bp, Homo sapiens
cagcctgggcaa

SEQ ID NO: 4481938 - DNA, 20 bp, Homo sapiens
cagcctgggcagccaggctg

SEQ ID NO: 4481939 - DNA, 22 bp, Homo sapiens
cagcctgggcctgggtggaaat

SEQ ID NO: 4481940 - DNA, 16 bp, Homo sapiens
cagcctgtccaacatg

SEQ ID NO: 4481941 - DNA, 12 bp, Homo sapiens
cagcctgtggca

SEQ ID NO: 4481942 - DNA, 15 bp, Homo sapiens
cagcctgtggcatct

SEQ ID NO: 4481943 - DNA, 20 bp, Homo sapiens
cagcctgtggcggtgcctgg

SEQ ID NO: 4481944 - DNA, 22 bp, Homo sapiens
cagcctgtggcggtgcctgggt

SEQ ID NO: 4481945 - DNA, 20 bp, Homo sapiens
cagccttatgtgttacatta

SEQ ID NO: 4481946 - DNA, 21 bp, Homo sapiens
cagcagcctgcacctgccccg

SEQ ID NO: 4481947 - DNA, 23 bp, Homo sapiens
cagcagcctgcacctgccccgtg

SEQ ID NO: 4481948 - DNA, 20 bp, Homo sapiens
cagcagctctgagccagatt

SEQ ID NO: 4481949 - DNA, 13 bp, Homo sapiens
cagcagctctggc

SEQ ID NO: 4481950 - DNA, 22 bp, Homo sapiens
cagcagctctggctctgcctca

SEQ ID NO: 4481951 - DNA, 19 bp, Homo sapiens
cagcaggagagactgagca

SEQ ID NO: 4481952 - DNA, 23 bp, Homo sapiens
cagcaggagagactgagcagccg

SEQ ID NO: 4481953 - DNA, 20 bp, Homo sapiens
cagcaggcctctggttgcct

SEQ ID NO: 4481954 - DNA, 22 bp, Homo sapiens
cagcaggcctctggttgcctcc

SEQ ID NO: 4481955 - DNA, 14 bp, Homo sapiens
cagcaggctcaggc

SEQ ID NO: 4481956 - DNA, 14 bp, Homo sapiens
cagcaggctgccag

SEQ ID NO: 4481957 - DNA, 20 bp, Homo sapiens
cagcaggctgccagtgcctg

SEQ ID NO: 4481958 - DNA, 17 bp, Homo sapiens
cagcagggaaggcccaa

SEQ ID NO: 4481959 - DNA, 19 bp, Homo sapiens
cagcagggctaccctgagc

SEQ ID NO: 4481960 - DNA, 16 bp, Homo sapiens
cagcaggtagcctgct

SEQ ID NO: 4481961 - DNA, 18 bp, Homo sapiens
cagcaggtagcctgctgg

SEQ ID NO: 4481962 - DNA, 12 bp, Homo sapiens
cagcagtgtcca

SEQ ID NO: 4481963 - DNA, 19 bp, Homo sapiens
cagcagtgtccagagaccc

SEQ ID NO: 4481964 - DNA, 22 bp, Homo sapiens
cagcagtgtccagagacccctc

SEQ ID NO: 4481965 - DNA, 20 bp, Homo sapiens
cagcagtgtgaatagcctgg

SEQ ID NO: 4481966 - DNA, 22 bp, Homo sapiens
cagcagtgtgaatagcctggcc

SEQ ID NO: 4481967 - DNA, 20 bp, Homo sapiens
cagcagtgtgaggccagggc

SEQ ID NO: 4481968 - DNA, 22 bp, Homo sapiens
cagcagtgtgaggccagggcag

SEQ ID NO: 4481969 - DNA, 14 bp, Homo sapiens
cagcagtgtggaga

SEQ ID NO: 4481970 - DNA, 17 bp, Homo sapiens
cagcagtgtggagaccc

SEQ ID NO: 4481971 - DNA, 19 bp, Homo sapiens
cagcagtgtggagaccctg

SEQ ID NO: 4481972 - DNA, 21 bp, Homo sapiens
cagcagttgaaaagactccaa

SEQ ID NO: 4481973 - DNA, 13 bp, Homo sapiens
cagcagtttctga

SEQ ID NO: 4481974 - DNA, 17 bp, Homo sapiens
cagcagtttgggaggtc

SEQ ID NO: 4481975 - DNA, 14 bp, Homo sapiens
cagcatcactgatg

SEQ ID NO: 4481976 - DNA, 16 bp, Homo sapiens
cagcatcactgatggg

SEQ ID NO: 4481977 - DNA, 19 bp, Homo sapiens
cagcatcactgatgggaat

SEQ ID NO: 4481978 - DNA, 13 bp, Homo sapiens
cagcatcagctca

SEQ ID NO: 4481979 - DNA, 12 bp, Homo sapiens
cagcatccctgg

SEQ ID NO: 4481980 - DNA, 16 bp, Homo sapiens
cagcatccctggagca

SEQ ID NO: 4481981 - DNA, 15 bp, Homo sapiens
cagcatcccttccca

SEQ ID NO: 4481982 - DNA, 20 bp, Homo sapiens
cagcatcgggagcacccaga

SEQ ID NO: 4481983 - DNA, 14 bp, Homo sapiens
cagcatcttctggt

SEQ ID NO: 4481984 - DNA, 16 bp, Homo sapiens
cagcatgcaatacata

SEQ ID NO: 4481985 - DNA, 21 bp, Homo sapiens
cagcatgtacggattttcagt

SEQ ID NO: 4481986 - DNA, 22 bp, Homo sapiens
cagcatgtacggattttcagtt

SEQ ID NO: 4481987 - DNA, 18 bp, Homo sapiens
cagcatgtctattcagct

SEQ ID NO: 4481988 - DNA, 16 bp, Homo sapiens
cagcattccagacttc

SEQ ID NO: 4481989 - DNA, 17 bp, Homo sapiens
cagcattccagctctgc

SEQ ID NO: 4481990 - DNA, 15 bp, Homo sapiens
cagcattccatgacc

SEQ ID NO: 4481991 - DNA, 15 bp, Homo sapiens
cagcattcccaggga

SEQ ID NO: 4481992 - DNA, 18 bp, Homo sapiens
cagcattcccagggacct

SEQ ID NO: 4481993 - DNA, 21 bp, Homo sapiens
cagcattcttagcctgtggca

SEQ ID NO: 4481994 - DNA, 19 bp, Homo sapiens
cagcattgctggactctga

SEQ ID NO: 4481995 - DNA, 17 bp, Homo sapiens
cagcatttgataatgat

SEQ ID NO: 4481996 - DNA, 22 bp, Homo sapiens
cagcatttgataatgataaaac

SEQ ID NO: 4481997 - DNA, 15 bp, Homo sapiens
cagccaaatttcctg

SEQ ID NO: 4481998 - DNA, 21 bp, Homo sapiens
cagccaaatttcctgtttgaa

SEQ ID NO: 4481999 - DNA, 22 bp, Homo sapiens
cagccaacgagacacattgcct

SEQ ID NO: 4482000 - DNA, 17 bp, Homo sapiens
cagccaactagcccctg

SEQ ID NO: 4482001 - DNA, 20 bp, Homo sapiens
cagccaactagcccctgggg

SEQ ID NO: 4482002 - DNA, 13 bp, Homo sapiens
cagccaagggtcc

SEQ ID NO: 4482003 - DNA, 16 bp, Homo sapiens
cagccaagggtcctca

SEQ ID NO: 4482004 - DNA, 16 bp, Homo sapiens
cagccaagtgcagagt

SEQ ID NO: 4482005 - DNA, 14 bp, Homo sapiens
cagccacaaagccc

SEQ ID NO: 4482006 - DNA, 16 bp, Homo sapiens
cagccacaaagccccc

SEQ ID NO: 4482007 - DNA, 13 bp, Homo sapiens
cagccacaccact

SEQ ID NO: 4482008 - DNA, 10 bp, Homo sapiens
cagccacagg

SEQ ID NO: 4482009 - DNA, 14 bp, Homo sapiens
cagccacccaagcc

SEQ ID NO: 4482010 - DNA, 17 bp, Homo sapiens
cagccacccaagcctgc

SEQ ID NO: 4482011 - DNA, 21 bp, Homo sapiens
cagccacccaagcctgctggc

SEQ ID NO: 4482012 - DNA, 21 bp, Homo sapiens
cagccaccccgggctctctgc

SEQ ID NO: 4482013 - DNA, 22 bp, Homo sapiens
cagccaccccgggctctctgct

SEQ ID NO: 4482014 - DNA, 15 bp, Homo sapiens
cagccactgtcacag

SEQ ID NO: 4482015 - DNA, 18 bp, Homo sapiens
cagccactgtcaccgagc

SEQ ID NO: 4482016 - DNA, 22 bp, Homo sapiens
cagccagaccccacgctgacca

SEQ ID NO: 4482017 - DNA, 21 bp, Homo sapiens
cagccagaggagggcagaggg

SEQ ID NO: 4482018 - DNA, 16 bp, Homo sapiens
cagccagcccagccca

SEQ ID NO: 4482019 - DNA, 19 bp, Homo sapiens
cagccagcccagcccagct

SEQ ID NO: 4482020 - DNA, 20 bp, Homo sapiens
cagccagcccagcccagctg

SEQ ID NO: 4482021 - DNA, 20 bp, Homo sapiens
cagccagcccatggccccca

SEQ ID NO: 4482022 - DNA, 14 bp, Homo sapiens
cagccagcccttcc

SEQ ID NO: 4482023 - DNA, 17 bp, Homo sapiens
cagccagccgccctggg

SEQ ID NO: 4482024 - DNA, 18 bp, Homo sapiens
cagccagccgccctgggc

SEQ ID NO: 4482025 - DNA, 19 bp, Homo sapiens
cagccagccgccctgggct

SEQ ID NO: 4482026 - DNA, 18 bp, Homo sapiens
cagccagccgtggccaga

SEQ ID NO: 4482027 - DNA, 12 bp, Homo sapiens
cagccagcctca

SEQ ID NO: 4482028 - DNA, 18 bp, Homo sapiens
cagccagcgcctccctcc

SEQ ID NO: 4482029 - DNA, 20 bp, Homo sapiens
cagccagcgcctccctccac

SEQ ID NO: 4482030 - DNA, 23 bp, Homo sapiens
cagccagcgcctccctccacccc

SEQ ID NO: 4482031 - DNA, 13 bp, Homo sapiens
cagccagcttaaa

SEQ ID NO: 4482032 - DNA, 12 bp, Homo sapiens
cagccaggccct

SEQ ID NO: 4482033 - DNA, 15 bp, Homo sapiens
cagccaggctctgtg

SEQ ID NO: 4482034 - DNA, 18 bp, Homo sapiens
cagccaggctctgtgctg

SEQ ID NO: 4482035 - DNA, 12 bp, Homo sapiens
cagccaggctgc

SEQ ID NO: 4482036 - DNA, 16 bp, Homo sapiens
cagccaggctgccaag

SEQ ID NO: 4482037 - DNA, 22 bp, Homo sapiens
cagccaggctgccaaggccaga

SEQ ID NO: 4482038 - DNA, 15 bp, Homo sapiens
cagccagggctgggg

SEQ ID NO: 4482039 - DNA, 16 bp, Homo sapiens
cagccagggctggggt

SEQ ID NO: 4482040 - DNA, 14 bp, Homo sapiens
cagccaggtgcctt

SEQ ID NO: 4482041 - DNA, 16 bp, Homo sapiens
cagccaggtgccttgg

SEQ ID NO: 4482042 - DNA, 16 bp, Homo sapiens
cagccagtgacctttg

SEQ ID NO: 4482043 - DNA, 20 bp, Homo sapiens
cagccatacttatctctctg

SEQ ID NO: 4482044 - DNA, 23 bp, Homo sapiens
cagccatacttatctctctgtgc

SEQ ID NO: 4482045 - DNA, 13 bp, Homo sapiens
cagccatcaaaat

SEQ ID NO: 4482046 - DNA, 16 bp, Homo sapiens
cagccatcaaaatgct

SEQ ID NO: 4482047 - DNA, 17 bp, Homo sapiens
cagccatcaaaatgctt

SEQ ID NO: 4482048 - DNA, 15 bp, Homo sapiens
cagccatcctccctc

SEQ ID NO: 4482049 - DNA, 15 bp, Homo sapiens
cagccatcgtcctgg

SEQ ID NO: 4482050 - DNA, 21 bp, Homo sapiens
cagccatggggtccatcccct

SEQ ID NO: 4482051 - DNA, 17 bp, Homo sapiens
cagcccaacagcacttt

SEQ ID NO: 4482052 - DNA, 12 bp, Homo sapiens
cagcccaagcac

SEQ ID NO: 4482053 - DNA, 15 bp, Homo sapiens
cagcccaccctcctg

SEQ ID NO: 4482054 - DNA, 17 bp, Homo sapiens
cagcccaccctcctgtc

SEQ ID NO: 4482055 - DNA, 18 bp, Homo sapiens
cagcccaccctcctgtct

SEQ ID NO: 4482056 - DNA, 19 bp, Homo sapiens
cagcccagaagaaaattct

SEQ ID NO: 4482057 - DNA, 17 bp, Homo sapiens
cagcccagcagtgtgga

SEQ ID NO: 4482058 - DNA, 23 bp, Homo sapiens
cagcccagcagtgtggagaccct

SEQ ID NO: 4482059 - DNA, 13 bp, Homo sapiens
cagcccagcccag

SEQ ID NO: 4482060 - DNA, 15 bp, Homo sapiens
cagcccagcccagct

SEQ ID NO: 4482061 - DNA, 23 bp, Homo sapiens
cagcccagcttggccctttcctt

SEQ ID NO: 4482062 - DNA, 21 bp, Homo sapiens
cagcccatctgaacacaacca

SEQ ID NO: 4482063 - DNA, 24 bp, Homo sapiens
cagcccatgcccacctgcccatca

SEQ ID NO: 4482064 - DNA, 16 bp, Homo sapiens
cagcccatggccccca

SEQ ID NO: 4482065 - DNA, 23 bp, Homo sapiens
cagcccatggcccccaataaagg

SEQ ID NO: 4482066 - DNA, 18 bp, Homo sapiens
cagatgtcttccctgggc

SEQ ID NO: 4482067 - DNA, 13 bp, Homo sapiens
cagatgtcttctg

SEQ ID NO: 4482068 - DNA, 16 bp, Homo sapiens
cagatgtcttctgcct

SEQ ID NO: 4482069 - DNA, 18 bp, Homo sapiens
cagatgtcttctgcctgt

SEQ ID NO: 4482070 - DNA, 22 bp, Homo sapiens
cagatgtcttctgcctgttata

SEQ ID NO: 4482071 - DNA, 15 bp, Homo sapiens
cagatgtgagccacc

SEQ ID NO: 4482072 - DNA, 20 bp, Homo sapiens
cagatgtgctataatctgtt

SEQ ID NO: 4482073 - DNA, 23 bp, Homo sapiens
cagatgtggggagggtgtctggg

SEQ ID NO: 4482074 - DNA, 16 bp, Homo sapiens
cagatgttaaaataaa

SEQ ID NO: 4482075 - DNA, 21 bp, Homo sapiens
cagatgttaaaataaatggtt

SEQ ID NO: 4482076 - DNA, 15 bp, Homo sapiens
cagatgttgggagga

SEQ ID NO: 4482077 - DNA, 12 bp, Homo sapiens
cagattaaatta

SEQ ID NO: 4482078 - DNA, 20 bp, Homo sapiens
cagattaaattacagctttt

SEQ ID NO: 4482079 - DNA, 18 bp, Homo sapiens
cagattcaggccagccca

SEQ ID NO: 4482080 - DNA, 20 bp, Homo sapiens
cagattcaggccagcccagc

SEQ ID NO: 4482081 - DNA, 22 bp, Homo sapiens
cagattcggaccactaggcctg

SEQ ID NO: 4482082 - DNA, 13 bp, Homo sapiens
cagattctgagca

SEQ ID NO: 4482083 - DNA, 19 bp, Homo sapiens
cagattctgagcaaaggcc

SEQ ID NO: 4482084 - DNA, 20 bp, Homo sapiens
cagattctgagcaaaggccc

SEQ ID NO: 4482085 - DNA, 22 bp, Homo sapiens
cagattctgagcaaaggccctg

SEQ ID NO: 4482086 - DNA, 23 bp, Homo sapiens
cagattctgagcaaaggccctgg

SEQ ID NO: 4482087 - DNA, 18 bp, Homo sapiens
cagattctgcctatgtaa

SEQ ID NO: 4482088 - DNA, 17 bp, Homo sapiens
cagattctgcctctctg

SEQ ID NO: 4482089 - DNA, 14 bp, Homo sapiens
cagattgcttaaaa

SEQ ID NO: 4482090 - DNA, 17 bp, Homo sapiens
cagattggctcacactg

SEQ ID NO: 4482091 - DNA, 21 bp, Homo sapiens
cagattgtggaatgttggata

SEQ ID NO: 4482092 - DNA, 22 bp, Homo sapiens
cagatttaacctgttatttcta

SEQ ID NO: 4482093 - DNA, 23 bp, Homo sapiens
cagatttatttactcttgctgga

SEQ ID NO: 4482094 - DNA, 16 bp, Homo sapiens
cagatttctcactata

SEQ ID NO: 4482095 - DNA, 18 bp, Homo sapiens
cagatttggcttgacaaa

SEQ ID NO: 4482096 - DNA, 13 bp, Homo sapiens
cagattttcagca

SEQ ID NO: 4482097 - DNA, 15 bp, Homo sapiens
cagattttcagcaaa

SEQ ID NO: 4482098 - DNA, 11 bp, Homo sapiens
cagatttttat

SEQ ID NO: 4482099 - DNA, 22 bp, Homo sapiens
cagatttttatattagttgctt

SEQ ID NO: 4482100 - DNA, 22 bp, Homo sapiens
cagatttttatgttttctttct

SEQ ID NO: 4482101 - DNA, 20 bp, Homo sapiens
cagatttttatgttttgaaa

SEQ ID NO: 4482102 - DNA, 15 bp, Homo sapiens
cagattttttaaaat

SEQ ID NO: 4482103 - DNA, 16 bp, Homo sapiens
cagatttttttgtaag

SEQ ID NO: 4482104 - DNA, 18 bp, Homo sapiens
cagcaaaaaagtccaatt

SEQ ID NO: 4482105 - DNA, 14 bp, Homo sapiens
cagcaaacaggtgc

SEQ ID NO: 4482106 - DNA, 19 bp, Homo sapiens
cagcaaagcagcagtgtcc

SEQ ID NO: 4482107 - DNA, 21 bp, Homo sapiens
cagcaaataaagcagtcatga

SEQ ID NO: 4482108 - DNA, 22 bp, Homo sapiens
cagcaaatgcaaaaactctttg

SEQ ID NO: 4482109 - DNA, 14 bp, Homo sapiens
cagcaaatgggcat

SEQ ID NO: 4482110 - DNA, 19 bp, Homo sapiens
cagcaacaaaatcatggct

SEQ ID NO: 4482111 - DNA, 22 bp, Homo sapiens
cagcaacaaaatcatggcttag

SEQ ID NO: 4482112 - DNA, 23 bp, Homo sapiens
cagcaacaaaatcatggcttagg

SEQ ID NO: 4482113 - DNA, 20 bp, Homo sapiens
cagcaaccctacagtatata

SEQ ID NO: 4482114 - DNA, 23 bp, Homo sapiens
cagcaacgcaggcccccaggtgc

SEQ ID NO: 4482115 - DNA, 15 bp, Homo sapiens
cagcaactcccacga

SEQ ID NO: 4482116 - DNA, 12 bp, Homo sapiens
cagcaagaagct

SEQ ID NO: 4482117 - DNA, 13 bp, Homo sapiens
cagcaagatgttt

SEQ ID NO: 4482118 - DNA, 15 bp, Homo sapiens
cagcaagctgcccag

SEQ ID NO: 4482119 - DNA, 17 bp, Homo sapiens
cagcaagctgcccagcc

SEQ ID NO: 4482120 - DNA, 20 bp, Homo sapiens
cagcaagctgcccagccctg

SEQ ID NO: 4482121 - DNA, 21 bp, Homo sapiens
cagcaagctgcccagccctgg

SEQ ID NO: 4482122 - DNA, 23 bp, Homo sapiens
cagcaagtacagcggctcccctc

SEQ ID NO: 4482123 - DNA, 23 bp, Homo sapiens
cagcaagttagaactagccaaac

SEQ ID NO: 4482124 - DNA, 16 bp, Homo sapiens
cagcaatttaaatgtt

SEQ ID NO: 4482125 - DNA, 11 bp, Homo sapiens
cagcacaacct

SEQ ID NO: 4482126 - DNA, 16 bp, Homo sapiens
cagcacacaggcagcc

SEQ ID NO: 4482127 - DNA, 15 bp, Homo sapiens
cagcacattcgggac

SEQ ID NO: 4482128 - DNA, 15 bp, Homo sapiens
cagcaccaaccacag

SEQ ID NO: 4482129 - DNA, 21 bp, Homo sapiens
cagcaccaccctagtcccttc

SEQ ID NO: 4482130 - DNA, 22 bp, Homo sapiens
cagcaccaccctagtcccttcc

SEQ ID NO: 4482131 - DNA, 18 bp, Homo sapiens
cagcaccctctcctgggg

SEQ ID NO: 4482132 - DNA, 19 bp, Homo sapiens
cagcaccctctcctggggg

SEQ ID NO: 4482133 - DNA, 18 bp, Homo sapiens
cagcaccttctttctgga

SEQ ID NO: 4482134 - DNA, 20 bp, Homo sapiens
cagcaccttctttctggact

SEQ ID NO: 4482135 - DNA, 23 bp, Homo sapiens
cagcaccttctttctggactggc

SEQ ID NO: 4482136 - DNA, 14 bp, Homo sapiens
cagcacgagcctgg

SEQ ID NO: 4482137 - DNA, 17 bp, Homo sapiens
cagcacgtgtggcctgt

SEQ ID NO: 4482138 - DNA, 14 bp, Homo sapiens
cagcactaaacttg

SEQ ID NO: 4482139 - DNA, 16 bp, Homo sapiens
cagcactaaggccgtg

SEQ ID NO: 4482140 - DNA, 21 bp, Homo sapiens
cagcactaaggccgtgtctct

SEQ ID NO: 4482141 - DNA, 19 bp, Homo sapiens
cagcactaaggtggacagc

SEQ ID NO: 4482142 - DNA, 14 bp, Homo sapiens
cagcactactctgt

SEQ ID NO: 4482143 - DNA, 16 bp, Homo sapiens
cagcactactgggtgt

SEQ ID NO: 4482144 - DNA, 20 bp, Homo sapiens
cagcactatgctttccttct

SEQ ID NO: 4482145 - DNA, 12 bp, Homo sapiens
cagcactgagga

SEQ ID NO: 4482146 - DNA, 15 bp, Homo sapiens
cagcactgaggaaga

SEQ ID NO: 4482147 - DNA, 17 bp, Homo sapiens
cagcactgaggaagaac

SEQ ID NO: 4482148 - DNA, 18 bp, Homo sapiens
cagcactgatggaaaata

SEQ ID NO: 4482149 - DNA, 16 bp, Homo sapiens
cagcactgcttgagga

SEQ ID NO: 4482150 - DNA, 14 bp, Homo sapiens
cagcactgtggaca

SEQ ID NO: 4482151 - DNA, 15 bp, Homo sapiens
cagcactttgggagg

SEQ ID NO: 4482152 - DNA, 18 bp, Homo sapiens
cagcactttgggaggcag

SEQ ID NO: 4482153 - DNA, 22 bp, Homo sapiens
cagcagaaaacttgtgtgaaat

SEQ ID NO: 4482154 - DNA, 15 bp, Homo sapiens
cagcagaagcctcca

SEQ ID NO: 4482155 - DNA, 13 bp, Homo sapiens
cagcagaaggggg

SEQ ID NO: 4482156 - DNA, 17 bp, Homo sapiens
cagcagacaaaatgaaa

SEQ ID NO: 4482157 - DNA, 22 bp, Homo sapiens
cagcagacaagagggcaagcct

SEQ ID NO: 4482158 - DNA, 16 bp, Homo sapiens
cagcagacatttatct

SEQ ID NO: 4482159 - DNA, 19 bp, Homo sapiens
cagcagacatttatctttg

SEQ ID NO: 4482160 - DNA, 13 bp, Homo sapiens
cagcagagagccc

SEQ ID NO: 4482161 - DNA, 11 bp, Homo sapiens
cagcagagcca

SEQ ID NO: 4482162 - DNA, 14 bp, Homo sapiens
cagcagagccaggg

SEQ ID NO: 4482163 - DNA, 17 bp, Homo sapiens
cagcagagccagggcag

SEQ ID NO: 4482164 - DNA, 19 bp, Homo sapiens
cagcagagccagggcaggg

SEQ ID NO: 4482165 - DNA, 14 bp, Homo sapiens
cagcagaggacagt

SEQ ID NO: 4482166 - DNA, 16 bp, Homo sapiens
cagcagaggcaggctg

SEQ ID NO: 4482167 - DNA, 17 bp, Homo sapiens
cagcagaggcaggctgg

SEQ ID NO: 4482168 - DNA, 18 bp, Homo sapiens
cagcagaggcaggctggg

SEQ ID NO: 4482169 - DNA, 17 bp, Homo sapiens
cagcagcaacctgttca

SEQ ID NO: 4482170 - DNA, 14 bp, Homo sapiens
cagcagcaccaacc

SEQ ID NO: 4482171 - DNA, 19 bp, Homo sapiens
cagcagcaccaaccacagc

SEQ ID NO: 4482172 - DNA, 19 bp, Homo sapiens
cagcagcacttagacctgc

SEQ ID NO: 4482173 - DNA, 14 bp, Homo sapiens
cagcagcagcactt

SEQ ID NO: 4482174 - DNA, 15 bp, Homo sapiens
cagcagcagcctgca

SEQ ID NO: 4482175 - DNA, 13 bp, Homo sapiens
cagcagcagctct

SEQ ID NO: 4482176 - DNA, 21 bp, Homo sapiens
cagcagcatttttatttcaga

SEQ ID NO: 4482177 - DNA, 18 bp, Homo sapiens
cagcagccccccagcact

SEQ ID NO: 4482178 - DNA, 20 bp, Homo sapiens
cagcagcccctgagagcctg

SEQ ID NO: 4482179 - DNA, 11 bp, Homo sapiens
cagcagcccta

SEQ ID NO: 4482180 - DNA, 20 bp, Homo sapiens
cagcagccctagcggctgct

SEQ ID NO: 4482181 - DNA, 13 bp, Homo sapiens
cagcagccctcct

SEQ ID NO: 4482182 - DNA, 15 bp, Homo sapiens
cagcagccctcctca

SEQ ID NO: 4482183 - DNA, 14 bp, Homo sapiens
cagcagcctgcacc

SEQ ID NO: 4482184 - DNA, 19 bp, Homo sapiens
cagcagcctgcacctgccc

SEQ ID NO: 4482185 - DNA, 20 bp, Homo sapiens
cagcagcctgcacctgcccc

SEQ ID NO: 4482186 - DNA, 16 bp, Homo sapiens
cagctgctcccctgga

SEQ ID NO: 4482187 - DNA, 21 bp, Homo sapiens
cagctgctgaaacaacaaata

SEQ ID NO: 4482188 - DNA, 12 bp, Homo sapiens
cagctgctgaga

SEQ ID NO: 4482189 - DNA, 15 bp, Homo sapiens
cagctgctggagaat

SEQ ID NO: 4482190 - DNA, 14 bp, Homo sapiens
cagctgctggatga

SEQ ID NO: 4482191 - DNA, 22 bp, Homo sapiens
cagctgctgtctgagtagtggc

SEQ ID NO: 4482192 - DNA, 20 bp, Homo sapiens
cagctgctttgacaaaatga

SEQ ID NO: 4482193 - DNA, 16 bp, Homo sapiens
cagctggaatgtgcca

SEQ ID NO: 4482194 - DNA, 16 bp, Homo sapiens
cagctggatcgctgca

SEQ ID NO: 4482195 - DNA, 23 bp, Homo sapiens
cagctggatgagaatttgagtgc

SEQ ID NO: 4482196 - DNA, 21 bp, Homo sapiens
cagctggggccggttttcctc

SEQ ID NO: 4482197 - DNA, 21 bp, Homo sapiens
cagctggtgcaaattcagaac

SEQ ID NO: 4482198 - DNA, 13 bp, Homo sapiens
cagctggttgctc

SEQ ID NO: 4482199 - DNA, 18 bp, Homo sapiens
cagctgtacaaatcctct

SEQ ID NO: 4482200 - DNA, 23 bp, Homo sapiens
cagctgtatttatataagtctgt

SEQ ID NO: 4482201 - DNA, 14 bp, Homo sapiens
cagctgtcaagggc

SEQ ID NO: 4482202 - DNA, 12 bp, Homo sapiens
cagctgtccctg

SEQ ID NO: 4482203 - DNA, 14 bp, Homo sapiens
cagctgtccctgtc

SEQ ID NO: 4482204 - DNA, 16 bp, Homo sapiens
cagctgtccctgtcac

SEQ ID NO: 4482205 - DNA, 12 bp, Homo sapiens
cagctgtctccc

SEQ ID NO: 4482206 - DNA, 21 bp, Homo sapiens
cagctgtgccgggaggcagcc

SEQ ID NO: 4482207 - DNA, 23 bp, Homo sapiens
cagctgtggcagagttacagttc

SEQ ID NO: 4482208 - DNA, 22 bp, Homo sapiens
cagcttaaacccatacaatgta

SEQ ID NO: 4482209 - DNA, 21 bp, Homo sapiens
cagcttcacccaccaggccag

SEQ ID NO: 4482210 - DNA, 19 bp, Homo sapiens
cagcttcattttatttttg

SEQ ID NO: 4482211 - DNA, 19 bp, Homo sapiens
cagcttcctacccacacct

SEQ ID NO: 4482212 - DNA, 20 bp, Homo sapiens
cagcttcctacccacacctc

SEQ ID NO: 4482213 - DNA, 22 bp, Homo sapiens
cagcttcctacccacacctctg

SEQ ID NO: 4482214 - DNA, 21 bp, Homo sapiens
cagcttcggagggcccctgcg

SEQ ID NO: 4482215 - DNA, 16 bp, Homo sapiens
cagcttctactcctgc

SEQ ID NO: 4482216 - DNA, 14 bp, Homo sapiens
cagcttctctgcag

SEQ ID NO: 4482217 - DNA, 16 bp, Homo sapiens
cagcttctctgcagta

SEQ ID NO: 4482218 - DNA, 14 bp, Homo sapiens
cagcttgagccggg

SEQ ID NO: 4482219 - DNA, 21 bp, Homo sapiens
cagcttgccagggatgggcag

SEQ ID NO: 4482220 - DNA, 21 bp, Homo sapiens
cagcttgtggagccccacact

SEQ ID NO: 4482221 - DNA, 23 bp, Homo sapiens
cagctttatccccgtttcttgca

SEQ ID NO: 4482222 - DNA, 16 bp, Homo sapiens
cagctttcatgattag

SEQ ID NO: 4482223 - DNA, 17 bp, Homo sapiens
cagctttcatgattagc

SEQ ID NO: 4482224 - DNA, 22 bp, Homo sapiens
cagctttcctcaaaaagcagaa

SEQ ID NO: 4482225 - DNA, 23 bp, Homo sapiens
cagctttcctcaaaaagcagaag

SEQ ID NO: 4482226 - DNA, 12 bp, Homo sapiens
cagctttgagct

SEQ ID NO: 4482227 - DNA, 11 bp, Homo sapiens
cagcttttaac

SEQ ID NO: 4482228 - DNA, 15 bp, Homo sapiens
cagcttttaaccatc

SEQ ID NO: 4482229 - DNA, 21 bp, Homo sapiens
cagcttttaaccatctgatat

SEQ ID NO: 4482230 - DNA, 20 bp, Homo sapiens
cagcttttatggatgattaa

SEQ ID NO: 4482231 - DNA, 17 bp, Homo sapiens
cagcttttctttttctg

SEQ ID NO: 4482232 - DNA, 17 bp, Homo sapiens
cagcttttggttaatat

SEQ ID NO: 4482233 - DNA, 17 bp, Homo sapiens
cagcttttgttctagac

SEQ ID NO: 4482234 - DNA, 18 bp, Homo sapiens
cagcttttgttctagact

SEQ ID NO: 4482235 - DNA, 19 bp, Homo sapiens
cagctttttattccctgcc

SEQ ID NO: 4482236 - DNA, 22 bp, Homo sapiens
cagctttttattccctgcccaa

SEQ ID NO: 4482237 - DNA, 23 bp, Homo sapiens
caggaaaactgacagaggagggc

SEQ ID NO: 4482238 - DNA, 17 bp, Homo sapiens
caggaaaatcctctggc

SEQ ID NO: 4482239 - DNA, 17 bp, Homo sapiens
caggaaaatgtattgat

SEQ ID NO: 4482240 - DNA, 12 bp, Homo sapiens
caggaaacaaac

SEQ ID NO: 4482241 - DNA, 19 bp, Homo sapiens
caggaaactccacatctgc

SEQ ID NO: 4482242 - DNA, 20 bp, Homo sapiens
caggaaactccacatctgcc

SEQ ID NO: 4482243 - DNA, 23 bp, Homo sapiens
caggaaactccacatctgcctta

SEQ ID NO: 4482244 - DNA, 18 bp, Homo sapiens
caggaaagagcagtcaga

SEQ ID NO: 4482245 - DNA, 21 bp, Homo sapiens
caggaaagagcagtcagagtc

SEQ ID NO: 4482246 - DNA, 20 bp, Homo sapiens
caggaaaggacggctgagca

SEQ ID NO: 4482247 - DNA, 16 bp, Homo sapiens
caggaaagtggccaag

SEQ ID NO: 4482248 - DNA, 19 bp, Homo sapiens
caggaaatcaaatatgcaa

SEQ ID NO: 4482249 - DNA, 21 bp, Homo sapiens
caggaaatcaaatatgcaaag

SEQ ID NO: 4482250 - DNA, 22 bp, Homo sapiens
caggaacaacatttacaactca

SEQ ID NO: 4482251 - DNA, 20 bp, Homo sapiens
caggaacctcgagtactgtg

SEQ ID NO: 4482252 - DNA, 21 bp, Homo sapiens
caggaacctcgagtactgtgg

SEQ ID NO: 4482253 - DNA, 17 bp, Homo sapiens
caggaagatgggaggtg

SEQ ID NO: 4482254 - DNA, 16 bp, Homo sapiens
caggaagcaccccatg

SEQ ID NO: 4482255 - DNA, 18 bp, Homo sapiens
caggaagcccaggagcct

SEQ ID NO: 4482256 - DNA, 19 bp, Homo sapiens
caggaagcccaggagcctc

SEQ ID NO: 4482257 - DNA, 20 bp, Homo sapiens
caggaagcccaggagcctca

SEQ ID NO: 4482258 - DNA, 16 bp, Homo sapiens
caggaaggagagcctg

SEQ ID NO: 4482259 - DNA, 18 bp, Homo sapiens
caggaaggagagcctgct

SEQ ID NO: 4482260 - DNA, 17 bp, Homo sapiens
caggaaggaggggagag

SEQ ID NO: 4482261 - DNA, 15 bp, Homo sapiens
caggaagtagaggag

SEQ ID NO: 4482262 - DNA, 16 bp, Homo sapiens
caggaagtagaggagg

SEQ ID NO: 4482263 - DNA, 21 bp, Homo sapiens
caggaatatctgttcccagcc

SEQ ID NO: 4482264 - DNA, 19 bp, Homo sapiens
caggaatcacccctctgcc

SEQ ID NO: 4482265 - DNA, 16 bp, Homo sapiens
caggaatgaagaactg

SEQ ID NO: 4482266 - DNA, 17 bp, Homo sapiens
caggaatgtgtggcaga

SEQ ID NO: 4482267 - DNA, 18 bp, Homo sapiens
caggaatgttaaagtcag

SEQ ID NO: 4482268 - DNA, 19 bp, Homo sapiens
caggaatgttaaagtcagt

SEQ ID NO: 4482269 - DNA, 18 bp, Homo sapiens
caggaattctaaataaat

SEQ ID NO: 4482270 - DNA, 21 bp, Homo sapiens
caggaattcttggagaaaatg

SEQ ID NO: 4482271 - DNA, 13 bp, Homo sapiens
caggacagctcct

SEQ ID NO: 4482272 - DNA, 18 bp, Homo sapiens
caggacagctcctggacc

SEQ ID NO: 4482273 - DNA, 13 bp, Homo sapiens
caggacccagagg

SEQ ID NO: 4482274 - DNA, 14 bp, Homo sapiens
caggacccagagga

SEQ ID NO: 4482275 - DNA, 14 bp, Homo sapiens
caggacccagtggt

SEQ ID NO: 4482276 - DNA, 16 bp, Homo sapiens
caggacgccactcatt

SEQ ID NO: 4482277 - DNA, 20 bp, Homo sapiens
caggacgccactcatttcat

SEQ ID NO: 4482278 - DNA, 21 bp, Homo sapiens
caggacgccactcatttcatc

SEQ ID NO: 4482279 - DNA, 18 bp, Homo sapiens
caggacggctcctcagag

SEQ ID NO: 4482280 - DNA, 18 bp, Homo sapiens
caggactccaggcccaag

SEQ ID NO: 4482281 - DNA, 14 bp, Homo sapiens
caggactccctcct

SEQ ID NO: 4482282 - DNA, 23 bp, Homo sapiens
caggactccctcctcacctctgg

SEQ ID NO: 4482283 - DNA, 16 bp, Homo sapiens
caggacttctcaccag

SEQ ID NO: 4482284 - DNA, 16 bp, Homo sapiens
caggacttgaaagaaa

SEQ ID NO: 4482285 - DNA, 19 bp, Homo sapiens
caggagaaggccaattcct

SEQ ID NO: 4482286 - DNA, 22 bp, Homo sapiens
caggagacagaccacttgccac

SEQ ID NO: 4482287 - DNA, 18 bp, Homo sapiens
caggagagactgagcagc

SEQ ID NO: 4482288 - DNA, 19 bp, Homo sapiens
caggagagactgagcagcc

SEQ ID NO: 4482289 - DNA, 15 bp, Homo sapiens
caggagagcaaggtc

SEQ ID NO: 4482290 - DNA, 18 bp, Homo sapiens
caggagagccagccctcc

SEQ ID NO: 4482291 - DNA, 16 bp, Homo sapiens
caggagatggagggct

SEQ ID NO: 4482292 - DNA, 15 bp, Homo sapiens
caggagatgggtcca

SEQ ID NO: 4482293 - DNA, 15 bp, Homo sapiens
caggagattggattt

SEQ ID NO: 4482294 - DNA, 11 bp, Homo sapiens
caggagcactg

SEQ ID NO: 4482295 - DNA, 14 bp, Homo sapiens
caggagcagccctg

SEQ ID NO: 4482296 - DNA, 15 bp, Homo sapiens
caggagcagccctgg

SEQ ID NO: 4482297 - DNA, 17 bp, Homo sapiens
caggagcagccctggcc

SEQ ID NO: 4482298 - DNA, 18 bp, Homo sapiens
caggagcagccctggccc

SEQ ID NO: 4482299 - DNA, 15 bp, Homo sapiens
caggagcaggaccta

SEQ ID NO: 4482300 - DNA, 13 bp, Homo sapiens
caggagcccccct

SEQ ID NO: 4482301 - DNA, 14 bp, Homo sapiens
caggagccccccta

SEQ ID NO: 4482302 - DNA, 13 bp, Homo sapiens
caggagcctagcg

SEQ ID NO: 4482303 - DNA, 19 bp, Homo sapiens
caggagcctagcggagccc

SEQ ID NO: 4482304 - DNA, 23 bp, Homo sapiens
caggagcctagcggagcccagcc

SEQ ID NO: 4482305 - DNA, 20 bp, Homo sapiens
caggagcctcatccagcctc

SEQ ID NO: 4482306 - DNA, 22 bp, Homo sapiens
caggcccccagcccctcctccc

SEQ ID NO: 4482307 - DNA, 14 bp, Homo sapiens
caggcccccaggtg

SEQ ID NO: 4482308 - DNA, 19 bp, Homo sapiens
caggcccccaggtgccagt

SEQ ID NO: 4482309 - DNA, 22 bp, Homo sapiens
caggcccctggaggctgcctcc

SEQ ID NO: 4482310 - DNA, 17 bp, Homo sapiens
caggcccgagcgcctgc

SEQ ID NO: 4482311 - DNA, 19 bp, Homo sapiens
caggcccggcgcggtggct

SEQ ID NO: 4482312 - DNA, 20 bp, Homo sapiens
caggccctccctgactccct

SEQ ID NO: 4482313 - DNA, 15 bp, Homo sapiens
caggccctccctgtc

SEQ ID NO: 4482314 - DNA, 14 bp, Homo sapiens
caggccctgactcc

SEQ ID NO: 4482315 - DNA, 20 bp, Homo sapiens
caggcccttgtcggccccac

SEQ ID NO: 4482316 - DNA, 16 bp, Homo sapiens
caggccgagagcctta

SEQ ID NO: 4482317 - DNA, 13 bp, Homo sapiens
caggccggcccag

SEQ ID NO: 4482318 - DNA, 15 bp, Homo sapiens
caggccggcccagat

SEQ ID NO: 4482319 - DNA, 14 bp, Homo sapiens
caggcctccctctc

SEQ ID NO: 4482320 - DNA, 16 bp, Homo sapiens
caggcctccctctctc

SEQ ID NO: 4482321 - DNA, 17 bp, Homo sapiens
caggcctccctctctct

SEQ ID NO: 4482322 - DNA, 20 bp, Homo sapiens
caggcctctcggtgctccat

SEQ ID NO: 4482323 - DNA, 23 bp, Homo sapiens
caggcctctcggtgctccatctc

SEQ ID NO: 4482324 - DNA, 14 bp, Homo sapiens
caggcctctctctg

SEQ ID NO: 4482325 - DNA, 16 bp, Homo sapiens
caggcctctctctgct

SEQ ID NO: 4482326 - DNA, 21 bp, Homo sapiens
caggcctctgctggctcagga

SEQ ID NO: 4482327 - DNA, 22 bp, Homo sapiens
caggcctctgctggctcaggag

SEQ ID NO: 4482328 - DNA, 18 bp, Homo sapiens
caggcctctggttgcctc

SEQ ID NO: 4482329 - DNA, 19 bp, Homo sapiens
caggcctcttggcagtcac

SEQ ID NO: 4482330 - DNA, 16 bp, Homo sapiens
caggcctgagatttca

SEQ ID NO: 4482331 - DNA, 19 bp, Homo sapiens
caggcctgagatttcatct

SEQ ID NO: 4482332 - DNA, 12 bp, Homo sapiens
caggcctgcctc

SEQ ID NO: 4482333 - DNA, 14 bp, Homo sapiens
caggcctgcctccc

SEQ ID NO: 4482334 - DNA, 14 bp, Homo sapiens
caggcctgcctgca

SEQ ID NO: 4482335 - DNA, 17 bp, Homo sapiens
caggcctggcctcatct

SEQ ID NO: 4482336 - DNA, 14 bp, Homo sapiens
caggcctgtccctg

SEQ ID NO: 4482337 - DNA, 17 bp, Homo sapiens
caggcctgtccctggga

SEQ ID NO: 4482338 - DNA, 18 bp, Homo sapiens
caggcctgtccctgggag

SEQ ID NO: 4482339 - DNA, 24 bp, Homo sapiens
caggcgcctataatcccagctact

SEQ ID NO: 4482340 - DNA, 12 bp, Homo sapiens
caggcgctgcat

SEQ ID NO: 4482341 - DNA, 23 bp, Homo sapiens
caggcggagctgctgagtgacag

SEQ ID NO: 4482342 - DNA, 19 bp, Homo sapiens
caggcgggacagtgctgca

SEQ ID NO: 4482343 - DNA, 16 bp, Homo sapiens
caggcgggctcctttg

SEQ ID NO: 4482344 - DNA, 15 bp, Homo sapiens
caggcgggctcggag

SEQ ID NO: 4482345 - DNA, 18 bp, Homo sapiens
caggcgggctcggaggct

SEQ ID NO: 4482346 - DNA, 11 bp, Homo sapiens
caggctactgt

SEQ ID NO: 4482347 - DNA, 17 bp, Homo sapiens
caggctagccctgccct

SEQ ID NO: 4482348 - DNA, 19 bp, Homo sapiens
caggctatcatatatactg

SEQ ID NO: 4482349 - DNA, 12 bp, Homo sapiens
caggctcaagtt

SEQ ID NO: 4482350 - DNA, 15 bp, Homo sapiens
caggctcaagttttt

SEQ ID NO: 4482351 - DNA, 15 bp, Homo sapiens
caggctcactgccag

SEQ ID NO: 4482352 - DNA, 22 bp, Homo sapiens
caggctcatgccatcatgccca

SEQ ID NO: 4482353 - DNA, 20 bp, Homo sapiens
caggctccctttctcttctt

SEQ ID NO: 4482354 - DNA, 18 bp, Homo sapiens
caggctcctaaagagaca

SEQ ID NO: 4482355 - DNA, 21 bp, Homo sapiens
caggctcgtggactgagtggg

SEQ ID NO: 4482356 - DNA, 12 bp, Homo sapiens
caggctctcctg

SEQ ID NO: 4482357 - DNA, 17 bp, Homo sapiens
caggctctcctggctgt

SEQ ID NO: 4482358 - DNA, 15 bp, Homo sapiens
caggctctgtgctga

SEQ ID NO: 4482359 - DNA, 24 bp, Homo sapiens
caggctctgtgctgaccctcctgt

SEQ ID NO: 4482360 - DNA, 12 bp, Homo sapiens
caggctgagagc

SEQ ID NO: 4482361 - DNA, 16 bp, Homo sapiens
caggctgcagtggctc

SEQ ID NO: 4482362 - DNA, 19 bp, Homo sapiens
caggctgcagtggctcccc

SEQ ID NO: 4482363 - DNA, 12 bp, Homo sapiens
caggctgctggc

SEQ ID NO: 4482364 - DNA, 16 bp, Homo sapiens
caggctgctggcgcct

SEQ ID NO: 4482365 - DNA, 20 bp, Homo sapiens
caggctgctggcgcctctgc

SEQ ID NO: 4482366 - DNA, 22 bp, Homo sapiens
caggctgctggcgcctctgcaa

SEQ ID NO: 4482367 - DNA, 15 bp, Homo sapiens
caggctgcttgggat

SEQ ID NO: 4482368 - DNA, 20 bp, Homo sapiens
caggctggaagatagctgtg

SEQ ID NO: 4482369 - DNA, 16 bp, Homo sapiens
caggctggagaccccc

SEQ ID NO: 4482370 - DNA, 12 bp, Homo sapiens
caggctgggaac

SEQ ID NO: 4482371 - DNA, 18 bp, Homo sapiens
caggctgggaactcatct

SEQ ID NO: 4482372 - DNA, 23 bp, Homo sapiens
caggctgggacggaccagcatct

SEQ ID NO: 4482373 - DNA, 11 bp, Homo sapiens
caggctgggcc

SEQ ID NO: 4482374 - DNA, 17 bp, Homo sapiens
caggctgggccatgtcc

SEQ ID NO: 4482375 - DNA, 18 bp, Homo sapiens
caggctgggccatgtcca

SEQ ID NO: 4482376 - DNA, 14 bp, Homo sapiens
caggctggggaggt

SEQ ID NO: 4482377 - DNA, 15 bp, Homo sapiens
caggctgggtcctgc

SEQ ID NO: 4482378 - DNA, 23 bp, Homo sapiens
caggctgggtcctgccagctgga

SEQ ID NO: 4482379 - DNA, 13 bp, Homo sapiens
caggctgtcctta

SEQ ID NO: 4482380 - DNA, 17 bp, Homo sapiens
caggctgtctggccagg

SEQ ID NO: 4482381 - DNA, 14 bp, Homo sapiens
caggctgttccatg

SEQ ID NO: 4482382 - DNA, 14 bp, Homo sapiens
caggctgttctcag

SEQ ID NO: 4482383 - DNA, 15 bp, Homo sapiens
caggctgttctcagc

SEQ ID NO: 4482384 - DNA, 15 bp, Homo sapiens
caggctgtttcagcc

SEQ ID NO: 4482385 - DNA, 17 bp, Homo sapiens
caggcttactgagctgt

SEQ ID NO: 4482386 - DNA, 20 bp, Homo sapiens
cagggaaaattatttgcata

SEQ ID NO: 4482387 - DNA, 12 bp, Homo sapiens
cagggaaacagc

SEQ ID NO: 4482388 - DNA, 14 bp, Homo sapiens
cagggaaacagcct

SEQ ID NO: 4482389 - DNA, 15 bp, Homo sapiens
cagggaaacagcctc

SEQ ID NO: 4482390 - DNA, 17 bp, Homo sapiens
cagggaagctggccgag

SEQ ID NO: 4482391 - DNA, 22 bp, Homo sapiens
cagggaaggtggccacagcaag

SEQ ID NO: 4482392 - DNA, 18 bp, Homo sapiens
cagggaatgcagcaggaa

SEQ ID NO: 4482393 - DNA, 22 bp, Homo sapiens
cagggaattcttacagccaagt

SEQ ID NO: 4482394 - DNA, 15 bp, Homo sapiens
cagggacaccagcca

SEQ ID NO: 4482395 - DNA, 20 bp, Homo sapiens
cagggacaccagccaggctc

SEQ ID NO: 4482396 - DNA, 21 bp, Homo sapiens
cagggacaccagccaggctct

SEQ ID NO: 4482397 - DNA, 14 bp, Homo sapiens
cagggacagagaca

SEQ ID NO: 4482398 - DNA, 17 bp, Homo sapiens
cagggacagagacacct

SEQ ID NO: 4482399 - DNA, 23 bp, Homo sapiens
cagggacagagacacctgcacct

SEQ ID NO: 4482400 - DNA, 19 bp, Homo sapiens
cagggacatgccctgtgtg

SEQ ID NO: 4482401 - DNA, 22 bp, Homo sapiens
cagggacatgccctgtgtggct

SEQ ID NO: 4482402 - DNA, 20 bp, Homo sapiens
cagggaccggtgctgcagga

SEQ ID NO: 4482403 - DNA, 12 bp, Homo sapiens
cagggacctgct

SEQ ID NO: 4482404 - DNA, 15 bp, Homo sapiens
cagggacctgctgct

SEQ ID NO: 4482405 - DNA, 18 bp, Homo sapiens
cagggacctgctgctcag

SEQ ID NO: 4482406 - DNA, 14 bp, Homo sapiens
cagggagaatgttg

SEQ ID NO: 4482407 - DNA, 15 bp, Homo sapiens
cagggagacatctgc

SEQ ID NO: 4482408 - DNA, 14 bp, Homo sapiens
cagggagcagggaa

SEQ ID NO: 4482409 - DNA, 15 bp, Homo sapiens
cagggaggaaggagg

SEQ ID NO: 4482410 - DNA, 22 bp, Homo sapiens
cagggaggctcccggggcctgg

SEQ ID NO: 4482411 - DNA, 12 bp, Homo sapiens
cagggagggctt

SEQ ID NO: 4482412 - DNA, 13 bp, Homo sapiens
cagggaggggagg

SEQ ID NO: 4482413 - DNA, 14 bp, Homo sapiens
cagggaggggaggc

SEQ ID NO: 4482414 - DNA, 17 bp, Homo sapiens
cagggaggggaggcaga

SEQ ID NO: 4482415 - DNA, 14 bp, Homo sapiens
cagggatattgcct

SEQ ID NO: 4482416 - DNA, 15 bp, Homo sapiens
cagggatattgcctt

SEQ ID NO: 4482417 - DNA, 20 bp, Homo sapiens
cagggatcacagaccacagg

SEQ ID NO: 4482418 - DNA, 20 bp, Homo sapiens
cagggatgattcaagccatt

SEQ ID NO: 4482419 - DNA, 14 bp, Homo sapiens
cagggatgctgggc

SEQ ID NO: 4482420 - DNA, 19 bp, Homo sapiens
cagggatgctgggctgggc

SEQ ID NO: 4482421 - DNA, 20 bp, Homo sapiens
cagggatgctgggctgggcc

SEQ ID NO: 4482422 - DNA, 22 bp, Homo sapiens
cagggatgctgggctgggccct

SEQ ID NO: 4482423 - DNA, 19 bp, Homo sapiens
cagggatgggcagcccaac

SEQ ID NO: 4482424 - DNA, 17 bp, Homo sapiens
cagggatgggggatggg

SEQ ID NO: 4482425 - DNA, 22 bp, Homo sapiens
cagggatgggggatgggccagg

SEQ ID NO: 4482426 - DNA, 15 bp, Homo sapiens
cagggatgttcctta

SEQ ID NO: 4482427 - DNA, 21 bp, Homo sapiens
caggagcctggtccttccctg

SEQ ID NO: 4482428 - DNA, 18 bp, Homo sapiens
caggagctcttcaggcct

SEQ ID NO: 4482429 - DNA, 19 bp, Homo sapiens
caggagctcttcaggcctc

SEQ ID NO: 4482430 - DNA, 15 bp, Homo sapiens
caggagcttcaatga

SEQ ID NO: 4482431 - DNA, 23 bp, Homo sapiens
caggagcttgggcagtgccccag

SEQ ID NO: 4482432 - DNA, 20 bp, Homo sapiens
caggagcttgggtctctctc

SEQ ID NO: 4482433 - DNA, 21 bp, Homo sapiens
caggagcttgggtctctctcg

SEQ ID NO: 4482434 - DNA, 17 bp, Homo sapiens
caggaggaaaaggcttg

SEQ ID NO: 4482435 - DNA, 22 bp, Homo sapiens
caggaggagaaaagaaatgcac

SEQ ID NO: 4482436 - DNA, 16 bp, Homo sapiens
caggaggcgaataaat

SEQ ID NO: 4482437 - DNA, 19 bp, Homo sapiens
caggaggcgaataaatgtt

SEQ ID NO: 4482438 - DNA, 17 bp, Homo sapiens
caggaggctgaggcaga

SEQ ID NO: 4482439 - DNA, 18 bp, Homo sapiens
caggaggctgaggcagaa

SEQ ID NO: 4482440 - DNA, 20 bp, Homo sapiens
caggaggctgaggcagaaga

SEQ ID NO: 4482441 - DNA, 14 bp, Homo sapiens
caggaggctgccac

SEQ ID NO: 4482442 - DNA, 13 bp, Homo sapiens
caggagggccagc

SEQ ID NO: 4482443 - DNA, 19 bp, Homo sapiens
caggagggccagcgctgtg

SEQ ID NO: 4482444 - DNA, 12 bp, Homo sapiens
caggagggccct

SEQ ID NO: 4482445 - DNA, 16 bp, Homo sapiens
caggagggccctacct

SEQ ID NO: 4482446 - DNA, 16 bp, Homo sapiens
caggaggtcacctgcc

SEQ ID NO: 4482447 - DNA, 21 bp, Homo sapiens
caggagtcacagatgaggccc

SEQ ID NO: 4482448 - DNA, 14 bp, Homo sapiens
caggagtccagacc

SEQ ID NO: 4482449 - DNA, 21 bp, Homo sapiens
caggagtccagaccccccagc

SEQ ID NO: 4482450 - DNA, 22 bp, Homo sapiens
caggagtccagaccccccagcc

SEQ ID NO: 4482451 - DNA, 19 bp, Homo sapiens
caggagtccagcccctcct

SEQ ID NO: 4482452 - DNA, 20 bp, Homo sapiens
caggagtccagcccctcctc

SEQ ID NO: 4482453 - DNA, 22 bp, Homo sapiens
caggagtccagcccctcctccc

SEQ ID NO: 4482454 - DNA, 23 bp, Homo sapiens
caggagtccagcccctcctccct

SEQ ID NO: 4482455 - DNA, 21 bp, Homo sapiens
caggagtccaggcccccagcc

SEQ ID NO: 4482456 - DNA, 23 bp, Homo sapiens
caggagtccaggcccccagcccc

SEQ ID NO: 4482457 - DNA, 21 bp, Homo sapiens
caggagtccctgccatcatgt

SEQ ID NO: 4482458 - DNA, 15 bp, Homo sapiens
caggagtctgccact

SEQ ID NO: 4482459 - DNA, 17 bp, Homo sapiens
caggagtgggttgattt

SEQ ID NO: 4482460 - DNA, 21 bp, Homo sapiens
caggagtgtcctcttccctct

SEQ ID NO: 4482461 - DNA, 22 bp, Homo sapiens
caggagtgtcctgcccatgccc

SEQ ID NO: 4482462 - DNA, 16 bp, Homo sapiens
caggagtgtcctggct

SEQ ID NO: 4482463 - DNA, 19 bp, Homo sapiens
caggagttcaagaccagcc

SEQ ID NO: 4482464 - DNA, 21 bp, Homo sapiens
caggagttcaagaccagcctg

SEQ ID NO: 4482465 - DNA, 16 bp, Homo sapiens
caggagtttgagacca

SEQ ID NO: 4482466 - DNA, 22 bp, Homo sapiens
caggagtttgagaccaggctgg

SEQ ID NO: 4482467 - DNA, 19 bp, Homo sapiens
caggagtttgaggctgcaa

SEQ ID NO: 4482468 - DNA, 17 bp, Homo sapiens
caggagttttactgcct

SEQ ID NO: 4482469 - DNA, 17 bp, Homo sapiens
caggatactggcacaga

SEQ ID NO: 4482470 - DNA, 19 bp, Homo sapiens
caggatactggcacagagg

SEQ ID NO: 4482471 - DNA, 23 bp, Homo sapiens
caggatatcacattggagtcact

SEQ ID NO: 4482472 - DNA, 17 bp, Homo sapiens
caggatcagttaactat

SEQ ID NO: 4482473 - DNA, 21 bp, Homo sapiens
caggatcccaggggcccaagg

SEQ ID NO: 4482474 - DNA, 14 bp, Homo sapiens
caggatctgctcca

SEQ ID NO: 4482475 - DNA, 17 bp, Homo sapiens
caggatctgtctgtgca

SEQ ID NO: 4482476 - DNA, 18 bp, Homo sapiens
caggatctgtctgtgcac

SEQ ID NO: 4482477 - DNA, 14 bp, Homo sapiens
caggatgaggacag

SEQ ID NO: 4482478 - DNA, 21 bp, Homo sapiens
caggatggcctttccttccct

SEQ ID NO: 4482479 - DNA, 23 bp, Homo sapiens
caggatggggtatggattctaaa

SEQ ID NO: 4482480 - DNA, 18 bp, Homo sapiens
caggatgtaggggttaac

SEQ ID NO: 4482481 - DNA, 22 bp, Homo sapiens
caggatttgaactcagatctgt

SEQ ID NO: 4482482 - DNA, 15 bp, Homo sapiens
caggatttggccaca

SEQ ID NO: 4482483 - DNA, 23 bp, Homo sapiens
caggatttggccacactggggct

SEQ ID NO: 4482484 - DNA, 23 bp, Homo sapiens
caggcaaaggaggggaaacaatg

SEQ ID NO: 4482485 - DNA, 18 bp, Homo sapiens
caggcaatcgttctgctg

SEQ ID NO: 4482486 - DNA, 20 bp, Homo sapiens
caggcaatcgttctgctggc

SEQ ID NO: 4482487 - DNA, 13 bp, Homo sapiens
caggcacacacag

SEQ ID NO: 4482488 - DNA, 16 bp, Homo sapiens
caggcacacagggccc

SEQ ID NO: 4482489 - DNA, 18 bp, Homo sapiens
caggcacccgtccccaca

SEQ ID NO: 4482490 - DNA, 20 bp, Homo sapiens
caggcaccctcagggagcct

SEQ ID NO: 4482491 - DNA, 17 bp, Homo sapiens
caggcacgaacccacct

SEQ ID NO: 4482492 - DNA, 20 bp, Homo sapiens
caggcacgaacccacctgct

SEQ ID NO: 4482493 - DNA, 21 bp, Homo sapiens
caggcacgaacccacctgctg

SEQ ID NO: 4482494 - DNA, 22 bp, Homo sapiens
caggcagatctgtgccccatgc

SEQ ID NO: 4482495 - DNA, 14 bp, Homo sapiens
caggcagcactgac

SEQ ID NO: 4482496 - DNA, 12 bp, Homo sapiens
caggcagcccag

SEQ ID NO: 4482497 - DNA, 14 bp, Homo sapiens
caggcagcccagca

SEQ ID NO: 4482498 - DNA, 15 bp, Homo sapiens
caggcagcctatgaa

SEQ ID NO: 4482499 - DNA, 20 bp, Homo sapiens
caggcagcttctactcctgc

SEQ ID NO: 4482500 - DNA, 14 bp, Homo sapiens
caggcaggagccct

SEQ ID NO: 4482501 - DNA, 14 bp, Homo sapiens
caggcagggagggc

SEQ ID NO: 4482502 - DNA, 14 bp, Homo sapiens
caggcagggcctgg

SEQ ID NO: 4482503 - DNA, 20 bp, Homo sapiens
caggcagggcctggctccag

SEQ ID NO: 4482504 - DNA, 21 bp, Homo sapiens
caggcagggcctggctccagt

SEQ ID NO: 4482505 - DNA, 13 bp, Homo sapiens
caggcaggggtgg

SEQ ID NO: 4482506 - DNA, 23 bp, Homo sapiens
caggcaggggtgggggtggaggc

SEQ ID NO: 4482507 - DNA, 14 bp, Homo sapiens
caggcatagaggct

SEQ ID NO: 4482508 - DNA, 17 bp, Homo sapiens
caggcatagaggcttct

SEQ ID NO: 4482509 - DNA, 19 bp, Homo sapiens
caggcatagaggcttctcc

SEQ ID NO: 4482510 - DNA, 21 bp, Homo sapiens
caggcatagaggcttctccgc

SEQ ID NO: 4482511 - DNA, 23 bp, Homo sapiens
caggcatagaggcttctccgcca

SEQ ID NO: 4482512 - DNA, 20 bp, Homo sapiens
caggcatattccctgcacac

SEQ ID NO: 4482513 - DNA, 21 bp, Homo sapiens
caggcatattccctgcacaca

SEQ ID NO: 4482514 - DNA, 20 bp, Homo sapiens
caggcatcggggagccggga

SEQ ID NO: 4482515 - DNA, 19 bp, Homo sapiens
caggcattgccaagggctt

SEQ ID NO: 4482516 - DNA, 18 bp, Homo sapiens
caggcatttgactgaaga

SEQ ID NO: 4482517 - DNA, 21 bp, Homo sapiens
caggcatttgactgaagatgc

SEQ ID NO: 4482518 - DNA, 17 bp, Homo sapiens
caggcatttgctaaggc

SEQ ID NO: 4482519 - DNA, 21 bp, Homo sapiens
caggcatttgctaaggcagct

SEQ ID NO: 4482520 - DNA, 22 bp, Homo sapiens
caggccaaagagtctccagttt

SEQ ID NO: 4482521 - DNA, 16 bp, Homo sapiens
caggccaacagcacct

SEQ ID NO: 4482522 - DNA, 16 bp, Homo sapiens
caggccaagggaccag

SEQ ID NO: 4482523 - DNA, 15 bp, Homo sapiens
caggccacagccagg

SEQ ID NO: 4482524 - DNA, 17 bp, Homo sapiens
caggccagatggcccct

SEQ ID NO: 4482525 - DNA, 21 bp, Homo sapiens
caggccagcaggcgggctcct

SEQ ID NO: 4482526 - DNA, 12 bp, Homo sapiens
caggccagccca

SEQ ID NO: 4482527 - DNA, 19 bp, Homo sapiens
caggccagcccagccaggc

SEQ ID NO: 4482528 - DNA, 20 bp, Homo sapiens
caggccagcccagccaggcc

SEQ ID NO: 4482529 - DNA, 12 bp, Homo sapiens
caggccagcctc

SEQ ID NO: 4482530 - DNA, 13 bp, Homo sapiens
caggccagctcag

SEQ ID NO: 4482531 - DNA, 13 bp, Homo sapiens
caggccaggtgcc

SEQ ID NO: 4482532 - DNA, 16 bp, Homo sapiens
caggccaggtgcccag

SEQ ID NO: 4482533 - DNA, 18 bp, Homo sapiens
caggccaggtgcccagga

SEQ ID NO: 4482534 - DNA, 15 bp, Homo sapiens
caggccattgtgaac

SEQ ID NO: 4482535 - DNA, 16 bp, Homo sapiens
caggcccaaggctccc

SEQ ID NO: 4482536 - DNA, 17 bp, Homo sapiens
caggcccaaggctcccg

SEQ ID NO: 4482537 - DNA, 22 bp, Homo sapiens
caggcccacagcgtgggaactc

SEQ ID NO: 4482538 - DNA, 13 bp, Homo sapiens
caggcccactccc

SEQ ID NO: 4482539 - DNA, 18 bp, Homo sapiens
caggcccactccccagcc

SEQ ID NO: 4482540 - DNA, 15 bp, Homo sapiens
caggcccagctgctc

SEQ ID NO: 4482541 - DNA, 18 bp, Homo sapiens
caggcccaggagtccagg

SEQ ID NO: 4482542 - DNA, 20 bp, Homo sapiens
caggcccaggagtccaggcc

SEQ ID NO: 4482543 - DNA, 21 bp, Homo sapiens
caggcccaggagtccaggccc

SEQ ID NO: 4482544 - DNA, 14 bp, Homo sapiens
caggccccagacag

SEQ ID NO: 4482545 - DNA, 13 bp, Homo sapiens
caggccccagggg

SEQ ID NO: 4482546 - DNA, 11 bp, Homo sapiens
cagccttcccc

SEQ ID NO: 4482547 - DNA, 15 bp, Homo sapiens
cagccttcctcctca

SEQ ID NO: 4482548 - DNA, 19 bp, Homo sapiens
cagccttcggacagacata

SEQ ID NO: 4482549 - DNA, 16 bp, Homo sapiens
cagccttctactgctc

SEQ ID NO: 4482550 - DNA, 13 bp, Homo sapiens
cagccttctctca

SEQ ID NO: 4482551 - DNA, 15 bp, Homo sapiens
cagccttctctcaag

SEQ ID NO: 4482552 - DNA, 18 bp, Homo sapiens
cagccttgagccctggct

SEQ ID NO: 4482553 - DNA, 19 bp, Homo sapiens
cagccttgagccctggctg

SEQ ID NO: 4482554 - DNA, 19 bp, Homo sapiens
cagccttgcagcggctcct

SEQ ID NO: 4482555 - DNA, 16 bp, Homo sapiens
cagccttgcccagctt

SEQ ID NO: 4482556 - DNA, 19 bp, Homo sapiens
cagccttgctacttgaagg

SEQ ID NO: 4482557 - DNA, 16 bp, Homo sapiens
cagccttgctctcttc

SEQ ID NO: 4482558 - DNA, 21 bp, Homo sapiens
cagccttggataatgctgttg

SEQ ID NO: 4482559 - DNA, 18 bp, Homo sapiens
cagcctttttgtttcaat

SEQ ID NO: 4482560 - DNA, 20 bp, Homo sapiens
cagcgaccacccctgcctcc

SEQ ID NO: 4482561 - DNA, 21 bp, Homo sapiens
cagcgaccacccctgcctcca

SEQ ID NO: 4482562 - DNA, 18 bp, Homo sapiens
cagcgaggaggctccaga

SEQ ID NO: 4482563 - DNA, 18 bp, Homo sapiens
cagcgatataattttatt

SEQ ID NO: 4482564 - DNA, 24 bp, Homo sapiens
cagcgccaagtaaacagggtacct

SEQ ID NO: 4482565 - DNA, 12 bp, Homo sapiens
cagcgccccacc

SEQ ID NO: 4482566 - DNA, 22 bp, Homo sapiens
cagcgcctagtggggtctccct

SEQ ID NO: 4482567 - DNA, 14 bp, Homo sapiens
cagcgcctccctcc

SEQ ID NO: 4482568 - DNA, 15 bp, Homo sapiens
cagcgcctccctcca

SEQ ID NO: 4482569 - DNA, 21 bp, Homo sapiens
cagcgcctccctccaccccag

SEQ ID NO: 4482570 - DNA, 23 bp, Homo sapiens
cagcgctcgatggacctcagcaa

SEQ ID NO: 4482571 - DNA, 14 bp, Homo sapiens
cagcggccccccgc

SEQ ID NO: 4482572 - DNA, 12 bp, Homo sapiens
cagcggctcctg

SEQ ID NO: 4482573 - DNA, 14 bp, Homo sapiens
cagcggctcctgca

SEQ ID NO: 4482574 - DNA, 14 bp, Homo sapiens
cagcgggagccagt

SEQ ID NO: 4482575 - DNA, 18 bp, Homo sapiens
cagcgggctggcgggcct

SEQ ID NO: 4482576 - DNA, 22 bp, Homo sapiens
cagcgggctggcgggccttttt

SEQ ID NO: 4482577 - DNA, 14 bp, Homo sapiens
cagcggggctgctc

SEQ ID NO: 4482578 - DNA, 22 bp, Homo sapiens
cagcggggtggggggggagaga

SEQ ID NO: 4482579 - DNA, 19 bp, Homo sapiens
cagcggtccaatgccacct

SEQ ID NO: 4482580 - DNA, 12 bp, Homo sapiens
cagcggtgcagc

SEQ ID NO: 4482581 - DNA, 13 bp, Homo sapiens
cagcgtccctggc

SEQ ID NO: 4482582 - DNA, 15 bp, Homo sapiens
cagcgtccctggcgc

SEQ ID NO: 4482583 - DNA, 15 bp, Homo sapiens
cagcgtcctgtccac

SEQ ID NO: 4482584 - DNA, 18 bp, Homo sapiens
cagcgtcttccttcttta

SEQ ID NO: 4482585 - DNA, 19 bp, Homo sapiens
cagcgtgctttaaaaaata

SEQ ID NO: 4482586 - DNA, 21 bp, Homo sapiens
cagcgttcctagagaagacag

SEQ ID NO: 4482587 - DNA, 14 bp, Homo sapiens
cagcgtttattgta

SEQ ID NO: 4482588 - DNA, 17 bp, Homo sapiens
cagcgtttattgtagta

SEQ ID NO: 4482589 - DNA, 21 bp, Homo sapiens
cagctaacccgtgcagaacca

SEQ ID NO: 4482590 - DNA, 22 bp, Homo sapiens
cagctaaggaggggaaaaaaat

SEQ ID NO: 4482591 - DNA, 17 bp, Homo sapiens
cagctaatttttgtatt

SEQ ID NO: 4482592 - DNA, 18 bp, Homo sapiens
cagctaatttttgtattt

SEQ ID NO: 4482593 - DNA, 21 bp, Homo sapiens
cagctacaaacttttaagatt

SEQ ID NO: 4482594 - DNA, 19 bp, Homo sapiens
cagctactcaggaggctga

SEQ ID NO: 4482595 - DNA, 13 bp, Homo sapiens
cagctactctccc

SEQ ID NO: 4482596 - DNA, 14 bp, Homo sapiens
cagctactggaatg

SEQ ID NO: 4482597 - DNA, 18 bp, Homo sapiens
cagctacttgggaggctg

SEQ ID NO: 4482598 - DNA, 15 bp, Homo sapiens
cagctagaatttctg

SEQ ID NO: 4482599 - DNA, 20 bp, Homo sapiens
cagctagtgccaaataattg

SEQ ID NO: 4482600 - DNA, 12 bp, Homo sapiens
cagctagtgcct

SEQ ID NO: 4482601 - DNA, 13 bp, Homo sapiens
cagctagtgcctt

SEQ ID NO: 4482602 - DNA, 14 bp, Homo sapiens
cagctataattctg

SEQ ID NO: 4482603 - DNA, 18 bp, Homo sapiens
cagctataattctgttat

SEQ ID NO: 4482604 - DNA, 14 bp, Homo sapiens
cagctatatttgat

SEQ ID NO: 4482605 - DNA, 14 bp, Homo sapiens
cagctatctgtcat

SEQ ID NO: 4482606 - DNA, 13 bp, Homo sapiens
cagctatgggagc

SEQ ID NO: 4482607 - DNA, 15 bp, Homo sapiens
cagctatgggagccc

SEQ ID NO: 4482608 - DNA, 20 bp, Homo sapiens
cagctatgggagccccaggg

SEQ ID NO: 4482609 - DNA, 21 bp, Homo sapiens
cagctatgggagccccagggt

SEQ ID NO: 4482610 - DNA, 16 bp, Homo sapiens
cagctatgtagcaaag

SEQ ID NO: 4482611 - DNA, 20 bp, Homo sapiens
cagctatgttatattgaaaa

SEQ ID NO: 4482612 - DNA, 23 bp, Homo sapiens
cagctattggcaagttttaaacc

SEQ ID NO: 4482613 - DNA, 15 bp, Homo sapiens
cagctattttgtgaa

SEQ ID NO: 4482614 - DNA, 19 bp, Homo sapiens
cagctcaccccccacactc

SEQ ID NO: 4482615 - DNA, 20 bp, Homo sapiens
cagctcaccccccacactca

SEQ ID NO: 4482616 - DNA, 19 bp, Homo sapiens
cagctcaggaattccctgg

SEQ ID NO: 4482617 - DNA, 19 bp, Homo sapiens
cagctccatgttctcccaa

SEQ ID NO: 4482618 - DNA, 11 bp, Homo sapiens
cagctcccaca

SEQ ID NO: 4482619 - DNA, 12 bp, Homo sapiens
cagctcccacac

SEQ ID NO: 4482620 - DNA, 13 bp, Homo sapiens
cagctcccacacc

SEQ ID NO: 4482621 - DNA, 15 bp, Homo sapiens
cagctcccacaccgc

SEQ ID NO: 4482622 - DNA, 14 bp, Homo sapiens
cagctcccacccca

SEQ ID NO: 4482623 - DNA, 19 bp, Homo sapiens
cagctcccaccccaccccc

SEQ ID NO: 4482624 - DNA, 23 bp, Homo sapiens
cagctcccaccccacccccttca

SEQ ID NO: 4482625 - DNA, 18 bp, Homo sapiens
cagctcccctcggagaag

SEQ ID NO: 4482626 - DNA, 22 bp, Homo sapiens
cagctcccctcggagaagagct

SEQ ID NO: 4482627 - DNA, 16 bp, Homo sapiens
cagctcccctcttttg

SEQ ID NO: 4482628 - DNA, 19 bp, Homo sapiens
cagctcccctcttttgtaa

SEQ ID NO: 4482629 - DNA, 12 bp, Homo sapiens
cagctccctggc

SEQ ID NO: 4482630 - DNA, 17 bp, Homo sapiens
cagctccctttctcagg

SEQ ID NO: 4482631 - DNA, 20 bp, Homo sapiens
cagctccctttctcaggagc

SEQ ID NO: 4482632 - DNA, 22 bp, Homo sapiens
cagctccctttctcaggagctt

SEQ ID NO: 4482633 - DNA, 14 bp, Homo sapiens
cagctcctggacca

SEQ ID NO: 4482634 - DNA, 14 bp, Homo sapiens
cagctccttcctgg

SEQ ID NO: 4482635 - DNA, 18 bp, Homo sapiens
cagctcctttctcctgtg

SEQ ID NO: 4482636 - DNA, 21 bp, Homo sapiens
cagctcctttctcctgtgaat

SEQ ID NO: 4482637 - DNA, 22 bp, Homo sapiens
cagctcctttctcctgtgaatg

SEQ ID NO: 4482638 - DNA, 18 bp, Homo sapiens
cagctcgatccaaattgt

SEQ ID NO: 4482639 - DNA, 20 bp, Homo sapiens
cagctctaggctgttctgta

SEQ ID NO: 4482640 - DNA, 17 bp, Homo sapiens
cagctctccctctggcc

SEQ ID NO: 4482641 - DNA, 21 bp, Homo sapiens
cagctctccctctggccctgc

SEQ ID NO: 4482642 - DNA, 23 bp, Homo sapiens
cagctctccctctggccctgcct

SEQ ID NO: 4482643 - DNA, 13 bp, Homo sapiens
cagctctctggga

SEQ ID NO: 4482644 - DNA, 19 bp, Homo sapiens
cagctctgaaaccagtgtt

SEQ ID NO: 4482645 - DNA, 14 bp, Homo sapiens
cagctctgagccag

SEQ ID NO: 4482646 - DNA, 15 bp, Homo sapiens
cagctctgagccaga

SEQ ID NO: 4482647 - DNA, 17 bp, Homo sapiens
cagctctgatctgaggc

SEQ ID NO: 4482648 - DNA, 23 bp, Homo sapiens
cagctctgcccccgcgggttcta

SEQ ID NO: 4482649 - DNA, 13 bp, Homo sapiens
cagctctgccttg

SEQ ID NO: 4482650 - DNA, 22 bp, Homo sapiens
cagctctgccttgcactgtggt

SEQ ID NO: 4482651 - DNA, 18 bp, Homo sapiens
cagctctgctatgagtgt

SEQ ID NO: 4482652 - DNA, 14 bp, Homo sapiens
cagctctggcacag

SEQ ID NO: 4482653 - DNA, 18 bp, Homo sapiens
cagctctggggcagagga

SEQ ID NO: 4482654 - DNA, 20 bp, Homo sapiens
cagctctggggcagaggaag

SEQ ID NO: 4482655 - DNA, 13 bp, Homo sapiens
cagctgactaaac

SEQ ID NO: 4482656 - DNA, 19 bp, Homo sapiens
cagctgactccagtataat

SEQ ID NO: 4482657 - DNA, 20 bp, Homo sapiens
cagctgagagccctgctgtg

SEQ ID NO: 4482658 - DNA, 21 bp, Homo sapiens
cagctgagagccctgctgtgg

SEQ ID NO: 4482659 - DNA, 22 bp, Homo sapiens
cagctgagcacttagcaggcac

SEQ ID NO: 4482660 - DNA, 12 bp, Homo sapiens
cagctgcaaagt

SEQ ID NO: 4482661 - DNA, 22 bp, Homo sapiens
cagctgccccggcccctccccc

SEQ ID NO: 4482662 - DNA, 14 bp, Homo sapiens
cagctgcctcactt

SEQ ID NO: 4482663 - DNA, 17 bp, Homo sapiens
cagctgcctcacttcct

SEQ ID NO: 4482664 - DNA, 15 bp, Homo sapiens
cagctgcctcctgcg

SEQ ID NO: 4482665 - DNA, 15 bp, Homo sapiens
cagctgccttagctt

SEQ ID NO: 4482666 - DNA, 17 bp, Homo sapiens
cagctgcgcttgctttt

SEQ ID NO: 4482667 - DNA, 18 bp, Homo sapiens
caagattcccagagacag

SEQ ID NO: 4482668 - DNA, 16 bp, Homo sapiens
caagatttaaaattaa

SEQ ID NO: 4482669 - DNA, 16 bp, Homo sapiens
caagatttccttgtgc

SEQ ID NO: 4482670 - DNA, 17 bp, Homo sapiens
caagattttccacaaga

SEQ ID NO: 4482671 - DNA, 19 bp, Homo sapiens
caagattttttttgtaact

SEQ ID NO: 4482672 - DNA, 19 bp, Homo sapiens
caagcaaggatatcagagc

SEQ ID NO: 4482673 - DNA, 22 bp, Homo sapiens
caagcaatcctcctgcctcagc

SEQ ID NO: 4482674 - DNA, 17 bp, Homo sapiens
caagcacactggaatat

SEQ ID NO: 4482675 - DNA, 15 bp, Homo sapiens
caagcacagagcctg

SEQ ID NO: 4482676 - DNA, 14 bp, Homo sapiens
caagcacagccctt

SEQ ID NO: 4482677 - DNA, 22 bp, Homo sapiens
caagcactaaaaagttgaacca

SEQ ID NO: 4482678 - DNA, 20 bp, Homo sapiens
caagcactatgcccttttat

SEQ ID NO: 4482679 - DNA, 20 bp, Homo sapiens
caagcactcggggtccctgg

SEQ ID NO: 4482680 - DNA, 23 bp, Homo sapiens
caagcactcggggtccctggagg

SEQ ID NO: 4482681 - DNA, 17 bp, Homo sapiens
caagcagcatcttctgg

SEQ ID NO: 4482682 - DNA, 23 bp, Homo sapiens
caagcagctttttattccctgcc

SEQ ID NO: 4482683 - DNA, 23 bp, Homo sapiens
caagcaggaaatgaaaatgtctt

SEQ ID NO: 4482684 - DNA, 18 bp, Homo sapiens
caagcaggacagtgcttg

SEQ ID NO: 4482685 - DNA, 20 bp, Homo sapiens
caagcatgtttaaaacaaat

SEQ ID NO: 4482686 - DNA, 16 bp, Homo sapiens
caagcattcagaagaa

SEQ ID NO: 4482687 - DNA, 13 bp, Homo sapiens
caagcatttcatg

SEQ ID NO: 4482688 - DNA, 20 bp, Homo sapiens
caagccaaaagtccctccct

SEQ ID NO: 4482689 - DNA, 21 bp, Homo sapiens
caagccaaagagcctcccacc

SEQ ID NO: 4482690 - DNA, 20 bp, Homo sapiens
caagccacaagctgacccct

SEQ ID NO: 4482691 - DNA, 22 bp, Homo sapiens
caagccactcggcggcagcatg

SEQ ID NO: 4482692 - DNA, 15 bp, Homo sapiens
caagccagacctagc

SEQ ID NO: 4482693 - DNA, 21 bp, Homo sapiens
caagccagacctagcaggctg

SEQ ID NO: 4482694 - DNA, 22 bp, Homo sapiens
caagccagacctagcaggctgt

SEQ ID NO: 4482695 - DNA, 22 bp, Homo sapiens
caagcccacgtcaggcctggcc

SEQ ID NO: 4482696 - DNA, 17 bp, Homo sapiens
caagccccatttcctca

SEQ ID NO: 4482697 - DNA, 17 bp, Homo sapiens
caagcccctctttctgt

SEQ ID NO: 4482698 - DNA, 23 bp, Homo sapiens
caagccctcctccccagagctgg

SEQ ID NO: 4482699 - DNA, 11 bp, Homo sapiens
caagccctgcc

SEQ ID NO: 4482700 - DNA, 14 bp, Homo sapiens
caagccctgcccac

SEQ ID NO: 4482701 - DNA, 19 bp, Homo sapiens
caagccctgcccacagaaa

SEQ ID NO: 4482702 - DNA, 11 bp, Homo sapiens
caagccctggc

SEQ ID NO: 4482703 - DNA, 13 bp, Homo sapiens
caagccctggccc

SEQ ID NO: 4482704 - DNA, 21 bp, Homo sapiens
caagccgaccttccctccgcc

SEQ ID NO: 4482705 - DNA, 18 bp, Homo sapiens
caagcctaagggatcctg

SEQ ID NO: 4482706 - DNA, 13 bp, Homo sapiens
caagcctcctgta

SEQ ID NO: 4482707 - DNA, 13 bp, Homo sapiens
caagcctgagaac

SEQ ID NO: 4482708 - DNA, 16 bp, Homo sapiens
caagcctgctggctgc

SEQ ID NO: 4482709 - DNA, 16 bp, Homo sapiens
caagccttactcacct

SEQ ID NO: 4482710 - DNA, 19 bp, Homo sapiens
caagccttactcacctctc

SEQ ID NO: 4482711 - DNA, 14 bp, Homo sapiens
caagcgagcacagt

SEQ ID NO: 4482712 - DNA, 15 bp, Homo sapiens
caagcgtgttctcag

SEQ ID NO: 4482713 - DNA, 18 bp, Homo sapiens
caagcgtgttctcagcac

SEQ ID NO: 4482714 - DNA, 15 bp, Homo sapiens
caagcgttcctggcc

SEQ ID NO: 4482715 - DNA, 18 bp, Homo sapiens
caagcgttcctggccttc

SEQ ID NO: 4482716 - DNA, 12 bp, Homo sapiens
caagctcacagt

SEQ ID NO: 4482717 - DNA, 22 bp, Homo sapiens
caagctcaggaggcgaataaat

SEQ ID NO: 4482718 - DNA, 15 bp, Homo sapiens
caagctgcactgtga

SEQ ID NO: 4482719 - DNA, 16 bp, Homo sapiens
caagctgcccagccct

SEQ ID NO: 4482720 - DNA, 23 bp, Homo sapiens
caagctgcttgtcctgggcctgc

SEQ ID NO: 4482721 - DNA, 17 bp, Homo sapiens
caagctgggccccagcc

SEQ ID NO: 4482722 - DNA, 20 bp, Homo sapiens
caagcttaatggctgataat

SEQ ID NO: 4482723 - DNA, 16 bp, Homo sapiens
caagcttctctgttct

SEQ ID NO: 4482724 - DNA, 14 bp, Homo sapiens
caagctttaggtaa

SEQ ID NO: 4482725 - DNA, 21 bp, Homo sapiens
caagcttttgcttgatccaga

SEQ ID NO: 4482726 - DNA, 16 bp, Homo sapiens
caaggaaaaagaaaat

SEQ ID NO: 4482727 - DNA, 13 bp, Homo sapiens
caaggaaaagttc

SEQ ID NO: 4482728 - DNA, 20 bp, Homo sapiens
caaggaaaggctcatttaaa

SEQ ID NO: 4482729 - DNA, 18 bp, Homo sapiens
caaggaagggatgtattt

SEQ ID NO: 4482730 - DNA, 20 bp, Homo sapiens
caaggaagggatgtatttgt

SEQ ID NO: 4482731 - DNA, 16 bp, Homo sapiens
caaggaagtagaaaca

SEQ ID NO: 4482732 - DNA, 12 bp, Homo sapiens
caaggaatttct

SEQ ID NO: 4482733 - DNA, 16 bp, Homo sapiens
caaggaatttcttaac

SEQ ID NO: 4482734 - DNA, 14 bp, Homo sapiens
caaggacaccctcc

SEQ ID NO: 4482735 - DNA, 14 bp, Homo sapiens
caaggacaggagcc

SEQ ID NO: 4482736 - DNA, 15 bp, Homo sapiens
caaggacaggagcct

SEQ ID NO: 4482737 - DNA, 18 bp, Homo sapiens
caaggaccaggactccct

SEQ ID NO: 4482738 - DNA, 14 bp, Homo sapiens
caaggacccaggcg

SEQ ID NO: 4482739 - DNA, 16 bp, Homo sapiens
caaggacccaggcgct

SEQ ID NO: 4482740 - DNA, 18 bp, Homo sapiens
caaggacccaggcgctgc

SEQ ID NO: 4482741 - DNA, 14 bp, Homo sapiens
caaggactgaggga

SEQ ID NO: 4482742 - DNA, 13 bp, Homo sapiens
caaggagaacaaa

SEQ ID NO: 4482743 - DNA, 16 bp, Homo sapiens
caaggaggcccactgt

SEQ ID NO: 4482744 - DNA, 12 bp, Homo sapiens
caaggaggcctg

SEQ ID NO: 4482745 - DNA, 13 bp, Homo sapiens
caaggaggcctgg

SEQ ID NO: 4482746 - DNA, 13 bp, Homo sapiens
caaggagggaaga

SEQ ID NO: 4482747 - DNA, 23 bp, Homo sapiens
caaggagggtgtaatggagcatc

SEQ ID NO: 4482748 - DNA, 18 bp, Homo sapiens
caaggagtttattacaat

SEQ ID NO: 4482749 - DNA, 18 bp, Homo sapiens
caaggatcggactctgcc

SEQ ID NO: 4482750 - DNA, 20 bp, Homo sapiens
caaggatcggactctgcccc

SEQ ID NO: 4482751 - DNA, 23 bp, Homo sapiens
caaggattctgttctgcaactcc

SEQ ID NO: 4482752 - DNA, 17 bp, Homo sapiens
caaggcaagcatgaata

SEQ ID NO: 4482753 - DNA, 14 bp, Homo sapiens
caaggccagagtgg

SEQ ID NO: 4482754 - DNA, 20 bp, Homo sapiens
caaggccagagtggcctggc

SEQ ID NO: 4482755 - DNA, 20 bp, Homo sapiens
caaggccagtccccatttct

SEQ ID NO: 4482756 - DNA, 16 bp, Homo sapiens
caaggcccagaagcct

SEQ ID NO: 4482757 - DNA, 19 bp, Homo sapiens
caaggccgctgttcaccca

SEQ ID NO: 4482758 - DNA, 20 bp, Homo sapiens
caaggccgctgttcacccac

SEQ ID NO: 4482759 - DNA, 16 bp, Homo sapiens
caaggcctaccccagt

SEQ ID NO: 4482760 - DNA, 21 bp, Homo sapiens
caaggcgagtttccccactaa

SEQ ID NO: 4482761 - DNA, 13 bp, Homo sapiens
caaggcggcccct

SEQ ID NO: 4482762 - DNA, 22 bp, Homo sapiens
caaggctcagaaggaatggtgc

SEQ ID NO: 4482763 - DNA, 15 bp, Homo sapiens
caagggaaaagtctc

SEQ ID NO: 4482764 - DNA, 14 bp, Homo sapiens
caagggaaaggggt

SEQ ID NO: 4482765 - DNA, 14 bp, Homo sapiens
caagggaagagcct

SEQ ID NO: 4482766 - DNA, 13 bp, Homo sapiens
caagggagaagac

SEQ ID NO: 4482767 - DNA, 21 bp, Homo sapiens
caagggagaagacaacagaaa

SEQ ID NO: 4482768 - DNA, 22 bp, Homo sapiens
caagggatctgccattgggacc

SEQ ID NO: 4482769 - DNA, 20 bp, Homo sapiens
caagggcagaacactaacct

SEQ ID NO: 4482770 - DNA, 20 bp, Homo sapiens
caagggctttgttttgcaca

SEQ ID NO: 4482771 - DNA, 20 bp, Homo sapiens
caaggggtggccgggcacag

SEQ ID NO: 4482772 - DNA, 16 bp, Homo sapiens
caagggtacagatccc

SEQ ID NO: 4482773 - DNA, 22 bp, Homo sapiens
caagggtacagatccccagccc

SEQ ID NO: 4482774 - DNA, 19 bp, Homo sapiens
caagggtccgtggaccagg

SEQ ID NO: 4482775 - DNA, 16 bp, Homo sapiens
caagggttgagagcca

SEQ ID NO: 4482776 - DNA, 19 bp, Homo sapiens
caagggttgagagccagtg

SEQ ID NO: 4482777 - DNA, 19 bp, Homo sapiens
caaggtaggctgcaaaatt

SEQ ID NO: 4482778 - DNA, 20 bp, Homo sapiens
caaggtcacttaaagggtct

SEQ ID NO: 4482779 - DNA, 21 bp, Homo sapiens
caaggtcatagacaattcctc

SEQ ID NO: 4482780 - DNA, 15 bp, Homo sapiens
caaggtcctcttgaa

SEQ ID NO: 4482781 - DNA, 14 bp, Homo sapiens
caaggtgctaacat

SEQ ID NO: 4482782 - DNA, 22 bp, Homo sapiens
caaggtggcagatgtcttccct

SEQ ID NO: 4482783 - DNA, 21 bp, Homo sapiens
caaggtggcctttgtgctgcg

SEQ ID NO: 4482784 - DNA, 20 bp, Homo sapiens
caaggtggggattgcccctg

SEQ ID NO: 4482785 - DNA, 17 bp, Homo sapiens
caaggtggtgtgatctt

SEQ ID NO: 4482786 - DNA, 20 bp, Homo sapiens
caaggtgtgctctgagccac

SEQ ID NO: 4482787 - DNA, 19 bp, Homo sapiens
caactcgctttaggtcagc

SEQ ID NO: 4482788 - DNA, 17 bp, Homo sapiens
caactctaatattgctt

SEQ ID NO: 4482789 - DNA, 11 bp, Homo sapiens
caactctcccc

SEQ ID NO: 4482790 - DNA, 13 bp, Homo sapiens
caactctccccag

SEQ ID NO: 4482791 - DNA, 18 bp, Homo sapiens
caactctgaaagagcaaa

SEQ ID NO: 4482792 - DNA, 22 bp, Homo sapiens
caactctgaaagagcaaaccta

SEQ ID NO: 4482793 - DNA, 12 bp, Homo sapiens
caactcttgatt

SEQ ID NO: 4482794 - DNA, 18 bp, Homo sapiens
caactcttgattatccat

SEQ ID NO: 4482795 - DNA, 19 bp, Homo sapiens
caactcttttaagtgcctt

SEQ ID NO: 4482796 - DNA, 15 bp, Homo sapiens
caactgacctgccag

SEQ ID NO: 4482797 - DNA, 15 bp, Homo sapiens
caactgccaggctgc

SEQ ID NO: 4482798 - DNA, 16 bp, Homo sapiens
caactgccaggctgcc

SEQ ID NO: 4482799 - DNA, 21 bp, Homo sapiens
caactgccaggctgcctcctg

SEQ ID NO: 4482800 - DNA, 14 bp, Homo sapiens
caactgcccagcaa

SEQ ID NO: 4482801 - DNA, 15 bp, Homo sapiens
caactgccccagggg

SEQ ID NO: 4482802 - DNA, 22 bp, Homo sapiens
caactgcctactccaaaatgtt

SEQ ID NO: 4482803 - DNA, 14 bp, Homo sapiens
caactgctccagcc

SEQ ID NO: 4482804 - DNA, 17 bp, Homo sapiens
caactgctccagcctct

SEQ ID NO: 4482805 - DNA, 22 bp, Homo sapiens
caactggagtgggtagaagcct

SEQ ID NO: 4482806 - DNA, 16 bp, Homo sapiens
caactggctggccagt

SEQ ID NO: 4482807 - DNA, 13 bp, Homo sapiens
caactgggcccaa

SEQ ID NO: 4482808 - DNA, 12 bp, Homo sapiens
caactggttcag

SEQ ID NO: 4482809 - DNA, 17 bp, Homo sapiens
caactggttcaggctca

SEQ ID NO: 4482810 - DNA, 12 bp, Homo sapiens
caactgtgtgat

SEQ ID NO: 4482811 - DNA, 19 bp, Homo sapiens
caactgttgtaactaggct

SEQ ID NO: 4482812 - DNA, 21 bp, Homo sapiens
caacttagatctctcctgcaa

SEQ ID NO: 4482813 - DNA, 22 bp, Homo sapiens
caacttcaagtgcatgctctct

SEQ ID NO: 4482814 - DNA, 22 bp, Homo sapiens
caacttcaccaccccctgtccc

SEQ ID NO: 4482815 - DNA, 11 bp, Homo sapiens
caacttcctgt

SEQ ID NO: 4482816 - DNA, 19 bp, Homo sapiens
caacttcctgtggcctgaa

SEQ ID NO: 4482817 - DNA, 21 bp, Homo sapiens
caacttgatgttccacctgcc

SEQ ID NO: 4482818 - DNA, 22 bp, Homo sapiens
caacttgatgttccacctgcca

SEQ ID NO: 4482819 - DNA, 12 bp, Homo sapiens
caactttactgt

SEQ ID NO: 4482820 - DNA, 19 bp, Homo sapiens
caactttagtatttttact

SEQ ID NO: 4482821 - DNA, 19 bp, Homo sapiens
caactttcctcaaatcaaa

SEQ ID NO: 4482822 - DNA, 23 bp, Homo sapiens
caactttgaataaagaatacttg

SEQ ID NO: 4482823 - DNA, 23 bp, Homo sapiens
caacttttatgcagcaaatatat

SEQ ID NO: 4482824 - DNA, 19 bp, Homo sapiens
caacttttcaatgtgattc

SEQ ID NO: 4482825 - DNA, 14 bp, Homo sapiens
caactttttaaagt

SEQ ID NO: 4482826 - DNA, 15 bp, Homo sapiens
caactttttaaagta

SEQ ID NO: 4482827 - DNA, 19 bp, Homo sapiens
caactttttaaagtaaatt

SEQ ID NO: 4482828 - DNA, 20 bp, Homo sapiens
caactttttaaagtaaatta

SEQ ID NO: 4482829 - DNA, 16 bp, Homo sapiens
caactttttattgcct

SEQ ID NO: 4482830 - DNA, 17 bp, Homo sapiens
caactttttattgcctt

SEQ ID NO: 4482831 - DNA, 23 bp, Homo sapiens
caactttttttccttgtggttag

SEQ ID NO: 4482832 - DNA, 18 bp, Homo sapiens
caagaaaatcaggtatta

SEQ ID NO: 4482833 - DNA, 18 bp, Homo sapiens
caagaaataagtttttgt

SEQ ID NO: 4482834 - DNA, 13 bp, Homo sapiens
caagaaatgaaag

SEQ ID NO: 4482835 - DNA, 17 bp, Homo sapiens
caagaagcattttgtaa

SEQ ID NO: 4482836 - DNA, 23 bp, Homo sapiens
caagaagggctagaacctggagg

SEQ ID NO: 4482837 - DNA, 16 bp, Homo sapiens
caagaagtaatcagta

SEQ ID NO: 4482838 - DNA, 21 bp, Homo sapiens
caagaagtacgaatcttattt

SEQ ID NO: 4482839 - DNA, 20 bp, Homo sapiens
caagaagtatttttttaatt

SEQ ID NO: 4482840 - DNA, 19 bp, Homo sapiens
caagaagttaaaaaacagc

SEQ ID NO: 4482841 - DNA, 20 bp, Homo sapiens
caagaagttaaaaaacagct

SEQ ID NO: 4482842 - DNA, 21 bp, Homo sapiens
caagaataatcacgctttcct

SEQ ID NO: 4482843 - DNA, 14 bp, Homo sapiens
caagaatacttgaa

SEQ ID NO: 4482844 - DNA, 15 bp, Homo sapiens
caagaatcagagaag

SEQ ID NO: 4482845 - DNA, 10 bp, Homo sapiens
caagaatcta

SEQ ID NO: 4482846 - DNA, 15 bp, Homo sapiens
caagaatctagaaga

SEQ ID NO: 4482847 - DNA, 18 bp, Homo sapiens
caagaatgaaatgaatga

SEQ ID NO: 4482848 - DNA, 21 bp, Homo sapiens
caagaatgaaatgaatgattc

SEQ ID NO: 4482849 - DNA, 21 bp, Homo sapiens
caagacagatgccccagagct

SEQ ID NO: 4482850 - DNA, 13 bp, Homo sapiens
caagacagcagca

SEQ ID NO: 4482851 - DNA, 21 bp, Homo sapiens
caagacagcagcagcctgcac

SEQ ID NO: 4482852 - DNA, 23 bp, Homo sapiens
caagacagcagcagcctgcacct

SEQ ID NO: 4482853 - DNA, 24 bp, Homo sapiens
caagacagcagcagcctgcacctg

SEQ ID NO: 4482854 - DNA, 15 bp, Homo sapiens
caagacatgtctgtt

SEQ ID NO: 4482855 - DNA, 11 bp, Homo sapiens
caagacatttg

SEQ ID NO: 4482856 - DNA, 14 bp, Homo sapiens
caagaccagcctgt

SEQ ID NO: 4482857 - DNA, 16 bp, Homo sapiens
caagaccagcctgtcc

SEQ ID NO: 4482858 - DNA, 14 bp, Homo sapiens
caagacccccagca

SEQ ID NO: 4482859 - DNA, 22 bp, Homo sapiens
caagacccccatttgtcccaga

SEQ ID NO: 4482860 - DNA, 16 bp, Homo sapiens
caagaccgatcggcgg

SEQ ID NO: 4482861 - DNA, 23 bp, Homo sapiens
caagacgggatgattgcttgagc

SEQ ID NO: 4482862 - DNA, 14 bp, Homo sapiens
caagacgtaaagaa

SEQ ID NO: 4482863 - DNA, 14 bp, Homo sapiens
caagactcccatga

SEQ ID NO: 4482864 - DNA, 18 bp, Homo sapiens
caagactcctcaggcagc

SEQ ID NO: 4482865 - DNA, 17 bp, Homo sapiens
caagactgaagatggct

SEQ ID NO: 4482866 - DNA, 23 bp, Homo sapiens
caagactgaagatggcttttcct

SEQ ID NO: 4482867 - DNA, 12 bp, Homo sapiens
caagagaaactt

SEQ ID NO: 4482868 - DNA, 15 bp, Homo sapiens
caagagaactaaagc

SEQ ID NO: 4482869 - DNA, 20 bp, Homo sapiens
caagagagcgagaccctgtc

SEQ ID NO: 4482870 - DNA, 18 bp, Homo sapiens
caagagatctacacatgt

SEQ ID NO: 4482871 - DNA, 19 bp, Homo sapiens
caagagatctacacatgtt

SEQ ID NO: 4482872 - DNA, 19 bp, Homo sapiens
caagagcaaaactccgtct

SEQ ID NO: 4482873 - DNA, 21 bp, Homo sapiens
caagagcaaaactccgtctca

SEQ ID NO: 4482874 - DNA, 14 bp, Homo sapiens
caagagcagcctgt

SEQ ID NO: 4482875 - DNA, 15 bp, Homo sapiens
caagagcagcctgtg

SEQ ID NO: 4482876 - DNA, 18 bp, Homo sapiens
caagagcagcctgtggca

SEQ ID NO: 4482877 - DNA, 18 bp, Homo sapiens
caagagcgaaactccgtc

SEQ ID NO: 4482878 - DNA, 22 bp, Homo sapiens
caagagctacgtatttaatagc

SEQ ID NO: 4482879 - DNA, 14 bp, Homo sapiens
caagagctgccctc

SEQ ID NO: 4482880 - DNA, 15 bp, Homo sapiens
caagaggaatctgtt

SEQ ID NO: 4482881 - DNA, 20 bp, Homo sapiens
caagaggaatctgtttctct

SEQ ID NO: 4482882 - DNA, 17 bp, Homo sapiens
caagaggattgtaaaat

SEQ ID NO: 4482883 - DNA, 18 bp, Homo sapiens
caagagggcaagcctcta

SEQ ID NO: 4482884 - DNA, 18 bp, Homo sapiens
caagaggggcgggctcag

SEQ ID NO: 4482885 - DNA, 19 bp, Homo sapiens
caagaggggcgggctcaga

SEQ ID NO: 4482886 - DNA, 20 bp, Homo sapiens
caagaggggcgggctcagag

SEQ ID NO: 4482887 - DNA, 14 bp, Homo sapiens
caagagggggtgga

SEQ ID NO: 4482888 - DNA, 15 bp, Homo sapiens
caagagggggtggag

SEQ ID NO: 4482889 - DNA, 21 bp, Homo sapiens
caagagggggtggaggggtgt

SEQ ID NO: 4482890 - DNA, 14 bp, Homo sapiens
caagaggtctgagc

SEQ ID NO: 4482891 - DNA, 15 bp, Homo sapiens
caagaggtgggaggg

SEQ ID NO: 4482892 - DNA, 16 bp, Homo sapiens
caagaggtgggagggc

SEQ ID NO: 4482893 - DNA, 15 bp, Homo sapiens
caagagtatgtggca

SEQ ID NO: 4482894 - DNA, 22 bp, Homo sapiens
caagagtggactgaatgtgcct

SEQ ID NO: 4482895 - DNA, 16 bp, Homo sapiens
caagagttaaacttag

SEQ ID NO: 4482896 - DNA, 21 bp, Homo sapiens
caagatatggaagtggattgt

SEQ ID NO: 4482897 - DNA, 17 bp, Homo sapiens
caagatcgcaccactgc

SEQ ID NO: 4482898 - DNA, 18 bp, Homo sapiens
caagatgaaggagaggca

SEQ ID NO: 4482899 - DNA, 19 bp, Homo sapiens
caagatgagctgcagcccc

SEQ ID NO: 4482900 - DNA, 20 bp, Homo sapiens
caagatggacacgagccaca

SEQ ID NO: 4482901 - DNA, 13 bp, Homo sapiens
caagatgggacag

SEQ ID NO: 4482902 - DNA, 21 bp, Homo sapiens
caagatggtgttatcttttga

SEQ ID NO: 4482903 - DNA, 12 bp, Homo sapiens
caagatgtgaat

SEQ ID NO: 4482904 - DNA, 12 bp, Homo sapiens
caagatgtttct

SEQ ID NO: 4482905 - DNA, 14 bp, Homo sapiens
caagatgtttcttg

SEQ ID NO: 4482906 - DNA, 13 bp, Homo sapiens
caagattcccaga

SEQ ID NO: 4482907 - DNA, 23 bp, Homo sapiens
caaggtgtgctctgagccacaga

SEQ ID NO: 4482908 - DNA, 19 bp, Homo sapiens
caaggttactcagcagcag

SEQ ID NO: 4482909 - DNA, 21 bp, Homo sapiens
caaggttactcagcagcagag

SEQ ID NO: 4482910 - DNA, 16 bp, Homo sapiens
caaggttcccttgtgg

SEQ ID NO: 4482911 - DNA, 16 bp, Homo sapiens
caaggttgcacagcaa

SEQ ID NO: 4482912 - DNA, 15 bp, Homo sapiens
caagtaagaaataat

SEQ ID NO: 4482913 - DNA, 15 bp, Homo sapiens
caagtaagagtggtg

SEQ ID NO: 4482914 - DNA, 17 bp, Homo sapiens
caagtaatcctgcacag

SEQ ID NO: 4482915 - DNA, 20 bp, Homo sapiens
caagtaatcctgcacagatc

SEQ ID NO: 4482916 - DNA, 23 bp, Homo sapiens
caagtaattgtgaaaaagttaaa

SEQ ID NO: 4482917 - DNA, 17 bp, Homo sapiens
caagtactaaagcacct

SEQ ID NO: 4482918 - DNA, 16 bp, Homo sapiens
caagtactgctgtaaa

SEQ ID NO: 4482919 - DNA, 19 bp, Homo sapiens
caagtagtccaccttcatt

SEQ ID NO: 4482920 - DNA, 22 bp, Homo sapiens
caagtatataatttactttgta

SEQ ID NO: 4482921 - DNA, 18 bp, Homo sapiens
caagtatatttatttcta

SEQ ID NO: 4482922 - DNA, 19 bp, Homo sapiens
caagtatttgggaagtgaa

SEQ ID NO: 4482923 - DNA, 19 bp, Homo sapiens
caagtatttgttaatttag

SEQ ID NO: 4482924 - DNA, 20 bp, Homo sapiens
caagtatttgttaatttaga

SEQ ID NO: 4482925 - DNA, 23 bp, Homo sapiens
caagtatttttatttaaattatt

SEQ ID NO: 4482926 - DNA, 21 bp, Homo sapiens
caagtccagctgggaagccct

SEQ ID NO: 4482927 - DNA, 17 bp, Homo sapiens
caagtcccatcatagaa

SEQ ID NO: 4482928 - DNA, 21 bp, Homo sapiens
caagtctgcatttcatattat

SEQ ID NO: 4482929 - DNA, 21 bp, Homo sapiens
caagtgaacactgttctacca

SEQ ID NO: 4482930 - DNA, 17 bp, Homo sapiens
caagtgaactcatccct

SEQ ID NO: 4482931 - DNA, 17 bp, Homo sapiens
caagtgacgaaaacatt

SEQ ID NO: 4482932 - DNA, 14 bp, Homo sapiens
caagtgcaatagat

SEQ ID NO: 4482933 - DNA, 16 bp, Homo sapiens
caagtgcaatagatta

SEQ ID NO: 4482934 - DNA, 23 bp, Homo sapiens
caagtgcaatagattactgatgt

SEQ ID NO: 4482935 - DNA, 16 bp, Homo sapiens
caagtgccgcaaattg

SEQ ID NO: 4482936 - DNA, 12 bp, Homo sapiens
caagtgcctaga

SEQ ID NO: 4482937 - DNA, 17 bp, Homo sapiens
caagtgcctagactgtt

SEQ ID NO: 4482938 - DNA, 15 bp, Homo sapiens
caagtgcctgcacca

SEQ ID NO: 4482939 - DNA, 22 bp, Homo sapiens
caagtgctgcacaaaagcagat

SEQ ID NO: 4482940 - DNA, 14 bp, Homo sapiens
caagtgctggccca

SEQ ID NO: 4482941 - DNA, 21 bp, Homo sapiens
caagtgctggcccacccagtc

SEQ ID NO: 4482942 - DNA, 22 bp, Homo sapiens
caagtgggatctgtcacaccag

SEQ ID NO: 4482943 - DNA, 20 bp, Homo sapiens
caagtgggggcagagggcag

SEQ ID NO: 4482944 - DNA, 17 bp, Homo sapiens
caagtggggtgctggga

SEQ ID NO: 4482945 - DNA, 18 bp, Homo sapiens
caagtggggtgctgggag

SEQ ID NO: 4482946 - DNA, 19 bp, Homo sapiens
caagtggggtgctgggagg

SEQ ID NO: 4482947 - DNA, 16 bp, Homo sapiens
caagtggtattttcca

SEQ ID NO: 4482948 - DNA, 13 bp, Homo sapiens
caagtgtggagga

SEQ ID NO: 4482949 - DNA, 18 bp, Homo sapiens
caagttctatttcttgaa

SEQ ID NO: 4482950 - DNA, 12 bp, Homo sapiens
caagttgtaaat

SEQ ID NO: 4482951 - DNA, 17 bp, Homo sapiens
caagttgtgcttgttta

SEQ ID NO: 4482952 - DNA, 13 bp, Homo sapiens
caagttttaaagt

SEQ ID NO: 4482953 - DNA, 16 bp, Homo sapiens
caagttttagttaaaa

SEQ ID NO: 4482954 - DNA, 19 bp, Homo sapiens
caagtttttaatcgttttt

SEQ ID NO: 4482955 - DNA, 13 bp, Homo sapiens
caagtttttcata

SEQ ID NO: 4482956 - DNA, 23 bp, Homo sapiens
caagtttttcatactgtacacat

SEQ ID NO: 4482957 - DNA, 14 bp, Homo sapiens
caataaaaatcata

SEQ ID NO: 4482958 - DNA, 17 bp, Homo sapiens
caataaaaatgtttaac

SEQ ID NO: 4482959 - DNA, 13 bp, Homo sapiens
caataaaacaaat

SEQ ID NO: 4482960 - DNA, 12 bp, Homo sapiens
caataaaagctt

SEQ ID NO: 4482961 - DNA, 18 bp, Homo sapiens
caataaaattatttgcag

SEQ ID NO: 4482962 - DNA, 15 bp, Homo sapiens
caataaacagtcact

SEQ ID NO: 4482963 - DNA, 10 bp, Homo sapiens
caataaacca

SEQ ID NO: 4482964 - DNA, 14 bp, Homo sapiens
caataaaccacaag

SEQ ID NO: 4482965 - DNA, 15 bp, Homo sapiens
caataaaccagtgtg

SEQ ID NO: 4482966 - DNA, 18 bp, Homo sapiens
caataaaccagtgtgaac

SEQ ID NO: 4482967 - DNA, 15 bp, Homo sapiens
caataaaccctcaga

SEQ ID NO: 4482968 - DNA, 20 bp, Homo sapiens
caataaaccctcagagcctc

SEQ ID NO: 4482969 - DNA, 11 bp, Homo sapiens
caataaagaat

SEQ ID NO: 4482970 - DNA, 18 bp, Homo sapiens
caataaagatacatgatt

SEQ ID NO: 4482971 - DNA, 12 bp, Homo sapiens
caataaagcctt

SEQ ID NO: 4482972 - DNA, 13 bp, Homo sapiens
caataaagccttt

SEQ ID NO: 4482973 - DNA, 13 bp, Homo sapiens
caataaaggcagc

SEQ ID NO: 4482974 - DNA, 17 bp, Homo sapiens
caataaaggcagctgcc

SEQ ID NO: 4482975 - DNA, 19 bp, Homo sapiens
caataaaggcagctgcctc

SEQ ID NO: 4482976 - DNA, 23 bp, Homo sapiens
caataaaggcagctgcctctgct

SEQ ID NO: 4482977 - DNA, 21 bp, Homo sapiens
caataaagggagaatggtgct

SEQ ID NO: 4482978 - DNA, 22 bp, Homo sapiens
caataaagggagaatggtgctg

SEQ ID NO: 4482979 - DNA, 16 bp, Homo sapiens
caataaagtataatgt

SEQ ID NO: 4482980 - DNA, 17 bp, Homo sapiens
caataaagtgccttctg

SEQ ID NO: 4482981 - DNA, 19 bp, Homo sapiens
caataaagtgccttctggg

SEQ ID NO: 4482982 - DNA, 13 bp, Homo sapiens
caataaataaatg

SEQ ID NO: 4482983 - DNA, 15 bp, Homo sapiens
caataaataaatgtt

SEQ ID NO: 4482984 - DNA, 16 bp, Homo sapiens
caataaataaatgttt

SEQ ID NO: 4482985 - DNA, 12 bp, Homo sapiens
caataaatgaat

SEQ ID NO: 4482986 - DNA, 19 bp, Homo sapiens
caataacaaaacgaaacta

SEQ ID NO: 4482987 - DNA, 17 bp, Homo sapiens
caataacactgtatttt

SEQ ID NO: 4482988 - DNA, 17 bp, Homo sapiens
caataacagatggtgct

SEQ ID NO: 4482989 - DNA, 15 bp, Homo sapiens
caataacgtttaagc

SEQ ID NO: 4482990 - DNA, 14 bp, Homo sapiens
caataactgaaaat

SEQ ID NO: 4482991 - DNA, 19 bp, Homo sapiens
caataagattgcgcctgag

SEQ ID NO: 4482992 - DNA, 20 bp, Homo sapiens
caataagattgcgcctgaga

SEQ ID NO: 4482993 - DNA, 21 bp, Homo sapiens
caataataagtgatgtgctga

SEQ ID NO: 4482994 - DNA, 17 bp, Homo sapiens
caataatatttcaagtg

SEQ ID NO: 4482995 - DNA, 18 bp, Homo sapiens
caataatatttcaagtgc

SEQ ID NO: 4482996 - DNA, 13 bp, Homo sapiens
caataatgcagta

SEQ ID NO: 4482997 - DNA, 20 bp, Homo sapiens
caataatgcagtatggtaca

SEQ ID NO: 4482998 - DNA, 16 bp, Homo sapiens
caataattctacatgt

SEQ ID NO: 4482999 - DNA, 19 bp, Homo sapiens
caatacaaacaatctctta

SEQ ID NO: 4483000 - DNA, 14 bp, Homo sapiens
caatacaaagatga

SEQ ID NO: 4483001 - DNA, 13 bp, Homo sapiens
caatacaaattga

SEQ ID NO: 4483002 - DNA, 19 bp, Homo sapiens
caatacaatgtacaattat

SEQ ID NO: 4483003 - DNA, 19 bp, Homo sapiens
caatacactagttgtttct

SEQ ID NO: 4483004 - DNA, 18 bp, Homo sapiens
caatacagggaggctccc

SEQ ID NO: 4483005 - DNA, 21 bp, Homo sapiens
caatacagtattatagacaaa

SEQ ID NO: 4483006 - DNA, 16 bp, Homo sapiens
caatagaaagaaacta

SEQ ID NO: 4483007 - DNA, 17 bp, Homo sapiens
caatagcacatatggaa

SEQ ID NO: 4483008 - DNA, 14 bp, Homo sapiens
caatagcaccccta

SEQ ID NO: 4483009 - DNA, 20 bp, Homo sapiens
caatagcacccctactcaca

SEQ ID NO: 4483010 - DNA, 17 bp, Homo sapiens
caataggcaaattaatc

SEQ ID NO: 4483011 - DNA, 23 bp, Homo sapiens
caatagggctaaatgtttaaaga

SEQ ID NO: 4483012 - DNA, 17 bp, Homo sapiens
caataggtctttctctc

SEQ ID NO: 4483013 - DNA, 19 bp, Homo sapiens
caataggtttgtaaaatgc

SEQ ID NO: 4483014 - DNA, 17 bp, Homo sapiens
caatagtatacatttta

SEQ ID NO: 4483015 - DNA, 18 bp, Homo sapiens
caatagtatacattttat

SEQ ID NO: 4483016 - DNA, 13 bp, Homo sapiens
caatagtatttct

SEQ ID NO: 4483017 - DNA, 17 bp, Homo sapiens
caatagtatttctcctt

SEQ ID NO: 4483018 - DNA, 18 bp, Homo sapiens
caatagtatttctccttt

SEQ ID NO: 4483019 - DNA, 19 bp, Homo sapiens
caatagtatttctcctttg

SEQ ID NO: 4483020 - DNA, 21 bp, Homo sapiens
caatagtgtcctatgcaataa

SEQ ID NO: 4483021 - DNA, 22 bp, Homo sapiens
caatagtgtcctatgcaataaa

SEQ ID NO: 4483022 - DNA, 21 bp, Homo sapiens
caatagttttttacttctctt

SEQ ID NO: 4483023 - DNA, 14 bp, Homo sapiens
caatataagaagca

SEQ ID NO: 4483024 - DNA, 15 bp, Homo sapiens
caatatattgaactt

SEQ ID NO: 4483025 - DNA, 20 bp, Homo sapiens
caatatattgaacttttgta

SEQ ID NO: 4483026 - DNA, 18 bp, Homo sapiens
caatatcagctttgataa

SEQ ID NO: 4483027 - DNA, 23 bp, Homo sapiens
caatatcttcgttagtaatctgt

SEQ ID NO: 4483028 - DNA, 21 bp, Homo sapiens
caatatgaattcaagaaagga

SEQ ID NO: 4483029 - DNA, 18 bp, Homo sapiens
caatatgacacttgtaaa

SEQ ID NO: 4483030 - DNA, 19 bp, Homo sapiens
caatatgcaagcagctttt

SEQ ID NO: 4483031 - DNA, 19 bp, Homo sapiens
caatatgtgccaatcaata

SEQ ID NO: 4483032 - DNA, 19 bp, Homo sapiens
caatattctctcttattgt

SEQ ID NO: 4483033 - DNA, 15 bp, Homo sapiens
caatattgtacagtt

SEQ ID NO: 4483034 - DNA, 17 bp, Homo sapiens
caatattgtacagtttt

SEQ ID NO: 4483035 - DNA, 18 bp, Homo sapiens
caatattgtacagttttt

SEQ ID NO: 4483036 - DNA, 21 bp, Homo sapiens
caatatttctgctttctttga

SEQ ID NO: 4483037 - DNA, 16 bp, Homo sapiens
caatatttcttttgtt

SEQ ID NO: 4483038 - DNA, 19 bp, Homo sapiens
caatatttcttttgttgta

SEQ ID NO: 4483039 - DNA, 13 bp, Homo sapiens
caatattttaata

SEQ ID NO: 4483040 - DNA, 14 bp, Homo sapiens
caatattttaataa

SEQ ID NO: 4483041 - DNA, 17 bp, Homo sapiens
caatattttaataaagt

SEQ ID NO: 4483042 - DNA, 15 bp, Homo sapiens
caatattttgccttt

SEQ ID NO: 4483043 - DNA, 22 bp, Homo sapiens
caatattttgtatattatgttt

SEQ ID NO: 4483044 - DNA, 16 bp, Homo sapiens
caatatttttatatca

SEQ ID NO: 4483045 - DNA, 18 bp, Homo sapiens
caatcaaaggaaaatagt

SEQ ID NO: 4483046 - DNA, 16 bp, Homo sapiens
caatcaccaccaggta

SEQ ID NO: 4483047 - DNA, 18 bp, Homo sapiens
caatcagctccttcctgg

SEQ ID NO: 4483048 - DNA, 18 bp, Homo sapiens
caatcagcttttgttcta

SEQ ID NO: 4483049 - DNA, 20 bp, Homo sapiens
caatcattgttttgaatatt

SEQ ID NO: 4483050 - DNA, 15 bp, Homo sapiens
caatccaaataaaga

SEQ ID NO: 4483051 - DNA, 16 bp, Homo sapiens
caatccacctgccttg

SEQ ID NO: 4483052 - DNA, 12 bp, Homo sapiens
caatccaccttc

SEQ ID NO: 4483053 - DNA, 23 bp, Homo sapiens
caatccattcacaagcctcctgt

SEQ ID NO: 4483054 - DNA, 15 bp, Homo sapiens
caatcccctcattca

SEQ ID NO: 4483055 - DNA, 22 bp, Homo sapiens
caatcccctcattcaggaaaac

SEQ ID NO: 4483056 - DNA, 19 bp, Homo sapiens
caatcctaatttctcctcc

SEQ ID NO: 4483057 - DNA, 20 bp, Homo sapiens
caatcctatgtttttgttca

SEQ ID NO: 4483058 - DNA, 14 bp, Homo sapiens
caatcctcctgcct

SEQ ID NO: 4483059 - DNA, 15 bp, Homo sapiens
caatcctcctgcctc

SEQ ID NO: 4483060 - DNA, 11 bp, Homo sapiens
caatcctggac

SEQ ID NO: 4483061 - DNA, 14 bp, Homo sapiens
caatcctttattat

SEQ ID NO: 4483062 - DNA, 16 bp, Homo sapiens
caatcgggtccagaga

SEQ ID NO: 4483063 - DNA, 17 bp, Homo sapiens
caatctaaaacaattcc

SEQ ID NO: 4483064 - DNA, 19 bp, Homo sapiens
caatctatttaaaaaactg

SEQ ID NO: 4483065 - DNA, 20 bp, Homo sapiens
caatctcggctcactgcatc

SEQ ID NO: 4483066 - DNA, 13 bp, Homo sapiens
caatctgaaattc

SEQ ID NO: 4483067 - DNA, 22 bp, Homo sapiens
caatctgaaattcaaaatgctc

SEQ ID NO: 4483068 - DNA, 20 bp, Homo sapiens
caatctggattcatatttaa

SEQ ID NO: 4483069 - DNA, 19 bp, Homo sapiens
caatctggcttagtgccac

SEQ ID NO: 4483070 - DNA, 13 bp, Homo sapiens
caatctggcttct

SEQ ID NO: 4483071 - DNA, 17 bp, Homo sapiens
caatctgtaaactgtgt

SEQ ID NO: 4483072 - DNA, 21 bp, Homo sapiens
caatcttaaagacaaattttg

SEQ ID NO: 4483073 - DNA, 15 bp, Homo sapiens
caatcttgcccactg

SEQ ID NO: 4483074 - DNA, 20 bp, Homo sapiens
caatcttgcccactggccgc

SEQ ID NO: 4483075 - DNA, 13 bp, Homo sapiens
caatcttgttact

SEQ ID NO: 4483076 - DNA, 17 bp, Homo sapiens
caatcttgtttatagca

SEQ ID NO: 4483077 - DNA, 20 bp, Homo sapiens
caatcttgtttatagcaaaa

SEQ ID NO: 4483078 - DNA, 18 bp, Homo sapiens
caatctttcatgtcttgt

SEQ ID NO: 4483079 - DNA, 15 bp, Homo sapiens
caatgaaaacatgta

SEQ ID NO: 4483080 - DNA, 19 bp, Homo sapiens
caatgaaaactctttgctg

SEQ ID NO: 4483081 - DNA, 11 bp, Homo sapiens
caatgaaatga

SEQ ID NO: 4483082 - DNA, 19 bp, Homo sapiens
caatgaaatgaattaaagt

SEQ ID NO: 4483083 - DNA, 18 bp, Homo sapiens
caatgaatatactcatta

SEQ ID NO: 4483084 - DNA, 14 bp, Homo sapiens
caatgagtctgtaa

SEQ ID NO: 4483085 - DNA, 21 bp, Homo sapiens
caatgatcacatctaaagctt

SEQ ID NO: 4483086 - DNA, 17 bp, Homo sapiens
caatgatggtttaatag

SEQ ID NO: 4483087 - DNA, 18 bp, Homo sapiens
caatgcactgatgtgtga

SEQ ID NO: 4483088 - DNA, 19 bp, Homo sapiens
caatgcactgatgtgtgaa

SEQ ID NO: 4483089 - DNA, 13 bp, Homo sapiens
caatgccacagac

SEQ ID NO: 4483090 - DNA, 15 bp, Homo sapiens
caatgccacatactt

SEQ ID NO: 4483091 - DNA, 20 bp, Homo sapiens
caatgccacatacttgcagc

SEQ ID NO: 4483092 - DNA, 15 bp, Homo sapiens
caatgccacctagac

SEQ ID NO: 4483093 - DNA, 13 bp, Homo sapiens
caatgccatcatc

SEQ ID NO: 4483094 - DNA, 14 bp, Homo sapiens
caatgccatcatct

SEQ ID NO: 4483095 - DNA, 20 bp, Homo sapiens
caatgcctttttagatgtat

SEQ ID NO: 4483096 - DNA, 21 bp, Homo sapiens
caatgctagcacaatattcct

SEQ ID NO: 4483097 - DNA, 20 bp, Homo sapiens
caatgctatttttgttttta

SEQ ID NO: 4483098 - DNA, 13 bp, Homo sapiens
caatggaagattt

SEQ ID NO: 4483099 - DNA, 19 bp, Homo sapiens
caatggacaagcagtggat

SEQ ID NO: 4483100 - DNA, 20 bp, Homo sapiens
caatggccagagcctctggc

SEQ ID NO: 4483101 - DNA, 23 bp, Homo sapiens
caatgggaagcagacaataactt

SEQ ID NO: 4483102 - DNA, 11 bp, Homo sapiens
caatgggtaag

SEQ ID NO: 4483103 - DNA, 12 bp, Homo sapiens
caatgggtaagg

SEQ ID NO: 4483104 - DNA, 17 bp, Homo sapiens
caatgggtaagggaggg

SEQ ID NO: 4483105 - DNA, 18 bp, Homo sapiens
caatgggtaagggaggga

SEQ ID NO: 4483106 - DNA, 16 bp, Homo sapiens
caatggttcaagtctt

SEQ ID NO: 4483107 - DNA, 18 bp, Homo sapiens
caatggtttttaaatttt

SEQ ID NO: 4483108 - DNA, 17 bp, Homo sapiens
caatgtaaatattttaa

SEQ ID NO: 4483109 - DNA, 16 bp, Homo sapiens
caatgtacaattatgt

SEQ ID NO: 4483110 - DNA, 21 bp, Homo sapiens
caatgtacaattatgtctctt

SEQ ID NO: 4483111 - DNA, 18 bp, Homo sapiens
caatgtatacaatgcact

SEQ ID NO: 4483112 - DNA, 14 bp, Homo sapiens
caatgtatctttat

SEQ ID NO: 4483113 - DNA, 22 bp, Homo sapiens
caatgtatctttattaaaacaa

SEQ ID NO: 4483114 - DNA, 13 bp, Homo sapiens
caatgtatgtaca

SEQ ID NO: 4483115 - DNA, 15 bp, Homo sapiens
caatgtatgtacaat

SEQ ID NO: 4483116 - DNA, 12 bp, Homo sapiens
caatgtgaaaaa

SEQ ID NO: 4483117 - DNA, 18 bp, Homo sapiens
caatgtgaatcagaccct

SEQ ID NO: 4483118 - DNA, 16 bp, Homo sapiens
caatgtgccttgattg

SEQ ID NO: 4483119 - DNA, 18 bp, Homo sapiens
caatgtggaaaaaatatt

SEQ ID NO: 4483120 - DNA, 22 bp, Homo sapiens
caatgtggaaaaaatattttaa

SEQ ID NO: 4483121 - DNA, 23 bp, Homo sapiens
caatgtggaaaaaatattttaaa

SEQ ID NO: 4483122 - DNA, 23 bp, Homo sapiens
caatgtggcaaggaaaaacaggt

SEQ ID NO: 4483123 - DNA, 17 bp, Homo sapiens
caatgtgggatctcaga

SEQ ID NO: 4483124 - DNA, 16 bp, Homo sapiens
caatgtgtataaattg

SEQ ID NO: 4483125 - DNA, 17 bp, Homo sapiens
caatgtgtataaattgt

SEQ ID NO: 4483126 - DNA, 11 bp, Homo sapiens
caatgtgttca

SEQ ID NO: 4483127 - DNA, 16 bp, Homo sapiens
caatgtgttttctgta

SEQ ID NO: 4483128 - DNA, 17 bp, Homo sapiens
caatgtgttttctgtag

SEQ ID NO: 4483129 - DNA, 16 bp, Homo sapiens
caatgttatgccagct

SEQ ID NO: 4483130 - DNA, 17 bp, Homo sapiens
caatgttatgccagctc

SEQ ID NO: 4483131 - DNA, 18 bp, Homo sapiens
caatgttatgccagctcc

SEQ ID NO: 4483132 - DNA, 12 bp, Homo sapiens
caatgtttcaag

SEQ ID NO: 4483133 - DNA, 11 bp, Homo sapiens
caattaaaata

SEQ ID NO: 4483134 - DNA, 18 bp, Homo sapiens
caattaaaatactatgca

SEQ ID NO: 4483135 - DNA, 17 bp, Homo sapiens
caattaacatacatcat

SEQ ID NO: 4483136 - DNA, 18 bp, Homo sapiens
caattaattgtcttgcac

SEQ ID NO: 4483137 - DNA, 21 bp, Homo sapiens
caattactgcactcttaaaca

SEQ ID NO: 4483138 - DNA, 17 bp, Homo sapiens
caattactggtccaaaa

SEQ ID NO: 4483139 - DNA, 21 bp, Homo sapiens
caattagaaatattaaagatt

SEQ ID NO: 4483140 - DNA, 20 bp, Homo sapiens
caattagatctaaacagtta

SEQ ID NO: 4483141 - DNA, 21 bp, Homo sapiens
caattagtctgaaactggctt

SEQ ID NO: 4483142 - DNA, 13 bp, Homo sapiens
caattatattgtc

SEQ ID NO: 4483143 - DNA, 16 bp, Homo sapiens
caattatgtctcttga

SEQ ID NO: 4483144 - DNA, 18 bp, Homo sapiens
caattattgatatatatt

SEQ ID NO: 4483145 - DNA, 14 bp, Homo sapiens
caattattggcaaa

SEQ ID NO: 4483146 - DNA, 16 bp, Homo sapiens
caattattggcaaagt

SEQ ID NO: 4483147 - DNA, 16 bp, Homo sapiens
caattatttgcatatt

SEQ ID NO: 4483148 - DNA, 22 bp, Homo sapiens
caattcaatacaaacaatctct

SEQ ID NO: 4483149 - DNA, 20 bp, Homo sapiens
caattcacatctaacctcat

SEQ ID NO: 4483150 - DNA, 21 bp, Homo sapiens
caattccaatatttctgcttt

SEQ ID NO: 4483151 - DNA, 21 bp, Homo sapiens
caattcccttctttttcatcc

SEQ ID NO: 4483152 - DNA, 23 bp, Homo sapiens
caattcctacctcttcacctgac

SEQ ID NO: 4483153 - DNA, 16 bp, Homo sapiens
caattcctccagagac

SEQ ID NO: 4483154 - DNA, 17 bp, Homo sapiens
caattcctccagagaca

SEQ ID NO: 4483155 - DNA, 19 bp, Homo sapiens
caattcctccagagacact

SEQ ID NO: 4483156 - DNA, 21 bp, Homo sapiens
caattcctccagagacactga

SEQ ID NO: 4483157 - DNA, 22 bp, Homo sapiens
caattctaggatgaacaatgta

SEQ ID NO: 4483158 - DNA, 15 bp, Homo sapiens
caattctgactgtcc

SEQ ID NO: 4483159 - DNA, 22 bp, Homo sapiens
caattgacataggcaataataa

SEQ ID NO: 4483160 - DNA, 17 bp, Homo sapiens
caattgcaccaaaagaa

SEQ ID NO: 4483161 - DNA, 21 bp, Homo sapiens
caattgcacgcggagtgagtt

SEQ ID NO: 4483162 - DNA, 14 bp, Homo sapiens
caattgcatctccc

SEQ ID NO: 4483163 - DNA, 17 bp, Homo sapiens
caattgcatctcccaga

SEQ ID NO: 4483164 - DNA, 16 bp, Homo sapiens
caattgctcccatcag

SEQ ID NO: 4483165 - DNA, 14 bp, Homo sapiens
caattggggcggag

SEQ ID NO: 4483166 - DNA, 17 bp, Homo sapiens
caattggtggtaacagt

SEQ ID NO: 4483167 - DNA, 17 bp, Homo sapiens
caattgtcactttttat

SEQ ID NO: 4483168 - DNA, 11 bp, Homo sapiens
caatttaaatg

SEQ ID NO: 4483169 - DNA, 16 bp, Homo sapiens
caatttattactgaaa

SEQ ID NO: 4483170 - DNA, 14 bp, Homo sapiens
caatttattttatt

SEQ ID NO: 4483171 - DNA, 19 bp, Homo sapiens
caatttcaaacttttgaaa

SEQ ID NO: 4483172 - DNA, 21 bp, Homo sapiens
caatttcaaacttttgaaaga

SEQ ID NO: 4483173 - DNA, 11 bp, Homo sapiens
caatttcaagt

SEQ ID NO: 4483174 - DNA, 12 bp, Homo sapiens
caatttccccct

SEQ ID NO: 4483175 - DNA, 22 bp, Homo sapiens
caatttcggattttttccaaaa

SEQ ID NO: 4483176 - DNA, 20 bp, Homo sapiens
caatttctaatgtttactat

SEQ ID NO: 4483177 - DNA, 20 bp, Homo sapiens
caatttgaagtaacttattt

SEQ ID NO: 4483178 - DNA, 14 bp, Homo sapiens
caatttgcacaata

SEQ ID NO: 4483179 - DNA, 22 bp, Homo sapiens
caatttggagcattaactaaat

SEQ ID NO: 4483180 - DNA, 23 bp, Homo sapiens
caatttggatttaaaagcctgct

SEQ ID NO: 4483181 - DNA, 21 bp, Homo sapiens
caatttggtaaaaatgctgct

SEQ ID NO: 4483182 - DNA, 22 bp, Homo sapiens
caatttggtaaaaatgctgctc

SEQ ID NO: 4483183 - DNA, 16 bp, Homo sapiens
caatttgtaaatattg

SEQ ID NO: 4483184 - DNA, 12 bp, Homo sapiens
caatttgtaatg

SEQ ID NO: 4483185 - DNA, 21 bp, Homo sapiens
caattttaaagttcttatttt

SEQ ID NO: 4483186 - DNA, 22 bp, Homo sapiens
caattttaaggaaactttttaa

SEQ ID NO: 4483187 - DNA, 22 bp, Homo sapiens
caattttaatttagtaaatgtt

SEQ ID NO: 4483188 - DNA, 16 bp, Homo sapiens
caattttactgtgaaa

SEQ ID NO: 4483189 - DNA, 16 bp, Homo sapiens
caattttagtgtatta

SEQ ID NO: 4483190 - DNA, 21 bp, Homo sapiens
caattttcagacacatttttg

SEQ ID NO: 4483191 - DNA, 13 bp, Homo sapiens
caatttttaatgg

SEQ ID NO: 4483192 - DNA, 13 bp, Homo sapiens
caatttttatttc

SEQ ID NO: 4483193 - DNA, 16 bp, Homo sapiens
caattttttttcaaat

SEQ ID NO: 4483194 - DNA, 16 bp, Homo sapiens
cacaaaaaaagtaatt

SEQ ID NO: 4483195 - DNA, 22 bp, Homo sapiens
cacaaaatatattttgtttaca

SEQ ID NO: 4483196 - DNA, 21 bp, Homo sapiens
cacaaaattagaaaggacaac

SEQ ID NO: 4483197 - DNA, 14 bp, Homo sapiens
cacaaactgtaaat

SEQ ID NO: 4483198 - DNA, 15 bp, Homo sapiens
cacaaactgtaaata

SEQ ID NO: 4483199 - DNA, 19 bp, Homo sapiens
cacaaacttttatactctt

SEQ ID NO: 4483200 - DNA, 17 bp, Homo sapiens
cacaaagagatatttag

SEQ ID NO: 4483201 - DNA, 17 bp, Homo sapiens
cacaaagccccccagct

SEQ ID NO: 4483202 - DNA, 23 bp, Homo sapiens
cacaaagtaactttgcgggatat

SEQ ID NO: 4483203 - DNA, 13 bp, Homo sapiens
cacaaatgtcatt

SEQ ID NO: 4483204 - DNA, 21 bp, Homo sapiens
cacaaatgtcattgtctactc

SEQ ID NO: 4483205 - DNA, 14 bp, Homo sapiens
cacaacaagaaact

SEQ ID NO: 4483206 - DNA, 11 bp, Homo sapiens
cacaacagatt

SEQ ID NO: 4483207 - DNA, 19 bp, Homo sapiens
cacaaccagaggtggcagg

SEQ ID NO: 4483208 - DNA, 14 bp, Homo sapiens
cacaactaacaatg

SEQ ID NO: 4483209 - DNA, 18 bp, Homo sapiens
cacaactaacaatgcctt

SEQ ID NO: 4483210 - DNA, 19 bp, Homo sapiens
cacaactaacaatgccttg

SEQ ID NO: 4483211 - DNA, 12 bp, Homo sapiens
cacaactccctt

SEQ ID NO: 4483212 - DNA, 22 bp, Homo sapiens
cacaactcccttaaggtctcca

SEQ ID NO: 4483213 - DNA, 22 bp, Homo sapiens
cacaactgtcccgttccccgct

SEQ ID NO: 4483214 - DNA, 19 bp, Homo sapiens
cacaactgtgtgattaaaa

SEQ ID NO: 4483215 - DNA, 23 bp, Homo sapiens
cacaagacccaaaaggcagaagc

SEQ ID NO: 4483216 - DNA, 22 bp, Homo sapiens
cacaagcaaaaaaaaaaaaaag

SEQ ID NO: 4483217 - DNA, 12 bp, Homo sapiens
cacaagcatctc

SEQ ID NO: 4483218 - DNA, 15 bp, Homo sapiens
cacaagcctcctgta

SEQ ID NO: 4483219 - DNA, 21 bp, Homo sapiens
cacaagccttactcacctctc

SEQ ID NO: 4483220 - DNA, 16 bp, Homo sapiens
cacaagctcaggtcct

SEQ ID NO: 4483221 - DNA, 17 bp, Homo sapiens
cacaagctcaggtcctg

SEQ ID NO: 4483222 - DNA, 18 bp, Homo sapiens
cacaagctgcactgtgaa

SEQ ID NO: 4483223 - DNA, 15 bp, Homo sapiens
cacaaggaataaatg

SEQ ID NO: 4483224 - DNA, 18 bp, Homo sapiens
cacaaggaataaatgaga

SEQ ID NO: 4483225 - DNA, 21 bp, Homo sapiens
cacaagtgccgcaaattgtac

SEQ ID NO: 4483226 - DNA, 14 bp, Homo sapiens
cacaagttccctgg

SEQ ID NO: 4483227 - DNA, 18 bp, Homo sapiens
cacaagttccctggagaa

SEQ ID NO: 4483228 - DNA, 18 bp, Homo sapiens
cacaatatagttttttct

SEQ ID NO: 4483229 - DNA, 17 bp, Homo sapiens
cacaattattggcaaag

SEQ ID NO: 4483230 - DNA, 13 bp, Homo sapiens
cacaatttcattt

SEQ ID NO: 4483231 - DNA, 13 bp, Homo sapiens
cacacaaaaataa

SEQ ID NO: 4483232 - DNA, 17 bp, Homo sapiens
cacacaacgattatagt

SEQ ID NO: 4483233 - DNA, 15 bp, Homo sapiens
cacacaataaagaac

SEQ ID NO: 4483234 - DNA, 13 bp, Homo sapiens
cacacacagcccc

SEQ ID NO: 4483235 - DNA, 13 bp, Homo sapiens
cacacacaggagc

SEQ ID NO: 4483236 - DNA, 13 bp, Homo sapiens
cacacacatgcat

SEQ ID NO: 4483237 - DNA, 22 bp, Homo sapiens
cacacacattgctgtgaacagg

SEQ ID NO: 4483238 - DNA, 15 bp, Homo sapiens
cacacagactatttt

SEQ ID NO: 4483239 - DNA, 14 bp, Homo sapiens
cacacagcagcccc

SEQ ID NO: 4483240 - DNA, 23 bp, Homo sapiens
cacacagcagccccccagcacta

SEQ ID NO: 4483241 - DNA, 15 bp, Homo sapiens
cacacagcccagttc

SEQ ID NO: 4483242 - DNA, 18 bp, Homo sapiens
cacacagctactctcccc

SEQ ID NO: 4483243 - DNA, 16 bp, Homo sapiens
cacacagctgagcact

SEQ ID NO: 4483244 - DNA, 17 bp, Homo sapiens
cacacaggcagccagcc

SEQ ID NO: 4483245 - DNA, 20 bp, Homo sapiens
cacacaggcagccagccgtg

SEQ ID NO: 4483246 - DNA, 24 bp, Homo sapiens
cacacaggcagggcctggctccag

SEQ ID NO: 4483247 - DNA, 14 bp, Homo sapiens
cacacatcctgtca

SEQ ID NO: 4483248 - DNA, 16 bp, Homo sapiens
cacacattctgccttg

SEQ ID NO: 4483249 - DNA, 13 bp, Homo sapiens
cacacattgctgt

SEQ ID NO: 4483250 - DNA, 15 bp, Homo sapiens
cacacattttatgag

SEQ ID NO: 4483251 - DNA, 16 bp, Homo sapiens
cacaccaatcagcgct

SEQ ID NO: 4483252 - DNA, 14 bp, Homo sapiens
cacacccaggaagg

SEQ ID NO: 4483253 - DNA, 14 bp, Homo sapiens
cacacccatttaaa

SEQ ID NO: 4483254 - DNA, 17 bp, Homo sapiens
cacacccctctgctgca

SEQ ID NO: 4483255 - DNA, 15 bp, Homo sapiens
cacacccgcctgaca

SEQ ID NO: 4483256 - DNA, 21 bp, Homo sapiens
cacacctcagttcccttggcc

SEQ ID NO: 4483257 - DNA, 11 bp, Homo sapiens
cacacctgagc

SEQ ID NO: 4483258 - DNA, 18 bp, Homo sapiens
cacacctggactgaccct

SEQ ID NO: 4483259 - DNA, 22 bp, Homo sapiens
cacaccttttatgaatcaaata

SEQ ID NO: 4483260 - DNA, 16 bp, Homo sapiens
cacacgagttccagac

SEQ ID NO: 4483261 - DNA, 23 bp, Homo sapiens
cacacgccccggtcccccagagc

SEQ ID NO: 4483262 - DNA, 14 bp, Homo sapiens
cacacggaagcaag

SEQ ID NO: 4483263 - DNA, 14 bp, Homo sapiens
cacactaacatcaa

SEQ ID NO: 4483264 - DNA, 21 bp, Homo sapiens
cacactagggactatcaggta

SEQ ID NO: 4483265 - DNA, 21 bp, Homo sapiens
cacactcaaggacaggagcct

SEQ ID NO: 4483266 - DNA, 17 bp, Homo sapiens
cacactcactcctgaga

SEQ ID NO: 4483267 - DNA, 19 bp, Homo sapiens
cacactcactcctgagacc

SEQ ID NO: 4483268 - DNA, 18 bp, Homo sapiens
cacactgagttgcacata

SEQ ID NO: 4483269 - DNA, 16 bp, Homo sapiens
cacactgcaagagcct

SEQ ID NO: 4483270 - DNA, 18 bp, Homo sapiens
cacactgcaagagccttg

SEQ ID NO: 4483271 - DNA, 20 bp, Homo sapiens
cacactgcaagagccttggt

SEQ ID NO: 4483272 - DNA, 19 bp, Homo sapiens
cacactggctcacccagtc

SEQ ID NO: 4483273 - DNA, 19 bp, Homo sapiens
cacactggggtgccgcctg

SEQ ID NO: 4483274 - DNA, 22 bp, Homo sapiens
cacactggggtgccgcctgccc

SEQ ID NO: 4483275 - DNA, 22 bp, Homo sapiens
cacactgggtggtggcctggtc

SEQ ID NO: 4483276 - DNA, 16 bp, Homo sapiens
cacactggtacttaga

SEQ ID NO: 4483277 - DNA, 19 bp, Homo sapiens
cacactggtacttagagtt

SEQ ID NO: 4483278 - DNA, 22 bp, Homo sapiens
cacactggtacttagagtttct

SEQ ID NO: 4483279 - DNA, 15 bp, Homo sapiens
cacactgtgctttct

SEQ ID NO: 4483280 - DNA, 22 bp, Homo sapiens
cacactgtgctttctattgtac

SEQ ID NO: 4483281 - DNA, 23 bp, Homo sapiens
cacactgtgctttctattgtaca

SEQ ID NO: 4483282 - DNA, 20 bp, Homo sapiens
cacactgttacacgtgcctg

SEQ ID NO: 4483283 - DNA, 22 bp, Homo sapiens
cacacttgaagcctaaatttgt

SEQ ID NO: 4483284 - DNA, 16 bp, Homo sapiens
cacacttgttccagct

SEQ ID NO: 4483285 - DNA, 15 bp, Homo sapiens
cacactttggcccag

SEQ ID NO: 4483286 - DNA, 14 bp, Homo sapiens
cacagaaaataagg

SEQ ID NO: 4483287 - DNA, 23 bp, Homo sapiens
cacagaaaataaggcacccatct

SEQ ID NO: 4483288 - DNA, 23 bp, Homo sapiens
cacagaaagccaggagcagccct

SEQ ID NO: 4483289 - DNA, 21 bp, Homo sapiens
cacagaaagctccttccagac

SEQ ID NO: 4483290 - DNA, 17 bp, Homo sapiens
cacagaaatcacagtca

SEQ ID NO: 4483291 - DNA, 22 bp, Homo sapiens
cacagaacctttgtcaacttca

SEQ ID NO: 4483292 - DNA, 16 bp, Homo sapiens
cacagaatatttttat

SEQ ID NO: 4483293 - DNA, 18 bp, Homo sapiens
cacagaatatttttatat

SEQ ID NO: 4483294 - DNA, 13 bp, Homo sapiens
cacagaccacagg

SEQ ID NO: 4483295 - DNA, 17 bp, Homo sapiens
cacagaccacaggaaga

SEQ ID NO: 4483296 - DNA, 16 bp, Homo sapiens
cacagacccaggaccc

SEQ ID NO: 4483297 - DNA, 21 bp, Homo sapiens
cacagacccaggacccccgag

SEQ ID NO: 4483298 - DNA, 19 bp, Homo sapiens
cacagacggatactgggga

SEQ ID NO: 4483299 - DNA, 23 bp, Homo sapiens
cacagactgaactcgcagggaat

SEQ ID NO: 4483300 - DNA, 18 bp, Homo sapiens
cacagacttctggcctag

SEQ ID NO: 4483301 - DNA, 18 bp, Homo sapiens
cacagagaaatacaaaat

SEQ ID NO: 4483302 - DNA, 10 bp, Homo sapiens
cacagagagg

SEQ ID NO: 4483303 - DNA, 19 bp, Homo sapiens
cacagagcaagtcctcact

SEQ ID NO: 4483304 - DNA, 14 bp, Homo sapiens
cacagagcaggact

SEQ ID NO: 4483305 - DNA, 21 bp, Homo sapiens
cacagagcaggactgcacagc

SEQ ID NO: 4483306 - DNA, 13 bp, Homo sapiens
cacagagcctggc

SEQ ID NO: 4483307 - DNA, 18 bp, Homo sapiens
cacagagcctggccccag

SEQ ID NO: 4483308 - DNA, 18 bp, Homo sapiens
cacagaggccccacctga

SEQ ID NO: 4483309 - DNA, 23 bp, Homo sapiens
cacagaggtagtctcactgcttg

SEQ ID NO: 4483310 - DNA, 17 bp, Homo sapiens
cacagagtgagactcca

SEQ ID NO: 4483311 - DNA, 18 bp, Homo sapiens
cacagagtgagggaggag

SEQ ID NO: 4483312 - DNA, 18 bp, Homo sapiens
cacagatagacctttttt

SEQ ID NO: 4483313 - DNA, 21 bp, Homo sapiens
cacagatattgttataaataa

SEQ ID NO: 4483314 - DNA, 14 bp, Homo sapiens
cacagatgaggccc

SEQ ID NO: 4483315 - DNA, 18 bp, Homo sapiens
cacagattctttttttct

SEQ ID NO: 4483316 - DNA, 14 bp, Homo sapiens
cacagcagcatttt

SEQ ID NO: 4483317 - DNA, 15 bp, Homo sapiens
cacagcagcccccca

SEQ ID NO: 4483318 - DNA, 18 bp, Homo sapiens
cacagcagccccccagca

SEQ ID NO: 4483319 - DNA, 22 bp, Homo sapiens
cacagcagtgtgaatagcctgg

SEQ ID NO: 4483320 - DNA, 19 bp, Homo sapiens
cacagcagttgaaaagact

SEQ ID NO: 4483321 - DNA, 15 bp, Homo sapiens
cacagcatcagctca

SEQ ID NO: 4483322 - DNA, 16 bp, Homo sapiens
cacagccaaatttaaa

SEQ ID NO: 4483323 - DNA, 18 bp, Homo sapiens
cacagccacacctggact

SEQ ID NO: 4483324 - DNA, 12 bp, Homo sapiens
cacagccacccg

SEQ ID NO: 4483325 - DNA, 12 bp, Homo sapiens
cacagccagagg

SEQ ID NO: 4483326 - DNA, 13 bp, Homo sapiens
cacagccagagga

SEQ ID NO: 4483327 - DNA, 16 bp, Homo sapiens
cacagccaggtgcctt

SEQ ID NO: 4483328 - DNA, 20 bp, Homo sapiens
cacagccaggtgccttggag

SEQ ID NO: 4483329 - DNA, 23 bp, Homo sapiens
cacagcccaagaggactgagact

SEQ ID NO: 4483330 - DNA, 15 bp, Homo sapiens
cacagcccagcttgg

SEQ ID NO: 4483331 - DNA, 19 bp, Homo sapiens
cacagcccagttcccgtga

SEQ ID NO: 4483332 - DNA, 21 bp, Homo sapiens
cacagcccctggagcctcaga

SEQ ID NO: 4483333 - DNA, 22 bp, Homo sapiens
cacagcccctggagcctcagaa

SEQ ID NO: 4483334 - DNA, 23 bp, Homo sapiens
cacagcccttatgcggttaattt

SEQ ID NO: 4483335 - DNA, 20 bp, Homo sapiens
cacagccgcgggccaggagg

SEQ ID NO: 4483336 - DNA, 14 bp, Homo sapiens
cacagcctcccctg

SEQ ID NO: 4483337 - DNA, 19 bp, Homo sapiens
cacagcctcctctgtctgc

SEQ ID NO: 4483338 - DNA, 23 bp, Homo sapiens
cacagcctcctctgtctgccctt

SEQ ID NO: 4483339 - DNA, 16 bp, Homo sapiens
cacagcctgtccctgg

SEQ ID NO: 4483340 - DNA, 17 bp, Homo sapiens
cacagcctgtccctggg

SEQ ID NO: 4483341 - DNA, 21 bp, Homo sapiens
cacagccttcggacagacata

SEQ ID NO: 4483342 - DNA, 23 bp, Homo sapiens
cacagcgctcgatggacctcagc

SEQ ID NO: 4483343 - DNA, 15 bp, Homo sapiens
cacagcgtccctggc

SEQ ID NO: 4483344 - DNA, 16 bp, Homo sapiens
cacagctcccacccca

SEQ ID NO: 4483345 - DNA, 21 bp, Homo sapiens
cacagctgctgttctcaggac

SEQ ID NO: 4483346 - DNA, 12 bp, Homo sapiens
cacagctggggc

SEQ ID NO: 4483347 - DNA, 14 bp, Homo sapiens
cacagctggggccg

SEQ ID NO: 4483348 - DNA, 17 bp, Homo sapiens
cacagctgtatagctgc

SEQ ID NO: 4483349 - DNA, 15 bp, Homo sapiens
cacagcttagatttc

SEQ ID NO: 4483350 - DNA, 17 bp, Homo sapiens
cacagcttagatttcat

SEQ ID NO: 4483351 - DNA, 17 bp, Homo sapiens
cacaggacatttctcta

SEQ ID NO: 4483352 - DNA, 14 bp, Homo sapiens
cacaggagggccag

SEQ ID NO: 4483353 - DNA, 15 bp, Homo sapiens
cacaggataaagtta

SEQ ID NO: 4483354 - DNA, 16 bp, Homo sapiens
cacaggataaagttat

SEQ ID NO: 4483355 - DNA, 13 bp, Homo sapiens
cacaggcacacag

SEQ ID NO: 4483356 - DNA, 17 bp, Homo sapiens
cacaggcacacagggcc

SEQ ID NO: 4483357 - DNA, 18 bp, Homo sapiens
cacaggcacacagggccc

SEQ ID NO: 4483358 - DNA, 17 bp, Homo sapiens
cacaggcagccagccgt

SEQ ID NO: 4483359 - DNA, 19 bp, Homo sapiens
cacaggcagccagccgtgg

SEQ ID NO: 4483360 - DNA, 19 bp, Homo sapiens
cacaggcagggcctggctc

SEQ ID NO: 4483361 - DNA, 23 bp, Homo sapiens
cacaggcctgagatttcatctgc

SEQ ID NO: 4483362 - DNA, 21 bp, Homo sapiens
cacagggcagctgggcccaac

SEQ ID NO: 4483363 - DNA, 21 bp, Homo sapiens
cacagggctgttttgcctccc

SEQ ID NO: 4483364 - DNA, 16 bp, Homo sapiens
cacaggggccaccacc

SEQ ID NO: 4483365 - DNA, 12 bp, Homo sapiens
cacaggggcctt

SEQ ID NO: 4483366 - DNA, 18 bp, Homo sapiens
cacagggttgggcccaga

SEQ ID NO: 4483367 - DNA, 15 bp, Homo sapiens
cacaggtagcctatt

SEQ ID NO: 4483368 - DNA, 15 bp, Homo sapiens
cacagtaaaaataaa

SEQ ID NO: 4483369 - DNA, 16 bp, Homo sapiens
cacagtaaagagtaca

SEQ ID NO: 4483370 - DNA, 13 bp, Homo sapiens
cacagtagtcttg

SEQ ID NO: 4483371 - DNA, 16 bp, Homo sapiens
cacagtatattttatt

SEQ ID NO: 4483372 - DNA, 15 bp, Homo sapiens
cacagtatttgtaat

SEQ ID NO: 4483373 - DNA, 14 bp, Homo sapiens
cacagtcttgtgaa

SEQ ID NO: 4483374 - DNA, 17 bp, Homo sapiens
cacagtgagactgtaca

SEQ ID NO: 4483375 - DNA, 22 bp, Homo sapiens
cacagtgagactgtacataatt

SEQ ID NO: 4483376 - DNA, 13 bp, Homo sapiens
cacagtggctcac

SEQ ID NO: 4483377 - DNA, 19 bp, Homo sapiens
cacagtggctcacacctgt

SEQ ID NO: 4483378 - DNA, 17 bp, Homo sapiens
cacagtgggaagatttt

SEQ ID NO: 4483379 - DNA, 17 bp, Homo sapiens
cacagtggttcctggct

SEQ ID NO: 4483380 - DNA, 16 bp, Homo sapiens
cacagtgttggaggtt

SEQ ID NO: 4483381 - DNA, 21 bp, Homo sapiens
cacagtgtttttattgctcgc

SEQ ID NO: 4483382 - DNA, 14 bp, Homo sapiens
cacagttcatttaa

SEQ ID NO: 4483383 - DNA, 20 bp, Homo sapiens
cacagttcctcgccctgggt

SEQ ID NO: 4483384 - DNA, 22 bp, Homo sapiens
cacagttcctcgccctgggtct

SEQ ID NO: 4483385 - DNA, 23 bp, Homo sapiens
cacagttgtgttcctgacactca

SEQ ID NO: 4483386 - DNA, 14 bp, Homo sapiens
cacagttttaataa

SEQ ID NO: 4483387 - DNA, 16 bp, Homo sapiens
cacagttttctgagaa

SEQ ID NO: 4483388 - DNA, 19 bp, Homo sapiens
cacagttttctgagaaaga

SEQ ID NO: 4483389 - DNA, 22 bp, Homo sapiens
cacagttttctgagaaagacta

SEQ ID NO: 4483390 - DNA, 13 bp, Homo sapiens
cacagttttgtct

SEQ ID NO: 4483391 - DNA, 14 bp, Homo sapiens
cacataaattttaa

SEQ ID NO: 4483392 - DNA, 18 bp, Homo sapiens
cacataagagagatgaga

SEQ ID NO: 4483393 - DNA, 16 bp, Homo sapiens
cacataatttctgttt

SEQ ID NO: 4483394 - DNA, 18 bp, Homo sapiens
cacataatttctgtttca

SEQ ID NO: 4483395 - DNA, 18 bp, Homo sapiens
cacatactcatttttcat

SEQ ID NO: 4483396 - DNA, 19 bp, Homo sapiens
cacatactcatttttcatg

SEQ ID NO: 4483397 - DNA, 18 bp, Homo sapiens
cacatagcatgtaatggt

SEQ ID NO: 4483398 - DNA, 18 bp, Homo sapiens
cacatatccaggcaccag

SEQ ID NO: 4483399 - DNA, 19 bp, Homo sapiens
cacatatccaggcaccagg

SEQ ID NO: 4483400 - DNA, 21 bp, Homo sapiens
cacatcagggcggcctcccag

SEQ ID NO: 4483401 - DNA, 22 bp, Homo sapiens
cacatcagggcggcctcccagg

SEQ ID NO: 4483402 - DNA, 23 bp, Homo sapiens
cacatcagggcggcctcccaggt

SEQ ID NO: 4483403 - DNA, 16 bp, Homo sapiens
cacatcccatgttgaa

SEQ ID NO: 4483404 - DNA, 17 bp, Homo sapiens
cacatcccttcatatca

SEQ ID NO: 4483405 - DNA, 18 bp, Homo sapiens
cacatcctccgtccagcc

SEQ ID NO: 4483406 - DNA, 14 bp, Homo sapiens
cacatctaaagctt

SEQ ID NO: 4483407 - DNA, 18 bp, Homo sapiens
cacatctgtgtcttgttt

SEQ ID NO: 4483408 - DNA, 20 bp, Homo sapiens
cacatcttaaattcatttct

SEQ ID NO: 4483409 - DNA, 12 bp, Homo sapiens
cacatcttattt

SEQ ID NO: 4483410 - DNA, 15 bp, Homo sapiens
cacatcttatttatt

SEQ ID NO: 4483411 - DNA, 18 bp, Homo sapiens
cacatgaacagcttgcca

SEQ ID NO: 4483412 - DNA, 21 bp, Homo sapiens
cacatgaataaagcctttgta

SEQ ID NO: 4483413 - DNA, 22 bp, Homo sapiens
cacatgaggccatctcaggaga

SEQ ID NO: 4483414 - DNA, 15 bp, Homo sapiens
cacatgcagaataat

SEQ ID NO: 4483415 - DNA, 16 bp, Homo sapiens
cacatgcatgtctgcc

SEQ ID NO: 4483416 - DNA, 23 bp, Homo sapiens
cacatgcatgtctgcctatgcac

SEQ ID NO: 4483417 - DNA, 20 bp, Homo sapiens
cacatgctcaggctactata

SEQ ID NO: 4483418 - DNA, 22 bp, Homo sapiens
cacatgggagcagtccatgcat

SEQ ID NO: 4483419 - DNA, 17 bp, Homo sapiens
cacatggggaaaaaaat

SEQ ID NO: 4483420 - DNA, 20 bp, Homo sapiens
cacatggtcttcgtccttga

SEQ ID NO: 4483421 - DNA, 21 bp, Homo sapiens
cacatggtgtctcccaacatg

SEQ ID NO: 4483422 - DNA, 19 bp, Homo sapiens
cacatgtgccactgttcag

SEQ ID NO: 4483423 - DNA, 21 bp, Homo sapiens
cacatgtgttatctacctcaa

SEQ ID NO: 4483424 - DNA, 18 bp, Homo sapiens
cacattaatcagattagc

SEQ ID NO: 4483425 - DNA, 15 bp, Homo sapiens
cacattatcttctgg

SEQ ID NO: 4483426 - DNA, 20 bp, Homo sapiens
cacattcgggaccaatatat

SEQ ID NO: 4483427 - DNA, 22 bp, Homo sapiens
cacattcttggcttaatcattt

SEQ ID NO: 4483428 - DNA, 20 bp, Homo sapiens
cacattgctgtgaacaggaa

SEQ ID NO: 4483429 - DNA, 23 bp, Homo sapiens
cacattgggtggggctcctggga

SEQ ID NO: 4483430 - DNA, 11 bp, Homo sapiens
cacatttaagg

SEQ ID NO: 4483431 - DNA, 13 bp, Homo sapiens
cacatttaaggat

SEQ ID NO: 4483432 - DNA, 14 bp, Homo sapiens
cacatttaaggatg

SEQ ID NO: 4483433 - DNA, 16 bp, Homo sapiens
cacatttagaaatgtt

SEQ ID NO: 4483434 - DNA, 17 bp, Homo sapiens
cacatttcttaaaacac

SEQ ID NO: 4483435 - DNA, 22 bp, Homo sapiens
cacatttcttaaaacacatgat

SEQ ID NO: 4483436 - DNA, 23 bp, Homo sapiens
cacatttcttaaaacacatgata

SEQ ID NO: 4483437 - DNA, 19 bp, Homo sapiens
cacatttgccttcagtctt

SEQ ID NO: 4483438 - DNA, 17 bp, Homo sapiens
cacatttggaatacttt

SEQ ID NO: 4483439 - DNA, 19 bp, Homo sapiens
cacatttgggatgttcctt

SEQ ID NO: 4483440 - DNA, 20 bp, Homo sapiens
cacatttgggatgttccttt

SEQ ID NO: 4483441 - DNA, 12 bp, Homo sapiens
cacattttgtat

SEQ ID NO: 4483442 - DNA, 21 bp, Homo sapiens
cacatttttggatttctgtga

SEQ ID NO: 4483443 - DNA, 19 bp, Homo sapiens
caccaaactttatttttct

SEQ ID NO: 4483444 - DNA, 13 bp, Homo sapiens
caccaaatgtgct

SEQ ID NO: 4483445 - DNA, 15 bp, Homo sapiens
caccaacaccacggt

SEQ ID NO: 4483446 - DNA, 14 bp, Homo sapiens
caccaacatcccat

SEQ ID NO: 4483447 - DNA, 17 bp, Homo sapiens
caccaacatcccattgc

SEQ ID NO: 4483448 - DNA, 22 bp, Homo sapiens
caccaacatcccattgccctgg

SEQ ID NO: 4483449 - DNA, 22 bp, Homo sapiens
caccaaccacagcatcgggagc

SEQ ID NO: 4483450 - DNA, 19 bp, Homo sapiens
caccaacccatcagaagga

SEQ ID NO: 4483451 - DNA, 14 bp, Homo sapiens
caccaagctcacag

SEQ ID NO: 4483452 - DNA, 13 bp, Homo sapiens
caccaagtgcaat

SEQ ID NO: 4483453 - DNA, 20 bp, Homo sapiens
caccaataaatcagaccatg

SEQ ID NO: 4483454 - DNA, 17 bp, Homo sapiens
caccaatcttgtttata

SEQ ID NO: 4483455 - DNA, 20 bp, Homo sapiens
caccaatcttgtttatagca

SEQ ID NO: 4483456 - DNA, 12 bp, Homo sapiens
caccaatgaaaa

SEQ ID NO: 4483457 - DNA, 13 bp, Homo sapiens
caccaatgaaaac

SEQ ID NO: 4483458 - DNA, 16 bp, Homo sapiens
caccaatgaaaacatg

SEQ ID NO: 4483459 - DNA, 21 bp, Homo sapiens
caccaatgaaaacatgtacta

SEQ ID NO: 4483460 - DNA, 14 bp, Homo sapiens
caccacaactaaca

SEQ ID NO: 4483461 - DNA, 13 bp, Homo sapiens
caccaccagggct

SEQ ID NO: 4483462 - DNA, 17 bp, Homo sapiens
caccaccagggctccag

SEQ ID NO: 4483463 - DNA, 13 bp, Homo sapiens
caccaccatttaa

SEQ ID NO: 4483464 - DNA, 15 bp, Homo sapiens
caccaccatttaatt

SEQ ID NO: 4483465 - DNA, 20 bp, Homo sapiens
caccaccccctgtcccattc

SEQ ID NO: 4483466 - DNA, 22 bp, Homo sapiens
caccaccctagtcccttcccct

SEQ ID NO: 4483467 - DNA, 13 bp, Homo sapiens
caccaccttccca

SEQ ID NO: 4483468 - DNA, 21 bp, Homo sapiens
caccacgatgtggccctggcc

SEQ ID NO: 4483469 - DNA, 16 bp, Homo sapiens
caccacggcgtttttt

SEQ ID NO: 4483470 - DNA, 20 bp, Homo sapiens
caccacggcgtttttttaca

SEQ ID NO: 4483471 - DNA, 17 bp, Homo sapiens
caccactaaccatcccc

SEQ ID NO: 4483472 - DNA, 20 bp, Homo sapiens
caccactaaccatccccaac

SEQ ID NO: 4483473 - DNA, 18 bp, Homo sapiens
caccactaccagccagcc

SEQ ID NO: 4483474 - DNA, 21 bp, Homo sapiens
caccactgatatcatggggag

SEQ ID NO: 4483475 - DNA, 16 bp, Homo sapiens
caccactgcactccag

SEQ ID NO: 4483476 - DNA, 17 bp, Homo sapiens
caccactgcactccagc

SEQ ID NO: 4483477 - DNA, 17 bp, Homo sapiens
caccagaaatgtttatg

SEQ ID NO: 4483478 - DNA, 21 bp, Homo sapiens
caccagaacgcaccccactgg

SEQ ID NO: 4483479 - DNA, 17 bp, Homo sapiens
caccagacgtcaggccc

SEQ ID NO: 4483480 - DNA, 14 bp, Homo sapiens
caccagagacaagc

SEQ ID NO: 4483481 - DNA, 15 bp, Homo sapiens
caccagagacaagca

SEQ ID NO: 4483482 - DNA, 17 bp, Homo sapiens
caccagagacaagcaga

SEQ ID NO: 4483483 - DNA, 13 bp, Homo sapiens
caccagagctgcc

SEQ ID NO: 4483484 - DNA, 15 bp, Homo sapiens
caccagcagcatggc

SEQ ID NO: 4483485 - DNA, 13 bp, Homo sapiens
caccagccaggct

SEQ ID NO: 4483486 - DNA, 16 bp, Homo sapiens
caccagccaggctctg

SEQ ID NO: 4483487 - DNA, 22 bp, Homo sapiens
caccagcccccgccccagagtg

SEQ ID NO: 4483488 - DNA, 12 bp, Homo sapiens
caccagcccctc

SEQ ID NO: 4483489 - DNA, 17 bp, Homo sapiens
caccagcccctccccag

SEQ ID NO: 4483490 - DNA, 22 bp, Homo sapiens
caccagcccctccccagactct

SEQ ID NO: 4483491 - DNA, 20 bp, Homo sapiens
caccagccttgctctcttca

SEQ ID NO: 4483492 - DNA, 11 bp, Homo sapiens
caccagctgca

SEQ ID NO: 4483493 - DNA, 13 bp, Homo sapiens
caccaggaagccg

SEQ ID NO: 4483494 - DNA, 16 bp, Homo sapiens
caccaggagaaccact

SEQ ID NO: 4483495 - DNA, 24 bp, Homo sapiens
caccaggcacgaacccacctgctg

SEQ ID NO: 4483496 - DNA, 14 bp, Homo sapiens
caccaggccagctc

SEQ ID NO: 4483497 - DNA, 16 bp, Homo sapiens
caccaggccagctcag

SEQ ID NO: 4483498 - DNA, 19 bp, Homo sapiens
caccaggccagctcaggaa

SEQ ID NO: 4483499 - DNA, 17 bp, Homo sapiens
caccaggccgtgccttg

SEQ ID NO: 4483500 - DNA, 23 bp, Homo sapiens
caccagggatcacagaccacagg

SEQ ID NO: 4483501 - DNA, 24 bp, Homo sapiens
caccagggatcacagaccacagga

SEQ ID NO: 4483502 - DNA, 19 bp, Homo sapiens
caccagggctccaggagcc

SEQ ID NO: 4483503 - DNA, 22 bp, Homo sapiens
caccagggttgaccccagagga

SEQ ID NO: 4483504 - DNA, 19 bp, Homo sapiens
caccaggtgcctttcaaat

SEQ ID NO: 4483505 - DNA, 22 bp, Homo sapiens
caccaggtgcctttcaaattta

SEQ ID NO: 4483506 - DNA, 14 bp, Homo sapiens
caccagtccagcaa

SEQ ID NO: 4483507 - DNA, 17 bp, Homo sapiens
caccagtccagcaaata

SEQ ID NO: 4483508 - DNA, 15 bp, Homo sapiens
caccagtcccatgct

SEQ ID NO: 4483509 - DNA, 18 bp, Homo sapiens
caccagtcccatgctggc

SEQ ID NO: 4483510 - DNA, 13 bp, Homo sapiens
caccagtgcctct

SEQ ID NO: 4483511 - DNA, 17 bp, Homo sapiens
caccagtgcctctccct

SEQ ID NO: 4483512 - DNA, 19 bp, Homo sapiens
caccagtgttcctgaagct

SEQ ID NO: 4483513 - DNA, 23 bp, Homo sapiens
caccagtgttcctgaagctgctg

SEQ ID NO: 4483514 - DNA, 11 bp, Homo sapiens
caccagttctc

SEQ ID NO: 4483515 - DNA, 20 bp, Homo sapiens
caccagttctcatgggtggc

SEQ ID NO: 4483516 - DNA, 21 bp, Homo sapiens
caccataagctactgccatcc

SEQ ID NO: 4483517 - DNA, 12 bp, Homo sapiens
caccatctgctt

SEQ ID NO: 4483518 - DNA, 12 bp, Homo sapiens
caccatctttta

SEQ ID NO: 4483519 - DNA, 18 bp, Homo sapiens
caccatgatgtgaagagt

SEQ ID NO: 4483520 - DNA, 19 bp, Homo sapiens
caccatgcactgtaaatat

SEQ ID NO: 4483521 - DNA, 18 bp, Homo sapiens
caccatgcttgcctgaag

SEQ ID NO: 4483522 - DNA, 19 bp, Homo sapiens
caccatggaccagcccatt

SEQ ID NO: 4483523 - DNA, 18 bp, Homo sapiens
caccatgttagccaggat

SEQ ID NO: 4483524 - DNA, 19 bp, Homo sapiens
caccatgttagccaggatg

SEQ ID NO: 4483525 - DNA, 18 bp, Homo sapiens
caccatgtttgagctcag

SEQ ID NO: 4483526 - DNA, 14 bp, Homo sapiens
caccattgaaggct

SEQ ID NO: 4483527 - DNA, 21 bp, Homo sapiens
caccatttaatttcatgtata

SEQ ID NO: 4483528 - DNA, 22 bp, Homo sapiens
caccatttaatttcatgtatat

SEQ ID NO: 4483529 - DNA, 16 bp, Homo sapiens
cacccaactccacagg

SEQ ID NO: 4483530 - DNA, 16 bp, Homo sapiens
cacccaagcctgctgg

SEQ ID NO: 4483531 - DNA, 13 bp, Homo sapiens
cacccacagggct

SEQ ID NO: 4483532 - DNA, 20 bp, Homo sapiens
cacccaccatagggcatgat

SEQ ID NO: 4483533 - DNA, 17 bp, Homo sapiens
cacccaccatggaccag

SEQ ID NO: 4483534 - DNA, 14 bp, Homo sapiens
cacccacccctgca

SEQ ID NO: 4483535 - DNA, 21 bp, Homo sapiens
cacccactctcctctgcctca

SEQ ID NO: 4483536 - DNA, 12 bp, Homo sapiens
cacccagcccat

SEQ ID NO: 4483537 - DNA, 15 bp, Homo sapiens
cacccagcccattct

SEQ ID NO: 4483538 - DNA, 19 bp, Homo sapiens
cacccagccctggtctcag

SEQ ID NO: 4483539 - DNA, 14 bp, Homo sapiens
cacccagctcagca

SEQ ID NO: 4483540 - DNA, 11 bp, Homo sapiens
cacccaggaag

SEQ ID NO: 4483541 - DNA, 12 bp, Homo sapiens
cacccaggcaat

SEQ ID NO: 4483542 - DNA, 22 bp, Homo sapiens
cacccaggcaatcttgccttct

SEQ ID NO: 4483543 - DNA, 15 bp, Homo sapiens
cacccaggcaggtgc

SEQ ID NO: 4483544 - DNA, 23 bp, Homo sapiens
cacccaggcccgagcgcctgcgt

SEQ ID NO: 4483545 - DNA, 21 bp, Homo sapiens
cacccaggggaaggccctgag

SEQ ID NO: 4483546 - DNA, 23 bp, Homo sapiens
cacccaggggaaggccctgaggc

SEQ ID NO: 4483547 - DNA, 18 bp, Homo sapiens
cacccagtccatgctcca

SEQ ID NO: 4483548 - DNA, 14 bp, Homo sapiens
cacccatatcatgc

SEQ ID NO: 4483549 - DNA, 11 bp, Homo sapiens
cacccatctgt

SEQ ID NO: 4483550 - DNA, 17 bp, Homo sapiens
cacccatggcctcagcc

SEQ ID NO: 4483551 - DNA, 22 bp, Homo sapiens
cacccatggcctcagccctgct

SEQ ID NO: 4483552 - DNA, 16 bp, Homo sapiens
caccccaaaccccagc

SEQ ID NO: 4483553 - DNA, 16 bp, Homo sapiens
caccccaactctcccc

SEQ ID NO: 4483554 - DNA, 20 bp, Homo sapiens
caccccaactctccccagtg

SEQ ID NO: 4483555 - DNA, 22 bp, Homo sapiens
caccccaactctccccagtgcc

SEQ ID NO: 4483556 - DNA, 12 bp, Homo sapiens
caccccacactt

SEQ ID NO: 4483557 - DNA, 12 bp, Homo sapiens
caccccacagct

SEQ ID NO: 4483558 - DNA, 13 bp, Homo sapiens
caccccaccctcc

SEQ ID NO: 4483559 - DNA, 17 bp, Homo sapiens
caccccactgggagagc

SEQ ID NO: 4483560 - DNA, 17 bp, Homo sapiens
caccccagcattccagc

SEQ ID NO: 4483561 - DNA, 20 bp, Homo sapiens
caccccagcattccagctct

SEQ ID NO: 4483562 - DNA, 22 bp, Homo sapiens
caccccagcattccagctctgc

SEQ ID NO: 4483563 - DNA, 11 bp, Homo sapiens
caccccaggac

SEQ ID NO: 4483564 - DNA, 12 bp, Homo sapiens
caccccagggtc

SEQ ID NO: 4483565 - DNA, 23 bp, Homo sapiens
caccccatctttgctgccagctc

SEQ ID NO: 4483566 - DNA, 12 bp, Homo sapiens
caccccatgcca

SEQ ID NO: 4483567 - DNA, 16 bp, Homo sapiens
caccccattttctgtg

SEQ ID NO: 4483568 - DNA, 13 bp, Homo sapiens
cacccccagcccc

SEQ ID NO: 4483569 - DNA, 21 bp, Homo sapiens
cacccccagccccgactccag

SEQ ID NO: 4483570 - DNA, 23 bp, Homo sapiens
cacccccagccccgactccagcc

SEQ ID NO: 4483571 - DNA, 19 bp, Homo sapiens
cacccccagccttgcccag

SEQ ID NO: 4483572 - DNA, 17 bp, Homo sapiens
cacccccatgctgcctt

SEQ ID NO: 4483573 - DNA, 20 bp, Homo sapiens
cacccccatgctgccttcag

SEQ ID NO: 4483574 - DNA, 22 bp, Homo sapiens
cacccccatgctgccttcaggg

SEQ ID NO: 4483575 - DNA, 12 bp, Homo sapiens
cacccccatggc

SEQ ID NO: 4483576 - DNA, 19 bp, Homo sapiens
caccccctcccacccccag

SEQ ID NO: 4483577 - DNA, 16 bp, Homo sapiens
caccccctccccaggg

SEQ ID NO: 4483578 - DNA, 18 bp, Homo sapiens
caccccctcctcccccag

SEQ ID NO: 4483579 - DNA, 14 bp, Homo sapiens
caccccctgccctg

SEQ ID NO: 4483580 - DNA, 17 bp, Homo sapiens
caccccctgccctgcac

SEQ ID NO: 4483581 - DNA, 19 bp, Homo sapiens
caccccctgctccaccagc

SEQ ID NO: 4483582 - DNA, 22 bp, Homo sapiens
caccccctgctccaccagcagc

SEQ ID NO: 4483583 - DNA, 22 bp, Homo sapiens
caccccctgtcccattctagat

SEQ ID NO: 4483584 - DNA, 16 bp, Homo sapiens
cacccccttcagtgcc

SEQ ID NO: 4483585 - DNA, 20 bp, Homo sapiens
cacccccttcagtgcccacc

SEQ ID NO: 4483586 - DNA, 17 bp, Homo sapiens
cacccccttctctgctc

SEQ ID NO: 4483587 - DNA, 18 bp, Homo sapiens
cacccccttctctgctcc

SEQ ID NO: 4483588 - DNA, 18 bp, Homo sapiens
caccccggggaccctgtg

SEQ ID NO: 4483589 - DNA, 19 bp, Homo sapiens
caccccggggaccctgtga

SEQ ID NO: 4483590 - DNA, 20 bp, Homo sapiens
caccccggggaccctgtgac

SEQ ID NO: 4483591 - DNA, 22 bp, Homo sapiens
caccccgtctggggttcagccc

SEQ ID NO: 4483592 - DNA, 18 bp, Homo sapiens
cacccctccgtgtggagc

SEQ ID NO: 4483593 - DNA, 17 bp, Homo sapiens
cacccctctgcccctgc

SEQ ID NO: 4483594 - DNA, 14 bp, Homo sapiens
cacccctctgctgc

SEQ ID NO: 4483595 - DNA, 15 bp, Homo sapiens
cacccctctgctgca

SEQ ID NO: 4483596 - DNA, 15 bp, Homo sapiens
cacccctgagccagc

SEQ ID NO: 4483597 - DNA, 19 bp, Homo sapiens
cacccctgcccccagcccc

SEQ ID NO: 4483598 - DNA, 14 bp, Homo sapiens
cacccctgggccag

SEQ ID NO: 4483599 - DNA, 18 bp, Homo sapiens
cacccctggggctgagtc

SEQ ID NO: 4483600 - DNA, 12 bp, Homo sapiens
caccccttctct

SEQ ID NO: 4483601 - DNA, 18 bp, Homo sapiens
caccccttctctcctccc

SEQ ID NO: 4483602 - DNA, 21 bp, Homo sapiens
caccccttctctcctccccaa

SEQ ID NO: 4483603 - DNA, 16 bp, Homo sapiens
cacccgcccacccgcc

SEQ ID NO: 4483604 - DNA, 21 bp, Homo sapiens
cacccgcccacccgccttgtg

SEQ ID NO: 4483605 - DNA, 20 bp, Homo sapiens
cacccgccgccactaggtgt

SEQ ID NO: 4483606 - DNA, 21 bp, Homo sapiens
cacccgccgcctcccacggca

SEQ ID NO: 4483607 - DNA, 13 bp, Homo sapiens
cacccgccttgtg

SEQ ID NO: 4483608 - DNA, 14 bp, Homo sapiens
cacccggccacagc

SEQ ID NO: 4483609 - DNA, 17 bp, Homo sapiens
cacccggccacagctgc

SEQ ID NO: 4483610 - DNA, 17 bp, Homo sapiens
cacccgggggagcccag

SEQ ID NO: 4483611 - DNA, 18 bp, Homo sapiens
cacccgggggagcccagt

SEQ ID NO: 4483612 - DNA, 19 bp, Homo sapiens
cacccgggggagcccagtg

SEQ ID NO: 4483613 - DNA, 15 bp, Homo sapiens
cacccgtctctctgc

SEQ ID NO: 4483614 - DNA, 20 bp, Homo sapiens
cacccgtggggtgctgccct

SEQ ID NO: 4483615 - DNA, 16 bp, Homo sapiens
caccctagtcccttcc

SEQ ID NO: 4483616 - DNA, 17 bp, Homo sapiens
caccctagtcccttccc

SEQ ID NO: 4483617 - DNA, 18 bp, Homo sapiens
caccctagtcccttcccc

SEQ ID NO: 4483618 - DNA, 14 bp, Homo sapiens
caccctcatgaaaa

SEQ ID NO: 4483619 - DNA, 18 bp, Homo sapiens
caccctccatgctcctca

SEQ ID NO: 4483620 - DNA, 13 bp, Homo sapiens
caccctccctgga

SEQ ID NO: 4483621 - DNA, 21 bp, Homo sapiens
caccctccggcgggtgacagc

SEQ ID NO: 4483622 - DNA, 15 bp, Homo sapiens
caccctcctcttgga

SEQ ID NO: 4483623 - DNA, 18 bp, Homo sapiens
caccctcctcttggaatt

SEQ ID NO: 4483624 - DNA, 19 bp, Homo sapiens
caccctcctgtcttcccag

SEQ ID NO: 4483625 - DNA, 20 bp, Homo sapiens
caccctcctgtcttcccagg

SEQ ID NO: 4483626 - DNA, 15 bp, Homo sapiens
caccctctcctgggg

SEQ ID NO: 4483627 - DNA, 12 bp, Homo sapiens
caccctctgagc

SEQ ID NO: 4483628 - DNA, 22 bp, Homo sapiens
caccctctgagctttgcatgtt

SEQ ID NO: 4483629 - DNA, 20 bp, Homo sapiens
caccctggagagtgcacatg

SEQ ID NO: 4483630 - DNA, 16 bp, Homo sapiens
caacacctgcctctga

SEQ ID NO: 4483631 - DNA, 15 bp, Homo sapiens
caacaccttcctcct

SEQ ID NO: 4483632 - DNA, 19 bp, Homo sapiens
caacaccttcctcctgcag

SEQ ID NO: 4483633 - DNA, 15 bp, Homo sapiens
caacacgagcaggct

SEQ ID NO: 4483634 - DNA, 18 bp, Homo sapiens
caacactacttccctgcc

SEQ ID NO: 4483635 - DNA, 14 bp, Homo sapiens
caacactgccagca

SEQ ID NO: 4483636 - DNA, 13 bp, Homo sapiens
caacactggtgtg

SEQ ID NO: 4483637 - DNA, 19 bp, Homo sapiens
caacacttaatagcaacag

SEQ ID NO: 4483638 - DNA, 15 bp, Homo sapiens
caacacttaatcatt

SEQ ID NO: 4483639 - DNA, 12 bp, Homo sapiens
caacagaaagag

SEQ ID NO: 4483640 - DNA, 15 bp, Homo sapiens
caacagaaagaggga

SEQ ID NO: 4483641 - DNA, 16 bp, Homo sapiens
caacagaacccacagt

SEQ ID NO: 4483642 - DNA, 18 bp, Homo sapiens
caacagagaaggcaggaa

SEQ ID NO: 4483643 - DNA, 17 bp, Homo sapiens
caacagagacagtgaaa

SEQ ID NO: 4483644 - DNA, 20 bp, Homo sapiens
caacagagactgaatagata

SEQ ID NO: 4483645 - DNA, 22 bp, Homo sapiens
caacagagaggaccaacatcca

SEQ ID NO: 4483646 - DNA, 17 bp, Homo sapiens
caacagcaaaggaacta

SEQ ID NO: 4483647 - DNA, 12 bp, Homo sapiens
caacagcacaca

SEQ ID NO: 4483648 - DNA, 13 bp, Homo sapiens
caacagcacacag

SEQ ID NO: 4483649 - DNA, 11 bp, Homo sapiens
caacagcactt

SEQ ID NO: 4483650 - DNA, 15 bp, Homo sapiens
caacagcgttcctag

SEQ ID NO: 4483651 - DNA, 23 bp, Homo sapiens
caacaggaggctttttcagtgat

SEQ ID NO: 4483652 - DNA, 21 bp, Homo sapiens
caacaggccattgtgaaccaa

SEQ ID NO: 4483653 - DNA, 22 bp, Homo sapiens
caacagggaagaaactttctgg

SEQ ID NO: 4483654 - DNA, 23 bp, Homo sapiens
caacaggtaaaacagggccacat

SEQ ID NO: 4483655 - DNA, 17 bp, Homo sapiens
caacagtaaaccactga

SEQ ID NO: 4483656 - DNA, 14 bp, Homo sapiens
caacagtcacctca

SEQ ID NO: 4483657 - DNA, 22 bp, Homo sapiens
caacagttgtatgtttgctgat

SEQ ID NO: 4483658 - DNA, 16 bp, Homo sapiens
caacataattcttcct

SEQ ID NO: 4483659 - DNA, 17 bp, Homo sapiens
caacataattcttcctt

SEQ ID NO: 4483660 - DNA, 22 bp, Homo sapiens
caacatacattggttttgaaat

SEQ ID NO: 4483661 - DNA, 12 bp, Homo sapiens
caacatactgta

SEQ ID NO: 4483662 - DNA, 19 bp, Homo sapiens
caacatagtgagacactgt

SEQ ID NO: 4483663 - DNA, 15 bp, Homo sapiens
caacatgcactgatg

SEQ ID NO: 4483664 - DNA, 21 bp, Homo sapiens
caacatgcatgttctcctcta

SEQ ID NO: 4483665 - DNA, 13 bp, Homo sapiens
caacatggagaaa

SEQ ID NO: 4483666 - DNA, 23 bp, Homo sapiens
caacatggagaaaccctgtctct

SEQ ID NO: 4483667 - DNA, 14 bp, Homo sapiens
caacatgggaggga

SEQ ID NO: 4483668 - DNA, 19 bp, Homo sapiens
caacatgggagggatcagc

SEQ ID NO: 4483669 - DNA, 23 bp, Homo sapiens
caacatgggagggatcagccccg

SEQ ID NO: 4483670 - DNA, 17 bp, Homo sapiens
caacatgtggctcctcc

SEQ ID NO: 4483671 - DNA, 15 bp, Homo sapiens
caacatgttatttgt

SEQ ID NO: 4483672 - DNA, 22 bp, Homo sapiens
caacattcattgccaagggccc

SEQ ID NO: 4483673 - DNA, 18 bp, Homo sapiens
caacattggacagaaaat

SEQ ID NO: 4483674 - DNA, 18 bp, Homo sapiens
caacatttacaactcatt

SEQ ID NO: 4483675 - DNA, 15 bp, Homo sapiens
caacatttattattt

SEQ ID NO: 4483676 - DNA, 14 bp, Homo sapiens
caacatttccaaaa

SEQ ID NO: 4483677 - DNA, 22 bp, Homo sapiens
caacatttccaaaagtggctag

SEQ ID NO: 4483678 - DNA, 14 bp, Homo sapiens
caacatttctcaat

SEQ ID NO: 4483679 - DNA, 16 bp, Homo sapiens
caaccaactgccccag

SEQ ID NO: 4483680 - DNA, 18 bp, Homo sapiens
caaccaactgccccaggg

SEQ ID NO: 4483681 - DNA, 14 bp, Homo sapiens
caaccaagtgtgct

SEQ ID NO: 4483682 - DNA, 18 bp, Homo sapiens
caaccagaactttctgtc

SEQ ID NO: 4483683 - DNA, 13 bp, Homo sapiens
caaccatcgcttt

SEQ ID NO: 4483684 - DNA, 14 bp, Homo sapiens
caaccatgtcattt

SEQ ID NO: 4483685 - DNA, 22 bp, Homo sapiens
caaccatgtcatttcagaagtt

SEQ ID NO: 4483686 - DNA, 19 bp, Homo sapiens
caacccaaatgttcatcaa

SEQ ID NO: 4483687 - DNA, 19 bp, Homo sapiens
caacccagtgggtctggga

SEQ ID NO: 4483688 - DNA, 11 bp, Homo sapiens
caacccccacc

SEQ ID NO: 4483689 - DNA, 13 bp, Homo sapiens
caacccccacccc

SEQ ID NO: 4483690 - DNA, 12 bp, Homo sapiens
caacccccatct

SEQ ID NO: 4483691 - DNA, 17 bp, Homo sapiens
caacccccatctcccta

SEQ ID NO: 4483692 - DNA, 15 bp, Homo sapiens
caacccccctcccag

SEQ ID NO: 4483693 - DNA, 18 bp, Homo sapiens
caacccccctcccagaca

SEQ ID NO: 4483694 - DNA, 14 bp, Homo sapiens
caacccctcctccc

SEQ ID NO: 4483695 - DNA, 17 bp, Homo sapiens
caacccctcctccctca

SEQ ID NO: 4483696 - DNA, 19 bp, Homo sapiens
caacccctcctccctcaga

SEQ ID NO: 4483697 - DNA, 23 bp, Homo sapiens
caacccctcctccctcagactca

SEQ ID NO: 4483698 - DNA, 16 bp, Homo sapiens
caaccctacagtatat

SEQ ID NO: 4483699 - DNA, 22 bp, Homo sapiens
caaccctgggctattgctgctg

SEQ ID NO: 4483700 - DNA, 19 bp, Homo sapiens
caacccttaccccttagcc

SEQ ID NO: 4483701 - DNA, 22 bp, Homo sapiens
caacccttaccccttagcctcc

SEQ ID NO: 4483702 - DNA, 17 bp, Homo sapiens
caacccttcctgctgct

SEQ ID NO: 4483703 - DNA, 18 bp, Homo sapiens
caacccttcctgctgctg

SEQ ID NO: 4483704 - DNA, 19 bp, Homo sapiens
caacccttcctgctgctgc

SEQ ID NO: 4483705 - DNA, 14 bp, Homo sapiens
caacctaaatactg

SEQ ID NO: 4483706 - DNA, 18 bp, Homo sapiens
caacctcaactgcctact

SEQ ID NO: 4483707 - DNA, 17 bp, Homo sapiens
caacctcaccttcctgt

SEQ ID NO: 4483708 - DNA, 20 bp, Homo sapiens
caacctcaccttcctgtggg

SEQ ID NO: 4483709 - DNA, 15 bp, Homo sapiens
caacctcagggctcc

SEQ ID NO: 4483710 - DNA, 18 bp, Homo sapiens
caacctcagggctcccag

SEQ ID NO: 4483711 - DNA, 22 bp, Homo sapiens
caacctccacatcccatgttga

SEQ ID NO: 4483712 - DNA, 15 bp, Homo sapiens
caacctgaccaacat

SEQ ID NO: 4483713 - DNA, 20 bp, Homo sapiens
caacctgaccaacatggaga

SEQ ID NO: 4483714 - DNA, 23 bp, Homo sapiens
caacctgaccaacatggagaaac

SEQ ID NO: 4483715 - DNA, 16 bp, Homo sapiens
caacctgctctgtccc

SEQ ID NO: 4483716 - DNA, 15 bp, Homo sapiens
caacctggtggcacc

SEQ ID NO: 4483717 - DNA, 22 bp, Homo sapiens
caacctggtggcaccagatgca

SEQ ID NO: 4483718 - DNA, 23 bp, Homo sapiens
caacctgttacctactttgactt

SEQ ID NO: 4483719 - DNA, 18 bp, Homo sapiens
caaccttagatgttctaa

SEQ ID NO: 4483720 - DNA, 23 bp, Homo sapiens
caaccttccaacttcctgtggcc

SEQ ID NO: 4483721 - DNA, 21 bp, Homo sapiens
caaccttgtttattaaattgc

SEQ ID NO: 4483722 - DNA, 13 bp, Homo sapiens
caacgagacacat

SEQ ID NO: 4483723 - DNA, 20 bp, Homo sapiens
caacgagacacattgccttc

SEQ ID NO: 4483724 - DNA, 16 bp, Homo sapiens
caacgcctccccctcc

SEQ ID NO: 4483725 - DNA, 21 bp, Homo sapiens
caacgcttaaaggtgtcttcc

SEQ ID NO: 4483726 - DNA, 19 bp, Homo sapiens
caacggggggctcctgccc

SEQ ID NO: 4483727 - DNA, 14 bp, Homo sapiens
caacgtagcctggg

SEQ ID NO: 4483728 - DNA, 14 bp, Homo sapiens
caacgtcccctccg

SEQ ID NO: 4483729 - DNA, 12 bp, Homo sapiens
caacgtcttgct

SEQ ID NO: 4483730 - DNA, 19 bp, Homo sapiens
caacgtgggcttaaagcag

SEQ ID NO: 4483731 - DNA, 12 bp, Homo sapiens
caactaaataac

SEQ ID NO: 4483732 - DNA, 14 bp, Homo sapiens
caactaaataacac

SEQ ID NO: 4483733 - DNA, 21 bp, Homo sapiens
caactaacccttaaaaatgca

SEQ ID NO: 4483734 - DNA, 17 bp, Homo sapiens
caactaattcaataaaa

SEQ ID NO: 4483735 - DNA, 13 bp, Homo sapiens
caactactaatag

SEQ ID NO: 4483736 - DNA, 22 bp, Homo sapiens
caactactcagctctcctgctg

SEQ ID NO: 4483737 - DNA, 18 bp, Homo sapiens
caactagcccctggggtg

SEQ ID NO: 4483738 - DNA, 16 bp, Homo sapiens
caactatggatcagaa

SEQ ID NO: 4483739 - DNA, 17 bp, Homo sapiens
caactatggatcagaat

SEQ ID NO: 4483740 - DNA, 19 bp, Homo sapiens
caactattcttcatttaca

SEQ ID NO: 4483741 - DNA, 15 bp, Homo sapiens
caactcattccagat

SEQ ID NO: 4483742 - DNA, 16 bp, Homo sapiens
caactccacagggctg

SEQ ID NO: 4483743 - DNA, 14 bp, Homo sapiens
caactccaggggca

SEQ ID NO: 4483744 - DNA, 17 bp, Homo sapiens
caactccaggggcacct

SEQ ID NO: 4483745 - DNA, 21 bp, Homo sapiens
caactccatggggttcgagac

SEQ ID NO: 4483746 - DNA, 17 bp, Homo sapiens
caactccctctctgtgc

SEQ ID NO: 4483747 - DNA, 22 bp, Homo sapiens
caactcccttaaggtctccaaa

SEQ ID NO: 4483748 - DNA, 18 bp, Homo sapiens
caactccgcccagcctct

SEQ ID NO: 4483749 - DNA, 21 bp, Homo sapiens
caactcctggaagctgtgtcc

SEQ ID NO: 4483750 - DNA, 19 bp, Homo sapiens
caaagttaatgggatggtc

SEQ ID NO: 4483751 - DNA, 17 bp, Homo sapiens
caaagttagagaactaa

SEQ ID NO: 4483752 - DNA, 16 bp, Homo sapiens
caaagttctcagagct

SEQ ID NO: 4483753 - DNA, 17 bp, Homo sapiens
caaataaagcagtcatg

SEQ ID NO: 4483754 - DNA, 15 bp, Homo sapiens
caaataaatgattat

SEQ ID NO: 4483755 - DNA, 20 bp, Homo sapiens
caaataaatgattatattca

SEQ ID NO: 4483756 - DNA, 22 bp, Homo sapiens
caaataaatgattatattcaca

SEQ ID NO: 4483757 - DNA, 17 bp, Homo sapiens
caaataagggaataaaa

SEQ ID NO: 4483758 - DNA, 22 bp, Homo sapiens
caaataagtaatatctttcagt

SEQ ID NO: 4483759 - DNA, 22 bp, Homo sapiens
caaataatgatcgaaaaaataa

SEQ ID NO: 4483760 - DNA, 20 bp, Homo sapiens
caaataatgcttttctaatt

SEQ ID NO: 4483761 - DNA, 21 bp, Homo sapiens
caaataatggacttttttcta

SEQ ID NO: 4483762 - DNA, 19 bp, Homo sapiens
caaatacaaagtggaaact

SEQ ID NO: 4483763 - DNA, 20 bp, Homo sapiens
caaatacaaagtggaaactt

SEQ ID NO: 4483764 - DNA, 18 bp, Homo sapiens
caaatacatgcacagtca

SEQ ID NO: 4483765 - DNA, 20 bp, Homo sapiens
caaatacatgcacagtcata

SEQ ID NO: 4483766 - DNA, 16 bp, Homo sapiens
caaatacctcaatttt

SEQ ID NO: 4483767 - DNA, 15 bp, Homo sapiens
caaatactaaaaaga

SEQ ID NO: 4483768 - DNA, 21 bp, Homo sapiens
caaatactaaaaagaagtgct

SEQ ID NO: 4483769 - DNA, 12 bp, Homo sapiens
caaatagaaaac

SEQ ID NO: 4483770 - DNA, 14 bp, Homo sapiens
caaatagaaaacag

SEQ ID NO: 4483771 - DNA, 19 bp, Homo sapiens
caaatagccacaattatat

SEQ ID NO: 4483772 - DNA, 20 bp, Homo sapiens
caaataggctattaaaaaag

SEQ ID NO: 4483773 - DNA, 23 bp, Homo sapiens
caaataggctattaaaaaagtct

SEQ ID NO: 4483774 - DNA, 17 bp, Homo sapiens
caaatatctctatttaa

SEQ ID NO: 4483775 - DNA, 16 bp, Homo sapiens
caaatatgcaaagcac

SEQ ID NO: 4483776 - DNA, 19 bp, Homo sapiens
caaatatgcaaagcactga

SEQ ID NO: 4483777 - DNA, 13 bp, Homo sapiens
caaatattgaagt

SEQ ID NO: 4483778 - DNA, 18 bp, Homo sapiens
caaatattgaagttgttt

SEQ ID NO: 4483779 - DNA, 13 bp, Homo sapiens
caaatatttcact

SEQ ID NO: 4483780 - DNA, 15 bp, Homo sapiens
caaatatttcactta

SEQ ID NO: 4483781 - DNA, 18 bp, Homo sapiens
caaatcaaaaacaggcag

SEQ ID NO: 4483782 - DNA, 17 bp, Homo sapiens
caaatcaacttttatgc

SEQ ID NO: 4483783 - DNA, 14 bp, Homo sapiens
caaatcaatacact

SEQ ID NO: 4483784 - DNA, 18 bp, Homo sapiens
caaatcacatattttaaa

SEQ ID NO: 4483785 - DNA, 14 bp, Homo sapiens
caaatcagaagtca

SEQ ID NO: 4483786 - DNA, 19 bp, Homo sapiens
caaatcagtatattttctg

SEQ ID NO: 4483787 - DNA, 23 bp, Homo sapiens
caaatcagtatattttctgtatt

SEQ ID NO: 4483788 - DNA, 24 bp, Homo sapiens
caaatcagtatattttctgtattt

SEQ ID NO: 4483789 - DNA, 13 bp, Homo sapiens
caaatcatttgtt

SEQ ID NO: 4483790 - DNA, 16 bp, Homo sapiens
caaatccaaggaaaca

SEQ ID NO: 4483791 - DNA, 18 bp, Homo sapiens
caaatccaaggaaacatg

SEQ ID NO: 4483792 - DNA, 19 bp, Homo sapiens
caaatccaaggaaacatgc

SEQ ID NO: 4483793 - DNA, 21 bp, Homo sapiens
caaatcctggaaggacacagt

SEQ ID NO: 4483794 - DNA, 22 bp, Homo sapiens
caaatcctggaaggacacagtg

SEQ ID NO: 4483795 - DNA, 14 bp, Homo sapiens
caaatccttcaaaa

SEQ ID NO: 4483796 - DNA, 14 bp, Homo sapiens
caaatctaccactg

SEQ ID NO: 4483797 - DNA, 23 bp, Homo sapiens
caaatctcagttgtttgcttctt

SEQ ID NO: 4483798 - DNA, 12 bp, Homo sapiens
caaatcttgaaa

SEQ ID NO: 4483799 - DNA, 19 bp, Homo sapiens
caaatcttgaaattaagaa

SEQ ID NO: 4483800 - DNA, 17 bp, Homo sapiens
caaatgaaaaatctcaa

SEQ ID NO: 4483801 - DNA, 16 bp, Homo sapiens
caaatgaaatgccaaa

SEQ ID NO: 4483802 - DNA, 17 bp, Homo sapiens
caaatgaaatgccaaag

SEQ ID NO: 4483803 - DNA, 19 bp, Homo sapiens
caaatgaaatgccaaagga

SEQ ID NO: 4483804 - DNA, 20 bp, Homo sapiens
caaatgaatgattaaattat

SEQ ID NO: 4483805 - DNA, 21 bp, Homo sapiens
caaatgaatgattaaattatg

SEQ ID NO: 4483806 - DNA, 16 bp, Homo sapiens
caaatgacagatcttt

SEQ ID NO: 4483807 - DNA, 18 bp, Homo sapiens
caaatgacagatcttttt

SEQ ID NO: 4483808 - DNA, 21 bp, Homo sapiens
caaatgagggaagaacattat

SEQ ID NO: 4483809 - DNA, 18 bp, Homo sapiens
caaatgaggtcataaaca

SEQ ID NO: 4483810 - DNA, 9 bp, Homo sapiens
caaatgatg

SEQ ID NO: 4483811 - DNA, 11 bp, Homo sapiens
caaatgatttc

SEQ ID NO: 4483812 - DNA, 12 bp, Homo sapiens
caaatgatttca

SEQ ID NO: 4483813 - DNA, 23 bp, Homo sapiens
caaatgcaaatttctataaattt

SEQ ID NO: 4483814 - DNA, 20 bp, Homo sapiens
caaatgcagggaggggaggc

SEQ ID NO: 4483815 - DNA, 22 bp, Homo sapiens
caaatgcagggaggggaggcag

SEQ ID NO: 4483816 - DNA, 12 bp, Homo sapiens
caaatggactgt

SEQ ID NO: 4483817 - DNA, 21 bp, Homo sapiens
caaatggcgtctggaagtcca

SEQ ID NO: 4483818 - DNA, 22 bp, Homo sapiens
caaatggttccagatacttcag

SEQ ID NO: 4483819 - DNA, 18 bp, Homo sapiens
caaatgtaaactctcttc

SEQ ID NO: 4483820 - DNA, 15 bp, Homo sapiens
caaatgtaatagttt

SEQ ID NO: 4483821 - DNA, 21 bp, Homo sapiens
caaatgtcctaacagagaaat

SEQ ID NO: 4483822 - DNA, 16 bp, Homo sapiens
caaatgtcctttctca

SEQ ID NO: 4483823 - DNA, 16 bp, Homo sapiens
caaatgtgcaatttgt

SEQ ID NO: 4483824 - DNA, 15 bp, Homo sapiens
caaatgttagacttg

SEQ ID NO: 4483825 - DNA, 23 bp, Homo sapiens
caaatgttagacttgtgtgcatg

SEQ ID NO: 4483826 - DNA, 20 bp, Homo sapiens
caaatgttcatcaatgaatg

SEQ ID NO: 4483827 - DNA, 17 bp, Homo sapiens
caaatgttgtcctgtta

SEQ ID NO: 4483828 - DNA, 16 bp, Homo sapiens
caaatgtttactgtat

SEQ ID NO: 4483829 - DNA, 13 bp, Homo sapiens
caaatgttttaaa

SEQ ID NO: 4483830 - DNA, 12 bp, Homo sapiens
caaattaagaca

SEQ ID NO: 4483831 - DNA, 15 bp, Homo sapiens
caaattactgataaa

SEQ ID NO: 4483832 - DNA, 21 bp, Homo sapiens
caaattactttgtgaatagaa

SEQ ID NO: 4483833 - DNA, 21 bp, Homo sapiens
caaattagggcaattggaaca

SEQ ID NO: 4483834 - DNA, 15 bp, Homo sapiens
caaattattaatgaa

SEQ ID NO: 4483835 - DNA, 14 bp, Homo sapiens
caaattatttttat

SEQ ID NO: 4483836 - DNA, 14 bp, Homo sapiens
caaattcaaataaa

SEQ ID NO: 4483837 - DNA, 12 bp, Homo sapiens
caaattcagctc

SEQ ID NO: 4483838 - DNA, 15 bp, Homo sapiens
caaattcagtttcat

SEQ ID NO: 4483839 - DNA, 16 bp, Homo sapiens
caaattcagtttcata

SEQ ID NO: 4483840 - DNA, 20 bp, Homo sapiens
caaattcagtttcataaaag

SEQ ID NO: 4483841 - DNA, 23 bp, Homo sapiens
caaattcatggcatgcttaaatt

SEQ ID NO: 4483842 - DNA, 14 bp, Homo sapiens
caaattcttctgaa

SEQ ID NO: 4483843 - DNA, 21 bp, Homo sapiens
caaattcttttgaattgttac

SEQ ID NO: 4483844 - DNA, 20 bp, Homo sapiens
caaattgagtttaacaataa

SEQ ID NO: 4483845 - DNA, 13 bp, Homo sapiens
caaattgctgctt

SEQ ID NO: 4483846 - DNA, 16 bp, Homo sapiens
caaattggctttcaag

SEQ ID NO: 4483847 - DNA, 14 bp, Homo sapiens
caaatttaattaaa

SEQ ID NO: 4483848 - DNA, 14 bp, Homo sapiens
caaatttacagaga

SEQ ID NO: 4483849 - DNA, 23 bp, Homo sapiens
caaatttacagagacagaaagca

SEQ ID NO: 4483850 - DNA, 15 bp, Homo sapiens
caaatttatttccaa

SEQ ID NO: 4483851 - DNA, 14 bp, Homo sapiens
caaatttgattgat

SEQ ID NO: 4483852 - DNA, 17 bp, Homo sapiens
caaatttgattgatttg

SEQ ID NO: 4483853 - DNA, 17 bp, Homo sapiens
caaatttggccttaaga

SEQ ID NO: 4483854 - DNA, 18 bp, Homo sapiens
caaatttggccttaagaa

SEQ ID NO: 4483855 - DNA, 23 bp, Homo sapiens
caaatttggccttaagaactgtg

SEQ ID NO: 4483856 - DNA, 16 bp, Homo sapiens
caaatttgtaataaaa

SEQ ID NO: 4483857 - DNA, 13 bp, Homo sapiens
caaatttgtttaa

SEQ ID NO: 4483858 - DNA, 22 bp, Homo sapiens
caacaaagacatgctttccatt

SEQ ID NO: 4483859 - DNA, 19 bp, Homo sapiens
caacaaagacttgctttaa

SEQ ID NO: 4483860 - DNA, 21 bp, Homo sapiens
caacaaagattgagaagccat

SEQ ID NO: 4483861 - DNA, 15 bp, Homo sapiens
caacaacaaaaaata

SEQ ID NO: 4483862 - DNA, 12 bp, Homo sapiens
caacaagaagaa

SEQ ID NO: 4483863 - DNA, 17 bp, Homo sapiens
caacaagctcatccctg

SEQ ID NO: 4483864 - DNA, 20 bp, Homo sapiens
caacaagggtccgtggacca

SEQ ID NO: 4483865 - DNA, 22 bp, Homo sapiens
caacaattggtgtcattttctt

SEQ ID NO: 4483866 - DNA, 17 bp, Homo sapiens
caacaatttatgaattg

SEQ ID NO: 4483867 - DNA, 18 bp, Homo sapiens
caacaatttctactttga

SEQ ID NO: 4483868 - DNA, 19 bp, Homo sapiens
caacaatttctactttgaa

SEQ ID NO: 4483869 - DNA, 20 bp, Homo sapiens
caacaatttctactttgaag

SEQ ID NO: 4483870 - DNA, 15 bp, Homo sapiens
caaacatggagaaat

SEQ ID NO: 4483871 - DNA, 15 bp, Homo sapiens
caaacatgtatgtat

SEQ ID NO: 4483872 - DNA, 16 bp, Homo sapiens
caaacatgtatgtata

SEQ ID NO: 4483873 - DNA, 13 bp, Homo sapiens
caaacatgtattt

SEQ ID NO: 4483874 - DNA, 15 bp, Homo sapiens
caaacatgtatttat

SEQ ID NO: 4483875 - DNA, 18 bp, Homo sapiens
caaacatgtatttatgta

SEQ ID NO: 4483876 - DNA, 23 bp, Homo sapiens
caaacattttctggccagtgttt

SEQ ID NO: 4483877 - DNA, 21 bp, Homo sapiens
caaaccaagggtacagatccc

SEQ ID NO: 4483878 - DNA, 23 bp, Homo sapiens
caaaccaagggtacagatcccca

SEQ ID NO: 4483879 - DNA, 22 bp, Homo sapiens
caaaccagagaatgctttgaaa

SEQ ID NO: 4483880 - DNA, 16 bp, Homo sapiens
caaaccattacctgta

SEQ ID NO: 4483881 - DNA, 21 bp, Homo sapiens
caaacccacctgctagtgtga

SEQ ID NO: 4483882 - DNA, 14 bp, Homo sapiens
caaaccccagcccc

SEQ ID NO: 4483883 - DNA, 15 bp, Homo sapiens
caaaccccagcccca

SEQ ID NO: 4483884 - DNA, 15 bp, Homo sapiens
caaacccttaactga

SEQ ID NO: 4483885 - DNA, 19 bp, Homo sapiens
caaacctaaaaatcaagtt

SEQ ID NO: 4483886 - DNA, 21 bp, Homo sapiens
caaacctaacaggagaaagga

SEQ ID NO: 4483887 - DNA, 21 bp, Homo sapiens
caaacctcctgtcagtgagga

SEQ ID NO: 4483888 - DNA, 19 bp, Homo sapiens
caaacctgacccctgctca

SEQ ID NO: 4483889 - DNA, 13 bp, Homo sapiens
caaacctggttca

SEQ ID NO: 4483890 - DNA, 16 bp, Homo sapiens
caaaccttcctgggag

SEQ ID NO: 4483891 - DNA, 20 bp, Homo sapiens
caaacgccctttcctcctca

SEQ ID NO: 4483892 - DNA, 22 bp, Homo sapiens
caaacgccctttcctcctcagg

SEQ ID NO: 4483893 - DNA, 23 bp, Homo sapiens
caaacgccctttcctcctcaggc

SEQ ID NO: 4483894 - DNA, 13 bp, Homo sapiens
caaacgctaaaga

SEQ ID NO: 4483895 - DNA, 22 bp, Homo sapiens
caaactaggagatgaaactggt

SEQ ID NO: 4483896 - DNA, 18 bp, Homo sapiens
caaactatgatttatttt

SEQ ID NO: 4483897 - DNA, 16 bp, Homo sapiens
caaactcctatttcaa

SEQ ID NO: 4483898 - DNA, 14 bp, Homo sapiens
caaactgatctaaa

SEQ ID NO: 4483899 - DNA, 16 bp, Homo sapiens
caaactgatttctcac

SEQ ID NO: 4483900 - DNA, 19 bp, Homo sapiens
caaactgcttatgaaaagt

SEQ ID NO: 4483901 - DNA, 13 bp, Homo sapiens
caaactgctttat

SEQ ID NO: 4483902 - DNA, 18 bp, Homo sapiens
caaactgctttattttcc

SEQ ID NO: 4483903 - DNA, 17 bp, Homo sapiens
caaactgggtcttcagc

SEQ ID NO: 4483904 - DNA, 18 bp, Homo sapiens
caaactgggtcttcagct

SEQ ID NO: 4483905 - DNA, 21 bp, Homo sapiens
caaactgggtcttcagcttta

SEQ ID NO: 4483906 - DNA, 12 bp, Homo sapiens
caaactgtaaaa

SEQ ID NO: 4483907 - DNA, 21 bp, Homo sapiens
caaactgtaaaaataacataa

SEQ ID NO: 4483908 - DNA, 21 bp, Homo sapiens
caaactgtaaataaaaagaaa

SEQ ID NO: 4483909 - DNA, 18 bp, Homo sapiens
caaacttggatacttgga

SEQ ID NO: 4483910 - DNA, 23 bp, Homo sapiens
caaacttgtggcctcaagcaatc

SEQ ID NO: 4483911 - DNA, 16 bp, Homo sapiens
caaactttatttttct

SEQ ID NO: 4483912 - DNA, 18 bp, Homo sapiens
caaacttttgaaagatgt

SEQ ID NO: 4483913 - DNA, 19 bp, Homo sapiens
caaagaaaaattaattagg

SEQ ID NO: 4483914 - DNA, 13 bp, Homo sapiens
caaagaaaattcc

SEQ ID NO: 4483915 - DNA, 17 bp, Homo sapiens
caaagaaaattcctata

SEQ ID NO: 4483916 - DNA, 14 bp, Homo sapiens
caaagaaagtgtat

SEQ ID NO: 4483917 - DNA, 16 bp, Homo sapiens
caaagaaatgaacatt

SEQ ID NO: 4483918 - DNA, 22 bp, Homo sapiens
caaagaactcatttgaatgctt

SEQ ID NO: 4483919 - DNA, 21 bp, Homo sapiens
caaagaagcttccacaaaatt

SEQ ID NO: 4483920 - DNA, 22 bp, Homo sapiens
caaagaaggcatttgcagggtc

SEQ ID NO: 4483921 - DNA, 14 bp, Homo sapiens
caaagaaggtgctg

SEQ ID NO: 4483922 - DNA, 14 bp, Homo sapiens
caaagaagtcggaa

SEQ ID NO: 4483923 - DNA, 11 bp, Homo sapiens
caaagaatatt

SEQ ID NO: 4483924 - DNA, 18 bp, Homo sapiens
caaagaattccaaagcaa

SEQ ID NO: 4483925 - DNA, 19 bp, Homo sapiens
caaagaattccaaagcaaa

SEQ ID NO: 4483926 - DNA, 14 bp, Homo sapiens
caaagacaaaagtc

SEQ ID NO: 4483927 - DNA, 20 bp, Homo sapiens
caaagacgcaaggtgtgctc

SEQ ID NO: 4483928 - DNA, 16 bp, Homo sapiens
caaagactcaaatttt

SEQ ID NO: 4483929 - DNA, 17 bp, Homo sapiens
caaagactcaaattttg

SEQ ID NO: 4483930 - DNA, 16 bp, Homo sapiens
caaagactccgagaag

SEQ ID NO: 4483931 - DNA, 14 bp, Homo sapiens
caaagagaagatgc

SEQ ID NO: 4483932 - DNA, 18 bp, Homo sapiens
caaagagaagatgcctgt

SEQ ID NO: 4483933 - DNA, 23 bp, Homo sapiens
caaagagaagatgcctgttaatt

SEQ ID NO: 4483934 - DNA, 17 bp, Homo sapiens
caaagagacatttcaaa

SEQ ID NO: 4483935 - DNA, 22 bp, Homo sapiens
caaagagattgtggtggtgcta

SEQ ID NO: 4483936 - DNA, 14 bp, Homo sapiens
caaagagccttcag

SEQ ID NO: 4483937 - DNA, 23 bp, Homo sapiens
caaagaggctgcccctctcacca

SEQ ID NO: 4483938 - DNA, 22 bp, Homo sapiens
caaagaggtgaacattaaaata

SEQ ID NO: 4483939 - DNA, 16 bp, Homo sapiens
caaagagttcaagaaa

SEQ ID NO: 4483940 - DNA, 23 bp, Homo sapiens
caaagatctgaattaaataaata

SEQ ID NO: 4483941 - DNA, 12 bp, Homo sapiens
caaagatgaaaa

SEQ ID NO: 4483942 - DNA, 15 bp, Homo sapiens
caaagattaaatgtg

SEQ ID NO: 4483943 - DNA, 13 bp, Homo sapiens
caaagattgagaa

SEQ ID NO: 4483944 - DNA, 13 bp, Homo sapiens
caaagatttaatc

SEQ ID NO: 4483945 - DNA, 18 bp, Homo sapiens
caaagatttcatatctaa

SEQ ID NO: 4483946 - DNA, 17 bp, Homo sapiens
caaagatttgtggtaac

SEQ ID NO: 4483947 - DNA, 19 bp, Homo sapiens
caaagcaaccacaaatgca

SEQ ID NO: 4483948 - DNA, 23 bp, Homo sapiens
caaagcaagcattcagaagaaaa

SEQ ID NO: 4483949 - DNA, 22 bp, Homo sapiens
caaagcactgacttctaagtaa

SEQ ID NO: 4483950 - DNA, 21 bp, Homo sapiens
caaagcacttgcttacatcct

SEQ ID NO: 4483951 - DNA, 22 bp, Homo sapiens
caaagccagcgtcctcctctgt

SEQ ID NO: 4483952 - DNA, 15 bp, Homo sapiens
caaagccccccagct

SEQ ID NO: 4483953 - DNA, 16 bp, Homo sapiens
caaagccccccagctc

SEQ ID NO: 4483954 - DNA, 20 bp, Homo sapiens
caaagccccccagctcccac

SEQ ID NO: 4483955 - DNA, 15 bp, Homo sapiens
caaagcccttttata

SEQ ID NO: 4483956 - DNA, 19 bp, Homo sapiens
caaagcggtccctgtccct

SEQ ID NO: 4483957 - DNA, 14 bp, Homo sapiens
caaagctaaaatat

SEQ ID NO: 4483958 - DNA, 17 bp, Homo sapiens
caaagctaaaatatata

SEQ ID NO: 4483959 - DNA, 13 bp, Homo sapiens
caaagctaggatg

SEQ ID NO: 4483960 - DNA, 18 bp, Homo sapiens
caaagctaggatggttct

SEQ ID NO: 4483961 - DNA, 18 bp, Homo sapiens
caaagctttcttttctaa

SEQ ID NO: 4483962 - DNA, 18 bp, Homo sapiens
caaaggaatataagaaaa

SEQ ID NO: 4483963 - DNA, 18 bp, Homo sapiens
caaaggagcgagcatgtc

SEQ ID NO: 4483964 - DNA, 17 bp, Homo sapiens
caaaggaggctggcagg

SEQ ID NO: 4483965 - DNA, 16 bp, Homo sapiens
caaaggataaattttt

SEQ ID NO: 4483966 - DNA, 13 bp, Homo sapiens
caaaggccagtgg

SEQ ID NO: 4483967 - DNA, 20 bp, Homo sapiens
caaaggccagtggaagaaac

SEQ ID NO: 4483968 - DNA, 12 bp, Homo sapiens
caaaggccctgg

SEQ ID NO: 4483969 - DNA, 14 bp, Homo sapiens
caaaggccctgggt

SEQ ID NO: 4483970 - DNA, 21 bp, Homo sapiens
caaaggtagattttacagaga

SEQ ID NO: 4483971 - DNA, 20 bp, Homo sapiens
caaagtacaatgtgtttttc

SEQ ID NO: 4483972 - DNA, 15 bp, Homo sapiens
caaagtacagaattt

SEQ ID NO: 4483973 - DNA, 12 bp, Homo sapiens
caaagtactgta

SEQ ID NO: 4483974 - DNA, 13 bp, Homo sapiens
caaagtactgtaa

SEQ ID NO: 4483975 - DNA, 22 bp, Homo sapiens
caaagtagtacttcttctgtaa

SEQ ID NO: 4483976 - DNA, 14 bp, Homo sapiens
caaagtattgtaaa

SEQ ID NO: 4483977 - DNA, 19 bp, Homo sapiens
caaagtattgtaaattata

SEQ ID NO: 4483978 - DNA, 21 bp, Homo sapiens
caaagtccccctcctcagcca

SEQ ID NO: 4483979 - DNA, 22 bp, Homo sapiens
caaagtccccctcctcagccag

SEQ ID NO: 4483980 - DNA, 19 bp, Homo sapiens
caaagtctcaatgaaatag

SEQ ID NO: 4483981 - DNA, 23 bp, Homo sapiens
caaagtgaaggacatagaggtat

SEQ ID NO: 4483982 - DNA, 16 bp, Homo sapiens
caaagtgcccatggtg

SEQ ID NO: 4483983 - DNA, 18 bp, Homo sapiens
caaagtgctgggattaca

SEQ ID NO: 4483984 - DNA, 20 bp, Homo sapiens
caaagtgctgggattacagg

SEQ ID NO: 4483985 - DNA, 15 bp, Homo sapiens
caaagtggaacgaaa

SEQ ID NO: 4483986 - DNA, 19 bp, Homo sapiens
caaagtggtatagaaatgc

SEQ ID NO: 4483987 - DNA, 19 bp, Homo sapiens
caaagtgttgggattacag

SEQ ID NO: 4483988 - DNA, 19 bp, Homo sapiens
caaagtgttttgtaccagt

SEQ ID NO: 4483989 - DNA, 23 bp, Homo sapiens
caaagtgttttgtaccagtgaat

SEQ ID NO: 4483990 - DNA, 22 bp, Homo sapiens
attttttttttaaataaaagca

SEQ ID NO: 4483991 - DNA, 19 bp, Homo sapiens
atttttttttttttttcct

SEQ ID NO: 4483992 - DNA, 14 bp, Homo sapiens
caaaaaaaaaatga

SEQ ID NO: 4483993 - DNA, 21 bp, Homo sapiens
caaaaaaaatttagccgggcg

SEQ ID NO: 4483994 - DNA, 14 bp, Homo sapiens
caaaaaaaggaagg

SEQ ID NO: 4483995 - DNA, 15 bp, Homo sapiens
caaaaaaatgttcat

SEQ ID NO: 4483996 - DNA, 10 bp, Homo sapiens
caaaaaactt

SEQ ID NO: 4483997 - DNA, 12 bp, Homo sapiens
caaaaaagaaaa

SEQ ID NO: 4483998 - DNA, 12 bp, Homo sapiens
caaaaaatgagc

SEQ ID NO: 4483999 - DNA, 12 bp, Homo sapiens
caaaaacatttg

SEQ ID NO: 4484000 - DNA, 19 bp, Homo sapiens
caaaaaccaaacacccaga

SEQ ID NO: 4484001 - DNA, 13 bp, Homo sapiens
caaaaactgtaaa

SEQ ID NO: 4484002 - DNA, 22 bp, Homo sapiens
caaaaactgtaaaagtgtacag

SEQ ID NO: 4484003 - DNA, 23 bp, Homo sapiens
caaaaactgtaaaagtgtacaga

SEQ ID NO: 4484004 - DNA, 14 bp, Homo sapiens
caaaaagaaccact

SEQ ID NO: 4484005 - DNA, 13 bp, Homo sapiens
caaaaagaccaga

SEQ ID NO: 4484006 - DNA, 12 bp, Homo sapiens
caaaaagcacat

SEQ ID NO: 4484007 - DNA, 18 bp, Homo sapiens
caaaaagctaatgtgcag

SEQ ID NO: 4484008 - DNA, 21 bp, Homo sapiens
caaaaagctaatgtgcaggga

SEQ ID NO: 4484009 - DNA, 14 bp, Homo sapiens
caaaaagtatatta

SEQ ID NO: 4484010 - DNA, 17 bp, Homo sapiens
caaaaataaaaaatctg

SEQ ID NO: 4484011 - DNA, 19 bp, Homo sapiens
caaaaataaaaaatctgaa

SEQ ID NO: 4484012 - DNA, 22 bp, Homo sapiens
caaaaataaaaaatctgaagag

SEQ ID NO: 4484013 - DNA, 12 bp, Homo sapiens
caaaaataatag

SEQ ID NO: 4484014 - DNA, 20 bp, Homo sapiens
caaaaatactcttgatttca

SEQ ID NO: 4484015 - DNA, 15 bp, Homo sapiens
caaaaatagccctgc

SEQ ID NO: 4484016 - DNA, 19 bp, Homo sapiens
caaaaatctcccagtgaca

SEQ ID NO: 4484017 - DNA, 17 bp, Homo sapiens
caaaaatgccacttaac

SEQ ID NO: 4484018 - DNA, 14 bp, Homo sapiens
caaaaatgttccct

SEQ ID NO: 4484019 - DNA, 16 bp, Homo sapiens
caaaaattaaatatat

SEQ ID NO: 4484020 - DNA, 17 bp, Homo sapiens
caaaaattatctatagc

SEQ ID NO: 4484021 - DNA, 19 bp, Homo sapiens
caaaaattatctatagcta

SEQ ID NO: 4484022 - DNA, 20 bp, Homo sapiens
caaaaattttgaatgtacac

SEQ ID NO: 4484023 - DNA, 16 bp, Homo sapiens
caaaaattttgtgaca

SEQ ID NO: 4484024 - DNA, 10 bp, Homo sapiens
caaaacaaaa

SEQ ID NO: 4484025 - DNA, 11 bp, Homo sapiens
caaaacaaaaa

SEQ ID NO: 4484026 - DNA, 15 bp, Homo sapiens
caaaacaaaaaccaa

SEQ ID NO: 4484027 - DNA, 18 bp, Homo sapiens
caaaacaaaaagatgtct

SEQ ID NO: 4484028 - DNA, 14 bp, Homo sapiens
caaaacaaaactat

SEQ ID NO: 4484029 - DNA, 15 bp, Homo sapiens
caaaacaatctattt

SEQ ID NO: 4484030 - DNA, 20 bp, Homo sapiens
caaaacaatctatttaaaaa

SEQ ID NO: 4484031 - DNA, 19 bp, Homo sapiens
caaaacacttccagtctgg

SEQ ID NO: 4484032 - DNA, 21 bp, Homo sapiens
caaaacatttctggacagtac

SEQ ID NO: 4484033 - DNA, 11 bp, Homo sapiens
caaaaccaaac

SEQ ID NO: 4484034 - DNA, 23 bp, Homo sapiens
caaaacccctaagagactgcgtt

SEQ ID NO: 4484035 - DNA, 17 bp, Homo sapiens
caaaaccctcagcactg

SEQ ID NO: 4484036 - DNA, 21 bp, Homo sapiens
caaaacctgattggccactgg

SEQ ID NO: 4484037 - DNA, 22 bp, Homo sapiens
caaaacgatgaagttatgctgt

SEQ ID NO: 4484038 - DNA, 15 bp, Homo sapiens
caaaactatacttga

SEQ ID NO: 4484039 - DNA, 18 bp, Homo sapiens
caaaactatacttgaaca

SEQ ID NO: 4484040 - DNA, 21 bp, Homo sapiens
caaaactatacttgaacaaaa

SEQ ID NO: 4484041 - DNA, 13 bp, Homo sapiens
caaaactcaggca

SEQ ID NO: 4484042 - DNA, 14 bp, Homo sapiens
caaaactgcactgt

SEQ ID NO: 4484043 - DNA, 17 bp, Homo sapiens
caaaactttaaacctgt

SEQ ID NO: 4484044 - DNA, 23 bp, Homo sapiens
caaaagaaaattgatatttttat

SEQ ID NO: 4484045 - DNA, 15 bp, Homo sapiens
caaaagaagaagttt

SEQ ID NO: 4484046 - DNA, 17 bp, Homo sapiens
caaaagaagtaaaagca

SEQ ID NO: 4484047 - DNA, 18 bp, Homo sapiens
caaaagaagtaaaagcaa

SEQ ID NO: 4484048 - DNA, 19 bp, Homo sapiens
caaaagaagtaaaagcaaa

SEQ ID NO: 4484049 - DNA, 19 bp, Homo sapiens
caaaagaatctattagatt

SEQ ID NO: 4484050 - DNA, 21 bp, Homo sapiens
caaaagagcatggatgcattt

SEQ ID NO: 4484051 - DNA, 20 bp, Homo sapiens
caaaagatccttcattttag

SEQ ID NO: 4484052 - DNA, 21 bp, Homo sapiens
caaaagattcccttgaaattt

SEQ ID NO: 4484053 - DNA, 19 bp, Homo sapiens
caaaagattgctgaaattt

SEQ ID NO: 4484054 - DNA, 14 bp, Homo sapiens
caaaagatttattg

SEQ ID NO: 4484055 - DNA, 21 bp, Homo sapiens
caaaagcgccctcactattct

SEQ ID NO: 4484056 - DNA, 16 bp, Homo sapiens
caaaaggaaaaagctc

SEQ ID NO: 4484057 - DNA, 22 bp, Homo sapiens
caaaaggagagactcccatgaa

SEQ ID NO: 4484058 - DNA, 22 bp, Homo sapiens
caaaaggcctcttgtaaagact

SEQ ID NO: 4484059 - DNA, 16 bp, Homo sapiens
caaaaggctgagaagg

SEQ ID NO: 4484060 - DNA, 21 bp, Homo sapiens
caaaagggtgtatagtgttca

SEQ ID NO: 4484061 - DNA, 23 bp, Homo sapiens
caaaagggtgtatagtgttcaca

SEQ ID NO: 4484062 - DNA, 17 bp, Homo sapiens
caaaaggtaaatacaat

SEQ ID NO: 4484063 - DNA, 21 bp, Homo sapiens
caaaaggtattttaatcacca

SEQ ID NO: 4484064 - DNA, 22 bp, Homo sapiens
caaaaggtgcctgtgaggcagg

SEQ ID NO: 4484065 - DNA, 15 bp, Homo sapiens
caaaagtacattgct

SEQ ID NO: 4484066 - DNA, 17 bp, Homo sapiens
caaaagtacattgctta

SEQ ID NO: 4484067 - DNA, 23 bp, Homo sapiens
caaaagttttaattaaaaaaaat

SEQ ID NO: 4484068 - DNA, 18 bp, Homo sapiens
caaaataaacctgttctt

SEQ ID NO: 4484069 - DNA, 19 bp, Homo sapiens
caaaataaacctgttcttc

SEQ ID NO: 4484070 - DNA, 19 bp, Homo sapiens
caaaataatctatattaaa

SEQ ID NO: 4484071 - DNA, 20 bp, Homo sapiens
caaaataatctatattaaat

SEQ ID NO: 4484072 - DNA, 14 bp, Homo sapiens
caaaatattaacat

SEQ ID NO: 4484073 - DNA, 13 bp, Homo sapiens
caaaatatttaaa

SEQ ID NO: 4484074 - DNA, 14 bp, Homo sapiens
caaaatatttaagt

SEQ ID NO: 4484075 - DNA, 18 bp, Homo sapiens
caaaatatttaagtgaag

SEQ ID NO: 4484076 - DNA, 20 bp, Homo sapiens
caaaatatttaagtgaagga

SEQ ID NO: 4484077 - DNA, 16 bp, Homo sapiens
caaaatcaacatgact

SEQ ID NO: 4484078 - DNA, 22 bp, Homo sapiens
caaaatcctgaactttctccct

SEQ ID NO: 4484079 - DNA, 13 bp, Homo sapiens
caaaatctgtcca

SEQ ID NO: 4484080 - DNA, 17 bp, Homo sapiens
caaaatgactggctcct

SEQ ID NO: 4484081 - DNA, 18 bp, Homo sapiens
caaaatgctttttatttc

SEQ ID NO: 4484082 - DNA, 20 bp, Homo sapiens
caaaatgctttttatttctg

SEQ ID NO: 4484083 - DNA, 17 bp, Homo sapiens
caaaatggatacataaa

SEQ ID NO: 4484084 - DNA, 19 bp, Homo sapiens
caaaatggatacataaaga

SEQ ID NO: 4484085 - DNA, 20 bp, Homo sapiens
caaaatggggcagaagagaa

SEQ ID NO: 4484086 - DNA, 18 bp, Homo sapiens
caaaatggttatctttga

SEQ ID NO: 4484087 - DNA, 18 bp, Homo sapiens
caaaatgtacttaaatga

SEQ ID NO: 4484088 - DNA, 15 bp, Homo sapiens
caaaatgtgaagctt

SEQ ID NO: 4484089 - DNA, 15 bp, Homo sapiens
caaaattagaaatgt

SEQ ID NO: 4484090 - DNA, 21 bp, Homo sapiens
caaaattagatcctaagatgt

SEQ ID NO: 4484091 - DNA, 16 bp, Homo sapiens
caaaattagccgggca

SEQ ID NO: 4484092 - DNA, 13 bp, Homo sapiens
caaaattgtttac

SEQ ID NO: 4484093 - DNA, 16 bp, Homo sapiens
caaaatttcacagttc

SEQ ID NO: 4484094 - DNA, 20 bp, Homo sapiens
caaaatttcacagttctgta

SEQ ID NO: 4484095 - DNA, 13 bp, Homo sapiens
caaaatttgacta

SEQ ID NO: 4484096 - DNA, 14 bp, Homo sapiens
caaaattttaaaaa

SEQ ID NO: 4484097 - DNA, 13 bp, Homo sapiens
caaaattttaaca

SEQ ID NO: 4484098 - DNA, 18 bp, Homo sapiens
caaacaaaatttctatta

SEQ ID NO: 4484099 - DNA, 20 bp, Homo sapiens
caaacaatctcttaaattgg

SEQ ID NO: 4484100 - DNA, 18 bp, Homo sapiens
caaacaccaacataaaaa

SEQ ID NO: 4484101 - DNA, 12 bp, Homo sapiens
caaacacccaga

SEQ ID NO: 4484102 - DNA, 12 bp, Homo sapiens
caaacagaaatg

SEQ ID NO: 4484103 - DNA, 20 bp, Homo sapiens
caaacagccaactagcccct

SEQ ID NO: 4484104 - DNA, 15 bp, Homo sapiens
caaacaggctcagag

SEQ ID NO: 4484105 - DNA, 12 bp, Homo sapiens
caaacagggcct

SEQ ID NO: 4484106 - DNA, 15 bp, Homo sapiens
caaacagggcctctg

SEQ ID NO: 4484107 - DNA, 15 bp, Homo sapiens
caaacagtaacgtgt

SEQ ID NO: 4484108 - DNA, 16 bp, Homo sapiens
caaacagtctcaggaa

SEQ ID NO: 4484109 - DNA, 13 bp, Homo sapiens
caaacatgcttat

SEQ ID NO: 4484110 - DNA, 18 bp, Homo sapiens
caaacatgcttataacat

SEQ ID NO: 4484111 - DNA, 21 bp, Homo sapiens
attttgtaagaaggcaatatt

SEQ ID NO: 4484112 - DNA, 17 bp, Homo sapiens
attttgtaatattctgt

SEQ ID NO: 4484113 - DNA, 12 bp, Homo sapiens
attttgtaatga

SEQ ID NO: 4484114 - DNA, 20 bp, Homo sapiens
attttgtacatttttcagca

SEQ ID NO: 4484115 - DNA, 21 bp, Homo sapiens
attttgtaccaagtaaatcca

SEQ ID NO: 4484116 - DNA, 20 bp, Homo sapiens
attttgtataatcacagttg

SEQ ID NO: 4484117 - DNA, 19 bp, Homo sapiens
attttgtatattatgttta

SEQ ID NO: 4484118 - DNA, 20 bp, Homo sapiens
attttgtatattatgtttat

SEQ ID NO: 4484119 - DNA, 14 bp, Homo sapiens
attttgtatgaaat

SEQ ID NO: 4484120 - DNA, 22 bp, Homo sapiens
attttgtctaggagatgctttc

SEQ ID NO: 4484121 - DNA, 13 bp, Homo sapiens
attttgttgcctt

SEQ ID NO: 4484122 - DNA, 17 bp, Homo sapiens
attttgtttatgctgct

SEQ ID NO: 4484123 - DNA, 16 bp, Homo sapiens
attttgttttgttgga

SEQ ID NO: 4484124 - DNA, 18 bp, Homo sapiens
attttgtttttactgtat

SEQ ID NO: 4484125 - DNA, 14 bp, Homo sapiens
atttttaaaaaata

SEQ ID NO: 4484126 - DNA, 23 bp, Homo sapiens
atttttaaaaaatattttctctg

SEQ ID NO: 4484127 - DNA, 13 bp, Homo sapiens
atttttaaaagcc

SEQ ID NO: 4484128 - DNA, 13 bp, Homo sapiens
atttttaaacttg

SEQ ID NO: 4484129 - DNA, 15 bp, Homo sapiens
atttttaaaggcatt

SEQ ID NO: 4484130 - DNA, 13 bp, Homo sapiens
atttttaaccact

SEQ ID NO: 4484131 - DNA, 19 bp, Homo sapiens
atttttaagatgcatgtct

SEQ ID NO: 4484132 - DNA, 14 bp, Homo sapiens
atttttaagcaaat

SEQ ID NO: 4484133 - DNA, 17 bp, Homo sapiens
atttttaatgtatctat

SEQ ID NO: 4484134 - DNA, 23 bp, Homo sapiens
atttttaatgtatctatttgtac

SEQ ID NO: 4484135 - DNA, 13 bp, Homo sapiens
atttttacactat

SEQ ID NO: 4484136 - DNA, 16 bp, Homo sapiens
atttttacactattgt

SEQ ID NO: 4484137 - DNA, 19 bp, Homo sapiens
atttttacactattgtgaa

SEQ ID NO: 4484138 - DNA, 21 bp, Homo sapiens
atttttactatcacacatgaa

SEQ ID NO: 4484139 - DNA, 15 bp, Homo sapiens
atttttagactattt

SEQ ID NO: 4484140 - DNA, 19 bp, Homo sapiens
atttttagactatttcttt

SEQ ID NO: 4484141 - DNA, 23 bp, Homo sapiens
atttttagatggttacactgtta

SEQ ID NO: 4484142 - DNA, 16 bp, Homo sapiens
atttttaggcaaagat

SEQ ID NO: 4484143 - DNA, 16 bp, Homo sapiens
atttttagtaaccttt

SEQ ID NO: 4484144 - DNA, 20 bp, Homo sapiens
atttttataaactaccaaat

SEQ ID NO: 4484145 - DNA, 18 bp, Homo sapiens
atttttatacaagtaatt

SEQ ID NO: 4484146 - DNA, 15 bp, Homo sapiens
atttttatactgaca

SEQ ID NO: 4484147 - DNA, 14 bp, Homo sapiens
atttttatacttta

SEQ ID NO: 4484148 - DNA, 20 bp, Homo sapiens
atttttatactttattgaaa

SEQ ID NO: 4484149 - DNA, 13 bp, Homo sapiens
atttttatagcaa

SEQ ID NO: 4484150 - DNA, 21 bp, Homo sapiens
atttttatagcaacaacaatt

SEQ ID NO: 4484151 - DNA, 17 bp, Homo sapiens
atttttataggaataga

SEQ ID NO: 4484152 - DNA, 13 bp, Homo sapiens
atttttatatcat

SEQ ID NO: 4484153 - DNA, 19 bp, Homo sapiens
atttttatatcatgcaaaa

SEQ ID NO: 4484154 - DNA, 17 bp, Homo sapiens
atttttatatttccttt

SEQ ID NO: 4484155 - DNA, 15 bp, Homo sapiens
atttttatctatata

SEQ ID NO: 4484156 - DNA, 16 bp, Homo sapiens
atttttatctatataa

SEQ ID NO: 4484157 - DNA, 16 bp, Homo sapiens
atttttatgttttctt

SEQ ID NO: 4484158 - DNA, 12 bp, Homo sapiens
atttttattata

SEQ ID NO: 4484159 - DNA, 14 bp, Homo sapiens
atttttatttcaga

SEQ ID NO: 4484160 - DNA, 19 bp, Homo sapiens
atttttatttcagattttg

SEQ ID NO: 4484161 - DNA, 15 bp, Homo sapiens
atttttcaaagcaat

SEQ ID NO: 4484162 - DNA, 13 bp, Homo sapiens
atttttcaacttt

SEQ ID NO: 4484163 - DNA, 18 bp, Homo sapiens
atttttcaactttgaata

SEQ ID NO: 4484164 - DNA, 22 bp, Homo sapiens
atttttcaactttgaataaaga

SEQ ID NO: 4484165 - DNA, 22 bp, Homo sapiens
atttttcaatagcacatatgga

SEQ ID NO: 4484166 - DNA, 14 bp, Homo sapiens
atttttcaatatat

SEQ ID NO: 4484167 - DNA, 18 bp, Homo sapiens
atttttcaatatattgaa

SEQ ID NO: 4484168 - DNA, 20 bp, Homo sapiens
atttttcaatatattgaact

SEQ ID NO: 4484169 - DNA, 12 bp, Homo sapiens
atttttcataga

SEQ ID NO: 4484170 - DNA, 17 bp, Homo sapiens
atttttcattcatgaat

SEQ ID NO: 4484171 - DNA, 23 bp, Homo sapiens
atttttccaaatgaaaaatctca

SEQ ID NO: 4484172 - DNA, 21 bp, Homo sapiens
atttttccaactactaataga

SEQ ID NO: 4484173 - DNA, 24 bp, Homo sapiens
atttttctcccaagaaacctgact

SEQ ID NO: 4484174 - DNA, 17 bp, Homo sapiens
atttttctcttgtacca

SEQ ID NO: 4484175 - DNA, 15 bp, Homo sapiens
atttttctgactttt

SEQ ID NO: 4484176 - DNA, 20 bp, Homo sapiens
atttttcttatttcatttct

SEQ ID NO: 4484177 - DNA, 20 bp, Homo sapiens
atttttgaaactgcatttgt

SEQ ID NO: 4484178 - DNA, 19 bp, Homo sapiens
atttttgaagcaaagaagg

SEQ ID NO: 4484179 - DNA, 21 bp, Homo sapiens
atttttgacagactatttgct

SEQ ID NO: 4484180 - DNA, 19 bp, Homo sapiens
atttttgatactaagcatt

SEQ ID NO: 4484181 - DNA, 12 bp, Homo sapiens
atttttgatgta

SEQ ID NO: 4484182 - DNA, 18 bp, Homo sapiens
atttttgcctcttccagt

SEQ ID NO: 4484183 - DNA, 21 bp, Homo sapiens
atttttgctgaattcctttac

SEQ ID NO: 4484184 - DNA, 19 bp, Homo sapiens
atttttggcagtctgaatt

SEQ ID NO: 4484185 - DNA, 17 bp, Homo sapiens
atttttggtttccaaag

SEQ ID NO: 4484186 - DNA, 12 bp, Homo sapiens
atttttgtaatt

SEQ ID NO: 4484187 - DNA, 12 bp, Homo sapiens
atttttgtattt

SEQ ID NO: 4484188 - DNA, 22 bp, Homo sapiens
atttttgtcattgattaaattg

SEQ ID NO: 4484189 - DNA, 21 bp, Homo sapiens
atttttgttagcaaagattaa

SEQ ID NO: 4484190 - DNA, 16 bp, Homo sapiens
atttttgttgttgttg

SEQ ID NO: 4484191 - DNA, 22 bp, Homo sapiens
atttttgttttccactgtgcta

SEQ ID NO: 4484192 - DNA, 22 bp, Homo sapiens
atttttgtttttgagtactgta

SEQ ID NO: 4484193 - DNA, 21 bp, Homo sapiens
atttttgtttttggtttctta

SEQ ID NO: 4484194 - DNA, 18 bp, Homo sapiens
attttttaaaaaagctta

SEQ ID NO: 4484195 - DNA, 13 bp, Homo sapiens
attttttaaaaag

SEQ ID NO: 4484196 - DNA, 22 bp, Homo sapiens
attttttaaaacaagccaagaa

SEQ ID NO: 4484197 - DNA, 20 bp, Homo sapiens
attttttaaaagccttccag

SEQ ID NO: 4484198 - DNA, 13 bp, Homo sapiens
attttttaaattc

SEQ ID NO: 4484199 - DNA, 15 bp, Homo sapiens
attttttacttgaat

SEQ ID NO: 4484200 - DNA, 17 bp, Homo sapiens
attttttagatcttcct

SEQ ID NO: 4484201 - DNA, 16 bp, Homo sapiens
attttttatcatgcat

SEQ ID NO: 4484202 - DNA, 16 bp, Homo sapiens
attttttatgtacaac

SEQ ID NO: 4484203 - DNA, 12 bp, Homo sapiens
attttttccaaa

SEQ ID NO: 4484204 - DNA, 13 bp, Homo sapiens
attttttccaaaa

SEQ ID NO: 4484205 - DNA, 11 bp, Homo sapiens
attttttcctt

SEQ ID NO: 4484206 - DNA, 23 bp, Homo sapiens
attttttccttcaaagtttaata

SEQ ID NO: 4484207 - DNA, 16 bp, Homo sapiens
attttttgaaaagcag

SEQ ID NO: 4484208 - DNA, 19 bp, Homo sapiens
attttttgaaaagcagaca

SEQ ID NO: 4484209 - DNA, 14 bp, Homo sapiens
attttttgaaagtt

SEQ ID NO: 4484210 - DNA, 12 bp, Homo sapiens
attttttgaagg

SEQ ID NO: 4484211 - DNA, 16 bp, Homo sapiens
attttttgaaggtttc

SEQ ID NO: 4484212 - DNA, 16 bp, Homo sapiens
attttttggcacttgc

SEQ ID NO: 4484213 - DNA, 22 bp, Homo sapiens
attttttgggcagcaatttaaa

SEQ ID NO: 4484214 - DNA, 19 bp, Homo sapiens
attttttggtggtgaaatt

SEQ ID NO: 4484215 - DNA, 14 bp, Homo sapiens
atttttttaaacaa

SEQ ID NO: 4484216 - DNA, 18 bp, Homo sapiens
atttttttaaatcaagga

SEQ ID NO: 4484217 - DNA, 17 bp, Homo sapiens
atttttttatgctcttg

SEQ ID NO: 4484218 - DNA, 23 bp, Homo sapiens
atttttttcaaagactcaaattt

SEQ ID NO: 4484219 - DNA, 12 bp, Homo sapiens
atttttttccta

SEQ ID NO: 4484220 - DNA, 13 bp, Homo sapiens
atttttttgtaag

SEQ ID NO: 4484221 - DNA, 15 bp, Homo sapiens
atttttttgtaaggg

SEQ ID NO: 4484222 - DNA, 14 bp, Homo sapiens
atttttttgtaata

SEQ ID NO: 4484223 - DNA, 15 bp, Homo sapiens
atttttttgtaataa

SEQ ID NO: 4484224 - DNA, 22 bp, Homo sapiens
attttttttaaaatagaaattt

SEQ ID NO: 4484225 - DNA, 12 bp, Homo sapiens
attttttttccg

SEQ ID NO: 4484226 - DNA, 21 bp, Homo sapiens
attttttttccgtgtgtttat

SEQ ID NO: 4484227 - DNA, 14 bp, Homo sapiens
atttttttttcata

SEQ ID NO: 4484228 - DNA, 16 bp, Homo sapiens
atttttttttcataca

SEQ ID NO: 4484229 - DNA, 19 bp, Homo sapiens
atttttttttcatacactt

SEQ ID NO: 4484230 - DNA, 15 bp, Homo sapiens
atttttttttctaag

SEQ ID NO: 4484231 - DNA, 18 bp, Homo sapiens
atttttttttctaagaga

SEQ ID NO: 4484232 - DNA, 21 bp, Homo sapiens
atcattcatcttcttctttaa

SEQ ID NO: 4484233 - DNA, 13 bp, Homo sapiens
atcattccttcct

SEQ ID NO: 4484234 - DNA, 14 bp, Homo sapiens
atcattctctgtct

SEQ ID NO: 4484235 - DNA, 24 bp, Homo sapiens
atcattctctgtctcatccatcat

SEQ ID NO: 4484236 - DNA, 18 bp, Homo sapiens
atcatttataatactgtt

SEQ ID NO: 4484237 - DNA, 15 bp, Homo sapiens
atcatttattcattg

SEQ ID NO: 4484238 - DNA, 12 bp, Homo sapiens
atcatttcagcc

SEQ ID NO: 4484239 - DNA, 15 bp, Homo sapiens
atcatttctttagag

SEQ ID NO: 4484240 - DNA, 17 bp, Homo sapiens
atcattttaataaagtt

SEQ ID NO: 4484241 - DNA, 13 bp, Homo sapiens
atcattttagaat

SEQ ID NO: 4484242 - DNA, 17 bp, Homo sapiens
atcattttagaattaaa

SEQ ID NO: 4484243 - DNA, 16 bp, Homo sapiens
atcattttaggaaagg

SEQ ID NO: 4484244 - DNA, 11 bp, Homo sapiens
atcattttcat

SEQ ID NO: 4484245 - DNA, 14 bp, Homo sapiens
atcattttcccccc

SEQ ID NO: 4484246 - DNA, 17 bp, Homo sapiens
atcattttccccccact

SEQ ID NO: 4484247 - DNA, 17 bp, Homo sapiens
atccaaaaagctctgaa

SEQ ID NO: 4484248 - DNA, 18 bp, Homo sapiens
atccaaaaagctctgaaa

SEQ ID NO: 4484249 - DNA, 20 bp, Homo sapiens
atccaaacatgtatttatgt

SEQ ID NO: 4484250 - DNA, 20 bp, Homo sapiens
atccaaattgtgcttctccc

SEQ ID NO: 4484251 - DNA, 19 bp, Homo sapiens
atccaagatattttaaaat

SEQ ID NO: 4484252 - DNA, 15 bp, Homo sapiens
atccaaggaaacatg

SEQ ID NO: 4484253 - DNA, 17 bp, Homo sapiens
atccaagggttgagagc

SEQ ID NO: 4484254 - DNA, 22 bp, Homo sapiens
atccaagtctttcttctttttt

SEQ ID NO: 4484255 - DNA, 17 bp, Homo sapiens
atccaatattttgcctt

SEQ ID NO: 4484256 - DNA, 17 bp, Homo sapiens
atccaattgctctttca

SEQ ID NO: 4484257 - DNA, 21 bp, Homo sapiens
atccacaattattggcaaagt

SEQ ID NO: 4484258 - DNA, 19 bp, Homo sapiens
atccacagaaaatgtaaac

SEQ ID NO: 4484259 - DNA, 14 bp, Homo sapiens
atccacctgccttg

SEQ ID NO: 4484260 - DNA, 17 bp, Homo sapiens
atccaccttcaggcccc

SEQ ID NO: 4484261 - DNA, 14 bp, Homo sapiens
atccacgctgggcc

SEQ ID NO: 4484262 - DNA, 20 bp, Homo sapiens
atccacgctgggcctaggat

SEQ ID NO: 4484263 - DNA, 21 bp, Homo sapiens
atccactctaccctcccaccc

SEQ ID NO: 4484264 - DNA, 18 bp, Homo sapiens
atccactctgcaggaaat

SEQ ID NO: 4484265 - DNA, 21 bp, Homo sapiens
atccagaaataaagtctaaga

SEQ ID NO: 4484266 - DNA, 23 bp, Homo sapiens
atccagaaataaagtctaagaga

SEQ ID NO: 4484267 - DNA, 15 bp, Homo sapiens
atccagacctggctc

SEQ ID NO: 4484268 - DNA, 23 bp, Homo sapiens
atccagactttctttttctacat

SEQ ID NO: 4484269 - DNA, 17 bp, Homo sapiens
atccagagattcatttt

SEQ ID NO: 4484270 - DNA, 19 bp, Homo sapiens
atccagagattcattttct

SEQ ID NO: 4484271 - DNA, 23 bp, Homo sapiens
atccagagattcattttctagat

SEQ ID NO: 4484272 - DNA, 19 bp, Homo sapiens
atccagagtccctgcctgg

SEQ ID NO: 4484273 - DNA, 20 bp, Homo sapiens
atccagagtccctgcctgga

SEQ ID NO: 4484274 - DNA, 16 bp, Homo sapiens
atccagcctcagagat

SEQ ID NO: 4484275 - DNA, 23 bp, Homo sapiens
atccagcctcagagatctccctt

SEQ ID NO: 4484276 - DNA, 20 bp, Homo sapiens
atccaggcaatcgttctgct

SEQ ID NO: 4484277 - DNA, 23 bp, Homo sapiens
atccaggcaatcgttctgctggc

SEQ ID NO: 4484278 - DNA, 15 bp, Homo sapiens
atccaggcaccagga

SEQ ID NO: 4484279 - DNA, 16 bp, Homo sapiens
atccaggcaccaggac

SEQ ID NO: 4484280 - DNA, 18 bp, Homo sapiens
atccaggctggccagtgc

SEQ ID NO: 4484281 - DNA, 18 bp, Homo sapiens
atccaggctgttctcagc

SEQ ID NO: 4484282 - DNA, 17 bp, Homo sapiens
atccaggctttatgtac

SEQ ID NO: 4484283 - DNA, 17 bp, Homo sapiens
atccagggggcaagagg

SEQ ID NO: 4484284 - DNA, 16 bp, Homo sapiens
atccagtgatccttac

SEQ ID NO: 4484285 - DNA, 21 bp, Homo sapiens
atccagtgatccttacaagtt

SEQ ID NO: 4484286 - DNA, 20 bp, Homo sapiens
atccagtttgttctccgggt

SEQ ID NO: 4484287 - DNA, 19 bp, Homo sapiens
atccatagcacctccacat

SEQ ID NO: 4484288 - DNA, 16 bp, Homo sapiens
atccatatttgctaag

SEQ ID NO: 4484289 - DNA, 22 bp, Homo sapiens
atccatcaactaaaacattata

SEQ ID NO: 4484290 - DNA, 14 bp, Homo sapiens
atccatcatcatgt

SEQ ID NO: 4484291 - DNA, 18 bp, Homo sapiens
atccatcttgagccacag

SEQ ID NO: 4484292 - DNA, 20 bp, Homo sapiens
atccatcttgctttttcccc

SEQ ID NO: 4484293 - DNA, 24 bp, Homo sapiens
atccatgacaggcctgaagatatt

SEQ ID NO: 4484294 - DNA, 20 bp, Homo sapiens
atccatggggctgattgtat

SEQ ID NO: 4484295 - DNA, 13 bp, Homo sapiens
atccattaattaa

SEQ ID NO: 4484296 - DNA, 13 bp, Homo sapiens
atccattaattta

SEQ ID NO: 4484297 - DNA, 15 bp, Homo sapiens
atccattaatttaaa

SEQ ID NO: 4484298 - DNA, 13 bp, Homo sapiens
atccattcacaag

SEQ ID NO: 4484299 - DNA, 16 bp, Homo sapiens
atccattcacaagcct

SEQ ID NO: 4484300 - DNA, 18 bp, Homo sapiens
atccattcctcagggaca

SEQ ID NO: 4484301 - DNA, 15 bp, Homo sapiens
atccatttatctttt

SEQ ID NO: 4484302 - DNA, 11 bp, Homo sapiens
atcccaacact

SEQ ID NO: 4484303 - DNA, 19 bp, Homo sapiens
atcccaacctctttttcct

SEQ ID NO: 4484304 - DNA, 21 bp, Homo sapiens
atcccaccccctcctccccca

SEQ ID NO: 4484305 - DNA, 14 bp, Homo sapiens
atcccaccttccca

SEQ ID NO: 4484306 - DNA, 16 bp, Homo sapiens
atcccacgttctgtta

SEQ ID NO: 4484307 - DNA, 23 bp, Homo sapiens
atcccagaggtgggatcctccct

SEQ ID NO: 4484308 - DNA, 20 bp, Homo sapiens
atcccagctactcaggaggc

SEQ ID NO: 4484309 - DNA, 19 bp, Homo sapiens
atcccaggggcccaaggcg

SEQ ID NO: 4484310 - DNA, 17 bp, Homo sapiens
atcccagtctctgccag

SEQ ID NO: 4484311 - DNA, 14 bp, Homo sapiens
atcccattgccctg

SEQ ID NO: 4484312 - DNA, 16 bp, Homo sapiens
atcccattgccctggt

SEQ ID NO: 4484313 - DNA, 17 bp, Homo sapiens
atcccattgccctggtt

SEQ ID NO: 4484314 - DNA, 20 bp, Homo sapiens
atccccaacatgcactgatg

SEQ ID NO: 4484315 - DNA, 21 bp, Homo sapiens
atccccaactccatggggttc

SEQ ID NO: 4484316 - DNA, 11 bp, Homo sapiens
atccccagccc

SEQ ID NO: 4484317 - DNA, 18 bp, Homo sapiens
atccccagcccctcctcc

SEQ ID NO: 4484318 - DNA, 22 bp, Homo sapiens
atccccagcccctcctccctca

SEQ ID NO: 4484319 - DNA, 19 bp, Homo sapiens
atccccaggggtcccagcc

SEQ ID NO: 4484320 - DNA, 21 bp, Homo sapiens
atccccaggggtcccagccac

SEQ ID NO: 4484321 - DNA, 15 bp, Homo sapiens
atccccatctccctg

SEQ ID NO: 4484322 - DNA, 16 bp, Homo sapiens
atccccatctccctgc

SEQ ID NO: 4484323 - DNA, 16 bp, Homo sapiens
atcccctccctgcctg

SEQ ID NO: 4484324 - DNA, 18 bp, Homo sapiens
atcccctccctgcctgct

SEQ ID NO: 4484325 - DNA, 21 bp, Homo sapiens
atccccttcccccatccctac

SEQ ID NO: 4484326 - DNA, 20 bp, Homo sapiens
atcccgaagccatcacttct

SEQ ID NO: 4484327 - DNA, 23 bp, Homo sapiens
atcccgaagccatcacttctccc

SEQ ID NO: 4484328 - DNA, 14 bp, Homo sapiens
atcccgagcacctc

SEQ ID NO: 4484329 - DNA, 19 bp, Homo sapiens
atcccgagcacctccacat

SEQ ID NO: 4484330 - DNA, 18 bp, Homo sapiens
atcccgtatcacagtgtt

SEQ ID NO: 4484331 - DNA, 21 bp, Homo sapiens
atccctaccccctaagagcca

SEQ ID NO: 4484332 - DNA, 20 bp, Homo sapiens
atccctatagaccactgggt

SEQ ID NO: 4484333 - DNA, 19 bp, Homo sapiens
atccctcacccatcctaga

SEQ ID NO: 4484334 - DNA, 11 bp, Homo sapiens
atccctcatct

SEQ ID NO: 4484335 - DNA, 15 bp, Homo sapiens
atccctccttaagag

SEQ ID NO: 4484336 - DNA, 21 bp, Homo sapiens
atccctctacagagcttccct

SEQ ID NO: 4484337 - DNA, 23 bp, Homo sapiens
atccctctacagagcttccctga

SEQ ID NO: 4484338 - DNA, 19 bp, Homo sapiens
atccctctcccccaggccc

SEQ ID NO: 4484339 - DNA, 15 bp, Homo sapiens
atccctctcttcccc

SEQ ID NO: 4484340 - DNA, 20 bp, Homo sapiens
atccctctcttccccttccc

SEQ ID NO: 4484341 - DNA, 23 bp, Homo sapiens
atccctctcttccccttccctta

SEQ ID NO: 4484342 - DNA, 20 bp, Homo sapiens
atccctgcctcaggccaagg

SEQ ID NO: 4484343 - DNA, 23 bp, Homo sapiens
atccctgcttgcccgctcccaca

SEQ ID NO: 4484344 - DNA, 14 bp, Homo sapiens
atccctggagcagg

SEQ ID NO: 4484345 - DNA, 11 bp, Homo sapiens
atccctgggcc

SEQ ID NO: 4484346 - DNA, 15 bp, Homo sapiens
atccctgggcccctc

SEQ ID NO: 4484347 - DNA, 20 bp, Homo sapiens
atcccttatccaaaatgctt

SEQ ID NO: 4484348 - DNA, 16 bp, Homo sapiens
atccctttttttacat

SEQ ID NO: 4484349 - DNA, 19 bp, Homo sapiens
atccctttttttacatttc

SEQ ID NO: 4484350 - DNA, 20 bp, Homo sapiens
atccctttttttacatttca

SEQ ID NO: 4484351 - DNA, 14 bp, Homo sapiens
atccgaatctcttt

SEQ ID NO: 4484352 - DNA, 11 bp, Homo sapiens
atcacccaagc

SEQ ID NO: 4484353 - DNA, 22 bp, Homo sapiens
atcacccctctgcccctgcagc

SEQ ID NO: 4484354 - DNA, 23 bp, Homo sapiens
atcacccctctgcccctgcagct

SEQ ID NO: 4484355 - DNA, 13 bp, Homo sapiens
atcacccttccga

SEQ ID NO: 4484356 - DNA, 16 bp, Homo sapiens
atcacctaagcacttc

SEQ ID NO: 4484357 - DNA, 14 bp, Homo sapiens
atcacctatttcca

SEQ ID NO: 4484358 - DNA, 18 bp, Homo sapiens
atcacctgaaccccagag

SEQ ID NO: 4484359 - DNA, 13 bp, Homo sapiens
atcacctgaggtc

SEQ ID NO: 4484360 - DNA, 16 bp, Homo sapiens
atcacctgaggtcagg

SEQ ID NO: 4484361 - DNA, 22 bp, Homo sapiens
atcacggatggtgcatgggctc

SEQ ID NO: 4484362 - DNA, 13 bp, Homo sapiens
atcactaacatta

SEQ ID NO: 4484363 - DNA, 18 bp, Homo sapiens
atcactaacattatattg

SEQ ID NO: 4484364 - DNA, 17 bp, Homo sapiens
atcactaagctgtggct

SEQ ID NO: 4484365 - DNA, 23 bp, Homo sapiens
atcactcttgtactgcctgccac

SEQ ID NO: 4484366 - DNA, 22 bp, Homo sapiens
atcactgaattaagccatcagg

SEQ ID NO: 4484367 - DNA, 17 bp, Homo sapiens
atcactgagagtcagga

SEQ ID NO: 4484368 - DNA, 16 bp, Homo sapiens
atcactgatgggaata

SEQ ID NO: 4484369 - DNA, 21 bp, Homo sapiens
atcactgatgggaataaaagt

SEQ ID NO: 4484370 - DNA, 18 bp, Homo sapiens
atcactgcagtcacctct

SEQ ID NO: 4484371 - DNA, 14 bp, Homo sapiens
atcactgctccagg

SEQ ID NO: 4484372 - DNA, 17 bp, Homo sapiens
atcactggagcaccagg

SEQ ID NO: 4484373 - DNA, 22 bp, Homo sapiens
atcactgtctagctgtttcaaa

SEQ ID NO: 4484374 - DNA, 22 bp, Homo sapiens
atcactgtgaaccaacccccat

SEQ ID NO: 4484375 - DNA, 22 bp, Homo sapiens
atcactgtgcagttgctgttta

SEQ ID NO: 4484376 - DNA, 14 bp, Homo sapiens
atcacttaaaggca

SEQ ID NO: 4484377 - DNA, 14 bp, Homo sapiens
atcacttctccccg

SEQ ID NO: 4484378 - DNA, 23 bp, Homo sapiens
atcacttgaacccgggaggcaga

SEQ ID NO: 4484379 - DNA, 20 bp, Homo sapiens
atcactttctcagttttcat

SEQ ID NO: 4484380 - DNA, 15 bp, Homo sapiens
atcagaaaaccaaag

SEQ ID NO: 4484381 - DNA, 18 bp, Homo sapiens
atcagaataaagttgtat

SEQ ID NO: 4484382 - DNA, 20 bp, Homo sapiens
atcagaatggaagagagaaa

SEQ ID NO: 4484383 - DNA, 10 bp, Homo sapiens
atcagacagc

SEQ ID NO: 4484384 - DNA, 20 bp, Homo sapiens
atcagacagtggatgagaca

SEQ ID NO: 4484385 - DNA, 19 bp, Homo sapiens
atcagacccaacccatgaa

SEQ ID NO: 4484386 - DNA, 17 bp, Homo sapiens
atcagagataaagctta

SEQ ID NO: 4484387 - DNA, 17 bp, Homo sapiens
atcagagcgcacaggga

SEQ ID NO: 4484388 - DNA, 16 bp, Homo sapiens
atcagaggagtaaata

SEQ ID NO: 4484389 - DNA, 22 bp, Homo sapiens
atcagatgcaattgctcccatc

SEQ ID NO: 4484390 - DNA, 17 bp, Homo sapiens
atcagatggtgtcattt

SEQ ID NO: 4484391 - DNA, 18 bp, Homo sapiens
atcagatggtgtcattta

SEQ ID NO: 4484392 - DNA, 13 bp, Homo sapiens
atcagcaaagaaa

SEQ ID NO: 4484393 - DNA, 19 bp, Homo sapiens
atcagcaacccttcctgct

SEQ ID NO: 4484394 - DNA, 22 bp, Homo sapiens
atcagcactagaaattgggcag

SEQ ID NO: 4484395 - DNA, 13 bp, Homo sapiens
atcagcactctgt

SEQ ID NO: 4484396 - DNA, 17 bp, Homo sapiens
atcagcagacactccag

SEQ ID NO: 4484397 - DNA, 20 bp, Homo sapiens
atcagcatctgacaggtgaa

SEQ ID NO: 4484398 - DNA, 21 bp, Homo sapiens
atcagccagcccatggccccc

SEQ ID NO: 4484399 - DNA, 23 bp, Homo sapiens
atcagccagcccatggcccccaa

SEQ ID NO: 4484400 - DNA, 13 bp, Homo sapiens
atcagccccgcct

SEQ ID NO: 4484401 - DNA, 20 bp, Homo sapiens
atcagccccgcctgtcacaa

SEQ ID NO: 4484402 - DNA, 13 bp, Homo sapiens
atcagccctgcta

SEQ ID NO: 4484403 - DNA, 20 bp, Homo sapiens
atcagcctgggcaacatggt

SEQ ID NO: 4484404 - DNA, 17 bp, Homo sapiens
atcagctccttcctgga

SEQ ID NO: 4484405 - DNA, 19 bp, Homo sapiens
atcagctgcaatccattta

SEQ ID NO: 4484406 - DNA, 22 bp, Homo sapiens
atcagcttgccctgttaaaaga

SEQ ID NO: 4484407 - DNA, 20 bp, Homo sapiens
atcagcttttgttctagact

SEQ ID NO: 4484408 - DNA, 16 bp, Homo sapiens
atcaggacccagagga

SEQ ID NO: 4484409 - DNA, 16 bp, Homo sapiens
atcaggcttttgtttc

SEQ ID NO: 4484410 - DNA, 13 bp, Homo sapiens
atcaggtaacttt

SEQ ID NO: 4484411 - DNA, 14 bp, Homo sapiens
atcaggtaactttc

SEQ ID NO: 4484412 - DNA, 21 bp, Homo sapiens
atcagtaaaattatactgtgt

SEQ ID NO: 4484413 - DNA, 15 bp, Homo sapiens
atcagtagaaagcta

SEQ ID NO: 4484414 - DNA, 17 bp, Homo sapiens
atcagtagaaagctaaa

SEQ ID NO: 4484415 - DNA, 15 bp, Homo sapiens
atcagtatattttct

SEQ ID NO: 4484416 - DNA, 23 bp, Homo sapiens
atcagtcctagaatgtttcattt

SEQ ID NO: 4484417 - DNA, 14 bp, Homo sapiens
atcagtgataattg

SEQ ID NO: 4484418 - DNA, 17 bp, Homo sapiens
atcagtgataattggtt

SEQ ID NO: 4484419 - DNA, 17 bp, Homo sapiens
atcagtgctctgtaaaa

SEQ ID NO: 4484420 - DNA, 12 bp, Homo sapiens
atcagttaacta

SEQ ID NO: 4484421 - DNA, 18 bp, Homo sapiens
atcagttaactattgcat

SEQ ID NO: 4484422 - DNA, 17 bp, Homo sapiens
atcagttactcagccct

SEQ ID NO: 4484423 - DNA, 21 bp, Homo sapiens
atcagttatctgtttgttact

SEQ ID NO: 4484424 - DNA, 19 bp, Homo sapiens
atcagttcattagaaatat

SEQ ID NO: 4484425 - DNA, 16 bp, Homo sapiens
atcagttgatttttct

SEQ ID NO: 4484426 - DNA, 14 bp, Homo sapiens
atcataaagtcagt

SEQ ID NO: 4484427 - DNA, 11 bp, Homo sapiens
atcataaatct

SEQ ID NO: 4484428 - DNA, 12 bp, Homo sapiens
atcatacagttt

SEQ ID NO: 4484429 - DNA, 13 bp, Homo sapiens
atcatacagtttt

SEQ ID NO: 4484430 - DNA, 14 bp, Homo sapiens
atcatacagttttc

SEQ ID NO: 4484431 - DNA, 17 bp, Homo sapiens
atcatacagttttcatt

SEQ ID NO: 4484432 - DNA, 16 bp, Homo sapiens
atcatactcttctaaa

SEQ ID NO: 4484433 - DNA, 18 bp, Homo sapiens
atcatacttaacatttca

SEQ ID NO: 4484434 - DNA, 21 bp, Homo sapiens
atcatagaattgcagtcattt

SEQ ID NO: 4484435 - DNA, 18 bp, Homo sapiens
atcatagcaagacctcat

SEQ ID NO: 4484436 - DNA, 20 bp, Homo sapiens
atcatagcaagacctcatct

SEQ ID NO: 4484437 - DNA, 16 bp, Homo sapiens
atcatatattaaaaca

SEQ ID NO: 4484438 - DNA, 15 bp, Homo sapiens
atcatcactgtaaag

SEQ ID NO: 4484439 - DNA, 19 bp, Homo sapiens
atcatcactgtaaagacaa

SEQ ID NO: 4484440 - DNA, 20 bp, Homo sapiens
atcatcatgcagctcaactt

SEQ ID NO: 4484441 - DNA, 16 bp, Homo sapiens
atcatcccttaataaa

SEQ ID NO: 4484442 - DNA, 20 bp, Homo sapiens
atcatctcctgccttcctcc

SEQ ID NO: 4484443 - DNA, 23 bp, Homo sapiens
atcatctcctgccttcctcctgg

SEQ ID NO: 4484444 - DNA, 15 bp, Homo sapiens
atcatctgtcattat

SEQ ID NO: 4484445 - DNA, 23 bp, Homo sapiens
atcatctgtcattatattctaat

SEQ ID NO: 4484446 - DNA, 13 bp, Homo sapiens
atcatctgtttgt

SEQ ID NO: 4484447 - DNA, 21 bp, Homo sapiens
atcatcttgaacattaatcca

SEQ ID NO: 4484448 - DNA, 16 bp, Homo sapiens
atcatgaatgctttta

SEQ ID NO: 4484449 - DNA, 15 bp, Homo sapiens
atcatgaattttaaa

SEQ ID NO: 4484450 - DNA, 17 bp, Homo sapiens
atcatgaattttaaagt

SEQ ID NO: 4484451 - DNA, 18 bp, Homo sapiens
atcatgaattttaaagta

SEQ ID NO: 4484452 - DNA, 20 bp, Homo sapiens
atcatgaggtcaggagatca

SEQ ID NO: 4484453 - DNA, 22 bp, Homo sapiens
atcatgcagctcaactttctgt

SEQ ID NO: 4484454 - DNA, 19 bp, Homo sapiens
atcatgccagtatttttaa

SEQ ID NO: 4484455 - DNA, 15 bp, Homo sapiens
atcatggtgaaaagc

SEQ ID NO: 4484456 - DNA, 15 bp, Homo sapiens
atcatgtaacattct

SEQ ID NO: 4484457 - DNA, 18 bp, Homo sapiens
atcatgtactttttagta

SEQ ID NO: 4484458 - DNA, 21 bp, Homo sapiens
atcatgtctattgtccaaagt

SEQ ID NO: 4484459 - DNA, 15 bp, Homo sapiens
atcatgtctgtatac

SEQ ID NO: 4484460 - DNA, 22 bp, Homo sapiens
atcatgtggcccaactctcctg

SEQ ID NO: 4484461 - DNA, 19 bp, Homo sapiens
atcatgttgatcatgtact

SEQ ID NO: 4484462 - DNA, 14 bp, Homo sapiens
atcatgttgttgtg

SEQ ID NO: 4484463 - DNA, 23 bp, Homo sapiens
atcatgtttacagaggacagtat

SEQ ID NO: 4484464 - DNA, 16 bp, Homo sapiens
atcatgtttattttga

SEQ ID NO: 4484465 - DNA, 13 bp, Homo sapiens
atcattaaacaaa

SEQ ID NO: 4484466 - DNA, 20 bp, Homo sapiens
atcattataactgaaggaga

SEQ ID NO: 4484467 - DNA, 20 bp, Homo sapiens
atcattatcagcctgtgcca

SEQ ID NO: 4484468 - DNA, 20 bp, Homo sapiens
atcattattgtagtttgaaa

SEQ ID NO: 4484469 - DNA, 12 bp, Homo sapiens
atcattatttga

SEQ ID NO: 4484470 - DNA, 13 bp, Homo sapiens
atcattatttgag

SEQ ID NO: 4484471 - DNA, 15 bp, Homo sapiens
atcattatttgagac

SEQ ID NO: 4484472 - DNA, 18 bp, Homo sapiens
atatttcctttatgtgaa

SEQ ID NO: 4484473 - DNA, 19 bp, Homo sapiens
atatttcctttatgtgaat

SEQ ID NO: 4484474 - DNA, 23 bp, Homo sapiens
atatttctgaggagcctgcaaca

SEQ ID NO: 4484475 - DNA, 18 bp, Homo sapiens
atatttcttcaaatatct

SEQ ID NO: 4484476 - DNA, 19 bp, Homo sapiens
atatttcttcgttcttttt

SEQ ID NO: 4484477 - DNA, 22 bp, Homo sapiens
atatttcttcttctaagaagac

SEQ ID NO: 4484478 - DNA, 15 bp, Homo sapiens
atatttgaaatagta

SEQ ID NO: 4484479 - DNA, 15 bp, Homo sapiens
atatttgactattct

SEQ ID NO: 4484480 - DNA, 18 bp, Homo sapiens
atatttgattatgtatgg

SEQ ID NO: 4484481 - DNA, 22 bp, Homo sapiens
atatttgtatcacaaatcttaa

SEQ ID NO: 4484482 - DNA, 20 bp, Homo sapiens
atatttgtatgtttttctgt

SEQ ID NO: 4484483 - DNA, 21 bp, Homo sapiens
atatttgtcatgctgggattt

SEQ ID NO: 4484484 - DNA, 14 bp, Homo sapiens
atatttgtccagat

SEQ ID NO: 4484485 - DNA, 22 bp, Homo sapiens
atatttgttactttacttttgc

SEQ ID NO: 4484486 - DNA, 15 bp, Homo sapiens
atatttgttatgtag

SEQ ID NO: 4484487 - DNA, 23 bp, Homo sapiens
atatttgtttagttcagcaaaac

SEQ ID NO: 4484488 - DNA, 16 bp, Homo sapiens
atatttgtttatggta

SEQ ID NO: 4484489 - DNA, 15 bp, Homo sapiens
atatttgttttaata

SEQ ID NO: 4484490 - DNA, 20 bp, Homo sapiens
atattttaaaatctcctaaa

SEQ ID NO: 4484491 - DNA, 15 bp, Homo sapiens
atattttaaagaatt

SEQ ID NO: 4484492 - DNA, 16 bp, Homo sapiens
atattttaaagaattg

SEQ ID NO: 4484493 - DNA, 18 bp, Homo sapiens
atattttaaattctcata

SEQ ID NO: 4484494 - DNA, 12 bp, Homo sapiens
atattttaactt

SEQ ID NO: 4484495 - DNA, 14 bp, Homo sapiens
atattttagattac

SEQ ID NO: 4484496 - DNA, 22 bp, Homo sapiens
atattttatataaagtattctt

SEQ ID NO: 4484497 - DNA, 14 bp, Homo sapiens
atattttatcctgt

SEQ ID NO: 4484498 - DNA, 16 bp, Homo sapiens
atattttatgaacatt

SEQ ID NO: 4484499 - DNA, 20 bp, Homo sapiens
atattttatgtgagagaaag

SEQ ID NO: 4484500 - DNA, 20 bp, Homo sapiens
atattttcaagtttttcata

SEQ ID NO: 4484501 - DNA, 21 bp, Homo sapiens
atattttcctagtagatctat

SEQ ID NO: 4484502 - DNA, 13 bp, Homo sapiens
atattttctattt

SEQ ID NO: 4484503 - DNA, 13 bp, Homo sapiens
atattttctctgt

SEQ ID NO: 4484504 - DNA, 18 bp, Homo sapiens
atattttctctgtacttt

SEQ ID NO: 4484505 - DNA, 19 bp, Homo sapiens
atattttctgtatttaatt

SEQ ID NO: 4484506 - DNA, 12 bp, Homo sapiens
atattttctgtt

SEQ ID NO: 4484507 - DNA, 14 bp, Homo sapiens
atattttctttcta

SEQ ID NO: 4484508 - DNA, 16 bp, Homo sapiens
atattttcttttatgg

SEQ ID NO: 4484509 - DNA, 20 bp, Homo sapiens
atattttcttttatggcaaa

SEQ ID NO: 4484510 - DNA, 12 bp, Homo sapiens
atattttgaatc

SEQ ID NO: 4484511 - DNA, 15 bp, Homo sapiens
atattttgagaaact

SEQ ID NO: 4484512 - DNA, 20 bp, Homo sapiens
atattttgtaaaatgtatta

SEQ ID NO: 4484513 - DNA, 21 bp, Homo sapiens
atattttgttgctttcttacc

SEQ ID NO: 4484514 - DNA, 17 bp, Homo sapiens
atatttttaaattttgt

SEQ ID NO: 4484515 - DNA, 13 bp, Homo sapiens
atatttttatact

SEQ ID NO: 4484516 - DNA, 20 bp, Homo sapiens
atatttttatatttccttta

SEQ ID NO: 4484517 - DNA, 22 bp, Homo sapiens
atatttttatctatataaaata

SEQ ID NO: 4484518 - DNA, 14 bp, Homo sapiens
atatttttatcttt

SEQ ID NO: 4484519 - DNA, 16 bp, Homo sapiens
atattttttatcataa

SEQ ID NO: 4484520 - DNA, 13 bp, Homo sapiens
atattttttatga

SEQ ID NO: 4484521 - DNA, 13 bp, Homo sapiens
atattttttgctc

SEQ ID NO: 4484522 - DNA, 17 bp, Homo sapiens
atatttttttaacttta

SEQ ID NO: 4484523 - DNA, 13 bp, Homo sapiens
atcaaaagaaaat

SEQ ID NO: 4484524 - DNA, 12 bp, Homo sapiens
atcaaaattaca

SEQ ID NO: 4484525 - DNA, 23 bp, Homo sapiens
atcaaacaccaacataaaaatga

SEQ ID NO: 4484526 - DNA, 22 bp, Homo sapiens
atcaaactgcttatgaaaagta

SEQ ID NO: 4484527 - DNA, 17 bp, Homo sapiens
atcaaaggaatataaga

SEQ ID NO: 4484528 - DNA, 20 bp, Homo sapiens
atcaaaggaatataagaaaa

SEQ ID NO: 4484529 - DNA, 23 bp, Homo sapiens
atcaaagtggtaaatactgtgaa

SEQ ID NO: 4484530 - DNA, 14 bp, Homo sapiens
atcaaatatgcaaa

SEQ ID NO: 4484531 - DNA, 17 bp, Homo sapiens
atcaaatatgcaaagca

SEQ ID NO: 4484532 - DNA, 12 bp, Homo sapiens
atcaaatcaact

SEQ ID NO: 4484533 - DNA, 23 bp, Homo sapiens
atcaaatgaatgattaaattatg

SEQ ID NO: 4484534 - DNA, 21 bp, Homo sapiens
atcaaatgatttcatattgat

SEQ ID NO: 4484535 - DNA, 14 bp, Homo sapiens
atcaaattcaataa

SEQ ID NO: 4484536 - DNA, 15 bp, Homo sapiens
atcaacaagatttcc

SEQ ID NO: 4484537 - DNA, 23 bp, Homo sapiens
atcaaccacctatttttgacatg

SEQ ID NO: 4484538 - DNA, 18 bp, Homo sapiens
atcaactcccaacttctt

SEQ ID NO: 4484539 - DNA, 14 bp, Homo sapiens
atcaactctgaaag

SEQ ID NO: 4484540 - DNA, 18 bp, Homo sapiens
atcaactctgaaagagca

SEQ ID NO: 4484541 - DNA, 20 bp, Homo sapiens
atcaactctgaaagagcaaa

SEQ ID NO: 4484542 - DNA, 14 bp, Homo sapiens
atcaactgaatgag

SEQ ID NO: 4484543 - DNA, 17 bp, Homo sapiens
atcaacttcgctagaaa

SEQ ID NO: 4484544 - DNA, 18 bp, Homo sapiens
atcaacttcgctagaaaa

SEQ ID NO: 4484545 - DNA, 19 bp, Homo sapiens
atcaagactatctacaaaa

SEQ ID NO: 4484546 - DNA, 20 bp, Homo sapiens
atcaagactatctacaaaaa

SEQ ID NO: 4484547 - DNA, 13 bp, Homo sapiens
atcaagagaaact

SEQ ID NO: 4484548 - DNA, 15 bp, Homo sapiens
atcaagagaaacttc

SEQ ID NO: 4484549 - DNA, 16 bp, Homo sapiens
atcaagagctgccctc

SEQ ID NO: 4484550 - DNA, 17 bp, Homo sapiens
atcaagagctgccctcc

SEQ ID NO: 4484551 - DNA, 19 bp, Homo sapiens
atcaagagctgccctcctt

SEQ ID NO: 4484552 - DNA, 13 bp, Homo sapiens
atcaagatttttt

SEQ ID NO: 4484553 - DNA, 16 bp, Homo sapiens
atcaaggaaaggctca

SEQ ID NO: 4484554 - DNA, 21 bp, Homo sapiens
atcaaggaaaggctcatttaa

SEQ ID NO: 4484555 - DNA, 16 bp, Homo sapiens
atcaagggcactgtga

SEQ ID NO: 4484556 - DNA, 14 bp, Homo sapiens
atcaagtaatacaa

SEQ ID NO: 4484557 - DNA, 16 bp, Homo sapiens
atcaagtatttgggaa

SEQ ID NO: 4484558 - DNA, 16 bp, Homo sapiens
atcaagtccatctgac

SEQ ID NO: 4484559 - DNA, 20 bp, Homo sapiens
atcaagtccatctgacaaaa

SEQ ID NO: 4484560 - DNA, 22 bp, Homo sapiens
atcaagttgttgactgtgatta

SEQ ID NO: 4484561 - DNA, 14 bp, Homo sapiens
atcaataaaattct

SEQ ID NO: 4484562 - DNA, 15 bp, Homo sapiens
atcaataaaattctg

SEQ ID NO: 4484563 - DNA, 18 bp, Homo sapiens
atcaataaaattctgtaa

SEQ ID NO: 4484564 - DNA, 19 bp, Homo sapiens
atcaatacactagttgttt

SEQ ID NO: 4484565 - DNA, 19 bp, Homo sapiens
atcaatctggcttctgcat

SEQ ID NO: 4484566 - DNA, 15 bp, Homo sapiens
atcaatcttgttact

SEQ ID NO: 4484567 - DNA, 13 bp, Homo sapiens
atcaatttaaaaa

SEQ ID NO: 4484568 - DNA, 17 bp, Homo sapiens
atcaatttaagtgttgg

SEQ ID NO: 4484569 - DNA, 12 bp, Homo sapiens
atcaatttctaa

SEQ ID NO: 4484570 - DNA, 16 bp, Homo sapiens
atcaatttctaatgtt

SEQ ID NO: 4484571 - DNA, 22 bp, Homo sapiens
atcacaaaggctgacattcact

SEQ ID NO: 4484572 - DNA, 14 bp, Homo sapiens
atcacaaagtggaa

SEQ ID NO: 4484573 - DNA, 16 bp, Homo sapiens
atcacaatattcagtg

SEQ ID NO: 4484574 - DNA, 15 bp, Homo sapiens
atcacacccatttaa

SEQ ID NO: 4484575 - DNA, 15 bp, Homo sapiens
atcacacttatattt

SEQ ID NO: 4484576 - DNA, 14 bp, Homo sapiens
atcacagaccccag

SEQ ID NO: 4484577 - DNA, 15 bp, Homo sapiens
atcacagaccccagc

SEQ ID NO: 4484578 - DNA, 19 bp, Homo sapiens
atcacagaccccagctggg

SEQ ID NO: 4484579 - DNA, 14 bp, Homo sapiens
atcacagagcagca

SEQ ID NO: 4484580 - DNA, 18 bp, Homo sapiens
atcacagggttgggccca

SEQ ID NO: 4484581 - DNA, 19 bp, Homo sapiens
atcacagggttgggcccag

SEQ ID NO: 4484582 - DNA, 13 bp, Homo sapiens
atcacagtgtttt

SEQ ID NO: 4484583 - DNA, 20 bp, Homo sapiens
atcacagtgtttttattgct

SEQ ID NO: 4484584 - DNA, 13 bp, Homo sapiens
atcacatcacctt

SEQ ID NO: 4484585 - DNA, 14 bp, Homo sapiens
atcacatcaccttt

SEQ ID NO: 4484586 - DNA, 16 bp, Homo sapiens
atcacatctaaagctt

SEQ ID NO: 4484587 - DNA, 15 bp, Homo sapiens
atcacatcttattta

SEQ ID NO: 4484588 - DNA, 15 bp, Homo sapiens
atcaccaattaaaaa

SEQ ID NO: 4484589 - DNA, 22 bp, Homo sapiens
atcaccagtcctagctcttaca

SEQ ID NO: 4484590 - DNA, 14 bp, Homo sapiens
atcaccattatatt

SEQ ID NO: 4484591 - DNA, 18 bp, Homo sapiens
atcaccattatattttga

SEQ ID NO: 4484592 - DNA, 13 bp, Homo sapiens
atcaccatttctt

SEQ ID NO: 4484593 - DNA, 18 bp, Homo sapiens
atatgtatttaccaaaaa

SEQ ID NO: 4484594 - DNA, 11 bp, Homo sapiens
atatgtatttt

SEQ ID NO: 4484595 - DNA, 20 bp, Homo sapiens
atatgtcacgaacttgaaag

SEQ ID NO: 4484596 - DNA, 18 bp, Homo sapiens
atatgtcagtcactaaaa

SEQ ID NO: 4484597 - DNA, 18 bp, Homo sapiens
atatgtccactgttctgt

SEQ ID NO: 4484598 - DNA, 13 bp, Homo sapiens
atatgtgaagttt

SEQ ID NO: 4484599 - DNA, 19 bp, Homo sapiens
atatgtgccaatcaatagc

SEQ ID NO: 4484600 - DNA, 17 bp, Homo sapiens
atatgtgccacattttc

SEQ ID NO: 4484601 - DNA, 16 bp, Homo sapiens
atatgtgtatacatac

SEQ ID NO: 4484602 - DNA, 20 bp, Homo sapiens
atatgtgtatacatacatgt

SEQ ID NO: 4484603 - DNA, 17 bp, Homo sapiens
atatgtgtgccctggac

SEQ ID NO: 4484604 - DNA, 16 bp, Homo sapiens
atatgttaatttgtgt

SEQ ID NO: 4484605 - DNA, 15 bp, Homo sapiens
atatgttgaatactt

SEQ ID NO: 4484606 - DNA, 15 bp, Homo sapiens
atatgttgctttgaa

SEQ ID NO: 4484607 - DNA, 23 bp, Homo sapiens
atatgtttagttttacattttaa

SEQ ID NO: 4484608 - DNA, 18 bp, Homo sapiens
atatgttttccacataaa

SEQ ID NO: 4484609 - DNA, 19 bp, Homo sapiens
atatgttttccacataaat

SEQ ID NO: 4484610 - DNA, 23 bp, Homo sapiens
atatgttttccacataaatttta

SEQ ID NO: 4484611 - DNA, 24 bp, Homo sapiens
atattaaaaaacttcatgtaattt

SEQ ID NO: 4484612 - DNA, 19 bp, Homo sapiens
atattaaaacaataatgca

SEQ ID NO: 4484613 - DNA, 21 bp, Homo sapiens
atattaaaattccaaattcat

SEQ ID NO: 4484614 - DNA, 20 bp, Homo sapiens
atattaaagcgcaaatgaat

SEQ ID NO: 4484615 - DNA, 19 bp, Homo sapiens
atattaaaggtgaaaattg

SEQ ID NO: 4484616 - DNA, 12 bp, Homo sapiens
atattaaatatt

SEQ ID NO: 4484617 - DNA, 13 bp, Homo sapiens
atattaaatatta

SEQ ID NO: 4484618 - DNA, 13 bp, Homo sapiens
atattaaatctgc

SEQ ID NO: 4484619 - DNA, 13 bp, Homo sapiens
atattaaatgagg

SEQ ID NO: 4484620 - DNA, 19 bp, Homo sapiens
atattaagaagcaataact

SEQ ID NO: 4484621 - DNA, 19 bp, Homo sapiens
atattaatatatatctgct

SEQ ID NO: 4484622 - DNA, 15 bp, Homo sapiens
atattacactacaca

SEQ ID NO: 4484623 - DNA, 14 bp, Homo sapiens
atattacctggatt

SEQ ID NO: 4484624 - DNA, 21 bp, Homo sapiens
atattactacttaccatttgc

SEQ ID NO: 4484625 - DNA, 21 bp, Homo sapiens
atattactcctatttttgtaa

SEQ ID NO: 4484626 - DNA, 13 bp, Homo sapiens
atattactttgtc

SEQ ID NO: 4484627 - DNA, 16 bp, Homo sapiens
atattagcaaagaagc

SEQ ID NO: 4484628 - DNA, 15 bp, Homo sapiens
atattataaatatat

SEQ ID NO: 4484629 - DNA, 21 bp, Homo sapiens
atattataactctgtataata

SEQ ID NO: 4484630 - DNA, 16 bp, Homo sapiens
atattataagttgacc

SEQ ID NO: 4484631 - DNA, 21 bp, Homo sapiens
atattataagttgacctttat

SEQ ID NO: 4484632 - DNA, 14 bp, Homo sapiens
atattatagaaaat

SEQ ID NO: 4484633 - DNA, 22 bp, Homo sapiens
atattatagaaaattatttgta

SEQ ID NO: 4484634 - DNA, 14 bp, Homo sapiens
atattatgtgaaga

SEQ ID NO: 4484635 - DNA, 21 bp, Homo sapiens
atattatgtgaagaatttaga

SEQ ID NO: 4484636 - DNA, 14 bp, Homo sapiens
atattattaatata

SEQ ID NO: 4484637 - DNA, 21 bp, Homo sapiens
atattattataatcttataat

SEQ ID NO: 4484638 - DNA, 16 bp, Homo sapiens
atattcaatgtattga

SEQ ID NO: 4484639 - DNA, 22 bp, Homo sapiens
atattcactggttttacacaga

SEQ ID NO: 4484640 - DNA, 14 bp, Homo sapiens
atattcagacatca

SEQ ID NO: 4484641 - DNA, 23 bp, Homo sapiens
atattcagtggtgaaatcttgtt

SEQ ID NO: 4484642 - DNA, 14 bp, Homo sapiens
atattcatattgga

SEQ ID NO: 4484643 - DNA, 23 bp, Homo sapiens
atattcatctaataaatcagtga

SEQ ID NO: 4484644 - DNA, 19 bp, Homo sapiens
atattcatgaaatgtggaa

SEQ ID NO: 4484645 - DNA, 20 bp, Homo sapiens
atattccaggtttaagtaga

SEQ ID NO: 4484646 - DNA, 15 bp, Homo sapiens
atattcccattttat

SEQ ID NO: 4484647 - DNA, 23 bp, Homo sapiens
atattccctagaaacttccaaat

SEQ ID NO: 4484648 - DNA, 17 bp, Homo sapiens
atattcctattgtgcaa

SEQ ID NO: 4484649 - DNA, 23 bp, Homo sapiens
atattcctattgtgcaatgtaaa

SEQ ID NO: 4484650 - DNA, 14 bp, Homo sapiens
atattcctttttct

SEQ ID NO: 4484651 - DNA, 18 bp, Homo sapiens
atattcgctagtgtttaa

SEQ ID NO: 4484652 - DNA, 22 bp, Homo sapiens
atattctaagaaatatctgtga

SEQ ID NO: 4484653 - DNA, 14 bp, Homo sapiens
atattctaattaaa

SEQ ID NO: 4484654 - DNA, 18 bp, Homo sapiens
atattctaattaaaattg

SEQ ID NO: 4484655 - DNA, 20 bp, Homo sapiens
atattctctattttactttt

SEQ ID NO: 4484656 - DNA, 14 bp, Homo sapiens
atattctgttgctt

SEQ ID NO: 4484657 - DNA, 15 bp, Homo sapiens
atattctgttgcttt

SEQ ID NO: 4484658 - DNA, 16 bp, Homo sapiens
atattctgttgcttta

SEQ ID NO: 4484659 - DNA, 20 bp, Homo sapiens
atattctgttttgttaatat

SEQ ID NO: 4484660 - DNA, 16 bp, Homo sapiens
atattgaaaaaataga

SEQ ID NO: 4484661 - DNA, 21 bp, Homo sapiens
atattgaaagttgcttttatt

SEQ ID NO: 4484662 - DNA, 18 bp, Homo sapiens
atattgaacttttgtact

SEQ ID NO: 4484663 - DNA, 13 bp, Homo sapiens
atattgaattttt

SEQ ID NO: 4484664 - DNA, 17 bp, Homo sapiens
atattgactcaaaccat

SEQ ID NO: 4484665 - DNA, 18 bp, Homo sapiens
atattgagcaatatgtca

SEQ ID NO: 4484666 - DNA, 17 bp, Homo sapiens
atattgagtcaaatggt

SEQ ID NO: 4484667 - DNA, 14 bp, Homo sapiens
atattgataaattt

SEQ ID NO: 4484668 - DNA, 15 bp, Homo sapiens
atattgataaatttt

SEQ ID NO: 4484669 - DNA, 21 bp, Homo sapiens
atattgatctttttatcatga

SEQ ID NO: 4484670 - DNA, 19 bp, Homo sapiens
atattgcaattgatgtgat

SEQ ID NO: 4484671 - DNA, 14 bp, Homo sapiens
atattgccttattt

SEQ ID NO: 4484672 - DNA, 19 bp, Homo sapiens
atattgccttatttgtctg

SEQ ID NO: 4484673 - DNA, 15 bp, Homo sapiens
atattgctaaaagca

SEQ ID NO: 4484674 - DNA, 15 bp, Homo sapiens
atattgctactataa

SEQ ID NO: 4484675 - DNA, 21 bp, Homo sapiens
atattgcttcttgtgttttac

SEQ ID NO: 4484676 - DNA, 12 bp, Homo sapiens
atattgctttat

SEQ ID NO: 4484677 - DNA, 15 bp, Homo sapiens
atattggaaaaatca

SEQ ID NO: 4484678 - DNA, 16 bp, Homo sapiens
atattggggaccaaat

SEQ ID NO: 4484679 - DNA, 16 bp, Homo sapiens
atattgggtgtagatt

SEQ ID NO: 4484680 - DNA, 18 bp, Homo sapiens
atattgggtgtagatttc

SEQ ID NO: 4484681 - DNA, 20 bp, Homo sapiens
atattgggtgtagatttctg

SEQ ID NO: 4484682 - DNA, 23 bp, Homo sapiens
atattgggtgtagatttctgaca

SEQ ID NO: 4484683 - DNA, 13 bp, Homo sapiens
atattgtacagtt

SEQ ID NO: 4484684 - DNA, 14 bp, Homo sapiens
atattgtacagttt

SEQ ID NO: 4484685 - DNA, 21 bp, Homo sapiens
atattgtgtttgtgtatttac

SEQ ID NO: 4484686 - DNA, 14 bp, Homo sapiens
atattgtttctgca

SEQ ID NO: 4484687 - DNA, 17 bp, Homo sapiens
atattgtttttatatat

SEQ ID NO: 4484688 - DNA, 17 bp, Homo sapiens
atatttaaaaaattaaa

SEQ ID NO: 4484689 - DNA, 17 bp, Homo sapiens
atatttaaaaaattatg

SEQ ID NO: 4484690 - DNA, 19 bp, Homo sapiens
atatttaaaaaattatgga

SEQ ID NO: 4484691 - DNA, 20 bp, Homo sapiens
atatttaaaaaattatggaa

SEQ ID NO: 4484692 - DNA, 16 bp, Homo sapiens
atatttaaaaatgtct

SEQ ID NO: 4484693 - DNA, 19 bp, Homo sapiens
atatttaactctctttatg

SEQ ID NO: 4484694 - DNA, 21 bp, Homo sapiens
atatttaagagattaagaata

SEQ ID NO: 4484695 - DNA, 17 bp, Homo sapiens
atatttaagtgaaggag

SEQ ID NO: 4484696 - DNA, 15 bp, Homo sapiens
atatttaagtttgtt

SEQ ID NO: 4484697 - DNA, 13 bp, Homo sapiens
atatttaatgttt

SEQ ID NO: 4484698 - DNA, 15 bp, Homo sapiens
atatttaatgtttta

SEQ ID NO: 4484699 - DNA, 20 bp, Homo sapiens
atatttaatgttttaaatgt

SEQ ID NO: 4484700 - DNA, 16 bp, Homo sapiens
atatttacaatgtatt

SEQ ID NO: 4484701 - DNA, 17 bp, Homo sapiens
atatttacaatgtatta

SEQ ID NO: 4484702 - DNA, 13 bp, Homo sapiens
atatttacagaag

SEQ ID NO: 4484703 - DNA, 16 bp, Homo sapiens
atatttactgctcttt

SEQ ID NO: 4484704 - DNA, 22 bp, Homo sapiens
atatttagttacgtataatgct

SEQ ID NO: 4484705 - DNA, 23 bp, Homo sapiens
atatttagttacgtataatgctt

SEQ ID NO: 4484706 - DNA, 13 bp, Homo sapiens
atatttattgatt

SEQ ID NO: 4484707 - DNA, 11 bp, Homo sapiens
atatttattgt

SEQ ID NO: 4484708 - DNA, 19 bp, Homo sapiens
atatttattttattctatg

SEQ ID NO: 4484709 - DNA, 13 bp, Homo sapiens
atatttattttct

SEQ ID NO: 4484710 - DNA, 23 bp, Homo sapiens
atatttcaagtgcctagactgtt

SEQ ID NO: 4484711 - DNA, 24 bp, Homo sapiens
atatttccaagattggttataata

SEQ ID NO: 4484712 - DNA, 15 bp, Homo sapiens
atatttcctttatgt

SEQ ID NO: 4484713 - DNA, 13 bp, Homo sapiens
atatatgctgtat

SEQ ID NO: 4484714 - DNA, 17 bp, Homo sapiens
atatatggatcagagga

SEQ ID NO: 4484715 - DNA, 19 bp, Homo sapiens
atatatggtcatatacata

SEQ ID NO: 4484716 - DNA, 11 bp, Homo sapiens
atatatgtatg

SEQ ID NO: 4484717 - DNA, 19 bp, Homo sapiens
atatatgtatgtaaaaatg

SEQ ID NO: 4484718 - DNA, 13 bp, Homo sapiens
atatatgtgaaag

SEQ ID NO: 4484719 - DNA, 16 bp, Homo sapiens
atatatgtgtatacat

SEQ ID NO: 4484720 - DNA, 21 bp, Homo sapiens
atatatgtgtgccctggactg

SEQ ID NO: 4484721 - DNA, 15 bp, Homo sapiens
atatattatgtgaag

SEQ ID NO: 4484722 - DNA, 16 bp, Homo sapiens
atatattattataatc

SEQ ID NO: 4484723 - DNA, 16 bp, Homo sapiens
atatattcatatacaa

SEQ ID NO: 4484724 - DNA, 23 bp, Homo sapiens
atatattgtgttgactttataaa

SEQ ID NO: 4484725 - DNA, 16 bp, Homo sapiens
atatatttacagaaga

SEQ ID NO: 4484726 - DNA, 12 bp, Homo sapiens
atatatttatat

SEQ ID NO: 4484727 - DNA, 13 bp, Homo sapiens
atatatttatata

SEQ ID NO: 4484728 - DNA, 18 bp, Homo sapiens
atatatttatatactttt

SEQ ID NO: 4484729 - DNA, 21 bp, Homo sapiens
atatatttatatactttttca

SEQ ID NO: 4484730 - DNA, 15 bp, Homo sapiens
atatatttgaaatag

SEQ ID NO: 4484731 - DNA, 16 bp, Homo sapiens
atatatttgaaatagt

SEQ ID NO: 4484732 - DNA, 21 bp, Homo sapiens
atatatttgaaatagtataca

SEQ ID NO: 4484733 - DNA, 20 bp, Homo sapiens
atatattttcatcctataag

SEQ ID NO: 4484734 - DNA, 21 bp, Homo sapiens
atatcaaaaaacctttacagt

SEQ ID NO: 4484735 - DNA, 19 bp, Homo sapiens
atatcaaatagatatttta

SEQ ID NO: 4484736 - DNA, 12 bp, Homo sapiens
atatcaaatgca

SEQ ID NO: 4484737 - DNA, 21 bp, Homo sapiens
atatcaaatgcagtatatttc

SEQ ID NO: 4484738 - DNA, 19 bp, Homo sapiens
atatcaatattttctgcaa

SEQ ID NO: 4484739 - DNA, 15 bp, Homo sapiens
atatcaatttaaaaa

SEQ ID NO: 4484740 - DNA, 13 bp, Homo sapiens
atatcacacaata

SEQ ID NO: 4484741 - DNA, 14 bp, Homo sapiens
atatcactaaataa

SEQ ID NO: 4484742 - DNA, 14 bp, Homo sapiens
atatcactcattaa

SEQ ID NO: 4484743 - DNA, 15 bp, Homo sapiens
atatcagcagacact

SEQ ID NO: 4484744 - DNA, 19 bp, Homo sapiens
atatcagcagacactccag

SEQ ID NO: 4484745 - DNA, 16 bp, Homo sapiens
atatcagctttgataa

SEQ ID NO: 4484746 - DNA, 14 bp, Homo sapiens
atatcagtattctg

SEQ ID NO: 4484747 - DNA, 21 bp, Homo sapiens
atatcagtattctgacatgta

SEQ ID NO: 4484748 - DNA, 17 bp, Homo sapiens
atatcagttactcagcc

SEQ ID NO: 4484749 - DNA, 21 bp, Homo sapiens
atatcagttactcagccctgg

SEQ ID NO: 4484750 - DNA, 22 bp, Homo sapiens
atatcagttactcagccctggg

SEQ ID NO: 4484751 - DNA, 23 bp, Homo sapiens
atatcagttactcagccctgggc

SEQ ID NO: 4484752 - DNA, 16 bp, Homo sapiens
atatcatacagttttc

SEQ ID NO: 4484753 - DNA, 16 bp, Homo sapiens
atatcatctgtcatta

SEQ ID NO: 4484754 - DNA, 23 bp, Homo sapiens
atatcatgttaaattagaatgaa

SEQ ID NO: 4484755 - DNA, 14 bp, Homo sapiens
atatcattaaacaa

SEQ ID NO: 4484756 - DNA, 19 bp, Homo sapiens
atatcattaaacaaataaa

SEQ ID NO: 4484757 - DNA, 22 bp, Homo sapiens
atatcatttttataaattttaa

SEQ ID NO: 4484758 - DNA, 17 bp, Homo sapiens
atatccatttatctttt

SEQ ID NO: 4484759 - DNA, 20 bp, Homo sapiens
atatcccttggacattttat

SEQ ID NO: 4484760 - DNA, 13 bp, Homo sapiens
atatcctaaacat

SEQ ID NO: 4484761 - DNA, 17 bp, Homo sapiens
atatcctctccccctcc

SEQ ID NO: 4484762 - DNA, 21 bp, Homo sapiens
atatcctgaaagcattatttt

SEQ ID NO: 4484763 - DNA, 23 bp, Homo sapiens
atatcctgtgtacctcactgtcc

SEQ ID NO: 4484764 - DNA, 17 bp, Homo sapiens
atatcgagagtttctat

SEQ ID NO: 4484765 - DNA, 14 bp, Homo sapiens
atatctaaagttat

SEQ ID NO: 4484766 - DNA, 15 bp, Homo sapiens
atatctaaagttata

SEQ ID NO: 4484767 - DNA, 21 bp, Homo sapiens
atatctaaagttatatttcag

SEQ ID NO: 4484768 - DNA, 15 bp, Homo sapiens
atatctaacttcgaa

SEQ ID NO: 4484769 - DNA, 20 bp, Homo sapiens
atatctaacttcgaatatat

SEQ ID NO: 4484770 - DNA, 20 bp, Homo sapiens
atatctatttgaataaatta

SEQ ID NO: 4484771 - DNA, 21 bp, Homo sapiens
atatctatttgaataaattat

SEQ ID NO: 4484772 - DNA, 23 bp, Homo sapiens
atatctcaatgtgcaataacttg

SEQ ID NO: 4484773 - DNA, 13 bp, Homo sapiens
atatctctatttg

SEQ ID NO: 4484774 - DNA, 17 bp, Homo sapiens
atatctcttggaaaata

SEQ ID NO: 4484775 - DNA, 21 bp, Homo sapiens
atatctcttggaaaataagac

SEQ ID NO: 4484776 - DNA, 22 bp, Homo sapiens
atatctcttggaaaataagaca

SEQ ID NO: 4484777 - DNA, 22 bp, Homo sapiens
atatctgcatttaccactgtat

SEQ ID NO: 4484778 - DNA, 11 bp, Homo sapiens
atatctgctgt

SEQ ID NO: 4484779 - DNA, 12 bp, Homo sapiens
atatctgctgtc

SEQ ID NO: 4484780 - DNA, 13 bp, Homo sapiens
atatctgctgtcc

SEQ ID NO: 4484781 - DNA, 13 bp, Homo sapiens
atatctggcctct

SEQ ID NO: 4484782 - DNA, 13 bp, Homo sapiens
atatctgtaatga

SEQ ID NO: 4484783 - DNA, 13 bp, Homo sapiens
atatctgtgaaat

SEQ ID NO: 4484784 - DNA, 20 bp, Homo sapiens
atatcttacaaaatacacat

SEQ ID NO: 4484785 - DNA, 17 bp, Homo sapiens
atatcttataactgttt

SEQ ID NO: 4484786 - DNA, 21 bp, Homo sapiens
atatcttcccatttaacattg

SEQ ID NO: 4484787 - DNA, 20 bp, Homo sapiens
atatcttggacaaatcacat

SEQ ID NO: 4484788 - DNA, 14 bp, Homo sapiens
atatcttgttatta

SEQ ID NO: 4484789 - DNA, 15 bp, Homo sapiens
atatcttgttattaa

SEQ ID NO: 4484790 - DNA, 16 bp, Homo sapiens
atatcttgtttacaat

SEQ ID NO: 4484791 - DNA, 14 bp, Homo sapiens
atatctttaataag

SEQ ID NO: 4484792 - DNA, 12 bp, Homo sapiens
atatctttctgc

SEQ ID NO: 4484793 - DNA, 12 bp, Homo sapiens
atatgaacatag

SEQ ID NO: 4484794 - DNA, 14 bp, Homo sapiens
atatgacagctgtc

SEQ ID NO: 4484795 - DNA, 15 bp, Homo sapiens
atatgaccagaagcc

SEQ ID NO: 4484796 - DNA, 24 bp, Homo sapiens
atatgagcttcaatataagaagca

SEQ ID NO: 4484797 - DNA, 21 bp, Homo sapiens
atatgaggggcagtggacagt

SEQ ID NO: 4484798 - DNA, 17 bp, Homo sapiens
atatgagtgttttgaaa

SEQ ID NO: 4484799 - DNA, 13 bp, Homo sapiens
atatgataaaaca

SEQ ID NO: 4484800 - DNA, 20 bp, Homo sapiens
atatgatagcgggaaaagga

SEQ ID NO: 4484801 - DNA, 22 bp, Homo sapiens
atatgatagcgggaaaaggaga

SEQ ID NO: 4484802 - DNA, 19 bp, Homo sapiens
atatgatagcttcgcatgg

SEQ ID NO: 4484803 - DNA, 16 bp, Homo sapiens
atatgatatgcatgta

SEQ ID NO: 4484804 - DNA, 19 bp, Homo sapiens
atatgatcaggtaactttc

SEQ ID NO: 4484805 - DNA, 20 bp, Homo sapiens
atatgatccctaatgtgttt

SEQ ID NO: 4484806 - DNA, 13 bp, Homo sapiens
atatgatgagcag

SEQ ID NO: 4484807 - DNA, 15 bp, Homo sapiens
atatgatgttaaaaa

SEQ ID NO: 4484808 - DNA, 16 bp, Homo sapiens
atatgcaaagcactga

SEQ ID NO: 4484809 - DNA, 17 bp, Homo sapiens
atatgcaagcagctttt

SEQ ID NO: 4484810 - DNA, 23 bp, Homo sapiens
atatgcacaaaactacttttcta

SEQ ID NO: 4484811 - DNA, 15 bp, Homo sapiens
atatgcatgtagcat

SEQ ID NO: 4484812 - DNA, 14 bp, Homo sapiens
atatgccttgtata

SEQ ID NO: 4484813 - DNA, 15 bp, Homo sapiens
atatgctgcaacaaa

SEQ ID NO: 4484814 - DNA, 13 bp, Homo sapiens
atatgctgtattt

SEQ ID NO: 4484815 - DNA, 14 bp, Homo sapiens
atatgcttactgat

SEQ ID NO: 4484816 - DNA, 16 bp, Homo sapiens
atatggaaccttccct

SEQ ID NO: 4484817 - DNA, 16 bp, Homo sapiens
atatggaagaaagtaa

SEQ ID NO: 4484818 - DNA, 15 bp, Homo sapiens
atatggaattttgca

SEQ ID NO: 4484819 - DNA, 19 bp, Homo sapiens
atatggaattttgcaaaga

SEQ ID NO: 4484820 - DNA, 19 bp, Homo sapiens
atatggcaaatagccacaa

SEQ ID NO: 4484821 - DNA, 15 bp, Homo sapiens
atatggctgcccagg

SEQ ID NO: 4484822 - DNA, 17 bp, Homo sapiens
atatgggggcatctctt

SEQ ID NO: 4484823 - DNA, 16 bp, Homo sapiens
atatggtccactggtt

SEQ ID NO: 4484824 - DNA, 14 bp, Homo sapiens
atatggtgtatttt

SEQ ID NO: 4484825 - DNA, 24 bp, Homo sapiens
atatggtgtctattatagtgaaac

SEQ ID NO: 4484826 - DNA, 12 bp, Homo sapiens
atatgtaaaaca

SEQ ID NO: 4484827 - DNA, 14 bp, Homo sapiens
atatgtaaaacatt

SEQ ID NO: 4484828 - DNA, 13 bp, Homo sapiens
atatgtaaatgtg

SEQ ID NO: 4484829 - DNA, 17 bp, Homo sapiens
atatgtaagaacacatt

SEQ ID NO: 4484830 - DNA, 23 bp, Homo sapiens
atatgtagtgcatttttaaactt

SEQ ID NO: 4484831 - DNA, 20 bp, Homo sapiens
atatgtatgctgatttacta

SEQ ID NO: 4484832 - DNA, 10 bp, Homo sapiens
atatgtattt

SEQ ID NO: 4484833 - DNA, 15 bp, Homo sapiens
atatgtatttaccaa

SEQ ID NO: 4484834 - DNA, 20 bp, Homo sapiens
atagtcaaagagagttttta

SEQ ID NO: 4484835 - DNA, 20 bp, Homo sapiens
atagtcagcagcagctctga

SEQ ID NO: 4484836 - DNA, 16 bp, Homo sapiens
atagtcttgaaatgaa

SEQ ID NO: 4484837 - DNA, 23 bp, Homo sapiens
atagtcttgaaatgaaagggaaa

SEQ ID NO: 4484838 - DNA, 22 bp, Homo sapiens
atagtcttggaagctgtttgga

SEQ ID NO: 4484839 - DNA, 16 bp, Homo sapiens
atagtctttggagaaa

SEQ ID NO: 4484840 - DNA, 16 bp, Homo sapiens
atagtgaaaaatgtca

SEQ ID NO: 4484841 - DNA, 17 bp, Homo sapiens
atagtgaagtgttaata

SEQ ID NO: 4484842 - DNA, 18 bp, Homo sapiens
atagtgaagtgttaatac

SEQ ID NO: 4484843 - DNA, 19 bp, Homo sapiens
atagtgaagtgttaataca

SEQ ID NO: 4484844 - DNA, 19 bp, Homo sapiens
atagtgacctgtgtttcac

SEQ ID NO: 4484845 - DNA, 14 bp, Homo sapiens
atagtgagacactg

SEQ ID NO: 4484846 - DNA, 15 bp, Homo sapiens
atagtggaaaaacac

SEQ ID NO: 4484847 - DNA, 15 bp, Homo sapiens
atagtggaacatttt

SEQ ID NO: 4484848 - DNA, 16 bp, Homo sapiens
atagtggaacattttc

SEQ ID NO: 4484849 - DNA, 17 bp, Homo sapiens
atagtgggtacatcaag

SEQ ID NO: 4484850 - DNA, 14 bp, Homo sapiens
atagtgtaacttgc

SEQ ID NO: 4484851 - DNA, 12 bp, Homo sapiens
atagtgtaagaa

SEQ ID NO: 4484852 - DNA, 14 bp, Homo sapiens
atagtgtaagaact

SEQ ID NO: 4484853 - DNA, 19 bp, Homo sapiens
atagtgtaagaactgtaca

SEQ ID NO: 4484854 - DNA, 18 bp, Homo sapiens
atagtgtcctatgcaata

SEQ ID NO: 4484855 - DNA, 21 bp, Homo sapiens
atagtgtgttgtgctttcaag

SEQ ID NO: 4484856 - DNA, 22 bp, Homo sapiens
atagtgtgttgtgctttcaaga

SEQ ID NO: 4484857 - DNA, 17 bp, Homo sapiens
atagtgttcacaaactg

SEQ ID NO: 4484858 - DNA, 14 bp, Homo sapiens
atagtgttctctgt

SEQ ID NO: 4484859 - DNA, 14 bp, Homo sapiens
atagttaagcaaat

SEQ ID NO: 4484860 - DNA, 13 bp, Homo sapiens
atagttactgtgt

SEQ ID NO: 4484861 - DNA, 17 bp, Homo sapiens
atagttactgtgtaatt

SEQ ID NO: 4484862 - DNA, 18 bp, Homo sapiens
atagttagatctttgtaa

SEQ ID NO: 4484863 - DNA, 19 bp, Homo sapiens
atagttattaaatgtttca

SEQ ID NO: 4484864 - DNA, 20 bp, Homo sapiens
atagttcccaggtgatattt

SEQ ID NO: 4484865 - DNA, 12 bp, Homo sapiens
atagttgaatta

SEQ ID NO: 4484866 - DNA, 20 bp, Homo sapiens
atagttgcttttgaaggaat

SEQ ID NO: 4484867 - DNA, 20 bp, Homo sapiens
atagtttatcttatactcct

SEQ ID NO: 4484868 - DNA, 19 bp, Homo sapiens
atagtttggatatgtaaaa

SEQ ID NO: 4484869 - DNA, 22 bp, Homo sapiens
atagttttacttttaaactgtg

SEQ ID NO: 4484870 - DNA, 13 bp, Homo sapiens
atagttttcattt

SEQ ID NO: 4484871 - DNA, 15 bp, Homo sapiens
atataaaacagtcat

SEQ ID NO: 4484872 - DNA, 12 bp, Homo sapiens
atataaaactta

SEQ ID NO: 4484873 - DNA, 12 bp, Homo sapiens
atataaaataac

SEQ ID NO: 4484874 - DNA, 15 bp, Homo sapiens
atataaactgtgcca

SEQ ID NO: 4484875 - DNA, 17 bp, Homo sapiens
atataaagtattctttt

SEQ ID NO: 4484876 - DNA, 17 bp, Homo sapiens
atataaatatattttct

SEQ ID NO: 4484877 - DNA, 16 bp, Homo sapiens
atataaatgtttatat

SEQ ID NO: 4484878 - DNA, 15 bp, Homo sapiens
atataaattattact

SEQ ID NO: 4484879 - DNA, 12 bp, Homo sapiens
atataaattgta

SEQ ID NO: 4484880 - DNA, 13 bp, Homo sapiens
atataaattgtac

SEQ ID NO: 4484881 - DNA, 14 bp, Homo sapiens
atataaattgtaca

SEQ ID NO: 4484882 - DNA, 13 bp, Homo sapiens
atataacaaaaaa

SEQ ID NO: 4484883 - DNA, 23 bp, Homo sapiens
atataactattttaaatatccat

SEQ ID NO: 4484884 - DNA, 15 bp, Homo sapiens
atataactgtcttgt

SEQ ID NO: 4484885 - DNA, 21 bp, Homo sapiens
atataactgtcttgtttcagt

SEQ ID NO: 4484886 - DNA, 14 bp, Homo sapiens
atataactttagaa

SEQ ID NO: 4484887 - DNA, 23 bp, Homo sapiens
atataagaagcaatctttgaaat

SEQ ID NO: 4484888 - DNA, 15 bp, Homo sapiens
atataagactgctgc

SEQ ID NO: 4484889 - DNA, 19 bp, Homo sapiens
atataagactgctgcagtc

SEQ ID NO: 4484890 - DNA, 18 bp, Homo sapiens
atataagcccttaataat

SEQ ID NO: 4484891 - DNA, 21 bp, Homo sapiens
atataagcccttaataataat

SEQ ID NO: 4484892 - DNA, 23 bp, Homo sapiens
atataaggaaagcaataaatgaa

SEQ ID NO: 4484893 - DNA, 15 bp, Homo sapiens
atataagtgacttga

SEQ ID NO: 4484894 - DNA, 18 bp, Homo sapiens
atataagtgacttgaaca

SEQ ID NO: 4484895 - DNA, 14 bp, Homo sapiens
atataataaagaag

SEQ ID NO: 4484896 - DNA, 20 bp, Homo sapiens
atataataaagtattccacc

SEQ ID NO: 4484897 - DNA, 17 bp, Homo sapiens
atataatatctaaagtt

SEQ ID NO: 4484898 - DNA, 23 bp, Homo sapiens
atataatattcagccagcttaaa

SEQ ID NO: 4484899 - DNA, 23 bp, Homo sapiens
atataatcatgctcatgtatatt

SEQ ID NO: 4484900 - DNA, 16 bp, Homo sapiens
atataatgtgtgcttt

SEQ ID NO: 4484901 - DNA, 14 bp, Homo sapiens
atataattctggag

SEQ ID NO: 4484902 - DNA, 17 bp, Homo sapiens
atataattgtactgtgt

SEQ ID NO: 4484903 - DNA, 13 bp, Homo sapiens
atataatttaatg

SEQ ID NO: 4484904 - DNA, 15 bp, Homo sapiens
atataatttaatgta

SEQ ID NO: 4484905 - DNA, 22 bp, Homo sapiens
atataatttaatgtaaataaaa

SEQ ID NO: 4484906 - DNA, 15 bp, Homo sapiens
atatacaaaacttta

SEQ ID NO: 4484907 - DNA, 18 bp, Homo sapiens
atatacacatagttctgt

SEQ ID NO: 4484908 - DNA, 14 bp, Homo sapiens
atatacagtttgac

SEQ ID NO: 4484909 - DNA, 16 bp, Homo sapiens
atatacatattgtata

SEQ ID NO: 4484910 - DNA, 19 bp, Homo sapiens
atataccccaaattgtgta

SEQ ID NO: 4484911 - DNA, 20 bp, Homo sapiens
atataccccaaattgtgtat

SEQ ID NO: 4484912 - DNA, 14 bp, Homo sapiens
atataccttattta

SEQ ID NO: 4484913 - DNA, 16 bp, Homo sapiens
atataccttatttatt

SEQ ID NO: 4484914 - DNA, 21 bp, Homo sapiens
atatactaaaccaactctaat

SEQ ID NO: 4484915 - DNA, 19 bp, Homo sapiens
atatactcattagaattac

SEQ ID NO: 4484916 - DNA, 22 bp, Homo sapiens
atatactctagatgaagtttta

SEQ ID NO: 4484917 - DNA, 15 bp, Homo sapiens
atatacttgactcta

SEQ ID NO: 4484918 - DNA, 18 bp, Homo sapiens
atatacttgactctaata

SEQ ID NO: 4484919 - DNA, 21 bp, Homo sapiens
atatactttgtggaccaatta

SEQ ID NO: 4484920 - DNA, 15 bp, Homo sapiens
atatactttttcatg

SEQ ID NO: 4484921 - DNA, 14 bp, Homo sapiens
atatagaaaatctt

SEQ ID NO: 4484922 - DNA, 15 bp, Homo sapiens
atatagaatttcctg

SEQ ID NO: 4484923 - DNA, 16 bp, Homo sapiens
atatagaatttcctgt

SEQ ID NO: 4484924 - DNA, 23 bp, Homo sapiens
atatagaatttcctgtaatatat

SEQ ID NO: 4484925 - DNA, 19 bp, Homo sapiens
atatagacagtgcccttgg

SEQ ID NO: 4484926 - DNA, 22 bp, Homo sapiens
atatagagacaggacagaatgt

SEQ ID NO: 4484927 - DNA, 15 bp, Homo sapiens
atatagagactgtgt

SEQ ID NO: 4484928 - DNA, 12 bp, Homo sapiens
atatagatttta

SEQ ID NO: 4484929 - DNA, 14 bp, Homo sapiens
atatagattttatt

SEQ ID NO: 4484930 - DNA, 14 bp, Homo sapiens
atatagctgctcct

SEQ ID NO: 4484931 - DNA, 16 bp, Homo sapiens
atatagctggcaagaa

SEQ ID NO: 4484932 - DNA, 19 bp, Homo sapiens
atatagctggcaagaatgg

SEQ ID NO: 4484933 - DNA, 22 bp, Homo sapiens
atatagtgggtacatcaagtcc

SEQ ID NO: 4484934 - DNA, 13 bp, Homo sapiens
atatagttttact

SEQ ID NO: 4484935 - DNA, 16 bp, Homo sapiens
atatagttttactttt

SEQ ID NO: 4484936 - DNA, 21 bp, Homo sapiens
atatataaaacggtgctgtga

SEQ ID NO: 4484937 - DNA, 15 bp, Homo sapiens
atatataaagaatat

SEQ ID NO: 4484938 - DNA, 19 bp, Homo sapiens
atatataaagaatatatat

SEQ ID NO: 4484939 - DNA, 10 bp, Homo sapiens
atatataaat

SEQ ID NO: 4484940 - DNA, 18 bp, Homo sapiens
atatataaattattactt

SEQ ID NO: 4484941 - DNA, 18 bp, Homo sapiens
atatataagactgctgca

SEQ ID NO: 4484942 - DNA, 14 bp, Homo sapiens
atatataataaata

SEQ ID NO: 4484943 - DNA, 15 bp, Homo sapiens
atatataataaatac

SEQ ID NO: 4484944 - DNA, 11 bp, Homo sapiens
atatatataaa

SEQ ID NO: 4484945 - DNA, 13 bp, Homo sapiens
atatatataaaga

SEQ ID NO: 4484946 - DNA, 15 bp, Homo sapiens
atatatatataaagt

SEQ ID NO: 4484947 - DNA, 15 bp, Homo sapiens
atatatatatataaa

SEQ ID NO: 4484948 - DNA, 14 bp, Homo sapiens
atatatattgtaaa

SEQ ID NO: 4484949 - DNA, 20 bp, Homo sapiens
atatatcctgtgtacctcac

SEQ ID NO: 4484950 - DNA, 19 bp, Homo sapiens
atatatctgctgtccagac

SEQ ID NO: 4484951 - DNA, 18 bp, Homo sapiens
atatatctgtaaagataa

SEQ ID NO: 4484952 - DNA, 19 bp, Homo sapiens
atatatctgtaaagataat

SEQ ID NO: 4484953 - DNA, 23 bp, Homo sapiens
atatatcttaagcaggtttgttt

SEQ ID NO: 4484954 - DNA, 12 bp, Homo sapiens
atatatgctgta

SEQ ID NO: 4484955 - DNA, 24 bp, Homo sapiens
atactttgtggaccaattattgat

SEQ ID NO: 4484956 - DNA, 22 bp, Homo sapiens
atacttttgagtatggctatct

SEQ ID NO: 4484957 - DNA, 19 bp, Homo sapiens
atactttttaaatgtaaag

SEQ ID NO: 4484958 - DNA, 20 bp, Homo sapiens
atactttttacaattaaaaa

SEQ ID NO: 4484959 - DNA, 13 bp, Homo sapiens
atactttttcatg

SEQ ID NO: 4484960 - DNA, 21 bp, Homo sapiens
atacttttttttctttaaaaa

SEQ ID NO: 4484961 - DNA, 17 bp, Homo sapiens
atagaaaaaaacattct

SEQ ID NO: 4484962 - DNA, 21 bp, Homo sapiens
atagaaaagtagacaatcatt

SEQ ID NO: 4484963 - DNA, 17 bp, Homo sapiens
atagaaaatcttagtat

SEQ ID NO: 4484964 - DNA, 14 bp, Homo sapiens
atagaaaattattt

SEQ ID NO: 4484965 - DNA, 18 bp, Homo sapiens
atagaaaattatttgtat

SEQ ID NO: 4484966 - DNA, 19 bp, Homo sapiens
atagaaaattatttgtatg

SEQ ID NO: 4484967 - DNA, 13 bp, Homo sapiens
atagaaagaaact

SEQ ID NO: 4484968 - DNA, 14 bp, Homo sapiens
atagaaagaagcca

SEQ ID NO: 4484969 - DNA, 19 bp, Homo sapiens
atagaaatgctggtttttc

SEQ ID NO: 4484970 - DNA, 23 bp, Homo sapiens
atagaaatggaaattttgctatc

SEQ ID NO: 4484971 - DNA, 14 bp, Homo sapiens
atagaaattttgta

SEQ ID NO: 4484972 - DNA, 18 bp, Homo sapiens
atagaaattttgtaagaa

SEQ ID NO: 4484973 - DNA, 23 bp, Homo sapiens
atagaaattttgtaagaaggcaa

SEQ ID NO: 4484974 - DNA, 12 bp, Homo sapiens
atagaacattga

SEQ ID NO: 4484975 - DNA, 16 bp, Homo sapiens
atagaagagaagagcc

SEQ ID NO: 4484976 - DNA, 23 bp, Homo sapiens
atagaagctgcagtggtattaat

SEQ ID NO: 4484977 - DNA, 14 bp, Homo sapiens
atagaagcttcagc

SEQ ID NO: 4484978 - DNA, 15 bp, Homo sapiens
atagaagcttcagca

SEQ ID NO: 4484979 - DNA, 16 bp, Homo sapiens
atagaaggaagtgtgt

SEQ ID NO: 4484980 - DNA, 18 bp, Homo sapiens
atagaataaaggcagttt

SEQ ID NO: 4484981 - DNA, 17 bp, Homo sapiens
atagaattaacacatga

SEQ ID NO: 4484982 - DNA, 14 bp, Homo sapiens
atagaatttcctgt

SEQ ID NO: 4484983 - DNA, 19 bp, Homo sapiens
atagaatttcctgtaatat

SEQ ID NO: 4484984 - DNA, 15 bp, Homo sapiens
atagacaaaaagtat

SEQ ID NO: 4484985 - DNA, 13 bp, Homo sapiens
atagacaagtttt

SEQ ID NO: 4484986 - DNA, 16 bp, Homo sapiens
atagacagaagaaaca

SEQ ID NO: 4484987 - DNA, 18 bp, Homo sapiens
atagacagaagaaacaag

SEQ ID NO: 4484988 - DNA, 19 bp, Homo sapiens
atagacagaagaaacaagg

SEQ ID NO: 4484989 - DNA, 16 bp, Homo sapiens
atagacatttgtaaat

SEQ ID NO: 4484990 - DNA, 21 bp, Homo sapiens
atagagacaggacagaatgtg

SEQ ID NO: 4484991 - DNA, 21 bp, Homo sapiens
atagagactgtgttcatgtgt

SEQ ID NO: 4484992 - DNA, 15 bp, Homo sapiens
atagagatgagccca

SEQ ID NO: 4484993 - DNA, 13 bp, Homo sapiens
atagagcaaaatc

SEQ ID NO: 4484994 - DNA, 13 bp, Homo sapiens
atagagcctgagg

SEQ ID NO: 4484995 - DNA, 13 bp, Homo sapiens
atagagctgtatt

SEQ ID NO: 4484996 - DNA, 17 bp, Homo sapiens
atagagctttttaatag

SEQ ID NO: 4484997 - DNA, 22 bp, Homo sapiens
atagaggaaattcaaatccctt

SEQ ID NO: 4484998 - DNA, 21 bp, Homo sapiens
atagaggcttctccgccagcc

SEQ ID NO: 4484999 - DNA, 13 bp, Homo sapiens
atagaggggctgc

SEQ ID NO: 4485000 - DNA, 19 bp, Homo sapiens
atagaggtatattggaaga

SEQ ID NO: 4485001 - DNA, 20 bp, Homo sapiens
atagatataatgaacaaaat

SEQ ID NO: 4485002 - DNA, 16 bp, Homo sapiens
atagatatcctctccc

SEQ ID NO: 4485003 - DNA, 18 bp, Homo sapiens
atagatgcctcttaggac

SEQ ID NO: 4485004 - DNA, 20 bp, Homo sapiens
atagatgtcagcaattaggc
